United States Patent 7,691,997 (FUNCTIONAL AND HYPERFUNCTIONAL SIRNA) - sequence listing, part 24

SEQ ID NO: 964947 - RNA, 19 nt, Homo sapiens
agaggacugugcacuagaa

SEQ ID NO: 964948 - RNA, 19 nt, Homo sapiens
gcuucuuucccuacaauua

SEQ ID NO: 964949 - RNA, 19 nt, Homo sapiens
gcgcuucuuucccuacaau

SEQ ID NO: 964950 - RNA, 19 nt, Homo sapiens
caaaccauauugcacuuuu

SEQ ID NO: 964951 - RNA, 19 nt, Homo sapiens
ugacucugaugcacauaga

SEQ ID NO: 964952 - RNA, 19 nt, Homo sapiens
gagauggacagccggauuc

SEQ ID NO: 964953 - RNA, 19 nt, Homo sapiens
acagccggauuccuuauga

SEQ ID NO: 964954 - RNA, 19 nt, Homo sapiens
gaaccaucacacugaagaa

SEQ ID NO: 964955 - RNA, 19 nt, Homo sapiens
ccugaaaggaggaugauga

SEQ ID NO: 964956 - RNA, 19 nt, Homo sapiens
gcauuacccaaaccauauu

SEQ ID NO: 964957 - RNA, 19 nt, Homo sapiens
ugaauaucaugcacuaguc

SEQ ID NO: 964958 - RNA, 19 nt, Homo sapiens
ccugugaggaaccuaguua

SEQ ID NO: 964959 - RNA, 19 nt, Homo sapiens
ggacagccggauuccuuau

SEQ ID NO: 964960 - RNA, 19 nt, Homo sapiens
gcaaggcuguugagauccu

SEQ ID NO: 964961 - RNA, 19 nt, Homo sapiens
ggugauuccugacucugau

SEQ ID NO: 964962 - RNA, 19 nt, Homo sapiens
caaggugauuccugacucu

SEQ ID NO: 964963 - RNA, 19 nt, Homo sapiens
agagaggacugugcacuag

SEQ ID NO: 964964 - RNA, 19 nt, Homo sapiens
gacaacugacauuuauuga

SEQ ID NO: 964965 - RNA, 19 nt, Homo sapiens
aggaaaggccucccagcua

SEQ ID NO: 964966 - RNA, 19 nt, Homo sapiens
ggaaggggaccaaguucua

SEQ ID NO: 964967 - RNA, 19 nt, Homo sapiens
cgagauggacagccggauu

SEQ ID NO: 964968 - RNA, 19 nt, Homo sapiens
cgaaccaucacacugaaga

SEQ ID NO: 964969 - RNA, 19 nt, Homo sapiens
ugaaaggaggaugaugaua

SEQ ID NO: 964970 - RNA, 19 nt, Homo sapiens
cugcauuacccaaaccaua

SEQ ID NO: 964971 - RNA, 19 nt, Homo sapiens
ccaacugcauuacccaaac

SEQ ID NO: 964972 - RNA, 19 nt, Homo sapiens
acugugcacuagaaaguug

SEQ ID NO: 964973 - RNA, 19 nt, Homo sapiens
aaaacacaaugcugaagaa

SEQ ID NO: 964974 - RNA, 19 nt, Homo sapiens
aagagaggacugugcacua

SEQ ID NO: 964975 - RNA, 19 nt, Homo sapiens
uaacauccgaggaggaaag

SEQ ID NO: 964976 - RNA, 19 nt, Homo sapiens
aucaugcacuagucccuua

SEQ ID NO: 964977 - RNA, 19 nt, Homo sapiens
gacaugcuaacuagacuuc

SEQ ID NO: 964978 - RNA, 19 nt, Homo sapiens
gagaggacugugcacuaga

SEQ ID NO: 964979 - RNA, 19 nt, Homo sapiens
cagcuaggcaucuucaucu

SEQ ID NO: 964980 - RNA, 19 nt, Homo sapiens
aaacacaaugcugaagaaa

SEQ ID NO: 964981 - RNA, 19 nt, Homo sapiens
cugaagacagcucgugaaa

SEQ ID NO: 964982 - RNA, 19 nt, Homo sapiens
gaccaaguucuagcuguga

SEQ ID NO: 964983 - RNA, 19 nt, Homo sapiens
gcaggaaggggaccaaguu

SEQ ID NO: 964984 - RNA, 19 nt, Homo sapiens
cacccggacuacaacaaug

SEQ ID NO: 964985 - RNA, 19 nt, Homo sapiens
gccggauuccuuaugauga

SEQ ID NO: 964986 - RNA, 19 nt, Homo sapiens
gcucaguugggauuuaaca

SEQ ID NO: 964987 - RNA, 19 nt, Homo sapiens
ugcacuagucccuuacaua

SEQ ID NO: 964988 - RNA, 19 nt, Homo sapiens
ccaaaccauauugcacuuu

SEQ ID NO: 964989 - RNA, 19 nt, Homo sapiens
cccaaaccauauugcacuu

SEQ ID NO: 964990 - RNA, 19 nt, Homo sapiens
ugcauuacccaaaccauau

SEQ ID NO: 964991 - RNA, 19 nt, Homo sapiens
accagaagauucauacacu

SEQ ID NO: 964992 - RNA, 19 nt, Homo sapiens
gaugacuacccggugguuu

SEQ ID NO: 964993 - RNA, 19 nt, Homo sapiens
gcaucuucaucuccaaggu

SEQ ID NO: 964994 - RNA, 19 nt, Homo sapiens
ucaguugggauuuaacauc

SEQ ID NO: 964995 - RNA, 19 nt, Homo sapiens
uggacagccggauuccuua

SEQ ID NO: 964996 - RNA, 19 nt, Homo sapiens
acagcuaaccaacugcauu

SEQ ID NO: 964997 - RNA, 19 nt, Homo sapiens
gggagccacuucuguuuuc

SEQ ID NO: 964998 - RNA, 19 nt, Homo sapiens
gaacaagacuuucaauagg

SEQ ID NO: 964999 - RNA, 19 nt, Homo sapiens
gaacagauauacuuucucu

SEQ ID NO: 965000 - RNA, 19 nt, Homo sapiens
caagaugucucuccagcaa

SEQ ID NO: 965001 - RNA, 19 nt, Homo sapiens
gaggauaguagucacuuua

SEQ ID NO: 965002 - RNA, 19 nt, Homo sapiens
gauaguagucacuuuauug

SEQ ID NO: 965003 - RNA, 19 nt, Homo sapiens
ggauaguagucacuuuauu

SEQ ID NO: 965004 - RNA, 19 nt, Homo sapiens
aaaccagacuaccuuaauu

SEQ ID NO: 965005 - RNA, 19 nt, Homo sapiens
ggacuaagaaccagcagaa

SEQ ID NO: 965006 - RNA, 19 nt, Homo sapiens
gauauacuuucucucaaga

SEQ ID NO: 965007 - RNA, 19 nt, Homo sapiens
gaaaaucccugacaaguac

SEQ ID NO: 965008 - RNA, 19 nt, Homo sapiens
gguaauuuaucuucacaga

SEQ ID NO: 965009 - RNA, 19 nt, Homo sapiens
gagccaguuuccuaucuuu

SEQ ID NO: 965010 - RNA, 19 nt, Homo sapiens
cugcuuagcuguaacaugu

SEQ ID NO: 965011 - RNA, 19 nt, Homo sapiens
ggccuuggcuuuccucuca

SEQ ID NO: 965012 - RNA, 19 nt, Homo sapiens
agaacuaccuggcaucuuc

SEQ ID NO: 965013 - RNA, 19 nt, Homo sapiens
caaagucgccacagaaaca

SEQ ID NO: 965014 - RNA, 19 nt, Homo sapiens
guagauaacauuuguaugc

SEQ ID NO: 965015 - RNA, 19 nt, Homo sapiens
cagcagaacagauauacuu

SEQ ID NO: 965016 - RNA, 19 nt, Homo sapiens
gugcaacgcuggcaagucu

SEQ ID NO: 965017 - RNA, 19 nt, Homo sapiens
gaagccauagucacaguaa

SEQ ID NO: 965018 - RNA, 19 nt, Homo sapiens
ccucaagcaccaucacuua

SEQ ID NO: 965019 - RNA, 19 nt, Homo sapiens
ugguuugccuuccuuauuu

SEQ ID NO: 965020 - RNA, 19 nt, Homo sapiens
gugacagccuuguguguga

SEQ ID NO: 965021 - RNA, 19 nt, Homo sapiens
gcccaaagccagcauuaug

SEQ ID NO: 965022 - RNA, 19 nt, Homo sapiens
ucacuuuauuggccacuuu

SEQ ID NO: 965023 - RNA, 19 nt, Homo sapiens
uuacucagauggcuuaugg

SEQ ID NO: 965024 - RNA, 19 nt, Homo sapiens
gguaauuacuugagcaaaa

SEQ ID NO: 965025 - RNA, 19 nt, Homo sapiens
cacagauuguucuucauuu

SEQ ID NO: 965026 - RNA, 19 nt, Homo sapiens
ucacagauuguucuucauu

SEQ ID NO: 965027 - RNA, 19 nt, Homo sapiens
aagacacagugcuaucaua

SEQ ID NO: 965028 - RNA, 19 nt, Homo sapiens
gggaguagcauuccaccuu

SEQ ID NO: 965029 - RNA, 19 nt, Homo sapiens
caaaccagacuaccuuaau

SEQ ID NO: 965030 - RNA, 19 nt, Homo sapiens
ggagccaguuuccuaucuu

SEQ ID NO: 965031 - RNA, 19 nt, Homo sapiens
caccaucacuuaccuaacu

SEQ ID NO: 965032 - RNA, 19 nt, Homo sapiens
gcaagacacagugcuauca

SEQ ID NO: 965033 - RNA, 19 nt, Homo sapiens
agaaccagcagaacagaua

SEQ ID NO: 965034 - RNA, 19 nt, Homo sapiens
cauagucacaguaauaaug

SEQ ID NO: 965035 - RNA, 19 nt, Homo sapiens
acacagugcuaucauacau

SEQ ID NO: 965036 - RNA, 19 nt, Homo sapiens
guuuaaagcccugaggaua

SEQ ID NO: 965037 - RNA, 19 nt, Homo sapiens
gaguagcauuccaccuuga

SEQ ID NO: 965038 - RNA, 19 nt, Homo sapiens
aauaauggguaugggagua

SEQ ID NO: 965039 - RNA, 19 nt, Homo sapiens
aagccagcauuauguguaa

SEQ ID NO: 965040 - RNA, 19 nt, Homo sapiens
cuucacagauuguucuuca

SEQ ID NO: 965041 - RNA, 19 nt, Homo sapiens
uaucccaacugguuuaaag

SEQ ID NO: 965042 - RNA, 19 nt, Homo sapiens
acagauauacuuucucuca

SEQ ID NO: 965043 - RNA, 19 nt, Homo sapiens
gcagaacagauauacuuuc

SEQ ID NO: 965044 - RNA, 19 nt, Homo sapiens
cacauuaucccaacugguu

SEQ ID NO: 965045 - RNA, 19 nt, Homo sapiens
ucacaguaauaauggguau

SEQ ID NO: 965046 - RNA, 19 nt, Homo sapiens
cagauauacuuucucucaa

SEQ ID NO: 965047 - RNA, 19 nt, Homo sapiens
acagauuguucuucauuuc

SEQ ID NO: 965048 - RNA, 19 nt, Homo sapiens
cagacuaccuuaauuuagc

SEQ ID NO: 965049 - RNA, 19 nt, Homo sapiens
ugaggauaguagucacuuu

SEQ ID NO: 965050 - RNA, 19 nt, Homo sapiens
gccauagucacaguaauaa

SEQ ID NO: 965051 - RNA, 19 nt, Homo sapiens
gaaccagcagaacagauau

SEQ ID NO: 965052 - RNA, 19 nt, Homo sapiens
ccaaugguaauuuaucuuc

SEQ ID NO: 965053 - RNA, 19 nt, Homo sapiens
gaccaucugggaaguguga

SEQ ID NO: 965054 - RNA, 19 nt, Homo sapiens
gcauuccaccuugaacuuu

SEQ ID NO: 965055 - RNA, 19 nt, Homo sapiens
uauacuuucucucaagaug

SEQ ID NO: 965056 - RNA, 19 nt, Homo sapiens
ccaaaccagacuaccuuaa

SEQ ID NO: 965057 - RNA, 19 nt, Homo sapiens
gcuggcaagucucaaaguc

SEQ ID NO: 965058 - RNA, 19 nt, Homo sapiens
uuaaagcccugaggauagu

SEQ ID NO: 965059 - RNA, 19 nt, Homo sapiens
ccaguuuccuaucuuucuu

SEQ ID NO: 965060 - RNA, 19 nt, Homo sapiens
aaagccagcauuaugugua

SEQ ID NO: 965061 - RNA, 19 nt, Homo sapiens
gaaauuguuacuucauggu

SEQ ID NO: 965062 - RNA, 19 nt, Homo sapiens
gaaguuuucucaagcaucu

SEQ ID NO: 965063 - RNA, 19 nt, Homo sapiens
agccauagucacaguaaua

SEQ ID NO: 965064 - RNA, 19 nt, Homo sapiens
caguggaccugggcuguug

SEQ ID NO: 965065 - RNA, 19 nt, Homo sapiens
agauauacuuucucucaag

SEQ ID NO: 965066 - RNA, 19 nt, Homo sapiens
cacuguagauaacauuugu

SEQ ID NO: 965067 - RNA, 19 nt, Homo sapiens
cauuaucccaacugguuua

SEQ ID NO: 965068 - RNA, 19 nt, Homo sapiens
aaccagacuaccuuaauuu

SEQ ID NO: 965069 - RNA, 19 nt, Homo sapiens
gccaaaccagacuaccuua

SEQ ID NO: 965070 - RNA, 19 nt, Homo sapiens
agaagguaguccagccaaa

SEQ ID NO: 965071 - RNA, 19 nt, Homo sapiens
gauucagugccucugcuua

SEQ ID NO: 965072 - RNA, 19 nt, Homo sapiens
ucucaaagucgccacagaa

SEQ ID NO: 965073 - RNA, 19 nt, Homo sapiens
ugaaaaucccugacaagua

SEQ ID NO: 965074 - RNA, 19 nt, Homo sapiens
ccaaagccagcauuaugug

SEQ ID NO: 965075 - RNA, 19 nt, Homo sapiens
cagcccaaagccagcauua

SEQ ID NO: 965076 - RNA, 19 nt, Homo sapiens
ccuggcaucuuccugaaca

SEQ ID NO: 965077 - RNA, 19 nt, Homo sapiens
ugaagugacagccuugugu

SEQ ID NO: 965078 - RNA, 19 nt, Homo sapiens
gauuguucuucauuucuag

SEQ ID NO: 965079 - RNA, 19 nt, Homo sapiens
aagacuuagugaagccaua

SEQ ID NO: 965080 - RNA, 19 nt, Homo sapiens
gguuugccuuccuuauuuc

SEQ ID NO: 965081 - RNA, 19 nt, Homo sapiens
ccagacuaccuuaauuuag

SEQ ID NO: 965082 - RNA, 19 nt, Homo sapiens
accagacuaccuuaauuua

SEQ ID NO: 965083 - RNA, 19 nt, Homo sapiens
gaagguaguccagccaaac

SEQ ID NO: 965084 - RNA, 19 nt, Homo sapiens
uuauggagccaguuuccua

SEQ ID NO: 965085 - RNA, 19 nt, Homo sapiens
gcaacgcuggcaagucuca

SEQ ID NO: 965086 - RNA, 19 nt, Homo sapiens
ucugaaagacuuagugaag

SEQ ID NO: 965087 - RNA, 19 nt, Homo sapiens
uauaugagcaagacacagu

SEQ ID NO: 965088 - RNA, 19 nt, Homo sapiens
gaaacaugccccugauuca

SEQ ID NO: 965089 - RNA, 19 nt, Homo sapiens
ccucucauuuccagcguau

SEQ ID NO: 965090 - RNA, 19 nt, Homo sapiens
gggcuguuguugcgguugu

SEQ ID NO: 965091 - RNA, 19 nt, Homo sapiens
caaagccagcauuaugugu

SEQ ID NO: 965092 - RNA, 19 nt, Homo sapiens
cagcguauaugagcaagac

SEQ ID NO: 965093 - RNA, 19 nt, Homo sapiens
ccaguaugcuucgcuucau

SEQ ID NO: 965094 - RNA, 19 nt, Homo sapiens
ucucauuuccagcguauau

SEQ ID NO: 965095 - RNA, 19 nt, Homo sapiens
gccaguaugcuucgcuuca

SEQ ID NO: 965096 - RNA, 19 nt, Homo sapiens
uaccuggcaucuuccugaa

SEQ ID NO: 965097 - RNA, 19 nt, Homo sapiens
uugccuuccuuauuucuga

SEQ ID NO: 965098 - RNA, 19 nt, Homo sapiens
ggaagaugcuuucuacaaa

SEQ ID NO: 965099 - RNA, 19 nt, Homo sapiens
aagaggagcuugaggauga

SEQ ID NO: 965100 - RNA, 19 nt, Homo sapiens
gaaagugggagauacauug

SEQ ID NO: 965101 - RNA, 19 nt, Homo sapiens
caaguuacgugcaccaaau

SEQ ID NO: 965102 - RNA, 19 nt, Homo sapiens
gagcugcuuucuaguggua

SEQ ID NO: 965103 - RNA, 19 nt, Homo sapiens
gagggacaccuucaucaua

SEQ ID NO: 965104 - RNA, 19 nt, Homo sapiens
gcaggaacagagacaguua

SEQ ID NO: 965105 - RNA, 19 nt, Homo sapiens
gguaugauguuguccugaa

SEQ ID NO: 965106 - RNA, 19 nt, Homo sapiens
guuuaaaguugccuaagaa

SEQ ID NO: 965107 - RNA, 19 nt, Homo sapiens
agagaagacugaaagugaa

SEQ ID NO: 965108 - RNA, 19 nt, Homo sapiens
uacauuggaucuucucauu

SEQ ID NO: 965109 - RNA, 19 nt, Homo sapiens
ggcuauggcuaguguuaaa

SEQ ID NO: 965110 - RNA, 19 nt, Homo sapiens
cuaagaagagaaugucuaa

SEQ ID NO: 965111 - RNA, 19 nt, Homo sapiens
gaagagaagacugaaagug

SEQ ID NO: 965112 - RNA, 19 nt, Homo sapiens
gggccugacguacagauua

SEQ ID NO: 965113 - RNA, 19 nt, Homo sapiens
aagagaagacugaaaguga

SEQ ID NO: 965114 - RNA, 19 nt, Homo sapiens
ggauaaagaagcaggaaca

SEQ ID NO: 965115 - RNA, 19 nt, Homo sapiens
ggagaaacaaaguggaaga

SEQ ID NO: 965116 - RNA, 19 nt, Homo sapiens
aaaguucucuuagcguuug

SEQ ID NO: 965117 - RNA, 19 nt, Homo sapiens
gagaagacugaaagugaaa

SEQ ID NO: 965118 - RNA, 19 nt, Homo sapiens
gagagggccugacguacag

SEQ ID NO: 965119 - RNA, 19 nt, Homo sapiens
gacgagagggccugacgua

SEQ ID NO: 965120 - RNA, 19 nt, Homo sapiens
ggccugacguacagauuau

SEQ ID NO: 965121 - RNA, 19 nt, Homo sapiens
uuacgugcaccaaauuaua

SEQ ID NO: 965122 - RNA, 19 nt, Homo sapiens
uaaauugcuugccgguguu

SEQ ID NO: 965123 - RNA, 19 nt, Homo sapiens
uuuacuaucuccagaaugu

SEQ ID NO: 965124 - RNA, 19 nt, Homo sapiens
uaaaguugccuaagaagag

SEQ ID NO: 965125 - RNA, 19 nt, Homo sapiens
cauuggaucuucucauugg

SEQ ID NO: 965126 - RNA, 19 nt, Homo sapiens
ggacucugaugaagaaagc

SEQ ID NO: 965127 - RNA, 19 nt, Homo sapiens
ggaagaggagcuugaggau

SEQ ID NO: 965128 - RNA, 19 nt, Homo sapiens
ggcuagauauugggagaaa

SEQ ID NO: 965129 - RNA, 19 nt, Homo sapiens
ucucuuagcguuuguggaa

SEQ ID NO: 965130 - RNA, 19 nt, Homo sapiens
guggaaaaguuuaaaguug

SEQ ID NO: 965131 - RNA, 19 nt, Homo sapiens
gauauugggagaaacaaag

SEQ ID NO: 965132 - RNA, 19 nt, Homo sapiens
aaaguugccuaagaagaga

SEQ ID NO: 965133 - RNA, 19 nt, Homo sapiens
uggaagaugcuuucuacaa

SEQ ID NO: 965134 - RNA, 19 nt, Homo sapiens
ugagaugagugagcaggaa

SEQ ID NO: 965135 - RNA, 19 nt, Homo sapiens
ugaagaaagccaucaugau

SEQ ID NO: 965136 - RNA, 19 nt, Homo sapiens
ggacaccuucaucauacaa

SEQ ID NO: 965137 - RNA, 19 nt, Homo sapiens
uaaaguucucuuagcguuu

SEQ ID NO: 965138 - RNA, 19 nt, Homo sapiens
aguuuaaaguugccuaaga

SEQ ID NO: 965139 - RNA, 19 nt, Homo sapiens
cauuggagaggauaaagaa

SEQ ID NO: 965140 - RNA, 19 nt, Homo sapiens
cgagagggccugacguaca

SEQ ID NO: 965141 - RNA, 19 nt, Homo sapiens
uacgugcaccaaauuauaa

SEQ ID NO: 965142 - RNA, 19 nt, Homo sapiens
ccuaagaagagaaugucua

SEQ ID NO: 965143 - RNA, 19 nt, Homo sapiens
uauggcuaguguuaaauug

SEQ ID NO: 965144 - RNA, 19 nt, Homo sapiens
ugaaagugggagauacauu

SEQ ID NO: 965145 - RNA, 19 nt, Homo sapiens
aguggaagaugcuuucuac

SEQ ID NO: 965146 - RNA, 19 nt, Homo sapiens
gagaaacaaaguggaagau

SEQ ID NO: 965147 - RNA, 19 nt, Homo sapiens
ccguaagacucaaaaguaa

SEQ ID NO: 965148 - RNA, 19 nt, Homo sapiens
ccaaguuacgugcaccaaa

SEQ ID NO: 965149 - RNA, 19 nt, Homo sapiens
aaagaagcaggaacagaga

SEQ ID NO: 965150 - RNA, 19 nt, Homo sapiens
gcugcuuucuagugguaaa

SEQ ID NO: 965151 - RNA, 19 nt, Homo sapiens
guuaugcggauucucuuga

SEQ ID NO: 965152 - RNA, 19 nt, Homo sapiens
ggugaaagugggagauaca

SEQ ID NO: 965153 - RNA, 19 nt, Homo sapiens
ccuggaaucgauacuugua

SEQ ID NO: 965154 - RNA, 19 nt, Homo sapiens
gaagacggggcuagauauu

SEQ ID NO: 965155 - RNA, 19 nt, Homo sapiens
agggacaccuucaucauac

SEQ ID NO: 965156 - RNA, 19 nt, Homo sapiens
uuaaaguugccuaagaaga

SEQ ID NO: 965157 - RNA, 19 nt, Homo sapiens
ccugacguacagauuauaa

SEQ ID NO: 965158 - RNA, 19 nt, Homo sapiens
uaugcggauucucuugaaa

SEQ ID NO: 965159 - RNA, 19 nt, Homo sapiens
uuaugcggauucucuugaa

SEQ ID NO: 965160 - RNA, 19 nt, Homo sapiens
uggagaggauaaagaagca

SEQ ID NO: 965161 - RNA, 19 nt, Homo sapiens
gggacaccuucaucauaca

SEQ ID NO: 965162 - RNA, 19 nt, Homo sapiens
gaggauaaagaagcaggaa

SEQ ID NO: 965163 - RNA, 19 nt, Homo sapiens
uuacggcgguggaaaaguu

SEQ ID NO: 965164 - RNA, 19 nt, Homo sapiens
cuagauauugggagaaaca

SEQ ID NO: 965165 - RNA, 19 nt, Homo sapiens
guaugauguuguccugaag

SEQ ID NO: 965166 - RNA, 19 nt, Homo sapiens
agagacaguuaugcggauu

SEQ ID NO: 965167 - RNA, 19 nt, Homo sapiens
aaacaaaguggaagaugcu

SEQ ID NO: 965168 - RNA, 19 nt, Homo sapiens
cuauggcuaguguuaaauu

SEQ ID NO: 965169 - RNA, 19 nt, Homo sapiens
aagcagaacggugaaagug

SEQ ID NO: 965170 - RNA, 19 nt, Homo sapiens
aaacuauaaagaccuggaa

SEQ ID NO: 965171 - RNA, 19 nt, Homo sapiens
guuacgugcaccaaauuau

SEQ ID NO: 965172 - RNA, 19 nt, Homo sapiens
gaaauuaucuguggucuua

SEQ ID NO: 965173 - RNA, 19 nt, Homo sapiens
gaagagaaguacccuuaua

SEQ ID NO: 965174 - RNA, 19 nt, Homo sapiens
gauggugccuugaggaaua

SEQ ID NO: 965175 - RNA, 19 nt, Homo sapiens
caagaacccuacaagagua

SEQ ID NO: 965176 - RNA, 19 nt, Homo sapiens
gcugagagacuuauuuaua

SEQ ID NO: 965177 - RNA, 19 nt, Homo sapiens
ggaaugguauacuaaauca

SEQ ID NO: 965178 - RNA, 19 nt, Homo sapiens
gauaagcuccaacaacaua

SEQ ID NO: 965179 - RNA, 19 nt, Homo sapiens
gggaaaguuuguagaaauu

SEQ ID NO: 965180 - RNA, 19 nt, Homo sapiens
ucaaaguuguguccaauuu

SEQ ID NO: 965181 - RNA, 19 nt, Homo sapiens
gaaguagccaacucuauuu

SEQ ID NO: 965182 - RNA, 19 nt, Homo sapiens
gaaguguucccuuuguaua

SEQ ID NO: 965183 - RNA, 19 nt, Homo sapiens
caaggagacuuaagaaugg

SEQ ID NO: 965184 - RNA, 19 nt, Homo sapiens
aaacaagcauucuccaaga

SEQ ID NO: 965185 - RNA, 19 nt, Homo sapiens
uacauggacucuuaugaua

SEQ ID NO: 965186 - RNA, 19 nt, Homo sapiens
caaaggauuuaaaggagaa

SEQ ID NO: 965187 - RNA, 19 nt, Homo sapiens
aaaaguacauggacucuua

SEQ ID NO: 965188 - RNA, 19 nt, Homo sapiens
cauggacucuuaugauauu

SEQ ID NO: 965189 - RNA, 19 nt, Homo sapiens
uagaagagaaguacccuua

SEQ ID NO: 965190 - RNA, 19 nt, Homo sapiens
gaaauuguguuagguuugg

SEQ ID NO: 965191 - RNA, 19 nt, Homo sapiens
gauaauaacggacuuugau

SEQ ID NO: 965192 - RNA, 19 nt, Homo sapiens
caaagaaggauaugagaau

SEQ ID NO: 965193 - RNA, 19 nt, Homo sapiens
ucacaugguuugcuuguuc

SEQ ID NO: 965194 - RNA, 19 nt, Homo sapiens
ccaaggagacuuaagaaug

SEQ ID NO: 965195 - RNA, 19 nt, Homo sapiens
gcucaaaggauuuaaagga

SEQ ID NO: 965196 - RNA, 19 nt, Homo sapiens
uaaaucacaugguuugcuu

SEQ ID NO: 965197 - RNA, 19 nt, Homo sapiens
gaaguugauccuguucuua

SEQ ID NO: 965198 - RNA, 19 nt, Homo sapiens
caccaucucuugaaauugu

SEQ ID NO: 965199 - RNA, 19 nt, Homo sapiens
ggacucuuaugauauuguu

SEQ ID NO: 965200 - RNA, 19 nt, Homo sapiens
auacuacgcuauugaaguu

SEQ ID NO: 965201 - RNA, 19 nt, Homo sapiens
ggugcuggcucaguacaua

SEQ ID NO: 965202 - RNA, 19 nt, Homo sapiens
ggagaacuaauucauguau

SEQ ID NO: 965203 - RNA, 19 nt, Homo sapiens
gugaaugcauugacuggaa

SEQ ID NO: 965204 - RNA, 19 nt, Homo sapiens
uaaagaaauuguggcagaa

SEQ ID NO: 965205 - RNA, 19 nt, Homo sapiens
gauaugacacucaguagau

SEQ ID NO: 965206 - RNA, 19 nt, Homo sapiens
guacauggacucuuaugau

SEQ ID NO: 965207 - RNA, 19 nt, Homo sapiens
caaaggaggagcugccaaa

SEQ ID NO: 965208 - RNA, 19 nt, Homo sapiens
ggugaaauaauaugcauga

SEQ ID NO: 965209 - RNA, 19 nt, Homo sapiens
uaucuguggucuuaucaaa

SEQ ID NO: 965210 - RNA, 19 nt, Homo sapiens
aggaggagcugccaaacuu

SEQ ID NO: 965211 - RNA, 19 nt, Homo sapiens
aaggagaacuaauucaugu

SEQ ID NO: 965212 - RNA, 19 nt, Homo sapiens
ugcccaacaugucauaaua

SEQ ID NO: 965213 - RNA, 19 nt, Homo sapiens
cagauauggugaaugcauu

SEQ ID NO: 965214 - RNA, 19 nt, Homo sapiens
agaaguagccaacucuauu

SEQ ID NO: 965215 - RNA, 19 nt, Homo sapiens
gagaaguacccuuauaugg

SEQ ID NO: 965216 - RNA, 19 nt, Homo sapiens
uugauaagcuccaacaaca

SEQ ID NO: 965217 - RNA, 19 nt, Homo sapiens
gaaaagaugcccaacaugu

SEQ ID NO: 965218 - RNA, 19 nt, Homo sapiens
ugccaaacuucagauaaua

SEQ ID NO: 965219 - RNA, 19 nt, Homo sapiens
uaaaugauagaguggauga

SEQ ID NO: 965220 - RNA, 19 nt, Homo sapiens
agaaggauaugagaauuuc

SEQ ID NO: 965221 - RNA, 19 nt, Homo sapiens
ugggaaaguuuguagaaau

SEQ ID NO: 965222 - RNA, 19 nt, Homo sapiens
cagauggaguggccaaugu

SEQ ID NO: 965223 - RNA, 19 nt, Homo sapiens
guaucaccaucucuugaaa

SEQ ID NO: 965224 - RNA, 19 nt, Homo sapiens
ggauuuaaaggagaacuaa

SEQ ID NO: 965225 - RNA, 19 nt, Homo sapiens
agaccaagaucaucgagau

SEQ ID NO: 965226 - RNA, 19 nt, Homo sapiens
ggguggugcuggcucagua

SEQ ID NO: 965227 - RNA, 19 nt, Homo sapiens
ucaagaacccuacaagagu

SEQ ID NO: 965228 - RNA, 19 nt, Homo sapiens
ucagcaagcuuuaccaaaa

SEQ ID NO: 965229 - RNA, 19 nt, Homo sapiens
ugaaguugauccuguucuu

SEQ ID NO: 965230 - RNA, 19 nt, Homo sapiens
ggaaaagacuagcaguuag

SEQ ID NO: 965231 - RNA, 19 nt, Homo sapiens
caguacauauucaccuuga

SEQ ID NO: 965232 - RNA, 19 nt, Homo sapiens
uguguuagguuugguuauu

SEQ ID NO: 965233 - RNA, 19 nt, Homo sapiens
auaacggacuuugauauga

SEQ ID NO: 965234 - RNA, 19 nt, Homo sapiens
gccaaacuucagauaauaa

SEQ ID NO: 965235 - RNA, 19 nt, Homo sapiens
cuuauaugguggaauggua

SEQ ID NO: 965236 - RNA, 19 nt, Homo sapiens
ucgaaguguucccuuugua

SEQ ID NO: 965237 - RNA, 19 nt, Homo sapiens
ucaaagaaggauaugagaa

SEQ ID NO: 965238 - RNA, 19 nt, Homo sapiens
guggaaugguauacuaaau

SEQ ID NO: 965239 - RNA, 19 nt, Homo sapiens
uaacggacuuugauaugac

SEQ ID NO: 965240 - RNA, 19 nt, Homo sapiens
gguaucaccaucucuugaa

SEQ ID NO: 965241 - RNA, 19 nt, Homo sapiens
guuauuaugcugaugguau

SEQ ID NO: 965242 - RNA, 19 nt, Homo sapiens
gggaaaagaugcccaacau

SEQ ID NO: 965243 - RNA, 19 nt, Homo sapiens
cugccaaacuucagauaau

SEQ ID NO: 965244 - RNA, 19 nt, Homo sapiens
guguuagguuugguuauuu

SEQ ID NO: 965245 - RNA, 19 nt, Homo sapiens
ucgucaagcugguguuuau

SEQ ID NO: 965246 - RNA, 19 nt, Homo sapiens
ucgagaugaugccagaauu

SEQ ID NO: 965247 - RNA, 19 nt, Homo sapiens
ggugguguuuacaauguug

SEQ ID NO: 965248 - RNA, 19 nt, Homo sapiens
aaucugacguuaugcucaa

SEQ ID NO: 965249 - RNA, 19 nt, Homo sapiens
ugacaacuguaagcugguu

SEQ ID NO: 965250 - RNA, 19 nt, Homo sapiens
ccaccucucucaacacacu

SEQ ID NO: 965251 - RNA, 19 nt, Homo sapiens
cuugaggaauacagaauau

SEQ ID NO: 965252 - RNA, 19 nt, Homo sapiens
gaaucaagaacccuacaag

SEQ ID NO: 965253 - RNA, 19 nt, Homo sapiens
uaagcugguuacagaugaa

SEQ ID NO: 965254 - RNA, 19 nt, Homo sapiens
aaagaugcccaacauguca

SEQ ID NO: 965255 - RNA, 19 nt, Homo sapiens
aauguuaucaugcagcuuu

SEQ ID NO: 965256 - RNA, 19 nt, Homo sapiens
cgaaguguucccuuuguau

SEQ ID NO: 965257 - RNA, 19 nt, Homo sapiens
uugcugagagacuuauuua

SEQ ID NO: 965258 - RNA, 19 nt, Homo sapiens
ggaaguuauucgucaagcu

SEQ ID NO: 965259 - RNA, 19 nt, Homo sapiens
gaugccagaauuccagaaa

SEQ ID NO: 965260 - RNA, 19 nt, Homo sapiens
gguggaaugguauacuaaa

SEQ ID NO: 965261 - RNA, 19 nt, Homo sapiens
agaaguacccuuauauggu

SEQ ID NO: 965262 - RNA, 19 nt, Homo sapiens
cccaacaugucauaauauc

SEQ ID NO: 965263 - RNA, 19 nt, Homo sapiens
gcugccaaacuucagauaa

SEQ ID NO: 965264 - RNA, 19 nt, Homo sapiens
uagaguggaugagcuuuua

SEQ ID NO: 965265 - RNA, 19 nt, Homo sapiens
gcagauggaguggccaaug

SEQ ID NO: 965266 - RNA, 19 nt, Homo sapiens
aaaggagaacuaauucaug

SEQ ID NO: 965267 - RNA, 19 nt, Homo sapiens
aagagaaguacccuuauau

SEQ ID NO: 965268 - RNA, 19 nt, Homo sapiens
uauugaaguugauccuguu

SEQ ID NO: 965269 - RNA, 19 nt, Homo sapiens
gauguacuagaggaaguua

SEQ ID NO: 965270 - RNA, 19 nt, Homo sapiens
gcgauguacuagaggaagu

SEQ ID NO: 965271 - RNA, 19 nt, Homo sapiens
uauccuuacucucgaagug

SEQ ID NO: 965272 - RNA, 19 nt, Homo sapiens
ggcaauaccuggacucugu

SEQ ID NO: 965273 - RNA, 19 nt, Homo sapiens
uaaggccucugucuccaua

SEQ ID NO: 965274 - RNA, 19 nt, Homo sapiens
guuguuagcugccaggaau

SEQ ID NO: 965275 - RNA, 19 nt, Homo sapiens
ccaaaguagugccgagcua

SEQ ID NO: 965276 - RNA, 19 nt, Homo sapiens
acucaucucucaggcaaua

SEQ ID NO: 965277 - RNA, 19 nt, Homo sapiens
aaugugagguuucuuugug

SEQ ID NO: 965278 - RNA, 19 nt, Homo sapiens
gugccgagcuagaccacaa

SEQ ID NO: 965279 - RNA, 19 nt, Homo sapiens
gccaucuccucuucccuaa

SEQ ID NO: 965280 - RNA, 19 nt, Homo sapiens
gcaguuggaccgccacauc

SEQ ID NO: 965281 - RNA, 19 nt, Homo sapiens
caucuccucuucccuaagg

SEQ ID NO: 965282 - RNA, 19 nt, Homo sapiens
gagcaacagccaaaguagu

SEQ ID NO: 965283 - RNA, 19 nt, Homo sapiens
ggaggaagcgaagcaucaa

SEQ ID NO: 965284 - RNA, 19 nt, Homo sapiens
ggagcaacagccaaaguag

SEQ ID NO: 965285 - RNA, 19 nt, Homo sapiens
gccaggagcaacagccaaa

SEQ ID NO: 965286 - RNA, 19 nt, Homo sapiens
acuaaugugagguuucuuu

SEQ ID NO: 965287 - RNA, 19 nt, Homo sapiens
acacaggccaggcggaaug

SEQ ID NO: 965288 - RNA, 19 nt, Homo sapiens
aggagcaacagccaaagua

SEQ ID NO: 965289 - RNA, 19 nt, Homo sapiens
guuucuuugugcacauuaa

SEQ ID NO: 965290 - RNA, 19 nt, Homo sapiens
ccaggcggaaugaagauga

SEQ ID NO: 965291 - RNA, 19 nt, Homo sapiens
ucccagccaucuccucuuc

SEQ ID NO: 965292 - RNA, 19 nt, Homo sapiens
gcucagggaacuggaggaa

SEQ ID NO: 965293 - RNA, 19 nt, Homo sapiens
ugaacaggcucagggaacu

SEQ ID NO: 965294 - RNA, 19 nt, Homo sapiens
ggccaugcaccgaccaaug

SEQ ID NO: 965295 - RNA, 19 nt, Homo sapiens
gaacaggcucagggaacug

SEQ ID NO: 965296 - RNA, 19 nt, Homo sapiens
cuaaugugagguuucuuug

SEQ ID NO: 965297 - RNA, 19 nt, Homo sapiens
ggacaaagccaauuuacga

SEQ ID NO: 965298 - RNA, 19 nt, Homo sapiens
gauugaagcuacuaagaau

SEQ ID NO: 965299 - RNA, 19 nt, Homo sapiens
ccagagacauucagaaagu

SEQ ID NO: 965300 - RNA, 19 nt, Homo sapiens
uaacgagggugucaagaau

SEQ ID NO: 965301 - RNA, 19 nt, Homo sapiens
gaaagugcuuagccuuguu

SEQ ID NO: 965302 - RNA, 19 nt, Homo sapiens
gaccaggccugcuauaucu

SEQ ID NO: 965303 - RNA, 19 nt, Homo sapiens
cagaccagcuccucuauca

SEQ ID NO: 965304 - RNA, 19 nt, Homo sapiens
gcagaccacugaggaaauc

SEQ ID NO: 965305 - RNA, 19 nt, Homo sapiens
ggacgugucuuccauuucc

SEQ ID NO: 965306 - RNA, 19 nt, Homo sapiens
caaggaaccacauagagaa

SEQ ID NO: 965307 - RNA, 19 nt, Homo sapiens
gggccaagaugauccuguu

SEQ ID NO: 965308 - RNA, 19 nt, Homo sapiens
caucguggacaaccuaaua

SEQ ID NO: 965309 - RNA, 19 nt, Homo sapiens
guaacgagggugucaagaa

SEQ ID NO: 965310 - RNA, 19 nt, Homo sapiens
ccaaggaaccacauagaga

SEQ ID NO: 965311 - RNA, 19 nt, Homo sapiens
ggaaugaugccaaggucuu

SEQ ID NO: 965312 - RNA, 19 nt, Homo sapiens
acgagggugucaagaauuu

SEQ ID NO: 965313 - RNA, 19 nt, Homo sapiens
guggaggucuugaggcuau

SEQ ID NO: 965314 - RNA, 19 nt, Homo sapiens
gagauugaagcuacuaaga

SEQ ID NO: 965315 - RNA, 19 nt, Homo sapiens
gagcccgacugagcacuaa

SEQ ID NO: 965316 - RNA, 19 nt, Homo sapiens
caagacgagugcguucuga

SEQ ID NO: 965317 - RNA, 19 nt, Homo sapiens
acaaagaccaggccugcua

SEQ ID NO: 965318 - RNA, 19 nt, Homo sapiens
aaagagcccuugcguugca

SEQ ID NO: 965319 - RNA, 19 nt, Homo sapiens
caagaccaaguuaauagaa

SEQ ID NO: 965320 - RNA, 19 nt, Homo sapiens
gagccucagugcccguuug

SEQ ID NO: 965321 - RNA, 19 nt, Homo sapiens
gaucuucaugaaugcaaua

SEQ ID NO: 965322 - RNA, 19 nt, Homo sapiens
ucagaucgguauggcauug

SEQ ID NO: 965323 - RNA, 19 nt, Homo sapiens
caccaagaccaaguuaaua

SEQ ID NO: 965324 - RNA, 19 nt, Homo sapiens
ucaccaagaccaaguuaau

SEQ ID NO: 965325 - RNA, 19 nt, Homo sapiens
gugcuuagccuuguugaug

SEQ ID NO: 965326 - RNA, 19 nt, Homo sapiens
aaagagagugguuguggaa

SEQ ID NO: 965327 - RNA, 19 nt, Homo sapiens
agaaagugcuuagccuugu

SEQ ID NO: 965328 - RNA, 19 nt, Homo sapiens
gcucaccaagaccaaguua

SEQ ID NO: 965329 - RNA, 19 nt, Homo sapiens
cagcuccucuaucagcauu

SEQ ID NO: 965330 - RNA, 19 nt, Homo sapiens
agaugauccuguuugcuuu

SEQ ID NO: 965331 - RNA, 19 nt, Homo sapiens
gagcauccgcuguacaaag

SEQ ID NO: 965332 - RNA, 19 nt, Homo sapiens
ccaagaugauccuguuugc

SEQ ID NO: 965333 - RNA, 19 nt, Homo sapiens
ggaaccacauagagaacca

SEQ ID NO: 965334 - RNA, 19 nt, Homo sapiens
cagagacauucagaaaguu

SEQ ID NO: 965335 - RNA, 19 nt, Homo sapiens
ggucaucguggacaaccua

SEQ ID NO: 965336 - RNA, 19 nt, Homo sapiens
gaaccuguugggccaguug

SEQ ID NO: 965337 - RNA, 19 nt, Homo sapiens
ugucuuccauuuccuagug

SEQ ID NO: 965338 - RNA, 19 nt, Homo sapiens
aagaugauccuguuugcuu

SEQ ID NO: 965339 - RNA, 19 nt, Homo sapiens
ccaagaccaaguuaauaga

SEQ ID NO: 965340 - RNA, 19 nt, Homo sapiens
gccaagaugauccuguuug

SEQ ID NO: 965341 - RNA, 19 nt, Homo sapiens
aggaggaucuguguccaaa

SEQ ID NO: 965342 - RNA, 19 nt, Homo sapiens
gaggcuaucagaucgguau

SEQ ID NO: 965343 - RNA, 19 nt, Homo sapiens
agcauccgcuguacaaaga

SEQ ID NO: 965344 - RNA, 19 nt, Homo sapiens
agauugaagcuacuaagaa

SEQ ID NO: 965345 - RNA, 19 nt, Homo sapiens
ccaggccugcuauaucuuu

SEQ ID NO: 965346 - RNA, 19 nt, Homo sapiens
gcuacaaggacccaagguu

SEQ ID NO: 965347 - RNA, 19 nt, Homo sapiens
gacuggagcccaucaccuu

SEQ ID NO: 965348 - RNA, 19 nt, Homo sapiens
caaagaccaggccugcuau

SEQ ID NO: 965349 - RNA, 19 nt, Homo sapiens
uggauaggguguacgagau

SEQ ID NO: 965350 - RNA, 19 nt, Homo sapiens
gaagcuacuaagaaucaug

SEQ ID NO: 965351 - RNA, 19 nt, Homo sapiens
gacgagugcguucugaaug

SEQ ID NO: 965352 - RNA, 19 nt, Homo sapiens
ccacauagagaaccaagac

SEQ ID NO: 965353 - RNA, 19 nt, Homo sapiens
gauccaaggaaccacauag

SEQ ID NO: 965354 - RNA, 19 nt, Homo sapiens
uaucacccaucaucgaucu

SEQ ID NO: 965355 - RNA, 19 nt, Homo sapiens
ggagcccgacugagcacua

SEQ ID NO: 965356 - RNA, 19 nt, Homo sapiens
acgagugcguucugaaugu

SEQ ID NO: 965357 - RNA, 19 nt, Homo sapiens
agagacauucagaaaguuu

SEQ ID NO: 965358 - RNA, 19 nt, Homo sapiens
cugcugcucucgcugacaa

SEQ ID NO: 965359 - RNA, 19 nt, Homo sapiens
ggagauugaagcuacuaag

SEQ ID NO: 965360 - RNA, 19 nt, Homo sapiens
gcuuagccuuguugaugau

SEQ ID NO: 965361 - RNA, 19 nt, Homo sapiens
ccauaucacccaucaucga

SEQ ID NO: 965362 - RNA, 19 nt, Homo sapiens
ugcuuagccuuguugauga

SEQ ID NO: 965363 - RNA, 19 nt, Homo sapiens
guuucaagccagagacauu

SEQ ID NO: 965364 - RNA, 19 nt, Homo sapiens
uuccuaguguuucaacuga

SEQ ID NO: 965365 - RNA, 19 nt, Homo sapiens
aaagaccaggccugcuaua

SEQ ID NO: 965366 - RNA, 19 nt, Homo sapiens
ggauaggguguacgagauc

SEQ ID NO: 965367 - RNA, 19 nt, Homo sapiens
gaggagauugaagcuacua

SEQ ID NO: 965368 - RNA, 19 nt, Homo sapiens
cgagugcguucugaaugug

SEQ ID NO: 965369 - RNA, 19 nt, Homo sapiens
acaaggacccaagguucua

SEQ ID NO: 965370 - RNA, 19 nt, Homo sapiens
agccagagacauucagaaa

SEQ ID NO: 965371 - RNA, 19 nt, Homo sapiens
uugaagcuacuaagaauca

SEQ ID NO: 965372 - RNA, 19 nt, Homo sapiens
agaccaggccugcuauauc

SEQ ID NO: 965373 - RNA, 19 nt, Homo sapiens
ugcucucgcugacaauaaa

SEQ ID NO: 965374 - RNA, 19 nt, Homo sapiens
uggccuggguggacucaga

SEQ ID NO: 965375 - RNA, 19 nt, Homo sapiens
aagaccaaguuaauagaag

SEQ ID NO: 965376 - RNA, 19 nt, Homo sapiens
cauaucacccaucaucgau

SEQ ID NO: 965377 - RNA, 19 nt, Homo sapiens
gcuacuaagaaucauguuc

SEQ ID NO: 965378 - RNA, 19 nt, Homo sapiens
acucagaccagcuccucua

SEQ ID NO: 965379 - RNA, 19 nt, Homo sapiens
gaggaucuguguccaaaac

SEQ ID NO: 965380 - RNA, 19 nt, Homo sapiens
agacgagugcguucugaau

SEQ ID NO: 965381 - RNA, 19 nt, Homo sapiens
gcuaugagcugcccacuga

SEQ ID NO: 965382 - RNA, 19 nt, Homo sapiens
ccacugaugacgacacuua

SEQ ID NO: 965383 - RNA, 19 nt, Homo sapiens
gaggagcacagacgagaua

SEQ ID NO: 965384 - RNA, 19 nt, Homo sapiens
ccaagacugugguugagaa

SEQ ID NO: 965385 - RNA, 19 nt, Homo sapiens
gauggacuuugaagacuug

SEQ ID NO: 965386 - RNA, 19 nt, Homo sapiens
ggaggagacugccauugag

SEQ ID NO: 965387 - RNA, 19 nt, Homo sapiens
ggauggacuuugaagacuu

SEQ ID NO: 965388 - RNA, 19 nt, Homo sapiens
uaaccuugaauccucauua

SEQ ID NO: 965389 - RNA, 19 nt, Homo sapiens
caaggucacuuuucaauag

SEQ ID NO: 965390 - RNA, 19 nt, Homo sapiens
gaauccucauuaaagguuu

SEQ ID NO: 965391 - RNA, 19 nt, Homo sapiens
aaccuugaauccucauuaa

SEQ ID NO: 965392 - RNA, 19 nt, Homo sapiens
gaaaacagcagcagcaaca

SEQ ID NO: 965393 - RNA, 19 nt, Homo sapiens
uggcuaagcaagacaaauu

SEQ ID NO: 965394 - RNA, 19 nt, Homo sapiens
ggagacugccauugagaug

SEQ ID NO: 965395 - RNA, 19 nt, Homo sapiens
cucugcgucuuccuuauua

SEQ ID NO: 965396 - RNA, 19 nt, Homo sapiens
gaggagacugccauugaga

SEQ ID NO: 965397 - RNA, 19 nt, Homo sapiens
gcaaggucacuuuucaaua

SEQ ID NO: 965398 - RNA, 19 nt, Homo sapiens
gagcucgcaaggucacuuu

SEQ ID NO: 965399 - RNA, 19 nt, Homo sapiens
gagcacagacgagauaagg

SEQ ID NO: 965400 - RNA, 19 nt, Homo sapiens
ugaauccucauuaaagguu

SEQ ID NO: 965401 - RNA, 19 nt, Homo sapiens
cagccauggcguccuauuu

SEQ ID NO: 965402 - RNA, 19 nt, Homo sapiens
aggaggagacugccauuga

SEQ ID NO: 965403 - RNA, 19 nt, Homo sapiens
ggaggaggagacugccauu

SEQ ID NO: 965404 - RNA, 19 nt, Homo sapiens
gcccucugcgucuuccuua

SEQ ID NO: 965405 - RNA, 19 nt, Homo sapiens
cugaugacgacacuuauga

SEQ ID NO: 965406 - RNA, 19 nt, Homo sapiens
ggcguccuauuucgaugaa

SEQ ID NO: 965407 - RNA, 19 nt, Homo sapiens
ccuugaauccucauuaaag

SEQ ID NO: 965408 - RNA, 19 nt, Homo sapiens
cguccuauuucgaugaaca

SEQ ID NO: 965409 - RNA, 19 nt, Homo sapiens
ccucugcgucuuccuuauu

SEQ ID NO: 965410 - RNA, 19 nt, Homo sapiens
gccaucaccuuuuccauuc

SEQ ID NO: 965411 - RNA, 19 nt, Homo sapiens
caauaggauggacuuugaa

SEQ ID NO: 965412 - RNA, 19 nt, Homo sapiens
caggagacgcgaaccaaca

SEQ ID NO: 965413 - RNA, 19 nt, Homo sapiens
cuugaauccucauuaaagg

SEQ ID NO: 965414 - RNA, 19 nt, Homo sapiens
caaauuccugucccuugug

SEQ ID NO: 965415 - RNA, 19 nt, Homo sapiens
gaggaggagacugccauug

SEQ ID NO: 965416 - RNA, 19 nt, Homo sapiens
gaacagugcagagaagaua

SEQ ID NO: 965417 - RNA, 19 nt, Homo sapiens
cagagaagauaacaaaguu

SEQ ID NO: 965418 - RNA, 19 nt, Homo sapiens
cugggaaacugauugaaua

SEQ ID NO: 965419 - RNA, 19 nt, Homo sapiens
aagauagugucgacuguua

SEQ ID NO: 965420 - RNA, 19 nt, Homo sapiens
gcuggagucugggaaguua

SEQ ID NO: 965421 - RNA, 19 nt, Homo sapiens
ggagccagaugaugaagug

SEQ ID NO: 965422 - RNA, 19 nt, Homo sapiens
gugaguggauccuguaaga

SEQ ID NO: 965423 - RNA, 19 nt, Homo sapiens
gagaaugaaauaugacuga

SEQ ID NO: 965424 - RNA, 19 nt, Homo sapiens
uaugaucucugguucaaga

SEQ ID NO: 965425 - RNA, 19 nt, Homo sapiens
ugaaguguuucuugccaua

SEQ ID NO: 965426 - RNA, 19 nt, Homo sapiens
aaagaugaccgucuggaua

SEQ ID NO: 965427 - RNA, 19 nt, Homo sapiens
ggaagauagugucgacugu

SEQ ID NO: 965428 - RNA, 19 nt, Homo sapiens
gccagaugaugaaguguuu

SEQ ID NO: 965429 - RNA, 19 nt, Homo sapiens
guaaggagcaguacuugga

SEQ ID NO: 965430 - RNA, 19 nt, Homo sapiens
cugagaaacuuuguacuuu

SEQ ID NO: 965431 - RNA, 19 nt, Homo sapiens
gcagagaagauaacaaagu

SEQ ID NO: 965432 - RNA, 19 nt, Homo sapiens
ccaauuaaauaccaaguac

SEQ ID NO: 965433 - RNA, 19 nt, Homo sapiens
gugcagagaagauaacaaa

SEQ ID NO: 965434 - RNA, 19 nt, Homo sapiens
guacuuggauguccuucau

SEQ ID NO: 965435 - RNA, 19 nt, Homo sapiens
cgcccaaacuuccuuauga

SEQ ID NO: 965436 - RNA, 19 nt, Homo sapiens
gaacgcacccgcugguugu

SEQ ID NO: 965437 - RNA, 19 nt, Homo sapiens
uuacagaggguuugggaua

SEQ ID NO: 965438 - RNA, 19 nt, Homo sapiens
cuaaagccauggaggaaau

SEQ ID NO: 965439 - RNA, 19 nt, Homo sapiens
gaggaaaugguggaagaua

SEQ ID NO: 965440 - RNA, 19 nt, Homo sapiens
gaaauucuccuaaaagaug

SEQ ID NO: 965441 - RNA, 19 nt, Homo sapiens
gaugaugaaguguuucuug

SEQ ID NO: 965442 - RNA, 19 nt, Homo sapiens
gcacuacuagagaaugaaa

SEQ ID NO: 965443 - RNA, 19 nt, Homo sapiens
gcccaaacuuccuuaugau

SEQ ID NO: 965444 - RNA, 19 nt, Homo sapiens
gaagauagugucgacuguu

SEQ ID NO: 965445 - RNA, 19 nt, Homo sapiens
ggaaaugguggaagauagu

SEQ ID NO: 965446 - RNA, 19 nt, Homo sapiens
gaucugggaaacugauuga

SEQ ID NO: 965447 - RNA, 19 nt, Homo sapiens
uggaggaaaugguggaaga

SEQ ID NO: 965448 - RNA, 19 nt, Homo sapiens
uacagaggguuugggauaa

SEQ ID NO: 965449 - RNA, 19 nt, Homo sapiens
ccaaggugaugauguaucg

SEQ ID NO: 965450 - RNA, 19 nt, Homo sapiens
gcaccacagugagcauugu

SEQ ID NO: 965451 - RNA, 19 nt, Homo sapiens
ccaaguaccgggauuccuu

SEQ ID NO: 965452 - RNA, 19 nt, Homo sapiens
cugcuucucccaccacuua

SEQ ID NO: 965453 - RNA, 19 nt, Homo sapiens
caugugaucugggaaacug

SEQ ID NO: 965454 - RNA, 19 nt, Homo sapiens
acagaggguuugggauaaa

SEQ ID NO: 965455 - RNA, 19 nt, Homo sapiens
caaacuuccuuaugaucuc

SEQ ID NO: 965456 - RNA, 19 nt, Homo sapiens
ggguguguuugcacuacua

SEQ ID NO: 965457 - RNA, 19 nt, Homo sapiens
augccaaggugaugaugua

SEQ ID NO: 965458 - RNA, 19 nt, Homo sapiens
gugaugauguaucguaagg

SEQ ID NO: 965459 - RNA, 19 nt, Homo sapiens
gugaaccaauuaaauacca

SEQ ID NO: 965460 - RNA, 19 nt, Homo sapiens
ucugggaaguuaccucgaa

SEQ ID NO: 965461 - RNA, 19 nt, Homo sapiens
cagacgcgaucgugagcaa

SEQ ID NO: 965462 - RNA, 19 nt, Homo sapiens
cuuaugaucucugguucaa

SEQ ID NO: 965463 - RNA, 19 nt, Homo sapiens
ucucaacccggguguguuu

SEQ ID NO: 965464 - RNA, 19 nt, Homo sapiens
aaauaugacugaggacucu

SEQ ID NO: 965465 - RNA, 19 nt, Homo sapiens
gauacugagaaacuuugua

SEQ ID NO: 965466 - RNA, 19 nt, Homo sapiens
ccuguaagauccuaguuuu

SEQ ID NO: 965467 - RNA, 19 nt, Homo sapiens
gaaaugguggaagauagug

SEQ ID NO: 965468 - RNA, 19 nt, Homo sapiens
gcuaaagccauggaggaaa

SEQ ID NO: 965469 - RNA, 19 nt, Homo sapiens
gguuugggauaaaguugug

SEQ ID NO: 965470 - RNA, 19 nt, Homo sapiens
gacgcuuugugaaccaauu

SEQ ID NO: 965471 - RNA, 19 nt, Homo sapiens
aggaaaugguggaagauag

SEQ ID NO: 965472 - RNA, 19 nt, Homo sapiens
gucguucgcuuuguuagug

SEQ ID NO: 965473 - RNA, 19 nt, Homo sapiens
gauaaaguugugaguggau

SEQ ID NO: 965474 - RNA, 19 nt, Homo sapiens
ccaaacuuccuuaugaucu

SEQ ID NO: 965475 - RNA, 19 nt, Homo sapiens
uugcacuacuagagaauga

SEQ ID NO: 965476 - RNA, 19 nt, Homo sapiens
uaaaaguuauggcacugaa

SEQ ID NO: 965477 - RNA, 19 nt, Homo sapiens
gcgggauguuugccugaau

SEQ ID NO: 965478 - RNA, 19 nt, Homo sapiens
aagucuaucuccgcaugua

SEQ ID NO: 965479 - RNA, 19 nt, Homo sapiens
guccauguaccgugcauug

SEQ ID NO: 965480 - RNA, 19 nt, Homo sapiens
ugggaaacugauugaauaa

SEQ ID NO: 965481 - RNA, 19 nt, Homo sapiens
ugagcaaggccauugacuu

SEQ ID NO: 965482 - RNA, 19 nt, Homo sapiens
aaaguuauggcacugaaca

SEQ ID NO: 965483 - RNA, 19 nt, Homo sapiens
aaggugaugauguaucgua

SEQ ID NO: 965484 - RNA, 19 nt, Homo sapiens
acugagaaacuuuguacuu

SEQ ID NO: 965485 - RNA, 19 nt, Homo sapiens
gggaaacugauugaauaau

SEQ ID NO: 965486 - RNA, 19 nt, Homo sapiens
cagugagcauuguguucuu

SEQ ID NO: 965487 - RNA, 19 nt, Homo sapiens
uuuuguagcugucgaaauu

SEQ ID NO: 965488 - RNA, 19 nt, Homo sapiens
gaggguuugggauaaaguu

SEQ ID NO: 965489 - RNA, 19 nt, Homo sapiens
agacugcugacucaucuga

SEQ ID NO: 965490 - RNA, 19 nt, Homo sapiens
guugugaguggauccugua

SEQ ID NO: 965491 - RNA, 19 nt, Homo sapiens
gaggugcuuugcgggaugu

SEQ ID NO: 965492 - RNA, 19 nt, Homo sapiens
uguuugcacuacuagagaa

SEQ ID NO: 965493 - RNA, 19 nt, Homo sapiens
guucuuggcaugugaucug

SEQ ID NO: 965494 - RNA, 19 nt, Homo sapiens
gugcuuugcgggauguuug

SEQ ID NO: 965495 - RNA, 19 nt, Homo sapiens
gcgcccaaacuuccuuaug

SEQ ID NO: 965496 - RNA, 19 nt, Homo sapiens
cuggaucacccgacgcuuu

SEQ ID NO: 965497 - RNA, 19 nt, Homo sapiens
gggaaguuaccucgaaguc

SEQ ID NO: 965498 - RNA, 19 nt, Homo sapiens
gcaguacuuggauguccuu

SEQ ID NO: 965499 - RNA, 19 nt, Homo sapiens
ggagaaagaccaaccagaa

SEQ ID NO: 965500 - RNA, 19 nt, Homo sapiens
gaagauauuuucaggguuu

SEQ ID NO: 965501 - RNA, 19 nt, Homo sapiens
gaacuguccuagcgcaaga

SEQ ID NO: 965502 - RNA, 19 nt, Homo sapiens
gcgcaagaguuaguaauug

SEQ ID NO: 965503 - RNA, 19 nt, Homo sapiens
gauccugugugaagauauu

SEQ ID NO: 965504 - RNA, 19 nt, Homo sapiens
ccuuaaagcuggaacauuc

SEQ ID NO: 965505 - RNA, 19 nt, Homo sapiens
cagcuggacuccugaagaa

SEQ ID NO: 965506 - RNA, 19 nt, Homo sapiens
gagaaagaccaaccagaaa

SEQ ID NO: 965507 - RNA, 19 nt, Homo sapiens
ccaaagcgcugggauuaca

SEQ ID NO: 965508 - RNA, 19 nt, Homo sapiens
caccaugccuggcuaauuc

SEQ ID NO: 965509 - RNA, 19 nt, Homo sapiens
agaaguggcuuuccucauc

SEQ ID NO: 965510 - RNA, 19 nt, Homo sapiens
gcugcgacaugguguguuu

SEQ ID NO: 965511 - RNA, 19 nt, Homo sapiens
ggagacaccaguaugaaug

SEQ ID NO: 965512 - RNA, 19 nt, Homo sapiens
ccagaaaguucgccugaag

SEQ ID NO: 965513 - RNA, 19 nt, Homo sapiens
gaaagaccaaccagaaagu

SEQ ID NO: 965514 - RNA, 19 nt, Homo sapiens
gaaguggcuuuccucaucu

SEQ ID NO: 965515 - RNA, 19 nt, Homo sapiens
gugcaguggugugaucaua

SEQ ID NO: 965516 - RNA, 19 nt, Homo sapiens
ggagugcaguggugugauc

SEQ ID NO: 965517 - RNA, 19 nt, Homo sapiens
uguccuagcgcaagaguua

SEQ ID NO: 965518 - RNA, 19 nt, Homo sapiens
gaggacagguggacauggu

SEQ ID NO: 965519 - RNA, 19 nt, Homo sapiens
ugcccuagcucgucucaaa

SEQ ID NO: 965520 - RNA, 19 nt, Homo sapiens
gcaccaugccuggcuaauu

SEQ ID NO: 965521 - RNA, 19 nt, Homo sapiens
aacccacccugaaugaaua

SEQ ID NO: 965522 - RNA, 19 nt, Homo sapiens
gcagaggagacaccaguau

SEQ ID NO: 965523 - RNA, 19 nt, Homo sapiens
cacccucgacuuuauauaa

SEQ ID NO: 965524 - RNA, 19 nt, Homo sapiens
cuucaacacuuccacuuca

SEQ ID NO: 965525 - RNA, 19 nt, Homo sapiens
gauacccuguccuguggaa

SEQ ID NO: 965526 - RNA, 19 nt, Homo sapiens
gugauccugugugaagaua

SEQ ID NO: 965527 - RNA, 19 nt, Homo sapiens
gaggagacaccaguaugaa

SEQ ID NO: 965528 - RNA, 19 nt, Homo sapiens
gcagcuggacuccugaaga

SEQ ID NO: 965529 - RNA, 19 nt, Homo sapiens
caugguguguuuccuguuc

SEQ ID NO: 965530 - RNA, 19 nt, Homo sapiens
ucacagaguggcugaagga

SEQ ID NO: 965531 - RNA, 19 nt, Homo sapiens
ggaguuugcaguggagaaa

SEQ ID NO: 965532 - RNA, 19 nt, Homo sapiens
gcaguggugugaucauagc

SEQ ID NO: 965533 - RNA, 19 nt, Homo sapiens
gaagguggcagaggagaca

SEQ ID NO: 965534 - RNA, 19 nt, Homo sapiens
uggcacaggugacuucaag

SEQ ID NO: 965535 - RNA, 19 nt, Homo sapiens
gacugggucuugcucuguu

SEQ ID NO: 965536 - RNA, 19 nt, Homo sapiens
ggacuuccacuucaacacu

SEQ ID NO: 965537 - RNA, 19 nt, Homo sapiens
agagcugucuggagaagug

SEQ ID NO: 965538 - RNA, 19 nt, Homo sapiens
uaagagcugucuggagaag

SEQ ID NO: 965539 - RNA, 19 nt, Homo sapiens
ucaaacuccuggccucaag

SEQ ID NO: 965540 - RNA, 19 nt, Homo sapiens
aaacccacccugaaugaau

SEQ ID NO: 965541 - RNA, 19 nt, Homo sapiens
agaggagacaccaguauga

SEQ ID NO: 965542 - RNA, 19 nt, Homo sapiens
gcacccugaucucauucug

SEQ ID NO: 965543 - RNA, 19 nt, Homo sapiens
ccacuuuggagcucagauu

SEQ ID NO: 965544 - RNA, 19 nt, Homo sapiens
uggcuuuccucaucuaaca

SEQ ID NO: 965545 - RNA, 19 nt, Homo sapiens
cuccugggcucaagagguu

SEQ ID NO: 965546 - RNA, 19 nt, Homo sapiens
gcacccucgacuuuauaua

SEQ ID NO: 965547 - RNA, 19 nt, Homo sapiens
agucugugauccuguguga

SEQ ID NO: 965548 - RNA, 19 nt, Homo sapiens
gacuuccacuucaacacuu

SEQ ID NO: 965549 - RNA, 19 nt, Homo sapiens
ucuggacgcuggucuccuu

SEQ ID NO: 965550 - RNA, 19 nt, Homo sapiens
ggacacaccgagugauggu

SEQ ID NO: 965551 - RNA, 19 nt, Homo sapiens
cuccucagccucccaagua

SEQ ID NO: 965552 - RNA, 19 nt, Homo sapiens
caacacuuccacuucaaca

SEQ ID NO: 965553 - RNA, 19 nt, Homo sapiens
gaaaguucgccugaagauc

SEQ ID NO: 965554 - RNA, 19 nt, Homo sapiens
cagaaaguucgccugaaga

SEQ ID NO: 965555 - RNA, 19 nt, Homo sapiens
agaaagaccaaccagaaag

SEQ ID NO: 965556 - RNA, 19 nt, Homo sapiens
cagaggagacaccaguaug

SEQ ID NO: 965557 - RNA, 19 nt, Homo sapiens
gaacuccugggcucaagag

SEQ ID NO: 965558 - RNA, 19 nt, Homo sapiens
aaaguugcacugcguuuca

SEQ ID NO: 965559 - RNA, 19 nt, Homo sapiens
cuuuggagcucagauuugu

SEQ ID NO: 965560 - RNA, 19 nt, Homo sapiens
gguccuuucugccggaucu

SEQ ID NO: 965561 - RNA, 19 nt, Homo sapiens
ggaggccgugggucucauu

SEQ ID NO: 965562 - RNA, 19 nt, Homo sapiens
gagaaguggcuuuccucau

SEQ ID NO: 965563 - RNA, 19 nt, Homo sapiens
cacuuccacuucaacaguu

SEQ ID NO: 965564 - RNA, 19 nt, Homo sapiens
agaaaguucgccugaagau

SEQ ID NO: 965565 - RNA, 19 nt, Homo sapiens
uuggagcucagauuuguuu

SEQ ID NO: 965566 - RNA, 19 nt, Homo sapiens
ccucaucuaacaccagcua

SEQ ID NO: 965567 - RNA, 19 nt, Homo sapiens
uuuguuugcuugcuuucuu

SEQ ID NO: 965568 - RNA, 19 nt, Homo sapiens
acugggucuugcucuguua

SEQ ID NO: 965569 - RNA, 19 nt, Homo sapiens
ggcagaggagacaccagua

SEQ ID NO: 965570 - RNA, 19 nt, Homo sapiens
aaagaccaaccagaaaguu

SEQ ID NO: 965571 - RNA, 19 nt, Homo sapiens
ggacggagaagcggacacu

SEQ ID NO: 965572 - RNA, 19 nt, Homo sapiens
gaaagggaaugaauugcaa

SEQ ID NO: 965573 - RNA, 19 nt, Homo sapiens
ggaaaaggcucaucuguca

SEQ ID NO: 965574 - RNA, 19 nt, Homo sapiens
gggaaugaauugcaacguu

SEQ ID NO: 965575 - RNA, 19 nt, Homo sapiens
ggaaacggcuuuguauuuu

SEQ ID NO: 965576 - RNA, 19 nt, Homo sapiens
agagaaagcugagaacuuc

SEQ ID NO: 965577 - RNA, 19 nt, Homo sapiens
uaaccgacaugggaaguuu

SEQ ID NO: 965578 - RNA, 19 nt, Homo sapiens
guagaauguucgcugauga

SEQ ID NO: 965579 - RNA, 19 nt, Homo sapiens
gaaaaugguuggaaguaga

SEQ ID NO: 965580 - RNA, 19 nt, Homo sapiens
caugggaaguuucgauaga

SEQ ID NO: 965581 - RNA, 19 nt, Homo sapiens
gaccugcacaaccuuaaua

SEQ ID NO: 965582 - RNA, 19 nt, Homo sapiens
aggaaacggcuuuguauuu

SEQ ID NO: 965583 - RNA, 19 nt, Homo sapiens
ggaaagggaaugaauugca

SEQ ID NO: 965584 - RNA, 19 nt, Homo sapiens
gaggaaacggcuuuguauu

SEQ ID NO: 965585 - RNA, 19 nt, Homo sapiens
gacaugggaaguuucgaua

SEQ ID NO: 965586 - RNA, 19 nt, Homo sapiens
cauccgcuaucucuacaaa

SEQ ID NO: 965587 - RNA, 19 nt, Homo sapiens
gaagggaaacuguacuuuu

SEQ ID NO: 965588 - RNA, 19 nt, Homo sapiens
gugaggaaacggcuuugua

SEQ ID NO: 965589 - RNA, 19 nt, Homo sapiens
gagaagggaaacuguacuu

SEQ ID NO: 965590 - RNA, 19 nt, Homo sapiens
ugaggaaacggcuuuguau

SEQ ID NO: 965591 - RNA, 19 nt, Homo sapiens
ggacgguuccugucaucuu

SEQ ID NO: 965592 - RNA, 19 nt, Homo sapiens
gaugaccugcacaaccuua

SEQ ID NO: 965593 - RNA, 19 nt, Homo sapiens
gacgguuccugucaucuuc

SEQ ID NO: 965594 - RNA, 19 nt, Homo sapiens
gguuggaaguagaauguuc

SEQ ID NO: 965595 - RNA, 19 nt, Homo sapiens
uagaagagaaagcugagaa

SEQ ID NO: 965596 - RNA, 19 nt, Homo sapiens
caucuucuugggcuuauuu

SEQ ID NO: 965597 - RNA, 19 nt, Homo sapiens
caacguuguauccgaaaga

SEQ ID NO: 965598 - RNA, 19 nt, Homo sapiens
gaagagaaagcugagaacu

SEQ ID NO: 965599 - RNA, 19 nt, Homo sapiens
ggaaaaugguuggaaguag

SEQ ID NO: 965600 - RNA, 19 nt, Homo sapiens
gaaaagcaccccaaagaac

SEQ ID NO: 965601 - RNA, 19 nt, Homo sapiens
aaacgcauccgcuaucucu

SEQ ID NO: 965602 - RNA, 19 nt, Homo sapiens
uaauaaacgcauccgcuau

SEQ ID NO: 965603 - RNA, 19 nt, Homo sapiens
gaaugaauugcaacguugu

SEQ ID NO: 965604 - RNA, 19 nt, Homo sapiens
cggaguguaugacaacauc

SEQ ID NO: 965605 - RNA, 19 nt, Homo sapiens
aagagaaagcugagaacuu

SEQ ID NO: 965606 - RNA, 19 nt, Homo sapiens
gcaacguuguauccgaaag

SEQ ID NO: 965607 - RNA, 19 nt, Homo sapiens
guuggaaagggaaugaauu

SEQ ID NO: 965608 - RNA, 19 nt, Homo sapiens
aagcugagaacuucggaaa

SEQ ID NO: 965609 - RNA, 19 nt, Homo sapiens
aaauggggcuucuuuggaa

SEQ ID NO: 965610 - RNA, 19 nt, Homo sapiens
gauggcugucuucgccuua

SEQ ID NO: 965611 - RNA, 19 nt, Homo sapiens
uauuuggugugcuguugaa

SEQ ID NO: 965612 - RNA, 19 nt, Homo sapiens
uuaguacucgugugaaguu

SEQ ID NO: 965613 - RNA, 19 nt, Homo sapiens
gcugagaacuucggaaaag

SEQ ID NO: 965614 - RNA, 19 nt, Homo sapiens
ggaaguuucgauagaagag

SEQ ID NO: 965615 - RNA, 19 nt, Homo sapiens
gaauugcaacguuguaucc

SEQ ID NO: 965616 - RNA, 19 nt, Homo sapiens
gggaaguuucgauagaaga

SEQ ID NO: 965617 - RNA, 19 nt, Homo sapiens
cgacaugggaaguuucgau

SEQ ID NO: 965618 - RNA, 19 nt, Homo sapiens
uccgcuaucucuacaaaca

SEQ ID NO: 965619 - RNA, 19 nt, Homo sapiens
gauccugggaaacuuugaa

SEQ ID NO: 965620 - RNA, 19 nt, Homo sapiens
aaguuucgauagaagagaa

SEQ ID NO: 965621 - RNA, 19 nt, Homo sapiens
gaaguuucgauagaagaga

SEQ ID NO: 965622 - RNA, 19 nt, Homo sapiens
caaacacuuuaaccgacau

SEQ ID NO: 965623 - RNA, 19 nt, Homo sapiens
aguagaauguucgcugaug

SEQ ID NO: 965624 - RNA, 19 nt, Homo sapiens
gagguuggaaagggaauga

SEQ ID NO: 965625 - RNA, 19 nt, Homo sapiens
cuagauugaucgguauaag

SEQ ID NO: 965626 - RNA, 19 nt, Homo sapiens
ggccauguucggaguguau

SEQ ID NO: 965627 - RNA, 19 nt, Homo sapiens
aauaaacgcauccgcuauc

SEQ ID NO: 965628 - RNA, 19 nt, Homo sapiens
cugcacaaccuuaauaaac

SEQ ID NO: 965629 - RNA, 19 nt, Homo sapiens
acaucgggauccugggaaa

SEQ ID NO: 965630 - RNA, 19 nt, Homo sapiens
aauggcagggaaccucuua

SEQ ID NO: 965631 - RNA, 19 nt, Homo sapiens
uuggaaagggaaugaauug

SEQ ID NO: 965632 - RNA, 19 nt, Homo sapiens
agaagggaaacuguacuuu

SEQ ID NO: 965633 - RNA, 19 nt, Homo sapiens
cuuauuuggugugcuguug

SEQ ID NO: 965634 - RNA, 19 nt, Homo sapiens
guauaaagguguccugcua

SEQ ID NO: 965635 - RNA, 19 nt, Homo sapiens
ugaaguaauucgccuguuu

SEQ ID NO: 965636 - RNA, 19 nt, Homo sapiens
cgaaagaugccacucagua

SEQ ID NO: 965637 - RNA, 19 nt, Homo sapiens
caucaugaauggcaucuug

SEQ ID NO: 965638 - RNA, 19 nt, Homo sapiens
gaaagaugccacucaguau

SEQ ID NO: 965639 - RNA, 19 nt, Homo sapiens
uccaacagcuaaccuagua

SEQ ID NO: 965640 - RNA, 19 nt, Homo sapiens
gcaagcaacucagcauaag

SEQ ID NO: 965641 - RNA, 19 nt, Homo sapiens
gcacggagagccucauguu

SEQ ID NO: 965642 - RNA, 19 nt, Homo sapiens
guauaaugcuaccuauuuc

SEQ ID NO: 965643 - RNA, 19 nt, Homo sapiens
uuuaguagcucauaguguu

SEQ ID NO: 965644 - RNA, 19 nt, Homo sapiens
aagaugccacucaguauua

SEQ ID NO: 965645 - RNA, 19 nt, Homo sapiens
gcugacaccacacauauug

SEQ ID NO: 965646 - RNA, 19 nt, Homo sapiens
ggacacgauuugaaguaca

SEQ ID NO: 965647 - RNA, 19 nt, Homo sapiens
cuucuacacucaaguauag

SEQ ID NO: 965648 - RNA, 19 nt, Homo sapiens
ggcaagcaacucagcauaa

SEQ ID NO: 965649 - RNA, 19 nt, Homo sapiens
ggcaaguuguccugagaaa

SEQ ID NO: 965650 - RNA, 19 nt, Homo sapiens
gcuggaacuuuucauauuu

SEQ ID NO: 965651 - RNA, 19 nt, Homo sapiens
uaccauauccaacagcuaa

SEQ ID NO: 965652 - RNA, 19 nt, Homo sapiens
gguaccaucuucuaaacca

SEQ ID NO: 965653 - RNA, 19 nt, Homo sapiens
acacauauugcuucuggua

SEQ ID NO: 965654 - RNA, 19 nt, Homo sapiens
gggcaagcaacucagcaua

SEQ ID NO: 965655 - RNA, 19 nt, Homo sapiens
uuucuacucucuucaugaa

SEQ ID NO: 965656 - RNA, 19 nt, Homo sapiens
cugaacgggugguauaaug

SEQ ID NO: 965657 - RNA, 19 nt, Homo sapiens
aaagaugccacucaguauu

SEQ ID NO: 965658 - RNA, 19 nt, Homo sapiens
caaguuguccugagaaagg

SEQ ID NO: 965659 - RNA, 19 nt, Homo sapiens
ugaauggcaucuugcucuu

SEQ ID NO: 965660 - RNA, 19 nt, Homo sapiens
uggugaugcuccuccuuua

SEQ ID NO: 965661 - RNA, 19 nt, Homo sapiens
gaaagccucucaccccaau

SEQ ID NO: 965662 - RNA, 19 nt, Homo sapiens
gcaucuugcucuucuucug

SEQ ID NO: 965663 - RNA, 19 nt, Homo sapiens
gccaguggguaccaucuuc

SEQ ID NO: 965664 - RNA, 19 nt, Homo sapiens
uauugcuucugguacuuua

SEQ ID NO: 965665 - RNA, 19 nt, Homo sapiens
caugauggccuccuauuac

SEQ ID NO: 965666 - RNA, 19 nt, Homo sapiens
gaaguaauucgccuguuuu

SEQ ID NO: 965667 - RNA, 19 nt, Homo sapiens
aagguguccugcuaccaua

SEQ ID NO: 965668 - RNA, 19 nt, Homo sapiens
cuauaccugucccacauga

SEQ ID NO: 965669 - RNA, 19 nt, Homo sapiens
uguacgagcugugcuauac

SEQ ID NO: 965670 - RNA, 19 nt, Homo sapiens
guugguggguuuccagagu

SEQ ID NO: 965671 - RNA, 19 nt, Homo sapiens
guggguaccaucuucuaaa

SEQ ID NO: 965672 - RNA, 19 nt, Homo sapiens
guggugaugcuccuccuuu

SEQ ID NO: 965673 - RNA, 19 nt, Homo sapiens
gcuggaaauccuguucuuu

SEQ ID NO: 965674 - RNA, 19 nt, Homo sapiens
cauauugcuucugguacuu

SEQ ID NO: 965675 - RNA, 19 nt, Homo sapiens
gacacgauuugaaguacag

SEQ ID NO: 965676 - RNA, 19 nt, Homo sapiens
gcugcuuucuccaguaugg

SEQ ID NO: 965677 - RNA, 19 nt, Homo sapiens
ccuccuuuaucuuggaauu

SEQ ID NO: 965678 - RNA, 19 nt, Homo sapiens
gcuccuccuuuaucuugga

SEQ ID NO: 965679 - RNA, 19 nt, Homo sapiens
uuucugaacgggugguaua

SEQ ID NO: 965680 - RNA, 19 nt, Homo sapiens
ccacaccagugagaauugg

SEQ ID NO: 965681 - RNA, 19 nt, Homo sapiens
ccuggaagccaucaugaau

SEQ ID NO: 965682 - RNA, 19 nt, Homo sapiens
ggugaugcuccuccuuuau

SEQ ID NO: 965683 - RNA, 19 nt, Homo sapiens
cggagagccucauguuggu

SEQ ID NO: 965684 - RNA, 19 nt, Homo sapiens
gcaagguuauucccauccu

SEQ ID NO: 965685 - RNA, 19 nt, Homo sapiens
ggugagauuccggagguaa

SEQ ID NO: 965686 - RNA, 19 nt, Homo sapiens
cgauuugaaguacagaauu

SEQ ID NO: 965687 - RNA, 19 nt, Homo sapiens
guauggacacgauuugaag

SEQ ID NO: 965688 - RNA, 19 nt, Homo sapiens
gugcucaccuuggcugcuu

SEQ ID NO: 965689 - RNA, 19 nt, Homo sapiens
gccuugaccuucccaucug

SEQ ID NO: 965690 - RNA, 19 nt, Homo sapiens
uccuuuaucuuggaauuga

SEQ ID NO: 965691 - RNA, 19 nt, Homo sapiens
gugaugcuccuccuuuauc

SEQ ID NO: 965692 - RNA, 19 nt, Homo sapiens
gaacgggugguauaaugcu

SEQ ID NO: 965693 - RNA, 19 nt, Homo sapiens
uuaguagcucauaguguua

SEQ ID NO: 965694 - RNA, 19 nt, Homo sapiens
caggcugacaccacacaua

SEQ ID NO: 965695 - RNA, 19 nt, Homo sapiens
uggcugcuuucuccaguau

SEQ ID NO: 965696 - RNA, 19 nt, Homo sapiens
ccacaugcucccuguacga

SEQ ID NO: 965697 - RNA, 19 nt, Homo sapiens
cugcugaccucaaguucuc

SEQ ID NO: 965698 - RNA, 19 nt, Homo sapiens
cagcgaaagaugccacuca

SEQ ID NO: 965699 - RNA, 19 nt, Homo sapiens
gggcaaguuguccugagaa

SEQ ID NO: 965700 - RNA, 19 nt, Homo sapiens
ccaguauggacacgauuug

SEQ ID NO: 965701 - RNA, 19 nt, Homo sapiens
gugagauuccggagguaaa

SEQ ID NO: 965702 - RNA, 19 nt, Homo sapiens
gagcacggagagccucaug

SEQ ID NO: 965703 - RNA, 19 nt, Homo sapiens
cuacguacuccgccuggaa

SEQ ID NO: 965704 - RNA, 19 nt, Homo sapiens
ucuacucucuucaugaaac

SEQ ID NO: 965705 - RNA, 19 nt, Homo sapiens
caacagcuaaccuaguacu

SEQ ID NO: 965706 - RNA, 19 nt, Homo sapiens
caucucguguggaccaucu

SEQ ID NO: 965707 - RNA, 19 nt, Homo sapiens
acauauugcuucugguacu

SEQ ID NO: 965708 - RNA, 19 nt, Homo sapiens
aauggcaucuugcucuucu

SEQ ID NO: 965709 - RNA, 19 nt, Homo sapiens
caaaguagaugaccaaauu

SEQ ID NO: 965710 - RNA, 19 nt, Homo sapiens
cagaagaacucaagucaga

SEQ ID NO: 965711 - RNA, 19 nt, Homo sapiens
gcaacgauccugacauuga

SEQ ID NO: 965712 - RNA, 19 nt, Homo sapiens
cggcucagcuuuccaauca

SEQ ID NO: 965713 - RNA, 19 nt, Homo sapiens
ccauucugcuugaaguuua

SEQ ID NO: 965714 - RNA, 19 nt, Homo sapiens
uuaaugggauuguugaaga

SEQ ID NO: 965715 - RNA, 19 nt, Homo sapiens
ccaaucagcugcggaagga

SEQ ID NO: 965716 - RNA, 19 nt, Homo sapiens
gaagaacucaagucagaau

SEQ ID NO: 965717 - RNA, 19 nt, Homo sapiens
uggcaacgauccugacauu

SEQ ID NO: 965718 - RNA, 19 nt, Homo sapiens
gaaguuuaaugggauuguu

SEQ ID NO: 965719 - RNA, 19 nt, Homo sapiens
gaaacucaccaaaguagau

SEQ ID NO: 965720 - RNA, 19 nt, Homo sapiens
gaacugaugagccgguuuc

SEQ ID NO: 965721 - RNA, 19 nt, Homo sapiens
guacuuugcugcgacuaga

SEQ ID NO: 965722 - RNA, 19 nt, Homo sapiens
caacgauccugacauugag

SEQ ID NO: 965723 - RNA, 19 nt, Homo sapiens
gaacucaagucagaaucag

SEQ ID NO: 965724 - RNA, 19 nt, Homo sapiens
cuucaacuaugguacuuug

SEQ ID NO: 965725 - RNA, 19 nt, Homo sapiens
caagucagaaucagccaaa

SEQ ID NO: 965726 - RNA, 19 nt, Homo sapiens
cagaaucagccaaagagaa

SEQ ID NO: 965727 - RNA, 19 nt, Homo sapiens
auuacaagcugauuucauc

SEQ ID NO: 965728 - RNA, 19 nt, Homo sapiens
aaagucagcccucgacaca

SEQ ID NO: 965729 - RNA, 19 nt, Homo sapiens
augcugaagucuauuacaa

SEQ ID NO: 965730 - RNA, 19 nt, Homo sapiens
gcggaaggagccacgcuuu

SEQ ID NO: 965731 - RNA, 19 nt, Homo sapiens
cauucugcuugaaguuuaa

SEQ ID NO: 965732 - RNA, 19 nt, Homo sapiens
guagaugaccaaauuuacu

SEQ ID NO: 965733 - RNA, 19 nt, Homo sapiens
ggaaggagccacgcuuucg

SEQ ID NO: 965734 - RNA, 19 nt, Homo sapiens
ccugaaacucaccaaagua

SEQ ID NO: 965735 - RNA, 19 nt, Homo sapiens
uggaggccauucugcuuga

SEQ ID NO: 965736 - RNA, 19 nt, Homo sapiens
ggacccagaagaacucaag

SEQ ID NO: 965737 - RNA, 19 nt, Homo sapiens
agucagcccucgacacaag

SEQ ID NO: 965738 - RNA, 19 nt, Homo sapiens
ggaggccauucugcuugaa

SEQ ID NO: 965739 - RNA, 19 nt, Homo sapiens
agaaucagccaaagagaag

SEQ ID NO: 965740 - RNA, 19 nt, Homo sapiens
gccauucugcuugaaguuu

SEQ ID NO: 965741 - RNA, 19 nt, Homo sapiens
ccaaaguagaugaccaaau

SEQ ID NO: 965742 - RNA, 19 nt, Homo sapiens
gacuucaacuaugguacuu

SEQ ID NO: 965743 - RNA, 19 nt, Homo sapiens
caccaaaguagaugaccaa

SEQ ID NO: 965744 - RNA, 19 nt, Homo sapiens
uccugaaacucaccaaagu

SEQ ID NO: 965745 - RNA, 19 nt, Homo sapiens
uuugagacccuuaggauag

SEQ ID NO: 965746 - RNA, 19 nt, Homo sapiens
augaccaaauuuacucuga

SEQ ID NO: 965747 - RNA, 19 nt, Homo sapiens
gacccacaguuccugaaac

SEQ ID NO: 965748 - RNA, 19 nt, Homo sapiens
ucuauuacaagcugauuuc

SEQ ID NO: 965749 - RNA, 19 nt, Homo sapiens
uguguuggacccagaagaa

SEQ ID NO: 965750 - RNA, 19 nt, Homo sapiens
uugagacccuuaggauaga

SEQ ID NO: 965751 - RNA, 19 nt, Homo sapiens
gaaaguaguuaagcauuug

SEQ ID NO: 965752 - RNA, 19 nt, Homo sapiens
gguguggagucucuuauuu

SEQ ID NO: 965753 - RNA, 19 nt, Homo sapiens
caagaagacguccauauug

SEQ ID NO: 965754 - RNA, 19 nt, Homo sapiens
uaaagaugcuuggauuaga

SEQ ID NO: 965755 - RNA, 19 nt, Homo sapiens
aaagaugcuuggauuagaa

SEQ ID NO: 965756 - RNA, 19 nt, Homo sapiens
aagaauaucccuucaguga

SEQ ID NO: 965757 - RNA, 19 nt, Homo sapiens
gauaagguuuguuguuucu

SEQ ID NO: 965758 - RNA, 19 nt, Homo sapiens
ccucauaaacugcauauug

SEQ ID NO: 965759 - RNA, 19 nt, Homo sapiens
ccacagaacccucauaaac

SEQ ID NO: 965760 - RNA, 19 nt, Homo sapiens
gaucaagaauuccagaaaa

SEQ ID NO: 965761 - RNA, 19 nt, Homo sapiens
cuaaagagagcaaucacua

SEQ ID NO: 965762 - RNA, 19 nt, Homo sapiens
acaagaagacguccauauu

SEQ ID NO: 965763 - RNA, 19 nt, Homo sapiens
uguauugccuaguguaauu

SEQ ID NO: 965764 - RNA, 19 nt, Homo sapiens
caaauucaccagaucaaga

SEQ ID NO: 965765 - RNA, 19 nt, Homo sapiens
acagaacccucauaaacug

SEQ ID NO: 965766 - RNA, 19 nt, Homo sapiens
acaagaauaucccuucagu

SEQ ID NO: 965767 - RNA, 19 nt, Homo sapiens
gcacauaccccucaaguuc

SEQ ID NO: 965768 - RNA, 19 nt, Homo sapiens
agagcaaucacuacacuua

SEQ ID NO: 965769 - RNA, 19 nt, Homo sapiens
uaagguuuguuguuucuuc

SEQ ID NO: 965770 - RNA, 19 nt, Homo sapiens
ucacaagaauaucccuuca

SEQ ID NO: 965771 - RNA, 19 nt, Homo sapiens
uaaaauguauugccuagug

SEQ ID NO: 965772 - RNA, 19 nt, Homo sapiens
aagaagacguccauauugg

SEQ ID NO: 965773 - RNA, 19 nt, Homo sapiens
cucauaaacugcauauugu

SEQ ID NO: 965774 - RNA, 19 nt, Homo sapiens
ugauaagguuuguuguuuc

SEQ ID NO: 965775 - RNA, 19 nt, Homo sapiens
gagcaaucacuacacuuau

SEQ ID NO: 965776 - RNA, 19 nt, Homo sapiens
guuaagcauuugauaaggu

SEQ ID NO: 965777 - RNA, 19 nt, Homo sapiens
cgucacaaauucaccagau

SEQ ID NO: 965778 - RNA, 19 nt, Homo sapiens
cagauuggauucgucacaa

SEQ ID NO: 965779 - RNA, 19 nt, Homo sapiens
uggagucucuuauuuguac

SEQ ID NO: 965780 - RNA, 19 nt, Homo sapiens
agacguccauauugggaaa

SEQ ID NO: 965781 - RNA, 19 nt, Homo sapiens
uguggagucucuuauuugu

SEQ ID NO: 965782 - RNA, 19 nt, Homo sapiens
aaagagagcaaucacuaca

SEQ ID NO: 965783 - RNA, 19 nt, Homo sapiens
gcaaucacuacacuuaugg

SEQ ID NO: 965784 - RNA, 19 nt, Homo sapiens
ucacaaauucaccagauca

SEQ ID NO: 965785 - RNA, 19 nt, Homo sapiens
ggccucaccugaagaucau

SEQ ID NO: 965786 - RNA, 19 nt, Homo sapiens
aaagguguggagucucuua

SEQ ID NO: 965787 - RNA, 19 nt, Homo sapiens
aaauucaccagaucaagaa

SEQ ID NO: 965788 - RNA, 19 nt, Homo sapiens
gcgcuuaguaguucaaugg

SEQ ID NO: 965789 - RNA, 19 nt, Homo sapiens
ccucaaguucacaagaaua

SEQ ID NO: 965790 - RNA, 19 nt, Homo sapiens
guacaagaagacguccaua

SEQ ID NO: 965791 - RNA, 19 nt, Homo sapiens
gauccacagaacccucaua

SEQ ID NO: 965792 - RNA, 19 nt, Homo sapiens
caaaagguguggagucucu

SEQ ID NO: 965793 - RNA, 19 nt, Homo sapiens
agcaaucacuacacuuaug

SEQ ID NO: 965794 - RNA, 19 nt, Homo sapiens
guguagcacuugguaguuc

SEQ ID NO: 965795 - RNA, 19 nt, Homo sapiens
agauuggauucgucacaaa

SEQ ID NO: 965796 - RNA, 19 nt, Homo sapiens
gguuuguuguuucuucuca

SEQ ID NO: 965797 - RNA, 19 nt, Homo sapiens
cggcaggcuuugaguguag

SEQ ID NO: 965798 - RNA, 19 nt, Homo sapiens
uacaagaagacguccauau

SEQ ID NO: 965799 - RNA, 19 nt, Homo sapiens
cacagaacccucauaaacu

SEQ ID NO: 965800 - RNA, 19 nt, Homo sapiens
acacuuauggcugggauuu

SEQ ID NO: 965801 - RNA, 19 nt, Homo sapiens
agagagcaaucacuacacu

SEQ ID NO: 965802 - RNA, 19 nt, Homo sapiens
gauuggauucgucacaaau

SEQ ID NO: 965803 - RNA, 19 nt, Homo sapiens
cauuugauaagguuuguug

SEQ ID NO: 965804 - RNA, 19 nt, Homo sapiens
ccuaguguaauucuaaaug

SEQ ID NO: 965805 - RNA, 19 nt, Homo sapiens
cuaguguaauucuaaaugc

SEQ ID NO: 965806 - RNA, 19 nt, Homo sapiens
guguggagucucuuauuug

SEQ ID NO: 965807 - RNA, 19 nt, Homo sapiens
gacggcaggcuuugagugu

SEQ ID NO: 965808 - RNA, 19 nt, Homo sapiens
uaaagagagcaaucacuac

SEQ ID NO: 965809 - RNA, 19 nt, Homo sapiens
gaacccucauaaacugcau

SEQ ID NO: 965810 - RNA, 19 nt, Homo sapiens
gacaaaagguguggagucu

SEQ ID NO: 965811 - RNA, 19 nt, Homo sapiens
auaaagaugcuuggauuag

SEQ ID NO: 965812 - RNA, 19 nt, Homo sapiens
agaucaagaauuccagaaa

SEQ ID NO: 965813 - RNA, 19 nt, Homo sapiens
uucaccagaucaagaauuc

SEQ ID NO: 965814 - RNA, 19 nt, Homo sapiens
ugccuaguguaauucuaaa

SEQ ID NO: 965815 - RNA, 19 nt, Homo sapiens
aaauguauugccuagugua

SEQ ID NO: 965816 - RNA, 19 nt, Homo sapiens
uuggauucgucacaaauuc

SEQ ID NO: 965817 - RNA, 19 nt, Homo sapiens
gaacagagauucagccaaa

SEQ ID NO: 965818 - RNA, 19 nt, Homo sapiens
gaacaagggugugaaauga

SEQ ID NO: 965819 - RNA, 19 nt, Homo sapiens
ggaauacaguggcaugauu

SEQ ID NO: 965820 - RNA, 19 nt, Homo sapiens
gaaaguaguuaagcauuug

SEQ ID NO: 965821 - RNA, 19 nt, Homo sapiens
gaaagcacaugaguccuaa

SEQ ID NO: 965822 - RNA, 19 nt, Homo sapiens
gauugaagaugaugaugaa

SEQ ID NO: 965823 - RNA, 19 nt, Homo sapiens
caauauccauccugucgua

SEQ ID NO: 965824 - RNA, 19 nt, Homo sapiens
uaagggagguucaguagug

SEQ ID NO: 965825 - RNA, 19 nt, Homo sapiens
gguguggagucucuuauuu

SEQ ID NO: 965826 - RNA, 19 nt, Homo sapiens
ggagaaguaagaauuguaa

SEQ ID NO: 965827 - RNA, 19 nt, Homo sapiens
caagaagacguccauauug

SEQ ID NO: 965828 - RNA, 19 nt, Homo sapiens
caaaagcacuggggaguua

SEQ ID NO: 965829 - RNA, 19 nt, Homo sapiens
ugaagaugaugaugaagaa

SEQ ID NO: 965830 - RNA, 19 nt, Homo sapiens
guaccaaaccagcauuuaa

SEQ ID NO: 965831 - RNA, 19 nt, Homo sapiens
gacagggacucacuauguu

SEQ ID NO: 965832 - RNA, 19 nt, Homo sapiens
gaauacaguggcaugauuu

SEQ ID NO: 965833 - RNA, 19 nt, Homo sapiens
uaaagaugcuuggauuaga

SEQ ID NO: 965834 - RNA, 19 nt, Homo sapiens
ggaacaagggugugaaaug

SEQ ID NO: 965835 - RNA, 19 nt, Homo sapiens
ugucguagaucuuaauguu

SEQ ID NO: 965836 - RNA, 19 nt, Homo sapiens
gcuuuggugucuauaagua

SEQ ID NO: 965837 - RNA, 19 nt, Homo sapiens
gcaagguguuggagaaauc

SEQ ID NO: 965838 - RNA, 19 nt, Homo sapiens
uguccaagcuggucucaaa

SEQ ID NO: 965839 - RNA, 19 nt, Homo sapiens
aaagaugcuuggauuagaa

SEQ ID NO: 965840 - RNA, 19 nt, Homo sapiens
guagugcaguggcaucuga

SEQ ID NO: 965841 - RNA, 19 nt, Homo sapiens
aagaauaucccuucaguga

SEQ ID NO: 965842 - RNA, 19 nt, Homo sapiens
acaagggugugaaaugaaa

SEQ ID NO: 965843 - RNA, 19 nt, Homo sapiens
ccucauaaacugcauauug

SEQ ID NO: 965844 - RNA, 19 nt, Homo sapiens
ugugacagcugauugaaga

SEQ ID NO: 965845 - RNA, 19 nt, Homo sapiens
gaggagaacaugucuaaca

SEQ ID NO: 965846 - RNA, 19 nt, Homo sapiens
cuaaagagagcaaucacua

SEQ ID NO: 965847 - RNA, 19 nt, Homo sapiens
ccacagaacccucauaaac

SEQ ID NO: 965848 - RNA, 19 nt, Homo sapiens
gaucaagaauuccagaaaa

SEQ ID NO: 965849 - RNA, 19 nt, Homo sapiens
gaagugccacccacaguga

SEQ ID NO: 965850 - RNA, 19 nt, Homo sapiens
cagaggagaacaugucuaa

SEQ ID NO: 965851 - RNA, 19 nt, Homo sapiens
acaagaagacguccauauu

SEQ ID NO: 965852 - RNA, 19 nt, Homo sapiens
caaauucaccagaucaaga

SEQ ID NO: 965853 - RNA, 19 nt, Homo sapiens
uaaggaaccucugucaaca

SEQ ID NO: 965854 - RNA, 19 nt, Homo sapiens
ggauauggguucauuuuau

SEQ ID NO: 965855 - RNA, 19 nt, Homo sapiens
gauuaucuguucugugcuu

SEQ ID NO: 965856 - RNA, 19 nt, Homo sapiens
acagaacccucauaaacug

SEQ ID NO: 965857 - RNA, 19 nt, Homo sapiens
gaaccucugcauucuaguu

SEQ ID NO: 965858 - RNA, 19 nt, Homo sapiens
gacagcugauugaagauga

SEQ ID NO: 965859 - RNA, 19 nt, Homo sapiens
gaaggaggcggaaaucucu

SEQ ID NO: 965860 - RNA, 19 nt, Homo sapiens
guaagaauggcaauguuug

SEQ ID NO: 965861 - RNA, 19 nt, Homo sapiens
acaagaauaucccuucagu

SEQ ID NO: 965862 - RNA, 19 nt, Homo sapiens
caguugagguugcuguuga

SEQ ID NO: 965863 - RNA, 19 nt, Homo sapiens
caccacauccagcuaauuu

SEQ ID NO: 965864 - RNA, 19 nt, Homo sapiens
ugaaaccuguggagcagaa

SEQ ID NO: 965865 - RNA, 19 nt, Homo sapiens
gcacauaccccucaaguuc

SEQ ID NO: 965866 - RNA, 19 nt, Homo sapiens
agagcaaucacuacacuua

SEQ ID NO: 965867 - RNA, 19 nt, Homo sapiens
caaaccagcauuuaauauc

SEQ ID NO: 965868 - RNA, 19 nt, Homo sapiens
cagccaaagucaagaaaca

SEQ ID NO: 965869 - RNA, 19 nt, Homo sapiens
gcaagccucauuaaccauu

SEQ ID NO: 965870 - RNA, 19 nt, Homo sapiens
uagcaagccucauuaacca

SEQ ID NO: 965871 - RNA, 19 nt, Homo sapiens
gcaggagaaucacuugaac

SEQ ID NO: 965872 - RNA, 19 nt, Homo sapiens
uaaagauggugagaaagug

SEQ ID NO: 965873 - RNA, 19 nt, Homo sapiens
aaauuuggcuuggcaacaa

SEQ ID NO: 965874 - RNA, 19 nt, Homo sapiens
gaugaagaaccucugcauu

SEQ ID NO: 965875 - RNA, 19 nt, Homo sapiens
cuaauuuggccuaaacuuu

SEQ ID NO: 965876 - RNA, 19 nt, Homo sapiens
ucacaagaauaucccuuca

SEQ ID NO: 965877 - RNA, 19 nt, Homo sapiens
aaaccuauuugucucuaug

SEQ ID NO: 965878 - RNA, 19 nt, Homo sapiens
agacagggacucacuaugu

SEQ ID NO: 965879 - RNA, 19 nt, Homo sapiens
aagaagacguccauauugg

SEQ ID NO: 965880 - RNA, 19 nt, Homo sapiens
gaagaaggaggcggaaauc

SEQ ID NO: 965881 - RNA, 19 nt, Homo sapiens
ccaaaccagcauuuaauau

SEQ ID NO: 965882 - RNA, 19 nt, Homo sapiens
caagccucauuaaccauuu

SEQ ID NO: 965883 - RNA, 19 nt, Homo sapiens
cucauaaacugcauauugu

SEQ ID NO: 965884 - RNA, 19 nt, Homo sapiens
caccucagccuccagagua

SEQ ID NO: 965885 - RNA, 19 nt, Homo sapiens
cuacagacuuggagauuuu

SEQ ID NO: 965886 - RNA, 19 nt, Homo sapiens
gagcagaaagcacaugagu

SEQ ID NO: 965887 - RNA, 19 nt, Homo sapiens
gggagaaguaagaauugua

SEQ ID NO: 965888 - RNA, 19 nt, Homo sapiens
uaagaauggcaauguuuga

SEQ ID NO: 965889 - RNA, 19 nt, Homo sapiens
agaaagcacaugaguccua

SEQ ID NO: 965890 - RNA, 19 nt, Homo sapiens
gaguggcucuuugcaugaa

SEQ ID NO: 965891 - RNA, 19 nt, Homo sapiens
gaagcaggagaaucacuug

SEQ ID NO: 965892 - RNA, 19 nt, Homo sapiens
gagcaaucacuacacuuau

SEQ ID NO: 965893 - RNA, 19 nt, Homo sapiens
cgucacaaauucaccagau

SEQ ID NO: 965894 - RNA, 19 nt, Homo sapiens
gaaauccaaagcugaccaa

SEQ ID NO: 965895 - RNA, 19 nt, Homo sapiens
cagauuggauucgucacaa

SEQ ID NO: 965896 - RNA, 19 nt, Homo sapiens
gagaccagccugaccaaca

SEQ ID NO: 965897 - RNA, 19 nt, Homo sapiens
uggagucucuuauuuguac

SEQ ID NO: 965898 - RNA, 19 nt, Homo sapiens
cagggagaauuauuuccuu

SEQ ID NO: 965899 - RNA, 19 nt, Homo sapiens
agacguccauauugggaaa

SEQ ID NO: 965900 - RNA, 19 nt, Homo sapiens
cacccaagcuggaauacag

SEQ ID NO: 965901 - RNA, 19 nt, Homo sapiens
uguggagucucuuauuugu

SEQ ID NO: 965902 - RNA, 19 nt, Homo sapiens
gcacacugccugaacaaaa

SEQ ID NO: 965903 - RNA, 19 nt, Homo sapiens
uguaagaauggcaauguuu

SEQ ID NO: 965904 - RNA, 19 nt, Homo sapiens
aaagagagcaaucacuaca

SEQ ID NO: 965905 - RNA, 19 nt, Homo sapiens
gcauucuaguuacccuuug

SEQ ID NO: 965906 - RNA, 19 nt, Homo sapiens
gcaaucacuacacuuaugg

SEQ ID NO: 965907 - RNA, 19 nt, Homo sapiens
uaccaaaccagcauuuaau

SEQ ID NO: 965908 - RNA, 19 nt, Homo sapiens
caccuuagcaagccucauu

SEQ ID NO: 965909 - RNA, 19 nt, Homo sapiens
ucacaaauucaccagauca

SEQ ID NO: 965910 - RNA, 19 nt, Homo sapiens
uuaaagauggugagaaagu

SEQ ID NO: 965911 - RNA, 19 nt, Homo sapiens
cauccugucguagaucuua

SEQ ID NO: 965912 - RNA, 19 nt, Homo sapiens
ggccucaccugaagaucau

SEQ ID NO: 965913 - RNA, 19 nt, Homo sapiens
guuuucagcuucagaauug

SEQ ID NO: 965914 - RNA, 19 nt, Homo sapiens
ugugcaagguguuggagaa

SEQ ID NO: 965915 - RNA, 19 nt, Homo sapiens
caugaacacugugcaaggu

SEQ ID NO: 965916 - RNA, 19 nt, Homo sapiens
guuuaauucucuguccuuu

SEQ ID NO: 965917 - RNA, 19 nt, Homo sapiens
gaaaguaguuaagcauuug

SEQ ID NO: 965918 - RNA, 19 nt, Homo sapiens
gaaagcacaugaguccuaa

SEQ ID NO: 965919 - RNA, 19 nt, Homo sapiens
gauugaagaugaugaugaa

SEQ ID NO: 965920 - RNA, 19 nt, Homo sapiens
caauauccauccugucgua

SEQ ID NO: 965921 - RNA, 19 nt, Homo sapiens
uaagggagguucaguagug

SEQ ID NO: 965922 - RNA, 19 nt, Homo sapiens
gguguggagucucuuauuu

SEQ ID NO: 965923 - RNA, 19 nt, Homo sapiens
ggagaaguaagaauuguaa

SEQ ID NO: 965924 - RNA, 19 nt, Homo sapiens
caagaagacguccauauug

SEQ ID NO: 965925 - RNA, 19 nt, Homo sapiens
caaaagcacuggggaguua

SEQ ID NO: 965926 - RNA, 19 nt, Homo sapiens
ugaagaugaugaugaagaa

SEQ ID NO: 965927 - RNA, 19 nt, Homo sapiens
uaaagaugcuuggauuaga

SEQ ID NO: 965928 - RNA, 19 nt, Homo sapiens
ugucguagaucuuaauguu

SEQ ID NO: 965929 - RNA, 19 nt, Homo sapiens
aaagaugcuuggauuagaa

SEQ ID NO: 965930 - RNA, 19 nt, Homo sapiens
guagugcaguggcaucuga

SEQ ID NO: 965931 - RNA, 19 nt, Homo sapiens
aagaauaucccuucaguga

SEQ ID NO: 965932 - RNA, 19 nt, Homo sapiens
ccucauaaacugcauauug

SEQ ID NO: 965933 - RNA, 19 nt, Homo sapiens
ugugacagcugauugaaga

SEQ ID NO: 965934 - RNA, 19 nt, Homo sapiens
cuaaagagagcaaucacua

SEQ ID NO: 965935 - RNA, 19 nt, Homo sapiens
gaggagaacaugucuaaca

SEQ ID NO: 965936 - RNA, 19 nt, Homo sapiens
ccacagaacccucauaaac

SEQ ID NO: 965937 - RNA, 19 nt, Homo sapiens
gaucaagaauuccagaaaa

SEQ ID NO: 965938 - RNA, 19 nt, Homo sapiens
gaagugccacccacaguga

SEQ ID NO: 965939 - RNA, 19 nt, Homo sapiens
cagaggagaacaugucuaa

SEQ ID NO: 965940 - RNA, 19 nt, Homo sapiens
acaagaagacguccauauu

SEQ ID NO: 965941 - RNA, 19 nt, Homo sapiens
caaauucaccagaucaaga

SEQ ID NO: 965942 - RNA, 19 nt, Homo sapiens
acagaacccucauaaacug

SEQ ID NO: 965943 - RNA, 19 nt, Homo sapiens
gaaccucugcauucuaguu

SEQ ID NO: 965944 - RNA, 19 nt, Homo sapiens
gacagcugauugaagauga

SEQ ID NO: 965945 - RNA, 19 nt, Homo sapiens
acaagaauaucccuucagu

SEQ ID NO: 965946 - RNA, 19 nt, Homo sapiens
ugaaaccuguggagcagaa

SEQ ID NO: 965947 - RNA, 19 nt, Homo sapiens
agagcaaucacuacacuua

SEQ ID NO: 965948 - RNA, 19 nt, Homo sapiens
gcacauaccccucaaguuc

SEQ ID NO: 965949 - RNA, 19 nt, Homo sapiens
aaauuuggcuuggcaacaa

SEQ ID NO: 965950 - RNA, 19 nt, Homo sapiens
gaugaagaaccucugcauu

SEQ ID NO: 965951 - RNA, 19 nt, Homo sapiens
ucacaagaauaucccuuca

SEQ ID NO: 965952 - RNA, 19 nt, Homo sapiens
aagaagacguccauauugg

SEQ ID NO: 965953 - RNA, 19 nt, Homo sapiens
cucauaaacugcauauugu

SEQ ID NO: 965954 - RNA, 19 nt, Homo sapiens
gagcagaaagcacaugagu

SEQ ID NO: 965955 - RNA, 19 nt, Homo sapiens
gggagaaguaagaauugua

SEQ ID NO: 965956 - RNA, 19 nt, Homo sapiens
agaaagcacaugaguccua

SEQ ID NO: 965957 - RNA, 19 nt, Homo sapiens
gagcaaucacuacacuuau

SEQ ID NO: 965958 - RNA, 19 nt, Homo sapiens
cgucacaaauucaccagau

SEQ ID NO: 965959 - RNA, 19 nt, Homo sapiens
cagauuggauucgucacaa

SEQ ID NO: 965960 - RNA, 19 nt, Homo sapiens
uggagucucuuauuuguac

SEQ ID NO: 965961 - RNA, 19 nt, Homo sapiens
agacguccauauugggaaa

SEQ ID NO: 965962 - RNA, 19 nt, Homo sapiens
uguggagucucuuauuugu

SEQ ID NO: 965963 - RNA, 19 nt, Homo sapiens
gcauucuaguuacccuuug

SEQ ID NO: 965964 - RNA, 19 nt, Homo sapiens
aaagagagcaaucacuaca

SEQ ID NO: 965965 - RNA, 19 nt, Homo sapiens
gcaaucacuacacuuaugg

SEQ ID NO: 965966 - RNA, 19 nt, Homo sapiens
ucacaaauucaccagauca

SEQ ID NO: 965967 - RNA, 19 nt, Homo sapiens
cauccugucguagaucuua

SEQ ID NO: 965968 - RNA, 19 nt, Homo sapiens
aaagguguggagucucuua

SEQ ID NO: 965969 - RNA, 19 nt, Homo sapiens
ggccucaccugaagaucau

SEQ ID NO: 965970 - RNA, 19 nt, Homo sapiens
aaauucaccagaucaagaa

SEQ ID NO: 965971 - RNA, 19 nt, Homo sapiens
gcgcuuaguaguucaaugg

SEQ ID NO: 965972 - RNA, 19 nt, Homo sapiens
ccucaaguucacaagaaua

SEQ ID NO: 965973 - RNA, 19 nt, Homo sapiens
guacaagaagacguccaua

SEQ ID NO: 965974 - RNA, 19 nt, Homo sapiens
caaaagguguggagucucu

SEQ ID NO: 965975 - RNA, 19 nt, Homo sapiens
ugauugaagaugaugauga

SEQ ID NO: 965976 - RNA, 19 nt, Homo sapiens
gcagaggagaacaugucua

SEQ ID NO: 965977 - RNA, 19 nt, Homo sapiens
gauccacagaacccucaua

SEQ ID NO: 965978 - RNA, 19 nt, Homo sapiens
cccagcagcuuccgauugg

SEQ ID NO: 965979 - RNA, 19 nt, Homo sapiens
guguagcacuugguaguuc

SEQ ID NO: 965980 - RNA, 19 nt, Homo sapiens
agcaaucacuacacuuaug

SEQ ID NO: 965981 - RNA, 19 nt, Homo sapiens
agauuggauucgucacaaa

SEQ ID NO: 965982 - RNA, 19 nt, Homo sapiens
acacuuauggcugggauuu

SEQ ID NO: 965983 - RNA, 19 nt, Homo sapiens
cagcagaggagaacauguc

SEQ ID NO: 965984 - RNA, 19 nt, Homo sapiens
uacaagaagacguccauau

SEQ ID NO: 965985 - RNA, 19 nt, Homo sapiens
cggcaggcuuugaguguag

SEQ ID NO: 965986 - RNA, 19 nt, Homo sapiens
cacagaacccucauaaacu

SEQ ID NO: 965987 - RNA, 19 nt, Homo sapiens
uauccauccugucguagau

SEQ ID NO: 965988 - RNA, 19 nt, Homo sapiens
cuucaccucuuguaaaauu

SEQ ID NO: 965989 - RNA, 19 nt, Homo sapiens
augaagaaccucugcauuc

SEQ ID NO: 965990 - RNA, 19 nt, Homo sapiens
gauuggauucgucacaaau

SEQ ID NO: 965991 - RNA, 19 nt, Homo sapiens
agagagcaaucacuacacu

SEQ ID NO: 965992 - RNA, 19 nt, Homo sapiens
gacggcaggcuuugagugu

SEQ ID NO: 965993 - RNA, 19 nt, Homo sapiens
uaaagagagcaaucacuac

SEQ ID NO: 965994 - RNA, 19 nt, Homo sapiens
guguggagucucuuauuug

SEQ ID NO: 965995 - RNA, 19 nt, Homo sapiens
aaccucugcauucuaguua

SEQ ID NO: 965996 - RNA, 19 nt, Homo sapiens
gaacccucauaaacugcau

SEQ ID NO: 965997 - RNA, 19 nt, Homo sapiens
aagcacaugaguccuaaug

SEQ ID NO: 965998 - RNA, 19 nt, Homo sapiens
gacaaaagguguggagucu

SEQ ID NO: 965999 - RNA, 19 nt, Homo sapiens
auaaagaugcuuggauuag

SEQ ID NO: 966000 - RNA, 19 nt, Homo sapiens
agaucaagaauuccagaaa

SEQ ID NO: 966001 - RNA, 19 nt, Homo sapiens
uucaccagaucaagaauuc

SEQ ID NO: 966002 - RNA, 19 nt, Homo sapiens
uuggauucgucacaaauuc

SEQ ID NO: 966003 - RNA, 19 nt, Homo sapiens
uugaagaugaugaugaaga

SEQ ID NO: 966004 - RNA, 19 nt, Homo sapiens
gcaguggcaucugaaaccu

SEQ ID NO: 966005 - RNA, 19 nt, Homo sapiens
ggacagccguuacauccuu

SEQ ID NO: 966006 - RNA, 19 nt, Homo sapiens
gcaggagacucugaaguga

SEQ ID NO: 966007 - RNA, 19 nt, Homo sapiens
ugaagugacugcugggaaa

SEQ ID NO: 966008 - RNA, 19 nt, Homo sapiens
gaaggucacuauguucaug

SEQ ID NO: 966009 - RNA, 19 nt, Homo sapiens
ggaagugagugaucgaaag

SEQ ID NO: 966010 - RNA, 19 nt, Homo sapiens
gccguuacauccuugcuaa

SEQ ID NO: 966011 - RNA, 19 nt, Homo sapiens
ggaagaggucugcuugaug

SEQ ID NO: 966012 - RNA, 19 nt, Homo sapiens
aauggaaggucacuauguu

SEQ ID NO: 966013 - RNA, 19 nt, Homo sapiens
aaaccucgguggaaaguca

SEQ ID NO: 966014 - RNA, 19 nt, Homo sapiens
gaaaauggaaggucacuau

SEQ ID NO: 966015 - RNA, 19 nt, Homo sapiens
ggaacaucauugcaacaca

SEQ ID NO: 966016 - RNA, 19 nt, Homo sapiens
ggaagaauaaaugucugua

SEQ ID NO: 966017 - RNA, 19 nt, Homo sapiens
aaagugagccagcgucaug

SEQ ID NO: 966018 - RNA, 19 nt, Homo sapiens
ucagauacgcauccaagaa

SEQ ID NO: 966019 - RNA, 19 nt, Homo sapiens
gcugugcucuacaagacuu

SEQ ID NO: 966020 - RNA, 19 nt, Homo sapiens
ggcagacgccaaggcauua

SEQ ID NO: 966021 - RNA, 19 nt, Homo sapiens
aaacugguagcuaugcuuu

SEQ ID NO: 966022 - RNA, 19 nt, Homo sapiens
ggugauaccagaagucaag

SEQ ID NO: 966023 - RNA, 19 nt, Homo sapiens
gacaggagauggugauacc

SEQ ID NO: 966024 - RNA, 19 nt, Homo sapiens
caagggugcugugcucuac

SEQ ID NO: 966025 - RNA, 19 nt, Homo sapiens
acugguagcuaugcuuuga

SEQ ID NO: 966026 - RNA, 19 nt, Homo sapiens
uccaagaagucggguggua

SEQ ID NO: 966027 - RNA, 19 nt, Homo sapiens
gaggaagaggucugcuuga

SEQ ID NO: 966028 - RNA, 19 nt, Homo sapiens
gcugggaacaucauugcaa

SEQ ID NO: 966029 - RNA, 19 nt, Homo sapiens
ccuucaaacugguagcuau

SEQ ID NO: 966030 - RNA, 19 nt, Homo sapiens
gugcugugcucuacaagac

SEQ ID NO: 966031 - RNA, 19 nt, Homo sapiens
gcagacgccaaggcauuaa

SEQ ID NO: 966032 - RNA, 19 nt, Homo sapiens
gccaaggcauuaagaaaau

SEQ ID NO: 966033 - RNA, 19 nt, Homo sapiens
gcuuugauguccuguugag

SEQ ID NO: 966034 - RNA, 19 nt, Homo sapiens
ccaagggugcugugcucua

SEQ ID NO: 966035 - RNA, 19 nt, Homo sapiens
cagauacgcauccaagaag

SEQ ID NO: 966036 - RNA, 19 nt, Homo sapiens
aggaagaggucugcuugau

SEQ ID NO: 966037 - RNA, 19 nt, Homo sapiens
gggaagaauaaaugucugu

SEQ ID NO: 966038 - RNA, 19 nt, Homo sapiens
gaagugagugaucgaaagc

SEQ ID NO: 966039 - RNA, 19 nt, Homo sapiens
acacggaggcuguggaucu

SEQ ID NO: 966040 - RNA, 19 nt, Homo sapiens
ggaaggucacuauguucau

SEQ ID NO: 966041 - RNA, 19 nt, Homo sapiens
aaauggaaggucacuaugu

SEQ ID NO: 966042 - RNA, 19 nt, Homo sapiens
ugguagcuaugcuuugaug

SEQ ID NO: 966043 - RNA, 19 nt, Homo sapiens
gguguugggaagaauaaau

SEQ ID NO: 966044 - RNA, 19 nt, Homo sapiens
ugagggcaccuucaaacug

SEQ ID NO: 966045 - RNA, 19 nt, Homo sapiens
guagcuaugcuuugauguc

SEQ ID NO: 966046 - RNA, 19 nt, Homo sapiens
caaacugguagcuaugcuu

SEQ ID NO: 966047 - RNA, 19 nt, Homo sapiens
augcuuugauguccuguug

SEQ ID NO: 966048 - RNA, 19 nt, Homo sapiens
gggcaccuucaaacuggua

SEQ ID NO: 966049 - RNA, 19 nt, Homo sapiens
gaccugaccuggggccaaa

SEQ ID NO: 966050 - RNA, 19 nt, Homo sapiens
gcaggagacucugaaguga

SEQ ID NO: 966051 - RNA, 19 nt, Homo sapiens
ugaagugacugcugggaaa

SEQ ID NO: 966052 - RNA, 19 nt, Homo sapiens
gaaggucacuauguucaug

SEQ ID NO: 966053 - RNA, 19 nt, Homo sapiens
ggaagaggucugcuugaug

SEQ ID NO: 966054 - RNA, 19 nt, Homo sapiens
aauggaaggucacuauguu

SEQ ID NO: 966055 - RNA, 19 nt, Homo sapiens
aaaccucgguggaaaguca

SEQ ID NO: 966056 - RNA, 19 nt, Homo sapiens
gaaaauggaaggucacuau

SEQ ID NO: 966057 - RNA, 19 nt, Homo sapiens
ggaacaucauugcaacaca

SEQ ID NO: 966058 - RNA, 19 nt, Homo sapiens
ggaagaauaaaugucugua

SEQ ID NO: 966059 - RNA, 19 nt, Homo sapiens
aaagugagccagcgucaug

SEQ ID NO: 966060 - RNA, 19 nt, Homo sapiens
ucagauacgcauccaagaa

SEQ ID NO: 966061 - RNA, 19 nt, Homo sapiens
gcugugcucuacaagacuu

SEQ ID NO: 966062 - RNA, 19 nt, Homo sapiens
ggcagacgccaaggcauua

SEQ ID NO: 966063 - RNA, 19 nt, Homo sapiens
aaacugguagcuaugcuuu

SEQ ID NO: 966064 - RNA, 19 nt, Homo sapiens
ggugauaccagaagucaag

SEQ ID NO: 966065 - RNA, 19 nt, Homo sapiens
uugguuacauccuugcuaa

SEQ ID NO: 966066 - RNA, 19 nt, Homo sapiens
gacaggagauggugauacc

SEQ ID NO: 966067 - RNA, 19 nt, Homo sapiens
caagggugcugugcucuac

SEQ ID NO: 966068 - RNA, 19 nt, Homo sapiens
acugguagcuaugcuuuga

SEQ ID NO: 966069 - RNA, 19 nt, Homo sapiens
uccaagaagucggguggua

SEQ ID NO: 966070 - RNA, 19 nt, Homo sapiens
gaggaagaggucugcuuga

SEQ ID NO: 966071 - RNA, 19 nt, Homo sapiens
gcugggaacaucauugcaa

SEQ ID NO: 966072 - RNA, 19 nt, Homo sapiens
ccuucaaacugguagcuau

SEQ ID NO: 966073 - RNA, 19 nt, Homo sapiens
gagugagggcguuugaaga

SEQ ID NO: 966074 - RNA, 19 nt, Homo sapiens
gugcugugcucuacaagac

SEQ ID NO: 966075 - RNA, 19 nt, Homo sapiens
gcagacgccaaggcauuaa

SEQ ID NO: 966076 - RNA, 19 nt, Homo sapiens
gccaaggcauuaagaaaau

SEQ ID NO: 966077 - RNA, 19 nt, Homo sapiens
gcuuugauguccuguugag

SEQ ID NO: 966078 - RNA, 19 nt, Homo sapiens
ccaagggugcugugcucua

SEQ ID NO: 966079 - RNA, 19 nt, Homo sapiens
cagauacgcauccaagaag

SEQ ID NO: 966080 - RNA, 19 nt, Homo sapiens
aggaagaggucugcuugau

SEQ ID NO: 966081 - RNA, 19 nt, Homo sapiens
gggaagaauaaaugucugu

SEQ ID NO: 966082 - RNA, 19 nt, Homo sapiens
acacggaggcuguggaucu

SEQ ID NO: 966083 - RNA, 19 nt, Homo sapiens
ggaaggucacuauguucau

SEQ ID NO: 966084 - RNA, 19 nt, Homo sapiens
aaauggaaggucacuaugu

SEQ ID NO: 966085 - RNA, 19 nt, Homo sapiens
ugguagcuaugcuuugaug

SEQ ID NO: 966086 - RNA, 19 nt, Homo sapiens
gguguugggaagaauaaau

SEQ ID NO: 966087 - RNA, 19 nt, Homo sapiens
ugagggcaccuucaaacug

SEQ ID NO: 966088 - RNA, 19 nt, Homo sapiens
guagcuaugcuuugauguc

SEQ ID NO: 966089 - RNA, 19 nt, Homo sapiens
caaacugguagcuaugcuu

SEQ ID NO: 966090 - RNA, 19 nt, Homo sapiens
augcuuugauguccuguug

SEQ ID NO: 966091 - RNA, 19 nt, Homo sapiens
gggcaccuucaaacuggua

SEQ ID NO: 966092 - RNA, 19 nt, Homo sapiens
gaccugaccuggggccaaa

SEQ ID NO: 966093 - RNA, 19 nt, Homo sapiens
ugagugagggcguuugaag

SEQ ID NO: 966094 - RNA, 19 nt, Homo sapiens
caagauaccuggugauuua

SEQ ID NO: 966095 - RNA, 19 nt, Homo sapiens
guaggacaguucuuuguua

SEQ ID NO: 966096 - RNA, 19 nt, Homo sapiens
gcaagugacugcugggauu

SEQ ID NO: 966097 - RNA, 19 nt, Homo sapiens
ccauauagcuuugguuuau

SEQ ID NO: 966098 - RNA, 19 nt, Homo sapiens
gcagaugguugaaagauag

SEQ ID NO: 966099 - RNA, 19 nt, Homo sapiens
gaacuuaagacauuagaug

SEQ ID NO: 966100 - RNA, 19 nt, Homo sapiens
ggacagccguuacauccuu

SEQ ID NO: 966101 - RNA, 19 nt, Homo sapiens
gcaggagacucugaaguga

SEQ ID NO: 966102 - RNA, 19 nt, Homo sapiens
uaaagaagcagaagguuug

SEQ ID NO: 966103 - RNA, 19 nt, Homo sapiens
ucagagagacagagaauaa

SEQ ID NO: 966104 - RNA, 19 nt, Homo sapiens
ggacggaccaccucacuga

SEQ ID NO: 966105 - RNA, 19 nt, Homo sapiens
uuacauggguauuagcuaa

SEQ ID NO: 966106 - RNA, 19 nt, Homo sapiens
ugaagugacugcugggaaa

SEQ ID NO: 966107 - RNA, 19 nt, Homo sapiens
ggaagugagugaucgaaag

SEQ ID NO: 966108 - RNA, 19 nt, Homo sapiens
gaugcuaauuuguauguga

SEQ ID NO: 966109 - RNA, 19 nt, Homo sapiens
gaaggucacuauguucaug

SEQ ID NO: 966110 - RNA, 19 nt, Homo sapiens
guggcuaugucaacaauaa

SEQ ID NO: 966111 - RNA, 19 nt, Homo sapiens
ccacaucccuguaaguaag

SEQ ID NO: 966112 - RNA, 19 nt, Homo sapiens
ggaaagggaaccugagaug

SEQ ID NO: 966113 - RNA, 19 nt, Homo sapiens
gguaauaacaguugcaugu

SEQ ID NO: 966114 - RNA, 19 nt, Homo sapiens
uuacagagacauaacgaua

SEQ ID NO: 966115 - RNA, 19 nt, Homo sapiens
guugaaagauagcuugaau

SEQ ID NO: 966116 - RNA, 19 nt, Homo sapiens
gcauuggccugguauucuu

SEQ ID NO: 966117 - RNA, 19 nt, Homo sapiens
aaaguggcguuggaaauaa

SEQ ID NO: 966118 - RNA, 19 nt, Homo sapiens
agauggagcucucugauca

SEQ ID NO: 966119 - RNA, 19 nt, Homo sapiens
gaauaaugcuggacuaccu

SEQ ID NO: 966120 - RNA, 19 nt, Homo sapiens
cuucauauuucacaucuga

SEQ ID NO: 966121 - RNA, 19 nt, Homo sapiens
gccguuacauccuugcuaa

SEQ ID NO: 966122 - RNA, 19 nt, Homo sapiens
uaugacaguucuaguguug

SEQ ID NO: 966123 - RNA, 19 nt, Homo sapiens
uaaucucucugcuucauau

SEQ ID NO: 966124 - RNA, 19 nt, Homo sapiens
ucuaggcccuuuaugauug

SEQ ID NO: 966125 - RNA, 19 nt, Homo sapiens
ugacaguucuaguguuguu

SEQ ID NO: 966126 - RNA, 19 nt, Homo sapiens
cuaaugcaguaguaugauu

SEQ ID NO: 966127 - RNA, 19 nt, Homo sapiens
ggacaguucuuuguuacag

SEQ ID NO: 966128 - RNA, 19 nt, Homo sapiens
ucagcaaguuggcaucauu

SEQ ID NO: 966129 - RNA, 19 nt, Homo sapiens
ggaagaggucugcuugaug

SEQ ID NO: 966130 - RNA, 19 nt, Homo sapiens
aauggaaggucacuauguu

SEQ ID NO: 966131 - RNA, 19 nt, Homo sapiens
aaaccucgguggaaaguca

SEQ ID NO: 966132 - RNA, 19 nt, Homo sapiens
gcaguaguaugauuguuuu

SEQ ID NO: 966133 - RNA, 19 nt, Homo sapiens
guaauaacaguugcaugua

SEQ ID NO: 966134 - RNA, 19 nt, Homo sapiens
guucuaguguuguuuaagu

SEQ ID NO: 966135 - RNA, 19 nt, Homo sapiens
gaaaauggaaggucacuau

SEQ ID NO: 966136 - RNA, 19 nt, Homo sapiens
ggugagaauuaaaugacuu

SEQ ID NO: 966137 - RNA, 19 nt, Homo sapiens
gccaggaguuagguucaua

SEQ ID NO: 966138 - RNA, 19 nt, Homo sapiens
uacacgaucucauuucuuc

SEQ ID NO: 966139 - RNA, 19 nt, Homo sapiens
gggcuuacauggguauuag

SEQ ID NO: 966140 - RNA, 19 nt, Homo sapiens
gacaagauaccuggugauu

SEQ ID NO: 966141 - RNA, 19 nt, Homo sapiens
agacauggcuccagguaac

SEQ ID NO: 966142 - RNA, 19 nt, Homo sapiens
ggaacaucauugcaacaca

SEQ ID NO: 966143 - RNA, 19 nt, Homo sapiens
auacuguacucuccacauu

SEQ ID NO: 966144 - RNA, 19 nt, Homo sapiens
cgaucucauuucuuccuua

SEQ ID NO: 966145 - RNA, 19 nt, Homo sapiens
ggaagaauaaaugucugua

SEQ ID NO: 966146 - RNA, 19 nt, Homo sapiens
aaagugagccagcgucaug

SEQ ID NO: 966147 - RNA, 19 nt, Homo sapiens
caauaaagaagcagaaggu

SEQ ID NO: 966148 - RNA, 19 nt, Homo sapiens
agagaauaaugcuggacua

SEQ ID NO: 966149 - RNA, 19 nt, Homo sapiens
gcuaacacauuuugagcua

SEQ ID NO: 966150 - RNA, 19 nt, Homo sapiens
gauuauguauguaguagcu

SEQ ID NO: 966151 - RNA, 19 nt, Homo sapiens
ugcagaugguugaaagaua

SEQ ID NO: 966152 - RNA, 19 nt, Homo sapiens
aaacuuacuugcagauggu

SEQ ID NO: 966153 - RNA, 19 nt, Homo sapiens
gaucucauuucuuccuuac

SEQ ID NO: 966154 - RNA, 19 nt, Homo sapiens
ugagaagucugucccaaaa

SEQ ID NO: 966155 - RNA, 19 nt, Homo sapiens
gcauuauccauauagcuuu

SEQ ID NO: 966156 - RNA, 19 nt, Homo sapiens
ucagauacgcauccaagaa

SEQ ID NO: 966157 - RNA, 19 nt, Homo sapiens
gcugugcucuacaagacuu

SEQ ID NO: 966158 - RNA, 19 nt, Homo sapiens
aaagggaaccugagaugga

SEQ ID NO: 966159 - RNA, 19 nt, Homo sapiens
uaauaugacaguucuagug

SEQ ID NO: 966160 - RNA, 19 nt, Homo sapiens
gauuucaguuucagcaagu

SEQ ID NO: 966161 - RNA, 19 nt, Homo sapiens
gagcauuaauccucaaaau

SEQ ID NO: 966162 - RNA, 19 nt, Homo sapiens
ggcuaugucaacaauaaua

SEQ ID NO: 966163 - RNA, 19 nt, Homo sapiens
gguaggacaguucuuuguu

SEQ ID NO: 966164 - RNA, 19 nt, Homo sapiens
ggcagacgccaaggcauua

SEQ ID NO: 966165 - RNA, 19 nt, Homo sapiens
aaacugguagcuaugcuuu

SEQ ID NO: 966166 - RNA, 19 nt, Homo sapiens
auaaagaagcagaagguuu

SEQ ID NO: 966167 - RNA, 19 nt, Homo sapiens
cacccagccugaaguucua

SEQ ID NO: 966168 - RNA, 19 nt, Homo sapiens
gacaguucuuuguuacaga

SEQ ID NO: 966169 - RNA, 19 nt, Homo sapiens
ggugauaccagaagucaag

SEQ ID NO: 966170 - RNA, 19 nt, Homo sapiens
acuguacucuccacauuau

SEQ ID NO: 966171 - RNA, 19 nt, Homo sapiens
gauuugcccugguguugca

SEQ ID NO: 966172 - RNA, 19 nt, Homo sapiens
gaaaugccagagaccuaga

SEQ ID NO: 966173 - RNA, 19 nt, Homo sapiens
cauuauccauauagcuuug

SEQ ID NO: 966174 - RNA, 19 nt, Homo sapiens
gaccacacaggaguaagua

SEQ ID NO: 966175 - RNA, 19 nt, Homo sapiens
caccaggucugccuaacuc

SEQ ID NO: 966176 - RNA, 19 nt, Homo sapiens
uaccacaucccuguaagua

SEQ ID NO: 966177 - RNA, 19 nt, Homo sapiens
gacaggagauggugauacc

SEQ ID NO: 966178 - RNA, 19 nt, Homo sapiens
caagggugcugugcucuac

SEQ ID NO: 966179 - RNA, 19 nt, Homo sapiens
gugagaagucugucccaaa

SEQ ID NO: 966180 - RNA, 19 nt, Homo sapiens
acaguucuaguguuguuua

SEQ ID NO: 966181 - RNA, 19 nt, Homo sapiens
gaaaaguggcguuggaaau

SEQ ID NO: 966182 - RNA, 19 nt, Homo sapiens
ucucucugcuucauauuuc

SEQ ID NO: 966183 - RNA, 19 nt, Homo sapiens
uuaguugccuuuguaaaca

SEQ ID NO: 966184 - RNA, 19 nt, Homo sapiens
cagcaaguuggcaucauuu

SEQ ID NO: 966185 - RNA, 19 nt, Homo sapiens
agacuucuuccuuuguaua

SEQ ID NO: 966186 - RNA, 19 nt, Homo sapiens
cugccuaacucccagauca

SEQ ID NO: 966187 - RNA, 19 nt, Homo sapiens
auugagugcuuaccaaaug

SEQ ID NO: 966188 - RNA, 19 nt, Homo sapiens
acugguagcuaugcuuuga

SEQ ID NO: 966189 - RNA, 19 nt, Homo sapiens
uccaagaagucggguggua

SEQ ID NO: 966190 - RNA, 19 nt, Homo sapiens
uaagaccacacaggaguaa

SEQ ID NO: 966191 - RNA, 19 nt, Homo sapiens
gugaaaugccagagaccua

SEQ ID NO: 966192 - RNA, 19 nt, Homo sapiens
gaggaagaggucugcuuga

SEQ ID NO: 966193 - RNA, 19 nt, Homo sapiens
gcugggaacaucauugcaa

SEQ ID NO: 966194 - RNA, 19 nt, Homo sapiens
guauagagcucccgaauua

SEQ ID NO: 966195 - RNA, 19 nt, Homo sapiens
gaacagucaugaaauguaa

SEQ ID NO: 966196 - RNA, 19 nt, Homo sapiens
uuacuaagcucugugauuu

SEQ ID NO: 966197 - RNA, 19 nt, Homo sapiens
uguaauggcuugaaagaaa

SEQ ID NO: 966198 - RNA, 19 nt, Homo sapiens
gauaguggccauuaagaua

SEQ ID NO: 966199 - RNA, 19 nt, Homo sapiens
gaaaauaccucuuccagau

SEQ ID NO: 966200 - RNA, 19 nt, Homo sapiens
uaacagagaagaaaccuaa

SEQ ID NO: 966201 - RNA, 19 nt, Homo sapiens
ucaccucacuugcagaaua

SEQ ID NO: 966202 - RNA, 19 nt, Homo sapiens
gcaauugacuaucuucaca

SEQ ID NO: 966203 - RNA, 19 nt, Homo sapiens
agaacaaucugucaacaaa

SEQ ID NO: 966204 - RNA, 19 nt, Homo sapiens
gcaaaucucaguucaaauc

SEQ ID NO: 966205 - RNA, 19 nt, Homo sapiens
ccaauacacugcuaaguag

SEQ ID NO: 966206 - RNA, 19 nt, Homo sapiens
cauccuaugucuccagaua

SEQ ID NO: 966207 - RNA, 19 nt, Homo sapiens
uaagaauacugggcagaua

SEQ ID NO: 966208 - RNA, 19 nt, Homo sapiens
gaucaaagucagaguuauu

SEQ ID NO: 966209 - RNA, 19 nt, Homo sapiens
gagaucaaagucagaguua

SEQ ID NO: 966210 - RNA, 19 nt, Homo sapiens
gacaggauaucaucuagug

SEQ ID NO: 966211 - RNA, 19 nt, Homo sapiens
caaagaaucguguucauag

SEQ ID NO: 966212 - RNA, 19 nt, Homo sapiens
uaacuguaauggcuugaaa

SEQ ID NO: 966213 - RNA, 19 nt, Homo sapiens
ugccagaacugaaagcuaa

SEQ ID NO: 966214 - RNA, 19 nt, Homo sapiens
gaaagugggcaauuuguca

SEQ ID NO: 966215 - RNA, 19 nt, Homo sapiens
gaacugaaagcuaaauuac

SEQ ID NO: 966216 - RNA, 19 nt, Homo sapiens
ggaacagucaugaaaugua

SEQ ID NO: 966217 - RNA, 19 nt, Homo sapiens
cagagaagaaaccuaaaua

SEQ ID NO: 966218 - RNA, 19 nt, Homo sapiens
cugcaaaucucaguucaaa

SEQ ID NO: 966219 - RNA, 19 nt, Homo sapiens
ucaacaggaugcaaaugaa

SEQ ID NO: 966220 - RNA, 19 nt, Homo sapiens
gcuuugggcuguaugauca

SEQ ID NO: 966221 - RNA, 19 nt, Homo sapiens
uugacuaucuucacaguaa

SEQ ID NO: 966222 - RNA, 19 nt, Homo sapiens
gcagauauaguucaugcuu

SEQ ID NO: 966223 - RNA, 19 nt, Homo sapiens
ccagauccuucgagcaauu

SEQ ID NO: 966224 - RNA, 19 nt, Homo sapiens
ggacauuuauacggacuau

SEQ ID NO: 966225 - RNA, 19 nt, Homo sapiens
ucaaagaaucguguucaua

SEQ ID NO: 966226 - RNA, 19 nt, Homo sapiens
caggaaagaugaaagaaaa

SEQ ID NO: 966227 - RNA, 19 nt, Homo sapiens
gggcagauaguggccauua

SEQ ID NO: 966228 - RNA, 19 nt, Homo sapiens
caaaagagaguucuaaaga

SEQ ID NO: 966229 - RNA, 19 nt, Homo sapiens
gucauggacuagagaguaa

SEQ ID NO: 966230 - RNA, 19 nt, Homo sapiens
caacaggaugcaaaugaaa

SEQ ID NO: 966231 - RNA, 19 nt, Homo sapiens
gaacucaggaaagaugaaa

SEQ ID NO: 966232 - RNA, 19 nt, Homo sapiens
gaaagaaaauccacauugc

SEQ ID NO: 966233 - RNA, 19 nt, Homo sapiens
acugaaagcuaaauuacug

SEQ ID NO: 966234 - RNA, 19 nt, Homo sapiens
gaauuacuaagcucuguga

SEQ ID NO: 966235 - RNA, 19 nt, Homo sapiens
ggagaucaaagucagaguu

SEQ ID NO: 966236 - RNA, 19 nt, Homo sapiens
guaguucugauuuggauuu

SEQ ID NO: 966237 - RNA, 19 nt, Homo sapiens
guaugaagguggacuuggu

SEQ ID NO: 966238 - RNA, 19 nt, Homo sapiens
aaaaugaacucaggaaaga

SEQ ID NO: 966239 - RNA, 19 nt, Homo sapiens
uuacggaacagucaugaaa

SEQ ID NO: 966240 - RNA, 19 nt, Homo sapiens
ggcagauaguggccauuaa

SEQ ID NO: 966241 - RNA, 19 nt, Homo sapiens
aaagcaauuucaucacgaa

SEQ ID NO: 966242 - RNA, 19 nt, Homo sapiens
guaaacugaacuugaagaa

SEQ ID NO: 966243 - RNA, 19 nt, Homo sapiens
guauguaaacugaacuuga

SEQ ID NO: 966244 - RNA, 19 nt, Homo sapiens
gcagauaguggccauuaag

SEQ ID NO: 966245 - RNA, 19 nt, Homo sapiens
aaagaaagaguaugaaggu

SEQ ID NO: 966246 - RNA, 19 nt, Homo sapiens
ggaaguuacggaacaguca

SEQ ID NO: 966247 - RNA, 19 nt, Homo sapiens
agauauaguucaugcuugu

SEQ ID NO: 966248 - RNA, 19 nt, Homo sapiens
cacaguauuagaugaguua

SEQ ID NO: 966249 - RNA, 19 nt, Homo sapiens
ccaccaaacccuaucaauc

SEQ ID NO: 966250 - RNA, 19 nt, Homo sapiens
gguaguucuuccucaaguu

SEQ ID NO: 966251 - RNA, 19 nt, Homo sapiens
guaucccagucaggaauua

SEQ ID NO: 966252 - RNA, 19 nt, Homo sapiens
gcugacaggauaucaucua

SEQ ID NO: 966253 - RNA, 19 nt, Homo sapiens
gguauagagcucccgaauu

SEQ ID NO: 966254 - RNA, 19 nt, Homo sapiens
ugagagaccagaacaaucu

SEQ ID NO: 966255 - RNA, 19 nt, Homo sapiens
ucaggaaagaugaaagaaa

SEQ ID NO: 966256 - RNA, 19 nt, Homo sapiens
caccucacuugcagaauau

SEQ ID NO: 966257 - RNA, 19 nt, Homo sapiens
caauuugucaccucacuug

SEQ ID NO: 966258 - RNA, 19 nt, Homo sapiens
gacaaugccacccaucaau

SEQ ID NO: 966259 - RNA, 19 nt, Homo sapiens
gucaacaggaugcaaauga

SEQ ID NO: 966260 - RNA, 19 nt, Homo sapiens
gcuguaugaucauugagau

SEQ ID NO: 966261 - RNA, 19 nt, Homo sapiens
gcucccgaauuaguauuaa

SEQ ID NO: 966262 - RNA, 19 nt, Homo sapiens
aaagaaucguguucauagu

SEQ ID NO: 966263 - RNA, 19 nt, Homo sapiens
guaauggcuugaaagaaaa

SEQ ID NO: 966264 - RNA, 19 nt, Homo sapiens
agagggaaguuacggaaca

SEQ ID NO: 966265 - RNA, 19 nt, Homo sapiens
gcgaugagagaaauaaagu

SEQ ID NO: 966266 - RNA, 19 nt, Homo sapiens
accaauacacugcuaagua

SEQ ID NO: 966267 - RNA, 19 nt, Homo sapiens
aaagcuuaauggauuguug

SEQ ID NO: 966268 - RNA, 19 nt, Homo sapiens
gccacacgcugguauagag

SEQ ID NO: 966269 - RNA, 19 nt, Homo sapiens
agaaucguguucauagugu

SEQ ID NO: 966270 - RNA, 19 nt, Homo sapiens
agugugaggugagcuguaa

SEQ ID NO: 966271 - RNA, 19 nt, Homo sapiens
gaaccaccaaacccuauca

SEQ ID NO: 966272 - RNA, 19 nt, Homo sapiens
uaaagucaaaggaggaaga

SEQ ID NO: 966273 - RNA, 19 nt, Homo sapiens
caacaaaauugcgaugaga

SEQ ID NO: 966274 - RNA, 19 nt, Homo sapiens
ugagauggccacuggaaau

SEQ ID NO: 966275 - RNA, 19 nt, Homo sapiens
guggauaucugggcuuugg

SEQ ID NO: 966276 - RNA, 19 nt, Homo sapiens
gaaaaccuguggauaucug

SEQ ID NO: 966277 - RNA, 19 nt, Homo sapiens
ggaggaagaggagauaucu

SEQ ID NO: 966278 - RNA, 19 nt, Homo sapiens
caaaggaggaagaggagau

SEQ ID NO: 966279 - RNA, 19 nt, Homo sapiens
agucagaguuauuaaaguc

SEQ ID NO: 966280 - RNA, 19 nt, Homo sapiens
gaccacacaguauuagaug

SEQ ID NO: 966281 - RNA, 19 nt, Homo sapiens
uaguggccauuaagauauu

SEQ ID NO: 966282 - RNA, 19 nt, Homo sapiens
gacuaucuucacaguaaua

SEQ ID NO: 966283 - RNA, 19 nt, Homo sapiens
acggaacagucaugaaaug

SEQ ID NO: 966284 - RNA, 19 nt, Homo sapiens
gaaaaugaacucaggaaag

SEQ ID NO: 966285 - RNA, 19 nt, Homo sapiens
cuagagauggauuuauuga

SEQ ID NO: 966286 - RNA, 19 nt, Homo sapiens
ucacuugcagaauaucuuu

SEQ ID NO: 966287 - RNA, 19 nt, Homo sapiens
aaauugcgaugagagaaau

SEQ ID NO: 966288 - RNA, 19 nt, Homo sapiens
ccacccaucaaucuaacua

SEQ ID NO: 966289 - RNA, 19 nt, Homo sapiens
ggguaguucuuccucaagu

SEQ ID NO: 966290 - RNA, 19 nt, Homo sapiens
guucugauuuggauuuacu

SEQ ID NO: 966291 - RNA, 19 nt, Homo sapiens
gcucugugauuuugguuuu

SEQ ID NO: 966292 - RNA, 19 nt, Homo sapiens
gaaaauguucauccuaugu

SEQ ID NO: 966293 - RNA, 19 nt, Homo sapiens
ggaugcaaaugaaaauguu

SEQ ID NO: 966294 - RNA, 19 nt, Homo sapiens
gcaauuaccuacaagauga

SEQ ID NO: 966295 - RNA, 19 nt, Homo sapiens
gcaaagcgcuucugucaau

SEQ ID NO: 966296 - RNA, 19 nt, Homo sapiens
gcaaagagguggacaggau

SEQ ID NO: 966297 - RNA, 19 nt, Homo sapiens
ggauacaucaccuuaaaua

SEQ ID NO: 966298 - RNA, 19 nt, Homo sapiens
ccaacuaccuuaaugcaaa

SEQ ID NO: 966299 - RNA, 19 nt, Homo sapiens
gacacaaacuggagauauu

SEQ ID NO: 966300 - RNA, 19 nt, Homo sapiens
guacugcacugacaugaau

SEQ ID NO: 966301 - RNA, 19 nt, Homo sapiens
caaagucauugaacucuga

SEQ ID NO: 966302 - RNA, 19 nt, Homo sapiens
caggaacucugcaacaauu

SEQ ID NO: 966303 - RNA, 19 nt, Homo sapiens
gggaagagaguaagcagua

SEQ ID NO: 966304 - RNA, 19 nt, Homo sapiens
uaacacagauaagggcuuu

SEQ ID NO: 966305 - RNA, 19 nt, Homo sapiens
gggaagccaugcaggauga

SEQ ID NO: 966306 - RNA, 19 nt, Homo sapiens
gaggauggcucgguuaucu

SEQ ID NO: 966307 - RNA, 19 nt, Homo sapiens
cgaaugaggucuggaagug

SEQ ID NO: 966308 - RNA, 19 nt, Homo sapiens
uaacaugggaagagaguaa

SEQ ID NO: 966309 - RNA, 19 nt, Homo sapiens
gacaggauaacacagauaa

SEQ ID NO: 966310 - RNA, 19 nt, Homo sapiens
ggaaauaugaauugugcuu

SEQ ID NO: 966311 - RNA, 19 nt, Homo sapiens
gcagcgcaauuaccuacaa

SEQ ID NO: 966312 - RNA, 19 nt, Homo sapiens
ggacaggauaacacagaua

SEQ ID NO: 966313 - RNA, 19 nt, Homo sapiens
agccaggacucauuuaauu

SEQ ID NO: 966314 - RNA, 19 nt, Homo sapiens
caaagcgcuucugucaaua

SEQ ID NO: 966315 - RNA, 19 nt, Homo sapiens
acacaaacuggagauauua

SEQ ID NO: 966316 - RNA, 19 nt, Homo sapiens
uagcaaagcgcuucuguca

SEQ ID NO: 966317 - RNA, 19 nt, Homo sapiens
gcacaggaacucugcaaca

SEQ ID NO: 966318 - RNA, 19 nt, Homo sapiens
caaagagguggacaggaua

SEQ ID NO: 966319 - RNA, 19 nt, Homo sapiens
ucugugagaacaaacauua

SEQ ID NO: 966320 - RNA, 19 nt, Homo sapiens
cggauuaucucgccagaag

SEQ ID NO: 966321 - RNA, 19 nt, Homo sapiens
ucaaagccaggacucauuu

SEQ ID NO: 966322 - RNA, 19 nt, Homo sapiens
uuucaaaggucauaaaugc

SEQ ID NO: 966323 - RNA, 19 nt, Homo sapiens
gcgcuucugucaauaugug

SEQ ID NO: 966324 - RNA, 19 nt, Homo sapiens
cacccuaccuucugugaga

SEQ ID NO: 966325 - RNA, 19 nt, Homo sapiens
gagcucaguugcaguacuc

SEQ ID NO: 966326 - RNA, 19 nt, Homo sapiens
cuacucuccugaagauuga

SEQ ID NO: 966327 - RNA, 19 nt, Homo sapiens
caaagccaggacucauuua

SEQ ID NO: 966328 - RNA, 19 nt, Homo sapiens
cacaggaacucugcaacaa

SEQ ID NO: 966329 - RNA, 19 nt, Homo sapiens
gcuacucuccugaagauug

SEQ ID NO: 966330 - RNA, 19 nt, Homo sapiens
guucuucaggcacaacuua

SEQ ID NO: 966331 - RNA, 19 nt, Homo sapiens
caacuaccuuaaugcaaag

SEQ ID NO: 966332 - RNA, 19 nt, Homo sapiens
ggaacauuguggaguacau

SEQ ID NO: 966333 - RNA, 19 nt, Homo sapiens
gaaugcuacucuccugaag

SEQ ID NO: 966334 - RNA, 19 nt, Homo sapiens
uaagggcuuuauuguacaa

SEQ ID NO: 966335 - RNA, 19 nt, Homo sapiens
gaccaagguggaccaacua

SEQ ID NO: 966336 - RNA, 19 nt, Homo sapiens
auggauacaucaccuuaaa

SEQ ID NO: 966337 - RNA, 19 nt, Homo sapiens
ccuacaagaugagaaugaa

SEQ ID NO: 966338 - RNA, 19 nt, Homo sapiens
gaagauggaaaaggaaaua

SEQ ID NO: 966339 - RNA, 19 nt, Homo sapiens
ggaagagaguaagcaguac

SEQ ID NO: 966340 - RNA, 19 nt, Homo sapiens
ugaccaagguggaccaacu

SEQ ID NO: 966341 - RNA, 19 nt, Homo sapiens
ugauucugcugauccugua

SEQ ID NO: 966342 - RNA, 19 nt, Homo sapiens
gguggcgugugauggcuuu

SEQ ID NO: 966343 - RNA, 19 nt, Homo sapiens
caacuuaacaugggaagag

SEQ ID NO: 966344 - RNA, 19 nt, Homo sapiens
ggauggcucgguuaucuca

SEQ ID NO: 966345 - RNA, 19 nt, Homo sapiens
aaagccaggacucauuuaa

SEQ ID NO: 966346 - RNA, 19 nt, Homo sapiens
ggagauauuauggagauag

SEQ ID NO: 966347 - RNA, 19 nt, Homo sapiens
cuggagauauuauggagau

SEQ ID NO: 966348 - RNA, 19 nt, Homo sapiens
ugacacaaacuggagauau

SEQ ID NO: 966349 - RNA, 19 nt, Homo sapiens
ggaaggcuggcaugaccaa

SEQ ID NO: 966350 - RNA, 19 nt, Homo sapiens
gagaggaaggcuggcauga

SEQ ID NO: 966351 - RNA, 19 nt, Homo sapiens
ucgguuaucucagaaaaua

SEQ ID NO: 966352 - RNA, 19 nt, Homo sapiens
gguaaaacaaucagaacua

SEQ ID NO: 966353 - RNA, 19 nt, Homo sapiens
aaagagguggacaggauaa

SEQ ID NO: 966354 - RNA, 19 nt, Homo sapiens
uggaccaacuaccuuaaug

SEQ ID NO: 966355 - RNA, 19 nt, Homo sapiens
caugcaggaugaagaugga

SEQ ID NO: 966356 - RNA, 19 nt, Homo sapiens
gagauauuauggagauagc

SEQ ID NO: 966357 - RNA, 19 nt, Homo sapiens
ggaacucugcaacaauuag

SEQ ID NO: 966358 - RNA, 19 nt, Homo sapiens
gaacauuguggaguacauc

SEQ ID NO: 966359 - RNA, 19 nt, Homo sapiens
gauggaaaaggaaauauga

SEQ ID NO: 966360 - RNA, 19 nt, Homo sapiens
caaacuggagauauuaugg

SEQ ID NO: 966361 - RNA, 19 nt, Homo sapiens
gcgcaauuaccuacaagau

SEQ ID NO: 966362 - RNA, 19 nt, Homo sapiens
gaccaacuaccuuaaugca

SEQ ID NO: 966363 - RNA, 19 nt, Homo sapiens
gauuaucucgccagaaguc

SEQ ID NO: 966364 - RNA, 19 nt, Homo sapiens
accggaacauuguggagua

SEQ ID NO: 966365 - RNA, 19 nt, Homo sapiens
ugaaugcuacucuccugaa

SEQ ID NO: 966366 - RNA, 19 nt, Homo sapiens
gucaauaugugguaaaaca

SEQ ID NO: 966367 - RNA, 19 nt, Homo sapiens
ugugauggcuuugauucug

SEQ ID NO: 966368 - RNA, 19 nt, Homo sapiens
gggaggauggcucgguuau

SEQ ID NO: 966369 - RNA, 19 nt, Homo sapiens
aaacuggagauauuaugga

SEQ ID NO: 966370 - RNA, 19 nt, Homo sapiens
guggacaggauaacacaga

SEQ ID NO: 966371 - RNA, 19 nt, Homo sapiens
ggaccaacuaccuuaaugc

SEQ ID NO: 966372 - RNA, 19 nt, Homo sapiens
gguggaccaacuaccuuaa

SEQ ID NO: 966373 - RNA, 19 nt, Homo sapiens
gccaggacucauuuaauuc

SEQ ID NO: 966374 - RNA, 19 nt, Homo sapiens
augcuacucuccugaagau

SEQ ID NO: 966375 - RNA, 19 nt, Homo sapiens
aagcgcuucugucaauaug

SEQ ID NO: 966376 - RNA, 19 nt, Homo sapiens
cauuguggaguacaucaaa

SEQ ID NO: 966377 - RNA, 19 nt, Homo sapiens
cuacaagaugagaaugaaa

SEQ ID NO: 966378 - RNA, 19 nt, Homo sapiens
ggaaaaugcacccuaccuu

SEQ ID NO: 966379 - RNA, 19 nt, Homo sapiens
gcaggaugaagauggauac

SEQ ID NO: 966380 - RNA, 19 nt, Homo sapiens
gcucgguuaucucagaaaa

SEQ ID NO: 966381 - RNA, 19 nt, Homo sapiens
gaaaaucgcacaggaacuc

SEQ ID NO: 966382 - RNA, 19 nt, Homo sapiens
aaagcgcuucugucaauau

SEQ ID NO: 966383 - RNA, 19 nt, Homo sapiens
caacagggaugucacuuga

SEQ ID NO: 966384 - RNA, 19 nt, Homo sapiens
ggaaauacgucccaagagu

SEQ ID NO: 966385 - RNA, 19 nt, Homo sapiens
gaaauggcauggagacaau

SEQ ID NO: 966386 - RNA, 19 nt, Homo sapiens
gauauucccuucagagaga

SEQ ID NO: 966387 - RNA, 19 nt, Homo sapiens
ggaaauacauugagguaac

SEQ ID NO: 966388 - RNA, 19 nt, Homo sapiens
ucaaaggacugcaaagaau

SEQ ID NO: 966389 - RNA, 19 nt, Homo sapiens
acagggaugucacuugaua

SEQ ID NO: 966390 - RNA, 19 nt, Homo sapiens
gggaugaucuucucaaagg

SEQ ID NO: 966391 - RNA, 19 nt, Homo sapiens
gaaauacauugagguaaca

SEQ ID NO: 966392 - RNA, 19 nt, Homo sapiens
ggaaagacuaucucucuga

SEQ ID NO: 966393 - RNA, 19 nt, Homo sapiens
gaaauacgucccaagaguu

SEQ ID NO: 966394 - RNA, 19 nt, Homo sapiens
caagacaccauuucucaaa

SEQ ID NO: 966395 - RNA, 19 nt, Homo sapiens
cgagggacaugcuggauga

SEQ ID NO: 966396 - RNA, 19 nt, Homo sapiens
gaggaaauacauugaggua

SEQ ID NO: 966397 - RNA, 19 nt, Homo sapiens
gugcagcccuuguacagaa

SEQ ID NO: 966398 - RNA, 19 nt, Homo sapiens
gcaaauacacaaggaauuc

SEQ ID NO: 966399 - RNA, 19 nt, Homo sapiens
gcagucacuucccagauug

SEQ ID NO: 966400 - RNA, 19 nt, Homo sapiens
uaauaucaccucccuguuu

SEQ ID NO: 966401 - RNA, 19 nt, Homo sapiens
ggaggacuguaaauauuuc

SEQ ID NO: 966402 - RNA, 19 nt, Homo sapiens
ggaagaaagauuaggaaau

SEQ ID NO: 966403 - RNA, 19 nt, Homo sapiens
ggcagucacuucccagauu

SEQ ID NO: 966404 - RNA, 19 nt, Homo sapiens
gucgugagcuguauaacaa

SEQ ID NO: 966405 - RNA, 19 nt, Homo sapiens
gcuaccaguucuauaaaga

SEQ ID NO: 966406 - RNA, 19 nt, Homo sapiens
gggacaugcuggaugauga

SEQ ID NO: 966407 - RNA, 19 nt, Homo sapiens
ccauugacccauauuuaua

SEQ ID NO: 966408 - RNA, 19 nt, Homo sapiens
caucugccuucuuggcuua

SEQ ID NO: 966409 - RNA, 19 nt, Homo sapiens
cuaccaugcugaagauaaa

SEQ ID NO: 966410 - RNA, 19 nt, Homo sapiens
aagacuaucucucugacua

SEQ ID NO: 966411 - RNA, 19 nt, Homo sapiens
acaagaagaccuggaauuu

SEQ ID NO: 966412 - RNA, 19 nt, Homo sapiens
guaaauauuucugccuuag

SEQ ID NO: 966413 - RNA, 19 nt, Homo sapiens
ucaaguaguccaucagaaa

SEQ ID NO: 966414 - RNA, 19 nt, Homo sapiens
cuucuuggcuuagagauaa

SEQ ID NO: 966415 - RNA, 19 nt, Homo sapiens
ugggaggacuguaaauauu

SEQ ID NO: 966416 - RNA, 19 nt, Homo sapiens
caucagaaauuggcaguca

SEQ ID NO: 966417 - RNA, 19 nt, Homo sapiens
gggaggacuguaaauauuu

SEQ ID NO: 966418 - RNA, 19 nt, Homo sapiens
gaugucacuugauaugaga

SEQ ID NO: 966419 - RNA, 19 nt, Homo sapiens
caagaagaccuggaauuug

SEQ ID NO: 966420 - RNA, 19 nt, Homo sapiens
ggaaauggcauggagacaa

SEQ ID NO: 966421 - RNA, 19 nt, Homo sapiens
caggaagucugcagcaugu

SEQ ID NO: 966422 - RNA, 19 nt, Homo sapiens
guaauaguuucaguuccua

SEQ ID NO: 966423 - RNA, 19 nt, Homo sapiens
ggaugucacuugauaugag

SEQ ID NO: 966424 - RNA, 19 nt, Homo sapiens
caaaggacugcaaagaauu

SEQ ID NO: 966425 - RNA, 19 nt, Homo sapiens
gaacuaccguccccgauau

SEQ ID NO: 966426 - RNA, 19 nt, Homo sapiens
gcaauccgaccacauuuca

SEQ ID NO: 966427 - RNA, 19 nt, Homo sapiens
gaaguagaggaaauacauu

SEQ ID NO: 966428 - RNA, 19 nt, Homo sapiens
caaacaagaagaccuggaa

SEQ ID NO: 966429 - RNA, 19 nt, Homo sapiens
aaauauuucugccuuagug

SEQ ID NO: 966430 - RNA, 19 nt, Homo sapiens
guacagaacaauggaaaug

SEQ ID NO: 966431 - RNA, 19 nt, Homo sapiens
ggaacauaaucaggaaaga

SEQ ID NO: 966432 - RNA, 19 nt, Homo sapiens
aagaagaccuggaauuugc

SEQ ID NO: 966433 - RNA, 19 nt, Homo sapiens
caaaauggguucucguguu

SEQ ID NO: 966434 - RNA, 19 nt, Homo sapiens
aaugucaucugccuucuug

SEQ ID NO: 966435 - RNA, 19 nt, Homo sapiens
ucagaaacccauaauguca

SEQ ID NO: 966436 - RNA, 19 nt, Homo sapiens
cuucaaguccagaauauaa

SEQ ID NO: 966437 - RNA, 19 nt, Homo sapiens
aaagugagccucuucaucu

SEQ ID NO: 966438 - RNA, 19 nt, Homo sapiens
guauuuaacagucacaaga

SEQ ID NO: 966439 - RNA, 19 nt, Homo sapiens
ccucagaaacccauaaugu

SEQ ID NO: 966440 - RNA, 19 nt, Homo sapiens
gaauugaagcguugugucu

SEQ ID NO: 966441 - RNA, 19 nt, Homo sapiens
gaauuugccgcgucucaga

SEQ ID NO: 966442 - RNA, 19 nt, Homo sapiens
cagauuguaccagcaaaua

SEQ ID NO: 966443 - RNA, 19 nt, Homo sapiens
ggaaauggaacauaaucag

SEQ ID NO: 966444 - RNA, 19 nt, Homo sapiens
ugacccauauuuauaccuu

SEQ ID NO: 966445 - RNA, 19 nt, Homo sapiens
uaccagcucuccaauacug

SEQ ID NO: 966446 - RNA, 19 nt, Homo sapiens
uuucugagcucggguuuau

SEQ ID NO: 966447 - RNA, 19 nt, Homo sapiens
ccaaagcaagggcuaguug

SEQ ID NO: 966448 - RNA, 19 nt, Homo sapiens
aggcgaaggugacugauuc

SEQ ID NO: 966449 - RNA, 19 nt, Homo sapiens
aaaguugggaggacuguaa

SEQ ID NO: 966450 - RNA, 19 nt, Homo sapiens
gacaauugcuaccaguucu

SEQ ID NO: 966451 - RNA, 19 nt, Homo sapiens
guugcaaucucuucaaguc

SEQ ID NO: 966452 - RNA, 19 nt, Homo sapiens
caaguaguccaucagaaau

SEQ ID NO: 966453 - RNA, 19 nt, Homo sapiens
aaaauggguucucguguuu

SEQ ID NO: 966454 - RNA, 19 nt, Homo sapiens
gaugucaccagcccaagaa

SEQ ID NO: 966455 - RNA, 19 nt, Homo sapiens
caaaucucaaugccuuaua

SEQ ID NO: 966456 - RNA, 19 nt, Homo sapiens
ugaaguagaggaaauacau

SEQ ID NO: 966457 - RNA, 19 nt, Homo sapiens
auugggaaauggaacauaa

SEQ ID NO: 966458 - RNA, 19 nt, Homo sapiens
ucucaccgcuguaggaauc

SEQ ID NO: 966459 - RNA, 19 nt, Homo sapiens
caugucuuccuuacacuua

SEQ ID NO: 966460 - RNA, 19 nt, Homo sapiens
caaagcaagggcuaguuga

SEQ ID NO: 966461 - RNA, 19 nt, Homo sapiens
uuucuuccauugacccaua

SEQ ID NO: 966462 - RNA, 19 nt, Homo sapiens
gguuuaugcacguauuuaa

SEQ ID NO: 966463 - RNA, 19 nt, Homo sapiens
caggaaagacuaucucucu

SEQ ID NO: 966464 - RNA, 19 nt, Homo sapiens
gauucgcccucagcaacua

SEQ ID NO: 966465 - RNA, 19 nt, Homo sapiens
guugggaggacuguaaaua

SEQ ID NO: 966466 - RNA, 19 nt, Homo sapiens
gacccauauuuauaccuuu

SEQ ID NO: 966467 - RNA, 19 nt, Homo sapiens
ccaucuccguuucauauca

SEQ ID NO: 966468 - RNA, 19 nt, Homo sapiens
uuagcucucuuucuucuca

SEQ ID NO: 966469 - RNA, 19 nt, Homo sapiens
ggacugcaaagaauugaag

SEQ ID NO: 966470 - RNA, 19 nt, Homo sapiens
ggaugaucuucucaaagga

SEQ ID NO: 966471 - RNA, 19 nt, Homo sapiens
cgaccacauuucacucuca

SEQ ID NO: 966472 - RNA, 19 nt, Homo sapiens
gaguugcaaucucuucaag

SEQ ID NO: 966473 - RNA, 19 nt, Homo sapiens
aauggaacauaaucaggaa

SEQ ID NO: 966474 - RNA, 19 nt, Homo sapiens
uaggaaauacgucccaaga

SEQ ID NO: 966475 - RNA, 19 nt, Homo sapiens
gaacauaaucaggaaagac

SEQ ID NO: 966476 - RNA, 19 nt, Homo sapiens
uauaaagcuugcaggaagu

SEQ ID NO: 966477 - RNA, 19 nt, Homo sapiens
aaauacgucccaagaguug

SEQ ID NO: 966478 - RNA, 19 nt, Homo sapiens
gggcaauccgaccacauuu

SEQ ID NO: 966479 - RNA, 19 nt, Homo sapiens
guaacauccuuuucucuga

SEQ ID NO: 966480 - RNA, 19 nt, Homo sapiens
acauugagguaacauccuu

SEQ ID NO: 966481 - RNA, 19 nt, Homo sapiens
caaccucagaaacccauaa

SEQ ID NO: 966482 - RNA, 19 nt, Homo sapiens
ccucagcaacuacaaauag

SEQ ID NO: 966483 - RNA, 19 nt, Homo sapiens
ggaguuaucuaugcauaua

SEQ ID NO: 966484 - RNA, 19 nt, Homo sapiens
gaagauccuguaugaauua

SEQ ID NO: 966485 - RNA, 19 nt, Homo sapiens
ggaagauccuguaugaauu

SEQ ID NO: 966486 - RNA, 19 nt, Homo sapiens
gaucagauauucuacaauc

SEQ ID NO: 966487 - RNA, 19 nt, Homo sapiens
gaaacccuaucuccacuaa

SEQ ID NO: 966488 - RNA, 19 nt, Homo sapiens
gcuaagagcuuggucauca

SEQ ID NO: 966489 - RNA, 19 nt, Homo sapiens
ccucuuugcugguauauuu

SEQ ID NO: 966490 - RNA, 19 nt, Homo sapiens
aagcaacguuucccaaaua

SEQ ID NO: 966491 - RNA, 19 nt, Homo sapiens
gaagcaacguuucccaaau

SEQ ID NO: 966492 - RNA, 19 nt, Homo sapiens
gaagaugucucagaugaag

SEQ ID NO: 966493 - RNA, 19 nt, Homo sapiens
gagagaaggugguggagau

SEQ ID NO: 966494 - RNA, 19 nt, Homo sapiens
caucacaaaugcccauaaa

SEQ ID NO: 966495 - RNA, 19 nt, Homo sapiens
gaggaguuaucuaugcaua

SEQ ID NO: 966496 - RNA, 19 nt, Homo sapiens
ugagauggguauaucagua

SEQ ID NO: 966497 - RNA, 19 nt, Homo sapiens
cgucuuugaugaacaauaa

SEQ ID NO: 966498 - RNA, 19 nt, Homo sapiens
gagccgagauugcgccauu

SEQ ID NO: 966499 - RNA, 19 nt, Homo sapiens
gauugagucuaccuucuuu

SEQ ID NO: 966500 - RNA, 19 nt, Homo sapiens
ucacuuaccugaucugaag

SEQ ID NO: 966501 - RNA, 19 nt, Homo sapiens
gcacaggcagacuggauua

SEQ ID NO: 966502 - RNA, 19 nt, Homo sapiens
ugaacaaggugaucucaga

SEQ ID NO: 966503 - RNA, 19 nt, Homo sapiens
gggaagauccuguaugaau

SEQ ID NO: 966504 - RNA, 19 nt, Homo sapiens
auaaauaacugcccugcaa

SEQ ID NO: 966505 - RNA, 19 nt, Homo sapiens
gaagagggcacaagaacug

SEQ ID NO: 966506 - RNA, 19 nt, Homo sapiens
guaaacaccagacgauuga

SEQ ID NO: 966507 - RNA, 19 nt, Homo sapiens
ggccaaagcccaccuguga

SEQ ID NO: 966508 - RNA, 19 nt, Homo sapiens
ggacaauuccggaggaguu

SEQ ID NO: 966509 - RNA, 19 nt, Homo sapiens
caacguuucccaaauauuc

SEQ ID NO: 966510 - RNA, 19 nt, Homo sapiens
aaaucuggcucgucuuuga

SEQ ID NO: 966511 - RNA, 19 nt, Homo sapiens
guaagaagagggcacaaga

SEQ ID NO: 966512 - RNA, 19 nt, Homo sapiens
gagauggguauaucaguaa

SEQ ID NO: 966513 - RNA, 19 nt, Homo sapiens
gaaugaaagagaaucaaga

SEQ ID NO: 966514 - RNA, 19 nt, Homo sapiens
gaucacuacugcucuugga

SEQ ID NO: 966515 - RNA, 19 nt, Homo sapiens
caucauggcggcucagaaa

SEQ ID NO: 966516 - RNA, 19 nt, Homo sapiens
gcccgagccugcugucauu

SEQ ID NO: 966517 - RNA, 19 nt, Homo sapiens
ccuguaaucucggcacuuu

SEQ ID NO: 966518 - RNA, 19 nt, Homo sapiens
gagucuaccuucuuuccuu

SEQ ID NO: 966519 - RNA, 19 nt, Homo sapiens
ggagccaguuucacagaug

SEQ ID NO: 966520 - RNA, 19 nt, Homo sapiens
gagcagcuuugucagagau

SEQ ID NO: 966521 - RNA, 19 nt, Homo sapiens
gauugagucugaccuucuu

SEQ ID NO: 966522 - RNA, 19 nt, Homo sapiens
cauaaacaccagaugauug

SEQ ID NO: 966523 - RNA, 19 nt, Homo sapiens
agaaggugguggagauaaa

SEQ ID NO: 966524 - RNA, 19 nt, Homo sapiens
gaaaggcguaccuggaaga

SEQ ID NO: 966525 - RNA, 19 nt, Homo sapiens
aaaccucuuugcugguaua

SEQ ID NO: 966526 - RNA, 19 nt, Homo sapiens
cccaaaguaugacaacauu

SEQ ID NO: 966527 - RNA, 19 nt, Homo sapiens
ggaugcaauucgacagcua

SEQ ID NO: 966528 - RNA, 19 nt, Homo sapiens
gcucgucuuugaugaacaa

SEQ ID NO: 966529 - RNA, 19 nt, Homo sapiens
gaugaugcaugagugcuau

SEQ ID NO: 966530 - RNA, 19 nt, Homo sapiens
gaagagcuugggauggauu

SEQ ID NO: 966531 - RNA, 19 nt, Homo sapiens
ggguauaucaguaagaaga

SEQ ID NO: 966532 - RNA, 19 nt, Homo sapiens
gauauucuacaaucacaga

SEQ ID NO: 966533 - RNA, 19 nt, Homo sapiens
cauaccaccucgccaaaca

SEQ ID NO: 966534 - RNA, 19 nt, Homo sapiens
gagaaggugguggagauaa

SEQ ID NO: 966535 - RNA, 19 nt, Homo sapiens
cgaggagggugaacaaggu

SEQ ID NO: 966536 - RNA, 19 nt, Homo sapiens
cuaccacacucccgaggaa

SEQ ID NO: 966537 - RNA, 19 nt, Homo sapiens
gacaauuccggaggaguua

SEQ ID NO: 966538 - RNA, 19 nt, Homo sapiens
uaagaagagggcacaagaa

SEQ ID NO: 966539 - RNA, 19 nt, Homo sapiens
gauccuguaugaauuaagc

SEQ ID NO: 966540 - RNA, 19 nt, Homo sapiens
ggaaugaaagagaaucaag

SEQ ID NO: 966541 - RNA, 19 nt, Homo sapiens
auaaacaccagaugauuga

SEQ ID NO: 966542 - RNA, 19 nt, Homo sapiens
uuucacagauggagaagau

SEQ ID NO: 966543 - RNA, 19 nt, Homo sapiens
gauuacugcugcugggaau

SEQ ID NO: 966544 - RNA, 19 nt, Homo sapiens
uaaauaacugcccugcaaa

SEQ ID NO: 966545 - RNA, 19 nt, Homo sapiens
uugaagagcuugggaugga

SEQ ID NO: 966546 - RNA, 19 nt, Homo sapiens
cuuaugacuuggcaccuuu

SEQ ID NO: 966547 - RNA, 19 nt, Homo sapiens
aacaccaucuuaugacuug

SEQ ID NO: 966548 - RNA, 19 nt, Homo sapiens
ugaagcaacguuucccaaa

SEQ ID NO: 966549 - RNA, 19 nt, Homo sapiens
accagugucuuucaucuga

SEQ ID NO: 966550 - RNA, 19 nt, Homo sapiens
ggaugaugcaugagugcua

SEQ ID NO: 966551 - RNA, 19 nt, Homo sapiens
acacccggaugaugcauga

SEQ ID NO: 966552 - RNA, 19 nt, Homo sapiens
cagauauucuacaaucaca

SEQ ID NO: 966553 - RNA, 19 nt, Homo sapiens
ugucauuggugcuggauuc

SEQ ID NO: 966554 - RNA, 19 nt, Homo sapiens
aggcguaccuggaagacuu

SEQ ID NO: 966555 - RNA, 19 nt, Homo sapiens
gagcuugggauggauuuga

SEQ ID NO: 966556 - RNA, 19 nt, Homo sapiens
caacauggugaaacccuau

SEQ ID NO: 966557 - RNA, 19 nt, Homo sapiens
cguaaacaccagacgauug

SEQ ID NO: 966558 - RNA, 19 nt, Homo sapiens
ccauaaacaccagaugauu

SEQ ID NO: 966559 - RNA, 19 nt, Homo sapiens
ugucagagaucacuuaccu

SEQ ID NO: 966560 - RNA, 19 nt, Homo sapiens
guagcaaggacguuugaga

SEQ ID NO: 966561 - RNA, 19 nt, Homo sapiens
auucuacaaucacagagua

SEQ ID NO: 966562 - RNA, 19 nt, Homo sapiens
cuguaugaauuaagcauga

SEQ ID NO: 966563 - RNA, 19 nt, Homo sapiens
ccgaaaggcguaccuggaa

SEQ ID NO: 966564 - RNA, 19 nt, Homo sapiens
gaacugaagcaacguuucc

SEQ ID NO: 966565 - RNA, 19 nt, Homo sapiens
gaucgccacccaaaguaug

SEQ ID NO: 966566 - RNA, 19 nt, Homo sapiens
caucggagacguccagauc

SEQ ID NO: 966567 - RNA, 19 nt, Homo sapiens
ugggauggauuugacuaaa

SEQ ID NO: 966568 - RNA, 19 nt, Homo sapiens
auugagagcugcauguaca

SEQ ID NO: 966569 - RNA, 19 nt, Homo sapiens
gaugguuccugggagcuau

SEQ ID NO: 966570 - RNA, 19 nt, Homo sapiens
ggaucaacguguguuacug

SEQ ID NO: 966571 - RNA, 19 nt, Homo sapiens
gcaacguuucccaaauauu

SEQ ID NO: 966572 - RNA, 19 nt, Homo sapiens
gaguagcaaggacguuuga

SEQ ID NO: 966573 - RNA, 19 nt, Homo sapiens
cagaguagcaaggacguuu

SEQ ID NO: 966574 - RNA, 19 nt, Homo sapiens
uagcaaggacguuugagau

SEQ ID NO: 966575 - RNA, 19 nt, Homo sapiens
ccugagauaucauccuuuu

SEQ ID NO: 966576 - RNA, 19 nt, Homo sapiens
ucacagauggagaagaugu

SEQ ID NO: 966577 - RNA, 19 nt, Homo sapiens
ucacaaaugcccauaaaau

SEQ ID NO: 966578 - RNA, 19 nt, Homo sapiens
ggagacugaggcaagagaa

SEQ ID NO: 966579 - RNA, 19 nt, Homo sapiens
caggcagacuggauuacug

SEQ ID NO: 966580 - RNA, 19 nt, Homo sapiens
uaacaccaucuuaugacuu

SEQ ID NO: 966581 - RNA, 19 nt, Homo sapiens
ggacguuugagauggguau

SEQ ID NO: 966582 - RNA, 19 nt, Homo sapiens
gauaaacccagggcuacug

SEQ ID NO: 966583 - RNA, 19 nt, Homo sapiens
gaagagacuugaaagaaua

SEQ ID NO: 966584 - RNA, 19 nt, Homo sapiens
cuggaaaggugaacauuua

SEQ ID NO: 966585 - RNA, 19 nt, Homo sapiens
ggaaaggugaacauuuaua

SEQ ID NO: 966586 - RNA, 19 nt, Homo sapiens
gaacuucaacaacuuauuc

SEQ ID NO: 966587 - RNA, 19 nt, Homo sapiens
ucagaacugucagaacuua

SEQ ID NO: 966588 - RNA, 19 nt, Homo sapiens
uuuaacagcuccuuugaaa

SEQ ID NO: 966589 - RNA, 19 nt, Homo sapiens
gcaagaagaccgucaucaa

SEQ ID NO: 966590 - RNA, 19 nt, Homo sapiens
gcucagaacugucagaacu

SEQ ID NO: 966591 - RNA, 19 nt, Homo sapiens
uaacagcuccuuugaaauc

SEQ ID NO: 966592 - RNA, 19 nt, Homo sapiens
gaaaggugaacauuuauag

SEQ ID NO: 966593 - RNA, 19 nt, Homo sapiens
gaagauauugguaagcuau

SEQ ID NO: 966594 - RNA, 19 nt, Homo sapiens
agaagagacuugaaagaau

SEQ ID NO: 966595 - RNA, 19 nt, Homo sapiens
gcacucacuuugccucuca

SEQ ID NO: 966596 - RNA, 19 nt, Homo sapiens
aaacaucccugugguagga

SEQ ID NO: 966597 - RNA, 19 nt, Homo sapiens
gguaagcuauagaauuuag

SEQ ID NO: 966598 - RNA, 19 nt, Homo sapiens
caacuuauucuacagcaaa

SEQ ID NO: 966599 - RNA, 19 nt, Homo sapiens
ucccaaaucuguuaacaug

SEQ ID NO: 966600 - RNA, 19 nt, Homo sapiens
ccagugaccugaccaacau

SEQ ID NO: 966601 - RNA, 19 nt, Homo sapiens
gaacuuacggguggaaaga

SEQ ID NO: 966602 - RNA, 19 nt, Homo sapiens
caacucggcucagaacugu

SEQ ID NO: 966603 - RNA, 19 nt, Homo sapiens
gggagacggugcagaggaa

SEQ ID NO: 966604 - RNA, 19 nt, Homo sapiens
cagaagagacuugaaagaa

SEQ ID NO: 966605 - RNA, 19 nt, Homo sapiens
ggugaacauuuauagcauu

SEQ ID NO: 966606 - RNA, 19 nt, Homo sapiens
cagaagugcugauguggau

SEQ ID NO: 966607 - RNA, 19 nt, Homo sapiens
caaacgagucagcuuauga

SEQ ID NO: 966608 - RNA, 19 nt, Homo sapiens
gaacucaaggucuuaaugg

SEQ ID NO: 966609 - RNA, 19 nt, Homo sapiens
gaaugacgaggaugacuga

SEQ ID NO: 966610 - RNA, 19 nt, Homo sapiens
gaaagacagaagagacuug

SEQ ID NO: 966611 - RNA, 19 nt, Homo sapiens
cagcaucuccgacgacaaa

SEQ ID NO: 966612 - RNA, 19 nt, Homo sapiens
ccacauccaugaaaauaaa

SEQ ID NO: 966613 - RNA, 19 nt, Homo sapiens
gcaccuacgaugccuuaaa

SEQ ID NO: 966614 - RNA, 19 nt, Homo sapiens
ggaaaggagagaagaaugg

SEQ ID NO: 966615 - RNA, 19 nt, Homo sapiens
cacugaagcuaacgaagaa

SEQ ID NO: 966616 - RNA, 19 nt, Homo sapiens
agacagaagagacuugaaa

SEQ ID NO: 966617 - RNA, 19 nt, Homo sapiens
gauaugcaccucugauaag

SEQ ID NO: 966618 - RNA, 19 nt, Homo sapiens
caaggauuguuucccguau

SEQ ID NO: 966619 - RNA, 19 nt, Homo sapiens
gcgcaccuacgaugccuua

SEQ ID NO: 966620 - RNA, 19 nt, Homo sapiens
caccaaacgagucagcuua

SEQ ID NO: 966621 - RNA, 19 nt, Homo sapiens
ucacugaagcuaacgaaga

SEQ ID NO: 966622 - RNA, 19 nt, Homo sapiens
cgacgacaaaucagaauau

SEQ ID NO: 966623 - RNA, 19 nt, Homo sapiens
gaaagaauaaagcagaaac

SEQ ID NO: 966624 - RNA, 19 nt, Homo sapiens
uagauaugcaccucugaua

SEQ ID NO: 966625 - RNA, 19 nt, Homo sapiens
ggaaaacauuuagggaaaa

SEQ ID NO: 966626 - RNA, 19 nt, Homo sapiens
gugcugauggccaugaaua

SEQ ID NO: 966627 - RNA, 19 nt, Homo sapiens
gauaagcaaggauuguuuc

SEQ ID NO: 966628 - RNA, 19 nt, Homo sapiens
ccuuugaaauccacgauga

SEQ ID NO: 966629 - RNA, 19 nt, Homo sapiens
cagcaagugguaauuggua

SEQ ID NO: 966630 - RNA, 19 nt, Homo sapiens
gugcugacacagaaucuuu

SEQ ID NO: 966631 - RNA, 19 nt, Homo sapiens
gauuaagacgugcuguuga

SEQ ID NO: 966632 - RNA, 19 nt, Homo sapiens
gccuuaagauucagcuuca

SEQ ID NO: 966633 - RNA, 19 nt, Homo sapiens
caagaagaccgucaucaac

SEQ ID NO: 966634 - RNA, 19 nt, Homo sapiens
aaaagaagaucaaguggau

SEQ ID NO: 966635 - RNA, 19 nt, Homo sapiens
ccaaacgagucagcuuaug

SEQ ID NO: 966636 - RNA, 19 nt, Homo sapiens
guugauguguguuuugaua

SEQ ID NO: 966637 - RNA, 19 nt, Homo sapiens
ucuaauggcacguggcuuu

SEQ ID NO: 966638 - RNA, 19 nt, Homo sapiens
agaaauggcucagggaacu

SEQ ID NO: 966639 - RNA, 19 nt, Homo sapiens
ucagagaccagcagcauca

SEQ ID NO: 966640 - RNA, 19 nt, Homo sapiens
gagguuuucuguuucuuuu

SEQ ID NO: 966641 - RNA, 19 nt, Homo sapiens
ccucucgccuuaagauuca

SEQ ID NO: 966642 - RNA, 19 nt, Homo sapiens
gcagguuccaggucuaaug

SEQ ID NO: 966643 - RNA, 19 nt, Homo sapiens
aagaagaucaaguggauug

SEQ ID NO: 966644 - RNA, 19 nt, Homo sapiens
gcaaccacgccucaccaaa

SEQ ID NO: 966645 - RNA, 19 nt, Homo sapiens
aaugugagguuuucuguuu

SEQ ID NO: 966646 - RNA, 19 nt, Homo sapiens
aauccacgaugacacagaa

SEQ ID NO: 966647 - RNA, 19 nt, Homo sapiens
agaagaccgucaucaacug

SEQ ID NO: 966648 - RNA, 19 nt, Homo sapiens
guaauugguaugccucaga

SEQ ID NO: 966649 - RNA, 19 nt, Homo sapiens
caacauugaccagcaagug

SEQ ID NO: 966650 - RNA, 19 nt, Homo sapiens
gauuguuucccguaugauu

SEQ ID NO: 966651 - RNA, 19 nt, Homo sapiens
agaagauauugguaagcua

SEQ ID NO: 966652 - RNA, 19 nt, Homo sapiens
gacgacaaaucagaauauc

SEQ ID NO: 966653 - RNA, 19 nt, Homo sapiens
cacgugcccuucaucauca

SEQ ID NO: 966654 - RNA, 19 nt, Homo sapiens
ccacgugcccuucaucauc

SEQ ID NO: 966655 - RNA, 19 nt, Homo sapiens
acaguccagugucaacauu

SEQ ID NO: 966656 - RNA, 19 nt, Homo sapiens
agauaugcaccucugauaa

SEQ ID NO: 966657 - RNA, 19 nt, Homo sapiens
caucagcaguagcaagaag

SEQ ID NO: 966658 - RNA, 19 nt, Homo sapiens
ggaaagacagaagagacuu

SEQ ID NO: 966659 - RNA, 19 nt, Homo sapiens
caccuacgaugccuuaaac

SEQ ID NO: 966660 - RNA, 19 nt, Homo sapiens
caacaggaaaggagagaag

SEQ ID NO: 966661 - RNA, 19 nt, Homo sapiens
aggauuguuucccguauga

SEQ ID NO: 966662 - RNA, 19 nt, Homo sapiens
gaagcuaacgaagaacuca

SEQ ID NO: 966663 - RNA, 19 nt, Homo sapiens
ugauaagcaaggauuguuu

SEQ ID NO: 966664 - RNA, 19 nt, Homo sapiens
ugaaauccacgaugacaca

SEQ ID NO: 966665 - RNA, 19 nt, Homo sapiens
gauauugguaagcuauaga

SEQ ID NO: 966666 - RNA, 19 nt, Homo sapiens
gugagaaugacgaggauga

SEQ ID NO: 966667 - RNA, 19 nt, Homo sapiens
caaccacgccucaccaaac

SEQ ID NO: 966668 - RNA, 19 nt, Homo sapiens
ccacccagcacucacuuug

SEQ ID NO: 966669 - RNA, 19 nt, Homo sapiens
caucuccgacgacaaauca

SEQ ID NO: 966670 - RNA, 19 nt, Homo sapiens
gucaucaacugcagcaucu

SEQ ID NO: 966671 - RNA, 19 nt, Homo sapiens
gagcuggucgccaaguuca

SEQ ID NO: 966672 - RNA, 19 nt, Homo sapiens
ggaggaggacaacaacgau

SEQ ID NO: 966673 - RNA, 19 nt, Homo sapiens
gcaagugguaauugguaug

SEQ ID NO: 966674 - RNA, 19 nt, Homo sapiens
aagcagcucuugccgaaaa

SEQ ID NO: 966675 - RNA, 19 nt, Homo sapiens
gaaaacauuuagggaaaag

SEQ ID NO: 966676 - RNA, 19 nt, Homo sapiens
caacgaugacgaccucagu

SEQ ID NO: 966677 - RNA, 19 nt, Homo sapiens
uaagacgugcuguugaugu

SEQ ID NO: 966678 - RNA, 19 nt, Homo sapiens
agauucagcuucaggaaaa

SEQ ID NO: 966679 - RNA, 19 nt, Homo sapiens
cugacguccucucgccuua

SEQ ID NO: 966680 - RNA, 19 nt, Homo sapiens
acagaagagacuugaaaga

SEQ ID NO: 966681 - RNA, 19 nt, Homo sapiens
uuccugaguuuacugaaga

SEQ ID NO: 966682 - RNA, 19 nt, Homo sapiens
auuaagacgugcuguugau

SEQ ID NO: 966683 - RNA, 19 nt, Homo sapiens
gaagaagacccauuugaua

SEQ ID NO: 966684 - RNA, 19 nt, Homo sapiens
gcagacaggccaugauuua

SEQ ID NO: 966685 - RNA, 19 nt, Homo sapiens
caaaggauauacagucuug

SEQ ID NO: 966686 - RNA, 19 nt, Homo sapiens
uaacacugguucugcaaua

SEQ ID NO: 966687 - RNA, 19 nt, Homo sapiens
gauggaguuucuucaguua

SEQ ID NO: 966688 - RNA, 19 nt, Homo sapiens
ucagagagaacuacuaaua

SEQ ID NO: 966689 - RNA, 19 nt, Homo sapiens
gaagaaaggagagaauauu

SEQ ID NO: 966690 - RNA, 19 nt, Homo sapiens
ucagagaaguacaguauga

SEQ ID NO: 966691 - RNA, 19 nt, Homo sapiens
gcaccaguguucagaagaa

SEQ ID NO: 966692 - RNA, 19 nt, Homo sapiens
gagagaauauugagcagau

SEQ ID NO: 966693 - RNA, 19 nt, Homo sapiens
ugagugggcugaagagauu

SEQ ID NO: 966694 - RNA, 19 nt, Homo sapiens
ugaauaacaccuagucaua

SEQ ID NO: 966695 - RNA, 19 nt, Homo sapiens
ugaaagacauuaaggaagu

SEQ ID NO: 966696 - RNA, 19 nt, Homo sapiens
gaugaugucccauuuaaga

SEQ ID NO: 966697 - RNA, 19 nt, Homo sapiens
ucaguuaccuugaugaugu

SEQ ID NO: 966698 - RNA, 19 nt, Homo sapiens
gaaguugggugcagauuuu

SEQ ID NO: 966699 - RNA, 19 nt, Homo sapiens
gauauacagucuugaaucu

SEQ ID NO: 966700 - RNA, 19 nt, Homo sapiens
gcugaagccuggccuaguu

SEQ ID NO: 966701 - RNA, 19 nt, Homo sapiens
aggaagagcugagaaauau

SEQ ID NO: 966702 - RNA, 19 nt, Homo sapiens
gaaaucagucucucugguu

SEQ ID NO: 966703 - RNA, 19 nt, Homo sapiens
gaagagcugagaaauauuc

SEQ ID NO: 966704 - RNA, 19 nt, Homo sapiens
uaacaaagucucauagugu

SEQ ID NO: 966705 - RNA, 19 nt, Homo sapiens
uaaaguuggucuaccuauu

SEQ ID NO: 966706 - RNA, 19 nt, Homo sapiens
gaaagacauuaaggaaguu

SEQ ID NO: 966707 - RNA, 19 nt, Homo sapiens
cauuauggcucaguuauug

SEQ ID NO: 966708 - RNA, 19 nt, Homo sapiens
gacaggccaugauuuaguu

SEQ ID NO: 966709 - RNA, 19 nt, Homo sapiens
gcaguaagcaauaucaaau

SEQ ID NO: 966710 - RNA, 19 nt, Homo sapiens
gaagacccauuugauaauc

SEQ ID NO: 966711 - RNA, 19 nt, Homo sapiens
ucagagccaugaagaagaa

SEQ ID NO: 966712 - RNA, 19 nt, Homo sapiens
guacgaguguguccucaga

SEQ ID NO: 966713 - RNA, 19 nt, Homo sapiens
aaaaugagcuucuccaaga

SEQ ID NO: 966714 - RNA, 19 nt, Homo sapiens
acaaugccaccuccuauua

SEQ ID NO: 966715 - RNA, 19 nt, Homo sapiens
cagagagaacuacuaauaa

SEQ ID NO: 966716 - RNA, 19 nt, Homo sapiens
ggacaaugcuuuggaagac

SEQ ID NO: 966717 - RNA, 19 nt, Homo sapiens
aagaagacccauuugauaa

SEQ ID NO: 966718 - RNA, 19 nt, Homo sapiens
gaagcuaaagugaauucua

SEQ ID NO: 966719 - RNA, 19 nt, Homo sapiens
gguucuaaauggcuucuaa

SEQ ID NO: 966720 - RNA, 19 nt, Homo sapiens
gggcaacccuagauuucaa

SEQ ID NO: 966721 - RNA, 19 nt, Homo sapiens
gcccacugcuuuaggauga

SEQ ID NO: 966722 - RNA, 19 nt, Homo sapiens
caauggcuuuauaaccuua

SEQ ID NO: 966723 - RNA, 19 nt, Homo sapiens
uuucaagccucuucauaaa

SEQ ID NO: 966724 - RNA, 19 nt, Homo sapiens
gaacgggcaacccuagauu

SEQ ID NO: 966725 - RNA, 19 nt, Homo sapiens
gacaggagacaaauucaaa

SEQ ID NO: 966726 - RNA, 19 nt, Homo sapiens
uuaaggagaugggcuuuga

SEQ ID NO: 966727 - RNA, 19 nt, Homo sapiens
gaagaagaaaggagagaau

SEQ ID NO: 966728 - RNA, 19 nt, Homo sapiens
ggaaucaucaccuccaaau

SEQ ID NO: 966729 - RNA, 19 nt, Homo sapiens
gagcaaauuuaaggagaug

SEQ ID NO: 966730 - RNA, 19 nt, Homo sapiens
ggaagcagaagcuaaagug

SEQ ID NO: 966731 - RNA, 19 nt, Homo sapiens
uugaugaugucccauuuaa

SEQ ID NO: 966732 - RNA, 19 nt, Homo sapiens
aauaacaccuagucauaga

SEQ ID NO: 966733 - RNA, 19 nt, Homo sapiens
cuaacaaagucucauagug

SEQ ID NO: 966734 - RNA, 19 nt, Homo sapiens
gaauaacaccuagucauag

SEQ ID NO: 966735 - RNA, 19 nt, Homo sapiens
gcugaaagacauuaaggaa

SEQ ID NO: 966736 - RNA, 19 nt, Homo sapiens
gaaaggagagaauauugag

SEQ ID NO: 966737 - RNA, 19 nt, Homo sapiens
gcaauggcacguuccagaa

SEQ ID NO: 966738 - RNA, 19 nt, Homo sapiens
uaagacaggagacaaauuc

SEQ ID NO: 966739 - RNA, 19 nt, Homo sapiens
ucucugaggugcaaagaau

SEQ ID NO: 966740 - RNA, 19 nt, Homo sapiens
caaagucucauaguguuaa

SEQ ID NO: 966741 - RNA, 19 nt, Homo sapiens
ccaggacaaugcuuuggaa

SEQ ID NO: 966742 - RNA, 19 nt, Homo sapiens
gaaucaucaccuccaaaua

SEQ ID NO: 966743 - RNA, 19 nt, Homo sapiens
ccagaugccuucccucucu

SEQ ID NO: 966744 - RNA, 19 nt, Homo sapiens
cauaaaggcggauuucaau

SEQ ID NO: 966745 - RNA, 19 nt, Homo sapiens
uaggaugacacaaugaaua

SEQ ID NO: 966746 - RNA, 19 nt, Homo sapiens
caauaucucugaggugcaa

SEQ ID NO: 966747 - RNA, 19 nt, Homo sapiens
ggaagauucgggcauguga

SEQ ID NO: 966748 - RNA, 19 nt, Homo sapiens
gaaggaagagcugagaaau

SEQ ID NO: 966749 - RNA, 19 nt, Homo sapiens
aaaucagucucucugguuu

SEQ ID NO: 966750 - RNA, 19 nt, Homo sapiens
gcuuuaggaugacacaaug

SEQ ID NO: 966751 - RNA, 19 nt, Homo sapiens
gcacuaacuccaccucugu

SEQ ID NO: 966752 - RNA, 19 nt, Homo sapiens
ugauggaguuucuucaguu

SEQ ID NO: 966753 - RNA, 19 nt, Homo sapiens
gaugacagcaaucagaaga

SEQ ID NO: 966754 - RNA, 19 nt, Homo sapiens
gauuucaagccucuucaua

SEQ ID NO: 966755 - RNA, 19 nt, Homo sapiens
gaagcagagugcaaaauug

SEQ ID NO: 966756 - RNA, 19 nt, Homo sapiens
ccuggcuccuuccguauua

SEQ ID NO: 966757 - RNA, 19 nt, Homo sapiens
aaacuugacucugaugaca

SEQ ID NO: 966758 - RNA, 19 nt, Homo sapiens
ccaauggcuuuauaaccuu

SEQ ID NO: 966759 - RNA, 19 nt, Homo sapiens
ggaaccacuggacccauua

SEQ ID NO: 966760 - RNA, 19 nt, Homo sapiens
cagucucucugguuuguuu

SEQ ID NO: 966761 - RNA, 19 nt, Homo sapiens
cuaaagccuuccacccaaa

SEQ ID NO: 966762 - RNA, 19 nt, Homo sapiens
gaagcagaagcuaaaguga

SEQ ID NO: 966763 - RNA, 19 nt, Homo sapiens
gggcugaagagauuaagaa

SEQ ID NO: 966764 - RNA, 19 nt, Homo sapiens
uaacaccuagucauagaaa

SEQ ID NO: 966765 - RNA, 19 nt, Homo sapiens
ccaccucuguucuccuuga

SEQ ID NO: 966766 - RNA, 19 nt, Homo sapiens
ucauaaacccaauggcuuu

SEQ ID NO: 966767 - RNA, 19 nt, Homo sapiens
ugaagaagacccauuugau

SEQ ID NO: 966768 - RNA, 19 nt, Homo sapiens
caaugccaccuccuauuaa

SEQ ID NO: 966769 - RNA, 19 nt, Homo sapiens
ggauauacagucuugaauc

SEQ ID NO: 966770 - RNA, 19 nt, Homo sapiens
aaggaagagcugagaaaua

SEQ ID NO: 966771 - RNA, 19 nt, Homo sapiens
aaaguuggucuaccuauug

SEQ ID NO: 966772 - RNA, 19 nt, Homo sapiens
gauucucgacuaucucuuu

SEQ ID NO: 966773 - RNA, 19 nt, Homo sapiens
gugaagaagacccauuuga

SEQ ID NO: 966774 - RNA, 19 nt, Homo sapiens
gacuaucucuuugcacaug

SEQ ID NO: 966775 - RNA, 19 nt, Homo sapiens
ggacaguggcacagagaug

SEQ ID NO: 966776 - RNA, 19 nt, Homo sapiens
gaugacacaaugaauaaca

SEQ ID NO: 966777 - RNA, 19 nt, Homo sapiens
ggaguuucuucaguuaaug

SEQ ID NO: 966778 - RNA, 19 nt, Homo sapiens
uuuauaaccuuaccacagu

SEQ ID NO: 966779 - RNA, 19 nt, Homo sapiens
cagcccaccucacauaaag

SEQ ID NO: 966780 - RNA, 19 nt, Homo sapiens
cagcaguagugccacgaaa

SEQ ID NO: 966781 - RNA, 19 nt, Homo sapiens
caacucgggucagcaguag

SEQ ID NO: 966782 - RNA, 19 nt, Homo sapiens
caguaugacuucucuuugg

SEQ ID NO: 966783 - RNA, 19 nt, Homo sapiens
ggacuuaccuacaaaauac

SEQ ID NO: 966784 - RNA, 19 nt, Homo sapiens
cgauagggaugcagaggau

SEQ ID NO: 966785 - RNA, 19 nt, Homo sapiens
aaauacuccuuugcaauga

SEQ ID NO: 966786 - RNA, 19 nt, Homo sapiens
ggccgugggucuaauugug

SEQ ID NO: 966787 - RNA, 19 nt, Homo sapiens
caaagucaccaggcucaaa

SEQ ID NO: 966788 - RNA, 19 nt, Homo sapiens
agugggagcuggugucugu

SEQ ID NO: 966789 - RNA, 19 nt, Homo sapiens
cauccucuccuacuucuug

SEQ ID NO: 966790 - RNA, 19 nt, Homo sapiens
ggcauggacucggauuuca

SEQ ID NO: 966791 - RNA, 19 nt, Homo sapiens
gugaagcgcuuuuccacaa

SEQ ID NO: 966792 - RNA, 19 nt, Homo sapiens
caaccggaagcuucuaugu

SEQ ID NO: 966793 - RNA, 19 nt, Homo sapiens
gcaagguccggacaagaca

SEQ ID NO: 966794 - RNA, 19 nt, Homo sapiens
aaagucaccaggcucaaau

SEQ ID NO: 966795 - RNA, 19 nt, Homo sapiens
gacaaccggaagcuucuau

SEQ ID NO: 966796 - RNA, 19 nt, Homo sapiens
gggaugcagaggaucagaa

SEQ ID NO: 966797 - RNA, 19 nt, Homo sapiens
aaaauacuccuuugcaaug

SEQ ID NO: 966798 - RNA, 19 nt, Homo sapiens
gcauggccgugggucuaau

SEQ ID NO: 966799 - RNA, 19 nt, Homo sapiens
gaagcgcuuuuccacaaug

SEQ ID NO: 966800 - RNA, 19 nt, Homo sapiens
cagccuggccuccaaaguc

SEQ ID NO: 966801 - RNA, 19 nt, Homo sapiens
gcaaguaccuguaauugaa

SEQ ID NO: 966802 - RNA, 19 nt, Homo sapiens
aaagaaugcucauguuuga

SEQ ID NO: 966803 - RNA, 19 nt, Homo sapiens
ugucauacccaucuaauua

SEQ ID NO: 966804 - RNA, 19 nt, Homo sapiens
ccaugaagccuaacaagua

SEQ ID NO: 966805 - RNA, 19 nt, Homo sapiens
gaucuuacacuucaucuga

SEQ ID NO: 966806 - RNA, 19 nt, Homo sapiens
caagggaacauguaaacua

SEQ ID NO: 966807 - RNA, 19 nt, Homo sapiens
gaacaagggaacauguaaa

SEQ ID NO: 966808 - RNA, 19 nt, Homo sapiens
cccauuaucuaacacauuu

SEQ ID NO: 966809 - RNA, 19 nt, Homo sapiens
ggucugaaucucugaauuu

SEQ ID NO: 966810 - RNA, 19 nt, Homo sapiens
caaccuggaucuuacacuu

SEQ ID NO: 966811 - RNA, 19 nt, Homo sapiens
aagggaacauguaaacuaa

SEQ ID NO: 966812 - RNA, 19 nt, Homo sapiens
caugaagccuaacaaguau

SEQ ID NO: 966813 - RNA, 19 nt, Homo sapiens
gggaacauguaaacuaaca

SEQ ID NO: 966814 - RNA, 19 nt, Homo sapiens
ggaauucgcccuccucucu

SEQ ID NO: 966815 - RNA, 19 nt, Homo sapiens
gcaaacccuucuuacagau

SEQ ID NO: 966816 - RNA, 19 nt, Homo sapiens
gucugaaucucugaauuua

SEQ ID NO: 966817 - RNA, 19 nt, Homo sapiens
ggaagucuuugccaccaau

SEQ ID NO: 966818 - RNA, 19 nt, Homo sapiens
gaaugucagaguaaaugua

SEQ ID NO: 966819 - RNA, 19 nt, Homo sapiens
gcacacagaagaacacaca

SEQ ID NO: 966820 - RNA, 19 nt, Homo sapiens
cacagaggacagauuauua

SEQ ID NO: 966821 - RNA, 19 nt, Homo sapiens
gcucauguuugacccaguu

SEQ ID NO: 966822 - RNA, 19 nt, Homo sapiens
ggacuggagcccugacauu

SEQ ID NO: 966823 - RNA, 19 nt, Homo sapiens
cauaaccaauugucaguuc

SEQ ID NO: 966824 - RNA, 19 nt, Homo sapiens
ccucugcccugugaucaua

SEQ ID NO: 966825 - RNA, 19 nt, Homo sapiens
ccacagaggacagauuauu

SEQ ID NO: 966826 - RNA, 19 nt, Homo sapiens
auacuggaaucaaaccuuu

SEQ ID NO: 966827 - RNA, 19 nt, Homo sapiens
gaugaacuaacaagacauu

SEQ ID NO: 966828 - RNA, 19 nt, Homo sapiens
gaaguuugcucggucugau

SEQ ID NO: 966829 - RNA, 19 nt, Homo sapiens
ucaaaagaaugucagagua

SEQ ID NO: 966830 - RNA, 19 nt, Homo sapiens
gaaccacagaggacagauu

SEQ ID NO: 966831 - RNA, 19 nt, Homo sapiens
cuaauccucccucuccuua

SEQ ID NO: 966832 - RNA, 19 nt, Homo sapiens
gaaagcacacagaagaaca

SEQ ID NO: 966833 - RNA, 19 nt, Homo sapiens
uaugauggaugcaacaaag

SEQ ID NO: 966834 - RNA, 19 nt, Homo sapiens
aauagaaccugggaucgaa

SEQ ID NO: 966835 - RNA, 19 nt, Homo sapiens
gccugcagcucauauggaa

SEQ ID NO: 966836 - RNA, 19 nt, Homo sapiens
ugucaguucuccauguauu

SEQ ID NO: 966837 - RNA, 19 nt, Homo sapiens
cagaugugauuaugaugga

SEQ ID NO: 966838 - RNA, 19 nt, Homo sapiens
ccacaccauugccugagaa

SEQ ID NO: 966839 - RNA, 19 nt, Homo sapiens
caaaggaagcggaggauac

SEQ ID NO: 966840 - RNA, 19 nt, Homo sapiens
gacagauuauuauccugaa

SEQ ID NO: 966841 - RNA, 19 nt, Homo sapiens
acagccagauuucaagcua

SEQ ID NO: 966842 - RNA, 19 nt, Homo sapiens
gaacuaacaagacauuucc

SEQ ID NO: 966843 - RNA, 19 nt, Homo sapiens
uaaaagcucccacuugaaa

SEQ ID NO: 966844 - RNA, 19 nt, Homo sapiens
aaccacagaggacagauua

SEQ ID NO: 966845 - RNA, 19 nt, Homo sapiens
gaaguacagccagauuuca

SEQ ID NO: 966846 - RNA, 19 nt, Homo sapiens
gcccugugaucauauuuua

SEQ ID NO: 966847 - RNA, 19 nt, Homo sapiens
caaaagaaugucagaguaa

SEQ ID NO: 966848 - RNA, 19 nt, Homo sapiens
caaacccuucuuacagaua

SEQ ID NO: 966849 - RNA, 19 nt, Homo sapiens
gagcacccuagaagguuua

SEQ ID NO: 966850 - RNA, 19 nt, Homo sapiens
caccauugccugagaaguu

SEQ ID NO: 966851 - RNA, 19 nt, Homo sapiens
agcaaacccuucuuacaga

SEQ ID NO: 966852 - RNA, 19 nt, Homo sapiens
gaagggugcacauggaagu

SEQ ID NO: 966853 - RNA, 19 nt, Homo sapiens
gaaucacccuucggucauc

SEQ ID NO: 966854 - RNA, 19 nt, Homo sapiens
caagcauuguugcaagaga

SEQ ID NO: 966855 - RNA, 19 nt, Homo sapiens
cuagugcaaucaccucuuc

SEQ ID NO: 966856 - RNA, 19 nt, Homo sapiens
uagaaguacagccagauuu

SEQ ID NO: 966857 - RNA, 19 nt, Homo sapiens
gccacaugcuagucugauu

SEQ ID NO: 966858 - RNA, 19 nt, Homo sapiens
acuaaaagcucccacuuga

SEQ ID NO: 966859 - RNA, 19 nt, Homo sapiens
acagaggacagauuauuau

SEQ ID NO: 966860 - RNA, 19 nt, Homo sapiens
caucuugcccuccauagga

SEQ ID NO: 966861 - RNA, 19 nt, Homo sapiens
cugaugaacuaacaagaca

SEQ ID NO: 966862 - RNA, 19 nt, Homo sapiens
aagcauuguugcaagagaa

SEQ ID NO: 966863 - RNA, 19 nt, Homo sapiens
gagaagccuauaucacaga

SEQ ID NO: 966864 - RNA, 19 nt, Homo sapiens
cagcucauauggaagucuu

SEQ ID NO: 966865 - RNA, 19 nt, Homo sapiens
ccgguuagcuagaaguaca

SEQ ID NO: 966866 - RNA, 19 nt, Homo sapiens
agaacaagggaacauguaa

SEQ ID NO: 966867 - RNA, 19 nt, Homo sapiens
gcaugcaaguaccuguaau

SEQ ID NO: 966868 - RNA, 19 nt, Homo sapiens
caucuacuccacaccauug

SEQ ID NO: 966869 - RNA, 19 nt, Homo sapiens
ccacaugcuagucugauug

SEQ ID NO: 966870 - RNA, 19 nt, Homo sapiens
uaggaaacgccacaugcua

SEQ ID NO: 966871 - RNA, 19 nt, Homo sapiens
uaagaacaagggaacaugu

SEQ ID NO: 966872 - RNA, 19 nt, Homo sapiens
agagcacccuagaagguuu

SEQ ID NO: 966873 - RNA, 19 nt, Homo sapiens
cuugaaagcacacagaaga

SEQ ID NO: 966874 - RNA, 19 nt, Homo sapiens
cggaggagauggaaaauuc

SEQ ID NO: 966875 - RNA, 19 nt, Homo sapiens
aaucaccucuuccgccaau

SEQ ID NO: 966876 - RNA, 19 nt, Homo sapiens
ccagagcacccuagaaggu

SEQ ID NO: 966877 - RNA, 19 nt, Homo sapiens
ggaaacgccacaugcuagu

SEQ ID NO: 966878 - RNA, 19 nt, Homo sapiens
gggugcacauggaaguuug

SEQ ID NO: 966879 - RNA, 19 nt, Homo sapiens
auacccaucuaauuacaug

SEQ ID NO: 966880 - RNA, 19 nt, Homo sapiens
gguugagcaugccuucuuc

SEQ ID NO: 966881 - RNA, 19 nt, Homo sapiens
cuaaaagaaugcucauguu

SEQ ID NO: 966882 - RNA, 19 nt, Homo sapiens
cauauggucaguaguagau

SEQ ID NO: 966883 - RNA, 19 nt, Homo sapiens
gaccaucuugcccuccaua

SEQ ID NO: 966884 - RNA, 19 nt, Homo sapiens
ggaaguuugcucggucuga

SEQ ID NO: 966885 - RNA, 19 nt, Homo sapiens
ggccauggacccugucuca

SEQ ID NO: 966886 - RNA, 19 nt, Homo sapiens
gacuggagcccugacauug

SEQ ID NO: 966887 - RNA, 19 nt, Homo sapiens
ucaccucuuccgccaauuu

SEQ ID NO: 966888 - RNA, 19 nt, Homo sapiens
aagaacaagggaacaugua

SEQ ID NO: 966889 - RNA, 19 nt, Homo sapiens
ugaacuaacaagacauuuc

SEQ ID NO: 966890 - RNA, 19 nt, Homo sapiens
agaagccuauaucacagaa

SEQ ID NO: 966891 - RNA, 19 nt, Homo sapiens
caccagagcacccuagaag

SEQ ID NO: 966892 - RNA, 19 nt, Homo sapiens
aagcaaacccuucuuacag

SEQ ID NO: 966893 - RNA, 19 nt, Homo sapiens
cuaaagaaugugaacacuu

SEQ ID NO: 966894 - RNA, 19 nt, Homo sapiens
ucauacccaucuaauuaca

SEQ ID NO: 966895 - RNA, 19 nt, Homo sapiens
gggaagggugcacauggaa

SEQ ID NO: 966896 - RNA, 19 nt, Homo sapiens
ccacuugaaagcacacaga

SEQ ID NO: 966897 - RNA, 19 nt, Homo sapiens
cagauuauuauccugaaga

SEQ ID NO: 966898 - RNA, 19 nt, Homo sapiens
aaucauaugagaagccuau

SEQ ID NO: 966899 - RNA, 19 nt, Homo sapiens
agaaguacagccagauuuc

SEQ ID NO: 966900 - RNA, 19 nt, Homo sapiens
ugggaagggugcacaugga

SEQ ID NO: 966901 - RNA, 19 nt, Homo sapiens
gcaacuggauggauaauga

SEQ ID NO: 966902 - RNA, 19 nt, Homo sapiens
gagcauaaguuaaguaagu

SEQ ID NO: 966903 - RNA, 19 nt, Homo sapiens
gaagauggauuuaagacau

SEQ ID NO: 966904 - RNA, 19 nt, Homo sapiens
cagaagaggugugcaguuu

SEQ ID NO: 966905 - RNA, 19 nt, Homo sapiens
uuaagcaacuggauggaua

SEQ ID NO: 966906 - RNA, 19 nt, Homo sapiens
agaaacagaccaaggauaa

SEQ ID NO: 966907 - RNA, 19 nt, Homo sapiens
gauugggucucuccacauu

SEQ ID NO: 966908 - RNA, 19 nt, Homo sapiens
uaaacaggaugcugagaga

SEQ ID NO: 966909 - RNA, 19 nt, Homo sapiens
cagauuguaugugagaaua

SEQ ID NO: 966910 - RNA, 19 nt, Homo sapiens
ugacuaauaucacucagau

SEQ ID NO: 966911 - RNA, 19 nt, Homo sapiens
agacuggccuuacugacua

SEQ ID NO: 966912 - RNA, 19 nt, Homo sapiens
gaccaaggauaacuuucaa

SEQ ID NO: 966913 - RNA, 19 nt, Homo sapiens
ggaagggaaggauaagaaa

SEQ ID NO: 966914 - RNA, 19 nt, Homo sapiens
cgaaguagguaauaaacag

SEQ ID NO: 966915 - RNA, 19 nt, Homo sapiens
gaagauggagauucuaagu

SEQ ID NO: 966916 - RNA, 19 nt, Homo sapiens
gaagauucagaguucauuu

SEQ ID NO: 966917 - RNA, 19 nt, Homo sapiens
gugaccagcucuuggagaa

SEQ ID NO: 966918 - RNA, 19 nt, Homo sapiens
gaagaggugugcaguuucc

SEQ ID NO: 966919 - RNA, 19 nt, Homo sapiens
ggaggagacuggccuuacu

SEQ ID NO: 966920 - RNA, 19 nt, Homo sapiens
cauaccagagcauaaguua

SEQ ID NO: 966921 - RNA, 19 nt, Homo sapiens
guucauuucuaucuagguu

SEQ ID NO: 966922 - RNA, 19 nt, Homo sapiens
aaacuggguugacauuuac

SEQ ID NO: 966923 - RNA, 19 nt, Homo sapiens
cagaguucauuucuaucua

SEQ ID NO: 966924 - RNA, 19 nt, Homo sapiens
gauucagaguucauuucua

SEQ ID NO: 966925 - RNA, 19 nt, Homo sapiens
gaagcaaggccugaagaug

SEQ ID NO: 966926 - RNA, 19 nt, Homo sapiens
auauuggaguggagacuua

SEQ ID NO: 966927 - RNA, 19 nt, Homo sapiens
ugauggaaguggaagauuc

SEQ ID NO: 966928 - RNA, 19 nt, Homo sapiens
ccaaggauaacuuucaaau

SEQ ID NO: 966929 - RNA, 19 nt, Homo sapiens
ccaaaguacugggauuaca

SEQ ID NO: 966930 - RNA, 19 nt, Homo sapiens
acuaauaucacucagauug

SEQ ID NO: 966931 - RNA, 19 nt, Homo sapiens
agaagaacauaaacaggau

SEQ ID NO: 966932 - RNA, 19 nt, Homo sapiens
cagagcauaaguuaaguaa

SEQ ID NO: 966933 - RNA, 19 nt, Homo sapiens
cugagaagauggauuuaag

SEQ ID NO: 966934 - RNA, 19 nt, Homo sapiens
auaauaaacuggguugaca

SEQ ID NO: 966935 - RNA, 19 nt, Homo sapiens
gagaagcaaggccugaaga

SEQ ID NO: 966936 - RNA, 19 nt, Homo sapiens
cugcauuccucaaaguaaa

SEQ ID NO: 966937 - RNA, 19 nt, Homo sapiens
gcuaagaagaacauaaaca

SEQ ID NO: 966938 - RNA, 19 nt, Homo sapiens
ggaagauucagaguucauu

SEQ ID NO: 966939 - RNA, 19 nt, Homo sapiens
caaggauaacuuucaaaug

SEQ ID NO: 966940 - RNA, 19 nt, Homo sapiens
gcugagaagauggauuuaa

SEQ ID NO: 966941 - RNA, 19 nt, Homo sapiens
aguggaagauucagaguuc

SEQ ID NO: 966942 - RNA, 19 nt, Homo sapiens
caccgugccuggcugagaa

SEQ ID NO: 966943 - RNA, 19 nt, Homo sapiens
gagacauaccagagcauaa

SEQ ID NO: 966944 - RNA, 19 nt, Homo sapiens
gaugcuaagaagaacauaa

SEQ ID NO: 966945 - RNA, 19 nt, Homo sapiens
gaaaacgaaguagguaaua

SEQ ID NO: 966946 - RNA, 19 nt, Homo sapiens
uggcugagaagauggauuu

SEQ ID NO: 966947 - RNA, 19 nt, Homo sapiens
gauggaaguggaagauuca

SEQ ID NO: 966948 - RNA, 19 nt, Homo sapiens
gauguggaagggaaggaua

SEQ ID NO: 966949 - RNA, 19 nt, Homo sapiens
acaggaugcugagagauug

SEQ ID NO: 966950 - RNA, 19 nt, Homo sapiens
uggccuuacugacuaauau

SEQ ID NO: 966951 - RNA, 19 nt, Homo sapiens
ggaguggagacuuauuugu

SEQ ID NO: 966952 - RNA, 19 nt, Homo sapiens
uaccagagcauaaguuaag

SEQ ID NO: 966953 - RNA, 19 nt, Homo sapiens
acacugcauuccucaaagu

SEQ ID NO: 966954 - RNA, 19 nt, Homo sapiens
cuacacugcauuccucaaa

SEQ ID NO: 966955 - RNA, 19 nt, Homo sapiens
uaagcaacuggauggauaa

SEQ ID NO: 966956 - RNA, 19 nt, Homo sapiens
gaguggagacuuauuuguc

SEQ ID NO: 966957 - RNA, 19 nt, Homo sapiens
ccagagcauaaguuaagua

SEQ ID NO: 966958 - RNA, 19 nt, Homo sapiens
agaguucauuucuaucuag

SEQ ID NO: 966959 - RNA, 19 nt, Homo sapiens
auaagaaacagaccaagga

SEQ ID NO: 966960 - RNA, 19 nt, Homo sapiens
gugccuggcugagaagaug

SEQ ID NO: 966961 - RNA, 19 nt, Homo sapiens
gccugaagauggagauucu

SEQ ID NO: 966962 - RNA, 19 nt, Homo sapiens
gcccgagucugaugcuaag

SEQ ID NO: 966963 - RNA, 19 nt, Homo sapiens
gagaagauggauuuaagac

SEQ ID NO: 966964 - RNA, 19 nt, Homo sapiens
gagacuggccuuacugacu

SEQ ID NO: 966965 - RNA, 19 nt, Homo sapiens
ugagacauaccagagcaua

SEQ ID NO: 966966 - RNA, 19 nt, Homo sapiens
aagaaacagaccaaggaua

SEQ ID NO: 966967 - RNA, 19 nt, Homo sapiens
gaagggaaggauaagaaac

SEQ ID NO: 966968 - RNA, 19 nt, Homo sapiens
uggaagggaaggauaagaa

SEQ ID NO: 966969 - RNA, 19 nt, Homo sapiens
aauaaacuggguugacauu

SEQ ID NO: 966970 - RNA, 19 nt, Homo sapiens
agucugaugcuaagaagaa

SEQ ID NO: 966971 - RNA, 19 nt, Homo sapiens
ugagaagauggauuuaaga

SEQ ID NO: 966972 - RNA, 19 nt, Homo sapiens
ugaaggauuagauguggaa

SEQ ID NO: 966973 - RNA, 19 nt, Homo sapiens
ggguugacauuuaccaaaa

SEQ ID NO: 966974 - RNA, 19 nt, Homo sapiens
gacuggccuuacugacuaa

SEQ ID NO: 966975 - RNA, 19 nt, Homo sapiens
cugaagauggagauucuaa

SEQ ID NO: 966976 - RNA, 19 nt, Homo sapiens
cuaucuagguuaauuugag

SEQ ID NO: 966977 - RNA, 19 nt, Homo sapiens
cuaagaagaacauaaacag

SEQ ID NO: 966978 - RNA, 19 nt, Homo sapiens
agaccaaggauaacuuuca

SEQ ID NO: 966979 - RNA, 19 nt, Homo sapiens
ggagaagcaaggccugaag

SEQ ID NO: 966980 - RNA, 19 nt, Homo sapiens
cagcggaaagugaccagaa

SEQ ID NO: 966981 - RNA, 19 nt, Homo sapiens
gaaguggaagauucagagu

SEQ ID NO: 966982 - RNA, 19 nt, Homo sapiens
guaacauugucaggacuuc

SEQ ID NO: 966983 - RNA, 19 nt, Homo sapiens
ccagaagaggugugcaguu

SEQ ID NO: 966984 - RNA, 19 nt, Homo sapiens
gauaaugaugccacugagu

SEQ ID NO: 966985 - RNA, 19 nt, Homo sapiens
uaagaaacagaccaaggau

SEQ ID NO: 966986 - RNA, 19 nt, Homo sapiens
gaauaauaaacuggguuga

SEQ ID NO: 966987 - RNA, 19 nt, Homo sapiens
guagguaauaaacaggaaa

SEQ ID NO: 966988 - RNA, 19 nt, Homo sapiens
agcaaggccugaagaugga

SEQ ID NO: 966989 - RNA, 19 nt, Homo sapiens
cgagucugaugcuaagaag

SEQ ID NO: 966990 - RNA, 19 nt, Homo sapiens
ggaaaacgaaguagguaau

SEQ ID NO: 966991 - RNA, 19 nt, Homo sapiens
agacauauuuuggagguaa

SEQ ID NO: 966992 - RNA, 19 nt, Homo sapiens
acagaccaaggauaacuuu

SEQ ID NO: 966993 - RNA, 19 nt, Homo sapiens
gcggaaagugaccagaaga

SEQ ID NO: 966994 - RNA, 19 nt, Homo sapiens
caaaguacugggauuacag

SEQ ID NO: 966995 - RNA, 19 nt, Homo sapiens
uggauaaugaugccacuga

SEQ ID NO: 966996 - RNA, 19 nt, Homo sapiens
ucagaguucauuucuaucu

SEQ ID NO: 966997 - RNA, 19 nt, Homo sapiens
caacuggauggauaaugau

SEQ ID NO: 966998 - RNA, 19 nt, Homo sapiens
aacaggaugcugagagauu

SEQ ID NO: 966999 - RNA, 19 nt, Homo sapiens
gaggagacuggccuuacug

SEQ ID NO: 967000 - RNA, 19 nt, Homo sapiens
agacauaccagagcauaag

SEQ ID NO: 967001 - RNA, 19 nt, Homo sapiens
uaacauggaugcagaauaa

SEQ ID NO: 967002 - RNA, 19 nt, Homo sapiens
gagaaagccuugaauguga

SEQ ID NO: 967003 - RNA, 19 nt, Homo sapiens
gaacaucagagaauucaua

SEQ ID NO: 967004 - RNA, 19 nt, Homo sapiens
gaacaucagagaauucaua

SEQ ID NO: 967005 - RNA, 19 nt, Homo sapiens
auacaaggcuucauaauug

SEQ ID NO: 967006 - RNA, 19 nt, Homo sapiens
gaacauacucugcaucaaa

SEQ ID NO: 967007 - RNA, 19 nt, Homo sapiens
gagaaacccuuugaaugua

SEQ ID NO: 967008 - RNA, 19 nt, Homo sapiens
gggaaggccuuuauucuug

SEQ ID NO: 967009 - RNA, 19 nt, Homo sapiens
cuacacaacuuacauauca

SEQ ID NO: 967010 - RNA, 19 nt, Homo sapiens
gagagaagcccuacaaaug

SEQ ID NO: 967011 - RNA, 19 nt, Homo sapiens
caacauacaaggcuucaua

SEQ ID NO: 967012 - RNA, 19 nt, Homo sapiens
gacaaggccuuuauuuaug

SEQ ID NO: 967013 - RNA, 19 nt, Homo sapiens
gcaaacaacuuagugaaca

SEQ ID NO: 967014 - RNA, 19 nt, Homo sapiens
ggagagaaaccauaugauu

SEQ ID NO: 967015 - RNA, 19 nt, Homo sapiens
ugagaaaccuuaugagugu

SEQ ID NO: 967016 - RNA, 19 nt, Homo sapiens
ugagaaaccuuaugagugu

SEQ ID NO: 967017 - RNA, 19 nt, Homo sapiens
gagaaacccuaugaaugua

SEQ ID NO: 967018 - RNA, 19 nt, Homo sapiens
gagaaacccuaugaaugua

SEQ ID NO: 967019 - RNA, 19 nt, Homo sapiens
gaaugaacaucagagaauu

SEQ ID NO: 967020 - RNA, 19 nt, Homo sapiens
ggaaacguaucaaccauca

SEQ ID NO: 967021 - RNA, 19 nt, Homo sapiens
guacagggaugugauguug

SEQ ID NO: 967022 - RNA, 19 nt, Homo sapiens
ugacaaggccuuuauuuau

SEQ ID NO: 967023 - RNA, 19 nt, Homo sapiens
gaaacccuaugaauguaaa

SEQ ID NO: 967024 - RNA, 19 nt, Homo sapiens
uuucguggcucacaacuua

SEQ ID NO: 967025 - RNA, 19 nt, Homo sapiens
gcucugaaguuaagaaaca

SEQ ID NO: 967026 - RNA, 19 nt, Homo sapiens
gagaaacccuauacaugug

SEQ ID NO: 967027 - RNA, 19 nt, Homo sapiens
gagagaaacccuaugaaug

SEQ ID NO: 967028 - RNA, 19 nt, Homo sapiens
ugagagaccuuauaaaugc

SEQ ID NO: 967029 - RNA, 19 nt, Homo sapiens
gagagaaacccuaugaaug

SEQ ID NO: 967030 - RNA, 19 nt, Homo sapiens
gagagaaaccauaugauug

SEQ ID NO: 967031 - RNA, 19 nt, Homo sapiens
caacuuagagggucaagaa

SEQ ID NO: 967032 - RNA, 19 nt, Homo sapiens
gcucacaccuuacugaaca

SEQ ID NO: 967033 - RNA, 19 nt, Homo sapiens
auucuuggcucucaacuua

SEQ ID NO: 967034 - RNA, 19 nt, Homo sapiens
gagaaaccauaugauugua

SEQ ID NO: 967035 - RNA, 19 nt, Homo sapiens
caagcuauauucaacauca

SEQ ID NO: 967036 - RNA, 19 nt, Homo sapiens
uauccuaacugaaauccua

SEQ ID NO: 967037 - RNA, 19 nt, Homo sapiens
caacuuacuuaccaucaga

SEQ ID NO: 967038 - RNA, 19 nt, Homo sapiens
gaaagucauucaaccucuu

SEQ ID NO: 967039 - RNA, 19 nt, Homo sapiens
ggagagaaacccuaugaau

SEQ ID NO: 967040 - RNA, 19 nt, Homo sapiens
gugacaaggccuuuauuua

SEQ ID NO: 967041 - RNA, 19 nt, Homo sapiens
gaaaauucauggugagaaa

SEQ ID NO: 967042 - RNA, 19 nt, Homo sapiens
ggugagagaccuuauaaau

SEQ ID NO: 967043 - RNA, 19 nt, Homo sapiens
ggagagaaacccuaugaau

SEQ ID NO: 967044 - RNA, 19 nt, Homo sapiens
gaaaccauaugauuguaag

SEQ ID NO: 967045 - RNA, 19 nt, Homo sapiens
gauccauacuggugagaaa

SEQ ID NO: 967046 - RNA, 19 nt, Homo sapiens
ugagaaacccuuugaaugu

SEQ ID NO: 967047 - RNA, 19 nt, Homo sapiens
gcucacaacuuacuuacca

SEQ ID NO: 967048 - RNA, 19 nt, Homo sapiens
caccauauccuaacugaaa

SEQ ID NO: 967049 - RNA, 19 nt, Homo sapiens
ggaagggcuuuacaugugu

SEQ ID NO: 967050 - RNA, 19 nt, Homo sapiens
ggagugcaaaggcaacuua

SEQ ID NO: 967051 - RNA, 19 nt, Homo sapiens
ggagagaagcccuacaaau

SEQ ID NO: 967052 - RNA, 19 nt, Homo sapiens
gagacaauauggagugcaa

SEQ ID NO: 967053 - RNA, 19 nt, Homo sapiens
cauacaaggcuucauaauu

SEQ ID NO: 967054 - RNA, 19 nt, Homo sapiens
gaacaucagagaauucaca

SEQ ID NO: 967055 - RNA, 19 nt, Homo sapiens
auuuauggcucacaacuua

SEQ ID NO: 967056 - RNA, 19 nt, Homo sapiens
guuaagaaacacaggaaua

SEQ ID NO: 967057 - RNA, 19 nt, Homo sapiens
gcuagaauauaaugcugaa

SEQ ID NO: 967058 - RNA, 19 nt, Homo sapiens
aaacacaggaauaccuuua

SEQ ID NO: 967059 - RNA, 19 nt, Homo sapiens
ucagggauguggccauuga

SEQ ID NO: 967060 - RNA, 19 nt, Homo sapiens
agaaacccuuugaauguaa

SEQ ID NO: 967061 - RNA, 19 nt, Homo sapiens
acagcaaccugaucucauu

SEQ ID NO: 967062 - RNA, 19 nt, Homo sapiens
ugagaaacccuauacaugu

SEQ ID NO: 967063 - RNA, 19 nt, Homo sapiens
agagaaacccuaugaaugu

SEQ ID NO: 967064 - RNA, 19 nt, Homo sapiens
agagaaacccuaugaaugu

SEQ ID NO: 967065 - RNA, 19 nt, Homo sapiens
uagaaggccuacauuaaca

SEQ ID NO: 967066 - RNA, 19 nt, Homo sapiens
auucguggcucacaccuua

SEQ ID NO: 967067 - RNA, 19 nt, Homo sapiens
gcucucaacuuacuuacca

SEQ ID NO: 967068 - RNA, 19 nt, Homo sapiens
caucagagaauucauagug

SEQ ID NO: 967069 - RNA, 19 nt, Homo sapiens
gggaugugauguuggagaa

SEQ ID NO: 967070 - RNA, 19 nt, Homo sapiens
caucagagaauucauagug

SEQ ID NO: 967071 - RNA, 19 nt, Homo sapiens
caacaucagagaauucaga

SEQ ID NO: 967072 - RNA, 19 nt, Homo sapiens
ucagaaaccccuuaaauaa

SEQ ID NO: 967073 - RNA, 19 nt, Homo sapiens
gaacucauacuggagagaa

SEQ ID NO: 967074 - RNA, 19 nt, Homo sapiens
guacgugcuacacaacuua

SEQ ID NO: 967075 - RNA, 19 nt, Homo sapiens
uugcauaucuuacucaaca

SEQ ID NO: 967076 - RNA, 19 nt, Homo sapiens
ugaaaagccuuacauaugu

SEQ ID NO: 967077 - RNA, 19 nt, Homo sapiens
guucacaccuuacauacca

SEQ ID NO: 967078 - RNA, 19 nt, Homo sapiens
ucaauacaauggucuugga

SEQ ID NO: 967079 - RNA, 19 nt, Homo sapiens
agucguggcucagaacaua

SEQ ID NO: 967080 - RNA, 19 nt, Homo sapiens
gaaacccuaugaauguaag

SEQ ID NO: 967081 - RNA, 19 nt, Homo sapiens
ugucaugccuuauucaaca

SEQ ID NO: 967082 - RNA, 19 nt, Homo sapiens
gcagacaagguuucagcua

SEQ ID NO: 967083 - RNA, 19 nt, Homo sapiens
gugagaaacccuauacaug

SEQ ID NO: 967084 - RNA, 19 nt, Homo sapiens
ugacuucucucaggaggaa

SEQ ID NO: 967085 - RNA, 19 nt, Homo sapiens
gugagaaacccuuugaaug

SEQ ID NO: 967086 - RNA, 19 nt, Homo sapiens
ugaaugaacaucagagaau

SEQ ID NO: 967087 - RNA, 19 nt, Homo sapiens
cauggaugcagaauaauuu

SEQ ID NO: 967088 - RNA, 19 nt, Homo sapiens
cuuagaaggccuacauuaa

SEQ ID NO: 967089 - RNA, 19 nt, Homo sapiens
ucacaacuuacucaacaua

SEQ ID NO: 967090 - RNA, 19 nt, Homo sapiens
agauguccuucacaacuua

SEQ ID NO: 967091 - RNA, 19 nt, Homo sapiens
gugagagaccuuauaaaug

SEQ ID NO: 967092 - RNA, 19 nt, Homo sapiens
gagaaaccuuaugagugua

SEQ ID NO: 967093 - RNA, 19 nt, Homo sapiens
caauauacucuucaucaga

SEQ ID NO: 967094 - RNA, 19 nt, Homo sapiens
cuucugaucucauucaaca

SEQ ID NO: 967095 - RNA, 19 nt, Homo sapiens
gagaaaccuuaugagugua

SEQ ID NO: 967096 - RNA, 19 nt, Homo sapiens
aggaagggcuuuacaugug

SEQ ID NO: 967097 - RNA, 19 nt, Homo sapiens
uaucaaccaucaccuucaa

SEQ ID NO: 967098 - RNA, 19 nt, Homo sapiens
caacuuacucaacauacaa

SEQ ID NO: 967099 - RNA, 19 nt, Homo sapiens
gagaagaacccagaaaauu

SEQ ID NO: 967100 - RNA, 19 nt, Homo sapiens
gaagaacccagaaaauuga

SEQ ID NO: 967101 - RNA, 19 nt, Homo sapiens
gaacuagucucacaacuug

SEQ ID NO: 967102 - RNA, 19 nt, Homo sapiens
gaacuuagcugcaaaauau

SEQ ID NO: 967103 - RNA, 19 nt, Homo sapiens
gggaaaagcuguauuauaa

SEQ ID NO: 967104 - RNA, 19 nt, Homo sapiens
uaagugagauggugucuaa

SEQ ID NO: 967105 - RNA, 19 nt, Homo sapiens
ccaaagagcaucuaccuua

SEQ ID NO: 967106 - RNA, 19 nt, Homo sapiens
ccaaauuucugaagaguaa

SEQ ID NO: 967107 - RNA, 19 nt, Homo sapiens
ggagccagcugcaguagua

SEQ ID NO: 967108 - RNA, 19 nt, Homo sapiens
ggacaucccuucuucuaug

SEQ ID NO: 967109 - RNA, 19 nt, Homo sapiens
gagcauuccuuuaugauau

SEQ ID NO: 967110 - RNA, 19 nt, Homo sapiens
uccaacaccuucauuauua

SEQ ID NO: 967111 - RNA, 19 nt, Homo sapiens
cgucagcucuguaauuaua

SEQ ID NO: 967112 - RNA, 19 nt, Homo sapiens
gcaaaggguuccuguacuu

SEQ ID NO: 967113 - RNA, 19 nt, Homo sapiens
gcacuaacuucaugcagaa

SEQ ID NO: 967114 - RNA, 19 nt, Homo sapiens
cuaaauaccuggcaacaau

SEQ ID NO: 967115 - RNA, 19 nt, Homo sapiens
gaauguagaagucauauga

SEQ ID NO: 967116 - RNA, 19 nt, Homo sapiens
ggacucaaaugcaaacaga

SEQ ID NO: 967117 - RNA, 19 nt, Homo sapiens
uaucucagcugucaauauu

SEQ ID NO: 967118 - RNA, 19 nt, Homo sapiens
ucacagacaucuaugcauu

SEQ ID NO: 967119 - RNA, 19 nt, Homo sapiens
gaaagcagagucuauaaau

SEQ ID NO: 967120 - RNA, 19 nt, Homo sapiens
agccugagcuugauucuua

SEQ ID NO: 967121 - RNA, 19 nt, Homo sapiens
ccauauaccacuucauuua

SEQ ID NO: 967122 - RNA, 19 nt, Homo sapiens
caagauugauuguaccaaa

SEQ ID NO: 967123 - RNA, 19 nt, Homo sapiens
gauugcacaucauucuuua

SEQ ID NO: 967124 - RNA, 19 nt, Homo sapiens
gaaaugaguuuuacaagga

SEQ ID NO: 967125 - RNA, 19 nt, Homo sapiens
gcaucuaccuuaccuccua

SEQ ID NO: 967126 - RNA, 19 nt, Homo sapiens
ggagaaggcauuaaugaga

SEQ ID NO: 967127 - RNA, 19 nt, Homo sapiens
ccuauaaacuaguaccuaa

SEQ ID NO: 967128 - RNA, 19 nt, Homo sapiens
acagcuagcagaauaauua

SEQ ID NO: 967129 - RNA, 19 nt, Homo sapiens
aguaacagcuagcagaaua

SEQ ID NO: 967130 - RNA, 19 nt, Homo sapiens
ccauaucgauugccaaaga

SEQ ID NO: 967131 - RNA, 19 nt, Homo sapiens
gagaaggcauuaaugagau

SEQ ID NO: 967132 - RNA, 19 nt, Homo sapiens
guucguacuucucauaauu

SEQ ID NO: 967133 - RNA, 19 nt, Homo sapiens
uuagaaagguggagcugua

SEQ ID NO: 967134 - RNA, 19 nt, Homo sapiens
gaucugcaauggaaagguu

SEQ ID NO: 967135 - RNA, 19 nt, Homo sapiens
caauaaagcguaucggaaa

SEQ ID NO: 967136 - RNA, 19 nt, Homo sapiens
aaugaacucuuugcucuua

SEQ ID NO: 967137 - RNA, 19 nt, Homo sapiens
guacuucucauaauuggua

SEQ ID NO: 967138 - RNA, 19 nt, Homo sapiens
uaaccuaccuaagcacuuu

SEQ ID NO: 967139 - RNA, 19 nt, Homo sapiens
agaaaucccuggaggcauu

SEQ ID NO: 967140 - RNA, 19 nt, Homo sapiens
ucucacaacuugacucauu

SEQ ID NO: 967141 - RNA, 19 nt, Homo sapiens
caaacagacuuucccuaga

SEQ ID NO: 967142 - RNA, 19 nt, Homo sapiens
aaacagagugucauaugua

SEQ ID NO: 967143 - RNA, 19 nt, Homo sapiens
ccagagcguugcuuuauca

SEQ ID NO: 967144 - RNA, 19 nt, Homo sapiens
cagcaaaguuggccucuuc

SEQ ID NO: 967145 - RNA, 19 nt, Homo sapiens
gugauacaguucugaauug

SEQ ID NO: 967146 - RNA, 19 nt, Homo sapiens
ggacaguguugguuagcuu

SEQ ID NO: 967147 - RNA, 19 nt, Homo sapiens
ugaaagauagccagaguaa

SEQ ID NO: 967148 - RNA, 19 nt, Homo sapiens
gggcaagcuugaugcagua

SEQ ID NO: 967149 - RNA, 19 nt, Homo sapiens
ggugugaccuuacagacaa

SEQ ID NO: 967150 - RNA, 19 nt, Homo sapiens
uaaacagagugucauaugu

SEQ ID NO: 967151 - RNA, 19 nt, Homo sapiens
aacgagcagugcaauauua

SEQ ID NO: 967152 - RNA, 19 nt, Homo sapiens
ccaacaccuucauuauuaa

SEQ ID NO: 967153 - RNA, 19 nt, Homo sapiens
gaaaccagagcguugcuuu

SEQ ID NO: 967154 - RNA, 19 nt, Homo sapiens
gaaacuugcugugcuucuu

SEQ ID NO: 967155 - RNA, 19 nt, Homo sapiens
cagagugucauauguauuu

SEQ ID NO: 967156 - RNA, 19 nt, Homo sapiens
gugcgcgucuuacaacuaa

SEQ ID NO: 967157 - RNA, 19 nt, Homo sapiens
ggaccuaaauuuugcuuaa

SEQ ID NO: 967158 - RNA, 19 nt, Homo sapiens
gaaauaguaaagacaguug

SEQ ID NO: 967159 - RNA, 19 nt, Homo sapiens
gaaacgcccuaccaccaau

SEQ ID NO: 967160 - RNA, 19 nt, Homo sapiens
gaauuucacagacaucuau

SEQ ID NO: 967161 - RNA, 19 nt, Homo sapiens
gcagaauucgaaauaguaa

SEQ ID NO: 967162 - RNA, 19 nt, Homo sapiens
ucuaugagguucgaaauga

SEQ ID NO: 967163 - RNA, 19 nt, Homo sapiens
gacagagaaaucaaaguua

SEQ ID NO: 967164 - RNA, 19 nt, Homo sapiens
guaaacagagugucauaug

SEQ ID NO: 967165 - RNA, 19 nt, Homo sapiens
aagcagagucuauaaauga

SEQ ID NO: 967166 - RNA, 19 nt, Homo sapiens
ccaucaagcuuacucugaa

SEQ ID NO: 967167 - RNA, 19 nt, Homo sapiens
gcacagaugagcaauuaca

SEQ ID NO: 967168 - RNA, 19 nt, Homo sapiens
gagcuugucuucaggaaac

SEQ ID NO: 967169 - RNA, 19 nt, Homo sapiens
aaagauagccagaguaagu

SEQ ID NO: 967170 - RNA, 19 nt, Homo sapiens
gcagaauguagaagucaua

SEQ ID NO: 967171 - RNA, 19 nt, Homo sapiens
ugaaagcacucagacaugu

SEQ ID NO: 967172 - RNA, 19 nt, Homo sapiens
gccuuuaacuggcuucuga

SEQ ID NO: 967173 - RNA, 19 nt, Homo sapiens
caagggaugaagucaauaa

SEQ ID NO: 967174 - RNA, 19 nt, Homo sapiens
uaccaaacaucgcugugua

SEQ ID NO: 967175 - RNA, 19 nt, Homo sapiens
gaacaaugacaacaucaca

SEQ ID NO: 967176 - RNA, 19 nt, Homo sapiens
agauaaggcagcuaaauuu

SEQ ID NO: 967177 - RNA, 19 nt, Homo sapiens
caucauucuuuaaggcaua

SEQ ID NO: 967178 - RNA, 19 nt, Homo sapiens
caucauuucucuccucuag

SEQ ID NO: 967179 - RNA, 19 nt, Homo sapiens
acagacaaguugcugcuuu

SEQ ID NO: 967180 - RNA, 19 nt, Homo sapiens
guuaacaucuuugauaugg

SEQ ID NO: 967181 - RNA, 19 nt, Homo sapiens
aaacagacuuucccuagag

SEQ ID NO: 967182 - RNA, 19 nt, Homo sapiens
uggcagaaaugaagcaaga

SEQ ID NO: 967183 - RNA, 19 nt, Homo sapiens
acagacaucuaugcauuaa

SEQ ID NO: 967184 - RNA, 19 nt, Homo sapiens
acccaucgaucuauaauga

SEQ ID NO: 967185 - RNA, 19 nt, Homo sapiens
guaauucagguacccauuu

SEQ ID NO: 967186 - RNA, 19 nt, Homo sapiens
gcagaugccauucgcagaa

SEQ ID NO: 967187 - RNA, 19 nt, Homo sapiens
ggacgucuuugggcugaaa

SEQ ID NO: 967188 - RNA, 19 nt, Homo sapiens
uaaggcagcuaaauuucug

SEQ ID NO: 967189 - RNA, 19 nt, Homo sapiens
ucaggaaacuuacucuagu

SEQ ID NO: 967190 - RNA, 19 nt, Homo sapiens
cuaacuucaugcagaauuu

SEQ ID NO: 967191 - RNA, 19 nt, Homo sapiens
ggccauauaccacuucauu

SEQ ID NO: 967192 - RNA, 19 nt, Homo sapiens
aaauuuagccugagcuuga

SEQ ID NO: 967193 - RNA, 19 nt, Homo sapiens
ugugugaguuggugaaauu

SEQ ID NO: 967194 - RNA, 19 nt, Homo sapiens
gagacaggaggauugcuua

SEQ ID NO: 967195 - RNA, 19 nt, Homo sapiens
gaagcaaacaacaucagaa

SEQ ID NO: 967196 - RNA, 19 nt, Homo sapiens
aagaggacccuuucacuuu

SEQ ID NO: 967197 - RNA, 19 nt, Homo sapiens
uagauaaggcagcuaaauu

SEQ ID NO: 967198 - RNA, 19 nt, Homo sapiens
caaagagcaucuaccuuac

SEQ ID NO: 967199 - RNA, 19 nt, Homo sapiens
gggaggaaucucuguaauu

SEQ ID NO: 967200 - RNA, 19 nt, Homo sapiens
gcaguaguauccgccugua

SEQ ID NO: 967201 - RNA, 19 nt, Homo sapiens
gcaucaagcugcauaagaa

SEQ ID NO: 967202 - RNA, 19 nt, Homo sapiens
ggaaagaccuuaugguuuu

SEQ ID NO: 967203 - RNA, 19 nt, Homo sapiens
gaacguggcuaaccucauc

SEQ ID NO: 967204 - RNA, 19 nt, Homo sapiens
gcacagacuuggauuccuu

SEQ ID NO: 967205 - RNA, 19 nt, Homo sapiens
ggaagcagauggaguucaa

SEQ ID NO: 967206 - RNA, 19 nt, Homo sapiens
ggaagaggacgaucguuaa

SEQ ID NO: 967207 - RNA, 19 nt, Homo sapiens
gaagaaacguuuauauccu

SEQ ID NO: 967208 - RNA, 19 nt, Homo sapiens
gggagggacuuuacaccua

SEQ ID NO: 967209 - RNA, 19 nt, Homo sapiens
agacuuggauuccuucugu

SEQ ID NO: 967210 - RNA, 19 nt, Homo sapiens
gggcgcaucuggcuuaucu

SEQ ID NO: 967211 - RNA, 19 nt, Homo sapiens
ggaagcggcuaaaagguuu

SEQ ID NO: 967212 - RNA, 19 nt, Homo sapiens
uggaagaggacgaucguua

SEQ ID NO: 967213 - RNA, 19 nt, Homo sapiens
caucuucgguuccaguuuc

SEQ ID NO: 967214 - RNA, 19 nt, Homo sapiens
aaacguuuauauccuguga

SEQ ID NO: 967215 - RNA, 19 nt, Homo sapiens
agaggacgaucguuaacuu

SEQ ID NO: 967216 - RNA, 19 nt, Homo sapiens
guggaaagaccuuaugguu

SEQ ID NO: 967217 - RNA, 19 nt, Homo sapiens
gaaguggaaagaccuuaug

SEQ ID NO: 967218 - RNA, 19 nt, Homo sapiens
guucaagcuuggaaauaau

SEQ ID NO: 967219 - RNA, 19 nt, Homo sapiens
guguaugucuguguaugua

SEQ ID NO: 967220 - RNA, 19 nt, Homo sapiens
uggaaagaccuuaugguuu

SEQ ID NO: 967221 - RNA, 19 nt, Homo sapiens
gaagaguucaagcuuggaa

SEQ ID NO: 967222 - RNA, 19 nt, Homo sapiens
uauguaaguuugucuugug

SEQ ID NO: 967223 - RNA, 19 nt, Homo sapiens
aguucaagcuuggaaauaa

SEQ ID NO: 967224 - RNA, 19 nt, Homo sapiens
ccaccuuucucucccaaug

SEQ ID NO: 967225 - RNA, 19 nt, Homo sapiens
uccagucuuuguuguauaa

SEQ ID NO: 967226 - RNA, 19 nt, Homo sapiens
gcuuggaaauaauggaguu

SEQ ID NO: 967227 - RNA, 19 nt, Homo sapiens
uaaugagaguuuacagaca

SEQ ID NO: 967228 - RNA, 19 nt, Homo sapiens
gaguucaagcuuggaaaua

SEQ ID NO: 967229 - RNA, 19 nt, Homo sapiens
ccaaugaagaaacguuuau

SEQ ID NO: 967230 - RNA, 19 nt, Homo sapiens
gggaaguugucuuguuugg

SEQ ID NO: 967231 - RNA, 19 nt, Homo sapiens
gagagggauuuagccaaga

SEQ ID NO: 967232 - RNA, 19 nt, Homo sapiens
gaggacgaucguuaacuuu

SEQ ID NO: 967233 - RNA, 19 nt, Homo sapiens
gaaguacuacacagugcuu

SEQ ID NO: 967234 - RNA, 19 nt, Homo sapiens
ggacgaucguuaacuuuug

SEQ ID NO: 967235 - RNA, 19 nt, Homo sapiens
uauuaacgguccuuugcuu

SEQ ID NO: 967236 - RNA, 19 nt, Homo sapiens
guauguaaguuugucuugu

SEQ ID NO: 967237 - RNA, 19 nt, Homo sapiens
ggagaaggaagcggcuaaa

SEQ ID NO: 967238 - RNA, 19 nt, Homo sapiens
gaagaggacgaucguuaac

SEQ ID NO: 967239 - RNA, 19 nt, Homo sapiens
uggcuaaccucaucagcau

SEQ ID NO: 967240 - RNA, 19 nt, Homo sapiens
guuuguguaugucugugua

SEQ ID NO: 967241 - RNA, 19 nt, Homo sapiens
acagaagcccgaaguggaa

SEQ ID NO: 967242 - RNA, 19 nt, Homo sapiens
ugaagaaacguuuauaucc

SEQ ID NO: 967243 - RNA, 19 nt, Homo sapiens
guuuauauccugugauuac

SEQ ID NO: 967244 - RNA, 19 nt, Homo sapiens
acguuuauauccugugauu

SEQ ID NO: 967245 - RNA, 19 nt, Homo sapiens
aaguuugucuuguggcauu

SEQ ID NO: 967246 - RNA, 19 nt, Homo sapiens
gaaggaagcggcuaaaagg

SEQ ID NO: 967247 - RNA, 19 nt, Homo sapiens
guaugucuguguauguaag

SEQ ID NO: 967248 - RNA, 19 nt, Homo sapiens
ggcaucaagcugcauaaga

SEQ ID NO: 967249 - RNA, 19 nt, Homo sapiens
cuccuucguuguauugauu

SEQ ID NO: 967250 - RNA, 19 nt, Homo sapiens
uaaaagcucuaggucagaa

SEQ ID NO: 967251 - RNA, 19 nt, Homo sapiens
cuaagacgagagggauuua

SEQ ID NO: 967252 - RNA, 19 nt, Homo sapiens
auaagccggugcugagaga

SEQ ID NO: 967253 - RNA, 19 nt, Homo sapiens
gaaagaccuuaugguuuug

SEQ ID NO: 967254 - RNA, 19 nt, Homo sapiens
guacuacacagugcuuuua

SEQ ID NO: 967255 - RNA, 19 nt, Homo sapiens
cuuguggcauuaagacuau

SEQ ID NO: 967256 - RNA, 19 nt, Homo sapiens
ccuaagacgagagggauuu

SEQ ID NO: 967257 - RNA, 19 nt, Homo sapiens
cgaaguggaaagaccuuau

SEQ ID NO: 967258 - RNA, 19 nt, Homo sapiens
ugugauuacucuaggaaag

SEQ ID NO: 967259 - RNA, 19 nt, Homo sapiens
uauauccugugauuacucu

SEQ ID NO: 967260 - RNA, 19 nt, Homo sapiens
gcgcgucaccagagucguu

SEQ ID NO: 967261 - RNA, 19 nt, Homo sapiens
ugucuuguuuggagagguu

SEQ ID NO: 967262 - RNA, 19 nt, Homo sapiens
cacagaagaguucaagcuu

SEQ ID NO: 967263 - RNA, 19 nt, Homo sapiens
cccguucccucccaauuuc

SEQ ID NO: 967264 - RNA, 19 nt, Homo sapiens
ucacagaagaguucaagcu

SEQ ID NO: 967265 - RNA, 19 nt, Homo sapiens
cggggaaguugucuuguuu

SEQ ID NO: 967266 - RNA, 19 nt, Homo sapiens
ggaaguugucuuguuugga

SEQ ID NO: 967267 - RNA, 19 nt, Homo sapiens
gaagcccgaaguggaaaga

SEQ ID NO: 967268 - RNA, 19 nt, Homo sapiens
cccaaugaagaaacguuua

SEQ ID NO: 967269 - RNA, 19 nt, Homo sapiens
gcuaaccucaucagcaucu

SEQ ID NO: 967270 - RNA, 19 nt, Homo sapiens
guaacuucuacgugucuaa

SEQ ID NO: 967271 - RNA, 19 nt, Homo sapiens
acuccagucuuuguuguau

SEQ ID NO: 967272 - RNA, 19 nt, Homo sapiens
cuccagucuuuguuguaua

SEQ ID NO: 967273 - RNA, 19 nt, Homo sapiens
cuaggaaaggggcguauua

SEQ ID NO: 967274 - RNA, 19 nt, Homo sapiens
gucuguguauguaaguuug

SEQ ID NO: 967275 - RNA, 19 nt, Homo sapiens
gaagagagguaauuuguua

SEQ ID NO: 967276 - RNA, 19 nt, Homo sapiens
gagaugggcuggcuaacua

SEQ ID NO: 967277 - RNA, 19 nt, Homo sapiens
gaacaagacugcccaccuu

SEQ ID NO: 967278 - RNA, 19 nt, Homo sapiens
gcuccaagaugcaauuaua

SEQ ID NO: 967279 - RNA, 19 nt, Homo sapiens
gacaauauguucuguguug

SEQ ID NO: 967280 - RNA, 19 nt, Homo sapiens
gagaagcccucacuccaaa

SEQ ID NO: 967281 - RNA, 19 nt, Homo sapiens
caaaggauguguuauuauc

SEQ ID NO: 967282 - RNA, 19 nt, Homo sapiens
gcaaugaugcacacuuaua

SEQ ID NO: 967283 - RNA, 19 nt, Homo sapiens
gcuauauggucaaagguua

SEQ ID NO: 967284 - RNA, 19 nt, Homo sapiens
gcacuggacugaaguucuu

SEQ ID NO: 967285 - RNA, 19 nt, Homo sapiens
gaaugagucccauaacuuu

SEQ ID NO: 967286 - RNA, 19 nt, Homo sapiens
caacaacuuucgccuugaa

SEQ ID NO: 967287 - RNA, 19 nt, Homo sapiens
ccagagggcuuugcuguga

SEQ ID NO: 967288 - RNA, 19 nt, Homo sapiens
gagaagagagguaauuugu

SEQ ID NO: 967289 - RNA, 19 nt, Homo sapiens
ugcaaaggauguguuauua

SEQ ID NO: 967290 - RNA, 19 nt, Homo sapiens
gaguugaaguccagccuaa

SEQ ID NO: 967291 - RNA, 19 nt, Homo sapiens
gagccaagcugggcaacuu

SEQ ID NO: 967292 - RNA, 19 nt, Homo sapiens
aaauacaacuguucaaugg

SEQ ID NO: 967293 - RNA, 19 nt, Homo sapiens
uggcaagccuucaccagua

SEQ ID NO: 967294 - RNA, 19 nt, Homo sapiens
gaggugauuuacagugaaa

SEQ ID NO: 967295 - RNA, 19 nt, Homo sapiens
gcaccaagccacugcaaga

SEQ ID NO: 967296 - RNA, 19 nt, Homo sapiens
ggaggagguucuucagugu

SEQ ID NO: 967297 - RNA, 19 nt, Homo sapiens
gccaggagcccuauuauca

SEQ ID NO: 967298 - RNA, 19 nt, Homo sapiens
ccucuaaccugcuguguca

SEQ ID NO: 967299 - RNA, 19 nt, Homo sapiens
ccagugugcugcaauacuu

SEQ ID NO: 967300 - RNA, 19 nt, Homo sapiens
ccaagccacugcaagagaa

SEQ ID NO: 967301 - RNA, 19 nt, Homo sapiens
gagagaagagagguaauuu

SEQ ID NO: 967302 - RNA, 19 nt, Homo sapiens
aggaccaacucuuuaauuu

SEQ ID NO: 967303 - RNA, 19 nt, Homo sapiens
gcaaaggauguguuauuau

SEQ ID NO: 967304 - RNA, 19 nt, Homo sapiens
ugacaaaugaggaaacuga

SEQ ID NO: 967305 - RNA, 19 nt, Homo sapiens
aaaggcaggugcaaugaug

SEQ ID NO: 967306 - RNA, 19 nt, Homo sapiens
aaagauuggaggugauuua

SEQ ID NO: 967307 - RNA, 19 nt, Homo sapiens
caacgcaccuggagacaac

SEQ ID NO: 967308 - RNA, 19 nt, Homo sapiens
ggaggugauuuacagugaa

SEQ ID NO: 967309 - RNA, 19 nt, Homo sapiens
gguaugacuucuacaccaa

SEQ ID NO: 967310 - RNA, 19 nt, Homo sapiens
uagaugagaugcugaaacu

SEQ ID NO: 967311 - RNA, 19 nt, Homo sapiens
auacaacuguucaauggaa

SEQ ID NO: 967312 - RNA, 19 nt, Homo sapiens
gaggaccaacucuuuaauu

SEQ ID NO: 967313 - RNA, 19 nt, Homo sapiens
ccaaggugcucagcuaugu

SEQ ID NO: 967314 - RNA, 19 nt, Homo sapiens
gcucacacuuuccuaaugg

SEQ ID NO: 967315 - RNA, 19 nt, Homo sapiens
gauaagauuuuggcuguuu

SEQ ID NO: 967316 - RNA, 19 nt, Homo sapiens
gauuggaggugauuuacag

SEQ ID NO: 967317 - RNA, 19 nt, Homo sapiens
ggaagcagagucccacaga

SEQ ID NO: 967318 - RNA, 19 nt, Homo sapiens
gaaccagagugugaaugug

SEQ ID NO: 967319 - RNA, 19 nt, Homo sapiens
ggaaauccuauucacauca

SEQ ID NO: 967320 - RNA, 19 nt, Homo sapiens
gauuuuggcuguuugguuu

SEQ ID NO: 967321 - RNA, 19 nt, Homo sapiens
gcaggagaaucacuugaac

SEQ ID NO: 967322 - RNA, 19 nt, Homo sapiens
gaaaccccaucucuacuaa

SEQ ID NO: 967323 - RNA, 19 nt, Homo sapiens
gggaaauccuauucacauc

SEQ ID NO: 967324 - RNA, 19 nt, Homo sapiens
ucaagggagugaugaaugg

SEQ ID NO: 967325 - RNA, 19 nt, Homo sapiens
ggucagagggaguuuguau

SEQ ID NO: 967326 - RNA, 19 nt, Homo sapiens
ggacagaccaagacuucau

SEQ ID NO: 967327 - RNA, 19 nt, Homo sapiens
gaaauccuauucacaucac

SEQ ID NO: 967328 - RNA, 19 nt, Homo sapiens
ggacaguggcagcgucuau

SEQ ID NO: 967329 - RNA, 19 nt, Homo sapiens
cagaaugagucccauaacu

SEQ ID NO: 967330 - RNA, 19 nt, Homo sapiens
ggaagaaccagagugugaa

SEQ ID NO: 967331 - RNA, 19 nt, Homo sapiens
acuauucucuauuggcuaa

SEQ ID NO: 967332 - RNA, 19 nt, Homo sapiens
gagucaaguugcuauaugg

SEQ ID NO: 967333 - RNA, 19 nt, Homo sapiens
caacuguucaauggaaaua

SEQ ID NO: 967334 - RNA, 19 nt, Homo sapiens
gauucaaaguuguacauac

SEQ ID NO: 967335 - RNA, 19 nt, Homo sapiens
aaagagagaagagagguaa

SEQ ID NO: 967336 - RNA, 19 nt, Homo sapiens
ccaagaugcaauuauagaa

SEQ ID NO: 967337 - RNA, 19 nt, Homo sapiens
gcagggaaauccuauucac

SEQ ID NO: 967338 - RNA, 19 nt, Homo sapiens
ggcaagccuucaccaguau

SEQ ID NO: 967339 - RNA, 19 nt, Homo sapiens
acagagacccgagguguuu

SEQ ID NO: 967340 - RNA, 19 nt, Homo sapiens
gaagaaccagagugugaau

SEQ ID NO: 967341 - RNA, 19 nt, Homo sapiens
agagucaaguugcuauaug

SEQ ID NO: 967342 - RNA, 19 nt, Homo sapiens
caagagucaaguugcuaua

SEQ ID NO: 967343 - RNA, 19 nt, Homo sapiens
acagugaaagacacaaaua

SEQ ID NO: 967344 - RNA, 19 nt, Homo sapiens
caccuguuauuucacuuaa

SEQ ID NO: 967345 - RNA, 19 nt, Homo sapiens
guacaucucaacaacuuuc

SEQ ID NO: 967346 - RNA, 19 nt, Homo sapiens
ccaguucuguggucagcaa

SEQ ID NO: 967347 - RNA, 19 nt, Homo sapiens
cagugaaagacacaaauaa

SEQ ID NO: 967348 - RNA, 19 nt, Homo sapiens
uggaggugauuuacaguga

SEQ ID NO: 967349 - RNA, 19 nt, Homo sapiens
ccucauaccauauuugcaa

SEQ ID NO: 967350 - RNA, 19 nt, Homo sapiens
ccuguuauuucacuuaauc

SEQ ID NO: 967351 - RNA, 19 nt, Homo sapiens
ugacacagcuuuuauacuc

SEQ ID NO: 967352 - RNA, 19 nt, Homo sapiens
caacuuucgccuugaaugu

SEQ ID NO: 967353 - RNA, 19 nt, Homo sapiens
agaaugagucccauaacuu

SEQ ID NO: 967354 - RNA, 19 nt, Homo sapiens
gagugugaauguguucuug

SEQ ID NO: 967355 - RNA, 19 nt, Homo sapiens
ggauucaaaguuguacaua

SEQ ID NO: 967356 - RNA, 19 nt, Homo sapiens
ggaagccuguacaucucaa

SEQ ID NO: 967357 - RNA, 19 nt, Homo sapiens
guaauuuguuagcaucaag

SEQ ID NO: 967358 - RNA, 19 nt, Homo sapiens
gguaauuuguuagcaucaa

SEQ ID NO: 967359 - RNA, 19 nt, Homo sapiens
gcggacagaccaagacuuc

SEQ ID NO: 967360 - RNA, 19 nt, Homo sapiens
uaccauauuugcaaaggau

SEQ ID NO: 967361 - RNA, 19 nt, Homo sapiens
cuacucacccgcuauuaga

SEQ ID NO: 967362 - RNA, 19 nt, Homo sapiens
gaggagguucuucagugua

SEQ ID NO: 967363 - RNA, 19 nt, Homo sapiens
gagcagcacggacaucaag

SEQ ID NO: 967364 - RNA, 19 nt, Homo sapiens
gagacaacccugccaaggu

SEQ ID NO: 967365 - RNA, 19 nt, Homo sapiens
gugcuucaccuguuauuuc

SEQ ID NO: 967366 - RNA, 19 nt, Homo sapiens
ucaccuguuauuucacuua

SEQ ID NO: 967367 - RNA, 19 nt, Homo sapiens
gacccgagguguuuucuga

SEQ ID NO: 967368 - RNA, 19 nt, Homo sapiens
ccacacagccauagaugag

SEQ ID NO: 967369 - RNA, 19 nt, Homo sapiens
ggagguugcagugagcuaa

SEQ ID NO: 967370 - RNA, 19 nt, Homo sapiens
ggcaggagaaucacuugaa

SEQ ID NO: 967371 - RNA, 19 nt, Homo sapiens
ggaccaacucuuuaauuuu

SEQ ID NO: 967372 - RNA, 19 nt, Homo sapiens
acuuaauccucauaccaua

SEQ ID NO: 967373 - RNA, 19 nt, Homo sapiens
acacagccauagaugagau

SEQ ID NO: 967374 - RNA, 19 nt, Homo sapiens
agacgacccucgguucuuc

SEQ ID NO: 967375 - RNA, 19 nt, Homo sapiens
gaacuggaaucacauauuu

SEQ ID NO: 967376 - RNA, 19 nt, Homo sapiens
gcaaauaacuggccacauc

SEQ ID NO: 967377 - RNA, 19 nt, Homo sapiens
gaacauuuguggucuuuau

SEQ ID NO: 967378 - RNA, 19 nt, Homo sapiens
gaauugaacuggaaucaca

SEQ ID NO: 967379 - RNA, 19 nt, Homo sapiens
cuaauaaggugucacaauu

SEQ ID NO: 967380 - RNA, 19 nt, Homo sapiens
ccgaagagaugacuauaaa

SEQ ID NO: 967381 - RNA, 19 nt, Homo sapiens
gcaagaagcagauuagguu

SEQ ID NO: 967382 - RNA, 19 nt, Homo sapiens
gcauagaauugcugagaaa

SEQ ID NO: 967383 - RNA, 19 nt, Homo sapiens
aaacgucacuagcaaagua

SEQ ID NO: 967384 - RNA, 19 nt, Homo sapiens
auacaaagcuguucugugu

SEQ ID NO: 967385 - RNA, 19 nt, Homo sapiens
gcaacagcuuuaagucuaa

SEQ ID NO: 967386 - RNA, 19 nt, Homo sapiens
ucacuaagguuaaacuuuc

SEQ ID NO: 967387 - RNA, 19 nt, Homo sapiens
gcaacaucuucccuaaaua

SEQ ID NO: 967388 - RNA, 19 nt, Homo sapiens
uaaagacccugcagaggaa

SEQ ID NO: 967389 - RNA, 19 nt, Homo sapiens
gacaaucaaucaaucaaug

SEQ ID NO: 967390 - RNA, 19 nt, Homo sapiens
caacagggccgaagagaug

SEQ ID NO: 967391 - RNA, 19 nt, Homo sapiens
cuagagcacugacuguuaa

SEQ ID NO: 967392 - RNA, 19 nt, Homo sapiens
ugacuugaguugguucuua

SEQ ID NO: 967393 - RNA, 19 nt, Homo sapiens
gcauuaagguuugacuuga

SEQ ID NO: 967394 - RNA, 19 nt, Homo sapiens
gaaauuaggacuguuuaga

SEQ ID NO: 967395 - RNA, 19 nt, Homo sapiens
ggaaucacauauuucacaa

SEQ ID NO: 967396 - RNA, 19 nt, Homo sapiens
caacaucuucccuaaauau

SEQ ID NO: 967397 - RNA, 19 nt, Homo sapiens
acaaagcuguucuguguga

SEQ ID NO: 967398 - RNA, 19 nt, Homo sapiens
gaucugugccuacuuuauu

SEQ ID NO: 967399 - RNA, 19 nt, Homo sapiens
caacauggaugaaaaugaa

SEQ ID NO: 967400 - RNA, 19 nt, Homo sapiens
ugaaggaggugaaggaaca

SEQ ID NO: 967401 - RNA, 19 nt, Homo sapiens
uaacuggccacaucauuaa

SEQ ID NO: 967402 - RNA, 19 nt, Homo sapiens
cgaaggauauauacagugu

SEQ ID NO: 967403 - RNA, 19 nt, Homo sapiens
aaacaggaauacaaugguu

SEQ ID NO: 967404 - RNA, 19 nt, Homo sapiens
ucauugaugucgaaggaua

SEQ ID NO: 967405 - RNA, 19 nt, Homo sapiens
acacaaacgucacuagcaa

SEQ ID NO: 967406 - RNA, 19 nt, Homo sapiens
gaaaagagacaccauaaau

SEQ ID NO: 967407 - RNA, 19 nt, Homo sapiens
aaagcaacaucuucccuaa

SEQ ID NO: 967408 - RNA, 19 nt, Homo sapiens
uaaauuaacagccaccuau

SEQ ID NO: 967409 - RNA, 19 nt, Homo sapiens
agagacaaguugagaaaga

SEQ ID NO: 967410 - RNA, 19 nt, Homo sapiens
aauaggcucuuaccacuug

SEQ ID NO: 967411 - RNA, 19 nt, Homo sapiens
gaguugguucuuaguauua

SEQ ID NO: 967412 - RNA, 19 nt, Homo sapiens
aaucauacacucugaauug

SEQ ID NO: 967413 - RNA, 19 nt, Homo sapiens
gggagcaggugguggaaga

SEQ ID NO: 967414 - RNA, 19 nt, Homo sapiens
ccguggagcugaagaagaa

SEQ ID NO: 967415 - RNA, 19 nt, Homo sapiens
gaaaaggcaacuuagauaa

SEQ ID NO: 967416 - RNA, 19 nt, Homo sapiens
cuaaugcucuuguguaguc

SEQ ID NO: 967417 - RNA, 19 nt, Homo sapiens
agaaagaggaaaccaauga

SEQ ID NO: 967418 - RNA, 19 nt, Homo sapiens
agaccaaccuggagaggaa

SEQ ID NO: 967419 - RNA, 19 nt, Homo sapiens
ucucuugcuuucucaauaa

SEQ ID NO: 967420 - RNA, 19 nt, Homo sapiens
ucuuaccacuugcaaauaa

SEQ ID NO: 967421 - RNA, 19 nt, Homo sapiens
ggauauauacaguguuaga

SEQ ID NO: 967422 - RNA, 19 nt, Homo sapiens
guucauugaugucgaagga

SEQ ID NO: 967423 - RNA, 19 nt, Homo sapiens
ggagaaaccagcagaaacu

SEQ ID NO: 967424 - RNA, 19 nt, Homo sapiens
guacuuucauacucuucua

SEQ ID NO: 967425 - RNA, 19 nt, Homo sapiens
uaugguaaauaggcucuua

SEQ ID NO: 967426 - RNA, 19 nt, Homo sapiens
ggaaugacagaaacauaga

SEQ ID NO: 967427 - RNA, 19 nt, Homo sapiens
ugaguugguucuuaguauu

SEQ ID NO: 967428 - RNA, 19 nt, Homo sapiens
gugagaaguucaacaccaa

SEQ ID NO: 967429 - RNA, 19 nt, Homo sapiens
aaagagacaaguugagaaa

SEQ ID NO: 967430 - RNA, 19 nt, Homo sapiens
cuuuggaagugucuaauaa

SEQ ID NO: 967431 - RNA, 19 nt, Homo sapiens
gaauagaagaggucaccaa

SEQ ID NO: 967432 - RNA, 19 nt, Homo sapiens
uaaagucucuauucaucuc

SEQ ID NO: 967433 - RNA, 19 nt, Homo sapiens
uaugugauguccuuaguca

SEQ ID NO: 967434 - RNA, 19 nt, Homo sapiens
agcaacagcuuuaagucua

SEQ ID NO: 967435 - RNA, 19 nt, Homo sapiens
guagguauuucgugagaag

SEQ ID NO: 967436 - RNA, 19 nt, Homo sapiens
gagaagaugacuacaacau

SEQ ID NO: 967437 - RNA, 19 nt, Homo sapiens
gaggagaagaugacuacaa

SEQ ID NO: 967438 - RNA, 19 nt, Homo sapiens
gaaacgugcuugguaacag

SEQ ID NO: 967439 - RNA, 19 nt, Homo sapiens
gcucuuaccacuugcaaau

SEQ ID NO: 967440 - RNA, 19 nt, Homo sapiens
guaaaugacucacaaaacu

SEQ ID NO: 967441 - RNA, 19 nt, Homo sapiens
ggcaugagagggcaaguuu

SEQ ID NO: 967442 - RNA, 19 nt, Homo sapiens
gggagcagcuugacaaaau

SEQ ID NO: 967443 - RNA, 19 nt, Homo sapiens
gaccugagccagugcauca

SEQ ID NO: 967444 - RNA, 19 nt, Homo sapiens
cuucauaugugauguccuu

SEQ ID NO: 967445 - RNA, 19 nt, Homo sapiens
gaaguuacagagcaucuag

SEQ ID NO: 967446 - RNA, 19 nt, Homo sapiens
aaaguucauugaugucgaa

SEQ ID NO: 967447 - RNA, 19 nt, Homo sapiens
ggaaucauacacucugaau

SEQ ID NO: 967448 - RNA, 19 nt, Homo sapiens
gggaaugacagaaacauag

SEQ ID NO: 967449 - RNA, 19 nt, Homo sapiens
caaagagacaaguugagaa

SEQ ID NO: 967450 - RNA, 19 nt, Homo sapiens
auaacuggccacaucauua

SEQ ID NO: 967451 - RNA, 19 nt, Homo sapiens
ccuagagcacugacuguua

SEQ ID NO: 967452 - RNA, 19 nt, Homo sapiens
gcucuuguguagucacuuc

SEQ ID NO: 967453 - RNA, 19 nt, Homo sapiens
agggaaacgugcuugguaa

SEQ ID NO: 967454 - RNA, 19 nt, Homo sapiens
agcaacaucuucccuaaau

SEQ ID NO: 967455 - RNA, 19 nt, Homo sapiens
gcacugacuguuaacacaa

SEQ ID NO: 967456 - RNA, 19 nt, Homo sapiens
gagaggagaagaugacuac

SEQ ID NO: 967457 - RNA, 19 nt, Homo sapiens
gauccaacccucuuauuuu

SEQ ID NO: 967458 - RNA, 19 nt, Homo sapiens
agggagagcuggagaagca

SEQ ID NO: 967459 - RNA, 19 nt, Homo sapiens
ggaauggucuuuuaaacag

SEQ ID NO: 967460 - RNA, 19 nt, Homo sapiens
caaauaacuggccacauca

SEQ ID NO: 967461 - RNA, 19 nt, Homo sapiens
caagaagcagauuagguuu

SEQ ID NO: 967462 - RNA, 19 nt, Homo sapiens
ggaugaaaaugaagcagaa

SEQ ID NO: 967463 - RNA, 19 nt, Homo sapiens
gaaacugagaggagaagau

SEQ ID NO: 967464 - RNA, 19 nt, Homo sapiens
gagacaaguugagaaagag

SEQ ID NO: 967465 - RNA, 19 nt, Homo sapiens
ccagagaccugagugaaaa

SEQ ID NO: 967466 - RNA, 19 nt, Homo sapiens
ggaauuuucucuugcuuuc

SEQ ID NO: 967467 - RNA, 19 nt, Homo sapiens
uaacagccaccuauagaag

SEQ ID NO: 967468 - RNA, 19 nt, Homo sapiens
gcggaaucauacacucuga

SEQ ID NO: 967469 - RNA, 19 nt, Homo sapiens
cauaugugauguccuuagu

SEQ ID NO: 967470 - RNA, 19 nt, Homo sapiens
ugauccaacccucuuauuu

SEQ ID NO: 967471 - RNA, 19 nt, Homo sapiens
ugagagggcaaguuuguug

SEQ ID NO: 967472 - RNA, 19 nt, Homo sapiens
ggcuaaugcucuuguguag

SEQ ID NO: 967473 - RNA, 19 nt, Homo sapiens
gccgaagagaugacuauaa

SEQ ID NO: 967474 - RNA, 19 nt, Homo sapiens
agauccagguggugaauga

SEQ ID NO: 967475 - RNA, 19 nt, Homo sapiens
ggaaugagcugguugugaa

SEQ ID NO: 967476 - RNA, 19 nt, Homo sapiens
ggaccgaguuccacaagaa

SEQ ID NO: 967477 - RNA, 19 nt, Homo sapiens
caaauucccuucuucaagu

SEQ ID NO: 967478 - RNA, 19 nt, Homo sapiens
gacaagcucuuuccgcaaa

SEQ ID NO: 967479 - RNA, 19 nt, Homo sapiens
ccagauggcuccaguuuca

SEQ ID NO: 967480 - RNA, 19 nt, Homo sapiens
uauaagcgguuucuucuga

SEQ ID NO: 967481 - RNA, 19 nt, Homo sapiens
gaacaugaagcuuggauau

SEQ ID NO: 967482 - RNA, 19 nt, Homo sapiens
gcacagccguggacuaugg

SEQ ID NO: 967483 - RNA, 19 nt, Homo sapiens
gagaagaauuccagugaag

SEQ ID NO: 967484 - RNA, 19 nt, Homo sapiens
gagagaagaauuccaguga

SEQ ID NO: 967485 - RNA, 19 nt, Homo sapiens
gaguuuggguugaacauga

SEQ ID NO: 967486 - RNA, 19 nt, Homo sapiens
acacaaaccuggagucucu

SEQ ID NO: 967487 - RNA, 19 nt, Homo sapiens
ccauggagaugauccuaaa

SEQ ID NO: 967488 - RNA, 19 nt, Homo sapiens
uggagucucuguacuauga

SEQ ID NO: 967489 - RNA, 19 nt, Homo sapiens
ugacacaacuggagcaagu

SEQ ID NO: 967490 - RNA, 19 nt, Homo sapiens
caucauuuauggacacaaa

SEQ ID NO: 967491 - RNA, 19 nt, Homo sapiens
ggacuguguggguuucuua

SEQ ID NO: 967492 - RNA, 19 nt, Homo sapiens
gcuuggauauggcaaauuc

SEQ ID NO: 967493 - RNA, 19 nt, Homo sapiens
gcaaauucccuucuucaag

SEQ ID NO: 967494 - RNA, 19 nt, Homo sapiens
gugcugagacgaaauuuga

SEQ ID NO: 967495 - RNA, 19 nt, Homo sapiens
ggaucagccucucagaaga

SEQ ID NO: 967496 - RNA, 19 nt, Homo sapiens
ggacuauggcuacuucaga

SEQ ID NO: 967497 - RNA, 19 nt, Homo sapiens
gugaacaagugcucagaug

SEQ ID NO: 967498 - RNA, 19 nt, Homo sapiens
gcuucucccuccucagaua

SEQ ID NO: 967499 - RNA, 19 nt, Homo sapiens
gccacaggaugaagaagaa

SEQ ID NO: 967500 - RNA, 19 nt, Homo sapiens
cagcagagcgcgagacguu

SEQ ID NO: 967501 - RNA, 19 nt, Homo sapiens
gcccgcaucuuccucaaug

SEQ ID NO: 967502 - RNA, 19 nt, Homo sapiens
gcagugcugagacgaaauu

SEQ ID NO: 967503 - RNA, 19 nt, Homo sapiens
gcaggaugguugcauguac

SEQ ID NO: 967504 - RNA, 19 nt, Homo sapiens
guacaugggcuugcagcua

SEQ ID NO: 967505 - RNA, 19 nt, Homo sapiens
ccaggaaccuccaaaauuc

SEQ ID NO: 967506 - RNA, 19 nt, Homo sapiens
ugaaauuccuccguucguu

SEQ ID NO: 967507 - RNA, 19 nt, Homo sapiens
gaagaauuccagugaagca

SEQ ID NO: 967508 - RNA, 19 nt, Homo sapiens
gacuauggcuacuucagau

SEQ ID NO: 967509 - RNA, 19 nt, Homo sapiens
agacgaaauuugaguccaa

SEQ ID NO: 967510 - RNA, 19 nt, Homo sapiens
gggccgacgugaacaagug

SEQ ID NO: 967511 - RNA, 19 nt, Homo sapiens
gcaucuuccucaaugaaau

SEQ ID NO: 967512 - RNA, 19 nt, Homo sapiens
agagaagaauuccagugaa

SEQ ID NO: 967513 - RNA, 19 nt, Homo sapiens
ggaagggaaccacgaaugg

SEQ ID NO: 967514 - RNA, 19 nt, Homo sapiens
gggcacagccguggacuau

SEQ ID NO: 967515 - RNA, 19 nt, Homo sapiens
gugcagugcugagacgaaa

SEQ ID NO: 967516 - RNA, 19 nt, Homo sapiens
aagagcaacuuuccaugga

SEQ ID NO: 967517 - RNA, 19 nt, Homo sapiens
acaugaagcuuggauaugg

SEQ ID NO: 967518 - RNA, 19 nt, Homo sapiens
caagagagcggagcugauc

SEQ ID NO: 967519 - RNA, 19 nt, Homo sapiens
gcaagcuggcccugauuga

SEQ ID NO: 967520 - RNA, 19 nt, Homo sapiens
cugcugcccucaagucuga

SEQ ID NO: 967521 - RNA, 19 nt, Homo sapiens
gaagggaaccacgaaugga

SEQ ID NO: 967522 - RNA, 19 nt, Homo sapiens
gcaaguacugcaagaccaa

SEQ ID NO: 967523 - RNA, 19 nt, Homo sapiens
agaggaacauggacagcaa

SEQ ID NO: 967524 - RNA, 19 nt, Homo sapiens
ccugugaccugaccuacga

SEQ ID NO: 967525 - RNA, 19 nt, Homo sapiens
gcgggaggaugacaacaag

SEQ ID NO: 967526 - RNA, 19 nt, Homo sapiens
gaaggacaacuuugcuagu

SEQ ID NO: 967527 - RNA, 19 nt, Homo sapiens
gggaaccacgaauggauuu

SEQ ID NO: 967528 - RNA, 19 nt, Homo sapiens
cuccagaaauguaugucua

SEQ ID NO: 967529 - RNA, 19 nt, Homo sapiens
ccgacgaggacgacacuua

SEQ ID NO: 967530 - RNA, 19 nt, Homo sapiens
aaccacgaauggauuugua

SEQ ID NO: 967531 - RNA, 19 nt, Homo sapiens
aaauccagaagcaaacuua

SEQ ID NO: 967532 - RNA, 19 nt, Homo sapiens
gauauggcaaauucucuug

SEQ ID NO: 967533 - RNA, 19 nt, Homo sapiens
gggcaaauucccuucuuca

SEQ ID NO: 967534 - RNA, 19 nt, Homo sapiens
caagugugccagggacaua

SEQ ID NO: 967535 - RNA, 19 nt, Homo sapiens
ggauauggcaaauucucuu

SEQ ID NO: 967536 - RNA, 19 nt, Homo sapiens
gaggaccgacaucugcuuu

SEQ ID NO: 967537 - RNA, 19 nt, Homo sapiens
gaaccacgaauggauuugu

SEQ ID NO: 967538 - RNA, 19 nt, Homo sapiens
gacuauaagcgguuucuuc

SEQ ID NO: 967539 - RNA, 19 nt, Homo sapiens
gccauggccuggguaccua

SEQ ID NO: 967540 - RNA, 19 nt, Homo sapiens
ggaggacccaggacugugu

SEQ ID NO: 967541 - RNA, 19 nt, Homo sapiens
caaguucugcuaccagugu

SEQ ID NO: 967542 - RNA, 19 nt, Homo sapiens
gaagcuuggauauggcaaa

SEQ ID NO: 967543 - RNA, 19 nt, Homo sapiens
gcacucagcauguguuucc

SEQ ID NO: 967544 - RNA, 19 nt, Homo sapiens
gggaaugagcugguuguga

SEQ ID NO: 967545 - RNA, 19 nt, Homo sapiens
caggacggcucugcacaug

SEQ ID NO: 967546 - RNA, 19 nt, Homo sapiens
ucacggcacucagcaugug

SEQ ID NO: 967547 - RNA, 19 nt, Homo sapiens
ugaacaagugcucagauga

SEQ ID NO: 967548 - RNA, 19 nt, Homo sapiens
aaggacaacuuugcuagug

SEQ ID NO: 967549 - RNA, 19 nt, Homo sapiens
aggcauuucugcaccuuug

SEQ ID NO: 967550 - RNA, 19 nt, Homo sapiens
gggaggaugacaacaagug

SEQ ID NO: 967551 - RNA, 19 nt, Homo sapiens
caacuuuccauggagauga

SEQ ID NO: 967552 - RNA, 19 nt, Homo sapiens
uaacgcugccuccagaaau

SEQ ID NO: 967553 - RNA, 19 nt, Homo sapiens
uaagcgguuucuucugaau

SEQ ID NO: 967554 - RNA, 19 nt, Homo sapiens
gucauaccaugggcaguuu

SEQ ID NO: 967555 - RNA, 19 nt, Homo sapiens
uugaggacguguugggaaa

SEQ ID NO: 967556 - RNA, 19 nt, Homo sapiens
ggacacaaaccuggagucu

SEQ ID NO: 967557 - RNA, 19 nt, Homo sapiens
caaagcggaccagcgguuu

SEQ ID NO: 967558 - RNA, 19 nt, Homo sapiens
ccuggagucucuguacuau

SEQ ID NO: 967559 - RNA, 19 nt, Homo sapiens
ccaguuguuccaauccuuu

SEQ ID NO: 967560 - RNA, 19 nt, Homo sapiens
caagcccaauguugcugaa

SEQ ID NO: 967561 - RNA, 19 nt, Homo sapiens
gcucacaccagcuggaaca

SEQ ID NO: 967562 - RNA, 19 nt, Homo sapiens
aaauucccuucuucaaguu

SEQ ID NO: 967563 - RNA, 19 nt, Homo sapiens
gcaagagagcggagcugau

SEQ ID NO: 967564 - RNA, 19 nt, Homo sapiens
caccagcagcuucgacaaa

SEQ ID NO: 967565 - RNA, 19 nt, Homo sapiens
caucuuccucaaugaaauu

SEQ ID NO: 967566 - RNA, 19 nt, Homo sapiens
ggaggaugacaacaagugu

SEQ ID NO: 967567 - RNA, 19 nt, Homo sapiens
gaaggaagaggaggaagcu

SEQ ID NO: 967568 - RNA, 19 nt, Homo sapiens
ggcaaauucccuucuucaa

SEQ ID NO: 967569 - RNA, 19 nt, Homo sapiens
cguggacuauggcuacuuc

SEQ ID NO: 967570 - RNA, 19 nt, Homo sapiens
ccaggaggagagaagaauu

SEQ ID NO: 967571 - RNA, 19 nt, Homo sapiens
gagucuugcuugggauguu

SEQ ID NO: 967572 - RNA, 19 nt, Homo sapiens
uguguuuccuccuccacua

SEQ ID NO: 967573 - RNA, 19 nt, Homo sapiens
ucacugccacaacgacauu

SEQ ID NO: 967574 - RNA, 19 nt, Homo sapiens
ccugaguucuccagcuuca

SEQ ID NO: 967575 - RNA, 19 nt, Homo sapiens
ggaccgaguuccacaagaa

SEQ ID NO: 967576 - RNA, 19 nt, Homo sapiens
caaauucccuucuucaagu

SEQ ID NO: 967577 - RNA, 19 nt, Homo sapiens
ccagauggcuccaguuuca

SEQ ID NO: 967578 - RNA, 19 nt, Homo sapiens
gaacaugaagcuuggauau

SEQ ID NO: 967579 - RNA, 19 nt, Homo sapiens
gcacagccguggacuaugg

SEQ ID NO: 967580 - RNA, 19 nt, Homo sapiens
gagaagaauuccagugaag

SEQ ID NO: 967581 - RNA, 19 nt, Homo sapiens
gagagaagaauuccaguga

SEQ ID NO: 967582 - RNA, 19 nt, Homo sapiens
gaguuuggguugaacauga

SEQ ID NO: 967583 - RNA, 19 nt, Homo sapiens
acacaaaccuggagucucu

SEQ ID NO: 967584 - RNA, 19 nt, Homo sapiens
uggagucucuguacuauga

SEQ ID NO: 967585 - RNA, 19 nt, Homo sapiens
ugacacaacuggagcaagu

SEQ ID NO: 967586 - RNA, 19 nt, Homo sapiens
caucauuuauggacacaaa

SEQ ID NO: 967587 - RNA, 19 nt, Homo sapiens
ggacuguguggguuucuua

SEQ ID NO: 967588 - RNA, 19 nt, Homo sapiens
gcuuggauauggcaaauuc

SEQ ID NO: 967589 - RNA, 19 nt, Homo sapiens
gaagaccacagacauggaa

SEQ ID NO: 967590 - RNA, 19 nt, Homo sapiens
gcaaauucccuucuucaag

SEQ ID NO: 967591 - RNA, 19 nt, Homo sapiens
gugcugagacgaaauuuga

SEQ ID NO: 967592 - RNA, 19 nt, Homo sapiens
ggacuauggcuacuucaga

SEQ ID NO: 967593 - RNA, 19 nt, Homo sapiens
gugaacaagugcucagaug

SEQ ID NO: 967594 - RNA, 19 nt, Homo sapiens
gccacaggaugaagaagaa

SEQ ID NO: 967595 - RNA, 19 nt, Homo sapiens
cagcagagcgcgagacguu

SEQ ID NO: 967596 - RNA, 19 nt, Homo sapiens
gcagugcugagacgaaauu

SEQ ID NO: 967597 - RNA, 19 nt, Homo sapiens
gcaggaugguugcauguac

SEQ ID NO: 967598 - RNA, 19 nt, Homo sapiens
guacaugggcuugcagcua

SEQ ID NO: 967599 - RNA, 19 nt, Homo sapiens
ccaggaaccuccaaaauuc

SEQ ID NO: 967600 - RNA, 19 nt, Homo sapiens
gaagaauuccagugaagca

SEQ ID NO: 967601 - RNA, 19 nt, Homo sapiens
gacuauggcuacuucagau

SEQ ID NO: 967602 - RNA, 19 nt, Homo sapiens
agacgaaauuugaguccaa

SEQ ID NO: 967603 - RNA, 19 nt, Homo sapiens
gggccgacgugaacaagug

SEQ ID NO: 967604 - RNA, 19 nt, Homo sapiens
agagaagaauuccagugaa

SEQ ID NO: 967605 - RNA, 19 nt, Homo sapiens
gggcacagccguggacuau

SEQ ID NO: 967606 - RNA, 19 nt, Homo sapiens
gugcagugcugagacgaaa

SEQ ID NO: 967607 - RNA, 19 nt, Homo sapiens
acaugaagcuuggauaugg

SEQ ID NO: 967608 - RNA, 19 nt, Homo sapiens
caagagagcggagcugauc

SEQ ID NO: 967609 - RNA, 19 nt, Homo sapiens
gcaagcuggcccugauuga

SEQ ID NO: 967610 - RNA, 19 nt, Homo sapiens
gcaaguacugcaagaccaa

SEQ ID NO: 967611 - RNA, 19 nt, Homo sapiens
agaggaacauggacagcaa

SEQ ID NO: 967612 - RNA, 19 nt, Homo sapiens
ccugugaccugaccuacga

SEQ ID NO: 967613 - RNA, 19 nt, Homo sapiens
cuucgagucuugcuugguu

SEQ ID NO: 967614 - RNA, 19 nt, Homo sapiens
ccgacgaggacgacacuua

SEQ ID NO: 967615 - RNA, 19 nt, Homo sapiens
gauauggcaaauucucuug

SEQ ID NO: 967616 - RNA, 19 nt, Homo sapiens
gggcaaauucccuucuuca

SEQ ID NO: 967617 - RNA, 19 nt, Homo sapiens
gaggaccgacaucugcuuu

SEQ ID NO: 967618 - RNA, 19 nt, Homo sapiens
ccaugccucccuuagcuua

SEQ ID NO: 967619 - RNA, 19 nt, Homo sapiens
gccauggccuggguaccua

SEQ ID NO: 967620 - RNA, 19 nt, Homo sapiens
ggauauggcaaauucucuu

SEQ ID NO: 967621 - RNA, 19 nt, Homo sapiens
ggaggacccaggacugugu

SEQ ID NO: 967622 - RNA, 19 nt, Homo sapiens
caaguucugcuaccagugu

SEQ ID NO: 967623 - RNA, 19 nt, Homo sapiens
ccggcaagguugugaagga

SEQ ID NO: 967624 - RNA, 19 nt, Homo sapiens
gcacucagcauguguuucc

SEQ ID NO: 967625 - RNA, 19 nt, Homo sapiens
gcccaugccucccuuagcu

SEQ ID NO: 967626 - RNA, 19 nt, Homo sapiens
gaagcuuggauauggcaaa

SEQ ID NO: 967627 - RNA, 19 nt, Homo sapiens
ggaagaccacagacaugga

SEQ ID NO: 967628 - RNA, 19 nt, Homo sapiens
ucacggcacucagcaugug

SEQ ID NO: 967629 - RNA, 19 nt, Homo sapiens
ugaacaagugcucagauga

SEQ ID NO: 967630 - RNA, 19 nt, Homo sapiens
aggcauuucugcaccuuug

SEQ ID NO: 967631 - RNA, 19 nt, Homo sapiens
uugaggacguguugggaaa

SEQ ID NO: 967632 - RNA, 19 nt, Homo sapiens
ggacacaaaccuggagucu

SEQ ID NO: 967633 - RNA, 19 nt, Homo sapiens
gucauaccaugggcaguuu

SEQ ID NO: 967634 - RNA, 19 nt, Homo sapiens
ccuggagucucuguacuau

SEQ ID NO: 967635 - RNA, 19 nt, Homo sapiens
ccaguuguuccaauccuuu

SEQ ID NO: 967636 - RNA, 19 nt, Homo sapiens
caagcccaauguugcugaa

SEQ ID NO: 967637 - RNA, 19 nt, Homo sapiens
aaauucccuucuucaaguu

SEQ ID NO: 967638 - RNA, 19 nt, Homo sapiens
gcaagagagcggagcugau

SEQ ID NO: 967639 - RNA, 19 nt, Homo sapiens
caccagcagcuucgacaaa

SEQ ID NO: 967640 - RNA, 19 nt, Homo sapiens
gagucuugcuugguuggaa

SEQ ID NO: 967641 - RNA, 19 nt, Homo sapiens
ggcaaauucccuucuucaa

SEQ ID NO: 967642 - RNA, 19 nt, Homo sapiens
gaaggaagaggaggaagcu

SEQ ID NO: 967643 - RNA, 19 nt, Homo sapiens
cguggacuauggcuacuuc

SEQ ID NO: 967644 - RNA, 19 nt, Homo sapiens
ccaggaggagagaagaauu

SEQ ID NO: 967645 - RNA, 19 nt, Homo sapiens
uguguuuccuccuccacua

SEQ ID NO: 967646 - RNA, 19 nt, Homo sapiens
ucacugccacaacgacauu

SEQ ID NO: 967647 - RNA, 19 nt, Homo sapiens
ccuacgagcaccagaggaa

SEQ ID NO: 967648 - RNA, 19 nt, Homo sapiens
ggaccgacaucugcuuucc

SEQ ID NO: 967649 - RNA, 19 nt, Homo sapiens
ugaacaugaagcuuggaua

SEQ ID NO: 967650 - RNA, 19 nt, Homo sapiens
ccaauccuuucaucaucau

SEQ ID NO: 967651 - RNA, 19 nt, Homo sapiens
uccaauccuuucaucauca

SEQ ID NO: 967652 - RNA, 19 nt, Homo sapiens
caguuucacgggcacauuu

SEQ ID NO: 967653 - RNA, 19 nt, Homo sapiens
caggaggagagaagaauuc

SEQ ID NO: 967654 - RNA, 19 nt, Homo sapiens
uagcuuagaggacgaaguc

SEQ ID NO: 967655 - RNA, 19 nt, Homo sapiens
gaaggcuacggcaccaugu

SEQ ID NO: 967656 - RNA, 19 nt, Homo sapiens
gcuacggcaggcugucuuu

SEQ ID NO: 967657 - RNA, 19 nt, Homo sapiens
cgacgaggacgacacuuac

SEQ ID NO: 967658 - RNA, 19 nt, Homo sapiens
gcgagcucuucgagucuug

SEQ ID NO: 967659 - RNA, 19 nt, Homo sapiens
gcaccagcagcuucgacaa

SEQ ID NO: 967660 - RNA, 19 nt, Homo sapiens
guuccaauccuuucaucau

SEQ ID NO: 967661 - RNA, 19 nt, Homo sapiens
ccaggacuguguggguuuc

SEQ ID NO: 967662 - RNA, 19 nt, Homo sapiens
uacaugaagacacggcuuu

SEQ ID NO: 967663 - RNA, 19 nt, Homo sapiens
aagcuuggauauggcaaau

SEQ ID NO: 967664 - RNA, 19 nt, Homo sapiens
cugaagaacuacgcugucu

SEQ ID NO: 967665 - RNA, 19 nt, Homo sapiens
gcacacagcuaccggacaa

SEQ ID NO: 967666 - RNA, 19 nt, Homo sapiens
gcccggagcuggaguuaug

SEQ ID NO: 967667 - RNA, 19 nt, Homo sapiens
cagagaagccagagacuuu

SEQ ID NO: 967668 - RNA, 19 nt, Homo sapiens
gacgcgagcucugcccuuu

SEQ ID NO: 967669 - RNA, 19 nt, Homo sapiens
cgcgagcucugcccuuuaa

SEQ ID NO: 967670 - RNA, 19 nt, Homo sapiens
gcagagaagccagagacuu

SEQ ID NO: 967671 - RNA, 19 nt, Homo sapiens
uggagaugcuggugcaaga

SEQ ID NO: 967672 - RNA, 19 nt, Homo sapiens
gguaagcuccgcacacucu

SEQ ID NO: 967673 - RNA, 19 nt, Homo sapiens
cagguaagcuccgcacacu

SEQ ID NO: 967674 - RNA, 19 nt, Homo sapiens
gcaguuccgcuaccaggau

SEQ ID NO: 967675 - RNA, 19 nt, Homo sapiens
ggccugacauccgcaccaa

SEQ ID NO: 967676 - RNA, 19 nt, Homo sapiens
gcaccaaggagcagaucgu

SEQ ID NO: 967677 - RNA, 19 nt, Homo sapiens
aggagcagaucguggagau

SEQ ID NO: 967678 - RNA, 19 nt, Homo sapiens
gcacacagcuaccggacaa

SEQ ID NO: 967679 - RNA, 19 nt, Homo sapiens
gcccggagcuggaguuaug

SEQ ID NO: 967680 - RNA, 19 nt, Homo sapiens
cagagaagccagagacuuu

SEQ ID NO: 967681 - RNA, 19 nt, Homo sapiens
gcagagaagccagagacuu

SEQ ID NO: 967682 - RNA, 19 nt, Homo sapiens
uggagaugcuggugcaaga

SEQ ID NO: 967683 - RNA, 19 nt, Homo sapiens
gcaguuccgcuaccaggau

SEQ ID NO: 967684 - RNA, 19 nt, Homo sapiens
ggccugacauccgcaccaa

SEQ ID NO: 967685 - RNA, 19 nt, Homo sapiens
gcaccaaggagcagaucgu

SEQ ID NO: 967686 - RNA, 19 nt, Homo sapiens
aggagcagaucguggagau

SEQ ID NO: 967687 - RNA, 19 nt, Homo sapiens
caucaucaaugcuauguua

SEQ ID NO: 967688 - RNA, 19 nt, Homo sapiens
gagaguuccuggucaaaua

SEQ ID NO: 967689 - RNA, 19 nt, Homo sapiens
gcagggagcggacuucuua

SEQ ID NO: 967690 - RNA, 19 nt, Homo sapiens
gcaguucccauuagauuua

SEQ ID NO: 967691 - RNA, 19 nt, Homo sapiens
gagcuuugaugcuuaagaa

SEQ ID NO: 967692 - RNA, 19 nt, Homo sapiens
gaagguugcuuuuaacuuu

SEQ ID NO: 967693 - RNA, 19 nt, Homo sapiens
aggauaagauucugucaua

SEQ ID NO: 967694 - RNA, 19 nt, Homo sapiens
caauggaccuugagagaga

SEQ ID NO: 967695 - RNA, 19 nt, Homo sapiens
cgaguggaaugauuaauga

SEQ ID NO: 967696 - RNA, 19 nt, Homo sapiens
gaaaccucaucucuacuaa

SEQ ID NO: 967697 - RNA, 19 nt, Homo sapiens
cauagagaguugcacauaa

SEQ ID NO: 967698 - RNA, 19 nt, Homo sapiens
ggagagaguuccuggucaa

SEQ ID NO: 967699 - RNA, 19 nt, Homo sapiens
ggugaaaccucaucucuac

SEQ ID NO: 967700 - RNA, 19 nt, Homo sapiens
gagccuagaaugaugguua

SEQ ID NO: 967701 - RNA, 19 nt, Homo sapiens
guaaauggaagguugcuuu

SEQ ID NO: 967702 - RNA, 19 nt, Homo sapiens
cagggaggauugucuguuu

SEQ ID NO: 967703 - RNA, 19 nt, Homo sapiens
gcuacgacauccugguuaa

SEQ ID NO: 967704 - RNA, 19 nt, Homo sapiens
gcauagagaguugcacaua

SEQ ID NO: 967705 - RNA, 19 nt, Homo sapiens
gaagaaaacccaaaauuca

SEQ ID NO: 967706 - RNA, 19 nt, Homo sapiens
gcagaauaaugacauaguc

SEQ ID NO: 967707 - RNA, 19 nt, Homo sapiens
auagagaguugcacauaaa

SEQ ID NO: 967708 - RNA, 19 nt, Homo sapiens
ucaccaagcuucuggaucu

SEQ ID NO: 967709 - RNA, 19 nt, Homo sapiens
caagacgcccuauaccaua

SEQ ID NO: 967710 - RNA, 19 nt, Homo sapiens
ccaagcuucuggaucuuaa

SEQ ID NO: 967711 - RNA, 19 nt, Homo sapiens
gcuagaacgugucaaagca

SEQ ID NO: 967712 - RNA, 19 nt, Homo sapiens
ucagaagggugccacauca

SEQ ID NO: 967713 - RNA, 19 nt, Homo sapiens
ugacacagcagcagccuuu

SEQ ID NO: 967714 - RNA, 19 nt, Homo sapiens
cagaggauguggagccauu

SEQ ID NO: 967715 - RNA, 19 nt, Homo sapiens
uggagaaucuggucgagaa

SEQ ID NO: 967716 - RNA, 19 nt, Homo sapiens
gggagcggacuucuuauuu

SEQ ID NO: 967717 - RNA, 19 nt, Homo sapiens
ucucaguucuggaauuauu

SEQ ID NO: 967718 - RNA, 19 nt, Homo sapiens
gccauuagacugagauuug

SEQ ID NO: 967719 - RNA, 19 nt, Homo sapiens
ccucagggaugccauugaa

SEQ ID NO: 967720 - RNA, 19 nt, Homo sapiens
uuuaguggccuucauguua

SEQ ID NO: 967721 - RNA, 19 nt, Homo sapiens
gggaggacaucgucaccaa

SEQ ID NO: 967722 - RNA, 19 nt, Homo sapiens
ggagcuagaacgugucaaa

SEQ ID NO: 967723 - RNA, 19 nt, Homo sapiens
gggacgaguggaaugauua

SEQ ID NO: 967724 - RNA, 19 nt, Homo sapiens
ggacgaguggaaugauuaa

SEQ ID NO: 967725 - RNA, 19 nt, Homo sapiens
uuaaggagccuacguggaa

SEQ ID NO: 967726 - RNA, 19 nt, Homo sapiens
uugcuaggauucagaguaa

SEQ ID NO: 967727 - RNA, 19 nt, Homo sapiens
ggagcggacuucuuauuuu

SEQ ID NO: 967728 - RNA, 19 nt, Homo sapiens
ccaaauggacggcggaaga

SEQ ID NO: 967729 - RNA, 19 nt, Homo sapiens
ucacugggcuuuuguuuug

SEQ ID NO: 967730 - RNA, 19 nt, Homo sapiens
ggucaaauacuccuuccuu

SEQ ID NO: 967731 - RNA, 19 nt, Homo sapiens
ccauuagacugagauuuga

SEQ ID NO: 967732 - RNA, 19 nt, Homo sapiens
gggcaguucccauuagauu

SEQ ID NO: 967733 - RNA, 19 nt, Homo sapiens
gguguugcuuuguauauca

SEQ ID NO: 967734 - RNA, 19 nt, Homo sapiens
cgucugagcuuugaugcuu

SEQ ID NO: 967735 - RNA, 19 nt, Homo sapiens
acucucaguucuggaauua

SEQ ID NO: 967736 - RNA, 19 nt, Homo sapiens
caucugcccucugcaagaa

SEQ ID NO: 967737 - RNA, 19 nt, Homo sapiens
ucagcagaauaaugacaua

SEQ ID NO: 967738 - RNA, 19 nt, Homo sapiens
guuauuuccugaugccauu

SEQ ID NO: 967739 - RNA, 19 nt, Homo sapiens
ugaaaccucaucucuacua

SEQ ID NO: 967740 - RNA, 19 nt, Homo sapiens
gcaggcggaucacuugaag

SEQ ID NO: 967741 - RNA, 19 nt, Homo sapiens
acaaggcuguggccaaaug

SEQ ID NO: 967742 - RNA, 19 nt, Homo sapiens
agacugagauuugaagaca

SEQ ID NO: 967743 - RNA, 19 nt, Homo sapiens
guggaaugauuaaugaugu

SEQ ID NO: 967744 - RNA, 19 nt, Homo sapiens
ggucugugcugagaauaau

SEQ ID NO: 967745 - RNA, 19 nt, Homo sapiens
gaaaacagaauguccagaa

SEQ ID NO: 967746 - RNA, 19 nt, Homo sapiens
uugaagaguugcuaggauu

SEQ ID NO: 967747 - RNA, 19 nt, Homo sapiens
gcugacgucugagcuuuga

SEQ ID NO: 967748 - RNA, 19 nt, Homo sapiens
uuaguggccuucauguuau

SEQ ID NO: 967749 - RNA, 19 nt, Homo sapiens
ugaacacaauggaccuuga

SEQ ID NO: 967750 - RNA, 19 nt, Homo sapiens
ugagucugcucuaccugua

SEQ ID NO: 967751 - RNA, 19 nt, Homo sapiens
uagaacgugucaaagcauu

SEQ ID NO: 967752 - RNA, 19 nt, Homo sapiens
ucagaaauaugggaaugau

SEQ ID NO: 967753 - RNA, 19 nt, Homo sapiens
gacauaguccaaagucuug

SEQ ID NO: 967754 - RNA, 19 nt, Homo sapiens
aaugaugguuagacuugua

SEQ ID NO: 967755 - RNA, 19 nt, Homo sapiens
ccucaucccucaguuuguu

SEQ ID NO: 967756 - RNA, 19 nt, Homo sapiens
uaacacaggccgagcgaau

SEQ ID NO: 967757 - RNA, 19 nt, Homo sapiens
agaaauaugggaaugauca

SEQ ID NO: 967758 - RNA, 19 nt, Homo sapiens
ggauaagauucugucauag

SEQ ID NO: 967759 - RNA, 19 nt, Homo sapiens
acugggcccuguacuuuaa

SEQ ID NO: 967760 - RNA, 19 nt, Homo sapiens
acugagauuugaagacauu

SEQ ID NO: 967761 - RNA, 19 nt, Homo sapiens
gaaugaugguuagacuugu

SEQ ID NO: 967762 - RNA, 19 nt, Homo sapiens
gauaagauucugucauagg

SEQ ID NO: 967763 - RNA, 19 nt, Homo sapiens
ggacaucgucaccaagcuu

SEQ ID NO: 967764 - RNA, 19 nt, Homo sapiens
gggaauauaaggcugugaa

SEQ ID NO: 967765 - RNA, 19 nt, Homo sapiens
ugacauaguccaaagucuu

SEQ ID NO: 967766 - RNA, 19 nt, Homo sapiens
gaauaaugacauaguccaa

SEQ ID NO: 967767 - RNA, 19 nt, Homo sapiens
agaaugaugguuagacuug

SEQ ID NO: 967768 - RNA, 19 nt, Homo sapiens
ucauaggcauagagaguug

SEQ ID NO: 967769 - RNA, 19 nt, Homo sapiens
aaacaaggauaagauucug

SEQ ID NO: 967770 - RNA, 19 nt, Homo sapiens
ggacaucacgguuucucau

SEQ ID NO: 967771 - RNA, 19 nt, Homo sapiens
aaacagaauguccagaaug

SEQ ID NO: 967772 - RNA, 19 nt, Homo sapiens
uuacugggcccuguacuuu

SEQ ID NO: 967773 - RNA, 19 nt, Homo sapiens
caaauggacggcggaagaa

SEQ ID NO: 967774 - RNA, 19 nt, Homo sapiens
ggaaaacaaggauaagauu

SEQ ID NO: 967775 - RNA, 19 nt, Homo sapiens
caaauacuccuuccuucca

SEQ ID NO: 967776 - RNA, 19 nt, Homo sapiens
gaacgugucaaagcauuag

SEQ ID NO: 967777 - RNA, 19 nt, Homo sapiens
ccaagacgcccuauaccau

SEQ ID NO: 967778 - RNA, 19 nt, Homo sapiens
ucacugccuugcuuuaugg

SEQ ID NO: 967779 - RNA, 19 nt, Homo sapiens
caagguguugcuuuguaua

SEQ ID NO: 967780 - RNA, 19 nt, Homo sapiens
gaacccagaauuugcuaag

SEQ ID NO: 967781 - RNA, 19 nt, Homo sapiens
aauggaagguugcuuuuaa

SEQ ID NO: 967782 - RNA, 19 nt, Homo sapiens
gauggcacauaccuguaau

SEQ ID NO: 967783 - RNA, 19 nt, Homo sapiens
cacaauggaccuugagaga

SEQ ID NO: 967784 - RNA, 19 nt, Homo sapiens
gaagaguugcuaggauuca

SEQ ID NO: 967785 - RNA, 19 nt, Homo sapiens
ucugagcuuugaugcuuaa

SEQ ID NO: 967786 - RNA, 19 nt, Homo sapiens
ccgcugacgucugagcuuu

SEQ ID NO: 967787 - RNA, 19 nt, Homo sapiens
gaaaugagauugcccauau

SEQ ID NO: 967788 - RNA, 19 nt, Homo sapiens
ggaaaucacuuagauguuu

SEQ ID NO: 967789 - RNA, 19 nt, Homo sapiens
ggagaggccuggcuguuua

SEQ ID NO: 967790 - RNA, 19 nt, Homo sapiens
uagcagagcugagauauuu

SEQ ID NO: 967791 - RNA, 19 nt, Homo sapiens
ucaagaggcugcagauuaa

SEQ ID NO: 967792 - RNA, 19 nt, Homo sapiens
gagagaaggugauaacaga

SEQ ID NO: 967793 - RNA, 19 nt, Homo sapiens
gaaauugcccucguuguua

SEQ ID NO: 967794 - RNA, 19 nt, Homo sapiens
caagaaaguugaugcuauu

SEQ ID NO: 967795 - RNA, 19 nt, Homo sapiens
ggaagaaacuccagugucu

SEQ ID NO: 967796 - RNA, 19 nt, Homo sapiens
gggcagaccuuggaucuaa

SEQ ID NO: 967797 - RNA, 19 nt, Homo sapiens
gaucagaggauaugucuuu

SEQ ID NO: 967798 - RNA, 19 nt, Homo sapiens
uaacagaacuggccaacau

SEQ ID NO: 967799 - RNA, 19 nt, Homo sapiens
cgaaauccuuguuauguuu

SEQ ID NO: 967800 - RNA, 19 nt, Homo sapiens
gaucuuggcacuaacuuua

SEQ ID NO: 967801 - RNA, 19 nt, Homo sapiens
gcagugaauuccaaccuuu

SEQ ID NO: 967802 - RNA, 19 nt, Homo sapiens
gaucucagcucaaauaaaa

SEQ ID NO: 967803 - RNA, 19 nt, Homo sapiens
gaaaccagcuacuagagau

SEQ ID NO: 967804 - RNA, 19 nt, Homo sapiens
caacaaccggcuugauuua

SEQ ID NO: 967805 - RNA, 19 nt, Homo sapiens
cagaggauaugucuuuaaa

SEQ ID NO: 967806 - RNA, 19 nt, Homo sapiens
gagaagcccuuucagaagu

SEQ ID NO: 967807 - RNA, 19 nt, Homo sapiens
gaacgacaaugacaucucu

SEQ ID NO: 967808 - RNA, 19 nt, Homo sapiens
ugacuaaccugauucuguu

SEQ ID NO: 967809 - RNA, 19 nt, Homo sapiens
ggaaaucucauuagccaaa

SEQ ID NO: 967810 - RNA, 19 nt, Homo sapiens
agagaaagaugccuuccua

SEQ ID NO: 967811 - RNA, 19 nt, Homo sapiens
ggaaauugcccucguuguu

SEQ ID NO: 967812 - RNA, 19 nt, Homo sapiens
cagaaggaauuacucauau

SEQ ID NO: 967813 - RNA, 19 nt, Homo sapiens
gaccuuggaucuaaguaaa

SEQ ID NO: 967814 - RNA, 19 nt, Homo sapiens
gaaucuaucacaagcauuu

SEQ ID NO: 967815 - RNA, 19 nt, Homo sapiens
gcaggaccauggagaguga

SEQ ID NO: 967816 - RNA, 19 nt, Homo sapiens
gagaaggugauaacagaua

SEQ ID NO: 967817 - RNA, 19 nt, Homo sapiens
aaaaugggcucaaaucuuu

SEQ ID NO: 967818 - RNA, 19 nt, Homo sapiens
gaaagcugcuacaaguaug

SEQ ID NO: 967819 - RNA, 19 nt, Homo sapiens
gacaagcauuugacagaaa

SEQ ID NO: 967820 - RNA, 19 nt, Homo sapiens
caagaugguuuaagaacau

SEQ ID NO: 967821 - RNA, 19 nt, Homo sapiens
gaacuggccaacauagaaa

SEQ ID NO: 967822 - RNA, 19 nt, Homo sapiens
ccagaagccucaagaaucu

SEQ ID NO: 967823 - RNA, 19 nt, Homo sapiens
guaacucucuucagcaugu

SEQ ID NO: 967824 - RNA, 19 nt, Homo sapiens
ggaauuacucauaugcuaa

SEQ ID NO: 967825 - RNA, 19 nt, Homo sapiens
gaaagaugccuuccuaaac

SEQ ID NO: 967826 - RNA, 19 nt, Homo sapiens
uaauuuaugucucgaggaa

SEQ ID NO: 967827 - RNA, 19 nt, Homo sapiens
cagcaagucaccucuauuu

SEQ ID NO: 967828 - RNA, 19 nt, Homo sapiens
aaugaaagcugcuacaagu

SEQ ID NO: 967829 - RNA, 19 nt, Homo sapiens
cagaggaaaucacuuagau

SEQ ID NO: 967830 - RNA, 19 nt, Homo sapiens
gaaaagagaaucuaacaga

SEQ ID NO: 967831 - RNA, 19 nt, Homo sapiens
gaaccucacccucaccauu

SEQ ID NO: 967832 - RNA, 19 nt, Homo sapiens
gaggaaaucacuuagaugu

SEQ ID NO: 967833 - RNA, 19 nt, Homo sapiens
gagcauacagcuuagcaaa

SEQ ID NO: 967834 - RNA, 19 nt, Homo sapiens
ugggaugugugguauauuu

SEQ ID NO: 967835 - RNA, 19 nt, Homo sapiens
caagucaccucuauuucug

SEQ ID NO: 967836 - RNA, 19 nt, Homo sapiens
gggcucaaaucuuucaguu

SEQ ID NO: 967837 - RNA, 19 nt, Homo sapiens
ucagaaggaauuacucaua

SEQ ID NO: 967838 - RNA, 19 nt, Homo sapiens
gcuuuaaccucucgccauu

SEQ ID NO: 967839 - RNA, 19 nt, Homo sapiens
gauuaaacccagaagcuuu

SEQ ID NO: 967840 - RNA, 19 nt, Homo sapiens
gcaucuuucuuuccucaaa

SEQ ID NO: 967841 - RNA, 19 nt, Homo sapiens
aaagaugccuuccuaaacu

SEQ ID NO: 967842 - RNA, 19 nt, Homo sapiens
agaaauuccuggagguauu

SEQ ID NO: 967843 - RNA, 19 nt, Homo sapiens
gacagcaagucaccucuau

SEQ ID NO: 967844 - RNA, 19 nt, Homo sapiens
aaacuccagugucuaaaga

SEQ ID NO: 967845 - RNA, 19 nt, Homo sapiens
gcuaaccucagcauguuua

SEQ ID NO: 967846 - RNA, 19 nt, Homo sapiens
gagacaaauucuuauccuu

SEQ ID NO: 967847 - RNA, 19 nt, Homo sapiens
gcaagucaccucuauuucu

SEQ ID NO: 967848 - RNA, 19 nt, Homo sapiens
ggagucugacgaaguauuu

SEQ ID NO: 967849 - RNA, 19 nt, Homo sapiens
ccaacaaccggcuugauuu

SEQ ID NO: 967850 - RNA, 19 nt, Homo sapiens
acaacaacaugauugcaaa

SEQ ID NO: 967851 - RNA, 19 nt, Homo sapiens
gcugagauauuuggacuuc

SEQ ID NO: 967852 - RNA, 19 nt, Homo sapiens
gaacuggaucugucccaaa

SEQ ID NO: 967853 - RNA, 19 nt, Homo sapiens
ggaagacccaagagagaaa

SEQ ID NO: 967854 - RNA, 19 nt, Homo sapiens
ccaagaugguuuaagaaca

SEQ ID NO: 967855 - RNA, 19 nt, Homo sapiens
ggaaaccagcuacuagaga

SEQ ID NO: 967856 - RNA, 19 nt, Homo sapiens
aggccuggcuguuuaaauu

SEQ ID NO: 967857 - RNA, 19 nt, Homo sapiens
aagaccagcuucccagaaa

SEQ ID NO: 967858 - RNA, 19 nt, Homo sapiens
gaucuuggcaccucucaug

SEQ ID NO: 967859 - RNA, 19 nt, Homo sapiens
acaaucauguggccuauag

SEQ ID NO: 967860 - RNA, 19 nt, Homo sapiens
ucccagagcauacagcuua

SEQ ID NO: 967861 - RNA, 19 nt, Homo sapiens
uugaugcgcugacagaauu

SEQ ID NO: 967862 - RNA, 19 nt, Homo sapiens
gaaacggucuagcccuucu

SEQ ID NO: 967863 - RNA, 19 nt, Homo sapiens
gaaaauguccucaacaauc

SEQ ID NO: 967864 - RNA, 19 nt, Homo sapiens
gagagauuauccaacuguu

SEQ ID NO: 967865 - RNA, 19 nt, Homo sapiens
ugcagaaacugaugaugaa

SEQ ID NO: 967866 - RNA, 19 nt, Homo sapiens
cucauuagccaaacucuua

SEQ ID NO: 967867 - RNA, 19 nt, Homo sapiens
agaaagaugccuuccuaaa

SEQ ID NO: 967868 - RNA, 19 nt, Homo sapiens
ggaggugacuauuccuuac

SEQ ID NO: 967869 - RNA, 19 nt, Homo sapiens
gaagaaacuccagugucua

SEQ ID NO: 967870 - RNA, 19 nt, Homo sapiens
ugaaagcugcuacaaguau

SEQ ID NO: 967871 - RNA, 19 nt, Homo sapiens
ccaauuggaucugucuuuc

SEQ ID NO: 967872 - RNA, 19 nt, Homo sapiens
ugacagacaaguaugcaaa

SEQ ID NO: 967873 - RNA, 19 nt, Homo sapiens
cgaggaaagggacugguua

SEQ ID NO: 967874 - RNA, 19 nt, Homo sapiens
caaccagaccucuacauuc

SEQ ID NO: 967875 - RNA, 19 nt, Homo sapiens
cugauucuguucucacuuu

SEQ ID NO: 967876 - RNA, 19 nt, Homo sapiens
gcacacaagggccaaagug

SEQ ID NO: 967877 - RNA, 19 nt, Homo sapiens
cuaaagaaccuggaaacuu

SEQ ID NO: 967878 - RNA, 19 nt, Homo sapiens
gcucugcucucuucaacca

SEQ ID NO: 967879 - RNA, 19 nt, Homo sapiens
aaauugcccucguuguuau

SEQ ID NO: 967880 - RNA, 19 nt, Homo sapiens
ucgaaauccuuguuauguu

SEQ ID NO: 967881 - RNA, 19 nt, Homo sapiens
aggaauuacucauaugcua

SEQ ID NO: 967882 - RNA, 19 nt, Homo sapiens
ggaucugucuuucaauuuu

SEQ ID NO: 967883 - RNA, 19 nt, Homo sapiens
ucaaaucuuucaguuggaa

SEQ ID NO: 967884 - RNA, 19 nt, Homo sapiens
ucacuuagauguuuuaugg

SEQ ID NO: 967885 - RNA, 19 nt, Homo sapiens
ucaacaaacuccaggaacu

SEQ ID NO: 967886 - RNA, 19 nt, Homo sapiens
aaagugcucucccugaaag

SEQ ID NO: 967887 - RNA, 19 nt, Homo sapiens
gcagacagauucuccaugu

SEQ ID NO: 967888 - RNA, 19 nt, Homo sapiens
gauccaggcugcagaagaa

SEQ ID NO: 967889 - RNA, 19 nt, Homo sapiens
ccaagagguuuaucaguga

SEQ ID NO: 967890 - RNA, 19 nt, Homo sapiens
ccaaagaaccucagcauca

SEQ ID NO: 967891 - RNA, 19 nt, Homo sapiens
gagaacagccugcggaaug

SEQ ID NO: 967892 - RNA, 19 nt, Homo sapiens
ggaagaaauugcagugucu

SEQ ID NO: 967893 - RNA, 19 nt, Homo sapiens
gcaaugagucugaguguuc

SEQ ID NO: 967894 - RNA, 19 nt, Homo sapiens
ugaaggagaugcccacugu

SEQ ID NO: 967895 - RNA, 19 nt, Homo sapiens
gaucaggacacaccuuuga

SEQ ID NO: 967896 - RNA, 19 nt, Homo sapiens
ccacaugcuugcaguccua

SEQ ID NO: 967897 - RNA, 19 nt, Homo sapiens
gacagggacuggcuucuca

SEQ ID NO: 967898 - RNA, 19 nt, Homo sapiens
ccaggacccucagcaauga

SEQ ID NO: 967899 - RNA, 19 nt, Homo sapiens
ugugguaguugucugauuu

SEQ ID NO: 967900 - RNA, 19 nt, Homo sapiens
gcagguagaaacacaguau

SEQ ID NO: 967901 - RNA, 19 nt, Homo sapiens
acacuuggcgucucaauga

SEQ ID NO: 967902 - RNA, 19 nt, Homo sapiens
ccacugccaucugaacaaa

SEQ ID NO: 967903 - RNA, 19 nt, Homo sapiens
gggagggacuguagguugu

SEQ ID NO: 967904 - RNA, 19 nt, Homo sapiens
caaagaaccucagcaucag

SEQ ID NO: 967905 - RNA, 19 nt, Homo sapiens
ggauggcucugucaauguc

SEQ ID NO: 967906 - RNA, 19 nt, Homo sapiens
gacagauucuccauguguu

SEQ ID NO: 967907 - RNA, 19 nt, Homo sapiens
guggauggcucugucaaug

SEQ ID NO: 967908 - RNA, 19 nt, Homo sapiens
caagagguuuaucagugaa

SEQ ID NO: 967909 - RNA, 19 nt, Homo sapiens
gccuuggucuucaugguaa

SEQ ID NO: 967910 - RNA, 19 nt, Homo sapiens
cugaacaaacuaugcaaua

SEQ ID NO: 967911 - RNA, 19 nt, Homo sapiens
ggacuacuguuggauugca

SEQ ID NO: 967912 - RNA, 19 nt, Homo sapiens
caggacuacuguuggauug

SEQ ID NO: 967913 - RNA, 19 nt, Homo sapiens
gaagaaauugcagugucua

SEQ ID NO: 967914 - RNA, 19 nt, Homo sapiens
ugaacaaacuaugcaauac

SEQ ID NO: 967915 - RNA, 19 nt, Homo sapiens
guaguugucugauuuuguu

SEQ ID NO: 967916 - RNA, 19 nt, Homo sapiens
caaggcaggcaguguggua

SEQ ID NO: 967917 - RNA, 19 nt, Homo sapiens
ugaaguuucugaccaagag

SEQ ID NO: 967918 - RNA, 19 nt, Homo sapiens
agaacagccugcggaauga

SEQ ID NO: 967919 - RNA, 19 nt, Homo sapiens
cgccagagcuuugauagca

SEQ ID NO: 967920 - RNA, 19 nt, Homo sapiens
ccaggccacuugugugugu

SEQ ID NO: 967921 - RNA, 19 nt, Homo sapiens
ccuaaagcauuuuggguua

SEQ ID NO: 967922 - RNA, 19 nt, Homo sapiens
gcugugaacuacucaagac

SEQ ID NO: 967923 - RNA, 19 nt, Homo sapiens
ccaucaaccugaaggagau

SEQ ID NO: 967924 - RNA, 19 nt, Homo sapiens
ucaacacgcucuccaccau

SEQ ID NO: 967925 - RNA, 19 nt, Homo sapiens
guguaccacugccaucuga

SEQ ID NO: 967926 - RNA, 19 nt, Homo sapiens
gaacuacucaagaccacau

SEQ ID NO: 967927 - RNA, 19 nt, Homo sapiens
gggaucaggacacaccuuu

SEQ ID NO: 967928 - RNA, 19 nt, Homo sapiens
caaugagucugaguguuca

SEQ ID NO: 967929 - RNA, 19 nt, Homo sapiens
gcacgugcagcaugucuuc

SEQ ID NO: 967930 - RNA, 19 nt, Homo sapiens
caccagccuuuccgucuga

SEQ ID NO: 967931 - RNA, 19 nt, Homo sapiens
uguagguuguccagcauaa

SEQ ID NO: 967932 - RNA, 19 nt, Homo sapiens
gaaauugcagugucuaucc

SEQ ID NO: 967933 - RNA, 19 nt, Homo sapiens
cagggaugcugcuucuguu

SEQ ID NO: 967934 - RNA, 19 nt, Homo sapiens
ccacuuguguguguaugug

SEQ ID NO: 967935 - RNA, 19 nt, Homo sapiens
gacaugggaucaggacaca

SEQ ID NO: 967936 - RNA, 19 nt, Homo sapiens
agagguuuaucagugaaua

SEQ ID NO: 967937 - RNA, 19 nt, Homo sapiens
ucucaggacuacuguugga

SEQ ID NO: 967938 - RNA, 19 nt, Homo sapiens
gggucagccuuaaguagga

SEQ ID NO: 967939 - RNA, 19 nt, Homo sapiens
gaacaaacuaugcaauacc

SEQ ID NO: 967940 - RNA, 19 nt, Homo sapiens
ccugguggguggaaggauu

SEQ ID NO: 967941 - RNA, 19 nt, Homo sapiens
agacagauucuccaugugu

SEQ ID NO: 967942 - RNA, 19 nt, Homo sapiens
ccuuugagaucccacuguu

SEQ ID NO: 967943 - RNA, 19 nt, Homo sapiens
ggccuuggucuucauggua

SEQ ID NO: 967944 - RNA, 19 nt, Homo sapiens
cugccugucuggacuuuga

SEQ ID NO: 967945 - RNA, 19 nt, Homo sapiens
caagacaccauggcucaga

SEQ ID NO: 967946 - RNA, 19 nt, Homo sapiens
uguccucgguguuuggaaa

SEQ ID NO: 967947 - RNA, 19 nt, Homo sapiens
uagcagacaagcagggaaa

SEQ ID NO: 967948 - RNA, 19 nt, Homo sapiens
agaaggcccaggcuacaaa

SEQ ID NO: 967949 - RNA, 19 nt, Homo sapiens
ggcaggcagugugguaguu

SEQ ID NO: 967950 - RNA, 19 nt, Homo sapiens
cgacagccgccagagcuuu

SEQ ID NO: 967951 - RNA, 19 nt, Homo sapiens
ggucagccuuaaguaggaa

SEQ ID NO: 967952 - RNA, 19 nt, Homo sapiens
ggcagaggguguggcuuug

SEQ ID NO: 967953 - RNA, 19 nt, Homo sapiens
cuacggauuuugcacuuuu

SEQ ID NO: 967954 - RNA, 19 nt, Homo sapiens
gcucaguacaggcaaguca

SEQ ID NO: 967955 - RNA, 19 nt, Homo sapiens
guguguaugugugugugua

SEQ ID NO: 967956 - RNA, 19 nt, Homo sapiens
gcagaagaaaguugucacu

SEQ ID NO: 967957 - RNA, 19 nt, Homo sapiens
gagaucccacuguuagcaa

SEQ ID NO: 967958 - RNA, 19 nt, Homo sapiens
cagguagaaacacaguaua

SEQ ID NO: 967959 - RNA, 19 nt, Homo sapiens
uuucugaccaagagguuua

SEQ ID NO: 967960 - RNA, 19 nt, Homo sapiens
aggcagaggguguggcuuu

SEQ ID NO: 967961 - RNA, 19 nt, Homo sapiens
aacaaacuaugcaauacca

SEQ ID NO: 967962 - RNA, 19 nt, Homo sapiens
gaccaagagguuuaucagu

SEQ ID NO: 967963 - RNA, 19 nt, Homo sapiens
ucaggacuacuguuggauu

SEQ ID NO: 967964 - RNA, 19 nt, Homo sapiens
cacagacucuuagcagaca

SEQ ID NO: 967965 - RNA, 19 nt, Homo sapiens
ucaggacacaccuuugaga

SEQ ID NO: 967966 - RNA, 19 nt, Homo sapiens
ggacagggacuggcuucuc

SEQ ID NO: 967967 - RNA, 19 nt, Homo sapiens
agucugcccugaccgugaa

SEQ ID NO: 967968 - RNA, 19 nt, Homo sapiens
gcccugaccgugaaguuuc

SEQ ID NO: 967969 - RNA, 19 nt, Homo sapiens
ccgugaaguuucugaccaa

SEQ ID NO: 967970 - RNA, 19 nt, Homo sapiens
uaaguaggaagaaauugca

SEQ ID NO: 967971 - RNA, 19 nt, Homo sapiens
cgucucaggacuacuguug

SEQ ID NO: 967972 - RNA, 19 nt, Homo sapiens
gcaggcagugugguaguug

SEQ ID NO: 967973 - RNA, 19 nt, Homo sapiens
gacagccgccagagcuuug

SEQ ID NO: 967974 - RNA, 19 nt, Homo sapiens
uccaggagcauuuuaauaa

SEQ ID NO: 967975 - RNA, 19 nt, Homo sapiens
uugcaaacagcaucucuga

SEQ ID NO: 967976 - RNA, 19 nt, Homo sapiens
gccauguccucgguguuug

SEQ ID NO: 967977 - RNA, 19 nt, Homo sapiens
acagauucuccauguguuu

SEQ ID NO: 967978 - RNA, 19 nt, Homo sapiens
ccacaguuuaucaaggaaa

SEQ ID NO: 967979 - RNA, 19 nt, Homo sapiens
ccuuaaguaggaagaaauu

SEQ ID NO: 967980 - RNA, 19 nt, Homo sapiens
ucuucggacucauucugua

SEQ ID NO: 967981 - RNA, 19 nt, Homo sapiens
gugugguaguugucugauu

SEQ ID NO: 967982 - RNA, 19 nt, Homo sapiens
gagguuuaucagugaauau

SEQ ID NO: 967983 - RNA, 19 nt, Homo sapiens
cagcaaugagucugagugu

SEQ ID NO: 967984 - RNA, 19 nt, Homo sapiens
cccaggacccucagcaaug

SEQ ID NO: 967985 - RNA, 19 nt, Homo sapiens
cgccauguccucgguguuu

SEQ ID NO: 967986 - RNA, 19 nt, Homo sapiens
caucugaacaaacuaugca

SEQ ID NO: 967987 - RNA, 19 nt, Homo sapiens
aauaaacucugucgucuga

SEQ ID NO: 967988 - RNA, 19 nt, Homo sapiens
aauaacagguagaguagaa

SEQ ID NO: 967989 - RNA, 19 nt, Homo sapiens
gcaauaacagguagaguag

SEQ ID NO: 967990 - RNA, 19 nt, Homo sapiens
ugaccaagcccucgaagaa

SEQ ID NO: 967991 - RNA, 19 nt, Homo sapiens
gaggcugagucugaaauaa

SEQ ID NO: 967992 - RNA, 19 nt, Homo sapiens
gagucuaaccagcguauaa

SEQ ID NO: 967993 - RNA, 19 nt, Homo sapiens
guacacacgcacauucauu

SEQ ID NO: 967994 - RNA, 19 nt, Homo sapiens
cagcaccaccugagucuaa

SEQ ID NO: 967995 - RNA, 19 nt, Homo sapiens
ggaggcugagucugaaaua

SEQ ID NO: 967996 - RNA, 19 nt, Homo sapiens
caugcagaguucacccuua

SEQ ID NO: 967997 - RNA, 19 nt, Homo sapiens
gaguggaggcugagucuga

SEQ ID NO: 967998 - RNA, 19 nt, Homo sapiens
gaacggcaagaaaggaaug

SEQ ID NO: 967999 - RNA, 19 nt, Homo sapiens
uacacacgcacauucauua

SEQ ID NO: 968000 - RNA, 19 nt, Homo sapiens
uaaacucugucgucugaag

SEQ ID NO: 968001 - RNA, 19 nt, Homo sapiens
ugcaauaacagguagagua

SEQ ID NO: 968002 - RNA, 19 nt, Homo sapiens
ccaccugccugucccauac

SEQ ID NO: 968003 - RNA, 19 nt, Homo sapiens
uaaccagcguauaaugcaa

SEQ ID NO: 968004 - RNA, 19 nt, Homo sapiens
gaguucacccuuaccuauu

SEQ ID NO: 968005 - RNA, 19 nt, Homo sapiens
gccagugcaugcagaguuc

SEQ ID NO: 968006 - RNA, 19 nt, Homo sapiens
ggaagacggagcccugaag

SEQ ID NO: 968007 - RNA, 19 nt, Homo sapiens
agucugaaauaaacucugu

SEQ ID NO: 968008 - RNA, 19 nt, Homo sapiens
gggaacggcaagaaaggaa

SEQ ID NO: 968009 - RNA, 19 nt, Homo sapiens
ggcugagucugaaauaaac

SEQ ID NO: 968010 - RNA, 19 nt, Homo sapiens
aggcugagucugaaauaaa

SEQ ID NO: 968011 - RNA, 19 nt, Homo sapiens
cacauucauuacacaccua

SEQ ID NO: 968012 - RNA, 19 nt, Homo sapiens
agaguucacccuuaccuau

SEQ ID NO: 968013 - RNA, 19 nt, Homo sapiens
gguagaguagaacugcuuu

SEQ ID NO: 968014 - RNA, 19 nt, Homo sapiens
ucauuacacaccuacauau

SEQ ID NO: 968015 - RNA, 19 nt, Homo sapiens
acccugcccuucucaacaa

SEQ ID NO: 968016 - RNA, 19 nt, Homo sapiens
ggaacggcaagaaaggaau

SEQ ID NO: 968017 - RNA, 19 nt, Homo sapiens
cauuacacaccuacauaug

SEQ ID NO: 968018 - RNA, 19 nt, Homo sapiens
ggucccugguccugugaga

SEQ ID NO: 968019 - RNA, 19 nt, Homo sapiens
acacgcacauucauuacac

SEQ ID NO: 968020 - RNA, 19 nt, Homo sapiens
gaccaagcccucgaagaag

SEQ ID NO: 968021 - RNA, 19 nt, Homo sapiens
ggagccacuuccuguacag

SEQ ID NO: 968022 - RNA, 19 nt, Homo sapiens
gcagccauagcccugauuc

SEQ ID NO: 968023 - RNA, 19 nt, Homo sapiens
acaaacagcugucauaugu

SEQ ID NO: 968024 - RNA, 19 nt, Homo sapiens
gcaucugucuucaagcuua

SEQ ID NO: 968025 - RNA, 19 nt, Homo sapiens
ggacaugacuggcacaaac

SEQ ID NO: 968026 - RNA, 19 nt, Homo sapiens
ggucagugcuauuuauaau

SEQ ID NO: 968027 - RNA, 19 nt, Homo sapiens
gcaagauuauagaggaaga

SEQ ID NO: 968028 - RNA, 19 nt, Homo sapiens
gcacaaacagcugucauau

SEQ ID NO: 968029 - RNA, 19 nt, Homo sapiens
guucaaggauugcaugagu

SEQ ID NO: 968030 - RNA, 19 nt, Homo sapiens
gugcaggcguucaaggauu

SEQ ID NO: 968031 - RNA, 19 nt, Homo sapiens
gcacccagcaagauuauag

SEQ ID NO: 968032 - RNA, 19 nt, Homo sapiens
gccaaguacugagaugauu

SEQ ID NO: 968033 - RNA, 19 nt, Homo sapiens
ggcacaaacagcugucaua

SEQ ID NO: 968034 - RNA, 19 nt, Homo sapiens
ggagacagacacauuaaac

SEQ ID NO: 968035 - RNA, 19 nt, Homo sapiens
uaagucagugugccaagua

SEQ ID NO: 968036 - RNA, 19 nt, Homo sapiens
cagcaagauuauagaggaa

SEQ ID NO: 968037 - RNA, 19 nt, Homo sapiens
ccagcacccagcaagauua

SEQ ID NO: 968038 - RNA, 19 nt, Homo sapiens
gcagaggaggcaagaacaa

SEQ ID NO: 968039 - RNA, 19 nt, Homo sapiens
ccaaguacugagaugauuu

SEQ ID NO: 968040 - RNA, 19 nt, Homo sapiens
cccaacgggugaagaaaga

SEQ ID NO: 968041 - RNA, 19 nt, Homo sapiens
guacugagaugauuuuagg

SEQ ID NO: 968042 - RNA, 19 nt, Homo sapiens
gagacagacacauuaaaca

SEQ ID NO: 968043 - RNA, 19 nt, Homo sapiens
auucucagcugucuuguuc

SEQ ID NO: 968044 - RNA, 19 nt, Homo sapiens
gggagacagacacauuaaa

SEQ ID NO: 968045 - RNA, 19 nt, Homo sapiens
ucaaggauugcaugaguga

SEQ ID NO: 968046 - RNA, 19 nt, Homo sapiens
ggaagaaauccuaaaugcu

SEQ ID NO: 968047 - RNA, 19 nt, Homo sapiens
gcugucauauguucauggu

SEQ ID NO: 968048 - RNA, 19 nt, Homo sapiens
ucuggucagugcuauuuau

SEQ ID NO: 968049 - RNA, 19 nt, Homo sapiens
gcagucuggucagugcuau

SEQ ID NO: 968050 - RNA, 19 nt, Homo sapiens
caccaguauuuaccaggaa

SEQ ID NO: 968051 - RNA, 19 nt, Homo sapiens
cacaaacagcugucauaug

SEQ ID NO: 968052 - RNA, 19 nt, Homo sapiens
gaccagcacccagcaagau

SEQ ID NO: 968053 - RNA, 19 nt, Homo sapiens
ugagagccauggguuugga

SEQ ID NO: 968054 - RNA, 19 nt, Homo sapiens
guugagagccauggguuug

SEQ ID NO: 968055 - RNA, 19 nt, Homo sapiens
ugcaggcguucaaggauug

SEQ ID NO: 968056 - RNA, 19 nt, Homo sapiens
acgggagacagacacauua

SEQ ID NO: 968057 - RNA, 19 nt, Homo sapiens
cgggagacagacacauuaa

SEQ ID NO: 968058 - RNA, 19 nt, Homo sapiens
gggugaagaaagacgauga

SEQ ID NO: 968059 - RNA, 19 nt, Homo sapiens
gacaugacuggcacaaaca

SEQ ID NO: 968060 - RNA, 19 nt, Homo sapiens
uacauucucagcugucuug

SEQ ID NO: 968061 - RNA, 19 nt, Homo sapiens
cacgggagacagacacauu

SEQ ID NO: 968062 - RNA, 19 nt, Homo sapiens
agacagacacauuaaacag

SEQ ID NO: 968063 - RNA, 19 nt, Homo sapiens
gaacaaggaaggagacuac

SEQ ID NO: 968064 - RNA, 19 nt, Homo sapiens
gugaaggaguggccuguug

SEQ ID NO: 968065 - RNA, 19 nt, Homo sapiens
ggccuguuguccugcuuua

SEQ ID NO: 968066 - RNA, 19 nt, Homo sapiens
uggcuaugcucgucacuug

SEQ ID NO: 968067 - RNA, 19 nt, Homo sapiens
gcacgggcuuguguagguu

SEQ ID NO: 968068 - RNA, 19 nt, Homo sapiens
caaaugcacgggcuugugu

SEQ ID NO: 968069 - RNA, 19 nt, Homo sapiens
gugcacugcugguggcuau

SEQ ID NO: 968070 - RNA, 19 nt, Homo sapiens
uacacucucugcagucuug

SEQ ID NO: 968071 - RNA, 19 nt, Homo sapiens
gcuaugcucgucacuugaa

SEQ ID NO: 968072 - RNA, 19 nt, Homo sapiens
caaggaaggagacuacacu

SEQ ID NO: 968073 - RNA, 19 nt, Homo sapiens
gucuuacacugcacccaaa

SEQ ID NO: 968074 - RNA, 19 nt, Homo sapiens
gaaggaguggccuguuguc

SEQ ID NO: 968075 - RNA, 19 nt, Homo sapiens
gcauucuggcucuuuggaa

SEQ ID NO: 968076 - RNA, 19 nt, Homo sapiens
gguaaaccguguuaucuua

SEQ ID NO: 968077 - RNA, 19 nt, Homo sapiens
ggagaacgcucuugacuuc

SEQ ID NO: 968078 - RNA, 19 nt, Homo sapiens
uagcagaacucuucagucu

SEQ ID NO: 968079 - RNA, 19 nt, Homo sapiens
ggagcauccucaucaaguu

SEQ ID NO: 968080 - RNA, 19 nt, Homo sapiens
gcaaggccauguguaagau

SEQ ID NO: 968081 - RNA, 19 nt, Homo sapiens
cgauagccaccaugaauaa

SEQ ID NO: 968082 - RNA, 19 nt, Homo sapiens
ugucgaaggucaccaaauc

SEQ ID NO: 968083 - RNA, 19 nt, Homo sapiens
ugacggacuuucaguuugu

SEQ ID NO: 968084 - RNA, 19 nt, Homo sapiens
caagcuagcagaacucuuc

SEQ ID NO: 968085 - RNA, 19 nt, Homo sapiens
gaagucugcguuguacaua

SEQ ID NO: 968086 - RNA, 19 nt, Homo sapiens
cguguuaucuuaggucuug

SEQ ID NO: 968087 - RNA, 19 nt, Homo sapiens
guauacgcguucccuguga

SEQ ID NO: 968088 - RNA, 19 nt, Homo sapiens
ccucaacucugcuccaaag

SEQ ID NO: 968089 - RNA, 19 nt, Homo sapiens
gcaucauuaucuugugcua

SEQ ID NO: 968090 - RNA, 19 nt, Homo sapiens
ggaagucugcguuguacau

SEQ ID NO: 968091 - RNA, 19 nt, Homo sapiens
gggacaagcuagcagaacu

SEQ ID NO: 968092 - RNA, 19 nt, Homo sapiens
caacaaaacugggguaaac

SEQ ID NO: 968093 - RNA, 19 nt, Homo sapiens
gggcugcacuccucaacuc

SEQ ID NO: 968094 - RNA, 19 nt, Homo sapiens
agccggaccugcucuacua

SEQ ID NO: 968095 - RNA, 19 nt, Homo sapiens
ccaaaucagugaccaucgu

SEQ ID NO: 968096 - RNA, 19 nt, Homo sapiens
ggcaaggccauguguaaga

SEQ ID NO: 968097 - RNA, 19 nt, Homo sapiens
gaggugaaaggaugaagga

SEQ ID NO: 968098 - RNA, 19 nt, Homo sapiens
uaaagaggugaaaggauga

SEQ ID NO: 968099 - RNA, 19 nt, Homo sapiens
gcgcaaguccucuaucaac

SEQ ID NO: 968100 - RNA, 19 nt, Homo sapiens
uggcgcaaguccucuauca

SEQ ID NO: 968101 - RNA, 19 nt, Homo sapiens
cacgauagccaccaugaau

SEQ ID NO: 968102 - RNA, 19 nt, Homo sapiens
ggguaaaccguguuaucuu

SEQ ID NO: 968103 - RNA, 19 nt, Homo sapiens
gagcauccucaucaaguuc

SEQ ID NO: 968104 - RNA, 19 nt, Homo sapiens
guaagaucguguccauggu

SEQ ID NO: 968105 - RNA, 19 nt, Homo sapiens
ucucuucaguagcugcuuu

SEQ ID NO: 968106 - RNA, 19 nt, Homo sapiens
caaaucagugaccaucguu

SEQ ID NO: 968107 - RNA, 19 nt, Homo sapiens
uguguaagaucguguccau

SEQ ID NO: 968108 - RNA, 19 nt, Homo sapiens
cugguucucuaccugauga

SEQ ID NO: 968109 - RNA, 19 nt, Homo sapiens
cgccaggacgcgcuuagua

SEQ ID NO: 968110 - RNA, 19 nt, Homo sapiens
acgauagccaccaugaaua

SEQ ID NO: 968111 - RNA, 19 nt, Homo sapiens
gguaaagaggugaaaggau

SEQ ID NO: 968112 - RNA, 19 nt, Homo sapiens
guaaaccguguuaucuuag

SEQ ID NO: 968113 - RNA, 19 nt, Homo sapiens
uaaaccguguuaucuuagg

SEQ ID NO: 968114 - RNA, 19 nt, Homo sapiens
aagucugcguuguacauaa

SEQ ID NO: 968115 - RNA, 19 nt, Homo sapiens
ggacaagcuagcagaacuc

SEQ ID NO: 968116 - RNA, 19 nt, Homo sapiens
ggccgaugcagccacgaua

SEQ ID NO: 968117 - RNA, 19 nt, Homo sapiens
cccagaacaugaccuagag

SEQ ID NO: 968118 - RNA, 19 nt, Homo sapiens
ccugggcucucucuucagu

SEQ ID NO: 968119 - RNA, 19 nt, Homo sapiens
caccuggcgucguggucua

SEQ ID NO: 968120 - RNA, 19 nt, Homo sapiens
ucggcaaggccauguguaa

SEQ ID NO: 968121 - RNA, 19 nt, Homo sapiens
gcuagcagaacucuucagu

SEQ ID NO: 968122 - RNA, 19 nt, Homo sapiens
guguguggaucugggcuuu

SEQ ID NO: 968123 - RNA, 19 nt, Homo sapiens
augcagggcuggcgcaagu

SEQ ID NO: 968124 - RNA, 19 nt, Homo sapiens
ccacgauagccaccaugaa

SEQ ID NO: 968125 - RNA, 19 nt, Homo sapiens
ccgcugggcaucauuaucu

SEQ ID NO: 968126 - RNA, 19 nt, Homo sapiens
agagguaccugcgcaugca

SEQ ID NO: 968127 - RNA, 19 nt, Homo sapiens
ccuggagcauccucaucaa

SEQ ID NO: 968128 - RNA, 19 nt, Homo sapiens
gcguuucccggacaaguug

SEQ ID NO: 968129 - RNA, 19 nt, Homo sapiens
gccaaggcgcugugugugu

SEQ ID NO: 968130 - RNA, 19 nt, Homo sapiens
gcggccaacacgaguggua

SEQ ID NO: 968131 - RNA, 19 nt, Homo sapiens
gaaagggaacguaucauua

SEQ ID NO: 968132 - RNA, 19 nt, Homo sapiens
gagcggauguauuggauuu

SEQ ID NO: 968133 - RNA, 19 nt, Homo sapiens
gacaaccacuuaccucuuu

SEQ ID NO: 968134 - RNA, 19 nt, Homo sapiens
guaagacucugugguauug

SEQ ID NO: 968135 - RNA, 19 nt, Homo sapiens
ccaaaugcaugcagaauuc

SEQ ID NO: 968136 - RNA, 19 nt, Homo sapiens
caagauacauggaugaagu

SEQ ID NO: 968137 - RNA, 19 nt, Homo sapiens
ugucaaccauggaaucuua

SEQ ID NO: 968138 - RNA, 19 nt, Homo sapiens
ccacacagacaaccacuua

SEQ ID NO: 968139 - RNA, 19 nt, Homo sapiens
gaaauaugaucucaguucu

SEQ ID NO: 968140 - RNA, 19 nt, Homo sapiens
acaaccagauguuccaaua

SEQ ID NO: 968141 - RNA, 19 nt, Homo sapiens
ggagguacaguuucucuaa

SEQ ID NO: 968142 - RNA, 19 nt, Homo sapiens
gaccauaacacaagcauga

SEQ ID NO: 968143 - RNA, 19 nt, Homo sapiens
gcagaugguuuaguuuaug

SEQ ID NO: 968144 - RNA, 19 nt, Homo sapiens
gaucucaguucucuuaugg

SEQ ID NO: 968145 - RNA, 19 nt, Homo sapiens
ggauuuagcagaaacaaug

SEQ ID NO: 968146 - RNA, 19 nt, Homo sapiens
ccacuuaccucuuuuagaa

SEQ ID NO: 968147 - RNA, 19 nt, Homo sapiens
ggaggaaucuuuucaacaa

SEQ ID NO: 968148 - RNA, 19 nt, Homo sapiens
aaagggaacguaucauuaa

SEQ ID NO: 968149 - RNA, 19 nt, Homo sapiens
ggaauucucaguauaucaa

SEQ ID NO: 968150 - RNA, 19 nt, Homo sapiens
acacaagcaugacuauaug

SEQ ID NO: 968151 - RNA, 19 nt, Homo sapiens
uaugaucucaguucucuua

SEQ ID NO: 968152 - RNA, 19 nt, Homo sapiens
aaccagauguuccaauauu

SEQ ID NO: 968153 - RNA, 19 nt, Homo sapiens
gccaugaagugucaauaug

SEQ ID NO: 968154 - RNA, 19 nt, Homo sapiens
cauaauggaauucucagua

SEQ ID NO: 968155 - RNA, 19 nt, Homo sapiens
gcagggaauuuucacauaa

SEQ ID NO: 968156 - RNA, 19 nt, Homo sapiens
ccaacaguauuugaucuuu

SEQ ID NO: 968157 - RNA, 19 nt, Homo sapiens
caugaagugucaauauguu

SEQ ID NO: 968158 - RNA, 19 nt, Homo sapiens
gcgguaggcugggaccaua

SEQ ID NO: 968159 - RNA, 19 nt, Homo sapiens
caacaguauuugaucuuuc

SEQ ID NO: 968160 - RNA, 19 nt, Homo sapiens
gaagguuccugagagcuau

SEQ ID NO: 968161 - RNA, 19 nt, Homo sapiens
cuauaaaccugucaauucu

SEQ ID NO: 968162 - RNA, 19 nt, Homo sapiens
ccuauaaaccugucaauuc

SEQ ID NO: 968163 - RNA, 19 nt, Homo sapiens
gagcuuguuccagcaauua

SEQ ID NO: 968164 - RNA, 19 nt, Homo sapiens
gggcagcacuugucaacca

SEQ ID NO: 968165 - RNA, 19 nt, Homo sapiens
gaaccaacaguauuugauc

SEQ ID NO: 968166 - RNA, 19 nt, Homo sapiens
uggagucucugggauauuu

SEQ ID NO: 968167 - RNA, 19 nt, Homo sapiens
ggccaucuauaugucaaua

SEQ ID NO: 968168 - RNA, 19 nt, Homo sapiens
gaauucauggccaucuaua

SEQ ID NO: 968169 - RNA, 19 nt, Homo sapiens
cagaugguuuaguuuauga

SEQ ID NO: 968170 - RNA, 19 nt, Homo sapiens
uguauuggauuuagcagaa

SEQ ID NO: 968171 - RNA, 19 nt, Homo sapiens
ugaaauaugaucucaguuc

SEQ ID NO: 968172 - RNA, 19 nt, Homo sapiens
ccauggaaucuuacaauuu

SEQ ID NO: 968173 - RNA, 19 nt, Homo sapiens
cagaauucauggccaucua

SEQ ID NO: 968174 - RNA, 19 nt, Homo sapiens
gaagaugaggcgacugaau

SEQ ID NO: 968175 - RNA, 19 nt, Homo sapiens
gagguacaguuucucuaau

SEQ ID NO: 968176 - RNA, 19 nt, Homo sapiens
agacuuggauccuauaaac

SEQ ID NO: 968177 - RNA, 19 nt, Homo sapiens
auaauuugcugucguuuca

SEQ ID NO: 968178 - RNA, 19 nt, Homo sapiens
agguacaguuucucuaaua

SEQ ID NO: 968179 - RNA, 19 nt, Homo sapiens
gcacuugucaaccauggaa

SEQ ID NO: 968180 - RNA, 19 nt, Homo sapiens
ccugagagcuauguagaga

SEQ ID NO: 968181 - RNA, 19 nt, Homo sapiens
ucucuuauggugacaguua

SEQ ID NO: 968182 - RNA, 19 nt, Homo sapiens
agaaagggaacguaucauu

SEQ ID NO: 968183 - RNA, 19 nt, Homo sapiens
auuaacaccucccgauuga

SEQ ID NO: 968184 - RNA, 19 nt, Homo sapiens
gguacaguuucucuaauag

SEQ ID NO: 968185 - RNA, 19 nt, Homo sapiens
gaaggaagaggaagguuuu

SEQ ID NO: 968186 - RNA, 19 nt, Homo sapiens
cagcagacacccaucaguu

SEQ ID NO: 968187 - RNA, 19 nt, Homo sapiens
ugaaggaagaggaagguuu

SEQ ID NO: 968188 - RNA, 19 nt, Homo sapiens
uaacacaagcaugacuaua

SEQ ID NO: 968189 - RNA, 19 nt, Homo sapiens
gagcauucacuucaagaug

SEQ ID NO: 968190 - RNA, 19 nt, Homo sapiens
cugcagaugguuuaguuua

SEQ ID NO: 968191 - RNA, 19 nt, Homo sapiens
ugacagaaagggaacguau

SEQ ID NO: 968192 - RNA, 19 nt, Homo sapiens
gcauucacuucaagaugug

SEQ ID NO: 968193 - RNA, 19 nt, Homo sapiens
ucucugggauauuuaugaa

SEQ ID NO: 968194 - RNA, 19 nt, Homo sapiens
gggaacguaucauuaacca

SEQ ID NO: 968195 - RNA, 19 nt, Homo sapiens
gaggauggccacacagaca

SEQ ID NO: 968196 - RNA, 19 nt, Homo sapiens
cauggagucucugggauau

SEQ ID NO: 968197 - RNA, 19 nt, Homo sapiens
gcggauguauuggauuuag

SEQ ID NO: 968198 - RNA, 19 nt, Homo sapiens
caguuucucuaauagcauu

SEQ ID NO: 968199 - RNA, 19 nt, Homo sapiens
uaacaccucccgauugaag

SEQ ID NO: 968200 - RNA, 19 nt, Homo sapiens
aauaugaucucaguucucu

SEQ ID NO: 968201 - RNA, 19 nt, Homo sapiens
ccauggagucucugggaua

SEQ ID NO: 968202 - RNA, 19 nt, Homo sapiens
cgaagguuccugagagcua

SEQ ID NO: 968203 - RNA, 19 nt, Homo sapiens
cauaacacaagcaugacua

SEQ ID NO: 968204 - RNA, 19 nt, Homo sapiens
auaaaccugucaauucugu

SEQ ID NO: 968205 - RNA, 19 nt, Homo sapiens
gcaugacuauaugaaggaa

SEQ ID NO: 968206 - RNA, 19 nt, Homo sapiens
uaaaguagcagggaauuuu

SEQ ID NO: 968207 - RNA, 19 nt, Homo sapiens
cauuaacaccucccgauug

SEQ ID NO: 968208 - RNA, 19 nt, Homo sapiens
guauuggauuuagcagaaa

SEQ ID NO: 968209 - RNA, 19 nt, Homo sapiens
gauauuacuguugccauga

SEQ ID NO: 968210 - RNA, 19 nt, Homo sapiens
gccaguggagguacaguuu

SEQ ID NO: 968211 - RNA, 19 nt, Homo sapiens
acaagaagagcauucacuu

SEQ ID NO: 968212 - RNA, 19 nt, Homo sapiens
ugagagcuauguagagacu

SEQ ID NO: 968213 - RNA, 19 nt, Homo sapiens
acagaaagggaacguauca

SEQ ID NO: 968214 - RNA, 19 nt, Homo sapiens
caaccagauguuccaauau

SEQ ID NO: 968215 - RNA, 19 nt, Homo sapiens
caacuauggcuuuauuaac

SEQ ID NO: 968216 - RNA, 19 nt, Homo sapiens
cauggaugaaguaugaaua

SEQ ID NO: 968217 - RNA, 19 nt, Homo sapiens
aacacaagcaugacuauau

SEQ ID NO: 968218 - RNA, 19 nt, Homo sapiens
uuucagacuuggauccuau

SEQ ID NO: 968219 - RNA, 19 nt, Homo sapiens
caauaaaguagcagggaau

SEQ ID NO: 968220 - RNA, 19 nt, Homo sapiens
ggagucucugggauauuua

SEQ ID NO: 968221 - RNA, 19 nt, Homo sapiens
accagauguuccaauauuu

SEQ ID NO: 968222 - RNA, 19 nt, Homo sapiens
cuuguuccagcaauuauua

SEQ ID NO: 968223 - RNA, 19 nt, Homo sapiens
gaagugucaauauguugga

SEQ ID NO: 968224 - RNA, 19 nt, Homo sapiens
accauggaaucuuacaauu

SEQ ID NO: 968225 - RNA, 19 nt, Homo sapiens
gcacauuugggcagcacuu

SEQ ID NO: 968226 - RNA, 19 nt, Homo sapiens
ucaucacagucuccaaaug

SEQ ID NO: 968227 - RNA, 19 nt, Homo sapiens
ccaugaagugucaauaugu

SEQ ID NO: 968228 - RNA, 19 nt, Homo sapiens
aauacgaaguagacaagga

SEQ ID NO: 968229 - RNA, 19 nt, Homo sapiens
uuuguaagacucuguggua

SEQ ID NO: 968230 - RNA, 19 nt, Homo sapiens
gcagacacccaucaguuuu

SEQ ID NO: 968231 - RNA, 19 nt, Homo sapiens
ggacugagauugagaagug

SEQ ID NO: 968232 - RNA, 19 nt, Homo sapiens
gaagugcacggcugagaua

SEQ ID NO: 968233 - RNA, 19 nt, Homo sapiens
gaacgugacccuugagaug

SEQ ID NO: 968234 - RNA, 19 nt, Homo sapiens
gaagaggcccagauuguga

SEQ ID NO: 968235 - RNA, 19 nt, Homo sapiens
gagaggacguggcugaaga

SEQ ID NO: 968236 - RNA, 19 nt, Homo sapiens
caggguggcugcacgauuu

SEQ ID NO: 968237 - RNA, 19 nt, Homo sapiens
gcuaagagcaccaugaaga

SEQ ID NO: 968238 - RNA, 19 nt, Homo sapiens
gcuaugagcuggaguuugc

SEQ ID NO: 968239 - RNA, 19 nt, Homo sapiens
ugaccacccuggcaccuua

SEQ ID NO: 968240 - RNA, 19 nt, Homo sapiens
ggacgcagcccuggaauau

SEQ ID NO: 968241 - RNA, 19 nt, Homo sapiens
gcaggaagagguacaguga

SEQ ID NO: 968242 - RNA, 19 nt, Homo sapiens
ggucugauggccucuaaua

SEQ ID NO: 968243 - RNA, 19 nt, Homo sapiens
gaacacggacccauauauc

SEQ ID NO: 968244 - RNA, 19 nt, Homo sapiens
gagacgggcuggagaaugg

SEQ ID NO: 968245 - RNA, 19 nt, Homo sapiens
cuaauaaacuguguccuau

SEQ ID NO: 968246 - RNA, 19 nt, Homo sapiens
caagaugucugccaacaac

SEQ ID NO: 968247 - RNA, 19 nt, Homo sapiens
gcgcccagcugcaguaugu

SEQ ID NO: 968248 - RNA, 19 nt, Homo sapiens
gagcagaagcggaugaaug

SEQ ID NO: 968249 - RNA, 19 nt, Homo sapiens
guacaucuacacccuguuu

SEQ ID NO: 968250 - RNA, 19 nt, Homo sapiens
gagcuggaguuugcuaaga

SEQ ID NO: 968251 - RNA, 19 nt, Homo sapiens
gagguacagugacaucuuc

SEQ ID NO: 968252 - RNA, 19 nt, Homo sapiens
guccagaggguuccuauaa

SEQ ID NO: 968253 - RNA, 19 nt, Homo sapiens
ggccacaccuaccgagauu

SEQ ID NO: 968254 - RNA, 19 nt, Homo sapiens
gcacuacgagcagaucuuu

SEQ ID NO: 968255 - RNA, 19 nt, Homo sapiens
ccaaacggacugagauuga

SEQ ID NO: 968256 - RNA, 19 nt, Homo sapiens
ggacaaccucgaaaucuca

SEQ ID NO: 968257 - RNA, 19 nt, Homo sapiens
guuauccgcucgcugaaga

SEQ ID NO: 968258 - RNA, 19 nt, Homo sapiens
gugcacggcugagauagaa

SEQ ID NO: 968259 - RNA, 19 nt, Homo sapiens
gcugcacgauuuauggaaa

SEQ ID NO: 968260 - RNA, 19 nt, Homo sapiens
gcacgaggcagcuggugaa

SEQ ID NO: 968261 - RNA, 19 nt, Homo sapiens
uaaggaagaggcccagauu

SEQ ID NO: 968262 - RNA, 19 nt, Homo sapiens
caaccugggcauuguguuu

SEQ ID NO: 968263 - RNA, 19 nt, Homo sapiens
gguccacccuagucucuga

SEQ ID NO: 968264 - RNA, 19 nt, Homo sapiens
gagccgcuaugccaaggaa

SEQ ID NO: 968265 - RNA, 19 nt, Homo sapiens
ggaagaggcccagauugug

SEQ ID NO: 968266 - RNA, 19 nt, Homo sapiens
gugccaggcuuucgagaau

SEQ ID NO: 968267 - RNA, 19 nt, Homo sapiens
ccacaugccucugcaguac

SEQ ID NO: 968268 - RNA, 19 nt, Homo sapiens
ucugauggccucuaauaaa

SEQ ID NO: 968269 - RNA, 19 nt, Homo sapiens
cgaguguccucaagcgauu

SEQ ID NO: 968270 - RNA, 19 nt, Homo sapiens
ucuaauaaacuguguccua

SEQ ID NO: 968271 - RNA, 19 nt, Homo sapiens
ccagaggguuccuauaagg

SEQ ID NO: 968272 - RNA, 19 nt, Homo sapiens
ggacuucccggaggaggua

SEQ ID NO: 968273 - RNA, 19 nt, Homo sapiens
gaagagguacagugacauc

SEQ ID NO: 968274 - RNA, 19 nt, Homo sapiens
gaaaagagagccagcuaug

SEQ ID NO: 968275 - RNA, 19 nt, Homo sapiens
cugcuugccuggacugaaa

SEQ ID NO: 968276 - RNA, 19 nt, Homo sapiens
gguggugccugaggucuga

SEQ ID NO: 968277 - RNA, 19 nt, Homo sapiens
cacccuggcaccuuaaaua

SEQ ID NO: 968278 - RNA, 19 nt, Homo sapiens
gauggccucuaauaaacug

SEQ ID NO: 968279 - RNA, 19 nt, Homo sapiens
ugugaggagugcuuucuga

SEQ ID NO: 968280 - RNA, 19 nt, Homo sapiens
gacaguggcccagcagaaa

SEQ ID NO: 968281 - RNA, 19 nt, Homo sapiens
gcagaucuuugggauggau

SEQ ID NO: 968282 - RNA, 19 nt, Homo sapiens
gaagcucucugggccucuu

SEQ ID NO: 968283 - RNA, 19 nt, Homo sapiens
cggaggagguacccuuugu

SEQ ID NO: 968284 - RNA, 19 nt, Homo sapiens
ucaaggagcaguggaugaa

SEQ ID NO: 968285 - RNA, 19 nt, Homo sapiens
ggacguccagccugaggaa

SEQ ID NO: 968286 - RNA, 19 nt, Homo sapiens
cggcuacucucgaaauugg

SEQ ID NO: 968287 - RNA, 19 nt, Homo sapiens
gcugaagacaccaaagaug

SEQ ID NO: 968288 - RNA, 19 nt, Homo sapiens
aaagagagccagcuaugag

SEQ ID NO: 968289 - RNA, 19 nt, Homo sapiens
gagauuccaacuccacaga

SEQ ID NO: 968290 - RNA, 19 nt, Homo sapiens
aggaagagguacagugaca

SEQ ID NO: 968291 - RNA, 19 nt, Homo sapiens
caaacggacugagauugag

SEQ ID NO: 968292 - RNA, 19 nt, Homo sapiens
agaaguggcggaaggaguu

SEQ ID NO: 968293 - RNA, 19 nt, Homo sapiens
ugaacacggacccauauau

SEQ ID NO: 968294 - RNA, 19 nt, Homo sapiens
gcacggcugagauagaaca

SEQ ID NO: 968295 - RNA, 19 nt, Homo sapiens
cgagugcugugcgcccuuu

SEQ ID NO: 968296 - RNA, 19 nt, Homo sapiens
agcagaagcggaugaauga

SEQ ID NO: 968297 - RNA, 19 nt, Homo sapiens
gcaagguguccauucaaca

SEQ ID NO: 968298 - RNA, 19 nt, Homo sapiens
cagggucagugcagguuau

SEQ ID NO: 968299 - RNA, 19 nt, Homo sapiens
cuacgacgccuucaucucu

SEQ ID NO: 968300 - RNA, 19 nt, Homo sapiens
ggcaagguguccauucaac

SEQ ID NO: 968301 - RNA, 19 nt, Homo sapiens
cugauggccucuaauaaac

SEQ ID NO: 968302 - RNA, 19 nt, Homo sapiens
cagugcagguuaugagauc

SEQ ID NO: 968303 - RNA, 19 nt, Homo sapiens
gcccaagcauuuugagauu

SEQ ID NO: 968304 - RNA, 19 nt, Homo sapiens
gccaacaaccugggcauug

SEQ ID NO: 968305 - RNA, 19 nt, Homo sapiens
gugaacacggacccauaua

SEQ ID NO: 968306 - RNA, 19 nt, Homo sapiens
aggcccagcuuguggaguu

SEQ ID NO: 968307 - RNA, 19 nt, Homo sapiens
guacagcugccugacucua

SEQ ID NO: 968308 - RNA, 19 nt, Homo sapiens
ggagacgggcuggagaaug

SEQ ID NO: 968309 - RNA, 19 nt, Homo sapiens
ugcgcaagcugguguuuca

SEQ ID NO: 968310 - RNA, 19 nt, Homo sapiens
acgcagcccuggaauaugc

SEQ ID NO: 968311 - RNA, 19 nt, Homo sapiens
cagccacuguuaccaacga

SEQ ID NO: 968312 - RNA, 19 nt, Homo sapiens
ugggaacccuggccaugga

SEQ ID NO: 968313 - RNA, 19 nt, Homo sapiens
gccacaugccucugcagua

SEQ ID NO: 968314 - RNA, 19 nt, Homo sapiens
gagccuggacaaccucgaa

SEQ ID NO: 968315 - RNA, 19 nt, Homo sapiens
ggacaggggugcuuuugcu

SEQ ID NO: 968316 - RNA, 19 nt, Homo sapiens
acaggucacugccaagcau

SEQ ID NO: 968317 - RNA, 19 nt, Homo sapiens
aggaagaggcccagauugu

SEQ ID NO: 968318 - RNA, 19 nt, Homo sapiens
ggaacgugacccuugagau

SEQ ID NO: 968319 - RNA, 19 nt, Homo sapiens
gagagaggacguggcugaa

SEQ ID NO: 968320 - RNA, 19 nt, Homo sapiens
gccaggcuuucgagaaugg

SEQ ID NO: 968321 - RNA, 19 nt, Homo sapiens
cuaagagcaccaugaagau

SEQ ID NO: 968322 - RNA, 19 nt, Homo sapiens
agacaguggcccagcagaa

SEQ ID NO: 968323 - RNA, 19 nt, Homo sapiens
gguccagaggguuccuaua

SEQ ID NO: 968324 - RNA, 19 nt, Homo sapiens
ggagugugaggagugcuuu

SEQ ID NO: 968325 - RNA, 19 nt, Homo sapiens
cuggcaagguguccauuca

SEQ ID NO: 968326 - RNA, 19 nt, Homo sapiens
aacaagaugucugccaaca

SEQ ID NO: 968327 - RNA, 19 nt, Homo sapiens
ccugguggcccaucuguuc

SEQ ID NO: 968328 - RNA, 19 nt, Homo sapiens
uacagcugccugacucuaa

SEQ ID NO: 968329 - RNA, 19 nt, Homo sapiens
ggaggagguacccuuugug

SEQ ID NO: 968330 - RNA, 19 nt, Homo sapiens
gcagcuacccagggacuuc

SEQ ID NO: 968331 - RNA, 19 nt, Homo sapiens
gcucugaaguguuuguaua

SEQ ID NO: 968332 - RNA, 19 nt, Homo sapiens
gaacagauccuggaagcua

SEQ ID NO: 968333 - RNA, 19 nt, Homo sapiens
uaaauuggaccuucacaua

SEQ ID NO: 968334 - RNA, 19 nt, Homo sapiens
uagaagagcucauccuuuc

SEQ ID NO: 968335 - RNA, 19 nt, Homo sapiens
gaacauaccauccgagaca

SEQ ID NO: 968336 - RNA, 19 nt, Homo sapiens
gcaaauggcuacucugaac

SEQ ID NO: 968337 - RNA, 19 nt, Homo sapiens
ggaaugaguucugaaaugg

SEQ ID NO: 968338 - RNA, 19 nt, Homo sapiens
cacaacauccugaagauua

SEQ ID NO: 968339 - RNA, 19 nt, Homo sapiens
caggagagaugguagaaga

SEQ ID NO: 968340 - RNA, 19 nt, Homo sapiens
ggauggagcccuaggguaa

SEQ ID NO: 968341 - RNA, 19 nt, Homo sapiens
gaaaagaugcugauuggua

SEQ ID NO: 968342 - RNA, 19 nt, Homo sapiens
gcaggugaauccaaucuuc

SEQ ID NO: 968343 - RNA, 19 nt, Homo sapiens
gggauccgcucuacgugua

SEQ ID NO: 968344 - RNA, 19 nt, Homo sapiens
ccugagggcuccugcagua

SEQ ID NO: 968345 - RNA, 19 nt, Homo sapiens
cacaggcucuucugacuuu

SEQ ID NO: 968346 - RNA, 19 nt, Homo sapiens
uuaauccgcuucacuaaau

SEQ ID NO: 968347 - RNA, 19 nt, Homo sapiens
caacacaacauccugaaga

SEQ ID NO: 968348 - RNA, 19 nt, Homo sapiens
cuacugcagcucuguauua

SEQ ID NO: 968349 - RNA, 19 nt, Homo sapiens
gggcugacaucaucaaagu

SEQ ID NO: 968350 - RNA, 19 nt, Homo sapiens
ggaccacacuucggccuuu

SEQ ID NO: 968351 - RNA, 19 nt, Homo sapiens
gaagcaaacagucugagaa

SEQ ID NO: 968352 - RNA, 19 nt, Homo sapiens
uggcuacucugaacacuuu

SEQ ID NO: 968353 - RNA, 19 nt, Homo sapiens
gagagcucauugacuguaa

SEQ ID NO: 968354 - RNA, 19 nt, Homo sapiens
aaauggccaugaagaagua

SEQ ID NO: 968355 - RNA, 19 nt, Homo sapiens
gaaauggccaugaagaagu

SEQ ID NO: 968356 - RNA, 19 nt, Homo sapiens
guucugaaauggccaugaa

SEQ ID NO: 968357 - RNA, 19 nt, Homo sapiens
uacaagcucuucuauggaa

SEQ ID NO: 968358 - RNA, 19 nt, Homo sapiens
gaagauugguccuuaugac

SEQ ID NO: 968359 - RNA, 19 nt, Homo sapiens
gaugcugauugguacauaa

SEQ ID NO: 968360 - RNA, 19 nt, Homo sapiens
uggccaagguucucuguaa

SEQ ID NO: 968361 - RNA, 19 nt, Homo sapiens
ggaacucaaagcagacaua

SEQ ID NO: 968362 - RNA, 19 nt, Homo sapiens
ccucaaaggccacaucauu

SEQ ID NO: 968363 - RNA, 19 nt, Homo sapiens
gaaacuggacuucaaggau

SEQ ID NO: 968364 - RNA, 19 nt, Homo sapiens
gguagaagaaggaagugua

SEQ ID NO: 968365 - RNA, 19 nt, Homo sapiens
gggcguggcugaguacaga

SEQ ID NO: 968366 - RNA, 19 nt, Homo sapiens
uggaaugaguucugaaaug

SEQ ID NO: 968367 - RNA, 19 nt, Homo sapiens
guagaagagcucauccuuu

SEQ ID NO: 968368 - RNA, 19 nt, Homo sapiens
caggagaacuaccuucauc

SEQ ID NO: 968369 - RNA, 19 nt, Homo sapiens
ccaagguucucuguaaguu

SEQ ID NO: 968370 - RNA, 19 nt, Homo sapiens
cgagagggauggcaagaag

SEQ ID NO: 968371 - RNA, 19 nt, Homo sapiens
ggaagauugguccuuauga

SEQ ID NO: 968372 - RNA, 19 nt, Homo sapiens
ucacuaaauuggaccuuca

SEQ ID NO: 968373 - RNA, 19 nt, Homo sapiens
cugcagcucuguauuacuu

SEQ ID NO: 968374 - RNA, 19 nt, Homo sapiens
ggaaagacaguggaaguuc

SEQ ID NO: 968375 - RNA, 19 nt, Homo sapiens
gaagagcucauccuuucug

SEQ ID NO: 968376 - RNA, 19 nt, Homo sapiens
ugacaacgaugugaaacug

SEQ ID NO: 968377 - RNA, 19 nt, Homo sapiens
uaaguucucucucuucacu

SEQ ID NO: 968378 - RNA, 19 nt, Homo sapiens
gcagcucuguauuacuuug

SEQ ID NO: 968379 - RNA, 19 nt, Homo sapiens
gcucuucuauggaaugagu

SEQ ID NO: 968380 - RNA, 19 nt, Homo sapiens
aguacaagcucuucuaugg

SEQ ID NO: 968381 - RNA, 19 nt, Homo sapiens
gauugguccuuaugacuuc

SEQ ID NO: 968382 - RNA, 19 nt, Homo sapiens
gggccaggcucugugugua

SEQ ID NO: 968383 - RNA, 19 nt, Homo sapiens
acaacauccugaagauuau

SEQ ID NO: 968384 - RNA, 19 nt, Homo sapiens
ggaagcaaacagucugaga

SEQ ID NO: 968385 - RNA, 19 nt, Homo sapiens
guaacucuguacuucucua

SEQ ID NO: 968386 - RNA, 19 nt, Homo sapiens
cccaaacgcaguacccuua

SEQ ID NO: 968387 - RNA, 19 nt, Homo sapiens
uaaagagagagcucauuga

SEQ ID NO: 968388 - RNA, 19 nt, Homo sapiens
ucaaaggccacaucauuuc

SEQ ID NO: 968389 - RNA, 19 nt, Homo sapiens
uaagcgccaugccucauau

SEQ ID NO: 968390 - RNA, 19 nt, Homo sapiens
gcacaggcucuucugacuu

SEQ ID NO: 968391 - RNA, 19 nt, Homo sapiens
gaaauaccucaauaaagag

SEQ ID NO: 968392 - RNA, 19 nt, Homo sapiens
gcaaggaagcaaacagucu

SEQ ID NO: 968393 - RNA, 19 nt, Homo sapiens
ggagggauccgcucuacgu

SEQ ID NO: 968394 - RNA, 19 nt, Homo sapiens
gguaacaggagagauggua

SEQ ID NO: 968395 - RNA, 19 nt, Homo sapiens
agaguuugcuggccagaau

SEQ ID NO: 968396 - RNA, 19 nt, Homo sapiens
gcaaacagucugagaaaau

SEQ ID NO: 968397 - RNA, 19 nt, Homo sapiens
gguagaagagcucauccuu

SEQ ID NO: 968398 - RNA, 19 nt, Homo sapiens
cacaagauccuuuucauuu

SEQ ID NO: 968399 - RNA, 19 nt, Homo sapiens
aaauuggaccuucacauau

SEQ ID NO: 968400 - RNA, 19 nt, Homo sapiens
guuaauccgcuucacuaaa

SEQ ID NO: 968401 - RNA, 19 nt, Homo sapiens
gagaaaaugaugcaagaaa

SEQ ID NO: 968402 - RNA, 19 nt, Homo sapiens
aagcaaacagucugagaaa

SEQ ID NO: 968403 - RNA, 19 nt, Homo sapiens
guacaagcucuucuaugga

SEQ ID NO: 968404 - RNA, 19 nt, Homo sapiens
gggaaagacaguggaaguu

SEQ ID NO: 968405 - RNA, 19 nt, Homo sapiens
caaaggccacaucauuuca

SEQ ID NO: 968406 - RNA, 19 nt, Homo sapiens
uguaaguucucucucuuca

SEQ ID NO: 968407 - RNA, 19 nt, Homo sapiens
gcgccaugccucauauuga

SEQ ID NO: 968408 - RNA, 19 nt, Homo sapiens
auaaagagagagcucauug

SEQ ID NO: 968409 - RNA, 19 nt, Homo sapiens
agagggauggcaagaagua

SEQ ID NO: 968410 - RNA, 19 nt, Homo sapiens
aauuggaccuucacauauc

SEQ ID NO: 968411 - RNA, 19 nt, Homo sapiens
gaggaagcaaggaagcaaa

SEQ ID NO: 968412 - RNA, 19 nt, Homo sapiens
uaacaggagagaugguaga

SEQ ID NO: 968413 - RNA, 19 nt, Homo sapiens
ccaaacgcaguacccuuaa

SEQ ID NO: 968414 - RNA, 19 nt, Homo sapiens
gggaagauugguccuuaug

SEQ ID NO: 968415 - RNA, 19 nt, Homo sapiens
caaacagucugagaaaaug

SEQ ID NO: 968416 - RNA, 19 nt, Homo sapiens
gucauuuccuguugucuca

SEQ ID NO: 968417 - RNA, 19 nt, Homo sapiens
guagaagaaggaaguguag

SEQ ID NO: 968418 - RNA, 19 nt, Homo sapiens
gagcugacuucgugaugcu

SEQ ID NO: 968419 - RNA, 19 nt, Homo sapiens
caaacgcaguacccuuaag

SEQ ID NO: 968420 - RNA, 19 nt, Homo sapiens
ggaggaagcaaggaagcaa

SEQ ID NO: 968421 - RNA, 19 nt, Homo sapiens
ccaaggcaccaguacucua

SEQ ID NO: 968422 - RNA, 19 nt, Homo sapiens
gggauguggccaaggcuuu

SEQ ID NO: 968423 - RNA, 19 nt, Homo sapiens
cucaaaggccacaucauuu

SEQ ID NO: 968424 - RNA, 19 nt, Homo sapiens
ccacagcucagcgcaguga

SEQ ID NO: 968425 - RNA, 19 nt, Homo sapiens
uaagcacuauagccucguu

SEQ ID NO: 968426 - RNA, 19 nt, Homo sapiens
cuaagcgccaugccucaua

SEQ ID NO: 968427 - RNA, 19 nt, Homo sapiens
uaauccgcuucacuaaauu

SEQ ID NO: 968428 - RNA, 19 nt, Homo sapiens
ucuauggaaugaguucuga

SEQ ID NO: 968429 - RNA, 19 nt, Homo sapiens
ggccaagguucucuguaag

SEQ ID NO: 968430 - RNA, 19 nt, Homo sapiens
gaacucaaagcagacauac

SEQ ID NO: 968431 - RNA, 19 nt, Homo sapiens
gaggaggagugcaggauug

SEQ ID NO: 968432 - RNA, 19 nt, Homo sapiens
gaacggcccugugcuuaag

SEQ ID NO: 968433 - RNA, 19 nt, Homo sapiens
gcugagcgaugacugcauu

SEQ ID NO: 968434 - RNA, 19 nt, Homo sapiens
gaaguggcccuggagauug

SEQ ID NO: 968435 - RNA, 19 nt, Homo sapiens
acaagaaacugcgcaacug

SEQ ID NO: 968436 - RNA, 19 nt, Homo sapiens
gaggguggcgauuaaaguu

SEQ ID NO: 968437 - RNA, 19 nt, Homo sapiens
gcacaccagcccucagaga

SEQ ID NO: 968438 - RNA, 19 nt, Homo sapiens
uagaacggcccugugcuua

SEQ ID NO: 968439 - RNA, 19 nt, Homo sapiens
aacccgagcuccugcagaa

SEQ ID NO: 968440 - RNA, 19 nt, Homo sapiens
guagaacggcccugugcuu

SEQ ID NO: 968441 - RNA, 19 nt, Homo sapiens
gcucggcuguggaaccaau

SEQ ID NO: 968442 - RNA, 19 nt, Homo sapiens
cgucugaggguggcgauua

SEQ ID NO: 968443 - RNA, 19 nt, Homo sapiens
gucugaggguggcgauuaa

SEQ ID NO: 968444 - RNA, 19 nt, Homo sapiens
gaaccugccacagccagaa

SEQ ID NO: 968445 - RNA, 19 nt, Homo sapiens
agaaguggcccuggagauu

SEQ ID NO: 968446 - RNA, 19 nt, Homo sapiens
gagcucggcuguggaacca

SEQ ID NO: 968447 - RNA, 19 nt, Homo sapiens
gacaagaaacugcgcaacu

SEQ ID NO: 968448 - RNA, 19 nt, Homo sapiens
aaguggcccuggagauuga

SEQ ID NO: 968449 - RNA, 19 nt, Homo sapiens
gacaggaggagagcaguga

SEQ ID NO: 968450 - RNA, 19 nt, Homo sapiens
ugucaccucucucaggaau

SEQ ID NO: 968451 - RNA, 19 nt, Homo sapiens
gaugacugcauuccacuca

SEQ ID NO: 968452 - RNA, 19 nt, Homo sapiens
gcccugugcuuaagacacu

SEQ ID NO: 968453 - RNA, 19 nt, Homo sapiens
agaacggcccugugcuuaa

SEQ ID NO: 968454 - RNA, 19 nt, Homo sapiens
ugagccauguacccagaaa

SEQ ID NO: 968455 - RNA, 19 nt, Homo sapiens
gguuacugguggccaugaa

SEQ ID NO: 968456 - RNA, 19 nt, Homo sapiens
gacgagcucggcuguggaa

SEQ ID NO: 968457 - RNA, 19 nt, Homo sapiens
gaagcccaacugccuaugg

SEQ ID NO: 968458 - RNA, 19 nt, Homo sapiens
ucaccucucucaggaaugc

SEQ ID NO: 968459 - RNA, 19 nt, Homo sapiens
gcagcgauggcagcgauga

SEQ ID NO: 968460 - RNA, 19 nt, Homo sapiens
gcccugaggacaagcacuu

SEQ ID NO: 968461 - RNA, 19 nt, Homo sapiens
gugcaggauugagccaugu

SEQ ID NO: 968462 - RNA, 19 nt, Homo sapiens
ugaggaggagugcaggauu

SEQ ID NO: 968463 - RNA, 19 nt, Homo sapiens
gacaagagcugguuucuaa

SEQ ID NO: 968464 - RNA, 19 nt, Homo sapiens
ccacuuagcuucacaggaa

SEQ ID NO: 968465 - RNA, 19 nt, Homo sapiens
gaacagaugccacggagua

SEQ ID NO: 968466 - RNA, 19 nt, Homo sapiens
gaacuaauggcaacacaua

SEQ ID NO: 968467 - RNA, 19 nt, Homo sapiens
ugaaagaacucuagugguu

SEQ ID NO: 968468 - RNA, 19 nt, Homo sapiens
gaaaugcucucugaccuau

SEQ ID NO: 968469 - RNA, 19 nt, Homo sapiens
ucugauggcugcucuguua

SEQ ID NO: 968470 - RNA, 19 nt, Homo sapiens
gaaaagcagugauucaaaa

SEQ ID NO: 968471 - RNA, 19 nt, Homo sapiens
ucagaucgcuuccaaugaa

SEQ ID NO: 968472 - RNA, 19 nt, Homo sapiens
gaaagggcuacuauucuua

SEQ ID NO: 968473 - RNA, 19 nt, Homo sapiens
gcaaaguucucaucaaggu

SEQ ID NO: 968474 - RNA, 19 nt, Homo sapiens
ugacaccgcugguaaguug

SEQ ID NO: 968475 - RNA, 19 nt, Homo sapiens
gaacucuagugguuucuga

SEQ ID NO: 968476 - RNA, 19 nt, Homo sapiens
gaccagcucuuguccauca

SEQ ID NO: 968477 - RNA, 19 nt, Homo sapiens
acaaagauguggacaagga

SEQ ID NO: 968478 - RNA, 19 nt, Homo sapiens
ugaaagggcuacuauucuu

SEQ ID NO: 968479 - RNA, 19 nt, Homo sapiens
ccaaagcccuuccuacauc

SEQ ID NO: 968480 - RNA, 19 nt, Homo sapiens
agaggucacugaacuauga

SEQ ID NO: 968481 - RNA, 19 nt, Homo sapiens
gagcaguggcccaaauaua

SEQ ID NO: 968482 - RNA, 19 nt, Homo sapiens
aagaagagcugucaagucu

SEQ ID NO: 968483 - RNA, 19 nt, Homo sapiens
gaaagaacucuagugguuu

SEQ ID NO: 968484 - RNA, 19 nt, Homo sapiens
gccaggaaaugcucucuga

SEQ ID NO: 968485 - RNA, 19 nt, Homo sapiens
agaaacagcucagcauuca

SEQ ID NO: 968486 - RNA, 19 nt, Homo sapiens
ucucugaccuaucaauaaa

SEQ ID NO: 968487 - RNA, 19 nt, Homo sapiens
caacuaccgugacaaugug

SEQ ID NO: 968488 - RNA, 19 nt, Homo sapiens
gauccuggcuuuguucaug

SEQ ID NO: 968489 - RNA, 19 nt, Homo sapiens
cgacaaugcaccuguguuu

SEQ ID NO: 968490 - RNA, 19 nt, Homo sapiens
acagggaaauccauucauu

SEQ ID NO: 968491 - RNA, 19 nt, Homo sapiens
caaacaugcagaacucaua

SEQ ID NO: 968492 - RNA, 19 nt, Homo sapiens
ccagguggcuacuuauuuc

SEQ ID NO: 968493 - RNA, 19 nt, Homo sapiens
gagagaaacaggaaacaug

SEQ ID NO: 968494 - RNA, 19 nt, Homo sapiens
gaaaugaagcccaccucuu

SEQ ID NO: 968495 - RNA, 19 nt, Homo sapiens
gaaaagauaggaacaaaga

SEQ ID NO: 968496 - RNA, 19 nt, Homo sapiens
aauccaagauccagaggua

SEQ ID NO: 968497 - RNA, 19 nt, Homo sapiens
ggaaaugcucucugaccua

SEQ ID NO: 968498 - RNA, 19 nt, Homo sapiens
ccaaaccaccgaggaaaua

SEQ ID NO: 968499 - RNA, 19 nt, Homo sapiens
gaccaaacaugcagaacuc

SEQ ID NO: 968500 - RNA, 19 nt, Homo sapiens
gccgagaggugcugcaaga

SEQ ID NO: 968501 - RNA, 19 nt, Homo sapiens
gagagcaguggcccaaaua

SEQ ID NO: 968502 - RNA, 19 nt, Homo sapiens
acagagagguaaacaagau

SEQ ID NO: 968503 - RNA, 19 nt, Homo sapiens
gaagaagagcugucaaguc

SEQ ID NO: 968504 - RNA, 19 nt, Homo sapiens
ucacugaacuaugaagaga

SEQ ID NO: 968505 - RNA, 19 nt, Homo sapiens
cccaguugcucacuuagua

SEQ ID NO: 968506 - RNA, 19 nt, Homo sapiens
gacaauagcccugcguuug

SEQ ID NO: 968507 - RNA, 19 nt, Homo sapiens
gguggcuacuuauuucuuu

SEQ ID NO: 968508 - RNA, 19 nt, Homo sapiens
cauagggugugacaaguug

SEQ ID NO: 968509 - RNA, 19 nt, Homo sapiens
gaucaagccauccaggaaa

SEQ ID NO: 968510 - RNA, 19 nt, Homo sapiens
gaaguggaccaacuaguuc

SEQ ID NO: 968511 - RNA, 19 nt, Homo sapiens
guaagcagcucugagucuu

SEQ ID NO: 968512 - RNA, 19 nt, Homo sapiens
guggaguucuuccucagua

SEQ ID NO: 968513 - RNA, 19 nt, Homo sapiens
gccaagagcugggccacuu

SEQ ID NO: 968514 - RNA, 19 nt, Homo sapiens
cuggacaccuucaguauug

SEQ ID NO: 968515 - RNA, 19 nt, Homo sapiens
gaagaugcugcaccuggua

SEQ ID NO: 968516 - RNA, 19 nt, Homo sapiens
aaagaacucuagugguuuc

SEQ ID NO: 968517 - RNA, 19 nt, Homo sapiens
gguccugcuuguuucauaa

SEQ ID NO: 968518 - RNA, 19 nt, Homo sapiens
gacagcagcuucccaucug

SEQ ID NO: 968519 - RNA, 19 nt, Homo sapiens
gcugaaagggcuacuauuc

SEQ ID NO: 968520 - RNA, 19 nt, Homo sapiens
gaccaugggcacccucaua

SEQ ID NO: 968521 - RNA, 19 nt, Homo sapiens
caagaaacagcucagcauu

SEQ ID NO: 968522 - RNA, 19 nt, Homo sapiens
gaggaagugccaucuggua

SEQ ID NO: 968523 - RNA, 19 nt, Homo sapiens
ggacaagagcugguuucua

SEQ ID NO: 968524 - RNA, 19 nt, Homo sapiens
ggaccucucugugaagcaa

SEQ ID NO: 968525 - RNA, 19 nt, Homo sapiens
gaggaucuguggacaagag

SEQ ID NO: 968526 - RNA, 19 nt, Homo sapiens
gacccucaguuuagacuug

SEQ ID NO: 968527 - RNA, 19 nt, Homo sapiens
ucagugacaucaacgacaa

SEQ ID NO: 968528 - RNA, 19 nt, Homo sapiens
cugguacgcuucucauaaa

SEQ ID NO: 968529 - RNA, 19 nt, Homo sapiens
ggacagggaaauccauuca

SEQ ID NO: 968530 - RNA, 19 nt, Homo sapiens
ugaaguggaccaacuaguu

SEQ ID NO: 968531 - RNA, 19 nt, Homo sapiens
gcugguaaguugcaaaguc

SEQ ID NO: 968532 - RNA, 19 nt, Homo sapiens
agacacagauggcccaagu

SEQ ID NO: 968533 - RNA, 19 nt, Homo sapiens
cuaacacccugcacaccua

SEQ ID NO: 968534 - RNA, 19 nt, Homo sapiens
ugaaauaccaagugucaga

SEQ ID NO: 968535 - RNA, 19 nt, Homo sapiens
uaauuggcauugaaacuca

SEQ ID NO: 968536 - RNA, 19 nt, Homo sapiens
aaacagcucagcauucaga

SEQ ID NO: 968537 - RNA, 19 nt, Homo sapiens
aaauauacccucacucugu

SEQ ID NO: 968538 - RNA, 19 nt, Homo sapiens
ccaaauauacccucacucu

SEQ ID NO: 968539 - RNA, 19 nt, Homo sapiens
gcgucgaccucuagacuau

SEQ ID NO: 968540 - RNA, 19 nt, Homo sapiens
ggugaaauaccaaguguca

SEQ ID NO: 968541 - RNA, 19 nt, Homo sapiens
acaaugcaccuguguuuga

SEQ ID NO: 968542 - RNA, 19 nt, Homo sapiens
gcagguggaggcucaaguu

SEQ ID NO: 968543 - RNA, 19 nt, Homo sapiens
gaucagggcagagucaaga

SEQ ID NO: 968544 - RNA, 19 nt, Homo sapiens
ucuuguaacucacuagcua

SEQ ID NO: 968545 - RNA, 19 nt, Homo sapiens
caaagcccuuccuacauca

SEQ ID NO: 968546 - RNA, 19 nt, Homo sapiens
gcagaugacuuggauucag

SEQ ID NO: 968547 - RNA, 19 nt, Homo sapiens
aaacaggaaacaugacuug

SEQ ID NO: 968548 - RNA, 19 nt, Homo sapiens
ccaacuaccgugacaaugu

SEQ ID NO: 968549 - RNA, 19 nt, Homo sapiens
caaccauuguggcaagaga

SEQ ID NO: 968550 - RNA, 19 nt, Homo sapiens
gcccuuaucagccaagaaa

SEQ ID NO: 968551 - RNA, 19 nt, Homo sapiens
aauauacccucacucuguu

SEQ ID NO: 968552 - RNA, 19 nt, Homo sapiens
caagacaggccaggucauu

SEQ ID NO: 968553 - RNA, 19 nt, Homo sapiens
ugggaucccugccugguuu

SEQ ID NO: 968554 - RNA, 19 nt, Homo sapiens
ccaccagccuccucugcaa

SEQ ID NO: 968555 - RNA, 19 nt, Homo sapiens
ggagcuggagauaguagua

SEQ ID NO: 968556 - RNA, 19 nt, Homo sapiens
gguguuaacugccuaugac

SEQ ID NO: 968557 - RNA, 19 nt, Homo sapiens
ggacagcagcuucccaucu

SEQ ID NO: 968558 - RNA, 19 nt, Homo sapiens
aaagauaggaacaaagaga

SEQ ID NO: 968559 - RNA, 19 nt, Homo sapiens
cagaugacaccgcugguaa

SEQ ID NO: 968560 - RNA, 19 nt, Homo sapiens
ccaggaaaguuaagugacu

SEQ ID NO: 968561 - RNA, 19 nt, Homo sapiens
gcucucugaccuaucaaua

SEQ ID NO: 968562 - RNA, 19 nt, Homo sapiens
ggacaaggaggcgaugaug

SEQ ID NO: 968563 - RNA, 19 nt, Homo sapiens
gcaacaaguguguguauua

SEQ ID NO: 968564 - RNA, 19 nt, Homo sapiens
guacagcaaaucaauguuu

SEQ ID NO: 968565 - RNA, 19 nt, Homo sapiens
gagaugcccuuugagugua

SEQ ID NO: 968566 - RNA, 19 nt, Homo sapiens
gcccauagcucugaacagu

SEQ ID NO: 968567 - RNA, 19 nt, Homo sapiens
caacaaguguguguauuac

SEQ ID NO: 968568 - RNA, 19 nt, Homo sapiens
ggacugaaggcaugagaug

SEQ ID NO: 968569 - RNA, 19 nt, Homo sapiens
gcacauggagccugaccuu

SEQ ID NO: 968570 - RNA, 19 nt, Homo sapiens
ggagaaccacggugugaug

SEQ ID NO: 968571 - RNA, 19 nt, Homo sapiens
ggaccuggcuguguacaac

SEQ ID NO: 968572 - RNA, 19 nt, Homo sapiens
ucccucaucucuagcagua

SEQ ID NO: 968573 - RNA, 19 nt, Homo sapiens
gcaagaugcgggaguaugg

SEQ ID NO: 968574 - RNA, 19 nt, Homo sapiens
guucuccgaauucaaauaa

SEQ ID NO: 968575 - RNA, 19 nt, Homo sapiens
gugguucccucgauucaug

SEQ ID NO: 968576 - RNA, 19 nt, Homo sapiens
acaaccagcugcucaacau

SEQ ID NO: 968577 - RNA, 19 nt, Homo sapiens
cagcaggagugugggauug

SEQ ID NO: 968578 - RNA, 19 nt, Homo sapiens
ccucaucucuagcaguaug

SEQ ID NO: 968579 - RNA, 19 nt, Homo sapiens
cgggagcgcuguugguugu

SEQ ID NO: 968580 - RNA, 19 nt, Homo sapiens
ucucuucccucaucucuag

SEQ ID NO: 968581 - RNA, 19 nt, Homo sapiens
gcagacggugcagaaauuu

SEQ ID NO: 968582 - RNA, 19 nt, Homo sapiens
ugagaugcccuuugagugu

SEQ ID NO: 968583 - RNA, 19 nt, Homo sapiens
gugccagggucaccaucua

SEQ ID NO: 968584 - RNA, 19 nt, Homo sapiens
cauggagccugaccuuagu

SEQ ID NO: 968585 - RNA, 19 nt, Homo sapiens
ccacauugacuucaucuac

SEQ ID NO: 968586 - RNA, 19 nt, Homo sapiens
acaaguguguguauuacca

SEQ ID NO: 968587 - RNA, 19 nt, Homo sapiens
ccaacaaggagacggaguu

SEQ ID NO: 968588 - RNA, 19 nt, Homo sapiens
agacggaguuccugcugau

SEQ ID NO: 968589 - RNA, 19 nt, Homo sapiens
cuguggagcuggccauguu

SEQ ID NO: 968590 - RNA, 19 nt, Homo sapiens
cggaguuccugcugauuca

SEQ ID NO: 968591 - RNA, 19 nt, Homo sapiens
ggaguggcugggacaacua

SEQ ID NO: 968592 - RNA, 19 nt, Homo sapiens
ggaguggaaccucuacuac

SEQ ID NO: 968593 - RNA, 19 nt, Homo sapiens
ggaggagagggaaguggaa

SEQ ID NO: 968594 - RNA, 19 nt, Homo sapiens
gcuguugguugugcgcaaa

SEQ ID NO: 968595 - RNA, 19 nt, Homo sapiens
gaauccagagucccgauca

SEQ ID NO: 968596 - RNA, 19 nt, Homo sapiens
gcagcaggagugugggauu

SEQ ID NO: 968597 - RNA, 19 nt, Homo sapiens
gaguguacagcaaaucaau

SEQ ID NO: 968598 - RNA, 19 nt, Homo sapiens
aggcgacgauggcuaagug

SEQ ID NO: 968599 - RNA, 19 nt, Homo sapiens
ccaucuaccagguuccuuu

SEQ ID NO: 968600 - RNA, 19 nt, Homo sapiens
caugagaugcccuuugagu

SEQ ID NO: 968601 - RNA, 19 nt, Homo sapiens
caacaaggagacggaguuc

SEQ ID NO: 968602 - RNA, 19 nt, Homo sapiens
gcagcuggaccuggaguau

SEQ ID NO: 968603 - RNA, 19 nt, Homo sapiens
cgcaacaaguguguguauu

SEQ ID NO: 968604 - RNA, 19 nt, Homo sapiens
gggccacauugacuucauc

SEQ ID NO: 968605 - RNA, 19 nt, Homo sapiens
caucauccagcgcaucuuc

SEQ ID NO: 968606 - RNA, 19 nt, Homo sapiens
cacaggaaccuccaucucu

SEQ ID NO: 968607 - RNA, 19 nt, Homo sapiens
guguacagcaaaucaaugu

SEQ ID NO: 968608 - RNA, 19 nt, Homo sapiens
agcgggaccuggcugugua

SEQ ID NO: 968609 - RNA, 19 nt, Homo sapiens
gcccuuugaggaccuguuu

SEQ ID NO: 968610 - RNA, 19 nt, Homo sapiens
acauggagccugaccuuag

SEQ ID NO: 968611 - RNA, 19 nt, Homo sapiens
ucaaguuggugcgccugaa

SEQ ID NO: 968612 - RNA, 19 nt, Homo sapiens
ggagagggaaguggaagag

SEQ ID NO: 968613 - RNA, 19 nt, Homo sapiens
ccgcaacaaguguguguau

SEQ ID NO: 968614 - RNA, 19 nt, Homo sapiens
uggagcagauggagaacca

SEQ ID NO: 968615 - RNA, 19 nt, Homo sapiens
cugguucuccgaauucaaa

SEQ ID NO: 968616 - RNA, 19 nt, Homo sapiens
cgacgauggcuaaguggau

SEQ ID NO: 968617 - RNA, 19 nt, Homo sapiens
cucaacaggugcagcagau

SEQ ID NO: 968618 - RNA, 19 nt, Homo sapiens
ggucaccaucuaccagguu

SEQ ID NO: 968619 - RNA, 19 nt, Homo sapiens
caaguguccucuaugcuua

SEQ ID NO: 968620 - RNA, 19 nt, Homo sapiens
cgucacggcucuccuauuu

SEQ ID NO: 968621 - RNA, 19 nt, Homo sapiens
ggauggaccucuacuucuu

SEQ ID NO: 968622 - RNA, 19 nt, Homo sapiens
gguggcagaucccucagua

SEQ ID NO: 968623 - RNA, 19 nt, Homo sapiens
ccaaagcggugagaaagga

SEQ ID NO: 968624 - RNA, 19 nt, Homo sapiens
ucacggcucuccuauuugu

SEQ ID NO: 968625 - RNA, 19 nt, Homo sapiens
gcagccaaguguccucuau

SEQ ID NO: 968626 - RNA, 19 nt, Homo sapiens
ggccagagaccgucaaugu

SEQ ID NO: 968627 - RNA, 19 nt, Homo sapiens
ggaaggguagggcaagaaa

SEQ ID NO: 968628 - RNA, 19 nt, Homo sapiens
ccgccaaccucgugcugua

SEQ ID NO: 968629 - RNA, 19 nt, Homo sapiens
aagaggacaucgccaacuu

SEQ ID NO: 968630 - RNA, 19 nt, Homo sapiens
uugggaacaucaacaauug

SEQ ID NO: 968631 - RNA, 19 nt, Homo sapiens
ccaaguguccucuaugcuu

SEQ ID NO: 968632 - RNA, 19 nt, Homo sapiens
gaagaucuugcccgucaug

SEQ ID NO: 968633 - RNA, 19 nt, Homo sapiens
cuggaucgcuggacgcuau

SEQ ID NO: 968634 - RNA, 19 nt, Homo sapiens
gggauguucuuugguuuua

SEQ ID NO: 968635 - RNA, 19 nt, Homo sapiens
caacagcaccaacuucaac

SEQ ID NO: 968636 - RNA, 19 nt, Homo sapiens
gagaggagaggagagaaga

SEQ ID NO: 968637 - RNA, 19 nt, Homo sapiens
cagaugcaguccaccuaug

SEQ ID NO: 968638 - RNA, 19 nt, Homo sapiens
ccuacuggauggucuacuu

SEQ ID NO: 968639 - RNA, 19 nt, Homo sapiens
gggccaaagcggugagaaa

SEQ ID NO: 968640 - RNA, 19 nt, Homo sapiens
caucaugggcaucuucuuc

SEQ ID NO: 968641 - RNA, 19 nt, Homo sapiens
gauggucuacuuccagaug

SEQ ID NO: 968642 - RNA, 19 nt, Homo sapiens
cuccacaucccaaacauuu

SEQ ID NO: 968643 - RNA, 19 nt, Homo sapiens
gguagaguccggguaguga

SEQ ID NO: 968644 - RNA, 19 nt, Homo sapiens
agauggagcgcuuacacua

SEQ ID NO: 968645 - RNA, 19 nt, Homo sapiens
ccucaguaccugcucauug

SEQ ID NO: 968646 - RNA, 19 nt, Homo sapiens
gaccgugucccagcagauu

SEQ ID NO: 968647 - RNA, 19 nt, Homo sapiens
ggagaggagaggagagaag

SEQ ID NO: 968648 - RNA, 19 nt, Homo sapiens
ugaaggaccgcuugaucga

SEQ ID NO: 968649 - RNA, 19 nt, Homo sapiens
caaggacuuugggaacauc

SEQ ID NO: 968650 - RNA, 19 nt, Homo sapiens
uacacuacauccaccacaa

SEQ ID NO: 968651 - RNA, 19 nt, Homo sapiens
caggaaggguagggcaaga

SEQ ID NO: 968652 - RNA, 19 nt, Homo sapiens
cugguuuccuucucgguuu

SEQ ID NO: 968653 - RNA, 19 nt, Homo sapiens
gauggaccucuacuucuuc

SEQ ID NO: 968654 - RNA, 19 nt, Homo sapiens
cucaguaccugcucauugg

SEQ ID NO: 968655 - RNA, 19 nt, Homo sapiens
ugguuuccuucucgguuua

SEQ ID NO: 968656 - RNA, 19 nt, Homo sapiens
cggcaccacuguccaucug

SEQ ID NO: 968657 - RNA, 19 nt, Homo sapiens
ccgcuugaucgacccuuua

SEQ ID NO: 968658 - RNA, 19 nt, Homo sapiens
ggccaaagcggugagaaag

SEQ ID NO: 968659 - RNA, 19 nt, Homo sapiens
ggagauggagcgcuuacac

SEQ ID NO: 968660 - RNA, 19 nt, Homo sapiens
ccagaugcaguccaccuau

SEQ ID NO: 968661 - RNA, 19 nt, Homo sapiens
gagggaagggugggccaaa

SEQ ID NO: 968662 - RNA, 19 nt, Homo sapiens
uggcguuuauucagcagaa

SEQ ID NO: 968663 - RNA, 19 nt, Homo sapiens
ccggauggaccucuacuuc

SEQ ID NO: 968664 - RNA, 19 nt, Homo sapiens
aaggagggccagccaguug

SEQ ID NO: 968665 - RNA, 19 nt, Homo sapiens
gccagagaccgucaaugug

SEQ ID NO: 968666 - RNA, 19 nt, Homo sapiens
gauggagcgcuuacacuac

SEQ ID NO: 968667 - RNA, 19 nt, Homo sapiens
uuugggaacaucaacaauu

SEQ ID NO: 968668 - RNA, 19 nt, Homo sapiens
gagauggagcgcuuacacu

SEQ ID NO: 968669 - RNA, 19 nt, Homo sapiens
cuuaagcucgcucuccaaa

SEQ ID NO: 968670 - RNA, 19 nt, Homo sapiens
gcaggaagcuugacaaaug

SEQ ID NO: 968671 - RNA, 19 nt, Homo sapiens
ucacagggaucuugaauaa

SEQ ID NO: 968672 - RNA, 19 nt, Homo sapiens
gcagaaaucuuagcuguga

SEQ ID NO: 968673 - RNA, 19 nt, Homo sapiens
ggacaucacugcagaaauc

SEQ ID NO: 968674 - RNA, 19 nt, Homo sapiens
gcauaaagcuccaagugaa

SEQ ID NO: 968675 - RNA, 19 nt, Homo sapiens
gaacaacaucauugacaua

SEQ ID NO: 968676 - RNA, 19 nt, Homo sapiens
ccaugugccucaccuaaua

SEQ ID NO: 968677 - RNA, 19 nt, Homo sapiens
caacaucauugacauaaag

SEQ ID NO: 968678 - RNA, 19 nt, Homo sapiens
gcuggaagaugacacaguu

SEQ ID NO: 968679 - RNA, 19 nt, Homo sapiens
gcugagaccucuaagaagu

SEQ ID NO: 968680 - RNA, 19 nt, Homo sapiens
uaagaaguccagauacuaa

SEQ ID NO: 968681 - RNA, 19 nt, Homo sapiens
ccuggaagccugcaaauuu

SEQ ID NO: 968682 - RNA, 19 nt, Homo sapiens
caccaucccucucggcaua

SEQ ID NO: 968683 - RNA, 19 nt, Homo sapiens
ggacuacaguuugucauca

SEQ ID NO: 968684 - RNA, 19 nt, Homo sapiens
gcaaauuucucugcuugau

SEQ ID NO: 968685 - RNA, 19 nt, Homo sapiens
acagggaucuugaauaaag

SEQ ID NO: 968686 - RNA, 19 nt, Homo sapiens
caaaugcccucagcaaugg

SEQ ID NO: 968687 - RNA, 19 nt, Homo sapiens
caucacugcagaaaucuua

SEQ ID NO: 968688 - RNA, 19 nt, Homo sapiens
gagauaagcaggagaggau

SEQ ID NO: 968689 - RNA, 19 nt, Homo sapiens
gaccagacccugcccuuga

SEQ ID NO: 968690 - RNA, 19 nt, Homo sapiens
ccucuaagaaguccagaua

SEQ ID NO: 968691 - RNA, 19 nt, Homo sapiens
uaaaauggcucuucuucug

SEQ ID NO: 968692 - RNA, 19 nt, Homo sapiens
ugacacaguugccuucucu

SEQ ID NO: 968693 - RNA, 19 nt, Homo sapiens
gauccacggacuacaguuu

SEQ ID NO: 968694 - RNA, 19 nt, Homo sapiens
acaaaugcccucagcaaug

SEQ ID NO: 968695 - RNA, 19 nt, Homo sapiens
auaaaguccugccugaguu

SEQ ID NO: 968696 - RNA, 19 nt, Homo sapiens
ggcauaaagcuccaaguga

SEQ ID NO: 968697 - RNA, 19 nt, Homo sapiens
aaagugacgucagugauuc

SEQ ID NO: 968698 - RNA, 19 nt, Homo sapiens
ugacaaaugcccucagcaa

SEQ ID NO: 968699 - RNA, 19 nt, Homo sapiens
cccaugugcuggaagauga

SEQ ID NO: 968700 - RNA, 19 nt, Homo sapiens
ugaacaacaucauugacau

SEQ ID NO: 968701 - RNA, 19 nt, Homo sapiens
gacuacaguuugucaucaa

SEQ ID NO: 968702 - RNA, 19 nt, Homo sapiens
gauacuaagagcaaagaug

SEQ ID NO: 968703 - RNA, 19 nt, Homo sapiens
cuaagaaguccagauacua

SEQ ID NO: 968704 - RNA, 19 nt, Homo sapiens
gacaaaugcccucagcaau

SEQ ID NO: 968705 - RNA, 19 nt, Homo sapiens
cuggaagccugcaaauuuc

SEQ ID NO: 968706 - RNA, 19 nt, Homo sapiens
uaagagcaaagauguuuca

SEQ ID NO: 968707 - RNA, 19 nt, Homo sapiens
ucuaagaaguccagauacu

SEQ ID NO: 968708 - RNA, 19 nt, Homo sapiens
cugcugagaccucuaagaa

SEQ ID NO: 968709 - RNA, 19 nt, Homo sapiens
gaccauggcccaguuugga

SEQ ID NO: 968710 - RNA, 19 nt, Homo sapiens
auaaagcuccaagugaaua

SEQ ID NO: 968711 - RNA, 19 nt, Homo sapiens
acuaagagcaaagauguuu

SEQ ID NO: 968712 - RNA, 19 nt, Homo sapiens
gcuggaacuuggccuugug

SEQ ID NO: 968713 - RNA, 19 nt, Homo sapiens
ggccugaacaacaucauug

SEQ ID NO: 968714 - RNA, 19 nt, Homo sapiens
ccaccaggcguguguaaca

SEQ ID NO: 968715 - RNA, 19 nt, Homo sapiens
acccugcccuugaauguga

SEQ ID NO: 968716 - RNA, 19 nt, Homo sapiens
auacuaagagcaaagaugu

SEQ ID NO: 968717 - RNA, 19 nt, Homo sapiens
caaauuucucugcuugaug

SEQ ID NO: 968718 - RNA, 19 nt, Homo sapiens
ugcaugacauuguuaacau

SEQ ID NO: 968719 - RNA, 19 nt, Homo sapiens
ccuggugcaugacauuguu

SEQ ID NO: 968720 - RNA, 19 nt, Homo sapiens
ggaaaagugacgucaguga

SEQ ID NO: 968721 - RNA, 19 nt, Homo sapiens
uaaaguccugccugaguug

SEQ ID NO: 968722 - RNA, 19 nt, Homo sapiens
guccagauacuaagagcaa

SEQ ID NO: 968723 - RNA, 19 nt, Homo sapiens
cauaaagcuccaagugaau

SEQ ID NO: 968724 - RNA, 19 nt, Homo sapiens
ucuuagcugugagagauaa

SEQ ID NO: 968725 - RNA, 19 nt, Homo sapiens
caggaagcuugacaaaugc

SEQ ID NO: 968726 - RNA, 19 nt, Homo sapiens
aauaaaguccugccugagu

SEQ ID NO: 968727 - RNA, 19 nt, Homo sapiens
gaaguccagauacuaagag

SEQ ID NO: 968728 - RNA, 19 nt, Homo sapiens
cggcauaaagcuccaagug

SEQ ID NO: 968729 - RNA, 19 nt, Homo sapiens
ugugcccucuggucaauga

SEQ ID NO: 968730 - RNA, 19 nt, Homo sapiens
uguugaggcuggcugugaa

SEQ ID NO: 968731 - RNA, 19 nt, Homo sapiens
ggucuugcaggaagcuuga

SEQ ID NO: 968732 - RNA, 19 nt, Homo sapiens
ggucggugcaagucuguug

SEQ ID NO: 968733 - RNA, 19 nt, Homo sapiens
caugugccucaccuaauaa

SEQ ID NO: 968734 - RNA, 19 nt, Homo sapiens
gugcaugacauuguuaaca

SEQ ID NO: 968735 - RNA, 19 nt, Homo sapiens
agagcaaagauguuucaaa

SEQ ID NO: 968736 - RNA, 19 nt, Homo sapiens
ugucuucuacgggcuguua

SEQ ID NO: 968737 - RNA, 19 nt, Homo sapiens
gauggccaccgucucuaug

SEQ ID NO: 968738 - RNA, 19 nt, Homo sapiens
gggccucauugucuucuac

SEQ ID NO: 968739 - RNA, 19 nt, Homo sapiens
agaaaucuuagcugugaga

SEQ ID NO: 968740 - RNA, 19 nt, Homo sapiens
gaaaagugacgucagugau

SEQ ID NO: 968741 - RNA, 19 nt, Homo sapiens
accagacccugcccuugaa

SEQ ID NO: 968742 - RNA, 19 nt, Homo sapiens
gcaggaagcuugacaaaug

SEQ ID NO: 968743 - RNA, 19 nt, Homo sapiens
ucacagggaucuugaauaa

SEQ ID NO: 968744 - RNA, 19 nt, Homo sapiens
gcagaaaucuuagcuguga

SEQ ID NO: 968745 - RNA, 19 nt, Homo sapiens
ggacaucacugcagaaauc

SEQ ID NO: 968746 - RNA, 19 nt, Homo sapiens
gcauaaagcuccaagugaa

SEQ ID NO: 968747 - RNA, 19 nt, Homo sapiens
gaacaacaucauugacaua

SEQ ID NO: 968748 - RNA, 19 nt, Homo sapiens
ccaugugccucaccuaaua

SEQ ID NO: 968749 - RNA, 19 nt, Homo sapiens
caacaucauugacauaaag

SEQ ID NO: 968750 - RNA, 19 nt, Homo sapiens
gcuggaagaugacacaguu

SEQ ID NO: 968751 - RNA, 19 nt, Homo sapiens
gcugagaccucuaagaagu

SEQ ID NO: 968752 - RNA, 19 nt, Homo sapiens
uaaaauggcucuucuuaug

SEQ ID NO: 968753 - RNA, 19 nt, Homo sapiens
uaagaaguccagauacuaa

SEQ ID NO: 968754 - RNA, 19 nt, Homo sapiens
ccuggaagccugcaaauuu

SEQ ID NO: 968755 - RNA, 19 nt, Homo sapiens
caccaucccucucggcaua

SEQ ID NO: 968756 - RNA, 19 nt, Homo sapiens
ggacuacaguuugucauca

SEQ ID NO: 968757 - RNA, 19 nt, Homo sapiens
gcaaauuucucugcuugau

SEQ ID NO: 968758 - RNA, 19 nt, Homo sapiens
acagggaucuugaauaaag

SEQ ID NO: 968759 - RNA, 19 nt, Homo sapiens
caaaugcccucagcaaugg

SEQ ID NO: 968760 - RNA, 19 nt, Homo sapiens
caucacugcagaaaucuua

SEQ ID NO: 968761 - RNA, 19 nt, Homo sapiens
gagauaagcaggagaggau

SEQ ID NO: 968762 - RNA, 19 nt, Homo sapiens
gaccagacccugcccuuga

SEQ ID NO: 968763 - RNA, 19 nt, Homo sapiens
ccucuaagaaguccagaua

SEQ ID NO: 968764 - RNA, 19 nt, Homo sapiens
ugacacaguugccuucucu

SEQ ID NO: 968765 - RNA, 19 nt, Homo sapiens
gauccacggacuacaguuu

SEQ ID NO: 968766 - RNA, 19 nt, Homo sapiens
acaaaugcccucagcaaug

SEQ ID NO: 968767 - RNA, 19 nt, Homo sapiens
auaaaguccugccugaguu

SEQ ID NO: 968768 - RNA, 19 nt, Homo sapiens
ggcauaaagcuccaaguga

SEQ ID NO: 968769 - RNA, 19 nt, Homo sapiens
aaagugacgucagugauuc

SEQ ID NO: 968770 - RNA, 19 nt, Homo sapiens
ugacaaaugcccucagcaa

SEQ ID NO: 968771 - RNA, 19 nt, Homo sapiens
cccaugugcuggaagauga

SEQ ID NO: 968772 - RNA, 19 nt, Homo sapiens
ugaacaacaucauugacau

SEQ ID NO: 968773 - RNA, 19 nt, Homo sapiens
gacuacaguuugucaucaa

SEQ ID NO: 968774 - RNA, 19 nt, Homo sapiens
gauacuaagagcaaagaug

SEQ ID NO: 968775 - RNA, 19 nt, Homo sapiens
cuaagaaguccagauacua

SEQ ID NO: 968776 - RNA, 19 nt, Homo sapiens
gacaaaugcccucagcaau

SEQ ID NO: 968777 - RNA, 19 nt, Homo sapiens
cuggaagccugcaaauuuc

SEQ ID NO: 968778 - RNA, 19 nt, Homo sapiens
uaagagcaaagauguuuca

SEQ ID NO: 968779 - RNA, 19 nt, Homo sapiens
aaauggcucuucuuaugca

SEQ ID NO: 968780 - RNA, 19 nt, Homo sapiens
ucuaagaaguccagauacu

SEQ ID NO: 968781 - RNA, 19 nt, Homo sapiens
cugcugagaccucuaagaa

SEQ ID NO: 968782 - RNA, 19 nt, Homo sapiens
auaaagcuccaagugaaua

SEQ ID NO: 968783 - RNA, 19 nt, Homo sapiens
gaccauggcccaguuugga

SEQ ID NO: 968784 - RNA, 19 nt, Homo sapiens
acuaagagcaaagauguuu

SEQ ID NO: 968785 - RNA, 19 nt, Homo sapiens
gcuggaacuuggccuugug

SEQ ID NO: 968786 - RNA, 19 nt, Homo sapiens
ggccugaacaacaucauug

SEQ ID NO: 968787 - RNA, 19 nt, Homo sapiens
ccaccaggcguguguaaca

SEQ ID NO: 968788 - RNA, 19 nt, Homo sapiens
acccugcccuugaauguga

SEQ ID NO: 968789 - RNA, 19 nt, Homo sapiens
caaauuucucugcuugaug

SEQ ID NO: 968790 - RNA, 19 nt, Homo sapiens
auacuaagagcaaagaugu

SEQ ID NO: 968791 - RNA, 19 nt, Homo sapiens
ugcaugacauuguuaacau

SEQ ID NO: 968792 - RNA, 19 nt, Homo sapiens
ccuggugcaugacauuguu

SEQ ID NO: 968793 - RNA, 19 nt, Homo sapiens
ggaaaagugacgucaguga

SEQ ID NO: 968794 - RNA, 19 nt, Homo sapiens
uaaaguccugccugaguug

SEQ ID NO: 968795 - RNA, 19 nt, Homo sapiens
guccagauacuaagagcaa

SEQ ID NO: 968796 - RNA, 19 nt, Homo sapiens
cauaaagcuccaagugaau

SEQ ID NO: 968797 - RNA, 19 nt, Homo sapiens
ucuuagcugugagagauaa

SEQ ID NO: 968798 - RNA, 19 nt, Homo sapiens
caggaagcuugacaaaugc

SEQ ID NO: 968799 - RNA, 19 nt, Homo sapiens
gaaguccagauacuaagag

SEQ ID NO: 968800 - RNA, 19 nt, Homo sapiens
aauaaaguccugccugagu

SEQ ID NO: 968801 - RNA, 19 nt, Homo sapiens
cggcauaaagcuccaagug

SEQ ID NO: 968802 - RNA, 19 nt, Homo sapiens
ugugcccucuggucaauga

SEQ ID NO: 968803 - RNA, 19 nt, Homo sapiens
ggucuugcaggaagcuuga

SEQ ID NO: 968804 - RNA, 19 nt, Homo sapiens
uguugaggcuggcugugaa

SEQ ID NO: 968805 - RNA, 19 nt, Homo sapiens
ggucggugcaagucuguug

SEQ ID NO: 968806 - RNA, 19 nt, Homo sapiens
caugugccucaccuaauaa

SEQ ID NO: 968807 - RNA, 19 nt, Homo sapiens
gugcaugacauuguuaaca

SEQ ID NO: 968808 - RNA, 19 nt, Homo sapiens
agagcaaagauguuucaaa

SEQ ID NO: 968809 - RNA, 19 nt, Homo sapiens
ugucuucuacgggcuguua

SEQ ID NO: 968810 - RNA, 19 nt, Homo sapiens
gauggccaccgucucuaug

SEQ ID NO: 968811 - RNA, 19 nt, Homo sapiens
gggccucauugucuucuac

SEQ ID NO: 968812 - RNA, 19 nt, Homo sapiens
agaaaucuuagcugugaga

SEQ ID NO: 968813 - RNA, 19 nt, Homo sapiens
gaaaagugacgucagugau

SEQ ID NO: 968814 - RNA, 19 nt, Homo sapiens
accagacccugcccuugaa

SEQ ID NO: 968815 - RNA, 19 nt, Homo sapiens
ccacaugugucagaccaua

SEQ ID NO: 968816 - RNA, 19 nt, Homo sapiens
uggcagagcccaagauaaa

SEQ ID NO: 968817 - RNA, 19 nt, Homo sapiens
gaccuccgcucccaguaaa

SEQ ID NO: 968818 - RNA, 19 nt, Homo sapiens
gaugaggaggacaauaaua

SEQ ID NO: 968819 - RNA, 19 nt, Homo sapiens
gcugggaggugcuggaugu

SEQ ID NO: 968820 - RNA, 19 nt, Homo sapiens
caagagauucuaccuggaa

SEQ ID NO: 968821 - RNA, 19 nt, Homo sapiens
ggaaccagcccagcucuga

SEQ ID NO: 968822 - RNA, 19 nt, Homo sapiens
aagaugagcuugcacuucu

SEQ ID NO: 968823 - RNA, 19 nt, Homo sapiens
gaaggucacucgggaacca

SEQ ID NO: 968824 - RNA, 19 nt, Homo sapiens
aagaggcacuuucugaguu

SEQ ID NO: 968825 - RNA, 19 nt, Homo sapiens
ccaaaagcaucaccagaaa

SEQ ID NO: 968826 - RNA, 19 nt, Homo sapiens
ggacuuggaagaggacauu

SEQ ID NO: 968827 - RNA, 19 nt, Homo sapiens
gcucgcggauccuccaguu

SEQ ID NO: 968828 - RNA, 19 nt, Homo sapiens
ggaagggacgcugugguaa

SEQ ID NO: 968829 - RNA, 19 nt, Homo sapiens
aggaugaggaggacaauaa

SEQ ID NO: 968830 - RNA, 19 nt, Homo sapiens
gaccagaagacccagaaga

SEQ ID NO: 968831 - RNA, 19 nt, Homo sapiens
gaagggacgcugugguaag

SEQ ID NO: 968832 - RNA, 19 nt, Homo sapiens
ccaaagcucagucggacaa

SEQ ID NO: 968833 - RNA, 19 nt, Homo sapiens
gcuggcagagcccaagaua

SEQ ID NO: 968834 - RNA, 19 nt, Homo sapiens
gcaccaccaugaccaaagc

SEQ ID NO: 968835 - RNA, 19 nt, Homo sapiens
caagauaaacuggcaaguc

SEQ ID NO: 968836 - RNA, 19 nt, Homo sapiens
gacccuggaucccaaagag

SEQ ID NO: 968837 - RNA, 19 nt, Homo sapiens
gaacugucucggcccaaga

SEQ ID NO: 968838 - RNA, 19 nt, Homo sapiens
ggaugaggaggacaauaau

SEQ ID NO: 968839 - RNA, 19 nt, Homo sapiens
agaggcacuuucugaguug

SEQ ID NO: 968840 - RNA, 19 nt, Homo sapiens
aaacuggcaaguccugaaa

SEQ ID NO: 968841 - RNA, 19 nt, Homo sapiens
gguccucccuggaauacag

SEQ ID NO: 968842 - RNA, 19 nt, Homo sapiens
cauguaagaugagcuugca

SEQ ID NO: 968843 - RNA, 19 nt, Homo sapiens
gcagagcccaagauaaacu

SEQ ID NO: 968844 - RNA, 19 nt, Homo sapiens
ccuggaauauuacaacaac

SEQ ID NO: 968845 - RNA, 19 nt, Homo sapiens
aggaagggacgcuguggua

SEQ ID NO: 968846 - RNA, 19 nt, Homo sapiens
ccaagccacaugugucaga

SEQ ID NO: 968847 - RNA, 19 nt, Homo sapiens
uaagaugagcuugcacuuc

SEQ ID NO: 968848 - RNA, 19 nt, Homo sapiens
gacaccacccucaccauca

SEQ ID NO: 968849 - RNA, 19 nt, Homo sapiens
guaagaugagcuugcacuu

SEQ ID NO: 968850 - RNA, 19 nt, Homo sapiens
uaaacuggcaaguccugaa

SEQ ID NO: 968851 - RNA, 19 nt, Homo sapiens
gugcguuccugaccgagau

SEQ ID NO: 968852 - RNA, 19 nt, Homo sapiens
ucugaggugucccagguau

SEQ ID NO: 968853 - RNA, 19 nt, Homo sapiens
cgagucgccugaaggaacu

SEQ ID NO: 968854 - RNA, 19 nt, Homo sapiens
acuggcaaguccugaaaga

SEQ ID NO: 968855 - RNA, 19 nt, Homo sapiens
augaggaggacaauaauau

SEQ ID NO: 968856 - RNA, 19 nt, Homo sapiens
gaaggaugaggaggacaau

SEQ ID NO: 968857 - RNA, 19 nt, Homo sapiens
uaaccgccuccuucacuug

SEQ ID NO: 968858 - RNA, 19 nt, Homo sapiens
cauaaccgccuccuucacu

SEQ ID NO: 968859 - RNA, 19 nt, Homo sapiens
uuucugaguuggagagagu

SEQ ID NO: 968860 - RNA, 19 nt, Homo sapiens
uggcaaguccugaaagaca

SEQ ID NO: 968861 - RNA, 19 nt, Homo sapiens
agaccuccgcucccaguaa

SEQ ID NO: 968862 - RNA, 19 nt, Homo sapiens
ggaauauuacaacaacaac

SEQ ID NO: 968863 - RNA, 19 nt, Homo sapiens
gaugagcuugcacuucugu

SEQ ID NO: 968864 - RNA, 19 nt, Homo sapiens
guguaugugauuauucuga

SEQ ID NO: 968865 - RNA, 19 nt, Homo sapiens
ggagacccuggaucccaaa

SEQ ID NO: 968866 - RNA, 19 nt, Homo sapiens
acccuaacccuguguaugu

SEQ ID NO: 968867 - RNA, 19 nt, Homo sapiens
gcacccuaacccuguguau

SEQ ID NO: 968868 - RNA, 19 nt, Homo sapiens
ugcuggaugucaccaagaa

SEQ ID NO: 968869 - RNA, 19 nt, Homo sapiens
acuccugucuggcccauuc

SEQ ID NO: 968870 - RNA, 19 nt, Homo sapiens
uaccuggaauauuacaaca

SEQ ID NO: 968871 - RNA, 19 nt, Homo sapiens
gccuggaucuccccaugua

SEQ ID NO: 968872 - RNA, 19 nt, Homo sapiens
cgaaagauaugugggauaa

SEQ ID NO: 968873 - RNA, 19 nt, Homo sapiens
caaguucacugccuuuauu

SEQ ID NO: 968874 - RNA, 19 nt, Homo sapiens
gcagauauauuucacugau

SEQ ID NO: 968875 - RNA, 19 nt, Homo sapiens
ucacagcccuuacggauug

SEQ ID NO: 968876 - RNA, 19 nt, Homo sapiens
cgaaacauacggugaauaa

SEQ ID NO: 968877 - RNA, 19 nt, Homo sapiens
ggaugggacuuaaguugaa

SEQ ID NO: 968878 - RNA, 19 nt, Homo sapiens
agaggaagauccauuaguu

SEQ ID NO: 968879 - RNA, 19 nt, Homo sapiens
gcacauacugggaggauuu

SEQ ID NO: 968880 - RNA, 19 nt, Homo sapiens
gagagagagauguaauuua

SEQ ID NO: 968881 - RNA, 19 nt, Homo sapiens
cauauaggauugugggaaa

SEQ ID NO: 968882 - RNA, 19 nt, Homo sapiens
caacauccaaggcagcuua

SEQ ID NO: 968883 - RNA, 19 nt, Homo sapiens
cagaagacaugcugcuaug

SEQ ID NO: 968884 - RNA, 19 nt, Homo sapiens
acacaguaauaccugaaua

SEQ ID NO: 968885 - RNA, 19 nt, Homo sapiens
gaacggcagauauauuuca

SEQ ID NO: 968886 - RNA, 19 nt, Homo sapiens
aaacguaggaugggacuua

SEQ ID NO: 968887 - RNA, 19 nt, Homo sapiens
ggaaaucucugggguaaga

SEQ ID NO: 968888 - RNA, 19 nt, Homo sapiens
ucaagaccgugugcacaua

SEQ ID NO: 968889 - RNA, 19 nt, Homo sapiens
ugccaaauguuaccaauca

SEQ ID NO: 968890 - RNA, 19 nt, Homo sapiens
gauccucgcggugcaaaua

SEQ ID NO: 968891 - RNA, 19 nt, Homo sapiens
ugaaaacacucauauagga

SEQ ID NO: 968892 - RNA, 19 nt, Homo sapiens
ugggccaccuacuauauua

SEQ ID NO: 968893 - RNA, 19 nt, Homo sapiens
cgucuucacacacaaauaa

SEQ ID NO: 968894 - RNA, 19 nt, Homo sapiens
gaccuggcuuuccuucuga

SEQ ID NO: 968895 - RNA, 19 nt, Homo sapiens
gcgacagcauggccaacua

SEQ ID NO: 968896 - RNA, 19 nt, Homo sapiens
gaggaaaucucugggguaa

SEQ ID NO: 968897 - RNA, 19 nt, Homo sapiens
cgaccuggcuuuccuucug

SEQ ID NO: 968898 - RNA, 19 nt, Homo sapiens
gaugggcuccuccuaauag

SEQ ID NO: 968899 - RNA, 19 nt, Homo sapiens
aaagauaugugggauaaac

SEQ ID NO: 968900 - RNA, 19 nt, Homo sapiens
caagugcgaugcggucuuc

SEQ ID NO: 968901 - RNA, 19 nt, Homo sapiens
cugaauauccaacgguaua

SEQ ID NO: 968902 - RNA, 19 nt, Homo sapiens
gaagacaugcugcuauggu

SEQ ID NO: 968903 - RNA, 19 nt, Homo sapiens
cguuugauuucuuguguuu

SEQ ID NO: 968904 - RNA, 19 nt, Homo sapiens
aaacacucauauaggauug

SEQ ID NO: 968905 - RNA, 19 nt, Homo sapiens
gggauaaacugagaaaaga

SEQ ID NO: 968906 - RNA, 19 nt, Homo sapiens
aguaauaccugaauaucca

SEQ ID NO: 968907 - RNA, 19 nt, Homo sapiens
ggaaggggcugaggaaauc

SEQ ID NO: 968908 - RNA, 19 nt, Homo sapiens
gcaagcaagcacagccaaa

SEQ ID NO: 968909 - RNA, 19 nt, Homo sapiens
gcuacaaaguauagagaag

SEQ ID NO: 968910 - RNA, 19 nt, Homo sapiens
agagagagagauguaauuu

SEQ ID NO: 968911 - RNA, 19 nt, Homo sapiens
ucgagaggaagauccauua

SEQ ID NO: 968912 - RNA, 19 nt, Homo sapiens
uaaguugaacggcagauau

SEQ ID NO: 968913 - RNA, 19 nt, Homo sapiens
cauaaaagagccuugauuu

SEQ ID NO: 968914 - RNA, 19 nt, Homo sapiens
ccaaggcagcuuauucgaa

SEQ ID NO: 968915 - RNA, 19 nt, Homo sapiens
gcgaaagauaugugggaua

SEQ ID NO: 968916 - RNA, 19 nt, Homo sapiens
uugaacggcagauauauuu

SEQ ID NO: 968917 - RNA, 19 nt, Homo sapiens
uaugugggauaaacugaga

SEQ ID NO: 968918 - RNA, 19 nt, Homo sapiens
ccagaagacaugcugcuau

SEQ ID NO: 968919 - RNA, 19 nt, Homo sapiens
aaucggaccucagcuuuag

SEQ ID NO: 968920 - RNA, 19 nt, Homo sapiens
gaggaagauccauuaguuc

SEQ ID NO: 968921 - RNA, 19 nt, Homo sapiens
aaaucggaccucagcuuua

SEQ ID NO: 968922 - RNA, 19 nt, Homo sapiens
gagaggaagauccauuagu

SEQ ID NO: 968923 - RNA, 19 nt, Homo sapiens
gauaugugggauaaacuga

SEQ ID NO: 968924 - RNA, 19 nt, Homo sapiens
gacaagacgaacaucaaga

SEQ ID NO: 968925 - RNA, 19 nt, Homo sapiens
ccaacgguauagaucacaa

SEQ ID NO: 968926 - RNA, 19 nt, Homo sapiens
gaauauccaacgguauaga

SEQ ID NO: 968927 - RNA, 19 nt, Homo sapiens
guugaacggcagauauauu

SEQ ID NO: 968928 - RNA, 19 nt, Homo sapiens
ccaccuacuauauuaauca

SEQ ID NO: 968929 - RNA, 19 nt, Homo sapiens
ccuccucccucuuguuuua

SEQ ID NO: 968930 - RNA, 19 nt, Homo sapiens
cauccaaggcagcuuauuc

SEQ ID NO: 968931 - RNA, 19 nt, Homo sapiens
gaaagauaugugggauaaa

SEQ ID NO: 968932 - RNA, 19 nt, Homo sapiens
aaagagagagagauguaau

SEQ ID NO: 968933 - RNA, 19 nt, Homo sapiens
cauuuccacugcacauuuc

SEQ ID NO: 968934 - RNA, 19 nt, Homo sapiens
ucauuuccacugcacauuu

SEQ ID NO: 968935 - RNA, 19 nt, Homo sapiens
gaaacauacggugaauaau

SEQ ID NO: 968936 - RNA, 19 nt, Homo sapiens
aaugaugggcuccuccuaa

SEQ ID NO: 968937 - RNA, 19 nt, Homo sapiens
aaguugaacggcagauaua

SEQ ID NO: 968938 - RNA, 19 nt, Homo sapiens
uaggaugggacuuaaguug

SEQ ID NO: 968939 - RNA, 19 nt, Homo sapiens
ccaaguucacugccuuuau

SEQ ID NO: 968940 - RNA, 19 nt, Homo sapiens
gauucucugugaugcugaa

SEQ ID NO: 968941 - RNA, 19 nt, Homo sapiens
ggaaaucgagaggaagauc

SEQ ID NO: 968942 - RNA, 19 nt, Homo sapiens
ugaugcauccguccaaguu

SEQ ID NO: 968943 - RNA, 19 nt, Homo sapiens
ucccggaaaucgagaggaa

SEQ ID NO: 968944 - RNA, 19 nt, Homo sapiens
cgacaagacgaacaucaag

SEQ ID NO: 968945 - RNA, 19 nt, Homo sapiens
cagauauauuucacugauc

SEQ ID NO: 968946 - RNA, 19 nt, Homo sapiens
cacaguaauaccugaauau

SEQ ID NO: 968947 - RNA, 19 nt, Homo sapiens
gacuguuggcuuuguguuu

SEQ ID NO: 968948 - RNA, 19 nt, Homo sapiens
ggccgaaacauacggugaa

SEQ ID NO: 968949 - RNA, 19 nt, Homo sapiens
aagagagagagauguaauu

SEQ ID NO: 968950 - RNA, 19 nt, Homo sapiens
acuguuggcuuuguguuug

SEQ ID NO: 968951 - RNA, 19 nt, Homo sapiens
cuuccacaguaucuuguuu

SEQ ID NO: 968952 - RNA, 19 nt, Homo sapiens
ugaugggcuccuccuaaua

SEQ ID NO: 968953 - RNA, 19 nt, Homo sapiens
gaucauuuccacugcacau

SEQ ID NO: 968954 - RNA, 19 nt, Homo sapiens
cacaguaucuuguuuugau

SEQ ID NO: 968955 - RNA, 19 nt, Homo sapiens
aauucacgcucacgucguu

SEQ ID NO: 968956 - RNA, 19 nt, Homo sapiens
gccgaaacauacggugaau

SEQ ID NO: 968957 - RNA, 19 nt, Homo sapiens
uguccacggccgaaacaua

SEQ ID NO: 968958 - RNA, 19 nt, Homo sapiens
caaauaagaaaacggcaaa

SEQ ID NO: 968959 - RNA, 19 nt, Homo sapiens
gcugaaaacacucauauag

SEQ ID NO: 968960 - RNA, 19 nt, Homo sapiens
ccuuacggauugccaggaa

SEQ ID NO: 968961 - RNA, 19 nt, Homo sapiens
agcuuuaucugcuguuguu

SEQ ID NO: 968962 - RNA, 19 nt, Homo sapiens
gcuuuguguuuggaggaua

SEQ ID NO: 968963 - RNA, 19 nt, Homo sapiens
guucuuccacaguaucuug

SEQ ID NO: 968964 - RNA, 19 nt, Homo sapiens
cccgcguucucuaaacuaa

SEQ ID NO: 968965 - RNA, 19 nt, Homo sapiens
augaugggcuccuccuaau

SEQ ID NO: 968966 - RNA, 19 nt, Homo sapiens
ggccaccuacuauauuaau

SEQ ID NO: 968967 - RNA, 19 nt, Homo sapiens
ccaaauguuaccaaucagu

SEQ ID NO: 968968 - RNA, 19 nt, Homo sapiens
gcaagugcgaugcggucuu

SEQ ID NO: 968969 - RNA, 19 nt, Homo sapiens
augcugcuauggucacuga

SEQ ID NO: 968970 - RNA, 19 nt, Homo sapiens
agaguaaaggcuuccagaa

SEQ ID NO: 968971 - RNA, 19 nt, Homo sapiens
gggccaccuacuauauuaa

SEQ ID NO: 968972 - RNA, 19 nt, Homo sapiens
uagaaacccuucaguaaua

SEQ ID NO: 968973 - RNA, 19 nt, Homo sapiens
gcucugaacuugaaacuca

SEQ ID NO: 968974 - RNA, 19 nt, Homo sapiens
acacuagucugaauguaua

SEQ ID NO: 968975 - RNA, 19 nt, Homo sapiens
aaagaugccuuaagccauu

SEQ ID NO: 968976 - RNA, 19 nt, Homo sapiens
gaacacuagucugaaugua

SEQ ID NO: 968977 - RNA, 19 nt, Homo sapiens
gagcugccauguccgauga

SEQ ID NO: 968978 - RNA, 19 nt, Homo sapiens
aaaggcagacuacaaguua

SEQ ID NO: 968979 - RNA, 19 nt, Homo sapiens
gaaguacucuggugagacu

SEQ ID NO: 968980 - RNA, 19 nt, Homo sapiens
ugagaaugaugcuaagaaa

SEQ ID NO: 968981 - RNA, 19 nt, Homo sapiens
gaaaggcagacuacaaguu

SEQ ID NO: 968982 - RNA, 19 nt, Homo sapiens
gaaauaaagaugccuuaag

SEQ ID NO: 968983 - RNA, 19 nt, Homo sapiens
ggaccuugcuaauaucugu

SEQ ID NO: 968984 - RNA, 19 nt, Homo sapiens
gaacagcagagaauuucaa

SEQ ID NO: 968985 - RNA, 19 nt, Homo sapiens
ccuagaaacccuucaguaa

SEQ ID NO: 968986 - RNA, 19 nt, Homo sapiens
cugaauguauaccgaaaua

SEQ ID NO: 968987 - RNA, 19 nt, Homo sapiens
uuggagaacugcaguguuu

SEQ ID NO: 968988 - RNA, 19 nt, Homo sapiens
gagcagagccaggcagaaa

SEQ ID NO: 968989 - RNA, 19 nt, Homo sapiens
gaugaacagcagagaauuu

SEQ ID NO: 968990 - RNA, 19 nt, Homo sapiens
aagaugaaccugagaauga

SEQ ID NO: 968991 - RNA, 19 nt, Homo sapiens
ugaaaguaguuuacaggaa

SEQ ID NO: 968992 - RNA, 19 nt, Homo sapiens
gcagagccaggcagaaauu

SEQ ID NO: 968993 - RNA, 19 nt, Homo sapiens
ccugguggcugguggcaua

SEQ ID NO: 968994 - RNA, 19 nt, Homo sapiens
aaauaaagaugccuuaagc

SEQ ID NO: 968995 - RNA, 19 nt, Homo sapiens
gaagaugaaccugagaaug

SEQ ID NO: 968996 - RNA, 19 nt, Homo sapiens
ggacugaaagugcucugaa

SEQ ID NO: 968997 - RNA, 19 nt, Homo sapiens
gagccaggcagaaauuuau

SEQ ID NO: 968998 - RNA, 19 nt, Homo sapiens
ggcaguggcuugcucuugu

SEQ ID NO: 968999 - RNA, 19 nt, Homo sapiens
guggcuugcucuugucuuu

SEQ ID NO: 969000 - RNA, 19 nt, Homo sapiens
ugcuaaaccuuccuagaaa

SEQ ID NO: 969001 - RNA, 19 nt, Homo sapiens
gaaaacagaaggaucgaaa

SEQ ID NO: 969002 - RNA, 19 nt, Homo sapiens
ugauggcauuucagaagua

SEQ ID NO: 969003 - RNA, 19 nt, Homo sapiens
gcuguuguacucucacuuu

SEQ ID NO: 969004 - RNA, 19 nt, Homo sapiens
cuagaaacccuucaguaau

SEQ ID NO: 969005 - RNA, 19 nt, Homo sapiens
gguggcugguggcauaauu

SEQ ID NO: 969006 - RNA, 19 nt, Homo sapiens
gcaccucccugagaaaauu

SEQ ID NO: 969007 - RNA, 19 nt, Homo sapiens
ucaaaugcacggauucuca

SEQ ID NO: 969008 - RNA, 19 nt, Homo sapiens
cugcuaaaccuuccuagaa

SEQ ID NO: 969009 - RNA, 19 nt, Homo sapiens
ggaagaugaaccugagaau

SEQ ID NO: 969010 - RNA, 19 nt, Homo sapiens
guagagcauugugccuauu

SEQ ID NO: 969011 - RNA, 19 nt, Homo sapiens
cgaaauaaagaugccuuaa

SEQ ID NO: 969012 - RNA, 19 nt, Homo sapiens
caacagacaggccacucuu

SEQ ID NO: 969013 - RNA, 19 nt, Homo sapiens
gcuaaaccuuccuagaaac

SEQ ID NO: 969014 - RNA, 19 nt, Homo sapiens
ggguuaaccugggucaaau

SEQ ID NO: 969015 - RNA, 19 nt, Homo sapiens
ggagaacugcaguguuugu

SEQ ID NO: 969016 - RNA, 19 nt, Homo sapiens
cagcagagaauuucaaagg

SEQ ID NO: 969017 - RNA, 19 nt, Homo sapiens
uguacucucacuuuacuua

SEQ ID NO: 969018 - RNA, 19 nt, Homo sapiens
uaaacaagacaaggacuga

SEQ ID NO: 969019 - RNA, 19 nt, Homo sapiens
gcacugcuaaaccuuccua

SEQ ID NO: 969020 - RNA, 19 nt, Homo sapiens
guaguuuacaggaagauga

SEQ ID NO: 969021 - RNA, 19 nt, Homo sapiens
cgcaaaagauuaaaguuga

SEQ ID NO: 969022 - RNA, 19 nt, Homo sapiens
cggcacguccgaaggauuu

SEQ ID NO: 969023 - RNA, 19 nt, Homo sapiens
gcucaaguuuguccguagu

SEQ ID NO: 969024 - RNA, 19 nt, Homo sapiens
gaggccugcugauggcauu

SEQ ID NO: 969025 - RNA, 19 nt, Homo sapiens
cacggauucucaccucgua

SEQ ID NO: 969026 - RNA, 19 nt, Homo sapiens
gaauggggcuguuguacuc

SEQ ID NO: 969027 - RNA, 19 nt, Homo sapiens
gcaguggcuugcucuuguc

SEQ ID NO: 969028 - RNA, 19 nt, Homo sapiens
aaaguaguuuacaggaaga

SEQ ID NO: 969029 - RNA, 19 nt, Homo sapiens
cugagcaccucccugagaa

SEQ ID NO: 969030 - RNA, 19 nt, Homo sapiens
gcagacuacaaguuacuga

SEQ ID NO: 969031 - RNA, 19 nt, Homo sapiens
uagauaaacaagacaagga

SEQ ID NO: 969032 - RNA, 19 nt, Homo sapiens
ggaaaggcagacuacaagu

SEQ ID NO: 969033 - RNA, 19 nt, Homo sapiens
guggaaaggcagacuacaa

SEQ ID NO: 969034 - RNA, 19 nt, Homo sapiens
gugagacuguucaggaaag

SEQ ID NO: 969035 - RNA, 19 nt, Homo sapiens
guuguacucucacuuuacu

SEQ ID NO: 969036 - RNA, 19 nt, Homo sapiens
cuguuguacucucacuuua

SEQ ID NO: 969037 - RNA, 19 nt, Homo sapiens
uguagagcauugugccuau

SEQ ID NO: 969038 - RNA, 19 nt, Homo sapiens
agagccaggcagaaauuua

SEQ ID NO: 969039 - RNA, 19 nt, Homo sapiens
acagacaggccacucuuug

SEQ ID NO: 969040 - RNA, 19 nt, Homo sapiens
ccgaaauaaagaugccuua

SEQ ID NO: 969041 - RNA, 19 nt, Homo sapiens
caguguuugugacuauauu

SEQ ID NO: 969042 - RNA, 19 nt, Homo sapiens
gcaguguuugugacuauau

SEQ ID NO: 969043 - RNA, 19 nt, Homo sapiens
cugcaguguuugugacuau

SEQ ID NO: 969044 - RNA, 19 nt, Homo sapiens
aaagaugaacagcagagaa

SEQ ID NO: 969045 - RNA, 19 nt, Homo sapiens
aagaugaacagcagagaau

SEQ ID NO: 969046 - RNA, 19 nt, Homo sapiens
acccuucaguaauagauaa

SEQ ID NO: 969047 - RNA, 19 nt, Homo sapiens
aaccugagaaugaugcuaa

SEQ ID NO: 969048 - RNA, 19 nt, Homo sapiens
uagagcauugugccuauuu

SEQ ID NO: 969049 - RNA, 19 nt, Homo sapiens
auucucaccucguacaguu

SEQ ID NO: 969050 - RNA, 19 nt, Homo sapiens
ggugagacuguucaggaaa

SEQ ID NO: 969051 - RNA, 19 nt, Homo sapiens
gcugucacgggaagucuuu

SEQ ID NO: 969052 - RNA, 19 nt, Homo sapiens
gaaacccuucaguaauaga

SEQ ID NO: 969053 - RNA, 19 nt, Homo sapiens
agaaacccuucaguaauag

SEQ ID NO: 969054 - RNA, 19 nt, Homo sapiens
agaugaaccugagaaugau

SEQ ID NO: 969055 - RNA, 19 nt, Homo sapiens
agacuguucaggaaagaaa

SEQ ID NO: 969056 - RNA, 19 nt, Homo sapiens
ugacuauauucaacacagu

SEQ ID NO: 969057 - RNA, 19 nt, Homo sapiens
gacugaaagugcucugaac

SEQ ID NO: 969058 - RNA, 19 nt, Homo sapiens
caagacaaggacugaaagu

SEQ ID NO: 969059 - RNA, 19 nt, Homo sapiens
aacaagacaaggacugaaa

SEQ ID NO: 969060 - RNA, 19 nt, Homo sapiens
guacucuggugagacuguu

SEQ ID NO: 969061 - RNA, 19 nt, Homo sapiens
caggcagaaauuuaucaua

SEQ ID NO: 969062 - RNA, 19 nt, Homo sapiens
aaacagaaggaucgaaagg

SEQ ID NO: 969063 - RNA, 19 nt, Homo sapiens
uggugagacuguucaggaa

SEQ ID NO: 969064 - RNA, 19 nt, Homo sapiens
guacucucacuuuacuuau

SEQ ID NO: 969065 - RNA, 19 nt, Homo sapiens
gaaccugagaaugaugcua

SEQ ID NO: 969066 - RNA, 19 nt, Homo sapiens
caaagaugaacagcagaga

SEQ ID NO: 969067 - RNA, 19 nt, Homo sapiens
ugagacuguucaggaaaga

SEQ ID NO: 969068 - RNA, 19 nt, Homo sapiens
gauggcauuucagaaguac

SEQ ID NO: 969069 - RNA, 19 nt, Homo sapiens
ugggucaaaugcacggauu

SEQ ID NO: 969070 - RNA, 19 nt, Homo sapiens
uccgaugaaugccaacaga

SEQ ID NO: 969071 - RNA, 19 nt, Homo sapiens
cugagaaugaugcuaagaa

SEQ ID NO: 969072 - RNA, 19 nt, Homo sapiens
ggacauugguuugcuaaua

SEQ ID NO: 969073 - RNA, 19 nt, Homo sapiens
ggacaaacaucuccaagga

SEQ ID NO: 969074 - RNA, 19 nt, Homo sapiens
gcuaagugcuucuccaaua

SEQ ID NO: 969075 - RNA, 19 nt, Homo sapiens
gaucuagccuuugauguua

SEQ ID NO: 969076 - RNA, 19 nt, Homo sapiens
ccacaaagaugcaauuaug

SEQ ID NO: 969077 - RNA, 19 nt, Homo sapiens
guaaucgucugaucauaua

SEQ ID NO: 969078 - RNA, 19 nt, Homo sapiens
uuauggagcugcagaauua

SEQ ID NO: 969079 - RNA, 19 nt, Homo sapiens
gaagucagguaugaaguua

SEQ ID NO: 969080 - RNA, 19 nt, Homo sapiens
gaaagagucuggaaauaag

SEQ ID NO: 969081 - RNA, 19 nt, Homo sapiens
ggaaagagucuggaaauaa

SEQ ID NO: 969082 - RNA, 19 nt, Homo sapiens
gaaaauggguguuaacaaa

SEQ ID NO: 969083 - RNA, 19 nt, Homo sapiens
gcaagaauauucauuaagg

SEQ ID NO: 969084 - RNA, 19 nt, Homo sapiens
ggaauugaauaccauacua

SEQ ID NO: 969085 - RNA, 19 nt, Homo sapiens
gacauugguuugcuaauaa

SEQ ID NO: 969086 - RNA, 19 nt, Homo sapiens
ucagagaucuuaaacauuc

SEQ ID NO: 969087 - RNA, 19 nt, Homo sapiens
ugacaaguauugccaaauu

SEQ ID NO: 969088 - RNA, 19 nt, Homo sapiens
gaauuacuaugaaggcuuu

SEQ ID NO: 969089 - RNA, 19 nt, Homo sapiens
gaagggacaucauugacuu

SEQ ID NO: 969090 - RNA, 19 nt, Homo sapiens
ccaacuggauuauuucuuu

SEQ ID NO: 969091 - RNA, 19 nt, Homo sapiens
uaacucagcuuucaagaca

SEQ ID NO: 969092 - RNA, 19 nt, Homo sapiens
gagaaaagcuucccaauag

SEQ ID NO: 969093 - RNA, 19 nt, Homo sapiens
aauaagaacugaccaauag

SEQ ID NO: 969094 - RNA, 19 nt, Homo sapiens
gacccuaucuugauuaaau

SEQ ID NO: 969095 - RNA, 19 nt, Homo sapiens
gauaaaagcucuaaguuuc

SEQ ID NO: 969096 - RNA, 19 nt, Homo sapiens
acacuccacuugucucuua

SEQ ID NO: 969097 - RNA, 19 nt, Homo sapiens
ggacacagcaagaauauuc

SEQ ID NO: 969098 - RNA, 19 nt, Homo sapiens
gaagaagggacaucauuga

SEQ ID NO: 969099 - RNA, 19 nt, Homo sapiens
ccacuugucucuuaacuca

SEQ ID NO: 969100 - RNA, 19 nt, Homo sapiens
ccugauaccuucaaaguug

SEQ ID NO: 969101 - RNA, 19 nt, Homo sapiens
gaacaggagccuuuggaaa

SEQ ID NO: 969102 - RNA, 19 nt, Homo sapiens
gguaugaaguuaacuguuc

SEQ ID NO: 969103 - RNA, 19 nt, Homo sapiens
ccuaaguccucaauucaua

SEQ ID NO: 969104 - RNA, 19 nt, Homo sapiens
gcagaaaugcagacaauau

SEQ ID NO: 969105 - RNA, 19 nt, Homo sapiens
caaguggaauuacuaugaa

SEQ ID NO: 969106 - RNA, 19 nt, Homo sapiens
gaccagugauugugacauu

SEQ ID NO: 969107 - RNA, 19 nt, Homo sapiens
gaaaccaacaucucucaaa

SEQ ID NO: 969108 - RNA, 19 nt, Homo sapiens
ugaagaagcuuuugaaguu

SEQ ID NO: 969109 - RNA, 19 nt, Homo sapiens
ccaauacuguuuaaacuca

SEQ ID NO: 969110 - RNA, 19 nt, Homo sapiens
uggauaaacugaccugauu

SEQ ID NO: 969111 - RNA, 19 nt, Homo sapiens
caagacgaauguucccuuu

SEQ ID NO: 969112 - RNA, 19 nt, Homo sapiens
ucagaguaguguuuaagua

SEQ ID NO: 969113 - RNA, 19 nt, Homo sapiens
uaucaaagauggacauugg

SEQ ID NO: 969114 - RNA, 19 nt, Homo sapiens
ccaccacccuucuuucuga

SEQ ID NO: 969115 - RNA, 19 nt, Homo sapiens
ggaauacuuucuauggaau

SEQ ID NO: 969116 - RNA, 19 nt, Homo sapiens
uaaacucaguccucccaua

SEQ ID NO: 969117 - RNA, 19 nt, Homo sapiens
gaucguaaggcaccugaua

SEQ ID NO: 969118 - RNA, 19 nt, Homo sapiens
gaagggauuuauacaacau

SEQ ID NO: 969119 - RNA, 19 nt, Homo sapiens
ccacauaacagucaggauu

SEQ ID NO: 969120 - RNA, 19 nt, Homo sapiens
gggaaccucuugugcuuga

SEQ ID NO: 969121 - RNA, 19 nt, Homo sapiens
caaauuagaggcuguggaa

SEQ ID NO: 969122 - RNA, 19 nt, Homo sapiens
agcaaucccuccucaaaua

SEQ ID NO: 969123 - RNA, 19 nt, Homo sapiens
ucacacaccagaacauuaa

SEQ ID NO: 969124 - RNA, 19 nt, Homo sapiens
cagaaaugcagacaauaua

SEQ ID NO: 969125 - RNA, 19 nt, Homo sapiens
gagggugccugauaaaugg

SEQ ID NO: 969126 - RNA, 19 nt, Homo sapiens
auaagagggugccugauaa

SEQ ID NO: 969127 - RNA, 19 nt, Homo sapiens
caacaucucucaaaauuag

SEQ ID NO: 969128 - RNA, 19 nt, Homo sapiens
cagcuuaguuccagagaga

SEQ ID NO: 969129 - RNA, 19 nt, Homo sapiens
ugugaaauaugacagcuuu

SEQ ID NO: 969130 - RNA, 19 nt, Homo sapiens
acaaccagcacaauauuua

SEQ ID NO: 969131 - RNA, 19 nt, Homo sapiens
ccaccauucuucauaauuc

SEQ ID NO: 969132 - RNA, 19 nt, Homo sapiens
gagguagaaucaagacgaa

SEQ ID NO: 969133 - RNA, 19 nt, Homo sapiens
gacaaguauugccaaauug

SEQ ID NO: 969134 - RNA, 19 nt, Homo sapiens
guccucaauucauaaguua

SEQ ID NO: 969135 - RNA, 19 nt, Homo sapiens
gcgaagggauuuauacaac

SEQ ID NO: 969136 - RNA, 19 nt, Homo sapiens
caaggauguuugagagauu

SEQ ID NO: 969137 - RNA, 19 nt, Homo sapiens
agaaacagauacacucaug

SEQ ID NO: 969138 - RNA, 19 nt, Homo sapiens
uaauagggaucuggaggua

SEQ ID NO: 969139 - RNA, 19 nt, Homo sapiens
uaaggacacagcaagaaua

SEQ ID NO: 969140 - RNA, 19 nt, Homo sapiens
caaagaauaguccaauuuc

SEQ ID NO: 969141 - RNA, 19 nt, Homo sapiens
agacauuccuuaaccauca

SEQ ID NO: 969142 - RNA, 19 nt, Homo sapiens
ugucuugccugaauacaaa

SEQ ID NO: 969143 - RNA, 19 nt, Homo sapiens
agacgacucuuuccgcaaa

SEQ ID NO: 969144 - RNA, 19 nt, Homo sapiens
agucagucaucaaacauua

SEQ ID NO: 969145 - RNA, 19 nt, Homo sapiens
acucaguccucccauauuu

SEQ ID NO: 969146 - RNA, 19 nt, Homo sapiens
uggaaagagucuggaaaua

SEQ ID NO: 969147 - RNA, 19 nt, Homo sapiens
gacaauauaagacacacua

SEQ ID NO: 969148 - RNA, 19 nt, Homo sapiens
gaaaagguugugugaaaua

SEQ ID NO: 969149 - RNA, 19 nt, Homo sapiens
gaccaacacuccacuuguc

SEQ ID NO: 969150 - RNA, 19 nt, Homo sapiens
aauaagagggugccugaua

SEQ ID NO: 969151 - RNA, 19 nt, Homo sapiens
ucaaguggaauuacuauga

SEQ ID NO: 969152 - RNA, 19 nt, Homo sapiens
ggaggaugaugauguugug

SEQ ID NO: 969153 - RNA, 19 nt, Homo sapiens
aagcagaaaugcagacaau

SEQ ID NO: 969154 - RNA, 19 nt, Homo sapiens
ucauauaaaccacccauuu

SEQ ID NO: 969155 - RNA, 19 nt, Homo sapiens
cagaaaagcuugaagaaca

SEQ ID NO: 969156 - RNA, 19 nt, Homo sapiens
gguggacccuaucuugauu

SEQ ID NO: 969157 - RNA, 19 nt, Homo sapiens
cuucgaagcguguguauuu

SEQ ID NO: 969158 - RNA, 19 nt, Homo sapiens
cccauaacauucagauauu

SEQ ID NO: 969159 - RNA, 19 nt, Homo sapiens
ggagaaaagcuucccaaua

SEQ ID NO: 969160 - RNA, 19 nt, Homo sapiens
cagauacacucauguuaag

SEQ ID NO: 969161 - RNA, 19 nt, Homo sapiens
uggcugcucucuuuguuaa

SEQ ID NO: 969162 - RNA, 19 nt, Homo sapiens
ggccuuaggugaguccuuu

SEQ ID NO: 969163 - RNA, 19 nt, Homo sapiens
gguaaucgucugaucauau

SEQ ID NO: 969164 - RNA, 19 nt, Homo sapiens
ccaaaucagagaucuuaaa

SEQ ID NO: 969165 - RNA, 19 nt, Homo sapiens
gauggacauugguuugcua

SEQ ID NO: 969166 - RNA, 19 nt, Homo sapiens
uaugugaagcuaccaauaa

SEQ ID NO: 969167 - RNA, 19 nt, Homo sapiens
uuagacgggugccuuauga

SEQ ID NO: 969168 - RNA, 19 nt, Homo sapiens
caauggagcaaauauguug

SEQ ID NO: 969169 - RNA, 19 nt, Homo sapiens
gaauuggugucagaguuga

SEQ ID NO: 969170 - RNA, 19 nt, Homo sapiens
cuaagugcuucuccaauau

SEQ ID NO: 969171 - RNA, 19 nt, Homo sapiens
ucuaagagguuaugcucaa

SEQ ID NO: 969172 - RNA, 19 nt, Homo sapiens
gcaacugacugaagaauua

SEQ ID NO: 969173 - RNA, 19 nt, Homo sapiens
gcauagaaauccaaaguau

SEQ ID NO: 969174 - RNA, 19 nt, Homo sapiens
caaagaauaugacaucugu

SEQ ID NO: 969175 - RNA, 19 nt, Homo sapiens
gaacuccuaggcucuauua

SEQ ID NO: 969176 - RNA, 19 nt, Homo sapiens
uaacaucacucucaguaau

SEQ ID NO: 969177 - RNA, 19 nt, Homo sapiens
aggcauaucuucuguguuu

SEQ ID NO: 969178 - RNA, 19 nt, Homo sapiens
ucaaggaguuccaucagua

SEQ ID NO: 969179 - RNA, 19 nt, Homo sapiens
gaaagccccucuagaauuu

SEQ ID NO: 969180 - RNA, 19 nt, Homo sapiens
guaaacguaucuaaugcua

SEQ ID NO: 969181 - RNA, 19 nt, Homo sapiens
gaaggcagcauacuuaaau

SEQ ID NO: 969182 - RNA, 19 nt, Homo sapiens
gcaaagcaggcaaagauaa

SEQ ID NO: 969183 - RNA, 19 nt, Homo sapiens
caauggaccugaacaacuu

SEQ ID NO: 969184 - RNA, 19 nt, Homo sapiens
aaacagaguuaucuccauu

SEQ ID NO: 969185 - RNA, 19 nt, Homo sapiens
cagcaucaauuccaaagaa

SEQ ID NO: 969186 - RNA, 19 nt, Homo sapiens
gaagaagaaggaauuaaug

SEQ ID NO: 969187 - RNA, 19 nt, Homo sapiens
aaucaaguauggaccaaua

SEQ ID NO: 969188 - RNA, 19 nt, Homo sapiens
gaagaaggaauuaaugugu

SEQ ID NO: 969189 - RNA, 19 nt, Homo sapiens
gaaugaccuuuguuacuga

SEQ ID NO: 969190 - RNA, 19 nt, Homo sapiens
cggaauacaugguuuauag

SEQ ID NO: 969191 - RNA, 19 nt, Homo sapiens
ggaccaauauuuacagucu

SEQ ID NO: 969192 - RNA, 19 nt, Homo sapiens
gaccaagaaucuaacauca

SEQ ID NO: 969193 - RNA, 19 nt, Homo sapiens
ccuaggcucuauuaacaua

SEQ ID NO: 969194 - RNA, 19 nt, Homo sapiens
gaaggcagcauacuuaaag

SEQ ID NO: 969195 - RNA, 19 nt, Homo sapiens
ggugaagccuguggaaauu

SEQ ID NO: 969196 - RNA, 19 nt, Homo sapiens
gagguucagauguguauua

SEQ ID NO: 969197 - RNA, 19 nt, Homo sapiens
augaacaacuggagaauuu

SEQ ID NO: 969198 - RNA, 19 nt, Homo sapiens
ggaguuggauuugaguuug

SEQ ID NO: 969199 - RNA, 19 nt, Homo sapiens
ggaauuugauuucaugcau

SEQ ID NO: 969200 - RNA, 19 nt, Homo sapiens
cagcauacuuaaaggaauu

SEQ ID NO: 969201 - RNA, 19 nt, Homo sapiens
ggaauuugauuucaugcau

SEQ ID NO: 969202 - RNA, 19 nt, Homo sapiens
gaaguuggaauuugauuuc

SEQ ID NO: 969203 - RNA, 19 nt, Homo sapiens
cagugaauaugcucuuuaa

SEQ ID NO: 969204 - RNA, 19 nt, Homo sapiens
cgaaugaccuuuguuacug

SEQ ID NO: 969205 - RNA, 19 nt, Homo sapiens
gaaaccgaaugaccuuugu

SEQ ID NO: 969206 - RNA, 19 nt, Homo sapiens
gcaggcaaagauaagauua

SEQ ID NO: 969207 - RNA, 19 nt, Homo sapiens
uaauauagagaccggaaua

SEQ ID NO: 969208 - RNA, 19 nt, Homo sapiens
uaagacaucuccuuuaucc

SEQ ID NO: 969209 - RNA, 19 nt, Homo sapiens
agaauuacaugaacaacug

SEQ ID NO: 969210 - RNA, 19 nt, Homo sapiens
ccaagaaucuaacaucacu

SEQ ID NO: 969211 - RNA, 19 nt, Homo sapiens
aguaagacaucuccuuuau

SEQ ID NO: 969212 - RNA, 19 nt, Homo sapiens
gaccugaacaacuuaguaa

SEQ ID NO: 969213 - RNA, 19 nt, Homo sapiens
uuugguaucuucaacagua

SEQ ID NO: 969214 - RNA, 19 nt, Homo sapiens
guagagacggaaacaagua

SEQ ID NO: 969215 - RNA, 19 nt, Homo sapiens
caaguauggaccaauauuu

SEQ ID NO: 969216 - RNA, 19 nt, Homo sapiens
gaaagcaagaaucaaguau

SEQ ID NO: 969217 - RNA, 19 nt, Homo sapiens
gaauacaugguuuauagga

SEQ ID NO: 969218 - RNA, 19 nt, Homo sapiens
uaugggcucuuacugcuuu

SEQ ID NO: 969219 - RNA, 19 nt, Homo sapiens
aagcuacgcuggauauugu

SEQ ID NO: 969220 - RNA, 19 nt, Homo sapiens
ggaccugaacaacuuagua

SEQ ID NO: 969221 - RNA, 19 nt, Homo sapiens
gaacaacuggagaauuuag

SEQ ID NO: 969222 - RNA, 19 nt, Homo sapiens
gggcuucucugucuaaugc

SEQ ID NO: 969223 - RNA, 19 nt, Homo sapiens
gaacuagcagugcaaaaua

SEQ ID NO: 969224 - RNA, 19 nt, Homo sapiens
ugugaaggcagcauacuua

SEQ ID NO: 969225 - RNA, 19 nt, Homo sapiens
ugugaaggcagcauacuua

SEQ ID NO: 969226 - RNA, 19 nt, Homo sapiens
ggaaaccgaaugaccuuug

SEQ ID NO: 969227 - RNA, 19 nt, Homo sapiens
gaaucuaacaucacucuca

SEQ ID NO: 969228 - RNA, 19 nt, Homo sapiens
ucaaauggugcauguguuu

SEQ ID NO: 969229 - RNA, 19 nt, Homo sapiens
caaggugguuugcucuguu

SEQ ID NO: 969230 - RNA, 19 nt, Homo sapiens
ggauuggaguuggauuuga

SEQ ID NO: 969231 - RNA, 19 nt, Homo sapiens
gcagcauacuuaaaggaau

SEQ ID NO: 969232 - RNA, 19 nt, Homo sapiens
acacacugcuucacuuugu

SEQ ID NO: 969233 - RNA, 19 nt, Homo sapiens
ggacaauggaccugaacaa

SEQ ID NO: 969234 - RNA, 19 nt, Homo sapiens
gcauguguuugguaucuuc

SEQ ID NO: 969235 - RNA, 19 nt, Homo sapiens
cuaagaaacuggucaaaau

SEQ ID NO: 969236 - RNA, 19 nt, Homo sapiens
ggaaagccccucuagaauu

SEQ ID NO: 969237 - RNA, 19 nt, Homo sapiens
agaguuaucuccauuuggu

SEQ ID NO: 969238 - RNA, 19 nt, Homo sapiens
gucaaucuccaucaguuua

SEQ ID NO: 969239 - RNA, 19 nt, Homo sapiens
guuggaauuugauuucaug

SEQ ID NO: 969240 - RNA, 19 nt, Homo sapiens
gaccggaauacaugguuua

SEQ ID NO: 969241 - RNA, 19 nt, Homo sapiens
aagcaagaaucaaguaugg

SEQ ID NO: 969242 - RNA, 19 nt, Homo sapiens
acagaguuaucuccauuug

SEQ ID NO: 969243 - RNA, 19 nt, Homo sapiens
caaacagaguuaucuccau

SEQ ID NO: 969244 - RNA, 19 nt, Homo sapiens
aaggugguuugcucuguua

SEQ ID NO: 969245 - RNA, 19 nt, Homo sapiens
aaacacacugcuucacuuu

SEQ ID NO: 969246 - RNA, 19 nt, Homo sapiens
aaaggcaaauuuagagaag

SEQ ID NO: 969247 - RNA, 19 nt, Homo sapiens
gaccuuuguuacugaagaa

SEQ ID NO: 969248 - RNA, 19 nt, Homo sapiens
gggcuggauuccuuggauu

SEQ ID NO: 969249 - RNA, 19 nt, Homo sapiens
guagucuucuggacccauu

SEQ ID NO: 969250 - RNA, 19 nt, Homo sapiens
ggcaaagcaggcaaagaua

SEQ ID NO: 969251 - RNA, 19 nt, Homo sapiens
uugcauacguccuuucuca

SEQ ID NO: 969252 - RNA, 19 nt, Homo sapiens
gcuuugggcuucucugucu

SEQ ID NO: 969253 - RNA, 19 nt, Homo sapiens
ggaaaacucacccaauuau

SEQ ID NO: 969254 - RNA, 19 nt, Homo sapiens
agaaagcaagaaucaagua

SEQ ID NO: 969255 - RNA, 19 nt, Homo sapiens
ucuaacaucacucucagua

SEQ ID NO: 969256 - RNA, 19 nt, Homo sapiens
aagaauaugacaucuguug

SEQ ID NO: 969257 - RNA, 19 nt, Homo sapiens
gauuggaguuggauuugag

SEQ ID NO: 969258 - RNA, 19 nt, Homo sapiens
cuccuaggcucuauuaaca

SEQ ID NO: 969259 - RNA, 19 nt, Homo sapiens
uaguaagacaucuccuuua

SEQ ID NO: 969260 - RNA, 19 nt, Homo sapiens
ugacugaagaauuacauga

SEQ ID NO: 969261 - RNA, 19 nt, Homo sapiens
gcuaugggaaaccgaauga

SEQ ID NO: 969262 - RNA, 19 nt, Homo sapiens
gagaaagcaagaaucaagu

SEQ ID NO: 969263 - RNA, 19 nt, Homo sapiens
uaaaugguguguuuuggaa

SEQ ID NO: 969264 - RNA, 19 nt, Homo sapiens
uggcaaagcaggcaaagau

SEQ ID NO: 969265 - RNA, 19 nt, Homo sapiens
gauauccacaaggccauua

SEQ ID NO: 969266 - RNA, 19 nt, Homo sapiens
ggaguuccaucaguauuuu

SEQ ID NO: 969267 - RNA, 19 nt, Homo sapiens
guacagcaucaauuccaaa

SEQ ID NO: 969268 - RNA, 19 nt, Homo sapiens
ucaaguauggaccaauauu

SEQ ID NO: 969269 - RNA, 19 nt, Homo sapiens
gaacuaauuuccccaacag

SEQ ID NO: 969270 - RNA, 19 nt, Homo sapiens
uguuagagguucagaugug

SEQ ID NO: 969271 - RNA, 19 nt, Homo sapiens
caaagcaggcaaagauaag

SEQ ID NO: 969272 - RNA, 19 nt, Homo sapiens
gaagagaaacgaaacaaga

SEQ ID NO: 969273 - RNA, 19 nt, Homo sapiens
guagauggacguauuauug

SEQ ID NO: 969274 - RNA, 19 nt, Homo sapiens
gagacacgcuucacauaca

SEQ ID NO: 969275 - RNA, 19 nt, Homo sapiens
aaaagaagcucaaggaaga

SEQ ID NO: 969276 - RNA, 19 nt, Homo sapiens
aaucauuccuucucacuug

SEQ ID NO: 969277 - RNA, 19 nt, Homo sapiens
gagacccucugguuauaga

SEQ ID NO: 969278 - RNA, 19 nt, Homo sapiens
gaagcgaagggcaaucauu

SEQ ID NO: 969279 - RNA, 19 nt, Homo sapiens
gggcaaucauuccuucuca

SEQ ID NO: 969280 - RNA, 19 nt, Homo sapiens
gcagagucuucucgacaug

SEQ ID NO: 969281 - RNA, 19 nt, Homo sapiens
gaagcucaaggaagagaaa

SEQ ID NO: 969282 - RNA, 19 nt, Homo sapiens
gaaacgaaacaagagcaaa

SEQ ID NO: 969283 - RNA, 19 nt, Homo sapiens
cuugguagauggacguauu

SEQ ID NO: 969284 - RNA, 19 nt, Homo sapiens
acaccucccugaccagaga

SEQ ID NO: 969285 - RNA, 19 nt, Homo sapiens
uagauggacguauuauuga

SEQ ID NO: 969286 - RNA, 19 nt, Homo sapiens
ggagacacgcuucacauac

SEQ ID NO: 969287 - RNA, 19 nt, Homo sapiens
ucaaggaagagaaacgaaa

SEQ ID NO: 969288 - RNA, 19 nt, Homo sapiens
gagaagcgaagggcaauca

SEQ ID NO: 969289 - RNA, 19 nt, Homo sapiens
gcacuaauccgagccaacu

SEQ ID NO: 969290 - RNA, 19 nt, Homo sapiens
ggaagagaaacgaaacaag

SEQ ID NO: 969291 - RNA, 19 nt, Homo sapiens
gguagauggacguauuauu

SEQ ID NO: 969292 - RNA, 19 nt, Homo sapiens
uggagacacgcuucacaua

SEQ ID NO: 969293 - RNA, 19 nt, Homo sapiens
ucacuuggccuauggaaaa

SEQ ID NO: 969294 - RNA, 19 nt, Homo sapiens
acgggaagcuugguagaug

SEQ ID NO: 969295 - RNA, 19 nt, Homo sapiens
auacagaaaggccaauaga

SEQ ID NO: 969296 - RNA, 19 nt, Homo sapiens
aaaggccaauagacccaaa

SEQ ID NO: 969297 - RNA, 19 nt, Homo sapiens
gcaaucauuccuucucacu

SEQ ID NO: 969298 - RNA, 19 nt, Homo sapiens
gagagaagcgaagggcaau

SEQ ID NO: 969299 - RNA, 19 nt, Homo sapiens
aagcgaagggcaaucauuc

SEQ ID NO: 969300 - RNA, 19 nt, Homo sapiens
caaggaagagaaacgaaac

SEQ ID NO: 969301 - RNA, 19 nt, Homo sapiens
uaucaccuauacagaaagg

SEQ ID NO: 969302 - RNA, 19 nt, Homo sapiens
gauggacguauuauugaca

SEQ ID NO: 969303 - RNA, 19 nt, Homo sapiens
gcucaaggaagagaaacga

SEQ ID NO: 969304 - RNA, 19 nt, Homo sapiens
cuacacgggaagcuuggua

SEQ ID NO: 969305 - RNA, 19 nt, Homo sapiens
uuauagaacuuggccaaaa

SEQ ID NO: 969306 - RNA, 19 nt, Homo sapiens
aaacgaaacaagagcaaaa

SEQ ID NO: 969307 - RNA, 19 nt, Homo sapiens
ccucauuggguaucaccua

SEQ ID NO: 969308 - RNA, 19 nt, Homo sapiens
gcaauuauauucccuguga

SEQ ID NO: 969309 - RNA, 19 nt, Homo sapiens
gaccgaagcugcucucuuu

SEQ ID NO: 969310 - RNA, 19 nt, Homo sapiens
caaaggaaaugccacuaaa

SEQ ID NO: 969311 - RNA, 19 nt, Homo sapiens
caaaguggaugaacaugaa

SEQ ID NO: 969312 - RNA, 19 nt, Homo sapiens
ccagcaagaugucaauuaa

SEQ ID NO: 969313 - RNA, 19 nt, Homo sapiens
guacauagcucucauuucc

SEQ ID NO: 969314 - RNA, 19 nt, Homo sapiens
gaaaugccacuaaagaauu

SEQ ID NO: 969315 - RNA, 19 nt, Homo sapiens
gcacguaccugugucuuau

SEQ ID NO: 969316 - RNA, 19 nt, Homo sapiens
caccgaagauggaugcuua

SEQ ID NO: 969317 - RNA, 19 nt, Homo sapiens
ggucuuauuuguauucuga

SEQ ID NO: 969318 - RNA, 19 nt, Homo sapiens
gcaauugccugccuuguac

SEQ ID NO: 969319 - RNA, 19 nt, Homo sapiens
gggaauagaacaauugaaa

SEQ ID NO: 969320 - RNA, 19 nt, Homo sapiens
ggacacgguuugccugcua

SEQ ID NO: 969321 - RNA, 19 nt, Homo sapiens
ggccugcucuuccucauuu

SEQ ID NO: 969322 - RNA, 19 nt, Homo sapiens
ggaaaugccacuaaagaau

SEQ ID NO: 969323 - RNA, 19 nt, Homo sapiens
cagaauagcuuaugaugcu

SEQ ID NO: 969324 - RNA, 19 nt, Homo sapiens
ggguaggaguuaagguuua

SEQ ID NO: 969325 - RNA, 19 nt, Homo sapiens
gaagauggaccaccacugu

SEQ ID NO: 969326 - RNA, 19 nt, Homo sapiens
ggaagaguguguaggaaag

SEQ ID NO: 969327 - RNA, 19 nt, Homo sapiens
ccacagugauucuccuuau

SEQ ID NO: 969328 - RNA, 19 nt, Homo sapiens
guaccugugucuuaucuau

SEQ ID NO: 969329 - RNA, 19 nt, Homo sapiens
gagaagggcaggaucagaa

SEQ ID NO: 969330 - RNA, 19 nt, Homo sapiens
gaauagcuuaugaugcuua

SEQ ID NO: 969331 - RNA, 19 nt, Homo sapiens
ggacugaacagggaagaaa

SEQ ID NO: 969332 - RNA, 19 nt, Homo sapiens
uggaaucucucuucaugaa

SEQ ID NO: 969333 - RNA, 19 nt, Homo sapiens
caucgagaguuuacaguug

SEQ ID NO: 969334 - RNA, 19 nt, Homo sapiens
caaaaugccuuauacaauc

SEQ ID NO: 969335 - RNA, 19 nt, Homo sapiens
ggauuccacuuccugcauu

SEQ ID NO: 969336 - RNA, 19 nt, Homo sapiens
uaagcagugugaauucuga

SEQ ID NO: 969337 - RNA, 19 nt, Homo sapiens
ccaaaggaaaugccacuaa

SEQ ID NO: 969338 - RNA, 19 nt, Homo sapiens
gagagaagaugggcuaaaa

SEQ ID NO: 969339 - RNA, 19 nt, Homo sapiens
gcgagaacaaccagaagua

SEQ ID NO: 969340 - RNA, 19 nt, Homo sapiens
gcugagcauugcagagaaa

SEQ ID NO: 969341 - RNA, 19 nt, Homo sapiens
aagaauucaucgagaguuu

SEQ ID NO: 969342 - RNA, 19 nt, Homo sapiens
ggaauucucacacauugau

SEQ ID NO: 969343 - RNA, 19 nt, Homo sapiens
cauaaaaccucaccgaaga

SEQ ID NO: 969344 - RNA, 19 nt, Homo sapiens
ggaguuaagguuuauucaa

SEQ ID NO: 969345 - RNA, 19 nt, Homo sapiens
ugaaggagguggugauggu

SEQ ID NO: 969346 - RNA, 19 nt, Homo sapiens
gcacagaugagacgggaau

SEQ ID NO: 969347 - RNA, 19 nt, Homo sapiens
gaaucucucuucaugaaaa

SEQ ID NO: 969348 - RNA, 19 nt, Homo sapiens
gguaggaguuaagguuuau

SEQ ID NO: 969349 - RNA, 19 nt, Homo sapiens
ucucacacauugauuuguu

SEQ ID NO: 969350 - RNA, 19 nt, Homo sapiens
gcacugggacagaauagau

SEQ ID NO: 969351 - RNA, 19 nt, Homo sapiens
caccagugcccaacacaua

SEQ ID NO: 969352 - RNA, 19 nt, Homo sapiens
ggacagaauagcuuaugau

SEQ ID NO: 969353 - RNA, 19 nt, Homo sapiens
gaagaagauuggacaaccu

SEQ ID NO: 969354 - RNA, 19 nt, Homo sapiens
gagacuacguguauagcau

SEQ ID NO: 969355 - RNA, 19 nt, Homo sapiens
gaugguggauagaggugaa

SEQ ID NO: 969356 - RNA, 19 nt, Homo sapiens
gcaaaacaacuacucuuaa

SEQ ID NO: 969357 - RNA, 19 nt, Homo sapiens
gcauugcuuugaagaagau

SEQ ID NO: 969358 - RNA, 19 nt, Homo sapiens
ggaguucgugguccucuuu

SEQ ID NO: 969359 - RNA, 19 nt, Homo sapiens
ggaacaugcugccacuuuu

SEQ ID NO: 969360 - RNA, 19 nt, Homo sapiens
uggauucacuuucugauag

SEQ ID NO: 969361 - RNA, 19 nt, Homo sapiens
aaaccauccuuucgauuuc

SEQ ID NO: 969362 - RNA, 19 nt, Homo sapiens
agacgggaauagaacaauu

SEQ ID NO: 969363 - RNA, 19 nt, Homo sapiens
uuuaagcaauugccagaaa

SEQ ID NO: 969364 - RNA, 19 nt, Homo sapiens
ggacccaggugcacuccau

SEQ ID NO: 969365 - RNA, 19 nt, Homo sapiens
gaagauuggacaaccuaug

SEQ ID NO: 969366 - RNA, 19 nt, Homo sapiens
gaaauggcagagacuggaa

SEQ ID NO: 969367 - RNA, 19 nt, Homo sapiens
acauagcucucauuuccuu

SEQ ID NO: 969368 - RNA, 19 nt, Homo sapiens
gcugugcccauucuacuaa

SEQ ID NO: 969369 - RNA, 19 nt, Homo sapiens
uugccugccuuguacuuua

SEQ ID NO: 969370 - RNA, 19 nt, Homo sapiens
gugcguggauggaauaguc

SEQ ID NO: 969371 - RNA, 19 nt, Homo sapiens
cauccguucucaugaaugu

SEQ ID NO: 969372 - RNA, 19 nt, Homo sapiens
acuggaaucucucuucaug

SEQ ID NO: 969373 - RNA, 19 nt, Homo sapiens
ggaacugccuccggcuuca

SEQ ID NO: 969374 - RNA, 19 nt, Homo sapiens
aggcagacccguaccagua

SEQ ID NO: 969375 - RNA, 19 nt, Homo sapiens
aaacaaaguggaugaacau

SEQ ID NO: 969376 - RNA, 19 nt, Homo sapiens
gacagaauagcuuaugaug

SEQ ID NO: 969377 - RNA, 19 nt, Homo sapiens
ggauucacuuucugauagu

SEQ ID NO: 969378 - RNA, 19 nt, Homo sapiens
guauggacagaauagcuua

SEQ ID NO: 969379 - RNA, 19 nt, Homo sapiens
gaauaccuccagccagaga

SEQ ID NO: 969380 - RNA, 19 nt, Homo sapiens
aaaugccacuaaagaauuc

SEQ ID NO: 969381 - RNA, 19 nt, Homo sapiens
gcagacccguaccaguaug

SEQ ID NO: 969382 - RNA, 19 nt, Homo sapiens
agacuggaaucucucuuca

SEQ ID NO: 969383 - RNA, 19 nt, Homo sapiens
ucaacggaauuguguucaa

SEQ ID NO: 969384 - RNA, 19 nt, Homo sapiens
cuuauacaaucaagaggaa

SEQ ID NO: 969385 - RNA, 19 nt, Homo sapiens
gacacgguuugccugcuaa

SEQ ID NO: 969386 - RNA, 19 nt, Homo sapiens
ugucuggcaugacuaaugu

SEQ ID NO: 969387 - RNA, 19 nt, Homo sapiens
aaggaaaugccacuaaaga

SEQ ID NO: 969388 - RNA, 19 nt, Homo sapiens
caacggaauuguguucaac

SEQ ID NO: 969389 - RNA, 19 nt, Homo sapiens
gaagaguguguaggaaaga

SEQ ID NO: 969390 - RNA, 19 nt, Homo sapiens
ucaauuaagcagugugaau

SEQ ID NO: 969391 - RNA, 19 nt, Homo sapiens
guggauucacuuucugaua

SEQ ID NO: 969392 - RNA, 19 nt, Homo sapiens
acaaaguggaugaacauga

SEQ ID NO: 969393 - RNA, 19 nt, Homo sapiens
ggaaucucucuucaugaaa

SEQ ID NO: 969394 - RNA, 19 nt, Homo sapiens
ggcaggugguguacaagug

SEQ ID NO: 969395 - RNA, 19 nt, Homo sapiens
gauuccaucucgagacuac

SEQ ID NO: 969396 - RNA, 19 nt, Homo sapiens
uggaacaugcugccacuuu

SEQ ID NO: 969397 - RNA, 19 nt, Homo sapiens
cccagcaagaugucaauua

SEQ ID NO: 969398 - RNA, 19 nt, Homo sapiens
uggcaugacuaauguagag

SEQ ID NO: 969399 - RNA, 19 nt, Homo sapiens
cuggguagggcgaaaguua

SEQ ID NO: 969400 - RNA, 19 nt, Homo sapiens
caucauccccuucucauuu

SEQ ID NO: 969401 - RNA, 19 nt, Homo sapiens
gcugugcguggauggaaua

SEQ ID NO: 969402 - RNA, 19 nt, Homo sapiens
cuaacugagugagacauga

SEQ ID NO: 969403 - RNA, 19 nt, Homo sapiens
gacgggaauagaacaauug

SEQ ID NO: 969404 - RNA, 19 nt, Homo sapiens
cagaugagacgggaauaga

SEQ ID NO: 969405 - RNA, 19 nt, Homo sapiens
gacaaccuauggacugaac

SEQ ID NO: 969406 - RNA, 19 nt, Homo sapiens
uggacagaauagcuuauga

SEQ ID NO: 969407 - RNA, 19 nt, Homo sapiens
gauuccacuuccugcauug

SEQ ID NO: 969408 - RNA, 19 nt, Homo sapiens
gaacacggcuucgggauuu

SEQ ID NO: 969409 - RNA, 19 nt, Homo sapiens
ggaacuaacugcacauuca

SEQ ID NO: 969410 - RNA, 19 nt, Homo sapiens
gccuuuagcuuuauguaua

SEQ ID NO: 969411 - RNA, 19 nt, Homo sapiens
gaggagaucucaccaagca

SEQ ID NO: 969412 - RNA, 19 nt, Homo sapiens
gaucucaccaagcacauua

SEQ ID NO: 969413 - RNA, 19 nt, Homo sapiens
gcaacagcauggucauuca

SEQ ID NO: 969414 - RNA, 19 nt, Homo sapiens
cuacguggccuuuagcuuu

SEQ ID NO: 969415 - RNA, 19 nt, Homo sapiens
ggcaaggccuucugcaugu

SEQ ID NO: 969416 - RNA, 19 nt, Homo sapiens
gaacuaacugcacauucaa

SEQ ID NO: 969417 - RNA, 19 nt, Homo sapiens
uacguggccuuuagcuuua

SEQ ID NO: 969418 - RNA, 19 nt, Homo sapiens
cuccaucucuccuggguua

SEQ ID NO: 969419 - RNA, 19 nt, Homo sapiens
uaacugcacauucaagaga

SEQ ID NO: 969420 - RNA, 19 nt, Homo sapiens
gcaaggccuucugcauguu

SEQ ID NO: 969421 - RNA, 19 nt, Homo sapiens
ugaagcgcauuaagaagug

SEQ ID NO: 969422 - RNA, 19 nt, Homo sapiens
uggagaacauggugacugu

SEQ ID NO: 969423 - RNA, 19 nt, Homo sapiens
agaagaagccgcucuacgu

SEQ ID NO: 969424 - RNA, 19 nt, Homo sapiens
cgggauuucugccuucuca

SEQ ID NO: 969425 - RNA, 19 nt, Homo sapiens
ucccggaccugcagucugu

SEQ ID NO: 969426 - RNA, 19 nt, Homo sapiens
gcgagcgcaugaacaccuu

SEQ ID NO: 969427 - RNA, 19 nt, Homo sapiens
ggucaucaccaccauaggu

SEQ ID NO: 969428 - RNA, 19 nt, Homo sapiens
cuuacaagaucgaggagau

SEQ ID NO: 969429 - RNA, 19 nt, Homo sapiens
ccaugaacagugaggauga

SEQ ID NO: 969430 - RNA, 19 nt, Homo sapiens
gcgaggaggagaaacucaa

SEQ ID NO: 969431 - RNA, 19 nt, Homo sapiens
cgaggaggagaaacucaaa

SEQ ID NO: 969432 - RNA, 19 nt, Homo sapiens
cugcugaagcgcauuaaga

SEQ ID NO: 969433 - RNA, 19 nt, Homo sapiens
caucaccaccauagguuau

SEQ ID NO: 969434 - RNA, 19 nt, Homo sapiens
ggauuucugccuucucaag

SEQ ID NO: 969435 - RNA, 19 nt, Homo sapiens
caccagaggcugaugaaac

SEQ ID NO: 969436 - RNA, 19 nt, Homo sapiens
ucuugaccaugaacaguga

SEQ ID NO: 969437 - RNA, 19 nt, Homo sapiens
cucagguucuugaccauga

SEQ ID NO: 969438 - RNA, 19 nt, Homo sapiens
gaccaccagaggcugauga

SEQ ID NO: 969439 - RNA, 19 nt, Homo sapiens
ucagguucuugaccaugaa

SEQ ID NO: 969440 - RNA, 19 nt, Homo sapiens
ucaucaccaccauagguua

SEQ ID NO: 969441 - RNA, 19 nt, Homo sapiens
cuacuacuacugcuucauc

SEQ ID NO: 969442 - RNA, 19 nt, Homo sapiens
ggccuuuagcuuuauguau

SEQ ID NO: 969443 - RNA, 19 nt, Homo sapiens
gggaacuaacugcacauuc

SEQ ID NO: 969444 - RNA, 19 nt, Homo sapiens
gaccaugaacagugaggau

SEQ ID NO: 969445 - RNA, 19 nt, Homo sapiens
cugaagcgcauuaagaagu

SEQ ID NO: 969446 - RNA, 19 nt, Homo sapiens
acucaaagccgaggagauc

SEQ ID NO: 969447 - RNA, 19 nt, Homo sapiens
gaagaaaggcacauuguua

SEQ ID NO: 969448 - RNA, 19 nt, Homo sapiens
gcagcaagauuguguauuu

SEQ ID NO: 969449 - RNA, 19 nt, Homo sapiens
uaagauacguuccuugaaa

SEQ ID NO: 969450 - RNA, 19 nt, Homo sapiens
gauguucccucagcuauua

SEQ ID NO: 969451 - RNA, 19 nt, Homo sapiens
gaagaugaauuuggaagaa

SEQ ID NO: 969452 - RNA, 19 nt, Homo sapiens
gcaauucgcuggucacaca

SEQ ID NO: 969453 - RNA, 19 nt, Homo sapiens
gaagaaauuuggucugcaa

SEQ ID NO: 969454 - RNA, 19 nt, Homo sapiens
ucacacagcucccggauga

SEQ ID NO: 969455 - RNA, 19 nt, Homo sapiens
gaggguagcuggugcagaa

SEQ ID NO: 969456 - RNA, 19 nt, Homo sapiens
gcaacuguguucucuguuu

SEQ ID NO: 969457 - RNA, 19 nt, Homo sapiens
gagggaagaauauuuguua

SEQ ID NO: 969458 - RNA, 19 nt, Homo sapiens
gaagcaacccuugaacuua

SEQ ID NO: 969459 - RNA, 19 nt, Homo sapiens
gcaacaagcacccauauau

SEQ ID NO: 969460 - RNA, 19 nt, Homo sapiens
gauaauggcuggacuucug

SEQ ID NO: 969461 - RNA, 19 nt, Homo sapiens
ugaguuaggugauauguug

SEQ ID NO: 969462 - RNA, 19 nt, Homo sapiens
guaagcacaugaaguaguu

SEQ ID NO: 969463 - RNA, 19 nt, Homo sapiens
gaagauaacaguugguaga

SEQ ID NO: 969464 - RNA, 19 nt, Homo sapiens
gaagagccauuuccugcuu

SEQ ID NO: 969465 - RNA, 19 nt, Homo sapiens
cagaaaguauucauuguga

SEQ ID NO: 969466 - RNA, 19 nt, Homo sapiens
gaaauagugagcaggauaa

SEQ ID NO: 969467 - RNA, 19 nt, Homo sapiens
gagaagagguggauuuggu

SEQ ID NO: 969468 - RNA, 19 nt, Homo sapiens
caugaaagagcaagaaaua

SEQ ID NO: 969469 - RNA, 19 nt, Homo sapiens
gaaggaaugcccagaaaga

SEQ ID NO: 969470 - RNA, 19 nt, Homo sapiens
acgauuaacugcugaagua

SEQ ID NO: 969471 - RNA, 19 nt, Homo sapiens
gaucuccgauugucaaguu

SEQ ID NO: 969472 - RNA, 19 nt, Homo sapiens
auuaacagcugcuucaaua

SEQ ID NO: 969473 - RNA, 19 nt, Homo sapiens
acacagaacugaaucauac

SEQ ID NO: 969474 - RNA, 19 nt, Homo sapiens
ucucacagguaguauguua

SEQ ID NO: 969475 - RNA, 19 nt, Homo sapiens
gguacagucuucauuagaa

SEQ ID NO: 969476 - RNA, 19 nt, Homo sapiens
gauaaauugucacacuuga

SEQ ID NO: 969477 - RNA, 19 nt, Homo sapiens
cgacaacaacgcccucuua

SEQ ID NO: 969478 - RNA, 19 nt, Homo sapiens
gaagaaaauuggaggaaaa

SEQ ID NO: 969479 - RNA, 19 nt, Homo sapiens
gaaagaggaucguguucca

SEQ ID NO: 969480 - RNA, 19 nt, Homo sapiens
agaagaagaugguguuaau

SEQ ID NO: 969481 - RNA, 19 nt, Homo sapiens
caaagugugguguguaaua

SEQ ID NO: 969482 - RNA, 19 nt, Homo sapiens
ggaagaagaggaagaugaa

SEQ ID NO: 969483 - RNA, 19 nt, Homo sapiens
gggaggacauccagacauu

SEQ ID NO: 969484 - RNA, 19 nt, Homo sapiens
gaauucuucuguugccuuu

SEQ ID NO: 969485 - RNA, 19 nt, Homo sapiens
guacagucuucauuagaaa

SEQ ID NO: 969486 - RNA, 19 nt, Homo sapiens
cuaccagccucuacagaua

SEQ ID NO: 969487 - RNA, 19 nt, Homo sapiens
gaagagguggauuugguua

SEQ ID NO: 969488 - RNA, 19 nt, Homo sapiens
cacaugaaguaguuugaua

SEQ ID NO: 969489 - RNA, 19 nt, Homo sapiens
gcuaaucauuguuacagaa

SEQ ID NO: 969490 - RNA, 19 nt, Homo sapiens
gcaauggugugauuugucu

SEQ ID NO: 969491 - RNA, 19 nt, Homo sapiens
ggaauuugaagaagcauuu

SEQ ID NO: 969492 - RNA, 19 nt, Homo sapiens
gaaggccggugaccaagga

SEQ ID NO: 969493 - RNA, 19 nt, Homo sapiens
gcucuucucuagaccauga

SEQ ID NO: 969494 - RNA, 19 nt, Homo sapiens
gaucauccuuuaguucaaa

SEQ ID NO: 969495 - RNA, 19 nt, Homo sapiens
caguguacauuucagauaa

SEQ ID NO: 969496 - RNA, 19 nt, Homo sapiens
gaaaauagccaugucagua

SEQ ID NO: 969497 - RNA, 19 nt, Homo sapiens
gcaguagcugguagaauua

SEQ ID NO: 969498 - RNA, 19 nt, Homo sapiens
caacaacgcccucuuaagg

SEQ ID NO: 969499 - RNA, 19 nt, Homo sapiens
caacccaccuccagauaau

SEQ ID NO: 969500 - RNA, 19 nt, Homo sapiens
gacaagagcuagcaucacu

SEQ ID NO: 969501 - RNA, 19 nt, Homo sapiens
gaaaguauucauugugaug

SEQ ID NO: 969502 - RNA, 19 nt, Homo sapiens
gcagcuuucucaagauuau

SEQ ID NO: 969503 - RNA, 19 nt, Homo sapiens
gaacuuccugaaccuguua

SEQ ID NO: 969504 - RNA, 19 nt, Homo sapiens
gauguuacagccaaucaua

SEQ ID NO: 969505 - RNA, 19 nt, Homo sapiens
ccaugaagaugaagagaau

SEQ ID NO: 969506 - RNA, 19 nt, Homo sapiens
auucgaagaucauccuuua

SEQ ID NO: 969507 - RNA, 19 nt, Homo sapiens
guagcaagauaugugauuu

SEQ ID NO: 969508 - RNA, 19 nt, Homo sapiens
gaagaagaagaugguguua

SEQ ID NO: 969509 - RNA, 19 nt, Homo sapiens
ggaagaagaagaugguguu

SEQ ID NO: 969510 - RNA, 19 nt, Homo sapiens
ugaagagaaugaagaugaa

SEQ ID NO: 969511 - RNA, 19 nt, Homo sapiens
aaacugcggaagcaaauua

SEQ ID NO: 969512 - RNA, 19 nt, Homo sapiens
gcuggaacauauugaagaa

SEQ ID NO: 969513 - RNA, 19 nt, Homo sapiens
gcaguguacauuucagaua

SEQ ID NO: 969514 - RNA, 19 nt, Homo sapiens
cuuaucagcuggucaagaa

SEQ ID NO: 969515 - RNA, 19 nt, Homo sapiens
gaagaucauccuuuaguuc

SEQ ID NO: 969516 - RNA, 19 nt, Homo sapiens
gaaagagcaagaaauagug

SEQ ID NO: 969517 - RNA, 19 nt, Homo sapiens
aggcugaucuucugccaua

SEQ ID NO: 969518 - RNA, 19 nt, Homo sapiens
ugaccucgcuuaguauauu

SEQ ID NO: 969519 - RNA, 19 nt, Homo sapiens
caagggagcguaagugaug

SEQ ID NO: 969520 - RNA, 19 nt, Homo sapiens
guguuaaucuguccucuga

SEQ ID NO: 969521 - RNA, 19 nt, Homo sapiens
ggaagaaaggcacauuguu

SEQ ID NO: 969522 - RNA, 19 nt, Homo sapiens
cgaagaucauccuuuaguu

SEQ ID NO: 969523 - RNA, 19 nt, Homo sapiens
gucuguagguauauuguua

SEQ ID NO: 969524 - RNA, 19 nt, Homo sapiens
cagcuucuaugccugaauu

SEQ ID NO: 969525 - RNA, 19 nt, Homo sapiens
uaaagaagcaacccuugaa

SEQ ID NO: 969526 - RNA, 19 nt, Homo sapiens
gaaauagcaagcccuccua

SEQ ID NO: 969527 - RNA, 19 nt, Homo sapiens
gaagcagcgugugucagua

SEQ ID NO: 969528 - RNA, 19 nt, Homo sapiens
aaagugugguguguaauaa

SEQ ID NO: 969529 - RNA, 19 nt, Homo sapiens
ugaugcagcuuucucaaga

SEQ ID NO: 969530 - RNA, 19 nt, Homo sapiens
agcaguagcugguagaauu

SEQ ID NO: 969531 - RNA, 19 nt, Homo sapiens
gcacuuaugcucugugaca

SEQ ID NO: 969532 - RNA, 19 nt, Homo sapiens
aagcaacccuugaacuuau

SEQ ID NO: 969533 - RNA, 19 nt, Homo sapiens
ugccagaggugguacaauu

SEQ ID NO: 969534 - RNA, 19 nt, Homo sapiens
uuacugaacagguuaauga

SEQ ID NO: 969535 - RNA, 19 nt, Homo sapiens
guuacuguuuccugaguua

SEQ ID NO: 969536 - RNA, 19 nt, Homo sapiens
caauuaaggaugacugaaa

SEQ ID NO: 969537 - RNA, 19 nt, Homo sapiens
cuauuagccuucuuagauu

SEQ ID NO: 969538 - RNA, 19 nt, Homo sapiens
auauauauguccaccagua

SEQ ID NO: 969539 - RNA, 19 nt, Homo sapiens
auaguaagcacaugaagua

SEQ ID NO: 969540 - RNA, 19 nt, Homo sapiens
cguaagugauguuccauau

SEQ ID NO: 969541 - RNA, 19 nt, Homo sapiens
cauaaagucaguuguauuc

SEQ ID NO: 969542 - RNA, 19 nt, Homo sapiens
gagaggacagaacaccuua

SEQ ID NO: 969543 - RNA, 19 nt, Homo sapiens
aaacagccauaaaugacaa

SEQ ID NO: 969544 - RNA, 19 nt, Homo sapiens
agauugauauugcugauga

SEQ ID NO: 969545 - RNA, 19 nt, Homo sapiens
gcagaaaguauucauugug

SEQ ID NO: 969546 - RNA, 19 nt, Homo sapiens
gaauuuggaagaaaguuga

SEQ ID NO: 969547 - RNA, 19 nt, Homo sapiens
gggagaaggucuacaguua

SEQ ID NO: 969548 - RNA, 19 nt, Homo sapiens
gggaagacauccaucauuu

SEQ ID NO: 969549 - RNA, 19 nt, Homo sapiens
gcacuugugucuuagaauu

SEQ ID NO: 969550 - RNA, 19 nt, Homo sapiens
aaagggcacuugugucuua

SEQ ID NO: 969551 - RNA, 19 nt, Homo sapiens
gaccuggacuugaauuuga

SEQ ID NO: 969552 - RNA, 19 nt, Homo sapiens
gcccuaagcugaagaagug

SEQ ID NO: 969553 - RNA, 19 nt, Homo sapiens
ggacccaguuccucaugua

SEQ ID NO: 969554 - RNA, 19 nt, Homo sapiens
gagaagcaguugggaguuu

SEQ ID NO: 969555 - RNA, 19 nt, Homo sapiens
caagugaggucuggaagaa

SEQ ID NO: 969556 - RNA, 19 nt, Homo sapiens
caaagucccugugcuaaug

SEQ ID NO: 969557 - RNA, 19 nt, Homo sapiens
gaaccaggcuuguaaucca

SEQ ID NO: 969558 - RNA, 19 nt, Homo sapiens
gggauuggcugaggaugua

SEQ ID NO: 969559 - RNA, 19 nt, Homo sapiens
gagaaggucuacaguuauc

SEQ ID NO: 969560 - RNA, 19 nt, Homo sapiens
ggaaaccaauucuuacaag

SEQ ID NO: 969561 - RNA, 19 nt, Homo sapiens
agucagaacugucaucuug

SEQ ID NO: 969562 - RNA, 19 nt, Homo sapiens
ggucuacaguuaucauuau

SEQ ID NO: 969563 - RNA, 19 nt, Homo sapiens
gccaggaaguguuuauuug

SEQ ID NO: 969564 - RNA, 19 nt, Homo sapiens
gaaggugacugcaggaaac

SEQ ID NO: 969565 - RNA, 19 nt, Homo sapiens
gagcagacccuuccuaugg

SEQ ID NO: 969566 - RNA, 19 nt, Homo sapiens
cuacagcccuccuuucuuc

SEQ ID NO: 969567 - RNA, 19 nt, Homo sapiens
gagaggagguggcuauguc

SEQ ID NO: 969568 - RNA, 19 nt, Homo sapiens
caaccucccuccacuuuag

SEQ ID NO: 969569 - RNA, 19 nt, Homo sapiens
caacagaaguggcauucag

SEQ ID NO: 969570 - RNA, 19 nt, Homo sapiens
ggaauugaaccugacauuu

SEQ ID NO: 969571 - RNA, 19 nt, Homo sapiens
gaagggguguuuagcauuu

SEQ ID NO: 969572 - RNA, 19 nt, Homo sapiens
cuaaauagcucuggaacca

SEQ ID NO: 969573 - RNA, 19 nt, Homo sapiens
gaccugcccuuguuuaugg

SEQ ID NO: 969574 - RNA, 19 nt, Homo sapiens
gaauugaaccugacauuuu

SEQ ID NO: 969575 - RNA, 19 nt, Homo sapiens
gacccugcaugaccaaauu

SEQ ID NO: 969576 - RNA, 19 nt, Homo sapiens
ggaaacacauacugaagcu

SEQ ID NO: 969577 - RNA, 19 nt, Homo sapiens
gaacaacagggaagacauc

SEQ ID NO: 969578 - RNA, 19 nt, Homo sapiens
ggacugcugaccauuuaaa

SEQ ID NO: 969579 - RNA, 19 nt, Homo sapiens
ggaguguacuuguggaaag

SEQ ID NO: 969580 - RNA, 19 nt, Homo sapiens
ucacugagcagcuacagaa

SEQ ID NO: 969581 - RNA, 19 nt, Homo sapiens
ggaagacauccaucauuug

SEQ ID NO: 969582 - RNA, 19 nt, Homo sapiens
ggagaaggucuacaguuau

SEQ ID NO: 969583 - RNA, 19 nt, Homo sapiens
ccuaucuccuggcuaguua

SEQ ID NO: 969584 - RNA, 19 nt, Homo sapiens
uaacagcagaguaucauga

SEQ ID NO: 969585 - RNA, 19 nt, Homo sapiens
ggaguuugguugucauugg

SEQ ID NO: 969586 - RNA, 19 nt, Homo sapiens
gcuguggacucccauaaag

SEQ ID NO: 969587 - RNA, 19 nt, Homo sapiens
gaacacuuuucaagaauug

SEQ ID NO: 969588 - RNA, 19 nt, Homo sapiens
gaagugaggcagugauucu

SEQ ID NO: 969589 - RNA, 19 nt, Homo sapiens
gcucgaccaugccaagaga

SEQ ID NO: 969590 - RNA, 19 nt, Homo sapiens
gaggauguauaaagcaaag

SEQ ID NO: 969591 - RNA, 19 nt, Homo sapiens
ggaaggugacugcaggaaa

SEQ ID NO: 969592 - RNA, 19 nt, Homo sapiens
gaagacauccaucauuugc

SEQ ID NO: 969593 - RNA, 19 nt, Homo sapiens
cagggcagcuggaaaucuu

SEQ ID NO: 969594 - RNA, 19 nt, Homo sapiens
ggccuucguuggacuuuga

SEQ ID NO: 969595 - RNA, 19 nt, Homo sapiens
gggcacuugugucuuagaa

SEQ ID NO: 969596 - RNA, 19 nt, Homo sapiens
ggacuugaauuugauugag

SEQ ID NO: 969597 - RNA, 19 nt, Homo sapiens
gcaaccucccuccacuuua

SEQ ID NO: 969598 - RNA, 19 nt, Homo sapiens
ccucugcccuucuaaguca

SEQ ID NO: 969599 - RNA, 19 nt, Homo sapiens
caucugugcugugugugua

SEQ ID NO: 969600 - RNA, 19 nt, Homo sapiens
uuggacugcugaccauuua

SEQ ID NO: 969601 - RNA, 19 nt, Homo sapiens
gagcaucagugaggcuuca

SEQ ID NO: 969602 - RNA, 19 nt, Homo sapiens
gaagcugccaccacaauag

SEQ ID NO: 969603 - RNA, 19 nt, Homo sapiens
gcaaugggcagggaaggaa

SEQ ID NO: 969604 - RNA, 19 nt, Homo sapiens
guagugugguuggccagua

SEQ ID NO: 969605 - RNA, 19 nt, Homo sapiens
caucuugcuucccaaucua

SEQ ID NO: 969606 - RNA, 19 nt, Homo sapiens
uaauuucccuggugccaau

SEQ ID NO: 969607 - RNA, 19 nt, Homo sapiens
gcaugggaguguacuugug

SEQ ID NO: 969608 - RNA, 19 nt, Homo sapiens
ggaccuggacuugaauuug

SEQ ID NO: 969609 - RNA, 19 nt, Homo sapiens
ugcaggaaaccaauucuua

SEQ ID NO: 969610 - RNA, 19 nt, Homo sapiens
ggcaauugcuccuuaacag

SEQ ID NO: 969611 - RNA, 19 nt, Homo sapiens
gaauuucacuagccccuuu

SEQ ID NO: 969612 - RNA, 19 nt, Homo sapiens
ucucauggcuacuaacaag

SEQ ID NO: 969613 - RNA, 19 nt, Homo sapiens
gcugaguccuugucaccuu

SEQ ID NO: 969614 - RNA, 19 nt, Homo sapiens
gcacugccgcucacucuca

SEQ ID NO: 969615 - RNA, 19 nt, Homo sapiens
gcaccaguggaaacacaua

SEQ ID NO: 969616 - RNA, 19 nt, Homo sapiens
acagugauggguuuaagua

SEQ ID NO: 969617 - RNA, 19 nt, Homo sapiens
ccaaguggccacagugaug

SEQ ID NO: 969618 - RNA, 19 nt, Homo sapiens
gcaggaaaccaauucuuac

SEQ ID NO: 969619 - RNA, 19 nt, Homo sapiens
gcacugcuguugggaaggu

SEQ ID NO: 969620 - RNA, 19 nt, Homo sapiens
gacuucagcuaaugaucuu

SEQ ID NO: 969621 - RNA, 19 nt, Homo sapiens
ucagagaaacugcgugaga

SEQ ID NO: 969622 - RNA, 19 nt, Homo sapiens
caagaugaaucagaaacca

SEQ ID NO: 969623 - RNA, 19 nt, Homo sapiens
gaguuugguugucauugga

SEQ ID NO: 969624 - RNA, 19 nt, Homo sapiens
ggaagaacaacagggaaga

SEQ ID NO: 969625 - RNA, 19 nt, Homo sapiens
ccauaagucuguguguguu

SEQ ID NO: 969626 - RNA, 19 nt, Homo sapiens
gcagaagacggcucacaag

SEQ ID NO: 969627 - RNA, 19 nt, Homo sapiens
gagaauccagggaaacugu

SEQ ID NO: 969628 - RNA, 19 nt, Homo sapiens
gucauuggauugaauuuac

SEQ ID NO: 969629 - RNA, 19 nt, Homo sapiens
gagucagccuccucagaga

SEQ ID NO: 969630 - RNA, 19 nt, Homo sapiens
ccacacagacugacucucu

SEQ ID NO: 969631 - RNA, 19 nt, Homo sapiens
uugacaagaugaaucagaa

SEQ ID NO: 969632 - RNA, 19 nt, Homo sapiens
gcucucugcuguagauugg

SEQ ID NO: 969633 - RNA, 19 nt, Homo sapiens
ccagagaggagguggcuau

SEQ ID NO: 969634 - RNA, 19 nt, Homo sapiens
aauuugaccugcccuuguu

SEQ ID NO: 969635 - RNA, 19 nt, Homo sapiens
gauguuggguuugcucaag

SEQ ID NO: 969636 - RNA, 19 nt, Homo sapiens
agaugaaucagaaaccaua

SEQ ID NO: 969637 - RNA, 19 nt, Homo sapiens
ggaacacuuuucaagaauu

SEQ ID NO: 969638 - RNA, 19 nt, Homo sapiens
ggagguggcuaugucuucu

SEQ ID NO: 969639 - RNA, 19 nt, Homo sapiens
cagcaucagucugccuuug

SEQ ID NO: 969640 - RNA, 19 nt, Homo sapiens
ucaaagggcacuugugucu

SEQ ID NO: 969641 - RNA, 19 nt, Homo sapiens
cauaagucuguguguguua

SEQ ID NO: 969642 - RNA, 19 nt, Homo sapiens
caacagggaagacauccau

SEQ ID NO: 969643 - RNA, 19 nt, Homo sapiens
ccacagugauggguuuaag

SEQ ID NO: 969644 - RNA, 19 nt, Homo sapiens
ccugaucacugagcagcua

SEQ ID NO: 969645 - RNA, 19 nt, Homo sapiens
ccucccaggugcugaguga

SEQ ID NO: 969646 - RNA, 19 nt, Homo sapiens
caggacagccucaacuuca

SEQ ID NO: 969647 - RNA, 19 nt, Homo sapiens
gcacaaacccggcagauuc

SEQ ID NO: 969648 - RNA, 19 nt, Homo sapiens
agaaggagaucgacgagua

SEQ ID NO: 969649 - RNA, 19 nt, Homo sapiens
gaaggaauaugugaaaugg

SEQ ID NO: 969650 - RNA, 19 nt, Homo sapiens
ugaaauggaugauguacug

SEQ ID NO: 969651 - RNA, 19 nt, Homo sapiens
ggacugagccacccaagga

SEQ ID NO: 969652 - RNA, 19 nt, Homo sapiens
ggaagagggugcccauugg

SEQ ID NO: 969653 - RNA, 19 nt, Homo sapiens
ccgagacgcucacggauau

SEQ ID NO: 969654 - RNA, 19 nt, Homo sapiens
ggacccagcccaugagaga

SEQ ID NO: 969655 - RNA, 19 nt, Homo sapiens
gaucgucuuugccuucuuc

SEQ ID NO: 969656 - RNA, 19 nt, Homo sapiens
gggaagagggugcccauug

SEQ ID NO: 969657 - RNA, 19 nt, Homo sapiens
ggaaggggcuuggaaaaga

SEQ ID NO: 969658 - RNA, 19 nt, Homo sapiens
acaaggccgugaagacaaa

SEQ ID NO: 969659 - RNA, 19 nt, Homo sapiens
ggacaccaucgaggacuua

SEQ ID NO: 969660 - RNA, 19 nt, Homo sapiens
gaauaugugaaauggauga

SEQ ID NO: 969661 - RNA, 19 nt, Homo sapiens
uaugugaaauggaugaugu

SEQ ID NO: 969662 - RNA, 19 nt, Homo sapiens
gcacuggaugagccaauaa

SEQ ID NO: 969663 - RNA, 19 nt, Homo sapiens
caagcagacugggcccuaa

SEQ ID NO: 969664 - RNA, 19 nt, Homo sapiens
ggcacuggaugagccaaua

SEQ ID NO: 969665 - RNA, 19 nt, Homo sapiens
ugaaggagaaagagaaaug

SEQ ID NO: 969666 - RNA, 19 nt, Homo sapiens
aggaauaugugaaauggau

SEQ ID NO: 969667 - RNA, 19 nt, Homo sapiens
ccacugcucgccuugguuu

SEQ ID NO: 969668 - RNA, 19 nt, Homo sapiens
gacccugcccugagucuaa

SEQ ID NO: 969669 - RNA, 19 nt, Homo sapiens
gaugagccaauaaaccaaa

SEQ ID NO: 969670 - RNA, 19 nt, Homo sapiens
gaagagggugcccauugga

SEQ ID NO: 969671 - RNA, 19 nt, Homo sapiens
gggauuggccugugcuuca

SEQ ID NO: 969672 - RNA, 19 nt, Homo sapiens
acccaacgcuguccaacaa

SEQ ID NO: 969673 - RNA, 19 nt, Homo sapiens
agucuaagguccagcacaa

SEQ ID NO: 969674 - RNA, 19 nt, Homo sapiens
cagaggacccagcccauga

SEQ ID NO: 969675 - RNA, 19 nt, Homo sapiens
ggagaucgacgaguacauc

SEQ ID NO: 969676 - RNA, 19 nt, Homo sapiens
ugaaggaauaugugaaaug

SEQ ID NO: 969677 - RNA, 19 nt, Homo sapiens
ccucucaccugcuccuaug

SEQ ID NO: 969678 - RNA, 19 nt, Homo sapiens
acagucaucuggcccuuuc

SEQ ID NO: 969679 - RNA, 19 nt, Homo sapiens
gcuaugagaccaugaugag

SEQ ID NO: 969680 - RNA, 19 nt, Homo sapiens
gccgagacgcucacggaua

SEQ ID NO: 969681 - RNA, 19 nt, Homo sapiens
caaacucuggcaccucaaa

SEQ ID NO: 969682 - RNA, 19 nt, Homo sapiens
aggaacacgugaaggagaa

SEQ ID NO: 969683 - RNA, 19 nt, Homo sapiens
gggaaguccuagcccagau

SEQ ID NO: 969684 - RNA, 19 nt, Homo sapiens
auauagugcucuccugguu

SEQ ID NO: 969685 - RNA, 19 nt, Homo sapiens
cgugaaggaauaugugaaa

SEQ ID NO: 969686 - RNA, 19 nt, Homo sapiens
gauguacuggaucgucuuu

SEQ ID NO: 969687 - RNA, 19 nt, Homo sapiens
gugaaggaauaugugaaau

SEQ ID NO: 969688 - RNA, 19 nt, Homo sapiens
cgccaaugcugcagucaca

SEQ ID NO: 969689 - RNA, 19 nt, Homo sapiens
gaaggagaucgacgaguac

SEQ ID NO: 969690 - RNA, 19 nt, Homo sapiens
cuacaaggccgugaagaca

SEQ ID NO: 969691 - RNA, 19 nt, Homo sapiens
gggcugagugccacauguu

SEQ ID NO: 969692 - RNA, 19 nt, Homo sapiens
gagacaaagcucccaagag

SEQ ID NO: 969693 - RNA, 19 nt, Homo sapiens
cgagacaagagcuaugaga

SEQ ID NO: 969694 - RNA, 19 nt, Homo sapiens
gcugugugagugugucuuu

SEQ ID NO: 969695 - RNA, 19 nt, Homo sapiens
ggaaguccuagcccagaug

SEQ ID NO: 969696 - RNA, 19 nt, Homo sapiens
ccaacaaggagaaggagau

SEQ ID NO: 969697 - RNA, 19 nt, Homo sapiens
caucgaggacuuaggagau

SEQ ID NO: 969698 - RNA, 19 nt, Homo sapiens
gaaccuugccgccaaugcu

SEQ ID NO: 969699 - RNA, 19 nt, Homo sapiens
aagaucgccuucgugauau

SEQ ID NO: 969700 - RNA, 19 nt, Homo sapiens
cuaugaccuugcucccuuu

SEQ ID NO: 969701 - RNA, 19 nt, Homo sapiens
ggauggaagacagggauug

SEQ ID NO: 969702 - RNA, 19 nt, Homo sapiens
gcugaagcccauagcaauc

SEQ ID NO: 969703 - RNA, 19 nt, Homo sapiens
gaccuuuggcacuggauga

SEQ ID NO: 969704 - RNA, 19 nt, Homo sapiens
ggaugacaugggagacaaa

SEQ ID NO: 969705 - RNA, 19 nt, Homo sapiens
caccaucgaggacuuagga

SEQ ID NO: 969706 - RNA, 19 nt, Homo sapiens
gagaucgacgaguacauca

SEQ ID NO: 969707 - RNA, 19 nt, Homo sapiens
ggaugagccaauaaaccaa

SEQ ID NO: 969708 - RNA, 19 nt, Homo sapiens
aaacgugaaggaauaugug

SEQ ID NO: 969709 - RNA, 19 nt, Homo sapiens
accagaggcugaggacuga

SEQ ID NO: 969710 - RNA, 19 nt, Homo sapiens
caacaaggagaaggagauc

SEQ ID NO: 969711 - RNA, 19 nt, Homo sapiens
gaaggagaaagagaaaugc

SEQ ID NO: 969712 - RNA, 19 nt, Homo sapiens
gccaguagccuaggugucu

SEQ ID NO: 969713 - RNA, 19 nt, Homo sapiens
cagccuauucuuccuacaa

SEQ ID NO: 969714 - RNA, 19 nt, Homo sapiens
gagcuaugagaccaugaug

SEQ ID NO: 969715 - RNA, 19 nt, Homo sapiens
acaaggagaaggagaucga

SEQ ID NO: 969716 - RNA, 19 nt, Homo sapiens
caacgcuguccaacaagga

SEQ ID NO: 969717 - RNA, 19 nt, Homo sapiens
uggaugagccaauaaacca

SEQ ID NO: 969718 - RNA, 19 nt, Homo sapiens
cgugaaggagaaagagaaa

SEQ ID NO: 969719 - RNA, 19 nt, Homo sapiens
ggauuggccugugcuucag

SEQ ID NO: 969720 - RNA, 19 nt, Homo sapiens
gaccaaggacgggccugaa

SEQ ID NO: 969721 - RNA, 19 nt, Homo sapiens
uagcaauccgcuucucaga

SEQ ID NO: 969722 - RNA, 19 nt, Homo sapiens
gagacgcucacggauauag

SEQ ID NO: 969723 - RNA, 19 nt, Homo sapiens
agaugacccugcccugagu

SEQ ID NO: 969724 - RNA, 19 nt, Homo sapiens
caagagagcuggucaguug

SEQ ID NO: 969725 - RNA, 19 nt, Homo sapiens
ggaaaucacuucaccaaga

SEQ ID NO: 969726 - RNA, 19 nt, Homo sapiens
gaauugauuucccucuuua

SEQ ID NO: 969727 - RNA, 19 nt, Homo sapiens
gcagauggcugggcuaaga

SEQ ID NO: 969728 - RNA, 19 nt, Homo sapiens
ggaaaggcccgaaguaaga

SEQ ID NO: 969729 - RNA, 19 nt, Homo sapiens
gguacgaugugauuuguaa

SEQ ID NO: 969730 - RNA, 19 nt, Homo sapiens
cuuaauaacuugaguguga

SEQ ID NO: 969731 - RNA, 19 nt, Homo sapiens
uaaaguaccaucagaauug

SEQ ID NO: 969732 - RNA, 19 nt, Homo sapiens
gaaaucacuucaccaagau

SEQ ID NO: 969733 - RNA, 19 nt, Homo sapiens
ggaauagucugccuggaau

SEQ ID NO: 969734 - RNA, 19 nt, Homo sapiens
ggacucagcugugcagaug

SEQ ID NO: 969735 - RNA, 19 nt, Homo sapiens
ucaaagcacuagcaaauca

SEQ ID NO: 969736 - RNA, 19 nt, Homo sapiens
guacaucagucaagugugu

SEQ ID NO: 969737 - RNA, 19 nt, Homo sapiens
guaggacgcugugccauuu

SEQ ID NO: 969738 - RNA, 19 nt, Homo sapiens
gauagagagauucuucuua

SEQ ID NO: 969739 - RNA, 19 nt, Homo sapiens
ugacugauguugguuguaa

SEQ ID NO: 969740 - RNA, 19 nt, Homo sapiens
gcuggucaguuguaaagua

SEQ ID NO: 969741 - RNA, 19 nt, Homo sapiens
caacaugacugugacuaau

SEQ ID NO: 969742 - RNA, 19 nt, Homo sapiens
acaaugcccuuaauaacuu

SEQ ID NO: 969743 - RNA, 19 nt, Homo sapiens
gaagagacgagaacgagaa

SEQ ID NO: 969744 - RNA, 19 nt, Homo sapiens
acaaugaucugguggugaa

SEQ ID NO: 969745 - RNA, 19 nt, Homo sapiens
uaccuaaacugacaaugaa

SEQ ID NO: 969746 - RNA, 19 nt, Homo sapiens
gauguugguuguaaugguu

SEQ ID NO: 969747 - RNA, 19 nt, Homo sapiens
ggaaagaauucagcagaag

SEQ ID NO: 969748 - RNA, 19 nt, Homo sapiens
ucaccaagauacagauuau

SEQ ID NO: 969749 - RNA, 19 nt, Homo sapiens
ggaagaaacgcaaaguugu

SEQ ID NO: 969750 - RNA, 19 nt, Homo sapiens
agaauugauuucccucuuu

SEQ ID NO: 969751 - RNA, 19 nt, Homo sapiens
gcaaaguugucaagaacca

SEQ ID NO: 969752 - RNA, 19 nt, Homo sapiens
agaaugggauagagagauu

SEQ ID NO: 969753 - RNA, 19 nt, Homo sapiens
guaaaguaccaucagaauu

SEQ ID NO: 969754 - RNA, 19 nt, Homo sapiens
cccaaacaauauugagaua

SEQ ID NO: 969755 - RNA, 19 nt, Homo sapiens
acaaaagaccccauaauua

SEQ ID NO: 969756 - RNA, 19 nt, Homo sapiens
gaucugguggugaaaguaa

SEQ ID NO: 969757 - RNA, 19 nt, Homo sapiens
ucaacacgcugaaggaaca

SEQ ID NO: 969758 - RNA, 19 nt, Homo sapiens
gaaaggagcuaaaacuaac

SEQ ID NO: 969759 - RNA, 19 nt, Homo sapiens
caacauuugcuuuccuauu

SEQ ID NO: 969760 - RNA, 19 nt, Homo sapiens
gugcagacguccuucuaau

SEQ ID NO: 969761 - RNA, 19 nt, Homo sapiens
gaagaaacgcaaaguuguc

SEQ ID NO: 969762 - RNA, 19 nt, Homo sapiens
agacuuguguuucaucaau

SEQ ID NO: 969763 - RNA, 19 nt, Homo sapiens
cuuauuaccuagauugaga

SEQ ID NO: 969764 - RNA, 19 nt, Homo sapiens
aaucaaagcacuagcaaau

SEQ ID NO: 969765 - RNA, 19 nt, Homo sapiens
gagagcuggucaguuguaa

SEQ ID NO: 969766 - RNA, 19 nt, Homo sapiens
ggccagagcgagccuguuu

SEQ ID NO: 969767 - RNA, 19 nt, Homo sapiens
gacuuguguuucaucaaua

SEQ ID NO: 969768 - RNA, 19 nt, Homo sapiens
gaaaguaaaaguccugaaa

SEQ ID NO: 969769 - RNA, 19 nt, Homo sapiens
gaaagaauucagcagaagu

SEQ ID NO: 969770 - RNA, 19 nt, Homo sapiens
gugcucggguuaagagauu

SEQ ID NO: 969771 - RNA, 19 nt, Homo sapiens
cuaccuaaacugacaauga

SEQ ID NO: 969772 - RNA, 19 nt, Homo sapiens
aacauuugcuuuccuauuc

SEQ ID NO: 969773 - RNA, 19 nt, Homo sapiens
caaaagaccccauaauuag

SEQ ID NO: 969774 - RNA, 19 nt, Homo sapiens
uuaaggaugccaaaugaaa

SEQ ID NO: 969775 - RNA, 19 nt, Homo sapiens
gugcguauaugguaaagag

SEQ ID NO: 969776 - RNA, 19 nt, Homo sapiens
gagucugucccaaacaaua

SEQ ID NO: 969777 - RNA, 19 nt, Homo sapiens
aaaguaccaucagaauuga

SEQ ID NO: 969778 - RNA, 19 nt, Homo sapiens
uaagacuuguguuucauca

SEQ ID NO: 969779 - RNA, 19 nt, Homo sapiens
ugcauaagcuacacuuuua

SEQ ID NO: 969780 - RNA, 19 nt, Homo sapiens
cuuaauauccuuacccuau

SEQ ID NO: 969781 - RNA, 19 nt, Homo sapiens
cagaauugauuucccucuu

SEQ ID NO: 969782 - RNA, 19 nt, Homo sapiens
gcgaacaaaugauccuuuu

SEQ ID NO: 969783 - RNA, 19 nt, Homo sapiens
gagauuugucccagcuaua

SEQ ID NO: 969784 - RNA, 19 nt, Homo sapiens
guaaaaguccugaaaguau

SEQ ID NO: 969785 - RNA, 19 nt, Homo sapiens
gagucuggaguuuguguua

SEQ ID NO: 969786 - RNA, 19 nt, Homo sapiens
uggaaucccugcagaucuu

SEQ ID NO: 969787 - RNA, 19 nt, Homo sapiens
ggucaagccugaggugagu

SEQ ID NO: 969788 - RNA, 19 nt, Homo sapiens
aaucuuuccucuaccuaaa

SEQ ID NO: 969789 - RNA, 19 nt, Homo sapiens
ggauagagagauucuucuu

SEQ ID NO: 969790 - RNA, 19 nt, Homo sapiens
cgguugcacucuuccuaua

SEQ ID NO: 969791 - RNA, 19 nt, Homo sapiens
agacguccuucuaauccua

SEQ ID NO: 969792 - RNA, 19 nt, Homo sapiens
guuguaaaguaccaucaga

SEQ ID NO: 969793 - RNA, 19 nt, Homo sapiens
ccaacaugacugugacuaa

SEQ ID NO: 969794 - RNA, 19 nt, Homo sapiens
ggcuaagacuguuaaccaa

SEQ ID NO: 969795 - RNA, 19 nt, Homo sapiens
aggaaagaauucagcagaa

SEQ ID NO: 969796 - RNA, 19 nt, Homo sapiens
gagcuggucaguuguaaag

SEQ ID NO: 969797 - RNA, 19 nt, Homo sapiens
agggcaagauuaagacgua

SEQ ID NO: 969798 - RNA, 19 nt, Homo sapiens
caccagggcuccagcuaca

SEQ ID NO: 969799 - RNA, 19 nt, Homo sapiens
ugagauauuugcaguuggu

SEQ ID NO: 969800 - RNA, 19 nt, Homo sapiens
caucauccaggaaagaauu

SEQ ID NO: 969801 - RNA, 19 nt, Homo sapiens
gggaaaggcccgaaguaag

SEQ ID NO: 969802 - RNA, 19 nt, Homo sapiens
guuugggacucgaggauug

SEQ ID NO: 969803 - RNA, 19 nt, Homo sapiens
aaggaugccaaaugaaaua

SEQ ID NO: 969804 - RNA, 19 nt, Homo sapiens
gggcuaagacuguuaacca

SEQ ID NO: 969805 - RNA, 19 nt, Homo sapiens
ucagucaagugugugauga

SEQ ID NO: 969806 - RNA, 19 nt, Homo sapiens
agacuuacaaugcccuuaa

SEQ ID NO: 969807 - RNA, 19 nt, Homo sapiens
gagaaggcccauucaggau

SEQ ID NO: 969808 - RNA, 19 nt, Homo sapiens
ggaaggaggacgagguucu

SEQ ID NO: 969809 - RNA, 19 nt, Homo sapiens
gaaaguauuaaccaaacuc

SEQ ID NO: 969810 - RNA, 19 nt, Homo sapiens
aaagaauucagcagaaguu

SEQ ID NO: 969811 - RNA, 19 nt, Homo sapiens
cuuacaaugcccuuaauaa

SEQ ID NO: 969812 - RNA, 19 nt, Homo sapiens
gcacuagcaaaucacaaug

SEQ ID NO: 969813 - RNA, 19 nt, Homo sapiens
ccaagauacagauuaugaa

SEQ ID NO: 969814 - RNA, 19 nt, Homo sapiens
acaugacugugacuaauca

SEQ ID NO: 969815 - RNA, 19 nt, Homo sapiens
cagaaugccauacgugaau

SEQ ID NO: 969816 - RNA, 19 nt, Homo sapiens
uggaguuuguguuaagaaa

SEQ ID NO: 969817 - RNA, 19 nt, Homo sapiens
aggaagaaacgcaaaguug

SEQ ID NO: 969818 - RNA, 19 nt, Homo sapiens
gcucgcaucauccaggaaa

SEQ ID NO: 969819 - RNA, 19 nt, Homo sapiens
gaaacgcaaaguugucaag

SEQ ID NO: 969820 - RNA, 19 nt, Homo sapiens
gacuuacaaugcccuuaau

SEQ ID NO: 969821 - RNA, 19 nt, Homo sapiens
gaauugguuauacaucaug

SEQ ID NO: 969822 - RNA, 19 nt, Homo sapiens
ccuaaacugacaaugaauu

SEQ ID NO: 969823 - RNA, 19 nt, Homo sapiens
uaaggaugccaaaugaaau

SEQ ID NO: 969824 - RNA, 19 nt, Homo sapiens
ggaauaaacgagcauauca

SEQ ID NO: 969825 - RNA, 19 nt, Homo sapiens
gcaagaagaucgggaagac

SEQ ID NO: 969826 - RNA, 19 nt, Homo sapiens
acagaaagguggcaagaag

SEQ ID NO: 969827 - RNA, 19 nt, Homo sapiens
gcacgguggcugauaguga

SEQ ID NO: 969828 - RNA, 19 nt, Homo sapiens
acccagaccucauuauuuc

SEQ ID NO: 969829 - RNA, 19 nt, Homo sapiens
gcucuaucauucuguuuca

SEQ ID NO: 969830 - RNA, 19 nt, Homo sapiens
gccuggcccuugucucuaa

SEQ ID NO: 969831 - RNA, 19 nt, Homo sapiens
gaauaaacgagcauaucau

SEQ ID NO: 969832 - RNA, 19 nt, Homo sapiens
ccacccagaccucauuauu

SEQ ID NO: 969833 - RNA, 19 nt, Homo sapiens
gggcuucaccaacuucauu

SEQ ID NO: 969834 - RNA, 19 nt, Homo sapiens
uugcuucccuccucaacua

SEQ ID NO: 969835 - RNA, 19 nt, Homo sapiens
cacccagaccucauuauuu

SEQ ID NO: 969836 - RNA, 19 nt, Homo sapiens
cacgguggcugauagugaa

SEQ ID NO: 969837 - RNA, 19 nt, Homo sapiens
cgucauggcccuccgauuc

SEQ ID NO: 969838 - RNA, 19 nt, Homo sapiens
gcccuccucugcauucuca

SEQ ID NO: 969839 - RNA, 19 nt, Homo sapiens
caacauccuccucuuccuu

SEQ ID NO: 969840 - RNA, 19 nt, Homo sapiens
gaggcuggcccacacagaa

SEQ ID NO: 969841 - RNA, 19 nt, Homo sapiens
uggcuggccugguuuguuc

SEQ ID NO: 969842 - RNA, 19 nt, Homo sapiens
aggcugccaucaccacuuu

SEQ ID NO: 969843 - RNA, 19 nt, Homo sapiens
gauccuggcugagcgaaac

SEQ ID NO: 969844 - RNA, 19 nt, Homo sapiens
uaaacgagcauaucauagc

SEQ ID NO: 969845 - RNA, 19 nt, Homo sapiens
uagugaagcggcagauuga

SEQ ID NO: 969846 - RNA, 19 nt, Homo sapiens
cauuauuucuugcucuauc

SEQ ID NO: 969847 - RNA, 19 nt, Homo sapiens
ccuccucccugcugcuuug

SEQ ID NO: 969848 - RNA, 19 nt, Homo sapiens
ccucugcauucucagcauu

SEQ ID NO: 969849 - RNA, 19 nt, Homo sapiens
cagaaagguggcaagaaga

SEQ ID NO: 969850 - RNA, 19 nt, Homo sapiens
cagaccucauuauuucuug

SEQ ID NO: 969851 - RNA, 19 nt, Homo sapiens
ccagaccucauuauuucuu

SEQ ID NO: 969852 - RNA, 19 nt, Homo sapiens
ucacuuccuuggccagagu

SEQ ID NO: 969853 - RNA, 19 nt, Homo sapiens
gaaagguggcaagaagauc

SEQ ID NO: 969854 - RNA, 19 nt, Homo sapiens
ucugagcggccucugagua

SEQ ID NO: 969855 - RNA, 19 nt, Homo sapiens
gauagugaagcggcagauu

SEQ ID NO: 969856 - RNA, 19 nt, Homo sapiens
gggagggcacuuccuguuc

SEQ ID NO: 969857 - RNA, 19 nt, Homo sapiens
guguugaccugggugucua

SEQ ID NO: 969858 - RNA, 19 nt, Homo sapiens
cucauuauuucuugcucua

SEQ ID NO: 969859 - RNA, 19 nt, Homo sapiens
cuucauugcccaugccauu

SEQ ID NO: 969860 - RNA, 19 nt, Homo sapiens
gcaacauccuccucuuccu

SEQ ID NO: 969861 - RNA, 19 nt, Homo sapiens
gagggagcuccacacugua

SEQ ID NO: 969862 - RNA, 19 nt, Homo sapiens
agaaagguggcaagaagau

SEQ ID NO: 969863 - RNA, 19 nt, Homo sapiens
cauccacccagaccucauu

SEQ ID NO: 969864 - RNA, 19 nt, Homo sapiens
gcuuugcauucacuuccuu

SEQ ID NO: 969865 - RNA, 19 nt, Homo sapiens
ccugugggauuaucugaac

SEQ ID NO: 969866 - RNA, 19 nt, Homo sapiens
auagugaagcggcagauug

SEQ ID NO: 969867 - RNA, 19 nt, Homo sapiens
acacagaaagguggcaaga

SEQ ID NO: 969868 - RNA, 19 nt, Homo sapiens
gcuccauccugcgcccaaa

SEQ ID NO: 969869 - RNA, 19 nt, Homo sapiens
cugcauccucuuccuguuu

SEQ ID NO: 969870 - RNA, 19 nt, Homo sapiens
gcucuucuccucccaagcu

SEQ ID NO: 969871 - RNA, 19 nt, Homo sapiens
gcaagaagaucgggaagac

SEQ ID NO: 969872 - RNA, 19 nt, Homo sapiens
acagaaagguggcaagaag

SEQ ID NO: 969873 - RNA, 19 nt, Homo sapiens
gcacgguggcugauaguga

SEQ ID NO: 969874 - RNA, 19 nt, Homo sapiens
ggauugugcugcugaccuu

SEQ ID NO: 969875 - RNA, 19 nt, Homo sapiens
ucaaggauugggacuauaa

SEQ ID NO: 969876 - RNA, 19 nt, Homo sapiens
acccagaccucauuauuuc

SEQ ID NO: 969877 - RNA, 19 nt, Homo sapiens
gcucuaucauucuguuuca

SEQ ID NO: 969878 - RNA, 19 nt, Homo sapiens
gccuggcccuugucucuaa

SEQ ID NO: 969879 - RNA, 19 nt, Homo sapiens
ccucaaggauugggacuau

SEQ ID NO: 969880 - RNA, 19 nt, Homo sapiens
agugggaucugguguguga

SEQ ID NO: 969881 - RNA, 19 nt, Homo sapiens
ccacccagaccucauuauu

SEQ ID NO: 969882 - RNA, 19 nt, Homo sapiens
gggcuucaccaacuucauu

SEQ ID NO: 969883 - RNA, 19 nt, Homo sapiens
uugcuucccuccucaacua

SEQ ID NO: 969884 - RNA, 19 nt, Homo sapiens
cacccagaccucauuauuu

SEQ ID NO: 969885 - RNA, 19 nt, Homo sapiens
agagagcuccacacuguaa

SEQ ID NO: 969886 - RNA, 19 nt, Homo sapiens
cacgguggcugauagugaa

SEQ ID NO: 969887 - RNA, 19 nt, Homo sapiens
cgucauggcccuccgauuc

SEQ ID NO: 969888 - RNA, 19 nt, Homo sapiens
gcccuccucugcauucuca

SEQ ID NO: 969889 - RNA, 19 nt, Homo sapiens
gaggcuggcccacacagaa

SEQ ID NO: 969890 - RNA, 19 nt, Homo sapiens
uggcuggccugguuuguuc

SEQ ID NO: 969891 - RNA, 19 nt, Homo sapiens
gcuaccuguuccuggguua

SEQ ID NO: 969892 - RNA, 19 nt, Homo sapiens
aggcugccaucaccacuuu

SEQ ID NO: 969893 - RNA, 19 nt, Homo sapiens
gagagagcuccacacugua

SEQ ID NO: 969894 - RNA, 19 nt, Homo sapiens
gauccuggcugagcgaaac

SEQ ID NO: 969895 - RNA, 19 nt, Homo sapiens
accauugccucaaggauug

SEQ ID NO: 969896 - RNA, 19 nt, Homo sapiens
uagugaagcggcagauuga

SEQ ID NO: 969897 - RNA, 19 nt, Homo sapiens
cgccggacuucaaccauug

SEQ ID NO: 969898 - RNA, 19 nt, Homo sapiens
cauuauuucuugcucuauc

SEQ ID NO: 969899 - RNA, 19 nt, Homo sapiens
ccuccucccugcugcuuug

SEQ ID NO: 969900 - RNA, 19 nt, Homo sapiens
ccucugcauucucagcauu

SEQ ID NO: 969901 - RNA, 19 nt, Homo sapiens
cagaaagguggcaagaaga

SEQ ID NO: 969902 - RNA, 19 nt, Homo sapiens
cagaccucauuauuucuug

SEQ ID NO: 969903 - RNA, 19 nt, Homo sapiens
ccagaccucauuauuucuu

SEQ ID NO: 969904 - RNA, 19 nt, Homo sapiens
ucacuuccuuggccagagu

SEQ ID NO: 969905 - RNA, 19 nt, Homo sapiens
ggacuauaauggccuuccu

SEQ ID NO: 969906 - RNA, 19 nt, Homo sapiens
gaaagguggcaagaagauc

SEQ ID NO: 969907 - RNA, 19 nt, Homo sapiens
ucugagcggccucugagua

SEQ ID NO: 969908 - RNA, 19 nt, Homo sapiens
gauagugaagcggcagauu

SEQ ID NO: 969909 - RNA, 19 nt, Homo sapiens
cuucaaccauugccucaag

SEQ ID NO: 969910 - RNA, 19 nt, Homo sapiens
gggagggcacuuccuguuc

SEQ ID NO: 969911 - RNA, 19 nt, Homo sapiens
guguugaccugggugucua

SEQ ID NO: 969912 - RNA, 19 nt, Homo sapiens
cucauuauuucuugcucua

SEQ ID NO: 969913 - RNA, 19 nt, Homo sapiens
cuucauugcccaugccauu

SEQ ID NO: 969914 - RNA, 19 nt, Homo sapiens
agaaagguggcaagaagau

SEQ ID NO: 969915 - RNA, 19 nt, Homo sapiens
aaccauugccucaaggauu

SEQ ID NO: 969916 - RNA, 19 nt, Homo sapiens
uggagcagauccucuucau

SEQ ID NO: 969917 - RNA, 19 nt, Homo sapiens
cauccacccagaccucauu

SEQ ID NO: 969918 - RNA, 19 nt, Homo sapiens
gcuuugcauucacuuccuu

SEQ ID NO: 969919 - RNA, 19 nt, Homo sapiens
auagugaagcggcagauug

SEQ ID NO: 969920 - RNA, 19 nt, Homo sapiens
acacagaaagguggcaaga

SEQ ID NO: 969921 - RNA, 19 nt, Homo sapiens
gcuccauccugcgcccaaa

SEQ ID NO: 969922 - RNA, 19 nt, Homo sapiens
gcucuucuccucccaagcu

SEQ ID NO: 969923 - RNA, 19 nt, Homo sapiens
cugcauccucuuccuguuu

SEQ ID NO: 969924 - RNA, 19 nt, Homo sapiens
gaacggaaaucccgguaua

SEQ ID NO: 969925 - RNA, 19 nt, Homo sapiens
cauagaagauggaguauuu

SEQ ID NO: 969926 - RNA, 19 nt, Homo sapiens
gcaagucccugguagaauu

SEQ ID NO: 969927 - RNA, 19 nt, Homo sapiens
gaaauguggucuugacuga

SEQ ID NO: 969928 - RNA, 19 nt, Homo sapiens
gaagauggauggaugaaca

SEQ ID NO: 969929 - RNA, 19 nt, Homo sapiens
aaacgacgcucaacagauu

SEQ ID NO: 969930 - RNA, 19 nt, Homo sapiens
ggacauuacuccagcaguu

SEQ ID NO: 969931 - RNA, 19 nt, Homo sapiens
gaagauggaguauuugaaa

SEQ ID NO: 969932 - RNA, 19 nt, Homo sapiens
uugaaacgcugacaaauuu

SEQ ID NO: 969933 - RNA, 19 nt, Homo sapiens
uaacauagaagauggagua

SEQ ID NO: 969934 - RNA, 19 nt, Homo sapiens
gcaaauaugugacagaacu

SEQ ID NO: 969935 - RNA, 19 nt, Homo sapiens
gaucaaagagggaagagua

SEQ ID NO: 969936 - RNA, 19 nt, Homo sapiens
ugacuuacguggaaacaaa

SEQ ID NO: 969937 - RNA, 19 nt, Homo sapiens
gauuuaagccucaacagua

SEQ ID NO: 969938 - RNA, 19 nt, Homo sapiens
gagggcauuucaagacuua

SEQ ID NO: 969939 - RNA, 19 nt, Homo sapiens
gcaacacccagaucaaaua

SEQ ID NO: 969940 - RNA, 19 nt, Homo sapiens
gauuaaugcugccugguuu

SEQ ID NO: 969941 - RNA, 19 nt, Homo sapiens
ucaaaggucucaagaaucu

SEQ ID NO: 969942 - RNA, 19 nt, Homo sapiens
caacagguauaucuccauu

SEQ ID NO: 969943 - RNA, 19 nt, Homo sapiens
ggaaaagccuuagauuuaa

SEQ ID NO: 969944 - RNA, 19 nt, Homo sapiens
gaaaaugauucacgguaua

SEQ ID NO: 969945 - RNA, 19 nt, Homo sapiens
caacuuguguuucagaugu

SEQ ID NO: 969946 - RNA, 19 nt, Homo sapiens
gacauugccuguuuaaauc

SEQ ID NO: 969947 - RNA, 19 nt, Homo sapiens
gaauaucaccguugguaaa

SEQ ID NO: 969948 - RNA, 19 nt, Homo sapiens
ucacacacauaacgaauga

SEQ ID NO: 969949 - RNA, 19 nt, Homo sapiens
gaaggcagaaggcuuguuu

SEQ ID NO: 969950 - RNA, 19 nt, Homo sapiens
uaagaccaccaccaaauua

SEQ ID NO: 969951 - RNA, 19 nt, Homo sapiens
gcucaaguguuaaguggaa

SEQ ID NO: 969952 - RNA, 19 nt, Homo sapiens
gguggugcuucaauuaaua

SEQ ID NO: 969953 - RNA, 19 nt, Homo sapiens
gcaaauaguuccucuuuuc

SEQ ID NO: 969954 - RNA, 19 nt, Homo sapiens
uaacaggauuucccaccua

SEQ ID NO: 969955 - RNA, 19 nt, Homo sapiens
guuuaaaucugucugcaaa

SEQ ID NO: 969956 - RNA, 19 nt, Homo sapiens
ggaagaguauugugagucu

SEQ ID NO: 969957 - RNA, 19 nt, Homo sapiens
ggaaaucccgguauacaau

SEQ ID NO: 969958 - RNA, 19 nt, Homo sapiens
acuaucaacuuggguauua

SEQ ID NO: 969959 - RNA, 19 nt, Homo sapiens
gaugcagcuuccaaacuua

SEQ ID NO: 969960 - RNA, 19 nt, Homo sapiens
cuacgggcauugcauuuaa

SEQ ID NO: 969961 - RNA, 19 nt, Homo sapiens
ggaguuauccacagcauau

SEQ ID NO: 969962 - RNA, 19 nt, Homo sapiens
gggcaaauaugugacagaa

SEQ ID NO: 969963 - RNA, 19 nt, Homo sapiens
caaaaugacucaguuauug

SEQ ID NO: 969964 - RNA, 19 nt, Homo sapiens
uuacugggauguuugguuu

SEQ ID NO: 969965 - RNA, 19 nt, Homo sapiens
ggaaagcaagucccuggua

SEQ ID NO: 969966 - RNA, 19 nt, Homo sapiens
cuagugcucuuacugaauu

SEQ ID NO: 969967 - RNA, 19 nt, Homo sapiens
acaauagacuagacuuuga

SEQ ID NO: 969968 - RNA, 19 nt, Homo sapiens
gggcauuccucaaccuaaa

SEQ ID NO: 969969 - RNA, 19 nt, Homo sapiens
gaagcuauccuugugauga

SEQ ID NO: 969970 - RNA, 19 nt, Homo sapiens
gcuaauggaugagaacaug

SEQ ID NO: 969971 - RNA, 19 nt, Homo sapiens
cguaacacaucaucuagaa

SEQ ID NO: 969972 - RNA, 19 nt, Homo sapiens
caacagauuuugaguuuga

SEQ ID NO: 969973 - RNA, 19 nt, Homo sapiens
gaugguggugcuucaauua

SEQ ID NO: 969974 - RNA, 19 nt, Homo sapiens
gauucacgguauaacaaua

SEQ ID NO: 969975 - RNA, 19 nt, Homo sapiens
uaaaugagcugcgcuacca

SEQ ID NO: 969976 - RNA, 19 nt, Homo sapiens
ugaaggugcuggaucuuga

SEQ ID NO: 969977 - RNA, 19 nt, Homo sapiens
ucgauuccauuaagcaaua

SEQ ID NO: 969978 - RNA, 19 nt, Homo sapiens
aaacaugguucucuugaca

SEQ ID NO: 969979 - RNA, 19 nt, Homo sapiens
gcaaucgccuugacauuuu

SEQ ID NO: 969980 - RNA, 19 nt, Homo sapiens
ugacauugccuguuuaaau

SEQ ID NO: 969981 - RNA, 19 nt, Homo sapiens
caccaaagaugccucuguu

SEQ ID NO: 969982 - RNA, 19 nt, Homo sapiens
uuuaagagguuauguguuc

SEQ ID NO: 969983 - RNA, 19 nt, Homo sapiens
agacuagacuuugauaaug

SEQ ID NO: 969984 - RNA, 19 nt, Homo sapiens
gaacaacagaaacaugguu

SEQ ID NO: 969985 - RNA, 19 nt, Homo sapiens
ggcaaacucugagaaaugu

SEQ ID NO: 969986 - RNA, 19 nt, Homo sapiens
aauccgcacuugaaacuaa

SEQ ID NO: 969987 - RNA, 19 nt, Homo sapiens
cagaauagcaggcguaaca

SEQ ID NO: 969988 - RNA, 19 nt, Homo sapiens
gcagaguuaugcaaauagu

SEQ ID NO: 969989 - RNA, 19 nt, Homo sapiens
gagcaacacccagaucaaa

SEQ ID NO: 969990 - RNA, 19 nt, Homo sapiens
gaagagagccgagacaaaa

SEQ ID NO: 969991 - RNA, 19 nt, Homo sapiens
ugacacgucuggauuuauc

SEQ ID NO: 969992 - RNA, 19 nt, Homo sapiens
gaaaacauguuccuucagu

SEQ ID NO: 969993 - RNA, 19 nt, Homo sapiens
ccaaacuuaucgacuauca

SEQ ID NO: 969994 - RNA, 19 nt, Homo sapiens
ugaugcagcuuccaaacuu

SEQ ID NO: 969995 - RNA, 19 nt, Homo sapiens
gggaguuacugcuugaaga

SEQ ID NO: 969996 - RNA, 19 nt, Homo sapiens
uaagggaguuacugcuuga

SEQ ID NO: 969997 - RNA, 19 nt, Homo sapiens
ugaagcaccucgauuuaag

SEQ ID NO: 969998 - RNA, 19 nt, Homo sapiens
uuucaaaggucucaagaau

SEQ ID NO: 969999 - RNA, 19 nt, Homo sapiens
uggaaaagccuuagauuua

SEQ ID NO: 970000 - RNA, 19 nt, Homo sapiens
gcuugaagacaaccaguua

SEQ ID NO: 970001 - RNA, 19 nt, Homo sapiens
gagccaguguuacagcauu

SEQ ID NO: 970002 - RNA, 19 nt, Homo sapiens
caaagagggaagaguauug

SEQ ID NO: 970003 - RNA, 19 nt, Homo sapiens
cauuggagauuuccgaaga

SEQ ID NO: 970004 - RNA, 19 nt, Homo sapiens
ggcaaucgccuugacauuu

SEQ ID NO: 970005 - RNA, 19 nt, Homo sapiens
ggaaacgacgcucaacaga

SEQ ID NO: 970006 - RNA, 19 nt, Homo sapiens
aagaagauuucaagggauu

SEQ ID NO: 970007 - RNA, 19 nt, Homo sapiens
gaaggagucaucuuugcaa

SEQ ID NO: 970008 - RNA, 19 nt, Homo sapiens
gugcagcaaucgucgacua

SEQ ID NO: 970009 - RNA, 19 nt, Homo sapiens
ugauuucgcgccauaauaa

SEQ ID NO: 970010 - RNA, 19 nt, Homo sapiens
gaugaugacaacagguaua

SEQ ID NO: 970011 - RNA, 19 nt, Homo sapiens
gaaacgacgcucaacagau

SEQ ID NO: 970012 - RNA, 19 nt, Homo sapiens
gcauugcauuuaagagguu

SEQ ID NO: 970013 - RNA, 19 nt, Homo sapiens
ggugcuggaucuugaauuc

SEQ ID NO: 970014 - RNA, 19 nt, Homo sapiens
cuaaaccucucuagcacuu

SEQ ID NO: 970015 - RNA, 19 nt, Homo sapiens
aauguggucuugacugaaa

SEQ ID NO: 970016 - RNA, 19 nt, Homo sapiens
ccaccuacccucuggcuuu

SEQ ID NO: 970017 - RNA, 19 nt, Homo sapiens
uaucugacuuuacaucuuc

SEQ ID NO: 970018 - RNA, 19 nt, Homo sapiens
cuagaucucagcuauaauu

SEQ ID NO: 970019 - RNA, 19 nt, Homo sapiens
gaacucagagaagaugauu

SEQ ID NO: 970020 - RNA, 19 nt, Homo sapiens
agaaauacuugacuugucu

SEQ ID NO: 970021 - RNA, 19 nt, Homo sapiens
gcugacaaauuuggaguug

SEQ ID NO: 970022 - RNA, 19 nt, Homo sapiens
acacauaacgaaugaauca

SEQ ID NO: 970023 - RNA, 19 nt, Homo sapiens
aaacuaagaccaccaccaa

SEQ ID NO: 970024 - RNA, 19 nt, Homo sapiens
gaacggaaaucccgguaua

SEQ ID NO: 970025 - RNA, 19 nt, Homo sapiens
cauagaagauggaguauuu

SEQ ID NO: 970026 - RNA, 19 nt, Homo sapiens
gcaagucccugguagaauu

SEQ ID NO: 970027 - RNA, 19 nt, Homo sapiens
gaaauguggucuugacuga

SEQ ID NO: 970028 - RNA, 19 nt, Homo sapiens
gaagauggauggaugaaca

SEQ ID NO: 970029 - RNA, 19 nt, Homo sapiens
aaacgacgcucaacagauu

SEQ ID NO: 970030 - RNA, 19 nt, Homo sapiens
ggacauuacuccagcaguu

SEQ ID NO: 970031 - RNA, 19 nt, Homo sapiens
gaagauggaguauuugaaa

SEQ ID NO: 970032 - RNA, 19 nt, Homo sapiens
uugaaacgcugacaaauuu

SEQ ID NO: 970033 - RNA, 19 nt, Homo sapiens
uaacauagaagauggagua

SEQ ID NO: 970034 - RNA, 19 nt, Homo sapiens
gcaaauaugugacagaacu

SEQ ID NO: 970035 - RNA, 19 nt, Homo sapiens
gaucaaagagggaagagua

SEQ ID NO: 970036 - RNA, 19 nt, Homo sapiens
ugacuuacguggaaacaaa

SEQ ID NO: 970037 - RNA, 19 nt, Homo sapiens
gauuuaagccucaacagua

SEQ ID NO: 970038 - RNA, 19 nt, Homo sapiens
gagggcauuucaagacuua

SEQ ID NO: 970039 - RNA, 19 nt, Homo sapiens
gcaacacccagaucaaaua

SEQ ID NO: 970040 - RNA, 19 nt, Homo sapiens
gauuaaugcugccugguuu

SEQ ID NO: 970041 - RNA, 19 nt, Homo sapiens
ucaaaggucucaagaaucu

SEQ ID NO: 970042 - RNA, 19 nt, Homo sapiens
caacagguauaucuccauu

SEQ ID NO: 970043 - RNA, 19 nt, Homo sapiens
ggaaaagccuuagauuuaa

SEQ ID NO: 970044 - RNA, 19 nt, Homo sapiens
gaaaaugauucacgguaua

SEQ ID NO: 970045 - RNA, 19 nt, Homo sapiens
caacuuguguuucagaugu

SEQ ID NO: 970046 - RNA, 19 nt, Homo sapiens
gacauugccuguuuaaauc

SEQ ID NO: 970047 - RNA, 19 nt, Homo sapiens
gaauaucaccguugguaaa

SEQ ID NO: 970048 - RNA, 19 nt, Homo sapiens
ucacacacauaacgaauga

SEQ ID NO: 970049 - RNA, 19 nt, Homo sapiens
gaaggcagaaggcuuguuu

SEQ ID NO: 970050 - RNA, 19 nt, Homo sapiens
uaagaccaccaccaaauua

SEQ ID NO: 970051 - RNA, 19 nt, Homo sapiens
gcucaaguguuaaguggaa

SEQ ID NO: 970052 - RNA, 19 nt, Homo sapiens
gguggugcuucaauuaaua

SEQ ID NO: 970053 - RNA, 19 nt, Homo sapiens
gcaaauaguuccucuuuuc

SEQ ID NO: 970054 - RNA, 19 nt, Homo sapiens
uaacaggauuucccaccua

SEQ ID NO: 970055 - RNA, 19 nt, Homo sapiens
guuuaaaucugucugcaaa

SEQ ID NO: 970056 - RNA, 19 nt, Homo sapiens
ggaagaguauugugagucu

SEQ ID NO: 970057 - RNA, 19 nt, Homo sapiens
ggaaaucccgguauacaau

SEQ ID NO: 970058 - RNA, 19 nt, Homo sapiens
acuaucaacuuggguauua

SEQ ID NO: 970059 - RNA, 19 nt, Homo sapiens
gaugcagcuuccaaacuua

SEQ ID NO: 970060 - RNA, 19 nt, Homo sapiens
cuacgggcauugcauuuaa

SEQ ID NO: 970061 - RNA, 19 nt, Homo sapiens
ggaguuauccacagcauau

SEQ ID NO: 970062 - RNA, 19 nt, Homo sapiens
gggcaaauaugugacagaa

SEQ ID NO: 970063 - RNA, 19 nt, Homo sapiens
caaaaugacucaguuauug

SEQ ID NO: 970064 - RNA, 19 nt, Homo sapiens
uuacugggauguuugguuu

SEQ ID NO: 970065 - RNA, 19 nt, Homo sapiens
ggaaagcaagucccuggua

SEQ ID NO: 970066 - RNA, 19 nt, Homo sapiens
cuagugcucuuacugaauu

SEQ ID NO: 970067 - RNA, 19 nt, Homo sapiens
acaauagacuagacuuuga

SEQ ID NO: 970068 - RNA, 19 nt, Homo sapiens
gggcauuccucaaccuaaa

SEQ ID NO: 970069 - RNA, 19 nt, Homo sapiens
gaagcuauccuugugauga

SEQ ID NO: 970070 - RNA, 19 nt, Homo sapiens
gcuaauggaugagaacaug

SEQ ID NO: 970071 - RNA, 19 nt, Homo sapiens
cguaacacaucaucuagaa

SEQ ID NO: 970072 - RNA, 19 nt, Homo sapiens
caacagauuuugaguuuga

SEQ ID NO: 970073 - RNA, 19 nt, Homo sapiens
gaugguggugcuucaauua

SEQ ID NO: 970074 - RNA, 19 nt, Homo sapiens
gauucacgguauaacaaua

SEQ ID NO: 970075 - RNA, 19 nt, Homo sapiens
uaaaugagcugcgcuacca

SEQ ID NO: 970076 - RNA, 19 nt, Homo sapiens
ugaaggugcuggaucuuga

SEQ ID NO: 970077 - RNA, 19 nt, Homo sapiens
ucgauuccauuaagcaaua

SEQ ID NO: 970078 - RNA, 19 nt, Homo sapiens
gcaaucgccuugacauuuu

SEQ ID NO: 970079 - RNA, 19 nt, Homo sapiens
ugacauugccuguuuaaau

SEQ ID NO: 970080 - RNA, 19 nt, Homo sapiens
caccaaagaugccucuguu

SEQ ID NO: 970081 - RNA, 19 nt, Homo sapiens
gaacaacagaaacauggaa

SEQ ID NO: 970082 - RNA, 19 nt, Homo sapiens
uuuaagagguuauguguuc

SEQ ID NO: 970083 - RNA, 19 nt, Homo sapiens
agacuagacuuugauaaug

SEQ ID NO: 970084 - RNA, 19 nt, Homo sapiens
ggcaaacucugagaaaugu

SEQ ID NO: 970085 - RNA, 19 nt, Homo sapiens
aauccgcacuugaaacuaa

SEQ ID NO: 970086 - RNA, 19 nt, Homo sapiens
cagaauagcaggcguaaca

SEQ ID NO: 970087 - RNA, 19 nt, Homo sapiens
gcagaguuaugcaaauagu

SEQ ID NO: 970088 - RNA, 19 nt, Homo sapiens
gagcaacacccagaucaaa

SEQ ID NO: 970089 - RNA, 19 nt, Homo sapiens
gaaaacauguuccuucagu

SEQ ID NO: 970090 - RNA, 19 nt, Homo sapiens
gaagagagccgagacaaaa

SEQ ID NO: 970091 - RNA, 19 nt, Homo sapiens
ugacacgucuggauuuauc

SEQ ID NO: 970092 - RNA, 19 nt, Homo sapiens
ccaaacuuaucgacuauca

SEQ ID NO: 970093 - RNA, 19 nt, Homo sapiens
ugaugcagcuuccaaacuu

SEQ ID NO: 970094 - RNA, 19 nt, Homo sapiens
gggaguuacugcuugaaga

SEQ ID NO: 970095 - RNA, 19 nt, Homo sapiens
uaagggaguuacugcuuga

SEQ ID NO: 970096 - RNA, 19 nt, Homo sapiens
ugaagcaccucgauuuaag

SEQ ID NO: 970097 - RNA, 19 nt, Homo sapiens
uuucaaaggucucaagaau

SEQ ID NO: 970098 - RNA, 19 nt, Homo sapiens
uggaaaagccuuagauuua

SEQ ID NO: 970099 - RNA, 19 nt, Homo sapiens
gcuugaagacaaccaguua

SEQ ID NO: 970100 - RNA, 19 nt, Homo sapiens
gagccaguguuacagcauu

SEQ ID NO: 970101 - RNA, 19 nt, Homo sapiens
caaagagggaagaguauug

SEQ ID NO: 970102 - RNA, 19 nt, Homo sapiens
cauuggagauuuccgaaga

SEQ ID NO: 970103 - RNA, 19 nt, Homo sapiens
ggcaaucgccuugacauuu

SEQ ID NO: 970104 - RNA, 19 nt, Homo sapiens
ggaaacgacgcucaacaga

SEQ ID NO: 970105 - RNA, 19 nt, Homo sapiens
gugcagcaaucgucgacua

SEQ ID NO: 970106 - RNA, 19 nt, Homo sapiens
aagaagauuucaagggauu

SEQ ID NO: 970107 - RNA, 19 nt, Homo sapiens
ugauuucgcgccauaauaa

SEQ ID NO: 970108 - RNA, 19 nt, Homo sapiens
gaugaugacaacagguaua

SEQ ID NO: 970109 - RNA, 19 nt, Homo sapiens
gaaacgacgcucaacagau

SEQ ID NO: 970110 - RNA, 19 nt, Homo sapiens
gcauugcauuuaagagguu

SEQ ID NO: 970111 - RNA, 19 nt, Homo sapiens
ggugcuggaucuugaauuc

SEQ ID NO: 970112 - RNA, 19 nt, Homo sapiens
cuaaaccucucuagcacuu

SEQ ID NO: 970113 - RNA, 19 nt, Homo sapiens
aauguggucuugacugaaa

SEQ ID NO: 970114 - RNA, 19 nt, Homo sapiens
ccaccuacccucuggcuuu

SEQ ID NO: 970115 - RNA, 19 nt, Homo sapiens
uaucugacuuuacaucuuc

SEQ ID NO: 970116 - RNA, 19 nt, Homo sapiens
cuagaucucagcuauaauu

SEQ ID NO: 970117 - RNA, 19 nt, Homo sapiens
gaacucagagaagaugauu

SEQ ID NO: 970118 - RNA, 19 nt, Homo sapiens
agaaauacuugacuugucu

SEQ ID NO: 970119 - RNA, 19 nt, Homo sapiens
gcugacaaauuuggaguug

SEQ ID NO: 970120 - RNA, 19 nt, Homo sapiens
acacauaacgaaugaauca

SEQ ID NO: 970121 - RNA, 19 nt, Homo sapiens
aaacuaagaccaccaccaa

SEQ ID NO: 970122 - RNA, 19 nt, Homo sapiens
gauaaugcuagugcucuua

SEQ ID NO: 970123 - RNA, 19 nt, Homo sapiens
acaaugugcugcuuaugga

SEQ ID NO: 970124 - RNA, 19 nt, Homo sapiens
aaaucgagcuccauacuaa

SEQ ID NO: 970125 - RNA, 19 nt, Homo sapiens
ccacgcagcugaccaugaa

SEQ ID NO: 970126 - RNA, 19 nt, Homo sapiens
ucuaugaguucuucaagua

SEQ ID NO: 970127 - RNA, 19 nt, Homo sapiens
gguaaugaauccagcagaa

SEQ ID NO: 970128 - RNA, 19 nt, Homo sapiens
gaauguagcuuuucugcuu

SEQ ID NO: 970129 - RNA, 19 nt, Homo sapiens
cuacggagcccucaagaaa

SEQ ID NO: 970130 - RNA, 19 nt, Homo sapiens
agacacgaaugcagaguuu

SEQ ID NO: 970131 - RNA, 19 nt, Homo sapiens
cagcagaaguggugaagca

SEQ ID NO: 970132 - RNA, 19 nt, Homo sapiens
ccucacacguagaucauuu

SEQ ID NO: 970133 - RNA, 19 nt, Homo sapiens
ccaccuagccaacgggaua

SEQ ID NO: 970134 - RNA, 19 nt, Homo sapiens
ggaagaaaauuugcaguga

SEQ ID NO: 970135 - RNA, 19 nt, Homo sapiens
ccuccucccuggauccuua

SEQ ID NO: 970136 - RNA, 19 nt, Homo sapiens
gaagggaucauagaaucuu

SEQ ID NO: 970137 - RNA, 19 nt, Homo sapiens
guaagacccuucugaacac

SEQ ID NO: 970138 - RNA, 19 nt, Homo sapiens
uaaaggaagggaucauaga

SEQ ID NO: 970139 - RNA, 19 nt, Homo sapiens
cgggauagcugggaguaug

SEQ ID NO: 970140 - RNA, 19 nt, Homo sapiens
ggucggaggacuacgagaa

SEQ ID NO: 970141 - RNA, 19 nt, Homo sapiens
aggaagggaucauagaauc

SEQ ID NO: 970142 - RNA, 19 nt, Homo sapiens
aaaggaagggaucauagaa

SEQ ID NO: 970143 - RNA, 19 nt, Homo sapiens
cagcaccggucagcaauca

SEQ ID NO: 970144 - RNA, 19 nt, Homo sapiens
gcuccacgaugcgguaaug

SEQ ID NO: 970145 - RNA, 19 nt, Homo sapiens
ccaaggaaacagccaccua

SEQ ID NO: 970146 - RNA, 19 nt, Homo sapiens
acgagaaccugccgacuag

SEQ ID NO: 970147 - RNA, 19 nt, Homo sapiens
uguaagacccuucugaaca

SEQ ID NO: 970148 - RNA, 19 nt, Homo sapiens
ccaaagcccaguacacaag

SEQ ID NO: 970149 - RNA, 19 nt, Homo sapiens
acacgaaugcagaguuuga

SEQ ID NO: 970150 - RNA, 19 nt, Homo sapiens
ccacgaugcgguaaugaau

SEQ ID NO: 970151 - RNA, 19 nt, Homo sapiens
aaagcccaguacacaagua

SEQ ID NO: 970152 - RNA, 19 nt, Homo sapiens
ggaaggggagcgagaaauu

SEQ ID NO: 970153 - RNA, 19 nt, Homo sapiens
uacgagaaccugccgacua

SEQ ID NO: 970154 - RNA, 19 nt, Homo sapiens
ggaagggaucauagaaucu

SEQ ID NO: 970155 - RNA, 19 nt, Homo sapiens
gcuugcagauguacaacuc

SEQ ID NO: 970156 - RNA, 19 nt, Homo sapiens
cgagcuccauacuaaagga

SEQ ID NO: 970157 - RNA, 19 nt, Homo sapiens
uaaugaauccagcagaagu

SEQ ID NO: 970158 - RNA, 19 nt, Homo sapiens
cuaaaggaagggaucauag

SEQ ID NO: 970159 - RNA, 19 nt, Homo sapiens
aagggaucauagaaucuuu

SEQ ID NO: 970160 - RNA, 19 nt, Homo sapiens
acuaaaggaagggaucaua

SEQ ID NO: 970161 - RNA, 19 nt, Homo sapiens
ccauccacuucaucaccua

SEQ ID NO: 970162 - RNA, 19 nt, Homo sapiens
gaaaaucgagcuccauacu

SEQ ID NO: 970163 - RNA, 19 nt, Homo sapiens
cuuggucugucuaugaguu

SEQ ID NO: 970164 - RNA, 19 nt, Homo sapiens
gaggagggaagaaaauuug

SEQ ID NO: 970165 - RNA, 19 nt, Homo sapiens
uaugaguucuucaaguacu

SEQ ID NO: 970166 - RNA, 19 nt, Homo sapiens
uuucuuggucugucuauga

SEQ ID NO: 970167 - RNA, 19 nt, Homo sapiens
agacccuucugaacacuca

SEQ ID NO: 970168 - RNA, 19 nt, Homo sapiens
guaaugaauccagcagaag

SEQ ID NO: 970169 - RNA, 19 nt, Homo sapiens
ggagcacucggucauguac

SEQ ID NO: 970170 - RNA, 19 nt, Homo sapiens
gacuuuaaaugacguuuuc

SEQ ID NO: 970171 - RNA, 19 nt, Homo sapiens
gaaaacaugaaaaggacuu

SEQ ID NO: 970172 - RNA, 19 nt, Homo sapiens
ucuguaagacccuucugaa

SEQ ID NO: 970173 - RNA, 19 nt, Homo sapiens
gcagucccacaucaucuca

SEQ ID NO: 970174 - RNA, 19 nt, Homo sapiens
gagaaacccugaauagaaa

SEQ ID NO: 970175 - RNA, 19 nt, Homo sapiens
gaaacugccuuacguaaug

SEQ ID NO: 970176 - RNA, 19 nt, Homo sapiens
ggagaaacccugaauagaa

SEQ ID NO: 970177 - RNA, 19 nt, Homo sapiens
caaagugaguuaaugugua

SEQ ID NO: 970178 - RNA, 19 nt, Homo sapiens
aaaucgagcuccauacuaa

SEQ ID NO: 970179 - RNA, 19 nt, Homo sapiens
ccacgcagcugaccaugaa

SEQ ID NO: 970180 - RNA, 19 nt, Homo sapiens
gaguuaauguguagacaaa

SEQ ID NO: 970181 - RNA, 19 nt, Homo sapiens
gccagcagcucuuacguaa

SEQ ID NO: 970182 - RNA, 19 nt, Homo sapiens
ucuaugaguucuucaagua

SEQ ID NO: 970183 - RNA, 19 nt, Homo sapiens
gaaagagauuugacggaau

SEQ ID NO: 970184 - RNA, 19 nt, Homo sapiens
gguaaugaauccagcagaa

SEQ ID NO: 970185 - RNA, 19 nt, Homo sapiens
aaaguuaucuggacagcuu

SEQ ID NO: 970186 - RNA, 19 nt, Homo sapiens
caccaucacuucaggguuu

SEQ ID NO: 970187 - RNA, 19 nt, Homo sapiens
caccaacacuugcagguuu

SEQ ID NO: 970188 - RNA, 19 nt, Homo sapiens
uuuaaagccuggauuguaa

SEQ ID NO: 970189 - RNA, 19 nt, Homo sapiens
gaauguagcuuuucugcuu

SEQ ID NO: 970190 - RNA, 19 nt, Homo sapiens
gaagagucauccugguguu

SEQ ID NO: 970191 - RNA, 19 nt, Homo sapiens
cuacggagcccucaagaaa

SEQ ID NO: 970192 - RNA, 19 nt, Homo sapiens
gggcggagcugguaguaca

SEQ ID NO: 970193 - RNA, 19 nt, Homo sapiens
agacacgaaugcagaguuu

SEQ ID NO: 970194 - RNA, 19 nt, Homo sapiens
uaucauauuuccaccauca

SEQ ID NO: 970195 - RNA, 19 nt, Homo sapiens
gggcugagcuuuuauuuuc

SEQ ID NO: 970196 - RNA, 19 nt, Homo sapiens
aaaguucucuucuucaaca

SEQ ID NO: 970197 - RNA, 19 nt, Homo sapiens
uuucaacaauggagacaua

SEQ ID NO: 970198 - RNA, 19 nt, Homo sapiens
cagcagaaguggugaagca

SEQ ID NO: 970199 - RNA, 19 nt, Homo sapiens
uuacaugcauugcugaaga

SEQ ID NO: 970200 - RNA, 19 nt, Homo sapiens
ccucacacguagaucauuu

SEQ ID NO: 970201 - RNA, 19 nt, Homo sapiens
gcaaagugaguuaaugugu

SEQ ID NO: 970202 - RNA, 19 nt, Homo sapiens
aagcaucucuccucccauu

SEQ ID NO: 970203 - RNA, 19 nt, Homo sapiens
agcaagggcugaaaucauu

SEQ ID NO: 970204 - RNA, 19 nt, Homo sapiens
caagaucuaacuaagcuuu

SEQ ID NO: 970205 - RNA, 19 nt, Homo sapiens
ggaagaaaauuugcaguga

SEQ ID NO: 970206 - RNA, 19 nt, Homo sapiens
ccuccucccuggauccuua

SEQ ID NO: 970207 - RNA, 19 nt, Homo sapiens
caaccuuggucauaagugu

SEQ ID NO: 970208 - RNA, 19 nt, Homo sapiens
gguugagugugccuaaauu

SEQ ID NO: 970209 - RNA, 19 nt, Homo sapiens
caagagagaguuaacaucu

SEQ ID NO: 970210 - RNA, 19 nt, Homo sapiens
ggaaugauuauaagugugu

SEQ ID NO: 970211 - RNA, 19 nt, Homo sapiens
ggccauuagugcauuuauu

SEQ ID NO: 970212 - RNA, 19 nt, Homo sapiens
gaguuaacaucuagacagu

SEQ ID NO: 970213 - RNA, 19 nt, Homo sapiens
aaagugaguuaauguguag

SEQ ID NO: 970214 - RNA, 19 nt, Homo sapiens
cuucucagcuguagauaug

SEQ ID NO: 970215 - RNA, 19 nt, Homo sapiens
gaagggaucauagaaucuu

SEQ ID NO: 970216 - RNA, 19 nt, Homo sapiens
acucaaagccgaaagcaaa

SEQ ID NO: 970217 - RNA, 19 nt, Homo sapiens
gcaaagggaggaaacucaa

SEQ ID NO: 970218 - RNA, 19 nt, Homo sapiens
caauggagacauagauuug

SEQ ID NO: 970219 - RNA, 19 nt, Homo sapiens
cuggacagcuucuuugaga

SEQ ID NO: 970220 - RNA, 19 nt, Homo sapiens
guaagacccuucugaacac

SEQ ID NO: 970221 - RNA, 19 nt, Homo sapiens
cuacaacgccaagaucuaa

SEQ ID NO: 970222 - RNA, 19 nt, Homo sapiens
uaaaggaagggaucauaga

SEQ ID NO: 970223 - RNA, 19 nt, Homo sapiens
agagagaguuaacaucuag

SEQ ID NO: 970224 - RNA, 19 nt, Homo sapiens
ccucuucucuugcccaguu

SEQ ID NO: 970225 - RNA, 19 nt, Homo sapiens
uagauuugacccacaauaa

SEQ ID NO: 970226 - RNA, 19 nt, Homo sapiens
ggaauggaaauauggauag

SEQ ID NO: 970227 - RNA, 19 nt, Homo sapiens
ggggagggcugagcuuuua

SEQ ID NO: 970228 - RNA, 19 nt, Homo sapiens
gccaagaucuaacuaagcu

SEQ ID NO: 970229 - RNA, 19 nt, Homo sapiens
gcguuugucuggaguuaga

SEQ ID NO: 970230 - RNA, 19 nt, Homo sapiens
aagagagaguuaacaucua

SEQ ID NO: 970231 - RNA, 19 nt, Homo sapiens
gccauuagugcauuuauug

SEQ ID NO: 970232 - RNA, 19 nt, Homo sapiens
guacaacaggucucuacaa

SEQ ID NO: 970233 - RNA, 19 nt, Homo sapiens
caacaauggagacauagau

SEQ ID NO: 970234 - RNA, 19 nt, Homo sapiens
ccaccuagccaacgguauu

SEQ ID NO: 970235 - RNA, 19 nt, Homo sapiens
ugagguuccugguucuuga

SEQ ID NO: 970236 - RNA, 19 nt, Homo sapiens
gaucagacauaggagaaac

SEQ ID NO: 970237 - RNA, 19 nt, Homo sapiens
gagggacaagagagaguua

SEQ ID NO: 970238 - RNA, 19 nt, Homo sapiens
gggcaaagugaguuaaugu

SEQ ID NO: 970239 - RNA, 19 nt, Homo sapiens
gauauuuguucugcuuugu

SEQ ID NO: 970240 - RNA, 19 nt, Homo sapiens
gguuuggaauggaaauaug

SEQ ID NO: 970241 - RNA, 19 nt, Homo sapiens
gcaagcaagggcugaaauc

SEQ ID NO: 970242 - RNA, 19 nt, Homo sapiens
guugagugugccuaaauua

SEQ ID NO: 970243 - RNA, 19 nt, Homo sapiens
ggucggaggacuacgagaa

SEQ ID NO: 970244 - RNA, 19 nt, Homo sapiens
aggaagggaucauagaauc

SEQ ID NO: 970245 - RNA, 19 nt, Homo sapiens
aaaggaagggaucauagaa

SEQ ID NO: 970246 - RNA, 19 nt, Homo sapiens
cagcaccggucagcaauca

SEQ ID NO: 970247 - RNA, 19 nt, Homo sapiens
gcuccacgaugcgguaaug

SEQ ID NO: 970248 - RNA, 19 nt, Homo sapiens
ggacaagagagaguuaaca

SEQ ID NO: 970249 - RNA, 19 nt, Homo sapiens
gcugaaacugccuuacgua

SEQ ID NO: 970250 - RNA, 19 nt, Homo sapiens
cccauucucuucuguuugu

SEQ ID NO: 970251 - RNA, 19 nt, Homo sapiens
ccaaggaaacagccaccua

SEQ ID NO: 970252 - RNA, 19 nt, Homo sapiens
gcagggauagcugggagua

SEQ ID NO: 970253 - RNA, 19 nt, Homo sapiens
acgagaaccugccgacuag

SEQ ID NO: 970254 - RNA, 19 nt, Homo sapiens
cagcuuaagggcaaaguga

SEQ ID NO: 970255 - RNA, 19 nt, Homo sapiens
caaagggaggaaacucaaa

SEQ ID NO: 970256 - RNA, 19 nt, Homo sapiens
acaauggagacauagauuu

SEQ ID NO: 970257 - RNA, 19 nt, Homo sapiens
gggguuggcuuuuauuguu

SEQ ID NO: 970258 - RNA, 19 nt, Homo sapiens
uguaagacccuucugaaca

SEQ ID NO: 970259 - RNA, 19 nt, Homo sapiens
gacaagagagaguuaacau

SEQ ID NO: 970260 - RNA, 19 nt, Homo sapiens
guuaauguguagacaaagg

SEQ ID NO: 970261 - RNA, 19 nt, Homo sapiens
cugauuuccucuucucuug

SEQ ID NO: 970262 - RNA, 19 nt, Homo sapiens
gugcauuuauugagaugau

SEQ ID NO: 970263 - RNA, 19 nt, Homo sapiens
uaggagaaacccugaauag

SEQ ID NO: 970264 - RNA, 19 nt, Homo sapiens
uaacaucuagacaguggaa

SEQ ID NO: 970265 - RNA, 19 nt, Homo sapiens
cguaaggcauguuuuauug

SEQ ID NO: 970266 - RNA, 19 nt, Homo sapiens
cccgcuugcucacgaauaa

SEQ ID NO: 970267 - RNA, 19 nt, Homo sapiens
guaauuuucuggaguuugu

SEQ ID NO: 970268 - RNA, 19 nt, Homo sapiens
accaacacuugcagguuua

SEQ ID NO: 970269 - RNA, 19 nt, Homo sapiens
ccaaagcccaguacacaag

SEQ ID NO: 970270 - RNA, 19 nt, Homo sapiens
ugggaaugauuauaagugu

SEQ ID NO: 970271 - RNA, 19 nt, Homo sapiens
gaucuugcugggaaugauu

SEQ ID NO: 970272 - RNA, 19 nt, Homo sapiens
acauagauuugacccacaa

SEQ ID NO: 970273 - RNA, 19 nt, Homo sapiens
acacgaaugcagaguuuga

SEQ ID NO: 970274 - RNA, 19 nt, Homo sapiens
gaaagagagucaagaauuu

SEQ ID NO: 970275 - RNA, 19 nt, Homo sapiens
ggaaaucauucacaucuga

SEQ ID NO: 970276 - RNA, 19 nt, Homo sapiens
gacacugacuccauuaaua

SEQ ID NO: 970277 - RNA, 19 nt, Homo sapiens
gaccauacauuuaaacaga

SEQ ID NO: 970278 - RNA, 19 nt, Homo sapiens
caaggaagaugccugugua

SEQ ID NO: 970279 - RNA, 19 nt, Homo sapiens
agagagagaucauuugaaa

SEQ ID NO: 970280 - RNA, 19 nt, Homo sapiens
ggacaugagugagguguuu

SEQ ID NO: 970281 - RNA, 19 nt, Homo sapiens
gcccagauauugagaauug

SEQ ID NO: 970282 - RNA, 19 nt, Homo sapiens
ugacuguucugaccaaaua

SEQ ID NO: 970283 - RNA, 19 nt, Homo sapiens
ggucaagguuaacucaaua

SEQ ID NO: 970284 - RNA, 19 nt, Homo sapiens
uauccaagaucaucacaua

SEQ ID NO: 970285 - RNA, 19 nt, Homo sapiens
ucuaguggcugagaaauua

SEQ ID NO: 970286 - RNA, 19 nt, Homo sapiens
gagcugaccauacauuuaa

SEQ ID NO: 970287 - RNA, 19 nt, Homo sapiens
uuaccaagguggcauauuu

SEQ ID NO: 970288 - RNA, 19 nt, Homo sapiens
caaaucagguucauguguu

SEQ ID NO: 970289 - RNA, 19 nt, Homo sapiens
ggacaaaucagguucaugu

SEQ ID NO: 970290 - RNA, 19 nt, Homo sapiens
cagaauagauuaccauuac

SEQ ID NO: 970291 - RNA, 19 nt, Homo sapiens
gaacaauucuugacguuuu

SEQ ID NO: 970292 - RNA, 19 nt, Homo sapiens
gagaauacucugugcauuu

SEQ ID NO: 970293 - RNA, 19 nt, Homo sapiens
gaaagagaacuacuaacaa

SEQ ID NO: 970294 - RNA, 19 nt, Homo sapiens
guucauguguugcaucuuu

SEQ ID NO: 970295 - RNA, 19 nt, Homo sapiens
gauaaaguguauugggaaa

SEQ ID NO: 970296 - RNA, 19 nt, Homo sapiens
gaaguuaccuaucugaaaa

SEQ ID NO: 970297 - RNA, 19 nt, Homo sapiens
gcuuaucgauguaauagaa

SEQ ID NO: 970298 - RNA, 19 nt, Homo sapiens
guacugaaauacaucauca

SEQ ID NO: 970299 - RNA, 19 nt, Homo sapiens
aaucauagccuguuuauuc

SEQ ID NO: 970300 - RNA, 19 nt, Homo sapiens
caguguagaugaauacgua

SEQ ID NO: 970301 - RNA, 19 nt, Homo sapiens
caaaugcacuccgauuaug

SEQ ID NO: 970302 - RNA, 19 nt, Homo sapiens
ggagagagagaucauuuga

SEQ ID NO: 970303 - RNA, 19 nt, Homo sapiens
gucaaaguauuaccuauga

SEQ ID NO: 970304 - RNA, 19 nt, Homo sapiens
uuacacauccuacuccuua

SEQ ID NO: 970305 - RNA, 19 nt, Homo sapiens
cagaaaugcuggcagaaug

SEQ ID NO: 970306 - RNA, 19 nt, Homo sapiens
ggaugcaucuuuaucuuca

SEQ ID NO: 970307 - RNA, 19 nt, Homo sapiens
gaaucggguuguacugaaa

SEQ ID NO: 970308 - RNA, 19 nt, Homo sapiens
ucacauggaguuucaaauu

SEQ ID NO: 970309 - RNA, 19 nt, Homo sapiens
ggagugaagauaacuuaaa

SEQ ID NO: 970310 - RNA, 19 nt, Homo sapiens
caacaaggguuucuuugac

SEQ ID NO: 970311 - RNA, 19 nt, Homo sapiens
uacauucucuccugucuuu

SEQ ID NO: 970312 - RNA, 19 nt, Homo sapiens
ucaaggagguagacaagga

SEQ ID NO: 970313 - RNA, 19 nt, Homo sapiens
aagggaagcugaugcugua

SEQ ID NO: 970314 - RNA, 19 nt, Homo sapiens
agaaagagagucaagaauu

SEQ ID NO: 970315 - RNA, 19 nt, Homo sapiens
gaaagcagaguucauccaa

SEQ ID NO: 970316 - RNA, 19 nt, Homo sapiens
cagagacacugacuccauu

SEQ ID NO: 970317 - RNA, 19 nt, Homo sapiens
gcaaugaggcaguguagau

SEQ ID NO: 970318 - RNA, 19 nt, Homo sapiens
gaaaggcccaggaacaugu

SEQ ID NO: 970319 - RNA, 19 nt, Homo sapiens
ugaaagagaacuacuaaca

SEQ ID NO: 970320 - RNA, 19 nt, Homo sapiens
gggaacaauucuugacguu

SEQ ID NO: 970321 - RNA, 19 nt, Homo sapiens
agauggcacucuuugauuu

SEQ ID NO: 970322 - RNA, 19 nt, Homo sapiens
caucaugagugguccaaga

SEQ ID NO: 970323 - RNA, 19 nt, Homo sapiens
aagcagaguucauccaaga

SEQ ID NO: 970324 - RNA, 19 nt, Homo sapiens
gagaacuacuaacaacguu

SEQ ID NO: 970325 - RNA, 19 nt, Homo sapiens
aaagagaacuacuaacaac

SEQ ID NO: 970326 - RNA, 19 nt, Homo sapiens
acacugacuccauuaauaa

SEQ ID NO: 970327 - RNA, 19 nt, Homo sapiens
gcuaggguguuagauauau

SEQ ID NO: 970328 - RNA, 19 nt, Homo sapiens
caauagaggcuagauuuga

SEQ ID NO: 970329 - RNA, 19 nt, Homo sapiens
ccucaugacuagaacuaaa

SEQ ID NO: 970330 - RNA, 19 nt, Homo sapiens
gaggcaguguagaugaaua

SEQ ID NO: 970331 - RNA, 19 nt, Homo sapiens
uagaaggcaucaaagaguu

SEQ ID NO: 970332 - RNA, 19 nt, Homo sapiens
caguugagcuuuggauuau

SEQ ID NO: 970333 - RNA, 19 nt, Homo sapiens
aauagaggcuagauuugaa

SEQ ID NO: 970334 - RNA, 19 nt, Homo sapiens
gaucaucacauaugguaga

SEQ ID NO: 970335 - RNA, 19 nt, Homo sapiens
ggagguagacaaggaauug

SEQ ID NO: 970336 - RNA, 19 nt, Homo sapiens
uacaauagaggcuagauuu

SEQ ID NO: 970337 - RNA, 19 nt, Homo sapiens
uggaagacauggacaaauc

SEQ ID NO: 970338 - RNA, 19 nt, Homo sapiens
ccacugacuugaaauaacu

SEQ ID NO: 970339 - RNA, 19 nt, Homo sapiens
uggauuaucuuccucuuca

SEQ ID NO: 970340 - RNA, 19 nt, Homo sapiens
gagugaagauaacuuaaac

SEQ ID NO: 970341 - RNA, 19 nt, Homo sapiens
uguaaucuuuggacuugua

SEQ ID NO: 970342 - RNA, 19 nt, Homo sapiens
aaagaaagagagucaagaa

SEQ ID NO: 970343 - RNA, 19 nt, Homo sapiens
ccaggaacauguuuauuuu

SEQ ID NO: 970344 - RNA, 19 nt, Homo sapiens
gagccacugacuugaaaua

SEQ ID NO: 970345 - RNA, 19 nt, Homo sapiens
uaugguagauauucacaug

SEQ ID NO: 970346 - RNA, 19 nt, Homo sapiens
caaauaaucaucuccaaac

SEQ ID NO: 970347 - RNA, 19 nt, Homo sapiens
acaaauugcuguggauuca

SEQ ID NO: 970348 - RNA, 19 nt, Homo sapiens
gacacccauucuucuguua

SEQ ID NO: 970349 - RNA, 19 nt, Homo sapiens
gaaacaaugagaauacucu

SEQ ID NO: 970350 - RNA, 19 nt, Homo sapiens
gagacuggaauccuacuuu

SEQ ID NO: 970351 - RNA, 19 nt, Homo sapiens
cacauggaguuucaaauuc

SEQ ID NO: 970352 - RNA, 19 nt, Homo sapiens
gucaugcuguuuaauagaa

SEQ ID NO: 970353 - RNA, 19 nt, Homo sapiens
gaacacagagccaaaauuc

SEQ ID NO: 970354 - RNA, 19 nt, Homo sapiens
uaaaguguauugggaaagu

SEQ ID NO: 970355 - RNA, 19 nt, Homo sapiens
gauacaaauugcuguggau

SEQ ID NO: 970356 - RNA, 19 nt, Homo sapiens
uaauuuaccuuagcagaca

SEQ ID NO: 970357 - RNA, 19 nt, Homo sapiens
gcaaggaagaugccugugu

SEQ ID NO: 970358 - RNA, 19 nt, Homo sapiens
ggaauguuugcuaccuuua

SEQ ID NO: 970359 - RNA, 19 nt, Homo sapiens
ucaaaugcacuccgauuau

SEQ ID NO: 970360 - RNA, 19 nt, Homo sapiens
cccaggaacauguuuauuu

SEQ ID NO: 970361 - RNA, 19 nt, Homo sapiens
agacuggaauccuacuuug

SEQ ID NO: 970362 - RNA, 19 nt, Homo sapiens
acaguugagcuuuggauua

SEQ ID NO: 970363 - RNA, 19 nt, Homo sapiens
uggcuaggguguuagauau

SEQ ID NO: 970364 - RNA, 19 nt, Homo sapiens
ccaaaauucuuaucaccua

SEQ ID NO: 970365 - RNA, 19 nt, Homo sapiens
gaggaauguuugcuaccuu

SEQ ID NO: 970366 - RNA, 19 nt, Homo sapiens
agaauacucugugcauuuc

SEQ ID NO: 970367 - RNA, 19 nt, Homo sapiens
uuauuugccuccaguuauu

SEQ ID NO: 970368 - RNA, 19 nt, Homo sapiens
ugaaguuaccuaucugaaa

SEQ ID NO: 970369 - RNA, 19 nt, Homo sapiens
gagccauccuucccugaga

SEQ ID NO: 970370 - RNA, 19 nt, Homo sapiens
caggagugaagauaacuua

SEQ ID NO: 970371 - RNA, 19 nt, Homo sapiens
ugaaucggguuguacugaa

SEQ ID NO: 970372 - RNA, 19 nt, Homo sapiens
ucuuugggaugcaucuuua

SEQ ID NO: 970373 - RNA, 19 nt, Homo sapiens
guaaucauagccuguuuau

SEQ ID NO: 970374 - RNA, 19 nt, Homo sapiens
gcaaagacaaguaguauua

SEQ ID NO: 970375 - RNA, 19 nt, Homo sapiens
gaccaaaucucuuucauga

SEQ ID NO: 970376 - RNA, 19 nt, Homo sapiens
gaauggcuaugcauaauaa

SEQ ID NO: 970377 - RNA, 19 nt, Homo sapiens
cagaagagguggaggauuu

SEQ ID NO: 970378 - RNA, 19 nt, Homo sapiens
gcaaaugcaccgcuuguua

SEQ ID NO: 970379 - RNA, 19 nt, Homo sapiens
uaccaaagcuggauuuauu

SEQ ID NO: 970380 - RNA, 19 nt, Homo sapiens
caacuucuauagucgaaua

SEQ ID NO: 970381 - RNA, 19 nt, Homo sapiens
acaaguggcuuaagcuaua

SEQ ID NO: 970382 - RNA, 19 nt, Homo sapiens
ugaaucagcuggagaagaa

SEQ ID NO: 970383 - RNA, 19 nt, Homo sapiens
gcagagcaaugcaaccuuu

SEQ ID NO: 970384 - RNA, 19 nt, Homo sapiens
caaaagagguuguuaauag

SEQ ID NO: 970385 - RNA, 19 nt, Homo sapiens
gcaauacuggaaacaauua

SEQ ID NO: 970386 - RNA, 19 nt, Homo sapiens
gggaugagauguugcagaa

SEQ ID NO: 970387 - RNA, 19 nt, Homo sapiens
gaguuuaugugcacaguuu

SEQ ID NO: 970388 - RNA, 19 nt, Homo sapiens
ggaaugcuguugcagaaug

SEQ ID NO: 970389 - RNA, 19 nt, Homo sapiens
gauuaaaccucaugcaaca

SEQ ID NO: 970390 - RNA, 19 nt, Homo sapiens
guucaggaauuauacagua

SEQ ID NO: 970391 - RNA, 19 nt, Homo sapiens
caagacaguuuacaagaau

SEQ ID NO: 970392 - RNA, 19 nt, Homo sapiens
gagcagauccugaagauag

SEQ ID NO: 970393 - RNA, 19 nt, Homo sapiens
ugaagaagccauugaauau

SEQ ID NO: 970394 - RNA, 19 nt, Homo sapiens
cagcuaauguugcuaaguu

SEQ ID NO: 970395 - RNA, 19 nt, Homo sapiens
gaacgaagacgaaauucug

SEQ ID NO: 970396 - RNA, 19 nt, Homo sapiens
gagagcagauccugaagau

SEQ ID NO: 970397 - RNA, 19 nt, Homo sapiens
caaguaguauuaucggaaa

SEQ ID NO: 970398 - RNA, 19 nt, Homo sapiens
caaaugcaccgcuuguuaa

SEQ ID NO: 970399 - RNA, 19 nt, Homo sapiens
aacaaaggcuuaacaguga

SEQ ID NO: 970400 - RNA, 19 nt, Homo sapiens
caacgagggagccgauuua

SEQ ID NO: 970401 - RNA, 19 nt, Homo sapiens
gaagaaaccgaaccacaga

SEQ ID NO: 970402 - RNA, 19 nt, Homo sapiens
agacucagauucagaaguu

SEQ ID NO: 970403 - RNA, 19 nt, Homo sapiens
cgcagaagcugacaacauu

SEQ ID NO: 970404 - RNA, 19 nt, Homo sapiens
ggacuucguuguuccuuca

SEQ ID NO: 970405 - RNA, 19 nt, Homo sapiens
aagaauaucuggaaagaca

SEQ ID NO: 970406 - RNA, 19 nt, Homo sapiens
gaagaagccauugaauauu

SEQ ID NO: 970407 - RNA, 19 nt, Homo sapiens
gacaauggcuugcaauacu

SEQ ID NO: 970408 - RNA, 19 nt, Homo sapiens
guucauggaugcuuucuuc

SEQ ID NO: 970409 - RNA, 19 nt, Homo sapiens
gcucagcucugugacauug

SEQ ID NO: 970410 - RNA, 19 nt, Homo sapiens
gaaucccucuucuuccuuu

SEQ ID NO: 970411 - RNA, 19 nt, Homo sapiens
uaaggaggcuggauuugau

SEQ ID NO: 970412 - RNA, 19 nt, Homo sapiens
gaugauguuuugcguauua

SEQ ID NO: 970413 - RNA, 19 nt, Homo sapiens
gaaaggaaagaugauguuu

SEQ ID NO: 970414 - RNA, 19 nt, Homo sapiens
acaagacaguuuacaagaa

SEQ ID NO: 970415 - RNA, 19 nt, Homo sapiens
caaaccggaugcugugauu

SEQ ID NO: 970416 - RNA, 19 nt, Homo sapiens
uggcagcgauucauuagaa

SEQ ID NO: 970417 - RNA, 19 nt, Homo sapiens
gaaccaggacuucguuguu

SEQ ID NO: 970418 - RNA, 19 nt, Homo sapiens
augcaccgcuuguuaauaa

SEQ ID NO: 970419 - RNA, 19 nt, Homo sapiens
uacagacagucaucaauaa

SEQ ID NO: 970420 - RNA, 19 nt, Homo sapiens
gaaagggaaauacagcauu

SEQ ID NO: 970421 - RNA, 19 nt, Homo sapiens
accaagaacuguugaagaa

SEQ ID NO: 970422 - RNA, 19 nt, Homo sapiens
cagcauuucuuuccucuuc

SEQ ID NO: 970423 - RNA, 19 nt, Homo sapiens
gcaaugcaaccuuuauuca

SEQ ID NO: 970424 - RNA, 19 nt, Homo sapiens
gagcaucuaacgccuauga

SEQ ID NO: 970425 - RNA, 19 nt, Homo sapiens
gagagacaauggcuugcaa

SEQ ID NO: 970426 - RNA, 19 nt, Homo sapiens
ggagcaaagacaaguagua

SEQ ID NO: 970427 - RNA, 19 nt, Homo sapiens
acaagaauaucuggaaaga

SEQ ID NO: 970428 - RNA, 19 nt, Homo sapiens
cggaugcugugauuaguaa

SEQ ID NO: 970429 - RNA, 19 nt, Homo sapiens
gaaauuccauuaguagacu

SEQ ID NO: 970430 - RNA, 19 nt, Homo sapiens
uuacagacagucaucaaua

SEQ ID NO: 970431 - RNA, 19 nt, Homo sapiens
gagacaauggcuugcaaua

SEQ ID NO: 970432 - RNA, 19 nt, Homo sapiens
gagcaaagacaaguaguau

SEQ ID NO: 970433 - RNA, 19 nt, Homo sapiens
gguuacaccuggaaugaug

SEQ ID NO: 970434 - RNA, 19 nt, Homo sapiens
ucaaggaaguaaacacaau

SEQ ID NO: 970435 - RNA, 19 nt, Homo sapiens
gaacugaacgaagacgaaa

SEQ ID NO: 970436 - RNA, 19 nt, Homo sapiens
agacagucaucaauaauca

SEQ ID NO: 970437 - RNA, 19 nt, Homo sapiens
aaaaugaacugaacgaaga

SEQ ID NO: 970438 - RNA, 19 nt, Homo sapiens
cgagggagccgauuuagau

SEQ ID NO: 970439 - RNA, 19 nt, Homo sapiens
guggaaugcuguugcagaa

SEQ ID NO: 970440 - RNA, 19 nt, Homo sapiens
gcacuuuaggcuugauuaa

SEQ ID NO: 970441 - RNA, 19 nt, Homo sapiens
uugcagccauuuagagaua

SEQ ID NO: 970442 - RNA, 19 nt, Homo sapiens
uuagauaaauggcaagcaa

SEQ ID NO: 970443 - RNA, 19 nt, Homo sapiens
aaagagagcagauccugaa

SEQ ID NO: 970444 - RNA, 19 nt, Homo sapiens
guauggcagcgauucauua

SEQ ID NO: 970445 - RNA, 19 nt, Homo sapiens
ugaagaggaugcagcuaau

SEQ ID NO: 970446 - RNA, 19 nt, Homo sapiens
gagcaaugcaaccuuuauu

SEQ ID NO: 970447 - RNA, 19 nt, Homo sapiens
gaggaaaacucaagauaca

SEQ ID NO: 970448 - RNA, 19 nt, Homo sapiens
gguccuagguacuggaaug

SEQ ID NO: 970449 - RNA, 19 nt, Homo sapiens
ggaugaggcagcugaagaa

SEQ ID NO: 970450 - RNA, 19 nt, Homo sapiens
gaaaagacauuggcauuac

SEQ ID NO: 970451 - RNA, 19 nt, Homo sapiens
ggaaagacaacauuuagcu

SEQ ID NO: 970452 - RNA, 19 nt, Homo sapiens
ggcuuaagcuauauucuag

SEQ ID NO: 970453 - RNA, 19 nt, Homo sapiens
gcagaauggagacgauuga

SEQ ID NO: 970454 - RNA, 19 nt, Homo sapiens
guuccuaacuccugagcaa

SEQ ID NO: 970455 - RNA, 19 nt, Homo sapiens
gaagaacaaacaagacagu

SEQ ID NO: 970456 - RNA, 19 nt, Homo sapiens
gaguuugucucuuuuauga

SEQ ID NO: 970457 - RNA, 19 nt, Homo sapiens
gaagacgaaauucugcauu

SEQ ID NO: 970458 - RNA, 19 nt, Homo sapiens
auacauauguucacgucaa

SEQ ID NO: 970459 - RNA, 19 nt, Homo sapiens
gaggcuggauuugaucuga

SEQ ID NO: 970460 - RNA, 19 nt, Homo sapiens
cuaaguucauggaugcuuu

SEQ ID NO: 970461 - RNA, 19 nt, Homo sapiens
caccuggaaugaugaagaa

SEQ ID NO: 970462 - RNA, 19 nt, Homo sapiens
aaugcaaccuuuauucaga

SEQ ID NO: 970463 - RNA, 19 nt, Homo sapiens
gcuuaacagugauugaugu

SEQ ID NO: 970464 - RNA, 19 nt, Homo sapiens
uugaagaagccauugaaua

SEQ ID NO: 970465 - RNA, 19 nt, Homo sapiens
agaaguuagugaagaauca

SEQ ID NO: 970466 - RNA, 19 nt, Homo sapiens
agauaaaugugaaccuguu

SEQ ID NO: 970467 - RNA, 19 nt, Homo sapiens
ggaccuguuuuguuagaua

SEQ ID NO: 970468 - RNA, 19 nt, Homo sapiens
ugaauggcuaugcauaaua

SEQ ID NO: 970469 - RNA, 19 nt, Homo sapiens
ugacacaggugaagaaaau

SEQ ID NO: 970470 - RNA, 19 nt, Homo sapiens
gaccaagaacuguugaaga

SEQ ID NO: 970471 - RNA, 19 nt, Homo sapiens
acacaauccucccucugaa

SEQ ID NO: 970472 - RNA, 19 nt, Homo sapiens
cuaguuguaucucaaggaa

SEQ ID NO: 970473 - RNA, 19 nt, Homo sapiens
gcagaacaaaggcuuaaca

SEQ ID NO: 970474 - RNA, 19 nt, Homo sapiens
gaucuuagguuacauaaag

SEQ ID NO: 970475 - RNA, 19 nt, Homo sapiens
aaacagagguggaaauaga

SEQ ID NO: 970476 - RNA, 19 nt, Homo sapiens
guugggagguuauuuauuu

SEQ ID NO: 970477 - RNA, 19 nt, Homo sapiens
gaggagcggucuaagcaua

SEQ ID NO: 970478 - RNA, 19 nt, Homo sapiens
ggaaauugacuuagacaaa

SEQ ID NO: 970479 - RNA, 19 nt, Homo sapiens
ccaaagacuuguuucagaa

SEQ ID NO: 970480 - RNA, 19 nt, Homo sapiens
gaucuaacuugcaguguau

SEQ ID NO: 970481 - RNA, 19 nt, Homo sapiens
gaaauugacuuagacaaac

SEQ ID NO: 970482 - RNA, 19 nt, Homo sapiens
ggucuaagcauaagagaaa

SEQ ID NO: 970483 - RNA, 19 nt, Homo sapiens
gagugaauaugaucagauu

SEQ ID NO: 970484 - RNA, 19 nt, Homo sapiens
gaucagauuucuccaccaa

SEQ ID NO: 970485 - RNA, 19 nt, Homo sapiens
gcgaggaaauugacuuaga

SEQ ID NO: 970486 - RNA, 19 nt, Homo sapiens
gagaagauaccacauugaa

SEQ ID NO: 970487 - RNA, 19 nt, Homo sapiens
gccaaagacuuguuucaga

SEQ ID NO: 970488 - RNA, 19 nt, Homo sapiens
gaacuuuguuuacagauac

SEQ ID NO: 970489 - RNA, 19 nt, Homo sapiens
gugaauagguucuuuaacu

SEQ ID NO: 970490 - RNA, 19 nt, Homo sapiens
gaacaaggccaagaaagga

SEQ ID NO: 970491 - RNA, 19 nt, Homo sapiens
cagagaagauaccacauug

SEQ ID NO: 970492 - RNA, 19 nt, Homo sapiens
ggaaaccuguggguacaaa

SEQ ID NO: 970493 - RNA, 19 nt, Homo sapiens
uacccaagaucaugcaaua

SEQ ID NO: 970494 - RNA, 19 nt, Homo sapiens
uaacaaaggccuaguaaac

SEQ ID NO: 970495 - RNA, 19 nt, Homo sapiens
gauguagucucuaagaaag

SEQ ID NO: 970496 - RNA, 19 nt, Homo sapiens
acaaacagauacaucagaa

SEQ ID NO: 970497 - RNA, 19 nt, Homo sapiens
ucagauaacaguaccagua

SEQ ID NO: 970498 - RNA, 19 nt, Homo sapiens
acaaaggccuaguaaacaa

SEQ ID NO: 970499 - RNA, 19 nt, Homo sapiens
gcucaccaguuauugugua

SEQ ID NO: 970500 - RNA, 19 nt, Homo sapiens
ggaguaguguuacaguuca

SEQ ID NO: 970501 - RNA, 19 nt, Homo sapiens
gacagcagauugagacuag

SEQ ID NO: 970502 - RNA, 19 nt, Homo sapiens
ggaccagucuauucuugga

SEQ ID NO: 970503 - RNA, 19 nt, Homo sapiens
acaagagcauccaaagaaa

SEQ ID NO: 970504 - RNA, 19 nt, Homo sapiens
cacaagagcauccaaagaa

SEQ ID NO: 970505 - RNA, 19 nt, Homo sapiens
gaaaaucgguugccucagu

SEQ ID NO: 970506 - RNA, 19 nt, Homo sapiens
ccaagaucaugcaauauuc

SEQ ID NO: 970507 - RNA, 19 nt, Homo sapiens
gagugagaguggagaauug

SEQ ID NO: 970508 - RNA, 19 nt, Homo sapiens
ggaaauagaaaccguacau

SEQ ID NO: 970509 - RNA, 19 nt, Homo sapiens
gaaaacagagguggaaaua

SEQ ID NO: 970510 - RNA, 19 nt, Homo sapiens
gcuuagagccaaagacuug

SEQ ID NO: 970511 - RNA, 19 nt, Homo sapiens
uuaaugaccuuugcacaau

SEQ ID NO: 970512 - RNA, 19 nt, Homo sapiens
gaauagguucuuuaacuuc

SEQ ID NO: 970513 - RNA, 19 nt, Homo sapiens
aaacagauacaucagaaga

SEQ ID NO: 970514 - RNA, 19 nt, Homo sapiens
aagcacuucuccucagaua

SEQ ID NO: 970515 - RNA, 19 nt, Homo sapiens
agacugaacuuuguuuaca

SEQ ID NO: 970516 - RNA, 19 nt, Homo sapiens
gauuggguuuguuauaguu

SEQ ID NO: 970517 - RNA, 19 nt, Homo sapiens
aaagaugucuguggaguag

SEQ ID NO: 970518 - RNA, 19 nt, Homo sapiens
ggaacaaggccaagaaagg

SEQ ID NO: 970519 - RNA, 19 nt, Homo sapiens
cagaaaagcuuaagaaucg

SEQ ID NO: 970520 - RNA, 19 nt, Homo sapiens
agaucuaacuugcagugua

SEQ ID NO: 970521 - RNA, 19 nt, Homo sapiens
guucauaccacuuuucuua

SEQ ID NO: 970522 - RNA, 19 nt, Homo sapiens
guacaaaggagagguuaau

SEQ ID NO: 970523 - RNA, 19 nt, Homo sapiens
gcacuucuccucagauaac

SEQ ID NO: 970524 - RNA, 19 nt, Homo sapiens
uagaauguuugaccagaga

SEQ ID NO: 970525 - RNA, 19 nt, Homo sapiens
caaaguguuuagcaugcuu

SEQ ID NO: 970526 - RNA, 19 nt, Homo sapiens
ggugagagcuugguuuuau

SEQ ID NO: 970527 - RNA, 19 nt, Homo sapiens
gagcauccaaagaaagaaa

SEQ ID NO: 970528 - RNA, 19 nt, Homo sapiens
gagcuugguuuuaugauau

SEQ ID NO: 970529 - RNA, 19 nt, Homo sapiens
gaaauagaaaccguacaug

SEQ ID NO: 970530 - RNA, 19 nt, Homo sapiens
ucagagaagauaccacauu

SEQ ID NO: 970531 - RNA, 19 nt, Homo sapiens
gaaaggggacuauuuggaa

SEQ ID NO: 970532 - RNA, 19 nt, Homo sapiens
gcuggaaaguggaaaauga

SEQ ID NO: 970533 - RNA, 19 nt, Homo sapiens
ccacguauagaauguuuga

SEQ ID NO: 970534 - RNA, 19 nt, Homo sapiens
ggacagaggaggaaaugcu

SEQ ID NO: 970535 - RNA, 19 nt, Homo sapiens
cuaagaaagaggaacguaa

SEQ ID NO: 970536 - RNA, 19 nt, Homo sapiens
caaaggccuaguaaacaaa

SEQ ID NO: 970537 - RNA, 19 nt, Homo sapiens
cccaagaucaugcaauauu

SEQ ID NO: 970538 - RNA, 19 nt, Homo sapiens
gugaauaugaucagauuuc

SEQ ID NO: 970539 - RNA, 19 nt, Homo sapiens
ugcacaaucuguuucuuga

SEQ ID NO: 970540 - RNA, 19 nt, Homo sapiens
gaaaggacagaggaggaaa

SEQ ID NO: 970541 - RNA, 19 nt, Homo sapiens
ucacaugguguagaacaua

SEQ ID NO: 970542 - RNA, 19 nt, Homo sapiens
cugaaaccauccagaccua

SEQ ID NO: 970543 - RNA, 19 nt, Homo sapiens
uaagaaagaggaacguaag

SEQ ID NO: 970544 - RNA, 19 nt, Homo sapiens
aaauagaaaccguacaugu

SEQ ID NO: 970545 - RNA, 19 nt, Homo sapiens
aaacacaagagcauccaaa

SEQ ID NO: 970546 - RNA, 19 nt, Homo sapiens
uggcucacaugguguagaa

SEQ ID NO: 970547 - RNA, 19 nt, Homo sapiens
gcccaugacagcagauuga

SEQ ID NO: 970548 - RNA, 19 nt, Homo sapiens
guguagaacauagaguuua

SEQ ID NO: 970549 - RNA, 19 nt, Homo sapiens
gcaauauuccacaaacagu

SEQ ID NO: 970550 - RNA, 19 nt, Homo sapiens
ccagucuauucuuggauuu

SEQ ID NO: 970551 - RNA, 19 nt, Homo sapiens
guacagaaaagcuuaagaa

SEQ ID NO: 970552 - RNA, 19 nt, Homo sapiens
gaaaaggcacccagaggaa

SEQ ID NO: 970553 - RNA, 19 nt, Homo sapiens
gaggauuaaugaccuuugc

SEQ ID NO: 970554 - RNA, 19 nt, Homo sapiens
aaaggaacaaggccaagaa

SEQ ID NO: 970555 - RNA, 19 nt, Homo sapiens
ugacuuagacaaacacaag

SEQ ID NO: 970556 - RNA, 19 nt, Homo sapiens
cgaggaaauugacuuagac

SEQ ID NO: 970557 - RNA, 19 nt, Homo sapiens
acaagcacuucuccucaga

SEQ ID NO: 970558 - RNA, 19 nt, Homo sapiens
gguguagaacauagaguuu

SEQ ID NO: 970559 - RNA, 19 nt, Homo sapiens
ucgguugccucagugguua

SEQ ID NO: 970560 - RNA, 19 nt, Homo sapiens
acaaaggagagguuaauuc

SEQ ID NO: 970561 - RNA, 19 nt, Homo sapiens
gagccaaagacuuguuuca

SEQ ID NO: 970562 - RNA, 19 nt, Homo sapiens
guggaguaguguuacaguu

SEQ ID NO: 970563 - RNA, 19 nt, Homo sapiens
ucuguugggagguuauuua

SEQ ID NO: 970564 - RNA, 19 nt, Homo sapiens
ccagaggaaggcagagaaa

SEQ ID NO: 970565 - RNA, 19 nt, Homo sapiens
caaaggagagguuaauucc

SEQ ID NO: 970566 - RNA, 19 nt, Homo sapiens
ucuaacaaaggccuaguaa

SEQ ID NO: 970567 - RNA, 19 nt, Homo sapiens
agauguagucucuaagaaa

SEQ ID NO: 970568 - RNA, 19 nt, Homo sapiens
uuaagaaucgaaaggagaa

SEQ ID NO: 970569 - RNA, 19 nt, Homo sapiens
acacaagagcauccaaaga

SEQ ID NO: 970570 - RNA, 19 nt, Homo sapiens
ucaucaagccagucacaaa

SEQ ID NO: 970571 - RNA, 19 nt, Homo sapiens
guacucaucaagccaguca

SEQ ID NO: 970572 - RNA, 19 nt, Homo sapiens
gaugaaaggggacuauuug

SEQ ID NO: 970573 - RNA, 19 nt, Homo sapiens
auagaaaccguacauguca

SEQ ID NO: 970574 - RNA, 19 nt, Homo sapiens
cgaauuuccuggcuuauaa

SEQ ID NO: 970575 - RNA, 19 nt, Homo sapiens
caagagagauaucaacaga

SEQ ID NO: 970576 - RNA, 19 nt, Homo sapiens
gcagacaccucuucagcuu

SEQ ID NO: 970577 - RNA, 19 nt, Homo sapiens
ucuccuugcuuucauauua

SEQ ID NO: 970578 - RNA, 19 nt, Homo sapiens
ugauggauaugcuuaagua

SEQ ID NO: 970579 - RNA, 19 nt, Homo sapiens
ggagagccaugcguacuuu

SEQ ID NO: 970580 - RNA, 19 nt, Homo sapiens
gaacaagcgucgcaaugag

SEQ ID NO: 970581 - RNA, 19 nt, Homo sapiens
uaucgaauuuccuggcuua

SEQ ID NO: 970582 - RNA, 19 nt, Homo sapiens
cagcugauaugaaugaaug

SEQ ID NO: 970583 - RNA, 19 nt, Homo sapiens
ggaacaagcgucgcaauga

SEQ ID NO: 970584 - RNA, 19 nt, Homo sapiens
ggaaccuuguuuacuaauu

SEQ ID NO: 970585 - RNA, 19 nt, Homo sapiens
uuaaggcccugcacugaaa

SEQ ID NO: 970586 - RNA, 19 nt, Homo sapiens
agacaccucuucagcuuga

SEQ ID NO: 970587 - RNA, 19 nt, Homo sapiens
gaaugaaugcugucugugu

SEQ ID NO: 970588 - RNA, 19 nt, Homo sapiens
caacugaaauaugauggau

SEQ ID NO: 970589 - RNA, 19 nt, Homo sapiens
agagagauaucaacagaag

SEQ ID NO: 970590 - RNA, 19 nt, Homo sapiens
uggauaugcuuaaguacaa

SEQ ID NO: 970591 - RNA, 19 nt, Homo sapiens
gcaaugaggacucucuaca

SEQ ID NO: 970592 - RNA, 19 nt, Homo sapiens
gacuauauggcaacucuuu

SEQ ID NO: 970593 - RNA, 19 nt, Homo sapiens
cucggaaccuuguuuacua

SEQ ID NO: 970594 - RNA, 19 nt, Homo sapiens
acucuuugcuguccucauu

SEQ ID NO: 970595 - RNA, 19 nt, Homo sapiens
ucggaaccuuguuuacuaa

SEQ ID NO: 970596 - RNA, 19 nt, Homo sapiens
uuacuaauuuccacugcuu

SEQ ID NO: 970597 - RNA, 19 nt, Homo sapiens
gaauuuccuggcuuauaaa

SEQ ID NO: 970598 - RNA, 19 nt, Homo sapiens
cuuaguuucuccuugcuuu

SEQ ID NO: 970599 - RNA, 19 nt, Homo sapiens
uuuccuggcuuauaaacuu

SEQ ID NO: 970600 - RNA, 19 nt, Homo sapiens
uacaacugauggcaugaaa

SEQ ID NO: 970601 - RNA, 19 nt, Homo sapiens
ucccugaacuuagcuaaau

SEQ ID NO: 970602 - RNA, 19 nt, Homo sapiens
caaaucaagagagauauca

SEQ ID NO: 970603 - RNA, 19 nt, Homo sapiens
gagccaugcguacuuucua

SEQ ID NO: 970604 - RNA, 19 nt, Homo sapiens
ugccaaaucaagagagaua

SEQ ID NO: 970605 - RNA, 19 nt, Homo sapiens
aauguugucccugaacuua

SEQ ID NO: 970606 - RNA, 19 nt, Homo sapiens
gcaacugaaauaugaugga

SEQ ID NO: 970607 - RNA, 19 nt, Homo sapiens
agagauaucaacagaagga

SEQ ID NO: 970608 - RNA, 19 nt, Homo sapiens
gaauguugucccugaacuu

SEQ ID NO: 970609 - RNA, 19 nt, Homo sapiens
caaguugcagcugauauga

SEQ ID NO: 970610 - RNA, 19 nt, Homo sapiens
uuucauuuguggugagauu

SEQ ID NO: 970611 - RNA, 19 nt, Homo sapiens
uguccucauuguacucuuu

SEQ ID NO: 970612 - RNA, 19 nt, Homo sapiens
ucaaguugcagcugauaug

SEQ ID NO: 970613 - RNA, 19 nt, Homo sapiens
agccaugcguacuuucuaa

SEQ ID NO: 970614 - RNA, 19 nt, Homo sapiens
guacaacugauggcaugaa

SEQ ID NO: 970615 - RNA, 19 nt, Homo sapiens
aguugcagcugauaugaau

SEQ ID NO: 970616 - RNA, 19 nt, Homo sapiens
guuucuccuugcuuucaua

SEQ ID NO: 970617 - RNA, 19 nt, Homo sapiens
ucgaauuuccuggcuuaua

SEQ ID NO: 970618 - RNA, 19 nt, Homo sapiens
caacaaaauucagcagaca

SEQ ID NO: 970619 - RNA, 19 nt, Homo sapiens
cuggaucuauuugugauga

SEQ ID NO: 970620 - RNA, 19 nt, Homo sapiens
gaucuauuugugaugacua

SEQ ID NO: 970621 - RNA, 19 nt, Homo sapiens
aggcaugugugacuguuuc

SEQ ID NO: 970622 - RNA, 19 nt, Homo sapiens
gaacuccaacuggcagaca

SEQ ID NO: 970623 - RNA, 19 nt, Homo sapiens
ccaaaucaagagagauauc

SEQ ID NO: 970624 - RNA, 19 nt, Homo sapiens
augaaugaaugcugucugu

SEQ ID NO: 970625 - RNA, 19 nt, Homo sapiens
gcucuuaccgaagcaacaa

SEQ ID NO: 970626 - RNA, 19 nt, Homo sapiens
uaugauggauaugcuuaag

SEQ ID NO: 970627 - RNA, 19 nt, Homo sapiens
ugaguucuucaccaucuuu

SEQ ID NO: 970628 - RNA, 19 nt, Homo sapiens
ugaauguugucccugaacu

SEQ ID NO: 970629 - RNA, 19 nt, Homo sapiens
aaugaauguugucccugaa

SEQ ID NO: 970630 - RNA, 19 nt, Homo sapiens
gcucggaaccuuguuuacu

SEQ ID NO: 970631 - RNA, 19 nt, Homo sapiens
gaaugcugucuguguggaa

SEQ ID NO: 970632 - RNA, 19 nt, Homo sapiens
uugcagcugauaugaauga

SEQ ID NO: 970633 - RNA, 19 nt, Homo sapiens
ggaagaaccugauaguaaa

SEQ ID NO: 970634 - RNA, 19 nt, Homo sapiens
gagaagaucuugagugaag

SEQ ID NO: 970635 - RNA, 19 nt, Homo sapiens
gaagagagccaaugaggaa

SEQ ID NO: 970636 - RNA, 19 nt, Homo sapiens
gaagaaauccaaagcaaga

SEQ ID NO: 970637 - RNA, 19 nt, Homo sapiens
gaaacugguugcucaaaug

SEQ ID NO: 970638 - RNA, 19 nt, Homo sapiens
guaaaugcauggaaaugaa

SEQ ID NO: 970639 - RNA, 19 nt, Homo sapiens
ggaggaggaugaagaguug

SEQ ID NO: 970640 - RNA, 19 nt, Homo sapiens
gaagacaaguccaaagagu

SEQ ID NO: 970641 - RNA, 19 nt, Homo sapiens
ugaaacagcucagcaauuc

SEQ ID NO: 970642 - RNA, 19 nt, Homo sapiens
gaagaaggaagaagcaauu

SEQ ID NO: 970643 - RNA, 19 nt, Homo sapiens
ggcagaggcuguccaaauu

SEQ ID NO: 970644 - RNA, 19 nt, Homo sapiens
gaagaggaguuuguuacuu

SEQ ID NO: 970645 - RNA, 19 nt, Homo sapiens
caccagaguuugccaauug

SEQ ID NO: 970646 - RNA, 19 nt, Homo sapiens
gguaacacaugaccaucua

SEQ ID NO: 970647 - RNA, 19 nt, Homo sapiens
ggagaacccucagaaacuu

SEQ ID NO: 970648 - RNA, 19 nt, Homo sapiens
uaaagaaacagcuucauga

SEQ ID NO: 970649 - RNA, 19 nt, Homo sapiens
gacacuaccucucgucuug

SEQ ID NO: 970650 - RNA, 19 nt, Homo sapiens
gaagcaggauccacagaau

SEQ ID NO: 970651 - RNA, 19 nt, Homo sapiens
gggaagagacuaaauaaca

SEQ ID NO: 970652 - RNA, 19 nt, Homo sapiens
cggaagaaccugauaguaa

SEQ ID NO: 970653 - RNA, 19 nt, Homo sapiens
aagaggaguuuguuacuuu

SEQ ID NO: 970654 - RNA, 19 nt, Homo sapiens
gcagugacauaccuaaaca

SEQ ID NO: 970655 - RNA, 19 nt, Homo sapiens
caauugauccuucuuauuc

SEQ ID NO: 970656 - RNA, 19 nt, Homo sapiens
gaagguagaggauggaguu

SEQ ID NO: 970657 - RNA, 19 nt, Homo sapiens
gaccuugcaugguagagua

SEQ ID NO: 970658 - RNA, 19 nt, Homo sapiens
gcaauuccauaaguaaaug

SEQ ID NO: 970659 - RNA, 19 nt, Homo sapiens
ccacaacccuucccacauc

SEQ ID NO: 970660 - RNA, 19 nt, Homo sapiens
gagaagacaaguccaaaga

SEQ ID NO: 970661 - RNA, 19 nt, Homo sapiens
gaggagagcagguuucaga

SEQ ID NO: 970662 - RNA, 19 nt, Homo sapiens
ggaagagacuaaauaacag

SEQ ID NO: 970663 - RNA, 19 nt, Homo sapiens
caugccaagugaaauaaua

SEQ ID NO: 970664 - RNA, 19 nt, Homo sapiens
gcucagcaauuccauaagu

SEQ ID NO: 970665 - RNA, 19 nt, Homo sapiens
uagaagaaauccaaagcaa

SEQ ID NO: 970666 - RNA, 19 nt, Homo sapiens
ggaagaaggaugugugugu

SEQ ID NO: 970667 - RNA, 19 nt, Homo sapiens
gggacaguguaucaaauaa

SEQ ID NO: 970668 - RNA, 19 nt, Homo sapiens
agaaacagcuucaugaacu

SEQ ID NO: 970669 - RNA, 19 nt, Homo sapiens
ugugugggcuuuccuguuu

SEQ ID NO: 970670 - RNA, 19 nt, Homo sapiens
gaggaacacuggccaaagg

SEQ ID NO: 970671 - RNA, 19 nt, Homo sapiens
ggaaucauagugucaguga

SEQ ID NO: 970672 - RNA, 19 nt, Homo sapiens
ugaauugaauggagacguu

SEQ ID NO: 970673 - RNA, 19 nt, Homo sapiens
gggcuuuccuguuucuaaa

SEQ ID NO: 970674 - RNA, 19 nt, Homo sapiens
gcaaagauuggaccauguu

SEQ ID NO: 970675 - RNA, 19 nt, Homo sapiens
gccuggaacuuuagcaauu

SEQ ID NO: 970676 - RNA, 19 nt, Homo sapiens
agaaacagaugagaaacaa

SEQ ID NO: 970677 - RNA, 19 nt, Homo sapiens
caucaaaguaccacaguuu

SEQ ID NO: 970678 - RNA, 19 nt, Homo sapiens
acaggaggcucuuaaagug

SEQ ID NO: 970679 - RNA, 19 nt, Homo sapiens
ggagcccacuaccucauaa

SEQ ID NO: 970680 - RNA, 19 nt, Homo sapiens
gguuucagauccuuacuug

SEQ ID NO: 970681 - RNA, 19 nt, Homo sapiens
gagaacagaacacugaaga

SEQ ID NO: 970682 - RNA, 19 nt, Homo sapiens
gagaggaggaggaggauga

SEQ ID NO: 970683 - RNA, 19 nt, Homo sapiens
gcaccagaguuugccaauu

SEQ ID NO: 970684 - RNA, 19 nt, Homo sapiens
gagaacaacuagagcaaaa

SEQ ID NO: 970685 - RNA, 19 nt, Homo sapiens
ucagaaacuugccuucaug

SEQ ID NO: 970686 - RNA, 19 nt, Homo sapiens
guaacuacagcuucuauga

SEQ ID NO: 970687 - RNA, 19 nt, Homo sapiens
gauaguaaagcaagaacaa

SEQ ID NO: 970688 - RNA, 19 nt, Homo sapiens
aagaguaguugaacagcua

SEQ ID NO: 970689 - RNA, 19 nt, Homo sapiens
acagaaugcugacuuaaag

SEQ ID NO: 970690 - RNA, 19 nt, Homo sapiens
gcagugagaagaggaguuu

SEQ ID NO: 970691 - RNA, 19 nt, Homo sapiens
gaagagacuaaauaacaga

SEQ ID NO: 970692 - RNA, 19 nt, Homo sapiens
ccaaaccuguagacucuga

SEQ ID NO: 970693 - RNA, 19 nt, Homo sapiens
gcaauuguucauuccuaua

SEQ ID NO: 970694 - RNA, 19 nt, Homo sapiens
uaagaagagugcagugaca

SEQ ID NO: 970695 - RNA, 19 nt, Homo sapiens
ggccagagaccuaccauug

SEQ ID NO: 970696 - RNA, 19 nt, Homo sapiens
agaggaguuuguuacuuua

SEQ ID NO: 970697 - RNA, 19 nt, Homo sapiens
ggauguguguguccaggaa

SEQ ID NO: 970698 - RNA, 19 nt, Homo sapiens
gcaagaggcaagagcgaaa

SEQ ID NO: 970699 - RNA, 19 nt, Homo sapiens
gggcagaggcuguccaaau

SEQ ID NO: 970700 - RNA, 19 nt, Homo sapiens
gaguugggcuuguuugucu

SEQ ID NO: 970701 - RNA, 19 nt, Homo sapiens
gccaauugauccuucuuau

SEQ ID NO: 970702 - RNA, 19 nt, Homo sapiens
gaacagaacacugaagacu

SEQ ID NO: 970703 - RNA, 19 nt, Homo sapiens
caaagggugauauucauga

SEQ ID NO: 970704 - RNA, 19 nt, Homo sapiens
ucucagaaccuuuaauaug

SEQ ID NO: 970705 - RNA, 19 nt, Homo sapiens
gaagagaaacagaaguuac

SEQ ID NO: 970706 - RNA, 19 nt, Homo sapiens
gaugagaaacaaacagaga

SEQ ID NO: 970707 - RNA, 19 nt, Homo sapiens
gaaacagcuucaugaacuc

SEQ ID NO: 970708 - RNA, 19 nt, Homo sapiens
aaauucagguucaccagaa

SEQ ID NO: 970709 - RNA, 19 nt, Homo sapiens
uagcaauuguucauuccua

SEQ ID NO: 970710 - RNA, 19 nt, Homo sapiens
aacuacagcuucuaugauu

SEQ ID NO: 970711 - RNA, 19 nt, Homo sapiens
caagguaagaaacauugua

SEQ ID NO: 970712 - RNA, 19 nt, Homo sapiens
gaucaagguaagaaacauu

SEQ ID NO: 970713 - RNA, 19 nt, Homo sapiens
ccacagccacgauggguuu

SEQ ID NO: 970714 - RNA, 19 nt, Homo sapiens
guguguacaugcaaagauu

SEQ ID NO: 970715 - RNA, 19 nt, Homo sapiens
aguuaaaucucacacagaa

SEQ ID NO: 970716 - RNA, 19 nt, Homo sapiens
gagaagaggaguuuguuac

SEQ ID NO: 970717 - RNA, 19 nt, Homo sapiens
cagagaaaguggagaaggu

SEQ ID NO: 970718 - RNA, 19 nt, Homo sapiens
caaagauuggaccauguua

SEQ ID NO: 970719 - RNA, 19 nt, Homo sapiens
gaaaagcaaagccggauuu

SEQ ID NO: 970720 - RNA, 19 nt, Homo sapiens
acagaacacugaagacucu

SEQ ID NO: 970721 - RNA, 19 nt, Homo sapiens
cagcucagcaauuccauaa

SEQ ID NO: 970722 - RNA, 19 nt, Homo sapiens
gccaaagggugauauucau

SEQ ID NO: 970723 - RNA, 19 nt, Homo sapiens
gcagaggcuguccaaauug

SEQ ID NO: 970724 - RNA, 19 nt, Homo sapiens
aaacagaggcugaagaaac

SEQ ID NO: 970725 - RNA, 19 nt, Homo sapiens
gaaugcugacuuaaagaaa

SEQ ID NO: 970726 - RNA, 19 nt, Homo sapiens
ucagugaggucccgugagu

SEQ ID NO: 970727 - RNA, 19 nt, Homo sapiens
gguagaggauggaguugca

SEQ ID NO: 970728 - RNA, 19 nt, Homo sapiens
gaauggagacguuucuuuu

SEQ ID NO: 970729 - RNA, 19 nt, Homo sapiens
ggaauugagauuucaccaa

SEQ ID NO: 970730 - RNA, 19 nt, Homo sapiens
caccaugccaagugaaaua

SEQ ID NO: 970731 - RNA, 19 nt, Homo sapiens
gaacacugaagacucuaga

SEQ ID NO: 970732 - RNA, 19 nt, Homo sapiens
aaagaaacagcuucaugaa

SEQ ID NO: 970733 - RNA, 19 nt, Homo sapiens
gaacaaaccugaaaguaua

SEQ ID NO: 970734 - RNA, 19 nt, Homo sapiens
gcacauaacuuacgggaaa

SEQ ID NO: 970735 - RNA, 19 nt, Homo sapiens
gaacagacauuugauuuga

SEQ ID NO: 970736 - RNA, 19 nt, Homo sapiens
caaguuagcucaagcaaug

SEQ ID NO: 970737 - RNA, 19 nt, Homo sapiens
gguauuggcuuaacuaguu

SEQ ID NO: 970738 - RNA, 19 nt, Homo sapiens
gcaugugacuugcuucuuu

SEQ ID NO: 970739 - RNA, 19 nt, Homo sapiens
gaucagacuuugccagauu

SEQ ID NO: 970740 - RNA, 19 nt, Homo sapiens
gagaaaggcuggcuauaag

SEQ ID NO: 970741 - RNA, 19 nt, Homo sapiens
gagaaaggauaacaauaga

SEQ ID NO: 970742 - RNA, 19 nt, Homo sapiens
ggagaaaggcuggcuauaa

SEQ ID NO: 970743 - RNA, 19 nt, Homo sapiens
ugaaauuccucuguuguua

SEQ ID NO: 970744 - RNA, 19 nt, Homo sapiens
ggagaaaggauaacaauag

SEQ ID NO: 970745 - RNA, 19 nt, Homo sapiens
gagagcagcuucaggaauc

SEQ ID NO: 970746 - RNA, 19 nt, Homo sapiens
gcagcacacuuaacaucua

SEQ ID NO: 970747 - RNA, 19 nt, Homo sapiens
gaaaguaaucucaguuguu

SEQ ID NO: 970748 - RNA, 19 nt, Homo sapiens
cggcaaagccaaccacuua

SEQ ID NO: 970749 - RNA, 19 nt, Homo sapiens
ggagauuccucgaaacuag

SEQ ID NO: 970750 - RNA, 19 nt, Homo sapiens
guaaauagcccuucagcau

SEQ ID NO: 970751 - RNA, 19 nt, Homo sapiens
agaagaggcuguacaagug

SEQ ID NO: 970752 - RNA, 19 nt, Homo sapiens
gaaaggcuggcuauaagaa

SEQ ID NO: 970753 - RNA, 19 nt, Homo sapiens
caacuucucuacacagcuu

SEQ ID NO: 970754 - RNA, 19 nt, Homo sapiens
caugaugucuuuauugcaa

SEQ ID NO: 970755 - RNA, 19 nt, Homo sapiens
gaguaaaguucaauugagu

SEQ ID NO: 970756 - RNA, 19 nt, Homo sapiens
gggauuggcuguccuuaag

SEQ ID NO: 970757 - RNA, 19 nt, Homo sapiens
ggacagguguagagauaag

SEQ ID NO: 970758 - RNA, 19 nt, Homo sapiens
guucauaacacuugucauu

SEQ ID NO: 970759 - RNA, 19 nt, Homo sapiens
uaacacaccagguucauug

SEQ ID NO: 970760 - RNA, 19 nt, Homo sapiens
cgugaaagcugucaucgau

SEQ ID NO: 970761 - RNA, 19 nt, Homo sapiens
guagugagauggaaauggu

SEQ ID NO: 970762 - RNA, 19 nt, Homo sapiens
guuaagcauuguuuacuug

SEQ ID NO: 970763 - RNA, 19 nt, Homo sapiens
cgaacaaaccugaaaguau

SEQ ID NO: 970764 - RNA, 19 nt, Homo sapiens
ugaaagcugucaucgauag

SEQ ID NO: 970765 - RNA, 19 nt, Homo sapiens
gagaguaaauagcccuuca

SEQ ID NO: 970766 - RNA, 19 nt, Homo sapiens
gagagaaaccugacaugug

SEQ ID NO: 970767 - RNA, 19 nt, Homo sapiens
uaggagggcuuaucaucaa

SEQ ID NO: 970768 - RNA, 19 nt, Homo sapiens
ugucaggccaggauuauua

SEQ ID NO: 970769 - RNA, 19 nt, Homo sapiens
cagcacacuuaacaucuaa

SEQ ID NO: 970770 - RNA, 19 nt, Homo sapiens
uuagggagauuccucgaaa

SEQ ID NO: 970771 - RNA, 19 nt, Homo sapiens
ccucagagcaccuucguuu

SEQ ID NO: 970772 - RNA, 19 nt, Homo sapiens
aaaguucaauugagugguu

SEQ ID NO: 970773 - RNA, 19 nt, Homo sapiens
agggacagguguagagaua

SEQ ID NO: 970774 - RNA, 19 nt, Homo sapiens
gcaaagccaaccacuuaga

SEQ ID NO: 970775 - RNA, 19 nt, Homo sapiens
gaagaggcuguacaaguga

SEQ ID NO: 970776 - RNA, 19 nt, Homo sapiens
gaaaguauagaucagaagu

SEQ ID NO: 970777 - RNA, 19 nt, Homo sapiens
ggaaauggugccugcagaa

SEQ ID NO: 970778 - RNA, 19 nt, Homo sapiens
acaguuaugugagcaguuu

SEQ ID NO: 970779 - RNA, 19 nt, Homo sapiens
ucaagugggacaaacauaa

SEQ ID NO: 970780 - RNA, 19 nt, Homo sapiens
guauagaucagaaguuuca

SEQ ID NO: 970781 - RNA, 19 nt, Homo sapiens
gcaaggaagaagcgauuga

SEQ ID NO: 970782 - RNA, 19 nt, Homo sapiens
ugacaagggucucuguuac

SEQ ID NO: 970783 - RNA, 19 nt, Homo sapiens
cagccuccaugaugucuuu

SEQ ID NO: 970784 - RNA, 19 nt, Homo sapiens
ggaagcagcacugaguaaa

SEQ ID NO: 970785 - RNA, 19 nt, Homo sapiens
cacuucagauuucauguuu

SEQ ID NO: 970786 - RNA, 19 nt, Homo sapiens
ggaauuucauacauacgau

SEQ ID NO: 970787 - RNA, 19 nt, Homo sapiens
caagugggacaaacauaaa

SEQ ID NO: 970788 - RNA, 19 nt, Homo sapiens
gcaugucaggccaggauua

SEQ ID NO: 970789 - RNA, 19 nt, Homo sapiens
gaaauuccucuguuguuag

SEQ ID NO: 970790 - RNA, 19 nt, Homo sapiens
gucaggagcccgcuuugua

SEQ ID NO: 970791 - RNA, 19 nt, Homo sapiens
caagagaaagaccgugaaa

SEQ ID NO: 970792 - RNA, 19 nt, Homo sapiens
ccucgaaacuagugugugu

SEQ ID NO: 970793 - RNA, 19 nt, Homo sapiens
gauaaacuuuucccacaaa

SEQ ID NO: 970794 - RNA, 19 nt, Homo sapiens
uaacuccauucucucuauu

SEQ ID NO: 970795 - RNA, 19 nt, Homo sapiens
gcaugcaugugacuugcuu

SEQ ID NO: 970796 - RNA, 19 nt, Homo sapiens
caaagccaaccacuuagaa

SEQ ID NO: 970797 - RNA, 19 nt, Homo sapiens
gguaaaagccugaaacaug

SEQ ID NO: 970798 - RNA, 19 nt, Homo sapiens
aagaugaaauuccucuguu

SEQ ID NO: 970799 - RNA, 19 nt, Homo sapiens
ucaauugagugguuacagu

SEQ ID NO: 970800 - RNA, 19 nt, Homo sapiens
uaacacuugucauuuacug

SEQ ID NO: 970801 - RNA, 19 nt, Homo sapiens
aacaaaugguauuggcuua

SEQ ID NO: 970802 - RNA, 19 nt, Homo sapiens
ucacuuguuucucaguuau

SEQ ID NO: 970803 - RNA, 19 nt, Homo sapiens
gaguaaggauauguauuuc

SEQ ID NO: 970804 - RNA, 19 nt, Homo sapiens
cagaagaggcuguacaagu

SEQ ID NO: 970805 - RNA, 19 nt, Homo sapiens
caguuucuguuccuuugua

SEQ ID NO: 970806 - RNA, 19 nt, Homo sapiens
ugaguaaaguucaauugag

SEQ ID NO: 970807 - RNA, 19 nt, Homo sapiens
gggaagcagcacugaguaa

SEQ ID NO: 970808 - RNA, 19 nt, Homo sapiens
cauaacacuugucauuuac

SEQ ID NO: 970809 - RNA, 19 nt, Homo sapiens
aagaagcgauugagggaau

SEQ ID NO: 970810 - RNA, 19 nt, Homo sapiens
aauggugccugcagaaguu

SEQ ID NO: 970811 - RNA, 19 nt, Homo sapiens
uuaaugugguaguugguaa

SEQ ID NO: 970812 - RNA, 19 nt, Homo sapiens
ggagcccgcuuuguauuag

SEQ ID NO: 970813 - RNA, 19 nt, Homo sapiens
aacuuuaacuugcaccuuu

SEQ ID NO: 970814 - RNA, 19 nt, Homo sapiens
guguacauaucuuugcaaa

SEQ ID NO: 970815 - RNA, 19 nt, Homo sapiens
guaggagggcuuaucauca

SEQ ID NO: 970816 - RNA, 19 nt, Homo sapiens
uugcaaauauggaugacaa

SEQ ID NO: 970817 - RNA, 19 nt, Homo sapiens
gcacuucugagacggcaaa

SEQ ID NO: 970818 - RNA, 19 nt, Homo sapiens
gaaguucugcagcauguca

SEQ ID NO: 970819 - RNA, 19 nt, Homo sapiens
uggcuuaacuaguuguuuc

SEQ ID NO: 970820 - RNA, 19 nt, Homo sapiens
gugacaacauuaaacuuag

SEQ ID NO: 970821 - RNA, 19 nt, Homo sapiens
agacuuaccacaucugaga

SEQ ID NO: 970822 - RNA, 19 nt, Homo sapiens
uuaacuccauucucucuau

SEQ ID NO: 970823 - RNA, 19 nt, Homo sapiens
aaacauacagugacaacau

SEQ ID NO: 970824 - RNA, 19 nt, Homo sapiens
cgacuucauuguggccuuu

SEQ ID NO: 970825 - RNA, 19 nt, Homo sapiens
gaugaaauuccucuguugu

SEQ ID NO: 970826 - RNA, 19 nt, Homo sapiens
agaugaaauuccucuguug

SEQ ID NO: 970827 - RNA, 19 nt, Homo sapiens
guucccaacucuccgauca

SEQ ID NO: 970828 - RNA, 19 nt, Homo sapiens
acacuugucauuuacugua

SEQ ID NO: 970829 - RNA, 19 nt, Homo sapiens
gggaaacagaaauuuagaa

SEQ ID NO: 970830 - RNA, 19 nt, Homo sapiens
gcgauugagggaauuugua

SEQ ID NO: 970831 - RNA, 19 nt, Homo sapiens
gguaguugguaauaauaag

SEQ ID NO: 970832 - RNA, 19 nt, Homo sapiens
gaagcagcacugaguaaag

SEQ ID NO: 970833 - RNA, 19 nt, Homo sapiens
gcacauaacuuacgggaaa

SEQ ID NO: 970834 - RNA, 19 nt, Homo sapiens
gagaaaggcuggcuauaag

SEQ ID NO: 970835 - RNA, 19 nt, Homo sapiens
ggagaaaggcuggcuauaa

SEQ ID NO: 970836 - RNA, 19 nt, Homo sapiens
gagagcagcuucaggaauc

SEQ ID NO: 970837 - RNA, 19 nt, Homo sapiens
cggcaaagccaaccacuua

SEQ ID NO: 970838 - RNA, 19 nt, Homo sapiens
gaaaggcuggcuauaagaa

SEQ ID NO: 970839 - RNA, 19 nt, Homo sapiens
caugaugucuuuauugcaa

SEQ ID NO: 970840 - RNA, 19 nt, Homo sapiens
ggacagguguagagauaag

SEQ ID NO: 970841 - RNA, 19 nt, Homo sapiens
cgugaaagcugucaucgau

SEQ ID NO: 970842 - RNA, 19 nt, Homo sapiens
guagugagauggaaauggu

SEQ ID NO: 970843 - RNA, 19 nt, Homo sapiens
ugaaagcugucaucgauag

SEQ ID NO: 970844 - RNA, 19 nt, Homo sapiens
gagagaaaccugacaugug

SEQ ID NO: 970845 - RNA, 19 nt, Homo sapiens
uaggagggcuuaucaucaa

SEQ ID NO: 970846 - RNA, 19 nt, Homo sapiens
ccucagagcaccuucguuu

SEQ ID NO: 970847 - RNA, 19 nt, Homo sapiens
agggacagguguagagaua

SEQ ID NO: 970848 - RNA, 19 nt, Homo sapiens
gcaaagccaaccacuuaga

SEQ ID NO: 970849 - RNA, 19 nt, Homo sapiens
ggaaauggugccugcagaa

SEQ ID NO: 970850 - RNA, 19 nt, Homo sapiens
gcaaggaagaagcgauuga

SEQ ID NO: 970851 - RNA, 19 nt, Homo sapiens
ugacaagggucucuguuac

SEQ ID NO: 970852 - RNA, 19 nt, Homo sapiens
cagccuccaugaugucuuu

SEQ ID NO: 970853 - RNA, 19 nt, Homo sapiens
ggaauuucauacauacgau

SEQ ID NO: 970854 - RNA, 19 nt, Homo sapiens
caagagaaagaccgugaaa

SEQ ID NO: 970855 - RNA, 19 nt, Homo sapiens
caaagccaaccacuuagaa

SEQ ID NO: 970856 - RNA, 19 nt, Homo sapiens
aggcgaaacugacggcaaa

SEQ ID NO: 970857 - RNA, 19 nt, Homo sapiens
aagaagcgauugagggaau

SEQ ID NO: 970858 - RNA, 19 nt, Homo sapiens
aauggugccugcagaaguu

SEQ ID NO: 970859 - RNA, 19 nt, Homo sapiens
guaggagggcuuaucauca

SEQ ID NO: 970860 - RNA, 19 nt, Homo sapiens
uugcaaauauggaugacaa

SEQ ID NO: 970861 - RNA, 19 nt, Homo sapiens
cgacuucauuguggccuuu

SEQ ID NO: 970862 - RNA, 19 nt, Homo sapiens
agacuuaccacaucugaga

SEQ ID NO: 970863 - RNA, 19 nt, Homo sapiens
gcgauugagggaauuugua

SEQ ID NO: 970864 - RNA, 19 nt, Homo sapiens
gaggagaaaggcuggcuau

SEQ ID NO: 970865 - RNA, 19 nt, Homo sapiens
ccaaagauggacugaagug

SEQ ID NO: 970866 - RNA, 19 nt, Homo sapiens
gcaagagaaagaccgugaa

SEQ ID NO: 970867 - RNA, 19 nt, Homo sapiens
cugacaggcacauaacuua

SEQ ID NO: 970868 - RNA, 19 nt, Homo sapiens
ccuccaugaugucuuuauu

SEQ ID NO: 970869 - RNA, 19 nt, Homo sapiens
gguaggagggcuuaucauc

SEQ ID NO: 970870 - RNA, 19 nt, Homo sapiens
cuaacauacuucagugcaa

SEQ ID NO: 970871 - RNA, 19 nt, Homo sapiens
caccuucguuucuccucua

SEQ ID NO: 970872 - RNA, 19 nt, Homo sapiens
gaaauggugccugcagaag

SEQ ID NO: 970873 - RNA, 19 nt, Homo sapiens
gauggcugccucugccuuu

SEQ ID NO: 970874 - RNA, 19 nt, Homo sapiens
gaagcgauugagggaauuu

SEQ ID NO: 970875 - RNA, 19 nt, Homo sapiens
cgauagguuucuucgacuu

SEQ ID NO: 970876 - RNA, 19 nt, Homo sapiens
gggaauuucauacauacga

SEQ ID NO: 970877 - RNA, 19 nt, Homo sapiens
gcugacaggcacauaacuu

SEQ ID NO: 970878 - RNA, 19 nt, Homo sapiens
gacaagggucucuguuaca

SEQ ID NO: 970879 - RNA, 19 nt, Homo sapiens
gcacagccuccaugauguc

SEQ ID NO: 970880 - RNA, 19 nt, Homo sapiens
caagaaaaggcaagagaaa

SEQ ID NO: 970881 - RNA, 19 nt, Homo sapiens
aaccugacaugugggcaua

SEQ ID NO: 970882 - RNA, 19 nt, Homo sapiens
cgauugagggaauuuguau

SEQ ID NO: 970883 - RNA, 19 nt, Homo sapiens
ucagagcaccuucguuucu

SEQ ID NO: 970884 - RNA, 19 nt, Homo sapiens
cauauucagacaccaguug

SEQ ID NO: 970885 - RNA, 19 nt, Homo sapiens
ggagaaggauacuuuugca

SEQ ID NO: 970886 - RNA, 19 nt, Homo sapiens
gugaaagcugucaucgaua

SEQ ID NO: 970887 - RNA, 19 nt, Homo sapiens
gagaaagaccgugaaagcu

SEQ ID NO: 970888 - RNA, 19 nt, Homo sapiens
gcaagaaaaggcaagagaa

SEQ ID NO: 970889 - RNA, 19 nt, Homo sapiens
gaugacaagggucucuguu

SEQ ID NO: 970890 - RNA, 19 nt, Homo sapiens
gagccucagcauccaaaga

SEQ ID NO: 970891 - RNA, 19 nt, Homo sapiens
uugcacagccuccaugaug

SEQ ID NO: 970892 - RNA, 19 nt, Homo sapiens
agagaaagaccgugaaagc

SEQ ID NO: 970893 - RNA, 19 nt, Homo sapiens
ugagagaaaccugacaugu

SEQ ID NO: 970894 - RNA, 19 nt, Homo sapiens
aagggaauuucauacauac

SEQ ID NO: 970895 - RNA, 19 nt, Homo sapiens
agaaaggcuggcuauaaga

SEQ ID NO: 970896 - RNA, 19 nt, Homo sapiens
ggcuuaucaucaacacuga

SEQ ID NO: 970897 - RNA, 19 nt, Homo sapiens
gaaguuggggagaaggaua

SEQ ID NO: 970898 - RNA, 19 nt, Homo sapiens
aaaggcuggcuauaagaaa

SEQ ID NO: 970899 - RNA, 19 nt, Homo sapiens
gccuuugggugaggagaaa

SEQ ID NO: 970900 - RNA, 19 nt, Homo sapiens
gauagguuucuucgacuuc

SEQ ID NO: 970901 - RNA, 19 nt, Homo sapiens
aagcugucaucgauagguu

SEQ ID NO: 970902 - RNA, 19 nt, Homo sapiens
augacaagggucucuguua

SEQ ID NO: 970903 - RNA, 19 nt, Homo sapiens
ucucuuauuucugcauugu

SEQ ID NO: 970904 - RNA, 19 nt, Homo sapiens
gcuccugcucucugaugua

SEQ ID NO: 970905 - RNA, 19 nt, Homo sapiens
gauugagggaauuuguauu

SEQ ID NO: 970906 - RNA, 19 nt, Homo sapiens
ugucaucgauagguuucuu

SEQ ID NO: 970907 - RNA, 19 nt, Homo sapiens
ccucucuuauuucugcauu

SEQ ID NO: 970908 - RNA, 19 nt, Homo sapiens
gcaaccagagccucagcau

SEQ ID NO: 970909 - RNA, 19 nt, Homo sapiens
ugagagcagcuucaggaau

SEQ ID NO: 970910 - RNA, 19 nt, Homo sapiens
ggaugacaagggucucugu

SEQ ID NO: 970911 - RNA, 19 nt, Homo sapiens
uccaugaugucuuuauugc

SEQ ID NO: 970912 - RNA, 19 nt, Homo sapiens
uaccacaucugagagaaac

SEQ ID NO: 970913 - RNA, 19 nt, Homo sapiens
ggacgucggucaucagaua

SEQ ID NO: 970914 - RNA, 19 nt, Homo sapiens
caucaaagcuggauuuaga

SEQ ID NO: 970915 - RNA, 19 nt, Homo sapiens
gaagaaagcagaagcaaga

SEQ ID NO: 970916 - RNA, 19 nt, Homo sapiens
gggcagagauaaagagaaa

SEQ ID NO: 970917 - RNA, 19 nt, Homo sapiens
ggaaggaaaucaagaucaa

SEQ ID NO: 970918 - RNA, 19 nt, Homo sapiens
gaaggacaaggaauacaua

SEQ ID NO: 970919 - RNA, 19 nt, Homo sapiens
gaacauacagccgaaagaa

SEQ ID NO: 970920 - RNA, 19 nt, Homo sapiens
ggacaaggaauacauaaca

SEQ ID NO: 970921 - RNA, 19 nt, Homo sapiens
gaaagcagaagcaagagaa

SEQ ID NO: 970922 - RNA, 19 nt, Homo sapiens
gacuacagcugguucuuga

SEQ ID NO: 970923 - RNA, 19 nt, Homo sapiens
gagcaguucuucagauagu

SEQ ID NO: 970924 - RNA, 19 nt, Homo sapiens
gaaaucaagaucaaaguca

SEQ ID NO: 970925 - RNA, 19 nt, Homo sapiens
guucagaggucuaggucaa

SEQ ID NO: 970926 - RNA, 19 nt, Homo sapiens
gaaaggaggaaggaaauca

SEQ ID NO: 970927 - RNA, 19 nt, Homo sapiens
aaacaucaaagcuggauuu

SEQ ID NO: 970928 - RNA, 19 nt, Homo sapiens
cgacguaagggcagagaua

SEQ ID NO: 970929 - RNA, 19 nt, Homo sapiens
gggaaauccuauagaguuc

SEQ ID NO: 970930 - RNA, 19 nt, Homo sapiens
aggcaucgaucaagcagua

SEQ ID NO: 970931 - RNA, 19 nt, Homo sapiens
cguagucggucucgggaua

SEQ ID NO: 970932 - RNA, 19 nt, Homo sapiens
gaaagguccagucacagaa

SEQ ID NO: 970933 - RNA, 19 nt, Homo sapiens
ucgagcaguucuucagaua

SEQ ID NO: 970934 - RNA, 19 nt, Homo sapiens
acaagaagguccaggucaa

SEQ ID NO: 970935 - RNA, 19 nt, Homo sapiens
aaagaaaggaggaaggaaa

SEQ ID NO: 970936 - RNA, 19 nt, Homo sapiens
gugggaaucuggaaacauc

SEQ ID NO: 970937 - RNA, 19 nt, Homo sapiens
cgagggaaauccuauagag

SEQ ID NO: 970938 - RNA, 19 nt, Homo sapiens
gacaaggaauacauaacau

SEQ ID NO: 970939 - RNA, 19 nt, Homo sapiens
agcaguagcucuucuuaug

SEQ ID NO: 970940 - RNA, 19 nt, Homo sapiens
gaagaagaaagcagaagca

SEQ ID NO: 970941 - RNA, 19 nt, Homo sapiens
caagcaguagcucuucuua

SEQ ID NO: 970942 - RNA, 19 nt, Homo sapiens
caaggaauacauaacauca

SEQ ID NO: 970943 - RNA, 19 nt, Homo sapiens
ggaaggacaaggaauacau

SEQ ID NO: 970944 - RNA, 19 nt, Homo sapiens
gaaggaaaucaagaucaaa

SEQ ID NO: 970945 - RNA, 19 nt, Homo sapiens
ccucgucuccguucucaua

SEQ ID NO: 970946 - RNA, 19 nt, Homo sapiens
ggaggaaggaaaucaagau

SEQ ID NO: 970947 - RNA, 19 nt, Homo sapiens
gcagugaaagguccaguca

SEQ ID NO: 970948 - RNA, 19 nt, Homo sapiens
ucuuauggcuccagaagga

SEQ ID NO: 970949 - RNA, 19 nt, Homo sapiens
gaaagaaaggaggaaggaa

SEQ ID NO: 970950 - RNA, 19 nt, Homo sapiens
gaaaugggacgucggucau

SEQ ID NO: 970951 - RNA, 19 nt, Homo sapiens
gaaauccuauagaguucag

SEQ ID NO: 970952 - RNA, 19 nt, Homo sapiens
ggaaaucaagaucaaaguc

SEQ ID NO: 970953 - RNA, 19 nt, Homo sapiens
aaagcuggauuuagaacau

SEQ ID NO: 970954 - RNA, 19 nt, Homo sapiens
ugaaagguccagucacaga

SEQ ID NO: 970955 - RNA, 19 nt, Homo sapiens
gagaaaagggagaggauaa

SEQ ID NO: 970956 - RNA, 19 nt, Homo sapiens
agaaggaaacgaagucgaa

SEQ ID NO: 970957 - RNA, 19 nt, Homo sapiens
gaucuaaagaaacgacuca

SEQ ID NO: 970958 - RNA, 19 nt, Homo sapiens
gcgcccugaucuaaagaaa

SEQ ID NO: 970959 - RNA, 19 nt, Homo sapiens
caucaaacgugggaaucug

SEQ ID NO: 970960 - RNA, 19 nt, Homo sapiens
aagggaaggacaaggaaua

SEQ ID NO: 970961 - RNA, 19 nt, Homo sapiens
gcccugaucuaaagaaacg

SEQ ID NO: 970962 - RNA, 19 nt, Homo sapiens
gacguaagggcagagauaa

SEQ ID NO: 970963 - RNA, 19 nt, Homo sapiens
ggauagagaacgacguaag

SEQ ID NO: 970964 - RNA, 19 nt, Homo sapiens
uaaagggaaggacaaggaa

SEQ ID NO: 970965 - RNA, 19 nt, Homo sapiens
ggucgagggaaauccuaua

SEQ ID NO: 970966 - RNA, 19 nt, Homo sapiens
cgaaagaaaggaggaagga

SEQ ID NO: 970967 - RNA, 19 nt, Homo sapiens
ggaaucuggaaacaucaaa

SEQ ID NO: 970968 - RNA, 19 nt, Homo sapiens
uaacaucaaacgugggaau

SEQ ID NO: 970969 - RNA, 19 nt, Homo sapiens
guaagggcagagauaaaga

SEQ ID NO: 970970 - RNA, 19 nt, Homo sapiens
agggaaauccuauagaguu

SEQ ID NO: 970971 - RNA, 19 nt, Homo sapiens
gauagagaacgacguaagg

SEQ ID NO: 970972 - RNA, 19 nt, Homo sapiens
gcaguagcucuucuuaugg

SEQ ID NO: 970973 - RNA, 19 nt, Homo sapiens
ggaaacaucaaagcuggau

SEQ ID NO: 970974 - RNA, 19 nt, Homo sapiens
gaauacauaacaucaaacg

SEQ ID NO: 970975 - RNA, 19 nt, Homo sapiens
ucagauaguagaacauaca

SEQ ID NO: 970976 - RNA, 19 nt, Homo sapiens
gaccucgucuccguucuca

SEQ ID NO: 970977 - RNA, 19 nt, Homo sapiens
cuucagauaguagaacaua

SEQ ID NO: 970978 - RNA, 19 nt, Homo sapiens
cgaagucgaagucguucaa

SEQ ID NO: 970979 - RNA, 19 nt, Homo sapiens
ggccaaagccagacuacag

SEQ ID NO: 970980 - RNA, 19 nt, Homo sapiens
cgggauagagaacgacgua

SEQ ID NO: 970981 - RNA, 19 nt, Homo sapiens
cauagucguagcagugaaa

SEQ ID NO: 970982 - RNA, 19 nt, Homo sapiens
gagggaaauccuauagagu

SEQ ID NO: 970983 - RNA, 19 nt, Homo sapiens
gaucaagcaguagcucuuc

SEQ ID NO: 970984 - RNA, 19 nt, Homo sapiens
guucacauucuuaugauag

SEQ ID NO: 970985 - RNA, 19 nt, Homo sapiens
cagccucguucacauucuu

SEQ ID NO: 970986 - RNA, 19 nt, Homo sapiens
gaggaaggaaaucaagauc

SEQ ID NO: 970987 - RNA, 19 nt, Homo sapiens
acauacagccgaaagaaag

SEQ ID NO: 970988 - RNA, 19 nt, Homo sapiens
cguucacauucuuaugaua

SEQ ID NO: 970989 - RNA, 19 nt, Homo sapiens
aaacgugggaaucuggaaa

SEQ ID NO: 970990 - RNA, 19 nt, Homo sapiens
ggaaauccuauagaguuca

SEQ ID NO: 970991 - RNA, 19 nt, Homo sapiens
gaaacaucaaagcuggauu

SEQ ID NO: 970992 - RNA, 19 nt, Homo sapiens
gcaguucuucagauaguag

SEQ ID NO: 970993 - RNA, 19 nt, Homo sapiens
auaaagggaaggacaagga

SEQ ID NO: 970994 - RNA, 19 nt, Homo sapiens
aagaaaggaggaaggaaau

SEQ ID NO: 970995 - RNA, 19 nt, Homo sapiens
ugcaaaagcugaugaagca

SEQ ID NO: 970996 - RNA, 19 nt, Homo sapiens
ucuugaagcugcugcaaaa

SEQ ID NO: 970997 - RNA, 19 nt, Homo sapiens
gagauaaagagaaaagaga

SEQ ID NO: 970998 - RNA, 19 nt, Homo sapiens
aaaggaggaaggaaaucaa

SEQ ID NO: 970999 - RNA, 19 nt, Homo sapiens
agaagacgcaggcaucgau

SEQ ID NO: 971000 - RNA, 19 nt, Homo sapiens
aaaagcugaugaagcauug

SEQ ID NO: 971001 - RNA, 19 nt, Homo sapiens
caaagcuggauuuagaaca

SEQ ID NO: 971002 - RNA, 19 nt, Homo sapiens
caaaagcugaugaagcauu

SEQ ID NO: 971003 - RNA, 19 nt, Homo sapiens
caucuugccaccagcugaa

SEQ ID NO: 971004 - RNA, 19 nt, Homo sapiens
gggaaucuggaaacaucaa

SEQ ID NO: 971005 - RNA, 19 nt, Homo sapiens
gagaggauaaagggaagga

SEQ ID NO: 971006 - RNA, 19 nt, Homo sapiens
cguaagggcagagauaaag

SEQ ID NO: 971007 - RNA, 19 nt, Homo sapiens
ccaaagcacugauauuaua

SEQ ID NO: 971008 - RNA, 19 nt, Homo sapiens
ccaguaaacuuccuaauga

SEQ ID NO: 971009 - RNA, 19 nt, Homo sapiens
gcuaauugcuuguaggaua

SEQ ID NO: 971010 - RNA, 19 nt, Homo sapiens
gauaguaaauggucaguau

SEQ ID NO: 971011 - RNA, 19 nt, Homo sapiens
caauauauaucccugcuuu

SEQ ID NO: 971012 - RNA, 19 nt, Homo sapiens
gcaccuauauuggcugaua

SEQ ID NO: 971013 - RNA, 19 nt, Homo sapiens
ccagagacauaguuuauau

SEQ ID NO: 971014 - RNA, 19 nt, Homo sapiens
gaagucauagggauuauaa

SEQ ID NO: 971015 - RNA, 19 nt, Homo sapiens
ggccaaagcacugauauua

SEQ ID NO: 971016 - RNA, 19 nt, Homo sapiens
gcauugugauuacuuauug

SEQ ID NO: 971017 - RNA, 19 nt, Homo sapiens
ccaaucaguuuacuucauu

SEQ ID NO: 971018 - RNA, 19 nt, Homo sapiens
gaucacugguuauaauuug

SEQ ID NO: 971019 - RNA, 19 nt, Homo sapiens
caacuuggcugagugaaga

SEQ ID NO: 971020 - RNA, 19 nt, Homo sapiens
gccaaggaaucgacauaua

SEQ ID NO: 971021 - RNA, 19 nt, Homo sapiens
uaaguggucucuugucuau

SEQ ID NO: 971022 - RNA, 19 nt, Homo sapiens
caauccaaauucacucuua

SEQ ID NO: 971023 - RNA, 19 nt, Homo sapiens
gaaauggccaccuggguuu

SEQ ID NO: 971024 - RNA, 19 nt, Homo sapiens
gaucaggaaugcaauugug

SEQ ID NO: 971025 - RNA, 19 nt, Homo sapiens
ccaaaucugugcuggcauu

SEQ ID NO: 971026 - RNA, 19 nt, Homo sapiens
guguauacgucuaagauuu

SEQ ID NO: 971027 - RNA, 19 nt, Homo sapiens
aguggucucuugucuauua

SEQ ID NO: 971028 - RNA, 19 nt, Homo sapiens
gggaguauccuucugguaa

SEQ ID NO: 971029 - RNA, 19 nt, Homo sapiens
gaaauccuauguguauuca

SEQ ID NO: 971030 - RNA, 19 nt, Homo sapiens
aaaccuaaguggucucuug

SEQ ID NO: 971031 - RNA, 19 nt, Homo sapiens
cuagaucacugguuauaau

SEQ ID NO: 971032 - RNA, 19 nt, Homo sapiens
cuaaugguaccaauaguua

SEQ ID NO: 971033 - RNA, 19 nt, Homo sapiens
gguuauugcugcccuaguu

SEQ ID NO: 971034 - RNA, 19 nt, Homo sapiens
ggagaaagggauaaugaug

SEQ ID NO: 971035 - RNA, 19 nt, Homo sapiens
uuuacuagaucacugguua

SEQ ID NO: 971036 - RNA, 19 nt, Homo sapiens
caacaacauaugccuaauu

SEQ ID NO: 971037 - RNA, 19 nt, Homo sapiens
gagcauagaacauccacuu

SEQ ID NO: 971038 - RNA, 19 nt, Homo sapiens
caacauaugccuaauucug

SEQ ID NO: 971039 - RNA, 19 nt, Homo sapiens
guaaaggcauggguauaau

SEQ ID NO: 971040 - RNA, 19 nt, Homo sapiens
uagcucaccuccagaauca

SEQ ID NO: 971041 - RNA, 19 nt, Homo sapiens
caaggaaucgacauauauu

SEQ ID NO: 971042 - RNA, 19 nt, Homo sapiens
ggucaguauugaaaccuaa

SEQ ID NO: 971043 - RNA, 19 nt, Homo sapiens
ccacaaacuaagaaugaua

SEQ ID NO: 971044 - RNA, 19 nt, Homo sapiens
ccaaggaaucgacauauau

SEQ ID NO: 971045 - RNA, 19 nt, Homo sapiens
caacuaauaagccaaggaa

SEQ ID NO: 971046 - RNA, 19 nt, Homo sapiens
gcaaacauuccaucauuag

SEQ ID NO: 971047 - RNA, 19 nt, Homo sapiens
ugcaaacauuccaucauua

SEQ ID NO: 971048 - RNA, 19 nt, Homo sapiens
ccuaaccacuuuaagaguu

SEQ ID NO: 971049 - RNA, 19 nt, Homo sapiens
ugucaaggcugguaugauc

SEQ ID NO: 971050 - RNA, 19 nt, Homo sapiens
ccaaauucacucuuaacua

SEQ ID NO: 971051 - RNA, 19 nt, Homo sapiens
gaaucgacauauauuaggu

SEQ ID NO: 971052 - RNA, 19 nt, Homo sapiens
gaagauaaucauagguugu

SEQ ID NO: 971053 - RNA, 19 nt, Homo sapiens
gauggcaguuuacuagauc

SEQ ID NO: 971054 - RNA, 19 nt, Homo sapiens
guaaauggucaguauugaa

SEQ ID NO: 971055 - RNA, 19 nt, Homo sapiens
ggacaaaacauuauacuag

SEQ ID NO: 971056 - RNA, 19 nt, Homo sapiens
gcauuacagacgauucaua

SEQ ID NO: 971057 - RNA, 19 nt, Homo sapiens
cuaaccacuuuaagaguuu

SEQ ID NO: 971058 - RNA, 19 nt, Homo sapiens
gacaaccuccaaucaguuu

SEQ ID NO: 971059 - RNA, 19 nt, Homo sapiens
augcaaacauuccaucauu

SEQ ID NO: 971060 - RNA, 19 nt, Homo sapiens
auaaaaggcugcuauggua

SEQ ID NO: 971061 - RNA, 19 nt, Homo sapiens
cguaaaggcauggguauaa

SEQ ID NO: 971062 - RNA, 19 nt, Homo sapiens
gacgaaagcacgacugugu

SEQ ID NO: 971063 - RNA, 19 nt, Homo sapiens
uuaggugcguguacuguuu

SEQ ID NO: 971064 - RNA, 19 nt, Homo sapiens
gauguaaugcuaauugcuu

SEQ ID NO: 971065 - RNA, 19 nt, Homo sapiens
aacaacauaugccuaauuc

SEQ ID NO: 971066 - RNA, 19 nt, Homo sapiens
ugacuguuaucaggcuuua

SEQ ID NO: 971067 - RNA, 19 nt, Homo sapiens
aggcauggguauaauggua

SEQ ID NO: 971068 - RNA, 19 nt, Homo sapiens
gaggguacuuggcauuaca

SEQ ID NO: 971069 - RNA, 19 nt, Homo sapiens
ucucguggcuuugggagua

SEQ ID NO: 971070 - RNA, 19 nt, Homo sapiens
aaagagaacgccaucaugu

SEQ ID NO: 971071 - RNA, 19 nt, Homo sapiens
ugauuugcuuugagaauga

SEQ ID NO: 971072 - RNA, 19 nt, Homo sapiens
gaagaguuacauuucguau

SEQ ID NO: 971073 - RNA, 19 nt, Homo sapiens
aaucugugcuggcauugaa

SEQ ID NO: 971074 - RNA, 19 nt, Homo sapiens
aagcacgacugugugauuu

SEQ ID NO: 971075 - RNA, 19 nt, Homo sapiens
gugacaaccuccaaucagu

SEQ ID NO: 971076 - RNA, 19 nt, Homo sapiens
ggucucuugucuauuaguu

SEQ ID NO: 971077 - RNA, 19 nt, Homo sapiens
ggaaugugccaacaagauc

SEQ ID NO: 971078 - RNA, 19 nt, Homo sapiens
cgaaagcacgacuguguga

SEQ ID NO: 971079 - RNA, 19 nt, Homo sapiens
ggaagucauagggauuaua

SEQ ID NO: 971080 - RNA, 19 nt, Homo sapiens
ugaucgagcuguuaauuuu

SEQ ID NO: 971081 - RNA, 19 nt, Homo sapiens
gcugauggcaguuuacuag

SEQ ID NO: 971082 - RNA, 19 nt, Homo sapiens
aagaauugcuaaagcugaa

SEQ ID NO: 971083 - RNA, 19 nt, Homo sapiens
gugauuugcuuugagaaug

SEQ ID NO: 971084 - RNA, 19 nt, Homo sapiens
guggaugucuauaacuuca

SEQ ID NO: 971085 - RNA, 19 nt, Homo sapiens
gaggagggagaaagggaua

SEQ ID NO: 971086 - RNA, 19 nt, Homo sapiens
gugaagauaaucauagguu

SEQ ID NO: 971087 - RNA, 19 nt, Homo sapiens
gagugaagauaaucauagg

SEQ ID NO: 971088 - RNA, 19 nt, Homo sapiens
ucucuugucuauuaguuug

SEQ ID NO: 971089 - RNA, 19 nt, Homo sapiens
caagaucugugaaaagaga

SEQ ID NO: 971090 - RNA, 19 nt, Homo sapiens
gccaaagcacugauauuau

SEQ ID NO: 971091 - RNA, 19 nt, Homo sapiens
gugcguguacuguuucuaa

SEQ ID NO: 971092 - RNA, 19 nt, Homo sapiens
ccacuugcucggaggguua

SEQ ID NO: 971093 - RNA, 19 nt, Homo sapiens
cauuguacacugcaacuaa

SEQ ID NO: 971094 - RNA, 19 nt, Homo sapiens
gcugccgucuuguagauau

SEQ ID NO: 971095 - RNA, 19 nt, Homo sapiens
cuaauugcuuguaggauag

SEQ ID NO: 971096 - RNA, 19 nt, Homo sapiens
aaacauuccaucauuagug

SEQ ID NO: 971097 - RNA, 19 nt, Homo sapiens
aauugaggaugcaaacauu

SEQ ID NO: 971098 - RNA, 19 nt, Homo sapiens
gccuaauucugcaggauug

SEQ ID NO: 971099 - RNA, 19 nt, Homo sapiens
uuccagugcugccuucuuu

SEQ ID NO: 971100 - RNA, 19 nt, Homo sapiens
guucaccaagcauguauuu

SEQ ID NO: 971101 - RNA, 19 nt, Homo sapiens
ggaguauccuucugguaac

SEQ ID NO: 971102 - RNA, 19 nt, Homo sapiens
gugaucgagcuguuaauuu

SEQ ID NO: 971103 - RNA, 19 nt, Homo sapiens
cauggaaugugccaacaag

SEQ ID NO: 971104 - RNA, 19 nt, Homo sapiens
guaaugcuaauugcuugua

SEQ ID NO: 971105 - RNA, 19 nt, Homo sapiens
uacaacaacauaugccuaa

SEQ ID NO: 971106 - RNA, 19 nt, Homo sapiens
uaugguaacacuaaaccua

SEQ ID NO: 971107 - RNA, 19 nt, Homo sapiens
gaacagcguuuaaugaaug

SEQ ID NO: 971108 - RNA, 19 nt, Homo sapiens
ggaaagaguggauaauaaa

SEQ ID NO: 971109 - RNA, 19 nt, Homo sapiens
gacaaacgcaguauuuaua

SEQ ID NO: 971110 - RNA, 19 nt, Homo sapiens
ccaagagacucguggaauu

SEQ ID NO: 971111 - RNA, 19 nt, Homo sapiens
gcaccagaauuaucaguga

SEQ ID NO: 971112 - RNA, 19 nt, Homo sapiens
uggaaagaguggauaauaa

SEQ ID NO: 971113 - RNA, 19 nt, Homo sapiens
cuaugaagcaccagaauua

SEQ ID NO: 971114 - RNA, 19 nt, Homo sapiens
cuacuucgauccuguaaga

SEQ ID NO: 971115 - RNA, 19 nt, Homo sapiens
ggaacagcguuuaaugaau

SEQ ID NO: 971116 - RNA, 19 nt, Homo sapiens
caaauaggagugauugaaa

SEQ ID NO: 971117 - RNA, 19 nt, Homo sapiens
ugagguggauugaugauga

SEQ ID NO: 971118 - RNA, 19 nt, Homo sapiens
ccagaaauaacuaguguuu

SEQ ID NO: 971119 - RNA, 19 nt, Homo sapiens
ccagacaaacgcaguauuu

SEQ ID NO: 971120 - RNA, 19 nt, Homo sapiens
gauacccucuccagacaaa

SEQ ID NO: 971121 - RNA, 19 nt, Homo sapiens
gcauauuucuaucgcuuga

SEQ ID NO: 971122 - RNA, 19 nt, Homo sapiens
gggaacagcguuuaaugaa

SEQ ID NO: 971123 - RNA, 19 nt, Homo sapiens
aaauagcugucaucucaaa

SEQ ID NO: 971124 - RNA, 19 nt, Homo sapiens
gaacacagucacgaggaua

SEQ ID NO: 971125 - RNA, 19 nt, Homo sapiens
ugagaucggacacauauuu

SEQ ID NO: 971126 - RNA, 19 nt, Homo sapiens
guaagacuuuaacccauga

SEQ ID NO: 971127 - RNA, 19 nt, Homo sapiens
gagccuuccuuccuaauca

SEQ ID NO: 971128 - RNA, 19 nt, Homo sapiens
gaauggaaagaguggauaa

SEQ ID NO: 971129 - RNA, 19 nt, Homo sapiens
caagagacucguggaauuu

SEQ ID NO: 971130 - RNA, 19 nt, Homo sapiens
agacauguccguccuugua

SEQ ID NO: 971131 - RNA, 19 nt, Homo sapiens
gaucuugugcugugucaaa

SEQ ID NO: 971132 - RNA, 19 nt, Homo sapiens
gcugucaucucaaagaauc

SEQ ID NO: 971133 - RNA, 19 nt, Homo sapiens
cgaggauaaugggaauuua

SEQ ID NO: 971134 - RNA, 19 nt, Homo sapiens
cgacaacuauuauauucca

SEQ ID NO: 971135 - RNA, 19 nt, Homo sapiens
gaccuugcauucuccauca

SEQ ID NO: 971136 - RNA, 19 nt, Homo sapiens
gggcuacuguaaagcauau

SEQ ID NO: 971137 - RNA, 19 nt, Homo sapiens
caaagaauccagugcuugu

SEQ ID NO: 971138 - RNA, 19 nt, Homo sapiens
gagguggauugaugaugaa

SEQ ID NO: 971139 - RNA, 19 nt, Homo sapiens
uguccguccuuguaaguua

SEQ ID NO: 971140 - RNA, 19 nt, Homo sapiens
caugagaucggacacauau

SEQ ID NO: 971141 - RNA, 19 nt, Homo sapiens
ucagucauccuuacagaaa

SEQ ID NO: 971142 - RNA, 19 nt, Homo sapiens
ucauuuggguggaauacuu

SEQ ID NO: 971143 - RNA, 19 nt, Homo sapiens
cagacaaacgcaguauuua

SEQ ID NO: 971144 - RNA, 19 nt, Homo sapiens
gaauaaacuacugaucuug

SEQ ID NO: 971145 - RNA, 19 nt, Homo sapiens
cauguuaugcuuucauuug

SEQ ID NO: 971146 - RNA, 19 nt, Homo sapiens
gcacuggugagguggauug

SEQ ID NO: 971147 - RNA, 19 nt, Homo sapiens
ugaagaagcucaagaaaac

SEQ ID NO: 971148 - RNA, 19 nt, Homo sapiens
ggaauggaaagaguggaua

SEQ ID NO: 971149 - RNA, 19 nt, Homo sapiens
ugaagcaccagaauuauca

SEQ ID NO: 971150 - RNA, 19 nt, Homo sapiens
agacaaacgcaguauuuau

SEQ ID NO: 971151 - RNA, 19 nt, Homo sapiens
gccagccagugaucucuuu

SEQ ID NO: 971152 - RNA, 19 nt, Homo sapiens
ucacgaggauaaugggaau

SEQ ID NO: 971153 - RNA, 19 nt, Homo sapiens
gagaucggacacauauuug

SEQ ID NO: 971154 - RNA, 19 nt, Homo sapiens
uucuaucgcuugagaguaa

SEQ ID NO: 971155 - RNA, 19 nt, Homo sapiens
cccaagacuuugaacaguu

SEQ ID NO: 971156 - RNA, 19 nt, Homo sapiens
uagcugucaucucaaagaa

SEQ ID NO: 971157 - RNA, 19 nt, Homo sapiens
cuucagcauuguagaaaga

SEQ ID NO: 971158 - RNA, 19 nt, Homo sapiens
gaucggacacauauuugga

SEQ ID NO: 971159 - RNA, 19 nt, Homo sapiens
gcaaagugaagaagcucaa

SEQ ID NO: 971160 - RNA, 19 nt, Homo sapiens
gcucacgggcuacuguaaa

SEQ ID NO: 971161 - RNA, 19 nt, Homo sapiens
ccagaauuaucagugaaga

SEQ ID NO: 971162 - RNA, 19 nt, Homo sapiens
gacauguccguccuuguaa

SEQ ID NO: 971163 - RNA, 19 nt, Homo sapiens
gaaacccguggaagccuuu

SEQ ID NO: 971164 - RNA, 19 nt, Homo sapiens
aagauacccucuccagaca

SEQ ID NO: 971165 - RNA, 19 nt, Homo sapiens
cuggugagguggauugaug

SEQ ID NO: 971166 - RNA, 19 nt, Homo sapiens
ucagcauuguagaaagaua

SEQ ID NO: 971167 - RNA, 19 nt, Homo sapiens
caccagaauuaucagugaa

SEQ ID NO: 971168 - RNA, 19 nt, Homo sapiens
gggacauccugaaguucuu

SEQ ID NO: 971169 - RNA, 19 nt, Homo sapiens
gcuacuguaaagcauauuu

SEQ ID NO: 971170 - RNA, 19 nt, Homo sapiens
guccguccuuguaaguuaa

SEQ ID NO: 971171 - RNA, 19 nt, Homo sapiens
guucgcgggugcugucaga

SEQ ID NO: 971172 - RNA, 19 nt, Homo sapiens
caagauguuccuuuagagu

SEQ ID NO: 971173 - RNA, 19 nt, Homo sapiens
auaaacuacugaucuugug

SEQ ID NO: 971174 - RNA, 19 nt, Homo sapiens
cuaaaccuuugcccuaucu

SEQ ID NO: 971175 - RNA, 19 nt, Homo sapiens
gacuuuaacccaugagauc

SEQ ID NO: 971176 - RNA, 19 nt, Homo sapiens
gucacaguaugagaaagua

SEQ ID NO: 971177 - RNA, 19 nt, Homo sapiens
caucuucaagugacuauuc

SEQ ID NO: 971178 - RNA, 19 nt, Homo sapiens
gaggauaaugggaauuuac

SEQ ID NO: 971179 - RNA, 19 nt, Homo sapiens
cuaaucaagaugcaaauag

SEQ ID NO: 971180 - RNA, 19 nt, Homo sapiens
agauguuccuuuagaguca

SEQ ID NO: 971181 - RNA, 19 nt, Homo sapiens
ccaguuccuguuucuguaa

SEQ ID NO: 971182 - RNA, 19 nt, Homo sapiens
aaagaagaaaccugaagau

SEQ ID NO: 971183 - RNA, 19 nt, Homo sapiens
guaaagcauauuucuaucg

SEQ ID NO: 971184 - RNA, 19 nt, Homo sapiens
guucuucagucauccuuac

SEQ ID NO: 971185 - RNA, 19 nt, Homo sapiens
uuuaaggaauggaaagagu

SEQ ID NO: 971186 - RNA, 19 nt, Homo sapiens
ugggagccuuccuuccuaa

SEQ ID NO: 971187 - RNA, 19 nt, Homo sapiens
ccuaaucaagaugcaaaua

SEQ ID NO: 971188 - RNA, 19 nt, Homo sapiens
ccaugagaucggacacaua

SEQ ID NO: 971189 - RNA, 19 nt, Homo sapiens
ccuuuagagucaaugagaa

SEQ ID NO: 971190 - RNA, 19 nt, Homo sapiens
acaagauguuccuuuagag

SEQ ID NO: 971191 - RNA, 19 nt, Homo sapiens
agucauccuuacagaaaga

SEQ ID NO: 971192 - RNA, 19 nt, Homo sapiens
cuucagucauccuuacaga

SEQ ID NO: 971193 - RNA, 19 nt, Homo sapiens
guacgguauuccgaacaga

SEQ ID NO: 971194 - RNA, 19 nt, Homo sapiens
ggacauccugaaguucuug

SEQ ID NO: 971195 - RNA, 19 nt, Homo sapiens
uauaaaggcaaagugaaga

SEQ ID NO: 971196 - RNA, 19 nt, Homo sapiens
caugcacuauaaaggcaaa

SEQ ID NO: 971197 - RNA, 19 nt, Homo sapiens
auggaaagaguggauaaua

SEQ ID NO: 971198 - RNA, 19 nt, Homo sapiens
uuccagaaauaacuagugu

SEQ ID NO: 971199 - RNA, 19 nt, Homo sapiens
gugaagaagcucaagaaaa

SEQ ID NO: 971200 - RNA, 19 nt, Homo sapiens
aagaagaaaccugaagaug

SEQ ID NO: 971201 - RNA, 19 nt, Homo sapiens
auauuucuaucgcuugaga

SEQ ID NO: 971202 - RNA, 19 nt, Homo sapiens
ucuaugaagcaccagaauu

SEQ ID NO: 971203 - RNA, 19 nt, Homo sapiens
agaacacagucacgaggau

SEQ ID NO: 971204 - RNA, 19 nt, Homo sapiens
uagagucaaugagaacaca

SEQ ID NO: 971205 - RNA, 19 nt, Homo sapiens
gauguuccuuuagagucaa

SEQ ID NO: 971206 - RNA, 19 nt, Homo sapiens
gaauccagugcuuguguca

SEQ ID NO: 971207 - RNA, 19 nt, Homo sapiens
gaacagaaguuucacaaug

SEQ ID NO: 971208 - RNA, 19 nt, Homo sapiens
gagcauaaccuacuuguuu

SEQ ID NO: 971209 - RNA, 19 nt, Homo sapiens
aaacagagcuagucagaug

SEQ ID NO: 971210 - RNA, 19 nt, Homo sapiens
gugaagaugugaauaauug

SEQ ID NO: 971211 - RNA, 19 nt, Homo sapiens
gaagcaggcaucaagauua

SEQ ID NO: 971212 - RNA, 19 nt, Homo sapiens
gaaccugucucuccucgaa

SEQ ID NO: 971213 - RNA, 19 nt, Homo sapiens
caacauaacgucucugauu

SEQ ID NO: 971214 - RNA, 19 nt, Homo sapiens
gacaauugcuuccugcuuu

SEQ ID NO: 971215 - RNA, 19 nt, Homo sapiens
uaacgucucugauuucuca

SEQ ID NO: 971216 - RNA, 19 nt, Homo sapiens
gccaauaccucccuuacuu

SEQ ID NO: 971217 - RNA, 19 nt, Homo sapiens
guaaaacccuugaaaugua

SEQ ID NO: 971218 - RNA, 19 nt, Homo sapiens
uaauggagcaucuacuuua

SEQ ID NO: 971219 - RNA, 19 nt, Homo sapiens
gagcaucuacuuuaucaaa

SEQ ID NO: 971220 - RNA, 19 nt, Homo sapiens
guagauuucuuguagaugu

SEQ ID NO: 971221 - RNA, 19 nt, Homo sapiens
guaaaucuguugcccaauc

SEQ ID NO: 971222 - RNA, 19 nt, Homo sapiens
ggacccaaaucuucuuaga

SEQ ID NO: 971223 - RNA, 19 nt, Homo sapiens
gcacuuaaguauucaucga

SEQ ID NO: 971224 - RNA, 19 nt, Homo sapiens
gagcagagacucacaguag

SEQ ID NO: 971225 - RNA, 19 nt, Homo sapiens
caaacaagauggcagucaa

SEQ ID NO: 971226 - RNA, 19 nt, Homo sapiens
gaaagagaacagagacaaa

SEQ ID NO: 971227 - RNA, 19 nt, Homo sapiens
ggaaacagagcuagucaga

SEQ ID NO: 971228 - RNA, 19 nt, Homo sapiens
gcucaaauauaaggaaaug

SEQ ID NO: 971229 - RNA, 19 nt, Homo sapiens
aaaccugucugcaaaauua

SEQ ID NO: 971230 - RNA, 19 nt, Homo sapiens
gaucaguacuccuccuguu

SEQ ID NO: 971231 - RNA, 19 nt, Homo sapiens
ucacugcagucuauaauuc

SEQ ID NO: 971232 - RNA, 19 nt, Homo sapiens
guaguuugcucccacagaa

SEQ ID NO: 971233 - RNA, 19 nt, Homo sapiens
ccacagugcucuucauagu

SEQ ID NO: 971234 - RNA, 19 nt, Homo sapiens
augcugagguggcuaaaua

SEQ ID NO: 971235 - RNA, 19 nt, Homo sapiens
cgaagaagcgcauaacaug

SEQ ID NO: 971236 - RNA, 19 nt, Homo sapiens
uaacacagucccuaucaaa

SEQ ID NO: 971237 - RNA, 19 nt, Homo sapiens
gcucagcucucuacacaag

SEQ ID NO: 971238 - RNA, 19 nt, Homo sapiens
caaacaagcagacacaaug

SEQ ID NO: 971239 - RNA, 19 nt, Homo sapiens
agaauaagcacaccucaaa

SEQ ID NO: 971240 - RNA, 19 nt, Homo sapiens
gaaagaggaaacagagcua

SEQ ID NO: 971241 - RNA, 19 nt, Homo sapiens
aagaguggcuugaaagaga

SEQ ID NO: 971242 - RNA, 19 nt, Homo sapiens
gaugugaauuguaucuguu

SEQ ID NO: 971243 - RNA, 19 nt, Homo sapiens
agucagaugugaauuguau

SEQ ID NO: 971244 - RNA, 19 nt, Homo sapiens
cgauuugugucuaaggaua

SEQ ID NO: 971245 - RNA, 19 nt, Homo sapiens
aacauaacgucucugauuu

SEQ ID NO: 971246 - RNA, 19 nt, Homo sapiens
ugacuggucugagcauauu

SEQ ID NO: 971247 - RNA, 19 nt, Homo sapiens
cucuuuaucuccuuucuua

SEQ ID NO: 971248 - RNA, 19 nt, Homo sapiens
ggugugaagaugugaauaa

SEQ ID NO: 971249 - RNA, 19 nt, Homo sapiens
ggagauccuucaccaccaa

SEQ ID NO: 971250 - RNA, 19 nt, Homo sapiens
gacaaacccguaucacauu

SEQ ID NO: 971251 - RNA, 19 nt, Homo sapiens
cagcagagacucagugaug

SEQ ID NO: 971252 - RNA, 19 nt, Homo sapiens
gguaauguaugcgaggaaa

SEQ ID NO: 971253 - RNA, 19 nt, Homo sapiens
gagcaaaggauacuauuuu

SEQ ID NO: 971254 - RNA, 19 nt, Homo sapiens
ucacauguccgaaauuugu

SEQ ID NO: 971255 - RNA, 19 nt, Homo sapiens
uaagcacaccucaaacuaa

SEQ ID NO: 971256 - RNA, 19 nt, Homo sapiens
gcgcauaacaugggaacua

SEQ ID NO: 971257 - RNA, 19 nt, Homo sapiens
gacaagcauuccagugaug

SEQ ID NO: 971258 - RNA, 19 nt, Homo sapiens
gacaacaaauuaaggaacu

SEQ ID NO: 971259 - RNA, 19 nt, Homo sapiens
ccaaucauacuucuaauag

SEQ ID NO: 971260 - RNA, 19 nt, Homo sapiens
cauuuacgcuacagucuga

SEQ ID NO: 971261 - RNA, 19 nt, Homo sapiens
gcagagacucacaguaguu

SEQ ID NO: 971262 - RNA, 19 nt, Homo sapiens
agauagggauuacagaaga

SEQ ID NO: 971263 - RNA, 19 nt, Homo sapiens
acagugcucuucauaguuc

SEQ ID NO: 971264 - RNA, 19 nt, Homo sapiens
caguuacucuccacaagaa

SEQ ID NO: 971265 - RNA, 19 nt, Homo sapiens
cuacaauugucgaacagaa

SEQ ID NO: 971266 - RNA, 19 nt, Homo sapiens
gaaaacaaauacagugaca

SEQ ID NO: 971267 - RNA, 19 nt, Homo sapiens
uauuagcucuucugggaaa

SEQ ID NO: 971268 - RNA, 19 nt, Homo sapiens
aaacuucagaugcaccuua

SEQ ID NO: 971269 - RNA, 19 nt, Homo sapiens
gcacuuuucuauaaccuuu

SEQ ID NO: 971270 - RNA, 19 nt, Homo sapiens
ccacgcugcagcuuaauaa

SEQ ID NO: 971271 - RNA, 19 nt, Homo sapiens
gauccuucaccaccaaaua

SEQ ID NO: 971272 - RNA, 19 nt, Homo sapiens
ggugaucacagacaugaaa

SEQ ID NO: 971273 - RNA, 19 nt, Homo sapiens
auaaggaaauggcccaaug

SEQ ID NO: 971274 - RNA, 19 nt, Homo sapiens
uugcagugauugagcauaa

SEQ ID NO: 971275 - RNA, 19 nt, Homo sapiens
uuaaggcacuguugcuaug

SEQ ID NO: 971276 - RNA, 19 nt, Homo sapiens
gauguauccuucacguugu

SEQ ID NO: 971277 - RNA, 19 nt, Homo sapiens
gagacaaacccguaucaca

SEQ ID NO: 971278 - RNA, 19 nt, Homo sapiens
gcuaauggagcaucuacuu

SEQ ID NO: 971279 - RNA, 19 nt, Homo sapiens
gaugacuggucugagcaua

SEQ ID NO: 971280 - RNA, 19 nt, Homo sapiens
gaaauggcccaaugaacgu

SEQ ID NO: 971281 - RNA, 19 nt, Homo sapiens
ggaaagauacaagauugau

SEQ ID NO: 971282 - RNA, 19 nt, Homo sapiens
gaauaauugcacaugguuu

SEQ ID NO: 971283 - RNA, 19 nt, Homo sapiens
cgauccacguguucauuaa

SEQ ID NO: 971284 - RNA, 19 nt, Homo sapiens
gcagacacaaugacagaga

SEQ ID NO: 971285 - RNA, 19 nt, Homo sapiens
ccaaaagaguggcuugaaa

SEQ ID NO: 971286 - RNA, 19 nt, Homo sapiens
gagcuagucagaugugaau

SEQ ID NO: 971287 - RNA, 19 nt, Homo sapiens
caguagcggugaucacaga

SEQ ID NO: 971288 - RNA, 19 nt, Homo sapiens
ccaggcgauuugugucuaa

SEQ ID NO: 971289 - RNA, 19 nt, Homo sapiens
ucacagacaugaaaagaug

SEQ ID NO: 971290 - RNA, 19 nt, Homo sapiens
ucaaguagccagagaaguc

SEQ ID NO: 971291 - RNA, 19 nt, Homo sapiens
uggagcaucuacuuuauca

SEQ ID NO: 971292 - RNA, 19 nt, Homo sapiens
caagcacuguuccuucuag

SEQ ID NO: 971293 - RNA, 19 nt, Homo sapiens
aaagauagggauuacagaa

SEQ ID NO: 971294 - RNA, 19 nt, Homo sapiens
cuacuacaauugucgaaca

SEQ ID NO: 971295 - RNA, 19 nt, Homo sapiens
cagcacaggucacaguaag

SEQ ID NO: 971296 - RNA, 19 nt, Homo sapiens
gauacgauuuugaaccaua

SEQ ID NO: 971297 - RNA, 19 nt, Homo sapiens
ggggaaagauacaagauug

SEQ ID NO: 971298 - RNA, 19 nt, Homo sapiens
acccaaaucuucuuagaca

SEQ ID NO: 971299 - RNA, 19 nt, Homo sapiens
gaaucuacaucaggagaca

SEQ ID NO: 971300 - RNA, 19 nt, Homo sapiens
aaacaagcagacacaauga

SEQ ID NO: 971301 - RNA, 19 nt, Homo sapiens
ccaguggaauggaagacaa

SEQ ID NO: 971302 - RNA, 19 nt, Homo sapiens
ucagaugcaccuuaugauu

SEQ ID NO: 971303 - RNA, 19 nt, Homo sapiens
gcuagucagaugugaauug

SEQ ID NO: 971304 - RNA, 19 nt, Homo sapiens
gcgaagaagcgcauaacau

SEQ ID NO: 971305 - RNA, 19 nt, Homo sapiens
ccaaaucuucuuagacaau

SEQ ID NO: 971306 - RNA, 19 nt, Homo sapiens
cagaugcaccuuaugauuc

SEQ ID NO: 971307 - RNA, 19 nt, Homo sapiens
gaacagaaguuucacaaug

SEQ ID NO: 971308 - RNA, 19 nt, Homo sapiens
gagcauaaccuacuuguuu

SEQ ID NO: 971309 - RNA, 19 nt, Homo sapiens
aaacagagcuagucagaug

SEQ ID NO: 971310 - RNA, 19 nt, Homo sapiens
gugaagaugugaauaauug

SEQ ID NO: 971311 - RNA, 19 nt, Homo sapiens
gaagcaggcaucaagauua

SEQ ID NO: 971312 - RNA, 19 nt, Homo sapiens
gaaccugucucuccucgaa

SEQ ID NO: 971313 - RNA, 19 nt, Homo sapiens
caacauaacgucucugauu

SEQ ID NO: 971314 - RNA, 19 nt, Homo sapiens
gacaauugcuuccugcuuu

SEQ ID NO: 971315 - RNA, 19 nt, Homo sapiens
uaacgucucugauuucuca

SEQ ID NO: 971316 - RNA, 19 nt, Homo sapiens
gccaauaccucccuuacuu

SEQ ID NO: 971317 - RNA, 19 nt, Homo sapiens
guaaaacccuugaaaugua

SEQ ID NO: 971318 - RNA, 19 nt, Homo sapiens
uaauggagcaucuacuuua

SEQ ID NO: 971319 - RNA, 19 nt, Homo sapiens
gagcaucuacuuuaucaaa

SEQ ID NO: 971320 - RNA, 19 nt, Homo sapiens
guagauuucuuguagaugu

SEQ ID NO: 971321 - RNA, 19 nt, Homo sapiens
guaaaucuguugcccaauc

SEQ ID NO: 971322 - RNA, 19 nt, Homo sapiens
ggacccaaaucuucuuaga

SEQ ID NO: 971323 - RNA, 19 nt, Homo sapiens
gcacuuaaguauucaucga

SEQ ID NO: 971324 - RNA, 19 nt, Homo sapiens
gagcagagacucacaguag

SEQ ID NO: 971325 - RNA, 19 nt, Homo sapiens
caaacaagauggcagucaa

SEQ ID NO: 971326 - RNA, 19 nt, Homo sapiens
gaaagagaacagagacaaa

SEQ ID NO: 971327 - RNA, 19 nt, Homo sapiens
ggaaacagagcuagucaga

SEQ ID NO: 971328 - RNA, 19 nt, Homo sapiens
gcucaaauauaaggaaaug

SEQ ID NO: 971329 - RNA, 19 nt, Homo sapiens
gagcgagacuaucccuaaa

SEQ ID NO: 971330 - RNA, 19 nt, Homo sapiens
aaaccugucugcaaaauua

SEQ ID NO: 971331 - RNA, 19 nt, Homo sapiens
gaucaguacuccuccuguu

SEQ ID NO: 971332 - RNA, 19 nt, Homo sapiens
ucacugcagucuauaauuc

SEQ ID NO: 971333 - RNA, 19 nt, Homo sapiens
guaguuugcucccacagaa

SEQ ID NO: 971334 - RNA, 19 nt, Homo sapiens
ccacagugcucuucauagu

SEQ ID NO: 971335 - RNA, 19 nt, Homo sapiens
augcugagguggcuaaaua

SEQ ID NO: 971336 - RNA, 19 nt, Homo sapiens
cgaagaagcgcauaacaug

SEQ ID NO: 971337 - RNA, 19 nt, Homo sapiens
uaacacagucccuaucaaa

SEQ ID NO: 971338 - RNA, 19 nt, Homo sapiens
gcucagcucucuacacaag

SEQ ID NO: 971339 - RNA, 19 nt, Homo sapiens
caaacaagcagacacaaug

SEQ ID NO: 971340 - RNA, 19 nt, Homo sapiens
agaauaagcacaccucaaa

SEQ ID NO: 971341 - RNA, 19 nt, Homo sapiens
gaaagaggaaacagagcua

SEQ ID NO: 971342 - RNA, 19 nt, Homo sapiens
aagaguggcuugaaagaga

SEQ ID NO: 971343 - RNA, 19 nt, Homo sapiens
gaugugaauuguaucuguu

SEQ ID NO: 971344 - RNA, 19 nt, Homo sapiens
agucagaugugaauuguau

SEQ ID NO: 971345 - RNA, 19 nt, Homo sapiens
cgauuugugucuaaggaua

SEQ ID NO: 971346 - RNA, 19 nt, Homo sapiens
aacauaacgucucugauuu

SEQ ID NO: 971347 - RNA, 19 nt, Homo sapiens
ugacuggucugagcauauu

SEQ ID NO: 971348 - RNA, 19 nt, Homo sapiens
cucuuuaucuccuuucuua

SEQ ID NO: 971349 - RNA, 19 nt, Homo sapiens
ggugugaagaugugaauaa

SEQ ID NO: 971350 - RNA, 19 nt, Homo sapiens
ggagauccuucaccaccaa

SEQ ID NO: 971351 - RNA, 19 nt, Homo sapiens
gacaaacccguaucacauu

SEQ ID NO: 971352 - RNA, 19 nt, Homo sapiens
gagcaaaggauacuauuuu

SEQ ID NO: 971353 - RNA, 19 nt, Homo sapiens
ucacauguccgaaauuugu

SEQ ID NO: 971354 - RNA, 19 nt, Homo sapiens
uaagcacaccucaaacuaa

SEQ ID NO: 971355 - RNA, 19 nt, Homo sapiens
gcgcauaacaugggaacua

SEQ ID NO: 971356 - RNA, 19 nt, Homo sapiens
gacaagcauuccagugaug

SEQ ID NO: 971357 - RNA, 19 nt, Homo sapiens
gacaacaaauuaaggaacu

SEQ ID NO: 971358 - RNA, 19 nt, Homo sapiens
ccaaucauacuucuaauag

SEQ ID NO: 971359 - RNA, 19 nt, Homo sapiens
cauuuacgcuacagucuga

SEQ ID NO: 971360 - RNA, 19 nt, Homo sapiens
gcagagacucacaguaguu

SEQ ID NO: 971361 - RNA, 19 nt, Homo sapiens
agauagggauuacagaaga

SEQ ID NO: 971362 - RNA, 19 nt, Homo sapiens
acagugcucuucauaguuc

SEQ ID NO: 971363 - RNA, 19 nt, Homo sapiens
caguuacucuccacaagaa

SEQ ID NO: 971364 - RNA, 19 nt, Homo sapiens
cuacaauugucgaacagaa

SEQ ID NO: 971365 - RNA, 19 nt, Homo sapiens
gaaaacaaauacagugaca

SEQ ID NO: 971366 - RNA, 19 nt, Homo sapiens
uauuagcucuucugggaaa

SEQ ID NO: 971367 - RNA, 19 nt, Homo sapiens
aaacuucagaugcaccuua

SEQ ID NO: 971368 - RNA, 19 nt, Homo sapiens
gcacuuuucuauaaccuuu

SEQ ID NO: 971369 - RNA, 19 nt, Homo sapiens
gauccuucaccaccaaaua

SEQ ID NO: 971370 - RNA, 19 nt, Homo sapiens
ggugaucacagacaugaaa

SEQ ID NO: 971371 - RNA, 19 nt, Homo sapiens
ccacgcugcagcuuaauaa

SEQ ID NO: 971372 - RNA, 19 nt, Homo sapiens
auaaggaaauggcccaaug

SEQ ID NO: 971373 - RNA, 19 nt, Homo sapiens
uugcagugauugagcauaa

SEQ ID NO: 971374 - RNA, 19 nt, Homo sapiens
uuaaggcacuguugcuaug

SEQ ID NO: 971375 - RNA, 19 nt, Homo sapiens
gauguauccuucacguugu

SEQ ID NO: 971376 - RNA, 19 nt, Homo sapiens
gagacaaacccguaucaca

SEQ ID NO: 971377 - RNA, 19 nt, Homo sapiens
gcuaauggagcaucuacuu

SEQ ID NO: 971378 - RNA, 19 nt, Homo sapiens
gaugacuggucugagcaua

SEQ ID NO: 971379 - RNA, 19 nt, Homo sapiens
gaaauggcccaaugaacgu

SEQ ID NO: 971380 - RNA, 19 nt, Homo sapiens
ggaaagauacaagauugau

SEQ ID NO: 971381 - RNA, 19 nt, Homo sapiens
gaauaauugcacaugguuu

SEQ ID NO: 971382 - RNA, 19 nt, Homo sapiens
cgauccacguguucauuaa

SEQ ID NO: 971383 - RNA, 19 nt, Homo sapiens
gcagacacaaugacagaga

SEQ ID NO: 971384 - RNA, 19 nt, Homo sapiens
ccaaaagaguggcuugaaa

SEQ ID NO: 971385 - RNA, 19 nt, Homo sapiens
gagcuagucagaugugaau

SEQ ID NO: 971386 - RNA, 19 nt, Homo sapiens
caguagcggugaucacaga

SEQ ID NO: 971387 - RNA, 19 nt, Homo sapiens
ccaggcgauuugugucuaa

SEQ ID NO: 971388 - RNA, 19 nt, Homo sapiens
ucaaguagccagagaaguc

SEQ ID NO: 971389 - RNA, 19 nt, Homo sapiens
uggagcaucuacuuuauca

SEQ ID NO: 971390 - RNA, 19 nt, Homo sapiens
ucacagacaugaaaagaug

SEQ ID NO: 971391 - RNA, 19 nt, Homo sapiens
caagcacuguuccuucuag

SEQ ID NO: 971392 - RNA, 19 nt, Homo sapiens
aaagauagggauuacagaa

SEQ ID NO: 971393 - RNA, 19 nt, Homo sapiens
cgagcgagacuaucccuaa

SEQ ID NO: 971394 - RNA, 19 nt, Homo sapiens
cuacuacaauugucgaaca

SEQ ID NO: 971395 - RNA, 19 nt, Homo sapiens
cagcacaggucacaguaag

SEQ ID NO: 971396 - RNA, 19 nt, Homo sapiens
gauacgauuuugaaccaua

SEQ ID NO: 971397 - RNA, 19 nt, Homo sapiens
ggggaaagauacaagauug

SEQ ID NO: 971398 - RNA, 19 nt, Homo sapiens
acccaaaucuucuuagaca

SEQ ID NO: 971399 - RNA, 19 nt, Homo sapiens
gaaucuacaucaggagaca

SEQ ID NO: 971400 - RNA, 19 nt, Homo sapiens
aaacaagcagacacaauga

SEQ ID NO: 971401 - RNA, 19 nt, Homo sapiens
ccaguggaauggaagacaa

SEQ ID NO: 971402 - RNA, 19 nt, Homo sapiens
ucagaugcaccuuaugauu

SEQ ID NO: 971403 - RNA, 19 nt, Homo sapiens
gcuagucagaugugaauug

SEQ ID NO: 971404 - RNA, 19 nt, Homo sapiens
gcgaagaagcgcauaacau

SEQ ID NO: 971405 - RNA, 19 nt, Homo sapiens
ccaaaucuucuuagacaau

SEQ ID NO: 971406 - RNA, 19 nt, Homo sapiens
cagaugcaccuuaugauuc

SEQ ID NO: 971407 - RNA, 19 nt, Homo sapiens
gaacagaaguuucacaaug

SEQ ID NO: 971408 - RNA, 19 nt, Homo sapiens
gagcauaaccuacuuguuu

SEQ ID NO: 971409 - RNA, 19 nt, Homo sapiens
aaacagagcuagucagaug

SEQ ID NO: 971410 - RNA, 19 nt, Homo sapiens
gugaagaugugaauaauug

SEQ ID NO: 971411 - RNA, 19 nt, Homo sapiens
gaagcaggcaucaagauua

SEQ ID NO: 971412 - RNA, 19 nt, Homo sapiens
gaaccugucucuccucgaa

SEQ ID NO: 971413 - RNA, 19 nt, Homo sapiens
caacauaacgucucugauu

SEQ ID NO: 971414 - RNA, 19 nt, Homo sapiens
gacaauugcuuccugcuuu

SEQ ID NO: 971415 - RNA, 19 nt, Homo sapiens
uaacgucucugauuucuca

SEQ ID NO: 971416 - RNA, 19 nt, Homo sapiens
gccaauaccucccuuacuu

SEQ ID NO: 971417 - RNA, 19 nt, Homo sapiens
guaaaacccuugaaaugua

SEQ ID NO: 971418 - RNA, 19 nt, Homo sapiens
guagauuucuuguagaugu

SEQ ID NO: 971419 - RNA, 19 nt, Homo sapiens
guaaaucuguugcccaauc

SEQ ID NO: 971420 - RNA, 19 nt, Homo sapiens
ggacccaaaucuucuuaga

SEQ ID NO: 971421 - RNA, 19 nt, Homo sapiens
gcacuuaaguauucaucga

SEQ ID NO: 971422 - RNA, 19 nt, Homo sapiens
caaacaagauggcagucaa

SEQ ID NO: 971423 - RNA, 19 nt, Homo sapiens
gaaagagaacagagacaaa

SEQ ID NO: 971424 - RNA, 19 nt, Homo sapiens
ggaaacagagcuagucaga

SEQ ID NO: 971425 - RNA, 19 nt, Homo sapiens
gcucaaauauaaggaaaug

SEQ ID NO: 971426 - RNA, 19 nt, Homo sapiens
aaaccugucugcaaaauua

SEQ ID NO: 971427 - RNA, 19 nt, Homo sapiens
gaucaguacuccuccuguu

SEQ ID NO: 971428 - RNA, 19 nt, Homo sapiens
ucacugcagucuauaauuc

SEQ ID NO: 971429 - RNA, 19 nt, Homo sapiens
ccacagugcucuucauagu

SEQ ID NO: 971430 - RNA, 19 nt, Homo sapiens
augcugagguggcuaaaua

SEQ ID NO: 971431 - RNA, 19 nt, Homo sapiens
cgaagaagcgcauaacaug

SEQ ID NO: 971432 - RNA, 19 nt, Homo sapiens
uaacacagucccuaucaaa

SEQ ID NO: 971433 - RNA, 19 nt, Homo sapiens
gcucagcucucuacacaag

SEQ ID NO: 971434 - RNA, 19 nt, Homo sapiens
agaauaagcacaccucaaa

SEQ ID NO: 971435 - RNA, 19 nt, Homo sapiens
gaaagaggaaacagagcua

SEQ ID NO: 971436 - RNA, 19 nt, Homo sapiens
aagaguggcuugaaagaga

SEQ ID NO: 971437 - RNA, 19 nt, Homo sapiens
gaugugaauuguaucuguu

SEQ ID NO: 971438 - RNA, 19 nt, Homo sapiens
agucagaugugaauuguau

SEQ ID NO: 971439 - RNA, 19 nt, Homo sapiens
cgauuugugucuaaggaua

SEQ ID NO: 971440 - RNA, 19 nt, Homo sapiens
aacauaacgucucugauuu

SEQ ID NO: 971441 - RNA, 19 nt, Homo sapiens
ugacuggucugagcauauu

SEQ ID NO: 971442 - RNA, 19 nt, Homo sapiens
cucuuuaucuccuuucuua

SEQ ID NO: 971443 - RNA, 19 nt, Homo sapiens
ggugugaagaugugaauaa

SEQ ID NO: 971444 - RNA, 19 nt, Homo sapiens
ggagauccuucaccaccaa

SEQ ID NO: 971445 - RNA, 19 nt, Homo sapiens
gacaaacccguaucacauu

SEQ ID NO: 971446 - RNA, 19 nt, Homo sapiens
gguaauguaugcgaggaaa

SEQ ID NO: 971447 - RNA, 19 nt, Homo sapiens
gagcaaaggauacuauuuu

SEQ ID NO: 971448 - RNA, 19 nt, Homo sapiens
ucacauguccgaaauuugu

SEQ ID NO: 971449 - RNA, 19 nt, Homo sapiens
uaagcacaccucaaacuaa

SEQ ID NO: 971450 - RNA, 19 nt, Homo sapiens
cagcagagacucagugaug

SEQ ID NO: 971451 - RNA, 19 nt, Homo sapiens
gcgcauaacaugggaacua

SEQ ID NO: 971452 - RNA, 19 nt, Homo sapiens
gacaacaaauuaaggaacu

SEQ ID NO: 971453 - RNA, 19 nt, Homo sapiens
ccaaucauacuucuaauag

SEQ ID NO: 971454 - RNA, 19 nt, Homo sapiens
agauagggauuacagaaga

SEQ ID NO: 971455 - RNA, 19 nt, Homo sapiens
acagugcucuucauaguuc

SEQ ID NO: 971456 - RNA, 19 nt, Homo sapiens
caguuacucuccacaagaa

SEQ ID NO: 971457 - RNA, 19 nt, Homo sapiens
cuacaauugucgaacagaa

SEQ ID NO: 971458 - RNA, 19 nt, Homo sapiens
gaaaacaaauacagugaca

SEQ ID NO: 971459 - RNA, 19 nt, Homo sapiens
uauuagcucuucugggaaa

SEQ ID NO: 971460 - RNA, 19 nt, Homo sapiens
aaacuucagaugcaccuua

SEQ ID NO: 971461 - RNA, 19 nt, Homo sapiens
gcacuuuucuauaaccuuu

SEQ ID NO: 971462 - RNA, 19 nt, Homo sapiens
ggugaucacagacaugaaa

SEQ ID NO: 971463 - RNA, 19 nt, Homo sapiens
ccacgcugcagcuuaauaa

SEQ ID NO: 971464 - RNA, 19 nt, Homo sapiens
gauccuucaccaccaaaua

SEQ ID NO: 971465 - RNA, 19 nt, Homo sapiens
auaaggaaauggcccaaug

SEQ ID NO: 971466 - RNA, 19 nt, Homo sapiens
uugcagugauugagcauaa

SEQ ID NO: 971467 - RNA, 19 nt, Homo sapiens
uuaaggcacuguugcuaug

SEQ ID NO: 971468 - RNA, 19 nt, Homo sapiens
gauguauccuucacguugu

SEQ ID NO: 971469 - RNA, 19 nt, Homo sapiens
gagacaaacccguaucaca

SEQ ID NO: 971470 - RNA, 19 nt, Homo sapiens
gaugacuggucugagcaua

SEQ ID NO: 971471 - RNA, 19 nt, Homo sapiens
gaaauggcccaaugaacgu

SEQ ID NO: 971472 - RNA, 19 nt, Homo sapiens
ggaaagauacaagauugau

SEQ ID NO: 971473 - RNA, 19 nt, Homo sapiens
gaauaauugcacaugguuu

SEQ ID NO: 971474 - RNA, 19 nt, Homo sapiens
cgauccacguguucauuaa

SEQ ID NO: 971475 - RNA, 19 nt, Homo sapiens
ccaaaagaguggcuugaaa

SEQ ID NO: 971476 - RNA, 19 nt, Homo sapiens
gagcuagucagaugugaau

SEQ ID NO: 971477 - RNA, 19 nt, Homo sapiens
ccaggcgauuugugucuaa

SEQ ID NO: 971478 - RNA, 19 nt, Homo sapiens
ucacagacaugaaaagaug

SEQ ID NO: 971479 - RNA, 19 nt, Homo sapiens
ucaaguagccagagaaguc

SEQ ID NO: 971480 - RNA, 19 nt, Homo sapiens
caguagcggugaucacaga

SEQ ID NO: 971481 - RNA, 19 nt, Homo sapiens
aaagauagggauuacagaa

SEQ ID NO: 971482 - RNA, 19 nt, Homo sapiens
cuacuacaauugucgaaca

SEQ ID NO: 971483 - RNA, 19 nt, Homo sapiens
cagcacaggucacaguaag

SEQ ID NO: 971484 - RNA, 19 nt, Homo sapiens
gauacgauuuugaaccaua

SEQ ID NO: 971485 - RNA, 19 nt, Homo sapiens
ggggaaagauacaagauug

SEQ ID NO: 971486 - RNA, 19 nt, Homo sapiens
acccaaaucuucuuagaca

SEQ ID NO: 971487 - RNA, 19 nt, Homo sapiens
ucagaugcaccuuaugauu

SEQ ID NO: 971488 - RNA, 19 nt, Homo sapiens
gcuagucagaugugaauug

SEQ ID NO: 971489 - RNA, 19 nt, Homo sapiens
gcgaagaagcgcauaacau

SEQ ID NO: 971490 - RNA, 19 nt, Homo sapiens
ccaaaucuucuuagacaau

SEQ ID NO: 971491 - RNA, 19 nt, Homo sapiens
cagaugcaccuuaugauuc

SEQ ID NO: 971492 - RNA, 19 nt, Homo sapiens
uaaggaaauggcccaauga

SEQ ID NO: 971493 - RNA, 19 nt, Homo sapiens
gugaauaauugcacauggu

SEQ ID NO: 971494 - RNA, 19 nt, Homo sapiens
gcuuagacauccaaaacua

SEQ ID NO: 971495 - RNA, 19 nt, Homo sapiens
gagagcaaaggauacuauu

SEQ ID NO: 971496 - RNA, 19 nt, Homo sapiens
cauaacaugggaacuauuc

SEQ ID NO: 971497 - RNA, 19 nt, Homo sapiens
ucuaaucagucuccgaugu

SEQ ID NO: 971498 - RNA, 19 nt, Homo sapiens
ccaucugcuuucaacauaa

SEQ ID NO: 971499 - RNA, 19 nt, Homo sapiens
cgcugcagcuuaauaauuc

SEQ ID NO: 971500 - RNA, 19 nt, Homo sapiens
agacaaacccguaucacau

SEQ ID NO: 971501 - RNA, 19 nt, Homo sapiens
ucacauucuucuaauccaa

SEQ ID NO: 971502 - RNA, 19 nt, Homo sapiens
gauugagcauaaccuacuu

SEQ ID NO: 971503 - RNA, 19 nt, Homo sapiens
gagcugcauuuaaguagac

SEQ ID NO: 971504 - RNA, 19 nt, Homo sapiens
gagaagcaggcaucaagau

SEQ ID NO: 971505 - RNA, 19 nt, Homo sapiens
gcgcucaaguagccagaga

SEQ ID NO: 971506 - RNA, 19 nt, Homo sapiens
gcccagccaucuaaucagu

SEQ ID NO: 971507 - RNA, 19 nt, Homo sapiens
ggacauaccuguaacuauu

SEQ ID NO: 971508 - RNA, 19 nt, Homo sapiens
gaacuggcuucaagacuua

SEQ ID NO: 971509 - RNA, 19 nt, Homo sapiens
gugcagaggucaaucuuua

SEQ ID NO: 971510 - RNA, 19 nt, Homo sapiens
ccgaagagcucaucugaaa

SEQ ID NO: 971511 - RNA, 19 nt, Homo sapiens
uaaagucucuccugauuau

SEQ ID NO: 971512 - RNA, 19 nt, Homo sapiens
gaaauuugcugaauacacu

SEQ ID NO: 971513 - RNA, 19 nt, Homo sapiens
gcuacugccuuucuagaua

SEQ ID NO: 971514 - RNA, 19 nt, Homo sapiens
gauuauaacugguuuagag

SEQ ID NO: 971515 - RNA, 19 nt, Homo sapiens
uaucagguguccucucaua

SEQ ID NO: 971516 - RNA, 19 nt, Homo sapiens
agagugcgcuuucaacuga

SEQ ID NO: 971517 - RNA, 19 nt, Homo sapiens
ugaauacacucacaaaucu

SEQ ID NO: 971518 - RNA, 19 nt, Homo sapiens
caacugaagcuaaagaaga

SEQ ID NO: 971519 - RNA, 19 nt, Homo sapiens
uaaccuccauuucagcuaa

SEQ ID NO: 971520 - RNA, 19 nt, Homo sapiens
ccagaaauuugcugaauac

SEQ ID NO: 971521 - RNA, 19 nt, Homo sapiens
uagacaggcuagaaaguuu

SEQ ID NO: 971522 - RNA, 19 nt, Homo sapiens
agacuuaccuugaauuguc

SEQ ID NO: 971523 - RNA, 19 nt, Homo sapiens
gaugaugacaguaagauau

SEQ ID NO: 971524 - RNA, 19 nt, Homo sapiens
gguuaucgcuuugcaguau

SEQ ID NO: 971525 - RNA, 19 nt, Homo sapiens
ggacauugguuauuuuaug

SEQ ID NO: 971526 - RNA, 19 nt, Homo sapiens
ccacuaagccuguguaacu

SEQ ID NO: 971527 - RNA, 19 nt, Homo sapiens
agaggucaaucuuuaugua

SEQ ID NO: 971528 - RNA, 19 nt, Homo sapiens
gacauaccuguaacuauua

SEQ ID NO: 971529 - RNA, 19 nt, Homo sapiens
uauaacugguuuagaggua

SEQ ID NO: 971530 - RNA, 19 nt, Homo sapiens
ggauuaaccuccauuucag

SEQ ID NO: 971531 - RNA, 19 nt, Homo sapiens
gcaaaucaacugcuuuuaa

SEQ ID NO: 971532 - RNA, 19 nt, Homo sapiens
cccagaaauuugcugaaua

SEQ ID NO: 971533 - RNA, 19 nt, Homo sapiens
cauaucaggacauugguua

SEQ ID NO: 971534 - RNA, 19 nt, Homo sapiens
gcucaccgguucucacugu

SEQ ID NO: 971535 - RNA, 19 nt, Homo sapiens
gaagagcggccuccugaag

SEQ ID NO: 971536 - RNA, 19 nt, Homo sapiens
cuucaccacuguguucuua

SEQ ID NO: 971537 - RNA, 19 nt, Homo sapiens
gcacauccagauugcauau

SEQ ID NO: 971538 - RNA, 19 nt, Homo sapiens
guguaacuguucccucuuu

SEQ ID NO: 971539 - RNA, 19 nt, Homo sapiens
auuaaagucucuccugauu

SEQ ID NO: 971540 - RNA, 19 nt, Homo sapiens
gacccgguguguucuugua

SEQ ID NO: 971541 - RNA, 19 nt, Homo sapiens
cgaguucugugauggauuc

SEQ ID NO: 971542 - RNA, 19 nt, Homo sapiens
aguguuagcuacugccuuu

SEQ ID NO: 971543 - RNA, 19 nt, Homo sapiens
ggauauaaccaugaucaga

SEQ ID NO: 971544 - RNA, 19 nt, Homo sapiens
gcagaggucaaucuuuaug

SEQ ID NO: 971545 - RNA, 19 nt, Homo sapiens
gcccagaaauuugcugaau

SEQ ID NO: 971546 - RNA, 19 nt, Homo sapiens
cuacugccuuucuagauau

SEQ ID NO: 971547 - RNA, 19 nt, Homo sapiens
gaucagagugcgcuuucaa

SEQ ID NO: 971548 - RNA, 19 nt, Homo sapiens
cuagaaaguuugggucaga

SEQ ID NO: 971549 - RNA, 19 nt, Homo sapiens
guagacaggcuagaaaguu

SEQ ID NO: 971550 - RNA, 19 nt, Homo sapiens
cagguguccucucauauuc

SEQ ID NO: 971551 - RNA, 19 nt, Homo sapiens
gauugcauaucaggacauu

SEQ ID NO: 971552 - RNA, 19 nt, Homo sapiens
aagaagaaauguacaagcu

SEQ ID NO: 971553 - RNA, 19 nt, Homo sapiens
aacugaagcuaaagaagaa

SEQ ID NO: 971554 - RNA, 19 nt, Homo sapiens
uagaguccauucccuaauc

SEQ ID NO: 971555 - RNA, 19 nt, Homo sapiens
gcuuugcaguauccaguuu

SEQ ID NO: 971556 - RNA, 19 nt, Homo sapiens
ucagguguccucucauauu

SEQ ID NO: 971557 - RNA, 19 nt, Homo sapiens
gaagaaguacuuuugaaga

SEQ ID NO: 971558 - RNA, 19 nt, Homo sapiens
gguguguucuuguauaguc

SEQ ID NO: 971559 - RNA, 19 nt, Homo sapiens
gaguugacccgguguguuc

SEQ ID NO: 971560 - RNA, 19 nt, Homo sapiens
uuaaagucucuccugauua

SEQ ID NO: 971561 - RNA, 19 nt, Homo sapiens
gcaggauuaaccuccauuu

SEQ ID NO: 971562 - RNA, 19 nt, Homo sapiens
acuguucccucuuugguuu

SEQ ID NO: 971563 - RNA, 19 nt, Homo sapiens
uuauggauguguuugauca

SEQ ID NO: 971564 - RNA, 19 nt, Homo sapiens
gaccauuuacaauuggaua

SEQ ID NO: 971565 - RNA, 19 nt, Homo sapiens
guuaccggguuaucgcuuu

SEQ ID NO: 971566 - RNA, 19 nt, Homo sapiens
guuagcuacugccuuucua

SEQ ID NO: 971567 - RNA, 19 nt, Homo sapiens
gaagugcagaggucaaucu

SEQ ID NO: 971568 - RNA, 19 nt, Homo sapiens
gcccgaagagcucaucuga

SEQ ID NO: 971569 - RNA, 19 nt, Homo sapiens
ggauguguuugaucagagu

SEQ ID NO: 971570 - RNA, 19 nt, Homo sapiens
ggaugaugaugacaguaag

SEQ ID NO: 971571 - RNA, 19 nt, Homo sapiens
caggcggcaucuccacuaa

SEQ ID NO: 971572 - RNA, 19 nt, Homo sapiens
gaggagcaguagugugucu

SEQ ID NO: 971573 - RNA, 19 nt, Homo sapiens
acauccagauugcauauca

SEQ ID NO: 971574 - RNA, 19 nt, Homo sapiens
uguggaaccucauaaaauu

SEQ ID NO: 971575 - RNA, 19 nt, Homo sapiens
uaagauauggucgcucuau

SEQ ID NO: 971576 - RNA, 19 nt, Homo sapiens
ugacaccucuaucuucaac

SEQ ID NO: 971577 - RNA, 19 nt, Homo sapiens
gggaccaucucgaguucug

SEQ ID NO: 971578 - RNA, 19 nt, Homo sapiens
uuugaagacucccauuuua

SEQ ID NO: 971579 - RNA, 19 nt, Homo sapiens
ccauaccugugcagaagug

SEQ ID NO: 971580 - RNA, 19 nt, Homo sapiens
aguaucagguguccucuca

SEQ ID NO: 971581 - RNA, 19 nt, Homo sapiens
uggaugaugaugacaguaa

SEQ ID NO: 971582 - RNA, 19 nt, Homo sapiens
gaagcuaaagaagaaaugu

SEQ ID NO: 971583 - RNA, 19 nt, Homo sapiens
ucccuaauccucugcaauu

SEQ ID NO: 971584 - RNA, 19 nt, Homo sapiens
ugcaguauccaguuuauug

SEQ ID NO: 971585 - RNA, 19 nt, Homo sapiens
gauuaaagucucuccugau

SEQ ID NO: 971586 - RNA, 19 nt, Homo sapiens
guuaauuucugagguuugg

SEQ ID NO: 971587 - RNA, 19 nt, Homo sapiens
ucaccacuguguucuuaag

SEQ ID NO: 971588 - RNA, 19 nt, Homo sapiens
cuaagccuguguaacuguu

SEQ ID NO: 971589 - RNA, 19 nt, Homo sapiens
aggauuaaccuccauuuca

SEQ ID NO: 971590 - RNA, 19 nt, Homo sapiens
agugacaccucuaucuuca

SEQ ID NO: 971591 - RNA, 19 nt, Homo sapiens
cugaauacacucacaaauc

SEQ ID NO: 971592 - RNA, 19 nt, Homo sapiens
agauauggucgcucuauga

SEQ ID NO: 971593 - RNA, 19 nt, Homo sapiens
uaucaggacauugguuauu

SEQ ID NO: 971594 - RNA, 19 nt, Homo sapiens
agauuauuguggaugauga

SEQ ID NO: 971595 - RNA, 19 nt, Homo sapiens
cccgguguguucuuguaua

SEQ ID NO: 971596 - RNA, 19 nt, Homo sapiens
gagguacaguuccccuuaa

SEQ ID NO: 971597 - RNA, 19 nt, Homo sapiens
ggucaaucuuuauguacag

SEQ ID NO: 971598 - RNA, 19 nt, Homo sapiens
caggaggcaauuucccaua

SEQ ID NO: 971599 - RNA, 19 nt, Homo sapiens
gggacauaccuguaacuau

SEQ ID NO: 971600 - RNA, 19 nt, Homo sapiens
gacuuaccuugaauuguca

SEQ ID NO: 971601 - RNA, 19 nt, Homo sapiens
uaacugguuuagagguaca

SEQ ID NO: 971602 - RNA, 19 nt, Homo sapiens
caaaucuccuagaguccau

SEQ ID NO: 971603 - RNA, 19 nt, Homo sapiens
aucaggacauugguuauuu

SEQ ID NO: 971604 - RNA, 19 nt, Homo sapiens
uguaaaugcugcacaucca

SEQ ID NO: 971605 - RNA, 19 nt, Homo sapiens
ccauucuucuuucuuucuu

SEQ ID NO: 971606 - RNA, 19 nt, Homo sapiens
gaugaugaugacaguaaga

SEQ ID NO: 971607 - RNA, 19 nt, Homo sapiens
gcuaucagcuucccaguuu

SEQ ID NO: 971608 - RNA, 19 nt, Homo sapiens
ggacagaugaugccaguua

SEQ ID NO: 971609 - RNA, 19 nt, Homo sapiens
caacaaaugagaagaaaga

SEQ ID NO: 971610 - RNA, 19 nt, Homo sapiens
aaaccaccaucuuguauaa

SEQ ID NO: 971611 - RNA, 19 nt, Homo sapiens
gaaacccuaugccagguaa

SEQ ID NO: 971612 - RNA, 19 nt, Homo sapiens
ugucuacacuugcacauaa

SEQ ID NO: 971613 - RNA, 19 nt, Homo sapiens
ggcaaaagcuuaucauuau

SEQ ID NO: 971614 - RNA, 19 nt, Homo sapiens
gcaacagaauucgauuaaa

SEQ ID NO: 971615 - RNA, 19 nt, Homo sapiens
acaccucacuccuagauuu

SEQ ID NO: 971616 - RNA, 19 nt, Homo sapiens
gacagaugaugccaguuaa

SEQ ID NO: 971617 - RNA, 19 nt, Homo sapiens
ggagacaguagaauauaaa

SEQ ID NO: 971618 - RNA, 19 nt, Homo sapiens
ccacuccuauuacaacuga

SEQ ID NO: 971619 - RNA, 19 nt, Homo sapiens
gaugccaguuaauuacuuu

SEQ ID NO: 971620 - RNA, 19 nt, Homo sapiens
cuggaaagcuuaacuucuu

SEQ ID NO: 971621 - RNA, 19 nt, Homo sapiens
gcacaauucaucaagaaau

SEQ ID NO: 971622 - RNA, 19 nt, Homo sapiens
ggaccucuguggcagcauu

SEQ ID NO: 971623 - RNA, 19 nt, Homo sapiens
gaagaaagaaacccuaugc

SEQ ID NO: 971624 - RNA, 19 nt, Homo sapiens
uggaaagcuuaacuucuua

SEQ ID NO: 971625 - RNA, 19 nt, Homo sapiens
gaugcggauucuuauauug

SEQ ID NO: 971626 - RNA, 19 nt, Homo sapiens
gggcaaaagcuuaucauua

SEQ ID NO: 971627 - RNA, 19 nt, Homo sapiens
ggcaacagaauucgauuaa

SEQ ID NO: 971628 - RNA, 19 nt, Homo sapiens
uggagacaguagaauauaa

SEQ ID NO: 971629 - RNA, 19 nt, Homo sapiens
ccagugcccucuguugaaa

SEQ ID NO: 971630 - RNA, 19 nt, Homo sapiens
caaaugagaagaaagaaac

SEQ ID NO: 971631 - RNA, 19 nt, Homo sapiens
ccaccaucuuguauaaauu

SEQ ID NO: 971632 - RNA, 19 nt, Homo sapiens
gagaagaaagaaacccuau

SEQ ID NO: 971633 - RNA, 19 nt, Homo sapiens
acaauccucugcaugucua

SEQ ID NO: 971634 - RNA, 19 nt, Homo sapiens
agaugaugccaguuaauua

SEQ ID NO: 971635 - RNA, 19 nt, Homo sapiens
cagaugaugccaguuaauu

SEQ ID NO: 971636 - RNA, 19 nt, Homo sapiens
aagcuuaacuucuuaucca

SEQ ID NO: 971637 - RNA, 19 nt, Homo sapiens
gaauaaauaugggcaaaag

SEQ ID NO: 971638 - RNA, 19 nt, Homo sapiens
gccaguuaauuacuuugaa

SEQ ID NO: 971639 - RNA, 19 nt, Homo sapiens
cagguaacaccaaagcuuu

SEQ ID NO: 971640 - RNA, 19 nt, Homo sapiens
gaugaugccaguuaauuac

SEQ ID NO: 971641 - RNA, 19 nt, Homo sapiens
ugaggcaucuccuggaaag

SEQ ID NO: 971642 - RNA, 19 nt, Homo sapiens
agaugcggauucuuauauu

SEQ ID NO: 971643 - RNA, 19 nt, Homo sapiens
ggaaagcuuaacuucuuau

SEQ ID NO: 971644 - RNA, 19 nt, Homo sapiens
uugcacaauucaucaagaa

SEQ ID NO: 971645 - RNA, 19 nt, Homo sapiens
ccagguaacaccaaagcuu

SEQ ID NO: 971646 - RNA, 19 nt, Homo sapiens
guguggagacaguagaaua

SEQ ID NO: 971647 - RNA, 19 nt, Homo sapiens
aaacaauccucugcauguc

SEQ ID NO: 971648 - RNA, 19 nt, Homo sapiens
uuacaacugaucugauuug

SEQ ID NO: 971649 - RNA, 19 nt, Homo sapiens
guggagacaguagaauaua

SEQ ID NO: 971650 - RNA, 19 nt, Homo sapiens
gcccagugcccucuguuga

SEQ ID NO: 971651 - RNA, 19 nt, Homo sapiens
uuuggacacuuuacauaug

SEQ ID NO: 971652 - RNA, 19 nt, Homo sapiens
gcaaaagcuuaucauuauc

SEQ ID NO: 971653 - RNA, 19 nt, Homo sapiens
uggcaacagaauucgauua

SEQ ID NO: 971654 - RNA, 19 nt, Homo sapiens
caccaucuuguauaaauug

SEQ ID NO: 971655 - RNA, 19 nt, Homo sapiens
uaccuugaguggcaacaga

SEQ ID NO: 971656 - RNA, 19 nt, Homo sapiens
uuucuuuccacuccuauua

SEQ ID NO: 971657 - RNA, 19 nt, Homo sapiens
gaaagcuuaacuucuuauc

SEQ ID NO: 971658 - RNA, 19 nt, Homo sapiens
cggagucggcgguguugua

SEQ ID NO: 971659 - RNA, 19 nt, Homo sapiens
ugaugccaguuaauuacuu

SEQ ID NO: 971660 - RNA, 19 nt, Homo sapiens
aauaacaccuucgcugucu

SEQ ID NO: 971661 - RNA, 19 nt, Homo sapiens
accaccaucuuguauaaau

SEQ ID NO: 971662 - RNA, 19 nt, Homo sapiens
ucacaccucacuccuagau

SEQ ID NO: 971663 - RNA, 19 nt, Homo sapiens
cuucccaguuugcacaauu

SEQ ID NO: 971664 - RNA, 19 nt, Homo sapiens
gaacacaaaagagcuauca

SEQ ID NO: 971665 - RNA, 19 nt, Homo sapiens
gcaucuccuggaaagcuua

SEQ ID NO: 971666 - RNA, 19 nt, Homo sapiens
uaugccagguaacaccaaa

SEQ ID NO: 971667 - RNA, 19 nt, Homo sapiens
ccaguuugcacaauucauc

SEQ ID NO: 971668 - RNA, 19 nt, Homo sapiens
acacuuuacauauggauuc

SEQ ID NO: 971669 - RNA, 19 nt, Homo sapiens
ggcaucuccuggaaagcuu

SEQ ID NO: 971670 - RNA, 19 nt, Homo sapiens
uguggagacaguagaauau

SEQ ID NO: 971671 - RNA, 19 nt, Homo sapiens
ccuauuacaacugaucuga

SEQ ID NO: 971672 - RNA, 19 nt, Homo sapiens
ggagucggcgguguuguag

SEQ ID NO: 971673 - RNA, 19 nt, Homo sapiens
gcagauggcucuucuuaag

SEQ ID NO: 971674 - RNA, 19 nt, Homo sapiens
gagaaacucugaccuucau

SEQ ID NO: 971675 - RNA, 19 nt, Homo sapiens
gaacuucuacaucaacuau

SEQ ID NO: 971676 - RNA, 19 nt, Homo sapiens
ccugacaccucaauaaaga

SEQ ID NO: 971677 - RNA, 19 nt, Homo sapiens
cagcaggucuucaaugauc

SEQ ID NO: 971678 - RNA, 19 nt, Homo sapiens
ccaauaaggaucucauuuc

SEQ ID NO: 971679 - RNA, 19 nt, Homo sapiens
aagaagacauggugacugu

SEQ ID NO: 971680 - RNA, 19 nt, Homo sapiens
caauaaggaucucauuucc

SEQ ID NO: 971681 - RNA, 19 nt, Homo sapiens
gccaauaaggaucucauuu

SEQ ID NO: 971682 - RNA, 19 nt, Homo sapiens
gaaacucugaccuucaugu

SEQ ID NO: 971683 - RNA, 19 nt, Homo sapiens
gagugugggugagacauau

SEQ ID NO: 971684 - RNA, 19 nt, Homo sapiens
cucaugagcucccgaguca

SEQ ID NO: 971685 - RNA, 19 nt, Homo sapiens
aggcagauggcucuucuua

SEQ ID NO: 971686 - RNA, 19 nt, Homo sapiens
ccgcaggauugaaggaguu

SEQ ID NO: 971687 - RNA, 19 nt, Homo sapiens
caaugauccucucgucucu

SEQ ID NO: 971688 - RNA, 19 nt, Homo sapiens
ugcaggagcuucggcaaga

SEQ ID NO: 971689 - RNA, 19 nt, Homo sapiens
guggaggacuggaugaacu

SEQ ID NO: 971690 - RNA, 19 nt, Homo sapiens
aggacuggaugaacuucua

SEQ ID NO: 971691 - RNA, 19 nt, Homo sapiens
aucagcaggucuucaauga

SEQ ID NO: 971692 - RNA, 19 nt, Homo sapiens
gagauucacgcacccucaa

SEQ ID NO: 971693 - RNA, 19 nt, Homo sapiens
acccuuuccuggccaagua

SEQ ID NO: 971694 - RNA, 19 nt, Homo sapiens
ggcagauggcucuucuuaa

SEQ ID NO: 971695 - RNA, 19 nt, Homo sapiens
gaucucauuuccgcaggau

SEQ ID NO: 971696 - RNA, 19 nt, Homo sapiens
ugagaaacucugaccuuca

SEQ ID NO: 971697 - RNA, 19 nt, Homo sapiens
ucucauuuccgcaggauug

SEQ ID NO: 971698 - RNA, 19 nt, Homo sapiens
uacccugacaccucaauaa

SEQ ID NO: 971699 - RNA, 19 nt, Homo sapiens
gauucacgcacccucaaga

SEQ ID NO: 971700 - RNA, 19 nt, Homo sapiens
augauccucucgucucuga

SEQ ID NO: 971701 - RNA, 19 nt, Homo sapiens
gaaucagcaggucuucaau

SEQ ID NO: 971702 - RNA, 19 nt, Homo sapiens
gauccucucgucucugaag

SEQ ID NO: 971703 - RNA, 19 nt, Homo sapiens
agagugugggugagacaua

SEQ ID NO: 971704 - RNA, 19 nt, Homo sapiens
gcaggagcuucggcaagag

SEQ ID NO: 971705 - RNA, 19 nt, Homo sapiens
ggccaauaaggaucucauu

SEQ ID NO: 971706 - RNA, 19 nt, Homo sapiens
cacgcacccucaagagugu

SEQ ID NO: 971707 - RNA, 19 nt, Homo sapiens
cauauguucugcaggaaua

SEQ ID NO: 971708 - RNA, 19 nt, Homo sapiens
ggaccuacuuucaaaugga

SEQ ID NO: 971709 - RNA, 19 nt, Homo sapiens
gaccuacuuucaaauggaa

SEQ ID NO: 971710 - RNA, 19 nt, Homo sapiens
aggaggaccuacuuucaaa

SEQ ID NO: 971711 - RNA, 19 nt, Homo sapiens
gaggaggaccuacuuucaa

SEQ ID NO: 971712 - RNA, 19 nt, Homo sapiens
gagaggaggaccuacuuuc

SEQ ID NO: 971713 - RNA, 19 nt, Homo sapiens
gaggaccuacuuucaaaug

SEQ ID NO: 971714 - RNA, 19 nt, Homo sapiens
gagagaggaggaccuacuu

SEQ ID NO: 971715 - RNA, 19 nt, Homo sapiens
ggagagaggaggaccuacu

SEQ ID NO: 971716 - RNA, 19 nt, Homo sapiens
ggaggaccuacuuucaaau

SEQ ID NO: 971717 - RNA, 19 nt, Homo sapiens
agaggaggaccuacuuuca

SEQ ID NO: 971718 - RNA, 19 nt, Homo sapiens
ugagugcuuugcuccaucu

SEQ ID NO: 971719 - RNA, 19 nt, Homo sapiens
ggaagaagcugaagaagaa

SEQ ID NO: 971720 - RNA, 19 nt, Homo sapiens
gagcagcacuucucagcua

SEQ ID NO: 971721 - RNA, 19 nt, Homo sapiens
ggaaagacaccucgaggaa

SEQ ID NO: 971722 - RNA, 19 nt, Homo sapiens
gcacuucucagcuauuaaa

SEQ ID NO: 971723 - RNA, 19 nt, Homo sapiens
ggaggaagaagaagaagaa

SEQ ID NO: 971724 - RNA, 19 nt, Homo sapiens
cagcacuucucagcuauua

SEQ ID NO: 971725 - RNA, 19 nt, Homo sapiens
gggcgcaccaggcuuauua

SEQ ID NO: 971726 - RNA, 19 nt, Homo sapiens
gaaagaagaagagcaggaa

SEQ ID NO: 971727 - RNA, 19 nt, Homo sapiens
acagagagaucaacaagca

SEQ ID NO: 971728 - RNA, 19 nt, Homo sapiens
ggaagaagaagaagaagag

SEQ ID NO: 971729 - RNA, 19 nt, Homo sapiens
ggaaaucguaaccaaagaa

SEQ ID NO: 971730 - RNA, 19 nt, Homo sapiens
gagcagaagucccgaaucc

SEQ ID NO: 971731 - RNA, 19 nt, Homo sapiens
gaaagagcagcacuucuca

SEQ ID NO: 971732 - RNA, 19 nt, Homo sapiens
gacaagaggaggaagaaga

SEQ ID NO: 971733 - RNA, 19 nt, Homo sapiens
ccaaagaacgacacagaga

SEQ ID NO: 971734 - RNA, 19 nt, Homo sapiens
uagaggaaaucguaaccaa

SEQ ID NO: 971735 - RNA, 19 nt, Homo sapiens
gcccaguccugacggauga

SEQ ID NO: 971736 - RNA, 19 nt, Homo sapiens
gaggaaaucguaaccaaag

SEQ ID NO: 971737 - RNA, 19 nt, Homo sapiens
gaaaagagaaagaagaaga

SEQ ID NO: 971738 - RNA, 19 nt, Homo sapiens
gaacgacacagagagauca

SEQ ID NO: 971739 - RNA, 19 nt, Homo sapiens
gaugcgagcuggguugcuu

SEQ ID NO: 971740 - RNA, 19 nt, Homo sapiens
aaagacaccucgaggaacu

SEQ ID NO: 971741 - RNA, 19 nt, Homo sapiens
ggaaguacaaggacaagag

SEQ ID NO: 971742 - RNA, 19 nt, Homo sapiens
agaagaagaagaagaggaa

SEQ ID NO: 971743 - RNA, 19 nt, Homo sapiens
ugaaagagcagcacuucuc

SEQ ID NO: 971744 - RNA, 19 nt, Homo sapiens
aagaagagcaggaaagaca

SEQ ID NO: 971745 - RNA, 19 nt, Homo sapiens
ugaagcccaugaccaagga

SEQ ID NO: 971746 - RNA, 19 nt, Homo sapiens
agaagaagggcaaggagaa

SEQ ID NO: 971747 - RNA, 19 nt, Homo sapiens
agaggaagaagcugaagaa

SEQ ID NO: 971748 - RNA, 19 nt, Homo sapiens
aaagaacgacacagagaga

SEQ ID NO: 971749 - RNA, 19 nt, Homo sapiens
acaagaggaggaagaagaa

SEQ ID NO: 971750 - RNA, 19 nt, Homo sapiens
agaagaagaagaggaagaa

SEQ ID NO: 971751 - RNA, 19 nt, Homo sapiens
gaagaagggcaaggagaag

SEQ ID NO: 971752 - RNA, 19 nt, Homo sapiens
agaagaagagcaggaaaga

SEQ ID NO: 971753 - RNA, 19 nt, Homo sapiens
gaaaucguaaccaaagaac

SEQ ID NO: 971754 - RNA, 19 nt, Homo sapiens
cgacacagagagaucaaca

SEQ ID NO: 971755 - RNA, 19 nt, Homo sapiens
aggaagaagcugaagaaga

SEQ ID NO: 971756 - RNA, 19 nt, Homo sapiens
ucuucuagcuccucuucuu

SEQ ID NO: 971757 - RNA, 19 nt, Homo sapiens
ugaagaagaagggcaagga

SEQ ID NO: 971758 - RNA, 19 nt, Homo sapiens
acacagagagaucaacaag

SEQ ID NO: 971759 - RNA, 19 nt, Homo sapiens
aaccaaagaacgacacaga

SEQ ID NO: 971760 - RNA, 19 nt, Homo sapiens
agaggaggaagaagaagaa

SEQ ID NO: 971761 - RNA, 19 nt, Homo sapiens
gcagcacuucucagcuauu

SEQ ID NO: 971762 - RNA, 19 nt, Homo sapiens
ccacaucccaagagagaag

SEQ ID NO: 971763 - RNA, 19 nt, Homo sapiens
aggaaaucguaaccaaaga

SEQ ID NO: 971764 - RNA, 19 nt, Homo sapiens
agaggaaaucguaaccaaa

SEQ ID NO: 971765 - RNA, 19 nt, Homo sapiens
ggaccaguggcaccgauca

SEQ ID NO: 971766 - RNA, 19 nt, Homo sapiens
gcccggaggagaacaagau

SEQ ID NO: 971767 - RNA, 19 nt, Homo sapiens
ccagcccagucucuucuca

SEQ ID NO: 971768 - RNA, 19 nt, Homo sapiens
aaagaagaagagcaggaaa

SEQ ID NO: 971769 - RNA, 19 nt, Homo sapiens
gagauggcgagguccuaga

SEQ ID NO: 971770 - RNA, 19 nt, Homo sapiens
ugacggaugagcagaaguc

SEQ ID NO: 971771 - RNA, 19 nt, Homo sapiens
agaagaggaagaagcugaa

SEQ ID NO: 971772 - RNA, 19 nt, Homo sapiens
gaagaagaagaggaagaag

SEQ ID NO: 971773 - RNA, 19 nt, Homo sapiens
aagaagaagaagaggaaga

SEQ ID NO: 971774 - RNA, 19 nt, Homo sapiens
gagcagcacuucucagcua

SEQ ID NO: 971775 - RNA, 19 nt, Homo sapiens
ggaaagacaccucgaggaa

SEQ ID NO: 971776 - RNA, 19 nt, Homo sapiens
ccagagagaucaacaagca

SEQ ID NO: 971777 - RNA, 19 nt, Homo sapiens
aggaagaacugaagaagaa

SEQ ID NO: 971778 - RNA, 19 nt, Homo sapiens
gcacuucucagcuauuaaa

SEQ ID NO: 971779 - RNA, 19 nt, Homo sapiens
ggaggaagaagaagaagaa

SEQ ID NO: 971780 - RNA, 19 nt, Homo sapiens
cagcacuucucagcuauua

SEQ ID NO: 971781 - RNA, 19 nt, Homo sapiens
gggcgcaccaggcuuauua

SEQ ID NO: 971782 - RNA, 19 nt, Homo sapiens
gaaagaagaagagcaggaa

SEQ ID NO: 971783 - RNA, 19 nt, Homo sapiens
ggaagaagaagaagaagag

SEQ ID NO: 971784 - RNA, 19 nt, Homo sapiens
ggaaaucguaaccaaagaa

SEQ ID NO: 971785 - RNA, 19 nt, Homo sapiens
gaaagagcagcacuucuca

SEQ ID NO: 971786 - RNA, 19 nt, Homo sapiens
gacaagaggaggaagaaga

SEQ ID NO: 971787 - RNA, 19 nt, Homo sapiens
uagaggaaaucguaaccaa

SEQ ID NO: 971788 - RNA, 19 nt, Homo sapiens
gaggaaaucguaaccaaag

SEQ ID NO: 971789 - RNA, 19 nt, Homo sapiens
gaaaagagaaagaagaaga

SEQ ID NO: 971790 - RNA, 19 nt, Homo sapiens
ccaaagaacgacccagaga

SEQ ID NO: 971791 - RNA, 19 nt, Homo sapiens
gaggaagaacugaagaaga

SEQ ID NO: 971792 - RNA, 19 nt, Homo sapiens
gaagaggaagaacugaaga

SEQ ID NO: 971793 - RNA, 19 nt, Homo sapiens
gaacgacccagagagauca

SEQ ID NO: 971794 - RNA, 19 nt, Homo sapiens
ggaaguacaaggacaagag

SEQ ID NO: 971795 - RNA, 19 nt, Homo sapiens
aaagacaccucgaggaacu

SEQ ID NO: 971796 - RNA, 19 nt, Homo sapiens
aaagaacgacccagagaga

SEQ ID NO: 971797 - RNA, 19 nt, Homo sapiens
agaagaagaagaagaggaa

SEQ ID NO: 971798 - RNA, 19 nt, Homo sapiens
gaugcgaacuggguugcuu

SEQ ID NO: 971799 - RNA, 19 nt, Homo sapiens
gaagaagaggaagaacuga

SEQ ID NO: 971800 - RNA, 19 nt, Homo sapiens
ugaaagagcagcacuucuc

SEQ ID NO: 971801 - RNA, 19 nt, Homo sapiens
aagaagagcaggaaagaca

SEQ ID NO: 971802 - RNA, 19 nt, Homo sapiens
agaagaagggcaaggagaa

SEQ ID NO: 971803 - RNA, 19 nt, Homo sapiens
acaagaggaggaagaagaa

SEQ ID NO: 971804 - RNA, 19 nt, Homo sapiens
agaagaagaagaggaagaa

SEQ ID NO: 971805 - RNA, 19 nt, Homo sapiens
gaagaagggcaaggagaag

SEQ ID NO: 971806 - RNA, 19 nt, Homo sapiens
gaagcacagcagaacauca

SEQ ID NO: 971807 - RNA, 19 nt, Homo sapiens
agaagaagaggaagaacug

SEQ ID NO: 971808 - RNA, 19 nt, Homo sapiens
agaagaagagcaggaaaga

SEQ ID NO: 971809 - RNA, 19 nt, Homo sapiens
gaaaucguaaccaaagaac

SEQ ID NO: 971810 - RNA, 19 nt, Homo sapiens
ucuucuagcuccucuucuu

SEQ ID NO: 971811 - RNA, 19 nt, Homo sapiens
ugaagaagaagggcaagga

SEQ ID NO: 971812 - RNA, 19 nt, Homo sapiens
agaggaggaagaagaagaa

SEQ ID NO: 971813 - RNA, 19 nt, Homo sapiens
gcagcacuucucagcuauu

SEQ ID NO: 971814 - RNA, 19 nt, Homo sapiens
aggaaaucguaaccaaaga

SEQ ID NO: 971815 - RNA, 19 nt, Homo sapiens
agaggaaaucguaaccaaa

SEQ ID NO: 971816 - RNA, 19 nt, Homo sapiens
aagaagaggaagaacugaa

SEQ ID NO: 971817 - RNA, 19 nt, Homo sapiens
ccagcccagucucuucuca

SEQ ID NO: 971818 - RNA, 19 nt, Homo sapiens
gagauggcgagguccuaga

SEQ ID NO: 971819 - RNA, 19 nt, Homo sapiens
aaagaagaagagcaggaaa

SEQ ID NO: 971820 - RNA, 19 nt, Homo sapiens
ggaagcacagcagaacauc

SEQ ID NO: 971821 - RNA, 19 nt, Homo sapiens
aagaagaagaagaggaaga

SEQ ID NO: 971822 - RNA, 19 nt, Homo sapiens
cuaaggaacugcagcauuu

SEQ ID NO: 971823 - RNA, 19 nt, Homo sapiens
ggagggagaauuuauuaau

SEQ ID NO: 971824 - RNA, 19 nt, Homo sapiens
gggaggagauauuuauuuu

SEQ ID NO: 971825 - RNA, 19 nt, Homo sapiens
caucauucauucauccauu

SEQ ID NO: 971826 - RNA, 19 nt, Homo sapiens
gaggagauauuuauuuugg

SEQ ID NO: 971827 - RNA, 19 nt, Homo sapiens
aaacagcugacacugacua

SEQ ID NO: 971828 - RNA, 19 nt, Homo sapiens
gcgcugauccagugacaau

SEQ ID NO: 971829 - RNA, 19 nt, Homo sapiens
ggggugcccuccuuccuua

SEQ ID NO: 971830 - RNA, 19 nt, Homo sapiens
gggagggagaauuuauuaa

SEQ ID NO: 971831 - RNA, 19 nt, Homo sapiens
gcgcaggacgugcacuaug

SEQ ID NO: 971832 - RNA, 19 nt, Homo sapiens
gcccacucaucauucauuc

SEQ ID NO: 971833 - RNA, 19 nt, Homo sapiens
gcugauccagugacaaugu

SEQ ID NO: 971834 - RNA, 19 nt, Homo sapiens
ggggagggagaauuuauua

SEQ ID NO: 971835 - RNA, 19 nt, Homo sapiens
ccacucaucauucauucau

SEQ ID NO: 971836 - RNA, 19 nt, Homo sapiens
cgcaggacgugcacuaugg

SEQ ID NO: 971837 - RNA, 19 nt, Homo sapiens
cagauguccugaaauucca

SEQ ID NO: 971838 - RNA, 19 nt, Homo sapiens
gcauggacugcgcgucuug

SEQ ID NO: 971839 - RNA, 19 nt, Homo sapiens
cagcugacacugacuaagg

SEQ ID NO: 971840 - RNA, 19 nt, Homo sapiens
gacacugacuaaggaacug

SEQ ID NO: 971841 - RNA, 19 nt, Homo sapiens
ucacgcuggcucacacaaa

SEQ ID NO: 971842 - RNA, 19 nt, Homo sapiens
ggggaggagauauuuauuu

SEQ ID NO: 971843 - RNA, 19 nt, Homo sapiens
ggagagagcuguugaguag

SEQ ID NO: 971844 - RNA, 19 nt, Homo sapiens
gagagcagcugcagaguau

SEQ ID NO: 971845 - RNA, 19 nt, Homo sapiens
gcaccaaguuugcaaaguu

SEQ ID NO: 971846 - RNA, 19 nt, Homo sapiens
gcacagacaccaggacuua

SEQ ID NO: 971847 - RNA, 19 nt, Homo sapiens
gaaacacacauucuccuua

SEQ ID NO: 971848 - RNA, 19 nt, Homo sapiens
caagacaacucccagaaga

SEQ ID NO: 971849 - RNA, 19 nt, Homo sapiens
aaacacacauucuccuuaa

SEQ ID NO: 971850 - RNA, 19 nt, Homo sapiens
gaaguuugaugcuuucaga

SEQ ID NO: 971851 - RNA, 19 nt, Homo sapiens
gaagagaaguuugaugcuu

SEQ ID NO: 971852 - RNA, 19 nt, Homo sapiens
ccaaggagguccaggaaga

SEQ ID NO: 971853 - RNA, 19 nt, Homo sapiens
ggccagaccuguuggacua

SEQ ID NO: 971854 - RNA, 19 nt, Homo sapiens
ggagaaaguagcuuccaua

SEQ ID NO: 971855 - RNA, 19 nt, Homo sapiens
ccaagaggauucaggagaa

SEQ ID NO: 971856 - RNA, 19 nt, Homo sapiens
gugaagaggagacguguua

SEQ ID NO: 971857 - RNA, 19 nt, Homo sapiens
agaaggaggugaagaugaa

SEQ ID NO: 971858 - RNA, 19 nt, Homo sapiens
ggacucaucugggucauca

SEQ ID NO: 971859 - RNA, 19 nt, Homo sapiens
ucacuaagauccugcuuca

SEQ ID NO: 971860 - RNA, 19 nt, Homo sapiens
ggaggaagaacacugauga

SEQ ID NO: 971861 - RNA, 19 nt, Homo sapiens
aggaggaacuagccauuua

SEQ ID NO: 971862 - RNA, 19 nt, Homo sapiens
gcugguggcugaccuucua

SEQ ID NO: 971863 - RNA, 19 nt, Homo sapiens
gaagccagcucaacaacag

SEQ ID NO: 971864 - RNA, 19 nt, Homo sapiens
gcaccaagcucagaaacuc

SEQ ID NO: 971865 - RNA, 19 nt, Homo sapiens
gcagaaguuuggccgagaa

SEQ ID NO: 971866 - RNA, 19 nt, Homo sapiens
aagagaaguuugaugcuuu

SEQ ID NO: 971867 - RNA, 19 nt, Homo sapiens
uaccagcccuugucaugua

SEQ ID NO: 971868 - RNA, 19 nt, Homo sapiens
ucaaggugcuggaagagaa

SEQ ID NO: 971869 - RNA, 19 nt, Homo sapiens
gggcagagauccuguuugc

SEQ ID NO: 971870 - RNA, 19 nt, Homo sapiens
ggacaacagccacuucaug

SEQ ID NO: 971871 - RNA, 19 nt, Homo sapiens
gccgagaaguggaugguuu

SEQ ID NO: 971872 - RNA, 19 nt, Homo sapiens
ggaagcagguggcagacau

SEQ ID NO: 971873 - RNA, 19 nt, Homo sapiens
uacagaagcagcagaauuu

SEQ ID NO: 971874 - RNA, 19 nt, Homo sapiens
ggugcuggcuggcuuagaa

SEQ ID NO: 971875 - RNA, 19 nt, Homo sapiens
cccgagagcuggacaaugu

SEQ ID NO: 971876 - RNA, 19 nt, Homo sapiens
ggcuggagcugcagaaguu

SEQ ID NO: 971877 - RNA, 19 nt, Homo sapiens
ccugggaacuccacacaaa

SEQ ID NO: 971878 - RNA, 19 nt, Homo sapiens
gcagacgugugcagagaau

SEQ ID NO: 971879 - RNA, 19 nt, Homo sapiens
agacucagcuacaggcaaa

SEQ ID NO: 971880 - RNA, 19 nt, Homo sapiens
gagaagacggcccugauga

SEQ ID NO: 971881 - RNA, 19 nt, Homo sapiens
caccaaguuugcaaaguuu

SEQ ID NO: 971882 - RNA, 19 nt, Homo sapiens
gcaaguacaggaacaagug

SEQ ID NO: 971883 - RNA, 19 nt, Homo sapiens
cagaggagacucacuaaga

SEQ ID NO: 971884 - RNA, 19 nt, Homo sapiens
agacaguuccuucugguua

SEQ ID NO: 971885 - RNA, 19 nt, Homo sapiens
gaauaagacucagcuacag

SEQ ID NO: 971886 - RNA, 19 nt, Homo sapiens
caguggagcugcaccaguu

SEQ ID NO: 971887 - RNA, 19 nt, Homo sapiens
caagcgaggacacaucuaa

SEQ ID NO: 971888 - RNA, 19 nt, Homo sapiens
gaaccgggacccugaggaa

SEQ ID NO: 971889 - RNA, 19 nt, Homo sapiens
ccaaguggaucaauaacgu

SEQ ID NO: 971890 - RNA, 19 nt, Homo sapiens
gagaaggaggugaagauga

SEQ ID NO: 971891 - RNA, 19 nt, Homo sapiens
ccauggcccuguucgguuu

SEQ ID NO: 971892 - RNA, 19 nt, Homo sapiens
gcccuucucagcaguaaua

SEQ ID NO: 971893 - RNA, 19 nt, Homo sapiens
ccaagagccuagaaugaca

SEQ ID NO: 971894 - RNA, 19 nt, Homo sapiens
cuacagagcucggaaacag

SEQ ID NO: 971895 - RNA, 19 nt, Homo sapiens
gaaacauccugcagacacu

SEQ ID NO: 971896 - RNA, 19 nt, Homo sapiens
gaacuccacacaaauccaa

SEQ ID NO: 971897 - RNA, 19 nt, Homo sapiens
caucuaagggaccagaaua

SEQ ID NO: 971898 - RNA, 19 nt, Homo sapiens
uggaagagguagagcaguu

SEQ ID NO: 971899 - RNA, 19 nt, Homo sapiens
gaagcaggcagccaaagga

SEQ ID NO: 971900 - RNA, 19 nt, Homo sapiens
accaacagcuggagaguga

SEQ ID NO: 971901 - RNA, 19 nt, Homo sapiens
ucaccaaguggaucaauaa

SEQ ID NO: 971902 - RNA, 19 nt, Homo sapiens
gacaacagccacuucaugu

SEQ ID NO: 971903 - RNA, 19 nt, Homo sapiens
aggcaaugcugcaggaauu

SEQ ID NO: 971904 - RNA, 19 nt, Homo sapiens
ugaaacaccaggccuuuga

SEQ ID NO: 971905 - RNA, 19 nt, Homo sapiens
ggaaacacacauucuccuu

SEQ ID NO: 971906 - RNA, 19 nt, Homo sapiens
gauggcagcggagaaagua

SEQ ID NO: 971907 - RNA, 19 nt, Homo sapiens
ggagaagacggcccugaug

SEQ ID NO: 971908 - RNA, 19 nt, Homo sapiens
ugaccucuguugccaagaa

SEQ ID NO: 971909 - RNA, 19 nt, Homo sapiens
ccucagaguucacagagau

SEQ ID NO: 971910 - RNA, 19 nt, Homo sapiens
gaaguuuggccgagaagug

SEQ ID NO: 971911 - RNA, 19 nt, Homo sapiens
gccaggagcugaagguuuu

SEQ ID NO: 971912 - RNA, 19 nt, Homo sapiens
caacugaggcagagauauc

SEQ ID NO: 971913 - RNA, 19 nt, Homo sapiens
ggucaugcagcucaaauau

SEQ ID NO: 971914 - RNA, 19 nt, Homo sapiens
agacagugcugcuccaaag

SEQ ID NO: 971915 - RNA, 19 nt, Homo sapiens
gaggugaagaugaauguug

SEQ ID NO: 971916 - RNA, 19 nt, Homo sapiens
gcuuugaaccgcaagauga

SEQ ID NO: 971917 - RNA, 19 nt, Homo sapiens
agaggagacucacuaagau

SEQ ID NO: 971918 - RNA, 19 nt, Homo sapiens
guacgagacgggccacauu

SEQ ID NO: 971919 - RNA, 19 nt, Homo sapiens
agagagcuguugaguagga

SEQ ID NO: 971920 - RNA, 19 nt, Homo sapiens
gaagagguagagcaguuga

SEQ ID NO: 971921 - RNA, 19 nt, Homo sapiens
ucacccagguccaggagaa

SEQ ID NO: 971922 - RNA, 19 nt, Homo sapiens
ugaccuacgucucccucua

SEQ ID NO: 971923 - RNA, 19 nt, Homo sapiens
gcgaugggcugggcuucaa

SEQ ID NO: 971924 - RNA, 19 nt, Homo sapiens
gagaaaguagcuuccauag

SEQ ID NO: 971925 - RNA, 19 nt, Homo sapiens
uggaggaacuggagaacug

SEQ ID NO: 971926 - RNA, 19 nt, Homo sapiens
gcaccucugcaccaaguuu

SEQ ID NO: 971927 - RNA, 19 nt, Homo sapiens
gcaagugggaagcuuugaa

SEQ ID NO: 971928 - RNA, 19 nt, Homo sapiens
gggagagagcuguugagua

SEQ ID NO: 971929 - RNA, 19 nt, Homo sapiens
gaauagacaguuccuucug

SEQ ID NO: 971930 - RNA, 19 nt, Homo sapiens
caacagccacuucaugucu

SEQ ID NO: 971931 - RNA, 19 nt, Homo sapiens
gcaggaagaacccagaaag

SEQ ID NO: 971932 - RNA, 19 nt, Homo sapiens
gacaguuccuucugguuag

SEQ ID NO: 971933 - RNA, 19 nt, Homo sapiens
gaggauggcagcggagaaa

SEQ ID NO: 971934 - RNA, 19 nt, Homo sapiens
uggaagcuauggagaagga

SEQ ID NO: 971935 - RNA, 19 nt, Homo sapiens
gaagacggcccugaugaag

SEQ ID NO: 971936 - RNA, 19 nt, Homo sapiens
agaagaagguggccaagcu

SEQ ID NO: 971937 - RNA, 19 nt, Homo sapiens
gagccagccucugcaagga

SEQ ID NO: 971938 - RNA, 19 nt, Homo sapiens
gaaacacaaggcccuggaa

SEQ ID NO: 971939 - RNA, 19 nt, Homo sapiens
gcaagacaacucccagaag

SEQ ID NO: 971940 - RNA, 19 nt, Homo sapiens
uuacagaagcagcagaauu

SEQ ID NO: 971941 - RNA, 19 nt, Homo sapiens
ggagaaggaagcccugauc

SEQ ID NO: 971942 - RNA, 19 nt, Homo sapiens
ccagaugagcgcucuauca

SEQ ID NO: 971943 - RNA, 19 nt, Homo sapiens
gaaagggcccauaaauaua

SEQ ID NO: 971944 - RNA, 19 nt, Homo sapiens
gaaacccggucucuacuaa

SEQ ID NO: 971945 - RNA, 19 nt, Homo sapiens
gaaccgagauagugccauu

SEQ ID NO: 971946 - RNA, 19 nt, Homo sapiens
agacagagguugcaaugaa

SEQ ID NO: 971947 - RNA, 19 nt, Homo sapiens
ugaaagggcccauaaauau

SEQ ID NO: 971948 - RNA, 19 nt, Homo sapiens
gcagaucacuugagguuag

SEQ ID NO: 971949 - RNA, 19 nt, Homo sapiens
caagugaguugucaaggaa

SEQ ID NO: 971950 - RNA, 19 nt, Homo sapiens
gaagacugccucaaacaaa

SEQ ID NO: 971951 - RNA, 19 nt, Homo sapiens
gcacgacccucagaucuca

SEQ ID NO: 971952 - RNA, 19 nt, Homo sapiens
gcaggaggaucucuugaag

SEQ ID NO: 971953 - RNA, 19 nt, Homo sapiens
gcaaugaaccgagauagug

SEQ ID NO: 971954 - RNA, 19 nt, Homo sapiens
ccaagugaguugucaagga

SEQ ID NO: 971955 - RNA, 19 nt, Homo sapiens
gggcgaggcuagcagauca

SEQ ID NO: 971956 - RNA, 19 nt, Homo sapiens
ggaagacugccucaaacaa

SEQ ID NO: 971957 - RNA, 19 nt, Homo sapiens
cugaaagggcccauaaaua

SEQ ID NO: 971958 - RNA, 19 nt, Homo sapiens
ggagacagagguugcaaug

SEQ ID NO: 971959 - RNA, 19 nt, Homo sapiens
gaggcuagcagaucacuug

SEQ ID NO: 971960 - RNA, 19 nt, Homo sapiens
uauacuauguucacgauca

SEQ ID NO: 971961 - RNA, 19 nt, Homo sapiens
gagagguggugaaacucaa

SEQ ID NO: 971962 - RNA, 19 nt, Homo sapiens
gaccugaaagggcccauaa

SEQ ID NO: 971963 - RNA, 19 nt, Homo sapiens
ccuguaaucuccagcacuu

SEQ ID NO: 971964 - RNA, 19 nt, Homo sapiens
uagcagcucaugccuguaa

SEQ ID NO: 971965 - RNA, 19 nt, Homo sapiens
cgccuaagcucgcacuuca

SEQ ID NO: 971966 - RNA, 19 nt, Homo sapiens
uagcagaucacuugagguu

SEQ ID NO: 971967 - RNA, 19 nt, Homo sapiens
ucagaucucagucuaguga

SEQ ID NO: 971968 - RNA, 19 nt, Homo sapiens
caaaccaaaccaaaccaaa

SEQ ID NO: 971969 - RNA, 19 nt, Homo sapiens
gaucagacacgcacugcau

SEQ ID NO: 971970 - RNA, 19 nt, Homo sapiens
aggaggaucucuugaaguc

SEQ ID NO: 971971 - RNA, 19 nt, Homo sapiens
gcaugagaaucacuugaac

SEQ ID NO: 971972 - RNA, 19 nt, Homo sapiens
ggugaaacccggucucuac

SEQ ID NO: 971973 - RNA, 19 nt, Homo sapiens
aacacuacguuaaagguuu

SEQ ID NO: 971974 - RNA, 19 nt, Homo sapiens
ggagagaaaacuguaauaa

SEQ ID NO: 971975 - RNA, 19 nt, Homo sapiens
gagaucagccuggagaaca

SEQ ID NO: 971976 - RNA, 19 nt, Homo sapiens
agucggcgcugaccaaaca

SEQ ID NO: 971977 - RNA, 19 nt, Homo sapiens
ggcaugagaaucacuugaa

SEQ ID NO: 971978 - RNA, 19 nt, Homo sapiens
gcaaggcacgacccucaga

SEQ ID NO: 971979 - RNA, 19 nt, Homo sapiens
ccuaagcucgcacuucauu

SEQ ID NO: 971980 - RNA, 19 nt, Homo sapiens
ccucagaucucagucuagu

SEQ ID NO: 971981 - RNA, 19 nt, Homo sapiens
ggaggugaucgcacacuug

SEQ ID NO: 971982 - RNA, 19 nt, Homo sapiens
aggcucaggugccaaguga

SEQ ID NO: 971983 - RNA, 19 nt, Homo sapiens
gaagucggcgcugaccaaa

SEQ ID NO: 971984 - RNA, 19 nt, Homo sapiens
aaacaacaaaccaaaccaa

SEQ ID NO: 971985 - RNA, 19 nt, Homo sapiens
gacagagguugcaaugaac

SEQ ID NO: 971986 - RNA, 19 nt, Homo sapiens
gagguuaggaguucgauac

SEQ ID NO: 971987 - RNA, 19 nt, Homo sapiens
caacaaaccaaaccaaacc

SEQ ID NO: 971988 - RNA, 19 nt, Homo sapiens
ccugaaagggcccauaaau

SEQ ID NO: 971989 - RNA, 19 nt, Homo sapiens
ggcaggaggaucucuugaa

SEQ ID NO: 971990 - RNA, 19 nt, Homo sapiens
ccuguaaucccagcacuuu

SEQ ID NO: 971991 - RNA, 19 nt, Homo sapiens
cgaccuggcugcacuaacc

SEQ ID NO: 971992 - RNA, 19 nt, Homo sapiens
ggcccguguuagugaauaa

SEQ ID NO: 971993 - RNA, 19 nt, Homo sapiens
ugaaacccggucucuacua

SEQ ID NO: 971994 - RNA, 19 nt, Homo sapiens
ggugggagaggaagaaagu

SEQ ID NO: 971995 - RNA, 19 nt, Homo sapiens
cguguuagugaauaaagua

SEQ ID NO: 971996 - RNA, 19 nt, Homo sapiens
aaagggcccauaaauauac

SEQ ID NO: 971997 - RNA, 19 nt, Homo sapiens
ggaaccaaauggggaugua

SEQ ID NO: 971998 - RNA, 19 nt, Homo sapiens
gaucagccuggagaacaaa

SEQ ID NO: 971999 - RNA, 19 nt, Homo sapiens
agaucagccuggagaacaa

SEQ ID NO: 972000 - RNA, 19 nt, Homo sapiens
gaggcaggaggaucucuug

SEQ ID NO: 972001 - RNA, 19 nt, Homo sapiens
ucacuugagguuaggaguu

SEQ ID NO: 972002 - RNA, 19 nt, Homo sapiens
ggaggcaggaggaucucuu

SEQ ID NO: 972003 - RNA, 19 nt, Homo sapiens
uguaaucuccagcacuuug

SEQ ID NO: 972004 - RNA, 19 nt, Homo sapiens
gagacagagguugcaauga

SEQ ID NO: 972005 - RNA, 19 nt, Homo sapiens
uuacguccucauaaccuua

SEQ ID NO: 972006 - RNA, 19 nt, Homo sapiens
acacuuggcccuugguuac

SEQ ID NO: 972007 - RNA, 19 nt, Homo sapiens
gcacacuuggcccuugguu

SEQ ID NO: 972008 - RNA, 19 nt, Homo sapiens
cacuugagguuaggaguuc

SEQ ID NO: 972009 - RNA, 19 nt, Homo sapiens
gaaggagagaaaacuguaa

SEQ ID NO: 972010 - RNA, 19 nt, Homo sapiens
aacaacaaaccaaaccaaa

SEQ ID NO: 972011 - RNA, 19 nt, Homo sapiens
aaauggggauguaaaccua

SEQ ID NO: 972012 - RNA, 19 nt, Homo sapiens
cuccgggucugggaaauug

SEQ ID NO: 972013 - RNA, 19 nt, Homo sapiens
agaagucggcgcugaccaa

SEQ ID NO: 972014 - RNA, 19 nt, Homo sapiens
acccucagaucucagucua

SEQ ID NO: 972015 - RNA, 19 nt, Homo sapiens
aagacugccucaaacaaac

SEQ ID NO: 972016 - RNA, 19 nt, Homo sapiens
cauaaccuuagaccugaaa

SEQ ID NO: 972017 - RNA, 19 nt, Homo sapiens
ucauaaccuuagaccugaa

SEQ ID NO: 972018 - RNA, 19 nt, Homo sapiens
ggagauaucugcugcauac

SEQ ID NO: 972019 - RNA, 19 nt, Homo sapiens
gcauuaacaugucauauuc

SEQ ID NO: 972020 - RNA, 19 nt, Homo sapiens
uauaagagcugggauuuga

SEQ ID NO: 972021 - RNA, 19 nt, Homo sapiens
gcaauugaccuaugacaaa

SEQ ID NO: 972022 - RNA, 19 nt, Homo sapiens
ggaauaagccacaguaaca

SEQ ID NO: 972023 - RNA, 19 nt, Homo sapiens
cgaguucgguuuaaugaaa

SEQ ID NO: 972024 - RNA, 19 nt, Homo sapiens
ccaaggaacuuaaggagau

SEQ ID NO: 972025 - RNA, 19 nt, Homo sapiens
ugaauuacaugcucagcua

SEQ ID NO: 972026 - RNA, 19 nt, Homo sapiens
gcugggauuugauucauuu

SEQ ID NO: 972027 - RNA, 19 nt, Homo sapiens
aaacagggagguccacuua

SEQ ID NO: 972028 - RNA, 19 nt, Homo sapiens
cuaaagauguuugucacua

SEQ ID NO: 972029 - RNA, 19 nt, Homo sapiens
cugcagauuucaccuauuu

SEQ ID NO: 972030 - RNA, 19 nt, Homo sapiens
cguggaggauuuggaauua

SEQ ID NO: 972031 - RNA, 19 nt, Homo sapiens
gccaauaccaagaaguuua

SEQ ID NO: 972032 - RNA, 19 nt, Homo sapiens
aaaccaaggugaaggaaca

SEQ ID NO: 972033 - RNA, 19 nt, Homo sapiens
ugaaggacguggccaagga

SEQ ID NO: 972034 - RNA, 19 nt, Homo sapiens
caaagaaugucagccaagu

SEQ ID NO: 972035 - RNA, 19 nt, Homo sapiens
gcuauuguccugacuguga

SEQ ID NO: 972036 - RNA, 19 nt, Homo sapiens
ucuacgaaauggaggcuua

SEQ ID NO: 972037 - RNA, 19 nt, Homo sapiens
uaaagauguuugucacuag

SEQ ID NO: 972038 - RNA, 19 nt, Homo sapiens
guaaguaugcagcacauug

SEQ ID NO: 972039 - RNA, 19 nt, Homo sapiens
cuaagucaucuaugcauua

SEQ ID NO: 972040 - RNA, 19 nt, Homo sapiens
gcucagcuauauauguaau

SEQ ID NO: 972041 - RNA, 19 nt, Homo sapiens
ugugauguaugccauuaaa

SEQ ID NO: 972042 - RNA, 19 nt, Homo sapiens
gaugaagucccacucuguu

SEQ ID NO: 972043 - RNA, 19 nt, Homo sapiens
aaacggacacgcugaauag

SEQ ID NO: 972044 - RNA, 19 nt, Homo sapiens
ugaaggaacagaucaagau

SEQ ID NO: 972045 - RNA, 19 nt, Homo sapiens
aaaaucaccugguaaguau

SEQ ID NO: 972046 - RNA, 19 nt, Homo sapiens
augcucagcuauauaugua

SEQ ID NO: 972047 - RNA, 19 nt, Homo sapiens
cgugugauguaugccauua

SEQ ID NO: 972048 - RNA, 19 nt, Homo sapiens
uaagagcugggauuugauu

SEQ ID NO: 972049 - RNA, 19 nt, Homo sapiens
guaaugagcacuuucuacu

SEQ ID NO: 972050 - RNA, 19 nt, Homo sapiens
acagggagguccacuuaca

SEQ ID NO: 972051 - RNA, 19 nt, Homo sapiens
cggacacgcugaauaguag

SEQ ID NO: 972052 - RNA, 19 nt, Homo sapiens
gagcugggauuugauucau

SEQ ID NO: 972053 - RNA, 19 nt, Homo sapiens
ggacguggccaaggaacuu

SEQ ID NO: 972054 - RNA, 19 nt, Homo sapiens
agucaucuaugcauuaaca

SEQ ID NO: 972055 - RNA, 19 nt, Homo sapiens
ccuaagucaucuaugcauu

SEQ ID NO: 972056 - RNA, 19 nt, Homo sapiens
ccaauaccaagaaguuuau

SEQ ID NO: 972057 - RNA, 19 nt, Homo sapiens
gaaggacguggccaaggaa

SEQ ID NO: 972058 - RNA, 19 nt, Homo sapiens
caacugccaauccuguaaa

SEQ ID NO: 972059 - RNA, 19 nt, Homo sapiens
gaaugucagccaaguccaa

SEQ ID NO: 972060 - RNA, 19 nt, Homo sapiens
agaucaaagugcaggcuaa

SEQ ID NO: 972061 - RNA, 19 nt, Homo sapiens
caaggaacuuaaggagaug

SEQ ID NO: 972062 - RNA, 19 nt, Homo sapiens
agauguuugucacuaguuu

SEQ ID NO: 972063 - RNA, 19 nt, Homo sapiens
acugugaaccugcagauuu

SEQ ID NO: 972064 - RNA, 19 nt, Homo sapiens
ggaagucaaccacuacaac

SEQ ID NO: 972065 - RNA, 19 nt, Homo sapiens
aaagauguuugucacuagu

SEQ ID NO: 972066 - RNA, 19 nt, Homo sapiens
ccacuacaaccgugugaug

SEQ ID NO: 972067 - RNA, 19 nt, Homo sapiens
acaguaccauggcuauugu

SEQ ID NO: 972068 - RNA, 19 nt, Homo sapiens
gaucaucguggaggauuug

SEQ ID NO: 972069 - RNA, 19 nt, Homo sapiens
uuacaugcucagcuauaua

SEQ ID NO: 972070 - RNA, 19 nt, Homo sapiens
uugcuuauauccuggguau

SEQ ID NO: 972071 - RNA, 19 nt, Homo sapiens
ccaacugccaauccuguaa

SEQ ID NO: 972072 - RNA, 19 nt, Homo sapiens
caucuaugcauuaacaugu

SEQ ID NO: 972073 - RNA, 19 nt, Homo sapiens
caauugaccuaugacaaac

SEQ ID NO: 972074 - RNA, 19 nt, Homo sapiens
ggagguccacuuacacagu

SEQ ID NO: 972075 - RNA, 19 nt, Homo sapiens
uagcucaaguggcacaaca

SEQ ID NO: 972076 - RNA, 19 nt, Homo sapiens
ccucccagguucaagcuau

SEQ ID NO: 972077 - RNA, 19 nt, Homo sapiens
uacaugcucagcuauauau

SEQ ID NO: 972078 - RNA, 19 nt, Homo sapiens
gaccuaugacaaacuguga

SEQ ID NO: 972079 - RNA, 19 nt, Homo sapiens
ucagcaaaguggcauaaaa

SEQ ID NO: 972080 - RNA, 19 nt, Homo sapiens
ccacccaccgggaaagauu

SEQ ID NO: 972081 - RNA, 19 nt, Homo sapiens
gaucaaagugcaggcuaau

SEQ ID NO: 972082 - RNA, 19 nt, Homo sapiens
accuacagcuggaggauga

SEQ ID NO: 972083 - RNA, 19 nt, Homo sapiens
caucguggaggauuuggaa

SEQ ID NO: 972084 - RNA, 19 nt, Homo sapiens
ggagaugaagucccacucu

SEQ ID NO: 972085 - RNA, 19 nt, Homo sapiens
cugugaaccugcagauuuc

SEQ ID NO: 972086 - RNA, 19 nt, Homo sapiens
gcugcauacccaacaguaa

SEQ ID NO: 972087 - RNA, 19 nt, Homo sapiens
caauggcacccuucuacga

SEQ ID NO: 972088 - RNA, 19 nt, Homo sapiens
gaauuacaugcucagcuau

SEQ ID NO: 972089 - RNA, 19 nt, Homo sapiens
uaaaugcugaggccaauac

SEQ ID NO: 972090 - RNA, 19 nt, Homo sapiens
uccuggguaugcauuauuu

SEQ ID NO: 972091 - RNA, 19 nt, Homo sapiens
gggaauaagccacaguaac

SEQ ID NO: 972092 - RNA, 19 nt, Homo sapiens
gcccaaauauauuaauccu

SEQ ID NO: 972093 - RNA, 19 nt, Homo sapiens
gcuccaguccagcuucuga

SEQ ID NO: 972094 - RNA, 19 nt, Homo sapiens
ucaaagugcaggcuaaugc

SEQ ID NO: 972095 - RNA, 19 nt, Homo sapiens
uggaggauuuggaauuagu

SEQ ID NO: 972096 - RNA, 19 nt, Homo sapiens
uugacacccugaccucuga

SEQ ID NO: 972097 - RNA, 19 nt, Homo sapiens
gugaaggaacagaucaaga

SEQ ID NO: 972098 - RNA, 19 nt, Homo sapiens
gaggaugagaugacugaca

SEQ ID NO: 972099 - RNA, 19 nt, Homo sapiens
gcugaggccaauaccaaga

SEQ ID NO: 972100 - RNA, 19 nt, Homo sapiens
gcagauuucaccuauuuug

SEQ ID NO: 972101 - RNA, 19 nt, Homo sapiens
gaauaagccacaguaacag

SEQ ID NO: 972102 - RNA, 19 nt, Homo sapiens
uacaguaccauggcuauug

SEQ ID NO: 972103 - RNA, 19 nt, Homo sapiens
gguugacaccugugaagug

SEQ ID NO: 972104 - RNA, 19 nt, Homo sapiens
gcugaauaguagcucaagu

SEQ ID NO: 972105 - RNA, 19 nt, Homo sapiens
aauuacaugcucagcuaua

SEQ ID NO: 972106 - RNA, 19 nt, Homo sapiens
ggccaauaccaagaaguuu

SEQ ID NO: 972107 - RNA, 19 nt, Homo sapiens
gcaccaaaaccacagaaga

SEQ ID NO: 972108 - RNA, 19 nt, Homo sapiens
gacguggccaaggaacuua

SEQ ID NO: 972109 - RNA, 19 nt, Homo sapiens
guccagcuucugaugcaua

SEQ ID NO: 972110 - RNA, 19 nt, Homo sapiens
gccuagagaagaucaaagu

SEQ ID NO: 972111 - RNA, 19 nt, Homo sapiens
acggacacgcugaauagua

SEQ ID NO: 972112 - RNA, 19 nt, Homo sapiens
auacuuuggucuguggaaa

SEQ ID NO: 972113 - RNA, 19 nt, Homo sapiens
caaggugaaggaacagauc

SEQ ID NO: 972114 - RNA, 19 nt, Homo sapiens
acuauaagagcugggauuu

SEQ ID NO: 972115 - RNA, 19 nt, Homo sapiens
uauccuggguaugcauuau

SEQ ID NO: 972116 - RNA, 19 nt, Homo sapiens
acuuucuacucaagcaaua

SEQ ID NO: 972117 - RNA, 19 nt, Homo sapiens
ccuccagccuagagaagau

SEQ ID NO: 972118 - RNA, 19 nt, Homo sapiens
caagagagcugcagaagua

SEQ ID NO: 972119 - RNA, 19 nt, Homo sapiens
ggaaagagcugcguggaua

SEQ ID NO: 972120 - RNA, 19 nt, Homo sapiens
aaacacagcugggcaagua

SEQ ID NO: 972121 - RNA, 19 nt, Homo sapiens
gggcaaguauuaauguaua

SEQ ID NO: 972122 - RNA, 19 nt, Homo sapiens
ggagaugccucgugaaaca

SEQ ID NO: 972123 - RNA, 19 nt, Homo sapiens
guaucaggcucuuugcuua

SEQ ID NO: 972124 - RNA, 19 nt, Homo sapiens
gcugggcgcuccaugauuu

SEQ ID NO: 972125 - RNA, 19 nt, Homo sapiens
gagaagaagugaaaaguuu

SEQ ID NO: 972126 - RNA, 19 nt, Homo sapiens
gaugugauccgaagaguuu

SEQ ID NO: 972127 - RNA, 19 nt, Homo sapiens
gauaagccaccuuggaaua

SEQ ID NO: 972128 - RNA, 19 nt, Homo sapiens
gggaagaaauaaagaaauc

SEQ ID NO: 972129 - RNA, 19 nt, Homo sapiens
guggauagauucaaacuuc

SEQ ID NO: 972130 - RNA, 19 nt, Homo sapiens
gaaggaagggaagaaauaa

SEQ ID NO: 972131 - RNA, 19 nt, Homo sapiens
cagaaguacuccagugauu

SEQ ID NO: 972132 - RNA, 19 nt, Homo sapiens
cagguuggcugaaggcuuu

SEQ ID NO: 972133 - RNA, 19 nt, Homo sapiens
caacuuagucaauugguuu

SEQ ID NO: 972134 - RNA, 19 nt, Homo sapiens
ugaaagccaucccguguug

SEQ ID NO: 972135 - RNA, 19 nt, Homo sapiens
gggcuuggcuuauggagau

SEQ ID NO: 972136 - RNA, 19 nt, Homo sapiens
gucagaagcuggaggaguu

SEQ ID NO: 972137 - RNA, 19 nt, Homo sapiens
gaagggaagaaauaaagaa

SEQ ID NO: 972138 - RNA, 19 nt, Homo sapiens
gcugaaggcuuugauguca

SEQ ID NO: 972139 - RNA, 19 nt, Homo sapiens
gcucuaagccggcaacaug

SEQ ID NO: 972140 - RNA, 19 nt, Homo sapiens
cagccuggauuucugcaua

SEQ ID NO: 972141 - RNA, 19 nt, Homo sapiens
ggaacagccuggauuucug

SEQ ID NO: 972142 - RNA, 19 nt, Homo sapiens
gaacuuccuguacagaauu

SEQ ID NO: 972143 - RNA, 19 nt, Homo sapiens
agaaggaagggaagaaaua

SEQ ID NO: 972144 - RNA, 19 nt, Homo sapiens
cuucauuagugacguauuu

SEQ ID NO: 972145 - RNA, 19 nt, Homo sapiens
ugaaagugauagagucaga

SEQ ID NO: 972146 - RNA, 19 nt, Homo sapiens
gggacaacuuagucaauug

SEQ ID NO: 972147 - RNA, 19 nt, Homo sapiens
gacacucacaggacaaaua

SEQ ID NO: 972148 - RNA, 19 nt, Homo sapiens
ucacagcacagcuuugaaa

SEQ ID NO: 972149 - RNA, 19 nt, Homo sapiens
caucaucaguuuagagagu

SEQ ID NO: 972150 - RNA, 19 nt, Homo sapiens
acaaauacaccaaggagaa

SEQ ID NO: 972151 - RNA, 19 nt, Homo sapiens
cguauuucaucaucaguuu

SEQ ID NO: 972152 - RNA, 19 nt, Homo sapiens
ggaagggaagaaauaaaga

SEQ ID NO: 972153 - RNA, 19 nt, Homo sapiens
caaaucacagcacagcuuu

SEQ ID NO: 972154 - RNA, 19 nt, Homo sapiens
gaccucauuuccuucuuga

SEQ ID NO: 972155 - RNA, 19 nt, Homo sapiens
cagaggagccagauaacuu

SEQ ID NO: 972156 - RNA, 19 nt, Homo sapiens
ggaauaggaagagguguug

SEQ ID NO: 972157 - RNA, 19 nt, Homo sapiens
ggagaaggaagggaagaaa

SEQ ID NO: 972158 - RNA, 19 nt, Homo sapiens
gggaagccauggagcagau

SEQ ID NO: 972159 - RNA, 19 nt, Homo sapiens
ugcaggagguggagaggua

SEQ ID NO: 972160 - RNA, 19 nt, Homo sapiens
cuucugaccucauuuccuu

SEQ ID NO: 972161 - RNA, 19 nt, Homo sapiens
gaaguacuccagugauucu

SEQ ID NO: 972162 - RNA, 19 nt, Homo sapiens
ggauuucugcauauggaua

SEQ ID NO: 972163 - RNA, 19 nt, Homo sapiens
ccacuggucccuucauuag

SEQ ID NO: 972164 - RNA, 19 nt, Homo sapiens
gagaaggaagggaagaaau

SEQ ID NO: 972165 - RNA, 19 nt, Homo sapiens
ugaccucauuuccuucuug

SEQ ID NO: 972166 - RNA, 19 nt, Homo sapiens
cugugauacuugcaauuua

SEQ ID NO: 972167 - RNA, 19 nt, Homo sapiens
auucaaacuuccuguggua

SEQ ID NO: 972168 - RNA, 19 nt, Homo sapiens
ccaaaucacagcacagcuu

SEQ ID NO: 972169 - RNA, 19 nt, Homo sapiens
caaacuuccugugguagug

SEQ ID NO: 972170 - RNA, 19 nt, Homo sapiens
caucuaaagacccaaauca

SEQ ID NO: 972171 - RNA, 19 nt, Homo sapiens
gguauuuacaugaggaauu

SEQ ID NO: 972172 - RNA, 19 nt, Homo sapiens
ggagagcuuugugccuguu

SEQ ID NO: 972173 - RNA, 19 nt, Homo sapiens
uuagugacguauuucauca

SEQ ID NO: 972174 - RNA, 19 nt, Homo sapiens
ucaaacauccauucugcuu

SEQ ID NO: 972175 - RNA, 19 nt, Homo sapiens
gaaagagcugcguggauag

SEQ ID NO: 972176 - RNA, 19 nt, Homo sapiens
gagaguucuuugacagcaa

SEQ ID NO: 972177 - RNA, 19 nt, Homo sapiens
gaaacgacagaaacaagca

SEQ ID NO: 972178 - RNA, 19 nt, Homo sapiens
uacucacucuucuugcuua

SEQ ID NO: 972179 - RNA, 19 nt, Homo sapiens
cugcguggauagauucaaa

SEQ ID NO: 972180 - RNA, 19 nt, Homo sapiens
gauuucugcauauggauaa

SEQ ID NO: 972181 - RNA, 19 nt, Homo sapiens
ggacaacuuagucaauugg

SEQ ID NO: 972182 - RNA, 19 nt, Homo sapiens
aggcagaggagccagauaa

SEQ ID NO: 972183 - RNA, 19 nt, Homo sapiens
gcagaaguacuccagugau

SEQ ID NO: 972184 - RNA, 19 nt, Homo sapiens
gcucuggaaauaccucaaa

SEQ ID NO: 972185 - RNA, 19 nt, Homo sapiens
uguucuagguguuagcuuu

SEQ ID NO: 972186 - RNA, 19 nt, Homo sapiens
ucaguacucacucuucuug

SEQ ID NO: 972187 - RNA, 19 nt, Homo sapiens
ggauaagccaccuuggaau

SEQ ID NO: 972188 - RNA, 19 nt, Homo sapiens
acaggcaguuauuguucua

SEQ ID NO: 972189 - RNA, 19 nt, Homo sapiens
uggauaagccaccuuggaa

SEQ ID NO: 972190 - RNA, 19 nt, Homo sapiens
guuauuguucuagguguua

SEQ ID NO: 972191 - RNA, 19 nt, Homo sapiens
agagaguucggcaugcuua

SEQ ID NO: 972192 - RNA, 19 nt, Homo sapiens
ugaaaaguuugccuucuga

SEQ ID NO: 972193 - RNA, 19 nt, Homo sapiens
ggccgagaguucuuugaca

SEQ ID NO: 972194 - RNA, 19 nt, Homo sapiens
ugacguauuucaucaucag

SEQ ID NO: 972195 - RNA, 19 nt, Homo sapiens
gagcugcguggauagauuc

SEQ ID NO: 972196 - RNA, 19 nt, Homo sapiens
agagcugcguggauagauu

SEQ ID NO: 972197 - RNA, 19 nt, Homo sapiens
cugaggcucuucaaacauc

SEQ ID NO: 972198 - RNA, 19 nt, Homo sapiens
acaacuuagucaauugguu

SEQ ID NO: 972199 - RNA, 19 nt, Homo sapiens
uauggaacagccuggauuu

SEQ ID NO: 972200 - RNA, 19 nt, Homo sapiens
cagauaacuucagcagcaa

SEQ ID NO: 972201 - RNA, 19 nt, Homo sapiens
ggaccuggaggagagcuuu

SEQ ID NO: 972202 - RNA, 19 nt, Homo sapiens
cggcccuuguuucuucuua

SEQ ID NO: 972203 - RNA, 19 nt, Homo sapiens
ggggacaacuuagucaauu

SEQ ID NO: 972204 - RNA, 19 nt, Homo sapiens
gaccuucaguacucacucu

SEQ ID NO: 972205 - RNA, 19 nt, Homo sapiens
gcgguuacccugagucucu

SEQ ID NO: 972206 - RNA, 19 nt, Homo sapiens
aaucacagcacagcuuuga

SEQ ID NO: 972207 - RNA, 19 nt, Homo sapiens
ucuaaagacccaaaucaca

SEQ ID NO: 972208 - RNA, 19 nt, Homo sapiens
ucugugauacuugcaauuu

SEQ ID NO: 972209 - RNA, 19 nt, Homo sapiens
guacucacucuucuugcuu

SEQ ID NO: 972210 - RNA, 19 nt, Homo sapiens
acuggucccuucauuagug

SEQ ID NO: 972211 - RNA, 19 nt, Homo sapiens
gcucuucaaacauccauuc

SEQ ID NO: 972212 - RNA, 19 nt, Homo sapiens
gguagugcucccagucuga

SEQ ID NO: 972213 - RNA, 19 nt, Homo sapiens
cagcugggcaaguauuaau

SEQ ID NO: 972214 - RNA, 19 nt, Homo sapiens
cacagcugggcaaguauua

SEQ ID NO: 972215 - RNA, 19 nt, Homo sapiens
ucugaccucuguagaccuu

SEQ ID NO: 972216 - RNA, 19 nt, Homo sapiens
cugggcaaguauuaaugua

SEQ ID NO: 972217 - RNA, 19 nt, Homo sapiens
caaauacaccaaggagaag

SEQ ID NO: 972218 - RNA, 19 nt, Homo sapiens
gaauucgacucuucuauua

SEQ ID NO: 972219 - RNA, 19 nt, Homo sapiens
gcucacaccuguaauuuca

SEQ ID NO: 972220 - RNA, 19 nt, Homo sapiens
gauugcagcuuaagacuug

SEQ ID NO: 972221 - RNA, 19 nt, Homo sapiens
ccaagagucauauauguua

SEQ ID NO: 972222 - RNA, 19 nt, Homo sapiens
caaauuguccucuaagaaa

SEQ ID NO: 972223 - RNA, 19 nt, Homo sapiens
gauuacagcucagacuuaa

SEQ ID NO: 972224 - RNA, 19 nt, Homo sapiens
gaucauugcuagauacugu

SEQ ID NO: 972225 - RNA, 19 nt, Homo sapiens
ggaugacacugauuucuuc

SEQ ID NO: 972226 - RNA, 19 nt, Homo sapiens
gaggaacugucauauuguu

SEQ ID NO: 972227 - RNA, 19 nt, Homo sapiens
gcucagacuuaaugggaua

SEQ ID NO: 972228 - RNA, 19 nt, Homo sapiens
gcauauauacccagaaguu

SEQ ID NO: 972229 - RNA, 19 nt, Homo sapiens
caccuuccauggacauuua

SEQ ID NO: 972230 - RNA, 19 nt, Homo sapiens
aguaguggguggaagauua

SEQ ID NO: 972231 - RNA, 19 nt, Homo sapiens
uugaggaacugucauauug

SEQ ID NO: 972232 - RNA, 19 nt, Homo sapiens
ucagcauccuguuuaauaa

SEQ ID NO: 972233 - RNA, 19 nt, Homo sapiens
ggcauuaaguacauucauu

SEQ ID NO: 972234 - RNA, 19 nt, Homo sapiens
gcccaagagucauauaugu

SEQ ID NO: 972235 - RNA, 19 nt, Homo sapiens
gcaaccaccauccuacuuu

SEQ ID NO: 972236 - RNA, 19 nt, Homo sapiens
ugaaucauuuggucugaaa

SEQ ID NO: 972237 - RNA, 19 nt, Homo sapiens
ucauauaaguggaacauag

SEQ ID NO: 972238 - RNA, 19 nt, Homo sapiens
ugggauagauuuggaauau

SEQ ID NO: 972239 - RNA, 19 nt, Homo sapiens
ggagugcaauggagugauc

SEQ ID NO: 972240 - RNA, 19 nt, Homo sapiens
gucagcauccuguuuaaua

SEQ ID NO: 972241 - RNA, 19 nt, Homo sapiens
caaauaauugcgauugcua

SEQ ID NO: 972242 - RNA, 19 nt, Homo sapiens
guauguuacugauaaagga

SEQ ID NO: 972243 - RNA, 19 nt, Homo sapiens
uaauugcgauugcuaucaa

SEQ ID NO: 972244 - RNA, 19 nt, Homo sapiens
auagguaccucauauaagu

SEQ ID NO: 972245 - RNA, 19 nt, Homo sapiens
gauacugugucuaaaugug

SEQ ID NO: 972246 - RNA, 19 nt, Homo sapiens
gagacucaauaauaguuug

SEQ ID NO: 972247 - RNA, 19 nt, Homo sapiens
caugguggcuggugucugu

SEQ ID NO: 972248 - RNA, 19 nt, Homo sapiens
gugguacaauccuuauaaa

SEQ ID NO: 972249 - RNA, 19 nt, Homo sapiens
gcucaguauuaucuuugua

SEQ ID NO: 972250 - RNA, 19 nt, Homo sapiens
gaacccugccucuacuaaa

SEQ ID NO: 972251 - RNA, 19 nt, Homo sapiens
ugcgauugcuaucaaauaa

SEQ ID NO: 972252 - RNA, 19 nt, Homo sapiens
gaaugucagcauccuguuu

SEQ ID NO: 972253 - RNA, 19 nt, Homo sapiens
ugacacugauuucuucugu

SEQ ID NO: 972254 - RNA, 19 nt, Homo sapiens
uaaauugcuggaucacaua

SEQ ID NO: 972255 - RNA, 19 nt, Homo sapiens
ugaauucgacucuucuauu

SEQ ID NO: 972256 - RNA, 19 nt, Homo sapiens
caaccaccauccuacuuuc

SEQ ID NO: 972257 - RNA, 19 nt, Homo sapiens
gugaaguggugauaaguag

SEQ ID NO: 972258 - RNA, 19 nt, Homo sapiens
acacugauuucuucuguag

SEQ ID NO: 972259 - RNA, 19 nt, Homo sapiens
gcaggagaaucacuugaac

SEQ ID NO: 972260 - RNA, 19 nt, Homo sapiens
gauaaaggaaugacuagag

SEQ ID NO: 972261 - RNA, 19 nt, Homo sapiens
uuaaauugcuggaucacau

SEQ ID NO: 972262 - RNA, 19 nt, Homo sapiens
ccaaauuguccucuaagaa

SEQ ID NO: 972263 - RNA, 19 nt, Homo sapiens
gaaguggugauaaguagug

SEQ ID NO: 972264 - RNA, 19 nt, Homo sapiens
cauauauacccagaaguua

SEQ ID NO: 972265 - RNA, 19 nt, Homo sapiens
cauagaguauuugcccuuu

SEQ ID NO: 972266 - RNA, 19 nt, Homo sapiens
aguggaacauagaguauuu

SEQ ID NO: 972267 - RNA, 19 nt, Homo sapiens
ucuguuaccguacuuauuu

SEQ ID NO: 972268 - RNA, 19 nt, Homo sapiens
gggauagauuuggaauauu

SEQ ID NO: 972269 - RNA, 19 nt, Homo sapiens
ggaacccugccucuacuaa

SEQ ID NO: 972270 - RNA, 19 nt, Homo sapiens
acauuuagguuguuucuac

SEQ ID NO: 972271 - RNA, 19 nt, Homo sapiens
gcaaauauuaccccaaauu

SEQ ID NO: 972272 - RNA, 19 nt, Homo sapiens
ucagugaaguggugauaag

SEQ ID NO: 972273 - RNA, 19 nt, Homo sapiens
gacacugauuucuucugua

SEQ ID NO: 972274 - RNA, 19 nt, Homo sapiens
cagcuuaagacuuggcaua

SEQ ID NO: 972275 - RNA, 19 nt, Homo sapiens
uaaaggaaugacuagagua

SEQ ID NO: 972276 - RNA, 19 nt, Homo sapiens
ccauggacauuuagguugu

SEQ ID NO: 972277 - RNA, 19 nt, Homo sapiens
caagagucauauauguuag

SEQ ID NO: 972278 - RNA, 19 nt, Homo sapiens
ccaccauccuacuuucuau

SEQ ID NO: 972279 - RNA, 19 nt, Homo sapiens
uuacagcucagacuuaaug

SEQ ID NO: 972280 - RNA, 19 nt, Homo sapiens
uaacaaagagaugcauuca

SEQ ID NO: 972281 - RNA, 19 nt, Homo sapiens
aaugucagcauccuguuua

SEQ ID NO: 972282 - RNA, 19 nt, Homo sapiens
cuucugcuuucaauucuuu

SEQ ID NO: 972283 - RNA, 19 nt, Homo sapiens
uuaaugggauagauuugga

SEQ ID NO: 972284 - RNA, 19 nt, Homo sapiens
cuaccuccuuuaaugguuu

SEQ ID NO: 972285 - RNA, 19 nt, Homo sapiens
auaaaggaaugacuagagu

SEQ ID NO: 972286 - RNA, 19 nt, Homo sapiens
gagcucaguauuaucuuug

SEQ ID NO: 972287 - RNA, 19 nt, Homo sapiens
cuccuuaaccucuuucuuu

SEQ ID NO: 972288 - RNA, 19 nt, Homo sapiens
gacccuauuugguuugcuu

SEQ ID NO: 972289 - RNA, 19 nt, Homo sapiens
guaacaaagagaugcauuc

SEQ ID NO: 972290 - RNA, 19 nt, Homo sapiens
cauauaaguggaacauaga

SEQ ID NO: 972291 - RNA, 19 nt, Homo sapiens
gacuuaaugggauagauuu

SEQ ID NO: 972292 - RNA, 19 nt, Homo sapiens
gaauucuguugaaaucagu

SEQ ID NO: 972293 - RNA, 19 nt, Homo sapiens
ucagugagccaagaucauu

SEQ ID NO: 972294 - RNA, 19 nt, Homo sapiens
cuucugggcucaagugauc

SEQ ID NO: 972295 - RNA, 19 nt, Homo sapiens
gcaggcagcauugaugaau

SEQ ID NO: 972296 - RNA, 19 nt, Homo sapiens
gaaaaucuguuaccguacu

SEQ ID NO: 972297 - RNA, 19 nt, Homo sapiens
ccaguucaguggcauuaag

SEQ ID NO: 972298 - RNA, 19 nt, Homo sapiens
agagcucaguauuaucuuu

SEQ ID NO: 972299 - RNA, 19 nt, Homo sapiens
uagcugggcaaaucaguuu

SEQ ID NO: 972300 - RNA, 19 nt, Homo sapiens
ugaaguagagaacaugaau

SEQ ID NO: 972301 - RNA, 19 nt, Homo sapiens
cagcuucugcuuucaauuc

SEQ ID NO: 972302 - RNA, 19 nt, Homo sapiens
ugccauccaucuccagaaa

SEQ ID NO: 972303 - RNA, 19 nt, Homo sapiens
ucaguggcauuaaguacau

SEQ ID NO: 972304 - RNA, 19 nt, Homo sapiens
agauuacagcucagacuua

SEQ ID NO: 972305 - RNA, 19 nt, Homo sapiens
aaacacacacacaaauuag

SEQ ID NO: 972306 - RNA, 19 nt, Homo sapiens
gaacugucauauuguuuuc

SEQ ID NO: 972307 - RNA, 19 nt, Homo sapiens
ucucugaauucgacucuuc

SEQ ID NO: 972308 - RNA, 19 nt, Homo sapiens
guacauucauuuugcuuug

SEQ ID NO: 972309 - RNA, 19 nt, Homo sapiens
gcguaagacucucucaaaa

SEQ ID NO: 972310 - RNA, 19 nt, Homo sapiens
ggcaggagaaucacuugaa

SEQ ID NO: 972311 - RNA, 19 nt, Homo sapiens
gaggcaggcggaucacuug

SEQ ID NO: 972312 - RNA, 19 nt, Homo sapiens
agagucuucuccuccuuaa

SEQ ID NO: 972313 - RNA, 19 nt, Homo sapiens
uugagacccuauuugguuu

SEQ ID NO: 972314 - RNA, 19 nt, Homo sapiens
ucauuuggucugaaacuuu

SEQ ID NO: 972315 - RNA, 19 nt, Homo sapiens
ucaugcagccauaaacauu

SEQ ID NO: 972316 - RNA, 19 nt, Homo sapiens
gaagauuacagcucagacu

SEQ ID NO: 972317 - RNA, 19 nt, Homo sapiens
gcuuauuucacuuagcaua

SEQ ID NO: 972318 - RNA, 19 nt, Homo sapiens
aaagaaagcccaacauuaa

SEQ ID NO: 972319 - RNA, 19 nt, Homo sapiens
uaaagaaagcccaacauua

SEQ ID NO: 972320 - RNA, 19 nt, Homo sapiens
uaacuccucuguccucuau

SEQ ID NO: 972321 - RNA, 19 nt, Homo sapiens
gaccugcuguugcacauga

SEQ ID NO: 972322 - RNA, 19 nt, Homo sapiens
ggaggcauuugcugacaga

SEQ ID NO: 972323 - RNA, 19 nt, Homo sapiens
gcagagggacccacaagug

SEQ ID NO: 972324 - RNA, 19 nt, Homo sapiens
ccuaaugccucaccuuaca

SEQ ID NO: 972325 - RNA, 19 nt, Homo sapiens
ggacuuggaccugcuguug

SEQ ID NO: 972326 - RNA, 19 nt, Homo sapiens
ccagggccaugcucuguga

SEQ ID NO: 972327 - RNA, 19 nt, Homo sapiens
ggagacaccaggcuacuag

SEQ ID NO: 972328 - RNA, 19 nt, Homo sapiens
gagagugggcucagugaug

SEQ ID NO: 972329 - RNA, 19 nt, Homo sapiens
uuaaagaaagcccaacauu

SEQ ID NO: 972330 - RNA, 19 nt, Homo sapiens
ucucaggucucccuaaugg

SEQ ID NO: 972331 - RNA, 19 nt, Homo sapiens
gcugggcguucccuuguug

SEQ ID NO: 972332 - RNA, 19 nt, Homo sapiens
gcccaacauuaaaggguuu

SEQ ID NO: 972333 - RNA, 19 nt, Homo sapiens
ccacagaugggcagucuca

SEQ ID NO: 972334 - RNA, 19 nt, Homo sapiens
gaaacugaggccuggaaug

SEQ ID NO: 972335 - RNA, 19 nt, Homo sapiens
aagaaagcccaacauuaaa

SEQ ID NO: 972336 - RNA, 19 nt, Homo sapiens
ccucuguccucuauauuca

SEQ ID NO: 972337 - RNA, 19 nt, Homo sapiens
gcugcaaccuuucuguuuu

SEQ ID NO: 972338 - RNA, 19 nt, Homo sapiens
agagugggcucagugaugu

SEQ ID NO: 972339 - RNA, 19 nt, Homo sapiens
gaaagcccaacauuaaagg

SEQ ID NO: 972340 - RNA, 19 nt, Homo sapiens
ccaggaagcccaccuugag

SEQ ID NO: 972341 - RNA, 19 nt, Homo sapiens
gagcagagggacccacaag

SEQ ID NO: 972342 - RNA, 19 nt, Homo sapiens
aaacugaggccuggaaugg

SEQ ID NO: 972343 - RNA, 19 nt, Homo sapiens
ugccuaaugccucaccuua

SEQ ID NO: 972344 - RNA, 19 nt, Homo sapiens
ucucagccauacucuguuc

SEQ ID NO: 972345 - RNA, 19 nt, Homo sapiens
uuacagccaccaugggaaa

SEQ ID NO: 972346 - RNA, 19 nt, Homo sapiens
gggaaacugaggccuggaa

SEQ ID NO: 972347 - RNA, 19 nt, Homo sapiens
acuccucuguccucuauau

SEQ ID NO: 972348 - RNA, 19 nt, Homo sapiens
agaaagcccaacauuaaag

SEQ ID NO: 972349 - RNA, 19 nt, Homo sapiens
ggaaacugaggccuggaau

SEQ ID NO: 972350 - RNA, 19 nt, Homo sapiens
cugcaaccuuucuguuuua

SEQ ID NO: 972351 - RNA, 19 nt, Homo sapiens
cuucucaggucucccuaau

SEQ ID NO: 972352 - RNA, 19 nt, Homo sapiens
ccagugaccgccaccuuca

SEQ ID NO: 972353 - RNA, 19 nt, Homo sapiens
ggccaugcucugugacuug

SEQ ID NO: 972354 - RNA, 19 nt, Homo sapiens
gggccaugcucugugacuu

SEQ ID NO: 972355 - RNA, 19 nt, Homo sapiens
gauggaagggaggcauuug

SEQ ID NO: 972356 - RNA, 19 nt, Homo sapiens
agaaggaggaguggcauug

SEQ ID NO: 972357 - RNA, 19 nt, Homo sapiens
ccagagucaccaaggcaaa

SEQ ID NO: 972358 - RNA, 19 nt, Homo sapiens
gggcugauccccacccuuu

SEQ ID NO: 972359 - RNA, 19 nt, Homo sapiens
gcacuggaucuccuacaac

SEQ ID NO: 972360 - RNA, 19 nt, Homo sapiens
gaaggaggaguggcauugg

SEQ ID NO: 972361 - RNA, 19 nt, Homo sapiens
uaaaggguuuucauugcaa

SEQ ID NO: 972362 - RNA, 19 nt, Homo sapiens
gaccagugaccgccaccuu

SEQ ID NO: 972363 - RNA, 19 nt, Homo sapiens
gcuccacgcuaggcagaag

SEQ ID NO: 972364 - RNA, 19 nt, Homo sapiens
ggaaugaaauuacgucuuu

SEQ ID NO: 972365 - RNA, 19 nt, Homo sapiens
ggaaaggauugcaagagaa

SEQ ID NO: 972366 - RNA, 19 nt, Homo sapiens
aaacauggcugucauacau

SEQ ID NO: 972367 - RNA, 19 nt, Homo sapiens
gcauuacauuggcaaauaa

SEQ ID NO: 972368 - RNA, 19 nt, Homo sapiens
ggaacucaauaacucauuu

SEQ ID NO: 972369 - RNA, 19 nt, Homo sapiens
gauguaaagugcucuguug

SEQ ID NO: 972370 - RNA, 19 nt, Homo sapiens
caacuucgauacugauaga

SEQ ID NO: 972371 - RNA, 19 nt, Homo sapiens
gacaaaugcuccagaaauc

SEQ ID NO: 972372 - RNA, 19 nt, Homo sapiens
ggcauuacauuggcaaaua

SEQ ID NO: 972373 - RNA, 19 nt, Homo sapiens
caugagaaauuaccaguau

SEQ ID NO: 972374 - RNA, 19 nt, Homo sapiens
ggaauaacaaugaugugua

SEQ ID NO: 972375 - RNA, 19 nt, Homo sapiens
ucauuucacuggcucuuua

SEQ ID NO: 972376 - RNA, 19 nt, Homo sapiens
caaauauacuuggagcuuu

SEQ ID NO: 972377 - RNA, 19 nt, Homo sapiens
gcagaugucucgauauagg

SEQ ID NO: 972378 - RNA, 19 nt, Homo sapiens
uaacuacuauggcaacuca

SEQ ID NO: 972379 - RNA, 19 nt, Homo sapiens
caucagggaucuuaaucaa

SEQ ID NO: 972380 - RNA, 19 nt, Homo sapiens
ucagggaucuuaaucaaca

SEQ ID NO: 972381 - RNA, 19 nt, Homo sapiens
gcaucagauucaacuuaua

SEQ ID NO: 972382 - RNA, 19 nt, Homo sapiens
cgagaguacuagaaguuaa

SEQ ID NO: 972383 - RNA, 19 nt, Homo sapiens
gaauaucaccagcucugua

SEQ ID NO: 972384 - RNA, 19 nt, Homo sapiens
ucaggauccuugucaauug

SEQ ID NO: 972385 - RNA, 19 nt, Homo sapiens
uauaucggguacacaauuu

SEQ ID NO: 972386 - RNA, 19 nt, Homo sapiens
cuacugggcauaauuauau

SEQ ID NO: 972387 - RNA, 19 nt, Homo sapiens
caaaugcuccagaaaucua

SEQ ID NO: 972388 - RNA, 19 nt, Homo sapiens
guaaagugcucuguuguac

SEQ ID NO: 972389 - RNA, 19 nt, Homo sapiens
uagaaaguaccuugaagua

SEQ ID NO: 972390 - RNA, 19 nt, Homo sapiens
agaaaucuaugcugacugu

SEQ ID NO: 972391 - RNA, 19 nt, Homo sapiens
augcagaugucucgauaua

SEQ ID NO: 972392 - RNA, 19 nt, Homo sapiens
gaagggagaacccaaaguc

SEQ ID NO: 972393 - RNA, 19 nt, Homo sapiens
uggaaaggauugcaagaga

SEQ ID NO: 972394 - RNA, 19 nt, Homo sapiens
cgagcuaucauuugaguaa

SEQ ID NO: 972395 - RNA, 19 nt, Homo sapiens
auacuucccucccauuuau

SEQ ID NO: 972396 - RNA, 19 nt, Homo sapiens
cugauagacuuguugauau

SEQ ID NO: 972397 - RNA, 19 nt, Homo sapiens
ugacaaccaugcaaggaau

SEQ ID NO: 972398 - RNA, 19 nt, Homo sapiens
gagaguacuagaaguuaaa

SEQ ID NO: 972399 - RNA, 19 nt, Homo sapiens
gugcuggaauucugcauug

SEQ ID NO: 972400 - RNA, 19 nt, Homo sapiens
gguagucuaggaaugaaua

SEQ ID NO: 972401 - RNA, 19 nt, Homo sapiens
gaaugaaauuacgucuuug

SEQ ID NO: 972402 - RNA, 19 nt, Homo sapiens
acagacaaaugcuccagaa

SEQ ID NO: 972403 - RNA, 19 nt, Homo sapiens
gcaucucccacaccacuua

SEQ ID NO: 972404 - RNA, 19 nt, Homo sapiens
gcauggugcuccucuuaag

SEQ ID NO: 972405 - RNA, 19 nt, Homo sapiens
gguccgagguagucuagga

SEQ ID NO: 972406 - RNA, 19 nt, Homo sapiens
gcagcaggaauuagaacua

SEQ ID NO: 972407 - RNA, 19 nt, Homo sapiens
guaacccuauuuccgugua

SEQ ID NO: 972408 - RNA, 19 nt, Homo sapiens
aagcaucagauucaacuua

SEQ ID NO: 972409 - RNA, 19 nt, Homo sapiens
uaagugugcuggaauucug

SEQ ID NO: 972410 - RNA, 19 nt, Homo sapiens
ggaucuuaaucaacacauu

SEQ ID NO: 972411 - RNA, 19 nt, Homo sapiens
gaaaggauugcaagagaag

SEQ ID NO: 972412 - RNA, 19 nt, Homo sapiens
aaugaggccuccaugcaaa

SEQ ID NO: 972413 - RNA, 19 nt, Homo sapiens
gagcuaucauuugaguaaa

SEQ ID NO: 972414 - RNA, 19 nt, Homo sapiens
uaugaacuguguguguaua

SEQ ID NO: 972415 - RNA, 19 nt, Homo sapiens
agacaaaugcuccagaaau

SEQ ID NO: 972416 - RNA, 19 nt, Homo sapiens
guauaucggguacacaauu

SEQ ID NO: 972417 - RNA, 19 nt, Homo sapiens
gccaucacauucucacaug

SEQ ID NO: 972418 - RNA, 19 nt, Homo sapiens
gagguagucuaggaaugaa

SEQ ID NO: 972419 - RNA, 19 nt, Homo sapiens
cauagaaaguaccuugaag

SEQ ID NO: 972420 - RNA, 19 nt, Homo sapiens
cauacuucccucccauuua

SEQ ID NO: 972421 - RNA, 19 nt, Homo sapiens
gcaggaauuagaacuacaa

SEQ ID NO: 972422 - RNA, 19 nt, Homo sapiens
gggaaacauggcugucaua

SEQ ID NO: 972423 - RNA, 19 nt, Homo sapiens
ugcacgagcuaucauuuga

SEQ ID NO: 972424 - RNA, 19 nt, Homo sapiens
caaaagaucaacagacaaa

SEQ ID NO: 972425 - RNA, 19 nt, Homo sapiens
gcaacucaaauaauuguca

SEQ ID NO: 972426 - RNA, 19 nt, Homo sapiens
gauucugacugcccugaug

SEQ ID NO: 972427 - RNA, 19 nt, Homo sapiens
ugucauacauucacaucug

SEQ ID NO: 972428 - RNA, 19 nt, Homo sapiens
gaaacauggcugucauaca

SEQ ID NO: 972429 - RNA, 19 nt, Homo sapiens
gaacucaauaacucauuuc

SEQ ID NO: 972430 - RNA, 19 nt, Homo sapiens
acacaagagccucacauga

SEQ ID NO: 972431 - RNA, 19 nt, Homo sapiens
auaugcagaugucucgaua

SEQ ID NO: 972432 - RNA, 19 nt, Homo sapiens
cgagguagucuaggaauga

SEQ ID NO: 972433 - RNA, 19 nt, Homo sapiens
ugaaauuacgucuuuggaa

SEQ ID NO: 972434 - RNA, 19 nt, Homo sapiens
uauaaaggcauuacauugg

SEQ ID NO: 972435 - RNA, 19 nt, Homo sapiens
gcaugggaauaacaaugau

SEQ ID NO: 972436 - RNA, 19 nt, Homo sapiens
guguguguauagagagaua

SEQ ID NO: 972437 - RNA, 19 nt, Homo sapiens
acugauagacuuguugaua

SEQ ID NO: 972438 - RNA, 19 nt, Homo sapiens
ccagaaaucuaugcugacu

SEQ ID NO: 972439 - RNA, 19 nt, Homo sapiens
aaagaucaacagacaaaug

SEQ ID NO: 972440 - RNA, 19 nt, Homo sapiens
ggaauuagaacuacaaaag

SEQ ID NO: 972441 - RNA, 19 nt, Homo sapiens
cuucuacugggcauaauua

SEQ ID NO: 972442 - RNA, 19 nt, Homo sapiens
cauauuaagcaucagauuc

SEQ ID NO: 972443 - RNA, 19 nt, Homo sapiens
ucaaauauacuuggagcuu

SEQ ID NO: 972444 - RNA, 19 nt, Homo sapiens
cucaauaacucauuucacu

SEQ ID NO: 972445 - RNA, 19 nt, Homo sapiens
cugcaaaugguuucaauau

SEQ ID NO: 972446 - RNA, 19 nt, Homo sapiens
uguaaagugcucuguugua

SEQ ID NO: 972447 - RNA, 19 nt, Homo sapiens
ccauagaaaguaccuugaa

SEQ ID NO: 972448 - RNA, 19 nt, Homo sapiens
ccucuuaagugugcuggaa

SEQ ID NO: 972449 - RNA, 19 nt, Homo sapiens
gacuauguccaucuuaaug

SEQ ID NO: 972450 - RNA, 19 nt, Homo sapiens
gggagaacccaaaguccuu

SEQ ID NO: 972451 - RNA, 19 nt, Homo sapiens
ugcaacauaugguauuugu

SEQ ID NO: 972452 - RNA, 19 nt, Homo sapiens
auuaugaacugugugugua

SEQ ID NO: 972453 - RNA, 19 nt, Homo sapiens
uuaauucugccaucacauu

SEQ ID NO: 972454 - RNA, 19 nt, Homo sapiens
gaggcaacagcacuugaaa

SEQ ID NO: 972455 - RNA, 19 nt, Homo sapiens
gaacuguguguguauagag

SEQ ID NO: 972456 - RNA, 19 nt, Homo sapiens
ucuuaagugugcuggaauu

SEQ ID NO: 972457 - RNA, 19 nt, Homo sapiens
uggcauggugcuccucuua

SEQ ID NO: 972458 - RNA, 19 nt, Homo sapiens
uacuauggcaacucaaaua

SEQ ID NO: 972459 - RNA, 19 nt, Homo sapiens
cagcaggaauuagaacuac

SEQ ID NO: 972460 - RNA, 19 nt, Homo sapiens
gggaauaacaaugaugugu

SEQ ID NO: 972461 - RNA, 19 nt, Homo sapiens
aaaguaccuugaaguagca

SEQ ID NO: 972462 - RNA, 19 nt, Homo sapiens
ggauguaaagugcucuguu

SEQ ID NO: 972463 - RNA, 19 nt, Homo sapiens
gcaucagggaucuuaauca

SEQ ID NO: 972464 - RNA, 19 nt, Homo sapiens
ggaaaggauugcaagagaa

SEQ ID NO: 972465 - RNA, 19 nt, Homo sapiens
aaacauggcugucauacau

SEQ ID NO: 972466 - RNA, 19 nt, Homo sapiens
gcauuacauuggcaaauaa

SEQ ID NO: 972467 - RNA, 19 nt, Homo sapiens
ggaacucaauaacucauuu

SEQ ID NO: 972468 - RNA, 19 nt, Homo sapiens
gauguaaagugcucuguug

SEQ ID NO: 972469 - RNA, 19 nt, Homo sapiens
caacuucgauacugauaga

SEQ ID NO: 972470 - RNA, 19 nt, Homo sapiens
gacaaaugcuccagaaauc

SEQ ID NO: 972471 - RNA, 19 nt, Homo sapiens
ggcauuacauuggcaaaua

SEQ ID NO: 972472 - RNA, 19 nt, Homo sapiens
caugagaaauuaccaguau

SEQ ID NO: 972473 - RNA, 19 nt, Homo sapiens
ggaauaacaaugaugugua

SEQ ID NO: 972474 - RNA, 19 nt, Homo sapiens
ucauuucacuggcucuuua

SEQ ID NO: 972475 - RNA, 19 nt, Homo sapiens
uaacuacuauggcaacuca

SEQ ID NO: 972476 - RNA, 19 nt, Homo sapiens
caucagggaucuuaaucaa

SEQ ID NO: 972477 - RNA, 19 nt, Homo sapiens
ucagggaucuuaaucaaca

SEQ ID NO: 972478 - RNA, 19 nt, Homo sapiens
gcaucagauucaacuuaua

SEQ ID NO: 972479 - RNA, 19 nt, Homo sapiens
cgagaguacuagaaguuaa

SEQ ID NO: 972480 - RNA, 19 nt, Homo sapiens
gaauaucaccagcucugua

SEQ ID NO: 972481 - RNA, 19 nt, Homo sapiens
ucaggauccuugucaauug

SEQ ID NO: 972482 - RNA, 19 nt, Homo sapiens
uauaucggguacacaauuu

SEQ ID NO: 972483 - RNA, 19 nt, Homo sapiens
cuacugggcauaauuauau

SEQ ID NO: 972484 - RNA, 19 nt, Homo sapiens
caaaugcuccagaaaucua

SEQ ID NO: 972485 - RNA, 19 nt, Homo sapiens
guaaagugcucuguuguac

SEQ ID NO: 972486 - RNA, 19 nt, Homo sapiens
uagaaaguaccuugaagua

SEQ ID NO: 972487 - RNA, 19 nt, Homo sapiens
agaaaucuaugcugacugu

SEQ ID NO: 972488 - RNA, 19 nt, Homo sapiens
gaagggagaacccaaaguc

SEQ ID NO: 972489 - RNA, 19 nt, Homo sapiens
uggaaaggauugcaagaga

SEQ ID NO: 972490 - RNA, 19 nt, Homo sapiens
cgagcuaucauuugaguaa

SEQ ID NO: 972491 - RNA, 19 nt, Homo sapiens
auacuucccucccauuuau

SEQ ID NO: 972492 - RNA, 19 nt, Homo sapiens
ugacaaccaugcaaggaau

SEQ ID NO: 972493 - RNA, 19 nt, Homo sapiens
cugauagacuuguugauau

SEQ ID NO: 972494 - RNA, 19 nt, Homo sapiens
gagaguacuagaaguuaaa

SEQ ID NO: 972495 - RNA, 19 nt, Homo sapiens
gugcuggaauucugcauug

SEQ ID NO: 972496 - RNA, 19 nt, Homo sapiens
gguagucuaggaaugaaua

SEQ ID NO: 972497 - RNA, 19 nt, Homo sapiens
acagacaaaugcuccagaa

SEQ ID NO: 972498 - RNA, 19 nt, Homo sapiens
gcaucucccacaccacuua

SEQ ID NO: 972499 - RNA, 19 nt, Homo sapiens
gcauggugcuccucuuaag

SEQ ID NO: 972500 - RNA, 19 nt, Homo sapiens
gguccgagguagucuagga

SEQ ID NO: 972501 - RNA, 19 nt, Homo sapiens
gcagcaggaauuagaacua

SEQ ID NO: 972502 - RNA, 19 nt, Homo sapiens
guaacccuauuuccgugua

SEQ ID NO: 972503 - RNA, 19 nt, Homo sapiens
aagcaucagauucaacuua

SEQ ID NO: 972504 - RNA, 19 nt, Homo sapiens
uaagugugcuggaauucug

SEQ ID NO: 972505 - RNA, 19 nt, Homo sapiens
ggaucuuaaucaacacauu

SEQ ID NO: 972506 - RNA, 19 nt, Homo sapiens
gaaaggauugcaagagaag

SEQ ID NO: 972507 - RNA, 19 nt, Homo sapiens
aaugaggccuccaugcaaa

SEQ ID NO: 972508 - RNA, 19 nt, Homo sapiens
gagcuaucauuugaguaaa

SEQ ID NO: 972509 - RNA, 19 nt, Homo sapiens
uaugaacuguguguguaua

SEQ ID NO: 972510 - RNA, 19 nt, Homo sapiens
agacaaaugcuccagaaau

SEQ ID NO: 972511 - RNA, 19 nt, Homo sapiens
guauaucggguacacaauu

SEQ ID NO: 972512 - RNA, 19 nt, Homo sapiens
gccaucacauucucacaug

SEQ ID NO: 972513 - RNA, 19 nt, Homo sapiens
gagguagucuaggaaugaa

SEQ ID NO: 972514 - RNA, 19 nt, Homo sapiens
cauagaaaguaccuugaag

SEQ ID NO: 972515 - RNA, 19 nt, Homo sapiens
cauacuucccucccauuua

SEQ ID NO: 972516 - RNA, 19 nt, Homo sapiens
gggaaacauggcugucaua

SEQ ID NO: 972517 - RNA, 19 nt, Homo sapiens
gcaggaauuagaacuacaa

SEQ ID NO: 972518 - RNA, 19 nt, Homo sapiens
ugcacgagcuaucauuuga

SEQ ID NO: 972519 - RNA, 19 nt, Homo sapiens
ugucauacauucacaucug

SEQ ID NO: 972520 - RNA, 19 nt, Homo sapiens
gaaacauggcugucauaca

SEQ ID NO: 972521 - RNA, 19 nt, Homo sapiens
caaaagaucaacagacaaa

SEQ ID NO: 972522 - RNA, 19 nt, Homo sapiens
gcaacucaaauaauuguca

SEQ ID NO: 972523 - RNA, 19 nt, Homo sapiens
gauucugacugcccugaug

SEQ ID NO: 972524 - RNA, 19 nt, Homo sapiens
gaacucaauaacucauuuc

SEQ ID NO: 972525 - RNA, 19 nt, Homo sapiens
acacaagagccucacauga

SEQ ID NO: 972526 - RNA, 19 nt, Homo sapiens
cgagguagucuaggaauga

SEQ ID NO: 972527 - RNA, 19 nt, Homo sapiens
uauaaaggcauuacauugg

SEQ ID NO: 972528 - RNA, 19 nt, Homo sapiens
gcaugggaauaacaaugau

SEQ ID NO: 972529 - RNA, 19 nt, Homo sapiens
guguguguauagagagaua

SEQ ID NO: 972530 - RNA, 19 nt, Homo sapiens
acugauagacuuguugaua

SEQ ID NO: 972531 - RNA, 19 nt, Homo sapiens
ccagaaaucuaugcugacu

SEQ ID NO: 972532 - RNA, 19 nt, Homo sapiens
aaagaucaacagacaaaug

SEQ ID NO: 972533 - RNA, 19 nt, Homo sapiens
ggaauuagaacuacaaaag

SEQ ID NO: 972534 - RNA, 19 nt, Homo sapiens
cuucuacugggcauaauua

SEQ ID NO: 972535 - RNA, 19 nt, Homo sapiens
cauauuaagcaucagauuc

SEQ ID NO: 972536 - RNA, 19 nt, Homo sapiens
cucaauaacucauuucacu

SEQ ID NO: 972537 - RNA, 19 nt, Homo sapiens
uguaaagugcucuguugua

SEQ ID NO: 972538 - RNA, 19 nt, Homo sapiens
ccauagaaaguaccuugaa

SEQ ID NO: 972539 - RNA, 19 nt, Homo sapiens
gggagaacccaaaguccuu

SEQ ID NO: 972540 - RNA, 19 nt, Homo sapiens
ccucuuaagugugcuggaa

SEQ ID NO: 972541 - RNA, 19 nt, Homo sapiens
gacuauguccaucuuaaug

SEQ ID NO: 972542 - RNA, 19 nt, Homo sapiens
ugcaacauaugguauuugu

SEQ ID NO: 972543 - RNA, 19 nt, Homo sapiens
auuaugaacugugugugua

SEQ ID NO: 972544 - RNA, 19 nt, Homo sapiens
uuaauucugccaucacauu

SEQ ID NO: 972545 - RNA, 19 nt, Homo sapiens
gaggcaacagcacuugaaa

SEQ ID NO: 972546 - RNA, 19 nt, Homo sapiens
gaacuguguguguauagag

SEQ ID NO: 972547 - RNA, 19 nt, Homo sapiens
ucuuaagugugcuggaauu

SEQ ID NO: 972548 - RNA, 19 nt, Homo sapiens
uggcauggugcuccucuua

SEQ ID NO: 972549 - RNA, 19 nt, Homo sapiens
uacuauggcaacucaaaua

SEQ ID NO: 972550 - RNA, 19 nt, Homo sapiens
cagcaggaauuagaacuac

SEQ ID NO: 972551 - RNA, 19 nt, Homo sapiens
gggaauaacaaugaugugu

SEQ ID NO: 972552 - RNA, 19 nt, Homo sapiens
aaaguaccuugaaguagca

SEQ ID NO: 972553 - RNA, 19 nt, Homo sapiens
ggauguaaagugcucuguu

SEQ ID NO: 972554 - RNA, 19 nt, Homo sapiens
gcaucagggaucuuaauca

SEQ ID NO: 972555 - RNA, 19 nt, Homo sapiens
ugaacuguguguguauaga

SEQ ID NO: 972556 - RNA, 19 nt, Homo sapiens
ccaauuaugaacugugugu

SEQ ID NO: 972557 - RNA, 19 nt, Homo sapiens
uauggaaguaacccuauuu

SEQ ID NO: 972558 - RNA, 19 nt, Homo sapiens
gacacaagagccucacaug

SEQ ID NO: 972559 - RNA, 19 nt, Homo sapiens
agcaucagauucaacuuau

SEQ ID NO: 972560 - RNA, 19 nt, Homo sapiens
cacgagcuaucauuugagu

SEQ ID NO: 972561 - RNA, 19 nt, Homo sapiens
gcacaguccguccuugcau

SEQ ID NO: 972562 - RNA, 19 nt, Homo sapiens
aaaugaggccuccaugcaa

SEQ ID NO: 972563 - RNA, 19 nt, Homo sapiens
uuauggaaguaacccuauu

SEQ ID NO: 972564 - RNA, 19 nt, Homo sapiens
gaaagcaauugaacuguuu

SEQ ID NO: 972565 - RNA, 19 nt, Homo sapiens
gagaacaucuugcugcuaa

SEQ ID NO: 972566 - RNA, 19 nt, Homo sapiens
cgaaagggcuucugaggaa

SEQ ID NO: 972567 - RNA, 19 nt, Homo sapiens
gcagauaagugaccugaga

SEQ ID NO: 972568 - RNA, 19 nt, Homo sapiens
ggaaagcgcucagcucuca

SEQ ID NO: 972569 - RNA, 19 nt, Homo sapiens
gcgaagagaugcugguuug

SEQ ID NO: 972570 - RNA, 19 nt, Homo sapiens
gcaacagugugaaccuuaa

SEQ ID NO: 972571 - RNA, 19 nt, Homo sapiens
cacauaaccucaagaagaa

SEQ ID NO: 972572 - RNA, 19 nt, Homo sapiens
aaacgggaaugauguauau

SEQ ID NO: 972573 - RNA, 19 nt, Homo sapiens
ucacauaaccucaagaaga

SEQ ID NO: 972574 - RNA, 19 nt, Homo sapiens
caggaucccuuuccaauuc

SEQ ID NO: 972575 - RNA, 19 nt, Homo sapiens
gaacaagccgaaagcaaga

SEQ ID NO: 972576 - RNA, 19 nt, Homo sapiens
gaacaugggcgucgugaag

SEQ ID NO: 972577 - RNA, 19 nt, Homo sapiens
cagaugacuuggauacaaa

SEQ ID NO: 972578 - RNA, 19 nt, Homo sapiens
ccuccgaccuucagaguaa

SEQ ID NO: 972579 - RNA, 19 nt, Homo sapiens
gaagaggacaggcuuggaa

SEQ ID NO: 972580 - RNA, 19 nt, Homo sapiens
cugcagaucucauaggauu

SEQ ID NO: 972581 - RNA, 19 nt, Homo sapiens
gaagaagauccuccgcuuu

SEQ ID NO: 972582 - RNA, 19 nt, Homo sapiens
gaagagaugcugguuuguu

SEQ ID NO: 972583 - RNA, 19 nt, Homo sapiens
gugugaaccuuaagaauuc

SEQ ID NO: 972584 - RNA, 19 nt, Homo sapiens
ugagcuagaugccgucaaa

SEQ ID NO: 972585 - RNA, 19 nt, Homo sapiens
aaauuaaggccucacauaa

SEQ ID NO: 972586 - RNA, 19 nt, Homo sapiens
ccagaugacuuggauacaa

SEQ ID NO: 972587 - RNA, 19 nt, Homo sapiens
gcagucgccuggaggagaa

SEQ ID NO: 972588 - RNA, 19 nt, Homo sapiens
ucauaggauuguuggaaua

SEQ ID NO: 972589 - RNA, 19 nt, Homo sapiens
gcaauuacaccaccaacug

SEQ ID NO: 972590 - RNA, 19 nt, Homo sapiens
agugugaucuggugucuaa

SEQ ID NO: 972591 - RNA, 19 nt, Homo sapiens
uaaagaaggccacugugaa

SEQ ID NO: 972592 - RNA, 19 nt, Homo sapiens
agaaagcaauugaacuguu

SEQ ID NO: 972593 - RNA, 19 nt, Homo sapiens
cuaacucgguguucaguga

SEQ ID NO: 972594 - RNA, 19 nt, Homo sapiens
uaagaaagcaauugaacug

SEQ ID NO: 972595 - RNA, 19 nt, Homo sapiens
gugcagagcccaauguuuc

SEQ ID NO: 972596 - RNA, 19 nt, Homo sapiens
gguguucagugaguguuua

SEQ ID NO: 972597 - RNA, 19 nt, Homo sapiens
aagagaugcugguuuguug

SEQ ID NO: 972598 - RNA, 19 nt, Homo sapiens
ggacaggcuuggaaaccau

SEQ ID NO: 972599 - RNA, 19 nt, Homo sapiens
gaagaacuccagccugaag

SEQ ID NO: 972600 - RNA, 19 nt, Homo sapiens
ugacuuggauacaaauaag

SEQ ID NO: 972601 - RNA, 19 nt, Homo sapiens
caaaacagacaguuccuua

SEQ ID NO: 972602 - RNA, 19 nt, Homo sapiens
gaggcgaccuugagucucu

SEQ ID NO: 972603 - RNA, 19 nt, Homo sapiens
auaagaaacucaagaaagc

SEQ ID NO: 972604 - RNA, 19 nt, Homo sapiens
gacagcgagucgaguguga

SEQ ID NO: 972605 - RNA, 19 nt, Homo sapiens
gcaguggucgaaagaauca

SEQ ID NO: 972606 - RNA, 19 nt, Homo sapiens
ggcaacagugugaaccuua

SEQ ID NO: 972607 - RNA, 19 nt, Homo sapiens
aagagcaccuggagacaga

SEQ ID NO: 972608 - RNA, 19 nt, Homo sapiens
uuaauuuggucccaguuug

SEQ ID NO: 972609 - RNA, 19 nt, Homo sapiens
uaccuucucugaacaaugg

SEQ ID NO: 972610 - RNA, 19 nt, Homo sapiens
guaaggaccaacaaaccaa

SEQ ID NO: 972611 - RNA, 19 nt, Homo sapiens
cgggauaccuucucugaac

SEQ ID NO: 972612 - RNA, 19 nt, Homo sapiens
gaugcugguuuguugaauc

SEQ ID NO: 972613 - RNA, 19 nt, Homo sapiens
caauguuucuccuuugucu

SEQ ID NO: 972614 - RNA, 19 nt, Homo sapiens
gcccaauguuucuccuuug

SEQ ID NO: 972615 - RNA, 19 nt, Homo sapiens
gcagaucucauaggauugu

SEQ ID NO: 972616 - RNA, 19 nt, Homo sapiens
caccagcgacucugaagaa

SEQ ID NO: 972617 - RNA, 19 nt, Homo sapiens
agaguaagcaccugccaaa

SEQ ID NO: 972618 - RNA, 19 nt, Homo sapiens
cagcgacucugaagaaagc

SEQ ID NO: 972619 - RNA, 19 nt, Homo sapiens
gagaugcugguuuguugaa

SEQ ID NO: 972620 - RNA, 19 nt, Homo sapiens
ggucaaggcccaguuuauc

SEQ ID NO: 972621 - RNA, 19 nt, Homo sapiens
aagcaguggucgaaagaau

SEQ ID NO: 972622 - RNA, 19 nt, Homo sapiens
gggcaacagugugaaccuu

SEQ ID NO: 972623 - RNA, 19 nt, Homo sapiens
aagaagauccuccgcuuuc

SEQ ID NO: 972624 - RNA, 19 nt, Homo sapiens
gggauaccuucucugaaca

SEQ ID NO: 972625 - RNA, 19 nt, Homo sapiens
cggccgagauuuccuacga

SEQ ID NO: 972626 - RNA, 19 nt, Homo sapiens
ggccaaaccuaagcacaag

SEQ ID NO: 972627 - RNA, 19 nt, Homo sapiens
auggauggcuacauucuga

SEQ ID NO: 972628 - RNA, 19 nt, Homo sapiens
cagaugugaaucccaagua

SEQ ID NO: 972629 - RNA, 19 nt, Homo sapiens
uaauucccuugaugucauu

SEQ ID NO: 972630 - RNA, 19 nt, Homo sapiens
ucaagaaagccuccuccaa

SEQ ID NO: 972631 - RNA, 19 nt, Homo sapiens
gaugacuuggauacaaaua

SEQ ID NO: 972632 - RNA, 19 nt, Homo sapiens
caagccagccucgcaagaa

SEQ ID NO: 972633 - RNA, 19 nt, Homo sapiens
agugugaaccuuaagaauu

SEQ ID NO: 972634 - RNA, 19 nt, Homo sapiens
uuaauucccuugaugucau

SEQ ID NO: 972635 - RNA, 19 nt, Homo sapiens
auaaagaaggccacuguga

SEQ ID NO: 972636 - RNA, 19 nt, Homo sapiens
aggacgagcagagcaauua

SEQ ID NO: 972637 - RNA, 19 nt, Homo sapiens
gcuaagaaagcaauugaac

SEQ ID NO: 972638 - RNA, 19 nt, Homo sapiens
cgagggcucuucccaaagc

SEQ ID NO: 972639 - RNA, 19 nt, Homo sapiens
cgaagcaguggucgaaaga

SEQ ID NO: 972640 - RNA, 19 nt, Homo sapiens
cgggagcguuugugucaga

SEQ ID NO: 972641 - RNA, 19 nt, Homo sapiens
gugaguguuuauccaguug

SEQ ID NO: 972642 - RNA, 19 nt, Homo sapiens
ggagaacaucuugcugcua

SEQ ID NO: 972643 - RNA, 19 nt, Homo sapiens
ggccgagauuuccuacgaa

SEQ ID NO: 972644 - RNA, 19 nt, Homo sapiens
ggauacaaauaagaaacuc

SEQ ID NO: 972645 - RNA, 19 nt, Homo sapiens
aagugucgcuucccagaug

SEQ ID NO: 972646 - RNA, 19 nt, Homo sapiens
aaagaaggccacugugaag

SEQ ID NO: 972647 - RNA, 19 nt, Homo sapiens
gaccugagacuggauguag

SEQ ID NO: 972648 - RNA, 19 nt, Homo sapiens
aaaauuaaggccucacaua

SEQ ID NO: 972649 - RNA, 19 nt, Homo sapiens
agcgagggcucuucccaaa

SEQ ID NO: 972650 - RNA, 19 nt, Homo sapiens
ccgaagcaguggucgaaag

SEQ ID NO: 972651 - RNA, 19 nt, Homo sapiens
gaaccuuaagaauucgaaa

SEQ ID NO: 972652 - RNA, 19 nt, Homo sapiens
ccucuccacaccacaauuu

SEQ ID NO: 972653 - RNA, 19 nt, Homo sapiens
ucaggaucccuuuccaauu

SEQ ID NO: 972654 - RNA, 19 nt, Homo sapiens
gagacuggauguagaaaag

SEQ ID NO: 972655 - RNA, 19 nt, Homo sapiens
caaccaccagcgacucuga

SEQ ID NO: 972656 - RNA, 19 nt, Homo sapiens
acaugggcgucgugaagaa

SEQ ID NO: 972657 - RNA, 19 nt, Homo sapiens
aaaccaugccagugacauu

SEQ ID NO: 972658 - RNA, 19 nt, Homo sapiens
ccucacauaaccucaagaa

SEQ ID NO: 972659 - RNA, 19 nt, Homo sapiens
gcacaagcgaacugacuac

SEQ ID NO: 972660 - RNA, 19 nt, Homo sapiens
gauaccuucucugaacaau

SEQ ID NO: 972661 - RNA, 19 nt, Homo sapiens
ggcgggauaccuucucuga

SEQ ID NO: 972662 - RNA, 19 nt, Homo sapiens
gaagcaguggucgaaagaa

SEQ ID NO: 972663 - RNA, 19 nt, Homo sapiens
gaaugauguauaucgcuau

SEQ ID NO: 972664 - RNA, 19 nt, Homo sapiens
gaagaaagguccagacuga

SEQ ID NO: 972665 - RNA, 19 nt, Homo sapiens
gaaggaaguuugacuaaau

SEQ ID NO: 972666 - RNA, 19 nt, Homo sapiens
gaucacagaugaagaagaa

SEQ ID NO: 972667 - RNA, 19 nt, Homo sapiens
gagaagaaguuuggugaua

SEQ ID NO: 972668 - RNA, 19 nt, Homo sapiens
ucaaagggcucgauccaua

SEQ ID NO: 972669 - RNA, 19 nt, Homo sapiens
gcacaagaaugaauguauu

SEQ ID NO: 972670 - RNA, 19 nt, Homo sapiens
gaacaacacuuggaaaaua

SEQ ID NO: 972671 - RNA, 19 nt, Homo sapiens
gcagacaaauuuaugaaga

SEQ ID NO: 972672 - RNA, 19 nt, Homo sapiens
gaaugcgaguggauuaaua

SEQ ID NO: 972673 - RNA, 19 nt, Homo sapiens
gggaaaugcuguugacaaa

SEQ ID NO: 972674 - RNA, 19 nt, Homo sapiens
gaucaacuaugcacucuau

SEQ ID NO: 972675 - RNA, 19 nt, Homo sapiens
gaaauacgcagaaauggaa

SEQ ID NO: 972676 - RNA, 19 nt, Homo sapiens
guagaggucugccuaguga

SEQ ID NO: 972677 - RNA, 19 nt, Homo sapiens
cauaguaagugcucaguaa

SEQ ID NO: 972678 - RNA, 19 nt, Homo sapiens
gaucagcuuugcucaguuu

SEQ ID NO: 972679 - RNA, 19 nt, Homo sapiens
gaucaaguaugcccgcuuu

SEQ ID NO: 972680 - RNA, 19 nt, Homo sapiens
caaccaaccuaaccucaaa

SEQ ID NO: 972681 - RNA, 19 nt, Homo sapiens
gaagaucacagaugaagaa

SEQ ID NO: 972682 - RNA, 19 nt, Homo sapiens
ucagaucacuucucgagua

SEQ ID NO: 972683 - RNA, 19 nt, Homo sapiens
gcucuaugcuaaauaauga

SEQ ID NO: 972684 - RNA, 19 nt, Homo sapiens
guaaauccuuucgauagua

SEQ ID NO: 972685 - RNA, 19 nt, Homo sapiens
ggacuguuguugagauaaa

SEQ ID NO: 972686 - RNA, 19 nt, Homo sapiens
ugagagagcuguggaauuc

SEQ ID NO: 972687 - RNA, 19 nt, Homo sapiens
gggaaauucuggacuaaga

SEQ ID NO: 972688 - RNA, 19 nt, Homo sapiens
acagauaacugcugaacaa

SEQ ID NO: 972689 - RNA, 19 nt, Homo sapiens
aauuguaccucauggauua

SEQ ID NO: 972690 - RNA, 19 nt, Homo sapiens
ccucacugcugacauguua

SEQ ID NO: 972691 - RNA, 19 nt, Homo sapiens
gagaugaacauauggauga

SEQ ID NO: 972692 - RNA, 19 nt, Homo sapiens
ggaauucuuuggagaugaa

SEQ ID NO: 972693 - RNA, 19 nt, Homo sapiens
gaaggacacuuugggaaau

SEQ ID NO: 972694 - RNA, 19 nt, Homo sapiens
gggaagaauacuuugauua

SEQ ID NO: 972695 - RNA, 19 nt, Homo sapiens
gcaaauguccaaagaacaa

SEQ ID NO: 972696 - RNA, 19 nt, Homo sapiens
ggacaagacagguguauca

SEQ ID NO: 972697 - RNA, 19 nt, Homo sapiens
guuaagaacuggaucaagu

SEQ ID NO: 972698 - RNA, 19 nt, Homo sapiens
ggguagggauugcaaguaa

SEQ ID NO: 972699 - RNA, 19 nt, Homo sapiens
ugugaaagcuggaaggaaa

SEQ ID NO: 972700 - RNA, 19 nt, Homo sapiens
ggagaacaucaucuuaaua

SEQ ID NO: 972701 - RNA, 19 nt, Homo sapiens
gagaacaucaucuuaauag

SEQ ID NO: 972702 - RNA, 19 nt, Homo sapiens
gaacuuccauaggcaaaug

SEQ ID NO: 972703 - RNA, 19 nt, Homo sapiens
gguagaaagugacgcagaa

SEQ ID NO: 972704 - RNA, 19 nt, Homo sapiens
uuacuaguguccaguuaua

SEQ ID NO: 972705 - RNA, 19 nt, Homo sapiens
uuuaaaugcucuuggguua

SEQ ID NO: 972706 - RNA, 19 nt, Homo sapiens
gaugagcaccuuuauguug

SEQ ID NO: 972707 - RNA, 19 nt, Homo sapiens
gaagaaacuaggacuguug

SEQ ID NO: 972708 - RNA, 19 nt, Homo sapiens
ccaacugaguccaaacuuu

SEQ ID NO: 972709 - RNA, 19 nt, Homo sapiens
ggaagaaacagaaagaaca

SEQ ID NO: 972710 - RNA, 19 nt, Homo sapiens
gaaaggguacgagugauuu

SEQ ID NO: 972711 - RNA, 19 nt, Homo sapiens
gcaggagaacaucaucuua

SEQ ID NO: 972712 - RNA, 19 nt, Homo sapiens
gacaauccuuggugauauu

SEQ ID NO: 972713 - RNA, 19 nt, Homo sapiens
ggaagaauacuuugauuac

SEQ ID NO: 972714 - RNA, 19 nt, Homo sapiens
gauuggagcuccguuccua

SEQ ID NO: 972715 - RNA, 19 nt, Homo sapiens
ucugaaagcuuugugguuu

SEQ ID NO: 972716 - RNA, 19 nt, Homo sapiens
ucacgugugugcuaugaaa

SEQ ID NO: 972717 - RNA, 19 nt, Homo sapiens
guuaggcgcucaucaguuc

SEQ ID NO: 972718 - RNA, 19 nt, Homo sapiens
gagacaauccuuggugaua

SEQ ID NO: 972719 - RNA, 19 nt, Homo sapiens
caauuaugaugcaugguuu

SEQ ID NO: 972720 - RNA, 19 nt, Homo sapiens
ggacagaauuucaaaacaa

SEQ ID NO: 972721 - RNA, 19 nt, Homo sapiens
gcaccuuuauguugccuuu

SEQ ID NO: 972722 - RNA, 19 nt, Homo sapiens
gcucugccacucaugauua

SEQ ID NO: 972723 - RNA, 19 nt, Homo sapiens
uaucuuugauggcuacuuu

SEQ ID NO: 972724 - RNA, 19 nt, Homo sapiens
ccuggaaguucuuauauau

SEQ ID NO: 972725 - RNA, 19 nt, Homo sapiens
gauuacaucuuuccagaag

SEQ ID NO: 972726 - RNA, 19 nt, Homo sapiens
gaaagguccagacugauga

SEQ ID NO: 972727 - RNA, 19 nt, Homo sapiens
gaaauacgacagaagaauc

SEQ ID NO: 972728 - RNA, 19 nt, Homo sapiens
ugucauacccauaaagaua

SEQ ID NO: 972729 - RNA, 19 nt, Homo sapiens
ggacgucgaugagagugaa

SEQ ID NO: 972730 - RNA, 19 nt, Homo sapiens
gaaggcgaauccacacaau

SEQ ID NO: 972731 - RNA, 19 nt, Homo sapiens
caaccaugcucgaaauauc

SEQ ID NO: 972732 - RNA, 19 nt, Homo sapiens
caacagaagaucacagaug

SEQ ID NO: 972733 - RNA, 19 nt, Homo sapiens
gaaacuaggacuguuguug

SEQ ID NO: 972734 - RNA, 19 nt, Homo sapiens
ccagugugcuauaguagaa

SEQ ID NO: 972735 - RNA, 19 nt, Homo sapiens
ucacagacuugaguucauu

SEQ ID NO: 972736 - RNA, 19 nt, Homo sapiens
gagagugaauccugaucuu

SEQ ID NO: 972737 - RNA, 19 nt, Homo sapiens
gcuacagcuucgagaauuu

SEQ ID NO: 972738 - RNA, 19 nt, Homo sapiens
gaagaaguuuggugauagg

SEQ ID NO: 972739 - RNA, 19 nt, Homo sapiens
cgagcgugcuuuagaugua

SEQ ID NO: 972740 - RNA, 19 nt, Homo sapiens
aacagaagaucacagauga

SEQ ID NO: 972741 - RNA, 19 nt, Homo sapiens
aagagaggcuaaagaaaga

SEQ ID NO: 972742 - RNA, 19 nt, Homo sapiens
gauaacugcugaacaacuc

SEQ ID NO: 972743 - RNA, 19 nt, Homo sapiens
aagaguagcacaagaauga

SEQ ID NO: 972744 - RNA, 19 nt, Homo sapiens
gcuaaauaaugaagaguag

SEQ ID NO: 972745 - RNA, 19 nt, Homo sapiens
ugagagaagucuaugaaag

SEQ ID NO: 972746 - RNA, 19 nt, Homo sapiens
gcacggaaaguguaugaga

SEQ ID NO: 972747 - RNA, 19 nt, Homo sapiens
ggaagacuuuugaagauaa

SEQ ID NO: 972748 - RNA, 19 nt, Homo sapiens
gaagaagaauuuggaacag

SEQ ID NO: 972749 - RNA, 19 nt, Homo sapiens
gcaggaagaaacagaaaga

SEQ ID NO: 972750 - RNA, 19 nt, Homo sapiens
uaugaugcaugguuugauu

SEQ ID NO: 972751 - RNA, 19 nt, Homo sapiens
gcagugauuauauuucuga

SEQ ID NO: 972752 - RNA, 19 nt, Homo sapiens
gaacagcuucagauaagga

SEQ ID NO: 972753 - RNA, 19 nt, Homo sapiens
gaguuaaucaguucuggua

SEQ ID NO: 972754 - RNA, 19 nt, Homo sapiens
gaaauggaaaugaagaauc

SEQ ID NO: 972755 - RNA, 19 nt, Homo sapiens
gcugaaauacgcagaaaug

SEQ ID NO: 972756 - RNA, 19 nt, Homo sapiens
uaagagaggcuaaagaaag

SEQ ID NO: 972757 - RNA, 19 nt, Homo sapiens
caggagaacaucaucuuaa

SEQ ID NO: 972758 - RNA, 19 nt, Homo sapiens
gcaaacggagauuccagua

SEQ ID NO: 972759 - RNA, 19 nt, Homo sapiens
uacgagugauuuacaagua

SEQ ID NO: 972760 - RNA, 19 nt, Homo sapiens
acacguacauggaggaaau

SEQ ID NO: 972761 - RNA, 19 nt, Homo sapiens
ggacuguguuucucaagca

SEQ ID NO: 972762 - RNA, 19 nt, Homo sapiens
caaaaugggccaauaguuu

SEQ ID NO: 972763 - RNA, 19 nt, Homo sapiens
gauaguuuaugcauucauc

SEQ ID NO: 972764 - RNA, 19 nt, Homo sapiens
gcacagacaccucaagaaa

SEQ ID NO: 972765 - RNA, 19 nt, Homo sapiens
acagacaccucaagaaaga

SEQ ID NO: 972766 - RNA, 19 nt, Homo sapiens
cgcagaagguggagaagaa

SEQ ID NO: 972767 - RNA, 19 nt, Homo sapiens
gccaggagaagcacuuuaa

SEQ ID NO: 972768 - RNA, 19 nt, Homo sapiens
gagccaaggccuuccagaa

SEQ ID NO: 972769 - RNA, 19 nt, Homo sapiens
ucaccgcgcucauggacuu

SEQ ID NO: 972770 - RNA, 19 nt, Homo sapiens
acaagggcgucauggacua

SEQ ID NO: 972771 - RNA, 19 nt, Homo sapiens
ggaccuuguagaucaaauu

SEQ ID NO: 972772 - RNA, 19 nt, Homo sapiens
aggaguaccucgaguucuu

SEQ ID NO: 972773 - RNA, 19 nt, Homo sapiens
gcagcuggaccuuguagau

SEQ ID NO: 972774 - RNA, 19 nt, Homo sapiens
ccaaggaguaccucgaguu

SEQ ID NO: 972775 - RNA, 19 nt, Homo sapiens
caaggaguaccucgaguuc

SEQ ID NO: 972776 - RNA, 19 nt, Homo sapiens
gcagaacguguacgagauc

SEQ ID NO: 972777 - RNA, 19 nt, Homo sapiens
gggcgacugcaacggcuua

SEQ ID NO: 972778 - RNA, 19 nt, Homo sapiens
gaccuuguagaucaaauug

SEQ ID NO: 972779 - RNA, 19 nt, Homo sapiens
ccacaacuacgaccugaag

SEQ ID NO: 972780 - RNA, 19 nt, Homo sapiens
gcagccaguacuucaagaa

SEQ ID NO: 972781 - RNA, 19 nt, Homo sapiens
aggagaagcacuuuaagga

SEQ ID NO: 972782 - RNA, 19 nt, Homo sapiens
ggaagcacacgggcgagaa

SEQ ID NO: 972783 - RNA, 19 nt, Homo sapiens
ggucgcagaagguggagaa

SEQ ID NO: 972784 - RNA, 19 nt, Homo sapiens
gcuggaccuuguagaucaa

SEQ ID NO: 972785 - RNA, 19 nt, Homo sapiens
ggccaggagaagcacuuua

SEQ ID NO: 972786 - RNA, 19 nt, Homo sapiens
gcaacggccaggagaagca

SEQ ID NO: 972787 - RNA, 19 nt, Homo sapiens
gaagcacacgggcgagaag

SEQ ID NO: 972788 - RNA, 19 nt, Homo sapiens
acaacuacgaccugaagaa

SEQ ID NO: 972789 - RNA, 19 nt, Homo sapiens
caacuacgaccugaagaac

SEQ ID NO: 972790 - RNA, 19 nt, Homo sapiens
ccgaccaccugcacagaca

SEQ ID NO: 972791 - RNA, 19 nt, Homo sapiens
gaagguggagaagaagauc

SEQ ID NO: 972792 - RNA, 19 nt, Homo sapiens
cugcaacggcuuagacuuc

SEQ ID NO: 972793 - RNA, 19 nt, Homo sapiens
acuacgaccugaagaacca

SEQ ID NO: 972794 - RNA, 19 nt, Homo sapiens
ggaagaagcuguccauguu

SEQ ID NO: 972795 - RNA, 19 nt, Homo sapiens
agaagggucuguucacgua

SEQ ID NO: 972796 - RNA, 19 nt, Homo sapiens
gcacggagaccgcuucauc

SEQ ID NO: 972797 - RNA, 19 nt, Homo sapiens
gaagaagcuguccauguug

SEQ ID NO: 972798 - RNA, 19 nt, Homo sapiens
gggaagaagcuguccaugu

SEQ ID NO: 972799 - RNA, 19 nt, Homo sapiens
gagacgagacccugagguu

SEQ ID NO: 972800 - RNA, 19 nt, Homo sapiens
gagaagaagggucuguuca

SEQ ID NO: 972801 - RNA, 19 nt, Homo sapiens
ccacaggauuaacgagaau

SEQ ID NO: 972802 - RNA, 19 nt, Homo sapiens
ggauuaacgagaaugagaa

SEQ ID NO: 972803 - RNA, 19 nt, Homo sapiens
gcaaaacccguucgacaaa

SEQ ID NO: 972804 - RNA, 19 nt, Homo sapiens
acucugcccugcucaagaa

SEQ ID NO: 972805 - RNA, 19 nt, Homo sapiens
acaagcugcuggucuggaa

SEQ ID NO: 972806 - RNA, 19 nt, Homo sapiens
ggacgacuucuaccucaau

SEQ ID NO: 972807 - RNA, 19 nt, Homo sapiens
ccaaggacgccaccucaga

SEQ ID NO: 972808 - RNA, 19 nt, Homo sapiens
gaaacccacccgcaagauc

SEQ ID NO: 972809 - RNA, 19 nt, Homo sapiens
uaacgagaaugagaagucu

SEQ ID NO: 972810 - RNA, 19 nt, Homo sapiens
gugaacuuccacaggauua

SEQ ID NO: 972811 - RNA, 19 nt, Homo sapiens
gagcacgcacgguuacuca

SEQ ID NO: 972812 - RNA, 19 nt, Homo sapiens
uguauccgcuucuggaaca

SEQ ID NO: 972813 - RNA, 19 nt, Homo sapiens
gcaacaagagccagaagcu

SEQ ID NO: 972814 - RNA, 19 nt, Homo sapiens
ucuggaacgucuuuagcaa

SEQ ID NO: 972815 - RNA, 19 nt, Homo sapiens
gcacgcacgguuacucaca

SEQ ID NO: 972816 - RNA, 19 nt, Homo sapiens
gguccaagcacgccaacga

SEQ ID NO: 972817 - RNA, 19 nt, Homo sapiens
ccuccacgccugagaagaa

SEQ ID NO: 972818 - RNA, 19 nt, Homo sapiens
gccagaucgucauccagaa

SEQ ID NO: 972819 - RNA, 19 nt, Homo sapiens
cguauucccuuagcaccaa

SEQ ID NO: 972820 - RNA, 19 nt, Homo sapiens
gacgagacccugagguucu

SEQ ID NO: 972821 - RNA, 19 nt, Homo sapiens
caacuggagcgugaacuuc

SEQ ID NO: 972822 - RNA, 19 nt, Homo sapiens
aagggucuguucacguauu

SEQ ID NO: 972823 - RNA, 19 nt, Homo sapiens
ggacgccaccucagacaac

SEQ ID NO: 972824 - RNA, 19 nt, Homo sapiens
gcuaggcaccugcguguac

SEQ ID NO: 972825 - RNA, 19 nt, Homo sapiens
ggaaacccacccgcaagau

SEQ ID NO: 972826 - RNA, 19 nt, Homo sapiens
cugcccugcucaagaauga

SEQ ID NO: 972827 - RNA, 19 nt, Homo sapiens
ugucugugcucaaccucuu

SEQ ID NO: 972828 - RNA, 19 nt, Homo sapiens
guaaagugggagucugugu

SEQ ID NO: 972829 - RNA, 19 nt, Homo sapiens
gcggcucugugaccucuca

SEQ ID NO: 972830 - RNA, 19 nt, Homo sapiens
ccaacuggagcgugaacuu

SEQ ID NO: 972831 - RNA, 19 nt, Homo sapiens
uccacaggauuaacgagaa

SEQ ID NO: 972832 - RNA, 19 nt, Homo sapiens
uggaacgucuuuagcaaaa

SEQ ID NO: 972833 - RNA, 19 nt, Homo sapiens
ccagaucgucauccagaau

SEQ ID NO: 972834 - RNA, 19 nt, Homo sapiens
cgacuucuaccucaaucug

SEQ ID NO: 972835 - RNA, 19 nt, Homo sapiens
gacgacuucuaccucaauc

SEQ ID NO: 972836 - RNA, 19 nt, Homo sapiens
gcgugaacuuccacaggau

SEQ ID NO: 972837 - RNA, 19 nt, Homo sapiens
gaacacgcugacaggacaa

SEQ ID NO: 972838 - RNA, 19 nt, Homo sapiens
agaagucucccagucagaa

SEQ ID NO: 972839 - RNA, 19 nt, Homo sapiens
ugagaagaagggucuguuc

SEQ ID NO: 972840 - RNA, 19 nt, Homo sapiens
ugcaggacccgcagacuga

SEQ ID NO: 972841 - RNA, 19 nt, Homo sapiens
gaacuuccacaggauuaac

SEQ ID NO: 972842 - RNA, 19 nt, Homo sapiens
acaagggcuucgugcagau

SEQ ID NO: 972843 - RNA, 19 nt, Homo sapiens
cggaaacccacccgcaaga

SEQ ID NO: 972844 - RNA, 19 nt, Homo sapiens
ugacccagguggccaagcu

SEQ ID NO: 972845 - RNA, 19 nt, Homo sapiens
gcacgguuacucacagaac

SEQ ID NO: 972846 - RNA, 19 nt, Homo sapiens
gcucccaagugugcaaucu

SEQ ID NO: 972847 - RNA, 19 nt, Homo sapiens
cuguucacguauucccuua

SEQ ID NO: 972848 - RNA, 19 nt, Homo sapiens
gaagggucuguucacguau

SEQ ID NO: 972849 - RNA, 19 nt, Homo sapiens
caacagauaucaucgugua

SEQ ID NO: 972850 - RNA, 19 nt, Homo sapiens
aaacaugucugcccucaaa

SEQ ID NO: 972851 - RNA, 19 nt, Homo sapiens
caaccuaacuggcuuacuu

SEQ ID NO: 972852 - RNA, 19 nt, Homo sapiens
ggaggacucugaugaacaa

SEQ ID NO: 972853 - RNA, 19 nt, Homo sapiens
ggaaacccuucaaauaguu

SEQ ID NO: 972854 - RNA, 19 nt, Homo sapiens
gcacagagaagggaaguuu

SEQ ID NO: 972855 - RNA, 19 nt, Homo sapiens
acaggaaacccuucaaaua

SEQ ID NO: 972856 - RNA, 19 nt, Homo sapiens
ucacaggucuauaugagaa

SEQ ID NO: 972857 - RNA, 19 nt, Homo sapiens
ggucagaugucagguuuga

SEQ ID NO: 972858 - RNA, 19 nt, Homo sapiens
cuaacuggcuuacuuccua

SEQ ID NO: 972859 - RNA, 19 nt, Homo sapiens
gcagggaacagaacaguga

SEQ ID NO: 972860 - RNA, 19 nt, Homo sapiens
ggugacauaugcacaguug

SEQ ID NO: 972861 - RNA, 19 nt, Homo sapiens
ggagagagcgugaccuugu

SEQ ID NO: 972862 - RNA, 19 nt, Homo sapiens
gaacucacaauuccaaaca

SEQ ID NO: 972863 - RNA, 19 nt, Homo sapiens
aaacacacuccuuugcuua

SEQ ID NO: 972864 - RNA, 19 nt, Homo sapiens
gcccaccucuccaaccuaa

SEQ ID NO: 972865 - RNA, 19 nt, Homo sapiens
caggaaacccuucaaauag

SEQ ID NO: 972866 - RNA, 19 nt, Homo sapiens
gagaagggaaguuuaagga

SEQ ID NO: 972867 - RNA, 19 nt, Homo sapiens
acucacaauuccaaacaua

SEQ ID NO: 972868 - RNA, 19 nt, Homo sapiens
gaacagggaggacucugau

SEQ ID NO: 972869 - RNA, 19 nt, Homo sapiens
caucacaggucuauaugag

SEQ ID NO: 972870 - RNA, 19 nt, Homo sapiens
gcugagcccugauccaaag

SEQ ID NO: 972871 - RNA, 19 nt, Homo sapiens
gaacauuccaggccgacuu

SEQ ID NO: 972872 - RNA, 19 nt, Homo sapiens
ggcgugagucugcaucuua

SEQ ID NO: 972873 - RNA, 19 nt, Homo sapiens
ggaggaaccuacagaugcu

SEQ ID NO: 972874 - RNA, 19 nt, Homo sapiens
acagagaagggaaguuuaa

SEQ ID NO: 972875 - RNA, 19 nt, Homo sapiens
ugacauaugcacaguugaa

SEQ ID NO: 972876 - RNA, 19 nt, Homo sapiens
gagcccugauccaaaguug

SEQ ID NO: 972877 - RNA, 19 nt, Homo sapiens
acaccugcauguucugauu

SEQ ID NO: 972878 - RNA, 19 nt, Homo sapiens
gcagggaccuacagaugcu

SEQ ID NO: 972879 - RNA, 19 nt, Homo sapiens
ccucuuaacacggcacuua

SEQ ID NO: 972880 - RNA, 19 nt, Homo sapiens
gcccacaauucuccauuuc

SEQ ID NO: 972881 - RNA, 19 nt, Homo sapiens
ggacucugaugaacaagac

SEQ ID NO: 972882 - RNA, 19 nt, Homo sapiens
uaugacauguaccaucuau

SEQ ID NO: 972883 - RNA, 19 nt, Homo sapiens
gagcuccuaugacauguac

SEQ ID NO: 972884 - RNA, 19 nt, Homo sapiens
gagagagcgugaccuuguc

SEQ ID NO: 972885 - RNA, 19 nt, Homo sapiens
cgucaucacaggucuauau

SEQ ID NO: 972886 - RNA, 19 nt, Homo sapiens
ggugaaaucagaagagaca

SEQ ID NO: 972887 - RNA, 19 nt, Homo sapiens
cauaugcacaguugaauca

SEQ ID NO: 972888 - RNA, 19 nt, Homo sapiens
ucaaauaguuggccuucac

SEQ ID NO: 972889 - RNA, 19 nt, Homo sapiens
aggaaacccuucaaauagu

SEQ ID NO: 972890 - RNA, 19 nt, Homo sapiens
ucacaggaaacccuucaaa

SEQ ID NO: 972891 - RNA, 19 nt, Homo sapiens
ccuaugacauguaccaucu

SEQ ID NO: 972892 - RNA, 19 nt, Homo sapiens
agacagucauccugcaaug

SEQ ID NO: 972893 - RNA, 19 nt, Homo sapiens
ccauacaccugcauguucu

SEQ ID NO: 972894 - RNA, 19 nt, Homo sapiens
caccuucccucaugcuguu

SEQ ID NO: 972895 - RNA, 19 nt, Homo sapiens
ccucacaccacaaaucuga

SEQ ID NO: 972896 - RNA, 19 nt, Homo sapiens
caaggucaacggaacauuc

SEQ ID NO: 972897 - RNA, 19 nt, Homo sapiens
ucccggagcuccuaugaca

SEQ ID NO: 972898 - RNA, 19 nt, Homo sapiens
ccacaauucuccauuucac

SEQ ID NO: 972899 - RNA, 19 nt, Homo sapiens
gaaacccuucaaauaguug

SEQ ID NO: 972900 - RNA, 19 nt, Homo sapiens
gcaaucacacugaggaacu

SEQ ID NO: 972901 - RNA, 19 nt, Homo sapiens
gcgugagucugcaucuuag

SEQ ID NO: 972902 - RNA, 19 nt, Homo sapiens
acagaugcuucggcucuuu

SEQ ID NO: 972903 - RNA, 19 nt, Homo sapiens
uggcuuacuuccuagucua

SEQ ID NO: 972904 - RNA, 19 nt, Homo sapiens
ugaacgugccucucucuug

SEQ ID NO: 972905 - RNA, 19 nt, Homo sapiens
ccacggaggaaccuacaga

SEQ ID NO: 972906 - RNA, 19 nt, Homo sapiens
uuggucagaugucagguuu

SEQ ID NO: 972907 - RNA, 19 nt, Homo sapiens
guugccagcuccaauguac

SEQ ID NO: 972908 - RNA, 19 nt, Homo sapiens
acagggaggacucugauga

SEQ ID NO: 972909 - RNA, 19 nt, Homo sapiens
cgaaaccgguaaccccaua

SEQ ID NO: 972910 - RNA, 19 nt, Homo sapiens
caauguuggucagauguca

SEQ ID NO: 972911 - RNA, 19 nt, Homo sapiens
gaggugacauaugcacagu

SEQ ID NO: 972912 - RNA, 19 nt, Homo sapiens
cacagagaagggaaguuua

SEQ ID NO: 972913 - RNA, 19 nt, Homo sapiens
acagucauccugcaauguu

SEQ ID NO: 972914 - RNA, 19 nt, Homo sapiens
ucacaauuccaaacauaca

SEQ ID NO: 972915 - RNA, 19 nt, Homo sapiens
acaauucuccauuucacuu

SEQ ID NO: 972916 - RNA, 19 nt, Homo sapiens
caugagggaguccacagaa

SEQ ID NO: 972917 - RNA, 19 nt, Homo sapiens
gccucucucuugcuuacaa

SEQ ID NO: 972918 - RNA, 19 nt, Homo sapiens
caaaugcugagcccugauc

SEQ ID NO: 972919 - RNA, 19 nt, Homo sapiens
ggucaucauccucuucauc

SEQ ID NO: 972920 - RNA, 19 nt, Homo sapiens
cacaggaaacccuucaaau

SEQ ID NO: 972921 - RNA, 19 nt, Homo sapiens
ggagcuccuaugacaugua

SEQ ID NO: 972922 - RNA, 19 nt, Homo sapiens
cagggaggacucugaugaa

SEQ ID NO: 972923 - RNA, 19 nt, Homo sapiens
ugaacagggaggacucuga

SEQ ID NO: 972924 - RNA, 19 nt, Homo sapiens
caggagagagcgugaccuu

SEQ ID NO: 972925 - RNA, 19 nt, Homo sapiens
cuacagaugcuacgguucu

SEQ ID NO: 972926 - RNA, 19 nt, Homo sapiens
ggacacuuugcgccucauu

SEQ ID NO: 972927 - RNA, 19 nt, Homo sapiens
gggaggacucugaugaaca

SEQ ID NO: 972928 - RNA, 19 nt, Homo sapiens
aaaaugcuguuguaaugga

SEQ ID NO: 972929 - RNA, 19 nt, Homo sapiens
cagucauccugcaauguug

SEQ ID NO: 972930 - RNA, 19 nt, Homo sapiens
ccggagcuccuaugacaug

SEQ ID NO: 972931 - RNA, 19 nt, Homo sapiens
gagacagucauccugcaau

SEQ ID NO: 972932 - RNA, 19 nt, Homo sapiens
gagaaaacacacuccuuug

SEQ ID NO: 972933 - RNA, 19 nt, Homo sapiens
gugccucucucuugcuuac

SEQ ID NO: 972934 - RNA, 19 nt, Homo sapiens
cccaugagcaccacaguca

SEQ ID NO: 972935 - RNA, 19 nt, Homo sapiens
cucaggaggugacauaugc

SEQ ID NO: 972936 - RNA, 19 nt, Homo sapiens
cugcaauguuggucagaug

SEQ ID NO: 972937 - RNA, 19 nt, Homo sapiens
gugacccacugcuuguuuc

SEQ ID NO: 972938 - RNA, 19 nt, Homo sapiens
ccauacgaguggucaaacu

SEQ ID NO: 972939 - RNA, 19 nt, Homo sapiens
ugacauguaccaucuaucc

SEQ ID NO: 972940 - RNA, 19 nt, Homo sapiens
augagggaguccacagaaa

SEQ ID NO: 972941 - RNA, 19 nt, Homo sapiens
agcccacaauucuccauuu

SEQ ID NO: 972942 - RNA, 19 nt, Homo sapiens
uugcuuagcccacaauucu

SEQ ID NO: 972943 - RNA, 19 nt, Homo sapiens
aaaacacacuccuuugcuu

SEQ ID NO: 972944 - RNA, 19 nt, Homo sapiens
cauccuccuccucuucuuu

SEQ ID NO: 972945 - RNA, 19 nt, Homo sapiens
gaggcugcaaucacacuga

SEQ ID NO: 972946 - RNA, 19 nt, Homo sapiens
caauucuccauuucacuug

SEQ ID NO: 972947 - RNA, 19 nt, Homo sapiens
gggaacagaacagugaaca

SEQ ID NO: 972948 - RNA, 19 nt, Homo sapiens
gaacagaugucagguuaua

SEQ ID NO: 972949 - RNA, 19 nt, Homo sapiens
ggagagguauuacuuauuu

SEQ ID NO: 972950 - RNA, 19 nt, Homo sapiens
gagcggaucuccaaacaua

SEQ ID NO: 972951 - RNA, 19 nt, Homo sapiens
ggucugagguugcaucaua

SEQ ID NO: 972952 - RNA, 19 nt, Homo sapiens
uuaacuagcugcugcauua

SEQ ID NO: 972953 - RNA, 19 nt, Homo sapiens
gggaacagaugucagguua

SEQ ID NO: 972954 - RNA, 19 nt, Homo sapiens
acaaaggacugaaguuaua

SEQ ID NO: 972955 - RNA, 19 nt, Homo sapiens
uaaagacacugaaagauga

SEQ ID NO: 972956 - RNA, 19 nt, Homo sapiens
aaagagaacugcacagaaa

SEQ ID NO: 972957 - RNA, 19 nt, Homo sapiens
uaucaguggugacauauua

SEQ ID NO: 972958 - RNA, 19 nt, Homo sapiens
gaacgcagcgagagaauaa

SEQ ID NO: 972959 - RNA, 19 nt, Homo sapiens
caugagaaauggcaagaua

SEQ ID NO: 972960 - RNA, 19 nt, Homo sapiens
gagcacaccuugagcagaa

SEQ ID NO: 972961 - RNA, 19 nt, Homo sapiens
ggacuagccuaccuacauu

SEQ ID NO: 972962 - RNA, 19 nt, Homo sapiens
guacaaaggcuguuacuug

SEQ ID NO: 972963 - RNA, 19 nt, Homo sapiens
ggaauuugguuacauuaga

SEQ ID NO: 972964 - RNA, 19 nt, Homo sapiens
ggaauggacccuugaauga

SEQ ID NO: 972965 - RNA, 19 nt, Homo sapiens
caaaggcuguuacuugaaa

SEQ ID NO: 972966 - RNA, 19 nt, Homo sapiens
gaagaaagauuugacaacu

SEQ ID NO: 972967 - RNA, 19 nt, Homo sapiens
ccaccaaucugugaaagua

SEQ ID NO: 972968 - RNA, 19 nt, Homo sapiens
gaucuuagcuauggaugaa

SEQ ID NO: 972969 - RNA, 19 nt, Homo sapiens
ggaaguuacuccaaagaau

SEQ ID NO: 972970 - RNA, 19 nt, Homo sapiens
ggaagagcaugauaacugu

SEQ ID NO: 972971 - RNA, 19 nt, Homo sapiens
ccauggaaaugcaaauuaa

SEQ ID NO: 972972 - RNA, 19 nt, Homo sapiens
gauggccucucaagcguua

SEQ ID NO: 972973 - RNA, 19 nt, Homo sapiens
uuaagaagauguccuauag

SEQ ID NO: 972974 - RNA, 19 nt, Homo sapiens
caacaugaaugcaaugagu

SEQ ID NO: 972975 - RNA, 19 nt, Homo sapiens
ggagaucgcugccauuacu

SEQ ID NO: 972976 - RNA, 19 nt, Homo sapiens
uaaagaaccuauuggaaag

SEQ ID NO: 972977 - RNA, 19 nt, Homo sapiens
guacagaccaaacaguaua

SEQ ID NO: 972978 - RNA, 19 nt, Homo sapiens
gaagaagcaguauaagauu

SEQ ID NO: 972979 - RNA, 19 nt, Homo sapiens
ggacugaaguuauaaaaga

SEQ ID NO: 972980 - RNA, 19 nt, Homo sapiens
auaaagcacucaagaauca

SEQ ID NO: 972981 - RNA, 19 nt, Homo sapiens
uggagaagcuggccaagaa

SEQ ID NO: 972982 - RNA, 19 nt, Homo sapiens
gacgaaagcacaaucaauu

SEQ ID NO: 972983 - RNA, 19 nt, Homo sapiens
ggaagacagugaacaugga

SEQ ID NO: 972984 - RNA, 19 nt, Homo sapiens
ucucaugcauugauucaua

SEQ ID NO: 972985 - RNA, 19 nt, Homo sapiens
cacaauauccgcagccuua

SEQ ID NO: 972986 - RNA, 19 nt, Homo sapiens
ccaauaaaccaacaacaaa

SEQ ID NO: 972987 - RNA, 19 nt, Homo sapiens
gaaagagaacugcacagaa

SEQ ID NO: 972988 - RNA, 19 nt, Homo sapiens
gaagcaaguggcuaucaua

SEQ ID NO: 972989 - RNA, 19 nt, Homo sapiens
uacaaaggcuguuacuuga

SEQ ID NO: 972990 - RNA, 19 nt, Homo sapiens
caaaugcucacaccaauga

SEQ ID NO: 972991 - RNA, 19 nt, Homo sapiens
gaaugggauuugggaauuu

SEQ ID NO: 972992 - RNA, 19 nt, Homo sapiens
ggacuacagaugagauuaa

SEQ ID NO: 972993 - RNA, 19 nt, Homo sapiens
ccaaugaggugguggcaau

SEQ ID NO: 972994 - RNA, 19 nt, Homo sapiens
ggauguauauugcuuuaag

SEQ ID NO: 972995 - RNA, 19 nt, Homo sapiens
gaaguuugcugcuaaaaug

SEQ ID NO: 972996 - RNA, 19 nt, Homo sapiens
aaacagaggcacaacauga

SEQ ID NO: 972997 - RNA, 19 nt, Homo sapiens
gaagcagacccaugagaaa

SEQ ID NO: 972998 - RNA, 19 nt, Homo sapiens
gaaguuacuccaaagaaug

SEQ ID NO: 972999 - RNA, 19 nt, Homo sapiens
gaccauagcacacccaaga

SEQ ID NO: 973000 - RNA, 19 nt, Homo sapiens
gcaggaaauauucuucuaa

SEQ ID NO: 973001 - RNA, 19 nt, Homo sapiens
caauugaagcauccuaaua

SEQ ID NO: 973002 - RNA, 19 nt, Homo sapiens
ggaagcagacccaugagaa

SEQ ID NO: 973003 - RNA, 19 nt, Homo sapiens
guggauguauauugcuuua

SEQ ID NO: 973004 - RNA, 19 nt, Homo sapiens
ggagauuuguugauuacug

SEQ ID NO: 973005 - RNA, 19 nt, Homo sapiens
ggugauggaauauugcuua

SEQ ID NO: 973006 - RNA, 19 nt, Homo sapiens
guauaaagcacucaagaau

SEQ ID NO: 973007 - RNA, 19 nt, Homo sapiens
aaagagaaguuugcugcua

SEQ ID NO: 973008 - RNA, 19 nt, Homo sapiens
aagagaaguuugcugcuaa

SEQ ID NO: 973009 - RNA, 19 nt, Homo sapiens
gaaaauaccucaggaaagg

SEQ ID NO: 973010 - RNA, 19 nt, Homo sapiens
gaggugaucuuagcuaugg

SEQ ID NO: 973011 - RNA, 19 nt, Homo sapiens
aagaagauguccuauagug

SEQ ID NO: 973012 - RNA, 19 nt, Homo sapiens
gaaauuggacauggaaguu

SEQ ID NO: 973013 - RNA, 19 nt, Homo sapiens
acauaucaguggugacaua

SEQ ID NO: 973014 - RNA, 19 nt, Homo sapiens
uggcaucacuuguauugaa

SEQ ID NO: 973015 - RNA, 19 nt, Homo sapiens
guugauauuuggucacuug

SEQ ID NO: 973016 - RNA, 19 nt, Homo sapiens
ccaaggaagagcaugauaa

SEQ ID NO: 973017 - RNA, 19 nt, Homo sapiens
gaaacuaauugugauguac

SEQ ID NO: 973018 - RNA, 19 nt, Homo sapiens
caacguuacagucuaauga

SEQ ID NO: 973019 - RNA, 19 nt, Homo sapiens
gagguugcaucauaaauac

SEQ ID NO: 973020 - RNA, 19 nt, Homo sapiens
aacaucagcagaacuauua

SEQ ID NO: 973021 - RNA, 19 nt, Homo sapiens
gaauggacagacuccuuua

SEQ ID NO: 973022 - RNA, 19 nt, Homo sapiens
ucacuuggcaucacuugua

SEQ ID NO: 973023 - RNA, 19 nt, Homo sapiens
ugagguugcaucauaaaua

SEQ ID NO: 973024 - RNA, 19 nt, Homo sapiens
agcgagagauugaaacuuu

SEQ ID NO: 973025 - RNA, 19 nt, Homo sapiens
ggaaauauucuucuaacag

SEQ ID NO: 973026 - RNA, 19 nt, Homo sapiens
ugaagcauccuaauacuau

SEQ ID NO: 973027 - RNA, 19 nt, Homo sapiens
cagaggagggauacacuua

SEQ ID NO: 973028 - RNA, 19 nt, Homo sapiens
uaacuugucucagcauauc

SEQ ID NO: 973029 - RNA, 19 nt, Homo sapiens
aaaucaagaugcaaacaga

SEQ ID NO: 973030 - RNA, 19 nt, Homo sapiens
gaaaugauggccucucaag

SEQ ID NO: 973031 - RNA, 19 nt, Homo sapiens
gcauaagaaagaucaugua

SEQ ID NO: 973032 - RNA, 19 nt, Homo sapiens
guucaacacugucucucaa

SEQ ID NO: 973033 - RNA, 19 nt, Homo sapiens
gacuacagaugagauuaaa

SEQ ID NO: 973034 - RNA, 19 nt, Homo sapiens
gcaaaguacagaccaaaca

SEQ ID NO: 973035 - RNA, 19 nt, Homo sapiens
gccauggaaaugcaaauua

SEQ ID NO: 973036 - RNA, 19 nt, Homo sapiens
ggaaaugaaugaggaccau

SEQ ID NO: 973037 - RNA, 19 nt, Homo sapiens
gcuccuccgucgugcauaa

SEQ ID NO: 973038 - RNA, 19 nt, Homo sapiens
uaaggaggacuacagauga

SEQ ID NO: 973039 - RNA, 19 nt, Homo sapiens
agaaugggauuugggaauu

SEQ ID NO: 973040 - RNA, 19 nt, Homo sapiens
gcaaacagaggcacaacau

SEQ ID NO: 973041 - RNA, 19 nt, Homo sapiens
auacaaaggacugaaguua

SEQ ID NO: 973042 - RNA, 19 nt, Homo sapiens
agaagaagcaguauaagau

SEQ ID NO: 973043 - RNA, 19 nt, Homo sapiens
aaaucagcaucuuugguua

SEQ ID NO: 973044 - RNA, 19 nt, Homo sapiens
gaugggaaaguugauauuu

SEQ ID NO: 973045 - RNA, 19 nt, Homo sapiens
caauuaagaagauguccua

SEQ ID NO: 973046 - RNA, 19 nt, Homo sapiens
acaggcagcugcacacguu

SEQ ID NO: 973047 - RNA, 19 nt, Homo sapiens
gucagaagaagcaguauaa

SEQ ID NO: 973048 - RNA, 19 nt, Homo sapiens
gcccaaacaucucaacuua

SEQ ID NO: 973049 - RNA, 19 nt, Homo sapiens
gaagaaagauacaugacau

SEQ ID NO: 973050 - RNA, 19 nt, Homo sapiens
gaugcaagaugaagaaaga

SEQ ID NO: 973051 - RNA, 19 nt, Homo sapiens
ccaaacaucucaacuuaca

SEQ ID NO: 973052 - RNA, 19 nt, Homo sapiens
aaaggaaguuguucaaaug

SEQ ID NO: 973053 - RNA, 19 nt, Homo sapiens
gaaagauacaugacauuga

SEQ ID NO: 973054 - RNA, 19 nt, Homo sapiens
ggauugggcuuaacuuuac

SEQ ID NO: 973055 - RNA, 19 nt, Homo sapiens
guuauugguucucuaauga

SEQ ID NO: 973056 - RNA, 19 nt, Homo sapiens
gaucaaauuaugccuguuu

SEQ ID NO: 973057 - RNA, 19 nt, Homo sapiens
gcacugguauaaaaucuua

SEQ ID NO: 973058 - RNA, 19 nt, Homo sapiens
gaagaugcaagaugaagaa

SEQ ID NO: 973059 - RNA, 19 nt, Homo sapiens
cagaauggcucaaauacca

SEQ ID NO: 973060 - RNA, 19 nt, Homo sapiens
caaaugccacucaguauga

SEQ ID NO: 973061 - RNA, 19 nt, Homo sapiens
cauugaagaugcaagauga

SEQ ID NO: 973062 - RNA, 19 nt, Homo sapiens
ugccaaaugugaucaaauu

SEQ ID NO: 973063 - RNA, 19 nt, Homo sapiens
gaauguacagucaaagaaa

SEQ ID NO: 973064 - RNA, 19 nt, Homo sapiens
gcaauuaaaugccaaaauc

SEQ ID NO: 973065 - RNA, 19 nt, Homo sapiens
gaaagaaaaucucaucuac

SEQ ID NO: 973066 - RNA, 19 nt, Homo sapiens
aaaccaaugugacuucaug

SEQ ID NO: 973067 - RNA, 19 nt, Homo sapiens
ugaggacacuggagaucua

SEQ ID NO: 973068 - RNA, 19 nt, Homo sapiens
guucaaaugccacucagua

SEQ ID NO: 973069 - RNA, 19 nt, Homo sapiens
ucacucagcuacaauaaac

SEQ ID NO: 973070 - RNA, 19 nt, Homo sapiens
uaacuuuaccuccuugaaa

SEQ ID NO: 973071 - RNA, 19 nt, Homo sapiens
ggagugacaguuaugugua

SEQ ID NO: 973072 - RNA, 19 nt, Homo sapiens
ggcacaagaagaaauauaa

SEQ ID NO: 973073 - RNA, 19 nt, Homo sapiens
gagugacaguuauguguau

SEQ ID NO: 973074 - RNA, 19 nt, Homo sapiens
caagggaaguguuauuggu

SEQ ID NO: 973075 - RNA, 19 nt, Homo sapiens
ggaugguucuccaauagau

SEQ ID NO: 973076 - RNA, 19 nt, Homo sapiens
gaaauggcuuuuauacaga

SEQ ID NO: 973077 - RNA, 19 nt, Homo sapiens
gaugaagaaagauacauga

SEQ ID NO: 973078 - RNA, 19 nt, Homo sapiens
uaaagggaccagcuaaaga

SEQ ID NO: 973079 - RNA, 19 nt, Homo sapiens
aauaauggcacaagaagaa

SEQ ID NO: 973080 - RNA, 19 nt, Homo sapiens
auauuaaucuccaggugua

SEQ ID NO: 973081 - RNA, 19 nt, Homo sapiens
aaucagaauggcucaaaua

SEQ ID NO: 973082 - RNA, 19 nt, Homo sapiens
caaugugacuucaugugau

SEQ ID NO: 973083 - RNA, 19 nt, Homo sapiens
aaagggaccagcuaaagaa

SEQ ID NO: 973084 - RNA, 19 nt, Homo sapiens
caauuaaacuacguaugga

SEQ ID NO: 973085 - RNA, 19 nt, Homo sapiens
acacacacauucacucaca

SEQ ID NO: 973086 - RNA, 19 nt, Homo sapiens
acaauaaacauccugaaug

SEQ ID NO: 973087 - RNA, 19 nt, Homo sapiens
ccaaugugacuucauguga

SEQ ID NO: 973088 - RNA, 19 nt, Homo sapiens
uggauugggcuuaacuuua

SEQ ID NO: 973089 - RNA, 19 nt, Homo sapiens
gaauaauggcacaagaaga

SEQ ID NO: 973090 - RNA, 19 nt, Homo sapiens
gguguaagauuuuaaagug

SEQ ID NO: 973091 - RNA, 19 nt, Homo sapiens
ggaaagaaaaucucaucua

SEQ ID NO: 973092 - RNA, 19 nt, Homo sapiens
acacuggucuagccucaga

SEQ ID NO: 973093 - RNA, 19 nt, Homo sapiens
aaagcuggagugacaguua

SEQ ID NO: 973094 - RNA, 19 nt, Homo sapiens
gccaaaugugaucaaauua

SEQ ID NO: 973095 - RNA, 19 nt, Homo sapiens
gugauaguauaaaccaaug

SEQ ID NO: 973096 - RNA, 19 nt, Homo sapiens
guacuaugccaaucagaau

SEQ ID NO: 973097 - RNA, 19 nt, Homo sapiens
ugacuuugaucuccuugau

SEQ ID NO: 973098 - RNA, 19 nt, Homo sapiens
acaauuaaacuacguaugg

SEQ ID NO: 973099 - RNA, 19 nt, Homo sapiens
gcacaagaagaaauauaag

SEQ ID NO: 973100 - RNA, 19 nt, Homo sapiens
cauccugaauguuuucuua

SEQ ID NO: 973101 - RNA, 19 nt, Homo sapiens
ugaaauggcuuuuauacag

SEQ ID NO: 973102 - RNA, 19 nt, Homo sapiens
gaaguguuauugguucucu

SEQ ID NO: 973103 - RNA, 19 nt, Homo sapiens
cauaaagggaccagcuaaa

SEQ ID NO: 973104 - RNA, 19 nt, Homo sapiens
guucuccaauagauucaaa

SEQ ID NO: 973105 - RNA, 19 nt, Homo sapiens
auacaugaccaacuugaaa

SEQ ID NO: 973106 - RNA, 19 nt, Homo sapiens
caaucagaauggcucaaau

SEQ ID NO: 973107 - RNA, 19 nt, Homo sapiens
ugacguugcacugguauaa

SEQ ID NO: 973108 - RNA, 19 nt, Homo sapiens
gugaauaauggcacaagaa

SEQ ID NO: 973109 - RNA, 19 nt, Homo sapiens
gcaagaugaagaaagauac

SEQ ID NO: 973110 - RNA, 19 nt, Homo sapiens
ugaauguacagucaaagaa

SEQ ID NO: 973111 - RNA, 19 nt, Homo sapiens
ugacaguuauguguauugu

SEQ ID NO: 973112 - RNA, 19 nt, Homo sapiens
ucaaaugccacucaguaug

SEQ ID NO: 973113 - RNA, 19 nt, Homo sapiens
gauaguauaaaccaaugug

SEQ ID NO: 973114 - RNA, 19 nt, Homo sapiens
gacauggacuuggguggau

SEQ ID NO: 973115 - RNA, 19 nt, Homo sapiens
gguauucucacuuugacuu

SEQ ID NO: 973116 - RNA, 19 nt, Homo sapiens
agaaagauacaugacauug

SEQ ID NO: 973117 - RNA, 19 nt, Homo sapiens
ggaguucugcccaaacauc

SEQ ID NO: 973118 - RNA, 19 nt, Homo sapiens
ucacauugaagaugcaaga

SEQ ID NO: 973119 - RNA, 19 nt, Homo sapiens
uguuauugguucucuaaug

SEQ ID NO: 973120 - RNA, 19 nt, Homo sapiens
acacauucacucacauuga

SEQ ID NO: 973121 - RNA, 19 nt, Homo sapiens
ccaaucagaauggcucaaa

SEQ ID NO: 973122 - RNA, 19 nt, Homo sapiens
ugaagaaagauacaugaca

SEQ ID NO: 973123 - RNA, 19 nt, Homo sapiens
ggauuugucaguauuagag

SEQ ID NO: 973124 - RNA, 19 nt, Homo sapiens
gcagcaguguuuucaaaug

SEQ ID NO: 973125 - RNA, 19 nt, Homo sapiens
gugcugccauuaaggaaag

SEQ ID NO: 973126 - RNA, 19 nt, Homo sapiens
ucauaaagggaccagcuaa

SEQ ID NO: 973127 - RNA, 19 nt, Homo sapiens
aagcuggagugacaguuau

SEQ ID NO: 973128 - RNA, 19 nt, Homo sapiens
gacaguacuaugccaauca

SEQ ID NO: 973129 - RNA, 19 nt, Homo sapiens
ucucagggaguauugcuaa

SEQ ID NO: 973130 - RNA, 19 nt, Homo sapiens
gacuucaugugaucauauc

SEQ ID NO: 973131 - RNA, 19 nt, Homo sapiens
caucaucgacacuggucua

SEQ ID NO: 973132 - RNA, 19 nt, Homo sapiens
aaggaguucugcccaaaca

SEQ ID NO: 973133 - RNA, 19 nt, Homo sapiens
guugguuucucagggagua

SEQ ID NO: 973134 - RNA, 19 nt, Homo sapiens
gugacuucaugugaucaua

SEQ ID NO: 973135 - RNA, 19 nt, Homo sapiens
gaauaucuggaaccgugaa

SEQ ID NO: 973136 - RNA, 19 nt, Homo sapiens
uaaacuacguauggauugg

SEQ ID NO: 973137 - RNA, 19 nt, Homo sapiens
ucaaauaccaagggaagug

SEQ ID NO: 973138 - RNA, 19 nt, Homo sapiens
aauggcacaagaagaaaua

SEQ ID NO: 973139 - RNA, 19 nt, Homo sapiens
uauaaaccaaugugacuuc

SEQ ID NO: 973140 - RNA, 19 nt, Homo sapiens
uggucuagccucagaguaa

SEQ ID NO: 973141 - RNA, 19 nt, Homo sapiens
ugaauaauggcacaagaag

SEQ ID NO: 973142 - RNA, 19 nt, Homo sapiens
ucuggaaccgugaauggua

SEQ ID NO: 973143 - RNA, 19 nt, Homo sapiens
ccuaagacaauuaaacuac

SEQ ID NO: 973144 - RNA, 19 nt, Homo sapiens
caagaugaagaaagauaca

SEQ ID NO: 973145 - RNA, 19 nt, Homo sapiens
caucuacuaaucauacaug

SEQ ID NO: 973146 - RNA, 19 nt, Homo sapiens
ugcaagaugaagaaagaua

SEQ ID NO: 973147 - RNA, 19 nt, Homo sapiens
uuacugggaauaucuggaa

SEQ ID NO: 973148 - RNA, 19 nt, Homo sapiens
caaguucccuggagaagaa

SEQ ID NO: 973149 - RNA, 19 nt, Homo sapiens
cagcauagcuccaccaagu

SEQ ID NO: 973150 - RNA, 19 nt, Homo sapiens
ucaagacccucaacaacaa

SEQ ID NO: 973151 - RNA, 19 nt, Homo sapiens
ggagaggagugcaggaugu

SEQ ID NO: 973152 - RNA, 19 nt, Homo sapiens
gcaagcagcuagauucacu

SEQ ID NO: 973153 - RNA, 19 nt, Homo sapiens
gaucuacuguuccaaaucu

SEQ ID NO: 973154 - RNA, 19 nt, Homo sapiens
gagcggagcaggcagcuuu

SEQ ID NO: 973155 - RNA, 19 nt, Homo sapiens
caggaugucuggagaaugu

SEQ ID NO: 973156 - RNA, 19 nt, Homo sapiens
caagcucucucacuaugaa

SEQ ID NO: 973157 - RNA, 19 nt, Homo sapiens
ccuccaagcucucucacua

SEQ ID NO: 973158 - RNA, 19 nt, Homo sapiens
cagacaaguuugcaagaaa

SEQ ID NO: 973159 - RNA, 19 nt, Homo sapiens
gauccugacucccuucugu

SEQ ID NO: 973160 - RNA, 19 nt, Homo sapiens
gcauaagggucaaccacau

SEQ ID NO: 973161 - RNA, 19 nt, Homo sapiens
guaugaagaugaaaucaac

SEQ ID NO: 973162 - RNA, 19 nt, Homo sapiens
ucauggagcucaacaggau

SEQ ID NO: 973163 - RNA, 19 nt, Homo sapiens
gaagcugaacuccugguuu

SEQ ID NO: 973164 - RNA, 19 nt, Homo sapiens
caagugaucuacuguucca

SEQ ID NO: 973165 - RNA, 19 nt, Homo sapiens
gcauagcuccaccaaguga

SEQ ID NO: 973166 - RNA, 19 nt, Homo sapiens
accaggagcugaugaaugu

SEQ ID NO: 973167 - RNA, 19 nt, Homo sapiens
gggcugagauugaaaaugu

SEQ ID NO: 973168 - RNA, 19 nt, Homo sapiens
gaaguaugaagaugaaauc

SEQ ID NO: 973169 - RNA, 19 nt, Homo sapiens
gagcagcuguggcuuugca

SEQ ID NO: 973170 - RNA, 19 nt, Homo sapiens
aagcugaacuccugguuuc

SEQ ID NO: 973171 - RNA, 19 nt, Homo sapiens
ggcaguagccguggaguuu

SEQ ID NO: 973172 - RNA, 19 nt, Homo sapiens
gcauuucaguggucagcaa

SEQ ID NO: 973173 - RNA, 19 nt, Homo sapiens
agacaaguuugcaagaaau

SEQ ID NO: 973174 - RNA, 19 nt, Homo sapiens
cagcuauggugguggcuuu

SEQ ID NO: 973175 - RNA, 19 nt, Homo sapiens
gcacuuucuuuucucaaua

SEQ ID NO: 973176 - RNA, 19 nt, Homo sapiens
gcuacgggcugagauugaa

SEQ ID NO: 973177 - RNA, 19 nt, Homo sapiens
gaccugggcagcaucauug

SEQ ID NO: 973178 - RNA, 19 nt, Homo sapiens
gaucaagacccucaacaac

SEQ ID NO: 973179 - RNA, 19 nt, Homo sapiens
ugguggagcugguggcuuu

SEQ ID NO: 973180 - RNA, 19 nt, Homo sapiens
ccacucagccugcaauagu

SEQ ID NO: 973181 - RNA, 19 nt, Homo sapiens
ggaugcggcuuucaugaac

SEQ ID NO: 973182 - RNA, 19 nt, Homo sapiens
gaagaugaaaucaacaaac

SEQ ID NO: 973183 - RNA, 19 nt, Homo sapiens
acagacaaguuugcaagaa

SEQ ID NO: 973184 - RNA, 19 nt, Homo sapiens
guggagagauggcccucaa

SEQ ID NO: 973185 - RNA, 19 nt, Homo sapiens
agauggagcugucccagau

SEQ ID NO: 973186 - RNA, 19 nt, Homo sapiens
ggaccugggcagcaucauu

SEQ ID NO: 973187 - RNA, 19 nt, Homo sapiens
acuaugaacagacaaguuu

SEQ ID NO: 973188 - RNA, 19 nt, Homo sapiens
uggcagugguggcuacaaa

SEQ ID NO: 973189 - RNA, 19 nt, Homo sapiens
cagagugccgugugcauuu

SEQ ID NO: 973190 - RNA, 19 nt, Homo sapiens
uacagaaggcuaaggauga

SEQ ID NO: 973191 - RNA, 19 nt, Homo sapiens
ugaggaacaccaagaguga

SEQ ID NO: 973192 - RNA, 19 nt, Homo sapiens
cuaauucccugagcuguag

SEQ ID NO: 973193 - RNA, 19 nt, Homo sapiens
acaacaaguuugccuccuu

SEQ ID NO: 973194 - RNA, 19 nt, Homo sapiens
caaguuugccuccuucauc

SEQ ID NO: 973195 - RNA, 19 nt, Homo sapiens
uggacagccugacagauga

SEQ ID NO: 973196 - RNA, 19 nt, Homo sapiens
guggacagccugacagaug

SEQ ID NO: 973197 - RNA, 19 nt, Homo sapiens
uacaucagcuuccuaugca

SEQ ID NO: 973198 - RNA, 19 nt, Homo sapiens
uaccagagcagcaguagug

SEQ ID NO: 973199 - RNA, 19 nt, Homo sapiens
gcaacaagagcaucuccau

SEQ ID NO: 973200 - RNA, 19 nt, Homo sapiens
gauccucuggugaugagua

SEQ ID NO: 973201 - RNA, 19 nt, Homo sapiens
ggauguggaugcggcuuuc

SEQ ID NO: 973202 - RNA, 19 nt, Homo sapiens
cggagcagcuguggcuuug

SEQ ID NO: 973203 - RNA, 19 nt, Homo sapiens
aacaagagcaucuccauca

SEQ ID NO: 973204 - RNA, 19 nt, Homo sapiens
cauaagggucaaccacauu

SEQ ID NO: 973205 - RNA, 19 nt, Homo sapiens
gagagauggcccucaagga

SEQ ID NO: 973206 - RNA, 19 nt, Homo sapiens
gaauucaggaagugauugu

SEQ ID NO: 973207 - RNA, 19 nt, Homo sapiens
acugggaguuggagauuug

SEQ ID NO: 973208 - RNA, 19 nt, Homo sapiens
uuccaaaucucuauaacca

SEQ ID NO: 973209 - RNA, 19 nt, Homo sapiens
gugaucuacuguuccaaau

SEQ ID NO: 973210 - RNA, 19 nt, Homo sapiens
ggaggaaguggcuacaagu

SEQ ID NO: 973211 - RNA, 19 nt, Homo sapiens
gaacaccaagagugagauc

SEQ ID NO: 973212 - RNA, 19 nt, Homo sapiens
caaaguggacagccugaca

SEQ ID NO: 973213 - RNA, 19 nt, Homo sapiens
ccgcagagaaugaguuugu

SEQ ID NO: 973214 - RNA, 19 nt, Homo sapiens
aagaugaaaucaacaaacg

SEQ ID NO: 973215 - RNA, 19 nt, Homo sapiens
uccaagcucucucacuaug

SEQ ID NO: 973216 - RNA, 19 nt, Homo sapiens
gcggagcagcuguggcuuu

SEQ ID NO: 973217 - RNA, 19 nt, Homo sapiens
cagcggcaguggcuaugga

SEQ ID NO: 973218 - RNA, 19 nt, Homo sapiens
gggaauucaggaagugauu

SEQ ID NO: 973219 - RNA, 19 nt, Homo sapiens
uggugguccugguguauuu

SEQ ID NO: 973220 - RNA, 19 nt, Homo sapiens
ugaugaguauguugcacuu

SEQ ID NO: 973221 - RNA, 19 nt, Homo sapiens
ccuaauucccugagcugua

SEQ ID NO: 973222 - RNA, 19 nt, Homo sapiens
gcaauggccccuuacuuug

SEQ ID NO: 973223 - RNA, 19 nt, Homo sapiens
cagcggcuauggagucagu

SEQ ID NO: 973224 - RNA, 19 nt, Homo sapiens
caccaagagugagaucaug

SEQ ID NO: 973225 - RNA, 19 nt, Homo sapiens
gaccugaggaacaccaaga

SEQ ID NO: 973226 - RNA, 19 nt, Homo sapiens
gggaugaccugaggaacac

SEQ ID NO: 973227 - RNA, 19 nt, Homo sapiens
ggacagccugacagaugaa

SEQ ID NO: 973228 - RNA, 19 nt, Homo sapiens
gagcgggaacagaucaaga

SEQ ID NO: 973229 - RNA, 19 nt, Homo sapiens
ggaauucaggaagugauug

SEQ ID NO: 973230 - RNA, 19 nt, Homo sapiens
gagcugucccagaugcaaa

SEQ ID NO: 973231 - RNA, 19 nt, Homo sapiens
uucaggaagugauuguaaa

SEQ ID NO: 973232 - RNA, 19 nt, Homo sapiens
uggaggaaguggcuacaag

SEQ ID NO: 973233 - RNA, 19 nt, Homo sapiens
aguggcagcucuggcagua

SEQ ID NO: 973234 - RNA, 19 nt, Homo sapiens
gacccucaacaacaaguuu

SEQ ID NO: 973235 - RNA, 19 nt, Homo sapiens
ggaggcagcaccaguaucc

SEQ ID NO: 973236 - RNA, 19 nt, Homo sapiens
augccaagcuccaagacuu

SEQ ID NO: 973237 - RNA, 19 nt, Homo sapiens
ugacacgucugugguucug

SEQ ID NO: 973238 - RNA, 19 nt, Homo sapiens
guagauccucuggugauga

SEQ ID NO: 973239 - RNA, 19 nt, Homo sapiens
ccaaugccaagcuccaaga

SEQ ID NO: 973240 - RNA, 19 nt, Homo sapiens
gaggcuacgggcugagauu

SEQ ID NO: 973241 - RNA, 19 nt, Homo sapiens
gaugcggcuuucaugaaca

SEQ ID NO: 973242 - RNA, 19 nt, Homo sapiens
uaugcaagcagcuagauuc

SEQ ID NO: 973243 - RNA, 19 nt, Homo sapiens
gaacuccugguuucuccau

SEQ ID NO: 973244 - RNA, 19 nt, Homo sapiens
ugagcagcguggagagaug

SEQ ID NO: 973245 - RNA, 19 nt, Homo sapiens
auaagggucaaccacauuu

SEQ ID NO: 973246 - RNA, 19 nt, Homo sapiens
gaggaaguggcuacaaguc

SEQ ID NO: 973247 - RNA, 19 nt, Homo sapiens
gcucaagaaggauguggau

SEQ ID NO: 973248 - RNA, 19 nt, Homo sapiens
gagagaagcuguacaaaug

SEQ ID NO: 973249 - RNA, 19 nt, Homo sapiens
guacaaaugugaugaaugu

SEQ ID NO: 973250 - RNA, 19 nt, Homo sapiens
guacaaaugugaagaaugu

SEQ ID NO: 973251 - RNA, 19 nt, Homo sapiens
gaagagacaugagauggua

SEQ ID NO: 973252 - RNA, 19 nt, Homo sapiens
gaaugaagcaggaaauaua

SEQ ID NO: 973253 - RNA, 19 nt, Homo sapiens
ggacauaagagaauucaua

SEQ ID NO: 973254 - RNA, 19 nt, Homo sapiens
gacaugagaugguagcuaa

SEQ ID NO: 973255 - RNA, 19 nt, Homo sapiens
cacaagacauguuuaagua

SEQ ID NO: 973256 - RNA, 19 nt, Homo sapiens
gaaauucccuacaaaugug

SEQ ID NO: 973257 - RNA, 19 nt, Homo sapiens
aaagagcccuggaauauga

SEQ ID NO: 973258 - RNA, 19 nt, Homo sapiens
gagagaagcccuacaaaug

SEQ ID NO: 973259 - RNA, 19 nt, Homo sapiens
ggacuuaaccaauguuuga

SEQ ID NO: 973260 - RNA, 19 nt, Homo sapiens
cuacaaaugugaagaaugu

SEQ ID NO: 973261 - RNA, 19 nt, Homo sapiens
cuacaaaugugaagaaugu

SEQ ID NO: 973262 - RNA, 19 nt, Homo sapiens
cuacaaaugugaagaaugu

SEQ ID NO: 973263 - RNA, 19 nt, Homo sapiens
cuacaaaugugaagaaugu

SEQ ID NO: 973264 - RNA, 19 nt, Homo sapiens
cuacaaaugugaagcauau

SEQ ID NO: 973265 - RNA, 19 nt, Homo sapiens
gaaagugacccuaagaaga

SEQ ID NO: 973266 - RNA, 19 nt, Homo sapiens
gagcagaacauaagagauu

SEQ ID NO: 973267 - RNA, 19 nt, Homo sapiens
gagagaaacccuacaaaug

SEQ ID NO: 973268 - RNA, 19 nt, Homo sapiens
uagagaaucuggcaaaguu

SEQ ID NO: 973269 - RNA, 19 nt, Homo sapiens
cuacaaauguggagaaugu

SEQ ID NO: 973270 - RNA, 19 nt, Homo sapiens
gagagaaacccuacaaaug

SEQ ID NO: 973271 - RNA, 19 nt, Homo sapiens
gagagaaacccuacaaaug

SEQ ID NO: 973272 - RNA, 19 nt, Homo sapiens
gaagagaaacccuacaaau

SEQ ID NO: 973273 - RNA, 19 nt, Homo sapiens
ccucaaagcuuacugaaca

SEQ ID NO: 973274 - RNA, 19 nt, Homo sapiens
uaaccaaucuucaacacuu

SEQ ID NO: 973275 - RNA, 19 nt, Homo sapiens
aaccagaccucacaccuua

SEQ ID NO: 973276 - RNA, 19 nt, Homo sapiens
gagaaacucuacaaaugug

SEQ ID NO: 973277 - RNA, 19 nt, Homo sapiens
acaccuaacucaacauaaa

SEQ ID NO: 973278 - RNA, 19 nt, Homo sapiens
agagaaaccuuacaagugu

SEQ ID NO: 973279 - RNA, 19 nt, Homo sapiens
gagagaaaccuuacaagug

SEQ ID NO: 973280 - RNA, 19 nt, Homo sapiens
gagaaacccuacaaaugug

SEQ ID NO: 973281 - RNA, 19 nt, Homo sapiens
gagaaacccuacaaaugug

SEQ ID NO: 973282 - RNA, 19 nt, Homo sapiens
aaccaacucucaaaccuua

SEQ ID NO: 973283 - RNA, 19 nt, Homo sapiens
gagaaacccuacaaaugug

SEQ ID NO: 973284 - RNA, 19 nt, Homo sapiens
gagaaacccuacaaaugug

SEQ ID NO: 973285 - RNA, 19 nt, Homo sapiens
gaaaagagcccuggaauau

SEQ ID NO: 973286 - RNA, 19 nt, Homo sapiens
gcacagcagaauuuauaua

SEQ ID NO: 973287 - RNA, 19 nt, Homo sapiens
gaagagaaacaguacaaau

SEQ ID NO: 973288 - RNA, 19 nt, Homo sapiens
agagaaacguuaugaaugu

SEQ ID NO: 973289 - RNA, 19 nt, Homo sapiens
gcacaaaggagauuauagu

SEQ ID NO: 973290 - RNA, 19 nt, Homo sapiens
ccacaaauguagagaaucu

SEQ ID NO: 973291 - RNA, 19 nt, Homo sapiens
ggagagaaacguuaugaau

SEQ ID NO: 973292 - RNA, 19 nt, Homo sapiens
ucaaauagacacaagauga

SEQ ID NO: 973293 - RNA, 19 nt, Homo sapiens
cagggaccauugacauuua

SEQ ID NO: 973294 - RNA, 19 nt, Homo sapiens
uaauggcccuaacuaagua

SEQ ID NO: 973295 - RNA, 19 nt, Homo sapiens
gagaagcccuacaaaugug

SEQ ID NO: 973296 - RNA, 19 nt, Homo sapiens
gcucagccuuuggauguua

SEQ ID NO: 973297 - RNA, 19 nt, Homo sapiens
ggagagaaacccuacaaau

SEQ ID NO: 973298 - RNA, 19 nt, Homo sapiens
ggagagaaacccuacaaau

SEQ ID NO: 973299 - RNA, 19 nt, Homo sapiens
ggagagaaacccuacaaau

SEQ ID NO: 973300 - RNA, 19 nt, Homo sapiens
ggagagaagcuguacaaau

SEQ ID NO: 973301 - RNA, 19 nt, Homo sapiens
gagagaaacguuaugaaug

SEQ ID NO: 973302 - RNA, 19 nt, Homo sapiens
cuacaaaugugagaaaugu

SEQ ID NO: 973303 - RNA, 19 nt, Homo sapiens
ccucaacccuuaauaaaca

SEQ ID NO: 973304 - RNA, 19 nt, Homo sapiens
gaaacguuaugaaugugaa

SEQ ID NO: 973305 - RNA, 19 nt, Homo sapiens
aaagugugguugaguguaa

SEQ ID NO: 973306 - RNA, 19 nt, Homo sapiens
gacauaagguaauucauac

SEQ ID NO: 973307 - RNA, 19 nt, Homo sapiens
guucugcucucacaacuau

SEQ ID NO: 973308 - RNA, 19 nt, Homo sapiens
uuacaagugugaagaaugu

SEQ ID NO: 973309 - RNA, 19 nt, Homo sapiens
gagaaacaguacaaaugug

SEQ ID NO: 973310 - RNA, 19 nt, Homo sapiens
ucucaaaccuuacuagaca

SEQ ID NO: 973311 - RNA, 19 nt, Homo sapiens
cuacaaaugugaggaaugu

SEQ ID NO: 973312 - RNA, 19 nt, Homo sapiens
ggagagaagcccuacaaau

SEQ ID NO: 973313 - RNA, 19 nt, Homo sapiens
cugcaagucuguaaagauu

SEQ ID NO: 973314 - RNA, 19 nt, Homo sapiens
aaccauuucucaaccuuua

SEQ ID NO: 973315 - RNA, 19 nt, Homo sapiens
caaccuagcccgcaucugu

SEQ ID NO: 973316 - RNA, 19 nt, Homo sapiens
caacauauaagcauuccuu

SEQ ID NO: 973317 - RNA, 19 nt, Homo sapiens
caagacauguuuaaguaag

SEQ ID NO: 973318 - RNA, 19 nt, Homo sapiens
ggagagaaaccuuacaagu

SEQ ID NO: 973319 - RNA, 19 nt, Homo sapiens
gagaagcuguacaaaugug

SEQ ID NO: 973320 - RNA, 19 nt, Homo sapiens
caacacuuacuacacauaa

SEQ ID NO: 973321 - RNA, 19 nt, Homo sapiens
agagaaacccuacaaaugu

SEQ ID NO: 973322 - RNA, 19 nt, Homo sapiens
agagaaacccuacaaaugu

SEQ ID NO: 973323 - RNA, 19 nt, Homo sapiens
agagaaacccuacaaaugu

SEQ ID NO: 973324 - RNA, 19 nt, Homo sapiens
caaguucuccuuaucaguu

SEQ ID NO: 973325 - RNA, 19 nt, Homo sapiens
cauaagagaauucauagug

SEQ ID NO: 973326 - RNA, 19 nt, Homo sapiens
agagaaacccuacaaaugu

SEQ ID NO: 973327 - RNA, 19 nt, Homo sapiens
gagaauucauacuggagaa

SEQ ID NO: 973328 - RNA, 19 nt, Homo sapiens
gaagaaugcggcaaagcuu

SEQ ID NO: 973329 - RNA, 19 nt, Homo sapiens
agaaauguguuagagcuuu

SEQ ID NO: 973330 - RNA, 19 nt, Homo sapiens
ggaaugaagcaggaaauau

SEQ ID NO: 973331 - RNA, 19 nt, Homo sapiens
ccucacaccuuauuagaca

SEQ ID NO: 973332 - RNA, 19 nt, Homo sapiens
ggucacaagacauguuuaa

SEQ ID NO: 973333 - RNA, 19 nt, Homo sapiens
gcaagucuguaaagauuuu

SEQ ID NO: 973334 - RNA, 19 nt, Homo sapiens
ccaguggccaccuaaauaa

SEQ ID NO: 973335 - RNA, 19 nt, Homo sapiens
gaugcuuucucuuaaacuu

SEQ ID NO: 973336 - RNA, 19 nt, Homo sapiens
ggauguggccauagaauuc

SEQ ID NO: 973337 - RNA, 19 nt, Homo sapiens
ggagugcaguggcaugauc

SEQ ID NO: 973338 - RNA, 19 nt, Homo sapiens
gucaagcccugucuuuguu

SEQ ID NO: 973339 - RNA, 19 nt, Homo sapiens
ggcccuaacuaaguauuaa

SEQ ID NO: 973340 - RNA, 19 nt, Homo sapiens
ccucagcccuuaauacaca

SEQ ID NO: 973341 - RNA, 19 nt, Homo sapiens
ccucaacccuuacuacaca

SEQ ID NO: 973342 - RNA, 19 nt, Homo sapiens
caucgacccuuacuacaca

SEQ ID NO: 973343 - RNA, 19 nt, Homo sapiens
gaauuuauauaggcaugug

SEQ ID NO: 973344 - RNA, 19 nt, Homo sapiens
uuucugagauggagucuug

SEQ ID NO: 973345 - RNA, 19 nt, Homo sapiens
auagugaugcuuucucuua

SEQ ID NO: 973346 - RNA, 19 nt, Homo sapiens
uggcaaagcuuuuaaacaa

SEQ ID NO: 973347 - RNA, 19 nt, Homo sapiens
aaccaguccucaacccuua

SEQ ID NO: 973348 - RNA, 19 nt, Homo sapiens
aaagaaagcugcagauuaa

SEQ ID NO: 973349 - RNA, 19 nt, Homo sapiens
ccucgaaggugcauaauua

SEQ ID NO: 973350 - RNA, 19 nt, Homo sapiens
ggaacaagcuuucgacuag

SEQ ID NO: 973351 - RNA, 19 nt, Homo sapiens
caaagaaagcugcagauua

SEQ ID NO: 973352 - RNA, 19 nt, Homo sapiens
gaggauaugucucaauuug

SEQ ID NO: 973353 - RNA, 19 nt, Homo sapiens
gaggauuucucaacccuua

SEQ ID NO: 973354 - RNA, 19 nt, Homo sapiens
ggauaugucucaauuuguu

SEQ ID NO: 973355 - RNA, 19 nt, Homo sapiens
caacgucauuccuucaauu

SEQ ID NO: 973356 - RNA, 19 nt, Homo sapiens
caaacgggauaaugggaua

SEQ ID NO: 973357 - RNA, 19 nt, Homo sapiens
gcggacaacugaauaaaca

SEQ ID NO: 973358 - RNA, 19 nt, Homo sapiens
gauaggcgcucuccuguac

SEQ ID NO: 973359 - RNA, 19 nt, Homo sapiens
ugaaauugaugaacugaga

SEQ ID NO: 973360 - RNA, 19 nt, Homo sapiens
uagaggauaugucucaauu

SEQ ID NO: 973361 - RNA, 19 nt, Homo sapiens
cgucauuccuucaauuaaa

SEQ ID NO: 973362 - RNA, 19 nt, Homo sapiens
ccucagcucugccagguaa

SEQ ID NO: 973363 - RNA, 19 nt, Homo sapiens
gaauuccagucugagguua

SEQ ID NO: 973364 - RNA, 19 nt, Homo sapiens
cgaaugcggugcaaaauuu

SEQ ID NO: 973365 - RNA, 19 nt, Homo sapiens
gcaaagaaagcugcagauu

SEQ ID NO: 973366 - RNA, 19 nt, Homo sapiens
cgaaggugcauaauuauug

SEQ ID NO: 973367 - RNA, 19 nt, Homo sapiens
gcacugccucuauuauuau

SEQ ID NO: 973368 - RNA, 19 nt, Homo sapiens
uuacagagaaggaaacuga

SEQ ID NO: 973369 - RNA, 19 nt, Homo sapiens
gaaggugcauaauuauugc

SEQ ID NO: 973370 - RNA, 19 nt, Homo sapiens
gcgcccaccucauagaguu

SEQ ID NO: 973371 - RNA, 19 nt, Homo sapiens
gcgcagcgguaaagagcaa

SEQ ID NO: 973372 - RNA, 19 nt, Homo sapiens
cgaaggagaggcagucuau

SEQ ID NO: 973373 - RNA, 19 nt, Homo sapiens
gagcgcaccaucuggaauu

SEQ ID NO: 973374 - RNA, 19 nt, Homo sapiens
agucugagguuacaauuag

SEQ ID NO: 973375 - RNA, 19 nt, Homo sapiens
cucaauuuguucugcauua

SEQ ID NO: 973376 - RNA, 19 nt, Homo sapiens
ggaauuccagucugagguu

SEQ ID NO: 973377 - RNA, 19 nt, Homo sapiens
gauucaacuuugcaaacaa

SEQ ID NO: 973378 - RNA, 19 nt, Homo sapiens
ggacaggaaacaaguuagu

SEQ ID NO: 973379 - RNA, 19 nt, Homo sapiens
uuacucgucuguucugaug

SEQ ID NO: 973380 - RNA, 19 nt, Homo sapiens
gcagggcagugaggauuuc

SEQ ID NO: 973381 - RNA, 19 nt, Homo sapiens
gaaagcugcagauuaaacu

SEQ ID NO: 973382 - RNA, 19 nt, Homo sapiens
gcaaguguuuaggaugguu

SEQ ID NO: 973383 - RNA, 19 nt, Homo sapiens
gagcagggcagugaggauu

SEQ ID NO: 973384 - RNA, 19 nt, Homo sapiens
guaaccaacagcuguguga

SEQ ID NO: 973385 - RNA, 19 nt, Homo sapiens
gggaggggcuuugugauaa

SEQ ID NO: 973386 - RNA, 19 nt, Homo sapiens
gguaggagcagggcaguga

SEQ ID NO: 973387 - RNA, 19 nt, Homo sapiens
ccaugaaauugaugaacug

SEQ ID NO: 973388 - RNA, 19 nt, Homo sapiens
uacguaggcccaugaaauu

SEQ ID NO: 973389 - RNA, 19 nt, Homo sapiens
cagcuucuucugaucauuu

SEQ ID NO: 973390 - RNA, 19 nt, Homo sapiens
agaguuguucugaggauua

SEQ ID NO: 973391 - RNA, 19 nt, Homo sapiens
gcagauuaaacuucucguu

SEQ ID NO: 973392 - RNA, 19 nt, Homo sapiens
gcucuccuguaccuccuuu

SEQ ID NO: 973393 - RNA, 19 nt, Homo sapiens
ccucauagaguuguucuga

SEQ ID NO: 973394 - RNA, 19 nt, Homo sapiens
ucuguccucuucuuuguug

SEQ ID NO: 973395 - RNA, 19 nt, Homo sapiens
guaggcccaugaaauugau

SEQ ID NO: 973396 - RNA, 19 nt, Homo sapiens
cacugccucuauuauuaua

SEQ ID NO: 973397 - RNA, 19 nt, Homo sapiens
ccgagaguccucagugaaa

SEQ ID NO: 973398 - RNA, 19 nt, Homo sapiens
gcagggcaaguguuuagga

SEQ ID NO: 973399 - RNA, 19 nt, Homo sapiens
ccgcaggccguaauaaaga

SEQ ID NO: 973400 - RNA, 19 nt, Homo sapiens
aaggacaggaaacaaguua

SEQ ID NO: 973401 - RNA, 19 nt, Homo sapiens
uacuagcgcccaccucaua

SEQ ID NO: 973402 - RNA, 19 nt, Homo sapiens
gcccgcaggccguaauaaa

SEQ ID NO: 973403 - RNA, 19 nt, Homo sapiens
gaggacagccccuggaaaa

SEQ ID NO: 973404 - RNA, 19 nt, Homo sapiens
gaagcccaggcgacacuaa

SEQ ID NO: 973405 - RNA, 19 nt, Homo sapiens
auacguaggcccaugaaau

SEQ ID NO: 973406 - RNA, 19 nt, Homo sapiens
gagaggaacaagcuuucga

SEQ ID NO: 973407 - RNA, 19 nt, Homo sapiens
gagcagugugggccuuuga

SEQ ID NO: 973408 - RNA, 19 nt, Homo sapiens
gagccucaguuuccuuacu

SEQ ID NO: 973409 - RNA, 19 nt, Homo sapiens
uaacuacucccagcuucuu

SEQ ID NO: 973410 - RNA, 19 nt, Homo sapiens
agauucaacuuugcaaaca

SEQ ID NO: 973411 - RNA, 19 nt, Homo sapiens
ucucuguccucuucuuugu

SEQ ID NO: 973412 - RNA, 19 nt, Homo sapiens
ucaacgucauuccuucaau

SEQ ID NO: 973413 - RNA, 19 nt, Homo sapiens
ggucugaaccaccgauugg

SEQ ID NO: 973414 - RNA, 19 nt, Homo sapiens
cguaggcccaugaaauuga

SEQ ID NO: 973415 - RNA, 19 nt, Homo sapiens
cgagaguccucagugaaag

SEQ ID NO: 973416 - RNA, 19 nt, Homo sapiens
guuagguacugccgaaugc

SEQ ID NO: 973417 - RNA, 19 nt, Homo sapiens
cagggcaaguguuuaggau

SEQ ID NO: 973418 - RNA, 19 nt, Homo sapiens
gagguuacaauuagaacuc

SEQ ID NO: 973419 - RNA, 19 nt, Homo sapiens
cagucugagguuacaauua

SEQ ID NO: 973420 - RNA, 19 nt, Homo sapiens
uggcaacgccgagcugaaa

SEQ ID NO: 973421 - RNA, 19 nt, Homo sapiens
gaguuguucugaggauuag

SEQ ID NO: 973422 - RNA, 19 nt, Homo sapiens
ccaccgauuggcaaagaaa

SEQ ID NO: 973423 - RNA, 19 nt, Homo sapiens
aacgucauuccuucaauua

SEQ ID NO: 973424 - RNA, 19 nt, Homo sapiens
cccaugaaauugaugaacu

SEQ ID NO: 973425 - RNA, 19 nt, Homo sapiens
cgauaggcgcucuccugua

SEQ ID NO: 973426 - RNA, 19 nt, Homo sapiens
uuacuggucaaacgggaua

SEQ ID NO: 973427 - RNA, 19 nt, Homo sapiens
ggaaacugaggcccagaca

SEQ ID NO: 973428 - RNA, 19 nt, Homo sapiens
ugggagcccggaaccguua

SEQ ID NO: 973429 - RNA, 19 nt, Homo sapiens
gacuccaacucuucggaau

SEQ ID NO: 973430 - RNA, 19 nt, Homo sapiens
gggagaggaacaagcuuuc

SEQ ID NO: 973431 - RNA, 19 nt, Homo sapiens
ucgaaggugcauaauuauu

SEQ ID NO: 973432 - RNA, 19 nt, Homo sapiens
uaaggacaggaaacaaguu

SEQ ID NO: 973433 - RNA, 19 nt, Homo sapiens
ccagauucaacuuugcaaa

SEQ ID NO: 973434 - RNA, 19 nt, Homo sapiens
aaccaccgauuggcaaaga

SEQ ID NO: 973435 - RNA, 19 nt, Homo sapiens
cagauacguaggcccauga

SEQ ID NO: 973436 - RNA, 19 nt, Homo sapiens
ccaagaagaaagugcuaag

SEQ ID NO: 973437 - RNA, 19 nt, Homo sapiens
cgggagaggaacaagcuuu

SEQ ID NO: 973438 - RNA, 19 nt, Homo sapiens
ucucaacccuuacuuucac

SEQ ID NO: 973439 - RNA, 19 nt, Homo sapiens
ucuuucacccaccuucuua

SEQ ID NO: 973440 - RNA, 19 nt, Homo sapiens
gugugacccuagacgaguu

SEQ ID NO: 973441 - RNA, 19 nt, Homo sapiens
ucuccucgcugacccuauc

SEQ ID NO: 973442 - RNA, 19 nt, Homo sapiens
aggaacaagcuuucgacua

SEQ ID NO: 973443 - RNA, 19 nt, Homo sapiens
aaaagcaggcuguggaaaa

SEQ ID NO: 973444 - RNA, 19 nt, Homo sapiens
gacaggaaacaaguuagug

SEQ ID NO: 973445 - RNA, 19 nt, Homo sapiens
gagagcagugugggccuuu

SEQ ID NO: 973446 - RNA, 19 nt, Homo sapiens
gaccccagauucaacuuug

SEQ ID NO: 973447 - RNA, 19 nt, Homo sapiens
gauaugucucaauuuguuc

SEQ ID NO: 973448 - RNA, 19 nt, Homo sapiens
gcagguaucuggcauaauu

SEQ ID NO: 973449 - RNA, 19 nt, Homo sapiens
ucaaucaacugaccuauuu

SEQ ID NO: 973450 - RNA, 19 nt, Homo sapiens
gcaguuaaguuucccaguu

SEQ ID NO: 973451 - RNA, 19 nt, Homo sapiens
gauggacaauggauucuaa

SEQ ID NO: 973452 - RNA, 19 nt, Homo sapiens
caacugaccuauuucuuca

SEQ ID NO: 973453 - RNA, 19 nt, Homo sapiens
gaagucaucugucuauuuu

SEQ ID NO: 973454 - RNA, 19 nt, Homo sapiens
caguuaaguuucccaguua

SEQ ID NO: 973455 - RNA, 19 nt, Homo sapiens
caaggaugcuuuaccaaug

SEQ ID NO: 973456 - RNA, 19 nt, Homo sapiens
ugacagaaucccugaguua

SEQ ID NO: 973457 - RNA, 19 nt, Homo sapiens
ggaaugguguuuggcguaa

SEQ ID NO: 973458 - RNA, 19 nt, Homo sapiens
ccauugaaauucuuacuug

SEQ ID NO: 973459 - RNA, 19 nt, Homo sapiens
gaaccaauaaagacuguaa

SEQ ID NO: 973460 - RNA, 19 nt, Homo sapiens
uuacuaaugugcaagauug

SEQ ID NO: 973461 - RNA, 19 nt, Homo sapiens
gaaacucacacucgcuuaa

SEQ ID NO: 973462 - RNA, 19 nt, Homo sapiens
guaauucucuugccauuuu

SEQ ID NO: 973463 - RNA, 19 nt, Homo sapiens
guauacagcuaugugguaa

SEQ ID NO: 973464 - RNA, 19 nt, Homo sapiens
gacaauggauucuaaacuc

SEQ ID NO: 973465 - RNA, 19 nt, Homo sapiens
caaguuugcagaaccaaua

SEQ ID NO: 973466 - RNA, 19 nt, Homo sapiens
auacagcuaugugguaaua

SEQ ID NO: 973467 - RNA, 19 nt, Homo sapiens
uagauaccaucgccuauga

SEQ ID NO: 973468 - RNA, 19 nt, Homo sapiens
gagcauuuguugaucuguu

SEQ ID NO: 973469 - RNA, 19 nt, Homo sapiens
uuuaauggcuuugggauuu

SEQ ID NO: 973470 - RNA, 19 nt, Homo sapiens
gcaaggaugcuuuaccaau

SEQ ID NO: 973471 - RNA, 19 nt, Homo sapiens
uaugaagacuggcuggaaa

SEQ ID NO: 973472 - RNA, 19 nt, Homo sapiens
aaacgcugaugcagacuuu

SEQ ID NO: 973473 - RNA, 19 nt, Homo sapiens
uaaauuuacccgucaauca

SEQ ID NO: 973474 - RNA, 19 nt, Homo sapiens
cuuccucgcuucacaauga

SEQ ID NO: 973475 - RNA, 19 nt, Homo sapiens
cacauaagauggcaaacug

SEQ ID NO: 973476 - RNA, 19 nt, Homo sapiens
acaaugaugucaaagaucu

SEQ ID NO: 973477 - RNA, 19 nt, Homo sapiens
ggagcucuggcuauuguua

SEQ ID NO: 973478 - RNA, 19 nt, Homo sapiens
caggagcucuggcuauugu

SEQ ID NO: 973479 - RNA, 19 nt, Homo sapiens
caccucagauugauauguu

SEQ ID NO: 973480 - RNA, 19 nt, Homo sapiens
gugcagguaucuggcauaa

SEQ ID NO: 973481 - RNA, 19 nt, Homo sapiens
acagcuaugugguaauauu

SEQ ID NO: 973482 - RNA, 19 nt, Homo sapiens
ugaagucaucugucuauuu

SEQ ID NO: 973483 - RNA, 19 nt, Homo sapiens
ucuaaacucuuucuuggau

SEQ ID NO: 973484 - RNA, 19 nt, Homo sapiens
ccacucauuugcaacuuau

SEQ ID NO: 973485 - RNA, 19 nt, Homo sapiens
gguaauguuugcacucauc

SEQ ID NO: 973486 - RNA, 19 nt, Homo sapiens
ggacauccucugcaucuuc

SEQ ID NO: 973487 - RNA, 19 nt, Homo sapiens
ggacucuccugccauugga

SEQ ID NO: 973488 - RNA, 19 nt, Homo sapiens
guucaccacucauuugcaa

SEQ ID NO: 973489 - RNA, 19 nt, Homo sapiens
gaaugaauguuuagauacc

SEQ ID NO: 973490 - RNA, 19 nt, Homo sapiens
ggauuguccuguuacuaau

SEQ ID NO: 973491 - RNA, 19 nt, Homo sapiens
ucacccaucuacaggauug

SEQ ID NO: 973492 - RNA, 19 nt, Homo sapiens
ggaaacucacacucgcuua

SEQ ID NO: 973493 - RNA, 19 nt, Homo sapiens
gcucaucacugaaguugcu

SEQ ID NO: 973494 - RNA, 19 nt, Homo sapiens
cugggacucuggaugguua

SEQ ID NO: 973495 - RNA, 19 nt, Homo sapiens
gcauacaaacgacuagaug

SEQ ID NO: 973496 - RNA, 19 nt, Homo sapiens
gaaauuggacaugggauag

SEQ ID NO: 973497 - RNA, 19 nt, Homo sapiens
ucacggcaguucucauuag

SEQ ID NO: 973498 - RNA, 19 nt, Homo sapiens
gaaauucuuacuugguaug

SEQ ID NO: 973499 - RNA, 19 nt, Homo sapiens
gacauccucugcaucuuca

SEQ ID NO: 973500 - RNA, 19 nt, Homo sapiens
ggaaugaauguuuagauac

SEQ ID NO: 973501 - RNA, 19 nt, Homo sapiens
uuagugguguuguacauga

SEQ ID NO: 973502 - RNA, 19 nt, Homo sapiens
gaguuacaguauacagcua

SEQ ID NO: 973503 - RNA, 19 nt, Homo sapiens
ucaacugaaugcuguaaca

SEQ ID NO: 973504 - RNA, 19 nt, Homo sapiens
gugcaagauuggaaugaau

SEQ ID NO: 973505 - RNA, 19 nt, Homo sapiens
ugaaauuggacaugggaua

SEQ ID NO: 973506 - RNA, 19 nt, Homo sapiens
ucucauuagugguguugua

SEQ ID NO: 973507 - RNA, 19 nt, Homo sapiens
gguaauauucauugccauu

SEQ ID NO: 973508 - RNA, 19 nt, Homo sapiens
gcugaagucaucugucuau

SEQ ID NO: 973509 - RNA, 19 nt, Homo sapiens
aaucacagccucacagaug

SEQ ID NO: 973510 - RNA, 19 nt, Homo sapiens
uauuuauccuggagcauuu

SEQ ID NO: 973511 - RNA, 19 nt, Homo sapiens
gacucucccucuucuuauu

SEQ ID NO: 973512 - RNA, 19 nt, Homo sapiens
ggacaauggauucuaaacu

SEQ ID NO: 973513 - RNA, 19 nt, Homo sapiens
caaguucaaguuucuguau

SEQ ID NO: 973514 - RNA, 19 nt, Homo sapiens
caguaauucucuugccauu

SEQ ID NO: 973515 - RNA, 19 nt, Homo sapiens
gaucuguucaccacucauu

SEQ ID NO: 973516 - RNA, 19 nt, Homo sapiens
gauucuaaacucuuucuug

SEQ ID NO: 973517 - RNA, 19 nt, Homo sapiens
guaccugauuucccucuca

SEQ ID NO: 973518 - RNA, 19 nt, Homo sapiens
uuaauaagcguuugcauac

SEQ ID NO: 973519 - RNA, 19 nt, Homo sapiens
gugcugaagucaucugucu

SEQ ID NO: 973520 - RNA, 19 nt, Homo sapiens
caaguugugguuccuggua

SEQ ID NO: 973521 - RNA, 19 nt, Homo sapiens
gagcucuggcuauuguuaa

SEQ ID NO: 973522 - RNA, 19 nt, Homo sapiens
aauaagcguuugcauacau

SEQ ID NO: 973523 - RNA, 19 nt, Homo sapiens
aaacacccaccucagauug

SEQ ID NO: 973524 - RNA, 19 nt, Homo sapiens
cagaaccaauaaagacugu

SEQ ID NO: 973525 - RNA, 19 nt, Homo sapiens
ucaacugaccuauuucuuc

SEQ ID NO: 973526 - RNA, 19 nt, Homo sapiens
aaauuuacccgucaaucaa

SEQ ID NO: 973527 - RNA, 19 nt, Homo sapiens
guauaaauuuacccgucaa

SEQ ID NO: 973528 - RNA, 19 nt, Homo sapiens
aacucacacucgcuuaaua

SEQ ID NO: 973529 - RNA, 19 nt, Homo sapiens
gacuagaugguucaacuga

SEQ ID NO: 973530 - RNA, 19 nt, Homo sapiens
cagaaucccugaguuacag

SEQ ID NO: 973531 - RNA, 19 nt, Homo sapiens
aaugguguuuggcguaauu

SEQ ID NO: 973532 - RNA, 19 nt, Homo sapiens
caucuccccuuuccacaua

SEQ ID NO: 973533 - RNA, 19 nt, Homo sapiens
gguuccugguauaaauuua

SEQ ID NO: 973534 - RNA, 19 nt, Homo sapiens
gaugcagacuuuggcacaa

SEQ ID NO: 973535 - RNA, 19 nt, Homo sapiens
guaauauucauugccauug

SEQ ID NO: 973536 - RNA, 19 nt, Homo sapiens
uaauaagcguuugcauaca

SEQ ID NO: 973537 - RNA, 19 nt, Homo sapiens
cugacucucccucuucuua

SEQ ID NO: 973538 - RNA, 19 nt, Homo sapiens
aagcucaaguucaaguuuc

SEQ ID NO: 973539 - RNA, 19 nt, Homo sapiens
acugaaugcuguaacaauc

SEQ ID NO: 973540 - RNA, 19 nt, Homo sapiens
gcuaugugguaauauucau

SEQ ID NO: 973541 - RNA, 19 nt, Homo sapiens
acaauggauucuaaacucu

SEQ ID NO: 973542 - RNA, 19 nt, Homo sapiens
guaaaacacccaccucaga

SEQ ID NO: 973543 - RNA, 19 nt, Homo sapiens
acucacacucgcuuaauaa

SEQ ID NO: 973544 - RNA, 19 nt, Homo sapiens
ugaccgacuuggugcugaa

SEQ ID NO: 973545 - RNA, 19 nt, Homo sapiens
cuuuacagcaguuaaguuu

SEQ ID NO: 973546 - RNA, 19 nt, Homo sapiens
gcaagauuggaaugaaugu

SEQ ID NO: 973547 - RNA, 19 nt, Homo sapiens
ugaaguugcugaggacucu

SEQ ID NO: 973548 - RNA, 19 nt, Homo sapiens
gaagaaaucucucuguuaa

SEQ ID NO: 973549 - RNA, 19 nt, Homo sapiens
gcaaagaugugaagaauug

SEQ ID NO: 973550 - RNA, 19 nt, Homo sapiens
gaagaaagaugaagauaug

SEQ ID NO: 973551 - RNA, 19 nt, Homo sapiens
gcaaagagcguauuagaga

SEQ ID NO: 973552 - RNA, 19 nt, Homo sapiens
ggagaaagccagaaaugua

SEQ ID NO: 973553 - RNA, 19 nt, Homo sapiens
ccagaaaucuuuacaggaa

SEQ ID NO: 973554 - RNA, 19 nt, Homo sapiens
ugaaugaacuggaaacuga

SEQ ID NO: 973555 - RNA, 19 nt, Homo sapiens
caagagcccugaaagauga

SEQ ID NO: 973556 - RNA, 19 nt, Homo sapiens
gaaagcaguuggcagagaa

SEQ ID NO: 973557 - RNA, 19 nt, Homo sapiens
gcauaggaaugaugaauug

SEQ ID NO: 973558 - RNA, 19 nt, Homo sapiens
gcacuuaucccugauuuaa

SEQ ID NO: 973559 - RNA, 19 nt, Homo sapiens
ucacagagguccaugaaga

SEQ ID NO: 973560 - RNA, 19 nt, Homo sapiens
gaagaaacaagaacucauu

SEQ ID NO: 973561 - RNA, 19 nt, Homo sapiens
cagcuuagaagaagaauua

SEQ ID NO: 973562 - RNA, 19 nt, Homo sapiens
caaauaaacuggagucaac

SEQ ID NO: 973563 - RNA, 19 nt, Homo sapiens
gaaaagaauucacugguuu

SEQ ID NO: 973564 - RNA, 19 nt, Homo sapiens
ugacuacacuucaagauga

SEQ ID NO: 973565 - RNA, 19 nt, Homo sapiens
gagaaagccagaaauguaa

SEQ ID NO: 973566 - RNA, 19 nt, Homo sapiens
gaaaguuccagcaaauuaa

SEQ ID NO: 973567 - RNA, 19 nt, Homo sapiens
caaguuaaauccagcauca

SEQ ID NO: 973568 - RNA, 19 nt, Homo sapiens
agagguccaugaagaauua

SEQ ID NO: 973569 - RNA, 19 nt, Homo sapiens
cgaaaguuccagcaaauua

SEQ ID NO: 973570 - RNA, 19 nt, Homo sapiens
caagaaggcucugagaaug

SEQ ID NO: 973571 - RNA, 19 nt, Homo sapiens
gaaacaagaacucauugaa

SEQ ID NO: 973572 - RNA, 19 nt, Homo sapiens
guuggaagcucauauggaa

SEQ ID NO: 973573 - RNA, 19 nt, Homo sapiens
gaaugaacguauugaggaa

SEQ ID NO: 973574 - RNA, 19 nt, Homo sapiens
ugaaauagauguucuuagg

SEQ ID NO: 973575 - RNA, 19 nt, Homo sapiens
ggucaugacugcuauucaa

SEQ ID NO: 973576 - RNA, 19 nt, Homo sapiens
gcaagaaggcucugagaau

SEQ ID NO: 973577 - RNA, 19 nt, Homo sapiens
gcaagcaggugaaaacuuu

SEQ ID NO: 973578 - RNA, 19 nt, Homo sapiens
gcacguacacaauuagaaa

SEQ ID NO: 973579 - RNA, 19 nt, Homo sapiens
gagcaaagagcguauuaga

SEQ ID NO: 973580 - RNA, 19 nt, Homo sapiens
gcacaaguucuucaucaaa

SEQ ID NO: 973581 - RNA, 19 nt, Homo sapiens
ccaaauaaccgaauguuca

SEQ ID NO: 973582 - RNA, 19 nt, Homo sapiens
gaauaaaggccaguaaugu

SEQ ID NO: 973583 - RNA, 19 nt, Homo sapiens
uaaagucccugcuacaaca

SEQ ID NO: 973584 - RNA, 19 nt, Homo sapiens
gaaagccagaaauguaaua

SEQ ID NO: 973585 - RNA, 19 nt, Homo sapiens
aacaagaacucauugaaga

SEQ ID NO: 973586 - RNA, 19 nt, Homo sapiens
ccugaaagaugaaauagau

SEQ ID NO: 973587 - RNA, 19 nt, Homo sapiens
gagagugaaugcaaaguag

SEQ ID NO: 973588 - RNA, 19 nt, Homo sapiens
caaagagcguauuagagaa

SEQ ID NO: 973589 - RNA, 19 nt, Homo sapiens
gaaagaaacaaaugaagag

SEQ ID NO: 973590 - RNA, 19 nt, Homo sapiens
gauggaaucuagacuugug

SEQ ID NO: 973591 - RNA, 19 nt, Homo sapiens
gggauggaaucuagacuug

SEQ ID NO: 973592 - RNA, 19 nt, Homo sapiens
ggagagugaaugcaaagua

SEQ ID NO: 973593 - RNA, 19 nt, Homo sapiens
gagaaagagagaagaauug

SEQ ID NO: 973594 - RNA, 19 nt, Homo sapiens
gaauauagggagguguuua

SEQ ID NO: 973595 - RNA, 19 nt, Homo sapiens
gagcuucgauguucacaag

SEQ ID NO: 973596 - RNA, 19 nt, Homo sapiens
agaagaaaucucucuguua

SEQ ID NO: 973597 - RNA, 19 nt, Homo sapiens
gcugaaauaaugcuacuaa

SEQ ID NO: 973598 - RNA, 19 nt, Homo sapiens
caaacacagugguugcaaa

SEQ ID NO: 973599 - RNA, 19 nt, Homo sapiens
gaacagaaacaccguaaaa

SEQ ID NO: 973600 - RNA, 19 nt, Homo sapiens
caagagggcagacacacua

SEQ ID NO: 973601 - RNA, 19 nt, Homo sapiens
gcaggugacuacacuucaa

SEQ ID NO: 973602 - RNA, 19 nt, Homo sapiens
uaauaagagucuagcauuc

SEQ ID NO: 973603 - RNA, 19 nt, Homo sapiens
gcaauggaggaaagauaua

SEQ ID NO: 973604 - RNA, 19 nt, Homo sapiens
caugaagaauuacagaaga

SEQ ID NO: 973605 - RNA, 19 nt, Homo sapiens
gcauaauacagucagcuua

SEQ ID NO: 973606 - RNA, 19 nt, Homo sapiens
gcuucgauguucacaagua

SEQ ID NO: 973607 - RNA, 19 nt, Homo sapiens
guucaagaucuucauguua

SEQ ID NO: 973608 - RNA, 19 nt, Homo sapiens
ugagauauaucgucagaag

SEQ ID NO: 973609 - RNA, 19 nt, Homo sapiens
ugacugcuauucaagaguu

SEQ ID NO: 973610 - RNA, 19 nt, Homo sapiens
gcuacaacaucugauuaaa

SEQ ID NO: 973611 - RNA, 19 nt, Homo sapiens
gcagagaaagagagaagaa

SEQ ID NO: 973612 - RNA, 19 nt, Homo sapiens
gaaguuggaagcucauaug

SEQ ID NO: 973613 - RNA, 19 nt, Homo sapiens
gcaaauuaaagcagaaguu

SEQ ID NO: 973614 - RNA, 19 nt, Homo sapiens
ggggacaacuggagaauaa

SEQ ID NO: 973615 - RNA, 19 nt, Homo sapiens
gaagcaagaacauauucaa

SEQ ID NO: 973616 - RNA, 19 nt, Homo sapiens
agaaaucucucuguuaaag

SEQ ID NO: 973617 - RNA, 19 nt, Homo sapiens
gagcagaggcugagcaaag

SEQ ID NO: 973618 - RNA, 19 nt, Homo sapiens
agaaacaaaugaagagcuu

SEQ ID NO: 973619 - RNA, 19 nt, Homo sapiens
acaugaagcuuuacuuaag

SEQ ID NO: 973620 - RNA, 19 nt, Homo sapiens
gaauuggagcaacagcuua

SEQ ID NO: 973621 - RNA, 19 nt, Homo sapiens
aaagagagaagaauugaga

SEQ ID NO: 973622 - RNA, 19 nt, Homo sapiens
cuaaucgaauuccagcaua

SEQ ID NO: 973623 - RNA, 19 nt, Homo sapiens
aauaaaggccaguaaugua

SEQ ID NO: 973624 - RNA, 19 nt, Homo sapiens
ggugaaaacuuuacaggaa

SEQ ID NO: 973625 - RNA, 19 nt, Homo sapiens
gaaacaagagcccugaaag

SEQ ID NO: 973626 - RNA, 19 nt, Homo sapiens
ugaaagcaauggaggaaag

SEQ ID NO: 973627 - RNA, 19 nt, Homo sapiens
gcagcgugauacuuugaaa

SEQ ID NO: 973628 - RNA, 19 nt, Homo sapiens
aaacaagagcccugaaaga

SEQ ID NO: 973629 - RNA, 19 nt, Homo sapiens
gaaaagaagcaagaacaua

SEQ ID NO: 973630 - RNA, 19 nt, Homo sapiens
caaauuaaagcagaaguug

SEQ ID NO: 973631 - RNA, 19 nt, Homo sapiens
ggcgaaaguuccagcaaau

SEQ ID NO: 973632 - RNA, 19 nt, Homo sapiens
acacuagcguuugaaauga

SEQ ID NO: 973633 - RNA, 19 nt, Homo sapiens
gguucaagaucuucauguu

SEQ ID NO: 973634 - RNA, 19 nt, Homo sapiens
guugagauauaucgucaga

SEQ ID NO: 973635 - RNA, 19 nt, Homo sapiens
gcaaauaaacuggagucaa

SEQ ID NO: 973636 - RNA, 19 nt, Homo sapiens
ggagaauaaaggccaguaa

SEQ ID NO: 973637 - RNA, 19 nt, Homo sapiens
cacaaguucuucaucaaau

SEQ ID NO: 973638 - RNA, 19 nt, Homo sapiens
ugaaugaccuucgcaagca

SEQ ID NO: 973639 - RNA, 19 nt, Homo sapiens
gaacaauuacaggaagaaa

SEQ ID NO: 973640 - RNA, 19 nt, Homo sapiens
aaaugaugcuguuggagaa

SEQ ID NO: 973641 - RNA, 19 nt, Homo sapiens
agcaucagcugaaauaaug

SEQ ID NO: 973642 - RNA, 19 nt, Homo sapiens
gagaauaaaggccaguaau

SEQ ID NO: 973643 - RNA, 19 nt, Homo sapiens
gaagagcugaggcaaagau

SEQ ID NO: 973644 - RNA, 19 nt, Homo sapiens
aagaagagcugaggcaaag

SEQ ID NO: 973645 - RNA, 19 nt, Homo sapiens
auaaaggccaguaauguaa

SEQ ID NO: 973646 - RNA, 19 nt, Homo sapiens
ggaaugaugaauugacuag

SEQ ID NO: 973647 - RNA, 19 nt, Homo sapiens
aaaagcagcuaaucgaauu

SEQ ID NO: 973648 - RNA, 19 nt, Homo sapiens
gaacggcgcugucugagaa

SEQ ID NO: 973649 - RNA, 19 nt, Homo sapiens
gggauggucucauuaaauu

SEQ ID NO: 973650 - RNA, 19 nt, Homo sapiens
gagaaauugugcaggaaua

SEQ ID NO: 973651 - RNA, 19 nt, Homo sapiens
ucaagugucugcuaaauau

SEQ ID NO: 973652 - RNA, 19 nt, Homo sapiens
uaaacuagcugggaucauu

SEQ ID NO: 973653 - RNA, 19 nt, Homo sapiens
gcacagaacagauuuagau

SEQ ID NO: 973654 - RNA, 19 nt, Homo sapiens
gagaauaggagauuuguga

SEQ ID NO: 973655 - RNA, 19 nt, Homo sapiens
gaaguucaguauaauccua

SEQ ID NO: 973656 - RNA, 19 nt, Homo sapiens
gauaaaagccuaagaguuu

SEQ ID NO: 973657 - RNA, 19 nt, Homo sapiens
agggauaucugcuucaaua

SEQ ID NO: 973658 - RNA, 19 nt, Homo sapiens
cuaaaucgccuucaucaaa

SEQ ID NO: 973659 - RNA, 19 nt, Homo sapiens
gacauugacccuuuguuua

SEQ ID NO: 973660 - RNA, 19 nt, Homo sapiens
cgaaccagcucauaucaau

SEQ ID NO: 973661 - RNA, 19 nt, Homo sapiens
ggaauaugaucggcauuug

SEQ ID NO: 973662 - RNA, 19 nt, Homo sapiens
ggacaaccaaaucuuaauu

SEQ ID NO: 973663 - RNA, 19 nt, Homo sapiens
caaggcagguccuaucuuc

SEQ ID NO: 973664 - RNA, 19 nt, Homo sapiens
cauguuugcuccugaguuu

SEQ ID NO: 973665 - RNA, 19 nt, Homo sapiens
ggagaacggcgcugucuga

SEQ ID NO: 973666 - RNA, 19 nt, Homo sapiens
ggauguugguguuaaucua

SEQ ID NO: 973667 - RNA, 19 nt, Homo sapiens
gcagugacuuugucuccaa

SEQ ID NO: 973668 - RNA, 19 nt, Homo sapiens
gauaucugcuucaauacug

SEQ ID NO: 973669 - RNA, 19 nt, Homo sapiens
gcaaauggcugccccuaga

SEQ ID NO: 973670 - RNA, 19 nt, Homo sapiens
gacaguguauaucaagauu

SEQ ID NO: 973671 - RNA, 19 nt, Homo sapiens
aaugaugcauccaauauug

SEQ ID NO: 973672 - RNA, 19 nt, Homo sapiens
ggagaacuuuugcaacaua

SEQ ID NO: 973673 - RNA, 19 nt, Homo sapiens
ugacauugacccuuuguuu

SEQ ID NO: 973674 - RNA, 19 nt, Homo sapiens
uggcugggaugucugauaa

SEQ ID NO: 973675 - RNA, 19 nt, Homo sapiens
uaaaucgccuucaucaaag

SEQ ID NO: 973676 - RNA, 19 nt, Homo sapiens
gaugaaaucacagcaaaga

SEQ ID NO: 973677 - RNA, 19 nt, Homo sapiens
agaauuggaugaaaucaca

SEQ ID NO: 973678 - RNA, 19 nt, Homo sapiens
ggagguggcaguuaaggaa

SEQ ID NO: 973679 - RNA, 19 nt, Homo sapiens
cuucuaaggucauaacaug

SEQ ID NO: 973680 - RNA, 19 nt, Homo sapiens
guaaggcuguuagggauau

SEQ ID NO: 973681 - RNA, 19 nt, Homo sapiens
ugcauuagacccuucauua

SEQ ID NO: 973682 - RNA, 19 nt, Homo sapiens
aguauaauccuaccuauga

SEQ ID NO: 973683 - RNA, 19 nt, Homo sapiens
acauugacccuuuguuuaa

SEQ ID NO: 973684 - RNA, 19 nt, Homo sapiens
ugaaacuucuaaggucaua

SEQ ID NO: 973685 - RNA, 19 nt, Homo sapiens
ggaugagaauaggagauuu

SEQ ID NO: 973686 - RNA, 19 nt, Homo sapiens
gcugggaugucugauaaga

SEQ ID NO: 973687 - RNA, 19 nt, Homo sapiens
cagguccuaucuucacaua

SEQ ID NO: 973688 - RNA, 19 nt, Homo sapiens
uggaugaaaucacagcaaa

SEQ ID NO: 973689 - RNA, 19 nt, Homo sapiens
caucaagugucugcuaaau

SEQ ID NO: 973690 - RNA, 19 nt, Homo sapiens
cgauuuaaagcucaugaua

SEQ ID NO: 973691 - RNA, 19 nt, Homo sapiens
guuaaucuacggucaacua

SEQ ID NO: 973692 - RNA, 19 nt, Homo sapiens
gaaaaugaugcauccaaua

SEQ ID NO: 973693 - RNA, 19 nt, Homo sapiens
gaugagaauaggagauuug

SEQ ID NO: 973694 - RNA, 19 nt, Homo sapiens
cauucgaaguggagaaauu

SEQ ID NO: 973695 - RNA, 19 nt, Homo sapiens
gaagauuuguugccgucau

SEQ ID NO: 973696 - RNA, 19 nt, Homo sapiens
cgucaaagaaguucaguau

SEQ ID NO: 973697 - RNA, 19 nt, Homo sapiens
gggcgucagugcagucaga

SEQ ID NO: 973698 - RNA, 19 nt, Homo sapiens
uuagacccuucauuagaua

SEQ ID NO: 973699 - RNA, 19 nt, Homo sapiens
uaaagcucaugauaaagug

SEQ ID NO: 973700 - RNA, 19 nt, Homo sapiens
aaacucuacagucgauuua

SEQ ID NO: 973701 - RNA, 19 nt, Homo sapiens
ugucugagaacauuuauug

SEQ ID NO: 973702 - RNA, 19 nt, Homo sapiens
caacuaugccaccugagaa

SEQ ID NO: 973703 - RNA, 19 nt, Homo sapiens
cauuagacccuucauuaga

SEQ ID NO: 973704 - RNA, 19 nt, Homo sapiens
gcauuagacccuucauuag

SEQ ID NO: 973705 - RNA, 19 nt, Homo sapiens
agacuggaguucaccuuga

SEQ ID NO: 973706 - RNA, 19 nt, Homo sapiens
uugaugacauugacccuuu

SEQ ID NO: 973707 - RNA, 19 nt, Homo sapiens
gaaaaguaccuuauugugu

SEQ ID NO: 973708 - RNA, 19 nt, Homo sapiens
gagacaggacaguguauau

SEQ ID NO: 973709 - RNA, 19 nt, Homo sapiens
gccuaugacagguaucuua

SEQ ID NO: 973710 - RNA, 19 nt, Homo sapiens
ugaaacuggucagaagaaa

SEQ ID NO: 973711 - RNA, 19 nt, Homo sapiens
gacaggacaguguauauca

SEQ ID NO: 973712 - RNA, 19 nt, Homo sapiens
gauggucucauuaaauugu

SEQ ID NO: 973713 - RNA, 19 nt, Homo sapiens
caugauaaaguguguauag

SEQ ID NO: 973714 - RNA, 19 nt, Homo sapiens
ggagcacagaacagauuua

SEQ ID NO: 973715 - RNA, 19 nt, Homo sapiens
gaaauugugcaggaauaug

SEQ ID NO: 973716 - RNA, 19 nt, Homo sapiens
ggacaguguauaucaagau

SEQ ID NO: 973717 - RNA, 19 nt, Homo sapiens
uaaggaagauuuggagacu

SEQ ID NO: 973718 - RNA, 19 nt, Homo sapiens
uccauggacuguaaaauua

SEQ ID NO: 973719 - RNA, 19 nt, Homo sapiens
cauugacccuuuguuuaaa

SEQ ID NO: 973720 - RNA, 19 nt, Homo sapiens
acucuacagucgauuuaaa

SEQ ID NO: 973721 - RNA, 19 nt, Homo sapiens
gagcagcaaaggagaacuu

SEQ ID NO: 973722 - RNA, 19 nt, Homo sapiens
aauggacaaccaaaucuua

SEQ ID NO: 973723 - RNA, 19 nt, Homo sapiens
ccuaagaguuugggaaugg

SEQ ID NO: 973724 - RNA, 19 nt, Homo sapiens
ggagaaauugugcaggaau

SEQ ID NO: 973725 - RNA, 19 nt, Homo sapiens
gacuaaaucgccuucauca

SEQ ID NO: 973726 - RNA, 19 nt, Homo sapiens
cuccggagguggcaguuaa

SEQ ID NO: 973727 - RNA, 19 nt, Homo sapiens
cucauuaaauugugggauu

SEQ ID NO: 973728 - RNA, 19 nt, Homo sapiens
gccaaucaauggacaacca

SEQ ID NO: 973729 - RNA, 19 nt, Homo sapiens
aaauugugcaggaauauga

SEQ ID NO: 973730 - RNA, 19 nt, Homo sapiens
cuuguuccauggacuguaa

SEQ ID NO: 973731 - RNA, 19 nt, Homo sapiens
cucaugcacuugacuaaau

SEQ ID NO: 973732 - RNA, 19 nt, Homo sapiens
gagcacagaacagauuuag

SEQ ID NO: 973733 - RNA, 19 nt, Homo sapiens
ucaguauaauccuaccuau

SEQ ID NO: 973734 - RNA, 19 nt, Homo sapiens
ugggaugucugauaagaag

SEQ ID NO: 973735 - RNA, 19 nt, Homo sapiens
aaucuacggucaacuaugc

SEQ ID NO: 973736 - RNA, 19 nt, Homo sapiens
gaaaacaggaagaagagaa

SEQ ID NO: 973737 - RNA, 19 nt, Homo sapiens
aaacuagcugggaucauuu

SEQ ID NO: 973738 - RNA, 19 nt, Homo sapiens
gcuagcaugccaaucaaug

SEQ ID NO: 973739 - RNA, 19 nt, Homo sapiens
gaauaugaucggcauuugg

SEQ ID NO: 973740 - RNA, 19 nt, Homo sapiens
ucaauccugaugaagauaa

SEQ ID NO: 973741 - RNA, 19 nt, Homo sapiens
ucaaauucaauccugauga

SEQ ID NO: 973742 - RNA, 19 nt, Homo sapiens
acaggacaguguauaucaa

SEQ ID NO: 973743 - RNA, 19 nt, Homo sapiens
ccuaugacagguaucuuaa

SEQ ID NO: 973744 - RNA, 19 nt, Homo sapiens
gaaccagcucauaucaaug

SEQ ID NO: 973745 - RNA, 19 nt, Homo sapiens
guugggauggucucauuaa

SEQ ID NO: 973746 - RNA, 19 nt, Homo sapiens
caagauuuacaaaccgaaa

SEQ ID NO: 973747 - RNA, 19 nt, Homo sapiens
caagugucugcuaaauaua

SEQ ID NO: 973748 - RNA, 19 nt, Homo sapiens
ggaaugagguuucuaagag

SEQ ID NO: 973749 - RNA, 19 nt, Homo sapiens
gagcagagcaagaugaaua

SEQ ID NO: 973750 - RNA, 19 nt, Homo sapiens
uaacgucacuguuuccaaa

SEQ ID NO: 973751 - RNA, 19 nt, Homo sapiens
cgugagagcugaauuguug

SEQ ID NO: 973752 - RNA, 19 nt, Homo sapiens
gaaggacuauccaagcauu

SEQ ID NO: 973753 - RNA, 19 nt, Homo sapiens
gcacaaggucuuccaguuu

SEQ ID NO: 973754 - RNA, 19 nt, Homo sapiens
gagcauuucucacaacaug

SEQ ID NO: 973755 - RNA, 19 nt, Homo sapiens
ugaauaacaugugguguaa

SEQ ID NO: 973756 - RNA, 19 nt, Homo sapiens
ggaugaagcuuugcacuca

SEQ ID NO: 973757 - RNA, 19 nt, Homo sapiens
ccacaaagaggaaauauuc

SEQ ID NO: 973758 - RNA, 19 nt, Homo sapiens
ggaccuggaugaagcuuug

SEQ ID NO: 973759 - RNA, 19 nt, Homo sapiens
gcuaucccguggaagauua

SEQ ID NO: 973760 - RNA, 19 nt, Homo sapiens
gaacaugacucugggacau

SEQ ID NO: 973761 - RNA, 19 nt, Homo sapiens
uagaagaccuuaagaagca

SEQ ID NO: 973762 - RNA, 19 nt, Homo sapiens
ccagacagcucccagacuu

SEQ ID NO: 973763 - RNA, 19 nt, Homo sapiens
gcuuugcacucaaguauug

SEQ ID NO: 973764 - RNA, 19 nt, Homo sapiens
caaagguacucaggaugua

SEQ ID NO: 973765 - RNA, 19 nt, Homo sapiens
cuagagaucuugucguuuc

SEQ ID NO: 973766 - RNA, 19 nt, Homo sapiens
aggcacacaugaauuauaa

SEQ ID NO: 973767 - RNA, 19 nt, Homo sapiens
cagggaagauugaagagaa

SEQ ID NO: 973768 - RNA, 19 nt, Homo sapiens
gaucauaccacauucacuu

SEQ ID NO: 973769 - RNA, 19 nt, Homo sapiens
ccaauccucuguaaauaau

SEQ ID NO: 973770 - RNA, 19 nt, Homo sapiens
ucucaucaccuuuccauua

SEQ ID NO: 973771 - RNA, 19 nt, Homo sapiens
ugagaauucuuccaccuuu

SEQ ID NO: 973772 - RNA, 19 nt, Homo sapiens
caguguguguguauauuua

SEQ ID NO: 973773 - RNA, 19 nt, Homo sapiens
gaacguggcguguugagau

SEQ ID NO: 973774 - RNA, 19 nt, Homo sapiens
gcacugcagcuguuugaaa

SEQ ID NO: 973775 - RNA, 19 nt, Homo sapiens
gagcugaaccaaagaaugu

SEQ ID NO: 973776 - RNA, 19 nt, Homo sapiens
ggacaucacuuccuuuugu

SEQ ID NO: 973777 - RNA, 19 nt, Homo sapiens
acagagaaccgcagucuuu

SEQ ID NO: 973778 - RNA, 19 nt, Homo sapiens
caccaauccucuguaaaua

SEQ ID NO: 973779 - RNA, 19 nt, Homo sapiens
gaagcgauguagccucguu

SEQ ID NO: 973780 - RNA, 19 nt, Homo sapiens
gguguaauucugcuucuua

SEQ ID NO: 973781 - RNA, 19 nt, Homo sapiens
gaauuuccuucgugauguu

SEQ ID NO: 973782 - RNA, 19 nt, Homo sapiens
uguaagguauguuaaguga

SEQ ID NO: 973783 - RNA, 19 nt, Homo sapiens
caaagcaaauuggagcauu

SEQ ID NO: 973784 - RNA, 19 nt, Homo sapiens
gaagagaacgcuugagcau

SEQ ID NO: 973785 - RNA, 19 nt, Homo sapiens
gaaucgcaguuacgcugua

SEQ ID NO: 973786 - RNA, 19 nt, Homo sapiens
guuaaauuguacucccuua

SEQ ID NO: 973787 - RNA, 19 nt, Homo sapiens
gcacuccuaugcaugugaa

SEQ ID NO: 973788 - RNA, 19 nt, Homo sapiens
gcaagggacuauagauacu

SEQ ID NO: 973789 - RNA, 19 nt, Homo sapiens
cagcaagggacuauagaua

SEQ ID NO: 973790 - RNA, 19 nt, Homo sapiens
cagaagcacugcagcuguu

SEQ ID NO: 973791 - RNA, 19 nt, Homo sapiens
gaucacaaggcauucuuaa

SEQ ID NO: 973792 - RNA, 19 nt, Homo sapiens
gcacucaaguauugucaag

SEQ ID NO: 973793 - RNA, 19 nt, Homo sapiens
gaauugaacacuucuugga

SEQ ID NO: 973794 - RNA, 19 nt, Homo sapiens
gaaccuagggcccuuaagu

SEQ ID NO: 973795 - RNA, 19 nt, Homo sapiens
ccaaaugccagacugauug

SEQ ID NO: 973796 - RNA, 19 nt, Homo sapiens
ccaacaaauuccuuccaaa

SEQ ID NO: 973797 - RNA, 19 nt, Homo sapiens
gugcuguggugucugcuua

SEQ ID NO: 973798 - RNA, 19 nt, Homo sapiens
gugaauaacauguggugua

SEQ ID NO: 973799 - RNA, 19 nt, Homo sapiens
ccaccaauccucuguaaau

SEQ ID NO: 973800 - RNA, 19 nt, Homo sapiens
gauaauaaugaccuuggua

SEQ ID NO: 973801 - RNA, 19 nt, Homo sapiens
ggcuagagaucuugucguu

SEQ ID NO: 973802 - RNA, 19 nt, Homo sapiens
ccacuuggcagcuugguuu

SEQ ID NO: 973803 - RNA, 19 nt, Homo sapiens
cuuguggacuuauguuuaa

SEQ ID NO: 973804 - RNA, 19 nt, Homo sapiens
gaaaauugcaugcuugauu

SEQ ID NO: 973805 - RNA, 19 nt, Homo sapiens
guaggaggaucugcaguug

SEQ ID NO: 973806 - RNA, 19 nt, Homo sapiens
gaagucacagggaagauug

SEQ ID NO: 973807 - RNA, 19 nt, Homo sapiens
ggcaauccauccaucaaug

SEQ ID NO: 973808 - RNA, 19 nt, Homo sapiens
caaauuccuuccaaacagu

SEQ ID NO: 973809 - RNA, 19 nt, Homo sapiens
aaaccacuuucugcauuua

SEQ ID NO: 973810 - RNA, 19 nt, Homo sapiens
ucuaggcacacaugaauua

SEQ ID NO: 973811 - RNA, 19 nt, Homo sapiens
ccaggacucugccacucua

SEQ ID NO: 973812 - RNA, 19 nt, Homo sapiens
gcaacaguuucucauucuu

SEQ ID NO: 973813 - RNA, 19 nt, Homo sapiens
ggacgacuuccaugagaaa

SEQ ID NO: 973814 - RNA, 19 nt, Homo sapiens
gcaauccauccaucaauga

SEQ ID NO: 973815 - RNA, 19 nt, Homo sapiens
ucaaugccauccagacaug

SEQ ID NO: 973816 - RNA, 19 nt, Homo sapiens
gagaucuugucguuucuug

SEQ ID NO: 973817 - RNA, 19 nt, Homo sapiens
guguugagauuuggaauga

SEQ ID NO: 973818 - RNA, 19 nt, Homo sapiens
ucagagaaacagaggauuu

SEQ ID NO: 973819 - RNA, 19 nt, Homo sapiens
caaaaccacuuucugcauu

SEQ ID NO: 973820 - RNA, 19 nt, Homo sapiens
gcggacgacuuccaugaga

SEQ ID NO: 973821 - RNA, 19 nt, Homo sapiens
agagcaagaugaauacaau

SEQ ID NO: 973822 - RNA, 19 nt, Homo sapiens
cacaaggucuuccaguuuc

SEQ ID NO: 973823 - RNA, 19 nt, Homo sapiens
caaaggagcagagcaagau

SEQ ID NO: 973824 - RNA, 19 nt, Homo sapiens
gcaaaggagcagagcaaga

SEQ ID NO: 973825 - RNA, 19 nt, Homo sapiens
caccaccaauccucuguaa

SEQ ID NO: 973826 - RNA, 19 nt, Homo sapiens
caguuacgcuguacuuuua

SEQ ID NO: 973827 - RNA, 19 nt, Homo sapiens
ggacacaacccuuuuauag

SEQ ID NO: 973828 - RNA, 19 nt, Homo sapiens
aagcaacaguuucucauuc

SEQ ID NO: 973829 - RNA, 19 nt, Homo sapiens
caacaacacccucaacaac

SEQ ID NO: 973830 - RNA, 19 nt, Homo sapiens
ggacuucauccacgccuuu

SEQ ID NO: 973831 - RNA, 19 nt, Homo sapiens
aagcaggaguugcauaugu

SEQ ID NO: 973832 - RNA, 19 nt, Homo sapiens
guugugaccguguuaaauu

SEQ ID NO: 973833 - RNA, 19 nt, Homo sapiens
ggaagucacagggaagauu

SEQ ID NO: 973834 - RNA, 19 nt, Homo sapiens
cagcggcucuuguagaaca

SEQ ID NO: 973835 - RNA, 19 nt, Homo sapiens
uacaagaucaucagagaaa

SEQ ID NO: 973836 - RNA, 19 nt, Homo sapiens
cuagggcccuuaagugaga

SEQ ID NO: 973837 - RNA, 19 nt, Homo sapiens
aggaggaucugcaguuguu

SEQ ID NO: 973838 - RNA, 19 nt, Homo sapiens
gcagucccaucccuucugu

SEQ ID NO: 973839 - RNA, 19 nt, Homo sapiens
ggcagcaccuucaucuuuc

SEQ ID NO: 973840 - RNA, 19 nt, Homo sapiens
uggcagcaccuucaucuuu

SEQ ID NO: 973841 - RNA, 19 nt, Homo sapiens
ggacguucuucuacgacaa

SEQ ID NO: 973842 - RNA, 19 nt, Homo sapiens
ggaccacagaccucuauga

SEQ ID NO: 973843 - RNA, 19 nt, Homo sapiens
ggacuauccaagcauuaaa

SEQ ID NO: 973844 - RNA, 19 nt, Homo sapiens
ucuguucaguugcuaauga

SEQ ID NO: 973845 - RNA, 19 nt, Homo sapiens
uuucugaccuccuccuauu

SEQ ID NO: 973846 - RNA, 19 nt, Homo sapiens
cagacuaucucuacuuugc

SEQ ID NO: 973847 - RNA, 19 nt, Homo sapiens
guacucagacuaucucuac

SEQ ID NO: 973848 - RNA, 19 nt, Homo sapiens
ccaauuaacuugucauuuc

SEQ ID NO: 973849 - RNA, 19 nt, Homo sapiens
ggaaugagguuucuaagag

SEQ ID NO: 973850 - RNA, 19 nt, Homo sapiens
gagcagagcaagaugaaua

SEQ ID NO: 973851 - RNA, 19 nt, Homo sapiens
uaacgucacuguuuccaaa

SEQ ID NO: 973852 - RNA, 19 nt, Homo sapiens
cgugagagcugaauuguug

SEQ ID NO: 973853 - RNA, 19 nt, Homo sapiens
gaaggacuauccaagcauu

SEQ ID NO: 973854 - RNA, 19 nt, Homo sapiens
gcacaaggucuuccaguuu

SEQ ID NO: 973855 - RNA, 19 nt, Homo sapiens
gagcauuucucacaacaug

SEQ ID NO: 973856 - RNA, 19 nt, Homo sapiens
ugaauaacaugugguguaa

SEQ ID NO: 973857 - RNA, 19 nt, Homo sapiens
ggaugaagcuuugcacuca

SEQ ID NO: 973858 - RNA, 19 nt, Homo sapiens
ggaccuggaugaagcuuug

SEQ ID NO: 973859 - RNA, 19 nt, Homo sapiens
gcuaucccguggaagauua

SEQ ID NO: 973860 - RNA, 19 nt, Homo sapiens
uagaagaccuuaagaagca

SEQ ID NO: 973861 - RNA, 19 nt, Homo sapiens
ccagacagcucccagacuu

SEQ ID NO: 973862 - RNA, 19 nt, Homo sapiens
gcuuugcacucaaguauug

SEQ ID NO: 973863 - RNA, 19 nt, Homo sapiens
cuagagaucuugucguuuc

SEQ ID NO: 973864 - RNA, 19 nt, Homo sapiens
aggcacacaugaauuauaa

SEQ ID NO: 973865 - RNA, 19 nt, Homo sapiens
cagggaagauugaagagaa

SEQ ID NO: 973866 - RNA, 19 nt, Homo sapiens
gaucauaccacauucacuu

SEQ ID NO: 973867 - RNA, 19 nt, Homo sapiens
ccaauccucuguaaauaau

SEQ ID NO: 973868 - RNA, 19 nt, Homo sapiens
ucucaucaccuuuccauua

SEQ ID NO: 973869 - RNA, 19 nt, Homo sapiens
caguguguguguauauuua

SEQ ID NO: 973870 - RNA, 19 nt, Homo sapiens
gagcugaaccaaagaaugu

SEQ ID NO: 973871 - RNA, 19 nt, Homo sapiens
gaacguggcguguugagau

SEQ ID NO: 973872 - RNA, 19 nt, Homo sapiens
gcacugcagcuguuugaaa

SEQ ID NO: 973873 - RNA, 19 nt, Homo sapiens
acagagaaccgcagucuuu

SEQ ID NO: 973874 - RNA, 19 nt, Homo sapiens
caccaauccucuguaaaua

SEQ ID NO: 973875 - RNA, 19 nt, Homo sapiens
gaagcgauguagccucguu

SEQ ID NO: 973876 - RNA, 19 nt, Homo sapiens
gguguaauucugcuucuua

SEQ ID NO: 973877 - RNA, 19 nt, Homo sapiens
gaauuuccuucgugauguu

SEQ ID NO: 973878 - RNA, 19 nt, Homo sapiens
uguaagguauguuaaguga

SEQ ID NO: 973879 - RNA, 19 nt, Homo sapiens
caaagcaaauuggagcauu

SEQ ID NO: 973880 - RNA, 19 nt, Homo sapiens
gaagagaacgcuugagcau

SEQ ID NO: 973881 - RNA, 19 nt, Homo sapiens
aagcagaagugcauauguu

SEQ ID NO: 973882 - RNA, 19 nt, Homo sapiens
gaaucgcaguuacgcugua

SEQ ID NO: 973883 - RNA, 19 nt, Homo sapiens
guuaaauuguacucccuua

SEQ ID NO: 973884 - RNA, 19 nt, Homo sapiens
gcacuccuaugcaugugaa

SEQ ID NO: 973885 - RNA, 19 nt, Homo sapiens
gcaagggacuauagauacu

SEQ ID NO: 973886 - RNA, 19 nt, Homo sapiens
cagcaagggacuauagaua

SEQ ID NO: 973887 - RNA, 19 nt, Homo sapiens
cagaagcacugcagcuguu

SEQ ID NO: 973888 - RNA, 19 nt, Homo sapiens
gaucacaaggcauucuuaa

SEQ ID NO: 973889 - RNA, 19 nt, Homo sapiens
gcacucaaguauugucaag

SEQ ID NO: 973890 - RNA, 19 nt, Homo sapiens
gaauugaacacuucuugga

SEQ ID NO: 973891 - RNA, 19 nt, Homo sapiens
gaaccuagggcccuuaagu

SEQ ID NO: 973892 - RNA, 19 nt, Homo sapiens
ccaaaugccagacugauug

SEQ ID NO: 973893 - RNA, 19 nt, Homo sapiens
ccaacaaauuccuuccaaa

SEQ ID NO: 973894 - RNA, 19 nt, Homo sapiens
gugcuguggugucugcuua

SEQ ID NO: 973895 - RNA, 19 nt, Homo sapiens
gugaauaacauguggugua

SEQ ID NO: 973896 - RNA, 19 nt, Homo sapiens
ccaccaauccucuguaaau

SEQ ID NO: 973897 - RNA, 19 nt, Homo sapiens
gauaauaaugaccuuggua

SEQ ID NO: 973898 - RNA, 19 nt, Homo sapiens
ggcuagagaucuugucguu

SEQ ID NO: 973899 - RNA, 19 nt, Homo sapiens
ccacuuggcagcuugguuu

SEQ ID NO: 973900 - RNA, 19 nt, Homo sapiens
cuuguggacuuauguuuaa

SEQ ID NO: 973901 - RNA, 19 nt, Homo sapiens
gaaaauugcaugcuugauu

SEQ ID NO: 973902 - RNA, 19 nt, Homo sapiens
guaggaggaucugcaguug

SEQ ID NO: 973903 - RNA, 19 nt, Homo sapiens
gaagucacagggaagauug

SEQ ID NO: 973904 - RNA, 19 nt, Homo sapiens
caaauuccuuccaaacagu

SEQ ID NO: 973905 - RNA, 19 nt, Homo sapiens
aaaccacuuucugcauuua

SEQ ID NO: 973906 - RNA, 19 nt, Homo sapiens
ucuaggcacacaugaauua

SEQ ID NO: 973907 - RNA, 19 nt, Homo sapiens
ccaggacucugccacucua

SEQ ID NO: 973908 - RNA, 19 nt, Homo sapiens
gcaacaguuucucauucuu

SEQ ID NO: 973909 - RNA, 19 nt, Homo sapiens
ggacgacuuccaugagaaa

SEQ ID NO: 973910 - RNA, 19 nt, Homo sapiens
ucaaugccauccagacaug

SEQ ID NO: 973911 - RNA, 19 nt, Homo sapiens
gagaucuugucguuucuug

SEQ ID NO: 973912 - RNA, 19 nt, Homo sapiens
guguugagauuuggaauga

SEQ ID NO: 973913 - RNA, 19 nt, Homo sapiens
ucagagaaacagaggauuu

SEQ ID NO: 973914 - RNA, 19 nt, Homo sapiens
caaaaccacuuucugcauu

SEQ ID NO: 973915 - RNA, 19 nt, Homo sapiens
gcggacgacuuccaugaga

SEQ ID NO: 973916 - RNA, 19 nt, Homo sapiens
agagcaagaugaauacaau

SEQ ID NO: 973917 - RNA, 19 nt, Homo sapiens
cacaaggucuuccaguuuc

SEQ ID NO: 973918 - RNA, 19 nt, Homo sapiens
guacaccaaugcacaaggu

SEQ ID NO: 973919 - RNA, 19 nt, Homo sapiens
caaaggagcagagcaagau

SEQ ID NO: 973920 - RNA, 19 nt, Homo sapiens
gcaaaggagcagagcaaga

SEQ ID NO: 973921 - RNA, 19 nt, Homo sapiens
caccaccaauccucuguaa

SEQ ID NO: 973922 - RNA, 19 nt, Homo sapiens
caguuacgcuguacuuuua

SEQ ID NO: 973923 - RNA, 19 nt, Homo sapiens
ggacacaacccuuuuauag

SEQ ID NO: 973924 - RNA, 19 nt, Homo sapiens
aagcaacaguuucucauuc

SEQ ID NO: 973925 - RNA, 19 nt, Homo sapiens
caacaacacccucaacaac

SEQ ID NO: 973926 - RNA, 19 nt, Homo sapiens
ggacuucauccacgccuuu

SEQ ID NO: 973927 - RNA, 19 nt, Homo sapiens
guugugaccguguuaaauu

SEQ ID NO: 973928 - RNA, 19 nt, Homo sapiens
ggaagucacagggaagauu

SEQ ID NO: 973929 - RNA, 19 nt, Homo sapiens
uacaagaucaucagagaaa

SEQ ID NO: 973930 - RNA, 19 nt, Homo sapiens
cuagggcccuuaagugaga

SEQ ID NO: 973931 - RNA, 19 nt, Homo sapiens
aggaggaucugcaguuguu

SEQ ID NO: 973932 - RNA, 19 nt, Homo sapiens
gcagucccaucccuucugu

SEQ ID NO: 973933 - RNA, 19 nt, Homo sapiens
ggcagcaccuucaucuuuc

SEQ ID NO: 973934 - RNA, 19 nt, Homo sapiens
uggcagcaccuucaucuuu

SEQ ID NO: 973935 - RNA, 19 nt, Homo sapiens
ggacguucuucuacgacaa

SEQ ID NO: 973936 - RNA, 19 nt, Homo sapiens
ggaccacagaccucuauga

SEQ ID NO: 973937 - RNA, 19 nt, Homo sapiens
ggacuauccaagcauuaaa

SEQ ID NO: 973938 - RNA, 19 nt, Homo sapiens
ucuguucaguugcuaauga

SEQ ID NO: 973939 - RNA, 19 nt, Homo sapiens
uuucugaccuccuccuauu

SEQ ID NO: 973940 - RNA, 19 nt, Homo sapiens
cagacuaucucuacuuugc

SEQ ID NO: 973941 - RNA, 19 nt, Homo sapiens
guacucagacuaucucuac

SEQ ID NO: 973942 - RNA, 19 nt, Homo sapiens
caacaaauuccuuccaaac

SEQ ID NO: 973943 - RNA, 19 nt, Homo sapiens
augaggcacugcauuaauu

SEQ ID NO: 973944 - RNA, 19 nt, Homo sapiens
gaugaagcuuugcacucaa

SEQ ID NO: 973945 - RNA, 19 nt, Homo sapiens
ucacagggaagauugaaga

SEQ ID NO: 973946 - RNA, 19 nt, Homo sapiens
gaucuugucguuucuugga

SEQ ID NO: 973947 - RNA, 19 nt, Homo sapiens
gacuaucucuacuuugcaa

SEQ ID NO: 973948 - RNA, 19 nt, Homo sapiens
aggcagagcugauggaauu

SEQ ID NO: 973949 - RNA, 19 nt, Homo sapiens
gcuacugccucacaaguuu

SEQ ID NO: 973950 - RNA, 19 nt, Homo sapiens
caucugacccuaacugaaa

SEQ ID NO: 973951 - RNA, 19 nt, Homo sapiens
gagggcagccguuggcaua

SEQ ID NO: 973952 - RNA, 19 nt, Homo sapiens
agaaggaccugguguugga

SEQ ID NO: 973953 - RNA, 19 nt, Homo sapiens
ggaaccagcagcaugagaa

SEQ ID NO: 973954 - RNA, 19 nt, Homo sapiens
aaacccagccuccuaagaa

SEQ ID NO: 973955 - RNA, 19 nt, Homo sapiens
cagaagguguucccugugu

SEQ ID NO: 973956 - RNA, 19 nt, Homo sapiens
uggaacagaucccagaaau

SEQ ID NO: 973957 - RNA, 19 nt, Homo sapiens
caaaugagggcugcaguug

SEQ ID NO: 973958 - RNA, 19 nt, Homo sapiens
ucuaagcgcugcucacgau

SEQ ID NO: 973959 - RNA, 19 nt, Homo sapiens
gcagugcagaggcuucuaa

SEQ ID NO: 973960 - RNA, 19 nt, Homo sapiens
gcugauggaauuugagauu

SEQ ID NO: 973961 - RNA, 19 nt, Homo sapiens
uggagaagcugaacaugca

SEQ ID NO: 973962 - RNA, 19 nt, Homo sapiens
gaaacccagccuccuaaga

SEQ ID NO: 973963 - RNA, 19 nt, Homo sapiens
uaaagcugcugaccgaucu

SEQ ID NO: 973964 - RNA, 19 nt, Homo sapiens
cagagcugauggaauuuga

SEQ ID NO: 973965 - RNA, 19 nt, Homo sapiens
ccacgaggccuccaucauc

SEQ ID NO: 973966 - RNA, 19 nt, Homo sapiens
uaagaaggaccugguguug

SEQ ID NO: 973967 - RNA, 19 nt, Homo sapiens
gaaggcccucucaguacua

SEQ ID NO: 973968 - RNA, 19 nt, Homo sapiens
gguggaaccagcagcauga

SEQ ID NO: 973969 - RNA, 19 nt, Homo sapiens
cacgaggccuccaucauca

SEQ ID NO: 973970 - RNA, 19 nt, Homo sapiens
gaagguguucccuguguuc

SEQ ID NO: 973971 - RNA, 19 nt, Homo sapiens
gagcugauggaauuugaga

SEQ ID NO: 973972 - RNA, 19 nt, Homo sapiens
aauuugagauugcacugaa

SEQ ID NO: 973973 - RNA, 19 nt, Homo sapiens
caagggaauccacccagaa

SEQ ID NO: 973974 - RNA, 19 nt, Homo sapiens
guggacagccucucucuca

SEQ ID NO: 973975 - RNA, 19 nt, Homo sapiens
agacaguguucuuccacaa

SEQ ID NO: 973976 - RNA, 19 nt, Homo sapiens
gaugccagaaugaguggua

SEQ ID NO: 973977 - RNA, 19 nt, Homo sapiens
gcagagcugauggaauuug

SEQ ID NO: 973978 - RNA, 19 nt, Homo sapiens
ccaaaugagggcugcaguu

SEQ ID NO: 973979 - RNA, 19 nt, Homo sapiens
ggaaaagcauggaaagacu

SEQ ID NO: 973980 - RNA, 19 nt, Homo sapiens
gaauuugagauugcacuga

SEQ ID NO: 973981 - RNA, 19 nt, Homo sapiens
gaagcaggcagagcugaug

SEQ ID NO: 973982 - RNA, 19 nt, Homo sapiens
ggaacagaucccagaaauc

SEQ ID NO: 973983 - RNA, 19 nt, Homo sapiens
cagaaugagugguauugcu

SEQ ID NO: 973984 - RNA, 19 nt, Homo sapiens
gccaagggacggcuacuca

SEQ ID NO: 973985 - RNA, 19 nt, Homo sapiens
ugaaggcccucucaguacu

SEQ ID NO: 973986 - RNA, 19 nt, Homo sapiens
gauggaauuugagauugca

SEQ ID NO: 973987 - RNA, 19 nt, Homo sapiens
cuaagaaggaccugguguu

SEQ ID NO: 973988 - RNA, 19 nt, Homo sapiens
caagucaagcacugggaaa

SEQ ID NO: 973989 - RNA, 19 nt, Homo sapiens
gcagggagugccaagucaa

SEQ ID NO: 973990 - RNA, 19 nt, Homo sapiens
gcgcgcuacugccucacaa

SEQ ID NO: 973991 - RNA, 19 nt, Homo sapiens
gggaauccacccagaaugc

SEQ ID NO: 973992 - RNA, 19 nt, Homo sapiens
gcucacgaugccagaauga

SEQ ID NO: 973993 - RNA, 19 nt, Homo sapiens
caaguuggacgggcaagug

SEQ ID NO: 973994 - RNA, 19 nt, Homo sapiens
accuugagccguaugcuua

SEQ ID NO: 973995 - RNA, 19 nt, Homo sapiens
cugauggaauuugagauug

SEQ ID NO: 973996 - RNA, 19 nt, Homo sapiens
gcaggcagagcugauggaa

SEQ ID NO: 973997 - RNA, 19 nt, Homo sapiens
ggacuugguagacuauugc

SEQ ID NO: 973998 - RNA, 19 nt, Homo sapiens
cgauaugggagaccuggaa

SEQ ID NO: 973999 - RNA, 19 nt, Homo sapiens
gcugaucgcaguggagaug

SEQ ID NO: 974000 - RNA, 19 nt, Homo sapiens
uguacaaccugcugcuaag

SEQ ID NO: 974001 - RNA, 19 nt, Homo sapiens
aaguguggaucgcccugua

SEQ ID NO: 974002 - RNA, 19 nt, Homo sapiens
caaggaggugugugaguca

SEQ ID NO: 974003 - RNA, 19 nt, Homo sapiens
aaugagggcugcaguugcu

SEQ ID NO: 974004 - RNA, 19 nt, Homo sapiens
gccagaaugagugguauug

SEQ ID NO: 974005 - RNA, 19 nt, Homo sapiens
agaagguguucccuguguu

SEQ ID NO: 974006 - RNA, 19 nt, Homo sapiens
ucaguacuacgcuacauca

SEQ ID NO: 974007 - RNA, 19 nt, Homo sapiens
uggacuugguagacuauug

SEQ ID NO: 974008 - RNA, 19 nt, Homo sapiens
cugaaacccagccuccuaa

SEQ ID NO: 974009 - RNA, 19 nt, Homo sapiens
caagggacggcuacucaag

SEQ ID NO: 974010 - RNA, 19 nt, Homo sapiens
gagcggcuggagcgagaaa

SEQ ID NO: 974011 - RNA, 19 nt, Homo sapiens
uggcccacuugcagaguuu

SEQ ID NO: 974012 - RNA, 19 nt, Homo sapiens
ggaucgcccuguacaaccu

SEQ ID NO: 974013 - RNA, 19 nt, Homo sapiens
caguggagauguggaagca

SEQ ID NO: 974014 - RNA, 19 nt, Homo sapiens
gaaccagcagcaugagaac

SEQ ID NO: 974015 - RNA, 19 nt, Homo sapiens
ggaauccacccagaaugca

SEQ ID NO: 974016 - RNA, 19 nt, Homo sapiens
ccaagggacggcuacucaa

SEQ ID NO: 974017 - RNA, 19 nt, Homo sapiens
ugauggaauuugagauugc

SEQ ID NO: 974018 - RNA, 19 nt, Homo sapiens
ucuuggacuugguagacua

SEQ ID NO: 974019 - RNA, 19 nt, Homo sapiens
cagaacaccuuccccaucu

SEQ ID NO: 974020 - RNA, 19 nt, Homo sapiens
gaaaagcauggaaagacuu

SEQ ID NO: 974021 - RNA, 19 nt, Homo sapiens
gaacaaagccuuccuggau

SEQ ID NO: 974022 - RNA, 19 nt, Homo sapiens
ggacacaucucccugcauu

SEQ ID NO: 974023 - RNA, 19 nt, Homo sapiens
gaagauagccuguguguag

SEQ ID NO: 974024 - RNA, 19 nt, Homo sapiens
gagaauuccuguccacuga

SEQ ID NO: 974025 - RNA, 19 nt, Homo sapiens
gcaguaacaucaccucuuc

SEQ ID NO: 974026 - RNA, 19 nt, Homo sapiens
ggaacaagguggugucaag

SEQ ID NO: 974027 - RNA, 19 nt, Homo sapiens
gaaccaaacuaauuaucca

SEQ ID NO: 974028 - RNA, 19 nt, Homo sapiens
uaacugcacuugcuuuauc

SEQ ID NO: 974029 - RNA, 19 nt, Homo sapiens
ccagugaacuuacaagcaa

SEQ ID NO: 974030 - RNA, 19 nt, Homo sapiens
ccaaggaagugaaagucua

SEQ ID NO: 974031 - RNA, 19 nt, Homo sapiens
acacagacaccgacaauuu

SEQ ID NO: 974032 - RNA, 19 nt, Homo sapiens
ugaaggaacugagaaacaa

SEQ ID NO: 974033 - RNA, 19 nt, Homo sapiens
auaguuaucugaucuguga

SEQ ID NO: 974034 - RNA, 19 nt, Homo sapiens
ggauaggacugguggaaca

SEQ ID NO: 974035 - RNA, 19 nt, Homo sapiens
guacuuaggauucaauaga

SEQ ID NO: 974036 - RNA, 19 nt, Homo sapiens
ccagauaaaccaagugaaa

SEQ ID NO: 974037 - RNA, 19 nt, Homo sapiens
acaagguggugucaagaua

SEQ ID NO: 974038 - RNA, 19 nt, Homo sapiens
gcuggacgcugucuggauu

SEQ ID NO: 974039 - RNA, 19 nt, Homo sapiens
gcacuugcuuuaucuccuu

SEQ ID NO: 974040 - RNA, 19 nt, Homo sapiens
agaaacauguacaggguaa

SEQ ID NO: 974041 - RNA, 19 nt, Homo sapiens
gagaaaagauggucugcuu

SEQ ID NO: 974042 - RNA, 19 nt, Homo sapiens
gauagccuguguguaguuu

SEQ ID NO: 974043 - RNA, 19 nt, Homo sapiens
gcuuucccaugcauacuua

SEQ ID NO: 974044 - RNA, 19 nt, Homo sapiens
gaaacaaggacaccaacau

SEQ ID NO: 974045 - RNA, 19 nt, Homo sapiens
uuacgcagguuauaguuau

SEQ ID NO: 974046 - RNA, 19 nt, Homo sapiens
caacggaggccaagaccaa

SEQ ID NO: 974047 - RNA, 19 nt, Homo sapiens
uaacaucaccucuucaucu

SEQ ID NO: 974048 - RNA, 19 nt, Homo sapiens
gaauuccuguccacugaug

SEQ ID NO: 974049 - RNA, 19 nt, Homo sapiens
caauuuggguauucggauu

SEQ ID NO: 974050 - RNA, 19 nt, Homo sapiens
ggagggagaacucauuuua

SEQ ID NO: 974051 - RNA, 19 nt, Homo sapiens
gcucagcguuggaaguuca

SEQ ID NO: 974052 - RNA, 19 nt, Homo sapiens
aaagaccggacuaccauua

SEQ ID NO: 974053 - RNA, 19 nt, Homo sapiens
acaaagccuuccuggauug

SEQ ID NO: 974054 - RNA, 19 nt, Homo sapiens
uguacaggguaaacaauuu

SEQ ID NO: 974055 - RNA, 19 nt, Homo sapiens
uagccuguguguaguuuaa

SEQ ID NO: 974056 - RNA, 19 nt, Homo sapiens
ugaaggcaccgaucucaaa

SEQ ID NO: 974057 - RNA, 19 nt, Homo sapiens
caaacuaauuauccaugga

SEQ ID NO: 974058 - RNA, 19 nt, Homo sapiens
gaacaagguggugucaaga

SEQ ID NO: 974059 - RNA, 19 nt, Homo sapiens
gcgcuuggaugcuggagau

SEQ ID NO: 974060 - RNA, 19 nt, Homo sapiens
gcaacgaaugcuaauguga

SEQ ID NO: 974061 - RNA, 19 nt, Homo sapiens
caagcaagugugacuguuu

SEQ ID NO: 974062 - RNA, 19 nt, Homo sapiens
gcaacgcuaugggaaagga

SEQ ID NO: 974063 - RNA, 19 nt, Homo sapiens
aacaaagccuuccuggauu

SEQ ID NO: 974064 - RNA, 19 nt, Homo sapiens
caacgaaugcuaaugugau

SEQ ID NO: 974065 - RNA, 19 nt, Homo sapiens
aacaucaccucuucaucua

SEQ ID NO: 974066 - RNA, 19 nt, Homo sapiens
agaccggacuaccauuauu

SEQ ID NO: 974067 - RNA, 19 nt, Homo sapiens
gauaaaccaagugaaauuc

SEQ ID NO: 974068 - RNA, 19 nt, Homo sapiens
gcagcaacgcuaugggaaa

SEQ ID NO: 974069 - RNA, 19 nt, Homo sapiens
ucuaagaucaccauaccua

SEQ ID NO: 974070 - RNA, 19 nt, Homo sapiens
ucagcgcccuggagaauuc

SEQ ID NO: 974071 - RNA, 19 nt, Homo sapiens
gccguggacuggauuuaug

SEQ ID NO: 974072 - RNA, 19 nt, Homo sapiens
gugugcagcuuauuguaga

SEQ ID NO: 974073 - RNA, 19 nt, Homo sapiens
caucaccucuucaucuaag

SEQ ID NO: 974074 - RNA, 19 nt, Homo sapiens
gguuauaguuaucugaucu

SEQ ID NO: 974075 - RNA, 19 nt, Homo sapiens
ggauugacacauuuauuag

SEQ ID NO: 974076 - RNA, 19 nt, Homo sapiens
cuacuucucagcugugaaa

SEQ ID NO: 974077 - RNA, 19 nt, Homo sapiens
cugggaaccaaacuaauua

SEQ ID NO: 974078 - RNA, 19 nt, Homo sapiens
aagcaagugugacuguuuc

SEQ ID NO: 974079 - RNA, 19 nt, Homo sapiens
gcagugaccuccaaaacuc

SEQ ID NO: 974080 - RNA, 19 nt, Homo sapiens
gaccggacuaccauuauug

SEQ ID NO: 974081 - RNA, 19 nt, Homo sapiens
cagcaacgcuaugggaaag

SEQ ID NO: 974082 - RNA, 19 nt, Homo sapiens
ggacaccaacaucgagguu

SEQ ID NO: 974083 - RNA, 19 nt, Homo sapiens
ccacacagacaccgacaau

SEQ ID NO: 974084 - RNA, 19 nt, Homo sapiens
gugcaacgaaugcuaaugu

SEQ ID NO: 974085 - RNA, 19 nt, Homo sapiens
aacgaaugcuaaugugauu

SEQ ID NO: 974086 - RNA, 19 nt, Homo sapiens
ugagagagaggugugauga

SEQ ID NO: 974087 - RNA, 19 nt, Homo sapiens
caccauaccuaagcagcaa

SEQ ID NO: 974088 - RNA, 19 nt, Homo sapiens
aaacaaggacaccaacauc

SEQ ID NO: 974089 - RNA, 19 nt, Homo sapiens
uggauugcuuuaacccuuu

SEQ ID NO: 974090 - RNA, 19 nt, Homo sapiens
cuuccuggauugacacauu

SEQ ID NO: 974091 - RNA, 19 nt, Homo sapiens
gacgcugucuggauugcuu

SEQ ID NO: 974092 - RNA, 19 nt, Homo sapiens
cacagacaccgacaauuug

SEQ ID NO: 974093 - RNA, 19 nt, Homo sapiens
auacuuaacugcacuugcu

SEQ ID NO: 974094 - RNA, 19 nt, Homo sapiens
gcugugcaccucuacauca

SEQ ID NO: 974095 - RNA, 19 nt, Homo sapiens
ucugggaaccaaacuaauu

SEQ ID NO: 974096 - RNA, 19 nt, Homo sapiens
gaugugugugugcagcuua

SEQ ID NO: 974097 - RNA, 19 nt, Homo sapiens
gugugacuguuuccuguga

SEQ ID NO: 974098 - RNA, 19 nt, Homo sapiens
ggaagcagugaccuccaaa

SEQ ID NO: 974099 - RNA, 19 nt, Homo sapiens
gaaggcaccgaucucaaag

SEQ ID NO: 974100 - RNA, 19 nt, Homo sapiens
gaagccauccacacagaca

SEQ ID NO: 974101 - RNA, 19 nt, Homo sapiens
cuacaggagucuacuucuc

SEQ ID NO: 974102 - RNA, 19 nt, Homo sapiens
ggagaacucauuuuacaga

SEQ ID NO: 974103 - RNA, 19 nt, Homo sapiens
caucagcgcccuggagaau

SEQ ID NO: 974104 - RNA, 19 nt, Homo sapiens
ccacaucauugguguuagc

SEQ ID NO: 974105 - RNA, 19 nt, Homo sapiens
ccuugggcauucguacuua

SEQ ID NO: 974106 - RNA, 19 nt, Homo sapiens
gaacucauuuuacagaacu

SEQ ID NO: 974107 - RNA, 19 nt, Homo sapiens
gaggugugaugagggaugu

SEQ ID NO: 974108 - RNA, 19 nt, Homo sapiens
ccaaaacucuggguucaau

SEQ ID NO: 974109 - RNA, 19 nt, Homo sapiens
gaucucaaaguccaguuuc

SEQ ID NO: 974110 - RNA, 19 nt, Homo sapiens
gaggccagcugggacagau

SEQ ID NO: 974111 - RNA, 19 nt, Homo sapiens
gggcauucguacuuaggau

SEQ ID NO: 974112 - RNA, 19 nt, Homo sapiens
uacagaacuugguuuccuu

SEQ ID NO: 974113 - RNA, 19 nt, Homo sapiens
ggaugugugugugcagcuu

SEQ ID NO: 974114 - RNA, 19 nt, Homo sapiens
cagauaaaccaagugaaau

SEQ ID NO: 974115 - RNA, 19 nt, Homo sapiens
ggaaccaaacuaauuaucc

SEQ ID NO: 974116 - RNA, 19 nt, Homo sapiens
cuuaacugcacuugcuuua

SEQ ID NO: 974117 - RNA, 19 nt, Homo sapiens
gauggucugcuuaccugaa

SEQ ID NO: 974118 - RNA, 19 nt, Homo sapiens
uaagaucaccauaccuaag

SEQ ID NO: 974119 - RNA, 19 nt, Homo sapiens
cuaagaucaccauaccuaa

SEQ ID NO: 974120 - RNA, 19 nt, Homo sapiens
gacaccaacaucgagguua

SEQ ID NO: 974121 - RNA, 19 nt, Homo sapiens
gaacaaaucuugaugugaa

SEQ ID NO: 974122 - RNA, 19 nt, Homo sapiens
gcacuuauauacuggauua

SEQ ID NO: 974123 - RNA, 19 nt, Homo sapiens
ggaaauggcuucauccaaa

SEQ ID NO: 974124 - RNA, 19 nt, Homo sapiens
ggacaggaaucucccauua

SEQ ID NO: 974125 - RNA, 19 nt, Homo sapiens
caacuuagaucuccugaaa

SEQ ID NO: 974126 - RNA, 19 nt, Homo sapiens
gaaauugacuuaccaagau

SEQ ID NO: 974127 - RNA, 19 nt, Homo sapiens
gaacgaagguggcuugaug

SEQ ID NO: 974128 - RNA, 19 nt, Homo sapiens
gaaauauccucaagugaaa

SEQ ID NO: 974129 - RNA, 19 nt, Homo sapiens
gcagggcagugaagaauua

SEQ ID NO: 974130 - RNA, 19 nt, Homo sapiens
gaacagcccuuacaugcaa

SEQ ID NO: 974131 - RNA, 19 nt, Homo sapiens
ccaggaaccuccaguaaua

SEQ ID NO: 974132 - RNA, 19 nt, Homo sapiens
cagcaaagguucuuguaua

SEQ ID NO: 974133 - RNA, 19 nt, Homo sapiens
gaagacagcuuuccaucga

SEQ ID NO: 974134 - RNA, 19 nt, Homo sapiens
cugagaagcugaacaaaua

SEQ ID NO: 974135 - RNA, 19 nt, Homo sapiens
gaagcaagguugaauuguu

SEQ ID NO: 974136 - RNA, 19 nt, Homo sapiens
gaaauaggacuuacugaaa

SEQ ID NO: 974137 - RNA, 19 nt, Homo sapiens
caucauggcuguagagaaa

SEQ ID NO: 974138 - RNA, 19 nt, Homo sapiens
gauggagccucauuugaua

SEQ ID NO: 974139 - RNA, 19 nt, Homo sapiens
ggaacaggcuacuauuaaa

SEQ ID NO: 974140 - RNA, 19 nt, Homo sapiens
ggaaguuaaugcugucaua

SEQ ID NO: 974141 - RNA, 19 nt, Homo sapiens
ggauacaccucaacuagaa

SEQ ID NO: 974142 - RNA, 19 nt, Homo sapiens
gaauacaccuguucaaagu

SEQ ID NO: 974143 - RNA, 19 nt, Homo sapiens
gcaaauagcauaagagcaa

SEQ ID NO: 974144 - RNA, 19 nt, Homo sapiens
gaaccuugcuguaaauaau

SEQ ID NO: 974145 - RNA, 19 nt, Homo sapiens
gcaauuaccaucuuagaaa

SEQ ID NO: 974146 - RNA, 19 nt, Homo sapiens
aaagaaagcugcuguuauc

SEQ ID NO: 974147 - RNA, 19 nt, Homo sapiens
ggacuggaaugccuugaaa

SEQ ID NO: 974148 - RNA, 19 nt, Homo sapiens
gauuguagguuacuuagaa

SEQ ID NO: 974149 - RNA, 19 nt, Homo sapiens
gaaauacgcagaacacaga

SEQ ID NO: 974150 - RNA, 19 nt, Homo sapiens
cagguaugcuugagaaaua

SEQ ID NO: 974151 - RNA, 19 nt, Homo sapiens
gaaacaaaccuuaaugcaa

SEQ ID NO: 974152 - RNA, 19 nt, Homo sapiens
gaucaauccuaacugaauu

SEQ ID NO: 974153 - RNA, 19 nt, Homo sapiens
gaaagcugcuguuaucauc

SEQ ID NO: 974154 - RNA, 19 nt, Homo sapiens
gcaguugcauuuucaauua

SEQ ID NO: 974155 - RNA, 19 nt, Homo sapiens
ggaaauggagugaaucuga

SEQ ID NO: 974156 - RNA, 19 nt, Homo sapiens
ggauuuagaugauacagau

SEQ ID NO: 974157 - RNA, 19 nt, Homo sapiens
ggaaugccuugaaaucuau

SEQ ID NO: 974158 - RNA, 19 nt, Homo sapiens
ggaccgggauagagacuuu

SEQ ID NO: 974159 - RNA, 19 nt, Homo sapiens
gaaaugaggaggaguagug

SEQ ID NO: 974160 - RNA, 19 nt, Homo sapiens
ccaagcaccuccacuauuc

SEQ ID NO: 974161 - RNA, 19 nt, Homo sapiens
cuaaacagauucucaaaca

SEQ ID NO: 974162 - RNA, 19 nt, Homo sapiens
ugaggcagcuuaacaauca

SEQ ID NO: 974163 - RNA, 19 nt, Homo sapiens
caauucggcuggacuguuu

SEQ ID NO: 974164 - RNA, 19 nt, Homo sapiens
gaaaucugcucgucuugau

SEQ ID NO: 974165 - RNA, 19 nt, Homo sapiens
uaaaguuggugucuuaaug

SEQ ID NO: 974166 - RNA, 19 nt, Homo sapiens
uaaguucuguggcuucuaa

SEQ ID NO: 974167 - RNA, 19 nt, Homo sapiens
ggauagagacuuuagaaga

SEQ ID NO: 974168 - RNA, 19 nt, Homo sapiens
ggucgaagaugugcuacua

SEQ ID NO: 974169 - RNA, 19 nt, Homo sapiens
acaaugagguuucuacguu

SEQ ID NO: 974170 - RNA, 19 nt, Homo sapiens
gagaacaaaucuugaugug

SEQ ID NO: 974171 - RNA, 19 nt, Homo sapiens
cagaggagcugauuucaca

SEQ ID NO: 974172 - RNA, 19 nt, Homo sapiens
ggguaaaccugauaauaau

SEQ ID NO: 974173 - RNA, 19 nt, Homo sapiens
acaggaaucucccauuauu

SEQ ID NO: 974174 - RNA, 19 nt, Homo sapiens
gaaauugggugcgauacug

SEQ ID NO: 974175 - RNA, 19 nt, Homo sapiens
ggaaggagagccaaacuug

SEQ ID NO: 974176 - RNA, 19 nt, Homo sapiens
ccauuaagaccaagaauuu

SEQ ID NO: 974177 - RNA, 19 nt, Homo sapiens
caauugaccuguguaaaga

SEQ ID NO: 974178 - RNA, 19 nt, Homo sapiens
gaagcucaauuacguuaug

SEQ ID NO: 974179 - RNA, 19 nt, Homo sapiens
ccaagaugcaguaaacuua

SEQ ID NO: 974180 - RNA, 19 nt, Homo sapiens
gcugaaauauccucaagug

SEQ ID NO: 974181 - RNA, 19 nt, Homo sapiens
gagagcggauaguuucuuu

SEQ ID NO: 974182 - RNA, 19 nt, Homo sapiens
cagcagaacaacauaauuu

SEQ ID NO: 974183 - RNA, 19 nt, Homo sapiens
caagagauuugucacuaga

SEQ ID NO: 974184 - RNA, 19 nt, Homo sapiens
ugaucuugcugcacaauua

SEQ ID NO: 974185 - RNA, 19 nt, Homo sapiens
ggugugcauucuuuaauaa

SEQ ID NO: 974186 - RNA, 19 nt, Homo sapiens
gaucuuccaccuauuagua

SEQ ID NO: 974187 - RNA, 19 nt, Homo sapiens
gcaaaugcaauaucaguug

SEQ ID NO: 974188 - RNA, 19 nt, Homo sapiens
gggugugcauucuuuaaua

SEQ ID NO: 974189 - RNA, 19 nt, Homo sapiens
aagcuaagccugaaaguaa

SEQ ID NO: 974190 - RNA, 19 nt, Homo sapiens
aagcaagguugaauuguuu

SEQ ID NO: 974191 - RNA, 19 nt, Homo sapiens
cuaaugcggucucauaaug

SEQ ID NO: 974192 - RNA, 19 nt, Homo sapiens
ggagugaaucugagccuua

SEQ ID NO: 974193 - RNA, 19 nt, Homo sapiens
gcaauugaccuguguaaag

SEQ ID NO: 974194 - RNA, 19 nt, Homo sapiens
gaaaccagcagucaagaga

SEQ ID NO: 974195 - RNA, 19 nt, Homo sapiens
ggccaccucucacaucuuu

SEQ ID NO: 974196 - RNA, 19 nt, Homo sapiens
agacaaaucucggacuuga

SEQ ID NO: 974197 - RNA, 19 nt, Homo sapiens
ucgaaugacucaagugauu

SEQ ID NO: 974198 - RNA, 19 nt, Homo sapiens
gaugaagacgggagugaua

SEQ ID NO: 974199 - RNA, 19 nt, Homo sapiens
uaugccagaucaugauuua

SEQ ID NO: 974200 - RNA, 19 nt, Homo sapiens
gugcaaggguuugucauaa

SEQ ID NO: 974201 - RNA, 19 nt, Homo sapiens
ugaaauauccucaagugaa

SEQ ID NO: 974202 - RNA, 19 nt, Homo sapiens
guaaauggcugcggugaag

SEQ ID NO: 974203 - RNA, 19 nt, Homo sapiens
gauagagacuuuagaagac

SEQ ID NO: 974204 - RNA, 19 nt, Homo sapiens
ggaacuggguauugauaau

SEQ ID NO: 974205 - RNA, 19 nt, Homo sapiens
gcaaggguuugucauaaag

SEQ ID NO: 974206 - RNA, 19 nt, Homo sapiens
cuuagaaacugcucagaaa

SEQ ID NO: 974207 - RNA, 19 nt, Homo sapiens
ggaccaagcaccuccacua

SEQ ID NO: 974208 - RNA, 19 nt, Homo sapiens
gaaugacagcuguagauuu

SEQ ID NO: 974209 - RNA, 19 nt, Homo sapiens
ggaagaaaauguuagagaa

SEQ ID NO: 974210 - RNA, 19 nt, Homo sapiens
caaccagcauuugcaagua

SEQ ID NO: 974211 - RNA, 19 nt, Homo sapiens
ggaagauguuggagcagaa

SEQ ID NO: 974212 - RNA, 19 nt, Homo sapiens
gaugagccauuagaaagaa

SEQ ID NO: 974213 - RNA, 19 nt, Homo sapiens
gggcagagaugaagaacag

SEQ ID NO: 974214 - RNA, 19 nt, Homo sapiens
gagcaccucuuacuauucu

SEQ ID NO: 974215 - RNA, 19 nt, Homo sapiens
cuacuaaucugguuacucu

SEQ ID NO: 974216 - RNA, 19 nt, Homo sapiens
ugggagaaauguaaaugua

SEQ ID NO: 974217 - RNA, 19 nt, Homo sapiens
ugaugacucuccuuuauau

SEQ ID NO: 974218 - RNA, 19 nt, Homo sapiens
agaggaagauguauucaug

SEQ ID NO: 974219 - RNA, 19 nt, Homo sapiens
caaagguucuuguauagag

SEQ ID NO: 974220 - RNA, 19 nt, Homo sapiens
ggugguaccuuaaagagau

SEQ ID NO: 974221 - RNA, 19 nt, Homo sapiens
gaaauggaguacucaguua

SEQ ID NO: 974222 - RNA, 19 nt, Homo sapiens
gaacugcacugaugaagga

SEQ ID NO: 974223 - RNA, 19 nt, Homo sapiens
ggagacagcuguugaucuu

SEQ ID NO: 974224 - RNA, 19 nt, Homo sapiens
guagacaucuuuauugcuu

SEQ ID NO: 974225 - RNA, 19 nt, Homo sapiens
ucacauacuuggagaacaa

SEQ ID NO: 974226 - RNA, 19 nt, Homo sapiens
ugucagaaguuccuaauuc

SEQ ID NO: 974227 - RNA, 19 nt, Homo sapiens
gaacaaaggacaccguuac

SEQ ID NO: 974228 - RNA, 19 nt, Homo sapiens
ccacacagcuggcuacacu

SEQ ID NO: 974229 - RNA, 19 nt, Homo sapiens
cagcagacauuacccacuu

SEQ ID NO: 974230 - RNA, 19 nt, Homo sapiens
agaaguuccuaauucagua

SEQ ID NO: 974231 - RNA, 19 nt, Homo sapiens
gggaagcuauccagaaguc

SEQ ID NO: 974232 - RNA, 19 nt, Homo sapiens
ggucagcucuucccuucau

SEQ ID NO: 974233 - RNA, 19 nt, Homo sapiens
gcgggaagcuauccagaag

SEQ ID NO: 974234 - RNA, 19 nt, Homo sapiens
caaugccuauacuggaaua

SEQ ID NO: 974235 - RNA, 19 nt, Homo sapiens
gaacucuguagacaucuuu

SEQ ID NO: 974236 - RNA, 19 nt, Homo sapiens
ugaggaggcugcagaagca

SEQ ID NO: 974237 - RNA, 19 nt, Homo sapiens
gcucuucccuucaucacau

SEQ ID NO: 974238 - RNA, 19 nt, Homo sapiens
gucagaaguuccuaauuca

SEQ ID NO: 974239 - RNA, 19 nt, Homo sapiens
ugaaauggaguacucaguu

SEQ ID NO: 974240 - RNA, 19 nt, Homo sapiens
gacauuacccacuugaaau

SEQ ID NO: 974241 - RNA, 19 nt, Homo sapiens
ggaauagugcuacuucgau

SEQ ID NO: 974242 - RNA, 19 nt, Homo sapiens
agacauuacccacuugaaa

SEQ ID NO: 974243 - RNA, 19 nt, Homo sapiens
agacagcuguugaucuugu

SEQ ID NO: 974244 - RNA, 19 nt, Homo sapiens
acaauaagaacaugucaga

SEQ ID NO: 974245 - RNA, 19 nt, Homo sapiens
gcgguucgauaucucaaug

SEQ ID NO: 974246 - RNA, 19 nt, Homo sapiens
caugugggagguacaauaa

SEQ ID NO: 974247 - RNA, 19 nt, Homo sapiens
ugugggagguacaauaaga

SEQ ID NO: 974248 - RNA, 19 nt, Homo sapiens
auaagaacaugucagaagu

SEQ ID NO: 974249 - RNA, 19 nt, Homo sapiens
ggagguacaauaagaacau

SEQ ID NO: 974250 - RNA, 19 nt, Homo sapiens
ucugcgaacuggugucuga

SEQ ID NO: 974251 - RNA, 19 nt, Homo sapiens
ugugaacucuguagacauc

SEQ ID NO: 974252 - RNA, 19 nt, Homo sapiens
aacagcaucuuccacaguu

SEQ ID NO: 974253 - RNA, 19 nt, Homo sapiens
agaacaaucuggguagcaa

SEQ ID NO: 974254 - RNA, 19 nt, Homo sapiens
cagaagcaauggagugaac

SEQ ID NO: 974255 - RNA, 19 nt, Homo sapiens
guugugaacucuguagaca

SEQ ID NO: 974256 - RNA, 19 nt, Homo sapiens
agaagucugugacaagaag

SEQ ID NO: 974257 - RNA, 19 nt, Homo sapiens
gaaggagagcgggaagcua

SEQ ID NO: 974258 - RNA, 19 nt, Homo sapiens
uaagaacaugucagaaguu

SEQ ID NO: 974259 - RNA, 19 nt, Homo sapiens
gcagacauuacccacuuga

SEQ ID NO: 974260 - RNA, 19 nt, Homo sapiens
gagguacaauaagaacaug

SEQ ID NO: 974261 - RNA, 19 nt, Homo sapiens
caacagcaucuuccacagu

SEQ ID NO: 974262 - RNA, 19 nt, Homo sapiens
aauaagaacaugucagaag

SEQ ID NO: 974263 - RNA, 19 nt, Homo sapiens
uggcuaagaguagauuuaa

SEQ ID NO: 974264 - RNA, 19 nt, Homo sapiens
aaauggaguacucaguuaa

SEQ ID NO: 974265 - RNA, 19 nt, Homo sapiens
gacagcuguugaucuuguu

SEQ ID NO: 974266 - RNA, 19 nt, Homo sapiens
cucaaugccuauacuggaa

SEQ ID NO: 974267 - RNA, 19 nt, Homo sapiens
aaggagagcgggaagcuau

SEQ ID NO: 974268 - RNA, 19 nt, Homo sapiens
cagaaguuccuaauucagu

SEQ ID NO: 974269 - RNA, 19 nt, Homo sapiens
ucuguagacaucuuuauug

SEQ ID NO: 974270 - RNA, 19 nt, Homo sapiens
gugaaguguugcagguugu

SEQ ID NO: 974271 - RNA, 19 nt, Homo sapiens
cggcuucgcgguucgauau

SEQ ID NO: 974272 - RNA, 19 nt, Homo sapiens
agaauucuaucagcuugug

SEQ ID NO: 974273 - RNA, 19 nt, Homo sapiens
ggcuaagaguagauuuaau

SEQ ID NO: 974274 - RNA, 19 nt, Homo sapiens
ugaacucuguagacaucuu

SEQ ID NO: 974275 - RNA, 19 nt, Homo sapiens
gcuucaggcccacuuguug

SEQ ID NO: 974276 - RNA, 19 nt, Homo sapiens
ggaggcugcagaagcaaug

SEQ ID NO: 974277 - RNA, 19 nt, Homo sapiens
guacaauaagaacauguca

SEQ ID NO: 974278 - RNA, 19 nt, Homo sapiens
ggacaccguuacccaugcu

SEQ ID NO: 974279 - RNA, 19 nt, Homo sapiens
agaacaaaggacaccguua

SEQ ID NO: 974280 - RNA, 19 nt, Homo sapiens
cuacacugcucaggcuuca

SEQ ID NO: 974281 - RNA, 19 nt, Homo sapiens
acaugugggagguacaaua

SEQ ID NO: 974282 - RNA, 19 nt, Homo sapiens
cuuuauugcuuggcuaaga

SEQ ID NO: 974283 - RNA, 19 nt, Homo sapiens
gaaguguugcagguuguga

SEQ ID NO: 974284 - RNA, 19 nt, Homo sapiens
agcauucccuggugaagug

SEQ ID NO: 974285 - RNA, 19 nt, Homo sapiens
gcagaagcaauggagugaa

SEQ ID NO: 974286 - RNA, 19 nt, Homo sapiens
cuacuucgaugcagaaaag

SEQ ID NO: 974287 - RNA, 19 nt, Homo sapiens
cgauaucucaaugccuaua

SEQ ID NO: 974288 - RNA, 19 nt, Homo sapiens
aauggaguacucaguuaaa

SEQ ID NO: 974289 - RNA, 19 nt, Homo sapiens
ccagggugcacggaacuuu

SEQ ID NO: 974290 - RNA, 19 nt, Homo sapiens
caauaagaacaugucagaa

SEQ ID NO: 974291 - RNA, 19 nt, Homo sapiens
acagcaucuuccacaguuu

SEQ ID NO: 974292 - RNA, 19 nt, Homo sapiens
gaaguuccuaauucaguac

SEQ ID NO: 974293 - RNA, 19 nt, Homo sapiens
gccaaugauuuacuuguuu

SEQ ID NO: 974294 - RNA, 19 nt, Homo sapiens
cacaggagcugacacaaug

SEQ ID NO: 974295 - RNA, 19 nt, Homo sapiens
gcacaggagcugacacaau

SEQ ID NO: 974296 - RNA, 19 nt, Homo sapiens
gcagggagacuucuaugug

SEQ ID NO: 974297 - RNA, 19 nt, Homo sapiens
cagaauaaagccaaugauu

SEQ ID NO: 974298 - RNA, 19 nt, Homo sapiens
gaccagauccauuucaugu

SEQ ID NO: 974299 - RNA, 19 nt, Homo sapiens
gaggagccagggacuauuu

SEQ ID NO: 974300 - RNA, 19 nt, Homo sapiens
ucuguaagcuuggaaguga

SEQ ID NO: 974301 - RNA, 19 nt, Homo sapiens
gagcugacacaaugaguga

SEQ ID NO: 974302 - RNA, 19 nt, Homo sapiens
ccagaaauuuggcuucaag

SEQ ID NO: 974303 - RNA, 19 nt, Homo sapiens
ccaaugauuuacuuguuuc

SEQ ID NO: 974304 - RNA, 19 nt, Homo sapiens
cuccaucgcugucuacuau

SEQ ID NO: 974305 - RNA, 19 nt, Homo sapiens
gcuccaggccucuugcuaa

SEQ ID NO: 974306 - RNA, 19 nt, Homo sapiens
gccuugaggugcaguguug

SEQ ID NO: 974307 - RNA, 19 nt, Homo sapiens
gcacagcuacagcgaguca

SEQ ID NO: 974308 - RNA, 19 nt, Homo sapiens
ucaucgaccucuaccagaa

SEQ ID NO: 974309 - RNA, 19 nt, Homo sapiens
gaagaccagauccauuuca

SEQ ID NO: 974310 - RNA, 19 nt, Homo sapiens
aggaagaccagauccauuu

SEQ ID NO: 974311 - RNA, 19 nt, Homo sapiens
ccaucgcugucuacuauga

SEQ ID NO: 974312 - RNA, 19 nt, Homo sapiens
uugaggagcuggacuugga

SEQ ID NO: 974313 - RNA, 19 nt, Homo sapiens
gaaggagacagaguggaaa

SEQ ID NO: 974314 - RNA, 19 nt, Homo sapiens
gggccugacucucuuacug

SEQ ID NO: 974315 - RNA, 19 nt, Homo sapiens
ugaaggagacagaguggaa

SEQ ID NO: 974316 - RNA, 19 nt, Homo sapiens
acugagagcugcagcaucu

SEQ ID NO: 974317 - RNA, 19 nt, Homo sapiens
ccugauaagugccgaugug

SEQ ID NO: 974318 - RNA, 19 nt, Homo sapiens
cgaccucuaccagaaauuu

SEQ ID NO: 974319 - RNA, 19 nt, Homo sapiens
ggagacagaguggaaaugg

SEQ ID NO: 974320 - RNA, 19 nt, Homo sapiens
ggaagaccagauccauuuc

SEQ ID NO: 974321 - RNA, 19 nt, Homo sapiens
gagugaaggugaggaaucg

SEQ ID NO: 974322 - RNA, 19 nt, Homo sapiens
ucacuguggccuacaaguu

SEQ ID NO: 974323 - RNA, 19 nt, Homo sapiens
uaccagaaauuuggcuuca

SEQ ID NO: 974324 - RNA, 19 nt, Homo sapiens
cagaggagccagggacuau

SEQ ID NO: 974325 - RNA, 19 nt, Homo sapiens
gcuaagccuucuccucacu

SEQ ID NO: 974326 - RNA, 19 nt, Homo sapiens
ugacacgaguucuguaagc

SEQ ID NO: 974327 - RNA, 19 nt, Homo sapiens
gagcuuccaggacccagaa

SEQ ID NO: 974328 - RNA, 19 nt, Homo sapiens
ugagaagggcaaggaguaa

SEQ ID NO: 974329 - RNA, 19 nt, Homo sapiens
agccaaugauuuacuuguu

SEQ ID NO: 974330 - RNA, 19 nt, Homo sapiens
caggaagaccagauccauu

SEQ ID NO: 974331 - RNA, 19 nt, Homo sapiens
ccaccauucuguccaucug

SEQ ID NO: 974332 - RNA, 19 nt, Homo sapiens
cuuccaggacccagaauaa

SEQ ID NO: 974333 - RNA, 19 nt, Homo sapiens
cugagaagggcaaggagua

SEQ ID NO: 974334 - RNA, 19 nt, Homo sapiens
cagugcaguugcugaggaa

SEQ ID NO: 974335 - RNA, 19 nt, Homo sapiens
ucuccucacugcccuuuag

SEQ ID NO: 974336 - RNA, 19 nt, Homo sapiens
gaagcugugugccuauccu

SEQ ID NO: 974337 - RNA, 19 nt, Homo sapiens
caucgaccucuaccagaaa

SEQ ID NO: 974338 - RNA, 19 nt, Homo sapiens
gacccagaauaaagccaau

SEQ ID NO: 974339 - RNA, 19 nt, Homo sapiens
gagaugaaggagacagagu

SEQ ID NO: 974340 - RNA, 19 nt, Homo sapiens
ugucggaccugcuacuacu

SEQ ID NO: 974341 - RNA, 19 nt, Homo sapiens
ucuaugugccugagaugaa

SEQ ID NO: 974342 - RNA, 19 nt, Homo sapiens
gcucuuugcaucuugucuu

SEQ ID NO: 974343 - RNA, 19 nt, Homo sapiens
cuacuacugggccugauug

SEQ ID NO: 974344 - RNA, 19 nt, Homo sapiens
gagugacacgaguucugua

SEQ ID NO: 974345 - RNA, 19 nt, Homo sapiens
ugacgcugcuggccuuugc

SEQ ID NO: 974346 - RNA, 19 nt, Homo sapiens
gcuuccaggacccagaaua

SEQ ID NO: 974347 - RNA, 19 nt, Homo sapiens
gccagcggcuccucuuuug

SEQ ID NO: 974348 - RNA, 19 nt, Homo sapiens
gcuacuacugggccugauu

SEQ ID NO: 974349 - RNA, 19 nt, Homo sapiens
aagaccagauccauuucau

SEQ ID NO: 974350 - RNA, 19 nt, Homo sapiens
gaccucuaccagaaauuug

SEQ ID NO: 974351 - RNA, 19 nt, Homo sapiens
aaagggagaucauguuaaa

SEQ ID NO: 974352 - RNA, 19 nt, Homo sapiens
ggacuuggaucugagcuaa

SEQ ID NO: 974353 - RNA, 19 nt, Homo sapiens
aguagcaucuuucagaaua

SEQ ID NO: 974354 - RNA, 19 nt, Homo sapiens
gugaauggaucaucuuuua

SEQ ID NO: 974355 - RNA, 19 nt, Homo sapiens
ggucuggucuuuaagugaa

SEQ ID NO: 974356 - RNA, 19 nt, Homo sapiens
acaguagccuuugucuuua

SEQ ID NO: 974357 - RNA, 19 nt, Homo sapiens
cuaaagggagaucauguua

SEQ ID NO: 974358 - RNA, 19 nt, Homo sapiens
ugaugagacuauuggauuu

SEQ ID NO: 974359 - RNA, 19 nt, Homo sapiens
aacaguagccuuugucuuu

SEQ ID NO: 974360 - RNA, 19 nt, Homo sapiens
gauuaucaguuucuuagca

SEQ ID NO: 974361 - RNA, 19 nt, Homo sapiens
uauaguagcaucuuucaga

SEQ ID NO: 974362 - RNA, 19 nt, Homo sapiens
cuuucaagcucaaaucuuu

SEQ ID NO: 974363 - RNA, 19 nt, Homo sapiens
guagcaucuuucagaauaa

SEQ ID NO: 974364 - RNA, 19 nt, Homo sapiens
gcauuugagucuauaaacu

SEQ ID NO: 974365 - RNA, 19 nt, Homo sapiens
guaauuugauguacacaac

SEQ ID NO: 974366 - RNA, 19 nt, Homo sapiens
ggauuugaggauauucuua

SEQ ID NO: 974367 - RNA, 19 nt, Homo sapiens
aguagaaguuccaagguuu

SEQ ID NO: 974368 - RNA, 19 nt, Homo sapiens
guaauagugugcuguucau

SEQ ID NO: 974369 - RNA, 19 nt, Homo sapiens
aaacauucagggucuauuu

SEQ ID NO: 974370 - RNA, 19 nt, Homo sapiens
accaguagauguagguuaa

SEQ ID NO: 974371 - RNA, 19 nt, Homo sapiens
agucaucuuuguacuguaa

SEQ ID NO: 974372 - RNA, 19 nt, Homo sapiens
gaucuacagguuucaauuc

SEQ ID NO: 974373 - RNA, 19 nt, Homo sapiens
caguagccuuugucuuuaa

SEQ ID NO: 974374 - RNA, 19 nt, Homo sapiens
guacugacaccugagaauu

SEQ ID NO: 974375 - RNA, 19 nt, Homo sapiens
gagaaacauucagggucua

SEQ ID NO: 974376 - RNA, 19 nt, Homo sapiens
ugaaagucaugaucuucuu

SEQ ID NO: 974377 - RNA, 19 nt, Homo sapiens
ccauuaacacucauaagaa

SEQ ID NO: 974378 - RNA, 19 nt, Homo sapiens
uaaagggagaucauguuaa

SEQ ID NO: 974379 - RNA, 19 nt, Homo sapiens
gcucaaguaguaucaguga

SEQ ID NO: 974380 - RNA, 19 nt, Homo sapiens
gaggauauucuuaaugauc

SEQ ID NO: 974381 - RNA, 19 nt, Homo sapiens
aguggcaacucucaaauug

SEQ ID NO: 974382 - RNA, 19 nt, Homo sapiens
acagccaugugacaauuaa

SEQ ID NO: 974383 - RNA, 19 nt, Homo sapiens
uuacagccaugugacaauu

SEQ ID NO: 974384 - RNA, 19 nt, Homo sapiens
cacacuugaugguggaaua

SEQ ID NO: 974385 - RNA, 19 nt, Homo sapiens
gagcuaaaggacaguauuc

SEQ ID NO: 974386 - RNA, 19 nt, Homo sapiens
aaagcaaccaguagaugua

SEQ ID NO: 974387 - RNA, 19 nt, Homo sapiens
uaaagcaaccaguagaugu

SEQ ID NO: 974388 - RNA, 19 nt, Homo sapiens
guuccaagguuuugauuuu

SEQ ID NO: 974389 - RNA, 19 nt, Homo sapiens
ggcugcaucuuguuuauag

SEQ ID NO: 974390 - RNA, 19 nt, Homo sapiens
gaugguggaauauaaacuu

SEQ ID NO: 974391 - RNA, 19 nt, Homo sapiens
guagauguagguuaaacuu

SEQ ID NO: 974392 - RNA, 19 nt, Homo sapiens
gcaaguggaccuuuugaaa

SEQ ID NO: 974393 - RNA, 19 nt, Homo sapiens
caauucaaccuguuucuag

SEQ ID NO: 974394 - RNA, 19 nt, Homo sapiens
gaucauguuaaagcucuua

SEQ ID NO: 974395 - RNA, 19 nt, Homo sapiens
gcacuaaagggagaucaug

SEQ ID NO: 974396 - RNA, 19 nt, Homo sapiens
gagggcugcaucuuguuua

SEQ ID NO: 974397 - RNA, 19 nt, Homo sapiens
acuauuggauuugaggaua

SEQ ID NO: 974398 - RNA, 19 nt, Homo sapiens
gaaagucaugaucuucuuc

SEQ ID NO: 974399 - RNA, 19 nt, Homo sapiens
aaguagaaguuccaagguu

SEQ ID NO: 974400 - RNA, 19 nt, Homo sapiens
aaaggacaguauuccaguu

SEQ ID NO: 974401 - RNA, 19 nt, Homo sapiens
aauuucugcucaaguagua

SEQ ID NO: 974402 - RNA, 19 nt, Homo sapiens
guaaugaugagacuauugg

SEQ ID NO: 974403 - RNA, 19 nt, Homo sapiens
gguucagcgucuuccauuu

SEQ ID NO: 974404 - RNA, 19 nt, Homo sapiens
cgucuuccauuucuuucaa

SEQ ID NO: 974405 - RNA, 19 nt, Homo sapiens
gguauucuuuaugaaguug

SEQ ID NO: 974406 - RNA, 19 nt, Homo sapiens
gaucuucuucggaaagguu

SEQ ID NO: 974407 - RNA, 19 nt, Homo sapiens
uaucagugucguccauuaa

SEQ ID NO: 974408 - RNA, 19 nt, Homo sapiens
aaggacaguauuccaguua

SEQ ID NO: 974409 - RNA, 19 nt, Homo sapiens
auaucagugucguccauua

SEQ ID NO: 974410 - RNA, 19 nt, Homo sapiens
auaguagcaucuuucagaa

SEQ ID NO: 974411 - RNA, 19 nt, Homo sapiens
aaaaugaucuacagguuuc

SEQ ID NO: 974412 - RNA, 19 nt, Homo sapiens
gguggaauauaaacuuggu

SEQ ID NO: 974413 - RNA, 19 nt, Homo sapiens
gguaaugaugagacuauug

SEQ ID NO: 974414 - RNA, 19 nt, Homo sapiens
cagcgucuuccauuucuuu

SEQ ID NO: 974415 - RNA, 19 nt, Homo sapiens
gaugaaugccagaggacuu

SEQ ID NO: 974416 - RNA, 19 nt, Homo sapiens
ugucguccauuaacacuca

SEQ ID NO: 974417 - RNA, 19 nt, Homo sapiens
cuacagguuucaauucaac

SEQ ID NO: 974418 - RNA, 19 nt, Homo sapiens
aguuguugcucaugaauau

SEQ ID NO: 974419 - RNA, 19 nt, Homo sapiens
acuugaugguggaauauaa

SEQ ID NO: 974420 - RNA, 19 nt, Homo sapiens
gaugagacuauuggauuug

SEQ ID NO: 974421 - RNA, 19 nt, Homo sapiens
gaauuucugcucaaguagu

SEQ ID NO: 974422 - RNA, 19 nt, Homo sapiens
caugggagagccacacuug

SEQ ID NO: 974423 - RNA, 19 nt, Homo sapiens
ggguaaugaugagacuauu

SEQ ID NO: 974424 - RNA, 19 nt, Homo sapiens
gaaacauucagggucuauu

SEQ ID NO: 974425 - RNA, 19 nt, Homo sapiens
uccauuaacacucauaaga

SEQ ID NO: 974426 - RNA, 19 nt, Homo sapiens
ucagugucguccauuaaca

SEQ ID NO: 974427 - RNA, 19 nt, Homo sapiens
gggcugcaucuuguuuaua

SEQ ID NO: 974428 - RNA, 19 nt, Homo sapiens
gggagagccacacuugaug

SEQ ID NO: 974429 - RNA, 19 nt, Homo sapiens
cuauuggauuugaggauau

SEQ ID NO: 974430 - RNA, 19 nt, Homo sapiens
guucagcgucuuccauuuc

SEQ ID NO: 974431 - RNA, 19 nt, Homo sapiens
caucuuguuuauagucauc

SEQ ID NO: 974432 - RNA, 19 nt, Homo sapiens
cgagggcugcaucuuguuu

SEQ ID NO: 974433 - RNA, 19 nt, Homo sapiens
auagugugcuguucaugga

SEQ ID NO: 974434 - RNA, 19 nt, Homo sapiens
gagcugcggaagaugaaug

SEQ ID NO: 974435 - RNA, 19 nt, Homo sapiens
ucaauucaaccuguuucua

SEQ ID NO: 974436 - RNA, 19 nt, Homo sapiens
uacugacaccugagaauuu

SEQ ID NO: 974437 - RNA, 19 nt, Homo sapiens
ccagcucaaccaagauaaa

SEQ ID NO: 974438 - RNA, 19 nt, Homo sapiens
auagucaucuuuguacugu

SEQ ID NO: 974439 - RNA, 19 nt, Homo sapiens
gggagaucauguuaaagcu

SEQ ID NO: 974440 - RNA, 19 nt, Homo sapiens
gaauggaucaucuuuuaca

SEQ ID NO: 974441 - RNA, 19 nt, Homo sapiens
caguggcaacucucaaauu

SEQ ID NO: 974442 - RNA, 19 nt, Homo sapiens
acugacaccugagaauuuc

SEQ ID NO: 974443 - RNA, 19 nt, Homo sapiens
gcaaccaguagauguaggu

SEQ ID NO: 974444 - RNA, 19 nt, Homo sapiens
ucuacagguuucaauucaa

SEQ ID NO: 974445 - RNA, 19 nt, Homo sapiens
augaugagacuauuggauu

SEQ ID NO: 974446 - RNA, 19 nt, Homo sapiens
gcuaaaggacaguauucca

SEQ ID NO: 974447 - RNA, 19 nt, Homo sapiens
ugauuucaguggcaacucu

SEQ ID NO: 974448 - RNA, 19 nt, Homo sapiens
ccauuucuuucaagcucaa

SEQ ID NO: 974449 - RNA, 19 nt, Homo sapiens
gcaucuuucagaauaaaca

SEQ ID NO: 974450 - RNA, 19 nt, Homo sapiens
aguagccuuugucuuuaaa

SEQ ID NO: 974451 - RNA, 19 nt, Homo sapiens
ggaauuaaguguugucuug

SEQ ID NO: 974452 - RNA, 19 nt, Homo sapiens
aaaguaagcuguuccuugu

SEQ ID NO: 974453 - RNA, 19 nt, Homo sapiens
ccacguauagcuggaauua

SEQ ID NO: 974454 - RNA, 19 nt, Homo sapiens
gcaagaagaagccacugaa

SEQ ID NO: 974455 - RNA, 19 nt, Homo sapiens
ccaagaagcaggccaagga

SEQ ID NO: 974456 - RNA, 19 nt, Homo sapiens
uagcuggaauuaaguguug

SEQ ID NO: 974457 - RNA, 19 nt, Homo sapiens
gaagaaacucgaggagcua

SEQ ID NO: 974458 - RNA, 19 nt, Homo sapiens
ugaaacagcccaagaagca

SEQ ID NO: 974459 - RNA, 19 nt, Homo sapiens
gaggagauggugacccuuu

SEQ ID NO: 974460 - RNA, 19 nt, Homo sapiens
caagaagaagccacugaaa

SEQ ID NO: 974461 - RNA, 19 nt, Homo sapiens
gauggugacccuuuauuuc

SEQ ID NO: 974462 - RNA, 19 nt, Homo sapiens
agaagaagccacugaaaca

SEQ ID NO: 974463 - RNA, 19 nt, Homo sapiens
uaacaucuuuugccacgua

SEQ ID NO: 974464 - RNA, 19 nt, Homo sapiens
ucuauucccugccauaaca

SEQ ID NO: 974465 - RNA, 19 nt, Homo sapiens
cagguggaauuaagaaauc

SEQ ID NO: 974466 - RNA, 19 nt, Homo sapiens
gagauggugacccuuuauu

SEQ ID NO: 974467 - RNA, 19 nt, Homo sapiens
acguauagcuggaauuaag

SEQ ID NO: 974468 - RNA, 19 nt, Homo sapiens
ggagauggacgaggaagau

SEQ ID NO: 974469 - RNA, 19 nt, Homo sapiens
uuggagcuguuguacauuu

SEQ ID NO: 974470 - RNA, 19 nt, Homo sapiens
aggagauggugacccuuua

SEQ ID NO: 974471 - RNA, 19 nt, Homo sapiens
uggagcuguuguacauuua

SEQ ID NO: 974472 - RNA, 19 nt, Homo sapiens
gagauggacgaggaagaua

SEQ ID NO: 974473 - RNA, 19 nt, Homo sapiens
ggagcuguuguacauuuaa

SEQ ID NO: 974474 - RNA, 19 nt, Homo sapiens
cgaggaagauaaggcuuuc

SEQ ID NO: 974475 - RNA, 19 nt, Homo sapiens
ggagauggugacccuuuau

SEQ ID NO: 974476 - RNA, 19 nt, Homo sapiens
ucuuggagcuguuguacau

SEQ ID NO: 974477 - RNA, 19 nt, Homo sapiens
ccacugaaacagcccaaga

SEQ ID NO: 974478 - RNA, 19 nt, Homo sapiens
gagcuguuguacauuuaag

SEQ ID NO: 974479 - RNA, 19 nt, Homo sapiens
gcuguuguacauuuaagaa

SEQ ID NO: 974480 - RNA, 19 nt, Homo sapiens
gaagcaggccaaggagaug

SEQ ID NO: 974481 - RNA, 19 nt, Homo sapiens
gacccuuuauuucaucugu

SEQ ID NO: 974482 - RNA, 19 nt, Homo sapiens
gaagaagccacugaaacag

SEQ ID NO: 974483 - RNA, 19 nt, Homo sapiens
ggugacccuuuauuucauc

SEQ ID NO: 974484 - RNA, 19 nt, Homo sapiens
ggcaagaagaagccacuga

SEQ ID NO: 974485 - RNA, 19 nt, Homo sapiens
agauggugacccuuuauuu

SEQ ID NO: 974486 - RNA, 19 nt, Homo sapiens
ucccugccauaacaucuuu

SEQ ID NO: 974487 - RNA, 19 nt, Homo sapiens
aauuaaguguugucuugga

SEQ ID NO: 974488 - RNA, 19 nt, Homo sapiens
aagaggagcagaagaaacu

SEQ ID NO: 974489 - RNA, 19 nt, Homo sapiens
ggaagauaaggcuuucaag

SEQ ID NO: 974490 - RNA, 19 nt, Homo sapiens
agauggacgaggaagauaa

SEQ ID NO: 974491 - RNA, 19 nt, Homo sapiens
gauggacgaggaagauaag

SEQ ID NO: 974492 - RNA, 19 nt, Homo sapiens
gaaacucgaggagcuaaaa

SEQ ID NO: 974493 - RNA, 19 nt, Homo sapiens
cccuuuauuucaucuguau

SEQ ID NO: 974494 - RNA, 19 nt, Homo sapiens
acagguggaauuaagaaau

SEQ ID NO: 974495 - RNA, 19 nt, Homo sapiens
agaagcaggccaaggagau

SEQ ID NO: 974496 - RNA, 19 nt, Homo sapiens
gagcaaagcaugugaaaca

SEQ ID NO: 974497 - RNA, 19 nt, Homo sapiens
ggaaagcccugugcuggaa

SEQ ID NO: 974498 - RNA, 19 nt, Homo sapiens
ucucagagcuuuaccuguu

SEQ ID NO: 974499 - RNA, 19 nt, Homo sapiens
gcaaaagacugcuaaagug

SEQ ID NO: 974500 - RNA, 19 nt, Homo sapiens
agaaggaucuaaagggaaa

SEQ ID NO: 974501 - RNA, 19 nt, Homo sapiens
ggaaggugauugggacaaa

SEQ ID NO: 974502 - RNA, 19 nt, Homo sapiens
cuggaucccuauuuauuaa

SEQ ID NO: 974503 - RNA, 19 nt, Homo sapiens
gcuaaaagcaaaugaagua

SEQ ID NO: 974504 - RNA, 19 nt, Homo sapiens
gaccaaagccacguaaugu

SEQ ID NO: 974505 - RNA, 19 nt, Homo sapiens
aaagacugcuaaagugaga

SEQ ID NO: 974506 - RNA, 19 nt, Homo sapiens
uggaagaacucaauaucuc

SEQ ID NO: 974507 - RNA, 19 nt, Homo sapiens
ugaacuggcugagaucguu

SEQ ID NO: 974508 - RNA, 19 nt, Homo sapiens
ucuggaucccuauuuauua

SEQ ID NO: 974509 - RNA, 19 nt, Homo sapiens
caguuucucugugguguuu

SEQ ID NO: 974510 - RNA, 19 nt, Homo sapiens
uguucuggaucccuauuua

SEQ ID NO: 974511 - RNA, 19 nt, Homo sapiens
gaaaccacccagcuaagca

SEQ ID NO: 974512 - RNA, 19 nt, Homo sapiens
gaacuggcugagaucguuu

SEQ ID NO: 974513 - RNA, 19 nt, Homo sapiens
cuucagcagugcacaguug

SEQ ID NO: 974514 - RNA, 19 nt, Homo sapiens
ggaagaacucaauaucucu

SEQ ID NO: 974515 - RNA, 19 nt, Homo sapiens
aacaugaacuggcugagau

SEQ ID NO: 974516 - RNA, 19 nt, Homo sapiens
ugaccaaagccacguaaug

SEQ ID NO: 974517 - RNA, 19 nt, Homo sapiens
ccacguaauguccguaguu

SEQ ID NO: 974518 - RNA, 19 nt, Homo sapiens
ucucugugguguuuaugaa

SEQ ID NO: 974519 - RNA, 19 nt, Homo sapiens
ugagaucguuuucaaaguu

SEQ ID NO: 974520 - RNA, 19 nt, Homo sapiens
uagauccagugacaggaaa

SEQ ID NO: 974521 - RNA, 19 nt, Homo sapiens
aaacaugaacuggcugaga

SEQ ID NO: 974522 - RNA, 19 nt, Homo sapiens
caaaagacugcuaaaguga

SEQ ID NO: 974523 - RNA, 19 nt, Homo sapiens
cugugguguuuaugaaaua

SEQ ID NO: 974524 - RNA, 19 nt, Homo sapiens
ucggaaaccacccagcuaa

SEQ ID NO: 974525 - RNA, 19 nt, Homo sapiens
ucugugguguuuaugaaau

SEQ ID NO: 974526 - RNA, 19 nt, Homo sapiens
gaaggugauugggacaaaa

SEQ ID NO: 974527 - RNA, 19 nt, Homo sapiens
cagugaagcgggaguggaa

SEQ ID NO: 974528 - RNA, 19 nt, Homo sapiens
ggauauugugcuucucaga

SEQ ID NO: 974529 - RNA, 19 nt, Homo sapiens
gagaucguuuucaaaguug

SEQ ID NO: 974530 - RNA, 19 nt, Homo sapiens
gagagugaccaggcuuguu

SEQ ID NO: 974531 - RNA, 19 nt, Homo sapiens
agagugaccaggcuuguuc

SEQ ID NO: 974532 - RNA, 19 nt, Homo sapiens
cacguaauguccguaguuc

SEQ ID NO: 974533 - RNA, 19 nt, Homo sapiens
gaacucaauaucucuucag

SEQ ID NO: 974534 - RNA, 19 nt, Homo sapiens
agaacucaauaucucuuca

SEQ ID NO: 974535 - RNA, 19 nt, Homo sapiens
ggaaaccacccagcuaagc

SEQ ID NO: 974536 - RNA, 19 nt, Homo sapiens
uggcggaggugaccaaagc

SEQ ID NO: 974537 - RNA, 19 nt, Homo sapiens
uuaauaagcggaaaaccua

SEQ ID NO: 974538 - RNA, 19 nt, Homo sapiens
ccacgagcaaagcauguga

SEQ ID NO: 974539 - RNA, 19 nt, Homo sapiens
guuucucugugguguuuau

SEQ ID NO: 974540 - RNA, 19 nt, Homo sapiens
aaucuggaagaacucaaua

SEQ ID NO: 974541 - RNA, 19 nt, Homo sapiens
guucuggaucccuauuuau

SEQ ID NO: 974542 - RNA, 19 nt, Homo sapiens
uggagaguccguugaguuc

SEQ ID NO: 974543 - RNA, 19 nt, Homo sapiens
aaagucauagauccaguga

SEQ ID NO: 974544 - RNA, 19 nt, Homo sapiens
ggugaccaaagccacguaa

SEQ ID NO: 974545 - RNA, 19 nt, Homo sapiens
ggaauacuaucaccucuua

SEQ ID NO: 974546 - RNA, 19 nt, Homo sapiens
cuacauaggucuuaccauu

SEQ ID NO: 974547 - RNA, 19 nt, Homo sapiens
gagaauggaucuuguguac

SEQ ID NO: 974548 - RNA, 19 nt, Homo sapiens
ggaauuaaugccuggaaua

SEQ ID NO: 974549 - RNA, 19 nt, Homo sapiens
ccagaaauguguccugaga

SEQ ID NO: 974550 - RNA, 19 nt, Homo sapiens
gagcucugcuuccuagaaa

SEQ ID NO: 974551 - RNA, 19 nt, Homo sapiens
gccaagacuucaugaacua

SEQ ID NO: 974552 - RNA, 19 nt, Homo sapiens
ucauagaccugcaagcaaa

SEQ ID NO: 974553 - RNA, 19 nt, Homo sapiens
gaauggaucuuguguaccu

SEQ ID NO: 974554 - RNA, 19 nt, Homo sapiens
acauaggucuuaccauuga

SEQ ID NO: 974555 - RNA, 19 nt, Homo sapiens
acauaccacugucaucaua

SEQ ID NO: 974556 - RNA, 19 nt, Homo sapiens
gcacauaccacugucauca

SEQ ID NO: 974557 - RNA, 19 nt, Homo sapiens
agaaauguguccugagaau

SEQ ID NO: 974558 - RNA, 19 nt, Homo sapiens
auuaaugccuggaauacua

SEQ ID NO: 974559 - RNA, 19 nt, Homo sapiens
acaaauaccaguucccauu

SEQ ID NO: 974560 - RNA, 19 nt, Homo sapiens
caaauaccaguucccauug

SEQ ID NO: 974561 - RNA, 19 nt, Homo sapiens
uuacucagcuccagacucu

SEQ ID NO: 974562 - RNA, 19 nt, Homo sapiens
ggccugcgguucugauuuc

SEQ ID NO: 974563 - RNA, 19 nt, Homo sapiens
uaucaccucuuauauagac

SEQ ID NO: 974564 - RNA, 19 nt, Homo sapiens
gaauuaaugccuggaauac

SEQ ID NO: 974565 - RNA, 19 nt, Homo sapiens
gccacaacaugucaacugu

SEQ ID NO: 974566 - RNA, 19 nt, Homo sapiens
ccagauaugcacccaaugu

SEQ ID NO: 974567 - RNA, 19 nt, Homo sapiens
gguguuguugccuauaaua

SEQ ID NO: 974568 - RNA, 19 nt, Homo sapiens
ggagcucugcuuccuagaa

SEQ ID NO: 974569 - RNA, 19 nt, Homo sapiens
caacaccuuccguggcuuu

SEQ ID NO: 974570 - RNA, 19 nt, Homo sapiens
gaaauguguccugagaaug

SEQ ID NO: 974571 - RNA, 19 nt, Homo sapiens
ucucacugcuuauguucuu

SEQ ID NO: 974572 - RNA, 19 nt, Homo sapiens
gcccguugcugccugaauc

SEQ ID NO: 974573 - RNA, 19 nt, Homo sapiens
gcaguguguuugugcugau

SEQ ID NO: 974574 - RNA, 19 nt, Homo sapiens
guuguugccuauaauaaac

SEQ ID NO: 974575 - RNA, 19 nt, Homo sapiens
ucagaagggcaccaucuug

SEQ ID NO: 974576 - RNA, 19 nt, Homo sapiens
gaaaagccaagacuucaug

SEQ ID NO: 974577 - RNA, 19 nt, Homo sapiens
aaaggugacuuggccaaca

SEQ ID NO: 974578 - RNA, 19 nt, Homo sapiens
caucauagaccugcaagca

SEQ ID NO: 974579 - RNA, 19 nt, Homo sapiens
gacccugcccagccagaua

SEQ ID NO: 974580 - RNA, 19 nt, Homo sapiens
gagguacagaagcaaguuu

SEQ ID NO: 974581 - RNA, 19 nt, Homo sapiens
ccagggagcgugcaaaauu

SEQ ID NO: 974582 - RNA, 19 nt, Homo sapiens
gcacucccuugguguagac

SEQ ID NO: 974583 - RNA, 19 nt, Homo sapiens
ggcucguucucacugcuua

SEQ ID NO: 974584 - RNA, 19 nt, Homo sapiens
aagaaccuuugcaauaaca

SEQ ID NO: 974585 - RNA, 19 nt, Homo sapiens
ccucuuauauagacaacca

SEQ ID NO: 974586 - RNA, 19 nt, Homo sapiens
ugagaauggaucuugugua

SEQ ID NO: 974587 - RNA, 19 nt, Homo sapiens
auaccacugucaucauaga

SEQ ID NO: 974588 - RNA, 19 nt, Homo sapiens
cagggagcgugcaaaauuu

SEQ ID NO: 974589 - RNA, 19 nt, Homo sapiens
uugguguuguugccuauaa

SEQ ID NO: 974590 - RNA, 19 nt, Homo sapiens
cccuugguguagacaaaua

SEQ ID NO: 974591 - RNA, 19 nt, Homo sapiens
gguacagaagcaaguuuga

SEQ ID NO: 974592 - RNA, 19 nt, Homo sapiens
uauagacaaccaaaucugu

SEQ ID NO: 974593 - RNA, 19 nt, Homo sapiens
aaauguguccugagaaugg

SEQ ID NO: 974594 - RNA, 19 nt, Homo sapiens
gaggaauuaaugccuggaa

SEQ ID NO: 974595 - RNA, 19 nt, Homo sapiens
aaauaccaguucccauugg

SEQ ID NO: 974596 - RNA, 19 nt, Homo sapiens
ccaguggauucgccucaag

SEQ ID NO: 974597 - RNA, 19 nt, Homo sapiens
uacauaggucuuaccauug

SEQ ID NO: 974598 - RNA, 19 nt, Homo sapiens
agacuucaugaacuacaua

SEQ ID NO: 974599 - RNA, 19 nt, Homo sapiens
cguucucacugcuuauguu

SEQ ID NO: 974600 - RNA, 19 nt, Homo sapiens
agccagauaugcacccaau

SEQ ID NO: 974601 - RNA, 19 nt, Homo sapiens
gggccugcgguucugauuu

SEQ ID NO: 974602 - RNA, 19 nt, Homo sapiens
guguuguugccuauaauaa

SEQ ID NO: 974603 - RNA, 19 nt, Homo sapiens
ccaguucccauugguguug

SEQ ID NO: 974604 - RNA, 19 nt, Homo sapiens
guacagaagcaaguuugag

SEQ ID NO: 974605 - RNA, 19 nt, Homo sapiens
uaccauugaccuaagauca

SEQ ID NO: 974606 - RNA, 19 nt, Homo sapiens
gauacugccacaacauguc

SEQ ID NO: 974607 - RNA, 19 nt, Homo sapiens
ggaauacuaucaccucuua

SEQ ID NO: 974608 - RNA, 19 nt, Homo sapiens
cuacauaggucuuaccauu

SEQ ID NO: 974609 - RNA, 19 nt, Homo sapiens
gagaauggaucuuguguac

SEQ ID NO: 974610 - RNA, 19 nt, Homo sapiens
ggaauuaaugccuggaaua

SEQ ID NO: 974611 - RNA, 19 nt, Homo sapiens
ccagaaauguguccugaga

SEQ ID NO: 974612 - RNA, 19 nt, Homo sapiens
gagcucugcuuccuagaaa

SEQ ID NO: 974613 - RNA, 19 nt, Homo sapiens
gccaagacuucaugaacua

SEQ ID NO: 974614 - RNA, 19 nt, Homo sapiens
ucauagaccugcaagcaaa

SEQ ID NO: 974615 - RNA, 19 nt, Homo sapiens
gaauggaucuuguguaccu

SEQ ID NO: 974616 - RNA, 19 nt, Homo sapiens
acauaggucuuaccauuga

SEQ ID NO: 974617 - RNA, 19 nt, Homo sapiens
acauaccacugucaucaua

SEQ ID NO: 974618 - RNA, 19 nt, Homo sapiens
gcacauaccacugucauca

SEQ ID NO: 974619 - RNA, 19 nt, Homo sapiens
agaaauguguccugagaau

SEQ ID NO: 974620 - RNA, 19 nt, Homo sapiens
auuaaugccuggaauacua

SEQ ID NO: 974621 - RNA, 19 nt, Homo sapiens
acaaauaccaguucccauu

SEQ ID NO: 974622 - RNA, 19 nt, Homo sapiens
caaauaccaguucccauug

SEQ ID NO: 974623 - RNA, 19 nt, Homo sapiens
uuacucagcuccagacucu

SEQ ID NO: 974624 - RNA, 19 nt, Homo sapiens
cgagauaugcacccaaugu

SEQ ID NO: 974625 - RNA, 19 nt, Homo sapiens
uaucaccucuuauauagac

SEQ ID NO: 974626 - RNA, 19 nt, Homo sapiens
gaauuaaugccuggaauac

SEQ ID NO: 974627 - RNA, 19 nt, Homo sapiens
gccacaacaugucaacugu

SEQ ID NO: 974628 - RNA, 19 nt, Homo sapiens
gguguuguugccuauaaua

SEQ ID NO: 974629 - RNA, 19 nt, Homo sapiens
ggagcucugcuuccuagaa

SEQ ID NO: 974630 - RNA, 19 nt, Homo sapiens
caacaccuuccguggcuuu

SEQ ID NO: 974631 - RNA, 19 nt, Homo sapiens
gaaauguguccugagaaug

SEQ ID NO: 974632 - RNA, 19 nt, Homo sapiens
ucucacugcuuauguucuu

SEQ ID NO: 974633 - RNA, 19 nt, Homo sapiens
gcccguugcugccugaauc

SEQ ID NO: 974634 - RNA, 19 nt, Homo sapiens
gcaguguguuugugcugau

SEQ ID NO: 974635 - RNA, 19 nt, Homo sapiens
guuguugccuauaauaaac

SEQ ID NO: 974636 - RNA, 19 nt, Homo sapiens
ucagaagggcaccaucuug

SEQ ID NO: 974637 - RNA, 19 nt, Homo sapiens
gaaaagccaagacuucaug

SEQ ID NO: 974638 - RNA, 19 nt, Homo sapiens
aaaggugacuuggccaaca

SEQ ID NO: 974639 - RNA, 19 nt, Homo sapiens
caucauagaccugcaagca

SEQ ID NO: 974640 - RNA, 19 nt, Homo sapiens
ccagggagcgugcaaaauu

SEQ ID NO: 974641 - RNA, 19 nt, Homo sapiens
gcacucccuugguguagac

SEQ ID NO: 974642 - RNA, 19 nt, Homo sapiens
ggcucguucucacugcuua

SEQ ID NO: 974643 - RNA, 19 nt, Homo sapiens
aagaaccuuugcaauaaca

SEQ ID NO: 974644 - RNA, 19 nt, Homo sapiens
ccucuuauauagacaacca

SEQ ID NO: 974645 - RNA, 19 nt, Homo sapiens
ugagaauggaucuugugua

SEQ ID NO: 974646 - RNA, 19 nt, Homo sapiens
auaccacugucaucauaga

SEQ ID NO: 974647 - RNA, 19 nt, Homo sapiens
cagggagcgugcaaaauuu

SEQ ID NO: 974648 - RNA, 19 nt, Homo sapiens
gagauaugcacccaauguc

SEQ ID NO: 974649 - RNA, 19 nt, Homo sapiens
uugguguuguugccuauaa

SEQ ID NO: 974650 - RNA, 19 nt, Homo sapiens
cccuugguguagacaaaua

SEQ ID NO: 974651 - RNA, 19 nt, Homo sapiens
uauagacaaccaaaucugu

SEQ ID NO: 974652 - RNA, 19 nt, Homo sapiens
aaauguguccugagaaugg

SEQ ID NO: 974653 - RNA, 19 nt, Homo sapiens
cccgagauaugcacccaau

SEQ ID NO: 974654 - RNA, 19 nt, Homo sapiens
gaggaauuaaugccuggaa

SEQ ID NO: 974655 - RNA, 19 nt, Homo sapiens
aaauaccaguucccauugg

SEQ ID NO: 974656 - RNA, 19 nt, Homo sapiens
ccaguggauucgccucaag

SEQ ID NO: 974657 - RNA, 19 nt, Homo sapiens
uacauaggucuuaccauug

SEQ ID NO: 974658 - RNA, 19 nt, Homo sapiens
agacuucaugaacuacaua

SEQ ID NO: 974659 - RNA, 19 nt, Homo sapiens
cguucucacugcuuauguu

SEQ ID NO: 974660 - RNA, 19 nt, Homo sapiens
guguuguugccuauaauaa

SEQ ID NO: 974661 - RNA, 19 nt, Homo sapiens
ccaguucccauugguguug

SEQ ID NO: 974662 - RNA, 19 nt, Homo sapiens
uaccauugaccuaagauca

SEQ ID NO: 974663 - RNA, 19 nt, Homo sapiens
gauacugccacaacauguc

SEQ ID NO: 974664 - RNA, 19 nt, Homo sapiens
gaaagaauauggcccaauu

SEQ ID NO: 974665 - RNA, 19 nt, Homo sapiens
gaagaagccucugaagaua

SEQ ID NO: 974666 - RNA, 19 nt, Homo sapiens
gcaggaaggcuuuacauaa

SEQ ID NO: 974667 - RNA, 19 nt, Homo sapiens
ggaagaagccucugaagau

SEQ ID NO: 974668 - RNA, 19 nt, Homo sapiens
gaucugccguguccuuaua

SEQ ID NO: 974669 - RNA, 19 nt, Homo sapiens
ggacuucuguuugaucuuu

SEQ ID NO: 974670 - RNA, 19 nt, Homo sapiens
gaaagcagauugggagaga

SEQ ID NO: 974671 - RNA, 19 nt, Homo sapiens
guuaauggguguuaugaaa

SEQ ID NO: 974672 - RNA, 19 nt, Homo sapiens
gaauuugacuccagugaau

SEQ ID NO: 974673 - RNA, 19 nt, Homo sapiens
gaaaagaagagaccaaaua

SEQ ID NO: 974674 - RNA, 19 nt, Homo sapiens
gaaccugaaagucauguua

SEQ ID NO: 974675 - RNA, 19 nt, Homo sapiens
ucacugacaugaauuugaa

SEQ ID NO: 974676 - RNA, 19 nt, Homo sapiens
agagauaucuggcuugguu

SEQ ID NO: 974677 - RNA, 19 nt, Homo sapiens
cagcaaggaugccucauug

SEQ ID NO: 974678 - RNA, 19 nt, Homo sapiens
gagacgauaucaagauuuc

SEQ ID NO: 974679 - RNA, 19 nt, Homo sapiens
ggaacucucuucucacaag

SEQ ID NO: 974680 - RNA, 19 nt, Homo sapiens
aaaguggaaugugcuaaua

SEQ ID NO: 974681 - RNA, 19 nt, Homo sapiens
ugggagagauggaaacaaa

SEQ ID NO: 974682 - RNA, 19 nt, Homo sapiens
gauaaaccuuaaucccauu

SEQ ID NO: 974683 - RNA, 19 nt, Homo sapiens
gaaauguuaauggguguua

SEQ ID NO: 974684 - RNA, 19 nt, Homo sapiens
caaguuagcauuuacagau

SEQ ID NO: 974685 - RNA, 19 nt, Homo sapiens
gcggaugucuggacucuca

SEQ ID NO: 974686 - RNA, 19 nt, Homo sapiens
gaagaggaucugguugaua

SEQ ID NO: 974687 - RNA, 19 nt, Homo sapiens
ccagaggaguucauggaaa

SEQ ID NO: 974688 - RNA, 19 nt, Homo sapiens
gaaguuaggagacgauauc

SEQ ID NO: 974689 - RNA, 19 nt, Homo sapiens
agaagccucugaagauaaa

SEQ ID NO: 974690 - RNA, 19 nt, Homo sapiens
gcuguugcguccucaauga

SEQ ID NO: 974691 - RNA, 19 nt, Homo sapiens
cagaggaguucauggaaau

SEQ ID NO: 974692 - RNA, 19 nt, Homo sapiens
gaaccgaauugcugaucau

SEQ ID NO: 974693 - RNA, 19 nt, Homo sapiens
caacuugaaaucucaggua

SEQ ID NO: 974694 - RNA, 19 nt, Homo sapiens
uaaaggaucucuucaucac

SEQ ID NO: 974695 - RNA, 19 nt, Homo sapiens
ccaacaacuugaaaucuca

SEQ ID NO: 974696 - RNA, 19 nt, Homo sapiens
gaaagucauguuacuacaa

SEQ ID NO: 974697 - RNA, 19 nt, Homo sapiens
ggagacagcauuuauuaac

SEQ ID NO: 974698 - RNA, 19 nt, Homo sapiens
gcaaggaugccucauugau

SEQ ID NO: 974699 - RNA, 19 nt, Homo sapiens
guacgugcuuuauagugaa

SEQ ID NO: 974700 - RNA, 19 nt, Homo sapiens
ggaaugguggaacgcuuua

SEQ ID NO: 974701 - RNA, 19 nt, Homo sapiens
caagauuuccuuugguuga

SEQ ID NO: 974702 - RNA, 19 nt, Homo sapiens
ugggagacagcauuuauua

SEQ ID NO: 974703 - RNA, 19 nt, Homo sapiens
aagaagagaccaaauacaa

SEQ ID NO: 974704 - RNA, 19 nt, Homo sapiens
cugaggagaauauccauua

SEQ ID NO: 974705 - RNA, 19 nt, Homo sapiens
ggaugaaccagauuuaaag

SEQ ID NO: 974706 - RNA, 19 nt, Homo sapiens
gaaagggaauauuuugaug

SEQ ID NO: 974707 - RNA, 19 nt, Homo sapiens
gaagauaaaguggaaugug

SEQ ID NO: 974708 - RNA, 19 nt, Homo sapiens
aagaggaucugguugauac

SEQ ID NO: 974709 - RNA, 19 nt, Homo sapiens
ugaaccagauuuaaaggau

SEQ ID NO: 974710 - RNA, 19 nt, Homo sapiens
gaggaugaaccagauuuaa

SEQ ID NO: 974711 - RNA, 19 nt, Homo sapiens
cuugaaaucucagguauuc

SEQ ID NO: 974712 - RNA, 19 nt, Homo sapiens
uaugaacagugccuugcua

SEQ ID NO: 974713 - RNA, 19 nt, Homo sapiens
gaagaaagggaauauuuug

SEQ ID NO: 974714 - RNA, 19 nt, Homo sapiens
ugaacuauuuagccagaaa

SEQ ID NO: 974715 - RNA, 19 nt, Homo sapiens
ggaauuugacuccagugaa

SEQ ID NO: 974716 - RNA, 19 nt, Homo sapiens
ccauugaggacuucuguuu

SEQ ID NO: 974717 - RNA, 19 nt, Homo sapiens
ggaagaaagggaauauuuu

SEQ ID NO: 974718 - RNA, 19 nt, Homo sapiens
ccagugaauuugaaguuag

SEQ ID NO: 974719 - RNA, 19 nt, Homo sapiens
ugacuccagugaauuugaa

SEQ ID NO: 974720 - RNA, 19 nt, Homo sapiens
caaggaugccucauugaug

SEQ ID NO: 974721 - RNA, 19 nt, Homo sapiens
ccucugaagauaaaccuua

SEQ ID NO: 974722 - RNA, 19 nt, Homo sapiens
aggaagaaagggaauauuu

SEQ ID NO: 974723 - RNA, 19 nt, Homo sapiens
gcugaucauccaacuuuaa

SEQ ID NO: 974724 - RNA, 19 nt, Homo sapiens
gggagacagcauuuauuaa

SEQ ID NO: 974725 - RNA, 19 nt, Homo sapiens
ggaucugguugauacucua

SEQ ID NO: 974726 - RNA, 19 nt, Homo sapiens
gcacaccccacucugauua

SEQ ID NO: 974727 - RNA, 19 nt, Homo sapiens
ggagacgauaucaagauuu

SEQ ID NO: 974728 - RNA, 19 nt, Homo sapiens
gaacagugccuugcuacgu

SEQ ID NO: 974729 - RNA, 19 nt, Homo sapiens
ugaggagaauauccauuau

SEQ ID NO: 974730 - RNA, 19 nt, Homo sapiens
gauaaaguggaaugugcua

SEQ ID NO: 974731 - RNA, 19 nt, Homo sapiens
ccaaauacaagcagaacug

SEQ ID NO: 974732 - RNA, 19 nt, Homo sapiens
gauaucaagauuuccuuug

SEQ ID NO: 974733 - RNA, 19 nt, Homo sapiens
cagcauuuauuaaccaaag

SEQ ID NO: 974734 - RNA, 19 nt, Homo sapiens
gaggacuucuguuugaucu

SEQ ID NO: 974735 - RNA, 19 nt, Homo sapiens
gcacaagcuugggaacucu

SEQ ID NO: 974736 - RNA, 19 nt, Homo sapiens
caugaguacgugcuuuaua

SEQ ID NO: 974737 - RNA, 19 nt, Homo sapiens
gauguugccagcugcauug

SEQ ID NO: 974738 - RNA, 19 nt, Homo sapiens
uccagugaauuugaaguua

SEQ ID NO: 974739 - RNA, 19 nt, Homo sapiens
ugaggaugaaccagauuua

SEQ ID NO: 974740 - RNA, 19 nt, Homo sapiens
uuuaaaggaucucuucauc

SEQ ID NO: 974741 - RNA, 19 nt, Homo sapiens
cuugggaacucucuucuca

SEQ ID NO: 974742 - RNA, 19 nt, Homo sapiens
gaucauccaacuuuaacau

SEQ ID NO: 974743 - RNA, 19 nt, Homo sapiens
ugaaagucauguuacuaca

SEQ ID NO: 974744 - RNA, 19 nt, Homo sapiens
auugaggacuucuguuuga

SEQ ID NO: 974745 - RNA, 19 nt, Homo sapiens
agauauggcugaggagaau

SEQ ID NO: 974746 - RNA, 19 nt, Homo sapiens
ugauggacaugaacuccuu

SEQ ID NO: 974747 - RNA, 19 nt, Homo sapiens
ggagucauuccuuacauca

SEQ ID NO: 974748 - RNA, 19 nt, Homo sapiens
gggagucauuccuuacauc

SEQ ID NO: 974749 - RNA, 19 nt, Homo sapiens
aguacgugcuuuauaguga

SEQ ID NO: 974750 - RNA, 19 nt, Homo sapiens
agacagcauuuauuaacca

SEQ ID NO: 974751 - RNA, 19 nt, Homo sapiens
caucacagaccaaccuuca

SEQ ID NO: 974752 - RNA, 19 nt, Homo sapiens
uaaaguggaaugugcuaau

SEQ ID NO: 974753 - RNA, 19 nt, Homo sapiens
aggagacgauaucaagauu

SEQ ID NO: 974754 - RNA, 19 nt, Homo sapiens
caacauccccuuuaucaau

SEQ ID NO: 974755 - RNA, 19 nt, Homo sapiens
gacagcauuuauuaaccaa

SEQ ID NO: 974756 - RNA, 19 nt, Homo sapiens
ccagcugcauugacagaug

SEQ ID NO: 974757 - RNA, 19 nt, Homo sapiens
gaucugguugauacucuaa

SEQ ID NO: 974758 - RNA, 19 nt, Homo sapiens
guuaggagacgauaucaag

SEQ ID NO: 974759 - RNA, 19 nt, Homo sapiens
gaaaaccaacaacuugaaa

SEQ ID NO: 974760 - RNA, 19 nt, Homo sapiens
gccguguccuuauaaagug

SEQ ID NO: 974761 - RNA, 19 nt, Homo sapiens
uacaugaguacgugcuuua

SEQ ID NO: 974762 - RNA, 19 nt, Homo sapiens
uaaggaagaaagggaauau

SEQ ID NO: 974763 - RNA, 19 nt, Homo sapiens
ugggaacucucuucucaca

SEQ ID NO: 974764 - RNA, 19 nt, Homo sapiens
gaaagaauauggcccaauu

SEQ ID NO: 974765 - RNA, 19 nt, Homo sapiens
gaagaagccucugaagaua

SEQ ID NO: 974766 - RNA, 19 nt, Homo sapiens
ucacaacgcuguauucauu

SEQ ID NO: 974767 - RNA, 19 nt, Homo sapiens
gcaggaaggcuuuacauaa

SEQ ID NO: 974768 - RNA, 19 nt, Homo sapiens
ggaagaagccucugaagau

SEQ ID NO: 974769 - RNA, 19 nt, Homo sapiens
gaucugccguguccuuaua

SEQ ID NO: 974770 - RNA, 19 nt, Homo sapiens
ggacuucuguuugaucuuu

SEQ ID NO: 974771 - RNA, 19 nt, Homo sapiens
guuaauggguguuaugaaa

SEQ ID NO: 974772 - RNA, 19 nt, Homo sapiens
cuaagaagccuguucauuu

SEQ ID NO: 974773 - RNA, 19 nt, Homo sapiens
caagggagguugaauguca

SEQ ID NO: 974774 - RNA, 19 nt, Homo sapiens
gaauuugacuccagugaau

SEQ ID NO: 974775 - RNA, 19 nt, Homo sapiens
gaaaagaagagaccaaaua

SEQ ID NO: 974776 - RNA, 19 nt, Homo sapiens
gaaccugaaagucauguua

SEQ ID NO: 974777 - RNA, 19 nt, Homo sapiens
ucacugacaugaauuugaa

SEQ ID NO: 974778 - RNA, 19 nt, Homo sapiens
agagauaucuggcuugguu

SEQ ID NO: 974779 - RNA, 19 nt, Homo sapiens
gagacgauaucaagauuuc

SEQ ID NO: 974780 - RNA, 19 nt, Homo sapiens
gauauuaggaugccucauu

SEQ ID NO: 974781 - RNA, 19 nt, Homo sapiens
gaaugucacuccaguuucu

SEQ ID NO: 974782 - RNA, 19 nt, Homo sapiens
ggaacucucuucucacaag

SEQ ID NO: 974783 - RNA, 19 nt, Homo sapiens
gauaaaccuuaaucccauu

SEQ ID NO: 974784 - RNA, 19 nt, Homo sapiens
uaagaagccuguucauuuu

SEQ ID NO: 974785 - RNA, 19 nt, Homo sapiens
gaaauguuaauggguguua

SEQ ID NO: 974786 - RNA, 19 nt, Homo sapiens
ucaaguugcugcugagaga

SEQ ID NO: 974787 - RNA, 19 nt, Homo sapiens
gcggaugucuggacucuca

SEQ ID NO: 974788 - RNA, 19 nt, Homo sapiens
gaagaggaucugguugaua

SEQ ID NO: 974789 - RNA, 19 nt, Homo sapiens
ccagaggaguucauggaaa

SEQ ID NO: 974790 - RNA, 19 nt, Homo sapiens
gaaguuaggagacgauauc

SEQ ID NO: 974791 - RNA, 19 nt, Homo sapiens
agaagccucugaagauaaa

SEQ ID NO: 974792 - RNA, 19 nt, Homo sapiens
gcuguugcguccucaauga

SEQ ID NO: 974793 - RNA, 19 nt, Homo sapiens
cagaggaguucauggaaau

SEQ ID NO: 974794 - RNA, 19 nt, Homo sapiens
gaaccgaauugcugaucau

SEQ ID NO: 974795 - RNA, 19 nt, Homo sapiens
caacuugaaaucucaggua

SEQ ID NO: 974796 - RNA, 19 nt, Homo sapiens
uaaaggaucucuucaucac

SEQ ID NO: 974797 - RNA, 19 nt, Homo sapiens
ccaacaacuugaaaucuca

SEQ ID NO: 974798 - RNA, 19 nt, Homo sapiens
gaaagucauguuacuacaa

SEQ ID NO: 974799 - RNA, 19 nt, Homo sapiens
ggagacagcauuuauuaac

SEQ ID NO: 974800 - RNA, 19 nt, Homo sapiens
guacgugcuuuauagugaa

SEQ ID NO: 974801 - RNA, 19 nt, Homo sapiens
ggaaugguggaacgcuuua

SEQ ID NO: 974802 - RNA, 19 nt, Homo sapiens
caagauuuccuuugguuga

SEQ ID NO: 974803 - RNA, 19 nt, Homo sapiens
ugggagacagcauuuauua

SEQ ID NO: 974804 - RNA, 19 nt, Homo sapiens
aagaagagaccaaauacaa

SEQ ID NO: 974805 - RNA, 19 nt, Homo sapiens
gaaagggaauauuuugaug

SEQ ID NO: 974806 - RNA, 19 nt, Homo sapiens
ggaugaaccagauuuaaag

SEQ ID NO: 974807 - RNA, 19 nt, Homo sapiens
aagaggaucugguugauac

SEQ ID NO: 974808 - RNA, 19 nt, Homo sapiens
ugaaccagauuuaaaggau

SEQ ID NO: 974809 - RNA, 19 nt, Homo sapiens
gaggaugaaccagauuuaa

SEQ ID NO: 974810 - RNA, 19 nt, Homo sapiens
aacguuaccuggagauauu

SEQ ID NO: 974811 - RNA, 19 nt, Homo sapiens
cuugaaaucucagguauuc

SEQ ID NO: 974812 - RNA, 19 nt, Homo sapiens
gaagaaagggaauauuuug

SEQ ID NO: 974813 - RNA, 19 nt, Homo sapiens
ugaacuauuuagccagaaa

SEQ ID NO: 974814 - RNA, 19 nt, Homo sapiens
ggaauuugacuccagugaa

SEQ ID NO: 974815 - RNA, 19 nt, Homo sapiens
ccauugaggacuucuguuu

SEQ ID NO: 974816 - RNA, 19 nt, Homo sapiens
ggaagaaagggaauauuuu

SEQ ID NO: 974817 - RNA, 19 nt, Homo sapiens
ccagugaauuugaaguuag

SEQ ID NO: 974818 - RNA, 19 nt, Homo sapiens
ugacuccagugaauuugaa

SEQ ID NO: 974819 - RNA, 19 nt, Homo sapiens
ccucugaagauaaaccuua

SEQ ID NO: 974820 - RNA, 19 nt, Homo sapiens
aggaagaaagggaauauuu

SEQ ID NO: 974821 - RNA, 19 nt, Homo sapiens
gcugaucauccaacuuuaa

SEQ ID NO: 974822 - RNA, 19 nt, Homo sapiens
gggagacagcauuuauuaa

SEQ ID NO: 974823 - RNA, 19 nt, Homo sapiens
ggaucugguugauacucua

SEQ ID NO: 974824 - RNA, 19 nt, Homo sapiens
gcacaccccacucugauua

SEQ ID NO: 974825 - RNA, 19 nt, Homo sapiens
ggagacgauaucaagauuu

SEQ ID NO: 974826 - RNA, 19 nt, Homo sapiens
ccaaauacaagcagaacug

SEQ ID NO: 974827 - RNA, 19 nt, Homo sapiens
gauaucaagauuuccuuug

SEQ ID NO: 974828 - RNA, 19 nt, Homo sapiens
cagcauuuauuaaccaaag

SEQ ID NO: 974829 - RNA, 19 nt, Homo sapiens
gaggacuucuguuugaucu

SEQ ID NO: 974830 - RNA, 19 nt, Homo sapiens
gcacaagcuugggaacucu

SEQ ID NO: 974831 - RNA, 19 nt, Homo sapiens
gaucacaacgcuguauuca

SEQ ID NO: 974832 - RNA, 19 nt, Homo sapiens
caugaguacgugcuuuaua

SEQ ID NO: 974833 - RNA, 19 nt, Homo sapiens
gauguugccagcugcauug

SEQ ID NO: 974834 - RNA, 19 nt, Homo sapiens
uccagugaauuugaaguua

SEQ ID NO: 974835 - RNA, 19 nt, Homo sapiens
gagagaagaccugaguuca

SEQ ID NO: 974836 - RNA, 19 nt, Homo sapiens
cuugggaacucucuucuca

SEQ ID NO: 974837 - RNA, 19 nt, Homo sapiens
gaucauccaacuuuaacau

SEQ ID NO: 974838 - RNA, 19 nt, Homo sapiens
ugaaagucauguuacuaca

SEQ ID NO: 974839 - RNA, 19 nt, Homo sapiens
uuuaaaggaucucuucauc

SEQ ID NO: 974840 - RNA, 19 nt, Homo sapiens
ugaggaugaaccagauuua

SEQ ID NO: 974841 - RNA, 19 nt, Homo sapiens
auugaggacuucuguuuga

SEQ ID NO: 974842 - RNA, 19 nt, Homo sapiens
ggagucauuccuuacauca

SEQ ID NO: 974843 - RNA, 19 nt, Homo sapiens
gggagucauuccuuacauc

SEQ ID NO: 974844 - RNA, 19 nt, Homo sapiens
ugauggacaugaacuccuu

SEQ ID NO: 974845 - RNA, 19 nt, Homo sapiens
aguacgugcuuuauaguga

SEQ ID NO: 974846 - RNA, 19 nt, Homo sapiens
agacagcauuuauuaacca

SEQ ID NO: 974847 - RNA, 19 nt, Homo sapiens
caucacagaccaaccuuca

SEQ ID NO: 974848 - RNA, 19 nt, Homo sapiens
auauuaggaugccucauug

SEQ ID NO: 974849 - RNA, 19 nt, Homo sapiens
aggagacgauaucaagauu

SEQ ID NO: 974850 - RNA, 19 nt, Homo sapiens
caacauccccuuuaucaau

SEQ ID NO: 974851 - RNA, 19 nt, Homo sapiens
gacagcauuuauuaaccaa

SEQ ID NO: 974852 - RNA, 19 nt, Homo sapiens
ccagcugcauugacagaug

SEQ ID NO: 974853 - RNA, 19 nt, Homo sapiens
gaucugguugauacucuaa

SEQ ID NO: 974854 - RNA, 19 nt, Homo sapiens
guuaggagacgauaucaag

SEQ ID NO: 974855 - RNA, 19 nt, Homo sapiens
gaaaaccaacaacuugaaa

SEQ ID NO: 974856 - RNA, 19 nt, Homo sapiens
gccguguccuuauaaagug

SEQ ID NO: 974857 - RNA, 19 nt, Homo sapiens
uacaugaguacgugcuuua

SEQ ID NO: 974858 - RNA, 19 nt, Homo sapiens
uaaggaagaaagggaauau

SEQ ID NO: 974859 - RNA, 19 nt, Homo sapiens
ugggaacucucuucucaca

SEQ ID NO: 974860 - RNA, 19 nt, Homo sapiens
aagaagccucugaagauaa

SEQ ID NO: 974861 - RNA, 19 nt, Homo sapiens
augaguacgugcuuuauag

SEQ ID NO: 974862 - RNA, 19 nt, Homo sapiens
guugccagcugcauugaca

SEQ ID NO: 974863 - RNA, 19 nt, Homo sapiens
uguggaacaugccauuuua

SEQ ID NO: 974864 - RNA, 19 nt, Homo sapiens
gaagaaauauggaguuuag

SEQ ID NO: 974865 - RNA, 19 nt, Homo sapiens
gcacaaacgauauuccuua

SEQ ID NO: 974866 - RNA, 19 nt, Homo sapiens
ccaccaggauguccauuua

SEQ ID NO: 974867 - RNA, 19 nt, Homo sapiens
gaaaccaaaugaagauguu

SEQ ID NO: 974868 - RNA, 19 nt, Homo sapiens
gagaaggaccgauugauuu

SEQ ID NO: 974869 - RNA, 19 nt, Homo sapiens
gaaggaagcauaauuaucu

SEQ ID NO: 974870 - RNA, 19 nt, Homo sapiens
gaagauagcagaguuacaa

SEQ ID NO: 974871 - RNA, 19 nt, Homo sapiens
uaagaaugcuuucccaaau

SEQ ID NO: 974872 - RNA, 19 nt, Homo sapiens
ucagaaggaagcauaauua

SEQ ID NO: 974873 - RNA, 19 nt, Homo sapiens
guuuagagccugagaauuu

SEQ ID NO: 974874 - RNA, 19 nt, Homo sapiens
ucaguuauguuccuguuaa

SEQ ID NO: 974875 - RNA, 19 nt, Homo sapiens
gcaaagaaagcucaggaaa

SEQ ID NO: 974876 - RNA, 19 nt, Homo sapiens
gcuaagcagguaauuaaua

SEQ ID NO: 974877 - RNA, 19 nt, Homo sapiens
ggauacagaucaagguaau

SEQ ID NO: 974878 - RNA, 19 nt, Homo sapiens
cagccugucuugucuuuaa

SEQ ID NO: 974879 - RNA, 19 nt, Homo sapiens
guucaggacucccgacuug

SEQ ID NO: 974880 - RNA, 19 nt, Homo sapiens
ccaguuauuugagaaagua

SEQ ID NO: 974881 - RNA, 19 nt, Homo sapiens
gcagaagauagcagaguua

SEQ ID NO: 974882 - RNA, 19 nt, Homo sapiens
gcagaacaccagcaguuaa

SEQ ID NO: 974883 - RNA, 19 nt, Homo sapiens
guuaauaccacuaguagaa

SEQ ID NO: 974884 - RNA, 19 nt, Homo sapiens
gcaguuaauaccacuagua

SEQ ID NO: 974885 - RNA, 19 nt, Homo sapiens
ucaccgagcucauuaaagg

SEQ ID NO: 974886 - RNA, 19 nt, Homo sapiens
gauuaaacugguugucuua

SEQ ID NO: 974887 - RNA, 19 nt, Homo sapiens
ugucagaucuugauuaaac

SEQ ID NO: 974888 - RNA, 19 nt, Homo sapiens
gaagaagaaguacagaaau

SEQ ID NO: 974889 - RNA, 19 nt, Homo sapiens
ugaagaagaaguacagaaa

SEQ ID NO: 974890 - RNA, 19 nt, Homo sapiens
uaagugcuauucagucaga

SEQ ID NO: 974891 - RNA, 19 nt, Homo sapiens
gauagcagaguuacaaaga

SEQ ID NO: 974892 - RNA, 19 nt, Homo sapiens
agaaggaccgauugauuua

SEQ ID NO: 974893 - RNA, 19 nt, Homo sapiens
gagacuguaugaauuagau

SEQ ID NO: 974894 - RNA, 19 nt, Homo sapiens
guacagugaaggugaaauu

SEQ ID NO: 974895 - RNA, 19 nt, Homo sapiens
aguaaggccugucauagaa

SEQ ID NO: 974896 - RNA, 19 nt, Homo sapiens
aaagccaguucauggguua

SEQ ID NO: 974897 - RNA, 19 nt, Homo sapiens
aagaaugcuuucccaaauu

SEQ ID NO: 974898 - RNA, 19 nt, Homo sapiens
guuaagugcuauucaguca

SEQ ID NO: 974899 - RNA, 19 nt, Homo sapiens
gguaauaguauguuaagug

SEQ ID NO: 974900 - RNA, 19 nt, Homo sapiens
gagcaauucagaugugauu

SEQ ID NO: 974901 - RNA, 19 nt, Homo sapiens
gaucuugauuaaacugguu

SEQ ID NO: 974902 - RNA, 19 nt, Homo sapiens
gcauguagugcauauuaaa

SEQ ID NO: 974903 - RNA, 19 nt, Homo sapiens
gagacauuaucagaguuua

SEQ ID NO: 974904 - RNA, 19 nt, Homo sapiens
ccauuuaggcgagacauua

SEQ ID NO: 974905 - RNA, 19 nt, Homo sapiens
caacuaccauaugaagcua

SEQ ID NO: 974906 - RNA, 19 nt, Homo sapiens
gaggaggaacccauggaua

SEQ ID NO: 974907 - RNA, 19 nt, Homo sapiens
ccgaggagcccaaguagaa

SEQ ID NO: 974908 - RNA, 19 nt, Homo sapiens
ccaaguagaagaaauaugg

SEQ ID NO: 974909 - RNA, 19 nt, Homo sapiens
gcaauugucagaucuugau

SEQ ID NO: 974910 - RNA, 19 nt, Homo sapiens
uaaagaacuuagagcaaca

SEQ ID NO: 974911 - RNA, 19 nt, Homo sapiens
aaacagaacgcaaagaaag

SEQ ID NO: 974912 - RNA, 19 nt, Homo sapiens
gcuauucagucagaaguug

SEQ ID NO: 974913 - RNA, 19 nt, Homo sapiens
gacaaguacacaacaguuu

SEQ ID NO: 974914 - RNA, 19 nt, Homo sapiens
cacaaacgauauuccuuau

SEQ ID NO: 974915 - RNA, 19 nt, Homo sapiens
uauuugacauugagucuga

SEQ ID NO: 974916 - RNA, 19 nt, Homo sapiens
gaagauguuuucagauaug

SEQ ID NO: 974917 - RNA, 19 nt, Homo sapiens
ugauuaaacugguugucuu

SEQ ID NO: 974918 - RNA, 19 nt, Homo sapiens
gaacaccagcaguuaauac

SEQ ID NO: 974919 - RNA, 19 nt, Homo sapiens
ucagaugcuuauugaagaa

SEQ ID NO: 974920 - RNA, 19 nt, Homo sapiens
ugauuuaggugcaugcaau

SEQ ID NO: 974921 - RNA, 19 nt, Homo sapiens
uuagauggauuaagagaag

SEQ ID NO: 974922 - RNA, 19 nt, Homo sapiens
gaagaugcuuuucacuuug

SEQ ID NO: 974923 - RNA, 19 nt, Homo sapiens
gaacuguacccaccaggau

SEQ ID NO: 974924 - RNA, 19 nt, Homo sapiens
uagcagaguuacaaagaca

SEQ ID NO: 974925 - RNA, 19 nt, Homo sapiens
gaagacaucagcaaaagaa

SEQ ID NO: 974926 - RNA, 19 nt, Homo sapiens
ggaaaccaaaugaagaugu

SEQ ID NO: 974927 - RNA, 19 nt, Homo sapiens
aaagaaagcucaggaaacc

SEQ ID NO: 974928 - RNA, 19 nt, Homo sapiens
gccagccugucuugucuuu

SEQ ID NO: 974929 - RNA, 19 nt, Homo sapiens
gaucaagguaauaguaugu

SEQ ID NO: 974930 - RNA, 19 nt, Homo sapiens
gauauaugagcagaagaua

SEQ ID NO: 974931 - RNA, 19 nt, Homo sapiens
aaaguacagugaaggugaa

SEQ ID NO: 974932 - RNA, 19 nt, Homo sapiens
gcaguaaggccugucauag

SEQ ID NO: 974933 - RNA, 19 nt, Homo sapiens
agaagaugcuuuucacuuu

SEQ ID NO: 974934 - RNA, 19 nt, Homo sapiens
ggcgagacauuaucagagu

SEQ ID NO: 974935 - RNA, 19 nt, Homo sapiens
acagaucaagguaauagua

SEQ ID NO: 974936 - RNA, 19 nt, Homo sapiens
agagaaggaccgauugauu

SEQ ID NO: 974937 - RNA, 19 nt, Homo sapiens
guagaagaaauauggaguu

SEQ ID NO: 974938 - RNA, 19 nt, Homo sapiens
uagagcaacauccuaauug

SEQ ID NO: 974939 - RNA, 19 nt, Homo sapiens
gaacuuagagcaacauccu

SEQ ID NO: 974940 - RNA, 19 nt, Homo sapiens
caaagaaagcucaggaaac

SEQ ID NO: 974941 - RNA, 19 nt, Homo sapiens
ugggagacuguaugaauua

SEQ ID NO: 974942 - RNA, 19 nt, Homo sapiens
gaaaaugcacaaacgauau

SEQ ID NO: 974943 - RNA, 19 nt, Homo sapiens
gagcccaaguagaagaaau

SEQ ID NO: 974944 - RNA, 19 nt, Homo sapiens
ucaggaaaccaaaugaaga

SEQ ID NO: 974945 - RNA, 19 nt, Homo sapiens
uagcagaacaccagcaguu

SEQ ID NO: 974946 - RNA, 19 nt, Homo sapiens
uaagagaaggaccgauuga

SEQ ID NO: 974947 - RNA, 19 nt, Homo sapiens
cauugagucugacaacugu

SEQ ID NO: 974948 - RNA, 19 nt, Homo sapiens
ggaguggugccucauggaa

SEQ ID NO: 974949 - RNA, 19 nt, Homo sapiens
uuaagaaugcuuucccaaa

SEQ ID NO: 974950 - RNA, 19 nt, Homo sapiens
gauuggaucagugcaguaa

SEQ ID NO: 974951 - RNA, 19 nt, Homo sapiens
agaugugauucgacaagua

SEQ ID NO: 974952 - RNA, 19 nt, Homo sapiens
uaauaaugcuugugcuacu

SEQ ID NO: 974953 - RNA, 19 nt, Homo sapiens
cagaaggaagcauaauuau

SEQ ID NO: 974954 - RNA, 19 nt, Homo sapiens
gcuuauugaagaagaagua

SEQ ID NO: 974955 - RNA, 19 nt, Homo sapiens
gaugcuuauugaagaagaa

SEQ ID NO: 974956 - RNA, 19 nt, Homo sapiens
cgacaaguacacaacaguu

SEQ ID NO: 974957 - RNA, 19 nt, Homo sapiens
cgagacauuaucagaguuu

SEQ ID NO: 974958 - RNA, 19 nt, Homo sapiens
cagugaaggugaaauucga

SEQ ID NO: 974959 - RNA, 19 nt, Homo sapiens
caguaaggccugucauaga

SEQ ID NO: 974960 - RNA, 19 nt, Homo sapiens
ccaguucauggguuaauuu

SEQ ID NO: 974961 - RNA, 19 nt, Homo sapiens
gcgagacauuaucagaguu

SEQ ID NO: 974962 - RNA, 19 nt, Homo sapiens
cugguugucuuauuucuuc

SEQ ID NO: 974963 - RNA, 19 nt, Homo sapiens
gcucaggaaaccaaaugaa

SEQ ID NO: 974964 - RNA, 19 nt, Homo sapiens
ccaggaagguguucuguga

SEQ ID NO: 974965 - RNA, 19 nt, Homo sapiens
agacaucccucgccauuga

SEQ ID NO: 974966 - RNA, 19 nt, Homo sapiens
gaacuggaaggauuacaaa

SEQ ID NO: 974967 - RNA, 19 nt, Homo sapiens
gcagugagaaccagcuaua

SEQ ID NO: 974968 - RNA, 19 nt, Homo sapiens
cagcggaacuggaaggauu

SEQ ID NO: 974969 - RNA, 19 nt, Homo sapiens
ccaacaagcuggagaacca

SEQ ID NO: 974970 - RNA, 19 nt, Homo sapiens
gcagacaucccucgccauu

SEQ ID NO: 974971 - RNA, 19 nt, Homo sapiens
ugaaugggcugagaacaga

SEQ ID NO: 974972 - RNA, 19 nt, Homo sapiens
gaaccagacaucaagaaug

SEQ ID NO: 974973 - RNA, 19 nt, Homo sapiens
gagaauggcaccgugaauu

SEQ ID NO: 974974 - RNA, 19 nt, Homo sapiens
ccaacacccuccagagaga

SEQ ID NO: 974975 - RNA, 19 nt, Homo sapiens
aagaauggaugcccagaug

SEQ ID NO: 974976 - RNA, 19 nt, Homo sapiens
gcaccagccuccugaacca

SEQ ID NO: 974977 - RNA, 19 nt, Homo sapiens
caaauggcccagaaucaga

SEQ ID NO: 974978 - RNA, 19 nt, Homo sapiens
agaauggcaccgugaauuu

SEQ ID NO: 974979 - RNA, 19 nt, Homo sapiens
gagcagguccagcagcaaa

SEQ ID NO: 974980 - RNA, 19 nt, Homo sapiens
cugcagaacaccagcuuua

SEQ ID NO: 974981 - RNA, 19 nt, Homo sapiens
ggaacuggaaggauuacaa

SEQ ID NO: 974982 - RNA, 19 nt, Homo sapiens
caacgaagcccaggaaggu

SEQ ID NO: 974983 - RNA, 19 nt, Homo sapiens
caagugugcccaagugaug

SEQ ID NO: 974984 - RNA, 19 nt, Homo sapiens
aaccagacaucaagaaugg

SEQ ID NO: 974985 - RNA, 19 nt, Homo sapiens
ccagaccacugcccagauc

SEQ ID NO: 974986 - RNA, 19 nt, Homo sapiens
cgacaacaaguacaagaug

SEQ ID NO: 974987 - RNA, 19 nt, Homo sapiens
gcaaauggcccagaaucag

SEQ ID NO: 974988 - RNA, 19 nt, Homo sapiens
gauacggccuuuggacauc

SEQ ID NO: 974989 - RNA, 19 nt, Homo sapiens
aaacagcgcgcucgagaag

SEQ ID NO: 974990 - RNA, 19 nt, Homo sapiens
ccaggacugugcagagauc

SEQ ID NO: 974991 - RNA, 19 nt, Homo sapiens
cuagagagggccaucaaga

SEQ ID NO: 974992 - RNA, 19 nt, Homo sapiens
gagggucacaguaccuuga

SEQ ID NO: 974993 - RNA, 19 nt, Homo sapiens
gaagggcagccuacucucu

SEQ ID NO: 974994 - RNA, 19 nt, Homo sapiens
ggucacaguaccuugaaug

SEQ ID NO: 974995 - RNA, 19 nt, Homo sapiens
gcaugaugauacggccuuu

SEQ ID NO: 974996 - RNA, 19 nt, Homo sapiens
gcaagugugcccaagugau

SEQ ID NO: 974997 - RNA, 19 nt, Homo sapiens
uuagcacccuugacucaga

SEQ ID NO: 974998 - RNA, 19 nt, Homo sapiens
gcaagccuggccacuguug

SEQ ID NO: 974999 - RNA, 19 nt, Homo sapiens
aaccagcuauacaggcuuu

SEQ ID NO: 975000 - RNA, 19 nt, Homo sapiens
gccagcauccucagcaaga

SEQ ID NO: 975001 - RNA, 19 nt, Homo sapiens
gggcugcgagacacuugua

SEQ ID NO: 975002 - RNA, 19 nt, Homo sapiens
cuaccacgcucccgacaac

SEQ ID NO: 975003 - RNA, 19 nt, Homo sapiens
cugcaagugugcccaagug

SEQ ID NO: 975004 - RNA, 19 nt, Homo sapiens
cagaacaccagcuuuagca

SEQ ID NO: 975005 - RNA, 19 nt, Homo sapiens
gcacuggcugggcaaugaa

SEQ ID NO: 975006 - RNA, 19 nt, Homo sapiens
ccagaugccagagaccuuu

SEQ ID NO: 975007 - RNA, 19 nt, Homo sapiens
gggcugagaacagaccaaa

SEQ ID NO: 975008 - RNA, 19 nt, Homo sapiens
cagaagggcagccuacucu

SEQ ID NO: 975009 - RNA, 19 nt, Homo sapiens
gcgugccucucgcaugaug

SEQ ID NO: 975010 - RNA, 19 nt, Homo sapiens
ccaugucuguggcucaaca

SEQ ID NO: 975011 - RNA, 19 nt, Homo sapiens
ccagcauccucagcaagaa

SEQ ID NO: 975012 - RNA, 19 nt, Homo sapiens
gcaagcugaccgacaugga

SEQ ID NO: 975013 - RNA, 19 nt, Homo sapiens
cagcaaauggcccagaauc

SEQ ID NO: 975014 - RNA, 19 nt, Homo sapiens
ucuggaggguggugguuug

SEQ ID NO: 975015 - RNA, 19 nt, Homo sapiens
gcagaacaccagcuuuagc

SEQ ID NO: 975016 - RNA, 19 nt, Homo sapiens
ccaccaacaagcuggagaa

SEQ ID NO: 975017 - RNA, 19 nt, Homo sapiens
agaccuuucuguccaccaa

SEQ ID NO: 975018 - RNA, 19 nt, Homo sapiens
caaggcaggaggcggauag

SEQ ID NO: 975019 - RNA, 19 nt, Homo sapiens
aggcgaagcugcugaacac

SEQ ID NO: 975020 - RNA, 19 nt, Homo sapiens
caccaugucuguggcucaa

SEQ ID NO: 975021 - RNA, 19 nt, Homo sapiens
caggagaagcucggacuug

SEQ ID NO: 975022 - RNA, 19 nt, Homo sapiens
gaauggcaccgugaauuuu

SEQ ID NO: 975023 - RNA, 19 nt, Homo sapiens
caagaauggaugcccagau

SEQ ID NO: 975024 - RNA, 19 nt, Homo sapiens
ccauugacacaucuucaga

SEQ ID NO: 975025 - RNA, 19 nt, Homo sapiens
cgcaguggcugaagaagcu

SEQ ID NO: 975026 - RNA, 19 nt, Homo sapiens
ucagaugcucucccagcua

SEQ ID NO: 975027 - RNA, 19 nt, Homo sapiens
cuggaaggauuacaaacag

SEQ ID NO: 975028 - RNA, 19 nt, Homo sapiens
ccagacaucaagaauggau

SEQ ID NO: 975029 - RNA, 19 nt, Homo sapiens
gcagguccagcagcaaaug

SEQ ID NO: 975030 - RNA, 19 nt, Homo sapiens
agagggccaucaagacgau

SEQ ID NO: 975031 - RNA, 19 nt, Homo sapiens
ucaacggcgucuacuacca

SEQ ID NO: 975032 - RNA, 19 nt, Homo sapiens
ccauccagguguccaaugc

SEQ ID NO: 975033 - RNA, 19 nt, Homo sapiens
ugaaccagacaucaagaau

SEQ ID NO: 975034 - RNA, 19 nt, Homo sapiens
ccucaacggcgucuacuac

SEQ ID NO: 975035 - RNA, 19 nt, Homo sapiens
gcagcaaauggcccagaau

SEQ ID NO: 975036 - RNA, 19 nt, Homo sapiens
acacgcaguggcugaagaa

SEQ ID NO: 975037 - RNA, 19 nt, Homo sapiens
gagaaacuguggagcuuua

SEQ ID NO: 975038 - RNA, 19 nt, Homo sapiens
gacaagggauguucucaaa

SEQ ID NO: 975039 - RNA, 19 nt, Homo sapiens
uaagguggaugaugacuuu

SEQ ID NO: 975040 - RNA, 19 nt, Homo sapiens
gaaagugcaucacagacaa

SEQ ID NO: 975041 - RNA, 19 nt, Homo sapiens
gagcugcaguccaguuuaa

SEQ ID NO: 975042 - RNA, 19 nt, Homo sapiens
caccacaccuggcuaauuu

SEQ ID NO: 975043 - RNA, 19 nt, Homo sapiens
gaagauauaggaaguucua

SEQ ID NO: 975044 - RNA, 19 nt, Homo sapiens
ggaaaguguuuacuggauu

SEQ ID NO: 975045 - RNA, 19 nt, Homo sapiens
ggaagcagaucaaagaaag

SEQ ID NO: 975046 - RNA, 19 nt, Homo sapiens
gauagaagaagcuguguaa

SEQ ID NO: 975047 - RNA, 19 nt, Homo sapiens
gggcagacauuaacauuca

SEQ ID NO: 975048 - RNA, 19 nt, Homo sapiens
gguguaagguggaugauga

SEQ ID NO: 975049 - RNA, 19 nt, Homo sapiens
agaagaagcuguguaaugu

SEQ ID NO: 975050 - RNA, 19 nt, Homo sapiens
ccagagcuccgacuuauuu

SEQ ID NO: 975051 - RNA, 19 nt, Homo sapiens
gaaaguguuuacuggauuc

SEQ ID NO: 975052 - RNA, 19 nt, Homo sapiens
caagcugugugcauuagua

SEQ ID NO: 975053 - RNA, 19 nt, Homo sapiens
ccacauuggugccucauga

SEQ ID NO: 975054 - RNA, 19 nt, Homo sapiens
gccagaagcucauagaaca

SEQ ID NO: 975055 - RNA, 19 nt, Homo sapiens
uaacuuaggccauuggaaa

SEQ ID NO: 975056 - RNA, 19 nt, Homo sapiens
caacguugauuaccaguuc

SEQ ID NO: 975057 - RNA, 19 nt, Homo sapiens
uuggaugacucaauucuua

SEQ ID NO: 975058 - RNA, 19 nt, Homo sapiens
aguauaggcuacaguauuu

SEQ ID NO: 975059 - RNA, 19 nt, Homo sapiens
ccaguuuaaugucaguuua

SEQ ID NO: 975060 - RNA, 19 nt, Homo sapiens
gauggaaaguguuaguguu

SEQ ID NO: 975061 - RNA, 19 nt, Homo sapiens
gaaccaccaguaauaauga

SEQ ID NO: 975062 - RNA, 19 nt, Homo sapiens
ucaguuggaugacucaauu

SEQ ID NO: 975063 - RNA, 19 nt, Homo sapiens
gaucaagcugugugcauua

SEQ ID NO: 975064 - RNA, 19 nt, Homo sapiens
gaagaagcuguguaaugua

SEQ ID NO: 975065 - RNA, 19 nt, Homo sapiens
gaauaggucagauagaaga

SEQ ID NO: 975066 - RNA, 19 nt, Homo sapiens
ggaaaguguuaguguuuua

SEQ ID NO: 975067 - RNA, 19 nt, Homo sapiens
ggaucaagcugugugcauu

SEQ ID NO: 975068 - RNA, 19 nt, Homo sapiens
gauaggucauuccacauug

SEQ ID NO: 975069 - RNA, 19 nt, Homo sapiens
ggacagcuuaccagaagua

SEQ ID NO: 975070 - RNA, 19 nt, Homo sapiens
uguaagcaguguugacuuu

SEQ ID NO: 975071 - RNA, 19 nt, Homo sapiens
uuggaaagcuccuggauga

SEQ ID NO: 975072 - RNA, 19 nt, Homo sapiens
aguaguagauuuccacuug

SEQ ID NO: 975073 - RNA, 19 nt, Homo sapiens
gaagauguucuagaaugua

SEQ ID NO: 975074 - RNA, 19 nt, Homo sapiens
guagauuuccacuuguuua

SEQ ID NO: 975075 - RNA, 19 nt, Homo sapiens
ugacugugcucuccauguu

SEQ ID NO: 975076 - RNA, 19 nt, Homo sapiens
cuaggaaccaccaguaaua

SEQ ID NO: 975077 - RNA, 19 nt, Homo sapiens
gcaguccaguuuaauguca

SEQ ID NO: 975078 - RNA, 19 nt, Homo sapiens
gcacguguguauccaaucu

SEQ ID NO: 975079 - RNA, 19 nt, Homo sapiens
gaucaaagaaagugcauca

SEQ ID NO: 975080 - RNA, 19 nt, Homo sapiens
ucucaaaguugguuauuag

SEQ ID NO: 975081 - RNA, 19 nt, Homo sapiens
aagaagcuguguaauguau

SEQ ID NO: 975082 - RNA, 19 nt, Homo sapiens
ggaaccaccaguaauaaug

SEQ ID NO: 975083 - RNA, 19 nt, Homo sapiens
gacauuaacauucagaguu

SEQ ID NO: 975084 - RNA, 19 nt, Homo sapiens
gagaagagaaugagaaacu

SEQ ID NO: 975085 - RNA, 19 nt, Homo sapiens
caacacugcagaggacuua

SEQ ID NO: 975086 - RNA, 19 nt, Homo sapiens
aggaauaggucagauagaa

SEQ ID NO: 975087 - RNA, 19 nt, Homo sapiens
acauuaacauucagaguug

SEQ ID NO: 975088 - RNA, 19 nt, Homo sapiens
gauagaagaacuaauagag

SEQ ID NO: 975089 - RNA, 19 nt, Homo sapiens
gaacaggagaccauuaaac

SEQ ID NO: 975090 - RNA, 19 nt, Homo sapiens
gcaguggugugaucucagu

SEQ ID NO: 975091 - RNA, 19 nt, Homo sapiens
ggagugcaguggugugauc

SEQ ID NO: 975092 - RNA, 19 nt, Homo sapiens
ccucuucaguaaucuuuaa

SEQ ID NO: 975093 - RNA, 19 nt, Homo sapiens
uagaagaagcuguguaaug

SEQ ID NO: 975094 - RNA, 19 nt, Homo sapiens
ggauguauauguagguucu

SEQ ID NO: 975095 - RNA, 19 nt, Homo sapiens
guacagauagaagaacuaa

SEQ ID NO: 975096 - RNA, 19 nt, Homo sapiens
guaauaugcacguguguau

SEQ ID NO: 975097 - RNA, 19 nt, Homo sapiens
ucuauacccuuccacugua

SEQ ID NO: 975098 - RNA, 19 nt, Homo sapiens
ggagaccauuaaaccacua

SEQ ID NO: 975099 - RNA, 19 nt, Homo sapiens
agacaggguuucaccaugu

SEQ ID NO: 975100 - RNA, 19 nt, Homo sapiens
ccauguaacucuuuagaac

SEQ ID NO: 975101 - RNA, 19 nt, Homo sapiens
gguccacugucacguuuga

SEQ ID NO: 975102 - RNA, 19 nt, Homo sapiens
agacagaagagacagcaua

SEQ ID NO: 975103 - RNA, 19 nt, Homo sapiens
guuuagggauuaagaagau

SEQ ID NO: 975104 - RNA, 19 nt, Homo sapiens
gcacauagaccccaacguu

SEQ ID NO: 975105 - RNA, 19 nt, Homo sapiens
gaagagaaugagaaacugu

SEQ ID NO: 975106 - RNA, 19 nt, Homo sapiens
guucuuucauugcaauuug

SEQ ID NO: 975107 - RNA, 19 nt, Homo sapiens
ccaaguccauguaacucuu

SEQ ID NO: 975108 - RNA, 19 nt, Homo sapiens
cagaagagacagcauagga

SEQ ID NO: 975109 - RNA, 19 nt, Homo sapiens
gggagaagagaaugagaaa

SEQ ID NO: 975110 - RNA, 19 nt, Homo sapiens
ccauuaaaccacuagauga

SEQ ID NO: 975111 - RNA, 19 nt, Homo sapiens
aagcuucgaguaacuauaa

SEQ ID NO: 975112 - RNA, 19 nt, Homo sapiens
gaaaugacaaaucaguuac

SEQ ID NO: 975113 - RNA, 19 nt, Homo sapiens
gaggauguauauguagguu

SEQ ID NO: 975114 - RNA, 19 nt, Homo sapiens
ccacuuguuuagggauuaa

SEQ ID NO: 975115 - RNA, 19 nt, Homo sapiens
ccaaagugcuaggauuaca

SEQ ID NO: 975116 - RNA, 19 nt, Homo sapiens
ugaugugccuuguuuaucu

SEQ ID NO: 975117 - RNA, 19 nt, Homo sapiens
guuagacaaucaugaccuu

SEQ ID NO: 975118 - RNA, 19 nt, Homo sapiens
caguauaggcuacaguauu

SEQ ID NO: 975119 - RNA, 19 nt, Homo sapiens
gacaggguuucaccauguu

SEQ ID NO: 975120 - RNA, 19 nt, Homo sapiens
uaagcaguguugacuuuua

SEQ ID NO: 975121 - RNA, 19 nt, Homo sapiens
ucgaagaaauauagcacuu

SEQ ID NO: 975122 - RNA, 19 nt, Homo sapiens
gagcagucgaagaaauaua

SEQ ID NO: 975123 - RNA, 19 nt, Homo sapiens
aaagaaagugcaucacaga

SEQ ID NO: 975124 - RNA, 19 nt, Homo sapiens
gauaccuuguccagccaua

SEQ ID NO: 975125 - RNA, 19 nt, Homo sapiens
gcuccaguuucguaaaugu

SEQ ID NO: 975126 - RNA, 19 nt, Homo sapiens
guaguagauuuccacuugu

SEQ ID NO: 975127 - RNA, 19 nt, Homo sapiens
guauauguagguucugaaa

SEQ ID NO: 975128 - RNA, 19 nt, Homo sapiens
ugguugaugugccuuguuu

SEQ ID NO: 975129 - RNA, 19 nt, Homo sapiens
uaguagauuuccacuuguu

SEQ ID NO: 975130 - RNA, 19 nt, Homo sapiens
gaccaagugucuaaaauag

SEQ ID NO: 975131 - RNA, 19 nt, Homo sapiens
gugguucucuuuacuuugg

SEQ ID NO: 975132 - RNA, 19 nt, Homo sapiens
ucaaagaaagugcaucaca

SEQ ID NO: 975133 - RNA, 19 nt, Homo sapiens
ggacaaaaucauacaauuc

SEQ ID NO: 975134 - RNA, 19 nt, Homo sapiens
ggauggaaaguguuagugu

SEQ ID NO: 975135 - RNA, 19 nt, Homo sapiens
gguggaugaugacuuuaca

SEQ ID NO: 975136 - RNA, 19 nt, Homo sapiens
uuguuuaucugcucaguug

SEQ ID NO: 975137 - RNA, 19 nt, Homo sapiens
caacauguaugcuguaaau

SEQ ID NO: 975138 - RNA, 19 nt, Homo sapiens
ggucaaggcugaugagaga

SEQ ID NO: 975139 - RNA, 19 nt, Homo sapiens
gaaacccugucucuacuaa

SEQ ID NO: 975140 - RNA, 19 nt, Homo sapiens
ggaaaagacugauaaaaug

SEQ ID NO: 975141 - RNA, 19 nt, Homo sapiens
gcaaugcucugcacuucuu

SEQ ID NO: 975142 - RNA, 19 nt, Homo sapiens
gaagggagcugcguuucug

SEQ ID NO: 975143 - RNA, 19 nt, Homo sapiens
gaaccagugucucccagaa

SEQ ID NO: 975144 - RNA, 19 nt, Homo sapiens
gcuuugaccuacuaacuuu

SEQ ID NO: 975145 - RNA, 19 nt, Homo sapiens
ccacugaaguccucauuuc

SEQ ID NO: 975146 - RNA, 19 nt, Homo sapiens
ccuacuaacuuucuccuaa

SEQ ID NO: 975147 - RNA, 19 nt, Homo sapiens
agagagagguccugcuaaa

SEQ ID NO: 975148 - RNA, 19 nt, Homo sapiens
cuaacuuucuccuaacuaa

SEQ ID NO: 975149 - RNA, 19 nt, Homo sapiens
gacccugacucccacagua

SEQ ID NO: 975150 - RNA, 19 nt, Homo sapiens
gaagaagcgggaaggguuu

SEQ ID NO: 975151 - RNA, 19 nt, Homo sapiens
gagagguccugcuaaagau

SEQ ID NO: 975152 - RNA, 19 nt, Homo sapiens
gggccaggcugcauuagga

SEQ ID NO: 975153 - RNA, 19 nt, Homo sapiens
caguaugucuauaugauga

SEQ ID NO: 975154 - RNA, 19 nt, Homo sapiens
gcacuucuucuccaggaua

SEQ ID NO: 975155 - RNA, 19 nt, Homo sapiens
uaucagcgcuacccggauu

SEQ ID NO: 975156 - RNA, 19 nt, Homo sapiens
guacgagacucuguuccaa

SEQ ID NO: 975157 - RNA, 19 nt, Homo sapiens
gugauucgcuacaguguca

SEQ ID NO: 975158 - RNA, 19 nt, Homo sapiens
ggaugaggccauucagaaa

SEQ ID NO: 975159 - RNA, 19 nt, Homo sapiens
aagaggaggugcugaggaa

SEQ ID NO: 975160 - RNA, 19 nt, Homo sapiens
uauaugcuuugaccuacua

SEQ ID NO: 975161 - RNA, 19 nt, Homo sapiens
gcaggagaguccagauuac

SEQ ID NO: 975162 - RNA, 19 nt, Homo sapiens
gguuugagcuagucaugga

SEQ ID NO: 975163 - RNA, 19 nt, Homo sapiens
gcgcaauguuuauaugcuu

SEQ ID NO: 975164 - RNA, 19 nt, Homo sapiens
gagcagagagauccugaug

SEQ ID NO: 975165 - RNA, 19 nt, Homo sapiens
gcaaaugcgcuugauggaa

SEQ ID NO: 975166 - RNA, 19 nt, Homo sapiens
gaauauguguugcuuuugu

SEQ ID NO: 975167 - RNA, 19 nt, Homo sapiens
ggacaaguucuacgaugug

SEQ ID NO: 975168 - RNA, 19 nt, Homo sapiens
ggaggcaauugcugaugug

SEQ ID NO: 975169 - RNA, 19 nt, Homo sapiens
ucaaggagcgcauggugaa

SEQ ID NO: 975170 - RNA, 19 nt, Homo sapiens
acgaaaggcugucaaaggu

SEQ ID NO: 975171 - RNA, 19 nt, Homo sapiens
gaguccagauuaccacgaa

SEQ ID NO: 975172 - RNA, 19 nt, Homo sapiens
gauggaaggagaugucaau

SEQ ID NO: 975173 - RNA, 19 nt, Homo sapiens
acagugaccugcgcaaugu

SEQ ID NO: 975174 - RNA, 19 nt, Homo sapiens
ggugaaacccugucucuac

SEQ ID NO: 975175 - RNA, 19 nt, Homo sapiens
agagagguccugcuaaaga

SEQ ID NO: 975176 - RNA, 19 nt, Homo sapiens
ugccuagccuuagccauua

SEQ ID NO: 975177 - RNA, 19 nt, Homo sapiens
gggaaggguuugagcuagu

SEQ ID NO: 975178 - RNA, 19 nt, Homo sapiens
ggacugcaaaugcgcuuga

SEQ ID NO: 975179 - RNA, 19 nt, Homo sapiens
gcagugagccgagauugca

SEQ ID NO: 975180 - RNA, 19 nt, Homo sapiens
gaccugcgcaauguuuaua

SEQ ID NO: 975181 - RNA, 19 nt, Homo sapiens
ucauggagccugaguuugu

SEQ ID NO: 975182 - RNA, 19 nt, Homo sapiens
ggaaggguuugagcuaguc

SEQ ID NO: 975183 - RNA, 19 nt, Homo sapiens
ccagaagggagcugcguuu

SEQ ID NO: 975184 - RNA, 19 nt, Homo sapiens
cauguaugcuguaaaucug

SEQ ID NO: 975185 - RNA, 19 nt, Homo sapiens
gagccugaguuugucaaug

SEQ ID NO: 975186 - RNA, 19 nt, Homo sapiens
ucacaucgaaggaguguca

SEQ ID NO: 975187 - RNA, 19 nt, Homo sapiens
gcucuucucuggguuggau

SEQ ID NO: 975188 - RNA, 19 nt, Homo sapiens
gaugucaauuccacugaag

SEQ ID NO: 975189 - RNA, 19 nt, Homo sapiens
guuuauaugcuuugaccua

SEQ ID NO: 975190 - RNA, 19 nt, Homo sapiens
caacuucuuccgugugguu

SEQ ID NO: 975191 - RNA, 19 nt, Homo sapiens
ccaguacacauaugaaauc

SEQ ID NO: 975192 - RNA, 19 nt, Homo sapiens
gugaaacccugucucuacu

SEQ ID NO: 975193 - RNA, 19 nt, Homo sapiens
gcgggaaggguuugagcua

SEQ ID NO: 975194 - RNA, 19 nt, Homo sapiens
gcgcaucgaccaggccuuu

SEQ ID NO: 975195 - RNA, 19 nt, Homo sapiens
ggagcguccugcugucaca

SEQ ID NO: 975196 - RNA, 19 nt, Homo sapiens
cgaccaggccuuuguccuu

SEQ ID NO: 975197 - RNA, 19 nt, Homo sapiens
aaagauggacugcaaaugc

SEQ ID NO: 975198 - RNA, 19 nt, Homo sapiens
uuagagagagguccugcua

SEQ ID NO: 975199 - RNA, 19 nt, Homo sapiens
gaugaggccauucagaaag

SEQ ID NO: 975200 - RNA, 19 nt, Homo sapiens
cgcaauguuuauaugcuuu

SEQ ID NO: 975201 - RNA, 19 nt, Homo sapiens
acaccagccaguacacaua

SEQ ID NO: 975202 - RNA, 19 nt, Homo sapiens
cguccagcaucaaacacua

SEQ ID NO: 975203 - RNA, 19 nt, Homo sapiens
uggaugaggccauucagaa

SEQ ID NO: 975204 - RNA, 19 nt, Homo sapiens
gagaugucaauuccacuga

SEQ ID NO: 975205 - RNA, 19 nt, Homo sapiens
gcaauguuuauaugcuuug

SEQ ID NO: 975206 - RNA, 19 nt, Homo sapiens
cgaggcggguggaucacuu

SEQ ID NO: 975207 - RNA, 19 nt, Homo sapiens
ccuguaaucccagcacuuu

SEQ ID NO: 975208 - RNA, 19 nt, Homo sapiens
agcaggagaguccagauua

SEQ ID NO: 975209 - RNA, 19 nt, Homo sapiens
agccugaguuugucaaugu

SEQ ID NO: 975210 - RNA, 19 nt, Homo sapiens
gaaggcacagggcgaucaa

SEQ ID NO: 975211 - RNA, 19 nt, Homo sapiens
ggaaggcacagggcgauca

SEQ ID NO: 975212 - RNA, 19 nt, Homo sapiens
gguggccugugccuguaaa

SEQ ID NO: 975213 - RNA, 19 nt, Homo sapiens
gcuaaagauggacugcaaa

SEQ ID NO: 975214 - RNA, 19 nt, Homo sapiens
cugaagcuguggcucaugu

SEQ ID NO: 975215 - RNA, 19 nt, Homo sapiens
aagcugaauacaagucuuu

SEQ ID NO: 975216 - RNA, 19 nt, Homo sapiens
cuacuaacuuucuccuaac

SEQ ID NO: 975217 - RNA, 19 nt, Homo sapiens
agucauggagccugaguuu

SEQ ID NO: 975218 - RNA, 19 nt, Homo sapiens
cuaaagauggacugcaaau

SEQ ID NO: 975219 - RNA, 19 nt, Homo sapiens
uggaggcaauugcugaugu

SEQ ID NO: 975220 - RNA, 19 nt, Homo sapiens
ugcuaaagauggacugcaa

SEQ ID NO: 975221 - RNA, 19 nt, Homo sapiens
ucccuggaauaggauaaua

SEQ ID NO: 975222 - RNA, 19 nt, Homo sapiens
aguaauauuugagcugugu

SEQ ID NO: 975223 - RNA, 19 nt, Homo sapiens
gcaucgaccaggccuuugu

SEQ ID NO: 975224 - RNA, 19 nt, Homo sapiens
gcaggacaaguucuacgau

SEQ ID NO: 975225 - RNA, 19 nt, Homo sapiens
gaugugugccagcgucaug

SEQ ID NO: 975226 - RNA, 19 nt, Homo sapiens
gccaguacacauaugaaau

SEQ ID NO: 975227 - RNA, 19 nt, Homo sapiens
ggacccaguggcuguggaa

SEQ ID NO: 975228 - RNA, 19 nt, Homo sapiens
gcugaauacaagucuuuau

SEQ ID NO: 975229 - RNA, 19 nt, Homo sapiens
agaugucaauuccacugaa

SEQ ID NO: 975230 - RNA, 19 nt, Homo sapiens
cugccuagccuuagccauu

SEQ ID NO: 975231 - RNA, 19 nt, Homo sapiens
aggacaaguucuacgaugu

SEQ ID NO: 975232 - RNA, 19 nt, Homo sapiens
cuggagaggcagauuggua

SEQ ID NO: 975233 - RNA, 19 nt, Homo sapiens
gaaaaugguccccgaggau

SEQ ID NO: 975234 - RNA, 19 nt, Homo sapiens
uccaacauguaugcuguaa

SEQ ID NO: 975235 - RNA, 19 nt, Homo sapiens
uguuugugcucauggaaga

SEQ ID NO: 975236 - RNA, 19 nt, Homo sapiens
ugaaacccugucucuacua

SEQ ID NO: 975237 - RNA, 19 nt, Homo sapiens
ggacgaggaucuucuauuu

SEQ ID NO: 975238 - RNA, 19 nt, Homo sapiens
ggaugaagcuauuaagaua

SEQ ID NO: 975239 - RNA, 19 nt, Homo sapiens
gaagaaagauaauguagca

SEQ ID NO: 975240 - RNA, 19 nt, Homo sapiens
gaagaguucuauagguuaa

SEQ ID NO: 975241 - RNA, 19 nt, Homo sapiens
gaauuucacugguuguaaa

SEQ ID NO: 975242 - RNA, 19 nt, Homo sapiens
ugaauaaucuuuccuguuc

SEQ ID NO: 975243 - RNA, 19 nt, Homo sapiens
gagccauucugccaauuua

SEQ ID NO: 975244 - RNA, 19 nt, Homo sapiens
gggaacaguuggcuaaauu

SEQ ID NO: 975245 - RNA, 19 nt, Homo sapiens
guuaugaacugacugguuu

SEQ ID NO: 975246 - RNA, 19 nt, Homo sapiens
gcaggugacuucagcacua

SEQ ID NO: 975247 - RNA, 19 nt, Homo sapiens
gaacaguuggcuaaauuaa

SEQ ID NO: 975248 - RNA, 19 nt, Homo sapiens
cgacagauccuaaagaaga

SEQ ID NO: 975249 - RNA, 19 nt, Homo sapiens
gaacguacucuugcuuaua

SEQ ID NO: 975250 - RNA, 19 nt, Homo sapiens
gagaaggacuuggagcaaa

SEQ ID NO: 975251 - RNA, 19 nt, Homo sapiens
caugaaggcucguuuaaag

SEQ ID NO: 975252 - RNA, 19 nt, Homo sapiens
gcaaagaccgaauugaaau

SEQ ID NO: 975253 - RNA, 19 nt, Homo sapiens
ccaggaacuuacagaauuu

SEQ ID NO: 975254 - RNA, 19 nt, Homo sapiens
uaaaugcgacugugguaua

SEQ ID NO: 975255 - RNA, 19 nt, Homo sapiens
aaagaggaauuaugccaaa

SEQ ID NO: 975256 - RNA, 19 nt, Homo sapiens
ggaacaguuggcuaaauua

SEQ ID NO: 975257 - RNA, 19 nt, Homo sapiens
ugccuuaacucuucgauuu

SEQ ID NO: 975258 - RNA, 19 nt, Homo sapiens
gggcaaagaccgaauugaa

SEQ ID NO: 975259 - RNA, 19 nt, Homo sapiens
gucgaaaccuccugaagaa

SEQ ID NO: 975260 - RNA, 19 nt, Homo sapiens
acgaggaucuucuauuuga

SEQ ID NO: 975261 - RNA, 19 nt, Homo sapiens
gagagaagcugccuuuuca

SEQ ID NO: 975262 - RNA, 19 nt, Homo sapiens
gaugagagaagcugccuuu

SEQ ID NO: 975263 - RNA, 19 nt, Homo sapiens
cccaggaacuuacagaauu

SEQ ID NO: 975264 - RNA, 19 nt, Homo sapiens
gauaauguagcagguguua

SEQ ID NO: 975265 - RNA, 19 nt, Homo sapiens
ugagauugcugcagccauu

SEQ ID NO: 975266 - RNA, 19 nt, Homo sapiens
agaccgaauugaaaucuuu

SEQ ID NO: 975267 - RNA, 19 nt, Homo sapiens
aauaaaugauugccgauga

SEQ ID NO: 975268 - RNA, 19 nt, Homo sapiens
ggaaguggguagcuauuuu

SEQ ID NO: 975269 - RNA, 19 nt, Homo sapiens
ggaugaaagagaucuguaa

SEQ ID NO: 975270 - RNA, 19 nt, Homo sapiens
gcagaagcguuaucauacu

SEQ ID NO: 975271 - RNA, 19 nt, Homo sapiens
gcacuacaguuauccaaaa

SEQ ID NO: 975272 - RNA, 19 nt, Homo sapiens
gcucagaucaguaguguca

SEQ ID NO: 975273 - RNA, 19 nt, Homo sapiens
ccuaagaauuucacugguu

SEQ ID NO: 975274 - RNA, 19 nt, Homo sapiens
cauugaacaugucaucauu

SEQ ID NO: 975275 - RNA, 19 nt, Homo sapiens
ggucgaaaccuccugaaga

SEQ ID NO: 975276 - RNA, 19 nt, Homo sapiens
ggcaaagaccgaauugaaa

SEQ ID NO: 975277 - RNA, 19 nt, Homo sapiens
aaugauugccgaugaguua

SEQ ID NO: 975278 - RNA, 19 nt, Homo sapiens
gaugaaagagaucuguaaa

SEQ ID NO: 975279 - RNA, 19 nt, Homo sapiens
gacuucagcacuacaguua

SEQ ID NO: 975280 - RNA, 19 nt, Homo sapiens
gagcgaagaaagauaaugu

SEQ ID NO: 975281 - RNA, 19 nt, Homo sapiens
gcagaaucauaauuuagca

SEQ ID NO: 975282 - RNA, 19 nt, Homo sapiens
uagcuucucugcagacuuc

SEQ ID NO: 975283 - RNA, 19 nt, Homo sapiens
acaguuggcuaaauuaaag

SEQ ID NO: 975284 - RNA, 19 nt, Homo sapiens
gaacauuaccaugaaggaa

SEQ ID NO: 975285 - RNA, 19 nt, Homo sapiens
caauaaagcgcaagugaag

SEQ ID NO: 975286 - RNA, 19 nt, Homo sapiens
gaaaaguuaucgucagaau

SEQ ID NO: 975287 - RNA, 19 nt, Homo sapiens
aaaguuaucgucagaaugu

SEQ ID NO: 975288 - RNA, 19 nt, Homo sapiens
ggagcagcuuucauuccua

SEQ ID NO: 975289 - RNA, 19 nt, Homo sapiens
caucaugaaggcucguuua

SEQ ID NO: 975290 - RNA, 19 nt, Homo sapiens
aaaugcgacugugguauaa

SEQ ID NO: 975291 - RNA, 19 nt, Homo sapiens
ucugaugccuuaacucuuc

SEQ ID NO: 975292 - RNA, 19 nt, Homo sapiens
ggagccauucugccaauuu

SEQ ID NO: 975293 - RNA, 19 nt, Homo sapiens
caugguacuucucaaacuu

SEQ ID NO: 975294 - RNA, 19 nt, Homo sapiens
aacguacucuugcuuauau

SEQ ID NO: 975295 - RNA, 19 nt, Homo sapiens
gaggaauuaugccaaagca

SEQ ID NO: 975296 - RNA, 19 nt, Homo sapiens
gacccgagccgaaaaguua

SEQ ID NO: 975297 - RNA, 19 nt, Homo sapiens
cacgugaucugcuuaccaa

SEQ ID NO: 975298 - RNA, 19 nt, Homo sapiens
uguagcagguguuacuuug

SEQ ID NO: 975299 - RNA, 19 nt, Homo sapiens
guuccugucuugucuguca

SEQ ID NO: 975300 - RNA, 19 nt, Homo sapiens
gcugcagccauucuuguua

SEQ ID NO: 975301 - RNA, 19 nt, Homo sapiens
ccuuggcgcuguugucuga

SEQ ID NO: 975302 - RNA, 19 nt, Homo sapiens
uugcagaagcguuaucaua

SEQ ID NO: 975303 - RNA, 19 nt, Homo sapiens
uuacuuugcagaagcguua

SEQ ID NO: 975304 - RNA, 19 nt, Homo sapiens
gacagauccuaaagaagau

SEQ ID NO: 975305 - RNA, 19 nt, Homo sapiens
ugccaguauuugaacauua

SEQ ID NO: 975306 - RNA, 19 nt, Homo sapiens
aaaguaagucauuccguuu

SEQ ID NO: 975307 - RNA, 19 nt, Homo sapiens
uuaccaagcauauuaggaa

SEQ ID NO: 975308 - RNA, 19 nt, Homo sapiens
uugcuuauaucaucacaga

SEQ ID NO: 975309 - RNA, 19 nt, Homo sapiens
ugaacguacucuugcuuau

SEQ ID NO: 975310 - RNA, 19 nt, Homo sapiens
ucaauaaagcgcaagugaa

SEQ ID NO: 975311 - RNA, 19 nt, Homo sapiens
gccaguauuugaacauuac

SEQ ID NO: 975312 - RNA, 19 nt, Homo sapiens
gaagcugccuuuucacuag

SEQ ID NO: 975313 - RNA, 19 nt, Homo sapiens
aaucuuuccuguucugguu

SEQ ID NO: 975314 - RNA, 19 nt, Homo sapiens
gaauaaucuuuccuguucu

SEQ ID NO: 975315 - RNA, 19 nt, Homo sapiens
gaggaucuucuauuugaau

SEQ ID NO: 975316 - RNA, 19 nt, Homo sapiens
ccaaagcaguggaacuacu

SEQ ID NO: 975317 - RNA, 19 nt, Homo sapiens
uaggaaauaccucuuagga

SEQ ID NO: 975318 - RNA, 19 nt, Homo sapiens
uaccaagcauauuaggaaa

SEQ ID NO: 975319 - RNA, 19 nt, Homo sapiens
guuggagccugcuaaucuu

SEQ ID NO: 975320 - RNA, 19 nt, Homo sapiens
gcgaagaaagauaauguag

SEQ ID NO: 975321 - RNA, 19 nt, Homo sapiens
gccauucugccaauuuaaa

SEQ ID NO: 975322 - RNA, 19 nt, Homo sapiens
agagagagcgagaagaguu

SEQ ID NO: 975323 - RNA, 19 nt, Homo sapiens
gcuauuaagauaaccaaca

SEQ ID NO: 975324 - RNA, 19 nt, Homo sapiens
cugcagacuucuuuuguua

SEQ ID NO: 975325 - RNA, 19 nt, Homo sapiens
cugcagacauguaggaagu

SEQ ID NO: 975326 - RNA, 19 nt, Homo sapiens
uaacacuggcuucauuuua

SEQ ID NO: 975327 - RNA, 19 nt, Homo sapiens
cccuaacacuggcuucauu

SEQ ID NO: 975328 - RNA, 19 nt, Homo sapiens
gaacuacugguggaacuag

SEQ ID NO: 975329 - RNA, 19 nt, Homo sapiens
agaaggacuuggagcaaag

SEQ ID NO: 975330 - RNA, 19 nt, Homo sapiens
gucaauaaagcgcaaguga

SEQ ID NO: 975331 - RNA, 19 nt, Homo sapiens
gagcacagacaggucgaaa

SEQ ID NO: 975332 - RNA, 19 nt, Homo sapiens
ggucucaggccaauuacug

SEQ ID NO: 975333 - RNA, 19 nt, Homo sapiens
cagaagcguuaucauacuc

SEQ ID NO: 975334 - RNA, 19 nt, Homo sapiens
cagaauuuacuuugcagaa

SEQ ID NO: 975335 - RNA, 19 nt, Homo sapiens
cgaggaucuucuauuugaa

SEQ ID NO: 975336 - RNA, 19 nt, Homo sapiens
guaggaaguggguagcuau

SEQ ID NO: 975337 - RNA, 19 nt, Homo sapiens
gcagaaaguuccuagauuu

SEQ ID NO: 975338 - RNA, 19 nt, Homo sapiens
uaaguggucuuucuuguuu

SEQ ID NO: 975339 - RNA, 19 nt, Homo sapiens
gaucugcucuauguuaaua

SEQ ID NO: 975340 - RNA, 19 nt, Homo sapiens
gaaccuacauaacaaugaa

SEQ ID NO: 975341 - RNA, 19 nt, Homo sapiens
gaaaaugucucagaucuaa

SEQ ID NO: 975342 - RNA, 19 nt, Homo sapiens
gcaagaugccucagcaaua

SEQ ID NO: 975343 - RNA, 19 nt, Homo sapiens
gcaaugaaccuacauaaca

SEQ ID NO: 975344 - RNA, 19 nt, Homo sapiens
ggacaucgaagagaauuua

SEQ ID NO: 975345 - RNA, 19 nt, Homo sapiens
ugacaaagccuaagagcua

SEQ ID NO: 975346 - RNA, 19 nt, Homo sapiens
caagaugccucagcaauau

SEQ ID NO: 975347 - RNA, 19 nt, Homo sapiens
gaugaucugcucuauguua

SEQ ID NO: 975348 - RNA, 19 nt, Homo sapiens
gaauagugaucaauuugug

SEQ ID NO: 975349 - RNA, 19 nt, Homo sapiens
ggaaaaccaugucuucuuu

SEQ ID NO: 975350 - RNA, 19 nt, Homo sapiens
ugacuuacccuuucaugua

SEQ ID NO: 975351 - RNA, 19 nt, Homo sapiens
gugcagcgcuaguaaaguu

SEQ ID NO: 975352 - RNA, 19 nt, Homo sapiens
ugacugauguccacacuug

SEQ ID NO: 975353 - RNA, 19 nt, Homo sapiens
caaugaaccuacauaacaa

SEQ ID NO: 975354 - RNA, 19 nt, Homo sapiens
gaagagaauuuaacuuagc

SEQ ID NO: 975355 - RNA, 19 nt, Homo sapiens
gauaagauccuugaauaug

SEQ ID NO: 975356 - RNA, 19 nt, Homo sapiens
gguaaacaguggagguaaa

SEQ ID NO: 975357 - RNA, 19 nt, Homo sapiens
ggauguguauuucuugcua

SEQ ID NO: 975358 - RNA, 19 nt, Homo sapiens
ccuaagagcuaaggcagua

SEQ ID NO: 975359 - RNA, 19 nt, Homo sapiens
ccaaagaaagguaaucaaa

SEQ ID NO: 975360 - RNA, 19 nt, Homo sapiens
cauuacagauguuuaguga

SEQ ID NO: 975361 - RNA, 19 nt, Homo sapiens
ugacauacaaggaagauaa

SEQ ID NO: 975362 - RNA, 19 nt, Homo sapiens
ccaaagagacagcauuuau

SEQ ID NO: 975363 - RNA, 19 nt, Homo sapiens
uuacagggcucuauuuaag

SEQ ID NO: 975364 - RNA, 19 nt, Homo sapiens
uaacaggaaagaucccuua

SEQ ID NO: 975365 - RNA, 19 nt, Homo sapiens
gaccugagaguuucccuua

SEQ ID NO: 975366 - RNA, 19 nt, Homo sapiens
caaagagacagcauuuauu

SEQ ID NO: 975367 - RNA, 19 nt, Homo sapiens
uuacaggacucaauaaugg

SEQ ID NO: 975368 - RNA, 19 nt, Homo sapiens
cuaguaaaguugacucuug

SEQ ID NO: 975369 - RNA, 19 nt, Homo sapiens
guaaaagucuuaacuggaa

SEQ ID NO: 975370 - RNA, 19 nt, Homo sapiens
gggcaaagccagaaagaug

SEQ ID NO: 975371 - RNA, 19 nt, Homo sapiens
ccaugcagcucaccacuug

SEQ ID NO: 975372 - RNA, 19 nt, Homo sapiens
gagacagcauuuauuuaug

SEQ ID NO: 975373 - RNA, 19 nt, Homo sapiens
gauaaucuguuuccuaagc

SEQ ID NO: 975374 - RNA, 19 nt, Homo sapiens
gacaaagccuaagagcuaa

SEQ ID NO: 975375 - RNA, 19 nt, Homo sapiens
gauguuuagugacaaagaa

SEQ ID NO: 975376 - RNA, 19 nt, Homo sapiens
uuacagauguuuagugaca

SEQ ID NO: 975377 - RNA, 19 nt, Homo sapiens
gugaucaauuuguggauuu

SEQ ID NO: 975378 - RNA, 19 nt, Homo sapiens
cgaagagaauuuaacuuag

SEQ ID NO: 975379 - RNA, 19 nt, Homo sapiens
gauagaagauguugaaaag

SEQ ID NO: 975380 - RNA, 19 nt, Homo sapiens
caggaaagaucccuuaugc

SEQ ID NO: 975381 - RNA, 19 nt, Homo sapiens
gaucaacccaucaaucaug

SEQ ID NO: 975382 - RNA, 19 nt, Homo sapiens
uaauaagucucccaacuac

SEQ ID NO: 975383 - RNA, 19 nt, Homo sapiens
ggccauuuguugaaggaua

SEQ ID NO: 975384 - RNA, 19 nt, Homo sapiens
ggacaaagagaauauucau

SEQ ID NO: 975385 - RNA, 19 nt, Homo sapiens
gggaggauccugaaacaug

SEQ ID NO: 975386 - RNA, 19 nt, Homo sapiens
gacauuaacaugaaucuca

SEQ ID NO: 975387 - RNA, 19 nt, Homo sapiens
aaggagacauuaacaugaa

SEQ ID NO: 975388 - RNA, 19 nt, Homo sapiens
aggaugaucugcucuaugu

SEQ ID NO: 975389 - RNA, 19 nt, Homo sapiens
agacuaagcauuuaacugu

SEQ ID NO: 975390 - RNA, 19 nt, Homo sapiens
gaauggacaaagagaauau

SEQ ID NO: 975391 - RNA, 19 nt, Homo sapiens
uaagauccuugaauaugga

SEQ ID NO: 975392 - RNA, 19 nt, Homo sapiens
gccauuuguugaaggauaa

SEQ ID NO: 975393 - RNA, 19 nt, Homo sapiens
gcaauaaggagacauuaac

SEQ ID NO: 975394 - RNA, 19 nt, Homo sapiens
gggugaacauuagucauuu

SEQ ID NO: 975395 - RNA, 19 nt, Homo sapiens
gugaaagcaugacugaugu

SEQ ID NO: 975396 - RNA, 19 nt, Homo sapiens
ccaaguugaugucaguaga

SEQ ID NO: 975397 - RNA, 19 nt, Homo sapiens
gauguguauuucuugcuaa

SEQ ID NO: 975398 - RNA, 19 nt, Homo sapiens
uaaggagacauuaacauga

SEQ ID NO: 975399 - RNA, 19 nt, Homo sapiens
ccacagucuucauucuauu

SEQ ID NO: 975400 - RNA, 19 nt, Homo sapiens
ucauguacuuccaaagaaa

SEQ ID NO: 975401 - RNA, 19 nt, Homo sapiens
agacaccucuuauagcaau

SEQ ID NO: 975402 - RNA, 19 nt, Homo sapiens
caagaaauaacaggaaaga

SEQ ID NO: 975403 - RNA, 19 nt, Homo sapiens
guggagaggugugagugua

SEQ ID NO: 975404 - RNA, 19 nt, Homo sapiens
uuaauaagucucccaacua

SEQ ID NO: 975405 - RNA, 19 nt, Homo sapiens
agauggaacugcaugauca

SEQ ID NO: 975406 - RNA, 19 nt, Homo sapiens
gaguuucccuuaccugauc

SEQ ID NO: 975407 - RNA, 19 nt, Homo sapiens
guuaauaagucucccaacu

SEQ ID NO: 975408 - RNA, 19 nt, Homo sapiens
agaaggagcugugcaagag

SEQ ID NO: 975409 - RNA, 19 nt, Homo sapiens
cauaagguauauagcaauc

SEQ ID NO: 975410 - RNA, 19 nt, Homo sapiens
caaaagaccucccuauggu

SEQ ID NO: 975411 - RNA, 19 nt, Homo sapiens
agaaauaacaggaaagauc

SEQ ID NO: 975412 - RNA, 19 nt, Homo sapiens
caaaguacuauuagcaaug

SEQ ID NO: 975413 - RNA, 19 nt, Homo sapiens
gcaugugguucagcagaaa

SEQ ID NO: 975414 - RNA, 19 nt, Homo sapiens
gcaaacccauggaaaaugu

SEQ ID NO: 975415 - RNA, 19 nt, Homo sapiens
gaucauuacagauguuuag

SEQ ID NO: 975416 - RNA, 19 nt, Homo sapiens
uaucacagaucaguuucaa

SEQ ID NO: 975417 - RNA, 19 nt, Homo sapiens
guuaaguggucuuucuugu

SEQ ID NO: 975418 - RNA, 19 nt, Homo sapiens
gagguaaacaguggaggua

SEQ ID NO: 975419 - RNA, 19 nt, Homo sapiens
gcaccaaagagacagcauu

SEQ ID NO: 975420 - RNA, 19 nt, Homo sapiens
gcaguggaaucccuagaac

SEQ ID NO: 975421 - RNA, 19 nt, Homo sapiens
gugaaaacaugcuggaaaa

SEQ ID NO: 975422 - RNA, 19 nt, Homo sapiens
cagaauagugaucaauuug

SEQ ID NO: 975423 - RNA, 19 nt, Homo sapiens
caccaaagagacagcauuu

SEQ ID NO: 975424 - RNA, 19 nt, Homo sapiens
ggaaaauaccaauccauaa

SEQ ID NO: 975425 - RNA, 19 nt, Homo sapiens
aaagauuggccauuuguug

SEQ ID NO: 975426 - RNA, 19 nt, Homo sapiens
ccgaugauguccaguaugg

SEQ ID NO: 975427 - RNA, 19 nt, Homo sapiens
acuaagcauuuaacuguga

SEQ ID NO: 975428 - RNA, 19 nt, Homo sapiens
uaaggaugaucugcucuau

SEQ ID NO: 975429 - RNA, 19 nt, Homo sapiens
aaauaccaauccauaagga

SEQ ID NO: 975430 - RNA, 19 nt, Homo sapiens
acagggcucuauuuaagga

SEQ ID NO: 975431 - RNA, 19 nt, Homo sapiens
guaaagacaguguuuugua

SEQ ID NO: 975432 - RNA, 19 nt, Homo sapiens
acagauguuuagugacaaa

SEQ ID NO: 975433 - RNA, 19 nt, Homo sapiens
ggcaggcugucgccaaguu

SEQ ID NO: 975434 - RNA, 19 nt, Homo sapiens
aaacaccacgggcaaagaa

SEQ ID NO: 975435 - RNA, 19 nt, Homo sapiens
gaaacaccacgggcaaaga

SEQ ID NO: 975436 - RNA, 19 nt, Homo sapiens
gagcuaaggcaguaaaauu

SEQ ID NO: 975437 - RNA, 19 nt, Homo sapiens
gcagaaaguuccuagauuu

SEQ ID NO: 975438 - RNA, 19 nt, Homo sapiens
uaaguggucuuucuuguuu

SEQ ID NO: 975439 - RNA, 19 nt, Homo sapiens
gaucugcucuauguuaaua

SEQ ID NO: 975440 - RNA, 19 nt, Homo sapiens
gaaccuacauaacaaugaa

SEQ ID NO: 975441 - RNA, 19 nt, Homo sapiens
gaaaaugucucagaucuaa

SEQ ID NO: 975442 - RNA, 19 nt, Homo sapiens
gcaagaugccucagcaaua

SEQ ID NO: 975443 - RNA, 19 nt, Homo sapiens
gcaaugaaccuacauaaca

SEQ ID NO: 975444 - RNA, 19 nt, Homo sapiens
ggacaucgaagagaauuua

SEQ ID NO: 975445 - RNA, 19 nt, Homo sapiens
ugacaaagccuaagagcua

SEQ ID NO: 975446 - RNA, 19 nt, Homo sapiens
caagaugccucagcaauau

SEQ ID NO: 975447 - RNA, 19 nt, Homo sapiens
gaugaucugcucuauguua

SEQ ID NO: 975448 - RNA, 19 nt, Homo sapiens
gaauagugaucaauuugug

SEQ ID NO: 975449 - RNA, 19 nt, Homo sapiens
ggaaaaccaugucuucuuu

SEQ ID NO: 975450 - RNA, 19 nt, Homo sapiens
ugacuuacccuuucaugua

SEQ ID NO: 975451 - RNA, 19 nt, Homo sapiens
gugcagcgcuaguaaaguu

SEQ ID NO: 975452 - RNA, 19 nt, Homo sapiens
ugacugauguccacacuug

SEQ ID NO: 975453 - RNA, 19 nt, Homo sapiens
caaugaaccuacauaacaa

SEQ ID NO: 975454 - RNA, 19 nt, Homo sapiens
gaagagaauuuaacuuagc

SEQ ID NO: 975455 - RNA, 19 nt, Homo sapiens
gauaagauccuugaauaug

SEQ ID NO: 975456 - RNA, 19 nt, Homo sapiens
gguaaacaguggagguaaa

SEQ ID NO: 975457 - RNA, 19 nt, Homo sapiens
ggauguguauuucuugcua

SEQ ID NO: 975458 - RNA, 19 nt, Homo sapiens
ccuaagagcuaaggcagua

SEQ ID NO: 975459 - RNA, 19 nt, Homo sapiens
ccaaagaaagguaaucaaa

SEQ ID NO: 975460 - RNA, 19 nt, Homo sapiens
cauuacagauguuuaguga

SEQ ID NO: 975461 - RNA, 19 nt, Homo sapiens
ugacauacaaggaagauaa

SEQ ID NO: 975462 - RNA, 19 nt, Homo sapiens
ccaaagagacagcauuuau

SEQ ID NO: 975463 - RNA, 19 nt, Homo sapiens
uuacagggcucuauuuaag

SEQ ID NO: 975464 - RNA, 19 nt, Homo sapiens
uaacaggaaagaucccuua

SEQ ID NO: 975465 - RNA, 19 nt, Homo sapiens
gaccugagaguuucccuua

SEQ ID NO: 975466 - RNA, 19 nt, Homo sapiens
caaagagacagcauuuauu

SEQ ID NO: 975467 - RNA, 19 nt, Homo sapiens
uuacaggacucaauaaugg

SEQ ID NO: 975468 - RNA, 19 nt, Homo sapiens
cuaguaaaguugacucuug

SEQ ID NO: 975469 - RNA, 19 nt, Homo sapiens
guaaaagucuuaacuggaa

SEQ ID NO: 975470 - RNA, 19 nt, Homo sapiens
gagacagcauuuauuuaug

SEQ ID NO: 975471 - RNA, 19 nt, Homo sapiens
gauaaucuguuuccuaagc

SEQ ID NO: 975472 - RNA, 19 nt, Homo sapiens
gacaaagccuaagagcuaa

SEQ ID NO: 975473 - RNA, 19 nt, Homo sapiens
gauguuuagugacaaagaa

SEQ ID NO: 975474 - RNA, 19 nt, Homo sapiens
uuacagauguuuagugaca

SEQ ID NO: 975475 - RNA, 19 nt, Homo sapiens
gugaucaauuuguggauuu

SEQ ID NO: 975476 - RNA, 19 nt, Homo sapiens
cgaagagaauuuaacuuag

SEQ ID NO: 975477 - RNA, 19 nt, Homo sapiens
ggaagagggcgagggauaa

SEQ ID NO: 975478 - RNA, 19 nt, Homo sapiens
gauagaagauguugaaaag

SEQ ID NO: 975479 - RNA, 19 nt, Homo sapiens
caggaaagaucccuuaugc

SEQ ID NO: 975480 - RNA, 19 nt, Homo sapiens
gaucaacccaucaaucaug

SEQ ID NO: 975481 - RNA, 19 nt, Homo sapiens
uaauaagucucccaacuac

SEQ ID NO: 975482 - RNA, 19 nt, Homo sapiens
ggccauuuguugaaggaua

SEQ ID NO: 975483 - RNA, 19 nt, Homo sapiens
ggacaaagagaauauucau

SEQ ID NO: 975484 - RNA, 19 nt, Homo sapiens
gggaggauccugaaacaug

SEQ ID NO: 975485 - RNA, 19 nt, Homo sapiens
gacauuaacaugaaucuca

SEQ ID NO: 975486 - RNA, 19 nt, Homo sapiens
aaggagacauuaacaugaa

SEQ ID NO: 975487 - RNA, 19 nt, Homo sapiens
aggaugaucugcucuaugu

SEQ ID NO: 975488 - RNA, 19 nt, Homo sapiens
agacuaagcauuuaacugu

SEQ ID NO: 975489 - RNA, 19 nt, Homo sapiens
gaauggacaaagagaauau

SEQ ID NO: 975490 - RNA, 19 nt, Homo sapiens
uaagauccuugaauaugga

SEQ ID NO: 975491 - RNA, 19 nt, Homo sapiens
gccauuuguugaaggauaa

SEQ ID NO: 975492 - RNA, 19 nt, Homo sapiens
gcaauaaggagacauuaac

SEQ ID NO: 975493 - RNA, 19 nt, Homo sapiens
gggugaacauuagucauuu

SEQ ID NO: 975494 - RNA, 19 nt, Homo sapiens
gugaaagcaugacugaugu

SEQ ID NO: 975495 - RNA, 19 nt, Homo sapiens
ccaaguugaugucaguaga

SEQ ID NO: 975496 - RNA, 19 nt, Homo sapiens
gauguguauuucuugcuaa

SEQ ID NO: 975497 - RNA, 19 nt, Homo sapiens
uaaggagacauuaacauga

SEQ ID NO: 975498 - RNA, 19 nt, Homo sapiens
ccacagucuucauucuauu

SEQ ID NO: 975499 - RNA, 19 nt, Homo sapiens
ucauguacuuccaaagaaa

SEQ ID NO: 975500 - RNA, 19 nt, Homo sapiens
agacaccucuuauagcaau

SEQ ID NO: 975501 - RNA, 19 nt, Homo sapiens
caagaaauaacaggaaaga

SEQ ID NO: 975502 - RNA, 19 nt, Homo sapiens
guggagaggugugagugua

SEQ ID NO: 975503 - RNA, 19 nt, Homo sapiens
uuaauaagucucccaacua

SEQ ID NO: 975504 - RNA, 19 nt, Homo sapiens
agauggaacugcaugauca

SEQ ID NO: 975505 - RNA, 19 nt, Homo sapiens
gaguuucccuuaccugauc

SEQ ID NO: 975506 - RNA, 19 nt, Homo sapiens
guuaauaagucucccaacu

SEQ ID NO: 975507 - RNA, 19 nt, Homo sapiens
cauaagguauauagcaauc

SEQ ID NO: 975508 - RNA, 19 nt, Homo sapiens
agaaauaacaggaaagauc

SEQ ID NO: 975509 - RNA, 19 nt, Homo sapiens
caaaguacuauuagcaaug

SEQ ID NO: 975510 - RNA, 19 nt, Homo sapiens
gcaugugguucagcagaaa

SEQ ID NO: 975511 - RNA, 19 nt, Homo sapiens
agaaggagcugugcaagag

SEQ ID NO: 975512 - RNA, 19 nt, Homo sapiens
gcaaacccauggaaaaugu

SEQ ID NO: 975513 - RNA, 19 nt, Homo sapiens
gaucauuacagauguuuag

SEQ ID NO: 975514 - RNA, 19 nt, Homo sapiens
uaucacagaucaguuucaa

SEQ ID NO: 975515 - RNA, 19 nt, Homo sapiens
guuaaguggucuuucuugu

SEQ ID NO: 975516 - RNA, 19 nt, Homo sapiens
gagguaaacaguggaggua

SEQ ID NO: 975517 - RNA, 19 nt, Homo sapiens
gcaguggaaucccuagaac

SEQ ID NO: 975518 - RNA, 19 nt, Homo sapiens
gugaaaacaugcuggaaaa

SEQ ID NO: 975519 - RNA, 19 nt, Homo sapiens
gcaccaaagagacagcauu

SEQ ID NO: 975520 - RNA, 19 nt, Homo sapiens
cagaauagugaucaauuug

SEQ ID NO: 975521 - RNA, 19 nt, Homo sapiens
ggaaaauaccaauccauaa

SEQ ID NO: 975522 - RNA, 19 nt, Homo sapiens
aaagauuggccauuuguug

SEQ ID NO: 975523 - RNA, 19 nt, Homo sapiens
ccgaugauguccaguaugg

SEQ ID NO: 975524 - RNA, 19 nt, Homo sapiens
caccaaagagacagcauuu

SEQ ID NO: 975525 - RNA, 19 nt, Homo sapiens
acuaagcauuuaacuguga

SEQ ID NO: 975526 - RNA, 19 nt, Homo sapiens
uaucacugcuggccuuuua

SEQ ID NO: 975527 - RNA, 19 nt, Homo sapiens
uaaggaugaucugcucuau

SEQ ID NO: 975528 - RNA, 19 nt, Homo sapiens
aaauaccaauccauaagga

SEQ ID NO: 975529 - RNA, 19 nt, Homo sapiens
acagggcucuauuuaagga

SEQ ID NO: 975530 - RNA, 19 nt, Homo sapiens
guaaagacaguguuuugua

SEQ ID NO: 975531 - RNA, 19 nt, Homo sapiens
acagauguuuagugacaaa

SEQ ID NO: 975532 - RNA, 19 nt, Homo sapiens
ggcaggcugucgccaaguu

SEQ ID NO: 975533 - RNA, 19 nt, Homo sapiens
aaacaccacgggcaaagaa

SEQ ID NO: 975534 - RNA, 19 nt, Homo sapiens
gaaacaccacgggcaaaga

SEQ ID NO: 975535 - RNA, 19 nt, Homo sapiens
gagcuaaggcaguaaaauu

SEQ ID NO: 975536 - RNA, 19 nt, Homo sapiens
guacuuccaaagaaaggua

SEQ ID NO: 975537 - RNA, 19 nt, Homo sapiens
aaacacagcuccucuuaaa

SEQ ID NO: 975538 - RNA, 19 nt, Homo sapiens
gauacggccuucaauuaua

SEQ ID NO: 975539 - RNA, 19 nt, Homo sapiens
caacuguguucuuccauua

SEQ ID NO: 975540 - RNA, 19 nt, Homo sapiens
gggcgaggcuuuauaguug

SEQ ID NO: 975541 - RNA, 19 nt, Homo sapiens
uaaauuacauccaggaaug

SEQ ID NO: 975542 - RNA, 19 nt, Homo sapiens
ucaggaaucuggucucauu

SEQ ID NO: 975543 - RNA, 19 nt, Homo sapiens
gggaagagaagccuagaua

SEQ ID NO: 975544 - RNA, 19 nt, Homo sapiens
ugacagggaucuagcaaug

SEQ ID NO: 975545 - RNA, 19 nt, Homo sapiens
ggaagagacugagccuuga

SEQ ID NO: 975546 - RNA, 19 nt, Homo sapiens
gugauacggccuucaauua

SEQ ID NO: 975547 - RNA, 19 nt, Homo sapiens
gaagagaagccuagauauc

SEQ ID NO: 975548 - RNA, 19 nt, Homo sapiens
gcaacuguguucuuccauu

SEQ ID NO: 975549 - RNA, 19 nt, Homo sapiens
gaagucacagcucaucaua

SEQ ID NO: 975550 - RNA, 19 nt, Homo sapiens
aagaugagcuacacaauca

SEQ ID NO: 975551 - RNA, 19 nt, Homo sapiens
gaucaaauaggaccaguga

SEQ ID NO: 975552 - RNA, 19 nt, Homo sapiens
gcagaggaaccuauacaaa

SEQ ID NO: 975553 - RNA, 19 nt, Homo sapiens
ggagagauguucauguaac

SEQ ID NO: 975554 - RNA, 19 nt, Homo sapiens
agaggaaccuauacaaaga

SEQ ID NO: 975555 - RNA, 19 nt, Homo sapiens
agucagagcucauuaagca

SEQ ID NO: 975556 - RNA, 19 nt, Homo sapiens
acacucuccugcuuuauuu

SEQ ID NO: 975557 - RNA, 19 nt, Homo sapiens
gggaggcaacagaauauua

SEQ ID NO: 975558 - RNA, 19 nt, Homo sapiens
cacaacauccuucugauaa

SEQ ID NO: 975559 - RNA, 19 nt, Homo sapiens
gaaccuauacaaagaagug

SEQ ID NO: 975560 - RNA, 19 nt, Homo sapiens
caucaucagccuuccaaua

SEQ ID NO: 975561 - RNA, 19 nt, Homo sapiens
ggaauggucuuugcaucug

SEQ ID NO: 975562 - RNA, 19 nt, Homo sapiens
ggggagagauguucaugua

SEQ ID NO: 975563 - RNA, 19 nt, Homo sapiens
ucacaacauccuucugaua

SEQ ID NO: 975564 - RNA, 19 nt, Homo sapiens
ggaaucuggucucauugga

SEQ ID NO: 975565 - RNA, 19 nt, Homo sapiens
cagcuuugcagaacuauaa

SEQ ID NO: 975566 - RNA, 19 nt, Homo sapiens
gaauggucuuugcaucuga

SEQ ID NO: 975567 - RNA, 19 nt, Homo sapiens
auaauaaacccaaguguga

SEQ ID NO: 975568 - RNA, 19 nt, Homo sapiens
ggaagagaagccuagauau

SEQ ID NO: 975569 - RNA, 19 nt, Homo sapiens
gcaacagaauauuagagau

SEQ ID NO: 975570 - RNA, 19 nt, Homo sapiens
guccauaccugcccuucuu

SEQ ID NO: 975571 - RNA, 19 nt, Homo sapiens
uuaaacacagcuccucuua

SEQ ID NO: 975572 - RNA, 19 nt, Homo sapiens
agucaaaccuguucagaca

SEQ ID NO: 975573 - RNA, 19 nt, Homo sapiens
gaggaaguagacagaauuu

SEQ ID NO: 975574 - RNA, 19 nt, Homo sapiens
ccuaaugugucuggaauug

SEQ ID NO: 975575 - RNA, 19 nt, Homo sapiens
gccagggccuuuagccauu

SEQ ID NO: 975576 - RNA, 19 nt, Homo sapiens
guagacagaauuuccaaga

SEQ ID NO: 975577 - RNA, 19 nt, Homo sapiens
gcuacacaaucauccuauu

SEQ ID NO: 975578 - RNA, 19 nt, Homo sapiens
acucaggacuuaaacauag

SEQ ID NO: 975579 - RNA, 19 nt, Homo sapiens
gcaaccaccugaguacaca

SEQ ID NO: 975580 - RNA, 19 nt, Homo sapiens
agucacagcucaucauaca

SEQ ID NO: 975581 - RNA, 19 nt, Homo sapiens
acaacauccuucugauaaa

SEQ ID NO: 975582 - RNA, 19 nt, Homo sapiens
acccugaccuccacaauga

SEQ ID NO: 975583 - RNA, 19 nt, Homo sapiens
guucugacaguuugccuua

SEQ ID NO: 975584 - RNA, 19 nt, Homo sapiens
uccauuagcuuccaugaca

SEQ ID NO: 975585 - RNA, 19 nt, Homo sapiens
uacccugucucaaguauug

SEQ ID NO: 975586 - RNA, 19 nt, Homo sapiens
acacagcuccucuuaaauc

SEQ ID NO: 975587 - RNA, 19 nt, Homo sapiens
caagggagaaaucguuuau

SEQ ID NO: 975588 - RNA, 19 nt, Homo sapiens
ggaggcaacagaauauuag

SEQ ID NO: 975589 - RNA, 19 nt, Homo sapiens
ccucuuaaauccuccaauc

SEQ ID NO: 975590 - RNA, 19 nt, Homo sapiens
ucucuagccuuugcuguuu

SEQ ID NO: 975591 - RNA, 19 nt, Homo sapiens
agggagaaaucguuuaugu

SEQ ID NO: 975592 - RNA, 19 nt, Homo sapiens
uaaccacacucuaaaaguu

SEQ ID NO: 975593 - RNA, 19 nt, Homo sapiens
ugcaagcucugaggaagua

SEQ ID NO: 975594 - RNA, 19 nt, Homo sapiens
gaaugcaagcucugaggaa

SEQ ID NO: 975595 - RNA, 19 nt, Homo sapiens
gugauacccugucucaagu

SEQ ID NO: 975596 - RNA, 19 nt, Homo sapiens
uaaaaguucuucagacuca

SEQ ID NO: 975597 - RNA, 19 nt, Homo sapiens
gaagucaaaccuguucaga

SEQ ID NO: 975598 - RNA, 19 nt, Homo sapiens
aaauaggaccagugacuuu

SEQ ID NO: 975599 - RNA, 19 nt, Homo sapiens
uugcugacuucaagaauga

SEQ ID NO: 975600 - RNA, 19 nt, Homo sapiens
ccauuugucucuccucaca

SEQ ID NO: 975601 - RNA, 19 nt, Homo sapiens
uaaacacagcuccucuuaa

SEQ ID NO: 975602 - RNA, 19 nt, Homo sapiens
gacacucuccugcuuuauu

SEQ ID NO: 975603 - RNA, 19 nt, Homo sapiens
uuccagagaccaccaauaa

SEQ ID NO: 975604 - RNA, 19 nt, Homo sapiens
caacauccuucugauaaaa

SEQ ID NO: 975605 - RNA, 19 nt, Homo sapiens
gagcuacacaaucauccua

SEQ ID NO: 975606 - RNA, 19 nt, Homo sapiens
caagaugagcuacacaauc

SEQ ID NO: 975607 - RNA, 19 nt, Homo sapiens
cagaggaaccuauacaaag

SEQ ID NO: 975608 - RNA, 19 nt, Homo sapiens
gagcagaggaaccuauaca

SEQ ID NO: 975609 - RNA, 19 nt, Homo sapiens
gaaccagcuuugcagaacu

SEQ ID NO: 975610 - RNA, 19 nt, Homo sapiens
gaaaagaaggggagagaug

SEQ ID NO: 975611 - RNA, 19 nt, Homo sapiens
gaaggcagucacagcagaa

SEQ ID NO: 975612 - RNA, 19 nt, Homo sapiens
aaucuggucucauuggaau

SEQ ID NO: 975613 - RNA, 19 nt, Homo sapiens
aauaaacccaagugugaua

SEQ ID NO: 975614 - RNA, 19 nt, Homo sapiens
uaaugugucuggaauuggu

SEQ ID NO: 975615 - RNA, 19 nt, Homo sapiens
cuuaaauccuccaaucuca

SEQ ID NO: 975616 - RNA, 19 nt, Homo sapiens
ccaugacacucuccugcuu

SEQ ID NO: 975617 - RNA, 19 nt, Homo sapiens
caucagaggacacacacaa

SEQ ID NO: 975618 - RNA, 19 nt, Homo sapiens
ggcaacagaauauuagaga

SEQ ID NO: 975619 - RNA, 19 nt, Homo sapiens
ggccuucaauuauaguugu

SEQ ID NO: 975620 - RNA, 19 nt, Homo sapiens
gugaguguuacaauucuua

SEQ ID NO: 975621 - RNA, 19 nt, Homo sapiens
ugauacggccuucaauuau

SEQ ID NO: 975622 - RNA, 19 nt, Homo sapiens
gaaaagucagagcucauua

SEQ ID NO: 975623 - RNA, 19 nt, Homo sapiens
gaaguagacagaauuucca

SEQ ID NO: 975624 - RNA, 19 nt, Homo sapiens
cacggugaguguuacaauu

SEQ ID NO: 975625 - RNA, 19 nt, Homo sapiens
cuacaucucuagccuuugc

SEQ ID NO: 975626 - RNA, 19 nt, Homo sapiens
ggaaucaaagccagaaguc

SEQ ID NO: 975627 - RNA, 19 nt, Homo sapiens
gaggaaccuauacaaagaa

SEQ ID NO: 975628 - RNA, 19 nt, Homo sapiens
ccugauacccugugucaau

SEQ ID NO: 975629 - RNA, 19 nt, Homo sapiens
auaguugucuuuccuucuu

SEQ ID NO: 975630 - RNA, 19 nt, Homo sapiens
gacucaggacuuaaacaua

SEQ ID NO: 975631 - RNA, 19 nt, Homo sapiens
ugucuuuccuucuuggauu

SEQ ID NO: 975632 - RNA, 19 nt, Homo sapiens
agccauaccucaucagaca

SEQ ID NO: 975633 - RNA, 19 nt, Homo sapiens
ggaagucacagcucaucau

SEQ ID NO: 975634 - RNA, 19 nt, Homo sapiens
gaaucuggucucauuggaa

SEQ ID NO: 975635 - RNA, 19 nt, Homo sapiens
caaauaggaccagugacuu

SEQ ID NO: 975636 - RNA, 19 nt, Homo sapiens
aaccagcuuugcagaacua

SEQ ID NO: 975637 - RNA, 19 nt, Homo sapiens
gcacauauaugccaaaguc

SEQ ID NO: 975638 - RNA, 19 nt, Homo sapiens
gcagaaaggugacccacaa

SEQ ID NO: 975639 - RNA, 19 nt, Homo sapiens
gaacugaacaagaagagua

SEQ ID NO: 975640 - RNA, 19 nt, Homo sapiens
gagauugacuuucuucguu

SEQ ID NO: 975641 - RNA, 19 nt, Homo sapiens
ggaccaagcugacugaaag

SEQ ID NO: 975642 - RNA, 19 nt, Homo sapiens
gagguugacuucuacauug

SEQ ID NO: 975643 - RNA, 19 nt, Homo sapiens
acagagaccuugaugauau

SEQ ID NO: 975644 - RNA, 19 nt, Homo sapiens
gaugcugucuuccugauuu

SEQ ID NO: 975645 - RNA, 19 nt, Homo sapiens
guacaaguaugagaugauu

SEQ ID NO: 975646 - RNA, 19 nt, Homo sapiens
ggacagagaccuugaugau

SEQ ID NO: 975647 - RNA, 19 nt, Homo sapiens
guagacaaauccaacauca

SEQ ID NO: 975648 - RNA, 19 nt, Homo sapiens
ucaaguggaucucaguaaa

SEQ ID NO: 975649 - RNA, 19 nt, Homo sapiens
gaacaagaagaguauguau

SEQ ID NO: 975650 - RNA, 19 nt, Homo sapiens
gcagagguuugaauccuau

SEQ ID NO: 975651 - RNA, 19 nt, Homo sapiens
ggaccgaaguguuucaagu

SEQ ID NO: 975652 - RNA, 19 nt, Homo sapiens
caagcugacugaaagauuc

SEQ ID NO: 975653 - RNA, 19 nt, Homo sapiens
guuaaggaccgaaguguuu

SEQ ID NO: 975654 - RNA, 19 nt, Homo sapiens
cgugaaaccuuuaccuaga

SEQ ID NO: 975655 - RNA, 19 nt, Homo sapiens
ccauugcccucacgaugua

SEQ ID NO: 975656 - RNA, 19 nt, Homo sapiens
caguggcucugggauauua

SEQ ID NO: 975657 - RNA, 19 nt, Homo sapiens
gcaggaccuugcuuaugaa

SEQ ID NO: 975658 - RNA, 19 nt, Homo sapiens
gcuguaagacugccaagaa

SEQ ID NO: 975659 - RNA, 19 nt, Homo sapiens
gcgaggcagccaugucuua

SEQ ID NO: 975660 - RNA, 19 nt, Homo sapiens
ggaccuugcuuaugaacgu

SEQ ID NO: 975661 - RNA, 19 nt, Homo sapiens
acaagaagaguauguauuc

SEQ ID NO: 975662 - RNA, 19 nt, Homo sapiens
cagauuugauugaccagaa

SEQ ID NO: 975663 - RNA, 19 nt, Homo sapiens
gacagagaccuugaugaua

SEQ ID NO: 975664 - RNA, 19 nt, Homo sapiens
ggauccagcuucuugucuu

SEQ ID NO: 975665 - RNA, 19 nt, Homo sapiens
acaucgaacugaacaagaa

SEQ ID NO: 975666 - RNA, 19 nt, Homo sapiens
ggaggagauugacuuucuu

SEQ ID NO: 975667 - RNA, 19 nt, Homo sapiens
cauccaguauuuccacaaa

SEQ ID NO: 975668 - RNA, 19 nt, Homo sapiens
gaugauauucacacacauu

SEQ ID NO: 975669 - RNA, 19 nt, Homo sapiens
cagagaccuugaugauauu

SEQ ID NO: 975670 - RNA, 19 nt, Homo sapiens
ccacaaaacugucucagau

SEQ ID NO: 975671 - RNA, 19 nt, Homo sapiens
ccacaaauuugaggagcuu

SEQ ID NO: 975672 - RNA, 19 nt, Homo sapiens
cgucagauccacaaauuug

SEQ ID NO: 975673 - RNA, 19 nt, Homo sapiens
guugacuucuacauugaua

SEQ ID NO: 975674 - RNA, 19 nt, Homo sapiens
gcccaacuaugauaaugug

SEQ ID NO: 975675 - RNA, 19 nt, Homo sapiens
gaaaggugacccacaaguc

SEQ ID NO: 975676 - RNA, 19 nt, Homo sapiens
ggaccacguacaaguauga

SEQ ID NO: 975677 - RNA, 19 nt, Homo sapiens
gaacaucgaacugaacaag

SEQ ID NO: 975678 - RNA, 19 nt, Homo sapiens
gcacacaggagauccaaag

SEQ ID NO: 975679 - RNA, 19 nt, Homo sapiens
ucaaggugcuggagaacau

SEQ ID NO: 975680 - RNA, 19 nt, Homo sapiens
gaggugacccugagagugu

SEQ ID NO: 975681 - RNA, 19 nt, Homo sapiens
ccagaaaguguaugagcua

SEQ ID NO: 975682 - RNA, 19 nt, Homo sapiens
ucaaacacaagaugaagaa

SEQ ID NO: 975683 - RNA, 19 nt, Homo sapiens
ccaucaaggugcuggagaa

SEQ ID NO: 975684 - RNA, 19 nt, Homo sapiens
gaagucagaggaggagauu

SEQ ID NO: 975685 - RNA, 19 nt, Homo sapiens
gaagaagaugggacagaga

SEQ ID NO: 975686 - RNA, 19 nt, Homo sapiens
acugcaaucucuucaacua

SEQ ID NO: 975687 - RNA, 19 nt, Homo sapiens
gugaaaccuuuaccuagau

SEQ ID NO: 975688 - RNA, 19 nt, Homo sapiens
gaccagaagguguaugaga

SEQ ID NO: 975689 - RNA, 19 nt, Homo sapiens
acaaaacugucucagauuu

SEQ ID NO: 975690 - RNA, 19 nt, Homo sapiens
gauccagcuucuugucuuc

SEQ ID NO: 975691 - RNA, 19 nt, Homo sapiens
ggucaccacauacuauuau

SEQ ID NO: 975692 - RNA, 19 nt, Homo sapiens
cuuaugaacgucaguauga

SEQ ID NO: 975693 - RNA, 19 nt, Homo sapiens
ugucuuaucccgcugauga

SEQ ID NO: 975694 - RNA, 19 nt, Homo sapiens
gagcagagguuugaauccu

SEQ ID NO: 975695 - RNA, 19 nt, Homo sapiens
cgaaguguuucaaguggau

SEQ ID NO: 975696 - RNA, 19 nt, Homo sapiens
gaguucaucuaccaguuuc

SEQ ID NO: 975697 - RNA, 19 nt, Homo sapiens
ccagucgugucuccaguga

SEQ ID NO: 975698 - RNA, 19 nt, Homo sapiens
aaucgaacccugaagaaga

SEQ ID NO: 975699 - RNA, 19 nt, Homo sapiens
ggguuugcauauuugauga

SEQ ID NO: 975700 - RNA, 19 nt, Homo sapiens
caaaaugcuugguuacuuc

SEQ ID NO: 975701 - RNA, 19 nt, Homo sapiens
gaaccuguuuugauguauu

SEQ ID NO: 975702 - RNA, 19 nt, Homo sapiens
gaagguguuuucugaugaa

SEQ ID NO: 975703 - RNA, 19 nt, Homo sapiens
gcguaucgaugagagcauu

SEQ ID NO: 975704 - RNA, 19 nt, Homo sapiens
gaggaccacguacaaguau

SEQ ID NO: 975705 - RNA, 19 nt, Homo sapiens
gagaacaucgaacugaaca

SEQ ID NO: 975706 - RNA, 19 nt, Homo sapiens
uggagaacaucgaacugaa

SEQ ID NO: 975707 - RNA, 19 nt, Homo sapiens
caacuacugcaaucucuuc

SEQ ID NO: 975708 - RNA, 19 nt, Homo sapiens
ugaauccuauuacaacuac

SEQ ID NO: 975709 - RNA, 19 nt, Homo sapiens
uccgucagauccacaaauu

SEQ ID NO: 975710 - RNA, 19 nt, Homo sapiens
gguguuuucugaugaagua

SEQ ID NO: 975711 - RNA, 19 nt, Homo sapiens
ccacaagucuaugaagaac

SEQ ID NO: 975712 - RNA, 19 nt, Homo sapiens
caacauccuccucuacauc

SEQ ID NO: 975713 - RNA, 19 nt, Homo sapiens
cuucuugucuucaaacaca

SEQ ID NO: 975714 - RNA, 19 nt, Homo sapiens
ugauuaacaagcagaauga

SEQ ID NO: 975715 - RNA, 19 nt, Homo sapiens
agucugaggcggcuuauga

SEQ ID NO: 975716 - RNA, 19 nt, Homo sapiens
guucauaguguccucaaug

SEQ ID NO: 975717 - RNA, 19 nt, Homo sapiens
ucuggaauguucauagugu

SEQ ID NO: 975718 - RNA, 19 nt, Homo sapiens
uggcaaugaugcugucuuc

SEQ ID NO: 975719 - RNA, 19 nt, Homo sapiens
uguaugagauccaggacau

SEQ ID NO: 975720 - RNA, 19 nt, Homo sapiens
ccaucagccugucaacuca

SEQ ID NO: 975721 - RNA, 19 nt, Homo sapiens
uuaccuagaucagccauca

SEQ ID NO: 975722 - RNA, 19 nt, Homo sapiens
ugaacaagaagaguaugua

SEQ ID NO: 975723 - RNA, 19 nt, Homo sapiens
gcaaucucuucaacuacau

SEQ ID NO: 975724 - RNA, 19 nt, Homo sapiens
uccaggacaucuaugagaa

SEQ ID NO: 975725 - RNA, 19 nt, Homo sapiens
gaccgaaguguuucaagug

SEQ ID NO: 975726 - RNA, 19 nt, Homo sapiens
ccaacauccuccucuacau

SEQ ID NO: 975727 - RNA, 19 nt, Homo sapiens
aggaggagauugacuuucu

SEQ ID NO: 975728 - RNA, 19 nt, Homo sapiens
ugauugaccagaaagugua

SEQ ID NO: 975729 - RNA, 19 nt, Homo sapiens
agcccuggauggugaauuu

SEQ ID NO: 975730 - RNA, 19 nt, Homo sapiens
agaggaccacguacaagua

SEQ ID NO: 975731 - RNA, 19 nt, Homo sapiens
ccaggucaccacauacuau

SEQ ID NO: 975732 - RNA, 19 nt, Homo sapiens
ucuaccaguuucagucauu

SEQ ID NO: 975733 - RNA, 19 nt, Homo sapiens
cucuucaacuacauucuua

SEQ ID NO: 975734 - RNA, 19 nt, Homo sapiens
ccaagcugacugaaagauu

SEQ ID NO: 975735 - RNA, 19 nt, Homo sapiens
agucgugucuccagugaug

SEQ ID NO: 975736 - RNA, 19 nt, Homo sapiens
cuacauugauaaggacaug

SEQ ID NO: 975737 - RNA, 19 nt, Homo sapiens
gaagagacguugacuuaaa

SEQ ID NO: 975738 - RNA, 19 nt, Homo sapiens
gaagauagcgaaauacauu

SEQ ID NO: 975739 - RNA, 19 nt, Homo sapiens
caacauagacauugccaua

SEQ ID NO: 975740 - RNA, 19 nt, Homo sapiens
uggauuaccuugcaccuua

SEQ ID NO: 975741 - RNA, 19 nt, Homo sapiens
ggagacccgugucauguuu

SEQ ID NO: 975742 - RNA, 19 nt, Homo sapiens
ggaaccauguguugaaauc

SEQ ID NO: 975743 - RNA, 19 nt, Homo sapiens
aaugcaggcuggauucuua

SEQ ID NO: 975744 - RNA, 19 nt, Homo sapiens
gggaauaugugcggcauga

SEQ ID NO: 975745 - RNA, 19 nt, Homo sapiens
ggacggaucacuugagguu

SEQ ID NO: 975746 - RNA, 19 nt, Homo sapiens
uugagaagauagcgaaaua

SEQ ID NO: 975747 - RNA, 19 nt, Homo sapiens
ccaccaucauguugaauuu

SEQ ID NO: 975748 - RNA, 19 nt, Homo sapiens
gagcaguccuuccuguaug

SEQ ID NO: 975749 - RNA, 19 nt, Homo sapiens
gaaccaggaacaagaauag

SEQ ID NO: 975750 - RNA, 19 nt, Homo sapiens
gcaggcuggauucuuauua

SEQ ID NO: 975751 - RNA, 19 nt, Homo sapiens
uucagggacuucuuauuua

SEQ ID NO: 975752 - RNA, 19 nt, Homo sapiens
ggaaccaggaacaagaaua

SEQ ID NO: 975753 - RNA, 19 nt, Homo sapiens
augaagagacguugacuua

SEQ ID NO: 975754 - RNA, 19 nt, Homo sapiens
ucauucagcuuuaauaagg

SEQ ID NO: 975755 - RNA, 19 nt, Homo sapiens
ucagagggcuucuuguucu

SEQ ID NO: 975756 - RNA, 19 nt, Homo sapiens
cuucagggacuucuuauuu

SEQ ID NO: 975757 - RNA, 19 nt, Homo sapiens
guaauuggugugugguaua

SEQ ID NO: 975758 - RNA, 19 nt, Homo sapiens
gagaagauagcgaaauaca

SEQ ID NO: 975759 - RNA, 19 nt, Homo sapiens
gcuauauggccuugaauga

SEQ ID NO: 975760 - RNA, 19 nt, Homo sapiens
ccagcuauauggccuugaa

SEQ ID NO: 975761 - RNA, 19 nt, Homo sapiens
gugagaagauuaugaagcu

SEQ ID NO: 975762 - RNA, 19 nt, Homo sapiens
ggacuucuuauuuacugua

SEQ ID NO: 975763 - RNA, 19 nt, Homo sapiens
ucaacacucuggccucuuc

SEQ ID NO: 975764 - RNA, 19 nt, Homo sapiens
ggacuccaccaucauguug

SEQ ID NO: 975765 - RNA, 19 nt, Homo sapiens
gaaaccccaucucuacuaa

SEQ ID NO: 975766 - RNA, 19 nt, Homo sapiens
gccaucuaccugagaauua

SEQ ID NO: 975767 - RNA, 19 nt, Homo sapiens
uauauggccuugaaugagu

SEQ ID NO: 975768 - RNA, 19 nt, Homo sapiens
ccauggcgauugugguauu

SEQ ID NO: 975769 - RNA, 19 nt, Homo sapiens
gaccggguguacuauguga

SEQ ID NO: 975770 - RNA, 19 nt, Homo sapiens
caggcuggauucuuauuau

SEQ ID NO: 975771 - RNA, 19 nt, Homo sapiens
gagcuuuguuuccuguguu

SEQ ID NO: 975772 - RNA, 19 nt, Homo sapiens
uaggagcaauucagcuauu

SEQ ID NO: 975773 - RNA, 19 nt, Homo sapiens
gaagaggagacccguguca

SEQ ID NO: 975774 - RNA, 19 nt, Homo sapiens
gcagccaaaucuacacaag

SEQ ID NO: 975775 - RNA, 19 nt, Homo sapiens
ggauuaccuugcaccuuau

SEQ ID NO: 975776 - RNA, 19 nt, Homo sapiens
ggugugugguauagaagaa

SEQ ID NO: 975777 - RNA, 19 nt, Homo sapiens
auacagagauggcucaaaa

SEQ ID NO: 975778 - RNA, 19 nt, Homo sapiens
ugucauguuugagaagaua

SEQ ID NO: 975779 - RNA, 19 nt, Homo sapiens
ucacagcucuggauuaccu

SEQ ID NO: 975780 - RNA, 19 nt, Homo sapiens
acauugccauaacagaaua

SEQ ID NO: 975781 - RNA, 19 nt, Homo sapiens
cauagacauugccauaaca

SEQ ID NO: 975782 - RNA, 19 nt, Homo sapiens
aggcuggauucuuauuaua

SEQ ID NO: 975783 - RNA, 19 nt, Homo sapiens
ugagugagaagauuaugaa

SEQ ID NO: 975784 - RNA, 19 nt, Homo sapiens
gaggagacccgugucaugu

SEQ ID NO: 975785 - RNA, 19 nt, Homo sapiens
gaauaugugcggcaugaag

SEQ ID NO: 975786 - RNA, 19 nt, Homo sapiens
cacuugagguuaggaguuu

SEQ ID NO: 975787 - RNA, 19 nt, Homo sapiens
gacaaaugcaggcuggauu

SEQ ID NO: 975788 - RNA, 19 nt, Homo sapiens
aaucagcuuuggccaucua

SEQ ID NO: 975789 - RNA, 19 nt, Homo sapiens
ugaaucagagggcuucuug

SEQ ID NO: 975790 - RNA, 19 nt, Homo sapiens
cgucacagcucuggauuac

SEQ ID NO: 975791 - RNA, 19 nt, Homo sapiens
gcacgucacagcucuggau

SEQ ID NO: 975792 - RNA, 19 nt, Homo sapiens
agacauugccauaacagaa

SEQ ID NO: 975793 - RNA, 19 nt, Homo sapiens
ucagggacuucuuauuuac

SEQ ID NO: 975794 - RNA, 19 nt, Homo sapiens
uaugugagugagaagauua

SEQ ID NO: 975795 - RNA, 19 nt, Homo sapiens
gcacaacgaccggguguac

SEQ ID NO: 975796 - RNA, 19 nt, Homo sapiens
gagucauucagcuuuaaua

SEQ ID NO: 975797 - RNA, 19 nt, Homo sapiens
gacauugccauaacagaau

SEQ ID NO: 975798 - RNA, 19 nt, Homo sapiens
aauaggagcaauucagcua

SEQ ID NO: 975799 - RNA, 19 nt, Homo sapiens
aaucagagggcuucuuguu

SEQ ID NO: 975800 - RNA, 19 nt, Homo sapiens
agaucuuugugacgaaaua

SEQ ID NO: 975801 - RNA, 19 nt, Homo sapiens
ccucuucagggacuucuua

SEQ ID NO: 975802 - RNA, 19 nt, Homo sapiens
ccaucuaccugagaauuag

SEQ ID NO: 975803 - RNA, 19 nt, Homo sapiens
uaauuggugugugguauag

SEQ ID NO: 975804 - RNA, 19 nt, Homo sapiens
cgaaauacauuggggagaa

SEQ ID NO: 975805 - RNA, 19 nt, Homo sapiens
acaacgaccggguguacua

SEQ ID NO: 975806 - RNA, 19 nt, Homo sapiens
ccaccuaccagcuauaugg

SEQ ID NO: 975807 - RNA, 19 nt, Homo sapiens
caggaacaagaauagcuua

SEQ ID NO: 975808 - RNA, 19 nt, Homo sapiens
ucugagaaauagguucaaa

SEQ ID NO: 975809 - RNA, 19 nt, Homo sapiens
ucagaucuuugugacgaaa

SEQ ID NO: 975810 - RNA, 19 nt, Homo sapiens
aaaugcggccuuugacuga

SEQ ID NO: 975811 - RNA, 19 nt, Homo sapiens
ugaagagacguugacuuaa

SEQ ID NO: 975812 - RNA, 19 nt, Homo sapiens
ccuguaaucccagcacuuu

SEQ ID NO: 975813 - RNA, 19 nt, Homo sapiens
gcuaauaggagcaauucag

SEQ ID NO: 975814 - RNA, 19 nt, Homo sapiens
gaauaauaaaccacaugug

SEQ ID NO: 975815 - RNA, 19 nt, Homo sapiens
acauagacauugccauaac

SEQ ID NO: 975816 - RNA, 19 nt, Homo sapiens
gugacgaaauagaauacug

SEQ ID NO: 975817 - RNA, 19 nt, Homo sapiens
acacaagacugcagaaaag

SEQ ID NO: 975818 - RNA, 19 nt, Homo sapiens
ggucgaaucacugaaaaua

SEQ ID NO: 975819 - RNA, 19 nt, Homo sapiens
agacccgugucauguuuga

SEQ ID NO: 975820 - RNA, 19 nt, Homo sapiens
cgauugugguauuucauca

SEQ ID NO: 975821 - RNA, 19 nt, Homo sapiens
ccgauggcaccuacuguuu

SEQ ID NO: 975822 - RNA, 19 nt, Homo sapiens
gaaauacauuggggagaau

SEQ ID NO: 975823 - RNA, 19 nt, Homo sapiens
ugaaauuuggcuaauagga

SEQ ID NO: 975824 - RNA, 19 nt, Homo sapiens
ugacgaaauagaauacugu

SEQ ID NO: 975825 - RNA, 19 nt, Homo sapiens
cagagcaguccuuccugua

SEQ ID NO: 975826 - RNA, 19 nt, Homo sapiens
aggagcaauucagcuauuu

SEQ ID NO: 975827 - RNA, 19 nt, Homo sapiens
aagcagacauuggggaaua

SEQ ID NO: 975828 - RNA, 19 nt, Homo sapiens
cauggcgauugugguauuu

SEQ ID NO: 975829 - RNA, 19 nt, Homo sapiens
agacaucccuuuggguuuu

SEQ ID NO: 975830 - RNA, 19 nt, Homo sapiens
ugggaaccauguguugaaa

SEQ ID NO: 975831 - RNA, 19 nt, Homo sapiens
acggaucacuugagguuag

SEQ ID NO: 975832 - RNA, 19 nt, Homo sapiens
cagaauaauaaaccacaug

SEQ ID NO: 975833 - RNA, 19 nt, Homo sapiens
ccaggaacaagaauagcuu

SEQ ID NO: 975834 - RNA, 19 nt, Homo sapiens
gacgaaauagaauacuguu

SEQ ID NO: 975835 - RNA, 19 nt, Homo sapiens
gcaccuuaugccaaguaua

SEQ ID NO: 975836 - RNA, 19 nt, Homo sapiens
ucacuugagguuaggaguu

SEQ ID NO: 975837 - RNA, 19 nt, Homo sapiens
gcagaacucuuggaaauua

SEQ ID NO: 975838 - RNA, 19 nt, Homo sapiens
ccacccagcuucaccauua

SEQ ID NO: 975839 - RNA, 19 nt, Homo sapiens
gaaauauucucccaggaaa

SEQ ID NO: 975840 - RNA, 19 nt, Homo sapiens
gaaacaacguggagguaga

SEQ ID NO: 975841 - RNA, 19 nt, Homo sapiens
gggccacgaugacagauua

SEQ ID NO: 975842 - RNA, 19 nt, Homo sapiens
ggaaacaacuauuugaaac

SEQ ID NO: 975843 - RNA, 19 nt, Homo sapiens
gcucagaggguuaugauuu

SEQ ID NO: 975844 - RNA, 19 nt, Homo sapiens
ggagguagaugagucuuug

SEQ ID NO: 975845 - RNA, 19 nt, Homo sapiens
gaaagaagaagaacaagca

SEQ ID NO: 975846 - RNA, 19 nt, Homo sapiens
gaagagagaagaaagaaca

SEQ ID NO: 975847 - RNA, 19 nt, Homo sapiens
ugacucagcugacuaaugg

SEQ ID NO: 975848 - RNA, 19 nt, Homo sapiens
guacuccaguuacaauuga

SEQ ID NO: 975849 - RNA, 19 nt, Homo sapiens
gaugaaagaagaagaacaa

SEQ ID NO: 975850 - RNA, 19 nt, Homo sapiens
gggaaacaacuauuugaaa

SEQ ID NO: 975851 - RNA, 19 nt, Homo sapiens
cagacuacccucaaguuua

SEQ ID NO: 975852 - RNA, 19 nt, Homo sapiens
ugaagaugauccagacuau

SEQ ID NO: 975853 - RNA, 19 nt, Homo sapiens
aagaugauccagacuauaa

SEQ ID NO: 975854 - RNA, 19 nt, Homo sapiens
caucugauauccaguucuu

SEQ ID NO: 975855 - RNA, 19 nt, Homo sapiens
gaagaugauccagacuaua

SEQ ID NO: 975856 - RNA, 19 nt, Homo sapiens
ggaggaugaugaagaugau

SEQ ID NO: 975857 - RNA, 19 nt, Homo sapiens
ggaggaugcuggaaacaac

SEQ ID NO: 975858 - RNA, 19 nt, Homo sapiens
gcuggaggaugaugaagau

SEQ ID NO: 975859 - RNA, 19 nt, Homo sapiens
aagcaauuauuccauggua

SEQ ID NO: 975860 - RNA, 19 nt, Homo sapiens
ugaaauauucucccaggaa

SEQ ID NO: 975861 - RNA, 19 nt, Homo sapiens
agacuacccucaaguuuac

SEQ ID NO: 975862 - RNA, 19 nt, Homo sapiens
ccauuacugugacgucuga

SEQ ID NO: 975863 - RNA, 19 nt, Homo sapiens
cagaacucuuggaaauuaa

SEQ ID NO: 975864 - RNA, 19 nt, Homo sapiens
augcagaacucuuggaaau

SEQ ID NO: 975865 - RNA, 19 nt, Homo sapiens
agaagaagcugaaaagcaa

SEQ ID NO: 975866 - RNA, 19 nt, Homo sapiens
acuuggagcuggaggauga

SEQ ID NO: 975867 - RNA, 19 nt, Homo sapiens
aaucuugacacaucugaua

SEQ ID NO: 975868 - RNA, 19 nt, Homo sapiens
gaugaaacuguccagacua

SEQ ID NO: 975869 - RNA, 19 nt, Homo sapiens
gaagaagaacaagcaggaa

SEQ ID NO: 975870 - RNA, 19 nt, Homo sapiens
agaaaaggaugaaagaaga

SEQ ID NO: 975871 - RNA, 19 nt, Homo sapiens
agaagauaaugaugucuca

SEQ ID NO: 975872 - RNA, 19 nt, Homo sapiens
ccagacuacccucaaguuu

SEQ ID NO: 975873 - RNA, 19 nt, Homo sapiens
agugacagcugugcaagaa

SEQ ID NO: 975874 - RNA, 19 nt, Homo sapiens
ugacuccuucacaguauua

SEQ ID NO: 975875 - RNA, 19 nt, Homo sapiens
ugacagcugugcaagaaaa

SEQ ID NO: 975876 - RNA, 19 nt, Homo sapiens
ugaugaaacuguccagacu

SEQ ID NO: 975877 - RNA, 19 nt, Homo sapiens
ucuagaagauaaugauguc

SEQ ID NO: 975878 - RNA, 19 nt, Homo sapiens
caaaagaaaagaagcagaa

SEQ ID NO: 975879 - RNA, 19 nt, Homo sapiens
gcaauuauuccaugguacu

SEQ ID NO: 975880 - RNA, 19 nt, Homo sapiens
gaagcuccccuuuaugaaa

SEQ ID NO: 975881 - RNA, 19 nt, Homo sapiens
ggagcuggaggaugaugaa

SEQ ID NO: 975882 - RNA, 19 nt, Homo sapiens
caagggccacgaugacaga

SEQ ID NO: 975883 - RNA, 19 nt, Homo sapiens
gguacuccaguuacaauug

SEQ ID NO: 975884 - RNA, 19 nt, Homo sapiens
aagaagaacaagcaggaaa

SEQ ID NO: 975885 - RNA, 19 nt, Homo sapiens
uagaagagagaagaaagaa

SEQ ID NO: 975886 - RNA, 19 nt, Homo sapiens
gugggaaacaacuauuuga

SEQ ID NO: 975887 - RNA, 19 nt, Homo sapiens
gaaagccaaguuugaugca

SEQ ID NO: 975888 - RNA, 19 nt, Homo sapiens
gaacaaaagaaaagaagca

SEQ ID NO: 975889 - RNA, 19 nt, Homo sapiens
cuagaagagagaagaaaga

SEQ ID NO: 975890 - RNA, 19 nt, Homo sapiens
aaacuagaagagagaagaa

SEQ ID NO: 975891 - RNA, 19 nt, Homo sapiens
agaugaagcuccccuuuau

SEQ ID NO: 975892 - RNA, 19 nt, Homo sapiens
caaguuuacauacagugaa

SEQ ID NO: 975893 - RNA, 19 nt, Homo sapiens
ccugacuccuucacaguau

SEQ ID NO: 975894 - RNA, 19 nt, Homo sapiens
gaaaauccacccagcuuca

SEQ ID NO: 975895 - RNA, 19 nt, Homo sapiens
gaugauccagacuauaauc

SEQ ID NO: 975896 - RNA, 19 nt, Homo sapiens
acacaucugauauccaguu

SEQ ID NO: 975897 - RNA, 19 nt, Homo sapiens
gaucauaaucuugacacau

SEQ ID NO: 975898 - RNA, 19 nt, Homo sapiens
uaagugggaaacaacuauu

SEQ ID NO: 975899 - RNA, 19 nt, Homo sapiens
gaugcagaacucuuggaaa

SEQ ID NO: 975900 - RNA, 19 nt, Homo sapiens
ccaugguacuccaguuaca

SEQ ID NO: 975901 - RNA, 19 nt, Homo sapiens
gagaagaaagaacaaaaga

SEQ ID NO: 975902 - RNA, 19 nt, Homo sapiens
gagagaagaaagaacaaaa

SEQ ID NO: 975903 - RNA, 19 nt, Homo sapiens
gagaaaaugaugaaacugu

SEQ ID NO: 975904 - RNA, 19 nt, Homo sapiens
aucauaaucuugacacauc

SEQ ID NO: 975905 - RNA, 19 nt, Homo sapiens
gaaaaggaugaaagaagaa

SEQ ID NO: 975906 - RNA, 19 nt, Homo sapiens
gagcaagggccacgaugac

SEQ ID NO: 975907 - RNA, 19 nt, Homo sapiens
gguagaugagucuuuguuc

SEQ ID NO: 975908 - RNA, 19 nt, Homo sapiens
caacguggagguagaugag

SEQ ID NO: 975909 - RNA, 19 nt, Homo sapiens
gaucuaugggcaagagcaa

SEQ ID NO: 975910 - RNA, 19 nt, Homo sapiens
aagauaaugaugucucaga

SEQ ID NO: 975911 - RNA, 19 nt, Homo sapiens
ucaaguuuacauacaguga

SEQ ID NO: 975912 - RNA, 19 nt, Homo sapiens
gaauauucuucugauagcu

SEQ ID NO: 975913 - RNA, 19 nt, Homo sapiens
uggaggaugaugaagauga

SEQ ID NO: 975914 - RNA, 19 nt, Homo sapiens
cagaugaagcuccccuuua

SEQ ID NO: 975915 - RNA, 19 nt, Homo sapiens
ccucaaguuuacauacagu

SEQ ID NO: 975916 - RNA, 19 nt, Homo sapiens
ggaugaaagaagaagaaca

SEQ ID NO: 975917 - RNA, 19 nt, Homo sapiens
agaugagucuuuguuccaa

SEQ ID NO: 975918 - RNA, 19 nt, Homo sapiens
ugggaaacaacuauuugaa

SEQ ID NO: 975919 - RNA, 19 nt, Homo sapiens
gauaaaacuagaagagaga

SEQ ID NO: 975920 - RNA, 19 nt, Homo sapiens
gcauuacaggcugaagaaa

SEQ ID NO: 975921 - RNA, 19 nt, Homo sapiens
uagcauuacaggcugaaga

SEQ ID NO: 975922 - RNA, 19 nt, Homo sapiens
cugcugacccagagaguga

SEQ ID NO: 975923 - RNA, 19 nt, Homo sapiens
uuaagugggaaacaacuau

SEQ ID NO: 975924 - RNA, 19 nt, Homo sapiens
caagagcaagggccacgau

SEQ ID NO: 975925 - RNA, 19 nt, Homo sapiens
aaggaugaaagaagaagaa

SEQ ID NO: 975926 - RNA, 19 nt, Homo sapiens
agaagcagaagaagcugaa

SEQ ID NO: 975927 - RNA, 19 nt, Homo sapiens
cuugguauggugaugauuu

SEQ ID NO: 975928 - RNA, 19 nt, Homo sapiens
ccaucuacccugacuccuu

SEQ ID NO: 975929 - RNA, 19 nt, Homo sapiens
gaagcagaagaagcugaaa

SEQ ID NO: 975930 - RNA, 19 nt, Homo sapiens
ggacagauguuucucauug

SEQ ID NO: 975931 - RNA, 19 nt, Homo sapiens
ggaaugagauccaagucua

SEQ ID NO: 975932 - RNA, 19 nt, Homo sapiens
gaauacaguuguuuccaaa

SEQ ID NO: 975933 - RNA, 19 nt, Homo sapiens
gcaguguucuggaucauuu

SEQ ID NO: 975934 - RNA, 19 nt, Homo sapiens
cgaagcugcuggauaauuu

SEQ ID NO: 975935 - RNA, 19 nt, Homo sapiens
ccaaagucauuacugauaa

SEQ ID NO: 975936 - RNA, 19 nt, Homo sapiens
ggacuuaccgccauaugua

SEQ ID NO: 975937 - RNA, 19 nt, Homo sapiens
guucugcccuuuauauuaa

SEQ ID NO: 975938 - RNA, 19 nt, Homo sapiens
ucaagaagcucaucucucu

SEQ ID NO: 975939 - RNA, 19 nt, Homo sapiens
ugcaaaugcugacuaauaa

SEQ ID NO: 975940 - RNA, 19 nt, Homo sapiens
aaagguggcuguaaucaug

SEQ ID NO: 975941 - RNA, 19 nt, Homo sapiens
gaacucacccucacugugu

SEQ ID NO: 975942 - RNA, 19 nt, Homo sapiens
cuacaaccaucuuaaugaa

SEQ ID NO: 975943 - RNA, 19 nt, Homo sapiens
gaggacaccuuuuauauau

SEQ ID NO: 975944 - RNA, 19 nt, Homo sapiens
agacaaagccacccugaaa

SEQ ID NO: 975945 - RNA, 19 nt, Homo sapiens
acccgaagcugcuggauaa

SEQ ID NO: 975946 - RNA, 19 nt, Homo sapiens
gagcaccauuuguaauaau

SEQ ID NO: 975947 - RNA, 19 nt, Homo sapiens
gggcauauauagaguaagg

SEQ ID NO: 975948 - RNA, 19 nt, Homo sapiens
gaaagaaaagccuaaauug

SEQ ID NO: 975949 - RNA, 19 nt, Homo sapiens
cgacgguucugcccuuuau

SEQ ID NO: 975950 - RNA, 19 nt, Homo sapiens
gaaugagauccaagucuaa

SEQ ID NO: 975951 - RNA, 19 nt, Homo sapiens
gguucugcccuuuauauua

SEQ ID NO: 975952 - RNA, 19 nt, Homo sapiens
gcaauuguaacuccaucua

SEQ ID NO: 975953 - RNA, 19 nt, Homo sapiens
agaauuggaccuuggauuu

SEQ ID NO: 975954 - RNA, 19 nt, Homo sapiens
caagagaggcagcucaaga

SEQ ID NO: 975955 - RNA, 19 nt, Homo sapiens
gcucuauccuguguaacua

SEQ ID NO: 975956 - RNA, 19 nt, Homo sapiens
gaguaaggcuuuuguguau

SEQ ID NO: 975957 - RNA, 19 nt, Homo sapiens
cuacaaggccaucgaaaug

SEQ ID NO: 975958 - RNA, 19 nt, Homo sapiens
guaaggcuuuuguguauuu

SEQ ID NO: 975959 - RNA, 19 nt, Homo sapiens
gcaaaugcugacuaauaaa

SEQ ID NO: 975960 - RNA, 19 nt, Homo sapiens
agaaaaggcuucaaaggaa

SEQ ID NO: 975961 - RNA, 19 nt, Homo sapiens
auauguaccuucucuguug

SEQ ID NO: 975962 - RNA, 19 nt, Homo sapiens
gcaucugugugcugacuga

SEQ ID NO: 975963 - RNA, 19 nt, Homo sapiens
uaacuggcaugugggugua

SEQ ID NO: 975964 - RNA, 19 nt, Homo sapiens
uguauugcaucucuugauu

SEQ ID NO: 975965 - RNA, 19 nt, Homo sapiens
ugagcaccauuuguaauaa

SEQ ID NO: 975966 - RNA, 19 nt, Homo sapiens
guaacuccaucuaaucaag

SEQ ID NO: 975967 - RNA, 19 nt, Homo sapiens
agaauacaguuguuuccaa

SEQ ID NO: 975968 - RNA, 19 nt, Homo sapiens
augcaaaugcugacuaaua

SEQ ID NO: 975969 - RNA, 19 nt, Homo sapiens
agaugcaaaugcugacuaa

SEQ ID NO: 975970 - RNA, 19 nt, Homo sapiens
agauguuucucauugcaua

SEQ ID NO: 975971 - RNA, 19 nt, Homo sapiens
ucacaguugccucaaauga

SEQ ID NO: 975972 - RNA, 19 nt, Homo sapiens
cuacugcucuauccugugu

SEQ ID NO: 975973 - RNA, 19 nt, Homo sapiens
ccaaugaggacaccuuuua

SEQ ID NO: 975974 - RNA, 19 nt, Homo sapiens
gagaaaaggcuucaaagga

SEQ ID NO: 975975 - RNA, 19 nt, Homo sapiens
gaucuuuccagucuucuga

SEQ ID NO: 975976 - RNA, 19 nt, Homo sapiens
cccaaagucauuacugaua

SEQ ID NO: 975977 - RNA, 19 nt, Homo sapiens
caaaugcugacuaauaaag

SEQ ID NO: 975978 - RNA, 19 nt, Homo sapiens
guagcaguguucuggauca

SEQ ID NO: 975979 - RNA, 19 nt, Homo sapiens
uaccuucucuguuggcuau

SEQ ID NO: 975980 - RNA, 19 nt, Homo sapiens
uggcaauccugcuguccua

SEQ ID NO: 975981 - RNA, 19 nt, Homo sapiens
guguuggccuuuccuguug

SEQ ID NO: 975982 - RNA, 19 nt, Homo sapiens
ugucacaguugccucaaau

SEQ ID NO: 975983 - RNA, 19 nt, Homo sapiens
caauuguaacuccaucuaa

SEQ ID NO: 975984 - RNA, 19 nt, Homo sapiens
gcugacuaauaaagacaaa

SEQ ID NO: 975985 - RNA, 19 nt, Homo sapiens
gacguucauugaucugguu

SEQ ID NO: 975986 - RNA, 19 nt, Homo sapiens
ucuacaaccaucuuaauga

SEQ ID NO: 975987 - RNA, 19 nt, Homo sapiens
guauugcaucucuugauuu

SEQ ID NO: 975988 - RNA, 19 nt, Homo sapiens
agauugagccgccauugaa

SEQ ID NO: 975989 - RNA, 19 nt, Homo sapiens
ucauugaucugguuaucca

SEQ ID NO: 975990 - RNA, 19 nt, Homo sapiens
ggucuacaaccaucuuaau

SEQ ID NO: 975991 - RNA, 19 nt, Homo sapiens
acaaccaucuuaaugaacu

SEQ ID NO: 975992 - RNA, 19 nt, Homo sapiens
uaacuacaaggccaucgaa

SEQ ID NO: 975993 - RNA, 19 nt, Homo sapiens
cacuguguguuaaagaauu

SEQ ID NO: 975994 - RNA, 19 nt, Homo sapiens
aaacgcaagagcuagauug

SEQ ID NO: 975995 - RNA, 19 nt, Homo sapiens
agaaaagccuaaauuggaa

SEQ ID NO: 975996 - RNA, 19 nt, Homo sapiens
aagagaggcagcucaagaa

SEQ ID NO: 975997 - RNA, 19 nt, Homo sapiens
guucauugaucugguuauc

SEQ ID NO: 975998 - RNA, 19 nt, Homo sapiens
agaaaaguauggaagaaga

SEQ ID NO: 975999 - RNA, 19 nt, Homo sapiens
caaccaucuuaaugaacuu

SEQ ID NO: 976000 - RNA, 19 nt, Homo sapiens
gaaauuccugacguucauu

SEQ ID NO: 976001 - RNA, 19 nt, Homo sapiens
cacccucacuguguguuaa

SEQ ID NO: 976002 - RNA, 19 nt, Homo sapiens
gguuauccaggcugucuuu

SEQ ID NO: 976003 - RNA, 19 nt, Homo sapiens
ugaaaagccugaguguauu

SEQ ID NO: 976004 - RNA, 19 nt, Homo sapiens
augagcaccauuuguaaua

SEQ ID NO: 976005 - RNA, 19 nt, Homo sapiens
uaacuccaucuaaucaaga

SEQ ID NO: 976006 - RNA, 19 nt, Homo sapiens
cauagaauacaguuguuuc

SEQ ID NO: 976007 - RNA, 19 nt, Homo sapiens
ugaggacaccuuuuauaua

SEQ ID NO: 976008 - RNA, 19 nt, Homo sapiens
gaguguauugcaucucuug

SEQ ID NO: 976009 - RNA, 19 nt, Homo sapiens
gaaaagccugaguguauug

SEQ ID NO: 976010 - RNA, 19 nt, Homo sapiens
ccaucgaaaugcccucaca

SEQ ID NO: 976011 - RNA, 19 nt, Homo sapiens
gaauuggaccuuggauuuu

SEQ ID NO: 976012 - RNA, 19 nt, Homo sapiens
uagauugagccgccauuga

SEQ ID NO: 976013 - RNA, 19 nt, Homo sapiens
guauggaagaagagaaaga

SEQ ID NO: 976014 - RNA, 19 nt, Homo sapiens
cuucucuguuggcuauaua

SEQ ID NO: 976015 - RNA, 19 nt, Homo sapiens
ccauauguaccuucucugu

SEQ ID NO: 976016 - RNA, 19 nt, Homo sapiens
ugacagagagaugauauac

SEQ ID NO: 976017 - RNA, 19 nt, Homo sapiens
gauguuucucauugcauaa

SEQ ID NO: 976018 - RNA, 19 nt, Homo sapiens
cagaauuggaccuuggauu

SEQ ID NO: 976019 - RNA, 19 nt, Homo sapiens
agucuaaacgcaagagcua

SEQ ID NO: 976020 - RNA, 19 nt, Homo sapiens
gacuggauguuagcugugu

SEQ ID NO: 976021 - RNA, 19 nt, Homo sapiens
acagauguuucucauugca

SEQ ID NO: 976022 - RNA, 19 nt, Homo sapiens
gacagauguuucucauugc

SEQ ID NO: 976023 - RNA, 19 nt, Homo sapiens
uggcgaacauggcgcuugu

SEQ ID NO: 976024 - RNA, 19 nt, Homo sapiens
aagaaaagccuaaauugga

SEQ ID NO: 976025 - RNA, 19 nt, Homo sapiens
ggaagaagagaaagaaaag

SEQ ID NO: 976026 - RNA, 19 nt, Homo sapiens
cauauguaccuucucuguu

SEQ ID NO: 976027 - RNA, 19 nt, Homo sapiens
ccgaagcugcuggauaauu

SEQ ID NO: 976028 - RNA, 19 nt, Homo sapiens
uucccaaagucauuacuga

SEQ ID NO: 976029 - RNA, 19 nt, Homo sapiens
uauggaagaagagaaagaa

SEQ ID NO: 976030 - RNA, 19 nt, Homo sapiens
gguaagacgugccugauga

SEQ ID NO: 976031 - RNA, 19 nt, Homo sapiens
acagagggcuccacaggua

SEQ ID NO: 976032 - RNA, 19 nt, Homo sapiens
gaugagcgcuggugcuuca

SEQ ID NO: 976033 - RNA, 19 nt, Homo sapiens
gaaaugggaucugcucauc

SEQ ID NO: 976034 - RNA, 19 nt, Homo sapiens
gaaauucgccccucagaua

SEQ ID NO: 976035 - RNA, 19 nt, Homo sapiens
ccuuggagcucuucaaauu

SEQ ID NO: 976036 - RNA, 19 nt, Homo sapiens
gaauucugguggcaaauau

SEQ ID NO: 976037 - RNA, 19 nt, Homo sapiens
guucauagacagcuacuuu

SEQ ID NO: 976038 - RNA, 19 nt, Homo sapiens
gaagaggagucugcagugu

SEQ ID NO: 976039 - RNA, 19 nt, Homo sapiens
auagacagcuacuuugaaa

SEQ ID NO: 976040 - RNA, 19 nt, Homo sapiens
gagaucggcucuucaaugc

SEQ ID NO: 976041 - RNA, 19 nt, Homo sapiens
gaaccugcuuuacuauaca

SEQ ID NO: 976042 - RNA, 19 nt, Homo sapiens
gcacaucgccauugagaag

SEQ ID NO: 976043 - RNA, 19 nt, Homo sapiens
ggacagagcagaggaucuu

SEQ ID NO: 976044 - RNA, 19 nt, Homo sapiens
ggcugaaccugcuuuacua

SEQ ID NO: 976045 - RNA, 19 nt, Homo sapiens
guaaucugaucuacauguu

SEQ ID NO: 976046 - RNA, 19 nt, Homo sapiens
gagcagaggaucuuuccaa

SEQ ID NO: 976047 - RNA, 19 nt, Homo sapiens
ccacagcgcucugcacauc

SEQ ID NO: 976048 - RNA, 19 nt, Homo sapiens
cagaggaucuuuccaacca

SEQ ID NO: 976049 - RNA, 19 nt, Homo sapiens
gugcacagaugacuauuac

SEQ ID NO: 976050 - RNA, 19 nt, Homo sapiens
gaggaaagcuggauuuugg

SEQ ID NO: 976051 - RNA, 19 nt, Homo sapiens
cugcugcgcuuccuucuga

SEQ ID NO: 976052 - RNA, 19 nt, Homo sapiens
ccacauccuuauccugcua

SEQ ID NO: 976053 - RNA, 19 nt, Homo sapiens
uguaugaccuggcuucugu

SEQ ID NO: 976054 - RNA, 19 nt, Homo sapiens
gaguuaagcucccguucuc

SEQ ID NO: 976055 - RNA, 19 nt, Homo sapiens
gaagacaggacccuugaca

SEQ ID NO: 976056 - RNA, 19 nt, Homo sapiens
ggagaucauugccuuucau

SEQ ID NO: 976057 - RNA, 19 nt, Homo sapiens
gaugaaggcugugcugaac

SEQ ID NO: 976058 - RNA, 19 nt, Homo sapiens
gcacacaggcaucuacagu

SEQ ID NO: 976059 - RNA, 19 nt, Homo sapiens
aaucugaucuacauguuca

SEQ ID NO: 976060 - RNA, 19 nt, Homo sapiens
ucuuaaacuuccuguguaa

SEQ ID NO: 976061 - RNA, 19 nt, Homo sapiens
gcgagaccgucaacagugu

SEQ ID NO: 976062 - RNA, 19 nt, Homo sapiens
gaucauugccuuucauugc

SEQ ID NO: 976063 - RNA, 19 nt, Homo sapiens
gaugaucucggacaacuca

SEQ ID NO: 976064 - RNA, 19 nt, Homo sapiens
ccagucagccggauccaaa

SEQ ID NO: 976065 - RNA, 19 nt, Homo sapiens
gauggagaauggcuauugg

SEQ ID NO: 976066 - RNA, 19 nt, Homo sapiens
cgagaucggcucuucaaug

SEQ ID NO: 976067 - RNA, 19 nt, Homo sapiens
caucuacagugucaugauc

SEQ ID NO: 976068 - RNA, 19 nt, Homo sapiens
ggacagcugugaggagaac

SEQ ID NO: 976069 - RNA, 19 nt, Homo sapiens
ggagauggagaauggcuau

SEQ ID NO: 976070 - RNA, 19 nt, Homo sapiens
ugucccaggugcuguguuu

SEQ ID NO: 976071 - RNA, 19 nt, Homo sapiens
gcaccaagcagugggaugu

SEQ ID NO: 976072 - RNA, 19 nt, Homo sapiens
agaggagucugcagugugu

SEQ ID NO: 976073 - RNA, 19 nt, Homo sapiens
aggcugugcugaaccuuaa

SEQ ID NO: 976074 - RNA, 19 nt, Homo sapiens
ugaaccugcuuuacuauac

SEQ ID NO: 976075 - RNA, 19 nt, Homo sapiens
ugaaagcggagguuggaaa

SEQ ID NO: 976076 - RNA, 19 nt, Homo sapiens
cgacagggacucuggcaau

SEQ ID NO: 976077 - RNA, 19 nt, Homo sapiens
gagcaagaccagcaaguac

SEQ ID NO: 976078 - RNA, 19 nt, Homo sapiens
ugaauucugguggcaaaua

SEQ ID NO: 976079 - RNA, 19 nt, Homo sapiens
gagcgagaccgucaacagu

SEQ ID NO: 976080 - RNA, 19 nt, Homo sapiens
agacagcuacuuugaaauc

SEQ ID NO: 976081 - RNA, 19 nt, Homo sapiens
gagaucauugccuuucauu

SEQ ID NO: 976082 - RNA, 19 nt, Homo sapiens
gagcagccuccuccuccua

SEQ ID NO: 976083 - RNA, 19 nt, Homo sapiens
gauaagagucaaccucaac

SEQ ID NO: 976084 - RNA, 19 nt, Homo sapiens
uuggagcucuucaaauuca

SEQ ID NO: 976085 - RNA, 19 nt, Homo sapiens
acaggcaucuacaguguca

SEQ ID NO: 976086 - RNA, 19 nt, Homo sapiens
ucauagacagcuacuuuga

SEQ ID NO: 976087 - RNA, 19 nt, Homo sapiens
uaaacuuccuguguaaucu

SEQ ID NO: 976088 - RNA, 19 nt, Homo sapiens
gcccuaccgugcagcuuga

SEQ ID NO: 976089 - RNA, 19 nt, Homo sapiens
gcagugggaugugguaagc

SEQ ID NO: 976090 - RNA, 19 nt, Homo sapiens
gacagggacucuggcaauc

SEQ ID NO: 976091 - RNA, 19 nt, Homo sapiens
aaaccgauuugaccgagau

SEQ ID NO: 976092 - RNA, 19 nt, Homo sapiens
ccuacgugcugcucaccua

SEQ ID NO: 976093 - RNA, 19 nt, Homo sapiens
ccagugcacagaugacuau

SEQ ID NO: 976094 - RNA, 19 nt, Homo sapiens
ugagcaagaccagcaagua

SEQ ID NO: 976095 - RNA, 19 nt, Homo sapiens
ccagaguaccugagcaaga

SEQ ID NO: 976096 - RNA, 19 nt, Homo sapiens
agacaggacccuugacauc

SEQ ID NO: 976097 - RNA, 19 nt, Homo sapiens
cauagacagcuacuuugaa

SEQ ID NO: 976098 - RNA, 19 nt, Homo sapiens
guaagacgugccugaugaa

SEQ ID NO: 976099 - RNA, 19 nt, Homo sapiens
cagaguaccugagcaagac

SEQ ID NO: 976100 - RNA, 19 nt, Homo sapiens
ggacagaggaaagcuggau

SEQ ID NO: 976101 - RNA, 19 nt, Homo sapiens
uaagagucaaccucaacua

SEQ ID NO: 976102 - RNA, 19 nt, Homo sapiens
gcaggugucccucgaacuc

SEQ ID NO: 976103 - RNA, 19 nt, Homo sapiens
cuucugaucuacuuagucu

SEQ ID NO: 976104 - RNA, 19 nt, Homo sapiens
ugaaauccucuuccuguuc

SEQ ID NO: 976105 - RNA, 19 nt, Homo sapiens
ugaucuacauguucaucuu

SEQ ID NO: 976106 - RNA, 19 nt, Homo sapiens
caaggaggaugaggauggu

SEQ ID NO: 976107 - RNA, 19 nt, Homo sapiens
gaaagcggagguuggaaac

SEQ ID NO: 976108 - RNA, 19 nt, Homo sapiens
gaucuacauguucaucuuc

SEQ ID NO: 976109 - RNA, 19 nt, Homo sapiens
caggaucucacgccucuga

SEQ ID NO: 976110 - RNA, 19 nt, Homo sapiens
agugggaugugguaagcua

SEQ ID NO: 976111 - RNA, 19 nt, Homo sapiens
acagaggaaagcuggauuu

SEQ ID NO: 976112 - RNA, 19 nt, Homo sapiens
acugacagcuggagcaucu

SEQ ID NO: 976113 - RNA, 19 nt, Homo sapiens
gugaugaucucggacaacu

SEQ ID NO: 976114 - RNA, 19 nt, Homo sapiens
ggagggcaagaucgagauu

SEQ ID NO: 976115 - RNA, 19 nt, Homo sapiens
ccaaggagggcaagaucga

SEQ ID NO: 976116 - RNA, 19 nt, Homo sapiens
agugaauucugguggcaaa

SEQ ID NO: 976117 - RNA, 19 nt, Homo sapiens
gaacucagugcuggagauc

SEQ ID NO: 976118 - RNA, 19 nt, Homo sapiens
acagugucaugauccagaa

SEQ ID NO: 976119 - RNA, 19 nt, Homo sapiens
gauggaggccaagaagaug

SEQ ID NO: 976120 - RNA, 19 nt, Homo sapiens
caagcagugggauguggua

SEQ ID NO: 976121 - RNA, 19 nt, Homo sapiens
uaaaugcccagugcacaga

SEQ ID NO: 976122 - RNA, 19 nt, Homo sapiens
cccuccagcucuccaguuu

SEQ ID NO: 976123 - RNA, 19 nt, Homo sapiens
uugaaauccucuuccuguu

SEQ ID NO: 976124 - RNA, 19 nt, Homo sapiens
ggccagcugugguacuucu

SEQ ID NO: 976125 - RNA, 19 nt, Homo sapiens
uucuuaaacuuccugugua

SEQ ID NO: 976126 - RNA, 19 nt, Homo sapiens
agauaagagucaaccucaa

SEQ ID NO: 976127 - RNA, 19 nt, Homo sapiens
gggcgaggaccggaaauuc

SEQ ID NO: 976128 - RNA, 19 nt, Homo sapiens
ugacgggccacauccuuau

SEQ ID NO: 976129 - RNA, 19 nt, Homo sapiens
caaccucaacuaccgaaag

SEQ ID NO: 976130 - RNA, 19 nt, Homo sapiens
agacaaagcugaagcauuu

SEQ ID NO: 976131 - RNA, 19 nt, Homo sapiens
gaaacaagaucuucaccua

SEQ ID NO: 976132 - RNA, 19 nt, Homo sapiens
uaagaacacuuucccuuua

SEQ ID NO: 976133 - RNA, 19 nt, Homo sapiens
gaagauacauugccagguu

SEQ ID NO: 976134 - RNA, 19 nt, Homo sapiens
agaaucaggucuugaauaa

SEQ ID NO: 976135 - RNA, 19 nt, Homo sapiens
gaacauucaucuuagacaa

SEQ ID NO: 976136 - RNA, 19 nt, Homo sapiens
auacagagcuuugguaauu

SEQ ID NO: 976137 - RNA, 19 nt, Homo sapiens
gagcuucucugucaacuuc

SEQ ID NO: 976138 - RNA, 19 nt, Homo sapiens
caaagagccuggagaaagu

SEQ ID NO: 976139 - RNA, 19 nt, Homo sapiens
ggaguuguuugauuucuau

SEQ ID NO: 976140 - RNA, 19 nt, Homo sapiens
gaauacagagcuuugguaa

SEQ ID NO: 976141 - RNA, 19 nt, Homo sapiens
gauggcagcuuaaccuuca

SEQ ID NO: 976142 - RNA, 19 nt, Homo sapiens
caaggagcguccauggaua

SEQ ID NO: 976143 - RNA, 19 nt, Homo sapiens
ggaaggaaauguaaaauag

SEQ ID NO: 976144 - RNA, 19 nt, Homo sapiens
caguuucucucucaguuua

SEQ ID NO: 976145 - RNA, 19 nt, Homo sapiens
gcugaagcauuugucaaua

SEQ ID NO: 976146 - RNA, 19 nt, Homo sapiens
gaauacugagguucuaaua

SEQ ID NO: 976147 - RNA, 19 nt, Homo sapiens
guccauggauacaagauaa

SEQ ID NO: 976148 - RNA, 19 nt, Homo sapiens
ucaaauacacuauggcauu

SEQ ID NO: 976149 - RNA, 19 nt, Homo sapiens
uuauauggcuuaucacuuc

SEQ ID NO: 976150 - RNA, 19 nt, Homo sapiens
gcacagcuggauucccuua

SEQ ID NO: 976151 - RNA, 19 nt, Homo sapiens
gaaaguucuuguggaauuc

SEQ ID NO: 976152 - RNA, 19 nt, Homo sapiens
gucaauacguggucuucua

SEQ ID NO: 976153 - RNA, 19 nt, Homo sapiens
guaguaugguaucaguuaa

SEQ ID NO: 976154 - RNA, 19 nt, Homo sapiens
agucugagcuucucuguca

SEQ ID NO: 976155 - RNA, 19 nt, Homo sapiens
gagcuuugguaauuacaug

SEQ ID NO: 976156 - RNA, 19 nt, Homo sapiens
aagaacacuuucccuuuaa

SEQ ID NO: 976157 - RNA, 19 nt, Homo sapiens
auaacaagcuagagacuau

SEQ ID NO: 976158 - RNA, 19 nt, Homo sapiens
ucaccuaguucuugaaaca

SEQ ID NO: 976159 - RNA, 19 nt, Homo sapiens
gauacaagauaagaugugu

SEQ ID NO: 976160 - RNA, 19 nt, Homo sapiens
gcuuaucacuucuuagaca

SEQ ID NO: 976161 - RNA, 19 nt, Homo sapiens
gaacaggcaguguaucaca

SEQ ID NO: 976162 - RNA, 19 nt, Homo sapiens
ugacuugcuuucuguaaau

SEQ ID NO: 976163 - RNA, 19 nt, Homo sapiens
cagaaucaggucuugaaua

SEQ ID NO: 976164 - RNA, 19 nt, Homo sapiens
gcuagagacuauacaagca

SEQ ID NO: 976165 - RNA, 19 nt, Homo sapiens
gaucuucaccuaguucuug

SEQ ID NO: 976166 - RNA, 19 nt, Homo sapiens
ggaaauaauauaggaagga

SEQ ID NO: 976167 - RNA, 19 nt, Homo sapiens
gagcguccauggauacaag

SEQ ID NO: 976168 - RNA, 19 nt, Homo sapiens
uagagaacauucaucuuag

SEQ ID NO: 976169 - RNA, 19 nt, Homo sapiens
gacagaaucaggucuugaa

SEQ ID NO: 976170 - RNA, 19 nt, Homo sapiens
gauguguaccuuaguagaa

SEQ ID NO: 976171 - RNA, 19 nt, Homo sapiens
gugacuugcuuucuguaaa

SEQ ID NO: 976172 - RNA, 19 nt, Homo sapiens
uacagagcuuugguaauua

SEQ ID NO: 976173 - RNA, 19 nt, Homo sapiens
uuaagaacacuuucccuuu

SEQ ID NO: 976174 - RNA, 19 nt, Homo sapiens
caaauaacaaccaauagag

SEQ ID NO: 976175 - RNA, 19 nt, Homo sapiens
uggauucccuuacaugaug

SEQ ID NO: 976176 - RNA, 19 nt, Homo sapiens
ugcaauagauacaggaaga

SEQ ID NO: 976177 - RNA, 19 nt, Homo sapiens
ucaaagagccuggagaaag

SEQ ID NO: 976178 - RNA, 19 nt, Homo sapiens
ggagugaacaaugaagauu

SEQ ID NO: 976179 - RNA, 19 nt, Homo sapiens
gcaauuagagaacauucau

SEQ ID NO: 976180 - RNA, 19 nt, Homo sapiens
aauagugaguaguauggua

SEQ ID NO: 976181 - RNA, 19 nt, Homo sapiens
gaauucuggcucccuguaa

SEQ ID NO: 976182 - RNA, 19 nt, Homo sapiens
agagaacauucaucuuaga

SEQ ID NO: 976183 - RNA, 19 nt, Homo sapiens
ccuaguucuugaaacaaua

SEQ ID NO: 976184 - RNA, 19 nt, Homo sapiens
uguaaugagugcuaaaugg

SEQ ID NO: 976185 - RNA, 19 nt, Homo sapiens
uauggcuuaucacuucuua

SEQ ID NO: 976186 - RNA, 19 nt, Homo sapiens
ucagugacuugcuuucugu

SEQ ID NO: 976187 - RNA, 19 nt, Homo sapiens
aguaguaugguaucaguua

SEQ ID NO: 976188 - RNA, 19 nt, Homo sapiens
uggaugauaccauaaugua

SEQ ID NO: 976189 - RNA, 19 nt, Homo sapiens
gcuggaugauaccauaaug

SEQ ID NO: 976190 - RNA, 19 nt, Homo sapiens
aacaagaucuucaccuagu

SEQ ID NO: 976191 - RNA, 19 nt, Homo sapiens
aagauaagauguguaccuu

SEQ ID NO: 976192 - RNA, 19 nt, Homo sapiens
ucauaguguugcuuucuug

SEQ ID NO: 976193 - RNA, 19 nt, Homo sapiens
acaaucaaauacacuaugg

SEQ ID NO: 976194 - RNA, 19 nt, Homo sapiens
ucaaggagcguccauggau

SEQ ID NO: 976195 - RNA, 19 nt, Homo sapiens
agaacacuuucccuuuaaa

SEQ ID NO: 976196 - RNA, 19 nt, Homo sapiens
gaaaaguuccggcagagaa

SEQ ID NO: 976197 - RNA, 19 nt, Homo sapiens
ugaguaguaugguaucagu

SEQ ID NO: 976198 - RNA, 19 nt, Homo sapiens
cuucggaaauaauauagga

SEQ ID NO: 976199 - RNA, 19 nt, Homo sapiens
cgaaucagauaccuuuuau

SEQ ID NO: 976200 - RNA, 19 nt, Homo sapiens
caauagauacaggaagauu

SEQ ID NO: 976201 - RNA, 19 nt, Homo sapiens
uuucuugccuguccugcua

SEQ ID NO: 976202 - RNA, 19 nt, Homo sapiens
cagcagcaauuagagaaca

SEQ ID NO: 976203 - RNA, 19 nt, Homo sapiens
uagaacaggcaguguauca

SEQ ID NO: 976204 - RNA, 19 nt, Homo sapiens
acaagaucuucaccuaguu

SEQ ID NO: 976205 - RNA, 19 nt, Homo sapiens
caagcuagagacuauacaa

SEQ ID NO: 976206 - RNA, 19 nt, Homo sapiens
gaaucaggucuugaauaaa

SEQ ID NO: 976207 - RNA, 19 nt, Homo sapiens
ugccuguccugcuaaguuu

SEQ ID NO: 976208 - RNA, 19 nt, Homo sapiens
gcuggauucccuuacauga

SEQ ID NO: 976209 - RNA, 19 nt, Homo sapiens
uaacaagcuagagacuaua

SEQ ID NO: 976210 - RNA, 19 nt, Homo sapiens
agaauacagagcuuuggua

SEQ ID NO: 976211 - RNA, 19 nt, Homo sapiens
ggauacaagauaagaugug

SEQ ID NO: 976212 - RNA, 19 nt, Homo sapiens
cuugcuggaugauaccaua

SEQ ID NO: 976213 - RNA, 19 nt, Homo sapiens
uaacaaccaauagagauca

SEQ ID NO: 976214 - RNA, 19 nt, Homo sapiens
gacuugcuuucuguaaauu

SEQ ID NO: 976215 - RNA, 19 nt, Homo sapiens
ucacucggauucuucaaaa

SEQ ID NO: 976216 - RNA, 19 nt, Homo sapiens
gagugaacaaugaagauuc

SEQ ID NO: 976217 - RNA, 19 nt, Homo sapiens
accguuggauggcagcuua

SEQ ID NO: 976218 - RNA, 19 nt, Homo sapiens
ucaauacguggucuucuau

SEQ ID NO: 976219 - RNA, 19 nt, Homo sapiens
caccauuauucgaaucaga

SEQ ID NO: 976220 - RNA, 19 nt, Homo sapiens
uguguaccuuaguagaaua

SEQ ID NO: 976221 - RNA, 19 nt, Homo sapiens
gucauaguguugcuuucuu

SEQ ID NO: 976222 - RNA, 19 nt, Homo sapiens
gacaaauaacaaccaauag

SEQ ID NO: 976223 - RNA, 19 nt, Homo sapiens
uggcuuaucacuucuuaga

SEQ ID NO: 976224 - RNA, 19 nt, Homo sapiens
aaacuaaaaucuccucaag

SEQ ID NO: 976225 - RNA, 19 nt, Homo sapiens
agaaacaguugaaaaguuc

SEQ ID NO: 976226 - RNA, 19 nt, Homo sapiens
acagagcuuugguaauuac

SEQ ID NO: 976227 - RNA, 19 nt, Homo sapiens
caagaucuucaccuaguuc

SEQ ID NO: 976228 - RNA, 19 nt, Homo sapiens
ugagccaacaguaauuauu

SEQ ID NO: 976229 - RNA, 19 nt, Homo sapiens
cugaagcauuugucaauac

SEQ ID NO: 976230 - RNA, 19 nt, Homo sapiens
guugaaaccuguuguuaau

SEQ ID NO: 976231 - RNA, 19 nt, Homo sapiens
cgaacaaagugcugaggua

SEQ ID NO: 976232 - RNA, 19 nt, Homo sapiens
gggagaugcuguccauguu

SEQ ID NO: 976233 - RNA, 19 nt, Homo sapiens
cgaagcaaaugaugaguag

SEQ ID NO: 976234 - RNA, 19 nt, Homo sapiens
gagaugcuguccauguuuc

SEQ ID NO: 976235 - RNA, 19 nt, Homo sapiens
ggagaugcuguccauguuu

SEQ ID NO: 976236 - RNA, 19 nt, Homo sapiens
acaaagugcugagguacaa

SEQ ID NO: 976237 - RNA, 19 nt, Homo sapiens
gcuauguccacuaacaaua

SEQ ID NO: 976238 - RNA, 19 nt, Homo sapiens
caaaugaugaguagcuuca

SEQ ID NO: 976239 - RNA, 19 nt, Homo sapiens
ggacacgaagcaaaugaug

SEQ ID NO: 976240 - RNA, 19 nt, Homo sapiens
gugcuugggucgcugucua

SEQ ID NO: 976241 - RNA, 19 nt, Homo sapiens
guccaagccucugucauga

SEQ ID NO: 976242 - RNA, 19 nt, Homo sapiens
ccucggguguuacucuaaa

SEQ ID NO: 976243 - RNA, 19 nt, Homo sapiens
gaggacacgaagcaaauga

SEQ ID NO: 976244 - RNA, 19 nt, Homo sapiens
ccacggaggccgaacaaag

SEQ ID NO: 976245 - RNA, 19 nt, Homo sapiens
gacucgcuauguccacuaa

SEQ ID NO: 976246 - RNA, 19 nt, Homo sapiens
gacccugucuauccacuag

SEQ ID NO: 976247 - RNA, 19 nt, Homo sapiens
cguugaaaccuguuguuaa

SEQ ID NO: 976248 - RNA, 19 nt, Homo sapiens
ccacuaggccugggcuuug

SEQ ID NO: 976249 - RNA, 19 nt, Homo sapiens
ggcgugaucuggccuucga

SEQ ID NO: 976250 - RNA, 19 nt, Homo sapiens
cagcugccauccuggacuu

SEQ ID NO: 976251 - RNA, 19 nt, Homo sapiens
cuagaagggucacauuuug

SEQ ID NO: 976252 - RNA, 19 nt, Homo sapiens
ggugauaccagccuagaag

SEQ ID NO: 976253 - RNA, 19 nt, Homo sapiens
gacacgaagcaaaugauga

SEQ ID NO: 976254 - RNA, 19 nt, Homo sapiens
caucagcuuugccaacucu

SEQ ID NO: 976255 - RNA, 19 nt, Homo sapiens
ggccucggguguuacucua

SEQ ID NO: 976256 - RNA, 19 nt, Homo sapiens
uauguccacuaacaauaug

SEQ ID NO: 976257 - RNA, 19 nt, Homo sapiens
ucauuugcuuucucguuga

SEQ ID NO: 976258 - RNA, 19 nt, Homo sapiens
gguauucauuugcuuucuc

SEQ ID NO: 976259 - RNA, 19 nt, Homo sapiens
gccuagaagggucacauuu

SEQ ID NO: 976260 - RNA, 19 nt, Homo sapiens
gauguccuaucugcagaau

SEQ ID NO: 976261 - RNA, 19 nt, Homo sapiens
ugugcggccucaugcuuaa

SEQ ID NO: 976262 - RNA, 19 nt, Homo sapiens
gcucggaggacacgaagca

SEQ ID NO: 976263 - RNA, 19 nt, Homo sapiens
ggaggacacgaagcaaaug

SEQ ID NO: 976264 - RNA, 19 nt, Homo sapiens
ggagcucggaggacacgaa

SEQ ID NO: 976265 - RNA, 19 nt, Homo sapiens
cuauguccacuaacaauau

SEQ ID NO: 976266 - RNA, 19 nt, Homo sapiens
cauuugcuuucucguugaa

SEQ ID NO: 976267 - RNA, 19 nt, Homo sapiens
cuucuggcuucuccuaaau

SEQ ID NO: 976268 - RNA, 19 nt, Homo sapiens
ccugggcuuuggcugcuaa

SEQ ID NO: 976269 - RNA, 19 nt, Homo sapiens
uguccuaucugcagaaucc

SEQ ID NO: 976270 - RNA, 19 nt, Homo sapiens
gcugucuacugcuccuuca

SEQ ID NO: 976271 - RNA, 19 nt, Homo sapiens
aguccaagccucugucaug

SEQ ID NO: 976272 - RNA, 19 nt, Homo sapiens
acgaagcaaaugaugagua

SEQ ID NO: 976273 - RNA, 19 nt, Homo sapiens
cggaggacacgaagcaaau

SEQ ID NO: 976274 - RNA, 19 nt, Homo sapiens
ggacccugucuauccacua

SEQ ID NO: 976275 - RNA, 19 nt, Homo sapiens
cagaauccucagcccauga

SEQ ID NO: 976276 - RNA, 19 nt, Homo sapiens
acacgaagcaaaugaugag

SEQ ID NO: 976277 - RNA, 19 nt, Homo sapiens
cgacgccggacuacaugaa

SEQ ID NO: 976278 - RNA, 19 nt, Homo sapiens
ucguugaaaccuguuguua

SEQ ID NO: 976279 - RNA, 19 nt, Homo sapiens
acuucuggcuucuccuaaa

SEQ ID NO: 976280 - RNA, 19 nt, Homo sapiens
gaaccugcugggcaugauc

SEQ ID NO: 976281 - RNA, 19 nt, Homo sapiens
agacuucuggcuucuccua

SEQ ID NO: 976282 - RNA, 19 nt, Homo sapiens
ggaaagaggugcuggagua

SEQ ID NO: 976283 - RNA, 19 nt, Homo sapiens
ggagcuagguccauaaaug

SEQ ID NO: 976284 - RNA, 19 nt, Homo sapiens
gcucuuuccuucuguauau

SEQ ID NO: 976285 - RNA, 19 nt, Homo sapiens
ugacagggaucaaguuugu

SEQ ID NO: 976286 - RNA, 19 nt, Homo sapiens
gagaguuccugcaacaaga

SEQ ID NO: 976287 - RNA, 19 nt, Homo sapiens
ggagacagacacauucaaa

SEQ ID NO: 976288 - RNA, 19 nt, Homo sapiens
ggagaaugcugacccugau

SEQ ID NO: 976289 - RNA, 19 nt, Homo sapiens
uagauucucuucuccgaaa

SEQ ID NO: 976290 - RNA, 19 nt, Homo sapiens
gaucaaguuugugguucua

SEQ ID NO: 976291 - RNA, 19 nt, Homo sapiens
cagggaagcucaggcauug

SEQ ID NO: 976292 - RNA, 19 nt, Homo sapiens
gacagacacauucaaauug

SEQ ID NO: 976293 - RNA, 19 nt, Homo sapiens
agacagacacauucaaauu

SEQ ID NO: 976294 - RNA, 19 nt, Homo sapiens
gagauuuacucagacuuug

SEQ ID NO: 976295 - RNA, 19 nt, Homo sapiens
ccgaaagauuuaugagauu

SEQ ID NO: 976296 - RNA, 19 nt, Homo sapiens
gaauacugcuguugacacu

SEQ ID NO: 976297 - RNA, 19 nt, Homo sapiens
guacacggccgacgggaaa

SEQ ID NO: 976298 - RNA, 19 nt, Homo sapiens
uaggcaagcuggaauagau

SEQ ID NO: 976299 - RNA, 19 nt, Homo sapiens
uaucaggugugagcucuuu

SEQ ID NO: 976300 - RNA, 19 nt, Homo sapiens
gagcuagguccauaaaugu

SEQ ID NO: 976301 - RNA, 19 nt, Homo sapiens
gaucuugguguuugcguaa

SEQ ID NO: 976302 - RNA, 19 nt, Homo sapiens
ggucuuacuuuccaacucu

SEQ ID NO: 976303 - RNA, 19 nt, Homo sapiens
gucauaggcugaaccuguu

SEQ ID NO: 976304 - RNA, 19 nt, Homo sapiens
cagagaaggcuggaacuuu

SEQ ID NO: 976305 - RNA, 19 nt, Homo sapiens
ggucucggcagcuaacuuu

SEQ ID NO: 976306 - RNA, 19 nt, Homo sapiens
ucaauggcauggacgugaa

SEQ ID NO: 976307 - RNA, 19 nt, Homo sapiens
caagaauacugcuguugac

SEQ ID NO: 976308 - RNA, 19 nt, Homo sapiens
agagaaggcuggaacuuuu

SEQ ID NO: 976309 - RNA, 19 nt, Homo sapiens
ccuuaacacugugcucuuu

SEQ ID NO: 976310 - RNA, 19 nt, Homo sapiens
acaagaauacugcuguuga

SEQ ID NO: 976311 - RNA, 19 nt, Homo sapiens
gaaagaggugcuggaguau

SEQ ID NO: 976312 - RNA, 19 nt, Homo sapiens
gaggagcuagguccauaaa

SEQ ID NO: 976313 - RNA, 19 nt, Homo sapiens
cugaugacuuguacugauu

SEQ ID NO: 976314 - RNA, 19 nt, Homo sapiens
gaaucugaauaccaguuuc

SEQ ID NO: 976315 - RNA, 19 nt, Homo sapiens
aaucccagcagccuuguua

SEQ ID NO: 976316 - RNA, 19 nt, Homo sapiens
uccgaaagauuuaugagau

SEQ ID NO: 976317 - RNA, 19 nt, Homo sapiens
ggaggagcuagguccauaa

SEQ ID NO: 976318 - RNA, 19 nt, Homo sapiens
ggaucaaguuugugguucu

SEQ ID NO: 976319 - RNA, 19 nt, Homo sapiens
gagcguguguugguugcuu

SEQ ID NO: 976320 - RNA, 19 nt, Homo sapiens
guguguauguggugaacaa

SEQ ID NO: 976321 - RNA, 19 nt, Homo sapiens
caccaggucucggcagcua

SEQ ID NO: 976322 - RNA, 19 nt, Homo sapiens
gcagagaaggcuggaacuu

SEQ ID NO: 976323 - RNA, 19 nt, Homo sapiens
gagacagacacauucaaau

SEQ ID NO: 976324 - RNA, 19 nt, Homo sapiens
cggcuugauuuaccaguug

SEQ ID NO: 976325 - RNA, 19 nt, Homo sapiens
ccugaugacuuguacugau

SEQ ID NO: 976326 - RNA, 19 nt, Homo sapiens
aagaggugcuggaguaucu

SEQ ID NO: 976327 - RNA, 19 nt, Homo sapiens
gcuagguccauaaauguug

SEQ ID NO: 976328 - RNA, 19 nt, Homo sapiens
ucugagaguuccugcaaca

SEQ ID NO: 976329 - RNA, 19 nt, Homo sapiens
acagacacauucaaauugc

SEQ ID NO: 976330 - RNA, 19 nt, Homo sapiens
gcggcuugauuuaccaguu

SEQ ID NO: 976331 - RNA, 19 nt, Homo sapiens
agacuuugcccucaagaau

SEQ ID NO: 976332 - RNA, 19 nt, Homo sapiens
uaacuuuccggcacuacuu

SEQ ID NO: 976333 - RNA, 19 nt, Homo sapiens
ccuuugaucuugguguuug

SEQ ID NO: 976334 - RNA, 19 nt, Homo sapiens
cuaauuacccgguguccau

SEQ ID NO: 976335 - RNA, 19 nt, Homo sapiens
gcagugcuggccaucaaug

SEQ ID NO: 976336 - RNA, 19 nt, Homo sapiens
cggcgcaagugcugugaug

SEQ ID NO: 976337 - RNA, 19 nt, Homo sapiens
cauucaaauugcacugcua

SEQ ID NO: 976338 - RNA, 19 nt, Homo sapiens
uugagaugcuggagacaga

SEQ ID NO: 976339 - RNA, 19 nt, Homo sapiens
uauauaccauggucuuacu

SEQ ID NO: 976340 - RNA, 19 nt, Homo sapiens
gauccuaggcaagcuggaa

SEQ ID NO: 976341 - RNA, 19 nt, Homo sapiens
gcuggagacagacacauuc

SEQ ID NO: 976342 - RNA, 19 nt, Homo sapiens
agaaucugaauaccaguuu

SEQ ID NO: 976343 - RNA, 19 nt, Homo sapiens
uauaccauggucuuacuuu

SEQ ID NO: 976344 - RNA, 19 nt, Homo sapiens
cuagguccauaaauguugu

SEQ ID NO: 976345 - RNA, 19 nt, Homo sapiens
agaaugcugacccugauga

SEQ ID NO: 976346 - RNA, 19 nt, Homo sapiens
acagggaagcucaggcauu

SEQ ID NO: 976347 - RNA, 19 nt, Homo sapiens
aggcugaaccuguuaugga

SEQ ID NO: 976348 - RNA, 19 nt, Homo sapiens
acucagacuuugcccucaa

SEQ ID NO: 976349 - RNA, 19 nt, Homo sapiens
aggcagcgauggcgauuuu

SEQ ID NO: 976350 - RNA, 19 nt, Homo sapiens
cgaugagcguguguugguu

SEQ ID NO: 976351 - RNA, 19 nt, Homo sapiens
ugcucaagcuacacgauga

SEQ ID NO: 976352 - RNA, 19 nt, Homo sapiens
uguauauaccauggucuua

SEQ ID NO: 976353 - RNA, 19 nt, Homo sapiens
acugauuccugagccuuaa

SEQ ID NO: 976354 - RNA, 19 nt, Homo sapiens
gagaaugcugacccugaug

SEQ ID NO: 976355 - RNA, 19 nt, Homo sapiens
ucauaggcugaaccuguua

SEQ ID NO: 976356 - RNA, 19 nt, Homo sapiens
ucaggugugagcucuuuga

SEQ ID NO: 976357 - RNA, 19 nt, Homo sapiens
aaaugccuaucagguguga

SEQ ID NO: 976358 - RNA, 19 nt, Homo sapiens
augcagugcuggccaucaa

SEQ ID NO: 976359 - RNA, 19 nt, Homo sapiens
ggaaggaagugagucuaua

SEQ ID NO: 976360 - RNA, 19 nt, Homo sapiens
cauggaagauguagaagua

SEQ ID NO: 976361 - RNA, 19 nt, Homo sapiens
gguaaagccuccagauuug

SEQ ID NO: 976362 - RNA, 19 nt, Homo sapiens
gaaugaaacuggcaaggau

SEQ ID NO: 976363 - RNA, 19 nt, Homo sapiens
ggauaaagaucugaccauu

SEQ ID NO: 976364 - RNA, 19 nt, Homo sapiens
ccauacaccuggagaauug

SEQ ID NO: 976365 - RNA, 19 nt, Homo sapiens
gaaggaagugagucuauaa

SEQ ID NO: 976366 - RNA, 19 nt, Homo sapiens
ucacaucacuccacacaga

SEQ ID NO: 976367 - RNA, 19 nt, Homo sapiens
ggagaaugcuauugaaugg

SEQ ID NO: 976368 - RNA, 19 nt, Homo sapiens
ggccaaagccuauggaauu

SEQ ID NO: 976369 - RNA, 19 nt, Homo sapiens
ggguaaagccuccagauuu

SEQ ID NO: 976370 - RNA, 19 nt, Homo sapiens
ggaagugagucuauaagca

SEQ ID NO: 976371 - RNA, 19 nt, Homo sapiens
caaacagugugaaggaauu

SEQ ID NO: 976372 - RNA, 19 nt, Homo sapiens
aaacaaaggucaagaaucc

SEQ ID NO: 976373 - RNA, 19 nt, Homo sapiens
gcuauugaauggaguguga

SEQ ID NO: 976374 - RNA, 19 nt, Homo sapiens
auaaauaucucccaaccuu

SEQ ID NO: 976375 - RNA, 19 nt, Homo sapiens
ggaccuuccuccuccaauu

SEQ ID NO: 976376 - RNA, 19 nt, Homo sapiens
gaagugagucuauaagcaa

SEQ ID NO: 976377 - RNA, 19 nt, Homo sapiens
ggucaagaauccugaagau

SEQ ID NO: 976378 - RNA, 19 nt, Homo sapiens
cagcuucucuuugccauuu

SEQ ID NO: 976379 - RNA, 19 nt, Homo sapiens
caaagccuauggaauuguu

SEQ ID NO: 976380 - RNA, 19 nt, Homo sapiens
ggaccuccauuccuugaga

SEQ ID NO: 976381 - RNA, 19 nt, Homo sapiens
gcucuuggcugguguugau

SEQ ID NO: 976382 - RNA, 19 nt, Homo sapiens
caugauugauguuguagaa

SEQ ID NO: 976383 - RNA, 19 nt, Homo sapiens
gaaacgagccugaaaauca

SEQ ID NO: 976384 - RNA, 19 nt, Homo sapiens
guaccaaccuuuucaugua

SEQ ID NO: 976385 - RNA, 19 nt, Homo sapiens
auaaagaucugaccauugg

SEQ ID NO: 976386 - RNA, 19 nt, Homo sapiens
caagaaagaccauccauac

SEQ ID NO: 976387 - RNA, 19 nt, Homo sapiens
gugcaugauugauguugua

SEQ ID NO: 976388 - RNA, 19 nt, Homo sapiens
gaagucauggugaaacaaa

SEQ ID NO: 976389 - RNA, 19 nt, Homo sapiens
cgauacaucugaguucaaa

SEQ ID NO: 976390 - RNA, 19 nt, Homo sapiens
uccaaucucuuucuuaguu

SEQ ID NO: 976391 - RNA, 19 nt, Homo sapiens
guggauagcaucacaagaa

SEQ ID NO: 976392 - RNA, 19 nt, Homo sapiens
gaucccauccuuagccaua

SEQ ID NO: 976393 - RNA, 19 nt, Homo sapiens
gauaaagaucugaccauug

SEQ ID NO: 976394 - RNA, 19 nt, Homo sapiens
gaccuuccuccuccaauua

SEQ ID NO: 976395 - RNA, 19 nt, Homo sapiens
ucagggaccuccauuccuu

SEQ ID NO: 976396 - RNA, 19 nt, Homo sapiens
guugauagauuggauaaag

SEQ ID NO: 976397 - RNA, 19 nt, Homo sapiens
ccaagaaagaccauccaua

SEQ ID NO: 976398 - RNA, 19 nt, Homo sapiens
agaagaagaugaggaagga

SEQ ID NO: 976399 - RNA, 19 nt, Homo sapiens
ccagaaggcucaaaaucua

SEQ ID NO: 976400 - RNA, 19 nt, Homo sapiens
cuuaauagcaugcagaauu

SEQ ID NO: 976401 - RNA, 19 nt, Homo sapiens
caagaauccugaagaucug

SEQ ID NO: 976402 - RNA, 19 nt, Homo sapiens
cggcagcgauuauuaguag

SEQ ID NO: 976403 - RNA, 19 nt, Homo sapiens
gccaaagccuauggaauug

SEQ ID NO: 976404 - RNA, 19 nt, Homo sapiens
gaaacaaaggucaagaauc

SEQ ID NO: 976405 - RNA, 19 nt, Homo sapiens
ucugggaccuacuuuguuu

SEQ ID NO: 976406 - RNA, 19 nt, Homo sapiens
ugucuuaggugauguguag

SEQ ID NO: 976407 - RNA, 19 nt, Homo sapiens
caucugaguucaaaugucu

SEQ ID NO: 976408 - RNA, 19 nt, Homo sapiens
uauccaaucucuuucuuag

SEQ ID NO: 976409 - RNA, 19 nt, Homo sapiens
aaucauagaggaagaagaa

SEQ ID NO: 976410 - RNA, 19 nt, Homo sapiens
acaucgagcucuguuguaa

SEQ ID NO: 976411 - RNA, 19 nt, Homo sapiens
cugaagcuguugccacuuu

SEQ ID NO: 976412 - RNA, 19 nt, Homo sapiens
ggaagaagaagaagaugag

SEQ ID NO: 976413 - RNA, 19 nt, Homo sapiens
gauuguagcuuuggaucug

SEQ ID NO: 976414 - RNA, 19 nt, Homo sapiens
ggaaggaaucauagaggaa

SEQ ID NO: 976415 - RNA, 19 nt, Homo sapiens
gcgaagucauggugaaaca

SEQ ID NO: 976416 - RNA, 19 nt, Homo sapiens
gagcgguggugguggauag

SEQ ID NO: 976417 - RNA, 19 nt, Homo sapiens
gacacuggcucccgguaga

SEQ ID NO: 976418 - RNA, 19 nt, Homo sapiens
uauaguggaaggaaucaua

SEQ ID NO: 976419 - RNA, 19 nt, Homo sapiens
ggaauuacaaguccagaag

SEQ ID NO: 976420 - RNA, 19 nt, Homo sapiens
gcuauggaugcacuuaaua

SEQ ID NO: 976421 - RNA, 19 nt, Homo sapiens
ucaagaauccugaagaucu

SEQ ID NO: 976422 - RNA, 19 nt, Homo sapiens
agaguucaguguaggauug

SEQ ID NO: 976423 - RNA, 19 nt, Homo sapiens
uggauagcaucacaagaaa

SEQ ID NO: 976424 - RNA, 19 nt, Homo sapiens
cgaaugggcccuggaagaa

SEQ ID NO: 976425 - RNA, 19 nt, Homo sapiens
caaaagacguuggcaaugu

SEQ ID NO: 976426 - RNA, 19 nt, Homo sapiens
ggaggucauucugcccuuu

SEQ ID NO: 976427 - RNA, 19 nt, Homo sapiens
aaaccuacagcuucucuuu

SEQ ID NO: 976428 - RNA, 19 nt, Homo sapiens
gaaugggcccuggaagaaa

SEQ ID NO: 976429 - RNA, 19 nt, Homo sapiens
gaagcuucgccuacuguuu

SEQ ID NO: 976430 - RNA, 19 nt, Homo sapiens
gcgaaugggcccuggaaga

SEQ ID NO: 976431 - RNA, 19 nt, Homo sapiens
gucguacucuuccagguuu

SEQ ID NO: 976432 - RNA, 19 nt, Homo sapiens
ccagggcccuugaccaaca

SEQ ID NO: 976433 - RNA, 19 nt, Homo sapiens
guugucccauuccuaaauu

SEQ ID NO: 976434 - RNA, 19 nt, Homo sapiens
aaacuggcaaggauacuuu

SEQ ID NO: 976435 - RNA, 19 nt, Homo sapiens
agaagaagaagaugaggaa

SEQ ID NO: 976436 - RNA, 19 nt, Homo sapiens
gccaagaucccauccuuag

SEQ ID NO: 976437 - RNA, 19 nt, Homo sapiens
uggcugguguugauagauu

SEQ ID NO: 976438 - RNA, 19 nt, Homo sapiens
aagaugacauggagaccaa

SEQ ID NO: 976439 - RNA, 19 nt, Homo sapiens
cauagaggaagaagaagaa

SEQ ID NO: 976440 - RNA, 19 nt, Homo sapiens
aaauacagcccaugcacaa

SEQ ID NO: 976441 - RNA, 19 nt, Homo sapiens
gaaacuggcaaggauacuu

SEQ ID NO: 976442 - RNA, 19 nt, Homo sapiens
uggaagauguagaaguaga

SEQ ID NO: 976443 - RNA, 19 nt, Homo sapiens
guagaaguagagaaugaaa

SEQ ID NO: 976444 - RNA, 19 nt, Homo sapiens
ugacauggagaccaagaaa

SEQ ID NO: 976445 - RNA, 19 nt, Homo sapiens
aguguaggauuguagcuuu

SEQ ID NO: 976446 - RNA, 19 nt, Homo sapiens
ggccaagaucccauccuua

SEQ ID NO: 976447 - RNA, 19 nt, Homo sapiens
uuucauguauucugccaaa

SEQ ID NO: 976448 - RNA, 19 nt, Homo sapiens
ccaaucucuuucuuaguug

SEQ ID NO: 976449 - RNA, 19 nt, Homo sapiens
acaagaaacgagccugaaa

SEQ ID NO: 976450 - RNA, 19 nt, Homo sapiens
cgagcucuguuguaaauac

SEQ ID NO: 976451 - RNA, 19 nt, Homo sapiens
ugugaagaguggccagauu

SEQ ID NO: 976452 - RNA, 19 nt, Homo sapiens
cagaaacaauggcaaaaga

SEQ ID NO: 976453 - RNA, 19 nt, Homo sapiens
uuucuuaguugucccauuc

SEQ ID NO: 976454 - RNA, 19 nt, Homo sapiens
aggcuuauccaaucucuuu

SEQ ID NO: 976455 - RNA, 19 nt, Homo sapiens
acauggagaccaagaaaga

SEQ ID NO: 976456 - RNA, 19 nt, Homo sapiens
aaacagugugaaggaauua

SEQ ID NO: 976457 - RNA, 19 nt, Homo sapiens
gaagauguagaaguagaga

SEQ ID NO: 976458 - RNA, 19 nt, Homo sapiens
ugaaacaaaggucaagaau

SEQ ID NO: 976459 - RNA, 19 nt, Homo sapiens
ccacucagaugaauucuua

SEQ ID NO: 976460 - RNA, 19 nt, Homo sapiens
gacaagcgaucauugagua

SEQ ID NO: 976461 - RNA, 19 nt, Homo sapiens
gcagucagcuaagccauuu

SEQ ID NO: 976462 - RNA, 19 nt, Homo sapiens
aauaugugcuggucaauaa

SEQ ID NO: 976463 - RNA, 19 nt, Homo sapiens
gcacauagagggcagcauu

SEQ ID NO: 976464 - RNA, 19 nt, Homo sapiens
gaucacacgucuccgaaug

SEQ ID NO: 976465 - RNA, 19 nt, Homo sapiens
cgaggaagcuucguucaga

SEQ ID NO: 976466 - RNA, 19 nt, Homo sapiens
gaguauggcucgcugugaa

SEQ ID NO: 976467 - RNA, 19 nt, Homo sapiens
cuacugccauccuuacuuu

SEQ ID NO: 976468 - RNA, 19 nt, Homo sapiens
acacugcacuagcaaguuu

SEQ ID NO: 976469 - RNA, 19 nt, Homo sapiens
gaauaugugcuggucaaua

SEQ ID NO: 976470 - RNA, 19 nt, Homo sapiens
ggacgucgcacacaaagug

SEQ ID NO: 976471 - RNA, 19 nt, Homo sapiens
cagaauaugugcuggucaa

SEQ ID NO: 976472 - RNA, 19 nt, Homo sapiens
guaguacccuugccaugga

SEQ ID NO: 976473 - RNA, 19 nt, Homo sapiens
gaggaagcuucguucagaa

SEQ ID NO: 976474 - RNA, 19 nt, Homo sapiens
gcagaugggcagcuacuug

SEQ ID NO: 976475 - RNA, 19 nt, Homo sapiens
ugucaagucugcaccaaga

SEQ ID NO: 976476 - RNA, 19 nt, Homo sapiens
gggcuuugcuguaguugug

SEQ ID NO: 976477 - RNA, 19 nt, Homo sapiens
gaggacaagcgaucauuga

SEQ ID NO: 976478 - RNA, 19 nt, Homo sapiens
gcgcugcccuuccucuaug

SEQ ID NO: 976479 - RNA, 19 nt, Homo sapiens
gucaauaaaugugucagaa

SEQ ID NO: 976480 - RNA, 19 nt, Homo sapiens
cgacaguguggguguguua

SEQ ID NO: 976481 - RNA, 19 nt, Homo sapiens
gcacuagugucaucuuucc

SEQ ID NO: 976482 - RNA, 19 nt, Homo sapiens
aaagggacgucgcacacaa

SEQ ID NO: 976483 - RNA, 19 nt, Homo sapiens
gugcacuagugucaucuuu

SEQ ID NO: 976484 - RNA, 19 nt, Homo sapiens
guucugugcuuccgagugu

SEQ ID NO: 976485 - RNA, 19 nt, Homo sapiens
ggucagcagcaaccaguuu

SEQ ID NO: 976486 - RNA, 19 nt, Homo sapiens
ugacagaagaaaucgcuuu

SEQ ID NO: 976487 - RNA, 19 nt, Homo sapiens
ccagggcuuugcuguaguu

SEQ ID NO: 976488 - RNA, 19 nt, Homo sapiens
ggacaagcgaucauugagu

SEQ ID NO: 976489 - RNA, 19 nt, Homo sapiens
ggaggacaagcgaucauug

SEQ ID NO: 976490 - RNA, 19 nt, Homo sapiens
gcaccguccuacccuuugu

SEQ ID NO: 976491 - RNA, 19 nt, Homo sapiens
gcauuugggcagaauaugu

SEQ ID NO: 976492 - RNA, 19 nt, Homo sapiens
gaagagugggugucaaguc

SEQ ID NO: 976493 - RNA, 19 nt, Homo sapiens
gagaagagugggugucaag

SEQ ID NO: 976494 - RNA, 19 nt, Homo sapiens
agugucaucuuucccauug

SEQ ID NO: 976495 - RNA, 19 nt, Homo sapiens
cucaggagcucuaggacaa

SEQ ID NO: 976496 - RNA, 19 nt, Homo sapiens
acacugagcaacaagauca

SEQ ID NO: 976497 - RNA, 19 nt, Homo sapiens
ugaggcugcugacagaaga

SEQ ID NO: 976498 - RNA, 19 nt, Homo sapiens
ugucugccuuggcccuuua

SEQ ID NO: 976499 - RNA, 19 nt, Homo sapiens
ugucaucuuucccauugaa

SEQ ID NO: 976500 - RNA, 19 nt, Homo sapiens
cagcagacacugagcaaca

SEQ ID NO: 976501 - RNA, 19 nt, Homo sapiens
aggcuggucuccaucuuga

SEQ ID NO: 976502 - RNA, 19 nt, Homo sapiens
gggcagcauuugggcagaa

SEQ ID NO: 976503 - RNA, 19 nt, Homo sapiens
cggcgucaaugcacuuuca

SEQ ID NO: 976504 - RNA, 19 nt, Homo sapiens
ucacaguacaugccagcua

SEQ ID NO: 976505 - RNA, 19 nt, Homo sapiens
ggagacuggucagcagcaa

SEQ ID NO: 976506 - RNA, 19 nt, Homo sapiens
ccacugggagcccuaacuu

SEQ ID NO: 976507 - RNA, 19 nt, Homo sapiens
gcuaagccauuugccuaag

SEQ ID NO: 976508 - RNA, 19 nt, Homo sapiens
gcagaccagagcacauaga

SEQ ID NO: 976509 - RNA, 19 nt, Homo sapiens
gggcaccguccuacccuuu

SEQ ID NO: 976510 - RNA, 19 nt, Homo sapiens
aagagugggugucaagucu

SEQ ID NO: 976511 - RNA, 19 nt, Homo sapiens
guuaggaggaucuguaugg

SEQ ID NO: 976512 - RNA, 19 nt, Homo sapiens
uggucuccaucuugaauaa

SEQ ID NO: 976513 - RNA, 19 nt, Homo sapiens
ggucaauaaaugugucaga

SEQ ID NO: 976514 - RNA, 19 nt, Homo sapiens
ggucccaacacccaaauca

SEQ ID NO: 976515 - RNA, 19 nt, Homo sapiens
agucagagccccuuuauga

SEQ ID NO: 976516 - RNA, 19 nt, Homo sapiens
cagcauuugggcagaauau

SEQ ID NO: 976517 - RNA, 19 nt, Homo sapiens
guccuacccuuuguucugu

SEQ ID NO: 976518 - RNA, 19 nt, Homo sapiens
acgcagaccagagcacaua

SEQ ID NO: 976519 - RNA, 19 nt, Homo sapiens
cccacagcgucccguagua

SEQ ID NO: 976520 - RNA, 19 nt, Homo sapiens
cagcaacuccugugauggu

SEQ ID NO: 976521 - RNA, 19 nt, Homo sapiens
acugggagcccuaacuuga

SEQ ID NO: 976522 - RNA, 19 nt, Homo sapiens
ggaucuguauggagcacau

SEQ ID NO: 976523 - RNA, 19 nt, Homo sapiens
gaguucuacugccauccuu

SEQ ID NO: 976524 - RNA, 19 nt, Homo sapiens
acuugaggcugcugacaga

SEQ ID NO: 976525 - RNA, 19 nt, Homo sapiens
agucagagaccuaccuuca

SEQ ID NO: 976526 - RNA, 19 nt, Homo sapiens
gcagucagagaccuaccuu

SEQ ID NO: 976527 - RNA, 19 nt, Homo sapiens
ggugagcucugaccuuccu

SEQ ID NO: 976528 - RNA, 19 nt, Homo sapiens
cugccuuggcccuuuauua

SEQ ID NO: 976529 - RNA, 19 nt, Homo sapiens
cagaugggcagcuacuugu

SEQ ID NO: 976530 - RNA, 19 nt, Homo sapiens
ucacacgucuccgaaugag

SEQ ID NO: 976531 - RNA, 19 nt, Homo sapiens
ggaggaggacaagccagaa

SEQ ID NO: 976532 - RNA, 19 nt, Homo sapiens
acaggaucauggcuuggaa

SEQ ID NO: 976533 - RNA, 19 nt, Homo sapiens
accagcaacuccugugaug

SEQ ID NO: 976534 - RNA, 19 nt, Homo sapiens
gacaucaggaggaggacaa

SEQ ID NO: 976535 - RNA, 19 nt, Homo sapiens
ugccauccuuacuuucaaa

SEQ ID NO: 976536 - RNA, 19 nt, Homo sapiens
gcuggucuccaucuugaau

SEQ ID NO: 976537 - RNA, 19 nt, Homo sapiens
uccgccagcuaaacuugua

SEQ ID NO: 976538 - RNA, 19 nt, Homo sapiens
gcuuguagagugaucaauc

SEQ ID NO: 976539 - RNA, 19 nt, Homo sapiens
gcagcauuugggcagaaua

SEQ ID NO: 976540 - RNA, 19 nt, Homo sapiens
cacauagagggcagcauuu

SEQ ID NO: 976541 - RNA, 19 nt, Homo sapiens
aaaggcuggucuccaucuu

SEQ ID NO: 976542 - RNA, 19 nt, Homo sapiens
uuaggaggaucuguaugga

SEQ ID NO: 976543 - RNA, 19 nt, Homo sapiens
caguguggguguguuagga

SEQ ID NO: 976544 - RNA, 19 nt, Homo sapiens
ggcagucagcuaagccauu

SEQ ID NO: 976545 - RNA, 19 nt, Homo sapiens
caucuugaauaaguuagag

SEQ ID NO: 976546 - RNA, 19 nt, Homo sapiens
uguguuaggaggaucugua

SEQ ID NO: 976547 - RNA, 19 nt, Homo sapiens
gacaggaucauggcuugga

SEQ ID NO: 976548 - RNA, 19 nt, Homo sapiens
aagcgaucauugaguaugg

SEQ ID NO: 976549 - RNA, 19 nt, Homo sapiens
caagcgaucauugaguaug

SEQ ID NO: 976550 - RNA, 19 nt, Homo sapiens
ccacacugcacuagcaagu

SEQ ID NO: 976551 - RNA, 19 nt, Homo sapiens
acaugcagaugggcagcua

SEQ ID NO: 976552 - RNA, 19 nt, Homo sapiens
ccaccagcaacuccuguga

SEQ ID NO: 976553 - RNA, 19 nt, Homo sapiens
gcuaggacaggguggaaag

SEQ ID NO: 976554 - RNA, 19 nt, Homo sapiens
gcacaagccuucauacaua

SEQ ID NO: 976555 - RNA, 19 nt, Homo sapiens
ggaaaugacuccaagaaag

SEQ ID NO: 976556 - RNA, 19 nt, Homo sapiens
ggacuacuguaaauaaguu

SEQ ID NO: 976557 - RNA, 19 nt, Homo sapiens
ugaagaaucuguacuuugu

SEQ ID NO: 976558 - RNA, 19 nt, Homo sapiens
uaaauaaguuccugucucu

SEQ ID NO: 976559 - RNA, 19 nt, Homo sapiens
gcgaggagcuguucaucga

SEQ ID NO: 976560 - RNA, 19 nt, Homo sapiens
gaaaugacuccaagaaagu

SEQ ID NO: 976561 - RNA, 19 nt, Homo sapiens
aacaagagguuaccaguga

SEQ ID NO: 976562 - RNA, 19 nt, Homo sapiens
agacuaacaucaagaaauc

SEQ ID NO: 976563 - RNA, 19 nt, Homo sapiens
ccaagaaaguuaaaguaca

SEQ ID NO: 976564 - RNA, 19 nt, Homo sapiens
ggugaaagaaguuaauuug

SEQ ID NO: 976565 - RNA, 19 nt, Homo sapiens
caggaaaggugaaagaagu

SEQ ID NO: 976566 - RNA, 19 nt, Homo sapiens
ggaaaggugaaagaaguua

SEQ ID NO: 976567 - RNA, 19 nt, Homo sapiens
gacgguggauggucagaaa

SEQ ID NO: 976568 - RNA, 19 nt, Homo sapiens
cacaagccuucauacauaa

SEQ ID NO: 976569 - RNA, 19 nt, Homo sapiens
gaaaggugaaagaaguuaa

SEQ ID NO: 976570 - RNA, 19 nt, Homo sapiens
gaagaaucuguacuuugua

SEQ ID NO: 976571 - RNA, 19 nt, Homo sapiens
caagaaaucgccaggaaag

SEQ ID NO: 976572 - RNA, 19 nt, Homo sapiens
acgaugaguuugacgauga

SEQ ID NO: 976573 - RNA, 19 nt, Homo sapiens
gaaucuguacuuuguaugu

SEQ ID NO: 976574 - RNA, 19 nt, Homo sapiens
aagagcugcuguccaguuu

SEQ ID NO: 976575 - RNA, 19 nt, Homo sapiens
gcuaaaugaagaaucugua

SEQ ID NO: 976576 - RNA, 19 nt, Homo sapiens
ggaaggggacgaugaguuu

SEQ ID NO: 976577 - RNA, 19 nt, Homo sapiens
ccacagcuucacagacuaa

SEQ ID NO: 976578 - RNA, 19 nt, Homo sapiens
caaaaugccaagagguuua

SEQ ID NO: 976579 - RNA, 19 nt, Homo sapiens
caagagguuaccagugaaa

SEQ ID NO: 976580 - RNA, 19 nt, Homo sapiens
ucaagaaaucgccaggaaa

SEQ ID NO: 976581 - RNA, 19 nt, Homo sapiens
aauaaguuccugucucuug

SEQ ID NO: 976582 - RNA, 19 nt, Homo sapiens
ggaaccaacaggacuacug

SEQ ID NO: 976583 - RNA, 19 nt, Homo sapiens
cagacuaacaucaagaaau

SEQ ID NO: 976584 - RNA, 19 nt, Homo sapiens
aaagagcugcuguccaguu

SEQ ID NO: 976585 - RNA, 19 nt, Homo sapiens
ccaggaaccaacaggacua

SEQ ID NO: 976586 - RNA, 19 nt, Homo sapiens
aaccacagcuucacagacu

SEQ ID NO: 976587 - RNA, 19 nt, Homo sapiens
ggacgaugaguuugacgau

SEQ ID NO: 976588 - RNA, 19 nt, Homo sapiens
acaagagguuaccagugaa

SEQ ID NO: 976589 - RNA, 19 nt, Homo sapiens
caggacuacuguaaauaag

SEQ ID NO: 976590 - RNA, 19 nt, Homo sapiens
gaauaaugcuuggggaauc

SEQ ID NO: 976591 - RNA, 19 nt, Homo sapiens
caagccuucauacauaauu

SEQ ID NO: 976592 - RNA, 19 nt, Homo sapiens
aaggaaaugacuccaagaa

SEQ ID NO: 976593 - RNA, 19 nt, Homo sapiens
ucacagacuaacaucaaga

SEQ ID NO: 976594 - RNA, 19 nt, Homo sapiens
gaacagaagaaaagaaaac

SEQ ID NO: 976595 - RNA, 19 nt, Homo sapiens
gccaagagguuuaaaagac

SEQ ID NO: 976596 - RNA, 19 nt, Homo sapiens
cagcacaagccuucauaca

SEQ ID NO: 976597 - RNA, 19 nt, Homo sapiens
aucaagaaaucgccaggaa

SEQ ID NO: 976598 - RNA, 19 nt, Homo sapiens
uggauggucagaaagauga

SEQ ID NO: 976599 - RNA, 19 nt, Homo sapiens
gagaaguuaaccacagcuu

SEQ ID NO: 976600 - RNA, 19 nt, Homo sapiens
gguggauggucagaaagau

SEQ ID NO: 976601 - RNA, 19 nt, Homo sapiens
gagaccgugcgcagggaua

SEQ ID NO: 976602 - RNA, 19 nt, Homo sapiens
aggaaaugacuccaagaaa

SEQ ID NO: 976603 - RNA, 19 nt, Homo sapiens
cuucacagacuaacaucaa

SEQ ID NO: 976604 - RNA, 19 nt, Homo sapiens
gaagaaaagaaaacuccuu

SEQ ID NO: 976605 - RNA, 19 nt, Homo sapiens
cuccaagaaaguuaaagua

SEQ ID NO: 976606 - RNA, 19 nt, Homo sapiens
gaaaagaaaacuccuucca

SEQ ID NO: 976607 - RNA, 19 nt, Homo sapiens
ccaggaaaggugaaagaag

SEQ ID NO: 976608 - RNA, 19 nt, Homo sapiens
cacagacuaacaucaagaa

SEQ ID NO: 976609 - RNA, 19 nt, Homo sapiens
cagcuucacagacuaacau

SEQ ID NO: 976610 - RNA, 19 nt, Homo sapiens
gcuaaaagaccaagaucug

SEQ ID NO: 976611 - RNA, 19 nt, Homo sapiens
gcacauccacguucauuua

SEQ ID NO: 976612 - RNA, 19 nt, Homo sapiens
ggcaaccucuuuacucuua

SEQ ID NO: 976613 - RNA, 19 nt, Homo sapiens
gaaagacucugguaguauc

SEQ ID NO: 976614 - RNA, 19 nt, Homo sapiens
gaacacacaccuucccuuu

SEQ ID NO: 976615 - RNA, 19 nt, Homo sapiens
ucauacagcugccuuauug

SEQ ID NO: 976616 - RNA, 19 nt, Homo sapiens
aaacaucccucccgaguug

SEQ ID NO: 976617 - RNA, 19 nt, Homo sapiens
ggauauggccaguaaagua

SEQ ID NO: 976618 - RNA, 19 nt, Homo sapiens
ugaaguggcuuuggaauug

SEQ ID NO: 976619 - RNA, 19 nt, Homo sapiens
ggacaucauuacccacauu

SEQ ID NO: 976620 - RNA, 19 nt, Homo sapiens
gaaaugggacuuaaugcuu

SEQ ID NO: 976621 - RNA, 19 nt, Homo sapiens
ggccugaccuguaccuuaa

SEQ ID NO: 976622 - RNA, 19 nt, Homo sapiens
ggcagaggcuggaagaauu

SEQ ID NO: 976623 - RNA, 19 nt, Homo sapiens
caguaaaugucuaucagua

SEQ ID NO: 976624 - RNA, 19 nt, Homo sapiens
guaauucuaucuccucuuc

SEQ ID NO: 976625 - RNA, 19 nt, Homo sapiens
cuauauugcuggagucaua

SEQ ID NO: 976626 - RNA, 19 nt, Homo sapiens
gcaacuccuuucccuauga

SEQ ID NO: 976627 - RNA, 19 nt, Homo sapiens
ggaaacgaauauagauugu

SEQ ID NO: 976628 - RNA, 19 nt, Homo sapiens
gccaauaccuugauuuuaa

SEQ ID NO: 976629 - RNA, 19 nt, Homo sapiens
gacaggaaaucucuagguu

SEQ ID NO: 976630 - RNA, 19 nt, Homo sapiens
ugaguaggcugucaucaga

SEQ ID NO: 976631 - RNA, 19 nt, Homo sapiens
guaaaugucuaucaguaag

SEQ ID NO: 976632 - RNA, 19 nt, Homo sapiens
gcuaagguccucaccagua

SEQ ID NO: 976633 - RNA, 19 nt, Homo sapiens
aaaccaggcugucucauuc

SEQ ID NO: 976634 - RNA, 19 nt, Homo sapiens
ggacuuugcagaugugauu

SEQ ID NO: 976635 - RNA, 19 nt, Homo sapiens
aaaugggacuuaaugcuuu

SEQ ID NO: 976636 - RNA, 19 nt, Homo sapiens
ggagaaccuuucccugaga

SEQ ID NO: 976637 - RNA, 19 nt, Homo sapiens
ugagagucaugauaaauug

SEQ ID NO: 976638 - RNA, 19 nt, Homo sapiens
cacaaaugcugccuccuuu

SEQ ID NO: 976639 - RNA, 19 nt, Homo sapiens
gcugagaaaugggacuuaa

SEQ ID NO: 976640 - RNA, 19 nt, Homo sapiens
ggagguggauggcacuuuc

SEQ ID NO: 976641 - RNA, 19 nt, Homo sapiens
gacaugaccucagaaagga

SEQ ID NO: 976642 - RNA, 19 nt, Homo sapiens
uaagaaacauggcaaacca

SEQ ID NO: 976643 - RNA, 19 nt, Homo sapiens
ggucuuugcugcacaguuc

SEQ ID NO: 976644 - RNA, 19 nt, Homo sapiens
gcucugcauuucuaggaua

SEQ ID NO: 976645 - RNA, 19 nt, Homo sapiens
gaucuggcauacccaaguu

SEQ ID NO: 976646 - RNA, 19 nt, Homo sapiens
ggcaggaguuucagucuug

SEQ ID NO: 976647 - RNA, 19 nt, Homo sapiens
gcgggaagcugcuaucucu

SEQ ID NO: 976648 - RNA, 19 nt, Homo sapiens
gcucuguguuggugaaauu

SEQ ID NO: 976649 - RNA, 19 nt, Homo sapiens
caucguggcucauguccuu

SEQ ID NO: 976650 - RNA, 19 nt, Homo sapiens
uaacacacgccuacugauu

SEQ ID NO: 976651 - RNA, 19 nt, Homo sapiens
gggaaacgaauauagauug

SEQ ID NO: 976652 - RNA, 19 nt, Homo sapiens
ccagaacaguaagaucaua

SEQ ID NO: 976653 - RNA, 19 nt, Homo sapiens
ccaguaaaguauugagaga

SEQ ID NO: 976654 - RNA, 19 nt, Homo sapiens
gcagaggcuggaagaauuu

SEQ ID NO: 976655 - RNA, 19 nt, Homo sapiens
cuuaaucaccuaaaccuua

SEQ ID NO: 976656 - RNA, 19 nt, Homo sapiens
guacaugcauuuucuagaa

SEQ ID NO: 976657 - RNA, 19 nt, Homo sapiens
gcaaacaauccacuucuuc

SEQ ID NO: 976658 - RNA, 19 nt, Homo sapiens
uaccauggguccuggcaua

SEQ ID NO: 976659 - RNA, 19 nt, Homo sapiens
gaacuggauuugggacugu

SEQ ID NO: 976660 - RNA, 19 nt, Homo sapiens
ugacaagguuugagaacug

SEQ ID NO: 976661 - RNA, 19 nt, Homo sapiens
gauauggccaguaaaguau

SEQ ID NO: 976662 - RNA, 19 nt, Homo sapiens
gcaauggccacuucgaaga

SEQ ID NO: 976663 - RNA, 19 nt, Homo sapiens
caaguucaguaaaugucua

SEQ ID NO: 976664 - RNA, 19 nt, Homo sapiens
cugaaagacucugguagua

SEQ ID NO: 976665 - RNA, 19 nt, Homo sapiens
cagcaugucuuucccuauc

SEQ ID NO: 976666 - RNA, 19 nt, Homo sapiens
ggaauccaguucugaagag

SEQ ID NO: 976667 - RNA, 19 nt, Homo sapiens
caggguggguccuaagaaa

SEQ ID NO: 976668 - RNA, 19 nt, Homo sapiens
gugagaagcugagauacug

SEQ ID NO: 976669 - RNA, 19 nt, Homo sapiens
aaggaugacugccugcuuu

SEQ ID NO: 976670 - RNA, 19 nt, Homo sapiens
gaagggaaggcaggaguuu

SEQ ID NO: 976671 - RNA, 19 nt, Homo sapiens
agaagagagugcaguguug

SEQ ID NO: 976672 - RNA, 19 nt, Homo sapiens
caaaccaggcugucucauu

SEQ ID NO: 976673 - RNA, 19 nt, Homo sapiens
acacacgccuacugauuga

SEQ ID NO: 976674 - RNA, 19 nt, Homo sapiens
gauuguggugcccaaauua

SEQ ID NO: 976675 - RNA, 19 nt, Homo sapiens
cagguaaacugaguauaau

SEQ ID NO: 976676 - RNA, 19 nt, Homo sapiens
ucucacaguuggaugcuuu

SEQ ID NO: 976677 - RNA, 19 nt, Homo sapiens
gagcauagacaggagugua

SEQ ID NO: 976678 - RNA, 19 nt, Homo sapiens
ggagucauacccagccuaa

SEQ ID NO: 976679 - RNA, 19 nt, Homo sapiens
ggacaggauuuggaucauc

SEQ ID NO: 976680 - RNA, 19 nt, Homo sapiens
ggacuggggucuuugagaa

SEQ ID NO: 976681 - RNA, 19 nt, Homo sapiens
ggugagugcuggugaugug

SEQ ID NO: 976682 - RNA, 19 nt, Homo sapiens
caugauaaauugccuuaac

SEQ ID NO: 976683 - RNA, 19 nt, Homo sapiens
ggaagaauuuugagaguca

SEQ ID NO: 976684 - RNA, 19 nt, Homo sapiens
uuagagugcugcuguaaca

SEQ ID NO: 976685 - RNA, 19 nt, Homo sapiens
ucacaagggccucuguaaa

SEQ ID NO: 976686 - RNA, 19 nt, Homo sapiens
gguaaacugaguauaauca

SEQ ID NO: 976687 - RNA, 19 nt, Homo sapiens
gaugugaccuugggcagau

SEQ ID NO: 976688 - RNA, 19 nt, Homo sapiens
cuaagguccucaccaguau

SEQ ID NO: 976689 - RNA, 19 nt, Homo sapiens
gggcaacuccuuucccuau

SEQ ID NO: 976690 - RNA, 19 nt, Homo sapiens
gaucauccaccucgacaug

SEQ ID NO: 976691 - RNA, 19 nt, Homo sapiens
ccugaggucuugagagaug

SEQ ID NO: 976692 - RNA, 19 nt, Homo sapiens
gauccagccuuccugucaa

SEQ ID NO: 976693 - RNA, 19 nt, Homo sapiens
agagugagaagcugagaua

SEQ ID NO: 976694 - RNA, 19 nt, Homo sapiens
gugcaugcguacacaauuc

SEQ ID NO: 976695 - RNA, 19 nt, Homo sapiens
uaacaaauggugaccuaau

SEQ ID NO: 976696 - RNA, 19 nt, Homo sapiens
guaaaguauugagagacua

SEQ ID NO: 976697 - RNA, 19 nt, Homo sapiens
ccugagacauggagcuuug

SEQ ID NO: 976698 - RNA, 19 nt, Homo sapiens
uugcagaugugauuaagga

SEQ ID NO: 976699 - RNA, 19 nt, Homo sapiens
uauauuaccuucacauagc

SEQ ID NO: 976700 - RNA, 19 nt, Homo sapiens
gaccugaucuccuccucau

SEQ ID NO: 976701 - RNA, 19 nt, Homo sapiens
gagcaauggccacuucgaa

SEQ ID NO: 976702 - RNA, 19 nt, Homo sapiens
ccaacuggcaaccucuuua

SEQ ID NO: 976703 - RNA, 19 nt, Homo sapiens
cugguaggcugaacaguga

SEQ ID NO: 976704 - RNA, 19 nt, Homo sapiens
caaacaauccacuucuuca

SEQ ID NO: 976705 - RNA, 19 nt, Homo sapiens
ugagaaaugggacuuaaug

SEQ ID NO: 976706 - RNA, 19 nt, Homo sapiens
gcuugacucugcugaggaa

SEQ ID NO: 976707 - RNA, 19 nt, Homo sapiens
gagggcaguugcucugugu

SEQ ID NO: 976708 - RNA, 19 nt, Homo sapiens
aaacagaggaacugguuga

SEQ ID NO: 976709 - RNA, 19 nt, Homo sapiens
aaauuagagugcugcugua

SEQ ID NO: 976710 - RNA, 19 nt, Homo sapiens
gaagcacucuggagaaccu

SEQ ID NO: 976711 - RNA, 19 nt, Homo sapiens
gaagcaacauuccaauaaa

SEQ ID NO: 976712 - RNA, 19 nt, Homo sapiens
caaagaagauggaagacaa

SEQ ID NO: 976713 - RNA, 19 nt, Homo sapiens
gaagagguauccacaagug

SEQ ID NO: 976714 - RNA, 19 nt, Homo sapiens
gaagagaacauuagacuca

SEQ ID NO: 976715 - RNA, 19 nt, Homo sapiens
cuaaagaccuggcauuaau

SEQ ID NO: 976716 - RNA, 19 nt, Homo sapiens
aaccaaagaugaacgauuu

SEQ ID NO: 976717 - RNA, 19 nt, Homo sapiens
ggaaacucguggacuauga

SEQ ID NO: 976718 - RNA, 19 nt, Homo sapiens
gaacaaagcgcuagcaacu

SEQ ID NO: 976719 - RNA, 19 nt, Homo sapiens
ccaagcaggugcagaagaa

SEQ ID NO: 976720 - RNA, 19 nt, Homo sapiens
ccucuuaccucaccuacua

SEQ ID NO: 976721 - RNA, 19 nt, Homo sapiens
ggaagacaauucugagauc

SEQ ID NO: 976722 - RNA, 19 nt, Homo sapiens
cguauuggcugcuauguga

SEQ ID NO: 976723 - RNA, 19 nt, Homo sapiens
acaaggaccugaagaacuu

SEQ ID NO: 976724 - RNA, 19 nt, Homo sapiens
ggaaagcuguagaaaccaa

SEQ ID NO: 976725 - RNA, 19 nt, Homo sapiens
agaaggugcugcagaaauu

SEQ ID NO: 976726 - RNA, 19 nt, Homo sapiens
gaagauggaagacaaggaa

SEQ ID NO: 976727 - RNA, 19 nt, Homo sapiens
gagaagcaacauuccaaua

SEQ ID NO: 976728 - RNA, 19 nt, Homo sapiens
gaaugcuggugcugucuaa

SEQ ID NO: 976729 - RNA, 19 nt, Homo sapiens
gaauaaugaucuccuuugg

SEQ ID NO: 976730 - RNA, 19 nt, Homo sapiens
gaucaaggagcucuuagaa

SEQ ID NO: 976731 - RNA, 19 nt, Homo sapiens
gaagacaauucugagauca

SEQ ID NO: 976732 - RNA, 19 nt, Homo sapiens
gccacaagcuguacaagga

SEQ ID NO: 976733 - RNA, 19 nt, Homo sapiens
acaaagcgcuagcaacuuc

SEQ ID NO: 976734 - RNA, 19 nt, Homo sapiens
ggagcugccuauucuuuau

SEQ ID NO: 976735 - RNA, 19 nt, Homo sapiens
ggaauaaugaucuccuuug

SEQ ID NO: 976736 - RNA, 19 nt, Homo sapiens
ugaaggaucugaacaacca

SEQ ID NO: 976737 - RNA, 19 nt, Homo sapiens
uaaggaccauggaaaucua

SEQ ID NO: 976738 - RNA, 19 nt, Homo sapiens
gaucugaacaaccaaagaa

SEQ ID NO: 976739 - RNA, 19 nt, Homo sapiens
gaagagaaacuaccaagac

SEQ ID NO: 976740 - RNA, 19 nt, Homo sapiens
caucucagguugcuucaga

SEQ ID NO: 976741 - RNA, 19 nt, Homo sapiens
uagaggagcugccuauucu

SEQ ID NO: 976742 - RNA, 19 nt, Homo sapiens
uugaagaucugaaccaaga

SEQ ID NO: 976743 - RNA, 19 nt, Homo sapiens
agaagcaacauuccaauaa

SEQ ID NO: 976744 - RNA, 19 nt, Homo sapiens
ugagcaagcugaaccacaa

SEQ ID NO: 976745 - RNA, 19 nt, Homo sapiens
gaggagcugccuauucuuu

SEQ ID NO: 976746 - RNA, 19 nt, Homo sapiens
gaaggaaggaucugaagca

SEQ ID NO: 976747 - RNA, 19 nt, Homo sapiens
gaggaagaguucaacaaag

SEQ ID NO: 976748 - RNA, 19 nt, Homo sapiens
gaacacauuuucagauugu

SEQ ID NO: 976749 - RNA, 19 nt, Homo sapiens
gaaccaagaacuacuagag

SEQ ID NO: 976750 - RNA, 19 nt, Homo sapiens
ccucuacacuuuccuugaa

SEQ ID NO: 976751 - RNA, 19 nt, Homo sapiens
acuagucccucuacacuuu

SEQ ID NO: 976752 - RNA, 19 nt, Homo sapiens
cagaaacccugcaggagau

SEQ ID NO: 976753 - RNA, 19 nt, Homo sapiens
ggaaauagagaaggaagga

SEQ ID NO: 976754 - RNA, 19 nt, Homo sapiens
ggaaaaggauaauaagcuu

SEQ ID NO: 976755 - RNA, 19 nt, Homo sapiens
ucaaagugaugcaugaaag

SEQ ID NO: 976756 - RNA, 19 nt, Homo sapiens
gaagaucuggcaccugaug

SEQ ID NO: 976757 - RNA, 19 nt, Homo sapiens
acacuugccuauacagaga

SEQ ID NO: 976758 - RNA, 19 nt, Homo sapiens
gagaagagaacauuagacu

SEQ ID NO: 976759 - RNA, 19 nt, Homo sapiens
gaaaacauccacaaucaga

SEQ ID NO: 976760 - RNA, 19 nt, Homo sapiens
gaagaggaggaaauagaga

SEQ ID NO: 976761 - RNA, 19 nt, Homo sapiens
gagaaggugcugcagaaau

SEQ ID NO: 976762 - RNA, 19 nt, Homo sapiens
gagcugccuauucuuuaua

SEQ ID NO: 976763 - RNA, 19 nt, Homo sapiens
gucggaaacucguggacua

SEQ ID NO: 976764 - RNA, 19 nt, Homo sapiens
acauuagacucagggaaua

SEQ ID NO: 976765 - RNA, 19 nt, Homo sapiens
caggcgcucuuuagucauu

SEQ ID NO: 976766 - RNA, 19 nt, Homo sapiens
ggaagacuacgaggagaaa

SEQ ID NO: 976767 - RNA, 19 nt, Homo sapiens
uagaagaggaggaaauaga

SEQ ID NO: 976768 - RNA, 19 nt, Homo sapiens
ugagcaaacuggagaagca

SEQ ID NO: 976769 - RNA, 19 nt, Homo sapiens
cacagacacuugccuauac

SEQ ID NO: 976770 - RNA, 19 nt, Homo sapiens
aagaagagguauccacaag

SEQ ID NO: 976771 - RNA, 19 nt, Homo sapiens
caaaacauuuccaacuuga

SEQ ID NO: 976772 - RNA, 19 nt, Homo sapiens
ggagcuuuaaucacuauaa

SEQ ID NO: 976773 - RNA, 19 nt, Homo sapiens
aggagaaggugcugcagaa

SEQ ID NO: 976774 - RNA, 19 nt, Homo sapiens
gcaaagaagauggaagaca

SEQ ID NO: 976775 - RNA, 19 nt, Homo sapiens
acacagacacuugccuaua

SEQ ID NO: 976776 - RNA, 19 nt, Homo sapiens
gaaucugucucagcaacug

SEQ ID NO: 976777 - RNA, 19 nt, Homo sapiens
ccagagaagccaguaagaa

SEQ ID NO: 976778 - RNA, 19 nt, Homo sapiens
agaggaagaguucaacaaa

SEQ ID NO: 976779 - RNA, 19 nt, Homo sapiens
caccugaaccucaagaaga

SEQ ID NO: 976780 - RNA, 19 nt, Homo sapiens
gaacccgcaccgcaaguga

SEQ ID NO: 976781 - RNA, 19 nt, Homo sapiens
aaaucuauguugcccaguu

SEQ ID NO: 976782 - RNA, 19 nt, Homo sapiens
cagucaaagugaugcauga

SEQ ID NO: 976783 - RNA, 19 nt, Homo sapiens
acagagacauaaccacaca

SEQ ID NO: 976784 - RNA, 19 nt, Homo sapiens
gggagaagagaacauuaga

SEQ ID NO: 976785 - RNA, 19 nt, Homo sapiens
ggaaugcuggugcugucua

SEQ ID NO: 976786 - RNA, 19 nt, Homo sapiens
cagcagcaggcgcucuuua

SEQ ID NO: 976787 - RNA, 19 nt, Homo sapiens
ccaaaacauuuccaacuug

SEQ ID NO: 976788 - RNA, 19 nt, Homo sapiens
cagaaggccacaagcugua

SEQ ID NO: 976789 - RNA, 19 nt, Homo sapiens
gagcugaaggccaucguau

SEQ ID NO: 976790 - RNA, 19 nt, Homo sapiens
agacucagggaauauuuaa

SEQ ID NO: 976791 - RNA, 19 nt, Homo sapiens
aagcaacauuccaauaaag

SEQ ID NO: 976792 - RNA, 19 nt, Homo sapiens
caacuugagggaugucuuc

SEQ ID NO: 976793 - RNA, 19 nt, Homo sapiens
gcugcuaugugaccaucuu

SEQ ID NO: 976794 - RNA, 19 nt, Homo sapiens
gcuguaaggaccauggaaa

SEQ ID NO: 976795 - RNA, 19 nt, Homo sapiens
ucuaaagaccuggcauuaa

SEQ ID NO: 976796 - RNA, 19 nt, Homo sapiens
ccaccuuaaugacaucuca

SEQ ID NO: 976797 - RNA, 19 nt, Homo sapiens
gggaagacaauucugagau

SEQ ID NO: 976798 - RNA, 19 nt, Homo sapiens
gaagagugagagugaaucu

SEQ ID NO: 976799 - RNA, 19 nt, Homo sapiens
ggagaagcaacauuccaau

SEQ ID NO: 976800 - RNA, 19 nt, Homo sapiens
gaaagcuguagaaaccaaa

SEQ ID NO: 976801 - RNA, 19 nt, Homo sapiens
gaugucuucuacagggaaa

SEQ ID NO: 976802 - RNA, 19 nt, Homo sapiens
guaaggaccauggaaaucu

SEQ ID NO: 976803 - RNA, 19 nt, Homo sapiens
gguauaggucagagggaua

SEQ ID NO: 976804 - RNA, 19 nt, Homo sapiens
ugagaucaaggagcucuua

SEQ ID NO: 976805 - RNA, 19 nt, Homo sapiens
caaggcagaggaagaguuc

SEQ ID NO: 976806 - RNA, 19 nt, Homo sapiens
gcagaaugccaagaaagau

SEQ ID NO: 976807 - RNA, 19 nt, Homo sapiens
gaccauggaaaucuauguu

SEQ ID NO: 976808 - RNA, 19 nt, Homo sapiens
gaggauagugaacaaaucu

SEQ ID NO: 976809 - RNA, 19 nt, Homo sapiens
cacacacacucagaggaua

SEQ ID NO: 976810 - RNA, 19 nt, Homo sapiens
uagacucagggaauauuua

SEQ ID NO: 976811 - RNA, 19 nt, Homo sapiens
gaagcaacauuccaauaaa

SEQ ID NO: 976812 - RNA, 19 nt, Homo sapiens
caaagaagauggaagacaa

SEQ ID NO: 976813 - RNA, 19 nt, Homo sapiens
gaagagguauccacaagug

SEQ ID NO: 976814 - RNA, 19 nt, Homo sapiens
gaagagaacauuagacuca

SEQ ID NO: 976815 - RNA, 19 nt, Homo sapiens
cuaaagaccuggcauuaau

SEQ ID NO: 976816 - RNA, 19 nt, Homo sapiens
gaacaaagcgcuaacaacu

SEQ ID NO: 976817 - RNA, 19 nt, Homo sapiens
aaccaaagaugaacgauuu

SEQ ID NO: 976818 - RNA, 19 nt, Homo sapiens
ggaaacucguggacuauga

SEQ ID NO: 976819 - RNA, 19 nt, Homo sapiens
ccaagcaggugcagaagaa

SEQ ID NO: 976820 - RNA, 19 nt, Homo sapiens
ccucuuaccucaccuacua

SEQ ID NO: 976821 - RNA, 19 nt, Homo sapiens
ggaagacaauucugagauc

SEQ ID NO: 976822 - RNA, 19 nt, Homo sapiens
cguauuggcugcuauguga

SEQ ID NO: 976823 - RNA, 19 nt, Homo sapiens
acaaggaccugaagaacuu

SEQ ID NO: 976824 - RNA, 19 nt, Homo sapiens
ggaaagcuguagaaaccaa

SEQ ID NO: 976825 - RNA, 19 nt, Homo sapiens
agaaggugcugcagaaauu

SEQ ID NO: 976826 - RNA, 19 nt, Homo sapiens
gaagauggaagacaaggaa

SEQ ID NO: 976827 - RNA, 19 nt, Homo sapiens
acaaagcgcuaacaacuuc

SEQ ID NO: 976828 - RNA, 19 nt, Homo sapiens
gagaagcaacauuccaaua

SEQ ID NO: 976829 - RNA, 19 nt, Homo sapiens
gaaugcuggugcugucuaa

SEQ ID NO: 976830 - RNA, 19 nt, Homo sapiens
gaauaaugaucuccuuugg

SEQ ID NO: 976831 - RNA, 19 nt, Homo sapiens
gaucaaggagcucuuagaa

SEQ ID NO: 976832 - RNA, 19 nt, Homo sapiens
gaagacaauucugagauca

SEQ ID NO: 976833 - RNA, 19 nt, Homo sapiens
gccacaagcuguacaagga

SEQ ID NO: 976834 - RNA, 19 nt, Homo sapiens
ggagcugccuauucuuuau

SEQ ID NO: 976835 - RNA, 19 nt, Homo sapiens
ggaauaaugaucuccuuug

SEQ ID NO: 976836 - RNA, 19 nt, Homo sapiens
ugaaggaucugaacaacca

SEQ ID NO: 976837 - RNA, 19 nt, Homo sapiens
uaaggaccauggaaaucua

SEQ ID NO: 976838 - RNA, 19 nt, Homo sapiens
gaucugaacaaccaaagaa

SEQ ID NO: 976839 - RNA, 19 nt, Homo sapiens
gaagagaaacuaccaagac

SEQ ID NO: 976840 - RNA, 19 nt, Homo sapiens
caucucagguugcuucaga

SEQ ID NO: 976841 - RNA, 19 nt, Homo sapiens
uagaggagcugccuauucu

SEQ ID NO: 976842 - RNA, 19 nt, Homo sapiens
uugaagaucugaaccaaga

SEQ ID NO: 976843 - RNA, 19 nt, Homo sapiens
agaagcaacauuccaauaa

SEQ ID NO: 976844 - RNA, 19 nt, Homo sapiens
ugagcaagcugaaccacaa

SEQ ID NO: 976845 - RNA, 19 nt, Homo sapiens
gaggagcugccuauucuuu

SEQ ID NO: 976846 - RNA, 19 nt, Homo sapiens
gaaggaaggaucugaagca

SEQ ID NO: 976847 - RNA, 19 nt, Homo sapiens
gaggaagaguucaacaaag

SEQ ID NO: 976848 - RNA, 19 nt, Homo sapiens
gaacacauuuucagauugu

SEQ ID NO: 976849 - RNA, 19 nt, Homo sapiens
gaaccaagaacuacuagag

SEQ ID NO: 976850 - RNA, 19 nt, Homo sapiens
ccucuacacuuuccuugaa

SEQ ID NO: 976851 - RNA, 19 nt, Homo sapiens
acuagucccucuacacuuu

SEQ ID NO: 976852 - RNA, 19 nt, Homo sapiens
cagaaacccugcaggagau

SEQ ID NO: 976853 - RNA, 19 nt, Homo sapiens
ggaaauagagaaggaagga

SEQ ID NO: 976854 - RNA, 19 nt, Homo sapiens
gcaaaaguaucuauagaca

SEQ ID NO: 976855 - RNA, 19 nt, Homo sapiens
ggaaaaggauaauaagcuu

SEQ ID NO: 976856 - RNA, 19 nt, Homo sapiens
ucaaagugaugcaugaaag

SEQ ID NO: 976857 - RNA, 19 nt, Homo sapiens
gaagaucuggcaccugaug

SEQ ID NO: 976858 - RNA, 19 nt, Homo sapiens
acacuugccuauacagaga

SEQ ID NO: 976859 - RNA, 19 nt, Homo sapiens
gagaagagaacauuagacu

SEQ ID NO: 976860 - RNA, 19 nt, Homo sapiens
gaaaacauccacaaucaga

SEQ ID NO: 976861 - RNA, 19 nt, Homo sapiens
gaagaggaggaaauagaga

SEQ ID NO: 976862 - RNA, 19 nt, Homo sapiens
gagaaggugcugcagaaau

SEQ ID NO: 976863 - RNA, 19 nt, Homo sapiens
gagcugccuauucuuuaua

SEQ ID NO: 976864 - RNA, 19 nt, Homo sapiens
gcagaaugccaagaagaaa

SEQ ID NO: 976865 - RNA, 19 nt, Homo sapiens
gucggaaacucguggacua

SEQ ID NO: 976866 - RNA, 19 nt, Homo sapiens
uaacaacuucuaccaacaa

SEQ ID NO: 976867 - RNA, 19 nt, Homo sapiens
acauuagacucagggaaua

SEQ ID NO: 976868 - RNA, 19 nt, Homo sapiens
caggcgcucuuuagucauu

SEQ ID NO: 976869 - RNA, 19 nt, Homo sapiens
ggaagacuacgaggagaaa

SEQ ID NO: 976870 - RNA, 19 nt, Homo sapiens
uagaagaggaggaaauaga

SEQ ID NO: 976871 - RNA, 19 nt, Homo sapiens
ugagcaaacuggagaagca

SEQ ID NO: 976872 - RNA, 19 nt, Homo sapiens
cacagacacuugccuauac

SEQ ID NO: 976873 - RNA, 19 nt, Homo sapiens
aagaagagguauccacaag

SEQ ID NO: 976874 - RNA, 19 nt, Homo sapiens
caaaacauuuccaacuuga

SEQ ID NO: 976875 - RNA, 19 nt, Homo sapiens
ggagcuuuaaucacuauaa

SEQ ID NO: 976876 - RNA, 19 nt, Homo sapiens
aggagaaggugcugcagaa

SEQ ID NO: 976877 - RNA, 19 nt, Homo sapiens
gcaaagaagauggaagaca

SEQ ID NO: 976878 - RNA, 19 nt, Homo sapiens
acacagacacuugccuaua

SEQ ID NO: 976879 - RNA, 19 nt, Homo sapiens
gaaucugucucagcaacug

SEQ ID NO: 976880 - RNA, 19 nt, Homo sapiens
ccagagaagccaguaagaa

SEQ ID NO: 976881 - RNA, 19 nt, Homo sapiens
agaggaagaguucaacaaa

SEQ ID NO: 976882 - RNA, 19 nt, Homo sapiens
caccugaaccucaagaaga

SEQ ID NO: 976883 - RNA, 19 nt, Homo sapiens
gaacccgcaccgcaaguga

SEQ ID NO: 976884 - RNA, 19 nt, Homo sapiens
aaaucuauguugcccaguu

SEQ ID NO: 976885 - RNA, 19 nt, Homo sapiens
cagucaaagugaugcauga

SEQ ID NO: 976886 - RNA, 19 nt, Homo sapiens
acagagacauaaccacaca

SEQ ID NO: 976887 - RNA, 19 nt, Homo sapiens
gggagaagagaacauuaga

SEQ ID NO: 976888 - RNA, 19 nt, Homo sapiens
ggaaugcuggugcugucua

SEQ ID NO: 976889 - RNA, 19 nt, Homo sapiens
cagaaggccacaagcugua

SEQ ID NO: 976890 - RNA, 19 nt, Homo sapiens
cagcagcaggcgcucuuua

SEQ ID NO: 976891 - RNA, 19 nt, Homo sapiens
ccaaaacauuuccaacuug

SEQ ID NO: 976892 - RNA, 19 nt, Homo sapiens
gagcugaaggccaucguau

SEQ ID NO: 976893 - RNA, 19 nt, Homo sapiens
agacucagggaauauuuaa

SEQ ID NO: 976894 - RNA, 19 nt, Homo sapiens
aagcaacauuccaauaaag

SEQ ID NO: 976895 - RNA, 19 nt, Homo sapiens
caacuugagggaugucuuc

SEQ ID NO: 976896 - RNA, 19 nt, Homo sapiens
gcugcuaugugaccaucuu

SEQ ID NO: 976897 - RNA, 19 nt, Homo sapiens
gcuguaaggaccauggaaa

SEQ ID NO: 976898 - RNA, 19 nt, Homo sapiens
ucuaaagaccuggcauuaa

SEQ ID NO: 976899 - RNA, 19 nt, Homo sapiens
ccaccuuaaugacaucuca

SEQ ID NO: 976900 - RNA, 19 nt, Homo sapiens
gggaagacaauucugagau

SEQ ID NO: 976901 - RNA, 19 nt, Homo sapiens
gaagagugagagugaaucu

SEQ ID NO: 976902 - RNA, 19 nt, Homo sapiens
ggagaagcaacauuccaau

SEQ ID NO: 976903 - RNA, 19 nt, Homo sapiens
gaugucuucuacagggaaa

SEQ ID NO: 976904 - RNA, 19 nt, Homo sapiens
gaaagcuguagaaaccaaa

SEQ ID NO: 976905 - RNA, 19 nt, Homo sapiens
guaaggaccauggaaaucu

SEQ ID NO: 976906 - RNA, 19 nt, Homo sapiens
gguauaggucagagggaua

SEQ ID NO: 976907 - RNA, 19 nt, Homo sapiens
ugagaucaaggagcucuua

SEQ ID NO: 976908 - RNA, 19 nt, Homo sapiens
caaggcagaggaagaguuc

SEQ ID NO: 976909 - RNA, 19 nt, Homo sapiens
gaccauggaaaucuauguu

SEQ ID NO: 976910 - RNA, 19 nt, Homo sapiens
gaggauagugaacaaaucu

SEQ ID NO: 976911 - RNA, 19 nt, Homo sapiens
gcaaacacgucaagucuga

SEQ ID NO: 976912 - RNA, 19 nt, Homo sapiens
ugacagagcugauguucga

SEQ ID NO: 976913 - RNA, 19 nt, Homo sapiens
caacauuccugccuucuuc

SEQ ID NO: 976914 - RNA, 19 nt, Homo sapiens
ccucauaaauggugauguu

SEQ ID NO: 976915 - RNA, 19 nt, Homo sapiens
acagguggcugcacaaaug

SEQ ID NO: 976916 - RNA, 19 nt, Homo sapiens
gcgcuggucuuugacauug

SEQ ID NO: 976917 - RNA, 19 nt, Homo sapiens
gaucacaccuacagcaaac

SEQ ID NO: 976918 - RNA, 19 nt, Homo sapiens
gaacagguggcugcacaaa

SEQ ID NO: 976919 - RNA, 19 nt, Homo sapiens
cauaaauggugauguuucu

SEQ ID NO: 976920 - RNA, 19 nt, Homo sapiens
ccaccgagcaugcgacuga

SEQ ID NO: 976921 - RNA, 19 nt, Homo sapiens
cgagagcuuucccagaaga

SEQ ID NO: 976922 - RNA, 19 nt, Homo sapiens
gaagaagaaggagaagcua

SEQ ID NO: 976923 - RNA, 19 nt, Homo sapiens
uccaggagauggccauuga

SEQ ID NO: 976924 - RNA, 19 nt, Homo sapiens
guacgggagugucauuguc

SEQ ID NO: 976925 - RNA, 19 nt, Homo sapiens
ggaagaagaaggagaagcu

SEQ ID NO: 976926 - RNA, 19 nt, Homo sapiens
gagaagaaagggaagaucu

SEQ ID NO: 976927 - RNA, 19 nt, Homo sapiens
cugcagggcuucacugaca

SEQ ID NO: 976928 - RNA, 19 nt, Homo sapiens
ucagauggaagucccuuaa

SEQ ID NO: 976929 - RNA, 19 nt, Homo sapiens
ucuccaagcaggaauauga

SEQ ID NO: 976930 - RNA, 19 nt, Homo sapiens
caucccaccuuacaugauc

SEQ ID NO: 976931 - RNA, 19 nt, Homo sapiens
ccucuuguccucauaaaug

SEQ ID NO: 976932 - RNA, 19 nt, Homo sapiens
caaacuggaagaagaagga

SEQ ID NO: 976933 - RNA, 19 nt, Homo sapiens
ccucaagaauggcaugauc

SEQ ID NO: 976934 - RNA, 19 nt, Homo sapiens
caucaucccaccuuacaug

SEQ ID NO: 976935 - RNA, 19 nt, Homo sapiens
ggaucacaccuacagcaaa

SEQ ID NO: 976936 - RNA, 19 nt, Homo sapiens
aucgagagcuuucccagaa

SEQ ID NO: 976937 - RNA, 19 nt, Homo sapiens
ccacggccauuccaguaca

SEQ ID NO: 976938 - RNA, 19 nt, Homo sapiens
ugacauuggcuccuucuca

SEQ ID NO: 976939 - RNA, 19 nt, Homo sapiens
gacaucaucccaccuuaca

SEQ ID NO: 976940 - RNA, 19 nt, Homo sapiens
ggauggagcggaggucaug

SEQ ID NO: 976941 - RNA, 19 nt, Homo sapiens
cagcaaacacgucaagucu

SEQ ID NO: 976942 - RNA, 19 nt, Homo sapiens
ggaucuccaagcaggaaua

SEQ ID NO: 976943 - RNA, 19 nt, Homo sapiens
gcacuuuccagcagaugug

SEQ ID NO: 976944 - RNA, 19 nt, Homo sapiens
ggugauguuucuggguuga

SEQ ID NO: 976945 - RNA, 19 nt, Homo sapiens
ccacagugcacuacgagau

SEQ ID NO: 976946 - RNA, 19 nt, Homo sapiens
gcaugcgacugaaacucau

SEQ ID NO: 976947 - RNA, 19 nt, Homo sapiens
ccaaguccuggcauaacua

SEQ ID NO: 976948 - RNA, 19 nt, Homo sapiens
caccacggccauuccagua

SEQ ID NO: 976949 - RNA, 19 nt, Homo sapiens
cccaauggcuacaauacag

SEQ ID NO: 976950 - RNA, 19 nt, Homo sapiens
gaugcccaauggcuacaau

SEQ ID NO: 976951 - RNA, 19 nt, Homo sapiens
gcucaccgccuuugcaaac

SEQ ID NO: 976952 - RNA, 19 nt, Homo sapiens
acuacgagaugcccaaugg

SEQ ID NO: 976953 - RNA, 19 nt, Homo sapiens
gcagcaaggcaucgucaag

SEQ ID NO: 976954 - RNA, 19 nt, Homo sapiens
ccugagggccuguuugauc

SEQ ID NO: 976955 - RNA, 19 nt, Homo sapiens
uggccucacugggcacuuu

SEQ ID NO: 976956 - RNA, 19 nt, Homo sapiens
ucauaaauggugauguuuc

SEQ ID NO: 976957 - RNA, 19 nt, Homo sapiens
cauuccugccuucuucuua

SEQ ID NO: 976958 - RNA, 19 nt, Homo sapiens
guucgagcaguacaacauu

SEQ ID NO: 976959 - RNA, 19 nt, Homo sapiens
ccaauggcuacaauacaga

SEQ ID NO: 976960 - RNA, 19 nt, Homo sapiens
cgucaagucugagccaaac

SEQ ID NO: 976961 - RNA, 19 nt, Homo sapiens
gaucuccaagcaggaauau

SEQ ID NO: 976962 - RNA, 19 nt, Homo sapiens
ucaagaauggcaugaucga

SEQ ID NO: 976963 - RNA, 19 nt, Homo sapiens
cugcacaaaugcccacagu

SEQ ID NO: 976964 - RNA, 19 nt, Homo sapiens
guccuggcauaacuacaug

SEQ ID NO: 976965 - RNA, 19 nt, Homo sapiens
cucccaagcucagauggaa

SEQ ID NO: 976966 - RNA, 19 nt, Homo sapiens
ccuccuccuuucccucuug

SEQ ID NO: 976967 - RNA, 19 nt, Homo sapiens
caccauggagcgcaaguuc

SEQ ID NO: 976968 - RNA, 19 nt, Homo sapiens
ugugugacauugauauucg

SEQ ID NO: 976969 - RNA, 19 nt, Homo sapiens
gcccaauggcuacaauaca

SEQ ID NO: 976970 - RNA, 19 nt, Homo sapiens
ggaacaagauggacaguga

SEQ ID NO: 976971 - RNA, 19 nt, Homo sapiens
ggagaaggcuggccgcauu

SEQ ID NO: 976972 - RNA, 19 nt, Homo sapiens
gcaagaagcaggccuaugu

SEQ ID NO: 976973 - RNA, 19 nt, Homo sapiens
uagcauaagugucuucauu

SEQ ID NO: 976974 - RNA, 19 nt, Homo sapiens
ggagaaggaugcagugauc

SEQ ID NO: 976975 - RNA, 19 nt, Homo sapiens
ggagaugucuuguuagcau

SEQ ID NO: 976976 - RNA, 19 nt, Homo sapiens
gugcgcaguuuguauauaa

SEQ ID NO: 976977 - RNA, 19 nt, Homo sapiens
ucaguacccucauguugua

SEQ ID NO: 976978 - RNA, 19 nt, Homo sapiens
caaagaccaugaugugugu

SEQ ID NO: 976979 - RNA, 19 nt, Homo sapiens
caagggcucucuucuagug

SEQ ID NO: 976980 - RNA, 19 nt, Homo sapiens
ggcaagggcucucuucuag

SEQ ID NO: 976981 - RNA, 19 nt, Homo sapiens
gcagaaguauuuggaggaa

SEQ ID NO: 976982 - RNA, 19 nt, Homo sapiens
gaaaugagccaccgugaac

SEQ ID NO: 976983 - RNA, 19 nt, Homo sapiens
ggaacauccugucaguuug

SEQ ID NO: 976984 - RNA, 19 nt, Homo sapiens
ggagauggaaagcagguua

SEQ ID NO: 976985 - RNA, 19 nt, Homo sapiens
gagaugucuuguuagcaua

SEQ ID NO: 976986 - RNA, 19 nt, Homo sapiens
caaauaguccucugaaugg

SEQ ID NO: 976987 - RNA, 19 nt, Homo sapiens
ccaagucggugccaucugu

SEQ ID NO: 976988 - RNA, 19 nt, Homo sapiens
gaagaggagcugcgcaaga

SEQ ID NO: 976989 - RNA, 19 nt, Homo sapiens
ucaaauaguccucugaaug

SEQ ID NO: 976990 - RNA, 19 nt, Homo sapiens
aacuggagaugucuuguua

SEQ ID NO: 976991 - RNA, 19 nt, Homo sapiens
uguuaaagcugcucgauuc

SEQ ID NO: 976992 - RNA, 19 nt, Homo sapiens
gagcuacaagagucaaaua

SEQ ID NO: 976993 - RNA, 19 nt, Homo sapiens
gggaguggcuguguugguu

SEQ ID NO: 976994 - RNA, 19 nt, Homo sapiens
aagaggagcugcgcaagaa

SEQ ID NO: 976995 - RNA, 19 nt, Homo sapiens
caagauggacagugaaaug

SEQ ID NO: 976996 - RNA, 19 nt, Homo sapiens
cuacaagagucaaauaguc

SEQ ID NO: 976997 - RNA, 19 nt, Homo sapiens
cagaacaacugcgagagaa

SEQ ID NO: 976998 - RNA, 19 nt, Homo sapiens
ccaccagccucuugaagug

SEQ ID NO: 976999 - RNA, 19 nt, Homo sapiens
ucacugccuucuugggaua

SEQ ID NO: 977000 - RNA, 19 nt, Homo sapiens
ccaagugggagcagaagua

SEQ ID NO: 977001 - RNA, 19 nt, Homo sapiens
ugaggaggcugcaagacuu

SEQ ID NO: 977002 - RNA, 19 nt, Homo sapiens
gagaagaccaugcggaaca

SEQ ID NO: 977003 - RNA, 19 nt, Homo sapiens
gcagugacuuugacuucug

SEQ ID NO: 977004 - RNA, 19 nt, Homo sapiens
caagucagccauauuguuc

SEQ ID NO: 977005 - RNA, 19 nt, Homo sapiens
cagguggacugguucacua

SEQ ID NO: 977006 - RNA, 19 nt, Homo sapiens
ggagagcucugcggagaag

SEQ ID NO: 977007 - RNA, 19 nt, Homo sapiens
caggauugcugccgcauuc

SEQ ID NO: 977008 - RNA, 19 nt, Homo sapiens
gaacaagauggacagugaa

SEQ ID NO: 977009 - RNA, 19 nt, Homo sapiens
uggaacauccugucaguuu

SEQ ID NO: 977010 - RNA, 19 nt, Homo sapiens
guuccucacugccuucuug

SEQ ID NO: 977011 - RNA, 19 nt, Homo sapiens
gggagacagugcgcaguuu

SEQ ID NO: 977012 - RNA, 19 nt, Homo sapiens
ugcauuugcuggacaauug

SEQ ID NO: 977013 - RNA, 19 nt, Homo sapiens
uaaagagucccucacuuca

SEQ ID NO: 977014 - RNA, 19 nt, Homo sapiens
caccagaugcuuuggaauu

SEQ ID NO: 977015 - RNA, 19 nt, Homo sapiens
ggagggaguggcuguguug

SEQ ID NO: 977016 - RNA, 19 nt, Homo sapiens
gagaggagcaaagcaguug

SEQ ID NO: 977017 - RNA, 19 nt, Homo sapiens
aaucaagucagccauauug

SEQ ID NO: 977018 - RNA, 19 nt, Homo sapiens
gagauggaaagcagguuaa

SEQ ID NO: 977019 - RNA, 19 nt, Homo sapiens
gcaggccuauguggagaaa

SEQ ID NO: 977020 - RNA, 19 nt, Homo sapiens
caugaugugugucuguaug

SEQ ID NO: 977021 - RNA, 19 nt, Homo sapiens
gaugugugucuguauguuu

SEQ ID NO: 977022 - RNA, 19 nt, Homo sapiens
cauaaacccugagccagau

SEQ ID NO: 977023 - RNA, 19 nt, Homo sapiens
gaacauccugucaguuugg

SEQ ID NO: 977024 - RNA, 19 nt, Homo sapiens
agugggagcagaaguauuu

SEQ ID NO: 977025 - RNA, 19 nt, Homo sapiens
gguuugguauguguuguuu

SEQ ID NO: 977026 - RNA, 19 nt, Homo sapiens
ucuccuugauucuuuguuu

SEQ ID NO: 977027 - RNA, 19 nt, Homo sapiens
uuaaagagucccucacuuc

SEQ ID NO: 977028 - RNA, 19 nt, Homo sapiens
acagugcgcaguuuguaua

SEQ ID NO: 977029 - RNA, 19 nt, Homo sapiens
cuaaucaagucagccauau

SEQ ID NO: 977030 - RNA, 19 nt, Homo sapiens
gaguggcuguguugguuug

SEQ ID NO: 977031 - RNA, 19 nt, Homo sapiens
ggagaggagcaaagcaguu

SEQ ID NO: 977032 - RNA, 19 nt, Homo sapiens
gauucagccuugacuucuu

SEQ ID NO: 977033 - RNA, 19 nt, Homo sapiens
agacacucauucccauuga

SEQ ID NO: 977034 - RNA, 19 nt, Homo sapiens
gugccacucucagccauuu

SEQ ID NO: 977035 - RNA, 19 nt, Homo sapiens
gagagaaggaggagcagau

SEQ ID NO: 977036 - RNA, 19 nt, Homo sapiens
gcauaagugucuucauucc

SEQ ID NO: 977037 - RNA, 19 nt, Homo sapiens
ggagacagugcgcaguuug

SEQ ID NO: 977038 - RNA, 19 nt, Homo sapiens
ggagaggagagcugugaga

SEQ ID NO: 977039 - RNA, 19 nt, Homo sapiens
cagccucucuggacucugu

SEQ ID NO: 977040 - RNA, 19 nt, Homo sapiens
gagccaccgugaacagaca

SEQ ID NO: 977041 - RNA, 19 nt, Homo sapiens
gggagggaguggcuguguu

SEQ ID NO: 977042 - RNA, 19 nt, Homo sapiens
gaagcuggagcgagagaug

SEQ ID NO: 977043 - RNA, 19 nt, Homo sapiens
ucaagucagccauauuguu

SEQ ID NO: 977044 - RNA, 19 nt, Homo sapiens
gugcagcaguagccagaga

SEQ ID NO: 977045 - RNA, 19 nt, Homo sapiens
gaccaccacugcugucacu

SEQ ID NO: 977046 - RNA, 19 nt, Homo sapiens
gacuucaaccgggaucuua

SEQ ID NO: 977047 - RNA, 19 nt, Homo sapiens
gcauugagaagcuggaaag

SEQ ID NO: 977048 - RNA, 19 nt, Homo sapiens
cugagaaacuggagauguc

SEQ ID NO: 977049 - RNA, 19 nt, Homo sapiens
gcgcaguuuguauauaauu

SEQ ID NO: 977050 - RNA, 19 nt, Homo sapiens
augugugucuguauguuua

SEQ ID NO: 977051 - RNA, 19 nt, Homo sapiens
gacuuugacuucuggucuu

SEQ ID NO: 977052 - RNA, 19 nt, Homo sapiens
gagcaaagcaguugaaaac

SEQ ID NO: 977053 - RNA, 19 nt, Homo sapiens
gaggagcaaagcaguugaa

SEQ ID NO: 977054 - RNA, 19 nt, Homo sapiens
gagaagcuggaaagcgaaa

SEQ ID NO: 977055 - RNA, 19 nt, Homo sapiens
ccugucaguuuggucauaa

SEQ ID NO: 977056 - RNA, 19 nt, Homo sapiens
uauuaaggguguuagucuu

SEQ ID NO: 977057 - RNA, 19 nt, Homo sapiens
ugguucaugugcauuguuu

SEQ ID NO: 977058 - RNA, 19 nt, Homo sapiens
uaguucuccuugauucuuu

SEQ ID NO: 977059 - RNA, 19 nt, Homo sapiens
cagcagugacuuugacuuc

SEQ ID NO: 977060 - RNA, 19 nt, Homo sapiens
ugaaaugagccaccgugaa

SEQ ID NO: 977061 - RNA, 19 nt, Homo sapiens
cauauuguucucuggcuaa

SEQ ID NO: 977062 - RNA, 19 nt, Homo sapiens
ucucuggacucuguagcua

SEQ ID NO: 977063 - RNA, 19 nt, Homo sapiens
cugcucggcugacuacaga

SEQ ID NO: 977064 - RNA, 19 nt, Homo sapiens
cuuaaagagucccucacuu

SEQ ID NO: 977065 - RNA, 19 nt, Homo sapiens
uaucuugagcccuauaaau

SEQ ID NO: 977066 - RNA, 19 nt, Homo sapiens
caggaucucggcugccuuu

SEQ ID NO: 977067 - RNA, 19 nt, Homo sapiens
gagaaggcuggccgcauug

SEQ ID NO: 977068 - RNA, 19 nt, Homo sapiens
ggaguggcuguguugguuu

SEQ ID NO: 977069 - RNA, 19 nt, Homo sapiens
gaagcuggaaagcgaaauc

SEQ ID NO: 977070 - RNA, 19 nt, Homo sapiens
gaacauauuuguggaaaga

SEQ ID NO: 977071 - RNA, 19 nt, Homo sapiens
gcaauaagcuggaaauacu

SEQ ID NO: 977072 - RNA, 19 nt, Homo sapiens
ggagggagcuuuauuuaca

SEQ ID NO: 977073 - RNA, 19 nt, Homo sapiens
guaggaaugcuaacaauua

SEQ ID NO: 977074 - RNA, 19 nt, Homo sapiens
gaggagaacuugaacaaag

SEQ ID NO: 977075 - RNA, 19 nt, Homo sapiens
ccacaacauugccuucaua

SEQ ID NO: 977076 - RNA, 19 nt, Homo sapiens
guucaaagcuuguugucuu

SEQ ID NO: 977077 - RNA, 19 nt, Homo sapiens
ggaaugcacuuuauauacu

SEQ ID NO: 977078 - RNA, 19 nt, Homo sapiens
gcaagugguuaagaaugua

SEQ ID NO: 977079 - RNA, 19 nt, Homo sapiens
aaacauggagggagcuuua

SEQ ID NO: 977080 - RNA, 19 nt, Homo sapiens
gauaguauuguggguauua

SEQ ID NO: 977081 - RNA, 19 nt, Homo sapiens
guagaagacucagaaagug

SEQ ID NO: 977082 - RNA, 19 nt, Homo sapiens
gaauguagacgcccuagga

SEQ ID NO: 977083 - RNA, 19 nt, Homo sapiens
ggagcuuuauuuacaagaa

SEQ ID NO: 977084 - RNA, 19 nt, Homo sapiens
caacauugccuucauacau

SEQ ID NO: 977085 - RNA, 19 nt, Homo sapiens
gccaaagccugccuucaug

SEQ ID NO: 977086 - RNA, 19 nt, Homo sapiens
gaacguaccacaacauugc

SEQ ID NO: 977087 - RNA, 19 nt, Homo sapiens
gaaccuggaugagcuugga

SEQ ID NO: 977088 - RNA, 19 nt, Homo sapiens
agaaagugguguuuacaug

SEQ ID NO: 977089 - RNA, 19 nt, Homo sapiens
ggacgaagcaguagaagac

SEQ ID NO: 977090 - RNA, 19 nt, Homo sapiens
guaaaugaagcagauagua

SEQ ID NO: 977091 - RNA, 19 nt, Homo sapiens
caccuaugguacagauuua

SEQ ID NO: 977092 - RNA, 19 nt, Homo sapiens
gaagugcaauaagcuggaa

SEQ ID NO: 977093 - RNA, 19 nt, Homo sapiens
uaaucuugcugcugagaaa

SEQ ID NO: 977094 - RNA, 19 nt, Homo sapiens
gagggagcuuuauuuacaa

SEQ ID NO: 977095 - RNA, 19 nt, Homo sapiens
gcuaacaauuacagauuuc

SEQ ID NO: 977096 - RNA, 19 nt, Homo sapiens
caaguguuaugacaucguu

SEQ ID NO: 977097 - RNA, 19 nt, Homo sapiens
cagauaguauuguggguau

SEQ ID NO: 977098 - RNA, 19 nt, Homo sapiens
gaccaucguggacagaaua

SEQ ID NO: 977099 - RNA, 19 nt, Homo sapiens
ggugguaaaugaagcagau

SEQ ID NO: 977100 - RNA, 19 nt, Homo sapiens
uaucagcucugccuguugu

SEQ ID NO: 977101 - RNA, 19 nt, Homo sapiens
cuauaaaucaccuauggua

SEQ ID NO: 977102 - RNA, 19 nt, Homo sapiens
ugaagcagauaguauugug

SEQ ID NO: 977103 - RNA, 19 nt, Homo sapiens
gaauaggaacguaccacaa

SEQ ID NO: 977104 - RNA, 19 nt, Homo sapiens
caucguggacagaauagua

SEQ ID NO: 977105 - RNA, 19 nt, Homo sapiens
gcuguauacuccuugauca

SEQ ID NO: 977106 - RNA, 19 nt, Homo sapiens
uggagaagcuggaguucga

SEQ ID NO: 977107 - RNA, 19 nt, Homo sapiens
ggaugagcuuggaauagga

SEQ ID NO: 977108 - RNA, 19 nt, Homo sapiens
ggccuucuuugcuuuggua

SEQ ID NO: 977109 - RNA, 19 nt, Homo sapiens
gggaaugcacuuuauauac

SEQ ID NO: 977110 - RNA, 19 nt, Homo sapiens
cagcaccguucacaguauu

SEQ ID NO: 977111 - RNA, 19 nt, Homo sapiens
ccacagauugcccguuauu

SEQ ID NO: 977112 - RNA, 19 nt, Homo sapiens
ccucuucgaugcuguauac

SEQ ID NO: 977113 - RNA, 19 nt, Homo sapiens
acagauugcccguuauuga

SEQ ID NO: 977114 - RNA, 19 nt, Homo sapiens
cauuuaagccuuuagugaa

SEQ ID NO: 977115 - RNA, 19 nt, Homo sapiens
cauggagggagcuuuauuu

SEQ ID NO: 977116 - RNA, 19 nt, Homo sapiens
ucaccuaugguacagauuu

SEQ ID NO: 977117 - RNA, 19 nt, Homo sapiens
ggaggagaacuugaacaaa

SEQ ID NO: 977118 - RNA, 19 nt, Homo sapiens
auccacagauugcccguua

SEQ ID NO: 977119 - RNA, 19 nt, Homo sapiens
caggaaaaguuguagauau

SEQ ID NO: 977120 - RNA, 19 nt, Homo sapiens
ggaacguaccacaacauug

SEQ ID NO: 977121 - RNA, 19 nt, Homo sapiens
ugaagcagaaccuggauga

SEQ ID NO: 977122 - RNA, 19 nt, Homo sapiens
gaugcuguauacuccuuga

SEQ ID NO: 977123 - RNA, 19 nt, Homo sapiens
caaagccuugaacauauuu

SEQ ID NO: 977124 - RNA, 19 nt, Homo sapiens
gcaguagaagacucagaaa

SEQ ID NO: 977125 - RNA, 19 nt, Homo sapiens
acaaaagaauccucaaguu

SEQ ID NO: 977126 - RNA, 19 nt, Homo sapiens
ugggaaugcacuuuauaua

SEQ ID NO: 977127 - RNA, 19 nt, Homo sapiens
ugcaagugguuaagaaugu

SEQ ID NO: 977128 - RNA, 19 nt, Homo sapiens
aauaucagcucugccuguu

SEQ ID NO: 977129 - RNA, 19 nt, Homo sapiens
caaagccugccuucaugaa

SEQ ID NO: 977130 - RNA, 19 nt, Homo sapiens
uacuauaaaucaccuaugg

SEQ ID NO: 977131 - RNA, 19 nt, Homo sapiens
cuuguugucuuugauacua

SEQ ID NO: 977132 - RNA, 19 nt, Homo sapiens
uaggaaugcuaacaauuac

SEQ ID NO: 977133 - RNA, 19 nt, Homo sapiens
ggagugaccgccgugaaug

SEQ ID NO: 977134 - RNA, 19 nt, Homo sapiens
ucagcaccguucacaguau

SEQ ID NO: 977135 - RNA, 19 nt, Homo sapiens
ggagacagaaacggaguga

SEQ ID NO: 977136 - RNA, 19 nt, Homo sapiens
ggcugguggugguaaauga

SEQ ID NO: 977137 - RNA, 19 nt, Homo sapiens
aacauugccuucauacauc

SEQ ID NO: 977138 - RNA, 19 nt, Homo sapiens
ccaaagccugccuucauga

SEQ ID NO: 977139 - RNA, 19 nt, Homo sapiens
cgaggacgaagcaguagaa

SEQ ID NO: 977140 - RNA, 19 nt, Homo sapiens
acauuuaagccuuuaguga

SEQ ID NO: 977141 - RNA, 19 nt, Homo sapiens
uaaaucaccuaugguacag

SEQ ID NO: 977142 - RNA, 19 nt, Homo sapiens
ggcugcaagugguuaagaa

SEQ ID NO: 977143 - RNA, 19 nt, Homo sapiens
aguaagagcugagguccau

SEQ ID NO: 977144 - RNA, 19 nt, Homo sapiens
acaauaaccuagauaucac

SEQ ID NO: 977145 - RNA, 19 nt, Homo sapiens
ggaaugcuaacaauuacag

SEQ ID NO: 977146 - RNA, 19 nt, Homo sapiens
uugaagguguugugaagug

SEQ ID NO: 977147 - RNA, 19 nt, Homo sapiens
gcugagaaaacauacaaua

SEQ ID NO: 977148 - RNA, 19 nt, Homo sapiens
gaaacauggagggagcuuu

SEQ ID NO: 977149 - RNA, 19 nt, Homo sapiens
ugaccgccgugaauguaga

SEQ ID NO: 977150 - RNA, 19 nt, Homo sapiens
guugugaagugcaauaagc

SEQ ID NO: 977151 - RNA, 19 nt, Homo sapiens
uggaugagcuuggaauagg

SEQ ID NO: 977152 - RNA, 19 nt, Homo sapiens
caaaagaauccucaaguuc

SEQ ID NO: 977153 - RNA, 19 nt, Homo sapiens
gugggaaugcacuuuauau

SEQ ID NO: 977154 - RNA, 19 nt, Homo sapiens
ccuaggaggagaacuugaa

SEQ ID NO: 977155 - RNA, 19 nt, Homo sapiens
cuucauacauccagacacu

SEQ ID NO: 977156 - RNA, 19 nt, Homo sapiens
gaugagcuuggaauaggaa

SEQ ID NO: 977157 - RNA, 19 nt, Homo sapiens
gguuaagaauguauaucag

SEQ ID NO: 977158 - RNA, 19 nt, Homo sapiens
cgaagcaguagaagacuca

SEQ ID NO: 977159 - RNA, 19 nt, Homo sapiens
gguguugugaagugcaaua

SEQ ID NO: 977160 - RNA, 19 nt, Homo sapiens
aaucaccuaugguacagau

SEQ ID NO: 977161 - RNA, 19 nt, Homo sapiens
aguagaagacucagaaagu

SEQ ID NO: 977162 - RNA, 19 nt, Homo sapiens
ucaaguuccuccagcuuuu

SEQ ID NO: 977163 - RNA, 19 nt, Homo sapiens
gugcaauaagcuggaaaua

SEQ ID NO: 977164 - RNA, 19 nt, Homo sapiens
auaaaucaccuaugguaca

SEQ ID NO: 977165 - RNA, 19 nt, Homo sapiens
gguaaaugaagcagauagu

SEQ ID NO: 977166 - RNA, 19 nt, Homo sapiens
acucagaaagugguguuua

SEQ ID NO: 977167 - RNA, 19 nt, Homo sapiens
gcagaaccuggaugagcuu

SEQ ID NO: 977168 - RNA, 19 nt, Homo sapiens
guauacuccuugaucaaaa

SEQ ID NO: 977169 - RNA, 19 nt, Homo sapiens
uguauacuccuugaucaaa

SEQ ID NO: 977170 - RNA, 19 nt, Homo sapiens
gaaaugagcucaagaaaga

SEQ ID NO: 977171 - RNA, 19 nt, Homo sapiens
aaagaaagcuccagaagua

SEQ ID NO: 977172 - RNA, 19 nt, Homo sapiens
gaagacagcuuaauaguag

SEQ ID NO: 977173 - RNA, 19 nt, Homo sapiens
gaaagaagacagcuuaaua

SEQ ID NO: 977174 - RNA, 19 nt, Homo sapiens
guaguuagcuuaaguaguu

SEQ ID NO: 977175 - RNA, 19 nt, Homo sapiens
gcacuuaacuacuuuguug

SEQ ID NO: 977176 - RNA, 19 nt, Homo sapiens
guaaagagguuaaggaaau

SEQ ID NO: 977177 - RNA, 19 nt, Homo sapiens
ccacaucccuugagauuaa

SEQ ID NO: 977178 - RNA, 19 nt, Homo sapiens
gaagaaauauuugccauug

SEQ ID NO: 977179 - RNA, 19 nt, Homo sapiens
ggaaauacuugcugauuau

SEQ ID NO: 977180 - RNA, 19 nt, Homo sapiens
guacagaacuuuaccaaca

SEQ ID NO: 977181 - RNA, 19 nt, Homo sapiens
gaugaagccuacuugaaua

SEQ ID NO: 977182 - RNA, 19 nt, Homo sapiens
ggaugggacuuaaugauaa

SEQ ID NO: 977183 - RNA, 19 nt, Homo sapiens
gcauguggauguuugcuua

SEQ ID NO: 977184 - RNA, 19 nt, Homo sapiens
caacaaaggagcauuauug

SEQ ID NO: 977185 - RNA, 19 nt, Homo sapiens
guagaacuguuaccauuaa

SEQ ID NO: 977186 - RNA, 19 nt, Homo sapiens
gaagaugaaugagaauuug

SEQ ID NO: 977187 - RNA, 19 nt, Homo sapiens
gaagccuacuugaauauaa

SEQ ID NO: 977188 - RNA, 19 nt, Homo sapiens
gaaauggagucaccaagau

SEQ ID NO: 977189 - RNA, 19 nt, Homo sapiens
gcaauaauccuuccucaga

SEQ ID NO: 977190 - RNA, 19 nt, Homo sapiens
uaacaaagcacuuagaaga

SEQ ID NO: 977191 - RNA, 19 nt, Homo sapiens
ucacaaccauuccaaguuu

SEQ ID NO: 977192 - RNA, 19 nt, Homo sapiens
gcaaggagauuugguguuc

SEQ ID NO: 977193 - RNA, 19 nt, Homo sapiens
gaagauguuggaucauuua

SEQ ID NO: 977194 - RNA, 19 nt, Homo sapiens
aaacgaagauguuggauca

SEQ ID NO: 977195 - RNA, 19 nt, Homo sapiens
ugacauggaugcuuucuau

SEQ ID NO: 977196 - RNA, 19 nt, Homo sapiens
ccacaaaucuauaaagaag

SEQ ID NO: 977197 - RNA, 19 nt, Homo sapiens
ggaaaucaauccuguuaag

SEQ ID NO: 977198 - RNA, 19 nt, Homo sapiens
gaaggcaagugcaauaauc

SEQ ID NO: 977199 - RNA, 19 nt, Homo sapiens
gcaauggaauuagaacaaa

SEQ ID NO: 977200 - RNA, 19 nt, Homo sapiens
auacuuaccuguccuguuu

SEQ ID NO: 977201 - RNA, 19 nt, Homo sapiens
agaagaagaugaaugagaa

SEQ ID NO: 977202 - RNA, 19 nt, Homo sapiens
gagaggacauucagugaga

SEQ ID NO: 977203 - RNA, 19 nt, Homo sapiens
gcaaaaguaugcagugaua

SEQ ID NO: 977204 - RNA, 19 nt, Homo sapiens
cuagaaaugucucauaaga

SEQ ID NO: 977205 - RNA, 19 nt, Homo sapiens
caacagagggcauugcuuu

SEQ ID NO: 977206 - RNA, 19 nt, Homo sapiens
ggagauccuuuccaaguga

SEQ ID NO: 977207 - RNA, 19 nt, Homo sapiens
gaaauuaggaaugggauaa

SEQ ID NO: 977208 - RNA, 19 nt, Homo sapiens
gaagagcaauacagccuau

SEQ ID NO: 977209 - RNA, 19 nt, Homo sapiens
caucaaggauuuacccauu

SEQ ID NO: 977210 - RNA, 19 nt, Homo sapiens
uaacucaucuaaagcagaa

SEQ ID NO: 977211 - RNA, 19 nt, Homo sapiens
gcuguaggaucaaugagua

SEQ ID NO: 977212 - RNA, 19 nt, Homo sapiens
ggaauggaaggauuagaua

SEQ ID NO: 977213 - RNA, 19 nt, Homo sapiens
uaaguaguuucuccaagua

SEQ ID NO: 977214 - RNA, 19 nt, Homo sapiens
acacaugccuauauuauca

SEQ ID NO: 977215 - RNA, 19 nt, Homo sapiens
caggauugaugacaaagua

SEQ ID NO: 977216 - RNA, 19 nt, Homo sapiens
gaucuaacccuguucaaug

SEQ ID NO: 977217 - RNA, 19 nt, Homo sapiens
guagaugaaugucuugaug

SEQ ID NO: 977218 - RNA, 19 nt, Homo sapiens
ugaauaagcacuugaauca

SEQ ID NO: 977219 - RNA, 19 nt, Homo sapiens
ucaauccuguuaagagaua

SEQ ID NO: 977220 - RNA, 19 nt, Homo sapiens
guggauguuugcuuaaaua

SEQ ID NO: 977221 - RNA, 19 nt, Homo sapiens
ggaaauaucagagaauuca

SEQ ID NO: 977222 - RNA, 19 nt, Homo sapiens
ugaaacaucuuggcauuau

SEQ ID NO: 977223 - RNA, 19 nt, Homo sapiens
aggaaauacuugcugauua

SEQ ID NO: 977224 - RNA, 19 nt, Homo sapiens
ugacagauuugcaauggaa

SEQ ID NO: 977225 - RNA, 19 nt, Homo sapiens
ucucaaagauucacacaug

SEQ ID NO: 977226 - RNA, 19 nt, Homo sapiens
acaaagcacuuagaagaaa

SEQ ID NO: 977227 - RNA, 19 nt, Homo sapiens
uagcauaagugguuucuuc

SEQ ID NO: 977228 - RNA, 19 nt, Homo sapiens
uaagggcucucaaagauuc

SEQ ID NO: 977229 - RNA, 19 nt, Homo sapiens
cgaagauguuggaucauuu

SEQ ID NO: 977230 - RNA, 19 nt, Homo sapiens
gcuuauggguguucggaua

SEQ ID NO: 977231 - RNA, 19 nt, Homo sapiens
ggaaauggagucaccaaga

SEQ ID NO: 977232 - RNA, 19 nt, Homo sapiens
gaaacaucuuggcauuauu

SEQ ID NO: 977233 - RNA, 19 nt, Homo sapiens
gcacuuagaagaaagacaa

SEQ ID NO: 977234 - RNA, 19 nt, Homo sapiens
ggauaaauuuaacccaguu

SEQ ID NO: 977235 - RNA, 19 nt, Homo sapiens
cuaccaaaguuaacaagaa

SEQ ID NO: 977236 - RNA, 19 nt, Homo sapiens
agaaaugucucauaagaag

SEQ ID NO: 977237 - RNA, 19 nt, Homo sapiens
gcaagucaaccaacgaauu

SEQ ID NO: 977238 - RNA, 19 nt, Homo sapiens
gcucuaguuuguccuguuu

SEQ ID NO: 977239 - RNA, 19 nt, Homo sapiens
ggauaaacccauugcugua

SEQ ID NO: 977240 - RNA, 19 nt, Homo sapiens
caaacauacccuugauaua

SEQ ID NO: 977241 - RNA, 19 nt, Homo sapiens
ccaaacaaucccaaacaua

SEQ ID NO: 977242 - RNA, 19 nt, Homo sapiens
guacucaacaucaaagaaa

SEQ ID NO: 977243 - RNA, 19 nt, Homo sapiens
uaauaaagcaggaauggaa

SEQ ID NO: 977244 - RNA, 19 nt, Homo sapiens
cuacagaaagaaagacuua

SEQ ID NO: 977245 - RNA, 19 nt, Homo sapiens
guaacuagcauaagugguu

SEQ ID NO: 977246 - RNA, 19 nt, Homo sapiens
uguaagggcucucaaagau

SEQ ID NO: 977247 - RNA, 19 nt, Homo sapiens
gcagauuuauuuagugaag

SEQ ID NO: 977248 - RNA, 19 nt, Homo sapiens
ccaagcaagucuuuuaaua

SEQ ID NO: 977249 - RNA, 19 nt, Homo sapiens
gucaagaacuuugcaguga

SEQ ID NO: 977250 - RNA, 19 nt, Homo sapiens
ggcaguauuucauuucuug

SEQ ID NO: 977251 - RNA, 19 nt, Homo sapiens
uaacuacuuuguuggcauu

SEQ ID NO: 977252 - RNA, 19 nt, Homo sapiens
gaauggaaggauuagauaa

SEQ ID NO: 977253 - RNA, 19 nt, Homo sapiens
gcccacaacuuauaauagu

SEQ ID NO: 977254 - RNA, 19 nt, Homo sapiens
ggcauuauuuccuucauau

SEQ ID NO: 977255 - RNA, 19 nt, Homo sapiens
gaacaaaacaauccucaaa

SEQ ID NO: 977256 - RNA, 19 nt, Homo sapiens
caggaaaggaaguuaauaa

SEQ ID NO: 977257 - RNA, 19 nt, Homo sapiens
cuaugcagcuguagaaaug

SEQ ID NO: 977258 - RNA, 19 nt, Homo sapiens
guaauaagcauagcaagga

SEQ ID NO: 977259 - RNA, 19 nt, Homo sapiens
uaucagagaauucagauga

SEQ ID NO: 977260 - RNA, 19 nt, Homo sapiens
ggacaauaccaaauucuuc

SEQ ID NO: 977261 - RNA, 19 nt, Homo sapiens
gaauaaaccaaauggacaa

SEQ ID NO: 977262 - RNA, 19 nt, Homo sapiens
gaacaucagcccaggaagu

SEQ ID NO: 977263 - RNA, 19 nt, Homo sapiens
ccaaacauacccuugauau

SEQ ID NO: 977264 - RNA, 19 nt, Homo sapiens
gugagaagcaagauuauga

SEQ ID NO: 977265 - RNA, 19 nt, Homo sapiens
gcauugcuuucucuccuuu

SEQ ID NO: 977266 - RNA, 19 nt, Homo sapiens
ggagaagugugacaguuac

SEQ ID NO: 977267 - RNA, 19 nt, Homo sapiens
ugagguaacggauaaguuu

SEQ ID NO: 977268 - RNA, 19 nt, Homo sapiens
caagucaaccaacgaauug

SEQ ID NO: 977269 - RNA, 19 nt, Homo sapiens
gaaaucaauccuguuaaga

SEQ ID NO: 977270 - RNA, 19 nt, Homo sapiens
gcaauauucuucugcauua

SEQ ID NO: 977271 - RNA, 19 nt, Homo sapiens
caacaaaugugaagaaugu

SEQ ID NO: 977272 - RNA, 19 nt, Homo sapiens
caacaaaugugaagaaugu

SEQ ID NO: 977273 - RNA, 19 nt, Homo sapiens
gaaagaaacccuacaaaug

SEQ ID NO: 977274 - RNA, 19 nt, Homo sapiens
gaaagaaacccuacaaaug

SEQ ID NO: 977275 - RNA, 19 nt, Homo sapiens
gcagagaaauccuauaaau

SEQ ID NO: 977276 - RNA, 19 nt, Homo sapiens
cccaagagcuagcuaauua

SEQ ID NO: 977277 - RNA, 19 nt, Homo sapiens
aaacaggccucacaccuua

SEQ ID NO: 977278 - RNA, 19 nt, Homo sapiens
aaagagcccuggaauauaa

SEQ ID NO: 977279 - RNA, 19 nt, Homo sapiens
gaaaagcacuguaaaugua

SEQ ID NO: 977280 - RNA, 19 nt, Homo sapiens
gagggaaacucaacaaaug

SEQ ID NO: 977281 - RNA, 19 nt, Homo sapiens
caaaggaggucauaauaca

SEQ ID NO: 977282 - RNA, 19 nt, Homo sapiens
ggagaaacccuacaaaugu

SEQ ID NO: 977283 - RNA, 19 nt, Homo sapiens
gaaacaaacacuucaaaug

SEQ ID NO: 977284 - RNA, 19 nt, Homo sapiens
gcaaauccuuuaaccaguu

SEQ ID NO: 977285 - RNA, 19 nt, Homo sapiens
agagaaaccuuacaaaugu

SEQ ID NO: 977286 - RNA, 19 nt, Homo sapiens
cuacaaaugugaagaaugu

SEQ ID NO: 977287 - RNA, 19 nt, Homo sapiens
cuacaaaugugaagaaugu

SEQ ID NO: 977288 - RNA, 19 nt, Homo sapiens
gagagaaacccuauaaaug

SEQ ID NO: 977289 - RNA, 19 nt, Homo sapiens
gagagaaaccuuacaaaug

SEQ ID NO: 977290 - RNA, 19 nt, Homo sapiens
gagagaaacccuauaaaug

SEQ ID NO: 977291 - RNA, 19 nt, Homo sapiens
cuacaaaugugaagaaugu

SEQ ID NO: 977292 - RNA, 19 nt, Homo sapiens
cuacaaaugugaagaaugu

SEQ ID NO: 977293 - RNA, 19 nt, Homo sapiens
cuacaaaugugaagaaugu

SEQ ID NO: 977294 - RNA, 19 nt, Homo sapiens
cuacaaaugugaagaaugu

SEQ ID NO: 977295 - RNA, 19 nt, Homo sapiens
gcagauaaacuaauugcua

SEQ ID NO: 977296 - RNA, 19 nt, Homo sapiens
ccucacaccuugcuacaua

SEQ ID NO: 977297 - RNA, 19 nt, Homo sapiens
cuacaaauguggagauuau

SEQ ID NO: 977298 - RNA, 19 nt, Homo sapiens
ccucaaaccuuaauaaaca

SEQ ID NO: 977299 - RNA, 19 nt, Homo sapiens
ucacagaacugauuagaag

SEQ ID NO: 977300 - RNA, 19 nt, Homo sapiens
gcacaggaaagcauuuaua

SEQ ID NO: 977301 - RNA, 19 nt, Homo sapiens
uuacaaaccugaaugaugu

SEQ ID NO: 977302 - RNA, 19 nt, Homo sapiens
gagaaacccugcaaaugug

SEQ ID NO: 977303 - RNA, 19 nt, Homo sapiens
uggcagagcuuucaaccua

SEQ ID NO: 977304 - RNA, 19 nt, Homo sapiens
agagaaaccuuaccaaugu

SEQ ID NO: 977305 - RNA, 19 nt, Homo sapiens
cuacugaggucaucauuug

SEQ ID NO: 977306 - RNA, 19 nt, Homo sapiens
ggaaagaaacccuacaaau

SEQ ID NO: 977307 - RNA, 19 nt, Homo sapiens
ggaaagaaacccuacaaau

SEQ ID NO: 977308 - RNA, 19 nt, Homo sapiens
gagagaauccuacaaaugu

SEQ ID NO: 977309 - RNA, 19 nt, Homo sapiens
gagagaaacccuacaaaug

SEQ ID NO: 977310 - RNA, 19 nt, Homo sapiens
gagagaaacccuacaaaug

SEQ ID NO: 977311 - RNA, 19 nt, Homo sapiens
gagaaccucuacaaauuug

SEQ ID NO: 977312 - RNA, 19 nt, Homo sapiens
gagagaaacccuacaaaug

SEQ ID NO: 977313 - RNA, 19 nt, Homo sapiens
gagagaaacccuacaaaug

SEQ ID NO: 977314 - RNA, 19 nt, Homo sapiens
gagagaaacccuacaaaug

SEQ ID NO: 977315 - RNA, 19 nt, Homo sapiens
gaagagaaacccuacaaau

SEQ ID NO: 977316 - RNA, 19 nt, Homo sapiens
gaagagaaacccaacaaau

SEQ ID NO: 977317 - RNA, 19 nt, Homo sapiens
ccacugacauuuaaagaug

SEQ ID NO: 977318 - RNA, 19 nt, Homo sapiens
ggaaagcauuuauacuuca

SEQ ID NO: 977319 - RNA, 19 nt, Homo sapiens
gagagaaacuacaaaugug

SEQ ID NO: 977320 - RNA, 19 nt, Homo sapiens
ggagagaaacuacaaaugu

SEQ ID NO: 977321 - RNA, 19 nt, Homo sapiens
ugaagaacauggcaaaguu

SEQ ID NO: 977322 - RNA, 19 nt, Homo sapiens
cagcauagaagaauucaua

SEQ ID NO: 977323 - RNA, 19 nt, Homo sapiens
uaaccuuccuuaacccuua

SEQ ID NO: 977324 - RNA, 19 nt, Homo sapiens
ggagagaaacccuauaaau

SEQ ID NO: 977325 - RNA, 19 nt, Homo sapiens
ggagagaaacccuauaaau

SEQ ID NO: 977326 - RNA, 19 nt, Homo sapiens
uaaccaaucuucaaaccuu

SEQ ID NO: 977327 - RNA, 19 nt, Homo sapiens
gcacagcgggauuuauaua

SEQ ID NO: 977328 - RNA, 19 nt, Homo sapiens
gcaaauccuuuaacugauc

SEQ ID NO: 977329 - RNA, 19 nt, Homo sapiens
gagaaacccuauaaaugug

SEQ ID NO: 977330 - RNA, 19 nt, Homo sapiens
aagagaaacucaacaaaug

SEQ ID NO: 977331 - RNA, 19 nt, Homo sapiens
gagaaacccuauaaaugug

SEQ ID NO: 977332 - RNA, 19 nt, Homo sapiens
uaacauauccucaaaccuu

SEQ ID NO: 977333 - RNA, 19 nt, Homo sapiens
gaaaugagacauccugugu

SEQ ID NO: 977334 - RNA, 19 nt, Homo sapiens
ugacaagagugguuaauuc

SEQ ID NO: 977335 - RNA, 19 nt, Homo sapiens
ccucaaaccucacuaaaca

SEQ ID NO: 977336 - RNA, 19 nt, Homo sapiens
gagagaaagccuacaauug

SEQ ID NO: 977337 - RNA, 19 nt, Homo sapiens
gcacaaaggaggucauaau

SEQ ID NO: 977338 - RNA, 19 nt, Homo sapiens
guugagaguuucccaguuu

SEQ ID NO: 977339 - RNA, 19 nt, Homo sapiens
ccagaggccucauacuaaa

SEQ ID NO: 977340 - RNA, 19 nt, Homo sapiens
ggacaaacaauacaaauac

SEQ ID NO: 977341 - RNA, 19 nt, Homo sapiens
cuacaaaugugaagucugu

SEQ ID NO: 977342 - RNA, 19 nt, Homo sapiens
gagaaagccuacaauugug

SEQ ID NO: 977343 - RNA, 19 nt, Homo sapiens
gagaaacccuacaaaugug

SEQ ID NO: 977344 - RNA, 19 nt, Homo sapiens
gagaaacccuacaaaugug

SEQ ID NO: 977345 - RNA, 19 nt, Homo sapiens
gaauguggcaaauccuuua

SEQ ID NO: 977346 - RNA, 19 nt, Homo sapiens
gagaaacccuacaaaugug

SEQ ID NO: 977347 - RNA, 19 nt, Homo sapiens
gagagaaaccuuaccaaug

SEQ ID NO: 977348 - RNA, 19 nt, Homo sapiens
gagaaacccuacaaaugug

SEQ ID NO: 977349 - RNA, 19 nt, Homo sapiens
gagaaacccuacaaaugug

SEQ ID NO: 977350 - RNA, 19 nt, Homo sapiens
gagaaacccuacaaaugug

SEQ ID NO: 977351 - RNA, 19 nt, Homo sapiens
ggaauguguuguuagagaa

SEQ ID NO: 977352 - RNA, 19 nt, Homo sapiens
ugaagaggcuguuuguguu

SEQ ID NO: 977353 - RNA, 19 nt, Homo sapiens
ccacuacacuccagccaaa

SEQ ID NO: 977354 - RNA, 19 nt, Homo sapiens
aaagaaacccuacaaaugu

SEQ ID NO: 977355 - RNA, 19 nt, Homo sapiens
aaagaaacccuacaaaugu

SEQ ID NO: 977356 - RNA, 19 nt, Homo sapiens
ccucaaaucuuacuacaca

SEQ ID NO: 977357 - RNA, 19 nt, Homo sapiens
gagagaaaccauacaaaug

SEQ ID NO: 977358 - RNA, 19 nt, Homo sapiens
gguauccgguugagaguuu

SEQ ID NO: 977359 - RNA, 19 nt, Homo sapiens
ccucauaccuuacuauaca

SEQ ID NO: 977360 - RNA, 19 nt, Homo sapiens
ggagagaaaccuuacaaau

SEQ ID NO: 977361 - RNA, 19 nt, Homo sapiens
ggagagaaaccauacaaau

SEQ ID NO: 977362 - RNA, 19 nt, Homo sapiens
gaagaaaacuccuggaagu

SEQ ID NO: 977363 - RNA, 19 nt, Homo sapiens
gacaacaccucgaacuuuc

SEQ ID NO: 977364 - RNA, 19 nt, Homo sapiens
ggagagaaagccuacaauu

SEQ ID NO: 977365 - RNA, 19 nt, Homo sapiens
ccucgaacuuucuaacaua

SEQ ID NO: 977366 - RNA, 19 nt, Homo sapiens
ggagagaauccuacaaaug

SEQ ID NO: 977367 - RNA, 19 nt, Homo sapiens
ucagugaccugcuacaguu

SEQ ID NO: 977368 - RNA, 19 nt, Homo sapiens
ccucaaaccuuacuacaca

SEQ ID NO: 977369 - RNA, 19 nt, Homo sapiens
gaagaacauggcaaaguuu

SEQ ID NO: 977370 - RNA, 19 nt, Homo sapiens
cgaagaagauucagaacuu

SEQ ID NO: 977371 - RNA, 19 nt, Homo sapiens
cagaggagauugagaacua

SEQ ID NO: 977372 - RNA, 19 nt, Homo sapiens
gaagaagauucagaacuuu

SEQ ID NO: 977373 - RNA, 19 nt, Homo sapiens
ccugugcucuucagaauua

SEQ ID NO: 977374 - RNA, 19 nt, Homo sapiens
ucaaagcgcugcugcuaga

SEQ ID NO: 977375 - RNA, 19 nt, Homo sapiens
gcaaagagucugccaagga

SEQ ID NO: 977376 - RNA, 19 nt, Homo sapiens
ugagaggccugaagaagaa

SEQ ID NO: 977377 - RNA, 19 nt, Homo sapiens
gaucagcaccagcaccuua

SEQ ID NO: 977378 - RNA, 19 nt, Homo sapiens
ggagauggcuaagggcauu

SEQ ID NO: 977379 - RNA, 19 nt, Homo sapiens
agaagcagcugaaggaaga

SEQ ID NO: 977380 - RNA, 19 nt, Homo sapiens
caagggagcugcggaggaa

SEQ ID NO: 977381 - RNA, 19 nt, Homo sapiens
gagcauugaugucagugaa

SEQ ID NO: 977382 - RNA, 19 nt, Homo sapiens
ccacagacguugccuccaa

SEQ ID NO: 977383 - RNA, 19 nt, Homo sapiens
cuaagggcauuacguauga

SEQ ID NO: 977384 - RNA, 19 nt, Homo sapiens
guacucaucuuugcagaga

SEQ ID NO: 977385 - RNA, 19 nt, Homo sapiens
caacaaagcgugugaugag

SEQ ID NO: 977386 - RNA, 19 nt, Homo sapiens
gcuaagagugcccuuguaa

SEQ ID NO: 977387 - RNA, 19 nt, Homo sapiens
uccagcacgucaucaauua

SEQ ID NO: 977388 - RNA, 19 nt, Homo sapiens
caaagcgugugaugaguca

SEQ ID NO: 977389 - RNA, 19 nt, Homo sapiens
ggacagaaucagcauuuca

SEQ ID NO: 977390 - RNA, 19 nt, Homo sapiens
cgacagacccugcucuuca

SEQ ID NO: 977391 - RNA, 19 nt, Homo sapiens
ccacuaccuucaucaacaa

SEQ ID NO: 977392 - RNA, 19 nt, Homo sapiens
ggaacaagagaagagguua

SEQ ID NO: 977393 - RNA, 19 nt, Homo sapiens
uggauuugcugcagaagaa

SEQ ID NO: 977394 - RNA, 19 nt, Homo sapiens
aucaagagcuucaaggaaa

SEQ ID NO: 977395 - RNA, 19 nt, Homo sapiens
ggagauugagaacuaugua

SEQ ID NO: 977396 - RNA, 19 nt, Homo sapiens
gaaggaggaggccaagaug

SEQ ID NO: 977397 - RNA, 19 nt, Homo sapiens
ggagguagaauaugugaag

SEQ ID NO: 977398 - RNA, 19 nt, Homo sapiens
ugacauccguaccaucuuc

SEQ ID NO: 977399 - RNA, 19 nt, Homo sapiens
gccacuaccuucaucaaca

SEQ ID NO: 977400 - RNA, 19 nt, Homo sapiens
gcuaagggcauuacguaug

SEQ ID NO: 977401 - RNA, 19 nt, Homo sapiens
uaagagugcccuuguaaag

SEQ ID NO: 977402 - RNA, 19 nt, Homo sapiens
auucagaacuuugcuaaga

SEQ ID NO: 977403 - RNA, 19 nt, Homo sapiens
gagguuacccuucucaaag

SEQ ID NO: 977404 - RNA, 19 nt, Homo sapiens
gaaggaagaagagaagauc

SEQ ID NO: 977405 - RNA, 19 nt, Homo sapiens
uaaagccugugaccaucaa

SEQ ID NO: 977406 - RNA, 19 nt, Homo sapiens
gaacuauguacaccggauu

SEQ ID NO: 977407 - RNA, 19 nt, Homo sapiens
cuaaggccaucgaggcauu

SEQ ID NO: 977408 - RNA, 19 nt, Homo sapiens
gggcaaagaccaggaggaa

SEQ ID NO: 977409 - RNA, 19 nt, Homo sapiens
ucaagagcuucaaggaaau

SEQ ID NO: 977410 - RNA, 19 nt, Homo sapiens
caacacccauucagaucca

SEQ ID NO: 977411 - RNA, 19 nt, Homo sapiens
caucaagagcuucaaggaa

SEQ ID NO: 977412 - RNA, 19 nt, Homo sapiens
agaagauccuggagagugu

SEQ ID NO: 977413 - RNA, 19 nt, Homo sapiens
ccaccagucuacacauaca

SEQ ID NO: 977414 - RNA, 19 nt, Homo sapiens
ccaaggagaagcagcugaa

SEQ ID NO: 977415 - RNA, 19 nt, Homo sapiens
ccaagcaggucagcaacau

SEQ ID NO: 977416 - RNA, 19 nt, Homo sapiens
caccagcaccuuaaagaga

SEQ ID NO: 977417 - RNA, 19 nt, Homo sapiens
ugccaccagucuacacaua

SEQ ID NO: 977418 - RNA, 19 nt, Homo sapiens
ccuaguagccacagacguu

SEQ ID NO: 977419 - RNA, 19 nt, Homo sapiens
uccaggagguagaauaugu

SEQ ID NO: 977420 - RNA, 19 nt, Homo sapiens
ucagaacuuugcuaagagu

SEQ ID NO: 977421 - RNA, 19 nt, Homo sapiens
ucauggauuugcugcagaa

SEQ ID NO: 977422 - RNA, 19 nt, Homo sapiens
acacaggcaucgccacuac

SEQ ID NO: 977423 - RNA, 19 nt, Homo sapiens
ccuauggacucaucaucug

SEQ ID NO: 977424 - RNA, 19 nt, Homo sapiens
gaacaagagaagagguuac

SEQ ID NO: 977425 - RNA, 19 nt, Homo sapiens
guucugagcaugucugaag

SEQ ID NO: 977426 - RNA, 19 nt, Homo sapiens
uggcuaagggcauuacgua

SEQ ID NO: 977427 - RNA, 19 nt, Homo sapiens
ccucaaagcgcugcugcua

SEQ ID NO: 977428 - RNA, 19 nt, Homo sapiens
ugaaggaggaggccaagau

SEQ ID NO: 977429 - RNA, 19 nt, Homo sapiens
gugccaccaugccgaagaa

SEQ ID NO: 977430 - RNA, 19 nt, Homo sapiens
cccauggcauccuggagua

SEQ ID NO: 977431 - RNA, 19 nt, Homo sapiens
ccaaaccucuagcccaaaa

SEQ ID NO: 977432 - RNA, 19 nt, Homo sapiens
gcaggacagcgguagugaa

SEQ ID NO: 977433 - RNA, 19 nt, Homo sapiens
ugacaugccagaggagauu

SEQ ID NO: 977434 - RNA, 19 nt, Homo sapiens
gacagacccugcucuucag

SEQ ID NO: 977435 - RNA, 19 nt, Homo sapiens
ggacuacgugcccuaugug

SEQ ID NO: 977436 - RNA, 19 nt, Homo sapiens
guaaagccugugaccauca

SEQ ID NO: 977437 - RNA, 19 nt, Homo sapiens
caucuucuccuacuucaag

SEQ ID NO: 977438 - RNA, 19 nt, Homo sapiens
guaccaucuucuccuacuu

SEQ ID NO: 977439 - RNA, 19 nt, Homo sapiens
caugagcgcgugcggaaga

SEQ ID NO: 977440 - RNA, 19 nt, Homo sapiens
agucuucccuucucuccaa

SEQ ID NO: 977441 - RNA, 19 nt, Homo sapiens
accagcaccuuaaagagaa

SEQ ID NO: 977442 - RNA, 19 nt, Homo sapiens
acgaguaccugcugcucaa

SEQ ID NO: 977443 - RNA, 19 nt, Homo sapiens
cauccaggagguagaauau

SEQ ID NO: 977444 - RNA, 19 nt, Homo sapiens
ggugacauccguaccaucu

SEQ ID NO: 977445 - RNA, 19 nt, Homo sapiens
gaagauggucagccuagac

SEQ ID NO: 977446 - RNA, 19 nt, Homo sapiens
gcaccagcaccuuaaagag

SEQ ID NO: 977447 - RNA, 19 nt, Homo sapiens
cagcacgucaucaauuaug

SEQ ID NO: 977448 - RNA, 19 nt, Homo sapiens
caacgucagccuccuggau

SEQ ID NO: 977449 - RNA, 19 nt, Homo sapiens
cuaagagugcccuuguaaa

SEQ ID NO: 977450 - RNA, 19 nt, Homo sapiens
caugauaggcaucgcuuuc

SEQ ID NO: 977451 - RNA, 19 nt, Homo sapiens
cgacagucuucccuucucu

SEQ ID NO: 977452 - RNA, 19 nt, Homo sapiens
ccaccaugccgaagaagau

SEQ ID NO: 977453 - RNA, 19 nt, Homo sapiens
ggagaagcagcugaaggaa

SEQ ID NO: 977454 - RNA, 19 nt, Homo sapiens
gcuagaagccaagcagaag

SEQ ID NO: 977455 - RNA, 19 nt, Homo sapiens
ucaacaaagcgugugauga

SEQ ID NO: 977456 - RNA, 19 nt, Homo sapiens
caucgccacuaccuucauc

SEQ ID NO: 977457 - RNA, 19 nt, Homo sapiens
cagugaaggagauggcuaa

SEQ ID NO: 977458 - RNA, 19 nt, Homo sapiens
caucauguucugccuggaa

SEQ ID NO: 977459 - RNA, 19 nt, Homo sapiens
cugagaggccugaagaaga

SEQ ID NO: 977460 - RNA, 19 nt, Homo sapiens
ucccugugcucuucagaau

SEQ ID NO: 977461 - RNA, 19 nt, Homo sapiens
gcucagcuggccuggaaug

SEQ ID NO: 977462 - RNA, 19 nt, Homo sapiens
aggacuacgugcccuaugu

SEQ ID NO: 977463 - RNA, 19 nt, Homo sapiens
aggagaagcagcugaagga

SEQ ID NO: 977464 - RNA, 19 nt, Homo sapiens
agagguuacccuucucaaa

SEQ ID NO: 977465 - RNA, 19 nt, Homo sapiens
cuggacagaaucagcauuu

SEQ ID NO: 977466 - RNA, 19 nt, Homo sapiens
ugaugucagugaaggagau

SEQ ID NO: 977467 - RNA, 19 nt, Homo sapiens
gcugaaggaagaagagaag

SEQ ID NO: 977468 - RNA, 19 nt, Homo sapiens
gggccgagcauugauguca

SEQ ID NO: 977469 - RNA, 19 nt, Homo sapiens
gagauggcuaagggcauua

SEQ ID NO: 977470 - RNA, 19 nt, Homo sapiens
gaaagaaagugacaaacua

SEQ ID NO: 977471 - RNA, 19 nt, Homo sapiens
cagaagagcuguagucaua

SEQ ID NO: 977472 - RNA, 19 nt, Homo sapiens
gaacgggccuugaagagaa

SEQ ID NO: 977473 - RNA, 19 nt, Homo sapiens
ggaaaggccuugcagaguu

SEQ ID NO: 977474 - RNA, 19 nt, Homo sapiens
caaauccucuuccuacuuu

SEQ ID NO: 977475 - RNA, 19 nt, Homo sapiens
gaaaggccuugcagaguuu

SEQ ID NO: 977476 - RNA, 19 nt, Homo sapiens
guaaccggaucuaugauua

SEQ ID NO: 977477 - RNA, 19 nt, Homo sapiens
ggagucacaugcaccauuu

SEQ ID NO: 977478 - RNA, 19 nt, Homo sapiens
ggagaaaucaucacaauca

SEQ ID NO: 977479 - RNA, 19 nt, Homo sapiens
ggaaagacuuaugaagaaa

SEQ ID NO: 977480 - RNA, 19 nt, Homo sapiens
caugaacuaugccagaaua

SEQ ID NO: 977481 - RNA, 19 nt, Homo sapiens
cuaaagagcuacaucgaau

SEQ ID NO: 977482 - RNA, 19 nt, Homo sapiens
auaaugaacugacgguuaa

SEQ ID NO: 977483 - RNA, 19 nt, Homo sapiens
ggaauguaaucacgaguau

SEQ ID NO: 977484 - RNA, 19 nt, Homo sapiens
caaagaaagaucuccauuu

SEQ ID NO: 977485 - RNA, 19 nt, Homo sapiens
ggacagaacgggccuugaa

SEQ ID NO: 977486 - RNA, 19 nt, Homo sapiens
gaaagugacaaacuaguug

SEQ ID NO: 977487 - RNA, 19 nt, Homo sapiens
gaaaucaucacaaucacaa

SEQ ID NO: 977488 - RNA, 19 nt, Homo sapiens
ugaaacagaucucaaugau

SEQ ID NO: 977489 - RNA, 19 nt, Homo sapiens
uguagaagccaacauauaa

SEQ ID NO: 977490 - RNA, 19 nt, Homo sapiens
gagucagcaucaugucuua

SEQ ID NO: 977491 - RNA, 19 nt, Homo sapiens
gaagagagucagcaucaug

SEQ ID NO: 977492 - RNA, 19 nt, Homo sapiens
caaacuaguugcaacaagu

SEQ ID NO: 977493 - RNA, 19 nt, Homo sapiens
aggaaagacuuaugaagaa

SEQ ID NO: 977494 - RNA, 19 nt, Homo sapiens
gaauaucagcuaacaccua

SEQ ID NO: 977495 - RNA, 19 nt, Homo sapiens
gcagagggaaugugaaaga

SEQ ID NO: 977496 - RNA, 19 nt, Homo sapiens
uaacaccuacuaacacuaa

SEQ ID NO: 977497 - RNA, 19 nt, Homo sapiens
ccaguaaucucagaaagug

SEQ ID NO: 977498 - RNA, 19 nt, Homo sapiens
gcacuuccuuccuaaucuu

SEQ ID NO: 977499 - RNA, 19 nt, Homo sapiens
gaucuaugauuacaacagu

SEQ ID NO: 977500 - RNA, 19 nt, Homo sapiens
gagaugagaaggaauggaa

SEQ ID NO: 977501 - RNA, 19 nt, Homo sapiens
ccacagguauaagcacuuu

SEQ ID NO: 977502 - RNA, 19 nt, Homo sapiens
uaacacuaaucgaucugua

SEQ ID NO: 977503 - RNA, 19 nt, Homo sapiens
ggaaggaagaaacaucaaa

SEQ ID NO: 977504 - RNA, 19 nt, Homo sapiens
cagaacagccaaagaaaga

SEQ ID NO: 977505 - RNA, 19 nt, Homo sapiens
gaacugacgguuaaugaag

SEQ ID NO: 977506 - RNA, 19 nt, Homo sapiens
uaagcacuuugacugguua

SEQ ID NO: 977507 - RNA, 19 nt, Homo sapiens
cagcaacaaucaccagguu

SEQ ID NO: 977508 - RNA, 19 nt, Homo sapiens
gaauucaucauuucaguuc

SEQ ID NO: 977509 - RNA, 19 nt, Homo sapiens
gaccagugcuuucucucuu

SEQ ID NO: 977510 - RNA, 19 nt, Homo sapiens
gggaagucguuacgccuuu

SEQ ID NO: 977511 - RNA, 19 nt, Homo sapiens
caggaaagacuuaugaaga

SEQ ID NO: 977512 - RNA, 19 nt, Homo sapiens
caucauuguuggagauuau

SEQ ID NO: 977513 - RNA, 19 nt, Homo sapiens
gaaaauuccccuuaacaaa

SEQ ID NO: 977514 - RNA, 19 nt, Homo sapiens
gaaacagucgugcuaguuc

SEQ ID NO: 977515 - RNA, 19 nt, Homo sapiens
gcacagcucaggccaguuc

SEQ ID NO: 977516 - RNA, 19 nt, Homo sapiens
ugacuuggacuuaguagaa

SEQ ID NO: 977517 - RNA, 19 nt, Homo sapiens
ggaaacagucgugcuaguu

SEQ ID NO: 977518 - RNA, 19 nt, Homo sapiens
caacauggcauauauaucc

SEQ ID NO: 977519 - RNA, 19 nt, Homo sapiens
aagcugagaugaaucacuu

SEQ ID NO: 977520 - RNA, 19 nt, Homo sapiens
gaacugggaaagcucagaa

SEQ ID NO: 977521 - RNA, 19 nt, Homo sapiens
gaacuaugccagaauaaaa

SEQ ID NO: 977522 - RNA, 19 nt, Homo sapiens
gcacuuugacugguuauau

SEQ ID NO: 977523 - RNA, 19 nt, Homo sapiens
guagucauacaaucacaua

SEQ ID NO: 977524 - RNA, 19 nt, Homo sapiens
gcaaugcaauucaaaacuu

SEQ ID NO: 977525 - RNA, 19 nt, Homo sapiens
ggacuuaguagaaauagag

SEQ ID NO: 977526 - RNA, 19 nt, Homo sapiens
aauaaugaacugacgguua

SEQ ID NO: 977527 - RNA, 19 nt, Homo sapiens
guagaagccaacauauaaa

SEQ ID NO: 977528 - RNA, 19 nt, Homo sapiens
ucacaagggagcaauagaa

SEQ ID NO: 977529 - RNA, 19 nt, Homo sapiens
gcccauuacccaaggaaua

SEQ ID NO: 977530 - RNA, 19 nt, Homo sapiens
aaggagaaaucaucacaau

SEQ ID NO: 977531 - RNA, 19 nt, Homo sapiens
gaugaugacugggaugaag

SEQ ID NO: 977532 - RNA, 19 nt, Homo sapiens
gaaggaagaaacaucaaag

SEQ ID NO: 977533 - RNA, 19 nt, Homo sapiens
caguggaaauugucucuau

SEQ ID NO: 977534 - RNA, 19 nt, Homo sapiens
gaaacagaucucaaugaug

SEQ ID NO: 977535 - RNA, 19 nt, Homo sapiens
ccaaggcucggguuaugua

SEQ ID NO: 977536 - RNA, 19 nt, Homo sapiens
caaaauguauggucuaaag

SEQ ID NO: 977537 - RNA, 19 nt, Homo sapiens
caacuggugaugaugauga

SEQ ID NO: 977538 - RNA, 19 nt, Homo sapiens
guggcaacauggcauauau

SEQ ID NO: 977539 - RNA, 19 nt, Homo sapiens
gagggaaugugaaagaaaa

SEQ ID NO: 977540 - RNA, 19 nt, Homo sapiens
gggacuuuguagagaauuu

SEQ ID NO: 977541 - RNA, 19 nt, Homo sapiens
ugagggacuuuguagagaa

SEQ ID NO: 977542 - RNA, 19 nt, Homo sapiens
acaguaaccggaucuauga

SEQ ID NO: 977543 - RNA, 19 nt, Homo sapiens
uccagcaguuccuaaauuu

SEQ ID NO: 977544 - RNA, 19 nt, Homo sapiens
gcuaacaccuacuaacacu

SEQ ID NO: 977545 - RNA, 19 nt, Homo sapiens
caucgaauaucagcuaaca

SEQ ID NO: 977546 - RNA, 19 nt, Homo sapiens
agagcuacaucgaauauca

SEQ ID NO: 977547 - RNA, 19 nt, Homo sapiens
uaaagagcuacaucgaaua

SEQ ID NO: 977548 - RNA, 19 nt, Homo sapiens
aaacagaacauggugaaga

SEQ ID NO: 977549 - RNA, 19 nt, Homo sapiens
gaacagccaaagaaagauc

SEQ ID NO: 977550 - RNA, 19 nt, Homo sapiens
gcaccugacuuggacuuag

SEQ ID NO: 977551 - RNA, 19 nt, Homo sapiens
acacaaacacucccaacaa

SEQ ID NO: 977552 - RNA, 19 nt, Homo sapiens
cugcuucccugacaucauu

SEQ ID NO: 977553 - RNA, 19 nt, Homo sapiens
cagaagcaggaaagacuua

SEQ ID NO: 977554 - RNA, 19 nt, Homo sapiens
ucaccaaggccauggauga

SEQ ID NO: 977555 - RNA, 19 nt, Homo sapiens
cuacaucgaauaucagcua

SEQ ID NO: 977556 - RNA, 19 nt, Homo sapiens
guucuuagauacguugaug

SEQ ID NO: 977557 - RNA, 19 nt, Homo sapiens
gaauguaagagcauguaga

SEQ ID NO: 977558 - RNA, 19 nt, Homo sapiens
gagggacuuuguagagaau

SEQ ID NO: 977559 - RNA, 19 nt, Homo sapiens
gaauugagggacuuuguag

SEQ ID NO: 977560 - RNA, 19 nt, Homo sapiens
ccaaagaaagaucuccauu

SEQ ID NO: 977561 - RNA, 19 nt, Homo sapiens
ucucaaugaugcaauaaca

SEQ ID NO: 977562 - RNA, 19 nt, Homo sapiens
caccaaggcucggguuaug

SEQ ID NO: 977563 - RNA, 19 nt, Homo sapiens
gacuuggacuuaguagaaa

SEQ ID NO: 977564 - RNA, 19 nt, Homo sapiens
gaaggagaaaucaucacaa

SEQ ID NO: 977565 - RNA, 19 nt, Homo sapiens
aaucacaaauccggaugua

SEQ ID NO: 977566 - RNA, 19 nt, Homo sapiens
cagagggaaugugaaagaa

SEQ ID NO: 977567 - RNA, 19 nt, Homo sapiens
ggugugaggcaaagugaaa

SEQ ID NO: 977568 - RNA, 19 nt, Homo sapiens
ccacugauauuuuacauag

SEQ ID NO: 977569 - RNA, 19 nt, Homo sapiens
gcagaacagccaaagaaag

SEQ ID NO: 977570 - RNA, 19 nt, Homo sapiens
guacaagucucaugauaua

SEQ ID NO: 977571 - RNA, 19 nt, Homo sapiens
ggagagaauugaccauuua

SEQ ID NO: 977572 - RNA, 19 nt, Homo sapiens
ggaaaggcauucagaaauu

SEQ ID NO: 977573 - RNA, 19 nt, Homo sapiens
gaaauuaugugaucugugu

SEQ ID NO: 977574 - RNA, 19 nt, Homo sapiens
gaaaggcauucagaaauua

SEQ ID NO: 977575 - RNA, 19 nt, Homo sapiens
gaagaaaguuauggaagua

SEQ ID NO: 977576 - RNA, 19 nt, Homo sapiens
ugacacagcuuguuucaaa

SEQ ID NO: 977577 - RNA, 19 nt, Homo sapiens
gaaggaagcucagaaacuu

SEQ ID NO: 977578 - RNA, 19 nt, Homo sapiens
gagauacagugagaaauua

SEQ ID NO: 977579 - RNA, 19 nt, Homo sapiens
gcaaacaacugauauaugc

SEQ ID NO: 977580 - RNA, 19 nt, Homo sapiens
ggauuaagcuggguacuuu

SEQ ID NO: 977581 - RNA, 19 nt, Homo sapiens
gaagauauaccaacauuug

SEQ ID NO: 977582 - RNA, 19 nt, Homo sapiens
guacauggaucaaaccaaa

SEQ ID NO: 977583 - RNA, 19 nt, Homo sapiens
gcaaagaaguagacccaaa

SEQ ID NO: 977584 - RNA, 19 nt, Homo sapiens
uuacaaagcugaucacuuc

SEQ ID NO: 977585 - RNA, 19 nt, Homo sapiens
gaaccaagccauucucaaa

SEQ ID NO: 977586 - RNA, 19 nt, Homo sapiens
gagcagagauacagugaga

SEQ ID NO: 977587 - RNA, 19 nt, Homo sapiens
gcacagauccaguuaguga

SEQ ID NO: 977588 - RNA, 19 nt, Homo sapiens
gcaaguccaucuacaguga

SEQ ID NO: 977589 - RNA, 19 nt, Homo sapiens
ccaacuggaucuuuguuua

SEQ ID NO: 977590 - RNA, 19 nt, Homo sapiens
gaugugaacuccaugcaaa

SEQ ID NO: 977591 - RNA, 19 nt, Homo sapiens
cuacaaaugugcagaggua

SEQ ID NO: 977592 - RNA, 19 nt, Homo sapiens
guacagaguuucccuuuag

SEQ ID NO: 977593 - RNA, 19 nt, Homo sapiens
gaaaccaucuauuaccuau

SEQ ID NO: 977594 - RNA, 19 nt, Homo sapiens
uauaaucacugccugcaua

SEQ ID NO: 977595 - RNA, 19 nt, Homo sapiens
cagacuggauuacuucuua

SEQ ID NO: 977596 - RNA, 19 nt, Homo sapiens
gaaaugaacacuuaaugga

SEQ ID NO: 977597 - RNA, 19 nt, Homo sapiens
gaaguagacccaaaugauu

SEQ ID NO: 977598 - RNA, 19 nt, Homo sapiens
gaaugaaaguggaacaugu

SEQ ID NO: 977599 - RNA, 19 nt, Homo sapiens
aaugagagcucugauuaua

SEQ ID NO: 977600 - RNA, 19 nt, Homo sapiens
ucacaaagcugucugaaac

SEQ ID NO: 977601 - RNA, 19 nt, Homo sapiens
ugacagauauccaacaaau

SEQ ID NO: 977602 - RNA, 19 nt, Homo sapiens
caaacucacuggaaaugaa

SEQ ID NO: 977603 - RNA, 19 nt, Homo sapiens
aaagcugucugaaacaaua

SEQ ID NO: 977604 - RNA, 19 nt, Homo sapiens
ucugagagcuuuaguucua

SEQ ID NO: 977605 - RNA, 19 nt, Homo sapiens
gagaauugaccauuuauug

SEQ ID NO: 977606 - RNA, 19 nt, Homo sapiens
gggagagaauugaccauuu

SEQ ID NO: 977607 - RNA, 19 nt, Homo sapiens
gaaguuaacaugucucuca

SEQ ID NO: 977608 - RNA, 19 nt, Homo sapiens
gaagaacagucuccagaag

SEQ ID NO: 977609 - RNA, 19 nt, Homo sapiens
gcacuagcaugguggaaga

SEQ ID NO: 977610 - RNA, 19 nt, Homo sapiens
cagaagauauaccaacauu

SEQ ID NO: 977611 - RNA, 19 nt, Homo sapiens
aaacuugccuaauaccuuu

SEQ ID NO: 977612 - RNA, 19 nt, Homo sapiens
gugcagagguaauacauau

SEQ ID NO: 977613 - RNA, 19 nt, Homo sapiens
gaagaggagggauaacuuu

SEQ ID NO: 977614 - RNA, 19 nt, Homo sapiens
cagaauacuucaagaauag

SEQ ID NO: 977615 - RNA, 19 nt, Homo sapiens
agaaaucacuccaaucuca

SEQ ID NO: 977616 - RNA, 19 nt, Homo sapiens
gaagagggcuuuaaaacga

SEQ ID NO: 977617 - RNA, 19 nt, Homo sapiens
uaaaugguguucaguuaga

SEQ ID NO: 977618 - RNA, 19 nt, Homo sapiens
gaauggaagaagaaaguua

SEQ ID NO: 977619 - RNA, 19 nt, Homo sapiens
caaccacccuuacuacuuc

SEQ ID NO: 977620 - RNA, 19 nt, Homo sapiens
gccaggaacuauuugauga

SEQ ID NO: 977621 - RNA, 19 nt, Homo sapiens
ccaaagauccagaagauau

SEQ ID NO: 977622 - RNA, 19 nt, Homo sapiens
caagagaguucuguugaga

SEQ ID NO: 977623 - RNA, 19 nt, Homo sapiens
guacauaaagguugaguug

SEQ ID NO: 977624 - RNA, 19 nt, Homo sapiens
gcagagauacagugagaaa

SEQ ID NO: 977625 - RNA, 19 nt, Homo sapiens
gggcagcggugaacaggaa

SEQ ID NO: 977626 - RNA, 19 nt, Homo sapiens
gcacaucugcuauucuuau

SEQ ID NO: 977627 - RNA, 19 nt, Homo sapiens
gguauuguuuguaauguga

SEQ ID NO: 977628 - RNA, 19 nt, Homo sapiens
gcaugcaucuucuaaugga

SEQ ID NO: 977629 - RNA, 19 nt, Homo sapiens
gaagaagaaaguuauggaa

SEQ ID NO: 977630 - RNA, 19 nt, Homo sapiens
caaaaggagucaguauuua

SEQ ID NO: 977631 - RNA, 19 nt, Homo sapiens
gaguuucccuuuagaugaa

SEQ ID NO: 977632 - RNA, 19 nt, Homo sapiens
caaagauccagaagauaua

SEQ ID NO: 977633 - RNA, 19 nt, Homo sapiens
gaaaagagguccagaugag

SEQ ID NO: 977634 - RNA, 19 nt, Homo sapiens
caaaugugcagagguaaua

SEQ ID NO: 977635 - RNA, 19 nt, Homo sapiens
gguuaagucuaaagagauu

SEQ ID NO: 977636 - RNA, 19 nt, Homo sapiens
cuggauuacuucuuacuua

SEQ ID NO: 977637 - RNA, 19 nt, Homo sapiens
gaucgauaaugaaacagaa

SEQ ID NO: 977638 - RNA, 19 nt, Homo sapiens
gaaacugauugugauguug

SEQ ID NO: 977639 - RNA, 19 nt, Homo sapiens
cacuggaaaugaacacuua

SEQ ID NO: 977640 - RNA, 19 nt, Homo sapiens
caaagcugaucacuuccua

SEQ ID NO: 977641 - RNA, 19 nt, Homo sapiens
ggaagaaggaggagaagau

SEQ ID NO: 977642 - RNA, 19 nt, Homo sapiens
gaucuaggauaugcuaaug

SEQ ID NO: 977643 - RNA, 19 nt, Homo sapiens
uuuccugucugcacaauua

SEQ ID NO: 977644 - RNA, 19 nt, Homo sapiens
ggcagcaacuguauuugaa

SEQ ID NO: 977645 - RNA, 19 nt, Homo sapiens
guauguaaccacugaagua

SEQ ID NO: 977646 - RNA, 19 nt, Homo sapiens
ugagagcucugauuauaca

SEQ ID NO: 977647 - RNA, 19 nt, Homo sapiens
gaaagagagggaccuauca

SEQ ID NO: 977648 - RNA, 19 nt, Homo sapiens
ugacuuauuuaacgccuuu

SEQ ID NO: 977649 - RNA, 19 nt, Homo sapiens
gcugaucacuuccuauaag

SEQ ID NO: 977650 - RNA, 19 nt, Homo sapiens
gcacagcugaccaacauga

SEQ ID NO: 977651 - RNA, 19 nt, Homo sapiens
gaggacagcuacagauuuu

SEQ ID NO: 977652 - RNA, 19 nt, Homo sapiens
uaucugagucuguugaaua

SEQ ID NO: 977653 - RNA, 19 nt, Homo sapiens
uaguacaagucucaugaua

SEQ ID NO: 977654 - RNA, 19 nt, Homo sapiens
uugaagguuuggccaauua

SEQ ID NO: 977655 - RNA, 19 nt, Homo sapiens
aaacacacuuaaccauuug

SEQ ID NO: 977656 - RNA, 19 nt, Homo sapiens
gcaaacacuacaaugcuuu

SEQ ID NO: 977657 - RNA, 19 nt, Homo sapiens
aaagcuaucuugucauauc

SEQ ID NO: 977658 - RNA, 19 nt, Homo sapiens
uguggauucuucuucauua

SEQ ID NO: 977659 - RNA, 19 nt, Homo sapiens
ugagaucgauaaugaaaca

SEQ ID NO: 977660 - RNA, 19 nt, Homo sapiens
gggagaaguuuaucacucu

SEQ ID NO: 977661 - RNA, 19 nt, Homo sapiens
aaccaucuauuaccuauga

SEQ ID NO: 977662 - RNA, 19 nt, Homo sapiens
caguagauguuucaguauu

SEQ ID NO: 977663 - RNA, 19 nt, Homo sapiens
gaacagauguaugcaaaau

SEQ ID NO: 977664 - RNA, 19 nt, Homo sapiens
ucugaacacuugucuuuau

SEQ ID NO: 977665 - RNA, 19 nt, Homo sapiens
ggaaaugaacacuuaaugg

SEQ ID NO: 977666 - RNA, 19 nt, Homo sapiens
aaacgaagacgaucuaaag

SEQ ID NO: 977667 - RNA, 19 nt, Homo sapiens
uaaagguccuccaucugaa

SEQ ID NO: 977668 - RNA, 19 nt, Homo sapiens
cauaaagccugaagaacca

SEQ ID NO: 977669 - RNA, 19 nt, Homo sapiens
auccaagucucuacaguua

SEQ ID NO: 977670 - RNA, 19 nt, Homo sapiens
guacaagucucaugauaua

SEQ ID NO: 977671 - RNA, 19 nt, Homo sapiens
ggagagaauugaccauuua

SEQ ID NO: 977672 - RNA, 19 nt, Homo sapiens
ggaaaggcauucagaaauu

SEQ ID NO: 977673 - RNA, 19 nt, Homo sapiens
gaaauuaugugaucugugu

SEQ ID NO: 977674 - RNA, 19 nt, Homo sapiens
gaaaggcauucagaaauua

SEQ ID NO: 977675 - RNA, 19 nt, Homo sapiens
gaagaaaguuauggaagua

SEQ ID NO: 977676 - RNA, 19 nt, Homo sapiens
ugacacagcuuguuucaaa

SEQ ID NO: 977677 - RNA, 19 nt, Homo sapiens
gaaggaagcucagaaacuu

SEQ ID NO: 977678 - RNA, 19 nt, Homo sapiens
gauaugaacuccaugcaaa

SEQ ID NO: 977679 - RNA, 19 nt, Homo sapiens
gagauacagugagaaauua

SEQ ID NO: 977680 - RNA, 19 nt, Homo sapiens
gcaaacaacugauauaugc

SEQ ID NO: 977681 - RNA, 19 nt, Homo sapiens
ggauuaagcuggguacuuu

SEQ ID NO: 977682 - RNA, 19 nt, Homo sapiens
gaagauauaccaacauuug

SEQ ID NO: 977683 - RNA, 19 nt, Homo sapiens
guacauggaucaaaccaaa

SEQ ID NO: 977684 - RNA, 19 nt, Homo sapiens
gcaaagaaguagacccaaa

SEQ ID NO: 977685 - RNA, 19 nt, Homo sapiens
uuacaaagcugaucacuuc

SEQ ID NO: 977686 - RNA, 19 nt, Homo sapiens
gcacuaacaugguggaaga

SEQ ID NO: 977687 - RNA, 19 nt, Homo sapiens
gaaccaagccauucucaaa

SEQ ID NO: 977688 - RNA, 19 nt, Homo sapiens
gagcagagauacagugaga

SEQ ID NO: 977689 - RNA, 19 nt, Homo sapiens
gcacagauccaguuaguga

SEQ ID NO: 977690 - RNA, 19 nt, Homo sapiens
gcaaguccaucuacaguga

SEQ ID NO: 977691 - RNA, 19 nt, Homo sapiens
ccaacuggaucuuuguuua

SEQ ID NO: 977692 - RNA, 19 nt, Homo sapiens
cuacaaaugugcagaggua

SEQ ID NO: 977693 - RNA, 19 nt, Homo sapiens
guacagaguuucccuuuag

SEQ ID NO: 977694 - RNA, 19 nt, Homo sapiens
gaaaccaucuauuaccuau

SEQ ID NO: 977695 - RNA, 19 nt, Homo sapiens
gaaaugaacacuuaaugga

SEQ ID NO: 977696 - RNA, 19 nt, Homo sapiens
gaaguagacccaaaugauu

SEQ ID NO: 977697 - RNA, 19 nt, Homo sapiens
gaaugaaaguggaacaugu

SEQ ID NO: 977698 - RNA, 19 nt, Homo sapiens
aaugagagcucugauuaua

SEQ ID NO: 977699 - RNA, 19 nt, Homo sapiens
ucacaaagcugucugaaac

SEQ ID NO: 977700 - RNA, 19 nt, Homo sapiens
ugacagauauccaacaaau

SEQ ID NO: 977701 - RNA, 19 nt, Homo sapiens
caaacucacuggaaaugaa

SEQ ID NO: 977702 - RNA, 19 nt, Homo sapiens
aaagcugucugaaacaaua

SEQ ID NO: 977703 - RNA, 19 nt, Homo sapiens
ucugagagcuuuaguucua

SEQ ID NO: 977704 - RNA, 19 nt, Homo sapiens
gagaauugaccauuuauug

SEQ ID NO: 977705 - RNA, 19 nt, Homo sapiens
gggagagaauugaccauuu

SEQ ID NO: 977706 - RNA, 19 nt, Homo sapiens
gaaguuaacaugucucuca

SEQ ID NO: 977707 - RNA, 19 nt, Homo sapiens
gaagaacagucuccagaag

SEQ ID NO: 977708 - RNA, 19 nt, Homo sapiens
cagaagauauaccaacauu

SEQ ID NO: 977709 - RNA, 19 nt, Homo sapiens
aaacuugccuaauaccuuu

SEQ ID NO: 977710 - RNA, 19 nt, Homo sapiens
gugcagagguaauacauau

SEQ ID NO: 977711 - RNA, 19 nt, Homo sapiens
gaagaggagggauaacuuu

SEQ ID NO: 977712 - RNA, 19 nt, Homo sapiens
cagaauacuucaagaauag

SEQ ID NO: 977713 - RNA, 19 nt, Homo sapiens
agaaaucacuccaaucuca

SEQ ID NO: 977714 - RNA, 19 nt, Homo sapiens
gaagagggcuuuaaaacga

SEQ ID NO: 977715 - RNA, 19 nt, Homo sapiens
uaaaugguguucaguuaga

SEQ ID NO: 977716 - RNA, 19 nt, Homo sapiens
gaauggaagaagaaaguua

SEQ ID NO: 977717 - RNA, 19 nt, Homo sapiens
caacgaagcacacuuaaag

SEQ ID NO: 977718 - RNA, 19 nt, Homo sapiens
caaccacccuuacuacuuc

SEQ ID NO: 977719 - RNA, 19 nt, Homo sapiens
gccaggaacuauuugauga

SEQ ID NO: 977720 - RNA, 19 nt, Homo sapiens
ccaaagauccagaagauau

SEQ ID NO: 977721 - RNA, 19 nt, Homo sapiens
caggcuggauuacuucuua

SEQ ID NO: 977722 - RNA, 19 nt, Homo sapiens
caagagaguucuguugaga

SEQ ID NO: 977723 - RNA, 19 nt, Homo sapiens
gcagagauacagugagaaa

SEQ ID NO: 977724 - RNA, 19 nt, Homo sapiens
gggcagcggugaacaggaa

SEQ ID NO: 977725 - RNA, 19 nt, Homo sapiens
gcacaucugcuauucuuau

SEQ ID NO: 977726 - RNA, 19 nt, Homo sapiens
gguauuguuuguaauguga

SEQ ID NO: 977727 - RNA, 19 nt, Homo sapiens
gcaugcaucuucuaaugga

SEQ ID NO: 977728 - RNA, 19 nt, Homo sapiens
gaagaagaaaguuauggaa

SEQ ID NO: 977729 - RNA, 19 nt, Homo sapiens
gcucaaucuugguuaauga

SEQ ID NO: 977730 - RNA, 19 nt, Homo sapiens
caaaaggagucaguauuua

SEQ ID NO: 977731 - RNA, 19 nt, Homo sapiens
gaguuucccuuuagaugaa

SEQ ID NO: 977732 - RNA, 19 nt, Homo sapiens
caaagauccagaagauaua

SEQ ID NO: 977733 - RNA, 19 nt, Homo sapiens
cagcgaaacuauagacuuc

SEQ ID NO: 977734 - RNA, 19 nt, Homo sapiens
gaaaagagguccagaugag

SEQ ID NO: 977735 - RNA, 19 nt, Homo sapiens
caaaugugcagagguaaua

SEQ ID NO: 977736 - RNA, 19 nt, Homo sapiens
gguuaagucuaaagagauu

SEQ ID NO: 977737 - RNA, 19 nt, Homo sapiens
cuggauuacuucuuacuua

SEQ ID NO: 977738 - RNA, 19 nt, Homo sapiens
gaucgauaaugaaacagaa

SEQ ID NO: 977739 - RNA, 19 nt, Homo sapiens
caacacacacgucauucua

SEQ ID NO: 977740 - RNA, 19 nt, Homo sapiens
gaaacugauugugauguug

SEQ ID NO: 977741 - RNA, 19 nt, Homo sapiens
cacuggaaaugaacacuua

SEQ ID NO: 977742 - RNA, 19 nt, Homo sapiens
caaagcugaucacuuccua

SEQ ID NO: 977743 - RNA, 19 nt, Homo sapiens
gaucuaggauaugcuaaug

SEQ ID NO: 977744 - RNA, 19 nt, Homo sapiens
ggaagaaggaggagaagau

SEQ ID NO: 977745 - RNA, 19 nt, Homo sapiens
uuuccugucugcacaauua

SEQ ID NO: 977746 - RNA, 19 nt, Homo sapiens
ggcagcaacuguauuugaa

SEQ ID NO: 977747 - RNA, 19 nt, Homo sapiens
guauguaaccacugaagua

SEQ ID NO: 977748 - RNA, 19 nt, Homo sapiens
ugagagcucugauuauaca

SEQ ID NO: 977749 - RNA, 19 nt, Homo sapiens
aaagagaguuccucagcuu

SEQ ID NO: 977750 - RNA, 19 nt, Homo sapiens
gacguuaaccgauuuguga

SEQ ID NO: 977751 - RNA, 19 nt, Homo sapiens
gcugaucacuuccuauaag

SEQ ID NO: 977752 - RNA, 19 nt, Homo sapiens
gcacagcugaccaacauga

SEQ ID NO: 977753 - RNA, 19 nt, Homo sapiens
gaggacagcuacagauuuu

SEQ ID NO: 977754 - RNA, 19 nt, Homo sapiens
uaucugagucuguugaaua

SEQ ID NO: 977755 - RNA, 19 nt, Homo sapiens
uaacaugguggaagaauau

SEQ ID NO: 977756 - RNA, 19 nt, Homo sapiens
uaguacaagucucaugaua

SEQ ID NO: 977757 - RNA, 19 nt, Homo sapiens
uugaagguuuggccaauua

SEQ ID NO: 977758 - RNA, 19 nt, Homo sapiens
gcaaacacuacaaugcuuu

SEQ ID NO: 977759 - RNA, 19 nt, Homo sapiens
aaagcuaucuugucauauc

SEQ ID NO: 977760 - RNA, 19 nt, Homo sapiens
uguggauucuucuucauua

SEQ ID NO: 977761 - RNA, 19 nt, Homo sapiens
ugagaucgauaaugaaaca

SEQ ID NO: 977762 - RNA, 19 nt, Homo sapiens
cuaacaugguggaagaaua

SEQ ID NO: 977763 - RNA, 19 nt, Homo sapiens
gggagaaguuuaucacucu

SEQ ID NO: 977764 - RNA, 19 nt, Homo sapiens
aaccaucuauuaccuauga

SEQ ID NO: 977765 - RNA, 19 nt, Homo sapiens
caguagauguuucaguauu

SEQ ID NO: 977766 - RNA, 19 nt, Homo sapiens
gaacagauguaugcaaaau

SEQ ID NO: 977767 - RNA, 19 nt, Homo sapiens
ucugaacacuugucuuuau

SEQ ID NO: 977768 - RNA, 19 nt, Homo sapiens
ggaaaugaacacuuaaugg

SEQ ID NO: 977769 - RNA, 19 nt, Homo sapiens
aaacgaagacgaucuaaag

SEQ ID NO: 977770 - RNA, 19 nt, Homo sapiens
gaacaggccuuaagucuuc

SEQ ID NO: 977771 - RNA, 19 nt, Homo sapiens
gaagagauccgauagcuau

SEQ ID NO: 977772 - RNA, 19 nt, Homo sapiens
uaggaaagcgguuguauua

SEQ ID NO: 977773 - RNA, 19 nt, Homo sapiens
ugucagagcucaucgauau

SEQ ID NO: 977774 - RNA, 19 nt, Homo sapiens
caacaggcuucuuugcuaa

SEQ ID NO: 977775 - RNA, 19 nt, Homo sapiens
cacccuaucuugucaauaa

SEQ ID NO: 977776 - RNA, 19 nt, Homo sapiens
ggaggaugcugauauggaa

SEQ ID NO: 977777 - RNA, 19 nt, Homo sapiens
gaaggcgaguugaaggaua

SEQ ID NO: 977778 - RNA, 19 nt, Homo sapiens
ggaauacagucccuuguuc

SEQ ID NO: 977779 - RNA, 19 nt, Homo sapiens
gaacaacacagaguccuuu

SEQ ID NO: 977780 - RNA, 19 nt, Homo sapiens
ucaacaggcuucuuugcua

SEQ ID NO: 977781 - RNA, 19 nt, Homo sapiens
gaacuugauguaucuguaa

SEQ ID NO: 977782 - RNA, 19 nt, Homo sapiens
gaacgauuuccgccuaaua

SEQ ID NO: 977783 - RNA, 19 nt, Homo sapiens
ugaaggauauggaacaguu

SEQ ID NO: 977784 - RNA, 19 nt, Homo sapiens
ggaaucacagcucucaaua

SEQ ID NO: 977785 - RNA, 19 nt, Homo sapiens
gagaugagggugaaagaaa

SEQ ID NO: 977786 - RNA, 19 nt, Homo sapiens
guccacagcuggcaaauuc

SEQ ID NO: 977787 - RNA, 19 nt, Homo sapiens
ugauguaucuguaagagaa

SEQ ID NO: 977788 - RNA, 19 nt, Homo sapiens
cacacagucuccuccauua

SEQ ID NO: 977789 - RNA, 19 nt, Homo sapiens
gcacuugaaggaacgauuu

SEQ ID NO: 977790 - RNA, 19 nt, Homo sapiens
ucaauaaacagcauucuga

SEQ ID NO: 977791 - RNA, 19 nt, Homo sapiens
guacuuggccucugaaaca

SEQ ID NO: 977792 - RNA, 19 nt, Homo sapiens
gcauagaggguguuuauag

SEQ ID NO: 977793 - RNA, 19 nt, Homo sapiens
gaagaaggcaguacauuuu

SEQ ID NO: 977794 - RNA, 19 nt, Homo sapiens
ugaagaaggcaguacauuu

SEQ ID NO: 977795 - RNA, 19 nt, Homo sapiens
gcagaaggaauuaaacaau

SEQ ID NO: 977796 - RNA, 19 nt, Homo sapiens
aagaagaacuugauguauc

SEQ ID NO: 977797 - RNA, 19 nt, Homo sapiens
ucaaugaagccaagaacua

SEQ ID NO: 977798 - RNA, 19 nt, Homo sapiens
gcacauaagcuuuuacaaa

SEQ ID NO: 977799 - RNA, 19 nt, Homo sapiens
uaucucagcuacuuaaaca

SEQ ID NO: 977800 - RNA, 19 nt, Homo sapiens
gcugauggaugcccuaaag

SEQ ID NO: 977801 - RNA, 19 nt, Homo sapiens
gagauacgccgcucugaau

SEQ ID NO: 977802 - RNA, 19 nt, Homo sapiens
ucacagcucucaauagcau

SEQ ID NO: 977803 - RNA, 19 nt, Homo sapiens
caaguuaauugaagagucu

SEQ ID NO: 977804 - RNA, 19 nt, Homo sapiens
cagcaguacuuccagaaug

SEQ ID NO: 977805 - RNA, 19 nt, Homo sapiens
gagauccgauagcuauguu

SEQ ID NO: 977806 - RNA, 19 nt, Homo sapiens
cagaaauggugaucagugu

SEQ ID NO: 977807 - RNA, 19 nt, Homo sapiens
gggcagaagagauccgaua

SEQ ID NO: 977808 - RNA, 19 nt, Homo sapiens
ucagggacgucguuuacuu

SEQ ID NO: 977809 - RNA, 19 nt, Homo sapiens
ucauuuggcugauucacuu

SEQ ID NO: 977810 - RNA, 19 nt, Homo sapiens
ggaagacccaggagaggaa

SEQ ID NO: 977811 - RNA, 19 nt, Homo sapiens
caaaggucgugccauguuc

SEQ ID NO: 977812 - RNA, 19 nt, Homo sapiens
gagcuguacuggcgaucuu

SEQ ID NO: 977813 - RNA, 19 nt, Homo sapiens
cugcagggcccagauauua

SEQ ID NO: 977814 - RNA, 19 nt, Homo sapiens
acagucuccuccauuauuu

SEQ ID NO: 977815 - RNA, 19 nt, Homo sapiens
gccaaguguuuaaacugua

SEQ ID NO: 977816 - RNA, 19 nt, Homo sapiens
cuacuucaaucccaugaug

SEQ ID NO: 977817 - RNA, 19 nt, Homo sapiens
gcuaaagaaugaugagacu

SEQ ID NO: 977818 - RNA, 19 nt, Homo sapiens
uagcauagaggguguuuau

SEQ ID NO: 977819 - RNA, 19 nt, Homo sapiens
caaccuccguguccaagau

SEQ ID NO: 977820 - RNA, 19 nt, Homo sapiens
agaagaacuugauguaucu

SEQ ID NO: 977821 - RNA, 19 nt, Homo sapiens
acaguaagcuuucuuucag

SEQ ID NO: 977822 - RNA, 19 nt, Homo sapiens
uugaugaccuuucagauuc

SEQ ID NO: 977823 - RNA, 19 nt, Homo sapiens
uagaggguguuuauaggaa

SEQ ID NO: 977824 - RNA, 19 nt, Homo sapiens
caaugaaugauggcaaaua

SEQ ID NO: 977825 - RNA, 19 nt, Homo sapiens
gaauacagucccuuguuca

SEQ ID NO: 977826 - RNA, 19 nt, Homo sapiens
uguuugagcuggcuuuaug

SEQ ID NO: 977827 - RNA, 19 nt, Homo sapiens
gcaggaggcaauuaggauu

SEQ ID NO: 977828 - RNA, 19 nt, Homo sapiens
gaucuuggccuacaguaag

SEQ ID NO: 977829 - RNA, 19 nt, Homo sapiens
ggcaguacauuuuggguua

SEQ ID NO: 977830 - RNA, 19 nt, Homo sapiens
guccaacgaucacgugugu

SEQ ID NO: 977831 - RNA, 19 nt, Homo sapiens
agaacuugauguaucugua

SEQ ID NO: 977832 - RNA, 19 nt, Homo sapiens
caaauucagugcagaucag

SEQ ID NO: 977833 - RNA, 19 nt, Homo sapiens
caaugaagccaagaacuau

SEQ ID NO: 977834 - RNA, 19 nt, Homo sapiens
gcgcagcucauucuuggaa

SEQ ID NO: 977835 - RNA, 19 nt, Homo sapiens
gcaaauucagugcagauca

SEQ ID NO: 977836 - RNA, 19 nt, Homo sapiens
gaaggauauggaacaguuu

SEQ ID NO: 977837 - RNA, 19 nt, Homo sapiens
cauagaggguguuuauagg

SEQ ID NO: 977838 - RNA, 19 nt, Homo sapiens
aguuauggauguuauguga

SEQ ID NO: 977839 - RNA, 19 nt, Homo sapiens
acacagaaauggugaucag

SEQ ID NO: 977840 - RNA, 19 nt, Homo sapiens
gaacacagaaauggugauc

SEQ ID NO: 977841 - RNA, 19 nt, Homo sapiens
aaucacagcucucaauagc

SEQ ID NO: 977842 - RNA, 19 nt, Homo sapiens
gauaucagcaucgcacaga

SEQ ID NO: 977843 - RNA, 19 nt, Homo sapiens
cagaagagauccgauagcu

SEQ ID NO: 977844 - RNA, 19 nt, Homo sapiens
aaacugaagaacacagaaa

SEQ ID NO: 977845 - RNA, 19 nt, Homo sapiens
gaaacugaagaacacagaa

SEQ ID NO: 977846 - RNA, 19 nt, Homo sapiens
gcaucagggacgucguuua

SEQ ID NO: 977847 - RNA, 19 nt, Homo sapiens
uacaguacuuggccucuga

SEQ ID NO: 977848 - RNA, 19 nt, Homo sapiens
gaaucacagcucucaauag

SEQ ID NO: 977849 - RNA, 19 nt, Homo sapiens
gcccaguuauggauguuau

SEQ ID NO: 977850 - RNA, 19 nt, Homo sapiens
ggccggagcuugagauacg

SEQ ID NO: 977851 - RNA, 19 nt, Homo sapiens
uaccggagccgaaagcaaa

SEQ ID NO: 977852 - RNA, 19 nt, Homo sapiens
caaaacaaguguaguaggu

SEQ ID NO: 977853 - RNA, 19 nt, Homo sapiens
gaacuauuuugcaaagguu

SEQ ID NO: 977854 - RNA, 19 nt, Homo sapiens
cugaaacagugcugaacuu

SEQ ID NO: 977855 - RNA, 19 nt, Homo sapiens
ccgcuucggucacuaucaa

SEQ ID NO: 977856 - RNA, 19 nt, Homo sapiens
cgcauuaucucagcuacuu

SEQ ID NO: 977857 - RNA, 19 nt, Homo sapiens
gggcuauccuggacaaagg

SEQ ID NO: 977858 - RNA, 19 nt, Homo sapiens
gauuuccgccuaauaguca

SEQ ID NO: 977859 - RNA, 19 nt, Homo sapiens
cacagucuccuccauuauu

SEQ ID NO: 977860 - RNA, 19 nt, Homo sapiens
ucaaucccaugaugaccaa

SEQ ID NO: 977861 - RNA, 19 nt, Homo sapiens
ucacaaaacaaguguagua

SEQ ID NO: 977862 - RNA, 19 nt, Homo sapiens
guugguucauugucagaaa

SEQ ID NO: 977863 - RNA, 19 nt, Homo sapiens
cauuaucucagcuacuuaa

SEQ ID NO: 977864 - RNA, 19 nt, Homo sapiens
caguagagaugagggugaa

SEQ ID NO: 977865 - RNA, 19 nt, Homo sapiens
acaaaggucgugccauguu

SEQ ID NO: 977866 - RNA, 19 nt, Homo sapiens
gcagggcccagauauuaca

SEQ ID NO: 977867 - RNA, 19 nt, Homo sapiens
uuugaucgucugauucuua

SEQ ID NO: 977868 - RNA, 19 nt, Homo sapiens
caagaacuauuuugcaaag

SEQ ID NO: 977869 - RNA, 19 nt, Homo sapiens
ccaucgagaaccucaauga

SEQ ID NO: 977870 - RNA, 19 nt, Homo sapiens
gaagaaagcgcuaaguaaa

SEQ ID NO: 977871 - RNA, 19 nt, Homo sapiens
gcacagacccuuacccuuu

SEQ ID NO: 977872 - RNA, 19 nt, Homo sapiens
gcagagaacagaaauauga

SEQ ID NO: 977873 - RNA, 19 nt, Homo sapiens
gaacagaaauaugaagaug

SEQ ID NO: 977874 - RNA, 19 nt, Homo sapiens
ggaaugcugugaguaagua

SEQ ID NO: 977875 - RNA, 19 nt, Homo sapiens
gcucgcaccuugucgcuua

SEQ ID NO: 977876 - RNA, 19 nt, Homo sapiens
ggaacgcacuggcuaauca

SEQ ID NO: 977877 - RNA, 19 nt, Homo sapiens
gguaauggcuaacaacguu

SEQ ID NO: 977878 - RNA, 19 nt, Homo sapiens
acaaagaacucccaaaaua

SEQ ID NO: 977879 - RNA, 19 nt, Homo sapiens
gcaauggaccaguauagua

SEQ ID NO: 977880 - RNA, 19 nt, Homo sapiens
gagauaacguggaccuauu

SEQ ID NO: 977881 - RNA, 19 nt, Homo sapiens
ggagaaagccaaaacauua

SEQ ID NO: 977882 - RNA, 19 nt, Homo sapiens
cagauucucucuuucauga

SEQ ID NO: 977883 - RNA, 19 nt, Homo sapiens
ggauguauauggcuaccua

SEQ ID NO: 977884 - RNA, 19 nt, Homo sapiens
uggcaaaccuguacaagaa

SEQ ID NO: 977885 - RNA, 19 nt, Homo sapiens
gauucucucuuucaugaua

SEQ ID NO: 977886 - RNA, 19 nt, Homo sapiens
gcaaaugcacagacccuua

SEQ ID NO: 977887 - RNA, 19 nt, Homo sapiens
caaaauggcugaauguuau

SEQ ID NO: 977888 - RNA, 19 nt, Homo sapiens
cucagcagcuuguuacuua

SEQ ID NO: 977889 - RNA, 19 nt, Homo sapiens
guaaguauaccauggcuuu

SEQ ID NO: 977890 - RNA, 19 nt, Homo sapiens
gauaaagcccugacccaaa

SEQ ID NO: 977891 - RNA, 19 nt, Homo sapiens
gcacacuggugacaacuca

SEQ ID NO: 977892 - RNA, 19 nt, Homo sapiens
cuucagagcuggagacaau

SEQ ID NO: 977893 - RNA, 19 nt, Homo sapiens
ucgcuuagauuguuaugaa

SEQ ID NO: 977894 - RNA, 19 nt, Homo sapiens
caucugaaauugaagugaa

SEQ ID NO: 977895 - RNA, 19 nt, Homo sapiens
ucaugcagauucucucuuu

SEQ ID NO: 977896 - RNA, 19 nt, Homo sapiens
gaacaugggcagaguccaa

SEQ ID NO: 977897 - RNA, 19 nt, Homo sapiens
ggugacaacucaagagcaa

SEQ ID NO: 977898 - RNA, 19 nt, Homo sapiens
caaaggccagauuacauua

SEQ ID NO: 977899 - RNA, 19 nt, Homo sapiens
cagaagaaagcgcuaagua

SEQ ID NO: 977900 - RNA, 19 nt, Homo sapiens
gaauugcuuugcugaggaa

SEQ ID NO: 977901 - RNA, 19 nt, Homo sapiens
acagaaauaugaagaugga

SEQ ID NO: 977902 - RNA, 19 nt, Homo sapiens
ccaaaggccagauuacauu

SEQ ID NO: 977903 - RNA, 19 nt, Homo sapiens
gagcagcacuuaggaacau

SEQ ID NO: 977904 - RNA, 19 nt, Homo sapiens
uaaagaugccauugcuaua

SEQ ID NO: 977905 - RNA, 19 nt, Homo sapiens
ugucacagcuucuauagca

SEQ ID NO: 977906 - RNA, 19 nt, Homo sapiens
caauaucucugaucagcau

SEQ ID NO: 977907 - RNA, 19 nt, Homo sapiens
gauguuggaucuuuaucug

SEQ ID NO: 977908 - RNA, 19 nt, Homo sapiens
gggcagagguggcauccau

SEQ ID NO: 977909 - RNA, 19 nt, Homo sapiens
agaagaaagcgcuaaguaa

SEQ ID NO: 977910 - RNA, 19 nt, Homo sapiens
ccucagaaguaccagcuuu

SEQ ID NO: 977911 - RNA, 19 nt, Homo sapiens
cauuaaggcuguggugaaa

SEQ ID NO: 977912 - RNA, 19 nt, Homo sapiens
uaaacaugaugcuggcaaa

SEQ ID NO: 977913 - RNA, 19 nt, Homo sapiens
gagaacagaaauaugaaga

SEQ ID NO: 977914 - RNA, 19 nt, Homo sapiens
caaagucagugucuuccau

SEQ ID NO: 977915 - RNA, 19 nt, Homo sapiens
uuaugaaggucuuaucgaa

SEQ ID NO: 977916 - RNA, 19 nt, Homo sapiens
guucaagcucugcuacuua

SEQ ID NO: 977917 - RNA, 19 nt, Homo sapiens
caauggaccaguauaguau

SEQ ID NO: 977918 - RNA, 19 nt, Homo sapiens
guaauaacaacccugaguu

SEQ ID NO: 977919 - RNA, 19 nt, Homo sapiens
gaagugaaauacaaaaugg

SEQ ID NO: 977920 - RNA, 19 nt, Homo sapiens
caacaguauucgagaagca

SEQ ID NO: 977921 - RNA, 19 nt, Homo sapiens
gcagagguggcauccauga

SEQ ID NO: 977922 - RNA, 19 nt, Homo sapiens
gcuagaggauguugagaac

SEQ ID NO: 977923 - RNA, 19 nt, Homo sapiens
caaugaaugugauccaaac

SEQ ID NO: 977924 - RNA, 19 nt, Homo sapiens
gacaaugaaugugauccaa

SEQ ID NO: 977925 - RNA, 19 nt, Homo sapiens
caaagaacucccaaaauaa

SEQ ID NO: 977926 - RNA, 19 nt, Homo sapiens
ccacaaagucagugucuuc

SEQ ID NO: 977927 - RNA, 19 nt, Homo sapiens
gagguggcauccaugacaa

SEQ ID NO: 977928 - RNA, 19 nt, Homo sapiens
gauaaagaugccauugcua

SEQ ID NO: 977929 - RNA, 19 nt, Homo sapiens
uagcagagaacagaaauau

SEQ ID NO: 977930 - RNA, 19 nt, Homo sapiens
aagcaaugguaauggcuaa

SEQ ID NO: 977931 - RNA, 19 nt, Homo sapiens
uuacuuagccuccaacagu

SEQ ID NO: 977932 - RNA, 19 nt, Homo sapiens
gaagcaauaauccacuuuc

SEQ ID NO: 977933 - RNA, 19 nt, Homo sapiens
uucaagcucugcuacuuaa

SEQ ID NO: 977934 - RNA, 19 nt, Homo sapiens
cagcugaacaguaauagug

SEQ ID NO: 977935 - RNA, 19 nt, Homo sapiens
uggcauccaugacaaugaa

SEQ ID NO: 977936 - RNA, 19 nt, Homo sapiens
ugcagaagauggagaagga

SEQ ID NO: 977937 - RNA, 19 nt, Homo sapiens
auaaagcccugacccaaag

SEQ ID NO: 977938 - RNA, 19 nt, Homo sapiens
gcccuucagucaccagcua

SEQ ID NO: 977939 - RNA, 19 nt, Homo sapiens
gggaucccuucaagacaaa

SEQ ID NO: 977940 - RNA, 19 nt, Homo sapiens
ggcugaauguuauacaaug

SEQ ID NO: 977941 - RNA, 19 nt, Homo sapiens
caucggauccuaggagauu

SEQ ID NO: 977942 - RNA, 19 nt, Homo sapiens
caaugguaauggcuaacaa

SEQ ID NO: 977943 - RNA, 19 nt, Homo sapiens
augaaggucuuaucgaaug

SEQ ID NO: 977944 - RNA, 19 nt, Homo sapiens
gcaaucaguaccaucuguu

SEQ ID NO: 977945 - RNA, 19 nt, Homo sapiens
aaagugagaccuucaacug

SEQ ID NO: 977946 - RNA, 19 nt, Homo sapiens
cagaguccaagaagcaaua

SEQ ID NO: 977947 - RNA, 19 nt, Homo sapiens
gggcagaguccaagaagca

SEQ ID NO: 977948 - RNA, 19 nt, Homo sapiens
ccaaugaccagaagucucu

SEQ ID NO: 977949 - RNA, 19 nt, Homo sapiens
guauagcacuaaguuugga

SEQ ID NO: 977950 - RNA, 19 nt, Homo sapiens
cuacuuagcagagaacaga

SEQ ID NO: 977951 - RNA, 19 nt, Homo sapiens
uaauggcuaacaacguuua

SEQ ID NO: 977952 - RNA, 19 nt, Homo sapiens
gaauaucggaaugcuguga

SEQ ID NO: 977953 - RNA, 19 nt, Homo sapiens
auaaagaugccauugcuau

SEQ ID NO: 977954 - RNA, 19 nt, Homo sapiens
ugacccaaaggccagauua

SEQ ID NO: 977955 - RNA, 19 nt, Homo sapiens
aaggucuuaucgaauguua

SEQ ID NO: 977956 - RNA, 19 nt, Homo sapiens
gcaccuugucgcuuagauu

SEQ ID NO: 977957 - RNA, 19 nt, Homo sapiens
ucacagcuucuauagcaaa

SEQ ID NO: 977958 - RNA, 19 nt, Homo sapiens
aaccuuggaugccgccuuu

SEQ ID NO: 977959 - RNA, 19 nt, Homo sapiens
uggcagaucuguacuucag

SEQ ID NO: 977960 - RNA, 19 nt, Homo sapiens
caagagcaaucaguaccau

SEQ ID NO: 977961 - RNA, 19 nt, Homo sapiens
ugggaucccuucaagacaa

SEQ ID NO: 977962 - RNA, 19 nt, Homo sapiens
caagauaaagaugccauug

SEQ ID NO: 977963 - RNA, 19 nt, Homo sapiens
ugucuuccaucugaaauug

SEQ ID NO: 977964 - RNA, 19 nt, Homo sapiens
ggaugcagaagauggagaa

SEQ ID NO: 977965 - RNA, 19 nt, Homo sapiens
gcuccucagcagcuuguua

SEQ ID NO: 977966 - RNA, 19 nt, Homo sapiens
ucagagcuggagacaauaa

SEQ ID NO: 977967 - RNA, 19 nt, Homo sapiens
gaugggaucccuucaagac

SEQ ID NO: 977968 - RNA, 19 nt, Homo sapiens
gugagaccuucaacuggaa

SEQ ID NO: 977969 - RNA, 19 nt, Homo sapiens
gcagauucucucuuucaug

SEQ ID NO: 977970 - RNA, 19 nt, Homo sapiens
ggagaugccuugugcguua

SEQ ID NO: 977971 - RNA, 19 nt, Homo sapiens
gcacacacaugcacacaua

SEQ ID NO: 977972 - RNA, 19 nt, Homo sapiens
gaagagaccaugaaaguga

SEQ ID NO: 977973 - RNA, 19 nt, Homo sapiens
gauaauaccauucugcaua

SEQ ID NO: 977974 - RNA, 19 nt, Homo sapiens
gcacacaaacacauauaua

SEQ ID NO: 977975 - RNA, 19 nt, Homo sapiens
gcacacggcucuccugauc

SEQ ID NO: 977976 - RNA, 19 nt, Homo sapiens
ggagaaauccuucgcaaug

SEQ ID NO: 977977 - RNA, 19 nt, Homo sapiens
ggaagggccuggacacuca

SEQ ID NO: 977978 - RNA, 19 nt, Homo sapiens
acacacacaugcacacaua

SEQ ID NO: 977979 - RNA, 19 nt, Homo sapiens
acacaugcaugcacacaua

SEQ ID NO: 977980 - RNA, 19 nt, Homo sapiens
acacacacaugcacacaua

SEQ ID NO: 977981 - RNA, 19 nt, Homo sapiens
acacaugcaugcacacaua

SEQ ID NO: 977982 - RNA, 19 nt, Homo sapiens
gaaccuaucuuugcacaca

SEQ ID NO: 977983 - RNA, 19 nt, Homo sapiens
cugagaaguucaacauuua

SEQ ID NO: 977984 - RNA, 19 nt, Homo sapiens
gaagagaacaugcaugauc

SEQ ID NO: 977985 - RNA, 19 nt, Homo sapiens
ccugagaaguucaacauuu

SEQ ID NO: 977986 - RNA, 19 nt, Homo sapiens
ggaggaaggucucacaucu

SEQ ID NO: 977987 - RNA, 19 nt, Homo sapiens
uaacucuccuguccacaua

SEQ ID NO: 977988 - RNA, 19 nt, Homo sapiens
gaaauuggcaccaucuuca

SEQ ID NO: 977989 - RNA, 19 nt, Homo sapiens
gaacaugcaugaucuucag

SEQ ID NO: 977990 - RNA, 19 nt, Homo sapiens
cgaaagcccugaacaacug

SEQ ID NO: 977991 - RNA, 19 nt, Homo sapiens
auacaugcaugcacacaua

SEQ ID NO: 977992 - RNA, 19 nt, Homo sapiens
gcacacauacacaggcaua

SEQ ID NO: 977993 - RNA, 19 nt, Homo sapiens
acacgcacaugcacacaua

SEQ ID NO: 977994 - RNA, 19 nt, Homo sapiens
gagaaauccuucgcaaugu

SEQ ID NO: 977995 - RNA, 19 nt, Homo sapiens
gcacaggcacacacaugua

SEQ ID NO: 977996 - RNA, 19 nt, Homo sapiens
gagaggcggucaagaacau

SEQ ID NO: 977997 - RNA, 19 nt, Homo sapiens
gagcaugcacgaccuggua

SEQ ID NO: 977998 - RNA, 19 nt, Homo sapiens
ccuguuggcuacacucuaa

SEQ ID NO: 977999 - RNA, 19 nt, Homo sapiens
acauacacgugcacacaua

SEQ ID NO: 978000 - RNA, 19 nt, Homo sapiens
ggacacacagcauggagaa

SEQ ID NO: 978001 - RNA, 19 nt, Homo sapiens
ccacgaggcugacauucuc

SEQ ID NO: 978002 - RNA, 19 nt, Homo sapiens
ccagaaagccucaccuaca

SEQ ID NO: 978003 - RNA, 19 nt, Homo sapiens
ggagcagccuggaaggaau

SEQ ID NO: 978004 - RNA, 19 nt, Homo sapiens
acauauccaugcacacaaa

SEQ ID NO: 978005 - RNA, 19 nt, Homo sapiens
acacauguaugcacacaca

SEQ ID NO: 978006 - RNA, 19 nt, Homo sapiens
cagcugugguccucugauu

SEQ ID NO: 978007 - RNA, 19 nt, Homo sapiens
acacauauauacacaugca

SEQ ID NO: 978008 - RNA, 19 nt, Homo sapiens
cagaaagccucaccuacag

SEQ ID NO: 978009 - RNA, 19 nt, Homo sapiens
gaacuacacacggcucuuc

SEQ ID NO: 978010 - RNA, 19 nt, Homo sapiens
gacauucucuggccuugca

SEQ ID NO: 978011 - RNA, 19 nt, Homo sapiens
acacacaugcacacauaua

SEQ ID NO: 978012 - RNA, 19 nt, Homo sapiens
caucggugcggauucuuua

SEQ ID NO: 978013 - RNA, 19 nt, Homo sapiens
acacaugcaugcacacaca

SEQ ID NO: 978014 - RNA, 19 nt, Homo sapiens
ggaccaagaggauucaaag

SEQ ID NO: 978015 - RNA, 19 nt, Homo sapiens
gaaauccuucgcaauguca

SEQ ID NO: 978016 - RNA, 19 nt, Homo sapiens
gaaggucucacaucugucu

SEQ ID NO: 978017 - RNA, 19 nt, Homo sapiens
cacaugcaccgcacacaua

SEQ ID NO: 978018 - RNA, 19 nt, Homo sapiens
gcacaugcacacauacaca

SEQ ID NO: 978019 - RNA, 19 nt, Homo sapiens
aggaaggucucacaucugu

SEQ ID NO: 978020 - RNA, 19 nt, Homo sapiens
cauagugacugugccauag

SEQ ID NO: 978021 - RNA, 19 nt, Homo sapiens
ugacccagucuauuuauga

SEQ ID NO: 978022 - RNA, 19 nt, Homo sapiens
ggucucacaucugucuuug

SEQ ID NO: 978023 - RNA, 19 nt, Homo sapiens
guguuggccucucugguuu

SEQ ID NO: 978024 - RNA, 19 nt, Homo sapiens
ggaagagaccaugaaagug

SEQ ID NO: 978025 - RNA, 19 nt, Homo sapiens
ccucagggccucagggaaa

SEQ ID NO: 978026 - RNA, 19 nt, Homo sapiens
aggaggagcuggagggaau

SEQ ID NO: 978027 - RNA, 19 nt, Homo sapiens
auaauaccauucugcauag

SEQ ID NO: 978028 - RNA, 19 nt, Homo sapiens
ccacauaugauaauaccau

SEQ ID NO: 978029 - RNA, 19 nt, Homo sapiens
ggaccuggcaaccacaaga

SEQ ID NO: 978030 - RNA, 19 nt, Homo sapiens
gcagagccacugucacaca

SEQ ID NO: 978031 - RNA, 19 nt, Homo sapiens
ugaaggcaguggacacaca

SEQ ID NO: 978032 - RNA, 19 nt, Homo sapiens
ucuacuaccugaacaaguc

SEQ ID NO: 978033 - RNA, 19 nt, Homo sapiens
aagagaacaugcaugaucu

SEQ ID NO: 978034 - RNA, 19 nt, Homo sapiens
uggauaacaucucguccuu

SEQ ID NO: 978035 - RNA, 19 nt, Homo sapiens
aagguuagggcauagauuu

SEQ ID NO: 978036 - RNA, 19 nt, Homo sapiens
guccggaaccucuccauga

SEQ ID NO: 978037 - RNA, 19 nt, Homo sapiens
ccgaggagcucuacuaccu

SEQ ID NO: 978038 - RNA, 19 nt, Homo sapiens
cugaacaacugcucuuucu

SEQ ID NO: 978039 - RNA, 19 nt, Homo sapiens
ccauagugacugugccaua

SEQ ID NO: 978040 - RNA, 19 nt, Homo sapiens
acgaagagaacaugcauga

SEQ ID NO: 978041 - RNA, 19 nt, Homo sapiens
gccuggaccucucucugaa

SEQ ID NO: 978042 - RNA, 19 nt, Homo sapiens
ggccuggaccucucucuga

SEQ ID NO: 978043 - RNA, 19 nt, Homo sapiens
ggaauccaagcaggaguuu

SEQ ID NO: 978044 - RNA, 19 nt, Homo sapiens
gcacacauacacgcacaug

SEQ ID NO: 978045 - RNA, 19 nt, Homo sapiens
ggcaccaucuucaccaaca

SEQ ID NO: 978046 - RNA, 19 nt, Homo sapiens
aggaagagaccaugaaagu

SEQ ID NO: 978047 - RNA, 19 nt, Homo sapiens
gcggauucuuuaccucuuc

SEQ ID NO: 978048 - RNA, 19 nt, Homo sapiens
gagcucuacuaccugaaca

SEQ ID NO: 978049 - RNA, 19 nt, Homo sapiens
gagcuggagggaauucaga

SEQ ID NO: 978050 - RNA, 19 nt, Homo sapiens
ccacaagacccuccccaua

SEQ ID NO: 978051 - RNA, 19 nt, Homo sapiens
agaaauccuucgcaauguc

SEQ ID NO: 978052 - RNA, 19 nt, Homo sapiens
ggauccagcggaagacaga

SEQ ID NO: 978053 - RNA, 19 nt, Homo sapiens
ggagugcuacgaugucaag

SEQ ID NO: 978054 - RNA, 19 nt, Homo sapiens
ggcauagauuugucuccuu

SEQ ID NO: 978055 - RNA, 19 nt, Homo sapiens
acacaucggugcggauucu

SEQ ID NO: 978056 - RNA, 19 nt, Homo sapiens
gaggacagccaggcccaaa

SEQ ID NO: 978057 - RNA, 19 nt, Homo sapiens
gcacagcaugcucaaguac

SEQ ID NO: 978058 - RNA, 19 nt, Homo sapiens
caucuucaccaacaucaau

SEQ ID NO: 978059 - RNA, 19 nt, Homo sapiens
gcacuguggagagguuuga

SEQ ID NO: 978060 - RNA, 19 nt, Homo sapiens
ugcaugaucuucaguacca

SEQ ID NO: 978061 - RNA, 19 nt, Homo sapiens
ggagaggcggucaagaaca

SEQ ID NO: 978062 - RNA, 19 nt, Homo sapiens
uggacucucucuccgaaga

SEQ ID NO: 978063 - RNA, 19 nt, Homo sapiens
ccgaagacaucuccuugac

SEQ ID NO: 978064 - RNA, 19 nt, Homo sapiens
ggagugguagggaggauca

SEQ ID NO: 978065 - RNA, 19 nt, Homo sapiens
ccaugcacacaaacacaua

SEQ ID NO: 978066 - RNA, 19 nt, Homo sapiens
gguccucugauuccaauga

SEQ ID NO: 978067 - RNA, 19 nt, Homo sapiens
gugcacagcaugcucaagu

SEQ ID NO: 978068 - RNA, 19 nt, Homo sapiens
gcaccaucuucaccaacau

SEQ ID NO: 978069 - RNA, 19 nt, Homo sapiens
gagaacaugcaugaucuuc

SEQ ID NO: 978070 - RNA, 19 nt, Homo sapiens
ggaaauaccuucucccuua

SEQ ID NO: 978071 - RNA, 19 nt, Homo sapiens
gcacauguauugcucuuua

SEQ ID NO: 978072 - RNA, 19 nt, Homo sapiens
gagaacagccuccugauua

SEQ ID NO: 978073 - RNA, 19 nt, Homo sapiens
guacaaggaugcuuugaaa

SEQ ID NO: 978074 - RNA, 19 nt, Homo sapiens
gaagaaaguacuagaguuu

SEQ ID NO: 978075 - RNA, 19 nt, Homo sapiens
gaagaaaguagcagaaauu

SEQ ID NO: 978076 - RNA, 19 nt, Homo sapiens
guaguuagcuucagagugu

SEQ ID NO: 978077 - RNA, 19 nt, Homo sapiens
gaacagggcaguuuagguu

SEQ ID NO: 978078 - RNA, 19 nt, Homo sapiens
cuagggagcuccucacuaa

SEQ ID NO: 978079 - RNA, 19 nt, Homo sapiens
gaaauaccuucucccuuau

SEQ ID NO: 978080 - RNA, 19 nt, Homo sapiens
guacugcgcugccgugaga

SEQ ID NO: 978081 - RNA, 19 nt, Homo sapiens
caagagagcccgugaguuc

SEQ ID NO: 978082 - RNA, 19 nt, Homo sapiens
gaaggguggucaguaguuu

SEQ ID NO: 978083 - RNA, 19 nt, Homo sapiens
cagaaagcaucaagaagaa

SEQ ID NO: 978084 - RNA, 19 nt, Homo sapiens
ccacaguucuccuccauau

SEQ ID NO: 978085 - RNA, 19 nt, Homo sapiens
ggugugauaccaaaucuua

SEQ ID NO: 978086 - RNA, 19 nt, Homo sapiens
gcagguaguuagcuucaga

SEQ ID NO: 978087 - RNA, 19 nt, Homo sapiens
acaguucuccuccauauua

SEQ ID NO: 978088 - RNA, 19 nt, Homo sapiens
gcaguuaaauaguggaaca

SEQ ID NO: 978089 - RNA, 19 nt, Homo sapiens
guaacaggguaguguggua

SEQ ID NO: 978090 - RNA, 19 nt, Homo sapiens
gaauauuagucgcacaugu

SEQ ID NO: 978091 - RNA, 19 nt, Homo sapiens
gacauuaccuggaguaucg

SEQ ID NO: 978092 - RNA, 19 nt, Homo sapiens
ucagaaagcaucaagaaga

SEQ ID NO: 978093 - RNA, 19 nt, Homo sapiens
uugcuuagcuuguugaaga

SEQ ID NO: 978094 - RNA, 19 nt, Homo sapiens
gcuucagaguguuaauuua

SEQ ID NO: 978095 - RNA, 19 nt, Homo sapiens
ggagggagcacuucgucua

SEQ ID NO: 978096 - RNA, 19 nt, Homo sapiens
ucacauauacacuagauga

SEQ ID NO: 978097 - RNA, 19 nt, Homo sapiens
ugaagaaaguagcagaaau

SEQ ID NO: 978098 - RNA, 19 nt, Homo sapiens
ugagugugaucuucauaaa

SEQ ID NO: 978099 - RNA, 19 nt, Homo sapiens
gaacagccuccugauuauu

SEQ ID NO: 978100 - RNA, 19 nt, Homo sapiens
ugggugauguagagauuua

SEQ ID NO: 978101 - RNA, 19 nt, Homo sapiens
agaagaaaguacuagaguu

SEQ ID NO: 978102 - RNA, 19 nt, Homo sapiens
aaagaaagccccacuaaaa

SEQ ID NO: 978103 - RNA, 19 nt, Homo sapiens
ugagugaagucuaggauag

SEQ ID NO: 978104 - RNA, 19 nt, Homo sapiens
ugaguccucuuucacauau

SEQ ID NO: 978105 - RNA, 19 nt, Homo sapiens
gcauuucugucccauaugg

SEQ ID NO: 978106 - RNA, 19 nt, Homo sapiens
gagcuccucacuaaaguuu

SEQ ID NO: 978107 - RNA, 19 nt, Homo sapiens
gguuuaagaguaacaguuu

SEQ ID NO: 978108 - RNA, 19 nt, Homo sapiens
agaacagccuccugauuau

SEQ ID NO: 978109 - RNA, 19 nt, Homo sapiens
caguaggccucaccgauga

SEQ ID NO: 978110 - RNA, 19 nt, Homo sapiens
gacagugaguccucuuuca

SEQ ID NO: 978111 - RNA, 19 nt, Homo sapiens
caauugauaccgcagauga

SEQ ID NO: 978112 - RNA, 19 nt, Homo sapiens
gaaagcaucaagaagaaag

SEQ ID NO: 978113 - RNA, 19 nt, Homo sapiens
ggugcccucuggugugaua

SEQ ID NO: 978114 - RNA, 19 nt, Homo sapiens
cacauccucuucucugauu

SEQ ID NO: 978115 - RNA, 19 nt, Homo sapiens
ccauaugggugauguagag

SEQ ID NO: 978116 - RNA, 19 nt, Homo sapiens
ccaagagcccauucagaaa

SEQ ID NO: 978117 - RNA, 19 nt, Homo sapiens
gguggucaguaguuucauu

SEQ ID NO: 978118 - RNA, 19 nt, Homo sapiens
uguagagauuuaccuguuu

SEQ ID NO: 978119 - RNA, 19 nt, Homo sapiens
gaaagauguggaagagaga

SEQ ID NO: 978120 - RNA, 19 nt, Homo sapiens
aauauuagucgcacaugua

SEQ ID NO: 978121 - RNA, 19 nt, Homo sapiens
guaguguucuuugcauuuc

SEQ ID NO: 978122 - RNA, 19 nt, Homo sapiens
agauuacuuuccugugaua

SEQ ID NO: 978123 - RNA, 19 nt, Homo sapiens
uccaagagcccauucagaa

SEQ ID NO: 978124 - RNA, 19 nt, Homo sapiens
aacagccuccugauuauua

SEQ ID NO: 978125 - RNA, 19 nt, Homo sapiens
cgacggccaucuugggaau

SEQ ID NO: 978126 - RNA, 19 nt, Homo sapiens
uaugggugauguagagauu

SEQ ID NO: 978127 - RNA, 19 nt, Homo sapiens
guccaggccacaauugaua

SEQ ID NO: 978128 - RNA, 19 nt, Homo sapiens
cgagaacagccuccugauu

SEQ ID NO: 978129 - RNA, 19 nt, Homo sapiens
caucauccauaucccuguu

SEQ ID NO: 978130 - RNA, 19 nt, Homo sapiens
ugagggcccugaggaagaa

SEQ ID NO: 978131 - RNA, 19 nt, Homo sapiens
acucagcaguuaaauagug

SEQ ID NO: 978132 - RNA, 19 nt, Homo sapiens
ugacggaucggaggcauuu

SEQ ID NO: 978133 - RNA, 19 nt, Homo sapiens
ggaccucccaccauagaga

SEQ ID NO: 978134 - RNA, 19 nt, Homo sapiens
uaaaagaaagccccacuaa

SEQ ID NO: 978135 - RNA, 19 nt, Homo sapiens
gcaguuuagguucuaggua

SEQ ID NO: 978136 - RNA, 19 nt, Homo sapiens
uuagaagacuggguagaug

SEQ ID NO: 978137 - RNA, 19 nt, Homo sapiens
gagaguccaggccacaauu

SEQ ID NO: 978138 - RNA, 19 nt, Homo sapiens
gguacaaggaugcuuugaa

SEQ ID NO: 978139 - RNA, 19 nt, Homo sapiens
caagagcccauucagaaag

SEQ ID NO: 978140 - RNA, 19 nt, Homo sapiens
gucaucaaguacaaagauu

SEQ ID NO: 978141 - RNA, 19 nt, Homo sapiens
ggaggcgcgaaucaaguua

SEQ ID NO: 978142 - RNA, 19 nt, Homo sapiens
guagagauuuaccuguuuu

SEQ ID NO: 978143 - RNA, 19 nt, Homo sapiens
uugcauuucugucccauau

SEQ ID NO: 978144 - RNA, 19 nt, Homo sapiens
caucaagaagaaaguacua

SEQ ID NO: 978145 - RNA, 19 nt, Homo sapiens
ggaagugcugaaugcagua

SEQ ID NO: 978146 - RNA, 19 nt, Homo sapiens
gucaaggccuguuggaucu

SEQ ID NO: 978147 - RNA, 19 nt, Homo sapiens
gaaagccucagugucaugu

SEQ ID NO: 978148 - RNA, 19 nt, Homo sapiens
agugaaagccucaguguca

SEQ ID NO: 978149 - RNA, 19 nt, Homo sapiens
uagccaagcugaacaacac

SEQ ID NO: 978150 - RNA, 19 nt, Homo sapiens
gggagcuccucacuaaagu

SEQ ID NO: 978151 - RNA, 19 nt, Homo sapiens
gggagcacuucgucuaugg

SEQ ID NO: 978152 - RNA, 19 nt, Homo sapiens
gaagcagaggagccuguaa

SEQ ID NO: 978153 - RNA, 19 nt, Homo sapiens
ucaguaguuucauuuccuu

SEQ ID NO: 978154 - RNA, 19 nt, Homo sapiens
gcuccucacuaaaguuugg

SEQ ID NO: 978155 - RNA, 19 nt, Homo sapiens
gagggagcacuucgucuau

SEQ ID NO: 978156 - RNA, 19 nt, Homo sapiens
agugugaucuucauaaagg

SEQ ID NO: 978157 - RNA, 19 nt, Homo sapiens
gaccacuucuguguguuug

SEQ ID NO: 978158 - RNA, 19 nt, Homo sapiens
ucaagaagaaaguacuaga

SEQ ID NO: 978159 - RNA, 19 nt, Homo sapiens
ccugaccacuucugugugu

SEQ ID NO: 978160 - RNA, 19 nt, Homo sapiens
guaguuucauuuccuuguc

SEQ ID NO: 978161 - RNA, 19 nt, Homo sapiens
ccuguuggaucucaucauc

SEQ ID NO: 978162 - RNA, 19 nt, Homo sapiens
caagaagaaaguacuagag

SEQ ID NO: 978163 - RNA, 19 nt, Homo sapiens
guuuaagaguaacaguuug

SEQ ID NO: 978164 - RNA, 19 nt, Homo sapiens
aauagcagguaguuagcuu

SEQ ID NO: 978165 - RNA, 19 nt, Homo sapiens
gcagaugaugccacuguca

SEQ ID NO: 978166 - RNA, 19 nt, Homo sapiens
ggacauuaccuggaguauc

SEQ ID NO: 978167 - RNA, 19 nt, Homo sapiens
gagagcccgugaguucaug

SEQ ID NO: 978168 - RNA, 19 nt, Homo sapiens
aggguagugugguauugua

SEQ ID NO: 978169 - RNA, 19 nt, Homo sapiens
cuaaaugcuuuuccuuuga

SEQ ID NO: 978170 - RNA, 19 nt, Homo sapiens
gaaauugucuuugguguuu

SEQ ID NO: 978171 - RNA, 19 nt, Homo sapiens
caacagauauucacauuug

SEQ ID NO: 978172 - RNA, 19 nt, Homo sapiens
ccaaagaacuuguccagaa

SEQ ID NO: 978173 - RNA, 19 nt, Homo sapiens
gagcuuugaucaagaauuu

SEQ ID NO: 978174 - RNA, 19 nt, Homo sapiens
gaaaugucccucaaucaua

SEQ ID NO: 978175 - RNA, 19 nt, Homo sapiens
gaacacaaauuggauaauc

SEQ ID NO: 978176 - RNA, 19 nt, Homo sapiens
ggaaugagaacacaaauug

SEQ ID NO: 978177 - RNA, 19 nt, Homo sapiens
gcaguuguuucuuugaaua

SEQ ID NO: 978178 - RNA, 19 nt, Homo sapiens
gcacauaucuauuaucacu

SEQ ID NO: 978179 - RNA, 19 nt, Homo sapiens
ccaagagucuguuucaauu

SEQ ID NO: 978180 - RNA, 19 nt, Homo sapiens
gcaguucccucucguaaug

SEQ ID NO: 978181 - RNA, 19 nt, Homo sapiens
ggauaaaguuccucauuuc

SEQ ID NO: 978182 - RNA, 19 nt, Homo sapiens
gaaaucaccuccaucaaac

SEQ ID NO: 978183 - RNA, 19 nt, Homo sapiens
gaugguggauuucuuuauu

SEQ ID NO: 978184 - RNA, 19 nt, Homo sapiens
gacaacagauauucacauu

SEQ ID NO: 978185 - RNA, 19 nt, Homo sapiens
acacagcacauaucuauua

SEQ ID NO: 978186 - RNA, 19 nt, Homo sapiens
gcaggugacuacucugaaa

SEQ ID NO: 978187 - RNA, 19 nt, Homo sapiens
ucgaacagcuuaugacauu

SEQ ID NO: 978188 - RNA, 19 nt, Homo sapiens
agaaauagaugaagacaca

SEQ ID NO: 978189 - RNA, 19 nt, Homo sapiens
uggcagagaugguggauuu

SEQ ID NO: 978190 - RNA, 19 nt, Homo sapiens
cagcacauaucuauuauca

SEQ ID NO: 978191 - RNA, 19 nt, Homo sapiens
gaaaguugucuucauugua

SEQ ID NO: 978192 - RNA, 19 nt, Homo sapiens
gcauaaguauuucuagcaa

SEQ ID NO: 978193 - RNA, 19 nt, Homo sapiens
gcacucaccuuccgauuuu

SEQ ID NO: 978194 - RNA, 19 nt, Homo sapiens
uuacguaacuuggcacuuu

SEQ ID NO: 978195 - RNA, 19 nt, Homo sapiens
uggauaaaguuccucauuu

SEQ ID NO: 978196 - RNA, 19 nt, Homo sapiens
aaacacagcacauaucuau

SEQ ID NO: 978197 - RNA, 19 nt, Homo sapiens
gaagaaaguauuagugcuu

SEQ ID NO: 978198 - RNA, 19 nt, Homo sapiens
aaggauaucucuaaguuug

SEQ ID NO: 978199 - RNA, 19 nt, Homo sapiens
gaauaugccuaaauaacag

SEQ ID NO: 978200 - RNA, 19 nt, Homo sapiens
ccaguuagcugugcugaga

SEQ ID NO: 978201 - RNA, 19 nt, Homo sapiens
gaaauguuacgcaaaguga

SEQ ID NO: 978202 - RNA, 19 nt, Homo sapiens
gcaggcagagaauauguua

SEQ ID NO: 978203 - RNA, 19 nt, Homo sapiens
gcaguucccuuaccugaag

SEQ ID NO: 978204 - RNA, 19 nt, Homo sapiens
ggagggaaacggagcagua

SEQ ID NO: 978205 - RNA, 19 nt, Homo sapiens
accauugucuuaagcauua

SEQ ID NO: 978206 - RNA, 19 nt, Homo sapiens
gugcugagauauaccugua

SEQ ID NO: 978207 - RNA, 19 nt, Homo sapiens
caaagaacuuguccagaag

SEQ ID NO: 978208 - RNA, 19 nt, Homo sapiens
aaaccagaauuggcaguua

SEQ ID NO: 978209 - RNA, 19 nt, Homo sapiens
ucacauacuacuuuccuua

SEQ ID NO: 978210 - RNA, 19 nt, Homo sapiens
aaaugucccucaaucauau

SEQ ID NO: 978211 - RNA, 19 nt, Homo sapiens
cagcaugaagaaaguauua

SEQ ID NO: 978212 - RNA, 19 nt, Homo sapiens
agaaaucaccuccaucaaa

SEQ ID NO: 978213 - RNA, 19 nt, Homo sapiens
ucacuugucaguaucauaa

SEQ ID NO: 978214 - RNA, 19 nt, Homo sapiens
uaauuuaggcgucuagaaa

SEQ ID NO: 978215 - RNA, 19 nt, Homo sapiens
ugaguuggcuacaagagaa

SEQ ID NO: 978216 - RNA, 19 nt, Homo sapiens
gaucuaagaauuugcugaa

SEQ ID NO: 978217 - RNA, 19 nt, Homo sapiens
ggguauggauauuaaaugu

SEQ ID NO: 978218 - RNA, 19 nt, Homo sapiens
ugagaauacugguucaaug

SEQ ID NO: 978219 - RNA, 19 nt, Homo sapiens
gagaacacaaauuggauaa

SEQ ID NO: 978220 - RNA, 19 nt, Homo sapiens
gguacuuucuuaagaucua

SEQ ID NO: 978221 - RNA, 19 nt, Homo sapiens
aaaguugucuucauuguac

SEQ ID NO: 978222 - RNA, 19 nt, Homo sapiens
aaauccagcuucccagaaa

SEQ ID NO: 978223 - RNA, 19 nt, Homo sapiens
ggaguaaguuuucacugua

SEQ ID NO: 978224 - RNA, 19 nt, Homo sapiens
ucaaauccauacugcaguu

SEQ ID NO: 978225 - RNA, 19 nt, Homo sapiens
ucugauggcccaccuauaa

SEQ ID NO: 978226 - RNA, 19 nt, Homo sapiens
cuaauaagccuucacuugu

SEQ ID NO: 978227 - RNA, 19 nt, Homo sapiens
aaucuggcauacugaauaa

SEQ ID NO: 978228 - RNA, 19 nt, Homo sapiens
gcuaaugcaccuugagaaa

SEQ ID NO: 978229 - RNA, 19 nt, Homo sapiens
guauaauucucaugcugaa

SEQ ID NO: 978230 - RNA, 19 nt, Homo sapiens
cugcucagauaauugaaua

SEQ ID NO: 978231 - RNA, 19 nt, Homo sapiens
uaacuuggcacuuuaguag

SEQ ID NO: 978232 - RNA, 19 nt, Homo sapiens
gacuaucucucuaaagcaa

SEQ ID NO: 978233 - RNA, 19 nt, Homo sapiens
gggcaaguuucucaugaug

SEQ ID NO: 978234 - RNA, 19 nt, Homo sapiens
gaacagcuuaugacauugu

SEQ ID NO: 978235 - RNA, 19 nt, Homo sapiens
gauggcccaccuauaaaua

SEQ ID NO: 978236 - RNA, 19 nt, Homo sapiens
uaauaagccuucacuuguc

SEQ ID NO: 978237 - RNA, 19 nt, Homo sapiens
uaagguagucuccugcuuu

SEQ ID NO: 978238 - RNA, 19 nt, Homo sapiens
cuauguagguucagucaga

SEQ ID NO: 978239 - RNA, 19 nt, Homo sapiens
auuaggagauguuacguaa

SEQ ID NO: 978240 - RNA, 19 nt, Homo sapiens
caaucuaggugguguucuu

SEQ ID NO: 978241 - RNA, 19 nt, Homo sapiens
guaaaaguauucccaguau

SEQ ID NO: 978242 - RNA, 19 nt, Homo sapiens
ggguuacacuaauugauga

SEQ ID NO: 978243 - RNA, 19 nt, Homo sapiens
acacaucaauggaagacuu

SEQ ID NO: 978244 - RNA, 19 nt, Homo sapiens
gcaaacacagcacauaucu

SEQ ID NO: 978245 - RNA, 19 nt, Homo sapiens
gagauauaccuguacuauu

SEQ ID NO: 978246 - RNA, 19 nt, Homo sapiens
ugagauaauuugcauuugg

SEQ ID NO: 978247 - RNA, 19 nt, Homo sapiens
ucagugggauaaaggauau

SEQ ID NO: 978248 - RNA, 19 nt, Homo sapiens
gauaaaguuccucauuuca

SEQ ID NO: 978249 - RNA, 19 nt, Homo sapiens
cccacugguuuaauaguua

SEQ ID NO: 978250 - RNA, 19 nt, Homo sapiens
gaacuaauaagccuucacu

SEQ ID NO: 978251 - RNA, 19 nt, Homo sapiens
auacuugaaugccaaagaa

SEQ ID NO: 978252 - RNA, 19 nt, Homo sapiens
gagaugguggauuucuuua

SEQ ID NO: 978253 - RNA, 19 nt, Homo sapiens
caagagaaagggacaagug

SEQ ID NO: 978254 - RNA, 19 nt, Homo sapiens
ggaaauugucuuugguguu

SEQ ID NO: 978255 - RNA, 19 nt, Homo sapiens
guaaacaccuauguaacuc

SEQ ID NO: 978256 - RNA, 19 nt, Homo sapiens
cuaaguuugcuaugcauua

SEQ ID NO: 978257 - RNA, 19 nt, Homo sapiens
guacaaacauauucaucac

SEQ ID NO: 978258 - RNA, 19 nt, Homo sapiens
ucauauaggucuggaauac

SEQ ID NO: 978259 - RNA, 19 nt, Homo sapiens
ccuguacuauuuaugguuu

SEQ ID NO: 978260 - RNA, 19 nt, Homo sapiens
aaacggagcaguaacaagu

SEQ ID NO: 978261 - RNA, 19 nt, Homo sapiens
gucaguaucauaaagagua

SEQ ID NO: 978262 - RNA, 19 nt, Homo sapiens
aaccagaauuggcaguuaa

SEQ ID NO: 978263 - RNA, 19 nt, Homo sapiens
uacguaacuuggcacuuua

SEQ ID NO: 978264 - RNA, 19 nt, Homo sapiens
ggaaauguuacgcaaagug

SEQ ID NO: 978265 - RNA, 19 nt, Homo sapiens
cuuaaugcuugaacaugua

SEQ ID NO: 978266 - RNA, 19 nt, Homo sapiens
cccaggagguggugaguug

SEQ ID NO: 978267 - RNA, 19 nt, Homo sapiens
gagggaaugagaacacaaa

SEQ ID NO: 978268 - RNA, 19 nt, Homo sapiens
uaaagaguauugcccaacu

SEQ ID NO: 978269 - RNA, 19 nt, Homo sapiens
agaaaguugucuucauugu

SEQ ID NO: 978270 - RNA, 19 nt, Homo sapiens
gaucagaaauuaccuuuga

SEQ ID NO: 978271 - RNA, 19 nt, Homo sapiens
uaaaggagcuacagucauu

SEQ ID NO: 978272 - RNA, 19 nt, Homo sapiens
cuaaggauauggucauuua

SEQ ID NO: 978273 - RNA, 19 nt, Homo sapiens
gcacaaggcuggcagagau

SEQ ID NO: 978274 - RNA, 19 nt, Homo sapiens
gaaucugccuucucacaua

SEQ ID NO: 978275 - RNA, 19 nt, Homo sapiens
acacaaagcugcagaagga

SEQ ID NO: 978276 - RNA, 19 nt, Homo sapiens
caacaaauauuuccugaag

SEQ ID NO: 978277 - RNA, 19 nt, Homo sapiens
gagagagacuugccacaaa

SEQ ID NO: 978278 - RNA, 19 nt, Homo sapiens
gagugaaacuaguguauau

SEQ ID NO: 978279 - RNA, 19 nt, Homo sapiens
gaggugagguuaaggaguu

SEQ ID NO: 978280 - RNA, 19 nt, Homo sapiens
gcagaaggacgaaaugaaa

SEQ ID NO: 978281 - RNA, 19 nt, Homo sapiens
gauaaggacgaccagauua

SEQ ID NO: 978282 - RNA, 19 nt, Homo sapiens
gcuuugagcugacuuuaga

SEQ ID NO: 978283 - RNA, 19 nt, Homo sapiens
cuauacagcugcaugcuuu

SEQ ID NO: 978284 - RNA, 19 nt, Homo sapiens
ccaugaaauuuaccagaua

SEQ ID NO: 978285 - RNA, 19 nt, Homo sapiens
gaggagcuauuucaucuuc

SEQ ID NO: 978286 - RNA, 19 nt, Homo sapiens
ccucaaggauguugcauug

SEQ ID NO: 978287 - RNA, 19 nt, Homo sapiens
gcuauccucuugcucauga

SEQ ID NO: 978288 - RNA, 19 nt, Homo sapiens
guaguucguuucuggauug

SEQ ID NO: 978289 - RNA, 19 nt, Homo sapiens
caaauugggucuguccauu

SEQ ID NO: 978290 - RNA, 19 nt, Homo sapiens
caacugggccuuugagaug

SEQ ID NO: 978291 - RNA, 19 nt, Homo sapiens
caaacucuccuuuaaauuc

SEQ ID NO: 978292 - RNA, 19 nt, Homo sapiens
gggaggagcuauuucaucu

SEQ ID NO: 978293 - RNA, 19 nt, Homo sapiens
ggagcuggcuauuagguau

SEQ ID NO: 978294 - RNA, 19 nt, Homo sapiens
gagaaaagaccaugaaauu

SEQ ID NO: 978295 - RNA, 19 nt, Homo sapiens
ggauuaugcuuuauaggau

SEQ ID NO: 978296 - RNA, 19 nt, Homo sapiens
agagacagguccuccagua

SEQ ID NO: 978297 - RNA, 19 nt, Homo sapiens
gcaacaacucugugaauug

SEQ ID NO: 978298 - RNA, 19 nt, Homo sapiens
gaacugggaccaccaucuu

SEQ ID NO: 978299 - RNA, 19 nt, Homo sapiens
gacaguugauuuccucuug

SEQ ID NO: 978300 - RNA, 19 nt, Homo sapiens
uggcagagauuuauguaug

SEQ ID NO: 978301 - RNA, 19 nt, Homo sapiens
agaaagagcuagaagaaaa

SEQ ID NO: 978302 - RNA, 19 nt, Homo sapiens
ggauaaggacgaccagauu

SEQ ID NO: 978303 - RNA, 19 nt, Homo sapiens
gaaaagcauuuggaaguuu

SEQ ID NO: 978304 - RNA, 19 nt, Homo sapiens
cagcaaaggcuacuucaga

SEQ ID NO: 978305 - RNA, 19 nt, Homo sapiens
caacaacucugugaauugc

SEQ ID NO: 978306 - RNA, 19 nt, Homo sapiens
gcaaagagugaaacuagug

SEQ ID NO: 978307 - RNA, 19 nt, Homo sapiens
ggcagagauuuauguauga

SEQ ID NO: 978308 - RNA, 19 nt, Homo sapiens
uuuauaggcuuccugcuaa

SEQ ID NO: 978309 - RNA, 19 nt, Homo sapiens
ggaagcaucccuugugcaa

SEQ ID NO: 978310 - RNA, 19 nt, Homo sapiens
ucagaaagagcuagaagaa

SEQ ID NO: 978311 - RNA, 19 nt, Homo sapiens
uuucagaacuggacuuguu

SEQ ID NO: 978312 - RNA, 19 nt, Homo sapiens
gauauggucauuuacaaga

SEQ ID NO: 978313 - RNA, 19 nt, Homo sapiens
gcuguagucaggauuauuu

SEQ ID NO: 978314 - RNA, 19 nt, Homo sapiens
guacuugugaucagaaauu

SEQ ID NO: 978315 - RNA, 19 nt, Homo sapiens
ccagguaguucaacaucuu

SEQ ID NO: 978316 - RNA, 19 nt, Homo sapiens
gcaacuuucugcuacauac

SEQ ID NO: 978317 - RNA, 19 nt, Homo sapiens
uggaggaccuuguucagaa

SEQ ID NO: 978318 - RNA, 19 nt, Homo sapiens
ccaguacccugucuucuag

SEQ ID NO: 978319 - RNA, 19 nt, Homo sapiens
augaaggcguguuugauua

SEQ ID NO: 978320 - RNA, 19 nt, Homo sapiens
gggauuaugcuuuauagga

SEQ ID NO: 978321 - RNA, 19 nt, Homo sapiens
gagcugacuuuagagauca

SEQ ID NO: 978322 - RNA, 19 nt, Homo sapiens
cacagaauuucauggcuuu

SEQ ID NO: 978323 - RNA, 19 nt, Homo sapiens
uauauuccguaucuuggua

SEQ ID NO: 978324 - RNA, 19 nt, Homo sapiens
caugaaggcguguuugauu

SEQ ID NO: 978325 - RNA, 19 nt, Homo sapiens
ccaccaucaucgucacuaa

SEQ ID NO: 978326 - RNA, 19 nt, Homo sapiens
gaagcauccugcauugucu

SEQ ID NO: 978327 - RNA, 19 nt, Homo sapiens
acacagggcuaagacuuga

SEQ ID NO: 978328 - RNA, 19 nt, Homo sapiens
gauggccacuuuaguccuu

SEQ ID NO: 978329 - RNA, 19 nt, Homo sapiens
agugugacaugcagaagua

SEQ ID NO: 978330 - RNA, 19 nt, Homo sapiens
cacauacucuacccucauu

SEQ ID NO: 978331 - RNA, 19 nt, Homo sapiens
ccacuggguugcuauccuu

SEQ ID NO: 978332 - RNA, 19 nt, Homo sapiens
cagcagcucuacaucaagu

SEQ ID NO: 978333 - RNA, 19 nt, Homo sapiens
uaaucuugcuucuucauca

SEQ ID NO: 978334 - RNA, 19 nt, Homo sapiens
gagcuacagucauuuuauu

SEQ ID NO: 978335 - RNA, 19 nt, Homo sapiens
cuaaauccuuuccugacaa

SEQ ID NO: 978336 - RNA, 19 nt, Homo sapiens
gcuauuagguaugucuugu

SEQ ID NO: 978337 - RNA, 19 nt, Homo sapiens
uggauuggguuuaguuuca

SEQ ID NO: 978338 - RNA, 19 nt, Homo sapiens
gguaguucguuucuggauu

SEQ ID NO: 978339 - RNA, 19 nt, Homo sapiens
gaagauggaccaggauaag

SEQ ID NO: 978340 - RNA, 19 nt, Homo sapiens
uaaauccuuuccugacaau

SEQ ID NO: 978341 - RNA, 19 nt, Homo sapiens
gcaaaggcuacuucagaug

SEQ ID NO: 978342 - RNA, 19 nt, Homo sapiens
aauaggagcuugguugaag

SEQ ID NO: 978343 - RNA, 19 nt, Homo sapiens
gagguuccuucccugcaaa

SEQ ID NO: 978344 - RNA, 19 nt, Homo sapiens
gagcguucauucaguccuu

SEQ ID NO: 978345 - RNA, 19 nt, Homo sapiens
guuaggaauucucuugauc

SEQ ID NO: 978346 - RNA, 19 nt, Homo sapiens
caagagugacccauccauu

SEQ ID NO: 978347 - RNA, 19 nt, Homo sapiens
ggaaagaaaagaaagagaa

SEQ ID NO: 978348 - RNA, 19 nt, Homo sapiens
ggaccaccaucuugcugau

SEQ ID NO: 978349 - RNA, 19 nt, Homo sapiens
gaucaucgaggcaaucuac

SEQ ID NO: 978350 - RNA, 19 nt, Homo sapiens
ucucuucccuguccauuuc

SEQ ID NO: 978351 - RNA, 19 nt, Homo sapiens
gaauuucauggcuuucaaa

SEQ ID NO: 978352 - RNA, 19 nt, Homo sapiens
gcaguuguuuauccagcaa

SEQ ID NO: 978353 - RNA, 19 nt, Homo sapiens
caaggccacuggguugcua

SEQ ID NO: 978354 - RNA, 19 nt, Homo sapiens
gacgugcagugacaguuga

SEQ ID NO: 978355 - RNA, 19 nt, Homo sapiens
caauucaacaagcaacuuu

SEQ ID NO: 978356 - RNA, 19 nt, Homo sapiens
ggacgaccagauuacauug

SEQ ID NO: 978357 - RNA, 19 nt, Homo sapiens
uaaguaaaggcacuaaauc

SEQ ID NO: 978358 - RNA, 19 nt, Homo sapiens
gcucaugaccagccauaug

SEQ ID NO: 978359 - RNA, 19 nt, Homo sapiens
ugagcugacuuuagagauc

SEQ ID NO: 978360 - RNA, 19 nt, Homo sapiens
ugcaacaacucugugaauu

SEQ ID NO: 978361 - RNA, 19 nt, Homo sapiens
gagauuguggucuuccaaa

SEQ ID NO: 978362 - RNA, 19 nt, Homo sapiens
gugaaacuaguguauauuc

SEQ ID NO: 978363 - RNA, 19 nt, Homo sapiens
gguuaggaauucucuugau

SEQ ID NO: 978364 - RNA, 19 nt, Homo sapiens
gcaacaaauauuuccugaa

SEQ ID NO: 978365 - RNA, 19 nt, Homo sapiens
aguaagcugacacuaaaua

SEQ ID NO: 978366 - RNA, 19 nt, Homo sapiens
caaggcuggcagagauuua

SEQ ID NO: 978367 - RNA, 19 nt, Homo sapiens
ccucgaagcauccugcauu

SEQ ID NO: 978368 - RNA, 19 nt, Homo sapiens
gcugggaccuaaaucuucu

SEQ ID NO: 978369 - RNA, 19 nt, Homo sapiens
guaagcugacacuaaauau

SEQ ID NO: 978370 - RNA, 19 nt, Homo sapiens
gaaauguucuguucuugua

SEQ ID NO: 978371 - RNA, 19 nt, Homo sapiens
gauauucaccguuccauua

SEQ ID NO: 978372 - RNA, 19 nt, Homo sapiens
ggacuuaacuggaaaauga

SEQ ID NO: 978373 - RNA, 19 nt, Homo sapiens
caugucagauuccuacuua

SEQ ID NO: 978374 - RNA, 19 nt, Homo sapiens
ggagaacacuugaguugug

SEQ ID NO: 978375 - RNA, 19 nt, Homo sapiens
guucuguucuuguacauua

SEQ ID NO: 978376 - RNA, 19 nt, Homo sapiens
gaaagugggaauuugauuu

SEQ ID NO: 978377 - RNA, 19 nt, Homo sapiens
aagcuucgguccauuaaua

SEQ ID NO: 978378 - RNA, 19 nt, Homo sapiens
gaaguuggguagcacagaa

SEQ ID NO: 978379 - RNA, 19 nt, Homo sapiens
cuacuuaacuucuuaugga

SEQ ID NO: 978380 - RNA, 19 nt, Homo sapiens
ggaagaagaaaguguuaaa

SEQ ID NO: 978381 - RNA, 19 nt, Homo sapiens
gcacagagcaugguaacaa

SEQ ID NO: 978382 - RNA, 19 nt, Homo sapiens
gagaagcuucgguccauua

SEQ ID NO: 978383 - RNA, 19 nt, Homo sapiens
ugaaggacguucccaauag

SEQ ID NO: 978384 - RNA, 19 nt, Homo sapiens
gagaaacgccaaagaggaa

SEQ ID NO: 978385 - RNA, 19 nt, Homo sapiens
gcaguggguucggucauaa

SEQ ID NO: 978386 - RNA, 19 nt, Homo sapiens
gauauuggaacuugggaua

SEQ ID NO: 978387 - RNA, 19 nt, Homo sapiens
gguagcggguccauuacua

SEQ ID NO: 978388 - RNA, 19 nt, Homo sapiens
gauaaagcauaacauggau

SEQ ID NO: 978389 - RNA, 19 nt, Homo sapiens
guugguagcggguccauua

SEQ ID NO: 978390 - RNA, 19 nt, Homo sapiens
gagaacacuugaguuguga

SEQ ID NO: 978391 - RNA, 19 nt, Homo sapiens
ucaagagaauuaggacuuu

SEQ ID NO: 978392 - RNA, 19 nt, Homo sapiens
gaauguuucuucaguuucu

SEQ ID NO: 978393 - RNA, 19 nt, Homo sapiens
gagacuggaugcugcuuau

SEQ ID NO: 978394 - RNA, 19 nt, Homo sapiens
gcacugaaguuggguagca

SEQ ID NO: 978395 - RNA, 19 nt, Homo sapiens
aaauggaucuguacaucaa

SEQ ID NO: 978396 - RNA, 19 nt, Homo sapiens
caucguggcuuccaauagu

SEQ ID NO: 978397 - RNA, 19 nt, Homo sapiens
uacccaagguugugucuuu

SEQ ID NO: 978398 - RNA, 19 nt, Homo sapiens
gaggaagaagaaaguguua

SEQ ID NO: 978399 - RNA, 19 nt, Homo sapiens
uaacauggauauuggaacu

SEQ ID NO: 978400 - RNA, 19 nt, Homo sapiens
aaacagcaaccuaaacuga

SEQ ID NO: 978401 - RNA, 19 nt, Homo sapiens
gaaaucugcuguggacuac

SEQ ID NO: 978402 - RNA, 19 nt, Homo sapiens
ccuaccagaugcaauguuu

SEQ ID NO: 978403 - RNA, 19 nt, Homo sapiens
aaaaugaccuucaagagaa

SEQ ID NO: 978404 - RNA, 19 nt, Homo sapiens
acauaggacuuaacuggaa

SEQ ID NO: 978405 - RNA, 19 nt, Homo sapiens
gugaaggacguucccaaua

SEQ ID NO: 978406 - RNA, 19 nt, Homo sapiens
ggucagcaggcuaacaaua

SEQ ID NO: 978407 - RNA, 19 nt, Homo sapiens
ggauauaguagcaauuaug

SEQ ID NO: 978408 - RNA, 19 nt, Homo sapiens
gagauccuguugagcauca

SEQ ID NO: 978409 - RNA, 19 nt, Homo sapiens
aagcagguguugaaaauua

SEQ ID NO: 978410 - RNA, 19 nt, Homo sapiens
gaacaacgagaauaaacca

SEQ ID NO: 978411 - RNA, 19 nt, Homo sapiens
uagagaacaacgagaauaa

SEQ ID NO: 978412 - RNA, 19 nt, Homo sapiens
ccagaaagugggaauuuga

SEQ ID NO: 978413 - RNA, 19 nt, Homo sapiens
ggcaguggguucggucaua

SEQ ID NO: 978414 - RNA, 19 nt, Homo sapiens
cagagacgauugcagacuu

SEQ ID NO: 978415 - RNA, 19 nt, Homo sapiens
cgauaaagcauaacaugga

SEQ ID NO: 978416 - RNA, 19 nt, Homo sapiens
aaaggcaguucuacacaga

SEQ ID NO: 978417 - RNA, 19 nt, Homo sapiens
caaagaggaagaagaaagu

SEQ ID NO: 978418 - RNA, 19 nt, Homo sapiens
gggauugacuucucagcau

SEQ ID NO: 978419 - RNA, 19 nt, Homo sapiens
acacagccaugcccuacuu

SEQ ID NO: 978420 - RNA, 19 nt, Homo sapiens
ccacaggcaaggcccaaua

SEQ ID NO: 978421 - RNA, 19 nt, Homo sapiens
cuagguaguuuaggugaaa

SEQ ID NO: 978422 - RNA, 19 nt, Homo sapiens
ucaaggucgugggaaauaa

SEQ ID NO: 978423 - RNA, 19 nt, Homo sapiens
gaugacuucucacacuaug

SEQ ID NO: 978424 - RNA, 19 nt, Homo sapiens
cuuuaagggugguucauuu

SEQ ID NO: 978425 - RNA, 19 nt, Homo sapiens
ugaaaucugcuguggacua

SEQ ID NO: 978426 - RNA, 19 nt, Homo sapiens
gagcuacucugaggacgau

SEQ ID NO: 978427 - RNA, 19 nt, Homo sapiens
ggagaagcuucgguccauu

SEQ ID NO: 978428 - RNA, 19 nt, Homo sapiens
gaaacaaaguacaaaaugg

SEQ ID NO: 978429 - RNA, 19 nt, Homo sapiens
gcuccuggcaugaauacua

SEQ ID NO: 978430 - RNA, 19 nt, Homo sapiens
caugauugauggacaguca

SEQ ID NO: 978431 - RNA, 19 nt, Homo sapiens
gcacuuggagaacacuuga

SEQ ID NO: 978432 - RNA, 19 nt, Homo sapiens
cauaggacuuaacuggaaa

SEQ ID NO: 978433 - RNA, 19 nt, Homo sapiens
caaaagacauaggacuuaa

SEQ ID NO: 978434 - RNA, 19 nt, Homo sapiens
gaaauaaaaggcaguucua

SEQ ID NO: 978435 - RNA, 19 nt, Homo sapiens
gaaggacguucccaauagc

SEQ ID NO: 978436 - RNA, 19 nt, Homo sapiens
aaccuaaacugaagaccaa

SEQ ID NO: 978437 - RNA, 19 nt, Homo sapiens
gcaucugcauauccuaaga

SEQ ID NO: 978438 - RNA, 19 nt, Homo sapiens
gccaugcccuacuuaacuu

SEQ ID NO: 978439 - RNA, 19 nt, Homo sapiens
uccauuggcuucuccuauu

SEQ ID NO: 978440 - RNA, 19 nt, Homo sapiens
gcuacaagcacaccacuuc

SEQ ID NO: 978441 - RNA, 19 nt, Homo sapiens
aagcauaacauggauauug

SEQ ID NO: 978442 - RNA, 19 nt, Homo sapiens
uuaugcaccuagcuccuua

SEQ ID NO: 978443 - RNA, 19 nt, Homo sapiens
caaggaaacaaaguacaaa

SEQ ID NO: 978444 - RNA, 19 nt, Homo sapiens
caaccaggagcccuaggua

SEQ ID NO: 978445 - RNA, 19 nt, Homo sapiens
uuacuacagucccuccauu

SEQ ID NO: 978446 - RNA, 19 nt, Homo sapiens
uuucaaagcugagaacagu

SEQ ID NO: 978447 - RNA, 19 nt, Homo sapiens
aagcacaccacuuccauuu

SEQ ID NO: 978448 - RNA, 19 nt, Homo sapiens
ucaaggaaacaaaguacaa

SEQ ID NO: 978449 - RNA, 19 nt, Homo sapiens
aaacugaagaccaagaaug

SEQ ID NO: 978450 - RNA, 19 nt, Homo sapiens
guugugauuucagagcaua

SEQ ID NO: 978451 - RNA, 19 nt, Homo sapiens
caaggucgugggaaauaaa

SEQ ID NO: 978452 - RNA, 19 nt, Homo sapiens
ccaaagaggaagaagaaag

SEQ ID NO: 978453 - RNA, 19 nt, Homo sapiens
gagaacaacgagaauaaac

SEQ ID NO: 978454 - RNA, 19 nt, Homo sapiens
ggauuaaacgaugaugauu

SEQ ID NO: 978455 - RNA, 19 nt, Homo sapiens
caugaauacuauagaccaa

SEQ ID NO: 978456 - RNA, 19 nt, Homo sapiens
cuagguagcacuccauuuc

SEQ ID NO: 978457 - RNA, 19 nt, Homo sapiens
cuagagaacaacgagaaua

SEQ ID NO: 978458 - RNA, 19 nt, Homo sapiens
aggcuuugguucagaauau

SEQ ID NO: 978459 - RNA, 19 nt, Homo sapiens
ggaaacaaaguacaaaaug

SEQ ID NO: 978460 - RNA, 19 nt, Homo sapiens
ccauuaaucacuucucaau

SEQ ID NO: 978461 - RNA, 19 nt, Homo sapiens
ccaagguugugucuuuaag

SEQ ID NO: 978462 - RNA, 19 nt, Homo sapiens
acacuugaguugugaaggu

SEQ ID NO: 978463 - RNA, 19 nt, Homo sapiens
aaucugcuguggacuacaa

SEQ ID NO: 978464 - RNA, 19 nt, Homo sapiens
caaaauggaucuguacauc

SEQ ID NO: 978465 - RNA, 19 nt, Homo sapiens
accguuccauuaaguauaa

SEQ ID NO: 978466 - RNA, 19 nt, Homo sapiens
cagggacagucuacucaga

SEQ ID NO: 978467 - RNA, 19 nt, Homo sapiens
gacauuugcacuuggagaa

SEQ ID NO: 978468 - RNA, 19 nt, Homo sapiens
cgccaaagaggaagaagaa

SEQ ID NO: 978469 - RNA, 19 nt, Homo sapiens
ccauuggcuucuccuauuc

SEQ ID NO: 978470 - RNA, 19 nt, Homo sapiens
cagcucagaugaugaauaa

SEQ ID NO: 978471 - RNA, 19 nt, Homo sapiens
gcacuaaccugcucugaag

SEQ ID NO: 978472 - RNA, 19 nt, Homo sapiens
gcucagaugaugaauaaua

SEQ ID NO: 978473 - RNA, 19 nt, Homo sapiens
guaccagccuuccaaauga

SEQ ID NO: 978474 - RNA, 19 nt, Homo sapiens
gcaaacagaagccuauaaa

SEQ ID NO: 978475 - RNA, 19 nt, Homo sapiens
gcacaggguugcucuucaa

SEQ ID NO: 978476 - RNA, 19 nt, Homo sapiens
aaacagaagccuauaaaga

SEQ ID NO: 978477 - RNA, 19 nt, Homo sapiens
gcauauuguuccagauaaa

SEQ ID NO: 978478 - RNA, 19 nt, Homo sapiens
gauagcaugucuccaaauc

SEQ ID NO: 978479 - RNA, 19 nt, Homo sapiens
agacaucccugcauauugu

SEQ ID NO: 978480 - RNA, 19 nt, Homo sapiens
gacaacacuuggucuaaga

SEQ ID NO: 978481 - RNA, 19 nt, Homo sapiens
gaugauagcaugucuccaa

SEQ ID NO: 978482 - RNA, 19 nt, Homo sapiens
ccugggaaauacucacuua

SEQ ID NO: 978483 - RNA, 19 nt, Homo sapiens
uuaaacagcuucgugucua

SEQ ID NO: 978484 - RNA, 19 nt, Homo sapiens
uaacagcucagaugaugaa

SEQ ID NO: 978485 - RNA, 19 nt, Homo sapiens
uaagagcugucaccugugu

SEQ ID NO: 978486 - RNA, 19 nt, Homo sapiens
caagacaucccugcauauu

SEQ ID NO: 978487 - RNA, 19 nt, Homo sapiens
agaaguaccugucacaaac

SEQ ID NO: 978488 - RNA, 19 nt, Homo sapiens
uguaacagcucagaugaug

SEQ ID NO: 978489 - RNA, 19 nt, Homo sapiens
cagcaucuuuagucaaguu

SEQ ID NO: 978490 - RNA, 19 nt, Homo sapiens
gcaagacaucccugcauau

SEQ ID NO: 978491 - RNA, 19 nt, Homo sapiens
gcucaguucacuauaagaa

SEQ ID NO: 978492 - RNA, 19 nt, Homo sapiens
agcaagacaucccugcaua

SEQ ID NO: 978493 - RNA, 19 nt, Homo sapiens
cagaaguaccugucacaaa

SEQ ID NO: 978494 - RNA, 19 nt, Homo sapiens
ccaaaucaguggcguuacu

SEQ ID NO: 978495 - RNA, 19 nt, Homo sapiens
gugaaggugugaugcugaa

SEQ ID NO: 978496 - RNA, 19 nt, Homo sapiens
ggacaucagcagcguagug

SEQ ID NO: 978497 - RNA, 19 nt, Homo sapiens
uagagacaccugggaaaua

SEQ ID NO: 978498 - RNA, 19 nt, Homo sapiens
gacaaagccacaaccagaa

SEQ ID NO: 978499 - RNA, 19 nt, Homo sapiens
cuauaaagacggaauggaa

SEQ ID NO: 978500 - RNA, 19 nt, Homo sapiens
gauaccugcagcaucuuua

SEQ ID NO: 978501 - RNA, 19 nt, Homo sapiens
ccggcucaguucacuauaa

SEQ ID NO: 978502 - RNA, 19 nt, Homo sapiens
aaacgugagccucuccuaa

SEQ ID NO: 978503 - RNA, 19 nt, Homo sapiens
gaaacgugagccucuccua

SEQ ID NO: 978504 - RNA, 19 nt, Homo sapiens
ccugcuugcuccuguguaa

SEQ ID NO: 978505 - RNA, 19 nt, Homo sapiens
gggaaauacucacuuacac

SEQ ID NO: 978506 - RNA, 19 nt, Homo sapiens
gcugucaccugugucauuc

SEQ ID NO: 978507 - RNA, 19 nt, Homo sapiens
uaagucuccuccagcaaga

SEQ ID NO: 978508 - RNA, 19 nt, Homo sapiens
uaaacagcuucgugucuag

SEQ ID NO: 978509 - RNA, 19 nt, Homo sapiens
ccauggcugugaaucaguu

SEQ ID NO: 978510 - RNA, 19 nt, Homo sapiens
uggaagaaaugaagaagac

SEQ ID NO: 978511 - RNA, 19 nt, Homo sapiens
aggugaugguccagaauua

SEQ ID NO: 978512 - RNA, 19 nt, Homo sapiens
uagcaugucuccaaaucag

SEQ ID NO: 978513 - RNA, 19 nt, Homo sapiens
ggugaugguccagaauuaa

SEQ ID NO: 978514 - RNA, 19 nt, Homo sapiens
agagacaccugggaaauac

SEQ ID NO: 978515 - RNA, 19 nt, Homo sapiens
ggcaaacagaagccuauaa

SEQ ID NO: 978516 - RNA, 19 nt, Homo sapiens
gggcggaaaguaacaagga

SEQ ID NO: 978517 - RNA, 19 nt, Homo sapiens
caucuuuagucaaguugga

SEQ ID NO: 978518 - RNA, 19 nt, Homo sapiens
ucucguggaucugccagua

SEQ ID NO: 978519 - RNA, 19 nt, Homo sapiens
ucaguucacuauaagaaac

SEQ ID NO: 978520 - RNA, 19 nt, Homo sapiens
caauggaagaaaugaagaa

SEQ ID NO: 978521 - RNA, 19 nt, Homo sapiens
ugcauauuguuccagauaa

SEQ ID NO: 978522 - RNA, 19 nt, Homo sapiens
cugcauauuguuccagaua

SEQ ID NO: 978523 - RNA, 19 nt, Homo sapiens
aaacgaugauagcaugucu

SEQ ID NO: 978524 - RNA, 19 nt, Homo sapiens
uaccagccuuccaaaugaa

SEQ ID NO: 978525 - RNA, 19 nt, Homo sapiens
cuauauguaucucguggau

SEQ ID NO: 978526 - RNA, 19 nt, Homo sapiens
gaggagaaagacaacacuu

SEQ ID NO: 978527 - RNA, 19 nt, Homo sapiens
aggcagcucuggccaucuu

SEQ ID NO: 978528 - RNA, 19 nt, Homo sapiens
gcagcguaguggaugaaca

SEQ ID NO: 978529 - RNA, 19 nt, Homo sapiens
uauaaagacggaauggaau

SEQ ID NO: 978530 - RNA, 19 nt, Homo sapiens
caaacagaagccuauaaag

SEQ ID NO: 978531 - RNA, 19 nt, Homo sapiens
auauguaucucguggaucu

SEQ ID NO: 978532 - RNA, 19 nt, Homo sapiens
gcccaaaggcaaacagaag

SEQ ID NO: 978533 - RNA, 19 nt, Homo sapiens
gagaaagacaacacuuggu

SEQ ID NO: 978534 - RNA, 19 nt, Homo sapiens
auaaagacggaauggaauu

SEQ ID NO: 978535 - RNA, 19 nt, Homo sapiens
ucaaguuggaggagaaaga

SEQ ID NO: 978536 - RNA, 19 nt, Homo sapiens
gugagccucuccuaagucu

SEQ ID NO: 978537 - RNA, 19 nt, Homo sapiens
guacuugcccugugaaaau

SEQ ID NO: 978538 - RNA, 19 nt, Homo sapiens
caggugaugguccagaauu

SEQ ID NO: 978539 - RNA, 19 nt, Homo sapiens
cuaagacacggcagcaaga

SEQ ID NO: 978540 - RNA, 19 nt, Homo sapiens
cuaaccugcucugaaguga

SEQ ID NO: 978541 - RNA, 19 nt, Homo sapiens
cggcucaguucacuauaag

SEQ ID NO: 978542 - RNA, 19 nt, Homo sapiens
guuagagacaccugggaaa

SEQ ID NO: 978543 - RNA, 19 nt, Homo sapiens
caaccagaaguaccuguca

SEQ ID NO: 978544 - RNA, 19 nt, Homo sapiens
ucagcagcguaguggauga

SEQ ID NO: 978545 - RNA, 19 nt, Homo sapiens
ccacuugccuccccaaucu

SEQ ID NO: 978546 - RNA, 19 nt, Homo sapiens
uagucaaguuggaggagaa

SEQ ID NO: 978547 - RNA, 19 nt, Homo sapiens
ugcagcaucuuuagucaag

SEQ ID NO: 978548 - RNA, 19 nt, Homo sapiens
aaagccacaaccagaagua

SEQ ID NO: 978549 - RNA, 19 nt, Homo sapiens
ucacaauggaagaaaugaa

SEQ ID NO: 978550 - RNA, 19 nt, Homo sapiens
gccaguaccagccuuccaa

SEQ ID NO: 978551 - RNA, 19 nt, Homo sapiens
guaacagcucagaugauga

SEQ ID NO: 978552 - RNA, 19 nt, Homo sapiens
cucaguacuugcccuguga

SEQ ID NO: 978553 - RNA, 19 nt, Homo sapiens
aacagaagccuauaaagac

SEQ ID NO: 978554 - RNA, 19 nt, Homo sapiens
gaaggugugaugcugaaaa

SEQ ID NO: 978555 - RNA, 19 nt, Homo sapiens
caucagcagcguaguggau

SEQ ID NO: 978556 - RNA, 19 nt, Homo sapiens
guuaaacagcuucgugucu

SEQ ID NO: 978557 - RNA, 19 nt, Homo sapiens
aguaccagccuuccaaaug

SEQ ID NO: 978558 - RNA, 19 nt, Homo sapiens
cuccaaaucaguggcguua

SEQ ID NO: 978559 - RNA, 19 nt, Homo sapiens
cacaauggaagaaaugaag

SEQ ID NO: 978560 - RNA, 19 nt, Homo sapiens
augauagcaugucuccaaa

SEQ ID NO: 978561 - RNA, 19 nt, Homo sapiens
acagcucagaugaugaaua

SEQ ID NO: 978562 - RNA, 19 nt, Homo sapiens
ucacucacaauggaagaaa

SEQ ID NO: 978563 - RNA, 19 nt, Homo sapiens
cgauaccugcagcaucuuu

SEQ ID NO: 978564 - RNA, 19 nt, Homo sapiens
ggagggaauuguauugaua

SEQ ID NO: 978565 - RNA, 19 nt, Homo sapiens
guaguuugcugcuaauaua

SEQ ID NO: 978566 - RNA, 19 nt, Homo sapiens
ggauagacuuuacagauuu

SEQ ID NO: 978567 - RNA, 19 nt, Homo sapiens
gagaaucccuguuguacuu

SEQ ID NO: 978568 - RNA, 19 nt, Homo sapiens
cauccaauaugucaaguua

SEQ ID NO: 978569 - RNA, 19 nt, Homo sapiens
cauccaauaugucaaguua

SEQ ID NO: 978570 - RNA, 19 nt, Homo sapiens
cauccaauaugucaaguua

SEQ ID NO: 978571 - RNA, 19 nt, Homo sapiens
uaacaaaucugagccaguu

SEQ ID NO: 978572 - RNA, 19 nt, Homo sapiens
gggauagacuuuacagauu

SEQ ID NO: 978573 - RNA, 19 nt, Homo sapiens
gaaagagaaucccuguugu

SEQ ID NO: 978574 - RNA, 19 nt, Homo sapiens
ggaauaauccaaaggaaau

SEQ ID NO: 978575 - RNA, 19 nt, Homo sapiens
agaaguaguuugcugcuaa

SEQ ID NO: 978576 - RNA, 19 nt, Homo sapiens
uaaauucuaucgcaugaga

SEQ ID NO: 978577 - RNA, 19 nt, Homo sapiens
agacaucucugcaucuuug

SEQ ID NO: 978578 - RNA, 19 nt, Homo sapiens
agugaaagcuuguuguaaa

SEQ ID NO: 978579 - RNA, 19 nt, Homo sapiens
gaaucccuguuguacuuua

SEQ ID NO: 978580 - RNA, 19 nt, Homo sapiens
gaauagggauagacuuuac

SEQ ID NO: 978581 - RNA, 19 nt, Homo sapiens
gaaaagccauacaucuuaa

SEQ ID NO: 978582 - RNA, 19 nt, Homo sapiens
gaaacauccacaucugaua

SEQ ID NO: 978583 - RNA, 19 nt, Homo sapiens
uagccaguauuucugauua

SEQ ID NO: 978584 - RNA, 19 nt, Homo sapiens
gaaagcuuguuguaaagau

SEQ ID NO: 978585 - RNA, 19 nt, Homo sapiens
ccagaaauuucguuaguca

SEQ ID NO: 978586 - RNA, 19 nt, Homo sapiens
ccugugacauguccuauuu

SEQ ID NO: 978587 - RNA, 19 nt, Homo sapiens
agaaguaucaggaugaaua

SEQ ID NO: 978588 - RNA, 19 nt, Homo sapiens
ggaauagggauagacuuua

SEQ ID NO: 978589 - RNA, 19 nt, Homo sapiens
ugaacgaugugauugauau

SEQ ID NO: 978590 - RNA, 19 nt, Homo sapiens
aaagagugguguuuacuau

SEQ ID NO: 978591 - RNA, 19 nt, Homo sapiens
guaaucaccuauuucagau

SEQ ID NO: 978592 - RNA, 19 nt, Homo sapiens
gaacagcaauaggagugaa

SEQ ID NO: 978593 - RNA, 19 nt, Homo sapiens
gggaauagggauagacuuu

SEQ ID NO: 978594 - RNA, 19 nt, Homo sapiens
ccauacaucuuaaugaaca

SEQ ID NO: 978595 - RNA, 19 nt, Homo sapiens
guaauaacaaccacaagaa

SEQ ID NO: 978596 - RNA, 19 nt, Homo sapiens
acacacaauuaccuguuua

SEQ ID NO: 978597 - RNA, 19 nt, Homo sapiens
ugaaagagaaucccuguug

SEQ ID NO: 978598 - RNA, 19 nt, Homo sapiens
ggagauccuagccagauua

SEQ ID NO: 978599 - RNA, 19 nt, Homo sapiens
gggaacuucuuuaaaggaa

SEQ ID NO: 978600 - RNA, 19 nt, Homo sapiens
gaaguaguuugcugcuaau

SEQ ID NO: 978601 - RNA, 19 nt, Homo sapiens
caugggcauuugauaauuu

SEQ ID NO: 978602 - RNA, 19 nt, Homo sapiens
guuaaaccauucugggauu

SEQ ID NO: 978603 - RNA, 19 nt, Homo sapiens
guuaaaccauucugggauu

SEQ ID NO: 978604 - RNA, 19 nt, Homo sapiens
guuaaaccauucugggauu

SEQ ID NO: 978605 - RNA, 19 nt, Homo sapiens
ggaugaauaugguguuucu

SEQ ID NO: 978606 - RNA, 19 nt, Homo sapiens
guaagaaguaucaggauga

SEQ ID NO: 978607 - RNA, 19 nt, Homo sapiens
auauggugcucauuuguua

SEQ ID NO: 978608 - RNA, 19 nt, Homo sapiens
uggcuacuauuacaccuua

SEQ ID NO: 978609 - RNA, 19 nt, Homo sapiens
gugcuaaguuaucuaguug

SEQ ID NO: 978610 - RNA, 19 nt, Homo sapiens
gaacgaugugauugauaua

SEQ ID NO: 978611 - RNA, 19 nt, Homo sapiens
auacuaagcugaauaacag

SEQ ID NO: 978612 - RNA, 19 nt, Homo sapiens
gaaggaaauacaaagagaa

SEQ ID NO: 978613 - RNA, 19 nt, Homo sapiens
cuagugagauuucuguaau

SEQ ID NO: 978614 - RNA, 19 nt, Homo sapiens
ucagauaguuccugugaca

SEQ ID NO: 978615 - RNA, 19 nt, Homo sapiens
gaauaugguguuucuucua

SEQ ID NO: 978616 - RNA, 19 nt, Homo sapiens
gaguggauuugcugacauu

SEQ ID NO: 978617 - RNA, 19 nt, Homo sapiens
guagaaggcccaaaucaca

SEQ ID NO: 978618 - RNA, 19 nt, Homo sapiens
ggaaagcggagcacauugu

SEQ ID NO: 978619 - RNA, 19 nt, Homo sapiens
agaaggaaauacaaagaga

SEQ ID NO: 978620 - RNA, 19 nt, Homo sapiens
aaacauccacaucugauaa

SEQ ID NO: 978621 - RNA, 19 nt, Homo sapiens
guagacaucucugcaucuu

SEQ ID NO: 978622 - RNA, 19 nt, Homo sapiens
ugacauguccuauuugugu

SEQ ID NO: 978623 - RNA, 19 nt, Homo sapiens
uaagaaguaucaggaugaa

SEQ ID NO: 978624 - RNA, 19 nt, Homo sapiens
gaaacuuaccaagagaaua

SEQ ID NO: 978625 - RNA, 19 nt, Homo sapiens
ggaacuucuuuaaaggaaa

SEQ ID NO: 978626 - RNA, 19 nt, Homo sapiens
aaacugcuguugaagaauc

SEQ ID NO: 978627 - RNA, 19 nt, Homo sapiens
gaaauuucguuagucaucu

SEQ ID NO: 978628 - RNA, 19 nt, Homo sapiens
cacagaaacuuaccaagag

SEQ ID NO: 978629 - RNA, 19 nt, Homo sapiens
gaaguaucaggaugaauau

SEQ ID NO: 978630 - RNA, 19 nt, Homo sapiens
gaaaugugacuagaagaga

SEQ ID NO: 978631 - RNA, 19 nt, Homo sapiens
gaugcauuccucccauuua

SEQ ID NO: 978632 - RNA, 19 nt, Homo sapiens
aaagagaaucccuguugua

SEQ ID NO: 978633 - RNA, 19 nt, Homo sapiens
acacagaaacuuaccaaga

SEQ ID NO: 978634 - RNA, 19 nt, Homo sapiens
gcaauaggagugaaacauc

SEQ ID NO: 978635 - RNA, 19 nt, Homo sapiens
ccacuuaggaaagcuauuu

SEQ ID NO: 978636 - RNA, 19 nt, Homo sapiens
caccgaagaugauuucuac

SEQ ID NO: 978637 - RNA, 19 nt, Homo sapiens
gucuuugacugauuuguaa

SEQ ID NO: 978638 - RNA, 19 nt, Homo sapiens
gaagugcuaaauggaauaa

SEQ ID NO: 978639 - RNA, 19 nt, Homo sapiens
ccucccauuuacuuuauua

SEQ ID NO: 978640 - RNA, 19 nt, Homo sapiens
uaaaggagggaauuguauu

SEQ ID NO: 978641 - RNA, 19 nt, Homo sapiens
ggauuugggaacuucuuua

SEQ ID NO: 978642 - RNA, 19 nt, Homo sapiens
uuaaugaacauacgccuuu

SEQ ID NO: 978643 - RNA, 19 nt, Homo sapiens
gauuugggaacuucuuuaa

SEQ ID NO: 978644 - RNA, 19 nt, Homo sapiens
uugcugacauuccauacua

SEQ ID NO: 978645 - RNA, 19 nt, Homo sapiens
cuagccagauuaccagaaa

SEQ ID NO: 978646 - RNA, 19 nt, Homo sapiens
gauaguuccugugacaugu

SEQ ID NO: 978647 - RNA, 19 nt, Homo sapiens
guagggaacagcaauagga

SEQ ID NO: 978648 - RNA, 19 nt, Homo sapiens
gcucauuuguuauucucaa

SEQ ID NO: 978649 - RNA, 19 nt, Homo sapiens
cacacacaauuaccuguuu

SEQ ID NO: 978650 - RNA, 19 nt, Homo sapiens
guaugcaguuugucagguu

SEQ ID NO: 978651 - RNA, 19 nt, Homo sapiens
aaagugaaagcuuguugua

SEQ ID NO: 978652 - RNA, 19 nt, Homo sapiens
aaucugagccaguuauuau

SEQ ID NO: 978653 - RNA, 19 nt, Homo sapiens
uaacacacaguagcaaauu

SEQ ID NO: 978654 - RNA, 19 nt, Homo sapiens
uaccagaaauuucguuagu

SEQ ID NO: 978655 - RNA, 19 nt, Homo sapiens
gggagauccuagccagauu

SEQ ID NO: 978656 - RNA, 19 nt, Homo sapiens
guggaaaugugacuagaag

SEQ ID NO: 978657 - RNA, 19 nt, Homo sapiens
aacagagucuuauuugaga

SEQ ID NO: 978658 - RNA, 19 nt, Homo sapiens
cacaauaccacuuaggaaa

SEQ ID NO: 978659 - RNA, 19 nt, Homo sapiens
agagugguguuuacuaugu

SEQ ID NO: 978660 - RNA, 19 nt, Homo sapiens
ggaaaugugacuagaagag

SEQ ID NO: 978661 - RNA, 19 nt, Homo sapiens
gcaagugccaucuuuaagg

SEQ ID NO: 978662 - RNA, 19 nt, Homo sapiens
ucugaaggcuguagacauc

SEQ ID NO: 978663 - RNA, 19 nt, Homo sapiens
uaguagaggucaucuugau

SEQ ID NO: 978664 - RNA, 19 nt, Homo sapiens
gagcacaucugcagucauu

SEQ ID NO: 978665 - RNA, 19 nt, Homo sapiens
gaauauaaguucccagcuu

SEQ ID NO: 978666 - RNA, 19 nt, Homo sapiens
gaacuugugucuaauagca

SEQ ID NO: 978667 - RNA, 19 nt, Homo sapiens
gaauuugaguggcuaaaga

SEQ ID NO: 978668 - RNA, 19 nt, Homo sapiens
guacaaaggugugguaucu

SEQ ID NO: 978669 - RNA, 19 nt, Homo sapiens
caacagacaguaagacgua

SEQ ID NO: 978670 - RNA, 19 nt, Homo sapiens
gaagagccauaaguuagaa

SEQ ID NO: 978671 - RNA, 19 nt, Homo sapiens
gcuaugaggugccuugugu

SEQ ID NO: 978672 - RNA, 19 nt, Homo sapiens
gaacauuccacauuugaug

SEQ ID NO: 978673 - RNA, 19 nt, Homo sapiens
ggacauugcacauaauuca

SEQ ID NO: 978674 - RNA, 19 nt, Homo sapiens
aaucugaagucuuguacua

SEQ ID NO: 978675 - RNA, 19 nt, Homo sapiens
gcucccugcuggucauuua

SEQ ID NO: 978676 - RNA, 19 nt, Homo sapiens
ggacaaacaacagacagua

SEQ ID NO: 978677 - RNA, 19 nt, Homo sapiens
caaagcaucggaaccagua

SEQ ID NO: 978678 - RNA, 19 nt, Homo sapiens
gaaugaaggagaaugcaaa

SEQ ID NO: 978679 - RNA, 19 nt, Homo sapiens
guucccagcuuaaacacua

SEQ ID NO: 978680 - RNA, 19 nt, Homo sapiens
cagcaacaguuacagagaa

SEQ ID NO: 978681 - RNA, 19 nt, Homo sapiens
ucuaauagcauauccauug

SEQ ID NO: 978682 - RNA, 19 nt, Homo sapiens
cuucgaacauuccacauuu

SEQ ID NO: 978683 - RNA, 19 nt, Homo sapiens
cggaaccaguacaaauuua

SEQ ID NO: 978684 - RNA, 19 nt, Homo sapiens
gcagugggcaguuaauguu

SEQ ID NO: 978685 - RNA, 19 nt, Homo sapiens
caugaaaugucaccagcaa

SEQ ID NO: 978686 - RNA, 19 nt, Homo sapiens
gaguguauauguucguaau

SEQ ID NO: 978687 - RNA, 19 nt, Homo sapiens
caacaguuacagagaauga

SEQ ID NO: 978688 - RNA, 19 nt, Homo sapiens
cuaauagcauauccauuga

SEQ ID NO: 978689 - RNA, 19 nt, Homo sapiens
acaaaggugugguaucugu

SEQ ID NO: 978690 - RNA, 19 nt, Homo sapiens
gccauaaguuagaagaaga

SEQ ID NO: 978691 - RNA, 19 nt, Homo sapiens
gacaaacaacagacaguaa

SEQ ID NO: 978692 - RNA, 19 nt, Homo sapiens
gugcuccgcuucaaugaga

SEQ ID NO: 978693 - RNA, 19 nt, Homo sapiens
gugcuuggagucuuuauuu

SEQ ID NO: 978694 - RNA, 19 nt, Homo sapiens
gaaggcagccaaccagauc

SEQ ID NO: 978695 - RNA, 19 nt, Homo sapiens
aaaccugacuucccgcuau

SEQ ID NO: 978696 - RNA, 19 nt, Homo sapiens
aagccaagguagccaagua

SEQ ID NO: 978697 - RNA, 19 nt, Homo sapiens
gagaagaaggggaauauaa

SEQ ID NO: 978698 - RNA, 19 nt, Homo sapiens
gcuagcugcuccaguacuu

SEQ ID NO: 978699 - RNA, 19 nt, Homo sapiens
cuugcuagcugcuccagua

SEQ ID NO: 978700 - RNA, 19 nt, Homo sapiens
aaugaagagccauaaguua

SEQ ID NO: 978701 - RNA, 19 nt, Homo sapiens
cuaaagaaaucugaagucu

SEQ ID NO: 978702 - RNA, 19 nt, Homo sapiens
gaaaggggaccauggaauu

SEQ ID NO: 978703 - RNA, 19 nt, Homo sapiens
ggaaccaguacaaauuuau

SEQ ID NO: 978704 - RNA, 19 nt, Homo sapiens
cugcugagaugcgcaaauu

SEQ ID NO: 978705 - RNA, 19 nt, Homo sapiens
gacccucccugcugagaug

SEQ ID NO: 978706 - RNA, 19 nt, Homo sapiens
ugaggugccuuguguccuu

SEQ ID NO: 978707 - RNA, 19 nt, Homo sapiens
gcugagaugcgcaaauuca

SEQ ID NO: 978708 - RNA, 19 nt, Homo sapiens
ccaguaacaagccaaggua

SEQ ID NO: 978709 - RNA, 19 nt, Homo sapiens
gaaccaguacaaauuuauc

SEQ ID NO: 978710 - RNA, 19 nt, Homo sapiens
aaaugaagagccauaaguu

SEQ ID NO: 978711 - RNA, 19 nt, Homo sapiens
caucaugucuuagaaacag

SEQ ID NO: 978712 - RNA, 19 nt, Homo sapiens
caaacaacagacaguaaga

SEQ ID NO: 978713 - RNA, 19 nt, Homo sapiens
uauaacccuuggagcauga

SEQ ID NO: 978714 - RNA, 19 nt, Homo sapiens
caggaacuugugucuaaua

SEQ ID NO: 978715 - RNA, 19 nt, Homo sapiens
ugaagagccauaaguuaga

SEQ ID NO: 978716 - RNA, 19 nt, Homo sapiens
guaaagaggagaaaaugaa

SEQ ID NO: 978717 - RNA, 19 nt, Homo sapiens
gcuuggagucuuuauuuau

SEQ ID NO: 978718 - RNA, 19 nt, Homo sapiens
ggcaguuaauguucaugaa

SEQ ID NO: 978719 - RNA, 19 nt, Homo sapiens
gcaggcagugggcaguuaa

SEQ ID NO: 978720 - RNA, 19 nt, Homo sapiens
gcacaucugcagucauugg

SEQ ID NO: 978721 - RNA, 19 nt, Homo sapiens
caucggaaccaguacaaau

SEQ ID NO: 978722 - RNA, 19 nt, Homo sapiens
gaugaagacaggaacuugu

SEQ ID NO: 978723 - RNA, 19 nt, Homo sapiens
ugugguaucugugcgcuuu

SEQ ID NO: 978724 - RNA, 19 nt, Homo sapiens
uacagagaaugaaggagaa

SEQ ID NO: 978725 - RNA, 19 nt, Homo sapiens
cuccuaagguggacaacaa

SEQ ID NO: 978726 - RNA, 19 nt, Homo sapiens
ugcuuggagucuuuauuua

SEQ ID NO: 978727 - RNA, 19 nt, Homo sapiens
caagaugggcacacgacaa

SEQ ID NO: 978728 - RNA, 19 nt, Homo sapiens
ugaaggagaaugcaaagca

SEQ ID NO: 978729 - RNA, 19 nt, Homo sapiens
ugaaaugucaccagcaaca

SEQ ID NO: 978730 - RNA, 19 nt, Homo sapiens
caaauucacuccccaguac

SEQ ID NO: 978731 - RNA, 19 nt, Homo sapiens
uugaguggcuaaagaaauc

SEQ ID NO: 978732 - RNA, 19 nt, Homo sapiens
gaagaauuugaguggcuaa

SEQ ID NO: 978733 - RNA, 19 nt, Homo sapiens
uaagguggacaacaaacaa

SEQ ID NO: 978734 - RNA, 19 nt, Homo sapiens
uagcauauccauugaaagg

SEQ ID NO: 978735 - RNA, 19 nt, Homo sapiens
agagcauccuggccaguaa

SEQ ID NO: 978736 - RNA, 19 nt, Homo sapiens
cgccagcucuguagaugug

SEQ ID NO: 978737 - RNA, 19 nt, Homo sapiens
gaaaucugaagucuuguac

SEQ ID NO: 978738 - RNA, 19 nt, Homo sapiens
ccauggaauuguggacauu

SEQ ID NO: 978739 - RNA, 19 nt, Homo sapiens
uuucuucccugaguguaua

SEQ ID NO: 978740 - RNA, 19 nt, Homo sapiens
ugagucugcuggugccuau

SEQ ID NO: 978741 - RNA, 19 nt, Homo sapiens
agagauaagugaggagagu

SEQ ID NO: 978742 - RNA, 19 nt, Homo sapiens
ggaccugucagaggaauca

SEQ ID NO: 978743 - RNA, 19 nt, Homo sapiens
gggcaguuaauguucauga

SEQ ID NO: 978744 - RNA, 19 nt, Homo sapiens
gagagggacacacggacaa

SEQ ID NO: 978745 - RNA, 19 nt, Homo sapiens
agaaaucugaagucuugua

SEQ ID NO: 978746 - RNA, 19 nt, Homo sapiens
gcuaaagaaaucugaaguc

SEQ ID NO: 978747 - RNA, 19 nt, Homo sapiens
ccaguacaaagguguggua

SEQ ID NO: 978748 - RNA, 19 nt, Homo sapiens
ggauuuggaggaccuguca

SEQ ID NO: 978749 - RNA, 19 nt, Homo sapiens
aaugugcaguggccucuga

SEQ ID NO: 978750 - RNA, 19 nt, Homo sapiens
ucggaaccaguacaaauuu

SEQ ID NO: 978751 - RNA, 19 nt, Homo sapiens
gcaaauucacuccccagua

SEQ ID NO: 978752 - RNA, 19 nt, Homo sapiens
cagagcauccuggccagua

SEQ ID NO: 978753 - RNA, 19 nt, Homo sapiens
gagaaaaugaagagccaua

SEQ ID NO: 978754 - RNA, 19 nt, Homo sapiens
acuugugucuaauagcaua

SEQ ID NO: 978755 - RNA, 19 nt, Homo sapiens
caagcucccugcuggucau

SEQ ID NO: 978756 - RNA, 19 nt, Homo sapiens
cagccaaccagauccgaaa

SEQ ID NO: 978757 - RNA, 19 nt, Homo sapiens
gcccugugcucaagaagcu

SEQ ID NO: 978758 - RNA, 19 nt, Homo sapiens
gaagaugaagacaggaacu

SEQ ID NO: 978759 - RNA, 19 nt, Homo sapiens
cuccagagccugauagaca

SEQ ID NO: 978760 - RNA, 19 nt, Homo sapiens
guuagaagaagaauuugag

SEQ ID NO: 978761 - RNA, 19 nt, Homo sapiens
ccauaaguuagaagaagaa

SEQ ID NO: 978762 - RNA, 19 nt, Homo sapiens
gagccauaaguuagaagaa

SEQ ID NO: 978763 - RNA, 19 nt, Homo sapiens
cagaaaagaccccuaagga

SEQ ID NO: 978764 - RNA, 19 nt, Homo sapiens
ggaaagaugugaagauaga

SEQ ID NO: 978765 - RNA, 19 nt, Homo sapiens
caacaaagauguaugaagu

SEQ ID NO: 978766 - RNA, 19 nt, Homo sapiens
gagagcaacugguucauaa

SEQ ID NO: 978767 - RNA, 19 nt, Homo sapiens
gaaaugauugcuccuguua

SEQ ID NO: 978768 - RNA, 19 nt, Homo sapiens
gcaacugguucauaauuaa

SEQ ID NO: 978769 - RNA, 19 nt, Homo sapiens
gaacacuucuugaaaccuu

SEQ ID NO: 978770 - RNA, 19 nt, Homo sapiens
caacuuugauccuccaauu

SEQ ID NO: 978771 - RNA, 19 nt, Homo sapiens
ggacaucaaugccuuugug

SEQ ID NO: 978772 - RNA, 19 nt, Homo sapiens
gcacuucagcagccuauua

SEQ ID NO: 978773 - RNA, 19 nt, Homo sapiens
aaacacacgguucuaauua

SEQ ID NO: 978774 - RNA, 19 nt, Homo sapiens
ccacaacgcugcacuccuu

SEQ ID NO: 978775 - RNA, 19 nt, Homo sapiens
gaagauagaccuguuugaa

SEQ ID NO: 978776 - RNA, 19 nt, Homo sapiens
caggauggcuuauaugaga

SEQ ID NO: 978777 - RNA, 19 nt, Homo sapiens
aaacugaacuaugaaguga

SEQ ID NO: 978778 - RNA, 19 nt, Homo sapiens
gagcagagaugauuuugaa

SEQ ID NO: 978779 - RNA, 19 nt, Homo sapiens
gaagguggcaauaaacuug

SEQ ID NO: 978780 - RNA, 19 nt, Homo sapiens
gagaaguuccucaaugaaa

SEQ ID NO: 978781 - RNA, 19 nt, Homo sapiens
cuaauuaagugugaaggua

SEQ ID NO: 978782 - RNA, 19 nt, Homo sapiens
gagcaacugguucauaauu

SEQ ID NO: 978783 - RNA, 19 nt, Homo sapiens
gcagaaauuugggaaagau

SEQ ID NO: 978784 - RNA, 19 nt, Homo sapiens
uugcauauccucacuauaa

SEQ ID NO: 978785 - RNA, 19 nt, Homo sapiens
gaaauccaacaaagaugua

SEQ ID NO: 978786 - RNA, 19 nt, Homo sapiens
ucuuauaucuggcucagua

SEQ ID NO: 978787 - RNA, 19 nt, Homo sapiens
uaaauuaguuuggcgcuau

SEQ ID NO: 978788 - RNA, 19 nt, Homo sapiens
ugggaaagaugugaagaua

SEQ ID NO: 978789 - RNA, 19 nt, Homo sapiens
ucacuguccuguucugauu

SEQ ID NO: 978790 - RNA, 19 nt, Homo sapiens
ggaauugaauacaucuauc

SEQ ID NO: 978791 - RNA, 19 nt, Homo sapiens
uaauguacaucgaggagaa

SEQ ID NO: 978792 - RNA, 19 nt, Homo sapiens
aguagaagguggcaauaaa

SEQ ID NO: 978793 - RNA, 19 nt, Homo sapiens
gaauacaucuaucuuuagc

SEQ ID NO: 978794 - RNA, 19 nt, Homo sapiens
ggagagcaacugguucaua

SEQ ID NO: 978795 - RNA, 19 nt, Homo sapiens
caacagauggaacauaugu

SEQ ID NO: 978796 - RNA, 19 nt, Homo sapiens
ggaaauccaacaaagaugu

SEQ ID NO: 978797 - RNA, 19 nt, Homo sapiens
ggagaugagugccauugca

SEQ ID NO: 978798 - RNA, 19 nt, Homo sapiens
ggaagauccugagccauca

SEQ ID NO: 978799 - RNA, 19 nt, Homo sapiens
ugucauccauccuuuaaau

SEQ ID NO: 978800 - RNA, 19 nt, Homo sapiens
agauagaccuguuugaaag

SEQ ID NO: 978801 - RNA, 19 nt, Homo sapiens
agcaacugguucauaauua

SEQ ID NO: 978802 - RNA, 19 nt, Homo sapiens
ggcaggagguucugucauc

SEQ ID NO: 978803 - RNA, 19 nt, Homo sapiens
ccacuccguugaaucgaaa

SEQ ID NO: 978804 - RNA, 19 nt, Homo sapiens
ugaaaugauugcuccuguu

SEQ ID NO: 978805 - RNA, 19 nt, Homo sapiens
guuccucaaugaaaugauu

SEQ ID NO: 978806 - RNA, 19 nt, Homo sapiens
agaaguuccucaaugaaau

SEQ ID NO: 978807 - RNA, 19 nt, Homo sapiens
guggguagaggacguguua

SEQ ID NO: 978808 - RNA, 19 nt, Homo sapiens
cuuuaaaucugcacaugaa

SEQ ID NO: 978809 - RNA, 19 nt, Homo sapiens
cuagacccauagauaaauu

SEQ ID NO: 978810 - RNA, 19 nt, Homo sapiens
aaugauugcuccuguuaug

SEQ ID NO: 978811 - RNA, 19 nt, Homo sapiens
uagaggacguguuagacaa

SEQ ID NO: 978812 - RNA, 19 nt, Homo sapiens
ugaucaggauggcuuauau

SEQ ID NO: 978813 - RNA, 19 nt, Homo sapiens
gcaagugccauggagauga

SEQ ID NO: 978814 - RNA, 19 nt, Homo sapiens
ccauauagugacaacuuua

SEQ ID NO: 978815 - RNA, 19 nt, Homo sapiens
gaggaauuccaucaauauu

SEQ ID NO: 978816 - RNA, 19 nt, Homo sapiens
gaaguuccucaaugaaaug

SEQ ID NO: 978817 - RNA, 19 nt, Homo sapiens
aacacacgguucuaauuaa

SEQ ID NO: 978818 - RNA, 19 nt, Homo sapiens
gaacgggcacacagacaug

SEQ ID NO: 978819 - RNA, 19 nt, Homo sapiens
uccaugaucgacuuuauua

SEQ ID NO: 978820 - RNA, 19 nt, Homo sapiens
ccaaagcacggacaucaau

SEQ ID NO: 978821 - RNA, 19 nt, Homo sapiens
acaucuaucuuuagcucua

SEQ ID NO: 978822 - RNA, 19 nt, Homo sapiens
gggaauugaauacaucuau

SEQ ID NO: 978823 - RNA, 19 nt, Homo sapiens
gaggagagcaacugguuca

SEQ ID NO: 978824 - RNA, 19 nt, Homo sapiens
gcuugcauauccucacuau

SEQ ID NO: 978825 - RNA, 19 nt, Homo sapiens
ugaggaauuccaucaauau

SEQ ID NO: 978826 - RNA, 19 nt, Homo sapiens
aaacaaagaccaaguacac

SEQ ID NO: 978827 - RNA, 19 nt, Homo sapiens
aagauagaccuguuugaaa

SEQ ID NO: 978828 - RNA, 19 nt, Homo sapiens
guucagacuucuaugacau

SEQ ID NO: 978829 - RNA, 19 nt, Homo sapiens
caggaaauccaacaaagau

SEQ ID NO: 978830 - RNA, 19 nt, Homo sapiens
ggcagaaauuugggaaaga

SEQ ID NO: 978831 - RNA, 19 nt, Homo sapiens
aaucgaacacuucuugaaa

SEQ ID NO: 978832 - RNA, 19 nt, Homo sapiens
guucugucauccauccuuu

SEQ ID NO: 978833 - RNA, 19 nt, Homo sapiens
cacaggaaauccaacaaag

SEQ ID NO: 978834 - RNA, 19 nt, Homo sapiens
gcucaguaauguacaucga

SEQ ID NO: 978835 - RNA, 19 nt, Homo sapiens
gcaguagaagguggcaaua

SEQ ID NO: 978836 - RNA, 19 nt, Homo sapiens
guuaugagggucaauuaug

SEQ ID NO: 978837 - RNA, 19 nt, Homo sapiens
gauauauaauggagagacu

SEQ ID NO: 978838 - RNA, 19 nt, Homo sapiens
acacgguucuaauuaagug

SEQ ID NO: 978839 - RNA, 19 nt, Homo sapiens
ccagauauuuugccauuau

SEQ ID NO: 978840 - RNA, 19 nt, Homo sapiens
gauagaccuguuugaaaga

SEQ ID NO: 978841 - RNA, 19 nt, Homo sapiens
gaaauuugggaaagaugug

SEQ ID NO: 978842 - RNA, 19 nt, Homo sapiens
gcacacagacaugauugau

SEQ ID NO: 978843 - RNA, 19 nt, Homo sapiens
acacacgguucuaauuaag

SEQ ID NO: 978844 - RNA, 19 nt, Homo sapiens
caagugccauggagaugag

SEQ ID NO: 978845 - RNA, 19 nt, Homo sapiens
cauagagugugcagcaagu

SEQ ID NO: 978846 - RNA, 19 nt, Homo sapiens
gggauugugcccucuguga

SEQ ID NO: 978847 - RNA, 19 nt, Homo sapiens
acacaggaaauccaacaaa

SEQ ID NO: 978848 - RNA, 19 nt, Homo sapiens
guagaggacguguuagaca

SEQ ID NO: 978849 - RNA, 19 nt, Homo sapiens
ggaaaacacacgguucuaa

SEQ ID NO: 978850 - RNA, 19 nt, Homo sapiens
uggcuuauaugagaaacuu

SEQ ID NO: 978851 - RNA, 19 nt, Homo sapiens
gaucaggauggcuuauaug

SEQ ID NO: 978852 - RNA, 19 nt, Homo sapiens
cauuaacaguauugggauu

SEQ ID NO: 978853 - RNA, 19 nt, Homo sapiens
uagacaaguucaugaggau

SEQ ID NO: 978854 - RNA, 19 nt, Homo sapiens
guacacaggaaauccaaca

SEQ ID NO: 978855 - RNA, 19 nt, Homo sapiens
ggacguguuagacaaguuc

SEQ ID NO: 978856 - RNA, 19 nt, Homo sapiens
gaaaacacacgguucuaau

SEQ ID NO: 978857 - RNA, 19 nt, Homo sapiens
gagaaaugccccucuauca

SEQ ID NO: 978858 - RNA, 19 nt, Homo sapiens
aucaacagauggaacauau

SEQ ID NO: 978859 - RNA, 19 nt, Homo sapiens
gauugugcccucugugaga

SEQ ID NO: 978860 - RNA, 19 nt, Homo sapiens
cuuuagcucuagacccaua

SEQ ID NO: 978861 - RNA, 19 nt, Homo sapiens
caccauauagugacaacuu

SEQ ID NO: 978862 - RNA, 19 nt, Homo sapiens
cggcagaaauuugggaaag

SEQ ID NO: 978863 - RNA, 19 nt, Homo sapiens
ggccaaagcacggacauca

SEQ ID NO: 978864 - RNA, 19 nt, Homo sapiens
ccaaggaccucauuuaguu

SEQ ID NO: 978865 - RNA, 19 nt, Homo sapiens
gcccagcucuucuguccuu

SEQ ID NO: 978866 - RNA, 19 nt, Homo sapiens
uggaagagccugccaagga

SEQ ID NO: 978867 - RNA, 19 nt, Homo sapiens
caaggaccucauuuaguuu

SEQ ID NO: 978868 - RNA, 19 nt, Homo sapiens
gaccucauuuaguuugugu

SEQ ID NO: 978869 - RNA, 19 nt, Homo sapiens
ggaccucauuuaguuugug

SEQ ID NO: 978870 - RNA, 19 nt, Homo sapiens
ccucgcugcucaaguccua

SEQ ID NO: 978871 - RNA, 19 nt, Homo sapiens
gccaaggaccucauuuagu

SEQ ID NO: 978872 - RNA, 19 nt, Homo sapiens
cugccaaggaccucauuua

SEQ ID NO: 978873 - RNA, 19 nt, Homo sapiens
gcacuaccccgacgccuuu

SEQ ID NO: 978874 - RNA, 19 nt, Homo sapiens
gcagacgcccaggaaguga

SEQ ID NO: 978875 - RNA, 19 nt, Homo sapiens
gugaccuucuccuggauga

SEQ ID NO: 978876 - RNA, 19 nt, Homo sapiens
ggguggacagcaauagaaa

SEQ ID NO: 978877 - RNA, 19 nt, Homo sapiens
ggaaugaaagggccaugcu

SEQ ID NO: 978878 - RNA, 19 nt, Homo sapiens
gcguucaggucugguuuca

SEQ ID NO: 978879 - RNA, 19 nt, Homo sapiens
gccgcaggauggugagugu

SEQ ID NO: 978880 - RNA, 19 nt, Homo sapiens
cugccucgcugcucaaguc

SEQ ID NO: 978881 - RNA, 19 nt, Homo sapiens
gaacaugggugaucgguuu

SEQ ID NO: 978882 - RNA, 19 nt, Homo sapiens
gaaaugagcuugggcugaa

SEQ ID NO: 978883 - RNA, 19 nt, Homo sapiens
cgagaaagcugcacaguau

SEQ ID NO: 978884 - RNA, 19 nt, Homo sapiens
gagguugacuuuccaauga

SEQ ID NO: 978885 - RNA, 19 nt, Homo sapiens
ucagauggauggacacaua

SEQ ID NO: 978886 - RNA, 19 nt, Homo sapiens
ucaaagagauaugccguua

SEQ ID NO: 978887 - RNA, 19 nt, Homo sapiens
gaagagaagcuaaagaaau

SEQ ID NO: 978888 - RNA, 19 nt, Homo sapiens
aaagagauaugccguuauu

SEQ ID NO: 978889 - RNA, 19 nt, Homo sapiens
gaagugagcaggauagaau

SEQ ID NO: 978890 - RNA, 19 nt, Homo sapiens
gggaggagguuugcaguaa

SEQ ID NO: 978891 - RNA, 19 nt, Homo sapiens
aagagaagcuaaagaaaug

SEQ ID NO: 978892 - RNA, 19 nt, Homo sapiens
guugacaugucguuguuua

SEQ ID NO: 978893 - RNA, 19 nt, Homo sapiens
gaacggcuccugucgaaug

SEQ ID NO: 978894 - RNA, 19 nt, Homo sapiens
gggcagaucaugauugaaa

SEQ ID NO: 978895 - RNA, 19 nt, Homo sapiens
gaaaucaacagaggauauu

SEQ ID NO: 978896 - RNA, 19 nt, Homo sapiens
gagagagccauguucauaa

SEQ ID NO: 978897 - RNA, 19 nt, Homo sapiens
ccgcaaaccuccugaagug

SEQ ID NO: 978898 - RNA, 19 nt, Homo sapiens
ggaagagaagcuaaagaaa

SEQ ID NO: 978899 - RNA, 19 nt, Homo sapiens
ugagagagccauguucaua

SEQ ID NO: 978900 - RNA, 19 nt, Homo sapiens
ugucugaacuggaagagaa

SEQ ID NO: 978901 - RNA, 19 nt, Homo sapiens
gagccauguucauaaacua

SEQ ID NO: 978902 - RNA, 19 nt, Homo sapiens
agagagccauguucauaaa

SEQ ID NO: 978903 - RNA, 19 nt, Homo sapiens
cugaaugugugcugguuua

SEQ ID NO: 978904 - RNA, 19 nt, Homo sapiens
caucuuggccacucugaua

SEQ ID NO: 978905 - RNA, 19 nt, Homo sapiens
gaacuggaagagaagcuaa

SEQ ID NO: 978906 - RNA, 19 nt, Homo sapiens
gacacauacuggauucaaa

SEQ ID NO: 978907 - RNA, 19 nt, Homo sapiens
cauacuggauucaaagaga

SEQ ID NO: 978908 - RNA, 19 nt, Homo sapiens
gauaccaccuucuggagau

SEQ ID NO: 978909 - RNA, 19 nt, Homo sapiens
cugauaggcuggacaguga

SEQ ID NO: 978910 - RNA, 19 nt, Homo sapiens
gacaugucguuguuuaaau

SEQ ID NO: 978911 - RNA, 19 nt, Homo sapiens
ugagaagccuuggucacua

SEQ ID NO: 978912 - RNA, 19 nt, Homo sapiens
gagaagcuaaagaaaugua

SEQ ID NO: 978913 - RNA, 19 nt, Homo sapiens
gcuacuggcaugacccuua

SEQ ID NO: 978914 - RNA, 19 nt, Homo sapiens
aagaacggcuccugucgaa

SEQ ID NO: 978915 - RNA, 19 nt, Homo sapiens
gagauuaaaggaugaagau

SEQ ID NO: 978916 - RNA, 19 nt, Homo sapiens
gagaagccuuggucacuac

SEQ ID NO: 978917 - RNA, 19 nt, Homo sapiens
cacuugaacuccuggauga

SEQ ID NO: 978918 - RNA, 19 nt, Homo sapiens
gcaagucauuagagucaca

SEQ ID NO: 978919 - RNA, 19 nt, Homo sapiens
gaagugggcagccaacagu

SEQ ID NO: 978920 - RNA, 19 nt, Homo sapiens
gagauaugccguuauugga

SEQ ID NO: 978921 - RNA, 19 nt, Homo sapiens
gcaugacccuuacauacag

SEQ ID NO: 978922 - RNA, 19 nt, Homo sapiens
gauagaaucacuugaacuc

SEQ ID NO: 978923 - RNA, 19 nt, Homo sapiens
ggacacacuucagauggau

SEQ ID NO: 978924 - RNA, 19 nt, Homo sapiens
cuacaguggucgcacaugu

SEQ ID NO: 978925 - RNA, 19 nt, Homo sapiens
gagcugaagugagcaggau

SEQ ID NO: 978926 - RNA, 19 nt, Homo sapiens
ggcugaaggagauaacuua

SEQ ID NO: 978927 - RNA, 19 nt, Homo sapiens
caggauagaaucacuugaa

SEQ ID NO: 978928 - RNA, 19 nt, Homo sapiens
uggaagagaagcuaaagaa

SEQ ID NO: 978929 - RNA, 19 nt, Homo sapiens
ggaggagguuugcaguaag

SEQ ID NO: 978930 - RNA, 19 nt, Homo sapiens
ugacaugucguuguuuaaa

SEQ ID NO: 978931 - RNA, 19 nt, Homo sapiens
ggagaccugcaagucauua

SEQ ID NO: 978932 - RNA, 19 nt, Homo sapiens
ggacacauacuggauucaa

SEQ ID NO: 978933 - RNA, 19 nt, Homo sapiens
caaaggaggaaaugagcuu

SEQ ID NO: 978934 - RNA, 19 nt, Homo sapiens
ugaaaucaacagaggauau

SEQ ID NO: 978935 - RNA, 19 nt, Homo sapiens
gauggacacauacuggauu

SEQ ID NO: 978936 - RNA, 19 nt, Homo sapiens
gauuaaaggaugaagaucu

SEQ ID NO: 978937 - RNA, 19 nt, Homo sapiens
ggugucagucagcuuauaa

SEQ ID NO: 978938 - RNA, 19 nt, Homo sapiens
cauggugucagucagcuua

SEQ ID NO: 978939 - RNA, 19 nt, Homo sapiens
gguugacuuuccaaugauu

SEQ ID NO: 978940 - RNA, 19 nt, Homo sapiens
ggagauuaaaggaugaaga

SEQ ID NO: 978941 - RNA, 19 nt, Homo sapiens
gcuuauaaaggcauuucua

SEQ ID NO: 978942 - RNA, 19 nt, Homo sapiens
gaggaaagccccugaaauc

SEQ ID NO: 978943 - RNA, 19 nt, Homo sapiens
gucauuagagucacagaaa

SEQ ID NO: 978944 - RNA, 19 nt, Homo sapiens
ggucgcacauguuccucuu

SEQ ID NO: 978945 - RNA, 19 nt, Homo sapiens
guggagaccugcaagucau

SEQ ID NO: 978946 - RNA, 19 nt, Homo sapiens
ggcaugacccuuacauaca

SEQ ID NO: 978947 - RNA, 19 nt, Homo sapiens
gagguuugcaguaagcauu

SEQ ID NO: 978948 - RNA, 19 nt, Homo sapiens
ucuaucaccuccugcuguu

SEQ ID NO: 978949 - RNA, 19 nt, Homo sapiens
ggaaagccccugaaaucaa

SEQ ID NO: 978950 - RNA, 19 nt, Homo sapiens
ucagaggacacacuucaga

SEQ ID NO: 978951 - RNA, 19 nt, Homo sapiens
gaaagccccugaaaucaac

SEQ ID NO: 978952 - RNA, 19 nt, Homo sapiens
gaggagguuugcaguaagc

SEQ ID NO: 978953 - RNA, 19 nt, Homo sapiens
aaaucucacuugccaccaa

SEQ ID NO: 978954 - RNA, 19 nt, Homo sapiens
ucgacaugauggaguugua

SEQ ID NO: 978955 - RNA, 19 nt, Homo sapiens
uugggcagaucaugauuga

SEQ ID NO: 978956 - RNA, 19 nt, Homo sapiens
uggcaaaucuuuucaucuu

SEQ ID NO: 978957 - RNA, 19 nt, Homo sapiens
gaaagcugcacaguaucaa

SEQ ID NO: 978958 - RNA, 19 nt, Homo sapiens
caaccaaaggaggaaauga

SEQ ID NO: 978959 - RNA, 19 nt, Homo sapiens
cauuagagucacagaaaga

SEQ ID NO: 978960 - RNA, 19 nt, Homo sapiens
agaaagcugcacaguauca

SEQ ID NO: 978961 - RNA, 19 nt, Homo sapiens
caucggccgucgacaugau

SEQ ID NO: 978962 - RNA, 19 nt, Homo sapiens
caaagagauaugccguuau

SEQ ID NO: 978963 - RNA, 19 nt, Homo sapiens
aaucucacuugccaccaaa

SEQ ID NO: 978964 - RNA, 19 nt, Homo sapiens
ggucucaucccacacucuu

SEQ ID NO: 978965 - RNA, 19 nt, Homo sapiens
gagcaggauagaaucacuu

SEQ ID NO: 978966 - RNA, 19 nt, Homo sapiens
gcauucagaggacacacuu

SEQ ID NO: 978967 - RNA, 19 nt, Homo sapiens
uucuagaacugcauucaga

SEQ ID NO: 978968 - RNA, 19 nt, Homo sapiens
uuacauacagcacuuugug

SEQ ID NO: 978969 - RNA, 19 nt, Homo sapiens
ucauuagagucacagaaag

SEQ ID NO: 978970 - RNA, 19 nt, Homo sapiens
agagauaugccguuauugg

SEQ ID NO: 978971 - RNA, 19 nt, Homo sapiens
acgagaaagcugcacagua

SEQ ID NO: 978972 - RNA, 19 nt, Homo sapiens
gcauggauaccaccuucug

SEQ ID NO: 978973 - RNA, 19 nt, Homo sapiens
gcaaccaaaggaggaaaug

SEQ ID NO: 978974 - RNA, 19 nt, Homo sapiens
gggcugaaggagauaacuu

SEQ ID NO: 978975 - RNA, 19 nt, Homo sapiens
gcaagagaacucccaucag

SEQ ID NO: 978976 - RNA, 19 nt, Homo sapiens
cuacuggcaugacccuuac

SEQ ID NO: 978977 - RNA, 19 nt, Homo sapiens
gaauacacaauugccaaca

SEQ ID NO: 978978 - RNA, 19 nt, Homo sapiens
ggauggacacauacuggau

SEQ ID NO: 978979 - RNA, 19 nt, Homo sapiens
ucucaucccacacucuuga

SEQ ID NO: 978980 - RNA, 19 nt, Homo sapiens
cuccagagcaguccgcaaa

SEQ ID NO: 978981 - RNA, 19 nt, Homo sapiens
gaacaugggugaucgguuu

SEQ ID NO: 978982 - RNA, 19 nt, Homo sapiens
gaaaugagcuugggcugaa

SEQ ID NO: 978983 - RNA, 19 nt, Homo sapiens
ucaaauggauggacacaua

SEQ ID NO: 978984 - RNA, 19 nt, Homo sapiens
cgagaaagcugcacaguau

SEQ ID NO: 978985 - RNA, 19 nt, Homo sapiens
gagguugacuuuccaauga

SEQ ID NO: 978986 - RNA, 19 nt, Homo sapiens
ucaaagagauaugccguua

SEQ ID NO: 978987 - RNA, 19 nt, Homo sapiens
gaagagaagcuaaagaaau

SEQ ID NO: 978988 - RNA, 19 nt, Homo sapiens
aaagagauaugccguuauu

SEQ ID NO: 978989 - RNA, 19 nt, Homo sapiens
gaagugagcaggauagaau

SEQ ID NO: 978990 - RNA, 19 nt, Homo sapiens
aagagaagcuaaagaaaug

SEQ ID NO: 978991 - RNA, 19 nt, Homo sapiens
guugacaugucguuguuua

SEQ ID NO: 978992 - RNA, 19 nt, Homo sapiens
gaacggcuccugucgaaug

SEQ ID NO: 978993 - RNA, 19 nt, Homo sapiens
gggcagaucaugauugaaa

SEQ ID NO: 978994 - RNA, 19 nt, Homo sapiens
ggacacacuucaaauggau

SEQ ID NO: 978995 - RNA, 19 nt, Homo sapiens
gaaaucaacagaggauauu

SEQ ID NO: 978996 - RNA, 19 nt, Homo sapiens
gagagagccauguucauaa

SEQ ID NO: 978997 - RNA, 19 nt, Homo sapiens
ccgcaaaccuccugaagug

SEQ ID NO: 978998 - RNA, 19 nt, Homo sapiens
gaucuucucccaaguaaau

SEQ ID NO: 978999 - RNA, 19 nt, Homo sapiens
ggaagagaagcuaaagaaa

SEQ ID NO: 979000 - RNA, 19 nt, Homo sapiens
ugagagagccauguucaua

SEQ ID NO: 979001 - RNA, 19 nt, Homo sapiens
ugucugaacuggaagagaa

SEQ ID NO: 979002 - RNA, 19 nt, Homo sapiens
gagccauguucauaaacua

SEQ ID NO: 979003 - RNA, 19 nt, Homo sapiens
agagagccauguucauaaa

SEQ ID NO: 979004 - RNA, 19 nt, Homo sapiens
cugaaugugugcugguuua

SEQ ID NO: 979005 - RNA, 19 nt, Homo sapiens
gaacuggaagagaagcuaa

SEQ ID NO: 979006 - RNA, 19 nt, Homo sapiens
gacacauacuggauucaaa

SEQ ID NO: 979007 - RNA, 19 nt, Homo sapiens
cauacuggauucaaagaga

SEQ ID NO: 979008 - RNA, 19 nt, Homo sapiens
gauaccaccuucuggagau

SEQ ID NO: 979009 - RNA, 19 nt, Homo sapiens
gacaugucguuguuuaaau

SEQ ID NO: 979010 - RNA, 19 nt, Homo sapiens
ugagaagccuuggucacua

SEQ ID NO: 979011 - RNA, 19 nt, Homo sapiens
gagaagcuaaagaaaugua

SEQ ID NO: 979012 - RNA, 19 nt, Homo sapiens
gcuacuggcaugacccuua

SEQ ID NO: 979013 - RNA, 19 nt, Homo sapiens
aagaacggcuccugucgaa

SEQ ID NO: 979014 - RNA, 19 nt, Homo sapiens
gagauuaaaggaugaagau

SEQ ID NO: 979015 - RNA, 19 nt, Homo sapiens
ggauagaaucacuugaauu

SEQ ID NO: 979016 - RNA, 19 nt, Homo sapiens
gagaagccuuggucacuac

SEQ ID NO: 979017 - RNA, 19 nt, Homo sapiens
gcaagucauuagagucaca

SEQ ID NO: 979018 - RNA, 19 nt, Homo sapiens
gaagugggcagccaacagu

SEQ ID NO: 979019 - RNA, 19 nt, Homo sapiens
gagauaugccguuauugga

SEQ ID NO: 979020 - RNA, 19 nt, Homo sapiens
gcaugacccuuacauacag

SEQ ID NO: 979021 - RNA, 19 nt, Homo sapiens
cuacaguggucgcacaugu

SEQ ID NO: 979022 - RNA, 19 nt, Homo sapiens
gagcugaagugagcaggau

SEQ ID NO: 979023 - RNA, 19 nt, Homo sapiens
ggcugaaggagauaacuua

SEQ ID NO: 979024 - RNA, 19 nt, Homo sapiens
caggauagaaucacuugaa

SEQ ID NO: 979025 - RNA, 19 nt, Homo sapiens
uggaagagaagcuaaagaa

SEQ ID NO: 979026 - RNA, 19 nt, Homo sapiens
ugacaugucguuguuuaaa

SEQ ID NO: 979027 - RNA, 19 nt, Homo sapiens
ggagaccugcaagucauua

SEQ ID NO: 979028 - RNA, 19 nt, Homo sapiens
ggacacauacuggauucaa

SEQ ID NO: 979029 - RNA, 19 nt, Homo sapiens
ucagaggacacacuucaaa

SEQ ID NO: 979030 - RNA, 19 nt, Homo sapiens
aagaucuucucccaaguaa

SEQ ID NO: 979031 - RNA, 19 nt, Homo sapiens
caaaggaggaaaugagcuu

SEQ ID NO: 979032 - RNA, 19 nt, Homo sapiens
ugaaaucaacagaggauau

SEQ ID NO: 979033 - RNA, 19 nt, Homo sapiens
gauggacacauacuggauu

SEQ ID NO: 979034 - RNA, 19 nt, Homo sapiens
gaggacacacuucaaaugg

SEQ ID NO: 979035 - RNA, 19 nt, Homo sapiens
gauuaaaggaugaagaucu

SEQ ID NO: 979036 - RNA, 19 nt, Homo sapiens
ggugucagucagcuuauaa

SEQ ID NO: 979037 - RNA, 19 nt, Homo sapiens
cauggugucagucagcuua

SEQ ID NO: 979038 - RNA, 19 nt, Homo sapiens
gaggaaagccccugaaauc

SEQ ID NO: 979039 - RNA, 19 nt, Homo sapiens
caagagguuugcaguaagc

SEQ ID NO: 979040 - RNA, 19 nt, Homo sapiens
gguugacuuuccaaugauu

SEQ ID NO: 979041 - RNA, 19 nt, Homo sapiens
ggagauuaaaggaugaaga

SEQ ID NO: 979042 - RNA, 19 nt, Homo sapiens
gcuuauaaaggcauuucua

SEQ ID NO: 979043 - RNA, 19 nt, Homo sapiens
gucauuagagucacagaaa

SEQ ID NO: 979044 - RNA, 19 nt, Homo sapiens
ggucgcacauguuccucuu

SEQ ID NO: 979045 - RNA, 19 nt, Homo sapiens
ggcaugacccuuacauaca

SEQ ID NO: 979046 - RNA, 19 nt, Homo sapiens
guggagaccugcaagucau

SEQ ID NO: 979047 - RNA, 19 nt, Homo sapiens
gagguuugcaguaagcauu

SEQ ID NO: 979048 - RNA, 19 nt, Homo sapiens
ucuaucaccuccugcuguu

SEQ ID NO: 979049 - RNA, 19 nt, Homo sapiens
ggaaagccccugaaaucaa

SEQ ID NO: 979050 - RNA, 19 nt, Homo sapiens
gaaagccccugaaaucaac

SEQ ID NO: 979051 - RNA, 19 nt, Homo sapiens
uugaauuccuggaugaaau

SEQ ID NO: 979052 - RNA, 19 nt, Homo sapiens
aaaucucacuugccaccaa

SEQ ID NO: 979053 - RNA, 19 nt, Homo sapiens
gcgcauuacugccuuugcu

SEQ ID NO: 979054 - RNA, 19 nt, Homo sapiens
ucgacaugauggaguugua

SEQ ID NO: 979055 - RNA, 19 nt, Homo sapiens
uugggcagaucaugauuga

SEQ ID NO: 979056 - RNA, 19 nt, Homo sapiens
gaaagcugcacaguaucaa

SEQ ID NO: 979057 - RNA, 19 nt, Homo sapiens
caaccaaaggaggaaauga

SEQ ID NO: 979058 - RNA, 19 nt, Homo sapiens
cacuugaauuccuggauga

SEQ ID NO: 979059 - RNA, 19 nt, Homo sapiens
aggauagaaucacuugaau

SEQ ID NO: 979060 - RNA, 19 nt, Homo sapiens
cauuagagucacagaaaga

SEQ ID NO: 979061 - RNA, 19 nt, Homo sapiens
agaaagcugcacaguauca

SEQ ID NO: 979062 - RNA, 19 nt, Homo sapiens
caucggccgucgacaugau

SEQ ID NO: 979063 - RNA, 19 nt, Homo sapiens
caaagagauaugccguuau

SEQ ID NO: 979064 - RNA, 19 nt, Homo sapiens
aaucucacuugccaccaaa

SEQ ID NO: 979065 - RNA, 19 nt, Homo sapiens
ggucucaucccacacucuu

SEQ ID NO: 979066 - RNA, 19 nt, Homo sapiens
gagcaggauagaaucacuu

SEQ ID NO: 979067 - RNA, 19 nt, Homo sapiens
uuacauacagcacuuugug

SEQ ID NO: 979068 - RNA, 19 nt, Homo sapiens
gcauucagaggacacacuu

SEQ ID NO: 979069 - RNA, 19 nt, Homo sapiens
uucuagaacugcauucaga

SEQ ID NO: 979070 - RNA, 19 nt, Homo sapiens
ucauuagagucacagaaag

SEQ ID NO: 979071 - RNA, 19 nt, Homo sapiens
agagauaugccguuauugg

SEQ ID NO: 979072 - RNA, 19 nt, Homo sapiens
agaggacacacuucaaaug

SEQ ID NO: 979073 - RNA, 19 nt, Homo sapiens
acgagaaagcugcacagua

SEQ ID NO: 979074 - RNA, 19 nt, Homo sapiens
gcauggauaccaccuucug

SEQ ID NO: 979075 - RNA, 19 nt, Homo sapiens
gcaaccaaaggaggaaaug

SEQ ID NO: 979076 - RNA, 19 nt, Homo sapiens
cagaggacacacuucaaau

SEQ ID NO: 979077 - RNA, 19 nt, Homo sapiens
gggcugaaggagauaacuu

SEQ ID NO: 979078 - RNA, 19 nt, Homo sapiens
ugaauuccuggaugaaaug

SEQ ID NO: 979079 - RNA, 19 nt, Homo sapiens
gaauacacaauugccaaca

SEQ ID NO: 979080 - RNA, 19 nt, Homo sapiens
cuacuggcaugacccuuac

SEQ ID NO: 979081 - RNA, 19 nt, Homo sapiens
guacauaacuggucauuaa

SEQ ID NO: 979082 - RNA, 19 nt, Homo sapiens
gagaauaacucaaguauca

SEQ ID NO: 979083 - RNA, 19 nt, Homo sapiens
ccagauggcuaguuuauua

SEQ ID NO: 979084 - RNA, 19 nt, Homo sapiens
gaacagaaguugugagaga

SEQ ID NO: 979085 - RNA, 19 nt, Homo sapiens
gagagaaacugaugaagaa

SEQ ID NO: 979086 - RNA, 19 nt, Homo sapiens
ggacuacucuucucauauu

SEQ ID NO: 979087 - RNA, 19 nt, Homo sapiens
gcauacaccugaagcuuua

SEQ ID NO: 979088 - RNA, 19 nt, Homo sapiens
gaugguauuugcacauuua

SEQ ID NO: 979089 - RNA, 19 nt, Homo sapiens
gcaguucucucuauucuga

SEQ ID NO: 979090 - RNA, 19 nt, Homo sapiens
gaagagaucacuuuaacaa

SEQ ID NO: 979091 - RNA, 19 nt, Homo sapiens
ccacugacaucuuugauau

SEQ ID NO: 979092 - RNA, 19 nt, Homo sapiens
cuacuggcaugaugaaaua

SEQ ID NO: 979093 - RNA, 19 nt, Homo sapiens
gccacaaggucacuaauuu

SEQ ID NO: 979094 - RNA, 19 nt, Homo sapiens
gagaucacuuuaacaauug

SEQ ID NO: 979095 - RNA, 19 nt, Homo sapiens
gcaaagauucugagucaaa

SEQ ID NO: 979096 - RNA, 19 nt, Homo sapiens
caaaggaaguucaacacaa

SEQ ID NO: 979097 - RNA, 19 nt, Homo sapiens
gagagaugcuguaaggaaa

SEQ ID NO: 979098 - RNA, 19 nt, Homo sapiens
uauaugagccuucuuguuu

SEQ ID NO: 979099 - RNA, 19 nt, Homo sapiens
uaacuugguucaucacauu

SEQ ID NO: 979100 - RNA, 19 nt, Homo sapiens
caagacauaucaagaaauc

SEQ ID NO: 979101 - RNA, 19 nt, Homo sapiens
gaacugaacauuuauuugg

SEQ ID NO: 979102 - RNA, 19 nt, Homo sapiens
gcaaggugauguuaguuau

SEQ ID NO: 979103 - RNA, 19 nt, Homo sapiens
guacuaagaugguauuugc

SEQ ID NO: 979104 - RNA, 19 nt, Homo sapiens
guuagcaucuugaaauuug

SEQ ID NO: 979105 - RNA, 19 nt, Homo sapiens
gcagauuucccuccagaua

SEQ ID NO: 979106 - RNA, 19 nt, Homo sapiens
ggacagauaucauuuuaug

SEQ ID NO: 979107 - RNA, 19 nt, Homo sapiens
agccauaccuuaaagauaa

SEQ ID NO: 979108 - RNA, 19 nt, Homo sapiens
guaacacaauggaguacua

SEQ ID NO: 979109 - RNA, 19 nt, Homo sapiens
ggagagaaacugaugaaga

SEQ ID NO: 979110 - RNA, 19 nt, Homo sapiens
ucaacgauauguuugguuu

SEQ ID NO: 979111 - RNA, 19 nt, Homo sapiens
acaagaggauauucacuuu

SEQ ID NO: 979112 - RNA, 19 nt, Homo sapiens
gauggcaacuguaugauag

SEQ ID NO: 979113 - RNA, 19 nt, Homo sapiens
ggaauguguuuacgauguu

SEQ ID NO: 979114 - RNA, 19 nt, Homo sapiens
ucguggaacugaacauuua

SEQ ID NO: 979115 - RNA, 19 nt, Homo sapiens
gagcauacccaggauuuaa

SEQ ID NO: 979116 - RNA, 19 nt, Homo sapiens
ccaaaugagauaagugaua

SEQ ID NO: 979117 - RNA, 19 nt, Homo sapiens
gcaggcaguucucucuauu

SEQ ID NO: 979118 - RNA, 19 nt, Homo sapiens
caggaaauuucuagaauca

SEQ ID NO: 979119 - RNA, 19 nt, Homo sapiens
aaaguggaguugcaaauau

SEQ ID NO: 979120 - RNA, 19 nt, Homo sapiens
caaggucacuaauuucuag

SEQ ID NO: 979121 - RNA, 19 nt, Homo sapiens
gacaguaggugcugacauc

SEQ ID NO: 979122 - RNA, 19 nt, Homo sapiens
gaagcuauauaaagucaag

SEQ ID NO: 979123 - RNA, 19 nt, Homo sapiens
gaggauauucacuuucaua

SEQ ID NO: 979124 - RNA, 19 nt, Homo sapiens
aaaggaaguucaacacaau

SEQ ID NO: 979125 - RNA, 19 nt, Homo sapiens
gaaaaccaacugagaauaa

SEQ ID NO: 979126 - RNA, 19 nt, Homo sapiens
uaaaguggaguugcaaaua

SEQ ID NO: 979127 - RNA, 19 nt, Homo sapiens
gacaaaacauggaugcaua

SEQ ID NO: 979128 - RNA, 19 nt, Homo sapiens
gagaaacugaugaagaauu

SEQ ID NO: 979129 - RNA, 19 nt, Homo sapiens
ccuaacagacuaauuugua

SEQ ID NO: 979130 - RNA, 19 nt, Homo sapiens
gugcugacaucaagaacaa

SEQ ID NO: 979131 - RNA, 19 nt, Homo sapiens
gcccuccacugacaucuuu

SEQ ID NO: 979132 - RNA, 19 nt, Homo sapiens
caaagauucugagucaaau

SEQ ID NO: 979133 - RNA, 19 nt, Homo sapiens
guaaucaacucugcuacug

SEQ ID NO: 979134 - RNA, 19 nt, Homo sapiens
gaacauuuauuuggcugau

SEQ ID NO: 979135 - RNA, 19 nt, Homo sapiens
agaaacugaugaagaauuc

SEQ ID NO: 979136 - RNA, 19 nt, Homo sapiens
ccuauaccuuuacccuuua

SEQ ID NO: 979137 - RNA, 19 nt, Homo sapiens
uaaagucaaguguccauuu

SEQ ID NO: 979138 - RNA, 19 nt, Homo sapiens
auaugagccuucuuguuua

SEQ ID NO: 979139 - RNA, 19 nt, Homo sapiens
ugaugaaccuggacuuuua

SEQ ID NO: 979140 - RNA, 19 nt, Homo sapiens
cuccagauauucaaucaaa

SEQ ID NO: 979141 - RNA, 19 nt, Homo sapiens
ggaccuguuuggagcagaa

SEQ ID NO: 979142 - RNA, 19 nt, Homo sapiens
aagaggauauucacuuuca

SEQ ID NO: 979143 - RNA, 19 nt, Homo sapiens
gguauuugcacauuuaaga

SEQ ID NO: 979144 - RNA, 19 nt, Homo sapiens
gagccuucuuguuuaguuu

SEQ ID NO: 979145 - RNA, 19 nt, Homo sapiens
gaaaaugugacuuagagua

SEQ ID NO: 979146 - RNA, 19 nt, Homo sapiens
uaaaugcaaggugauguua

SEQ ID NO: 979147 - RNA, 19 nt, Homo sapiens
gacaagaggauauucacuu

SEQ ID NO: 979148 - RNA, 19 nt, Homo sapiens
ggucaaaauuucuaacuug

SEQ ID NO: 979149 - RNA, 19 nt, Homo sapiens
cuaagucgcccuccacuga

SEQ ID NO: 979150 - RNA, 19 nt, Homo sapiens
gaauucugauggcaacugu

SEQ ID NO: 979151 - RNA, 19 nt, Homo sapiens
gccaaguuauuuaugauuc

SEQ ID NO: 979152 - RNA, 19 nt, Homo sapiens
agauuucccuccagauauu

SEQ ID NO: 979153 - RNA, 19 nt, Homo sapiens
aaagugugcugaagagauc

SEQ ID NO: 979154 - RNA, 19 nt, Homo sapiens
ggaacugaacauuuauuug

SEQ ID NO: 979155 - RNA, 19 nt, Homo sapiens
ggauuuaagucguggaacu

SEQ ID NO: 979156 - RNA, 19 nt, Homo sapiens
gauggcuaguuuauuaaug

SEQ ID NO: 979157 - RNA, 19 nt, Homo sapiens
augcaaagauucugaguca

SEQ ID NO: 979158 - RNA, 19 nt, Homo sapiens
guauauaugagccuucuug

SEQ ID NO: 979159 - RNA, 19 nt, Homo sapiens
uccuauaccuuuacccuuu

SEQ ID NO: 979160 - RNA, 19 nt, Homo sapiens
aaggacuacucuucucaua

SEQ ID NO: 979161 - RNA, 19 nt, Homo sapiens
guaaaugcaaggugauguu

SEQ ID NO: 979162 - RNA, 19 nt, Homo sapiens
acugacaucuuugauauga

SEQ ID NO: 979163 - RNA, 19 nt, Homo sapiens
ugcaagacauaucaagaaa

SEQ ID NO: 979164 - RNA, 19 nt, Homo sapiens
aaggugauguuaguuauga

SEQ ID NO: 979165 - RNA, 19 nt, Homo sapiens
gcugaagagaucacuuuaa

SEQ ID NO: 979166 - RNA, 19 nt, Homo sapiens
ugagagaugcuguaaggaa

SEQ ID NO: 979167 - RNA, 19 nt, Homo sapiens
uaucaaugguaacacaaug

SEQ ID NO: 979168 - RNA, 19 nt, Homo sapiens
agacuaauuuguacucagu

SEQ ID NO: 979169 - RNA, 19 nt, Homo sapiens
cuauuuaguuagcaucuug

SEQ ID NO: 979170 - RNA, 19 nt, Homo sapiens
gauguugaaugggacuuga

SEQ ID NO: 979171 - RNA, 19 nt, Homo sapiens
cacaauugccagcuucaua

SEQ ID NO: 979172 - RNA, 19 nt, Homo sapiens
ggaauuuucuucaaguguu

SEQ ID NO: 979173 - RNA, 19 nt, Homo sapiens
gauuccaucugauauacau

SEQ ID NO: 979174 - RNA, 19 nt, Homo sapiens
acuauucauuggacagaua

SEQ ID NO: 979175 - RNA, 19 nt, Homo sapiens
uggaauguguuuacgaugu

SEQ ID NO: 979176 - RNA, 19 nt, Homo sapiens
cugaagagaucacuuuaac

SEQ ID NO: 979177 - RNA, 19 nt, Homo sapiens
caaaguuucuuggcaguac

SEQ ID NO: 979178 - RNA, 19 nt, Homo sapiens
caacuauauuugagcauac

SEQ ID NO: 979179 - RNA, 19 nt, Homo sapiens
gaauguguuuacgauguug

SEQ ID NO: 979180 - RNA, 19 nt, Homo sapiens
auaccugccuugugucuga

SEQ ID NO: 979181 - RNA, 19 nt, Homo sapiens
ggaagaagcuccaccauga

SEQ ID NO: 979182 - RNA, 19 nt, Homo sapiens
gaaauugcaucuuguaguu

SEQ ID NO: 979183 - RNA, 19 nt, Homo sapiens
gaaguuaauugauggguuu

SEQ ID NO: 979184 - RNA, 19 nt, Homo sapiens
gaccagaucucaaaggaaa

SEQ ID NO: 979185 - RNA, 19 nt, Homo sapiens
gaauauggcauuugacuuu

SEQ ID NO: 979186 - RNA, 19 nt, Homo sapiens
gaaauacuguacugaucua

SEQ ID NO: 979187 - RNA, 19 nt, Homo sapiens
gcauuugacuuuauucuug

SEQ ID NO: 979188 - RNA, 19 nt, Homo sapiens
gaaaggcgaugcuaaacau

SEQ ID NO: 979189 - RNA, 19 nt, Homo sapiens
gaaaugugcugccucuguu

SEQ ID NO: 979190 - RNA, 19 nt, Homo sapiens
ggagauaugucaguauuga

SEQ ID NO: 979191 - RNA, 19 nt, Homo sapiens
gaaauuggaggaacaguuu

SEQ ID NO: 979192 - RNA, 19 nt, Homo sapiens
gcaaagugcaugauaguaa

SEQ ID NO: 979193 - RNA, 19 nt, Homo sapiens
gagaucaacuauggaauaa

SEQ ID NO: 979194 - RNA, 19 nt, Homo sapiens
caucagagcuguauaaugc

SEQ ID NO: 979195 - RNA, 19 nt, Homo sapiens
gagaagagcagcacugauu

SEQ ID NO: 979196 - RNA, 19 nt, Homo sapiens
cauaagugcuugugaggua

SEQ ID NO: 979197 - RNA, 19 nt, Homo sapiens
cagaagaaguagaugauuu

SEQ ID NO: 979198 - RNA, 19 nt, Homo sapiens
ccacaaaucuucccaaugc

SEQ ID NO: 979199 - RNA, 19 nt, Homo sapiens
ggaagcacauuaaaaguua

SEQ ID NO: 979200 - RNA, 19 nt, Homo sapiens
gaaauggaauggucuacau

SEQ ID NO: 979201 - RNA, 19 nt, Homo sapiens
gagaauggauaacuacaau

SEQ ID NO: 979202 - RNA, 19 nt, Homo sapiens
ggaguugccaucuauguua

SEQ ID NO: 979203 - RNA, 19 nt, Homo sapiens
ggaagucgcacaaacauug

SEQ ID NO: 979204 - RNA, 19 nt, Homo sapiens
gggcugaaauugcaucuug

SEQ ID NO: 979205 - RNA, 19 nt, Homo sapiens
ugauauggauugcuucuuu

SEQ ID NO: 979206 - RNA, 19 nt, Homo sapiens
gaaagcagcguaugaucaa

SEQ ID NO: 979207 - RNA, 19 nt, Homo sapiens
aaacaacuauguccuaauc

SEQ ID NO: 979208 - RNA, 19 nt, Homo sapiens
ccaaacagcucaacaacag

SEQ ID NO: 979209 - RNA, 19 nt, Homo sapiens
uaacaaggcugagucuuca

SEQ ID NO: 979210 - RNA, 19 nt, Homo sapiens
gcaagcaaauggaauugau

SEQ ID NO: 979211 - RNA, 19 nt, Homo sapiens
gcgcaucugugccaaagaa

SEQ ID NO: 979212 - RNA, 19 nt, Homo sapiens
gaaauaucaucugcuucua

SEQ ID NO: 979213 - RNA, 19 nt, Homo sapiens
gaucaacuauggaauaagg

SEQ ID NO: 979214 - RNA, 19 nt, Homo sapiens
aaacaggucagaugcuuua

SEQ ID NO: 979215 - RNA, 19 nt, Homo sapiens
ucugauagcugugccauaa

SEQ ID NO: 979216 - RNA, 19 nt, Homo sapiens
cagaagaaauucaaagaag

SEQ ID NO: 979217 - RNA, 19 nt, Homo sapiens
cauaucagcuguacaccaa

SEQ ID NO: 979218 - RNA, 19 nt, Homo sapiens
caaagugcaugauaguaau

SEQ ID NO: 979219 - RNA, 19 nt, Homo sapiens
gcaaauaccagaaccucaa

SEQ ID NO: 979220 - RNA, 19 nt, Homo sapiens
cagcugagaucaacuaugg

SEQ ID NO: 979221 - RNA, 19 nt, Homo sapiens
gaagacauucuccaaguug

SEQ ID NO: 979222 - RNA, 19 nt, Homo sapiens
uaauagcccuuccagcauu

SEQ ID NO: 979223 - RNA, 19 nt, Homo sapiens
ccacuggcaugaaggguaa

SEQ ID NO: 979224 - RNA, 19 nt, Homo sapiens
caggagauaugucaguauu

SEQ ID NO: 979225 - RNA, 19 nt, Homo sapiens
gaaggaaacagaauggaau

SEQ ID NO: 979226 - RNA, 19 nt, Homo sapiens
ggaaauaucaucugcuucu

SEQ ID NO: 979227 - RNA, 19 nt, Homo sapiens
ucaaagaccagacgaaaug

SEQ ID NO: 979228 - RNA, 19 nt, Homo sapiens
caaacuuacuccugaugaa

SEQ ID NO: 979229 - RNA, 19 nt, Homo sapiens
aagcuacacucauaacauu

SEQ ID NO: 979230 - RNA, 19 nt, Homo sapiens
ucaauggcaugaacaguug

SEQ ID NO: 979231 - RNA, 19 nt, Homo sapiens
ucaaugaugugaagaccuu

SEQ ID NO: 979232 - RNA, 19 nt, Homo sapiens
gguggacccugagguauuu

SEQ ID NO: 979233 - RNA, 19 nt, Homo sapiens
ccaggcaacuuggcauuaa

SEQ ID NO: 979234 - RNA, 19 nt, Homo sapiens
gauauggauugcuucuuug

SEQ ID NO: 979235 - RNA, 19 nt, Homo sapiens
cuacaaagacaaaguaaug

SEQ ID NO: 979236 - RNA, 19 nt, Homo sapiens
ggacagucuuguugcaaau

SEQ ID NO: 979237 - RNA, 19 nt, Homo sapiens
gcacuuucuugccaccuuu

SEQ ID NO: 979238 - RNA, 19 nt, Homo sapiens
gaaauucaaagaagacuag

SEQ ID NO: 979239 - RNA, 19 nt, Homo sapiens
cuaaacaacuauguccuaa

SEQ ID NO: 979240 - RNA, 19 nt, Homo sapiens
cagcagauauaccagauuc

SEQ ID NO: 979241 - RNA, 19 nt, Homo sapiens
ugagaucaacuauggaaua

SEQ ID NO: 979242 - RNA, 19 nt, Homo sapiens
caaagacaaaguaauggua

SEQ ID NO: 979243 - RNA, 19 nt, Homo sapiens
gggacuucaucuacaauuu

SEQ ID NO: 979244 - RNA, 19 nt, Homo sapiens
gcucaccacuccacuguuc

SEQ ID NO: 979245 - RNA, 19 nt, Homo sapiens
gaguugccaucuauguuaa

SEQ ID NO: 979246 - RNA, 19 nt, Homo sapiens
ggaaggaaacagaauggaa

SEQ ID NO: 979247 - RNA, 19 nt, Homo sapiens
cagaauggauuguggaaag

SEQ ID NO: 979248 - RNA, 19 nt, Homo sapiens
gggacagucuuguugcaaa

SEQ ID NO: 979249 - RNA, 19 nt, Homo sapiens
guggagacuugcaguauau

SEQ ID NO: 979250 - RNA, 19 nt, Homo sapiens
gcaaguguuuuguacauuu

SEQ ID NO: 979251 - RNA, 19 nt, Homo sapiens
agacuuaaccugaguauag

SEQ ID NO: 979252 - RNA, 19 nt, Homo sapiens
uauaccagauucaucauug

SEQ ID NO: 979253 - RNA, 19 nt, Homo sapiens
aggcaaagcagcagauaua

SEQ ID NO: 979254 - RNA, 19 nt, Homo sapiens
gaaauagaccagaucucaa

SEQ ID NO: 979255 - RNA, 19 nt, Homo sapiens
cagcaaagcaccagaaaca

SEQ ID NO: 979256 - RNA, 19 nt, Homo sapiens
cgacuccucuccuacauuc

SEQ ID NO: 979257 - RNA, 19 nt, Homo sapiens
ugccaggccuuucuaguuu

SEQ ID NO: 979258 - RNA, 19 nt, Homo sapiens
caggucagaugcuuuauag

SEQ ID NO: 979259 - RNA, 19 nt, Homo sapiens
gaagcgagcugaaaaugau

SEQ ID NO: 979260 - RNA, 19 nt, Homo sapiens
gcaaagcaccagaaacaca

SEQ ID NO: 979261 - RNA, 19 nt, Homo sapiens
guaaaucacaucguuaaga

SEQ ID NO: 979262 - RNA, 19 nt, Homo sapiens
cgaccaguccugauacuaa

SEQ ID NO: 979263 - RNA, 19 nt, Homo sapiens
ggccauggaauuugugaua

SEQ ID NO: 979264 - RNA, 19 nt, Homo sapiens
guaaacgucuaacucucaa

SEQ ID NO: 979265 - RNA, 19 nt, Homo sapiens
gcuaaacaacuauguccua

SEQ ID NO: 979266 - RNA, 19 nt, Homo sapiens
cgaaauagaccagaucuca

SEQ ID NO: 979267 - RNA, 19 nt, Homo sapiens
ccaguaaauggcuguaaua

SEQ ID NO: 979268 - RNA, 19 nt, Homo sapiens
gaugauagaccaguucgaa

SEQ ID NO: 979269 - RNA, 19 nt, Homo sapiens
cauugaagcugucaguugu

SEQ ID NO: 979270 - RNA, 19 nt, Homo sapiens
gaacaguuggaaugaagaa

SEQ ID NO: 979271 - RNA, 19 nt, Homo sapiens
caggguaaaucacaucguu

SEQ ID NO: 979272 - RNA, 19 nt, Homo sapiens
ggagcacaaagaaguauuu

SEQ ID NO: 979273 - RNA, 19 nt, Homo sapiens
aaauagaccagaucucaaa

SEQ ID NO: 979274 - RNA, 19 nt, Homo sapiens
gaacaguuucgaucagaug

SEQ ID NO: 979275 - RNA, 19 nt, Homo sapiens
caaagucaauggcaugaac

SEQ ID NO: 979276 - RNA, 19 nt, Homo sapiens
caagcaauauagccaaaca

SEQ ID NO: 979277 - RNA, 19 nt, Homo sapiens
ggaaucgguuuggaauaug

SEQ ID NO: 979278 - RNA, 19 nt, Homo sapiens
uggaaucgguuuggaauau

SEQ ID NO: 979279 - RNA, 19 nt, Homo sapiens
cgugaugucuuccaaguuc

SEQ ID NO: 979280 - RNA, 19 nt, Homo sapiens
ggaaaggcgaugcuaaaca

SEQ ID NO: 979281 - RNA, 19 nt, Homo sapiens
caucaugacuuucuuccaa

SEQ ID NO: 979282 - RNA, 19 nt, Homo sapiens
aagaagggcuuguccauuc

SEQ ID NO: 979283 - RNA, 19 nt, Homo sapiens
ggacacauguggcauuaac

SEQ ID NO: 979284 - RNA, 19 nt, Homo sapiens
gcaaggagagacagaauuc

SEQ ID NO: 979285 - RNA, 19 nt, Homo sapiens
ggaccucuuugccaugauu

SEQ ID NO: 979286 - RNA, 19 nt, Homo sapiens
ggacaaccuucagaugaga

SEQ ID NO: 979287 - RNA, 19 nt, Homo sapiens
caggacacauguggcauua

SEQ ID NO: 979288 - RNA, 19 nt, Homo sapiens
uggcauuccuggcaucaua

SEQ ID NO: 979289 - RNA, 19 nt, Homo sapiens
ccagauuuauggucucuug

SEQ ID NO: 979290 - RNA, 19 nt, Homo sapiens
gaaaguuccagauuuaugg

SEQ ID NO: 979291 - RNA, 19 nt, Homo sapiens
ggacuggaccgcaagaaca

SEQ ID NO: 979292 - RNA, 19 nt, Homo sapiens
gagccgccaucaacaccua

SEQ ID NO: 979293 - RNA, 19 nt, Homo sapiens
guggcagccuccaggaaua

SEQ ID NO: 979294 - RNA, 19 nt, Homo sapiens
gggcugguuccacuucuua

SEQ ID NO: 979295 - RNA, 19 nt, Homo sapiens
gggacaaccuucagaugag

SEQ ID NO: 979296 - RNA, 19 nt, Homo sapiens
ggguaccgcugcugagaug

SEQ ID NO: 979297 - RNA, 19 nt, Homo sapiens
guaccagucggaccucuuu

SEQ ID NO: 979298 - RNA, 19 nt, Homo sapiens
ccaugaccauccacacauu

SEQ ID NO: 979299 - RNA, 19 nt, Homo sapiens
gaaggagaagcuacaaagu

SEQ ID NO: 979300 - RNA, 19 nt, Homo sapiens
caagaacacagggaaaguu

SEQ ID NO: 979301 - RNA, 19 nt, Homo sapiens
cgacauggagaacgaauuc

SEQ ID NO: 979302 - RNA, 19 nt, Homo sapiens
gagaaggagaagcuacaaa

SEQ ID NO: 979303 - RNA, 19 nt, Homo sapiens
caucgugggugcugugaca

SEQ ID NO: 979304 - RNA, 19 nt, Homo sapiens
ggucagagaggacgcacaa

SEQ ID NO: 979305 - RNA, 19 nt, Homo sapiens
ccauucagcugcucaucau

SEQ ID NO: 979306 - RNA, 19 nt, Homo sapiens
cagagaggacgcacaagaa

SEQ ID NO: 979307 - RNA, 19 nt, Homo sapiens
gcaggugauuauggugauu

SEQ ID NO: 979308 - RNA, 19 nt, Homo sapiens
gccuugaagucuauggaaa

SEQ ID NO: 979309 - RNA, 19 nt, Homo sapiens
gggcaguucuggguaaagu

SEQ ID NO: 979310 - RNA, 19 nt, Homo sapiens
ucagagaggacgcacaaga

SEQ ID NO: 979311 - RNA, 19 nt, Homo sapiens
cauguggcauuaacaaucu

SEQ ID NO: 979312 - RNA, 19 nt, Homo sapiens
cagcuucaacucagccaua

SEQ ID NO: 979313 - RNA, 19 nt, Homo sapiens
gagcaaggagagacagaau

SEQ ID NO: 979314 - RNA, 19 nt, Homo sapiens
ggcuucggcuuccucauga

SEQ ID NO: 979315 - RNA, 19 nt, Homo sapiens
ugaagucuauggaaaagaa

SEQ ID NO: 979316 - RNA, 19 nt, Homo sapiens
gcaguucuggguaaaguca

SEQ ID NO: 979317 - RNA, 19 nt, Homo sapiens
gcaagaacacagggaaagu

SEQ ID NO: 979318 - RNA, 19 nt, Homo sapiens
gggcuucggcuuccucaug

SEQ ID NO: 979319 - RNA, 19 nt, Homo sapiens
gaauggagaaggagaagcu

SEQ ID NO: 979320 - RNA, 19 nt, Homo sapiens
cagaugagaacugcuuuga

SEQ ID NO: 979321 - RNA, 19 nt, Homo sapiens
gggcuuguccauuccuuug

SEQ ID NO: 979322 - RNA, 19 nt, Homo sapiens
ugagcgacauggagaacga

SEQ ID NO: 979323 - RNA, 19 nt, Homo sapiens
cuacaaagugggcauccaa

SEQ ID NO: 979324 - RNA, 19 nt, Homo sapiens
aaagaagggcuuguccauu

SEQ ID NO: 979325 - RNA, 19 nt, Homo sapiens
ccgccagccuugaagucua

SEQ ID NO: 979326 - RNA, 19 nt, Homo sapiens
acacauguggcauuaacaa

SEQ ID NO: 979327 - RNA, 19 nt, Homo sapiens
ggagaaggagaagcuacaa

SEQ ID NO: 979328 - RNA, 19 nt, Homo sapiens
uuaccucgguggcaauauc

SEQ ID NO: 979329 - RNA, 19 nt, Homo sapiens
ccaggacacauguggcauu

SEQ ID NO: 979330 - RNA, 19 nt, Homo sapiens
agaccucucuguguugugu

SEQ ID NO: 979331 - RNA, 19 nt, Homo sapiens
aaggagaagcuacaaagug

SEQ ID NO: 979332 - RNA, 19 nt, Homo sapiens
agaaggagaagcuacaaag

SEQ ID NO: 979333 - RNA, 19 nt, Homo sapiens
cgccagccuugaagucuau

SEQ ID NO: 979334 - RNA, 19 nt, Homo sapiens
ucaacucagccauauccua

SEQ ID NO: 979335 - RNA, 19 nt, Homo sapiens
cacauuuggcgccuacuuu

SEQ ID NO: 979336 - RNA, 19 nt, Homo sapiens
gcagggcugguuccacuuc

SEQ ID NO: 979337 - RNA, 19 nt, Homo sapiens
gcccucaggacccucagua

SEQ ID NO: 979338 - RNA, 19 nt, Homo sapiens
agaggacgcacaagaacuu

SEQ ID NO: 979339 - RNA, 19 nt, Homo sapiens
ucggcuuccucaugacuuu

SEQ ID NO: 979340 - RNA, 19 nt, Homo sapiens
gaagggcaagcuggacaug

SEQ ID NO: 979341 - RNA, 19 nt, Homo sapiens
caugaccauccacacauuu

SEQ ID NO: 979342 - RNA, 19 nt, Homo sapiens
ccucuucgcugugaaugag

SEQ ID NO: 979343 - RNA, 19 nt, Homo sapiens
ccucaucaacgcugacuuc

SEQ ID NO: 979344 - RNA, 19 nt, Homo sapiens
gccugagaauggagaagga

SEQ ID NO: 979345 - RNA, 19 nt, Homo sapiens
ugagaacugcuuugaggau

SEQ ID NO: 979346 - RNA, 19 nt, Homo sapiens
uaacaaucugcauggcauu

SEQ ID NO: 979347 - RNA, 19 nt, Homo sapiens
ugauuauggugauucucuu

SEQ ID NO: 979348 - RNA, 19 nt, Homo sapiens
ucggaccucuuugccauga

SEQ ID NO: 979349 - RNA, 19 nt, Homo sapiens
ugagaauggagaaggagaa

SEQ ID NO: 979350 - RNA, 19 nt, Homo sapiens
gcuagggaugcaagaguga

SEQ ID NO: 979351 - RNA, 19 nt, Homo sapiens
guccauuccuuugacuuuc

SEQ ID NO: 979352 - RNA, 19 nt, Homo sapiens
gugacccucuucgcuguga

SEQ ID NO: 979353 - RNA, 19 nt, Homo sapiens
gcuuugaggaugcggucua

SEQ ID NO: 979354 - RNA, 19 nt, Homo sapiens
ggggacaaccuucagauga

SEQ ID NO: 979355 - RNA, 19 nt, Homo sapiens
uguccauuccuuugacuuu

SEQ ID NO: 979356 - RNA, 19 nt, Homo sapiens
gagaggacgcacaagaacu

SEQ ID NO: 979357 - RNA, 19 nt, Homo sapiens
gauuauggugauucucuuc

SEQ ID NO: 979358 - RNA, 19 nt, Homo sapiens
ugaguucauucuccuuaac

SEQ ID NO: 979359 - RNA, 19 nt, Homo sapiens
gaacagauccugagaccua

SEQ ID NO: 979360 - RNA, 19 nt, Homo sapiens
gaauuaagcugggaagauu

SEQ ID NO: 979361 - RNA, 19 nt, Homo sapiens
gagaacugcucuguacuua

SEQ ID NO: 979362 - RNA, 19 nt, Homo sapiens
gcacuuggauuguuacugu

SEQ ID NO: 979363 - RNA, 19 nt, Homo sapiens
gaagcuacguuaugaagga

SEQ ID NO: 979364 - RNA, 19 nt, Homo sapiens
gaacauugguuguauuacu

SEQ ID NO: 979365 - RNA, 19 nt, Homo sapiens
gaagaaguguguguugcua

SEQ ID NO: 979366 - RNA, 19 nt, Homo sapiens
gcauaucagugcuucauug

SEQ ID NO: 979367 - RNA, 19 nt, Homo sapiens
gcacggcgauccuuugugu

SEQ ID NO: 979368 - RNA, 19 nt, Homo sapiens
aaauaaagguugugaggaa

SEQ ID NO: 979369 - RNA, 19 nt, Homo sapiens
gaaauaaggaucgaaguug

SEQ ID NO: 979370 - RNA, 19 nt, Homo sapiens
ggaagaaucagaaauguca

SEQ ID NO: 979371 - RNA, 19 nt, Homo sapiens
cagagucaguuaugauuaa

SEQ ID NO: 979372 - RNA, 19 nt, Homo sapiens
gcacgaguauauaaacaga

SEQ ID NO: 979373 - RNA, 19 nt, Homo sapiens
gccauuaccaucuuacuua

SEQ ID NO: 979374 - RNA, 19 nt, Homo sapiens
ggccauaucuuaacaaagg

SEQ ID NO: 979375 - RNA, 19 nt, Homo sapiens
aaauauugcuguccaaaga

SEQ ID NO: 979376 - RNA, 19 nt, Homo sapiens
ccagaaggcaucagagaua

SEQ ID NO: 979377 - RNA, 19 nt, Homo sapiens
ggaaauaaggaucgaaguu

SEQ ID NO: 979378 - RNA, 19 nt, Homo sapiens
caaacaaguuauuggcauu

SEQ ID NO: 979379 - RNA, 19 nt, Homo sapiens
ggacuguuccuaaggcaua

SEQ ID NO: 979380 - RNA, 19 nt, Homo sapiens
ggaagaggaagagccauua

SEQ ID NO: 979381 - RNA, 19 nt, Homo sapiens
uuaagcacuuggauuguua

SEQ ID NO: 979382 - RNA, 19 nt, Homo sapiens
uauggaagagguagaauua

SEQ ID NO: 979383 - RNA, 19 nt, Homo sapiens
gaucgaaguugcugaaagg

SEQ ID NO: 979384 - RNA, 19 nt, Homo sapiens
uaucagugcuucauuguca

SEQ ID NO: 979385 - RNA, 19 nt, Homo sapiens
agagaggacuuagcuuuaa

SEQ ID NO: 979386 - RNA, 19 nt, Homo sapiens
gguaucagcuugcucucuu

SEQ ID NO: 979387 - RNA, 19 nt, Homo sapiens
gggcagcacuuucauuugg

SEQ ID NO: 979388 - RNA, 19 nt, Homo sapiens
gaagcugaguggcaagaga

SEQ ID NO: 979389 - RNA, 19 nt, Homo sapiens
aaacuggaaugcuguccua

SEQ ID NO: 979390 - RNA, 19 nt, Homo sapiens
uaagaagccuauaccugaa

SEQ ID NO: 979391 - RNA, 19 nt, Homo sapiens
cgacaguccuggcaucuuc

SEQ ID NO: 979392 - RNA, 19 nt, Homo sapiens
cagaaggcaucagagauaa

SEQ ID NO: 979393 - RNA, 19 nt, Homo sapiens
ggugugagcagaauaagaa

SEQ ID NO: 979394 - RNA, 19 nt, Homo sapiens
cauuguagauugaacuuug

SEQ ID NO: 979395 - RNA, 19 nt, Homo sapiens
aagaaugcauggacuuaaa

SEQ ID NO: 979396 - RNA, 19 nt, Homo sapiens
caaguuauuggcauucaua

SEQ ID NO: 979397 - RNA, 19 nt, Homo sapiens
gaugaugauucccuaagug

SEQ ID NO: 979398 - RNA, 19 nt, Homo sapiens
gcaaaccuguaucaaacug

SEQ ID NO: 979399 - RNA, 19 nt, Homo sapiens
ggagguggcugugagaaca

SEQ ID NO: 979400 - RNA, 19 nt, Homo sapiens
ccacagcaguucccuaugg

SEQ ID NO: 979401 - RNA, 19 nt, Homo sapiens
ccauggauauauuuccuuu

SEQ ID NO: 979402 - RNA, 19 nt, Homo sapiens
gauccagacuagaauguca

SEQ ID NO: 979403 - RNA, 19 nt, Homo sapiens
gagcacgaguauauaaaca

SEQ ID NO: 979404 - RNA, 19 nt, Homo sapiens
caggaaggcugaucucuac

SEQ ID NO: 979405 - RNA, 19 nt, Homo sapiens
ccauaggccuuuccuuugu

SEQ ID NO: 979406 - RNA, 19 nt, Homo sapiens
ggaaagagaggacuuagcu

SEQ ID NO: 979407 - RNA, 19 nt, Homo sapiens
cauaguaacuuagcuugug

SEQ ID NO: 979408 - RNA, 19 nt, Homo sapiens
ggaugguucuggauaagug

SEQ ID NO: 979409 - RNA, 19 nt, Homo sapiens
gaaguacuuucugguggaa

SEQ ID NO: 979410 - RNA, 19 nt, Homo sapiens
gcacugauuugggacuguu

SEQ ID NO: 979411 - RNA, 19 nt, Homo sapiens
aaagugagauauccacauc

SEQ ID NO: 979412 - RNA, 19 nt, Homo sapiens
cagaucgggugacugaauu

SEQ ID NO: 979413 - RNA, 19 nt, Homo sapiens
guccaaagauauacuucaa

SEQ ID NO: 979414 - RNA, 19 nt, Homo sapiens
gaauuuaaggagaacauga

SEQ ID NO: 979415 - RNA, 19 nt, Homo sapiens
gugcuucccuccguuaauu

SEQ ID NO: 979416 - RNA, 19 nt, Homo sapiens
ccagauagacaaaggagaa

SEQ ID NO: 979417 - RNA, 19 nt, Homo sapiens
cggcaaaccuguaucaaac

SEQ ID NO: 979418 - RNA, 19 nt, Homo sapiens
cagcagaucgggugacuga

SEQ ID NO: 979419 - RNA, 19 nt, Homo sapiens
gaagaauggccuacacauc

SEQ ID NO: 979420 - RNA, 19 nt, Homo sapiens
gaucucuccugcuacaguu

SEQ ID NO: 979421 - RNA, 19 nt, Homo sapiens
gauccuagcagaaccauag

SEQ ID NO: 979422 - RNA, 19 nt, Homo sapiens
ccagugguguggccugaaa

SEQ ID NO: 979423 - RNA, 19 nt, Homo sapiens
ggaugaugauucccuaagu

SEQ ID NO: 979424 - RNA, 19 nt, Homo sapiens
gaccaaauacacacacuau

SEQ ID NO: 979425 - RNA, 19 nt, Homo sapiens
gguccucacuuuacuuauc

SEQ ID NO: 979426 - RNA, 19 nt, Homo sapiens
uaaccuaggcugcuggaaa

SEQ ID NO: 979427 - RNA, 19 nt, Homo sapiens
caaacaguguggugcugaa

SEQ ID NO: 979428 - RNA, 19 nt, Homo sapiens
uuacuuggauccauuucuu

SEQ ID NO: 979429 - RNA, 19 nt, Homo sapiens
gaaggcugaagcuacguua

SEQ ID NO: 979430 - RNA, 19 nt, Homo sapiens
uauaugcuguggaaaugaa

SEQ ID NO: 979431 - RNA, 19 nt, Homo sapiens
ucuguucccucucauugua

SEQ ID NO: 979432 - RNA, 19 nt, Homo sapiens
ggcuucaccuggacaguaa

SEQ ID NO: 979433 - RNA, 19 nt, Homo sapiens
ccacggaugguucuggaua

SEQ ID NO: 979434 - RNA, 19 nt, Homo sapiens
ucacuuuacuuaucaaugc

SEQ ID NO: 979435 - RNA, 19 nt, Homo sapiens
aagagaggacuuagcuuua

SEQ ID NO: 979436 - RNA, 19 nt, Homo sapiens
ucaagaaugcauggacuua

SEQ ID NO: 979437 - RNA, 19 nt, Homo sapiens
aggaugagcuacaggaaga

SEQ ID NO: 979438 - RNA, 19 nt, Homo sapiens
gaaacgcuccucugcaucu

SEQ ID NO: 979439 - RNA, 19 nt, Homo sapiens
gcagaucgggugacugaau

SEQ ID NO: 979440 - RNA, 19 nt, Homo sapiens
gaaauuggaagcuguagac

SEQ ID NO: 979441 - RNA, 19 nt, Homo sapiens
uuuguucucugcuuucuuu

SEQ ID NO: 979442 - RNA, 19 nt, Homo sapiens
gcaguggagucugaagaau

SEQ ID NO: 979443 - RNA, 19 nt, Homo sapiens
ggcugaagcuacguuauga

SEQ ID NO: 979444 - RNA, 19 nt, Homo sapiens
gauuugggacuguuccuaa

SEQ ID NO: 979445 - RNA, 19 nt, Homo sapiens
ccuucacccugcuuuauaa

SEQ ID NO: 979446 - RNA, 19 nt, Homo sapiens
aagaaacgcuccucugcau

SEQ ID NO: 979447 - RNA, 19 nt, Homo sapiens
ccuuugggcuggugugaaa

SEQ ID NO: 979448 - RNA, 19 nt, Homo sapiens
aagaauggccuacacauca

SEQ ID NO: 979449 - RNA, 19 nt, Homo sapiens
ggauacccauugaacagau

SEQ ID NO: 979450 - RNA, 19 nt, Homo sapiens
aagcacaaaugcagcaaau

SEQ ID NO: 979451 - RNA, 19 nt, Homo sapiens
caagaaugcauggacuuaa

SEQ ID NO: 979452 - RNA, 19 nt, Homo sapiens
ggaucgaaguugcugaaag

SEQ ID NO: 979453 - RNA, 19 nt, Homo sapiens
caaaggaaauaaggaucga

SEQ ID NO: 979454 - RNA, 19 nt, Homo sapiens
gaaaagacggaaagaaaga

SEQ ID NO: 979455 - RNA, 19 nt, Homo sapiens
ccauuaccaucuuacuuau

SEQ ID NO: 979456 - RNA, 19 nt, Homo sapiens
gcuccaggauccagacuag

SEQ ID NO: 979457 - RNA, 19 nt, Homo sapiens
uggaagagguagaauuaag

SEQ ID NO: 979458 - RNA, 19 nt, Homo sapiens
gagaaggacaaccaaagug

SEQ ID NO: 979459 - RNA, 19 nt, Homo sapiens
ggaaacagcugaucuauau

SEQ ID NO: 979460 - RNA, 19 nt, Homo sapiens
ggaaguggaugcuuuggaa

SEQ ID NO: 979461 - RNA, 19 nt, Homo sapiens
ggagaucccuuucccauuc

SEQ ID NO: 979462 - RNA, 19 nt, Homo sapiens
gagaauagaauacuccaaa

SEQ ID NO: 979463 - RNA, 19 nt, Homo sapiens
gaaacuaggagaucccuuu

SEQ ID NO: 979464 - RNA, 19 nt, Homo sapiens
caacacauuuccuucauuc

SEQ ID NO: 979465 - RNA, 19 nt, Homo sapiens
ccaagaaacuaaaggugaa

SEQ ID NO: 979466 - RNA, 19 nt, Homo sapiens
gaaugaguaugccuuuaga

SEQ ID NO: 979467 - RNA, 19 nt, Homo sapiens
cauaaucacugaaguccuu

SEQ ID NO: 979468 - RNA, 19 nt, Homo sapiens
gaacggcgacugcugcaaa

SEQ ID NO: 979469 - RNA, 19 nt, Homo sapiens
gguuauagcuuugccuuga

SEQ ID NO: 979470 - RNA, 19 nt, Homo sapiens
gaacuaacucaagacaaua

SEQ ID NO: 979471 - RNA, 19 nt, Homo sapiens
ccaauuugaugugaaguuu

SEQ ID NO: 979472 - RNA, 19 nt, Homo sapiens
ggaauccaauuugauguga

SEQ ID NO: 979473 - RNA, 19 nt, Homo sapiens
ccaaggagagaauagaaua

SEQ ID NO: 979474 - RNA, 19 nt, Homo sapiens
acacuuacaugucuuacuu

SEQ ID NO: 979475 - RNA, 19 nt, Homo sapiens
agaacuaacucaagacaau

SEQ ID NO: 979476 - RNA, 19 nt, Homo sapiens
gaauaccgcaccauaauca

SEQ ID NO: 979477 - RNA, 19 nt, Homo sapiens
gagaggagccaagaaacua

SEQ ID NO: 979478 - RNA, 19 nt, Homo sapiens
gcaguaaguccuccaaugu

SEQ ID NO: 979479 - RNA, 19 nt, Homo sapiens
gaggauugcugaucacucu

SEQ ID NO: 979480 - RNA, 19 nt, Homo sapiens
uggcugaccuuuauguauu

SEQ ID NO: 979481 - RNA, 19 nt, Homo sapiens
gagcucaucaucuuugaaa

SEQ ID NO: 979482 - RNA, 19 nt, Homo sapiens
gaacuuaagccuacuacag

SEQ ID NO: 979483 - RNA, 19 nt, Homo sapiens
ugaguaugccuuuagaaua

SEQ ID NO: 979484 - RNA, 19 nt, Homo sapiens
gaauaaucaucgucacauc

SEQ ID NO: 979485 - RNA, 19 nt, Homo sapiens
gcauacucuuccucuauuu

SEQ ID NO: 979486 - RNA, 19 nt, Homo sapiens
caugauuaccucccaaaua

SEQ ID NO: 979487 - RNA, 19 nt, Homo sapiens
caaacaaaaugcuauggua

SEQ ID NO: 979488 - RNA, 19 nt, Homo sapiens
gauaaugggcauguacuuu

SEQ ID NO: 979489 - RNA, 19 nt, Homo sapiens
gcaaauggcaccuugaacu

SEQ ID NO: 979490 - RNA, 19 nt, Homo sapiens
ggauugcugaucacucuua

SEQ ID NO: 979491 - RNA, 19 nt, Homo sapiens
gccaauuguuuaaagacua

SEQ ID NO: 979492 - RNA, 19 nt, Homo sapiens
uagcugagccaaacacgua

SEQ ID NO: 979493 - RNA, 19 nt, Homo sapiens
aauggcaccuugaacuuaa

SEQ ID NO: 979494 - RNA, 19 nt, Homo sapiens
gauuaccucccaaauacua

SEQ ID NO: 979495 - RNA, 19 nt, Homo sapiens
ccaacacauuuccuucauu

SEQ ID NO: 979496 - RNA, 19 nt, Homo sapiens
ggaagugcauaacaaacca

SEQ ID NO: 979497 - RNA, 19 nt, Homo sapiens
gcaauggcacggagaacaa

SEQ ID NO: 979498 - RNA, 19 nt, Homo sapiens
ucucauggcucuucuuucu

SEQ ID NO: 979499 - RNA, 19 nt, Homo sapiens
ucuuauggcugaccuuuau

SEQ ID NO: 979500 - RNA, 19 nt, Homo sapiens
cacauuuccuucauucuug

SEQ ID NO: 979501 - RNA, 19 nt, Homo sapiens
gaaaacggauccugucaca

SEQ ID NO: 979502 - RNA, 19 nt, Homo sapiens
ucaacugcccauacacuua

SEQ ID NO: 979503 - RNA, 19 nt, Homo sapiens
cauaaacaacgacugcuuu

SEQ ID NO: 979504 - RNA, 19 nt, Homo sapiens
caaauggcaccuugaacuu

SEQ ID NO: 979505 - RNA, 19 nt, Homo sapiens
uaugccaucucuagcagua

SEQ ID NO: 979506 - RNA, 19 nt, Homo sapiens
gaauagcagcucccguuau

SEQ ID NO: 979507 - RNA, 19 nt, Homo sapiens
gaucuucuccgugacguuu

SEQ ID NO: 979508 - RNA, 19 nt, Homo sapiens
gcggagaggagccaagaaa

SEQ ID NO: 979509 - RNA, 19 nt, Homo sapiens
gaauccaauuugaugugaa

SEQ ID NO: 979510 - RNA, 19 nt, Homo sapiens
acacguaggauuuccguuu

SEQ ID NO: 979511 - RNA, 19 nt, Homo sapiens
gagccaaacacguaggauu

SEQ ID NO: 979512 - RNA, 19 nt, Homo sapiens
gcacagauaaugggcaugu

SEQ ID NO: 979513 - RNA, 19 nt, Homo sapiens
ugaucacucuuaccaaguu

SEQ ID NO: 979514 - RNA, 19 nt, Homo sapiens
gcugucaacugcccauaca

SEQ ID NO: 979515 - RNA, 19 nt, Homo sapiens
aaacggauccugucacaag

SEQ ID NO: 979516 - RNA, 19 nt, Homo sapiens
aacaggaaguggaugcuuu

SEQ ID NO: 979517 - RNA, 19 nt, Homo sapiens
gacuccagcaucaugauua

SEQ ID NO: 979518 - RNA, 19 nt, Homo sapiens
gcaccauaaucacugaagu

SEQ ID NO: 979519 - RNA, 19 nt, Homo sapiens
uagaauaccgcaccauaau

SEQ ID NO: 979520 - RNA, 19 nt, Homo sapiens
ccgaaugaguaugccuuua

SEQ ID NO: 979521 - RNA, 19 nt, Homo sapiens
gaucuuauccauagaacag

SEQ ID NO: 979522 - RNA, 19 nt, Homo sapiens
ugaaaucuuaggaguauug

SEQ ID NO: 979523 - RNA, 19 nt, Homo sapiens
gauaugaggcugguguaga

SEQ ID NO: 979524 - RNA, 19 nt, Homo sapiens
ccagugguuucaaaauuua

SEQ ID NO: 979525 - RNA, 19 nt, Homo sapiens
aaauggcaccuugaacuua

SEQ ID NO: 979526 - RNA, 19 nt, Homo sapiens
uaaugggcauguacuuugu

SEQ ID NO: 979527 - RNA, 19 nt, Homo sapiens
ggcugaccuuuauguauuu

SEQ ID NO: 979528 - RNA, 19 nt, Homo sapiens
uguuugagcucaucaucuu

SEQ ID NO: 979529 - RNA, 19 nt, Homo sapiens
agacaauacucagcagaga

SEQ ID NO: 979530 - RNA, 19 nt, Homo sapiens
agggagaacuaacucaaga

SEQ ID NO: 979531 - RNA, 19 nt, Homo sapiens
cugcugauccgaaugagua

SEQ ID NO: 979532 - RNA, 19 nt, Homo sapiens
ugaauuaucugggaaucca

SEQ ID NO: 979533 - RNA, 19 nt, Homo sapiens
gaucgacuccagcaucaug

SEQ ID NO: 979534 - RNA, 19 nt, Homo sapiens
ugaauagcagcucccguua

SEQ ID NO: 979535 - RNA, 19 nt, Homo sapiens
ggaauaaucaucgucacau

SEQ ID NO: 979536 - RNA, 19 nt, Homo sapiens
gcucuucuuucuggauuug

SEQ ID NO: 979537 - RNA, 19 nt, Homo sapiens
gcauaaacaacgacugcuu

SEQ ID NO: 979538 - RNA, 19 nt, Homo sapiens
ggagaacuaacucaagaca

SEQ ID NO: 979539 - RNA, 19 nt, Homo sapiens
gccagugguuucaaaauuu

SEQ ID NO: 979540 - RNA, 19 nt, Homo sapiens
uagcauacucuuccucuau

SEQ ID NO: 979541 - RNA, 19 nt, Homo sapiens
uuagaauaccgcaccauaa

SEQ ID NO: 979542 - RNA, 19 nt, Homo sapiens
gcuaccaucaauauuguuu

SEQ ID NO: 979543 - RNA, 19 nt, Homo sapiens
gcucaucaucuuugaaauc

SEQ ID NO: 979544 - RNA, 19 nt, Homo sapiens
uaacucaagacaauacuca

SEQ ID NO: 979545 - RNA, 19 nt, Homo sapiens
ggugauacuaugaccauga

SEQ ID NO: 979546 - RNA, 19 nt, Homo sapiens
cgaaugaguaugccuuuag

SEQ ID NO: 979547 - RNA, 19 nt, Homo sapiens
augauuaccucccaaauac

SEQ ID NO: 979548 - RNA, 19 nt, Homo sapiens
acuaugagauacgucagua

SEQ ID NO: 979549 - RNA, 19 nt, Homo sapiens
aaaaugaaccugugcguaa

SEQ ID NO: 979550 - RNA, 19 nt, Homo sapiens
gaggagccaagaaacuaaa

SEQ ID NO: 979551 - RNA, 19 nt, Homo sapiens
ggagaggagccaagaaacu

SEQ ID NO: 979552 - RNA, 19 nt, Homo sapiens
gaagcaaauggcaccuuga

SEQ ID NO: 979553 - RNA, 19 nt, Homo sapiens
uggaaacagcugaucuaua

SEQ ID NO: 979554 - RNA, 19 nt, Homo sapiens
cagccggguuggugugauu

SEQ ID NO: 979555 - RNA, 19 nt, Homo sapiens
gaaccugugcguaauucug

SEQ ID NO: 979556 - RNA, 19 nt, Homo sapiens
uaaagacuaugagauacgu

SEQ ID NO: 979557 - RNA, 19 nt, Homo sapiens
aaaugaaccugugcguaau

SEQ ID NO: 979558 - RNA, 19 nt, Homo sapiens
aguaaguccuccaauguca

SEQ ID NO: 979559 - RNA, 19 nt, Homo sapiens
gaaagaagcggcagaauug

SEQ ID NO: 979560 - RNA, 19 nt, Homo sapiens
ugacucaacugcuucauua

SEQ ID NO: 979561 - RNA, 19 nt, Homo sapiens
gaauggcacuucacgguua

SEQ ID NO: 979562 - RNA, 19 nt, Homo sapiens
gcagggaaauaacuuguuu

SEQ ID NO: 979563 - RNA, 19 nt, Homo sapiens
gaagagggaguacuuugua

SEQ ID NO: 979564 - RNA, 19 nt, Homo sapiens
ucaaguagcuuccuuaaaa

SEQ ID NO: 979565 - RNA, 19 nt, Homo sapiens
cauaggagauguacuggaa

SEQ ID NO: 979566 - RNA, 19 nt, Homo sapiens
gaagucaauucaucuggaa

SEQ ID NO: 979567 - RNA, 19 nt, Homo sapiens
gcucuuauauuccgacgaa

SEQ ID NO: 979568 - RNA, 19 nt, Homo sapiens
cagagaagguugucuacuu

SEQ ID NO: 979569 - RNA, 19 nt, Homo sapiens
gaacuggcuaggcaaauaa

SEQ ID NO: 979570 - RNA, 19 nt, Homo sapiens
gccauaaucacacaaauuu

SEQ ID NO: 979571 - RNA, 19 nt, Homo sapiens
cauuaaacauucugcauug

SEQ ID NO: 979572 - RNA, 19 nt, Homo sapiens
aagccaagcugaccaagaa

SEQ ID NO: 979573 - RNA, 19 nt, Homo sapiens
ccacuuugauaugcuguua

SEQ ID NO: 979574 - RNA, 19 nt, Homo sapiens
ugauauaccuacaacauuc

SEQ ID NO: 979575 - RNA, 19 nt, Homo sapiens
gauguccuguugccuuuaa

SEQ ID NO: 979576 - RNA, 19 nt, Homo sapiens
caagauuucuguugugaag

SEQ ID NO: 979577 - RNA, 19 nt, Homo sapiens
gaagaguccggcuguuaaa

SEQ ID NO: 979578 - RNA, 19 nt, Homo sapiens
ugaaagaagcggcagaauu

SEQ ID NO: 979579 - RNA, 19 nt, Homo sapiens
aagcaaaacuccucaagua

SEQ ID NO: 979580 - RNA, 19 nt, Homo sapiens
guauagggauagaagaguu

SEQ ID NO: 979581 - RNA, 19 nt, Homo sapiens
agaacuggcuaggcaaaua

SEQ ID NO: 979582 - RNA, 19 nt, Homo sapiens
caagagacaaccacacuga

SEQ ID NO: 979583 - RNA, 19 nt, Homo sapiens
gaguauaaggacagcauua

SEQ ID NO: 979584 - RNA, 19 nt, Homo sapiens
gaaaccaccaagcauuauu

SEQ ID NO: 979585 - RNA, 19 nt, Homo sapiens
gccauagguucucuagauu

SEQ ID NO: 979586 - RNA, 19 nt, Homo sapiens
ccuaaacauucuucaguga

SEQ ID NO: 979587 - RNA, 19 nt, Homo sapiens
uaggagauguacuggaauu

SEQ ID NO: 979588 - RNA, 19 nt, Homo sapiens
uguagaauguauagggaua

SEQ ID NO: 979589 - RNA, 19 nt, Homo sapiens
ggcauuggcagcucuuaua

SEQ ID NO: 979590 - RNA, 19 nt, Homo sapiens
caaccuguagcuaagaaua

SEQ ID NO: 979591 - RNA, 19 nt, Homo sapiens
gaugauauaccuacaacau

SEQ ID NO: 979592 - RNA, 19 nt, Homo sapiens
ccaagaagccaaagaacug

SEQ ID NO: 979593 - RNA, 19 nt, Homo sapiens
gauuugaagugggcaagaa

SEQ ID NO: 979594 - RNA, 19 nt, Homo sapiens
ugaagaguccggcuguuaa

SEQ ID NO: 979595 - RNA, 19 nt, Homo sapiens
gcuaggcaaauaagcuuua

SEQ ID NO: 979596 - RNA, 19 nt, Homo sapiens
ccauagguucucuagauua

SEQ ID NO: 979597 - RNA, 19 nt, Homo sapiens
caaaguuccuugucucacu

SEQ ID NO: 979598 - RNA, 19 nt, Homo sapiens
ggguauaaucuaagaauug

SEQ ID NO: 979599 - RNA, 19 nt, Homo sapiens
gcucugccaugaaggaugu

SEQ ID NO: 979600 - RNA, 19 nt, Homo sapiens
aagaagagcacuugccaaa

SEQ ID NO: 979601 - RNA, 19 nt, Homo sapiens
ggagagggagccauagguu

SEQ ID NO: 979602 - RNA, 19 nt, Homo sapiens
gcuaagaauaccuccauga

SEQ ID NO: 979603 - RNA, 19 nt, Homo sapiens
ggaaagacuaucucugagu

SEQ ID NO: 979604 - RNA, 19 nt, Homo sapiens
gaggaaagaagagcacuug

SEQ ID NO: 979605 - RNA, 19 nt, Homo sapiens
aaaguuccuugucucacua

SEQ ID NO: 979606 - RNA, 19 nt, Homo sapiens
caauucaucuggaaagacu

SEQ ID NO: 979607 - RNA, 19 nt, Homo sapiens
cagccuucguggaguauaa

SEQ ID NO: 979608 - RNA, 19 nt, Homo sapiens
aagagggaguacuuuguaa

SEQ ID NO: 979609 - RNA, 19 nt, Homo sapiens
ugcauuggguauaaucuaa

SEQ ID NO: 979610 - RNA, 19 nt, Homo sapiens
gagacaaccacacugauca

SEQ ID NO: 979611 - RNA, 19 nt, Homo sapiens
gccaucauccugaaacuug

SEQ ID NO: 979612 - RNA, 19 nt, Homo sapiens
caugaaaccaccaagcauu

SEQ ID NO: 979613 - RNA, 19 nt, Homo sapiens
gucaaacauuuaugaggaa

SEQ ID NO: 979614 - RNA, 19 nt, Homo sapiens
ugacuuuauuuguguccua

SEQ ID NO: 979615 - RNA, 19 nt, Homo sapiens
guacucuguuucuacguau

SEQ ID NO: 979616 - RNA, 19 nt, Homo sapiens
agccauagguucucuagau

SEQ ID NO: 979617 - RNA, 19 nt, Homo sapiens
ccaccagaguaucccauga

SEQ ID NO: 979618 - RNA, 19 nt, Homo sapiens
gaauguauagggauagaag

SEQ ID NO: 979619 - RNA, 19 nt, Homo sapiens
cauccugacuuuggcauug

SEQ ID NO: 979620 - RNA, 19 nt, Homo sapiens
ugaccaagaagccaaagaa

SEQ ID NO: 979621 - RNA, 19 nt, Homo sapiens
cauagguucucuagauuac

SEQ ID NO: 979622 - RNA, 19 nt, Homo sapiens
gaggaaaugagaucacauc

SEQ ID NO: 979623 - RNA, 19 nt, Homo sapiens
cuuauugaguacucuguuu

SEQ ID NO: 979624 - RNA, 19 nt, Homo sapiens
aggcagaagucaauucauc

SEQ ID NO: 979625 - RNA, 19 nt, Homo sapiens
guccggcuguuaaacguuu

SEQ ID NO: 979626 - RNA, 19 nt, Homo sapiens
auuggcagcucuuauauuc

SEQ ID NO: 979627 - RNA, 19 nt, Homo sapiens
gcauuggcagcucuuauau

SEQ ID NO: 979628 - RNA, 19 nt, Homo sapiens
cuggaaagacuaucucuga

SEQ ID NO: 979629 - RNA, 19 nt, Homo sapiens
gacuuuauuuguguccuaa

SEQ ID NO: 979630 - RNA, 19 nt, Homo sapiens
gagauguacuggaauugcu

SEQ ID NO: 979631 - RNA, 19 nt, Homo sapiens
ucaacugcuucauuaaaca

SEQ ID NO: 979632 - RNA, 19 nt, Homo sapiens
caagaugauauaccuacaa

SEQ ID NO: 979633 - RNA, 19 nt, Homo sapiens
gcgcacgcuuuagaggaua

SEQ ID NO: 979634 - RNA, 19 nt, Homo sapiens
agaagcggcagaauugaaa

SEQ ID NO: 979635 - RNA, 19 nt, Homo sapiens
gcagcauccuuucaucaac

SEQ ID NO: 979636 - RNA, 19 nt, Homo sapiens
cuaacugauuuacaagaug

SEQ ID NO: 979637 - RNA, 19 nt, Homo sapiens
cuaggcaaauaagcuuuaa

SEQ ID NO: 979638 - RNA, 19 nt, Homo sapiens
uggcagccuucguggagua

SEQ ID NO: 979639 - RNA, 19 nt, Homo sapiens
gcuaauggucgauuugaag

SEQ ID NO: 979640 - RNA, 19 nt, Homo sapiens
gcccucugcugccauaauc

SEQ ID NO: 979641 - RNA, 19 nt, Homo sapiens
uauuuacccuucauuccuu

SEQ ID NO: 979642 - RNA, 19 nt, Homo sapiens
cauuggguauaaucuaaga

SEQ ID NO: 979643 - RNA, 19 nt, Homo sapiens
uaaggcagaagucaauuca

SEQ ID NO: 979644 - RNA, 19 nt, Homo sapiens
cugaagaguccggcuguua

SEQ ID NO: 979645 - RNA, 19 nt, Homo sapiens
augaaaccaccaagcauua

SEQ ID NO: 979646 - RNA, 19 nt, Homo sapiens
uuccuugucucacuauuug

SEQ ID NO: 979647 - RNA, 19 nt, Homo sapiens
gaagucaaaguuccuuguc

SEQ ID NO: 979648 - RNA, 19 nt, Homo sapiens
ccaagcauuauucuccuaa

SEQ ID NO: 979649 - RNA, 19 nt, Homo sapiens
ggcuaauggucgauuugaa

SEQ ID NO: 979650 - RNA, 19 nt, Homo sapiens
gucacuggaugcuacuuga

SEQ ID NO: 979651 - RNA, 19 nt, Homo sapiens
uagaauguauagggauaga

SEQ ID NO: 979652 - RNA, 19 nt, Homo sapiens
aguacucuguuucuacgua

SEQ ID NO: 979653 - RNA, 19 nt, Homo sapiens
auugaaagauccaacagau

SEQ ID NO: 979654 - RNA, 19 nt, Homo sapiens
agauuucuguugugaagga

SEQ ID NO: 979655 - RNA, 19 nt, Homo sapiens
cucauucugugacuuuauu

SEQ ID NO: 979656 - RNA, 19 nt, Homo sapiens
ucucauguuucaucuucuu

SEQ ID NO: 979657 - RNA, 19 nt, Homo sapiens
gagcaucucaggccaucau

SEQ ID NO: 979658 - RNA, 19 nt, Homo sapiens
ucugugacuuuauuugugu

SEQ ID NO: 979659 - RNA, 19 nt, Homo sapiens
gaaagaagcggcagaauug

SEQ ID NO: 979660 - RNA, 19 nt, Homo sapiens
ugacucaacugcuucauua

SEQ ID NO: 979661 - RNA, 19 nt, Homo sapiens
gaauggcacuucacgguua

SEQ ID NO: 979662 - RNA, 19 nt, Homo sapiens
gcagggaaauaacuuguuu

SEQ ID NO: 979663 - RNA, 19 nt, Homo sapiens
gaagucaauucaucuggaa

SEQ ID NO: 979664 - RNA, 19 nt, Homo sapiens
gcucuuauauuccgacgaa

SEQ ID NO: 979665 - RNA, 19 nt, Homo sapiens
cagagaagguugucuacuu

SEQ ID NO: 979666 - RNA, 19 nt, Homo sapiens
gagaauuacuaguuacuca

SEQ ID NO: 979667 - RNA, 19 nt, Homo sapiens
gaacuggcuaggcaaauaa

SEQ ID NO: 979668 - RNA, 19 nt, Homo sapiens
cauuaaacauucugcauug

SEQ ID NO: 979669 - RNA, 19 nt, Homo sapiens
aagccaagcugaccaagaa

SEQ ID NO: 979670 - RNA, 19 nt, Homo sapiens
ugauauaccuacaacauuc

SEQ ID NO: 979671 - RNA, 19 nt, Homo sapiens
gauguccuguugccuuuaa

SEQ ID NO: 979672 - RNA, 19 nt, Homo sapiens
caagauuucuguugugaag

SEQ ID NO: 979673 - RNA, 19 nt, Homo sapiens
gaagaguccggcuguuaaa

SEQ ID NO: 979674 - RNA, 19 nt, Homo sapiens
ugaaagaagcggcagaauu

SEQ ID NO: 979675 - RNA, 19 nt, Homo sapiens
agaacuggcuaggcaaaua

SEQ ID NO: 979676 - RNA, 19 nt, Homo sapiens
caagagacaaccacacuga

SEQ ID NO: 979677 - RNA, 19 nt, Homo sapiens
gaguauaaggacagcauua

SEQ ID NO: 979678 - RNA, 19 nt, Homo sapiens
gaaaccaccaagcauuauu

SEQ ID NO: 979679 - RNA, 19 nt, Homo sapiens
caauggagaauuacuaguu

SEQ ID NO: 979680 - RNA, 19 nt, Homo sapiens
gccauagguucucuagauu

SEQ ID NO: 979681 - RNA, 19 nt, Homo sapiens
ggcauuggcagcucuuaua

SEQ ID NO: 979682 - RNA, 19 nt, Homo sapiens
caaccuguagcuaagaaua

SEQ ID NO: 979683 - RNA, 19 nt, Homo sapiens
gaugauauaccuacaacau

SEQ ID NO: 979684 - RNA, 19 nt, Homo sapiens
ccaagaagccaaagaacug

SEQ ID NO: 979685 - RNA, 19 nt, Homo sapiens
gauuugaagugggcaagaa

SEQ ID NO: 979686 - RNA, 19 nt, Homo sapiens
gcuaggcaaauaagcuuua

SEQ ID NO: 979687 - RNA, 19 nt, Homo sapiens
ugaagaguccggcuguuaa

SEQ ID NO: 979688 - RNA, 19 nt, Homo sapiens
ccauagguucucuagauua

SEQ ID NO: 979689 - RNA, 19 nt, Homo sapiens
caaaguuccuugucucacu

SEQ ID NO: 979690 - RNA, 19 nt, Homo sapiens
ggguauaaucuaagaauug

SEQ ID NO: 979691 - RNA, 19 nt, Homo sapiens
gcucugccaugaaggaugu

SEQ ID NO: 979692 - RNA, 19 nt, Homo sapiens
aagaagagcacuugccaaa

SEQ ID NO: 979693 - RNA, 19 nt, Homo sapiens
ggagagggagccauagguu

SEQ ID NO: 979694 - RNA, 19 nt, Homo sapiens
gcgcagccuuuagaggaua

SEQ ID NO: 979695 - RNA, 19 nt, Homo sapiens
gcuaagaauaccuccauga

SEQ ID NO: 979696 - RNA, 19 nt, Homo sapiens
ggaaagacuaucucugagu

SEQ ID NO: 979697 - RNA, 19 nt, Homo sapiens
gaggaaagaagagcacuug

SEQ ID NO: 979698 - RNA, 19 nt, Homo sapiens
aaaguuccuugucucacua

SEQ ID NO: 979699 - RNA, 19 nt, Homo sapiens
caauucaucuggaaagacu

SEQ ID NO: 979700 - RNA, 19 nt, Homo sapiens
cagccuucguggaguauaa

SEQ ID NO: 979701 - RNA, 19 nt, Homo sapiens
ugcauuggguauaaucuaa

SEQ ID NO: 979702 - RNA, 19 nt, Homo sapiens
gagacaaccacacugauca

SEQ ID NO: 979703 - RNA, 19 nt, Homo sapiens
gccaucauccugaaacuug

SEQ ID NO: 979704 - RNA, 19 nt, Homo sapiens
caugaaaccaccaagcauu

SEQ ID NO: 979705 - RNA, 19 nt, Homo sapiens
agccauagguucucuagau

SEQ ID NO: 979706 - RNA, 19 nt, Homo sapiens
ccaccagaguaucccauga

SEQ ID NO: 979707 - RNA, 19 nt, Homo sapiens
cauccugacuuuggcauug

SEQ ID NO: 979708 - RNA, 19 nt, Homo sapiens
ugaccaagaagccaaagaa

SEQ ID NO: 979709 - RNA, 19 nt, Homo sapiens
cauagguucucuagauuac

SEQ ID NO: 979710 - RNA, 19 nt, Homo sapiens
cuuauugaguaaccuguuu

SEQ ID NO: 979711 - RNA, 19 nt, Homo sapiens
aggcagaagucaauucauc

SEQ ID NO: 979712 - RNA, 19 nt, Homo sapiens
guccggcuguuaaacguuu

SEQ ID NO: 979713 - RNA, 19 nt, Homo sapiens
auuggcagcucuuauauuc

SEQ ID NO: 979714 - RNA, 19 nt, Homo sapiens
gcauuggcagcucuuauau

SEQ ID NO: 979715 - RNA, 19 nt, Homo sapiens
cuggaaagacuaucucuga

SEQ ID NO: 979716 - RNA, 19 nt, Homo sapiens
ucaacugcuucauuaaaca

SEQ ID NO: 979717 - RNA, 19 nt, Homo sapiens
caagaugauauaccuacaa

SEQ ID NO: 979718 - RNA, 19 nt, Homo sapiens
gcagcauccuuucaucaac

SEQ ID NO: 979719 - RNA, 19 nt, Homo sapiens
cuaacugauuuacaagaug

SEQ ID NO: 979720 - RNA, 19 nt, Homo sapiens
cuaggcaaauaagcuuuaa

SEQ ID NO: 979721 - RNA, 19 nt, Homo sapiens
agaagcggcagaauugaaa

SEQ ID NO: 979722 - RNA, 19 nt, Homo sapiens
uggcagccuucguggagua

SEQ ID NO: 979723 - RNA, 19 nt, Homo sapiens
gcuaauggucgauuugaag

SEQ ID NO: 979724 - RNA, 19 nt, Homo sapiens
uauuuacccuucauuccuu

SEQ ID NO: 979725 - RNA, 19 nt, Homo sapiens
cauuggguauaaucuaaga

SEQ ID NO: 979726 - RNA, 19 nt, Homo sapiens
uaaggcagaagucaauuca

SEQ ID NO: 979727 - RNA, 19 nt, Homo sapiens
uacggaauguagaauguau

SEQ ID NO: 979728 - RNA, 19 nt, Homo sapiens
uuccuugucucacuauuug

SEQ ID NO: 979729 - RNA, 19 nt, Homo sapiens
gaagucaaaguuccuuguc

SEQ ID NO: 979730 - RNA, 19 nt, Homo sapiens
augaaaccaccaagcauua

SEQ ID NO: 979731 - RNA, 19 nt, Homo sapiens
cugaagaguccggcuguua

SEQ ID NO: 979732 - RNA, 19 nt, Homo sapiens
ggcuaauggucgauuugaa

SEQ ID NO: 979733 - RNA, 19 nt, Homo sapiens
ccaagcauuauucuccuaa

SEQ ID NO: 979734 - RNA, 19 nt, Homo sapiens
uugaguaaccuguuuccua

SEQ ID NO: 979735 - RNA, 19 nt, Homo sapiens
agauuucuguugugaagga

SEQ ID NO: 979736 - RNA, 19 nt, Homo sapiens
auugaaagauccaacagau

SEQ ID NO: 979737 - RNA, 19 nt, Homo sapiens
ucucauguuucaucuucuu

SEQ ID NO: 979738 - RNA, 19 nt, Homo sapiens
gagcaucucaggccaucau

SEQ ID NO: 979739 - RNA, 19 nt, Homo sapiens
cauucugcauuggguauaa

SEQ ID NO: 979740 - RNA, 19 nt, Homo sapiens
cuauauugcccuuugaaau

SEQ ID NO: 979741 - RNA, 19 nt, Homo sapiens
uuucucauguuucaucuuc

SEQ ID NO: 979742 - RNA, 19 nt, Homo sapiens
acucaacugcuucauuaaa

SEQ ID NO: 979743 - RNA, 19 nt, Homo sapiens
aaagaacuggcuaggcaaa

SEQ ID NO: 979744 - RNA, 19 nt, Homo sapiens
gcggcagaauugaaagauc

SEQ ID NO: 979745 - RNA, 19 nt, Homo sapiens
guuacucaauaccacuuau

SEQ ID NO: 979746 - RNA, 19 nt, Homo sapiens
gauccuuguaaguuuagua

SEQ ID NO: 979747 - RNA, 19 nt, Homo sapiens
uccaacagaucauuaccau

SEQ ID NO: 979748 - RNA, 19 nt, Homo sapiens
gucaauucaucuggaaaga

SEQ ID NO: 979749 - RNA, 19 nt, Homo sapiens
gcauuauuagccaucauug

SEQ ID NO: 979750 - RNA, 19 nt, Homo sapiens
ggaguauaaggacagcauu

SEQ ID NO: 979751 - RNA, 19 nt, Homo sapiens
uuuccuauauugcccuuug

SEQ ID NO: 979752 - RNA, 19 nt, Homo sapiens
guuccuugucucacuauuu

SEQ ID NO: 979753 - RNA, 19 nt, Homo sapiens
caccagaguaucccaugaa

SEQ ID NO: 979754 - RNA, 19 nt, Homo sapiens
gcaagaaaaucuguuugag

SEQ ID NO: 979755 - RNA, 19 nt, Homo sapiens
cagcagcauccuuucauca

SEQ ID NO: 979756 - RNA, 19 nt, Homo sapiens
aagaugauauaccuacaac

SEQ ID NO: 979757 - RNA, 19 nt, Homo sapiens
accagaguaucccaugaaa

SEQ ID NO: 979758 - RNA, 19 nt, Homo sapiens
caagccaagcugaccaaga

SEQ ID NO: 979759 - RNA, 19 nt, Homo sapiens
uaagucaccugcuucauua

SEQ ID NO: 979760 - RNA, 19 nt, Homo sapiens
ugaaagggcugaaguacaa

SEQ ID NO: 979761 - RNA, 19 nt, Homo sapiens
ucaggaaucucuagaaaga

SEQ ID NO: 979762 - RNA, 19 nt, Homo sapiens
gaaacguccugaccuguga

SEQ ID NO: 979763 - RNA, 19 nt, Homo sapiens
caucaugaauucccaagaa

SEQ ID NO: 979764 - RNA, 19 nt, Homo sapiens
ugagagagcuccacaaggu

SEQ ID NO: 979765 - RNA, 19 nt, Homo sapiens
gaaauggguaccaaucaaa

SEQ ID NO: 979766 - RNA, 19 nt, Homo sapiens
ggucuacggcuuaaacuuu

SEQ ID NO: 979767 - RNA, 19 nt, Homo sapiens
uagaggagguggugagaga

SEQ ID NO: 979768 - RNA, 19 nt, Homo sapiens
cgucaggaaucucuagaaa

SEQ ID NO: 979769 - RNA, 19 nt, Homo sapiens
guacauuucuuuggguuuc

SEQ ID NO: 979770 - RNA, 19 nt, Homo sapiens
cagccucacucuaggauga

SEQ ID NO: 979771 - RNA, 19 nt, Homo sapiens
gaagaugaaagccaaaugg

SEQ ID NO: 979772 - RNA, 19 nt, Homo sapiens
caaauggaagauccuagua

SEQ ID NO: 979773 - RNA, 19 nt, Homo sapiens
ggaucaacaucuaccacaa

SEQ ID NO: 979774 - RNA, 19 nt, Homo sapiens
agaaauggguaccaaucaa

SEQ ID NO: 979775 - RNA, 19 nt, Homo sapiens
cuaagucaccugcuucauu

SEQ ID NO: 979776 - RNA, 19 nt, Homo sapiens
gaagaaggaagaugaaagc

SEQ ID NO: 979777 - RNA, 19 nt, Homo sapiens
gaugacaccaguaagaaau

SEQ ID NO: 979778 - RNA, 19 nt, Homo sapiens
gcccugaacaucaugaauu

SEQ ID NO: 979779 - RNA, 19 nt, Homo sapiens
gcaaagagccccgaagcua

SEQ ID NO: 979780 - RNA, 19 nt, Homo sapiens
gggcuuccgugauggucua

SEQ ID NO: 979781 - RNA, 19 nt, Homo sapiens
gggccaagcugagaagagu

SEQ ID NO: 979782 - RNA, 19 nt, Homo sapiens
ggauucagccggaucaaca

SEQ ID NO: 979783 - RNA, 19 nt, Homo sapiens
gagucaaguugcaggauca

SEQ ID NO: 979784 - RNA, 19 nt, Homo sapiens
gagaagaaggaagaugaaa

SEQ ID NO: 979785 - RNA, 19 nt, Homo sapiens
ggaagaugaaagccaaaug

SEQ ID NO: 979786 - RNA, 19 nt, Homo sapiens
agcagguugugaucaauua

SEQ ID NO: 979787 - RNA, 19 nt, Homo sapiens
uaagaaauggguaccaauc

SEQ ID NO: 979788 - RNA, 19 nt, Homo sapiens
uuagacgguuuccagguuu

SEQ ID NO: 979789 - RNA, 19 nt, Homo sapiens
ggccacaagugaacagagu

SEQ ID NO: 979790 - RNA, 19 nt, Homo sapiens
ccagagaagacaagugaug

SEQ ID NO: 979791 - RNA, 19 nt, Homo sapiens
ccgagaagaaggaagauga

SEQ ID NO: 979792 - RNA, 19 nt, Homo sapiens
caacaucuaccacaacacu

SEQ ID NO: 979793 - RNA, 19 nt, Homo sapiens
cgacagaggacagccagaa

SEQ ID NO: 979794 - RNA, 19 nt, Homo sapiens
acaaacugcuggccaagag

SEQ ID NO: 979795 - RNA, 19 nt, Homo sapiens
ggacauccagagaagacaa

SEQ ID NO: 979796 - RNA, 19 nt, Homo sapiens
caccaggucugcucgucuu

SEQ ID NO: 979797 - RNA, 19 nt, Homo sapiens
gucuacggcuuaaacuuug

SEQ ID NO: 979798 - RNA, 19 nt, Homo sapiens
gcugggagcgugaaugaca

SEQ ID NO: 979799 - RNA, 19 nt, Homo sapiens
uggaggaaaugaacaaacu

SEQ ID NO: 979800 - RNA, 19 nt, Homo sapiens
aagugcaacuccuggguuu

SEQ ID NO: 979801 - RNA, 19 nt, Homo sapiens
cagagucguuggagucaag

SEQ ID NO: 979802 - RNA, 19 nt, Homo sapiens
ucagccggaucaacaucua

SEQ ID NO: 979803 - RNA, 19 nt, Homo sapiens
ccacaagugaacagaguau

SEQ ID NO: 979804 - RNA, 19 nt, Homo sapiens
cgagaagaaggaagaugaa

SEQ ID NO: 979805 - RNA, 19 nt, Homo sapiens
cagacaagccagccgagaa

SEQ ID NO: 979806 - RNA, 19 nt, Homo sapiens
caaagagccccgaagcuaa

SEQ ID NO: 979807 - RNA, 19 nt, Homo sapiens
ccaaauggaagauccuagu

SEQ ID NO: 979808 - RNA, 19 nt, Homo sapiens
guaagaaauggguaccaau

SEQ ID NO: 979809 - RNA, 19 nt, Homo sapiens
ggagcaacucgguggagaa

SEQ ID NO: 979810 - RNA, 19 nt, Homo sapiens
cgacgagagcuccauguca

SEQ ID NO: 979811 - RNA, 19 nt, Homo sapiens
gaaucucuagaaagaagaa

SEQ ID NO: 979812 - RNA, 19 nt, Homo sapiens
aggaaucucuagaaagaag

SEQ ID NO: 979813 - RNA, 19 nt, Homo sapiens
caugaauucccaagaagga

SEQ ID NO: 979814 - RNA, 19 nt, Homo sapiens
cgaugacaccaguaagaaa

SEQ ID NO: 979815 - RNA, 19 nt, Homo sapiens
ggugagagagcuccacaag

SEQ ID NO: 979816 - RNA, 19 nt, Homo sapiens
cccugaacaucaugaauuc

SEQ ID NO: 979817 - RNA, 19 nt, Homo sapiens
aguaagaaauggguaccaa

SEQ ID NO: 979818 - RNA, 19 nt, Homo sapiens
gugaggaaaccaagugcaa

SEQ ID NO: 979819 - RNA, 19 nt, Homo sapiens
gaucaacaucuaccacaac

SEQ ID NO: 979820 - RNA, 19 nt, Homo sapiens
ugaaggaggagaucaucga

SEQ ID NO: 979821 - RNA, 19 nt, Homo sapiens
gcagcagcgucaggaaucu

SEQ ID NO: 979822 - RNA, 19 nt, Homo sapiens
cagcagguugugaucaauu

SEQ ID NO: 979823 - RNA, 19 nt, Homo sapiens
auuagacgguuuccagguu

SEQ ID NO: 979824 - RNA, 19 nt, Homo sapiens
gaggaaaccaagugcaacu

SEQ ID NO: 979825 - RNA, 19 nt, Homo sapiens
cagccgagaagaaggaaga

SEQ ID NO: 979826 - RNA, 19 nt, Homo sapiens
ccagugggaccucaaaguc

SEQ ID NO: 979827 - RNA, 19 nt, Homo sapiens
gugaaagggcugaaguaca

SEQ ID NO: 979828 - RNA, 19 nt, Homo sapiens
acacaugacagugaggaaa

SEQ ID NO: 979829 - RNA, 19 nt, Homo sapiens
cgccaggucuacggcuuaa

SEQ ID NO: 979830 - RNA, 19 nt, Homo sapiens
cagguugugaucaauuauu

SEQ ID NO: 979831 - RNA, 19 nt, Homo sapiens
caacaccuucagagucguu

SEQ ID NO: 979832 - RNA, 19 nt, Homo sapiens
ccuguguccucgauucugu

SEQ ID NO: 979833 - RNA, 19 nt, Homo sapiens
gagcaacucgguggagaag

SEQ ID NO: 979834 - RNA, 19 nt, Homo sapiens
gaaagccaaauggaagauc

SEQ ID NO: 979835 - RNA, 19 nt, Homo sapiens
agaugaaagccaaauggaa

SEQ ID NO: 979836 - RNA, 19 nt, Homo sapiens
ggaggaaaugaacaaacug

SEQ ID NO: 979837 - RNA, 19 nt, Homo sapiens
ugacaccaguaagaaaugg

SEQ ID NO: 979838 - RNA, 19 nt, Homo sapiens
aagaaauggguaccaauca

SEQ ID NO: 979839 - RNA, 19 nt, Homo sapiens
gggaucagcaccacguaag

SEQ ID NO: 979840 - RNA, 19 nt, Homo sapiens
ccgugauggucuacgauga

SEQ ID NO: 979841 - RNA, 19 nt, Homo sapiens
uacgaugacaccaguaaga

SEQ ID NO: 979842 - RNA, 19 nt, Homo sapiens
gcagguugugaucaauuau

SEQ ID NO: 979843 - RNA, 19 nt, Homo sapiens
cagcgcucaugguguugaa

SEQ ID NO: 979844 - RNA, 19 nt, Homo sapiens
gugauggucuacgaugaca

SEQ ID NO: 979845 - RNA, 19 nt, Homo sapiens
ucuacgaugacaccaguaa

SEQ ID NO: 979846 - RNA, 19 nt, Homo sapiens
ccuggaugccuucgacuug

SEQ ID NO: 979847 - RNA, 19 nt, Homo sapiens
aagccuguguccucgauuc

SEQ ID NO: 979848 - RNA, 19 nt, Homo sapiens
agaagccuguguccucgau

SEQ ID NO: 979849 - RNA, 19 nt, Homo sapiens
agaagaaggaagaugaaag

SEQ ID NO: 979850 - RNA, 19 nt, Homo sapiens
gugaucaauuauucaaucg

SEQ ID NO: 979851 - RNA, 19 nt, Homo sapiens
gggcgucuaugauuucuuu

SEQ ID NO: 979852 - RNA, 19 nt, Homo sapiens
gaccagggcuacagugaag

SEQ ID NO: 979853 - RNA, 19 nt, Homo sapiens
ugaccuuucugugcaauaa

SEQ ID NO: 979854 - RNA, 19 nt, Homo sapiens
gaagguggugggcacagua

SEQ ID NO: 979855 - RNA, 19 nt, Homo sapiens
gcugguggaucuucauaca

SEQ ID NO: 979856 - RNA, 19 nt, Homo sapiens
uaggagcucugcccguuga

SEQ ID NO: 979857 - RNA, 19 nt, Homo sapiens
gguugcagcuguuucaucu

SEQ ID NO: 979858 - RNA, 19 nt, Homo sapiens
uaccagagcuugggcuuca

SEQ ID NO: 979859 - RNA, 19 nt, Homo sapiens
gagcucugcccguugauga

SEQ ID NO: 979860 - RNA, 19 nt, Homo sapiens
cuuaucacauccgcaaaua

SEQ ID NO: 979861 - RNA, 19 nt, Homo sapiens
uuucuuuccuucuguauug

SEQ ID NO: 979862 - RNA, 19 nt, Homo sapiens
ucauacaguucauuucauc

SEQ ID NO: 979863 - RNA, 19 nt, Homo sapiens
ggucagaauagaauccauu

SEQ ID NO: 979864 - RNA, 19 nt, Homo sapiens
gcagggcgucuaugauuuc

SEQ ID NO: 979865 - RNA, 19 nt, Homo sapiens
ugacugcaaugaccuuucu

SEQ ID NO: 979866 - RNA, 19 nt, Homo sapiens
ggaccagggcuacagugaa

SEQ ID NO: 979867 - RNA, 19 nt, Homo sapiens
gaguguggcuccugcuucu

SEQ ID NO: 979868 - RNA, 19 nt, Homo sapiens
gggcuacagugaaguuguc

SEQ ID NO: 979869 - RNA, 19 nt, Homo sapiens
ggcugaaucugaagagaag

SEQ ID NO: 979870 - RNA, 19 nt, Homo sapiens
caccaaauccuaccugagu

SEQ ID NO: 979871 - RNA, 19 nt, Homo sapiens
ugauuucuuuccuucugua

SEQ ID NO: 979872 - RNA, 19 nt, Homo sapiens
ccaaauccuaccugaguga

SEQ ID NO: 979873 - RNA, 19 nt, Homo sapiens
caaugaccuuucugugcaa

SEQ ID NO: 979874 - RNA, 19 nt, Homo sapiens
uaugauuucuuuccuucug

SEQ ID NO: 979875 - RNA, 19 nt, Homo sapiens
caguucauuucaucuauca

SEQ ID NO: 979876 - RNA, 19 nt, Homo sapiens
gcagcuguuucaucucucu

SEQ ID NO: 979877 - RNA, 19 nt, Homo sapiens
cuggguggcugaaucugaa

SEQ ID NO: 979878 - RNA, 19 nt, Homo sapiens
uuacugaagcugccucgaa

SEQ ID NO: 979879 - RNA, 19 nt, Homo sapiens
gucuguccauggcuccuua

SEQ ID NO: 979880 - RNA, 19 nt, Homo sapiens
gauucuggcccucguguuc

SEQ ID NO: 979881 - RNA, 19 nt, Homo sapiens
gguggaucuucauacaguu

SEQ ID NO: 979882 - RNA, 19 nt, Homo sapiens
ugguggaucuucauacagu

SEQ ID NO: 979883 - RNA, 19 nt, Homo sapiens
caaccucugacugcaauga

SEQ ID NO: 979884 - RNA, 19 nt, Homo sapiens
guccauggcuccuuaucac

SEQ ID NO: 979885 - RNA, 19 nt, Homo sapiens
cuucauacaguucauuuca

SEQ ID NO: 979886 - RNA, 19 nt, Homo sapiens
gaucuucauacaguucauu

SEQ ID NO: 979887 - RNA, 19 nt, Homo sapiens
gcauugcgcacagacaugu

SEQ ID NO: 979888 - RNA, 19 nt, Homo sapiens
ccucgaacccucauacucu

SEQ ID NO: 979889 - RNA, 19 nt, Homo sapiens
cccaaccucugacugcaau

SEQ ID NO: 979890 - RNA, 19 nt, Homo sapiens
gggaccagggcuacaguga

SEQ ID NO: 979891 - RNA, 19 nt, Homo sapiens
agaagcgguugcagcuguu

SEQ ID NO: 979892 - RNA, 19 nt, Homo sapiens
ccagggcuacagugaaguu

SEQ ID NO: 979893 - RNA, 19 nt, Homo sapiens
acaguucauuucaucuauc

SEQ ID NO: 979894 - RNA, 19 nt, Homo sapiens
gaagcgguugcagcuguuu

SEQ ID NO: 979895 - RNA, 19 nt, Homo sapiens
gcuucuggguggcugaauc

SEQ ID NO: 979896 - RNA, 19 nt, Homo sapiens
cauggcuccuuaucacauc

SEQ ID NO: 979897 - RNA, 19 nt, Homo sapiens
gaacccucauacucuuacu

SEQ ID NO: 979898 - RNA, 19 nt, Homo sapiens
cucagugacuucagacaca

SEQ ID NO: 979899 - RNA, 19 nt, Homo sapiens
caggagagcgaccgcaagu

SEQ ID NO: 979900 - RNA, 19 nt, Homo sapiens
gaaaugaucgccacucuaa

SEQ ID NO: 979901 - RNA, 19 nt, Homo sapiens
caagaaaccauuccaaaua

SEQ ID NO: 979902 - RNA, 19 nt, Homo sapiens
ggaagaagauggagagaag

SEQ ID NO: 979903 - RNA, 19 nt, Homo sapiens
gcacauaguuauugcugaa

SEQ ID NO: 979904 - RNA, 19 nt, Homo sapiens
ggaagacaauugccacuug

SEQ ID NO: 979905 - RNA, 19 nt, Homo sapiens
gaauacuaccuacgaauua

SEQ ID NO: 979906 - RNA, 19 nt, Homo sapiens
ucacaggcuuuauacuuua

SEQ ID NO: 979907 - RNA, 19 nt, Homo sapiens
gagcagaguuggagaaugg

SEQ ID NO: 979908 - RNA, 19 nt, Homo sapiens
guauauggaucgcaagaaa

SEQ ID NO: 979909 - RNA, 19 nt, Homo sapiens
uaggaucacucuuauugua

SEQ ID NO: 979910 - RNA, 19 nt, Homo sapiens
gcagagauaaguuuaagaa

SEQ ID NO: 979911 - RNA, 19 nt, Homo sapiens
gcaaauggagaccucauaa

SEQ ID NO: 979912 - RNA, 19 nt, Homo sapiens
uuaaauggcuacuaaagga

SEQ ID NO: 979913 - RNA, 19 nt, Homo sapiens
gaaggguuaucauacuuga

SEQ ID NO: 979914 - RNA, 19 nt, Homo sapiens
ggaaagaaagucucaagga

SEQ ID NO: 979915 - RNA, 19 nt, Homo sapiens
cagcagaaguccaagaaga

SEQ ID NO: 979916 - RNA, 19 nt, Homo sapiens
ucagugggaucauguacua

SEQ ID NO: 979917 - RNA, 19 nt, Homo sapiens
ggacauaggagaaaucaag

SEQ ID NO: 979918 - RNA, 19 nt, Homo sapiens
aggaaagcauguacuauuu

SEQ ID NO: 979919 - RNA, 19 nt, Homo sapiens
ccaagaagaugaagauacu

SEQ ID NO: 979920 - RNA, 19 nt, Homo sapiens
caauggaaguuguuaauac

SEQ ID NO: 979921 - RNA, 19 nt, Homo sapiens
uuaaagaacugguaauagg

SEQ ID NO: 979922 - RNA, 19 nt, Homo sapiens
cuaggaaggcguagaauuu

SEQ ID NO: 979923 - RNA, 19 nt, Homo sapiens
gaucagaggccagcagaaa

SEQ ID NO: 979924 - RNA, 19 nt, Homo sapiens
aagaagacgugaauucaga

SEQ ID NO: 979925 - RNA, 19 nt, Homo sapiens
gaccagauaacuuuaaaug

SEQ ID NO: 979926 - RNA, 19 nt, Homo sapiens
acacuauggucgaauacua

SEQ ID NO: 979927 - RNA, 19 nt, Homo sapiens
ggacagaggagaauuugca

SEQ ID NO: 979928 - RNA, 19 nt, Homo sapiens
gaaagauaagcacauaguu

SEQ ID NO: 979929 - RNA, 19 nt, Homo sapiens
ucagaggccagcagaaaua

SEQ ID NO: 979930 - RNA, 19 nt, Homo sapiens
agaagaagguguccagcuu

SEQ ID NO: 979931 - RNA, 19 nt, Homo sapiens
aaacaaggaugcagaacag

SEQ ID NO: 979932 - RNA, 19 nt, Homo sapiens
aagaaaccauuccaaauag

SEQ ID NO: 979933 - RNA, 19 nt, Homo sapiens
gcacggccguuacuucucu

SEQ ID NO: 979934 - RNA, 19 nt, Homo sapiens
ugaagagcgugcuugugua

SEQ ID NO: 979935 - RNA, 19 nt, Homo sapiens
gugacacuauggucgaaua

SEQ ID NO: 979936 - RNA, 19 nt, Homo sapiens
gagagaaggcaaacaagga

SEQ ID NO: 979937 - RNA, 19 nt, Homo sapiens
gaggccagcagaaauagua

SEQ ID NO: 979938 - RNA, 19 nt, Homo sapiens
uaaagggaguggaaaugau

SEQ ID NO: 979939 - RNA, 19 nt, Homo sapiens
gcacugcggguccugauug

SEQ ID NO: 979940 - RNA, 19 nt, Homo sapiens
caacgugucagcucgcuuu

SEQ ID NO: 979941 - RNA, 19 nt, Homo sapiens
ugcagcagguuaauaauga

SEQ ID NO: 979942 - RNA, 19 nt, Homo sapiens
uaggaaagcauguacuauu

SEQ ID NO: 979943 - RNA, 19 nt, Homo sapiens
cgaauacuaccuacgaauu

SEQ ID NO: 979944 - RNA, 19 nt, Homo sapiens
ucgaggagauucuggauca

SEQ ID NO: 979945 - RNA, 19 nt, Homo sapiens
gaucgccacucuaagucaa

SEQ ID NO: 979946 - RNA, 19 nt, Homo sapiens
cuacaaauggucacagaaa

SEQ ID NO: 979947 - RNA, 19 nt, Homo sapiens
cuugaaagauaagcacaua

SEQ ID NO: 979948 - RNA, 19 nt, Homo sapiens
gaaugaauggugaccuuga

SEQ ID NO: 979949 - RNA, 19 nt, Homo sapiens
ggaaaugaucgccacucua

SEQ ID NO: 979950 - RNA, 19 nt, Homo sapiens
caaauggagaccucauaaa

SEQ ID NO: 979951 - RNA, 19 nt, Homo sapiens
gugaagagcgugcuugugu

SEQ ID NO: 979952 - RNA, 19 nt, Homo sapiens
aaauagugaugaaggcauu

SEQ ID NO: 979953 - RNA, 19 nt, Homo sapiens
gaaaccauuccaaauagug

SEQ ID NO: 979954 - RNA, 19 nt, Homo sapiens
cgugucagcucgcuuuaga

SEQ ID NO: 979955 - RNA, 19 nt, Homo sapiens
ccaauggaaguuguuaaua

SEQ ID NO: 979956 - RNA, 19 nt, Homo sapiens
gaaaacaaccaacaaaaca

SEQ ID NO: 979957 - RNA, 19 nt, Homo sapiens
caaggaugcagaacagaaa

SEQ ID NO: 979958 - RNA, 19 nt, Homo sapiens
gaaagcuucuucacuaccu

SEQ ID NO: 979959 - RNA, 19 nt, Homo sapiens
guucacaggcuuuauacuu

SEQ ID NO: 979960 - RNA, 19 nt, Homo sapiens
ugcacuaucuucuugauug

SEQ ID NO: 979961 - RNA, 19 nt, Homo sapiens
gguaauaggaaagcaugua

SEQ ID NO: 979962 - RNA, 19 nt, Homo sapiens
gaagacgugaauucagaaa

SEQ ID NO: 979963 - RNA, 19 nt, Homo sapiens
gcuuuauacuuuagaagga

SEQ ID NO: 979964 - RNA, 19 nt, Homo sapiens
ccaccaaggccagaaguaa

SEQ ID NO: 979965 - RNA, 19 nt, Homo sapiens
cugacgaaauugaaacaaa

SEQ ID NO: 979966 - RNA, 19 nt, Homo sapiens
cauaggagaaaucaagaaa

SEQ ID NO: 979967 - RNA, 19 nt, Homo sapiens
cacaagaaaccauuccaaa

SEQ ID NO: 979968 - RNA, 19 nt, Homo sapiens
gaauucacaagaaaccauu

SEQ ID NO: 979969 - RNA, 19 nt, Homo sapiens
uucacaggcuuuauacuuu

SEQ ID NO: 979970 - RNA, 19 nt, Homo sapiens
uaaagaacugguaauagga

SEQ ID NO: 979971 - RNA, 19 nt, Homo sapiens
ugauguagacccucaaaga

SEQ ID NO: 979972 - RNA, 19 nt, Homo sapiens
gucaguuucucguucguuu

SEQ ID NO: 979973 - RNA, 19 nt, Homo sapiens
gcagguuaauaaugagcuu

SEQ ID NO: 979974 - RNA, 19 nt, Homo sapiens
caaacaaggaugcagaaca

SEQ ID NO: 979975 - RNA, 19 nt, Homo sapiens
agaaauaguagacgaggaa

SEQ ID NO: 979976 - RNA, 19 nt, Homo sapiens
agaugaagauacucagguu

SEQ ID NO: 979977 - RNA, 19 nt, Homo sapiens
acaagaaaccauuccaaau

SEQ ID NO: 979978 - RNA, 19 nt, Homo sapiens
gccgugcacuaucuucuug

SEQ ID NO: 979979 - RNA, 19 nt, Homo sapiens
ggccguuacuucucuuuca

SEQ ID NO: 979980 - RNA, 19 nt, Homo sapiens
gcagaaguccaagaagaug

SEQ ID NO: 979981 - RNA, 19 nt, Homo sapiens
gaagagcgugcuuguguac

SEQ ID NO: 979982 - RNA, 19 nt, Homo sapiens
ucaauuacuuggacauagg

SEQ ID NO: 979983 - RNA, 19 nt, Homo sapiens
ggucgaauacuaccuacga

SEQ ID NO: 979984 - RNA, 19 nt, Homo sapiens
gacaagaugaggcugaugu

SEQ ID NO: 979985 - RNA, 19 nt, Homo sapiens
uaaauggaggcaccgauga

SEQ ID NO: 979986 - RNA, 19 nt, Homo sapiens
cuaaagggaguggaaauga

SEQ ID NO: 979987 - RNA, 19 nt, Homo sapiens
gaaaagaccaauggaaguu

SEQ ID NO: 979988 - RNA, 19 nt, Homo sapiens
ugaaagauaagcacauagu

SEQ ID NO: 979989 - RNA, 19 nt, Homo sapiens
uucacuaccuccuauugua

SEQ ID NO: 979990 - RNA, 19 nt, Homo sapiens
gaaucagugggaucaugua

SEQ ID NO: 979991 - RNA, 19 nt, Homo sapiens
uggaaguuguuaauacaga

SEQ ID NO: 979992 - RNA, 19 nt, Homo sapiens
aaagaccaauggaaguugu

SEQ ID NO: 979993 - RNA, 19 nt, Homo sapiens
aaugaauggugaccuugaa

SEQ ID NO: 979994 - RNA, 19 nt, Homo sapiens
acaguuggauccagugaca

SEQ ID NO: 979995 - RNA, 19 nt, Homo sapiens
ggagcagaguuggagaaug

SEQ ID NO: 979996 - RNA, 19 nt, Homo sapiens
gcacuaucuucuugauugc

SEQ ID NO: 979997 - RNA, 19 nt, Homo sapiens
aauaggaaagcauguacua

SEQ ID NO: 979998 - RNA, 19 nt, Homo sapiens
caccaaggccagaaguaaa

SEQ ID NO: 979999 - RNA, 19 nt, Homo sapiens
ggaaagcauguacuauuuu

SEQ ID NO: 980000 - RNA, 19 nt, Homo sapiens
gaaagcagcugaagaaaca

SEQ ID NO: 980001 - RNA, 19 nt, Homo sapiens
gggcacaguuuguauauuu

SEQ ID NO: 980002 - RNA, 19 nt, Homo sapiens
ggaaucaucuccauuuaau

SEQ ID NO: 980003 - RNA, 19 nt, Homo sapiens
guagauagaugauuaguag

SEQ ID NO: 980004 - RNA, 19 nt, Homo sapiens
aaacaaacauggagaagaa

SEQ ID NO: 980005 - RNA, 19 nt, Homo sapiens
acugaaagcugcaauauuu

SEQ ID NO: 980006 - RNA, 19 nt, Homo sapiens
gaugaagagugacaaauug

SEQ ID NO: 980007 - RNA, 19 nt, Homo sapiens
gaacccaagucucugaauu

SEQ ID NO: 980008 - RNA, 19 nt, Homo sapiens
ccaaaugauugcuuucuuu

SEQ ID NO: 980009 - RNA, 19 nt, Homo sapiens
gaaugagaaucuuguagaa

SEQ ID NO: 980010 - RNA, 19 nt, Homo sapiens
ccaaagcaaugaagaaguu

SEQ ID NO: 980011 - RNA, 19 nt, Homo sapiens
gauaauagcccagauucua

SEQ ID NO: 980012 - RNA, 19 nt, Homo sapiens
gauaacagcuuccucaaac

SEQ ID NO: 980013 - RNA, 19 nt, Homo sapiens
gaacauacagaaggaauuu

SEQ ID NO: 980014 - RNA, 19 nt, Homo sapiens
uaaggaaggucauaguuug

SEQ ID NO: 980015 - RNA, 19 nt, Homo sapiens
caacuaugaugaaggcuuu

SEQ ID NO: 980016 - RNA, 19 nt, Homo sapiens
guauuuaccuguuaagaga

SEQ ID NO: 980017 - RNA, 19 nt, Homo sapiens
gaaggaagaucucugaaaa

SEQ ID NO: 980018 - RNA, 19 nt, Homo sapiens
gaaauauuccaccugauaa

SEQ ID NO: 980019 - RNA, 19 nt, Homo sapiens
ucacuucaaucaacucuuu

SEQ ID NO: 980020 - RNA, 19 nt, Homo sapiens
ggaagaaucuauuguaagc

SEQ ID NO: 980021 - RNA, 19 nt, Homo sapiens
ggaugaggaugaagaguga

SEQ ID NO: 980022 - RNA, 19 nt, Homo sapiens
gaaaacagcuauucucuag

SEQ ID NO: 980023 - RNA, 19 nt, Homo sapiens
gaacauaugcaucuuuaca

SEQ ID NO: 980024 - RNA, 19 nt, Homo sapiens
gaagaugacucccgugacu

SEQ ID NO: 980025 - RNA, 19 nt, Homo sapiens
gcaauggaccucacuauca

SEQ ID NO: 980026 - RNA, 19 nt, Homo sapiens
gcuuaaacauuacgacuga

SEQ ID NO: 980027 - RNA, 19 nt, Homo sapiens
gaacagauaaagagaaauc

SEQ ID NO: 980028 - RNA, 19 nt, Homo sapiens
acaacaaucuccacaagaa

SEQ ID NO: 980029 - RNA, 19 nt, Homo sapiens
guugucaucuucuacauuu

SEQ ID NO: 980030 - RNA, 19 nt, Homo sapiens
ucagaaaccucuauaaagg

SEQ ID NO: 980031 - RNA, 19 nt, Homo sapiens
gcagugaugauaugcauaa

SEQ ID NO: 980032 - RNA, 19 nt, Homo sapiens
caaagcagcucaaccaacu

SEQ ID NO: 980033 - RNA, 19 nt, Homo sapiens
aaagaccacucaacagaaa

SEQ ID NO: 980034 - RNA, 19 nt, Homo sapiens
ccagaaagcagcugaagaa

SEQ ID NO: 980035 - RNA, 19 nt, Homo sapiens
aaacagcuauucucuagau

SEQ ID NO: 980036 - RNA, 19 nt, Homo sapiens
gaacagcagcacugagauu

SEQ ID NO: 980037 - RNA, 19 nt, Homo sapiens
gcaaugaugcugggccuua

SEQ ID NO: 980038 - RNA, 19 nt, Homo sapiens
ggaugaagagugacaaauu

SEQ ID NO: 980039 - RNA, 19 nt, Homo sapiens
caacaccuuugcugaagaa

SEQ ID NO: 980040 - RNA, 19 nt, Homo sapiens
ccaaauggccuccugaaga

SEQ ID NO: 980041 - RNA, 19 nt, Homo sapiens
ggaaggaagaucucugaaa

SEQ ID NO: 980042 - RNA, 19 nt, Homo sapiens
uaccuagucugaaacauuu

SEQ ID NO: 980043 - RNA, 19 nt, Homo sapiens
guaaggaaggucauaguuu

SEQ ID NO: 980044 - RNA, 19 nt, Homo sapiens
caaagcaccucugucaaga

SEQ ID NO: 980045 - RNA, 19 nt, Homo sapiens
gaagaacagauaaagagaa

SEQ ID NO: 980046 - RNA, 19 nt, Homo sapiens
caguugauauuccaaauug

SEQ ID NO: 980047 - RNA, 19 nt, Homo sapiens
agagaaaucgguauuauga

SEQ ID NO: 980048 - RNA, 19 nt, Homo sapiens
guuuggagauggagaauga

SEQ ID NO: 980049 - RNA, 19 nt, Homo sapiens
ugaaaguucuccucccaaa

SEQ ID NO: 980050 - RNA, 19 nt, Homo sapiens
gcagcuguguccaaacaaa

SEQ ID NO: 980051 - RNA, 19 nt, Homo sapiens
agccaaagcugaccaagaa

SEQ ID NO: 980052 - RNA, 19 nt, Homo sapiens
agaaaucgguauuaugaug

SEQ ID NO: 980053 - RNA, 19 nt, Homo sapiens
gcacagaccacacaaggau

SEQ ID NO: 980054 - RNA, 19 nt, Homo sapiens
aggaacauaugcaucuuua

SEQ ID NO: 980055 - RNA, 19 nt, Homo sapiens
gugaugauaugcauaagug

SEQ ID NO: 980056 - RNA, 19 nt, Homo sapiens
gaaaucgguauuaugauga

SEQ ID NO: 980057 - RNA, 19 nt, Homo sapiens
gaagagaaguaaggaaggu

SEQ ID NO: 980058 - RNA, 19 nt, Homo sapiens
gaacaagucaucggcuauu

SEQ ID NO: 980059 - RNA, 19 nt, Homo sapiens
gagcagagucucacacaga

SEQ ID NO: 980060 - RNA, 19 nt, Homo sapiens
gaucugcugucucccaaau

SEQ ID NO: 980061 - RNA, 19 nt, Homo sapiens
ggaaauauucuccaaguac

SEQ ID NO: 980062 - RNA, 19 nt, Homo sapiens
gaagaauucacuacucaga

SEQ ID NO: 980063 - RNA, 19 nt, Homo sapiens
ggcuuaagaugauguuuga

SEQ ID NO: 980064 - RNA, 19 nt, Homo sapiens
gaacaggcuuaagaugaug

SEQ ID NO: 980065 - RNA, 19 nt, Homo sapiens
aaaccaaccuacacucuuc

SEQ ID NO: 980066 - RNA, 19 nt, Homo sapiens
aaacaacaaucuccacaag

SEQ ID NO: 980067 - RNA, 19 nt, Homo sapiens
caaauggccuccugaagac

SEQ ID NO: 980068 - RNA, 19 nt, Homo sapiens
ucaaccaacuauacaaaug

SEQ ID NO: 980069 - RNA, 19 nt, Homo sapiens
ggucaguugucaucuucua

SEQ ID NO: 980070 - RNA, 19 nt, Homo sapiens
gagaagaagagaaguaaca

SEQ ID NO: 980071 - RNA, 19 nt, Homo sapiens
gaaacaaacauggagaaga

SEQ ID NO: 980072 - RNA, 19 nt, Homo sapiens
agagcaaagugaagaguuu

SEQ ID NO: 980073 - RNA, 19 nt, Homo sapiens
gguaacagccaaagaacuu

SEQ ID NO: 980074 - RNA, 19 nt, Homo sapiens
gaaccaacucaaacuaaga

SEQ ID NO: 980075 - RNA, 19 nt, Homo sapiens
ugaacaggcuuaagaugau

SEQ ID NO: 980076 - RNA, 19 nt, Homo sapiens
agaggugucuuaagcugua

SEQ ID NO: 980077 - RNA, 19 nt, Homo sapiens
caccuuugcugaagaauuc

SEQ ID NO: 980078 - RNA, 19 nt, Homo sapiens
gaaaggaaacaaguggaaa

SEQ ID NO: 980079 - RNA, 19 nt, Homo sapiens
gaggguaacagccaaagaa

SEQ ID NO: 980080 - RNA, 19 nt, Homo sapiens
gaagacaagccagcugaaa

SEQ ID NO: 980081 - RNA, 19 nt, Homo sapiens
cagcagguguuucacauca

SEQ ID NO: 980082 - RNA, 19 nt, Homo sapiens
gaaauaggcccaggucagu

SEQ ID NO: 980083 - RNA, 19 nt, Homo sapiens
guacacaguugauauucca

SEQ ID NO: 980084 - RNA, 19 nt, Homo sapiens
ggagagacagggaagagaa

SEQ ID NO: 980085 - RNA, 19 nt, Homo sapiens
caauggaccucacuaucau

SEQ ID NO: 980086 - RNA, 19 nt, Homo sapiens
ugagaaaggugaaccaacu

SEQ ID NO: 980087 - RNA, 19 nt, Homo sapiens
cuuacuagcucugaaauau

SEQ ID NO: 980088 - RNA, 19 nt, Homo sapiens
gagcaaagugaagaguuua

SEQ ID NO: 980089 - RNA, 19 nt, Homo sapiens
uaucugugcuucucauaau

SEQ ID NO: 980090 - RNA, 19 nt, Homo sapiens
ggaagaacagauaaagaga

SEQ ID NO: 980091 - RNA, 19 nt, Homo sapiens
ucacuaucauugaggguaa

SEQ ID NO: 980092 - RNA, 19 nt, Homo sapiens
guacugcauuuauagagau

SEQ ID NO: 980093 - RNA, 19 nt, Homo sapiens
uguagcagcuucauuucaa

SEQ ID NO: 980094 - RNA, 19 nt, Homo sapiens
caaccaacuauacaaauga

SEQ ID NO: 980095 - RNA, 19 nt, Homo sapiens
gcccaaagccgaagugcaa

SEQ ID NO: 980096 - RNA, 19 nt, Homo sapiens
agucuuaccuagucugaaa

SEQ ID NO: 980097 - RNA, 19 nt, Homo sapiens
gcaaagugaagaguuuaaa

SEQ ID NO: 980098 - RNA, 19 nt, Homo sapiens
uaaacuacauccugaacuc

SEQ ID NO: 980099 - RNA, 19 nt, Homo sapiens
ggccuuaaauucauguuag

SEQ ID NO: 980100 - RNA, 19 nt, Homo sapiens
gcaaaucaguggcggaaag

SEQ ID NO: 980101 - RNA, 19 nt, Homo sapiens
gaagaguuugugcgaauga

SEQ ID NO: 980102 - RNA, 19 nt, Homo sapiens
ccaccagcauguuccuuga

SEQ ID NO: 980103 - RNA, 19 nt, Homo sapiens
ucgaagaguuugugcgaau

SEQ ID NO: 980104 - RNA, 19 nt, Homo sapiens
gcagagacggcagacauga

SEQ ID NO: 980105 - RNA, 19 nt, Homo sapiens
gggacggucuggucgacuu

SEQ ID NO: 980106 - RNA, 19 nt, Homo sapiens
ccaccgagauggagcucau

SEQ ID NO: 980107 - RNA, 19 nt, Homo sapiens
cgaagaguuugugcgaaug

SEQ ID NO: 980108 - RNA, 19 nt, Homo sapiens
ucggugagccuguacagaa

SEQ ID NO: 980109 - RNA, 19 nt, Homo sapiens
ugaagcccaucgccucuag

SEQ ID NO: 980110 - RNA, 19 nt, Homo sapiens
aucgagaucucacagcaaa

SEQ ID NO: 980111 - RNA, 19 nt, Homo sapiens
gcuacucggugcucaacag

SEQ ID NO: 980112 - RNA, 19 nt, Homo sapiens
cuacaugcccaccgagaug

SEQ ID NO: 980113 - RNA, 19 nt, Homo sapiens
cgccuggccuugucucugu

SEQ ID NO: 980114 - RNA, 19 nt, Homo sapiens
gaucucacagcaaaucagu

SEQ ID NO: 980115 - RNA, 19 nt, Homo sapiens
gaguuugugcgaaugaugu

SEQ ID NO: 980116 - RNA, 19 nt, Homo sapiens
cgagaucucacagcaaauc

SEQ ID NO: 980117 - RNA, 19 nt, Homo sapiens
gcaaaucaguggcggaaag

SEQ ID NO: 980118 - RNA, 19 nt, Homo sapiens
gaagaguuugugcgaauga

SEQ ID NO: 980119 - RNA, 19 nt, Homo sapiens
ccaccagcauguuccuuga

SEQ ID NO: 980120 - RNA, 19 nt, Homo sapiens
ucgaagaguuugugcgaau

SEQ ID NO: 980121 - RNA, 19 nt, Homo sapiens
gcagagacggcagacauga

SEQ ID NO: 980122 - RNA, 19 nt, Homo sapiens
gggacggucuggucgacuu

SEQ ID NO: 980123 - RNA, 19 nt, Homo sapiens
ccaccgagauggagcucau

SEQ ID NO: 980124 - RNA, 19 nt, Homo sapiens
cgaagaguuugugcgaaug

SEQ ID NO: 980125 - RNA, 19 nt, Homo sapiens
ucggugagccuguacagaa

SEQ ID NO: 980126 - RNA, 19 nt, Homo sapiens
ugaagcccaucgccucuag

SEQ ID NO: 980127 - RNA, 19 nt, Homo sapiens
aucgagaucucacagcaaa

SEQ ID NO: 980128 - RNA, 19 nt, Homo sapiens
cuacaugcccaccgagaug

SEQ ID NO: 980129 - RNA, 19 nt, Homo sapiens
cgccuggccuugucucugu

SEQ ID NO: 980130 - RNA, 19 nt, Homo sapiens
gaucucacagcaaaucagu

SEQ ID NO: 980131 - RNA, 19 nt, Homo sapiens
gaguuugugcgaaugaugu

SEQ ID NO: 980132 - RNA, 19 nt, Homo sapiens
cgagaucucacagcaaauc

SEQ ID NO: 980133 - RNA, 19 nt, Homo sapiens
gaacuuggguggccgugua

SEQ ID NO: 980134 - RNA, 19 nt, Homo sapiens
gaacccaucucgguccuua

SEQ ID NO: 980135 - RNA, 19 nt, Homo sapiens
gcaaugccuuuccucaaga

SEQ ID NO: 980136 - RNA, 19 nt, Homo sapiens
gcucuucaaucucaucuug

SEQ ID NO: 980137 - RNA, 19 nt, Homo sapiens
gaacuagguuaagaaggaa

SEQ ID NO: 980138 - RNA, 19 nt, Homo sapiens
ggaagagucuguggaugga

SEQ ID NO: 980139 - RNA, 19 nt, Homo sapiens
agaacuagguuaagaagga

SEQ ID NO: 980140 - RNA, 19 nt, Homo sapiens
caaauugcuugcagaaaca

SEQ ID NO: 980141 - RNA, 19 nt, Homo sapiens
ccaaauugcuugcagaaac

SEQ ID NO: 980142 - RNA, 19 nt, Homo sapiens
gcacuuguacucccuaaau

SEQ ID NO: 980143 - RNA, 19 nt, Homo sapiens
ccauaguccucaugagauu

SEQ ID NO: 980144 - RNA, 19 nt, Homo sapiens
gaaggaagagucuguggau

SEQ ID NO: 980145 - RNA, 19 nt, Homo sapiens
gagcucagccuccuuaucu

SEQ ID NO: 980146 - RNA, 19 nt, Homo sapiens
ccgcagcucuucaaucuca

SEQ ID NO: 980147 - RNA, 19 nt, Homo sapiens
gcaaaucccguuucucucu

SEQ ID NO: 980148 - RNA, 19 nt, Homo sapiens
ggagaucucugagguuguc

SEQ ID NO: 980149 - RNA, 19 nt, Homo sapiens
agaaacagcugggaugauc

SEQ ID NO: 980150 - RNA, 19 nt, Homo sapiens
ggggacaaauuauacuuua

SEQ ID NO: 980151 - RNA, 19 nt, Homo sapiens
uggccgagcucaaucaguu

SEQ ID NO: 980152 - RNA, 19 nt, Homo sapiens
caaugauucuugacaucuu

SEQ ID NO: 980153 - RNA, 19 nt, Homo sapiens
cggcacaguugacuuugaa

SEQ ID NO: 980154 - RNA, 19 nt, Homo sapiens
uuaucgaacucaagaaaug

SEQ ID NO: 980155 - RNA, 19 nt, Homo sapiens
gaagaguuugugaagauga

SEQ ID NO: 980156 - RNA, 19 nt, Homo sapiens
gcagaaacagcugggauga

SEQ ID NO: 980157 - RNA, 19 nt, Homo sapiens
gggcaccagucucaagaug

SEQ ID NO: 980158 - RNA, 19 nt, Homo sapiens
ggaggcugauguuaaugga

SEQ ID NO: 980159 - RNA, 19 nt, Homo sapiens
uguagacuuugaugacuuu

SEQ ID NO: 980160 - RNA, 19 nt, Homo sapiens
aauagucucuucuccuguu

SEQ ID NO: 980161 - RNA, 19 nt, Homo sapiens
uugaagaguuugugaagau

SEQ ID NO: 980162 - RNA, 19 nt, Homo sapiens
gcacaguugacuuugaaga

SEQ ID NO: 980163 - RNA, 19 nt, Homo sapiens
ggaaauccgcaugaacuug

SEQ ID NO: 980164 - RNA, 19 nt, Homo sapiens
cugcagaacuagguuaaga

SEQ ID NO: 980165 - RNA, 19 nt, Homo sapiens
ggguggccguguagacuuu

SEQ ID NO: 980166 - RNA, 19 nt, Homo sapiens
uguacucccuaaaucuaua

SEQ ID NO: 980167 - RNA, 19 nt, Homo sapiens
caaggaguuugacacgaau

SEQ ID NO: 980168 - RNA, 19 nt, Homo sapiens
agacggcacaguugacuuu

SEQ ID NO: 980169 - RNA, 19 nt, Homo sapiens
uaauggagacggcacaguu

SEQ ID NO: 980170 - RNA, 19 nt, Homo sapiens
agacuuugaugacuuugug

SEQ ID NO: 980171 - RNA, 19 nt, Homo sapiens
gcaauauauccauguaaca

SEQ ID NO: 980172 - RNA, 19 nt, Homo sapiens
ggugaugguuacaugaaca

SEQ ID NO: 980173 - RNA, 19 nt, Homo sapiens
aagagucuguggauggaaa

SEQ ID NO: 980174 - RNA, 19 nt, Homo sapiens
gcagaacuagguuaagaag

SEQ ID NO: 980175 - RNA, 19 nt, Homo sapiens
caaugccuuuccucaagaa

SEQ ID NO: 980176 - RNA, 19 nt, Homo sapiens
gcccagacuucaccacuac

SEQ ID NO: 980177 - RNA, 19 nt, Homo sapiens
gaugcgggaugccuucaag

SEQ ID NO: 980178 - RNA, 19 nt, Homo sapiens
ucaccacuacgcaauauau

SEQ ID NO: 980179 - RNA, 19 nt, Homo sapiens
caguugacuuugaagaguu

SEQ ID NO: 980180 - RNA, 19 nt, Homo sapiens
gguaaggggacaaauuaua

SEQ ID NO: 980181 - RNA, 19 nt, Homo sapiens
cucccuaaaucuauagaaa

SEQ ID NO: 980182 - RNA, 19 nt, Homo sapiens
gacccagagcgguaucuuu

SEQ ID NO: 980183 - RNA, 19 nt, Homo sapiens
ugaagaguuugugaagaug

SEQ ID NO: 980184 - RNA, 19 nt, Homo sapiens
guguagacuuugaugacuu

SEQ ID NO: 980185 - RNA, 19 nt, Homo sapiens
ucccgcagcucuucaaucu

SEQ ID NO: 980186 - RNA, 19 nt, Homo sapiens
gagauuccccagauccuua

SEQ ID NO: 980187 - RNA, 19 nt, Homo sapiens
uaacccauaguccucauga

SEQ ID NO: 980188 - RNA, 19 nt, Homo sapiens
uacgcaauauauccaugua

SEQ ID NO: 980189 - RNA, 19 nt, Homo sapiens
ucacuucacguaguccuaa

SEQ ID NO: 980190 - RNA, 19 nt, Homo sapiens
ccagauccuuacaagagau

SEQ ID NO: 980191 - RNA, 19 nt, Homo sapiens
gcucagccuccuuaucuuc

SEQ ID NO: 980192 - RNA, 19 nt, Homo sapiens
cagcaaugccuuuccucaa

SEQ ID NO: 980193 - RNA, 19 nt, Homo sapiens
cgcaauauauccauguaac

SEQ ID NO: 980194 - RNA, 19 nt, Homo sapiens
acaguugacuuugaagagu

SEQ ID NO: 980195 - RNA, 19 nt, Homo sapiens
cccagauccuuacaagaga

SEQ ID NO: 980196 - RNA, 19 nt, Homo sapiens
gggcuggaaauccgcauga

SEQ ID NO: 980197 - RNA, 19 nt, Homo sapiens
gaauggagauggggagauc

SEQ ID NO: 980198 - RNA, 19 nt, Homo sapiens
gcagggcaccagucucaag

SEQ ID NO: 980199 - RNA, 19 nt, Homo sapiens
cuucggucccggugucuua

SEQ ID NO: 980200 - RNA, 19 nt, Homo sapiens
cuucaccacuacgcaauau

SEQ ID NO: 980201 - RNA, 19 nt, Homo sapiens
caugaacagcccagacuuc

SEQ ID NO: 980202 - RNA, 19 nt, Homo sapiens
caggugaugguuacaugaa

SEQ ID NO: 980203 - RNA, 19 nt, Homo sapiens
agcaaugccuuuccucaag

SEQ ID NO: 980204 - RNA, 19 nt, Homo sapiens
gggcauguaacccauaguc

SEQ ID NO: 980205 - RNA, 19 nt, Homo sapiens
acccagagcgguaucuuug

SEQ ID NO: 980206 - RNA, 19 nt, Homo sapiens
ccgguaaggggacaaauua

SEQ ID NO: 980207 - RNA, 19 nt, Homo sapiens
uuaagaaggaagagucugu

SEQ ID NO: 980208 - RNA, 19 nt, Homo sapiens
ccuuaucgaacucaagaaa

SEQ ID NO: 980209 - RNA, 19 nt, Homo sapiens
ccaucucgguccuuaucga

SEQ ID NO: 980210 - RNA, 19 nt, Homo sapiens
uugcaaaucccguuucucu

SEQ ID NO: 980211 - RNA, 19 nt, Homo sapiens
ucgcagggcaccagucuca

SEQ ID NO: 980212 - RNA, 19 nt, Homo sapiens
cuuguacucccuaaaucua

SEQ ID NO: 980213 - RNA, 19 nt, Homo sapiens
uuuauucaggugaugguua

SEQ ID NO: 980214 - RNA, 19 nt, Homo sapiens
aguugacuuugaagaguuu

SEQ ID NO: 980215 - RNA, 19 nt, Homo sapiens
caucuccgugggcauguaa

SEQ ID NO: 980216 - RNA, 19 nt, Homo sapiens
guccuuaucgaacucaaga

SEQ ID NO: 980217 - RNA, 19 nt, Homo sapiens
gcaaggaggccaacuacua

SEQ ID NO: 980218 - RNA, 19 nt, Homo sapiens
ccauguccaucgugaguua

SEQ ID NO: 980219 - RNA, 19 nt, Homo sapiens
gggcggagaugacuucaag

SEQ ID NO: 980220 - RNA, 19 nt, Homo sapiens
cuaaggagguguccaagag

SEQ ID NO: 980221 - RNA, 19 nt, Homo sapiens
gaacacggagcgcuucugu

SEQ ID NO: 980222 - RNA, 19 nt, Homo sapiens
ccaccuacccuauguugaa

SEQ ID NO: 980223 - RNA, 19 nt, Homo sapiens
acacggagcgcuucuguga

SEQ ID NO: 980224 - RNA, 19 nt, Homo sapiens
ccaaugggcaucugcaaga

SEQ ID NO: 980225 - RNA, 19 nt, Homo sapiens
gcagggacauccgagacuu

SEQ ID NO: 980226 - RNA, 19 nt, Homo sapiens
gcaacccagugcucuauac

SEQ ID NO: 980227 - RNA, 19 nt, Homo sapiens
ucaaguaugugccguacgu

SEQ ID NO: 980228 - RNA, 19 nt, Homo sapiens
gcgcuucugugaggugauu

SEQ ID NO: 980229 - RNA, 19 nt, Homo sapiens
ccacgacccuaccuugaag

SEQ ID NO: 980230 - RNA, 19 nt, Homo sapiens
gcagcugcaucgagaacau

SEQ ID NO: 980231 - RNA, 19 nt, Homo sapiens
cuuguggacuuccucauug

SEQ ID NO: 980232 - RNA, 19 nt, Homo sapiens
aacaacggcuccacacuca

SEQ ID NO: 980233 - RNA, 19 nt, Homo sapiens
cugcucagcuuccucuuca

SEQ ID NO: 980234 - RNA, 19 nt, Homo sapiens
gcaacgugguggacgacau

SEQ ID NO: 980235 - RNA, 19 nt, Homo sapiens
gcucuaaggagguguccaa

SEQ ID NO: 980236 - RNA, 19 nt, Homo sapiens
gguacccgcugccaccaau

SEQ ID NO: 980237 - RNA, 19 nt, Homo sapiens
gccaaucgacugcguuugu

SEQ ID NO: 980238 - RNA, 19 nt, Homo sapiens
caaggaggccaacuacuac

SEQ ID NO: 980239 - RNA, 19 nt, Homo sapiens
gcugccaccuacccuaugu

SEQ ID NO: 980240 - RNA, 19 nt, Homo sapiens
ccauugcaguuccgcucua

SEQ ID NO: 980241 - RNA, 19 nt, Homo sapiens
gggcugugccuuccucaau

SEQ ID NO: 980242 - RNA, 19 nt, Homo sapiens
gaaccacaugcuccuggaa

SEQ ID NO: 980243 - RNA, 19 nt, Homo sapiens
caacgugguggacgacaug

SEQ ID NO: 980244 - RNA, 19 nt, Homo sapiens
gcuuguggacuuccucauu

SEQ ID NO: 980245 - RNA, 19 nt, Homo sapiens
caaagucaaguccgugcuu

SEQ ID NO: 980246 - RNA, 19 nt, Homo sapiens
caagucaggccagaccaaa

SEQ ID NO: 980247 - RNA, 19 nt, Homo sapiens
ggcugugccuuccucaaug

SEQ ID NO: 980248 - RNA, 19 nt, Homo sapiens
gagcuucugcacugacaug

SEQ ID NO: 980249 - RNA, 19 nt, Homo sapiens
cauugcaguuccgcucuaa

SEQ ID NO: 980250 - RNA, 19 nt, Homo sapiens
gaccauguccaucgugagu

SEQ ID NO: 980251 - RNA, 19 nt, Homo sapiens
gcuccggccucaagaccau

SEQ ID NO: 980252 - RNA, 19 nt, Homo sapiens
ucaaugggucuccgcagaa

SEQ ID NO: 980253 - RNA, 19 nt, Homo sapiens
acaaccaccugggcaacaa

SEQ ID NO: 980254 - RNA, 19 nt, Homo sapiens
gcugugccuuccucaaugg

SEQ ID NO: 980255 - RNA, 19 nt, Homo sapiens
gaaccugcugcgcaccauu

SEQ ID NO: 980256 - RNA, 19 nt, Homo sapiens
ccaaucgacugcguuuguc

SEQ ID NO: 980257 - RNA, 19 nt, Homo sapiens
gcguggucaucaaguaugu

SEQ ID NO: 980258 - RNA, 19 nt, Homo sapiens
ggacaucucgucgcugaac

SEQ ID NO: 980259 - RNA, 19 nt, Homo sapiens
ucaagaccauguccaucgu

SEQ ID NO: 980260 - RNA, 19 nt, Homo sapiens
caacgacacagccgagaac

SEQ ID NO: 980261 - RNA, 19 nt, Homo sapiens
cuucaaggcgccacuagug

SEQ ID NO: 980262 - RNA, 19 nt, Homo sapiens
gcaccggugaugccaaugg

SEQ ID NO: 980263 - RNA, 19 nt, Homo sapiens
acugcguggucaucaagua

SEQ ID NO: 980264 - RNA, 19 nt, Homo sapiens
ucgaggcgcaauacgagua

SEQ ID NO: 980265 - RNA, 19 nt, Homo sapiens
gcucagcuuccucuucaag

SEQ ID NO: 980266 - RNA, 19 nt, Homo sapiens
gugagcuucugcacugaca

SEQ ID NO: 980267 - RNA, 19 nt, Homo sapiens
caaugggucuccgcagaac

SEQ ID NO: 980268 - RNA, 19 nt, Homo sapiens
guacauggauuucuacuga

SEQ ID NO: 980269 - RNA, 19 nt, Homo sapiens
gcaaagguuucagagauua

SEQ ID NO: 980270 - RNA, 19 nt, Homo sapiens
ucaauccucugaucaaaua

SEQ ID NO: 980271 - RNA, 19 nt, Homo sapiens
gcagaaggaucacuugaga

SEQ ID NO: 980272 - RNA, 19 nt, Homo sapiens
cuacagcucuuccaaauau

SEQ ID NO: 980273 - RNA, 19 nt, Homo sapiens
cuacugaguuggauaauau

SEQ ID NO: 980274 - RNA, 19 nt, Homo sapiens
gaagauggaccuagaugaa

SEQ ID NO: 980275 - RNA, 19 nt, Homo sapiens
ccaaggaacuuaagcaaag

SEQ ID NO: 980276 - RNA, 19 nt, Homo sapiens
gcagugagcugagauugug

SEQ ID NO: 980277 - RNA, 19 nt, Homo sapiens
ggaauucugccuccguuua

SEQ ID NO: 980278 - RNA, 19 nt, Homo sapiens
gaucaugccuaauccacaa

SEQ ID NO: 980279 - RNA, 19 nt, Homo sapiens
ggaccuagaugaagacacu

SEQ ID NO: 980280 - RNA, 19 nt, Homo sapiens
gaacuuaagcaaagguuuc

SEQ ID NO: 980281 - RNA, 19 nt, Homo sapiens
gaacauugcauaccuucug

SEQ ID NO: 980282 - RNA, 19 nt, Homo sapiens
aagcaaagguuucagagau

SEQ ID NO: 980283 - RNA, 19 nt, Homo sapiens
gcagugcaaggaaaucuaa

SEQ ID NO: 980284 - RNA, 19 nt, Homo sapiens
gcacagcaaaggcaaggaa

SEQ ID NO: 980285 - RNA, 19 nt, Homo sapiens
ccuaauccacaacuaaaua

SEQ ID NO: 980286 - RNA, 19 nt, Homo sapiens
ucacuuugacaccauauaa

SEQ ID NO: 980287 - RNA, 19 nt, Homo sapiens
uuucagagauuagacugua

SEQ ID NO: 980288 - RNA, 19 nt, Homo sapiens
gaauucugccuccguuuau

SEQ ID NO: 980289 - RNA, 19 nt, Homo sapiens
gaacaugagcaaggcagaa

SEQ ID NO: 980290 - RNA, 19 nt, Homo sapiens
uugcauaccuucuguacau

SEQ ID NO: 980291 - RNA, 19 nt, Homo sapiens
ggcggaagaugaugagcuu

SEQ ID NO: 980292 - RNA, 19 nt, Homo sapiens
gcucaugccuauaauucca

SEQ ID NO: 980293 - RNA, 19 nt, Homo sapiens
ugaccaauuugacauaugg

SEQ ID NO: 980294 - RNA, 19 nt, Homo sapiens
gcacauuagggucacuauu

SEQ ID NO: 980295 - RNA, 19 nt, Homo sapiens
ggacuuccagcacagcaaa

SEQ ID NO: 980296 - RNA, 19 nt, Homo sapiens
gcgcgaagaugcgaaaggu

SEQ ID NO: 980297 - RNA, 19 nt, Homo sapiens
gaacuggaaaagcacauua

SEQ ID NO: 980298 - RNA, 19 nt, Homo sapiens
ucagagauuagacuguaua

SEQ ID NO: 980299 - RNA, 19 nt, Homo sapiens
gaugaagacacugcugaaa

SEQ ID NO: 980300 - RNA, 19 nt, Homo sapiens
agauggaccuagaugaaga

SEQ ID NO: 980301 - RNA, 19 nt, Homo sapiens
ccacuggcuuuggaagaaa

SEQ ID NO: 980302 - RNA, 19 nt, Homo sapiens
ucuacugaguuggauaaua

SEQ ID NO: 980303 - RNA, 19 nt, Homo sapiens
guugaugccggcaauauug

SEQ ID NO: 980304 - RNA, 19 nt, Homo sapiens
cagggucucuauuccaaug

SEQ ID NO: 980305 - RNA, 19 nt, Homo sapiens
cugcugaggucaccauugu

SEQ ID NO: 980306 - RNA, 19 nt, Homo sapiens
caaauaugccacugaccuu

SEQ ID NO: 980307 - RNA, 19 nt, Homo sapiens
cagcucaucuggacaucau

SEQ ID NO: 980308 - RNA, 19 nt, Homo sapiens
acauuagggucacuauuca

SEQ ID NO: 980309 - RNA, 19 nt, Homo sapiens
cccagaagauggaccuaga

SEQ ID NO: 980310 - RNA, 19 nt, Homo sapiens
cagcuacucagaaggauga

SEQ ID NO: 980311 - RNA, 19 nt, Homo sapiens
cacauuagggucacuauuc

SEQ ID NO: 980312 - RNA, 19 nt, Homo sapiens
ucucaauccucugaucaaa

SEQ ID NO: 980313 - RNA, 19 nt, Homo sapiens
gaggugggaggaucucuug

SEQ ID NO: 980314 - RNA, 19 nt, Homo sapiens
ggccaaggcagaaggauca

SEQ ID NO: 980315 - RNA, 19 nt, Homo sapiens
ucuaaaugcugggaucaug

SEQ ID NO: 980316 - RNA, 19 nt, Homo sapiens
caaugacacucuggaacau

SEQ ID NO: 980317 - RNA, 19 nt, Homo sapiens
ccucugaucaaauaucuga

SEQ ID NO: 980318 - RNA, 19 nt, Homo sapiens
gaaucucucaauccucuga

SEQ ID NO: 980319 - RNA, 19 nt, Homo sapiens
agcaaagguuucagagauu

SEQ ID NO: 980320 - RNA, 19 nt, Homo sapiens
ggaacuuaagcaaagguuu

SEQ ID NO: 980321 - RNA, 19 nt, Homo sapiens
cccuacagcucuuccaaau

SEQ ID NO: 980322 - RNA, 19 nt, Homo sapiens
gcugggaucaugccuaauc

SEQ ID NO: 980323 - RNA, 19 nt, Homo sapiens
ugaguuggauaauaugcau

SEQ ID NO: 980324 - RNA, 19 nt, Homo sapiens
gcgcauguagucccagcua

SEQ ID NO: 980325 - RNA, 19 nt, Homo sapiens
ggauuucuacugaguugga

SEQ ID NO: 980326 - RNA, 19 nt, Homo sapiens
gagcugacaaugacacucu

SEQ ID NO: 980327 - RNA, 19 nt, Homo sapiens
caguggcucaugccuauaa

SEQ ID NO: 980328 - RNA, 19 nt, Homo sapiens
cucaguggcucaugccuau

SEQ ID NO: 980329 - RNA, 19 nt, Homo sapiens
uauauuaugacccagaaga

SEQ ID NO: 980330 - RNA, 19 nt, Homo sapiens
ggcuuuggaagaaauuaua

SEQ ID NO: 980331 - RNA, 19 nt, Homo sapiens
augcugggaucaugccuaa

SEQ ID NO: 980332 - RNA, 19 nt, Homo sapiens
gaccagccugagaaacaua

SEQ ID NO: 980333 - RNA, 19 nt, Homo sapiens
guucaagaccagccugaga

SEQ ID NO: 980334 - RNA, 19 nt, Homo sapiens
caaggcagaaggaucacuu

SEQ ID NO: 980335 - RNA, 19 nt, Homo sapiens
gccuauaauuccagcacuu

SEQ ID NO: 980336 - RNA, 19 nt, Homo sapiens
gcauucacuuugacaccau

SEQ ID NO: 980337 - RNA, 19 nt, Homo sapiens
ggagguguuugagaccaau

SEQ ID NO: 980338 - RNA, 19 nt, Homo sapiens
acaaugacacucuggaaca

SEQ ID NO: 980339 - RNA, 19 nt, Homo sapiens
ugacaaugacacucuggaa

SEQ ID NO: 980340 - RNA, 19 nt, Homo sapiens
uaagcaaagguuucagaga

SEQ ID NO: 980341 - RNA, 19 nt, Homo sapiens
ucaagaccagccugagaaa

SEQ ID NO: 980342 - RNA, 19 nt, Homo sapiens
gagccucuccucugucaca

SEQ ID NO: 980343 - RNA, 19 nt, Homo sapiens
cagaagauggaccuagaug

SEQ ID NO: 980344 - RNA, 19 nt, Homo sapiens
gaagaugcgaaaggugguu

SEQ ID NO: 980345 - RNA, 19 nt, Homo sapiens
caaccagcagggucucuau

SEQ ID NO: 980346 - RNA, 19 nt, Homo sapiens
gcauaccuucuguacauuc

SEQ ID NO: 980347 - RNA, 19 nt, Homo sapiens
caaggaacuuaagcaaagg

SEQ ID NO: 980348 - RNA, 19 nt, Homo sapiens
cauucacuuugacaccaua

SEQ ID NO: 980349 - RNA, 19 nt, Homo sapiens
ccuacagcucuuccaaaua

SEQ ID NO: 980350 - RNA, 19 nt, Homo sapiens
caauccaucucagcucauc

SEQ ID NO: 980351 - RNA, 19 nt, Homo sapiens
augacacucuggaacauug

SEQ ID NO: 980352 - RNA, 19 nt, Homo sapiens
ccacaacuaaauaucaaag

SEQ ID NO: 980353 - RNA, 19 nt, Homo sapiens
aaacauagugagcccuugu

SEQ ID NO: 980354 - RNA, 19 nt, Homo sapiens
ccuauaauuccagcacuuu

SEQ ID NO: 980355 - RNA, 19 nt, Homo sapiens
gacccugucucaaaauaug

SEQ ID NO: 980356 - RNA, 19 nt, Homo sapiens
aauucugccuccguuuaua

SEQ ID NO: 980357 - RNA, 19 nt, Homo sapiens
agugagcccuugucucuac

SEQ ID NO: 980358 - RNA, 19 nt, Homo sapiens
auagugagcccuugucucu

SEQ ID NO: 980359 - RNA, 19 nt, Homo sapiens
gagcuucaucuguguuugg

SEQ ID NO: 980360 - RNA, 19 nt, Homo sapiens
agaagauggaccuagauga

SEQ ID NO: 980361 - RNA, 19 nt, Homo sapiens
ccaauuugacauauggaau

SEQ ID NO: 980362 - RNA, 19 nt, Homo sapiens
aaauaugccacugaccuuu

SEQ ID NO: 980363 - RNA, 19 nt, Homo sapiens
acauggauuucuacugagu

SEQ ID NO: 980364 - RNA, 19 nt, Homo sapiens
aagaccagccugagaaaca

SEQ ID NO: 980365 - RNA, 19 nt, Homo sapiens
ucacuugagaccaggaguu

SEQ ID NO: 980366 - RNA, 19 nt, Homo sapiens
uggcucaugccuauaauuc

SEQ ID NO: 980367 - RNA, 19 nt, Homo sapiens
gacuucaggagguguuuga

SEQ ID NO: 980368 - RNA, 19 nt, Homo sapiens
gaacuacugugcagaaauu

SEQ ID NO: 980369 - RNA, 19 nt, Homo sapiens
gcaaacaacuagauuuaga

SEQ ID NO: 980370 - RNA, 19 nt, Homo sapiens
uaacggagaucuggcauua

SEQ ID NO: 980371 - RNA, 19 nt, Homo sapiens
gcaauagacuggaacgauu

SEQ ID NO: 980372 - RNA, 19 nt, Homo sapiens
caagcaggcucagaaauua

SEQ ID NO: 980373 - RNA, 19 nt, Homo sapiens
gcacagagccauugaugaa

SEQ ID NO: 980374 - RNA, 19 nt, Homo sapiens
uaacaggguucaaagauga

SEQ ID NO: 980375 - RNA, 19 nt, Homo sapiens
caucagugcucacaaguuu

SEQ ID NO: 980376 - RNA, 19 nt, Homo sapiens
gauucaaacuugcuucuaa

SEQ ID NO: 980377 - RNA, 19 nt, Homo sapiens
uaacuugucuuccacuaaa

SEQ ID NO: 980378 - RNA, 19 nt, Homo sapiens
ggaagucucuggcuugugu

SEQ ID NO: 980379 - RNA, 19 nt, Homo sapiens
ggagagugcuggaggaaau

SEQ ID NO: 980380 - RNA, 19 nt, Homo sapiens
gauaugaauugaagugguu

SEQ ID NO: 980381 - RNA, 19 nt, Homo sapiens
gagccaaagugaacgaauu

SEQ ID NO: 980382 - RNA, 19 nt, Homo sapiens
gaccaugugcuauauauaa

SEQ ID NO: 980383 - RNA, 19 nt, Homo sapiens
uaaggaccauggugugaua

SEQ ID NO: 980384 - RNA, 19 nt, Homo sapiens
acacgaaucuccaaggaaa

SEQ ID NO: 980385 - RNA, 19 nt, Homo sapiens
aaacaaugcucuucaucuu

SEQ ID NO: 980386 - RNA, 19 nt, Homo sapiens
ccacuuuccucauuaagaa

SEQ ID NO: 980387 - RNA, 19 nt, Homo sapiens
gauaguguguccucuguau

SEQ ID NO: 980388 - RNA, 19 nt, Homo sapiens
guauugcgguagauuuaua

SEQ ID NO: 980389 - RNA, 19 nt, Homo sapiens
gguguuaugucucuaguga

SEQ ID NO: 980390 - RNA, 19 nt, Homo sapiens
ggagauuccuauuauaaag

SEQ ID NO: 980391 - RNA, 19 nt, Homo sapiens
cugauaaacuggaguacua

SEQ ID NO: 980392 - RNA, 19 nt, Homo sapiens
gaaagggaacgccaacuug

SEQ ID NO: 980393 - RNA, 19 nt, Homo sapiens
gaaugcagcggccaucuuu

SEQ ID NO: 980394 - RNA, 19 nt, Homo sapiens
gcaccucgcuguccaagca

SEQ ID NO: 980395 - RNA, 19 nt, Homo sapiens
gugcaaacaacuagauuua

SEQ ID NO: 980396 - RNA, 19 nt, Homo sapiens
gaucauugccuguacuauu

SEQ ID NO: 980397 - RNA, 19 nt, Homo sapiens
acaccgaaauuucccauaa

SEQ ID NO: 980398 - RNA, 19 nt, Homo sapiens
guacggaccaugugcuaua

SEQ ID NO: 980399 - RNA, 19 nt, Homo sapiens
ggacuuugcugccguggau

SEQ ID NO: 980400 - RNA, 19 nt, Homo sapiens
ugacugaacugaugaaacu

SEQ ID NO: 980401 - RNA, 19 nt, Homo sapiens
gcgcuuaucagcauuguuu

SEQ ID NO: 980402 - RNA, 19 nt, Homo sapiens
acucugagaugaacaauau

SEQ ID NO: 980403 - RNA, 19 nt, Homo sapiens
cuuaacaacugaaagcuuu

SEQ ID NO: 980404 - RNA, 19 nt, Homo sapiens
caacauacagggacacuug

SEQ ID NO: 980405 - RNA, 19 nt, Homo sapiens
cagaguacccgcuacauaa

SEQ ID NO: 980406 - RNA, 19 nt, Homo sapiens
gagggaacgucuugggaaa

SEQ ID NO: 980407 - RNA, 19 nt, Homo sapiens
gaaauccucccuagugaug

SEQ ID NO: 980408 - RNA, 19 nt, Homo sapiens
gaacucugauauugaaagu

SEQ ID NO: 980409 - RNA, 19 nt, Homo sapiens
caaacaaucuggaggacau

SEQ ID NO: 980410 - RNA, 19 nt, Homo sapiens
ggcaguagcugggcagaaa

SEQ ID NO: 980411 - RNA, 19 nt, Homo sapiens
gaacaaggaaggguaaugu

SEQ ID NO: 980412 - RNA, 19 nt, Homo sapiens
gcucaucgccagauuuauu

SEQ ID NO: 980413 - RNA, 19 nt, Homo sapiens
caacugacaacauugguuu

SEQ ID NO: 980414 - RNA, 19 nt, Homo sapiens
gaaauucccagaaguuaca

SEQ ID NO: 980415 - RNA, 19 nt, Homo sapiens
gggcuuagguagcuugguu

SEQ ID NO: 980416 - RNA, 19 nt, Homo sapiens
gagucaacaucuucaacua

SEQ ID NO: 980417 - RNA, 19 nt, Homo sapiens
gcacacugaugaacuacug

SEQ ID NO: 980418 - RNA, 19 nt, Homo sapiens
ccagcacacugaugaacua

SEQ ID NO: 980419 - RNA, 19 nt, Homo sapiens
cgaauggcuuaaacuaauu

SEQ ID NO: 980420 - RNA, 19 nt, Homo sapiens
guauaugcuuucuauguga

SEQ ID NO: 980421 - RNA, 19 nt, Homo sapiens
guucaucgcuguuaguaca

SEQ ID NO: 980422 - RNA, 19 nt, Homo sapiens
gaccucagcucacacgaau

SEQ ID NO: 980423 - RNA, 19 nt, Homo sapiens
caauagacuggaacgauua

SEQ ID NO: 980424 - RNA, 19 nt, Homo sapiens
gcucaguccuccuagagaa

SEQ ID NO: 980425 - RNA, 19 nt, Homo sapiens
ccaagcaggcucagaaauu

SEQ ID NO: 980426 - RNA, 19 nt, Homo sapiens
gcaccaggcagauauaaau

SEQ ID NO: 980427 - RNA, 19 nt, Homo sapiens
gcagaaagccaaugcucuu

SEQ ID NO: 980428 - RNA, 19 nt, Homo sapiens
ucgaauggcuuaaacuaau

SEQ ID NO: 980429 - RNA, 19 nt, Homo sapiens
auggauaccuguucuuuaa

SEQ ID NO: 980430 - RNA, 19 nt, Homo sapiens
ugucggugauuccaauuua

SEQ ID NO: 980431 - RNA, 19 nt, Homo sapiens
ugauagaucccauuucaaa

SEQ ID NO: 980432 - RNA, 19 nt, Homo sapiens
gggccuaagugguaaaugu

SEQ ID NO: 980433 - RNA, 19 nt, Homo sapiens
gaaguuugacuauaugugu

SEQ ID NO: 980434 - RNA, 19 nt, Homo sapiens
ggaugagaauggaaacaau

SEQ ID NO: 980435 - RNA, 19 nt, Homo sapiens
caggaugccuccaaguuga

SEQ ID NO: 980436 - RNA, 19 nt, Homo sapiens
ggacuggcaugcacacgau

SEQ ID NO: 980437 - RNA, 19 nt, Homo sapiens
aagaggagguggccaaguu

SEQ ID NO: 980438 - RNA, 19 nt, Homo sapiens
cagagaggaugauguguuc

SEQ ID NO: 980439 - RNA, 19 nt, Homo sapiens
ugaggcauguggucaguuu

SEQ ID NO: 980440 - RNA, 19 nt, Homo sapiens
uuaaugagcuggcuuuacu

SEQ ID NO: 980441 - RNA, 19 nt, Homo sapiens
ugugauagaucccauuuca

SEQ ID NO: 980442 - RNA, 19 nt, Homo sapiens
ggacgucuucuuugccaua

SEQ ID NO: 980443 - RNA, 19 nt, Homo sapiens
gaaacaaugcucuucaucu

SEQ ID NO: 980444 - RNA, 19 nt, Homo sapiens
gaaagccaaugcucuucau

SEQ ID NO: 980445 - RNA, 19 nt, Homo sapiens
ccacggcgcuuaucagcau

SEQ ID NO: 980446 - RNA, 19 nt, Homo sapiens
acagaugccuuaaagacuu

SEQ ID NO: 980447 - RNA, 19 nt, Homo sapiens
agagcugacuggcaagaua

SEQ ID NO: 980448 - RNA, 19 nt, Homo sapiens
ugucaacacuugcguacaa

SEQ ID NO: 980449 - RNA, 19 nt, Homo sapiens
aaaaugagcugauaaacug

SEQ ID NO: 980450 - RNA, 19 nt, Homo sapiens
caaaacaacucugagauga

SEQ ID NO: 980451 - RNA, 19 nt, Homo sapiens
caucuuugaucucuuccua

SEQ ID NO: 980452 - RNA, 19 nt, Homo sapiens
gccgaagccuuuaaucuca

SEQ ID NO: 980453 - RNA, 19 nt, Homo sapiens
ggaacuguauucgcuucua

SEQ ID NO: 980454 - RNA, 19 nt, Homo sapiens
cgaaauuucccauaaacuu

SEQ ID NO: 980455 - RNA, 19 nt, Homo sapiens
gcugaaauccucccuagug

SEQ ID NO: 980456 - RNA, 19 nt, Homo sapiens
gcuggagucuggcuaacuu

SEQ ID NO: 980457 - RNA, 19 nt, Homo sapiens
caacugcccuuugcucauc

SEQ ID NO: 980458 - RNA, 19 nt, Homo sapiens
guacauggauaccuguucu

SEQ ID NO: 980459 - RNA, 19 nt, Homo sapiens
ggaagagacaguacagugu

SEQ ID NO: 980460 - RNA, 19 nt, Homo sapiens
ggucagacauggcugugau

SEQ ID NO: 980461 - RNA, 19 nt, Homo sapiens
gaacuguauucgcuucuac

SEQ ID NO: 980462 - RNA, 19 nt, Homo sapiens
gaacugaugaaacuagcaa

SEQ ID NO: 980463 - RNA, 19 nt, Homo sapiens
ucccacaccugccauauug

SEQ ID NO: 980464 - RNA, 19 nt, Homo sapiens
aaaggaaugugggagauga

SEQ ID NO: 980465 - RNA, 19 nt, Homo sapiens
gaacgcacaggaugcagaa

SEQ ID NO: 980466 - RNA, 19 nt, Homo sapiens
ccgaggagcugacaugucu

SEQ ID NO: 980467 - RNA, 19 nt, Homo sapiens
gcugccacuuuccucauua

SEQ ID NO: 980468 - RNA, 19 nt, Homo sapiens
gaagaaccacugacugugu

SEQ ID NO: 980469 - RNA, 19 nt, Homo sapiens
ccagugacccgaagaagaa

SEQ ID NO: 980470 - RNA, 19 nt, Homo sapiens
ugaauguguugcaaauuga

SEQ ID NO: 980471 - RNA, 19 nt, Homo sapiens
cuaccaagguggccgagaa

SEQ ID NO: 980472 - RNA, 19 nt, Homo sapiens
augaauguguugcaaauug

SEQ ID NO: 980473 - RNA, 19 nt, Homo sapiens
cgaagaagaagacuaccaa

SEQ ID NO: 980474 - RNA, 19 nt, Homo sapiens
gagagcagcgacuaaguuc

SEQ ID NO: 980475 - RNA, 19 nt, Homo sapiens
cgagagcagcgacuaaguu

SEQ ID NO: 980476 - RNA, 19 nt, Homo sapiens
ggagagcgagguggaagaa

SEQ ID NO: 980477 - RNA, 19 nt, Homo sapiens
gaaaggggcugcgacaaag

SEQ ID NO: 980478 - RNA, 19 nt, Homo sapiens
agaagaagacuaccaaggu

SEQ ID NO: 980479 - RNA, 19 nt, Homo sapiens
gaauguguugcaaauugaa

SEQ ID NO: 980480 - RNA, 19 nt, Homo sapiens
gccauucugaagauaauaa

SEQ ID NO: 980481 - RNA, 19 nt, Homo sapiens
gagcagcgacuaaguucag

SEQ ID NO: 980482 - RNA, 19 nt, Homo sapiens
uggaagaaccacugacugu

SEQ ID NO: 980483 - RNA, 19 nt, Homo sapiens
guugagcugcggaagauga

SEQ ID NO: 980484 - RNA, 19 nt, Homo sapiens
gggagacgcgggaagaaag

SEQ ID NO: 980485 - RNA, 19 nt, Homo sapiens
gggaaaagcaguucguaga

SEQ ID NO: 980486 - RNA, 19 nt, Homo sapiens
gugcuugccauucugaaga

SEQ ID NO: 980487 - RNA, 19 nt, Homo sapiens
gagcuggaggaaccacuga

SEQ ID NO: 980488 - RNA, 19 nt, Homo sapiens
cgccagaccucagagaucu

SEQ ID NO: 980489 - RNA, 19 nt, Homo sapiens
gcuugccauucugaagaua

SEQ ID NO: 980490 - RNA, 19 nt, Homo sapiens
gagggagacgcgggaagaa

SEQ ID NO: 980491 - RNA, 19 nt, Homo sapiens
gcaccaggaucuacaguuu

SEQ ID NO: 980492 - RNA, 19 nt, Homo sapiens
ggaaggaucucaagcugau

SEQ ID NO: 980493 - RNA, 19 nt, Homo sapiens
gaacacggccaaaggauug

SEQ ID NO: 980494 - RNA, 19 nt, Homo sapiens
gcaggacccucgcaccaaa

SEQ ID NO: 980495 - RNA, 19 nt, Homo sapiens
ggaagcaacagaagaaaga

SEQ ID NO: 980496 - RNA, 19 nt, Homo sapiens
aaaaggaggugaagauuga

SEQ ID NO: 980497 - RNA, 19 nt, Homo sapiens
ggccacggcuccuuuguca

SEQ ID NO: 980498 - RNA, 19 nt, Homo sapiens
ugucaacuguggcaugaaa

SEQ ID NO: 980499 - RNA, 19 nt, Homo sapiens
cuacuuggccggucagauu

SEQ ID NO: 980500 - RNA, 19 nt, Homo sapiens
gaccuaccauggcaaagug

SEQ ID NO: 980501 - RNA, 19 nt, Homo sapiens
ggaauucacaggaguugga

SEQ ID NO: 980502 - RNA, 19 nt, Homo sapiens
gaaaauggaagcaacagaa

SEQ ID NO: 980503 - RNA, 19 nt, Homo sapiens
ggcaugcucuugugguguu

SEQ ID NO: 980504 - RNA, 19 nt, Homo sapiens
uggaugagaucgugguguu

SEQ ID NO: 980505 - RNA, 19 nt, Homo sapiens
ugaacccaguguccucuuu

SEQ ID NO: 980506 - RNA, 19 nt, Homo sapiens
gaugagaucgugguguuug

SEQ ID NO: 980507 - RNA, 19 nt, Homo sapiens
gaacccaguguccucuuug

SEQ ID NO: 980508 - RNA, 19 nt, Homo sapiens
aggugaagauugacaagaa

SEQ ID NO: 980509 - RNA, 19 nt, Homo sapiens
gcuaggaugccaagacugu

SEQ ID NO: 980510 - RNA, 19 nt, Homo sapiens
cagugaagcagcagugaaa

SEQ ID NO: 980511 - RNA, 19 nt, Homo sapiens
guaccugaguguccacagu

SEQ ID NO: 980512 - RNA, 19 nt, Homo sapiens
gggcuaggaugccaagacu

SEQ ID NO: 980513 - RNA, 19 nt, Homo sapiens
caagaccuaccauggcaaa

SEQ ID NO: 980514 - RNA, 19 nt, Homo sapiens
cggcacaccugaaaguucu

SEQ ID NO: 980515 - RNA, 19 nt, Homo sapiens
gcacaccugaaaguucuaa

SEQ ID NO: 980516 - RNA, 19 nt, Homo sapiens
gggccgaggacaucaguga

SEQ ID NO: 980517 - RNA, 19 nt, Homo sapiens
ucacaggaguuggaagaag

SEQ ID NO: 980518 - RNA, 19 nt, Homo sapiens
ggugaacacggccaaagga

SEQ ID NO: 980519 - RNA, 19 nt, Homo sapiens
aauggaagcaacagaagaa

SEQ ID NO: 980520 - RNA, 19 nt, Homo sapiens
ggugaagauugacaagaac

SEQ ID NO: 980521 - RNA, 19 nt, Homo sapiens
cagagccugugccaucuuc

SEQ ID NO: 980522 - RNA, 19 nt, Homo sapiens
ucugccagcuucccaacuu

SEQ ID NO: 980523 - RNA, 19 nt, Homo sapiens
ugaacacggccaaaggauu

SEQ ID NO: 980524 - RNA, 19 nt, Homo sapiens
cugccucagugcuguguuu

SEQ ID NO: 980525 - RNA, 19 nt, Homo sapiens
ccaaagcuggucucuacug

SEQ ID NO: 980526 - RNA, 19 nt, Homo sapiens
ccacaugcgucaggaugag

SEQ ID NO: 980527 - RNA, 19 nt, Homo sapiens
cuucaggcaugcucuugug

SEQ ID NO: 980528 - RNA, 19 nt, Homo sapiens
gaggugaagauugacaaga

SEQ ID NO: 980529 - RNA, 19 nt, Homo sapiens
ccacggcuccuuugucaac

SEQ ID NO: 980530 - RNA, 19 nt, Homo sapiens
gaucucaagcugaugaaaa

SEQ ID NO: 980531 - RNA, 19 nt, Homo sapiens
gaauucacaggaguuggaa

SEQ ID NO: 980532 - RNA, 19 nt, Homo sapiens
gagaucgugguguuugaug

SEQ ID NO: 980533 - RNA, 19 nt, Homo sapiens
ggaugagaucgugguguuu

SEQ ID NO: 980534 - RNA, 19 nt, Homo sapiens
ccugugccaucuucugugu

SEQ ID NO: 980535 - RNA, 19 nt, Homo sapiens
caacuucaggcaugcucuu

SEQ ID NO: 980536 - RNA, 19 nt, Homo sapiens
uaccugaguguccacagua

SEQ ID NO: 980537 - RNA, 19 nt, Homo sapiens
agaucgugguguuugauga

SEQ ID NO: 980538 - RNA, 19 nt, Homo sapiens
gggcucugcaggucacuug

SEQ ID NO: 980539 - RNA, 19 nt, Homo sapiens
aaauggaagcaacagaaga

SEQ ID NO: 980540 - RNA, 19 nt, Homo sapiens
ccaagcaccaggaucuaca

SEQ ID NO: 980541 - RNA, 19 nt, Homo sapiens
aacccaguguccucuuuga

SEQ ID NO: 980542 - RNA, 19 nt, Homo sapiens
uuugucaacuguggcauga

SEQ ID NO: 980543 - RNA, 19 nt, Homo sapiens
ggaguaagaucaacgucua

SEQ ID NO: 980544 - RNA, 19 nt, Homo sapiens
gaaaggaaauacucugucu

SEQ ID NO: 980545 - RNA, 19 nt, Homo sapiens
caacgucuauaaacgcuuu

SEQ ID NO: 980546 - RNA, 19 nt, Homo sapiens
ucucagaggcuccaauuua

SEQ ID NO: 980547 - RNA, 19 nt, Homo sapiens
ggaccucauugacuaugua

SEQ ID NO: 980548 - RNA, 19 nt, Homo sapiens
ggugggugauguaaauaua

SEQ ID NO: 980549 - RNA, 19 nt, Homo sapiens
ggagaggccuaaagagcuu

SEQ ID NO: 980550 - RNA, 19 nt, Homo sapiens
ggaggcagaaguuugguua

SEQ ID NO: 980551 - RNA, 19 nt, Homo sapiens
gagaagaauuacuaucaag

SEQ ID NO: 980552 - RNA, 19 nt, Homo sapiens
caaaacagauucggaguaa

SEQ ID NO: 980553 - RNA, 19 nt, Homo sapiens
gaacgaacuuuuccuugaa

SEQ ID NO: 980554 - RNA, 19 nt, Homo sapiens
gcagaaguuugguuacagu

SEQ ID NO: 980555 - RNA, 19 nt, Homo sapiens
aaacagauucggaguaaga

SEQ ID NO: 980556 - RNA, 19 nt, Homo sapiens
ccauggagguggacauaga

SEQ ID NO: 980557 - RNA, 19 nt, Homo sapiens
gugaugagaagaauuacua

SEQ ID NO: 980558 - RNA, 19 nt, Homo sapiens
gaauaaauugagccuugua

SEQ ID NO: 980559 - RNA, 19 nt, Homo sapiens
agacagaggcagcguguuu

SEQ ID NO: 980560 - RNA, 19 nt, Homo sapiens
uggcaagacuuccucgauu

SEQ ID NO: 980561 - RNA, 19 nt, Homo sapiens
cagggugggugauguaaau

SEQ ID NO: 980562 - RNA, 19 nt, Homo sapiens
ggcaagacuuccucgauuc

SEQ ID NO: 980563 - RNA, 19 nt, Homo sapiens
guaagaucaacgucuauaa

SEQ ID NO: 980564 - RNA, 19 nt, Homo sapiens
ggaaucagaagguuacaca

SEQ ID NO: 980565 - RNA, 19 nt, Homo sapiens
ggcagaaccuggccgagau

SEQ ID NO: 980566 - RNA, 19 nt, Homo sapiens
ccuugaaacucucuggauu

SEQ ID NO: 980567 - RNA, 19 nt, Homo sapiens
cagaggcuccaauuuauau

SEQ ID NO: 980568 - RNA, 19 nt, Homo sapiens
ucagaggcuccaauuuaua

SEQ ID NO: 980569 - RNA, 19 nt, Homo sapiens
cucagaggcuccaauuuau

SEQ ID NO: 980570 - RNA, 19 nt, Homo sapiens
cgaacgaacuuuuccuuga

SEQ ID NO: 980571 - RNA, 19 nt, Homo sapiens
caagauaccccaaaacaga

SEQ ID NO: 980572 - RNA, 19 nt, Homo sapiens
gaaaggugaaggccaugga

SEQ ID NO: 980573 - RNA, 19 nt, Homo sapiens
cuaaaucgguacggcagaa

SEQ ID NO: 980574 - RNA, 19 nt, Homo sapiens
cgaauaaauugagccuugu

SEQ ID NO: 980575 - RNA, 19 nt, Homo sapiens
uagaggagaggccuaaaga

SEQ ID NO: 980576 - RNA, 19 nt, Homo sapiens
gcuccaauuuauauucauc

SEQ ID NO: 980577 - RNA, 19 nt, Homo sapiens
guuacagugucaaccgaaa

SEQ ID NO: 980578 - RNA, 19 nt, Homo sapiens
cccgugaugagaagaauua

SEQ ID NO: 980579 - RNA, 19 nt, Homo sapiens
gaaaagaaaggaaauacuc

SEQ ID NO: 980580 - RNA, 19 nt, Homo sapiens
ggccacagcagcaggagaa

SEQ ID NO: 980581 - RNA, 19 nt, Homo sapiens
ucagaagguuacacacaca

SEQ ID NO: 980582 - RNA, 19 nt, Homo sapiens
gaagcccuaugugcugaau

SEQ ID NO: 980583 - RNA, 19 nt, Homo sapiens
ccauggaaucagaagguua

SEQ ID NO: 980584 - RNA, 19 nt, Homo sapiens
cucgggaccucauugacua

SEQ ID NO: 980585 - RNA, 19 nt, Homo sapiens
gggaaacgaauaaauugag

SEQ ID NO: 980586 - RNA, 19 nt, Homo sapiens
gccagaaccugcuguuuuc

SEQ ID NO: 980587 - RNA, 19 nt, Homo sapiens
guucucagaggcuccaauu

SEQ ID NO: 980588 - RNA, 19 nt, Homo sapiens
gcaagacuuccucgauucu

SEQ ID NO: 980589 - RNA, 19 nt, Homo sapiens
ggccauggagguggacaua

SEQ ID NO: 980590 - RNA, 19 nt, Homo sapiens
cagauucggaguaagauca

SEQ ID NO: 980591 - RNA, 19 nt, Homo sapiens
agcccuaugugcugaauga

SEQ ID NO: 980592 - RNA, 19 nt, Homo sapiens
gaugagaagaauuacuauc

SEQ ID NO: 980593 - RNA, 19 nt, Homo sapiens
gaggcuccaauuuauauuc

SEQ ID NO: 980594 - RNA, 19 nt, Homo sapiens
ggccaggucccauggaauc

SEQ ID NO: 980595 - RNA, 19 nt, Homo sapiens
cagcagaguggcaagacuu

SEQ ID NO: 980596 - RNA, 19 nt, Homo sapiens
caggucccauggaaucaga

SEQ ID NO: 980597 - RNA, 19 nt, Homo sapiens
cggugaaggucaugaaagg

SEQ ID NO: 980598 - RNA, 19 nt, Homo sapiens
gcagaaccuggccgagaug

SEQ ID NO: 980599 - RNA, 19 nt, Homo sapiens
guguguacauaauaaagca

SEQ ID NO: 980600 - RNA, 19 nt, Homo sapiens
gggaccucauugacuaugu

SEQ ID NO: 980601 - RNA, 19 nt, Homo sapiens
aggcagaaguuugguuaca

SEQ ID NO: 980602 - RNA, 19 nt, Homo sapiens
gacagaggcagcguguuug

SEQ ID NO: 980603 - RNA, 19 nt, Homo sapiens
aggcuccaauuuauauuca

SEQ ID NO: 980604 - RNA, 19 nt, Homo sapiens
aaucagaagguuacacaca

SEQ ID NO: 980605 - RNA, 19 nt, Homo sapiens
gaguaagaucaacgucuau

SEQ ID NO: 980606 - RNA, 19 nt, Homo sapiens
ggcagaaguuugguuacag

SEQ ID NO: 980607 - RNA, 19 nt, Homo sapiens
ggugauguaaauauagugu

SEQ ID NO: 980608 - RNA, 19 nt, Homo sapiens
ugggugauguaaauauagu

SEQ ID NO: 980609 - RNA, 19 nt, Homo sapiens
aguaagaucaacgucuaua

SEQ ID NO: 980610 - RNA, 19 nt, Homo sapiens
gcggggaaacgaauaaauu

SEQ ID NO: 980611 - RNA, 19 nt, Homo sapiens
ccaaaacagauucggagua

SEQ ID NO: 980612 - RNA, 19 nt, Homo sapiens
acagaggcagcguguuuga

SEQ ID NO: 980613 - RNA, 19 nt, Homo sapiens
guaaauaccugccaugaug

SEQ ID NO: 980614 - RNA, 19 nt, Homo sapiens
gaaugacccugaagcagua

SEQ ID NO: 980615 - RNA, 19 nt, Homo sapiens
gaagagagacaagauuaua

SEQ ID NO: 980616 - RNA, 19 nt, Homo sapiens
gaacagggcaugacugaga

SEQ ID NO: 980617 - RNA, 19 nt, Homo sapiens
ggaaggcggugcucugaga

SEQ ID NO: 980618 - RNA, 19 nt, Homo sapiens
ggauauggguuugcuauug

SEQ ID NO: 980619 - RNA, 19 nt, Homo sapiens
ggacaggugugugugauga

SEQ ID NO: 980620 - RNA, 19 nt, Homo sapiens
ugacagaugugguaaauac

SEQ ID NO: 980621 - RNA, 19 nt, Homo sapiens
gaacauggcagccuuugau

SEQ ID NO: 980622 - RNA, 19 nt, Homo sapiens
gaaaggaacggacacuguu

SEQ ID NO: 980623 - RNA, 19 nt, Homo sapiens
gagacaagauuauagucaa

SEQ ID NO: 980624 - RNA, 19 nt, Homo sapiens
ggaccuacaugugauuuau

SEQ ID NO: 980625 - RNA, 19 nt, Homo sapiens
gaaugaugcucuggagaaa

SEQ ID NO: 980626 - RNA, 19 nt, Homo sapiens
ggacugacaugcucuucug

SEQ ID NO: 980627 - RNA, 19 nt, Homo sapiens
caagaaagccauuaaacug

SEQ ID NO: 980628 - RNA, 19 nt, Homo sapiens
cgagaggugucaugaagaa

SEQ ID NO: 980629 - RNA, 19 nt, Homo sapiens
gggcaugacugagaccuuu

SEQ ID NO: 980630 - RNA, 19 nt, Homo sapiens
gaacggacacuguuaguac

SEQ ID NO: 980631 - RNA, 19 nt, Homo sapiens
cagaugcgcugguagcuau

SEQ ID NO: 980632 - RNA, 19 nt, Homo sapiens
gaaccaauuuagaugaaag

SEQ ID NO: 980633 - RNA, 19 nt, Homo sapiens
gguguccgcuugcuaagaa

SEQ ID NO: 980634 - RNA, 19 nt, Homo sapiens
gaaugugacagauguggua

SEQ ID NO: 980635 - RNA, 19 nt, Homo sapiens
gaaagccauuaaacugaga

SEQ ID NO: 980636 - RNA, 19 nt, Homo sapiens
gccaaggucuucaacacaa

SEQ ID NO: 980637 - RNA, 19 nt, Homo sapiens
gacaugcucuucugacauc

SEQ ID NO: 980638 - RNA, 19 nt, Homo sapiens
gcaagaaagccauuaaacu

SEQ ID NO: 980639 - RNA, 19 nt, Homo sapiens
ccaaacugguuauggaaga

SEQ ID NO: 980640 - RNA, 19 nt, Homo sapiens
gucaaccgcucuuccauga

SEQ ID NO: 980641 - RNA, 19 nt, Homo sapiens
ggaaaggaacggacacugu

SEQ ID NO: 980642 - RNA, 19 nt, Homo sapiens
gauauggguuugcuauugg

SEQ ID NO: 980643 - RNA, 19 nt, Homo sapiens
ggacagccagugcucauug

SEQ ID NO: 980644 - RNA, 19 nt, Homo sapiens
gaaauugauguuugaggaa

SEQ ID NO: 980645 - RNA, 19 nt, Homo sapiens
gcacauugcccaccuuugg

SEQ ID NO: 980646 - RNA, 19 nt, Homo sapiens
caaugaguaugcugcuaaa

SEQ ID NO: 980647 - RNA, 19 nt, Homo sapiens
ucacaacauugccaaagug

SEQ ID NO: 980648 - RNA, 19 nt, Homo sapiens
gggacaaguugcaaagugu

SEQ ID NO: 980649 - RNA, 19 nt, Homo sapiens
gcuccugaguccuauaaga

SEQ ID NO: 980650 - RNA, 19 nt, Homo sapiens
uuagacaaauuggcagaua

SEQ ID NO: 980651 - RNA, 19 nt, Homo sapiens
auaagaaugugacagaugu

SEQ ID NO: 980652 - RNA, 19 nt, Homo sapiens
uggagaaauugauguuuga

SEQ ID NO: 980653 - RNA, 19 nt, Homo sapiens
ucaauaagguuuuggaaug

SEQ ID NO: 980654 - RNA, 19 nt, Homo sapiens
ggaauugcgauccguguug

SEQ ID NO: 980655 - RNA, 19 nt, Homo sapiens
ggaacggacacuguuagua

SEQ ID NO: 980656 - RNA, 19 nt, Homo sapiens
caaccauuaugcagaaauc

SEQ ID NO: 980657 - RNA, 19 nt, Homo sapiens
accaagcucuguuuacauu

SEQ ID NO: 980658 - RNA, 19 nt, Homo sapiens
ccucauugcuguugauuac

SEQ ID NO: 980659 - RNA, 19 nt, Homo sapiens
ggagaaggccaugaagaga

SEQ ID NO: 980660 - RNA, 19 nt, Homo sapiens
gaagguguuuucuauguga

SEQ ID NO: 980661 - RNA, 19 nt, Homo sapiens
gcucuuccaugaccuucuu

SEQ ID NO: 980662 - RNA, 19 nt, Homo sapiens
ucaaugaguaugcugcuaa

SEQ ID NO: 980663 - RNA, 19 nt, Homo sapiens
agaaggccaugaagagaga

SEQ ID NO: 980664 - RNA, 19 nt, Homo sapiens
cuauugggcuuccugaugu

SEQ ID NO: 980665 - RNA, 19 nt, Homo sapiens
ugaaugaugcucuggagaa

SEQ ID NO: 980666 - RNA, 19 nt, Homo sapiens
acaccaagcucuguuuaca

SEQ ID NO: 980667 - RNA, 19 nt, Homo sapiens
gggaaccuguaguuauguu

SEQ ID NO: 980668 - RNA, 19 nt, Homo sapiens
aaaggaacggacacuguua

SEQ ID NO: 980669 - RNA, 19 nt, Homo sapiens
uggaugagauuuucaauga

SEQ ID NO: 980670 - RNA, 19 nt, Homo sapiens
cuggagaaauugauguuug

SEQ ID NO: 980671 - RNA, 19 nt, Homo sapiens
augaugcucuggagaaauu

SEQ ID NO: 980672 - RNA, 19 nt, Homo sapiens
aaaguucuguucaauaagg

SEQ ID NO: 980673 - RNA, 19 nt, Homo sapiens
caccaacccucucugaagu

SEQ ID NO: 980674 - RNA, 19 nt, Homo sapiens
uagacaaauuggcagauau

SEQ ID NO: 980675 - RNA, 19 nt, Homo sapiens
gcucugagaagccggacua

SEQ ID NO: 980676 - RNA, 19 nt, Homo sapiens
ggaauuguucaucgaucua

SEQ ID NO: 980677 - RNA, 19 nt, Homo sapiens
ccauuaaacugagaccaau

SEQ ID NO: 980678 - RNA, 19 nt, Homo sapiens
aagaaagccauuaaacuga

SEQ ID NO: 980679 - RNA, 19 nt, Homo sapiens
cacccaaacugguuaugga

SEQ ID NO: 980680 - RNA, 19 nt, Homo sapiens
ggaggaggccuuggagaug

SEQ ID NO: 980681 - RNA, 19 nt, Homo sapiens
gaggugucaugaagaaagu

SEQ ID NO: 980682 - RNA, 19 nt, Homo sapiens
ucacaccaagcucuguuua

SEQ ID NO: 980683 - RNA, 19 nt, Homo sapiens
gcaaagugugcagcuguaa

SEQ ID NO: 980684 - RNA, 19 nt, Homo sapiens
aagacuaucugaagggaau

SEQ ID NO: 980685 - RNA, 19 nt, Homo sapiens
ugauguccauucaggauau

SEQ ID NO: 980686 - RNA, 19 nt, Homo sapiens
caauugcugugaucaaagg

SEQ ID NO: 980687 - RNA, 19 nt, Homo sapiens
caugggaaccuguaguuau

SEQ ID NO: 980688 - RNA, 19 nt, Homo sapiens
augaugagcugcaguucuu

SEQ ID NO: 980689 - RNA, 19 nt, Homo sapiens
ugauaugaaugacccugaa

SEQ ID NO: 980690 - RNA, 19 nt, Homo sapiens
uguaacugcucacgccaaa

SEQ ID NO: 980691 - RNA, 19 nt, Homo sapiens
agucgcagcuauaaugaug

SEQ ID NO: 980692 - RNA, 19 nt, Homo sapiens
cagcaagaaagccauuaaa

SEQ ID NO: 980693 - RNA, 19 nt, Homo sapiens
caccaugagucgcagcuau

SEQ ID NO: 980694 - RNA, 19 nt, Homo sapiens
gcugguagcuauggagaag

SEQ ID NO: 980695 - RNA, 19 nt, Homo sapiens
cauggcagccuuugauaug

SEQ ID NO: 980696 - RNA, 19 nt, Homo sapiens
cccagagggucaagacuau

SEQ ID NO: 980697 - RNA, 19 nt, Homo sapiens
augaagagagacaagauua

SEQ ID NO: 980698 - RNA, 19 nt, Homo sapiens
aggcaaccauuaugcagaa

SEQ ID NO: 980699 - RNA, 19 nt, Homo sapiens
ccuauaagaaugugacaga

SEQ ID NO: 980700 - RNA, 19 nt, Homo sapiens
caaugaaugccaaagacuu

SEQ ID NO: 980701 - RNA, 19 nt, Homo sapiens
cgggacaaguugcaaagug

SEQ ID NO: 980702 - RNA, 19 nt, Homo sapiens
gagaccaauugcugugauc

SEQ ID NO: 980703 - RNA, 19 nt, Homo sapiens
acugagaccuuuggaacaa

SEQ ID NO: 980704 - RNA, 19 nt, Homo sapiens
caaaaggugucaucccaau

SEQ ID NO: 980705 - RNA, 19 nt, Homo sapiens
ggcccgugcuuguaaaaua

SEQ ID NO: 980706 - RNA, 19 nt, Homo sapiens
uugcugugaucaaaggaua

SEQ ID NO: 980707 - RNA, 19 nt, Homo sapiens
ugugacagaugugguaaau

SEQ ID NO: 980708 - RNA, 19 nt, Homo sapiens
cuacaugugauuuaugaug

SEQ ID NO: 980709 - RNA, 19 nt, Homo sapiens
gaacuaugccugggucaac

SEQ ID NO: 980710 - RNA, 19 nt, Homo sapiens
gaucggcaguuggcuugug

SEQ ID NO: 980711 - RNA, 19 nt, Homo sapiens
gacuuggaccuacauguga

SEQ ID NO: 980712 - RNA, 19 nt, Homo sapiens
ccaauuuagaugaaaguga

SEQ ID NO: 980713 - RNA, 19 nt, Homo sapiens
gaagaagagcgccuaaaua

SEQ ID NO: 980714 - RNA, 19 nt, Homo sapiens
agacuaaugucaacucuaa

SEQ ID NO: 980715 - RNA, 19 nt, Homo sapiens
ugacauggauuccugauau

SEQ ID NO: 980716 - RNA, 19 nt, Homo sapiens
gaacaaagcugugguuuuc

SEQ ID NO: 980717 - RNA, 19 nt, Homo sapiens
aaggauaccuguuuaugua

SEQ ID NO: 980718 - RNA, 19 nt, Homo sapiens
gaagagcgccuaaauaaac

SEQ ID NO: 980719 - RNA, 19 nt, Homo sapiens
aagaagagcgccuaaauaa

SEQ ID NO: 980720 - RNA, 19 nt, Homo sapiens
ggaagaagagcgccuaaau

SEQ ID NO: 980721 - RNA, 19 nt, Homo sapiens
ugacaguucuuacaguuga

SEQ ID NO: 980722 - RNA, 19 nt, Homo sapiens
gaaaggauaccuguuuaug

SEQ ID NO: 980723 - RNA, 19 nt, Homo sapiens
ucaaggacauggugccaaa

SEQ ID NO: 980724 - RNA, 19 nt, Homo sapiens
gcuaauugcuugguggauu

SEQ ID NO: 980725 - RNA, 19 nt, Homo sapiens
gaagcugucucagugauuc

SEQ ID NO: 980726 - RNA, 19 nt, Homo sapiens
agauuuagauggcuucuug

SEQ ID NO: 980727 - RNA, 19 nt, Homo sapiens
gaagaaaugcagaacaaag

SEQ ID NO: 980728 - RNA, 19 nt, Homo sapiens
uggaagaaaugcagaacaa

SEQ ID NO: 980729 - RNA, 19 nt, Homo sapiens
aggaaaggauaccuguuua

SEQ ID NO: 980730 - RNA, 19 nt, Homo sapiens
guucuuagaccuugugaaa

SEQ ID NO: 980731 - RNA, 19 nt, Homo sapiens
cugaaacucuuacaaacuu

SEQ ID NO: 980732 - RNA, 19 nt, Homo sapiens
gagguucauucuuguguau

SEQ ID NO: 980733 - RNA, 19 nt, Homo sapiens
gggagagacucacaaagca

SEQ ID NO: 980734 - RNA, 19 nt, Homo sapiens
cagguacucuuucuacaug

SEQ ID NO: 980735 - RNA, 19 nt, Homo sapiens
guacagaacccugccauca

SEQ ID NO: 980736 - RNA, 19 nt, Homo sapiens
cgaaggcucuccugaaacu

SEQ ID NO: 980737 - RNA, 19 nt, Homo sapiens
ggaaaggauaccuguuuau

SEQ ID NO: 980738 - RNA, 19 nt, Homo sapiens
gcagacggcgcuauggaaa

SEQ ID NO: 980739 - RNA, 19 nt, Homo sapiens
caaccugacugugcgauuc

SEQ ID NO: 980740 - RNA, 19 nt, Homo sapiens
uuucaaagcucaaggacau

SEQ ID NO: 980741 - RNA, 19 nt, Homo sapiens
aaugucaacucuaauggaa

SEQ ID NO: 980742 - RNA, 19 nt, Homo sapiens
cagaggcagguaaacauua

SEQ ID NO: 980743 - RNA, 19 nt, Homo sapiens
ucuaauacaugccagagau

SEQ ID NO: 980744 - RNA, 19 nt, Homo sapiens
aaccagagccuguuuacaa

SEQ ID NO: 980745 - RNA, 19 nt, Homo sapiens
ggaagaaaugcagaacaaa

SEQ ID NO: 980746 - RNA, 19 nt, Homo sapiens
gggauucuccuggaucuuu

SEQ ID NO: 980747 - RNA, 19 nt, Homo sapiens
gcagaacaaagcugugguu

SEQ ID NO: 980748 - RNA, 19 nt, Homo sapiens
aaggaaaggauaccuguuu

SEQ ID NO: 980749 - RNA, 19 nt, Homo sapiens
uaucucauguucagucugu

SEQ ID NO: 980750 - RNA, 19 nt, Homo sapiens
ggauucuccuggaucuuug

SEQ ID NO: 980751 - RNA, 19 nt, Homo sapiens
ucuaauggaaggcugguua

SEQ ID NO: 980752 - RNA, 19 nt, Homo sapiens
gauucuguaucuugggaaa

SEQ ID NO: 980753 - RNA, 19 nt, Homo sapiens
aauaaacuccgacuggaaa

SEQ ID NO: 980754 - RNA, 19 nt, Homo sapiens
gcuccugacuuugaucguu

SEQ ID NO: 980755 - RNA, 19 nt, Homo sapiens
gugauucaguccauuccaa

SEQ ID NO: 980756 - RNA, 19 nt, Homo sapiens
ucacauggcuucguuacac

SEQ ID NO: 980757 - RNA, 19 nt, Homo sapiens
gugcucacauggcuucguu

SEQ ID NO: 980758 - RNA, 19 nt, Homo sapiens
agcgaaggcucuccugaaa

SEQ ID NO: 980759 - RNA, 19 nt, Homo sapiens
guugaggauuugguucuuu

SEQ ID NO: 980760 - RNA, 19 nt, Homo sapiens
acgauucaguuucacauug

SEQ ID NO: 980761 - RNA, 19 nt, Homo sapiens
gauucaguccauuccaaua

SEQ ID NO: 980762 - RNA, 19 nt, Homo sapiens
gaaacuaucaaugcagcaa

SEQ ID NO: 980763 - RNA, 19 nt, Homo sapiens
gacauggauuccugauauc

SEQ ID NO: 980764 - RNA, 19 nt, Homo sapiens
caagacuaaugucaacucu

SEQ ID NO: 980765 - RNA, 19 nt, Homo sapiens
gcaguguggccauggagaa

SEQ ID NO: 980766 - RNA, 19 nt, Homo sapiens
uaauacaugccagagauuu

SEQ ID NO: 980767 - RNA, 19 nt, Homo sapiens
ccaacccuaucucauguuc

SEQ ID NO: 980768 - RNA, 19 nt, Homo sapiens
gguucauucuuguguauuc

SEQ ID NO: 980769 - RNA, 19 nt, Homo sapiens
ggaagcugucucagugauu

SEQ ID NO: 980770 - RNA, 19 nt, Homo sapiens
gcaauuggagucacuacgu

SEQ ID NO: 980771 - RNA, 19 nt, Homo sapiens
agaagagcgccuaaauaaa

SEQ ID NO: 980772 - RNA, 19 nt, Homo sapiens
accagagccuguuuacaaa

SEQ ID NO: 980773 - RNA, 19 nt, Homo sapiens
caaugagaccggacgauuc

SEQ ID NO: 980774 - RNA, 19 nt, Homo sapiens
ucaaugagaccggacgauu

SEQ ID NO: 980775 - RNA, 19 nt, Homo sapiens
aaaggauaccuguuuaugu

SEQ ID NO: 980776 - RNA, 19 nt, Homo sapiens
caaacuuaaggaaaggaua

SEQ ID NO: 980777 - RNA, 19 nt, Homo sapiens
ccagaggcagguaaacauu

SEQ ID NO: 980778 - RNA, 19 nt, Homo sapiens
ucaguccauuccaauauuc

SEQ ID NO: 980779 - RNA, 19 nt, Homo sapiens
ggaaaagcgaccacuguuu

SEQ ID NO: 980780 - RNA, 19 nt, Homo sapiens
agagguucauucuugugua

SEQ ID NO: 980781 - RNA, 19 nt, Homo sapiens
ccagugaaaaucaaaguua

SEQ ID NO: 980782 - RNA, 19 nt, Homo sapiens
ggugcugccuucucugauc

SEQ ID NO: 980783 - RNA, 19 nt, Homo sapiens
gaugcuggcaguuguggaa

SEQ ID NO: 980784 - RNA, 19 nt, Homo sapiens
gcaagacuaaugucaacuc

SEQ ID NO: 980785 - RNA, 19 nt, Homo sapiens
gagagguucauucuugugu

SEQ ID NO: 980786 - RNA, 19 nt, Homo sapiens
aagcaagacuaaugucaac

SEQ ID NO: 980787 - RNA, 19 nt, Homo sapiens
cagugaggcuaucuuccuu

SEQ ID NO: 980788 - RNA, 19 nt, Homo sapiens
cugaaaacgugcugcauuu

SEQ ID NO: 980789 - RNA, 19 nt, Homo sapiens
cauggagaaucagguguug

SEQ ID NO: 980790 - RNA, 19 nt, Homo sapiens
uacuguggcugacaugaug

SEQ ID NO: 980791 - RNA, 19 nt, Homo sapiens
ugaaucugaugcggaaaug

SEQ ID NO: 980792 - RNA, 19 nt, Homo sapiens
ggugggagagacucacaaa

SEQ ID NO: 980793 - RNA, 19 nt, Homo sapiens
acauuacaguacagaagaa

SEQ ID NO: 980794 - RNA, 19 nt, Homo sapiens
ucucugauccagcuucuug

SEQ ID NO: 980795 - RNA, 19 nt, Homo sapiens
guauaaucuugugcaauuc

SEQ ID NO: 980796 - RNA, 19 nt, Homo sapiens
ggagcugagugacguacag

SEQ ID NO: 980797 - RNA, 19 nt, Homo sapiens
aaauaaacuccgacuggaa

SEQ ID NO: 980798 - RNA, 19 nt, Homo sapiens
cagaagaaagugagucagu

SEQ ID NO: 980799 - RNA, 19 nt, Homo sapiens
aaagcaagacuaaugucaa

SEQ ID NO: 980800 - RNA, 19 nt, Homo sapiens
gcauuucaaagcucaagga

SEQ ID NO: 980801 - RNA, 19 nt, Homo sapiens
ucuguggauucccuuauau

SEQ ID NO: 980802 - RNA, 19 nt, Homo sapiens
aaacauuacaguacagaag

SEQ ID NO: 980803 - RNA, 19 nt, Homo sapiens
cuaauggaaggcugguuaa

SEQ ID NO: 980804 - RNA, 19 nt, Homo sapiens
ggacgauucaguuucacau

SEQ ID NO: 980805 - RNA, 19 nt, Homo sapiens
gagaccggacgauucaguu

SEQ ID NO: 980806 - RNA, 19 nt, Homo sapiens
aacuaucaaugcagcaauu

SEQ ID NO: 980807 - RNA, 19 nt, Homo sapiens
aaacgugcugcauuucaaa

SEQ ID NO: 980808 - RNA, 19 nt, Homo sapiens
auggauuccugauaucuga

SEQ ID NO: 980809 - RNA, 19 nt, Homo sapiens
cucuguggauucccuuaua

SEQ ID NO: 980810 - RNA, 19 nt, Homo sapiens
guguggccauggagaauca

SEQ ID NO: 980811 - RNA, 19 nt, Homo sapiens
acauugccauauccaguga

SEQ ID NO: 980812 - RNA, 19 nt, Homo sapiens
ugacugugcgauucuguau

SEQ ID NO: 980813 - RNA, 19 nt, Homo sapiens
gaaaguugguuuauggaua

SEQ ID NO: 980814 - RNA, 19 nt, Homo sapiens
aaacagauaucucgaguaa

SEQ ID NO: 980815 - RNA, 19 nt, Homo sapiens
gaacgaaugucucagaugu

SEQ ID NO: 980816 - RNA, 19 nt, Homo sapiens
caacaggaauggccaguaa

SEQ ID NO: 980817 - RNA, 19 nt, Homo sapiens
gcacacagauuuaauggau

SEQ ID NO: 980818 - RNA, 19 nt, Homo sapiens
gaagaagacugggaaguau

SEQ ID NO: 980819 - RNA, 19 nt, Homo sapiens
uguggaagcugaagaaaua

SEQ ID NO: 980820 - RNA, 19 nt, Homo sapiens
gcguauaucucaaauggua

SEQ ID NO: 980821 - RNA, 19 nt, Homo sapiens
gcacagugacucaguauuu

SEQ ID NO: 980822 - RNA, 19 nt, Homo sapiens
acagauaucucgaguaaga

SEQ ID NO: 980823 - RNA, 19 nt, Homo sapiens
gaggaaauauucagagguu

SEQ ID NO: 980824 - RNA, 19 nt, Homo sapiens
ggaaagacaccacacauug

SEQ ID NO: 980825 - RNA, 19 nt, Homo sapiens
ggacaucugcaguuuauaa

SEQ ID NO: 980826 - RNA, 19 nt, Homo sapiens
ggacuuaaauauucuugga

SEQ ID NO: 980827 - RNA, 19 nt, Homo sapiens
uggagaagcuugguaguua

SEQ ID NO: 980828 - RNA, 19 nt, Homo sapiens
gagcaaagaggaaauauuc

SEQ ID NO: 980829 - RNA, 19 nt, Homo sapiens
gaaaguacaguauuggaaa

SEQ ID NO: 980830 - RNA, 19 nt, Homo sapiens
ugaaggagcugguucuguu

SEQ ID NO: 980831 - RNA, 19 nt, Homo sapiens
gaagaacaacuaaauagga

SEQ ID NO: 980832 - RNA, 19 nt, Homo sapiens
gaaugaaaccggcuuguug

SEQ ID NO: 980833 - RNA, 19 nt, Homo sapiens
cauaucagcuuucuaaugg

SEQ ID NO: 980834 - RNA, 19 nt, Homo sapiens
gcaauggcacacagauuua

SEQ ID NO: 980835 - RNA, 19 nt, Homo sapiens
gaugagaucacuaccagua

SEQ ID NO: 980836 - RNA, 19 nt, Homo sapiens
ucaagagacuggguagaua

SEQ ID NO: 980837 - RNA, 19 nt, Homo sapiens
caaggaaacuauauaaagg

SEQ ID NO: 980838 - RNA, 19 nt, Homo sapiens
gaacauacuagacccuaaa

SEQ ID NO: 980839 - RNA, 19 nt, Homo sapiens
gcagacaaguuacugaaca

SEQ ID NO: 980840 - RNA, 19 nt, Homo sapiens
gcuagaagaugcagcacuu

SEQ ID NO: 980841 - RNA, 19 nt, Homo sapiens
gaaaccggcuuguugucuu

SEQ ID NO: 980842 - RNA, 19 nt, Homo sapiens
caaaucaaauccaaacaca

SEQ ID NO: 980843 - RNA, 19 nt, Homo sapiens
uguaaaggaugucaaagaa

SEQ ID NO: 980844 - RNA, 19 nt, Homo sapiens
gaaugucucagauguauga

SEQ ID NO: 980845 - RNA, 19 nt, Homo sapiens
gaauugaacgugauauaga

SEQ ID NO: 980846 - RNA, 19 nt, Homo sapiens
gcagucaaaucaaauccaa

SEQ ID NO: 980847 - RNA, 19 nt, Homo sapiens
caucugcaguuuauaaaga

SEQ ID NO: 980848 - RNA, 19 nt, Homo sapiens
caggacaucugcaguuuau

SEQ ID NO: 980849 - RNA, 19 nt, Homo sapiens
agacuuggaugaaacacua

SEQ ID NO: 980850 - RNA, 19 nt, Homo sapiens
ggaauucucccuaguuuua

SEQ ID NO: 980851 - RNA, 19 nt, Homo sapiens
gaagguguaugcagacaag

SEQ ID NO: 980852 - RNA, 19 nt, Homo sapiens
ggagaagcuugguaguuau

SEQ ID NO: 980853 - RNA, 19 nt, Homo sapiens
gagacuggguagauaagaa

SEQ ID NO: 980854 - RNA, 19 nt, Homo sapiens
gacaggacaucugcaguuu

SEQ ID NO: 980855 - RNA, 19 nt, Homo sapiens
gaaaugacaaaucaacaug

SEQ ID NO: 980856 - RNA, 19 nt, Homo sapiens
aaaguuuggucaccuguuu

SEQ ID NO: 980857 - RNA, 19 nt, Homo sapiens
uaacagucuugguaccuaa

SEQ ID NO: 980858 - RNA, 19 nt, Homo sapiens
uagguaggcuuaaacagaa

SEQ ID NO: 980859 - RNA, 19 nt, Homo sapiens
agagaaugcuggacccuuu

SEQ ID NO: 980860 - RNA, 19 nt, Homo sapiens
gaaacacuagugcauugua

SEQ ID NO: 980861 - RNA, 19 nt, Homo sapiens
caacuaauggagcagcuua

SEQ ID NO: 980862 - RNA, 19 nt, Homo sapiens
ggaaauauucagagguuga

SEQ ID NO: 980863 - RNA, 19 nt, Homo sapiens
uaacaguagcuaugcauaa

SEQ ID NO: 980864 - RNA, 19 nt, Homo sapiens
uaacagagaugaaaaugga

SEQ ID NO: 980865 - RNA, 19 nt, Homo sapiens
agauuucgcuugcaugauu

SEQ ID NO: 980866 - RNA, 19 nt, Homo sapiens
gagagaaaauccuucaaaa

SEQ ID NO: 980867 - RNA, 19 nt, Homo sapiens
uugaggcgcuucauaguuu

SEQ ID NO: 980868 - RNA, 19 nt, Homo sapiens
guagguaggcuuaaacaga

SEQ ID NO: 980869 - RNA, 19 nt, Homo sapiens
aaacaugucccgccacuga

SEQ ID NO: 980870 - RNA, 19 nt, Homo sapiens
caagagacuggguagauaa

SEQ ID NO: 980871 - RNA, 19 nt, Homo sapiens
cuaggcaacuccagugaaa

SEQ ID NO: 980872 - RNA, 19 nt, Homo sapiens
ggagaagcuuguagaacug

SEQ ID NO: 980873 - RNA, 19 nt, Homo sapiens
ugaagaagacugggaagua

SEQ ID NO: 980874 - RNA, 19 nt, Homo sapiens
cacaagagguugauauuuu

SEQ ID NO: 980875 - RNA, 19 nt, Homo sapiens
gcauaucagcuuucuaaug

SEQ ID NO: 980876 - RNA, 19 nt, Homo sapiens
caacucaccacaagccuuu

SEQ ID NO: 980877 - RNA, 19 nt, Homo sapiens
gaagaugcagcacuuacuu

SEQ ID NO: 980878 - RNA, 19 nt, Homo sapiens
gaagcagaagaaacaguua

SEQ ID NO: 980879 - RNA, 19 nt, Homo sapiens
guacuacuacaucaacuaa

SEQ ID NO: 980880 - RNA, 19 nt, Homo sapiens
gaagcuugguaguuaugaa

SEQ ID NO: 980881 - RNA, 19 nt, Homo sapiens
gaagcacaccuaaggaaga

SEQ ID NO: 980882 - RNA, 19 nt, Homo sapiens
uaaugcagcuaccacaaga

SEQ ID NO: 980883 - RNA, 19 nt, Homo sapiens
gaaguauucagcacaguga

SEQ ID NO: 980884 - RNA, 19 nt, Homo sapiens
ccacaagccuuugcauauc

SEQ ID NO: 980885 - RNA, 19 nt, Homo sapiens
uccaagaugucauuuauca

SEQ ID NO: 980886 - RNA, 19 nt, Homo sapiens
gaaagcuucucagcaguca

SEQ ID NO: 980887 - RNA, 19 nt, Homo sapiens
gacagaagaacaacuaaau

SEQ ID NO: 980888 - RNA, 19 nt, Homo sapiens
ucaagcaguucaagugaga

SEQ ID NO: 980889 - RNA, 19 nt, Homo sapiens
ggaagcugaagaaauagua

SEQ ID NO: 980890 - RNA, 19 nt, Homo sapiens
uacuguaggugaaaucuuu

SEQ ID NO: 980891 - RNA, 19 nt, Homo sapiens
ucucagcagucaaaucaaa

SEQ ID NO: 980892 - RNA, 19 nt, Homo sapiens
gguguaugcagacaaguua

SEQ ID NO: 980893 - RNA, 19 nt, Homo sapiens
ccacuuuucuguuacuuua

SEQ ID NO: 980894 - RNA, 19 nt, Homo sapiens
cuaauggaaucccuauaga

SEQ ID NO: 980895 - RNA, 19 nt, Homo sapiens
gccugcacauuguauauuu

SEQ ID NO: 980896 - RNA, 19 nt, Homo sapiens
gggaaagacaccacacauu

SEQ ID NO: 980897 - RNA, 19 nt, Homo sapiens
gaugucauuuaucagguuu

SEQ ID NO: 980898 - RNA, 19 nt, Homo sapiens
ccggaauucucccuaguuu

SEQ ID NO: 980899 - RNA, 19 nt, Homo sapiens
gcaccaguaacuccagaua

SEQ ID NO: 980900 - RNA, 19 nt, Homo sapiens
uggagcagcuuacucaaau

SEQ ID NO: 980901 - RNA, 19 nt, Homo sapiens
uaaagguggacaacugaua

SEQ ID NO: 980902 - RNA, 19 nt, Homo sapiens
uauaguagguaggcuuaaa

SEQ ID NO: 980903 - RNA, 19 nt, Homo sapiens
cagaagaacaacuaaauag

SEQ ID NO: 980904 - RNA, 19 nt, Homo sapiens
ggaggccaccuaugaagaa

SEQ ID NO: 980905 - RNA, 19 nt, Homo sapiens
agaagaagcagaagaaaca

SEQ ID NO: 980906 - RNA, 19 nt, Homo sapiens
ggcuuguugucuucaauua

SEQ ID NO: 980907 - RNA, 19 nt, Homo sapiens
ccacaagagguugauauuu

SEQ ID NO: 980908 - RNA, 19 nt, Homo sapiens
gaucgaauacauauaguag

SEQ ID NO: 980909 - RNA, 19 nt, Homo sapiens
auagaaaguugguuuaugg

SEQ ID NO: 980910 - RNA, 19 nt, Homo sapiens
uaucagcuuucuaauggaa

SEQ ID NO: 980911 - RNA, 19 nt, Homo sapiens
ucagguuuaugugagauua

SEQ ID NO: 980912 - RNA, 19 nt, Homo sapiens
cuagugcauuguagucuaa

SEQ ID NO: 980913 - RNA, 19 nt, Homo sapiens
ggagguggaugacuucuuu

SEQ ID NO: 980914 - RNA, 19 nt, Homo sapiens
gaacagaugauugcacaua

SEQ ID NO: 980915 - RNA, 19 nt, Homo sapiens
ccaguuagcugauguuuua

SEQ ID NO: 980916 - RNA, 19 nt, Homo sapiens
gaaaaucacuugaagaguu

SEQ ID NO: 980917 - RNA, 19 nt, Homo sapiens
gaaagugucuggagaagcu

SEQ ID NO: 980918 - RNA, 19 nt, Homo sapiens
guuuauagcucacugcaaa

SEQ ID NO: 980919 - RNA, 19 nt, Homo sapiens
ggauuggacuguaucagaa

SEQ ID NO: 980920 - RNA, 19 nt, Homo sapiens
gaacuucaccguuaagcuu

SEQ ID NO: 980921 - RNA, 19 nt, Homo sapiens
uggagaagcuggacacuga

SEQ ID NO: 980922 - RNA, 19 nt, Homo sapiens
ucaagaagcuguuuuaaga

SEQ ID NO: 980923 - RNA, 19 nt, Homo sapiens
ucgaaaccguucacaauuu

SEQ ID NO: 980924 - RNA, 19 nt, Homo sapiens
guugagaccuggaagaaga

SEQ ID NO: 980925 - RNA, 19 nt, Homo sapiens
ccguuaagcuuauuucuga

SEQ ID NO: 980926 - RNA, 19 nt, Homo sapiens
cgaaaccguucacaauuug

SEQ ID NO: 980927 - RNA, 19 nt, Homo sapiens
acaaauacauccacaucuu

SEQ ID NO: 980928 - RNA, 19 nt, Homo sapiens
gaauugagcacacuuuauc

SEQ ID NO: 980929 - RNA, 19 nt, Homo sapiens
guggaugacuucuuuacaa

SEQ ID NO: 980930 - RNA, 19 nt, Homo sapiens
gggaggagguggaugacuu

SEQ ID NO: 980931 - RNA, 19 nt, Homo sapiens
gagcugaagucaacgucaa

SEQ ID NO: 980932 - RNA, 19 nt, Homo sapiens
ggaccucucuagcuacaau

SEQ ID NO: 980933 - RNA, 19 nt, Homo sapiens
gaacccaguuagcugaugu

SEQ ID NO: 980934 - RNA, 19 nt, Homo sapiens
gagugagcaucaauaaaga

SEQ ID NO: 980935 - RNA, 19 nt, Homo sapiens
gcacaaauacauccacauc

SEQ ID NO: 980936 - RNA, 19 nt, Homo sapiens
gagcacacguaccuguuug

SEQ ID NO: 980937 - RNA, 19 nt, Homo sapiens
caauaaagaugagcugaag

SEQ ID NO: 980938 - RNA, 19 nt, Homo sapiens
gcuggacacugacauuuca

SEQ ID NO: 980939 - RNA, 19 nt, Homo sapiens
gagucgagguuauguacuu

SEQ ID NO: 980940 - RNA, 19 nt, Homo sapiens
cuccagagcugaagcagaa

SEQ ID NO: 980941 - RNA, 19 nt, Homo sapiens
caucgcagguaccaucaaa

SEQ ID NO: 980942 - RNA, 19 nt, Homo sapiens
uggagcagcuugaguugaa

SEQ ID NO: 980943 - RNA, 19 nt, Homo sapiens
cgucauugcuccuccuuau

SEQ ID NO: 980944 - RNA, 19 nt, Homo sapiens
cagcuugaguugaagaaga

SEQ ID NO: 980945 - RNA, 19 nt, Homo sapiens
ccgcaaagcagauucuauu

SEQ ID NO: 980946 - RNA, 19 nt, Homo sapiens
aagaugagcugaagucaac

SEQ ID NO: 980947 - RNA, 19 nt, Homo sapiens
cgagugagcaucaauaaag

SEQ ID NO: 980948 - RNA, 19 nt, Homo sapiens
caaauacauccacaucuug

SEQ ID NO: 980949 - RNA, 19 nt, Homo sapiens
uggaugacuucuuuacaaa

SEQ ID NO: 980950 - RNA, 19 nt, Homo sapiens
gaacuaguggcagaauuga

SEQ ID NO: 980951 - RNA, 19 nt, Homo sapiens
gaagcuggacacugacauu

SEQ ID NO: 980952 - RNA, 19 nt, Homo sapiens
cagaauugagcacacuuua

SEQ ID NO: 980953 - RNA, 19 nt, Homo sapiens
gcagaauugagcacacuuu

SEQ ID NO: 980954 - RNA, 19 nt, Homo sapiens
ggagcacacguaccuguuu

SEQ ID NO: 980955 - RNA, 19 nt, Homo sapiens
ugacaucaccguccuguuc

SEQ ID NO: 980956 - RNA, 19 nt, Homo sapiens
caucauggugaacuaauuu

SEQ ID NO: 980957 - RNA, 19 nt, Homo sapiens
cugcaaaucuaacuucauc

SEQ ID NO: 980958 - RNA, 19 nt, Homo sapiens
uuauccagcucuuaucuga

SEQ ID NO: 980959 - RNA, 19 nt, Homo sapiens
caaugggugugcugaagug

SEQ ID NO: 980960 - RNA, 19 nt, Homo sapiens
gccagcagcuagaaguguu

SEQ ID NO: 980961 - RNA, 19 nt, Homo sapiens
uugaagaguuugcugauca

SEQ ID NO: 980962 - RNA, 19 nt, Homo sapiens
gcuaagaacaaguaauaag

SEQ ID NO: 980963 - RNA, 19 nt, Homo sapiens
gagcugaagcagaacauuc

SEQ ID NO: 980964 - RNA, 19 nt, Homo sapiens
gcaaaucuaacuucaucau

SEQ ID NO: 980965 - RNA, 19 nt, Homo sapiens
caaaggggccucugaacua

SEQ ID NO: 980966 - RNA, 19 nt, Homo sapiens
gcaaagcagauucuauuuu

SEQ ID NO: 980967 - RNA, 19 nt, Homo sapiens
ucaguuacauccgaaagug

SEQ ID NO: 980968 - RNA, 19 nt, Homo sapiens
gaacaaaggggccucugaa

SEQ ID NO: 980969 - RNA, 19 nt, Homo sapiens
gcucuuaucugaaaacuac

SEQ ID NO: 980970 - RNA, 19 nt, Homo sapiens
ucaucauggugaacuaauu

SEQ ID NO: 980971 - RNA, 19 nt, Homo sapiens
aaacggaaggcgagcauga

SEQ ID NO: 980972 - RNA, 19 nt, Homo sapiens
guucaugcagucacucuuu

SEQ ID NO: 980973 - RNA, 19 nt, Homo sapiens
ugaagaguuugcugaucaa

SEQ ID NO: 980974 - RNA, 19 nt, Homo sapiens
ugaacuaguggcagaauug

SEQ ID NO: 980975 - RNA, 19 nt, Homo sapiens
guuauguacuuccuguugu

SEQ ID NO: 980976 - RNA, 19 nt, Homo sapiens
uauuagguuuccaguggua

SEQ ID NO: 980977 - RNA, 19 nt, Homo sapiens
gcagcaagcgugguugaga

SEQ ID NO: 980978 - RNA, 19 nt, Homo sapiens
gaauguuauccagcucuua

SEQ ID NO: 980979 - RNA, 19 nt, Homo sapiens
gagaagaaaaccuugaaaa

SEQ ID NO: 980980 - RNA, 19 nt, Homo sapiens
gaagcagaacauuccagaa

SEQ ID NO: 980981 - RNA, 19 nt, Homo sapiens
agacacugcuggacaggau

SEQ ID NO: 980982 - RNA, 19 nt, Homo sapiens
ccugaacccugcugacauc

SEQ ID NO: 980983 - RNA, 19 nt, Homo sapiens
cuccggaccucucuagcua

SEQ ID NO: 980984 - RNA, 19 nt, Homo sapiens
auccagcucuuaucugaaa

SEQ ID NO: 980985 - RNA, 19 nt, Homo sapiens
gcugggaggagguggauga

SEQ ID NO: 980986 - RNA, 19 nt, Homo sapiens
cacccgggauuauaucaug

SEQ ID NO: 980987 - RNA, 19 nt, Homo sapiens
acacugacauuucacucau

SEQ ID NO: 980988 - RNA, 19 nt, Homo sapiens
gugcugaaguggguggauu

SEQ ID NO: 980989 - RNA, 19 nt, Homo sapiens
gucgaaaccguucacaauu

SEQ ID NO: 980990 - RNA, 19 nt, Homo sapiens
aagaagaacaagcgaguga

SEQ ID NO: 980991 - RNA, 19 nt, Homo sapiens
auagcucacugcaaaucua

SEQ ID NO: 980992 - RNA, 19 nt, Homo sapiens
gguuauguacuuccuguug

SEQ ID NO: 980993 - RNA, 19 nt, Homo sapiens
guccugcagcugcuuguua

SEQ ID NO: 980994 - RNA, 19 nt, Homo sapiens
ucaauaaagaugagcugaa

SEQ ID NO: 980995 - RNA, 19 nt, Homo sapiens
ucaccguccuguucaagau

SEQ ID NO: 980996 - RNA, 19 nt, Homo sapiens
ugauggagcagcuugaguu

SEQ ID NO: 980997 - RNA, 19 nt, Homo sapiens
gcgagugagcaucaauaaa

SEQ ID NO: 980998 - RNA, 19 nt, Homo sapiens
uucaugcagucacucuuua

SEQ ID NO: 980999 - RNA, 19 nt, Homo sapiens
ugaagcccauccagacugu

SEQ ID NO: 981000 - RNA, 19 nt, Homo sapiens
caaaucuaacuucaucaug

SEQ ID NO: 981001 - RNA, 19 nt, Homo sapiens
ugucgaaaccguucacaau

SEQ ID NO: 981002 - RNA, 19 nt, Homo sapiens
gggccaugcuguccaaagg

SEQ ID NO: 981003 - RNA, 19 nt, Homo sapiens
augcggagguucagcaaga

SEQ ID NO: 981004 - RNA, 19 nt, Homo sapiens
uacuuccuguugucaguua

SEQ ID NO: 981005 - RNA, 19 nt, Homo sapiens
gcaaugggugugcugaagu

SEQ ID NO: 981006 - RNA, 19 nt, Homo sapiens
ccacaagcacaaauacauc

SEQ ID NO: 981007 - RNA, 19 nt, Homo sapiens
ggaggagguggaugacuuc

SEQ ID NO: 981008 - RNA, 19 nt, Homo sapiens
gauggagcagcuugaguug

SEQ ID NO: 981009 - RNA, 19 nt, Homo sapiens
uccugcagcugcuuguuaa

SEQ ID NO: 981010 - RNA, 19 nt, Homo sapiens
uaucagaaccaagguacuu

SEQ ID NO: 981011 - RNA, 19 nt, Homo sapiens
guggguggauuggacugua

SEQ ID NO: 981012 - RNA, 19 nt, Homo sapiens
ggaccacaagcacaaauac

SEQ ID NO: 981013 - RNA, 19 nt, Homo sapiens
gaacauagccaucagauuu

SEQ ID NO: 981014 - RNA, 19 nt, Homo sapiens
cacaagaggugucagauua

SEQ ID NO: 981015 - RNA, 19 nt, Homo sapiens
agaaagagauuccuauuga

SEQ ID NO: 981016 - RNA, 19 nt, Homo sapiens
gcaaacugaugauaaacua

SEQ ID NO: 981017 - RNA, 19 nt, Homo sapiens
gaaccuaaauugcaaagau

SEQ ID NO: 981018 - RNA, 19 nt, Homo sapiens
ggaagaaccuaaauugcaa

SEQ ID NO: 981019 - RNA, 19 nt, Homo sapiens
gcacaaaguuucagugagu

SEQ ID NO: 981020 - RNA, 19 nt, Homo sapiens
gaaagagauuccuauugaa

SEQ ID NO: 981021 - RNA, 19 nt, Homo sapiens
gaugaacucuuugagauga

SEQ ID NO: 981022 - RNA, 19 nt, Homo sapiens
ggaggaagaaccuaaauug

SEQ ID NO: 981023 - RNA, 19 nt, Homo sapiens
gaauagcuguggaggaaga

SEQ ID NO: 981024 - RNA, 19 nt, Homo sapiens
gaagacagcuuuuaacaca

SEQ ID NO: 981025 - RNA, 19 nt, Homo sapiens
guacuggggucacuauuua

SEQ ID NO: 981026 - RNA, 19 nt, Homo sapiens
ugugaaagcugcaagaaug

SEQ ID NO: 981027 - RNA, 19 nt, Homo sapiens
ggaauuaagauacuuggaa

SEQ ID NO: 981028 - RNA, 19 nt, Homo sapiens
gagaaagagauuccuauug

SEQ ID NO: 981029 - RNA, 19 nt, Homo sapiens
gauuaugguugcaauacuu

SEQ ID NO: 981030 - RNA, 19 nt, Homo sapiens
ccaagucagugaauuguca

SEQ ID NO: 981031 - RNA, 19 nt, Homo sapiens
ggagaaagagauuccuauu

SEQ ID NO: 981032 - RNA, 19 nt, Homo sapiens
aaagggaucugggcacaaa

SEQ ID NO: 981033 - RNA, 19 nt, Homo sapiens
ggagagaggaguuuuauuu

SEQ ID NO: 981034 - RNA, 19 nt, Homo sapiens
uggaauagcuguggaggaa

SEQ ID NO: 981035 - RNA, 19 nt, Homo sapiens
gagcacacuuuuaucuuua

SEQ ID NO: 981036 - RNA, 19 nt, Homo sapiens
gauaaacuagucaggauga

SEQ ID NO: 981037 - RNA, 19 nt, Homo sapiens
gcaaagaggaagacagcuu

SEQ ID NO: 981038 - RNA, 19 nt, Homo sapiens
uugcaaagaucugcuauug

SEQ ID NO: 981039 - RNA, 19 nt, Homo sapiens
gcaauaaaggagaaagaga

SEQ ID NO: 981040 - RNA, 19 nt, Homo sapiens
agaaagcaauaaaggagaa

SEQ ID NO: 981041 - RNA, 19 nt, Homo sapiens
ggugucagauuaagaugug

SEQ ID NO: 981042 - RNA, 19 nt, Homo sapiens
caacccaagucagugaauu

SEQ ID NO: 981043 - RNA, 19 nt, Homo sapiens
gaaagcugcaagaauguug

SEQ ID NO: 981044 - RNA, 19 nt, Homo sapiens
gggaacuaaugcucugaaa

SEQ ID NO: 981045 - RNA, 19 nt, Homo sapiens
ggaacugugugcuaaaauu

SEQ ID NO: 981046 - RNA, 19 nt, Homo sapiens
uaagauacuuggaauagcu

SEQ ID NO: 981047 - RNA, 19 nt, Homo sapiens
caaaagacauauacacugu

SEQ ID NO: 981048 - RNA, 19 nt, Homo sapiens
gaucugggcacaaaguuuc

SEQ ID NO: 981049 - RNA, 19 nt, Homo sapiens
guaugcaaacugaugauaa

SEQ ID NO: 981050 - RNA, 19 nt, Homo sapiens
ccagcaguguguucagaaa

SEQ ID NO: 981051 - RNA, 19 nt, Homo sapiens
ucaacuaacucugugaaca

SEQ ID NO: 981052 - RNA, 19 nt, Homo sapiens
gcaaagaaaagccugaaaa

SEQ ID NO: 981053 - RNA, 19 nt, Homo sapiens
caauaaaggagaaagagau

SEQ ID NO: 981054 - RNA, 19 nt, Homo sapiens
gugugcaguucaggaauua

SEQ ID NO: 981055 - RNA, 19 nt, Homo sapiens
uaccuuguaugcaaacuga

SEQ ID NO: 981056 - RNA, 19 nt, Homo sapiens
guggaucagcuuuacauaa

SEQ ID NO: 981057 - RNA, 19 nt, Homo sapiens
gaagaaccuaaauugcaaa

SEQ ID NO: 981058 - RNA, 19 nt, Homo sapiens
caagaggugucagauuaag

SEQ ID NO: 981059 - RNA, 19 nt, Homo sapiens
gggcacaaaguuucaguga

SEQ ID NO: 981060 - RNA, 19 nt, Homo sapiens
gaacuaaugcucugaaaag

SEQ ID NO: 981061 - RNA, 19 nt, Homo sapiens
uuucucaccugcuguggua

SEQ ID NO: 981062 - RNA, 19 nt, Homo sapiens
caacuaacucugugaacau

SEQ ID NO: 981063 - RNA, 19 nt, Homo sapiens
caccugcugugguaucuug

SEQ ID NO: 981064 - RNA, 19 nt, Homo sapiens
ugaauugucaaccugcaua

SEQ ID NO: 981065 - RNA, 19 nt, Homo sapiens
guucaggaauuaagauacu

SEQ ID NO: 981066 - RNA, 19 nt, Homo sapiens
ucacaagaggugucagauu

SEQ ID NO: 981067 - RNA, 19 nt, Homo sapiens
caagaauguugcagugaac

SEQ ID NO: 981068 - RNA, 19 nt, Homo sapiens
gaaaauucuucuugaccuu

SEQ ID NO: 981069 - RNA, 19 nt, Homo sapiens
gcaggaacugugugcuaaa

SEQ ID NO: 981070 - RNA, 19 nt, Homo sapiens
aagaaaagccugaaaauuc

SEQ ID NO: 981071 - RNA, 19 nt, Homo sapiens
ggacaugaagcgcgaguac

SEQ ID NO: 981072 - RNA, 19 nt, Homo sapiens
ggaucugggcacaaaguuu

SEQ ID NO: 981073 - RNA, 19 nt, Homo sapiens
ugccugacccucuugauuu

SEQ ID NO: 981074 - RNA, 19 nt, Homo sapiens
ugcaggaacugugugcuaa

SEQ ID NO: 981075 - RNA, 19 nt, Homo sapiens
aacuaacucugugaacaua

SEQ ID NO: 981076 - RNA, 19 nt, Homo sapiens
ggauuucgcaaguccagaa

SEQ ID NO: 981077 - RNA, 19 nt, Homo sapiens
acaagaggugucagauuaa

SEQ ID NO: 981078 - RNA, 19 nt, Homo sapiens
acaguucccugccuucaca

SEQ ID NO: 981079 - RNA, 19 nt, Homo sapiens
gaaauugaggacucuggau

SEQ ID NO: 981080 - RNA, 19 nt, Homo sapiens
uuacucauccugcccugua

SEQ ID NO: 981081 - RNA, 19 nt, Homo sapiens
ucauuugccuuguuuacuc

SEQ ID NO: 981082 - RNA, 19 nt, Homo sapiens
ugagcacacuuuuaucuuu

SEQ ID NO: 981083 - RNA, 19 nt, Homo sapiens
gaaagcaauaaaggagaaa

SEQ ID NO: 981084 - RNA, 19 nt, Homo sapiens
cagauuugaugaggaacuu

SEQ ID NO: 981085 - RNA, 19 nt, Homo sapiens
uccugaagauggaauaaau

SEQ ID NO: 981086 - RNA, 19 nt, Homo sapiens
caaccugcauauccuaaaa

SEQ ID NO: 981087 - RNA, 19 nt, Homo sapiens
gaacucuuugagaugauuu

SEQ ID NO: 981088 - RNA, 19 nt, Homo sapiens
uaaugucuguaauccugaa

SEQ ID NO: 981089 - RNA, 19 nt, Homo sapiens
aaagagauuccuauugaag

SEQ ID NO: 981090 - RNA, 19 nt, Homo sapiens
gcucucaacccaagucagu

SEQ ID NO: 981091 - RNA, 19 nt, Homo sapiens
gaugugaaagcugcaagaa

SEQ ID NO: 981092 - RNA, 19 nt, Homo sapiens
gccugacccucuugauuuc

SEQ ID NO: 981093 - RNA, 19 nt, Homo sapiens
gagauuaugguugcaauac

SEQ ID NO: 981094 - RNA, 19 nt, Homo sapiens
aaauucuucuugaccuuga

SEQ ID NO: 981095 - RNA, 19 nt, Homo sapiens
acauagccaucagauuuga

SEQ ID NO: 981096 - RNA, 19 nt, Homo sapiens
ucgcaaguccagaaauuga

SEQ ID NO: 981097 - RNA, 19 nt, Homo sapiens
ugaacucuuugagaugauu

SEQ ID NO: 981098 - RNA, 19 nt, Homo sapiens
cugaagauggaauaaauug

SEQ ID NO: 981099 - RNA, 19 nt, Homo sapiens
aaauugaggacucuggauu

SEQ ID NO: 981100 - RNA, 19 nt, Homo sapiens
gaauugucaaccugcauau

SEQ ID NO: 981101 - RNA, 19 nt, Homo sapiens
gcaguguguucagaaagca

SEQ ID NO: 981102 - RNA, 19 nt, Homo sapiens
guacgaccagugcuucaau

SEQ ID NO: 981103 - RNA, 19 nt, Homo sapiens
gaacugugugcuaaaauug

SEQ ID NO: 981104 - RNA, 19 nt, Homo sapiens
guucagaaagcaauaaagg

SEQ ID NO: 981105 - RNA, 19 nt, Homo sapiens
gaggaagaaccuaaauugc

SEQ ID NO: 981106 - RNA, 19 nt, Homo sapiens
gcaguucaggaauuaagau

SEQ ID NO: 981107 - RNA, 19 nt, Homo sapiens
caaagaaaagccugaaaau

SEQ ID NO: 981108 - RNA, 19 nt, Homo sapiens
gauugaugguggccuggau

SEQ ID NO: 981109 - RNA, 19 nt, Homo sapiens
ugagauuaugguugcaaua

SEQ ID NO: 981110 - RNA, 19 nt, Homo sapiens
aaccuaaauugcaaagauc

SEQ ID NO: 981111 - RNA, 19 nt, Homo sapiens
aggaagaaccuaaauugca

SEQ ID NO: 981112 - RNA, 19 nt, Homo sapiens
agugugcaguucaggaauu

SEQ ID NO: 981113 - RNA, 19 nt, Homo sapiens
gggaggaucugucuacuuu

SEQ ID NO: 981114 - RNA, 19 nt, Homo sapiens
ugacuuaccugauuaugaa

SEQ ID NO: 981115 - RNA, 19 nt, Homo sapiens
caaaugugguucugaaaug

SEQ ID NO: 981116 - RNA, 19 nt, Homo sapiens
guucugaaaugguaugaaa

SEQ ID NO: 981117 - RNA, 19 nt, Homo sapiens
caaaggaucacgaaaccua

SEQ ID NO: 981118 - RNA, 19 nt, Homo sapiens
gaagagaaggucagaguuc

SEQ ID NO: 981119 - RNA, 19 nt, Homo sapiens
caaauggaaugccaguaug

SEQ ID NO: 981120 - RNA, 19 nt, Homo sapiens
gauaacugacuccaucuaa

SEQ ID NO: 981121 - RNA, 19 nt, Homo sapiens
gcacagaacccucucuuuu

SEQ ID NO: 981122 - RNA, 19 nt, Homo sapiens
gcaaguggcagaggauaaa

SEQ ID NO: 981123 - RNA, 19 nt, Homo sapiens
gcagacacccucccgcaaa

SEQ ID NO: 981124 - RNA, 19 nt, Homo sapiens
gcaaaugugguucugaaau

SEQ ID NO: 981125 - RNA, 19 nt, Homo sapiens
caaaagauguuggacaauu

SEQ ID NO: 981126 - RNA, 19 nt, Homo sapiens
acaguagugugccaaguaa

SEQ ID NO: 981127 - RNA, 19 nt, Homo sapiens
aaaccuauaccaaacagua

SEQ ID NO: 981128 - RNA, 19 nt, Homo sapiens
cuuagagacugaagcuuaa

SEQ ID NO: 981129 - RNA, 19 nt, Homo sapiens
acaccaagcccaucugaaa

SEQ ID NO: 981130 - RNA, 19 nt, Homo sapiens
gauuggaauuucaguggaa

SEQ ID NO: 981131 - RNA, 19 nt, Homo sapiens
gagcugccgucgccauguu

SEQ ID NO: 981132 - RNA, 19 nt, Homo sapiens
cggcaaaugugguucugaa

SEQ ID NO: 981133 - RNA, 19 nt, Homo sapiens
gcagacuccuguagguaau

SEQ ID NO: 981134 - RNA, 19 nt, Homo sapiens
ucuuaaaucuggagaagga

SEQ ID NO: 981135 - RNA, 19 nt, Homo sapiens
ucaaauggaaugccaguau

SEQ ID NO: 981136 - RNA, 19 nt, Homo sapiens
ggcagaggauaaauuuguu

SEQ ID NO: 981137 - RNA, 19 nt, Homo sapiens
gagacugaagcuuaauuaa

SEQ ID NO: 981138 - RNA, 19 nt, Homo sapiens
aaagacgacuagcacagaa

SEQ ID NO: 981139 - RNA, 19 nt, Homo sapiens
ggaauuauuagacaguaug

SEQ ID NO: 981140 - RNA, 19 nt, Homo sapiens
gcagaggauaaauuuguuu

SEQ ID NO: 981141 - RNA, 19 nt, Homo sapiens
uauggcaacuccuaggauu

SEQ ID NO: 981142 - RNA, 19 nt, Homo sapiens
ggaagagaaggucagaguu

SEQ ID NO: 981143 - RNA, 19 nt, Homo sapiens
ggcaagacauuuuguuuug

SEQ ID NO: 981144 - RNA, 19 nt, Homo sapiens
auaacugacuccaucuaaa

SEQ ID NO: 981145 - RNA, 19 nt, Homo sapiens
ucaguggaauuauuagaca

SEQ ID NO: 981146 - RNA, 19 nt, Homo sapiens
ggagaaggaagccaacauc

SEQ ID NO: 981147 - RNA, 19 nt, Homo sapiens
ggucuuaaaucuggagaag

SEQ ID NO: 981148 - RNA, 19 nt, Homo sapiens
agagacugaagcuuaauua

SEQ ID NO: 981149 - RNA, 19 nt, Homo sapiens
caaagacgacuagcacaga

SEQ ID NO: 981150 - RNA, 19 nt, Homo sapiens
uauccucaguugacucauu

SEQ ID NO: 981151 - RNA, 19 nt, Homo sapiens
guuggacaauuucuacaau

SEQ ID NO: 981152 - RNA, 19 nt, Homo sapiens
gcugcuguauccucaguug

SEQ ID NO: 981153 - RNA, 19 nt, Homo sapiens
ggaaugggaggaucugucu

SEQ ID NO: 981154 - RNA, 19 nt, Homo sapiens
cagacacccucccgcaaau

SEQ ID NO: 981155 - RNA, 19 nt, Homo sapiens
aagcccaucugaaauguuc

SEQ ID NO: 981156 - RNA, 19 nt, Homo sapiens
gccaagugccaucuucaaa

SEQ ID NO: 981157 - RNA, 19 nt, Homo sapiens
guggaauuauuagacagua

SEQ ID NO: 981158 - RNA, 19 nt, Homo sapiens
ggucaaaggaucacgaaac

SEQ ID NO: 981159 - RNA, 19 nt, Homo sapiens
ccaagcccaucugaaaugu

SEQ ID NO: 981160 - RNA, 19 nt, Homo sapiens
uguccgaacuccaucuguu

SEQ ID NO: 981161 - RNA, 19 nt, Homo sapiens
caagugccaucuucaaaau

SEQ ID NO: 981162 - RNA, 19 nt, Homo sapiens
cacaaaagauguuggacaa

SEQ ID NO: 981163 - RNA, 19 nt, Homo sapiens
ucuggaagguucuuagucu

SEQ ID NO: 981164 - RNA, 19 nt, Homo sapiens
gaggaucugucuacuuuuc

SEQ ID NO: 981165 - RNA, 19 nt, Homo sapiens
uggcagaggauaaauuugu

SEQ ID NO: 981166 - RNA, 19 nt, Homo sapiens
ucacucaguucacacaaaa

SEQ ID NO: 981167 - RNA, 19 nt, Homo sapiens
ccuaggauuugucacgaau

SEQ ID NO: 981168 - RNA, 19 nt, Homo sapiens
uaacugacuccaucuaaaa

SEQ ID NO: 981169 - RNA, 19 nt, Homo sapiens
cagcagacuccuguaggua

SEQ ID NO: 981170 - RNA, 19 nt, Homo sapiens
uauccugauucaaauggaa

SEQ ID NO: 981171 - RNA, 19 nt, Homo sapiens
gauguuggacaauuucuac

SEQ ID NO: 981172 - RNA, 19 nt, Homo sapiens
ucagcagacuccuguaggu

SEQ ID NO: 981173 - RNA, 19 nt, Homo sapiens
caacuccuaggauuuguca

SEQ ID NO: 981174 - RNA, 19 nt, Homo sapiens
augaaaguaucaaccaugu

SEQ ID NO: 981175 - RNA, 19 nt, Homo sapiens
gaggucaaaggaucacgaa

SEQ ID NO: 981176 - RNA, 19 nt, Homo sapiens
uaggauuugucacgaaugg

SEQ ID NO: 981177 - RNA, 19 nt, Homo sapiens
aacaguagugugccaagua

SEQ ID NO: 981178 - RNA, 19 nt, Homo sapiens
aaacaguagugugccaagu

SEQ ID NO: 981179 - RNA, 19 nt, Homo sapiens
aaaggaucacgaaaccuaa

SEQ ID NO: 981180 - RNA, 19 nt, Homo sapiens
uguagguaaugcugcugua

SEQ ID NO: 981181 - RNA, 19 nt, Homo sapiens
cuaaaaguaugaggucaaa

SEQ ID NO: 981182 - RNA, 19 nt, Homo sapiens
ugacaccaagcccaucuga

SEQ ID NO: 981183 - RNA, 19 nt, Homo sapiens
caucauuugcugucucuca

SEQ ID NO: 981184 - RNA, 19 nt, Homo sapiens
gcucagcagacuccuguag

SEQ ID NO: 981185 - RNA, 19 nt, Homo sapiens
aguggcagaggauaaauuu

SEQ ID NO: 981186 - RNA, 19 nt, Homo sapiens
gacacccucccgcaaauuc

SEQ ID NO: 981187 - RNA, 19 nt, Homo sapiens
ggaucacgaaaccuaaguu

SEQ ID NO: 981188 - RNA, 19 nt, Homo sapiens
gucaaaggaucacgaaacc

SEQ ID NO: 981189 - RNA, 19 nt, Homo sapiens
aaagauguuggacaauuuc

SEQ ID NO: 981190 - RNA, 19 nt, Homo sapiens
ggaagccaagugccaucuu

SEQ ID NO: 981191 - RNA, 19 nt, Homo sapiens
uggcaacuccuaggauuug

SEQ ID NO: 981192 - RNA, 19 nt, Homo sapiens
uagagacugaagcuuaauu

SEQ ID NO: 981193 - RNA, 19 nt, Homo sapiens
aaaugugguucugaaaugg

SEQ ID NO: 981194 - RNA, 19 nt, Homo sapiens
ggcaaaugugguucugaaa

SEQ ID NO: 981195 - RNA, 19 nt, Homo sapiens
caccaagcccaucugaaau

SEQ ID NO: 981196 - RNA, 19 nt, Homo sapiens
uuggagccaugaauauugu

SEQ ID NO: 981197 - RNA, 19 nt, Homo sapiens
gaaugggaggaucugucua

SEQ ID NO: 981198 - RNA, 19 nt, Homo sapiens
cagcaaguggcagaggaua

SEQ ID NO: 981199 - RNA, 19 nt, Homo sapiens
auucaaaggcaagacauuu

SEQ ID NO: 981200 - RNA, 19 nt, Homo sapiens
aaaguaugaggucaaagga

SEQ ID NO: 981201 - RNA, 19 nt, Homo sapiens
caguauggcucagcagacu

SEQ ID NO: 981202 - RNA, 19 nt, Homo sapiens
uugcucagauuggaauuuc

SEQ ID NO: 981203 - RNA, 19 nt, Homo sapiens
ccaaauguuuccagugaua

SEQ ID NO: 981204 - RNA, 19 nt, Homo sapiens
gcaaaucugccuguaauaa

SEQ ID NO: 981205 - RNA, 19 nt, Homo sapiens
agugauaccuuacuugaua

SEQ ID NO: 981206 - RNA, 19 nt, Homo sapiens
agagagagcugcugcaaga

SEQ ID NO: 981207 - RNA, 19 nt, Homo sapiens
ggagagaguuggaagaaag

SEQ ID NO: 981208 - RNA, 19 nt, Homo sapiens
gguaauggcgucuguauga

SEQ ID NO: 981209 - RNA, 19 nt, Homo sapiens
gauaauggacuugggaaua

SEQ ID NO: 981210 - RNA, 19 nt, Homo sapiens
gaaacccucuccuuaaucu

SEQ ID NO: 981211 - RNA, 19 nt, Homo sapiens
gaagagaggauucguaugg

SEQ ID NO: 981212 - RNA, 19 nt, Homo sapiens
gaagaagagaggauucgua

SEQ ID NO: 981213 - RNA, 19 nt, Homo sapiens
ggacuugggaauagguuua

SEQ ID NO: 981214 - RNA, 19 nt, Homo sapiens
gaccuacccucucauacaa

SEQ ID NO: 981215 - RNA, 19 nt, Homo sapiens
uaacagaugaggaagauga

SEQ ID NO: 981216 - RNA, 19 nt, Homo sapiens
gcggaaacccucuccuuaa

SEQ ID NO: 981217 - RNA, 19 nt, Homo sapiens
caaaucugccuguaauaaa

SEQ ID NO: 981218 - RNA, 19 nt, Homo sapiens
gaacauacaaccuccucuu

SEQ ID NO: 981219 - RNA, 19 nt, Homo sapiens
aagcaaaucugccuguaau

SEQ ID NO: 981220 - RNA, 19 nt, Homo sapiens
uaaaggaucauucugacuu

SEQ ID NO: 981221 - RNA, 19 nt, Homo sapiens
cggaaacccucuccuuaau

SEQ ID NO: 981222 - RNA, 19 nt, Homo sapiens
agaagaaagugaugaugau

SEQ ID NO: 981223 - RNA, 19 nt, Homo sapiens
ugaggaagaugaagauuuu

SEQ ID NO: 981224 - RNA, 19 nt, Homo sapiens
cagaugacccucuaacaga

SEQ ID NO: 981225 - RNA, 19 nt, Homo sapiens
gagaggauucguauggaaa

SEQ ID NO: 981226 - RNA, 19 nt, Homo sapiens
cuccaaauguuuccaguga

SEQ ID NO: 981227 - RNA, 19 nt, Homo sapiens
gugauaccuuacuugauaa

SEQ ID NO: 981228 - RNA, 19 nt, Homo sapiens
agaaagugaugaugaugau

SEQ ID NO: 981229 - RNA, 19 nt, Homo sapiens
ggaccucggccagucauaa

SEQ ID NO: 981230 - RNA, 19 nt, Homo sapiens
uagaugaccagaagaaaga

SEQ ID NO: 981231 - RNA, 19 nt, Homo sapiens
gaaagugaugaugaugaua

SEQ ID NO: 981232 - RNA, 19 nt, Homo sapiens
ucaaagcaguauucaagca

SEQ ID NO: 981233 - RNA, 19 nt, Homo sapiens
gaagaaagugaugaugaug

SEQ ID NO: 981234 - RNA, 19 nt, Homo sapiens
gaagaagaaagugaugaug

SEQ ID NO: 981235 - RNA, 19 nt, Homo sapiens
gcagaugacccucuaacag

SEQ ID NO: 981236 - RNA, 19 nt, Homo sapiens
aagaagaaagugaugauga

SEQ ID NO: 981237 - RNA, 19 nt, Homo sapiens
acacugcgaucugaauuuc

SEQ ID NO: 981238 - RNA, 19 nt, Homo sapiens
ggaaacccucuccuuaauc

SEQ ID NO: 981239 - RNA, 19 nt, Homo sapiens
gugcuuaauuaaagacugu

SEQ ID NO: 981240 - RNA, 19 nt, Homo sapiens
gagcggaaacccucuccuu

SEQ ID NO: 981241 - RNA, 19 nt, Homo sapiens
guaauggcgucuguaugau

SEQ ID NO: 981242 - RNA, 19 nt, Homo sapiens
auaauggacuugggaauag

SEQ ID NO: 981243 - RNA, 19 nt, Homo sapiens
agagaggauucguauggaa

SEQ ID NO: 981244 - RNA, 19 nt, Homo sapiens
ugaugcagaugacccucua

SEQ ID NO: 981245 - RNA, 19 nt, Homo sapiens
aagaagagaggauucguau

SEQ ID NO: 981246 - RNA, 19 nt, Homo sapiens
caggaaggaccaagaacaa

SEQ ID NO: 981247 - RNA, 19 nt, Homo sapiens
ucuaacagaugaggaagau

SEQ ID NO: 981248 - RNA, 19 nt, Homo sapiens
aaagcaaaucugccuguaa

SEQ ID NO: 981249 - RNA, 19 nt, Homo sapiens
guagaugaccagaagaaag

SEQ ID NO: 981250 - RNA, 19 nt, Homo sapiens
aaagaaggugggaugauga

SEQ ID NO: 981251 - RNA, 19 nt, Homo sapiens
gagagaguuggaagaaaga

SEQ ID NO: 981252 - RNA, 19 nt, Homo sapiens
gaccucggccagucauaaa

SEQ ID NO: 981253 - RNA, 19 nt, Homo sapiens
aaggugggaugaugacguu

SEQ ID NO: 981254 - RNA, 19 nt, Homo sapiens
ggaaggaccaagaacaaaa

SEQ ID NO: 981255 - RNA, 19 nt, Homo sapiens
gcagccaggccaaccuuug

SEQ ID NO: 981256 - RNA, 19 nt, Homo sapiens
uaccuuacuugauaaugga

SEQ ID NO: 981257 - RNA, 19 nt, Homo sapiens
cauacaaccuccucuucag

SEQ ID NO: 981258 - RNA, 19 nt, Homo sapiens
cugaagagcaggccaggaa

SEQ ID NO: 981259 - RNA, 19 nt, Homo sapiens
uuagugauaccuuacuuga

SEQ ID NO: 981260 - RNA, 19 nt, Homo sapiens
ggaugaugacguugucuuc

SEQ ID NO: 981261 - RNA, 19 nt, Homo sapiens
gauacugcagcucuucuug

SEQ ID NO: 981262 - RNA, 19 nt, Homo sapiens
cagaugaggaagaugaaga

SEQ ID NO: 981263 - RNA, 19 nt, Homo sapiens
caggagagaguuggaagaa

SEQ ID NO: 981264 - RNA, 19 nt, Homo sapiens
aaacguaaaggaucauucu

SEQ ID NO: 981265 - RNA, 19 nt, Homo sapiens
aagaaagugaugaugauga

SEQ ID NO: 981266 - RNA, 19 nt, Homo sapiens
cguccaacccgagaacaua

SEQ ID NO: 981267 - RNA, 19 nt, Homo sapiens
uaacccaguuugcauucuc

SEQ ID NO: 981268 - RNA, 19 nt, Homo sapiens
aaaagaaggugggaugaug

SEQ ID NO: 981269 - RNA, 19 nt, Homo sapiens
uuucaaagcaguauucaag

SEQ ID NO: 981270 - RNA, 19 nt, Homo sapiens
agaugacccucuaacagau

SEQ ID NO: 981271 - RNA, 19 nt, Homo sapiens
ggugauuugagccaacuuu

SEQ ID NO: 981272 - RNA, 19 nt, Homo sapiens
ccaggaaggaccaagaaca

SEQ ID NO: 981273 - RNA, 19 nt, Homo sapiens
ugaagaagaaagugaugau

SEQ ID NO: 981274 - RNA, 19 nt, Homo sapiens
cagccaggccaaccuuuga

SEQ ID NO: 981275 - RNA, 19 nt, Homo sapiens
auaccuuacuugauaaugg

SEQ ID NO: 981276 - RNA, 19 nt, Homo sapiens
caagaacugugcaaaaggu

SEQ ID NO: 981277 - RNA, 19 nt, Homo sapiens
cagacagacuacucaggau

SEQ ID NO: 981278 - RNA, 19 nt, Homo sapiens
caaccuugaugcagaugac

SEQ ID NO: 981279 - RNA, 19 nt, Homo sapiens
gaacugugcaaaaggugua

SEQ ID NO: 981280 - RNA, 19 nt, Homo sapiens
gaugaugacguugucuuca

SEQ ID NO: 981281 - RNA, 19 nt, Homo sapiens
agaccuacccucucauaca

SEQ ID NO: 981282 - RNA, 19 nt, Homo sapiens
uguuuccagugauauguuu

SEQ ID NO: 981283 - RNA, 19 nt, Homo sapiens
aagagaggauucguaugga

SEQ ID NO: 981284 - RNA, 19 nt, Homo sapiens
ggccaggaaggaccaagaa

SEQ ID NO: 981285 - RNA, 19 nt, Homo sapiens
ccucucauacaaagauaaa

SEQ ID NO: 981286 - RNA, 19 nt, Homo sapiens
gagaguuggaagaaagaga

SEQ ID NO: 981287 - RNA, 19 nt, Homo sapiens
aaaaggagaaggugauuug

SEQ ID NO: 981288 - RNA, 19 nt, Homo sapiens
guguagaugaccagaagaa

SEQ ID NO: 981289 - RNA, 19 nt, Homo sapiens
ugaugacguugucuucaag

SEQ ID NO: 981290 - RNA, 19 nt, Homo sapiens
gaaaaggagaaggugauuu

SEQ ID NO: 981291 - RNA, 19 nt, Homo sapiens
agcggaaacccucuccuua

SEQ ID NO: 981292 - RNA, 19 nt, Homo sapiens
aaagugaugaugaugauac

SEQ ID NO: 981293 - RNA, 19 nt, Homo sapiens
augaugacguugucuucaa

SEQ ID NO: 981294 - RNA, 19 nt, Homo sapiens
gaugacccucuaacagaug

SEQ ID NO: 981295 - RNA, 19 nt, Homo sapiens
aaccuccucuucaguguca

SEQ ID NO: 981296 - RNA, 19 nt, Homo sapiens
caaauguuuccagugauau

SEQ ID NO: 981297 - RNA, 19 nt, Homo sapiens
agagagcugcugcaagaga

SEQ ID NO: 981298 - RNA, 19 nt, Homo sapiens
gaugaggaagaugaagauu

SEQ ID NO: 981299 - RNA, 19 nt, Homo sapiens
guucguaaccgugacuuca

SEQ ID NO: 981300 - RNA, 19 nt, Homo sapiens
guuuaacccaguuugcauu

SEQ ID NO: 981301 - RNA, 19 nt, Homo sapiens
acacacugcgaucugaauu

SEQ ID NO: 981302 - RNA, 19 nt, Homo sapiens
gggaugaugacguugucuu

SEQ ID NO: 981303 - RNA, 19 nt, Homo sapiens
gccgauaacuugcgucuga

SEQ ID NO: 981304 - RNA, 19 nt, Homo sapiens
ccaacaugcugcugaguga

SEQ ID NO: 981305 - RNA, 19 nt, Homo sapiens
ugaaacugcuuacccacaa

SEQ ID NO: 981306 - RNA, 19 nt, Homo sapiens
guugaucuauacccuguuu

SEQ ID NO: 981307 - RNA, 19 nt, Homo sapiens
gaaacugcuuacccacaau

SEQ ID NO: 981308 - RNA, 19 nt, Homo sapiens
ugagcucgguauuauauau

SEQ ID NO: 981309 - RNA, 19 nt, Homo sapiens
ggacguauguuccccauca

SEQ ID NO: 981310 - RNA, 19 nt, Homo sapiens
ugaggagaaugaggaguuu

SEQ ID NO: 981311 - RNA, 19 nt, Homo sapiens
uaucugcccuguggaauuc

SEQ ID NO: 981312 - RNA, 19 nt, Homo sapiens
cgaauucugccguguguau

SEQ ID NO: 981313 - RNA, 19 nt, Homo sapiens
gagcucgguauuauauauu

SEQ ID NO: 981314 - RNA, 19 nt, Homo sapiens
ugagggauaugaggagaau

SEQ ID NO: 981315 - RNA, 19 nt, Homo sapiens
ugagugaagaggaaacuga

SEQ ID NO: 981316 - RNA, 19 nt, Homo sapiens
cuucguggcgcguaugaua

SEQ ID NO: 981317 - RNA, 19 nt, Homo sapiens
gcugcugagugaagaggaa

SEQ ID NO: 981318 - RNA, 19 nt, Homo sapiens
gcuggagguggaagugaua

SEQ ID NO: 981319 - RNA, 19 nt, Homo sapiens
uauacccuguuuccgaauu

SEQ ID NO: 981320 - RNA, 19 nt, Homo sapiens
ggaaucuggacguauguuc

SEQ ID NO: 981321 - RNA, 19 nt, Homo sapiens
guaucugcccuguggaauu

SEQ ID NO: 981322 - RNA, 19 nt, Homo sapiens
cccggaaucuggacguaug

SEQ ID NO: 981323 - RNA, 19 nt, Homo sapiens
ccaccgagguccguaucug

SEQ ID NO: 981324 - RNA, 19 nt, Homo sapiens
ccaacuucguggcgcguau

SEQ ID NO: 981325 - RNA, 19 nt, Homo sapiens
agggauaugaggagaauga

SEQ ID NO: 981326 - RNA, 19 nt, Homo sapiens
ggcgacaugaaacugcuua

SEQ ID NO: 981327 - RNA, 19 nt, Homo sapiens
uuugagcucgguauuauau

SEQ ID NO: 981328 - RNA, 19 nt, Homo sapiens
ggaauucaaccccaacuuc

SEQ ID NO: 981329 - RNA, 19 nt, Homo sapiens
caaugacaccaaacacagu

SEQ ID NO: 981330 - RNA, 19 nt, Homo sapiens
gacccaaugacaccaaaca

SEQ ID NO: 981331 - RNA, 19 nt, Homo sapiens
ggagauaacccaucaauaa

SEQ ID NO: 981332 - RNA, 19 nt, Homo sapiens
ggaaggaacucggugguuu

SEQ ID NO: 981333 - RNA, 19 nt, Homo sapiens
guaacuaggugacaagaaa

SEQ ID NO: 981334 - RNA, 19 nt, Homo sapiens
caacaccacuuccgcguuu

SEQ ID NO: 981335 - RNA, 19 nt, Homo sapiens
cauauagucuuucugguuu

SEQ ID NO: 981336 - RNA, 19 nt, Homo sapiens
guacagggguggcaaaaua

SEQ ID NO: 981337 - RNA, 19 nt, Homo sapiens
gaaacaaacacacaccaaa

SEQ ID NO: 981338 - RNA, 19 nt, Homo sapiens
gagauaacccaucaauaaa

SEQ ID NO: 981339 - RNA, 19 nt, Homo sapiens
uccaugaccuccugaaaua

SEQ ID NO: 981340 - RNA, 19 nt, Homo sapiens
ggaacucggugguuuggaa

SEQ ID NO: 981341 - RNA, 19 nt, Homo sapiens
gaaagugaguacauauagu

SEQ ID NO: 981342 - RNA, 19 nt, Homo sapiens
gaaaugcaaccaaugaaga

SEQ ID NO: 981343 - RNA, 19 nt, Homo sapiens
gaaagacagcaaagaugua

SEQ ID NO: 981344 - RNA, 19 nt, Homo sapiens
caagaaugcugacaacgau

SEQ ID NO: 981345 - RNA, 19 nt, Homo sapiens
gugaguacauauagucuuu

SEQ ID NO: 981346 - RNA, 19 nt, Homo sapiens
gguccaagauggcggauga

SEQ ID NO: 981347 - RNA, 19 nt, Homo sapiens
ggacggaguaaucuguuua

SEQ ID NO: 981348 - RNA, 19 nt, Homo sapiens
ggaaagacagcaaagaugu

SEQ ID NO: 981349 - RNA, 19 nt, Homo sapiens
acacuuaacucaucuaacu

SEQ ID NO: 981350 - RNA, 19 nt, Homo sapiens
aaagagaaaugcaaccaau

SEQ ID NO: 981351 - RNA, 19 nt, Homo sapiens
ugacauuccuaucacauau

SEQ ID NO: 981352 - RNA, 19 nt, Homo sapiens
caacaagaaugcugacaac

SEQ ID NO: 981353 - RNA, 19 nt, Homo sapiens
aaacacacaccaaacagua

SEQ ID NO: 981354 - RNA, 19 nt, Homo sapiens
gcagagggaccuuugauag

SEQ ID NO: 981355 - RNA, 19 nt, Homo sapiens
aaauaugccugacggauca

SEQ ID NO: 981356 - RNA, 19 nt, Homo sapiens
gaauaucagucccuuaucc

SEQ ID NO: 981357 - RNA, 19 nt, Homo sapiens
ugauaggugucauauauag

SEQ ID NO: 981358 - RNA, 19 nt, Homo sapiens
uggacuagcucaucucaug

SEQ ID NO: 981359 - RNA, 19 nt, Homo sapiens
ugacaucgaguuugacauu

SEQ ID NO: 981360 - RNA, 19 nt, Homo sapiens
gaaauaugaguuugacauc

SEQ ID NO: 981361 - RNA, 19 nt, Homo sapiens
gcaucacacuuaacucauc

SEQ ID NO: 981362 - RNA, 19 nt, Homo sapiens
gaaggaacucggugguuug

SEQ ID NO: 981363 - RNA, 19 nt, Homo sapiens
ccugacggaucauuucaaa

SEQ ID NO: 981364 - RNA, 19 nt, Homo sapiens
agacugggcuuuggacaau

SEQ ID NO: 981365 - RNA, 19 nt, Homo sapiens
gagaaaugcaaccaaugaa

SEQ ID NO: 981366 - RNA, 19 nt, Homo sapiens
agagaaaugcaaccaauga

SEQ ID NO: 981367 - RNA, 19 nt, Homo sapiens
ccuaucacauauccuacua

SEQ ID NO: 981368 - RNA, 19 nt, Homo sapiens
ugaagaaucaagccacuga

SEQ ID NO: 981369 - RNA, 19 nt, Homo sapiens
gaacucggugguuuggaaa

SEQ ID NO: 981370 - RNA, 19 nt, Homo sapiens
cggaucauuucaaaccuuu

SEQ ID NO: 981371 - RNA, 19 nt, Homo sapiens
ggaaaaugcugguauaucc

SEQ ID NO: 981372 - RNA, 19 nt, Homo sapiens
ucccggugcugaagacuaa

SEQ ID NO: 981373 - RNA, 19 nt, Homo sapiens
ucauauauaggacggagua

SEQ ID NO: 981374 - RNA, 19 nt, Homo sapiens
ugaaagugaguacauauag

SEQ ID NO: 981375 - RNA, 19 nt, Homo sapiens
aauaugaguuugacaucga

SEQ ID NO: 981376 - RNA, 19 nt, Homo sapiens
uaacugaaagugaguacau

SEQ ID NO: 981377 - RNA, 19 nt, Homo sapiens
ggcagagggaccuuugaua

SEQ ID NO: 981378 - RNA, 19 nt, Homo sapiens
guggaaaucccugaucuga

SEQ ID NO: 981379 - RNA, 19 nt, Homo sapiens
cgucucaucuucccauagu

SEQ ID NO: 981380 - RNA, 19 nt, Homo sapiens
gaguacauauagucuuucu

SEQ ID NO: 981381 - RNA, 19 nt, Homo sapiens
gggaagaaacaaacacaca

SEQ ID NO: 981382 - RNA, 19 nt, Homo sapiens
gaguuugacauuccuauca

SEQ ID NO: 981383 - RNA, 19 nt, Homo sapiens
gacaaucuagagguaauuu

SEQ ID NO: 981384 - RNA, 19 nt, Homo sapiens
caaagagaaaugcaaccaa

SEQ ID NO: 981385 - RNA, 19 nt, Homo sapiens
gugcaucacacuuaacuca

SEQ ID NO: 981386 - RNA, 19 nt, Homo sapiens
gauaacccaucaauaaaag

SEQ ID NO: 981387 - RNA, 19 nt, Homo sapiens
ggacaaucuagagguaauu

SEQ ID NO: 981388 - RNA, 19 nt, Homo sapiens
guacugcuacuuaguuucu

SEQ ID NO: 981389 - RNA, 19 nt, Homo sapiens
uauauaggacggaguaauc

SEQ ID NO: 981390 - RNA, 19 nt, Homo sapiens
acauauagucuuucugguu

SEQ ID NO: 981391 - RNA, 19 nt, Homo sapiens
gcggguaacuaggugacaa

SEQ ID NO: 981392 - RNA, 19 nt, Homo sapiens
acaccaaacaguacugcua

SEQ ID NO: 981393 - RNA, 19 nt, Homo sapiens
cugaaagugaguacauaua

SEQ ID NO: 981394 - RNA, 19 nt, Homo sapiens
ggagcaacaugcgauucug

SEQ ID NO: 981395 - RNA, 19 nt, Homo sapiens
uugauaggcuacgauacua

SEQ ID NO: 981396 - RNA, 19 nt, Homo sapiens
ugagcuggauggaaagaca

SEQ ID NO: 981397 - RNA, 19 nt, Homo sapiens
gaggaauaucagucccuua

SEQ ID NO: 981398 - RNA, 19 nt, Homo sapiens
gacugaaggaggaauauca

SEQ ID NO: 981399 - RNA, 19 nt, Homo sapiens
aaaugcaaccaaugaagaa

SEQ ID NO: 981400 - RNA, 19 nt, Homo sapiens
gauggaaagacagcaaaga

SEQ ID NO: 981401 - RNA, 19 nt, Homo sapiens
ucucaucuucccauaguaa

SEQ ID NO: 981402 - RNA, 19 nt, Homo sapiens
acaagaaugcugacaacga

SEQ ID NO: 981403 - RNA, 19 nt, Homo sapiens
caacccaacgucucaucuu

SEQ ID NO: 981404 - RNA, 19 nt, Homo sapiens
caaacacacaccaaacagu

SEQ ID NO: 981405 - RNA, 19 nt, Homo sapiens
ucacacuuaacucaucuaa

SEQ ID NO: 981406 - RNA, 19 nt, Homo sapiens
ugcaaccaaugaagaauca

SEQ ID NO: 981407 - RNA, 19 nt, Homo sapiens
uaucacauauccuacuacu

SEQ ID NO: 981408 - RNA, 19 nt, Homo sapiens
gacaucgaguuugacauuc

SEQ ID NO: 981409 - RNA, 19 nt, Homo sapiens
aguuugacaucgaguuuga

SEQ ID NO: 981410 - RNA, 19 nt, Homo sapiens
caugaccuccugaaauaug

SEQ ID NO: 981411 - RNA, 19 nt, Homo sapiens
uuuggacaaucuagaggua

SEQ ID NO: 981412 - RNA, 19 nt, Homo sapiens
aaacaaacacacaccaaac

SEQ ID NO: 981413 - RNA, 19 nt, Homo sapiens
ggacacccuccaccucuag

SEQ ID NO: 981414 - RNA, 19 nt, Homo sapiens
caucacacuuaacucaucu

SEQ ID NO: 981415 - RNA, 19 nt, Homo sapiens
ugaguuugacaucgaguuu

SEQ ID NO: 981416 - RNA, 19 nt, Homo sapiens
guggagaacaacaagaaug

SEQ ID NO: 981417 - RNA, 19 nt, Homo sapiens
aggaauaucagucccuuau

SEQ ID NO: 981418 - RNA, 19 nt, Homo sapiens
aaagugaguacauauaguc

SEQ ID NO: 981419 - RNA, 19 nt, Homo sapiens
aacugaaagugaguacaua

SEQ ID NO: 981420 - RNA, 19 nt, Homo sapiens
uggacaaucuagagguaau

SEQ ID NO: 981421 - RNA, 19 nt, Homo sapiens
cggacacccuccaccucua

SEQ ID NO: 981422 - RNA, 19 nt, Homo sapiens
ggaauaucagucccuuauc

SEQ ID NO: 981423 - RNA, 19 nt, Homo sapiens
gggcagagggaccuuugau

SEQ ID NO: 981424 - RNA, 19 nt, Homo sapiens
gggcgucauccaccacaaa

SEQ ID NO: 981425 - RNA, 19 nt, Homo sapiens
caguggaaaucccugaucu

SEQ ID NO: 981426 - RNA, 19 nt, Homo sapiens
gcaguggaaaucccugauc

SEQ ID NO: 981427 - RNA, 19 nt, Homo sapiens
uggaaagacagcaaagaug

SEQ ID NO: 981428 - RNA, 19 nt, Homo sapiens
agaaugcugacaacgauug

SEQ ID NO: 981429 - RNA, 19 nt, Homo sapiens
gguauguggagaacaacaa

SEQ ID NO: 981430 - RNA, 19 nt, Homo sapiens
acaacaagaaugcugacaa

SEQ ID NO: 981431 - RNA, 19 nt, Homo sapiens
cgacaaagaugcugaauua

SEQ ID NO: 981432 - RNA, 19 nt, Homo sapiens
uaacaaagaugccgucauu

SEQ ID NO: 981433 - RNA, 19 nt, Homo sapiens
gaacuuggcagacuuuaua

SEQ ID NO: 981434 - RNA, 19 nt, Homo sapiens
caaagaugcugaauuagug

SEQ ID NO: 981435 - RNA, 19 nt, Homo sapiens
ccagaagguuguuuaguuu

SEQ ID NO: 981436 - RNA, 19 nt, Homo sapiens
gagcgagccuugaaagaga

SEQ ID NO: 981437 - RNA, 19 nt, Homo sapiens
gaaggcagcaucucacauu

SEQ ID NO: 981438 - RNA, 19 nt, Homo sapiens
ggacaaaucugcagaaaag

SEQ ID NO: 981439 - RNA, 19 nt, Homo sapiens
gaagaagccagccuugauu

SEQ ID NO: 981440 - RNA, 19 nt, Homo sapiens
gagcgaagcuggaaaagaa

SEQ ID NO: 981441 - RNA, 19 nt, Homo sapiens
gaagauagcagagucauag

SEQ ID NO: 981442 - RNA, 19 nt, Homo sapiens
aaugagagcucuucuggaa

SEQ ID NO: 981443 - RNA, 19 nt, Homo sapiens
gcagaguuggcacauauua

SEQ ID NO: 981444 - RNA, 19 nt, Homo sapiens
cgaagaagguugagaaggu

SEQ ID NO: 981445 - RNA, 19 nt, Homo sapiens
ggcagcaucucacauuaaa

SEQ ID NO: 981446 - RNA, 19 nt, Homo sapiens
gaacuauuguacucuaagu

SEQ ID NO: 981447 - RNA, 19 nt, Homo sapiens
ucaaguaggccaagugaaa

SEQ ID NO: 981448 - RNA, 19 nt, Homo sapiens
cccagaagguuguuuaguu

SEQ ID NO: 981449 - RNA, 19 nt, Homo sapiens
caaagaugccgucauugaa

SEQ ID NO: 981450 - RNA, 19 nt, Homo sapiens
uggcagacuuuauaacaaa

SEQ ID NO: 981451 - RNA, 19 nt, Homo sapiens
gaccaauaguugccuguga

SEQ ID NO: 981452 - RNA, 19 nt, Homo sapiens
gauagcagagucauaguug

SEQ ID NO: 981453 - RNA, 19 nt, Homo sapiens
caagugaaacugggcuuua

SEQ ID NO: 981454 - RNA, 19 nt, Homo sapiens
ugagugcgcugcugugugu

SEQ ID NO: 981455 - RNA, 19 nt, Homo sapiens
acaaagaugccgucauuga

SEQ ID NO: 981456 - RNA, 19 nt, Homo sapiens
ggaaaucccggaagugaca

SEQ ID NO: 981457 - RNA, 19 nt, Homo sapiens
guccaucgcugacagugaa

SEQ ID NO: 981458 - RNA, 19 nt, Homo sapiens
gaagccagccuugauucua

SEQ ID NO: 981459 - RNA, 19 nt, Homo sapiens
ggauaaaggaaacacuaaa

SEQ ID NO: 981460 - RNA, 19 nt, Homo sapiens
gccuacaagucccucuuua

SEQ ID NO: 981461 - RNA, 19 nt, Homo sapiens
uugagaaggucgacaaaga

SEQ ID NO: 981462 - RNA, 19 nt, Homo sapiens
guaggcaggucgcuuugug

SEQ ID NO: 981463 - RNA, 19 nt, Homo sapiens
gcuguguguucucucuaua

SEQ ID NO: 981464 - RNA, 19 nt, Homo sapiens
gggauaaaggaaacacuaa

SEQ ID NO: 981465 - RNA, 19 nt, Homo sapiens
gauaaaggaaacacuaaag

SEQ ID NO: 981466 - RNA, 19 nt, Homo sapiens
gcugaagcuuucugauaau

SEQ ID NO: 981467 - RNA, 19 nt, Homo sapiens
aagaugccgucauugaauu

SEQ ID NO: 981468 - RNA, 19 nt, Homo sapiens
ccucaccggugcagaguug

SEQ ID NO: 981469 - RNA, 19 nt, Homo sapiens
cuauaguucugugucauaa

SEQ ID NO: 981470 - RNA, 19 nt, Homo sapiens
gagaaggucgacaaagaug

SEQ ID NO: 981471 - RNA, 19 nt, Homo sapiens
ucucaucauuucgaagaua

SEQ ID NO: 981472 - RNA, 19 nt, Homo sapiens
ccagggccaucaaaaguua

SEQ ID NO: 981473 - RNA, 19 nt, Homo sapiens
aaggcagcaucucacauua

SEQ ID NO: 981474 - RNA, 19 nt, Homo sapiens
gaaauauuaagacgaccaa

SEQ ID NO: 981475 - RNA, 19 nt, Homo sapiens
aagugaaacugggcuuuaa

SEQ ID NO: 981476 - RNA, 19 nt, Homo sapiens
gagaugaacggccgacaca

SEQ ID NO: 981477 - RNA, 19 nt, Homo sapiens
uuaagacgaccaauaguug

SEQ ID NO: 981478 - RNA, 19 nt, Homo sapiens
acaaagaugcugaauuagu

SEQ ID NO: 981479 - RNA, 19 nt, Homo sapiens
uguguucucucuauaguuc

SEQ ID NO: 981480 - RNA, 19 nt, Homo sapiens
ugagagcucuucuggaaaa

SEQ ID NO: 981481 - RNA, 19 nt, Homo sapiens
gaaaagaaaccaaagaaac

SEQ ID NO: 981482 - RNA, 19 nt, Homo sapiens
gcaggugcauuugguccuu

SEQ ID NO: 981483 - RNA, 19 nt, Homo sapiens
guuguuuaguuuccacgua

SEQ ID NO: 981484 - RNA, 19 nt, Homo sapiens
ugaagaagccagccuugau

SEQ ID NO: 981485 - RNA, 19 nt, Homo sapiens
gugcugcggcuguguguuu

SEQ ID NO: 981486 - RNA, 19 nt, Homo sapiens
ggaaaagaaaccaaagaaa

SEQ ID NO: 981487 - RNA, 19 nt, Homo sapiens
uaaaggaaacacuaaaggu

SEQ ID NO: 981488 - RNA, 19 nt, Homo sapiens
aaagaugccgucauugaau

SEQ ID NO: 981489 - RNA, 19 nt, Homo sapiens
caucucaucauuucgaaga

SEQ ID NO: 981490 - RNA, 19 nt, Homo sapiens
cgaagauagcagagucaua

SEQ ID NO: 981491 - RNA, 19 nt, Homo sapiens
uuguuggucuagcuaaaua

SEQ ID NO: 981492 - RNA, 19 nt, Homo sapiens
ggagccaggauccuuguug

SEQ ID NO: 981493 - RNA, 19 nt, Homo sapiens
gaguuggcacauauuaauu

SEQ ID NO: 981494 - RNA, 19 nt, Homo sapiens
gauguggacgugcugaaga

SEQ ID NO: 981495 - RNA, 19 nt, Homo sapiens
ucauugaauuucucuugga

SEQ ID NO: 981496 - RNA, 19 nt, Homo sapiens
ucccggaagugacagcuuu

SEQ ID NO: 981497 - RNA, 19 nt, Homo sapiens
caggauccuuguuggucua

SEQ ID NO: 981498 - RNA, 19 nt, Homo sapiens
cagaguuggcacauauuaa

SEQ ID NO: 981499 - RNA, 19 nt, Homo sapiens
gaagcuuucugauaauccu

SEQ ID NO: 981500 - RNA, 19 nt, Homo sapiens
ggccgaagaagguugagaa

SEQ ID NO: 981501 - RNA, 19 nt, Homo sapiens
agaguuggcacauauuaau

SEQ ID NO: 981502 - RNA, 19 nt, Homo sapiens
aagccagccuugauucuag

SEQ ID NO: 981503 - RNA, 19 nt, Homo sapiens
aaccagaugucagugaaga

SEQ ID NO: 981504 - RNA, 19 nt, Homo sapiens
uggaacuauuguacucuaa

SEQ ID NO: 981505 - RNA, 19 nt, Homo sapiens
accaauaguugccugugaa

SEQ ID NO: 981506 - RNA, 19 nt, Homo sapiens
uugaauuucucuuggacaa

SEQ ID NO: 981507 - RNA, 19 nt, Homo sapiens
ugagaaggucgacaaagau

SEQ ID NO: 981508 - RNA, 19 nt, Homo sapiens
uaaaucaaguaggccaagu

SEQ ID NO: 981509 - RNA, 19 nt, Homo sapiens
auaguucugugucauaaag

SEQ ID NO: 981510 - RNA, 19 nt, Homo sapiens
ucuauaguucugugucaua

SEQ ID NO: 981511 - RNA, 19 nt, Homo sapiens
gaagguuguuuaguuucca

SEQ ID NO: 981512 - RNA, 19 nt, Homo sapiens
uacucuaagucaggaaaua

SEQ ID NO: 981513 - RNA, 19 nt, Homo sapiens
ugaauuaguggcccaaugg

SEQ ID NO: 981514 - RNA, 19 nt, Homo sapiens
gauaaaagcggaaguuugc

SEQ ID NO: 981515 - RNA, 19 nt, Homo sapiens
gaauuaguggcccaaugga

SEQ ID NO: 981516 - RNA, 19 nt, Homo sapiens
cgucauugaauuucucuug

SEQ ID NO: 981517 - RNA, 19 nt, Homo sapiens
caaaagcacagcaaugaau

SEQ ID NO: 981518 - RNA, 19 nt, Homo sapiens
gcugagagcgaagcuggaa

SEQ ID NO: 981519 - RNA, 19 nt, Homo sapiens
uggucuagcuaaauacugu

SEQ ID NO: 981520 - RNA, 19 nt, Homo sapiens
uaccagcaauaaaucaagu

SEQ ID NO: 981521 - RNA, 19 nt, Homo sapiens
ggccuacaagucccucuuu

SEQ ID NO: 981522 - RNA, 19 nt, Homo sapiens
gaaggucgacaaagaugcu

SEQ ID NO: 981523 - RNA, 19 nt, Homo sapiens
aaucaaguaggccaaguga

SEQ ID NO: 981524 - RNA, 19 nt, Homo sapiens
guuggccacucuugaugug

SEQ ID NO: 981525 - RNA, 19 nt, Homo sapiens
gcuaccagcaauaaaucaa

SEQ ID NO: 981526 - RNA, 19 nt, Homo sapiens
ucucuauaguucuguguca

SEQ ID NO: 981527 - RNA, 19 nt, Homo sapiens
gcaaugaaugagagcucuu

SEQ ID NO: 981528 - RNA, 19 nt, Homo sapiens
aaagcacagcaaugaauga

SEQ ID NO: 981529 - RNA, 19 nt, Homo sapiens
ggaacuauuguacucuaag

SEQ ID NO: 981530 - RNA, 19 nt, Homo sapiens
aaucggaggccuacaaguc

SEQ ID NO: 981531 - RNA, 19 nt, Homo sapiens
ggaugaagaugauuuagaa

SEQ ID NO: 981532 - RNA, 19 nt, Homo sapiens
gauggaagaugcaaaugaa

SEQ ID NO: 981533 - RNA, 19 nt, Homo sapiens
cagaaagccuugcgaguuu

SEQ ID NO: 981534 - RNA, 19 nt, Homo sapiens
ggaauuaucacuacuguau

SEQ ID NO: 981535 - RNA, 19 nt, Homo sapiens
gaauuuggauugccacaga

SEQ ID NO: 981536 - RNA, 19 nt, Homo sapiens
gaagauuucucgauuggau

SEQ ID NO: 981537 - RNA, 19 nt, Homo sapiens
caaagaauauggucaagca

SEQ ID NO: 981538 - RNA, 19 nt, Homo sapiens
gaacaagucguuacugugu

SEQ ID NO: 981539 - RNA, 19 nt, Homo sapiens
gaagaaggcauacaagcaa

SEQ ID NO: 981540 - RNA, 19 nt, Homo sapiens
ggaauggaauuaucacuac

SEQ ID NO: 981541 - RNA, 19 nt, Homo sapiens
cagaauccauugacaagaa

SEQ ID NO: 981542 - RNA, 19 nt, Homo sapiens
cauaacagauuuagguuuc

SEQ ID NO: 981543 - RNA, 19 nt, Homo sapiens
gcagaaagccuugcgaguu

SEQ ID NO: 981544 - RNA, 19 nt, Homo sapiens
gaagguguucccacugaua

SEQ ID NO: 981545 - RNA, 19 nt, Homo sapiens
cagaagguguucccacuga

SEQ ID NO: 981546 - RNA, 19 nt, Homo sapiens
gaucccugcuucauagauu

SEQ ID NO: 981547 - RNA, 19 nt, Homo sapiens
aaacaaggauggaguucug

SEQ ID NO: 981548 - RNA, 19 nt, Homo sapiens
gagaggguccugcaaagaa

SEQ ID NO: 981549 - RNA, 19 nt, Homo sapiens
uagaggauaugauggaaga

SEQ ID NO: 981550 - RNA, 19 nt, Homo sapiens
gaaacugggaguaaaggaa

SEQ ID NO: 981551 - RNA, 19 nt, Homo sapiens
gagagaggguccugcaaag

SEQ ID NO: 981552 - RNA, 19 nt, Homo sapiens
augcugagcuagugaagua

SEQ ID NO: 981553 - RNA, 19 nt, Homo sapiens
uaucacuacuguaucauga

SEQ ID NO: 981554 - RNA, 19 nt, Homo sapiens
gggacaaucuugcccaaca

SEQ ID NO: 981555 - RNA, 19 nt, Homo sapiens
gguauuauagguugguuaa

SEQ ID NO: 981556 - RNA, 19 nt, Homo sapiens
aguauuacaucuugacuug

SEQ ID NO: 981557 - RNA, 19 nt, Homo sapiens
guuacuguguccauuauug

SEQ ID NO: 981558 - RNA, 19 nt, Homo sapiens
acagaucccugcuucauag

SEQ ID NO: 981559 - RNA, 19 nt, Homo sapiens
gaacaagccaauuauacca

SEQ ID NO: 981560 - RNA, 19 nt, Homo sapiens
gugaacaagucguuacugu

SEQ ID NO: 981561 - RNA, 19 nt, Homo sapiens
ucauagauuugcaucauuc

SEQ ID NO: 981562 - RNA, 19 nt, Homo sapiens
agacaguucuuauuuggau

SEQ ID NO: 981563 - RNA, 19 nt, Homo sapiens
cgaccagauugaggauuua

SEQ ID NO: 981564 - RNA, 19 nt, Homo sapiens
uagcucguaugacuuguuu

SEQ ID NO: 981565 - RNA, 19 nt, Homo sapiens
gaguaaaggaaaugaagaa

SEQ ID NO: 981566 - RNA, 19 nt, Homo sapiens
gagcagaauccauugacaa

SEQ ID NO: 981567 - RNA, 19 nt, Homo sapiens
uaugguucccucaguauua

SEQ ID NO: 981568 - RNA, 19 nt, Homo sapiens
ugaagaugauuuagaagca

SEQ ID NO: 981569 - RNA, 19 nt, Homo sapiens
gcaaaugaaauccaagaag

SEQ ID NO: 981570 - RNA, 19 nt, Homo sapiens
gcuaugaaacugggaguaa

SEQ ID NO: 981571 - RNA, 19 nt, Homo sapiens
agaauauggucaagcagaa

SEQ ID NO: 981572 - RNA, 19 nt, Homo sapiens
ggaagaugcaaaugaaauc

SEQ ID NO: 981573 - RNA, 19 nt, Homo sapiens
ucgaccagauugaggauuu

SEQ ID NO: 981574 - RNA, 19 nt, Homo sapiens
caacauggaacaagccaau

SEQ ID NO: 981575 - RNA, 19 nt, Homo sapiens
gauuuagguuucuuuccuu

SEQ ID NO: 981576 - RNA, 19 nt, Homo sapiens
acauggaacaagccaauua

SEQ ID NO: 981577 - RNA, 19 nt, Homo sapiens
ucgauuggaugcugagcua

SEQ ID NO: 981578 - RNA, 19 nt, Homo sapiens
ggacuaggaaauauuuauc

SEQ ID NO: 981579 - RNA, 19 nt, Homo sapiens
ggaguaaaggaaaugaaga

SEQ ID NO: 981580 - RNA, 19 nt, Homo sapiens
gcccaacagucauucaaca

SEQ ID NO: 981581 - RNA, 19 nt, Homo sapiens
caaauuugccauaacagau

SEQ ID NO: 981582 - RNA, 19 nt, Homo sapiens
gcuagaggauaugauggaa

SEQ ID NO: 981583 - RNA, 19 nt, Homo sapiens
ggauuuacaagaccagcua

SEQ ID NO: 981584 - RNA, 19 nt, Homo sapiens
gauugaggauuuacaagac

SEQ ID NO: 981585 - RNA, 19 nt, Homo sapiens
gugaagaucgaccagauug

SEQ ID NO: 981586 - RNA, 19 nt, Homo sapiens
caguagagcagaauccauu

SEQ ID NO: 981587 - RNA, 19 nt, Homo sapiens
gauaagacaaagaugagau

SEQ ID NO: 981588 - RNA, 19 nt, Homo sapiens
ccugauaaauugauaagac

SEQ ID NO: 981589 - RNA, 19 nt, Homo sapiens
ccaaauuugccauaacaga

SEQ ID NO: 981590 - RNA, 19 nt, Homo sapiens
aaacugggaguaaaggaaa

SEQ ID NO: 981591 - RNA, 19 nt, Homo sapiens
cuaugaaacugggaguaaa

SEQ ID NO: 981592 - RNA, 19 nt, Homo sapiens
gaguucugguggaugaauu

SEQ ID NO: 981593 - RNA, 19 nt, Homo sapiens
aagaccagcuagaggauau

SEQ ID NO: 981594 - RNA, 19 nt, Homo sapiens
gaccacgguugaugcuaug

SEQ ID NO: 981595 - RNA, 19 nt, Homo sapiens
agaccacgguugaugcuau

SEQ ID NO: 981596 - RNA, 19 nt, Homo sapiens
gaauauggucaagcagaaa

SEQ ID NO: 981597 - RNA, 19 nt, Homo sapiens
ugagagaggguccugcaaa

SEQ ID NO: 981598 - RNA, 19 nt, Homo sapiens
gcugagcuagugaaguaua

SEQ ID NO: 981599 - RNA, 19 nt, Homo sapiens
gaagaucgaccagauugag

SEQ ID NO: 981600 - RNA, 19 nt, Homo sapiens
ggacaaucuugcccaacag

SEQ ID NO: 981601 - RNA, 19 nt, Homo sapiens
agaacuggaugaagaugau

SEQ ID NO: 981602 - RNA, 19 nt, Homo sapiens
ggauggaguucugguggau

SEQ ID NO: 981603 - RNA, 19 nt, Homo sapiens
auuauaccauccagucuuu

SEQ ID NO: 981604 - RNA, 19 nt, Homo sapiens
ucacuacuguaucaugagu

SEQ ID NO: 981605 - RNA, 19 nt, Homo sapiens
gaauggaauuaucacuacu

SEQ ID NO: 981606 - RNA, 19 nt, Homo sapiens
gacaaagaugagauuauug

SEQ ID NO: 981607 - RNA, 19 nt, Homo sapiens
ggaaauggaaucuuaaaag

SEQ ID NO: 981608 - RNA, 19 nt, Homo sapiens
gggacuaggaaauauuuau

SEQ ID NO: 981609 - RNA, 19 nt, Homo sapiens
ugauuuagaagcagaguug

SEQ ID NO: 981610 - RNA, 19 nt, Homo sapiens
cacgguugaugcuaugaaa

SEQ ID NO: 981611 - RNA, 19 nt, Homo sapiens
ugacucugcuuccguuucu

SEQ ID NO: 981612 - RNA, 19 nt, Homo sapiens
guaacucuacagucucaaa

SEQ ID NO: 981613 - RNA, 19 nt, Homo sapiens
aaaagucuaugacagugua

SEQ ID NO: 981614 - RNA, 19 nt, Homo sapiens
aaacuaaggaaauggaauc

SEQ ID NO: 981615 - RNA, 19 nt, Homo sapiens
ccauaacagauuuagguuu

SEQ ID NO: 981616 - RNA, 19 nt, Homo sapiens
agaguuggaugcacuaggu

SEQ ID NO: 981617 - RNA, 19 nt, Homo sapiens
ugaagaaggcauacaagca

SEQ ID NO: 981618 - RNA, 19 nt, Homo sapiens
gaaaugaagaaggcauaca

SEQ ID NO: 981619 - RNA, 19 nt, Homo sapiens
cugcuuccguuucugguuu

SEQ ID NO: 981620 - RNA, 19 nt, Homo sapiens
gaggguccugcaaagaaua

SEQ ID NO: 981621 - RNA, 19 nt, Homo sapiens
uggaauggaauuaucacua

SEQ ID NO: 981622 - RNA, 19 nt, Homo sapiens
cacagaucccugcuucaua

SEQ ID NO: 981623 - RNA, 19 nt, Homo sapiens
ugauggaagaugcaaauga

SEQ ID NO: 981624 - RNA, 19 nt, Homo sapiens
acaagcaagugaagaucga

SEQ ID NO: 981625 - RNA, 19 nt, Homo sapiens
aaaugaagaaggcauacaa

SEQ ID NO: 981626 - RNA, 19 nt, Homo sapiens
gguggacaguagagcagaa

SEQ ID NO: 981627 - RNA, 19 nt, Homo sapiens
acaaagaugagauuauugg

SEQ ID NO: 981628 - RNA, 19 nt, Homo sapiens
guagagcagaauccauuga

SEQ ID NO: 981629 - RNA, 19 nt, Homo sapiens
gaggauaugauggaagaug

SEQ ID NO: 981630 - RNA, 19 nt, Homo sapiens
caagaccagcuagaggaua

SEQ ID NO: 981631 - RNA, 19 nt, Homo sapiens
caaagaagcucacuuacug

SEQ ID NO: 981632 - RNA, 19 nt, Homo sapiens
guacaaagaagcucacuua

SEQ ID NO: 981633 - RNA, 19 nt, Homo sapiens
gaacagcccuaaagugguu

SEQ ID NO: 981634 - RNA, 19 nt, Homo sapiens
caagaacucugcaaugaga

SEQ ID NO: 981635 - RNA, 19 nt, Homo sapiens
gaacauggaugacccuaag

SEQ ID NO: 981636 - RNA, 19 nt, Homo sapiens
gggcaaagcuaaaucaagu

SEQ ID NO: 981637 - RNA, 19 nt, Homo sapiens
cgagauuccugucuaaauu

SEQ ID NO: 981638 - RNA, 19 nt, Homo sapiens
ugacuucgaucuuucauug

SEQ ID NO: 981639 - RNA, 19 nt, Homo sapiens
gacaaacacuccagacaug

SEQ ID NO: 981640 - RNA, 19 nt, Homo sapiens
caagugaauuugcaaguau

SEQ ID NO: 981641 - RNA, 19 nt, Homo sapiens
gcacucugcucaugcuuug

SEQ ID NO: 981642 - RNA, 19 nt, Homo sapiens
gaauaagacuagaaguauc

SEQ ID NO: 981643 - RNA, 19 nt, Homo sapiens
gugagaaccugucuuggaa

SEQ ID NO: 981644 - RNA, 19 nt, Homo sapiens
gaaagaacagcccuaaagu

SEQ ID NO: 981645 - RNA, 19 nt, Homo sapiens
ucaagugaauuugcaagua

SEQ ID NO: 981646 - RNA, 19 nt, Homo sapiens
ugaagaagacccuguuaaa

SEQ ID NO: 981647 - RNA, 19 nt, Homo sapiens
ggccugagcucaaggagau

SEQ ID NO: 981648 - RNA, 19 nt, Homo sapiens
agaaguagcucgggaggaa

SEQ ID NO: 981649 - RNA, 19 nt, Homo sapiens
cgcaagaacucugcaauga

SEQ ID NO: 981650 - RNA, 19 nt, Homo sapiens
ccagcaaucucgcaaggaa

SEQ ID NO: 981651 - RNA, 19 nt, Homo sapiens
ucucugggcuggaauguga

SEQ ID NO: 981652 - RNA, 19 nt, Homo sapiens
gcagugggcugugauugug

SEQ ID NO: 981653 - RNA, 19 nt, Homo sapiens
gaggaaagcgauucuacuu

SEQ ID NO: 981654 - RNA, 19 nt, Homo sapiens
gaaagagauuccagcuagu

SEQ ID NO: 981655 - RNA, 19 nt, Homo sapiens
caagggagagcaacagaaa

SEQ ID NO: 981656 - RNA, 19 nt, Homo sapiens
gcaaagcuaaaucaaguga

SEQ ID NO: 981657 - RNA, 19 nt, Homo sapiens
uagugaggcucuucuugua

SEQ ID NO: 981658 - RNA, 19 nt, Homo sapiens
aaaugaagaugaugaaguc

SEQ ID NO: 981659 - RNA, 19 nt, Homo sapiens
cggagaagcccaagaaaga

SEQ ID NO: 981660 - RNA, 19 nt, Homo sapiens
ugaucgaccucaugacaaa

SEQ ID NO: 981661 - RNA, 19 nt, Homo sapiens
aaugagaacugaaccaaca

SEQ ID NO: 981662 - RNA, 19 nt, Homo sapiens
aaacuccugucccuacaaa

SEQ ID NO: 981663 - RNA, 19 nt, Homo sapiens
gaccugagcuccccucuga

SEQ ID NO: 981664 - RNA, 19 nt, Homo sapiens
gaucuuucauugucuucuu

SEQ ID NO: 981665 - RNA, 19 nt, Homo sapiens
ugaaagaacagcccuaaag

SEQ ID NO: 981666 - RNA, 19 nt, Homo sapiens
cuuacuggcuuuacacauu

SEQ ID NO: 981667 - RNA, 19 nt, Homo sapiens
acacguggcuguaggaucu

SEQ ID NO: 981668 - RNA, 19 nt, Homo sapiens
gaggugggcggauuacuug

SEQ ID NO: 981669 - RNA, 19 nt, Homo sapiens
gugaggcucuucuuguaga

SEQ ID NO: 981670 - RNA, 19 nt, Homo sapiens
ccggacagcucaacaccaa

SEQ ID NO: 981671 - RNA, 19 nt, Homo sapiens
gaagaagacccuguuaaaa

SEQ ID NO: 981672 - RNA, 19 nt, Homo sapiens
caaaaguacugccacagaa

SEQ ID NO: 981673 - RNA, 19 nt, Homo sapiens
gcaaugagaacugaaccaa

SEQ ID NO: 981674 - RNA, 19 nt, Homo sapiens
caaaugaagaugaugaagu

SEQ ID NO: 981675 - RNA, 19 nt, Homo sapiens
gaggauggccugagcucaa

SEQ ID NO: 981676 - RNA, 19 nt, Homo sapiens
ccugggaaauauagugaaa

SEQ ID NO: 981677 - RNA, 19 nt, Homo sapiens
gagaagcccaagaaagaga

SEQ ID NO: 981678 - RNA, 19 nt, Homo sapiens
gccagggcguggaaagauu

SEQ ID NO: 981679 - RNA, 19 nt, Homo sapiens
ccaagcgggucgauguuuc

SEQ ID NO: 981680 - RNA, 19 nt, Homo sapiens
uuacuggcuuuacacauug

SEQ ID NO: 981681 - RNA, 19 nt, Homo sapiens
ggaugacccuaagaaggaa

SEQ ID NO: 981682 - RNA, 19 nt, Homo sapiens
gggcguggaaagauucaua

SEQ ID NO: 981683 - RNA, 19 nt, Homo sapiens
cggcgagauuccugucuaa

SEQ ID NO: 981684 - RNA, 19 nt, Homo sapiens
gcugaagaagacccuguua

SEQ ID NO: 981685 - RNA, 19 nt, Homo sapiens
gagaaccugucuuggaaaa

SEQ ID NO: 981686 - RNA, 19 nt, Homo sapiens
caaacacuccagacaugaa

SEQ ID NO: 981687 - RNA, 19 nt, Homo sapiens
ggacagcucaacaccaaag

SEQ ID NO: 981688 - RNA, 19 nt, Homo sapiens
ucguggagguguacaaaga

SEQ ID NO: 981689 - RNA, 19 nt, Homo sapiens
gagugcaaaugaagaugau

SEQ ID NO: 981690 - RNA, 19 nt, Homo sapiens
ucugaaagcaggccucuga

SEQ ID NO: 981691 - RNA, 19 nt, Homo sapiens
gcgagauuccugucuaaau

SEQ ID NO: 981692 - RNA, 19 nt, Homo sapiens
gagauuccugucuaaauuc

SEQ ID NO: 981693 - RNA, 19 nt, Homo sapiens
gcaacagaaagacagauuc

SEQ ID NO: 981694 - RNA, 19 nt, Homo sapiens
gcaagaacucugcaaugag

SEQ ID NO: 981695 - RNA, 19 nt, Homo sapiens
gcucaacaccaaagcuuuc

SEQ ID NO: 981696 - RNA, 19 nt, Homo sapiens
gugcaaaugaagaugauga

SEQ ID NO: 981697 - RNA, 19 nt, Homo sapiens
gccauucucugggcuggaa

SEQ ID NO: 981698 - RNA, 19 nt, Homo sapiens
aaagaacagcccuaaagug

SEQ ID NO: 981699 - RNA, 19 nt, Homo sapiens
gcccugaggcugacaagga

SEQ ID NO: 981700 - RNA, 19 nt, Homo sapiens
agaaguucguggaggugua

SEQ ID NO: 981701 - RNA, 19 nt, Homo sapiens
cucagucacucuaaaugaa

SEQ ID NO: 981702 - RNA, 19 nt, Homo sapiens
acaaggagaacguggauuc

SEQ ID NO: 981703 - RNA, 19 nt, Homo sapiens
ugacaaacacuccagacau

SEQ ID NO: 981704 - RNA, 19 nt, Homo sapiens
cgauucuacuuucuccaaa

SEQ ID NO: 981705 - RNA, 19 nt, Homo sapiens
ggagagcaacagaaagaca

SEQ ID NO: 981706 - RNA, 19 nt, Homo sapiens
uggaugacccuaagaagga

SEQ ID NO: 981707 - RNA, 19 nt, Homo sapiens
cagcaagucaggcagaaug

SEQ ID NO: 981708 - RNA, 19 nt, Homo sapiens
gaaugugaagccucaguca

SEQ ID NO: 981709 - RNA, 19 nt, Homo sapiens
gguagugcaugccuguagu

SEQ ID NO: 981710 - RNA, 19 nt, Homo sapiens
gaaacuccugucccuacaa

SEQ ID NO: 981711 - RNA, 19 nt, Homo sapiens
uaacuuuucuccagaggaa

SEQ ID NO: 981712 - RNA, 19 nt, Homo sapiens
gcagugggcaaagcuaaau

SEQ ID NO: 981713 - RNA, 19 nt, Homo sapiens
gaaccaggcagcccaagcu

SEQ ID NO: 981714 - RNA, 19 nt, Homo sapiens
ccucagucacucuaaauga

SEQ ID NO: 981715 - RNA, 19 nt, Homo sapiens
gcuguaggaucugaaagca

SEQ ID NO: 981716 - RNA, 19 nt, Homo sapiens
caguugcgcuuggucagaa

SEQ ID NO: 981717 - RNA, 19 nt, Homo sapiens
cgagugcaaaugaagauga

SEQ ID NO: 981718 - RNA, 19 nt, Homo sapiens
ugaaacuccugucccuaca

SEQ ID NO: 981719 - RNA, 19 nt, Homo sapiens
acacuccagacaugaauaa

SEQ ID NO: 981720 - RNA, 19 nt, Homo sapiens
ucauugaccuuccucucau

SEQ ID NO: 981721 - RNA, 19 nt, Homo sapiens
gcgauucuacuuucuccaa

SEQ ID NO: 981722 - RNA, 19 nt, Homo sapiens
ugucaaacaucagcaaguc

SEQ ID NO: 981723 - RNA, 19 nt, Homo sapiens
ggcgaucccuguuccaaac

SEQ ID NO: 981724 - RNA, 19 nt, Homo sapiens
gaaagaaaaggaaaugaag

SEQ ID NO: 981725 - RNA, 19 nt, Homo sapiens
aaucccagcugagaaggaa

SEQ ID NO: 981726 - RNA, 19 nt, Homo sapiens
gguuaugccuacuccuaca

SEQ ID NO: 981727 - RNA, 19 nt, Homo sapiens
cagcagugggcaaagcuaa

SEQ ID NO: 981728 - RNA, 19 nt, Homo sapiens
aaauuagccggguguggua

SEQ ID NO: 981729 - RNA, 19 nt, Homo sapiens
acaaagaagcucacuuacu

SEQ ID NO: 981730 - RNA, 19 nt, Homo sapiens
uaaauuccaagacaaaggu

SEQ ID NO: 981731 - RNA, 19 nt, Homo sapiens
gaauagaguucaaggacaa

SEQ ID NO: 981732 - RNA, 19 nt, Homo sapiens
gccaagaucuuccgaguug

SEQ ID NO: 981733 - RNA, 19 nt, Homo sapiens
gggcaggagugucaucuuu

SEQ ID NO: 981734 - RNA, 19 nt, Homo sapiens
gaacaugaccuacgagaag

SEQ ID NO: 981735 - RNA, 19 nt, Homo sapiens
gauaugagcccuacaucaa

SEQ ID NO: 981736 - RNA, 19 nt, Homo sapiens
gaugugaagcucaaauuaa

SEQ ID NO: 981737 - RNA, 19 nt, Homo sapiens
gagggagaauuggcuauuu

SEQ ID NO: 981738 - RNA, 19 nt, Homo sapiens
gaaugaagucccucacuga

SEQ ID NO: 981739 - RNA, 19 nt, Homo sapiens
caaaugggcucgccagacu

SEQ ID NO: 981740 - RNA, 19 nt, Homo sapiens
gcugugggauuacguguau

SEQ ID NO: 981741 - RNA, 19 nt, Homo sapiens
gagcacggguucgagauga

SEQ ID NO: 981742 - RNA, 19 nt, Homo sapiens
gaaacuccuguucagauuu

SEQ ID NO: 981743 - RNA, 19 nt, Homo sapiens
agaaacuccuguucagauu

SEQ ID NO: 981744 - RNA, 19 nt, Homo sapiens
uguaucagcugcuccuuga

SEQ ID NO: 981745 - RNA, 19 nt, Homo sapiens
ggacaagaggccagaaauc

SEQ ID NO: 981746 - RNA, 19 nt, Homo sapiens
gcccugcgccacuauuaua

SEQ ID NO: 981747 - RNA, 19 nt, Homo sapiens
gaccgagucucccaugaag

SEQ ID NO: 981748 - RNA, 19 nt, Homo sapiens
ggaccgagucucccaugaa

SEQ ID NO: 981749 - RNA, 19 nt, Homo sapiens
aaacuccuguucagauuuc

SEQ ID NO: 981750 - RNA, 19 nt, Homo sapiens
ccacaggauuacagccauu

SEQ ID NO: 981751 - RNA, 19 nt, Homo sapiens
gacagccucaguaacaaua

SEQ ID NO: 981752 - RNA, 19 nt, Homo sapiens
gagcaggacagaauagagu

SEQ ID NO: 981753 - RNA, 19 nt, Homo sapiens
guucagauuucuaaagacu

SEQ ID NO: 981754 - RNA, 19 nt, Homo sapiens
gggcagaaacuccuguuca

SEQ ID NO: 981755 - RNA, 19 nt, Homo sapiens
gcagaaacuccuguucaga

SEQ ID NO: 981756 - RNA, 19 nt, Homo sapiens
gggcagagcaggaguacuc

SEQ ID NO: 981757 - RNA, 19 nt, Homo sapiens
gcaggagugucaucuuuug

SEQ ID NO: 981758 - RNA, 19 nt, Homo sapiens
gacaagaggccagaaaucu

SEQ ID NO: 981759 - RNA, 19 nt, Homo sapiens
cagaaacuccuguucagau

SEQ ID NO: 981760 - RNA, 19 nt, Homo sapiens
gcgccacuauuauaagcuu

SEQ ID NO: 981761 - RNA, 19 nt, Homo sapiens
ggagggagaauuggcuauu

SEQ ID NO: 981762 - RNA, 19 nt, Homo sapiens
cagccucaguaacaauaaa

SEQ ID NO: 981763 - RNA, 19 nt, Homo sapiens
caacuucggccaccuggau

SEQ ID NO: 981764 - RNA, 19 nt, Homo sapiens
ggcagaaacuccuguucag

SEQ ID NO: 981765 - RNA, 19 nt, Homo sapiens
agaugugaagcucaaauua

SEQ ID NO: 981766 - RNA, 19 nt, Homo sapiens
gggugaacaugaccuacga

SEQ ID NO: 981767 - RNA, 19 nt, Homo sapiens
gaagccaggcaccgauaga

SEQ ID NO: 981768 - RNA, 19 nt, Homo sapiens
ccaggagcaggacagaaua

SEQ ID NO: 981769 - RNA, 19 nt, Homo sapiens
gccaggagcaggacagaau

SEQ ID NO: 981770 - RNA, 19 nt, Homo sapiens
ggggagcgcucaagacaga

SEQ ID NO: 981771 - RNA, 19 nt, Homo sapiens
aggagucccucaacuuaug

SEQ ID NO: 981772 - RNA, 19 nt, Homo sapiens
uaaagacuccgggaaagau

SEQ ID NO: 981773 - RNA, 19 nt, Homo sapiens
cuguucagauuucuaaaga

SEQ ID NO: 981774 - RNA, 19 nt, Homo sapiens
gaauuggcuauuucuccua

SEQ ID NO: 981775 - RNA, 19 nt, Homo sapiens
aauggaauuuaccagauga

SEQ ID NO: 981776 - RNA, 19 nt, Homo sapiens
uaugagcccuacaucaagu

SEQ ID NO: 981777 - RNA, 19 nt, Homo sapiens
gcuccuugauacccgauau

SEQ ID NO: 981778 - RNA, 19 nt, Homo sapiens
ccaccagacccagggcuua

SEQ ID NO: 981779 - RNA, 19 nt, Homo sapiens
cagaugugaagcucaaauu

SEQ ID NO: 981780 - RNA, 19 nt, Homo sapiens
aaacaaugguagcugaaaa

SEQ ID NO: 981781 - RNA, 19 nt, Homo sapiens
uuggcuauuucuccuauaa

SEQ ID NO: 981782 - RNA, 19 nt, Homo sapiens
ggacagaauagaguucaag

SEQ ID NO: 981783 - RNA, 19 nt, Homo sapiens
agacaaggacgccaagauc

SEQ ID NO: 981784 - RNA, 19 nt, Homo sapiens
acccagggcuuaccagcaa

SEQ ID NO: 981785 - RNA, 19 nt, Homo sapiens
ccugguguguggacccuuu

SEQ ID NO: 981786 - RNA, 19 nt, Homo sapiens
ggagcgcucaagacagaaa

SEQ ID NO: 981787 - RNA, 19 nt, Homo sapiens
caaggacgccaagaucuuc

SEQ ID NO: 981788 - RNA, 19 nt, Homo sapiens
ccacgcgaccuuccaguuc

SEQ ID NO: 981789 - RNA, 19 nt, Homo sapiens
caagaucuuccgaguugug

SEQ ID NO: 981790 - RNA, 19 nt, Homo sapiens
cuaaagacuccgggaaaga

SEQ ID NO: 981791 - RNA, 19 nt, Homo sapiens
gacaaggacgccaagaucu

SEQ ID NO: 981792 - RNA, 19 nt, Homo sapiens
agggagaauuggcuauuuc

SEQ ID NO: 981793 - RNA, 19 nt, Homo sapiens
gugcccugcgccacuauua

SEQ ID NO: 981794 - RNA, 19 nt, Homo sapiens
ucuaaagacuccgggaaag

SEQ ID NO: 981795 - RNA, 19 nt, Homo sapiens
acaagaaccgggugaacau

SEQ ID NO: 981796 - RNA, 19 nt, Homo sapiens
acaaggacgccaagaucuu

SEQ ID NO: 981797 - RNA, 19 nt, Homo sapiens
gaagacaaggacgccaaga

SEQ ID NO: 981798 - RNA, 19 nt, Homo sapiens
cgauaugagcccuacauca

SEQ ID NO: 981799 - RNA, 19 nt, Homo sapiens
ggagcacggguucgagaug

SEQ ID NO: 981800 - RNA, 19 nt, Homo sapiens
gcaggacagaauagaguuc

SEQ ID NO: 981801 - RNA, 19 nt, Homo sapiens
aacaugaccuacgagaaga

SEQ ID NO: 981802 - RNA, 19 nt, Homo sapiens
gccgccugcugugggauua

SEQ ID NO: 981803 - RNA, 19 nt, Homo sapiens
gaucuuccgaguuguggau

SEQ ID NO: 981804 - RNA, 19 nt, Homo sapiens
cagaugaagggaaugaagu

SEQ ID NO: 981805 - RNA, 19 nt, Homo sapiens
ggaagccaggcaccgauag

SEQ ID NO: 981806 - RNA, 19 nt, Homo sapiens
uuccucaccuccaccugua

SEQ ID NO: 981807 - RNA, 19 nt, Homo sapiens
gccacuauuauaagcuuaa

SEQ ID NO: 981808 - RNA, 19 nt, Homo sapiens
aauuggcuauuucuccuau

SEQ ID NO: 981809 - RNA, 19 nt, Homo sapiens
ugaacaugaccuacgagaa

SEQ ID NO: 981810 - RNA, 19 nt, Homo sapiens
aagaaccgggugaacauga

SEQ ID NO: 981811 - RNA, 19 nt, Homo sapiens
cacaagaaccgggugaaca

SEQ ID NO: 981812 - RNA, 19 nt, Homo sapiens
ucaagugggaagacaagga

SEQ ID NO: 981813 - RNA, 19 nt, Homo sapiens
ggagcaggacagaauagag

SEQ ID NO: 981814 - RNA, 19 nt, Homo sapiens
caagaaccgggugaacaug

SEQ ID NO: 981815 - RNA, 19 nt, Homo sapiens
gugcaagccagaugugaag

SEQ ID NO: 981816 - RNA, 19 nt, Homo sapiens
agccagaugugaagcucaa

SEQ ID NO: 981817 - RNA, 19 nt, Homo sapiens
gaauauagcucuuaacuga

SEQ ID NO: 981818 - RNA, 19 nt, Homo sapiens
gggaagauguuauuuauga

SEQ ID NO: 981819 - RNA, 19 nt, Homo sapiens
gcacauacuuccauagaaa

SEQ ID NO: 981820 - RNA, 19 nt, Homo sapiens
gagcugauccugaauaaua

SEQ ID NO: 981821 - RNA, 19 nt, Homo sapiens
aaauauaucucccguauga

SEQ ID NO: 981822 - RNA, 19 nt, Homo sapiens
uaacaugucucacuuggaa

SEQ ID NO: 981823 - RNA, 19 nt, Homo sapiens
ugaugaagcugccuacaua

SEQ ID NO: 981824 - RNA, 19 nt, Homo sapiens
gaagaaggcuuuguucgau

SEQ ID NO: 981825 - RNA, 19 nt, Homo sapiens
gaggaugaaugcuguguuu

SEQ ID NO: 981826 - RNA, 19 nt, Homo sapiens
gaaauugcauggaucaagu

SEQ ID NO: 981827 - RNA, 19 nt, Homo sapiens
gcucagauaaguacauuua

SEQ ID NO: 981828 - RNA, 19 nt, Homo sapiens
gucaagaccuggccuagua

SEQ ID NO: 981829 - RNA, 19 nt, Homo sapiens
ggucaacuguaaugagaua

SEQ ID NO: 981830 - RNA, 19 nt, Homo sapiens
ucaaauauaucucccguau

SEQ ID NO: 981831 - RNA, 19 nt, Homo sapiens
gcaauagccuuuuaguaua

SEQ ID NO: 981832 - RNA, 19 nt, Homo sapiens
caacugaaauugcauggau

SEQ ID NO: 981833 - RNA, 19 nt, Homo sapiens
gaugaaugcuguguuuaaa

SEQ ID NO: 981834 - RNA, 19 nt, Homo sapiens
gaagagauggcaacauuau

SEQ ID NO: 981835 - RNA, 19 nt, Homo sapiens
ucagugaucuugaaccauu

SEQ ID NO: 981836 - RNA, 19 nt, Homo sapiens
cuauaacucuggucuuuaa

SEQ ID NO: 981837 - RNA, 19 nt, Homo sapiens
agaagggucugaaauggua

SEQ ID NO: 981838 - RNA, 19 nt, Homo sapiens
gaacuuggaggcauuucua

SEQ ID NO: 981839 - RNA, 19 nt, Homo sapiens
gcacagacgauaacaucua

SEQ ID NO: 981840 - RNA, 19 nt, Homo sapiens
gcaagugaaucaaaucagu

SEQ ID NO: 981841 - RNA, 19 nt, Homo sapiens
uggaagagauggcaacauu

SEQ ID NO: 981842 - RNA, 19 nt, Homo sapiens
gaaauuauaccgagucuac

SEQ ID NO: 981843 - RNA, 19 nt, Homo sapiens
ccagaaacauaaaucuuga

SEQ ID NO: 981844 - RNA, 19 nt, Homo sapiens
gaaacuaggagaacaacaa

SEQ ID NO: 981845 - RNA, 19 nt, Homo sapiens
ccuccaacauguauaauuu

SEQ ID NO: 981846 - RNA, 19 nt, Homo sapiens
ugccaaaggucaacuguaa

SEQ ID NO: 981847 - RNA, 19 nt, Homo sapiens
gggauuuacguaagaauua

SEQ ID NO: 981848 - RNA, 19 nt, Homo sapiens
gaacauguacuagcaguug

SEQ ID NO: 981849 - RNA, 19 nt, Homo sapiens
aaaggaagccauagaauug

SEQ ID NO: 981850 - RNA, 19 nt, Homo sapiens
gaucaaguaagcauaguuu

SEQ ID NO: 981851 - RNA, 19 nt, Homo sapiens
gaauucaggugcagucauc

SEQ ID NO: 981852 - RNA, 19 nt, Homo sapiens
gaaauccucugcugaagac

SEQ ID NO: 981853 - RNA, 19 nt, Homo sapiens
ggaugaaugcuguguuuaa

SEQ ID NO: 981854 - RNA, 19 nt, Homo sapiens
gguauaacaugucucacuu

SEQ ID NO: 981855 - RNA, 19 nt, Homo sapiens
ggaagagauggcaacauua

SEQ ID NO: 981856 - RNA, 19 nt, Homo sapiens
ucacuggaaugccgucuuu

SEQ ID NO: 981857 - RNA, 19 nt, Homo sapiens
acuccuacguucucuauua

SEQ ID NO: 981858 - RNA, 19 nt, Homo sapiens
gcgcuugaauagaggcuua

SEQ ID NO: 981859 - RNA, 19 nt, Homo sapiens
ucaguucuguguagacuuu

SEQ ID NO: 981860 - RNA, 19 nt, Homo sapiens
ggagaagggucugaaaugg

SEQ ID NO: 981861 - RNA, 19 nt, Homo sapiens
ggauguaccuucucuucug

SEQ ID NO: 981862 - RNA, 19 nt, Homo sapiens
gaaaccaggaggugauaaa

SEQ ID NO: 981863 - RNA, 19 nt, Homo sapiens
ugauaaaugucaacucuuc

SEQ ID NO: 981864 - RNA, 19 nt, Homo sapiens
ugaggacuguguagacuuu

SEQ ID NO: 981865 - RNA, 19 nt, Homo sapiens
ugccuaaucugcuuauauu

SEQ ID NO: 981866 - RNA, 19 nt, Homo sapiens
aaugcagucucuugaguua

SEQ ID NO: 981867 - RNA, 19 nt, Homo sapiens
gaacgcuaccucuuccuuu

SEQ ID NO: 981868 - RNA, 19 nt, Homo sapiens
gaagcugccuacauaugga

SEQ ID NO: 981869 - RNA, 19 nt, Homo sapiens
gaauuauacugcuuaucga

SEQ ID NO: 981870 - RNA, 19 nt, Homo sapiens
uagaauugcucuggucaaa

SEQ ID NO: 981871 - RNA, 19 nt, Homo sapiens
caauauggaacauguacua

SEQ ID NO: 981872 - RNA, 19 nt, Homo sapiens
gguuaucagugcaguggua

SEQ ID NO: 981873 - RNA, 19 nt, Homo sapiens
uuaaagcuguaacaacuga

SEQ ID NO: 981874 - RNA, 19 nt, Homo sapiens
aaauguaccuaaucugguu

SEQ ID NO: 981875 - RNA, 19 nt, Homo sapiens
gcugaaauguaccuaaucu

SEQ ID NO: 981876 - RNA, 19 nt, Homo sapiens
ccgaacaccuuccucauca

SEQ ID NO: 981877 - RNA, 19 nt, Homo sapiens
ccagaguacuccugccaaa

SEQ ID NO: 981878 - RNA, 19 nt, Homo sapiens
caccauagccuuaacugaa

SEQ ID NO: 981879 - RNA, 19 nt, Homo sapiens
gacugacucuaaguuaaua

SEQ ID NO: 981880 - RNA, 19 nt, Homo sapiens
ugugaaggcugacugagaa

SEQ ID NO: 981881 - RNA, 19 nt, Homo sapiens
gaauccaucuccacgaagu

SEQ ID NO: 981882 - RNA, 19 nt, Homo sapiens
ugaacacucaacagaauua

SEQ ID NO: 981883 - RNA, 19 nt, Homo sapiens
caagcugucuggagagugu

SEQ ID NO: 981884 - RNA, 19 nt, Homo sapiens
ccaagccaccuucaucuuu

SEQ ID NO: 981885 - RNA, 19 nt, Homo sapiens
gcucuacuuuauuugcuaa

SEQ ID NO: 981886 - RNA, 19 nt, Homo sapiens
uaacacagaaucacaaagu

SEQ ID NO: 981887 - RNA, 19 nt, Homo sapiens
ccauagccuuaacugaaua

SEQ ID NO: 981888 - RNA, 19 nt, Homo sapiens
gagaauaguuccccagaga

SEQ ID NO: 981889 - RNA, 19 nt, Homo sapiens
gagccuccgucuccuauca

SEQ ID NO: 981890 - RNA, 19 nt, Homo sapiens
caagccaccuucaucuuuc

SEQ ID NO: 981891 - RNA, 19 nt, Homo sapiens
ugaacacacuucuuaugga

SEQ ID NO: 981892 - RNA, 19 nt, Homo sapiens
ugaccaauaucugccagua

SEQ ID NO: 981893 - RNA, 19 nt, Homo sapiens
gcuuauauuugguguuugu

SEQ ID NO: 981894 - RNA, 19 nt, Homo sapiens
gaaaaucuauucugacaac

SEQ ID NO: 981895 - RNA, 19 nt, Homo sapiens
ccaucugacuucacaaaga

SEQ ID NO: 981896 - RNA, 19 nt, Homo sapiens
gucaguggcucaagugaug

SEQ ID NO: 981897 - RNA, 19 nt, Homo sapiens
gaaacagaauucaaaagga

SEQ ID NO: 981898 - RNA, 19 nt, Homo sapiens
ccaagaagaaacagaauuc

SEQ ID NO: 981899 - RNA, 19 nt, Homo sapiens
gaugaacacacuucuuaug

SEQ ID NO: 981900 - RNA, 19 nt, Homo sapiens
uuaaaugggugccaaaggu

SEQ ID NO: 981901 - RNA, 19 nt, Homo sapiens
aaacaucccuccccuuauu

SEQ ID NO: 981902 - RNA, 19 nt, Homo sapiens
ugagaaauccucugcugaa

SEQ ID NO: 981903 - RNA, 19 nt, Homo sapiens
ccugaacacucaacagaau

SEQ ID NO: 981904 - RNA, 19 nt, Homo sapiens
gaacuuaaacuuguuacag

SEQ ID NO: 981905 - RNA, 19 nt, Homo sapiens
gaaacaggagucccaguuc

SEQ ID NO: 981906 - RNA, 19 nt, Homo sapiens
cagagaguguauagacuga

SEQ ID NO: 981907 - RNA, 19 nt, Homo sapiens
agaggaagauguuuuauga

SEQ ID NO: 981908 - RNA, 19 nt, Homo sapiens
ggagaaacuaggagaacaa

SEQ ID NO: 981909 - RNA, 19 nt, Homo sapiens
ggaggcauuucuacgacuu

SEQ ID NO: 981910 - RNA, 19 nt, Homo sapiens
gaugggauaaucaaaguau

SEQ ID NO: 981911 - RNA, 19 nt, Homo sapiens
ccaaaggucaacuguaaug

SEQ ID NO: 981912 - RNA, 19 nt, Homo sapiens
uaucucacuugcuuugaaa

SEQ ID NO: 981913 - RNA, 19 nt, Homo sapiens
caagcacaccauagccuua

SEQ ID NO: 981914 - RNA, 19 nt, Homo sapiens
ugucaacucuucggagaaa

SEQ ID NO: 981915 - RNA, 19 nt, Homo sapiens
ccucuucaaucccuucuga

SEQ ID NO: 981916 - RNA, 19 nt, Homo sapiens
guaugggauuuacguaaga

SEQ ID NO: 981917 - RNA, 19 nt, Homo sapiens
gaaacgaguucgagucugu

SEQ ID NO: 981918 - RNA, 19 nt, Homo sapiens
uagaggagcugcugcauau

SEQ ID NO: 981919 - RNA, 19 nt, Homo sapiens
gcacugagaaagccaauga

SEQ ID NO: 981920 - RNA, 19 nt, Homo sapiens
gcacaucgcagaccuguca

SEQ ID NO: 981921 - RNA, 19 nt, Homo sapiens
gaagaaguggcaacuggua

SEQ ID NO: 981922 - RNA, 19 nt, Homo sapiens
gaaagccaaugaccgaauc

SEQ ID NO: 981923 - RNA, 19 nt, Homo sapiens
ggccacagcugccaucuuc

SEQ ID NO: 981924 - RNA, 19 nt, Homo sapiens
gcaguugggcacuauauga

SEQ ID NO: 981925 - RNA, 19 nt, Homo sapiens
ccaaugaccgaaucucuuu

SEQ ID NO: 981926 - RNA, 19 nt, Homo sapiens
cgagagaugugcaaggaau

SEQ ID NO: 981927 - RNA, 19 nt, Homo sapiens
gagacaagcugcgcaugga

SEQ ID NO: 981928 - RNA, 19 nt, Homo sapiens
gugcgcaucuucaaacaug

SEQ ID NO: 981929 - RNA, 19 nt, Homo sapiens
cgagggacaugcagacaga

SEQ ID NO: 981930 - RNA, 19 nt, Homo sapiens
cccaccagcucuauucuuu

SEQ ID NO: 981931 - RNA, 19 nt, Homo sapiens
ccagauggaccgcaugauu

SEQ ID NO: 981932 - RNA, 19 nt, Homo sapiens
cagcacagccuacccaguu

SEQ ID NO: 981933 - RNA, 19 nt, Homo sapiens
gcaaacacgccaaugucaa

SEQ ID NO: 981934 - RNA, 19 nt, Homo sapiens
gcucuccuuuggaaauaaa

SEQ ID NO: 981935 - RNA, 19 nt, Homo sapiens
caucgaggcuguacacaac

SEQ ID NO: 981936 - RNA, 19 nt, Homo sapiens
ugccuuagcuuugcaguga

SEQ ID NO: 981937 - RNA, 19 nt, Homo sapiens
ccacagcugccaucuucua

SEQ ID NO: 981938 - RNA, 19 nt, Homo sapiens
gaggagcugcugcauauuc

SEQ ID NO: 981939 - RNA, 19 nt, Homo sapiens
uagcucuccuuuggaaaua

SEQ ID NO: 981940 - RNA, 19 nt, Homo sapiens
gcaaguacagccuggaaca

SEQ ID NO: 981941 - RNA, 19 nt, Homo sapiens
gagcaaacacgccaauguc

SEQ ID NO: 981942 - RNA, 19 nt, Homo sapiens
gcacgccuuucgcccaguu

SEQ ID NO: 981943 - RNA, 19 nt, Homo sapiens
cagauggaccgcaugauug

SEQ ID NO: 981944 - RNA, 19 nt, Homo sapiens
gguggccuauuaccaaaug

SEQ ID NO: 981945 - RNA, 19 nt, Homo sapiens
ucgcugcccuucacuccua

SEQ ID NO: 981946 - RNA, 19 nt, Homo sapiens
gagcugcugcauauucuga

SEQ ID NO: 981947 - RNA, 19 nt, Homo sapiens
ccgagaagcuguuguugcu

SEQ ID NO: 981948 - RNA, 19 nt, Homo sapiens
gagaaacgaguucgagucu

SEQ ID NO: 981949 - RNA, 19 nt, Homo sapiens
ugaaaagccauguguauuu

SEQ ID NO: 981950 - RNA, 19 nt, Homo sapiens
gaaucucuuuucucuguaa

SEQ ID NO: 981951 - RNA, 19 nt, Homo sapiens
caaacacgccaaugucaag

SEQ ID NO: 981952 - RNA, 19 nt, Homo sapiens
gaugcagacccugaaguuu

SEQ ID NO: 981953 - RNA, 19 nt, Homo sapiens
cuagaggagcugcugcaua

SEQ ID NO: 981954 - RNA, 19 nt, Homo sapiens
gcagcgcaguugggcacua

SEQ ID NO: 981955 - RNA, 19 nt, Homo sapiens
gagcuggugcggagaaaca

SEQ ID NO: 981956 - RNA, 19 nt, Homo sapiens
guagcucuccuuuggaaau

SEQ ID NO: 981957 - RNA, 19 nt, Homo sapiens
gaccgaaucucuuuucucu

SEQ ID NO: 981958 - RNA, 19 nt, Homo sapiens
ggauaagguggcagaagga

SEQ ID NO: 981959 - RNA, 19 nt, Homo sapiens
cacacucuguccucaaguu

SEQ ID NO: 981960 - RNA, 19 nt, Homo sapiens
cauccgugcugccuguaga

SEQ ID NO: 981961 - RNA, 19 nt, Homo sapiens
gcucuauucuuugccuuag

SEQ ID NO: 981962 - RNA, 19 nt, Homo sapiens
gagagaugugcaaggaauu

SEQ ID NO: 981963 - RNA, 19 nt, Homo sapiens
ccugaugcaugcuauaguc

SEQ ID NO: 981964 - RNA, 19 nt, Homo sapiens
ucuccacgcuugugucauc

SEQ ID NO: 981965 - RNA, 19 nt, Homo sapiens
aagaaaaugugcaagagaa

SEQ ID NO: 981966 - RNA, 19 nt, Homo sapiens
gaagaagaaguggcaacug

SEQ ID NO: 981967 - RNA, 19 nt, Homo sapiens
gcaagagaaacgaguucga

SEQ ID NO: 981968 - RNA, 19 nt, Homo sapiens
gcaagaaaaugugcaagag

SEQ ID NO: 981969 - RNA, 19 nt, Homo sapiens
cccugaaguuugcaagaaa

SEQ ID NO: 981970 - RNA, 19 nt, Homo sapiens
caucauagugggucacauc

SEQ ID NO: 981971 - RNA, 19 nt, Homo sapiens
cuguagcucuccuuuggaa

SEQ ID NO: 981972 - RNA, 19 nt, Homo sapiens
gccaaugaccgaaucucuu

SEQ ID NO: 981973 - RNA, 19 nt, Homo sapiens
gaugauggcacugagaaag

SEQ ID NO: 981974 - RNA, 19 nt, Homo sapiens
gauaagguggcagaaggaa

SEQ ID NO: 981975 - RNA, 19 nt, Homo sapiens
gcugauccaccaccggaaa

SEQ ID NO: 981976 - RNA, 19 nt, Homo sapiens
cagcgcaguugggcacuau

SEQ ID NO: 981977 - RNA, 19 nt, Homo sapiens
ggccugagccacgaauuau

SEQ ID NO: 981978 - RNA, 19 nt, Homo sapiens
gaaguggcaacugguacaa

SEQ ID NO: 981979 - RNA, 19 nt, Homo sapiens
ggaugauggcacugagaaa

SEQ ID NO: 981980 - RNA, 19 nt, Homo sapiens
caccagcucuauucuuugc

SEQ ID NO: 981981 - RNA, 19 nt, Homo sapiens
cugguaggcuuccucuuca

SEQ ID NO: 981982 - RNA, 19 nt, Homo sapiens
ugauggcucucauugacau

SEQ ID NO: 981983 - RNA, 19 nt, Homo sapiens
cagcugccaucuucuacca

SEQ ID NO: 981984 - RNA, 19 nt, Homo sapiens
gcgcaguugggcacuauau

SEQ ID NO: 981985 - RNA, 19 nt, Homo sapiens
ccgaaucucuuuucucugu

SEQ ID NO: 981986 - RNA, 19 nt, Homo sapiens
ccuggagccucauggaaca

SEQ ID NO: 981987 - RNA, 19 nt, Homo sapiens
ggaauaugcaagcuaaagc

SEQ ID NO: 981988 - RNA, 19 nt, Homo sapiens
gggaauaugcaagcuaaag

SEQ ID NO: 981989 - RNA, 19 nt, Homo sapiens
ugagcaaacacgccaaugu

SEQ ID NO: 981990 - RNA, 19 nt, Homo sapiens
ugaugcagacccugaaguu

SEQ ID NO: 981991 - RNA, 19 nt, Homo sapiens
acacgccaaugucaagauc

SEQ ID NO: 981992 - RNA, 19 nt, Homo sapiens
gcugugcccaggaccauug

SEQ ID NO: 981993 - RNA, 19 nt, Homo sapiens
gaagcccuggguacacuga

SEQ ID NO: 981994 - RNA, 19 nt, Homo sapiens
aaucacaggcaucuggaaa

SEQ ID NO: 981995 - RNA, 19 nt, Homo sapiens
ggccagcucaccagucaug

SEQ ID NO: 981996 - RNA, 19 nt, Homo sapiens
ggccaucggcaucauagug

SEQ ID NO: 981997 - RNA, 19 nt, Homo sapiens
ccugguaggcuuccucuuc

SEQ ID NO: 981998 - RNA, 19 nt, Homo sapiens
ccuccaguguugcaguuau

SEQ ID NO: 981999 - RNA, 19 nt, Homo sapiens
uccgagagaugugcaagga

SEQ ID NO: 982000 - RNA, 19 nt, Homo sapiens
augcagacccugaaguuug

SEQ ID NO: 982001 - RNA, 19 nt, Homo sapiens
gcgggaugguggcaaguac

SEQ ID NO: 982002 - RNA, 19 nt, Homo sapiens
gaaguuugcaagaaaaugu

SEQ ID NO: 982003 - RNA, 19 nt, Homo sapiens
agaccuuccuggugcuaga

SEQ ID NO: 982004 - RNA, 19 nt, Homo sapiens
acaagcugcgcauggagua

SEQ ID NO: 982005 - RNA, 19 nt, Homo sapiens
uaccagaucccacuuccau

SEQ ID NO: 982006 - RNA, 19 nt, Homo sapiens
ccuucagccuccaguguug

SEQ ID NO: 982007 - RNA, 19 nt, Homo sapiens
gcuuggcccuaagaauguu

SEQ ID NO: 982008 - RNA, 19 nt, Homo sapiens
acccugaaguuugcaagaa

SEQ ID NO: 982009 - RNA, 19 nt, Homo sapiens
ugucauccgcugcuaccua

SEQ ID NO: 982010 - RNA, 19 nt, Homo sapiens
uccagcggcuccucaguca

SEQ ID NO: 982011 - RNA, 19 nt, Homo sapiens
ggcuggaggugaucuuugc

SEQ ID NO: 982012 - RNA, 19 nt, Homo sapiens
gaggcuggaggugaucuuu

SEQ ID NO: 982013 - RNA, 19 nt, Homo sapiens
ugcuguagcucuccuuugg

SEQ ID NO: 982014 - RNA, 19 nt, Homo sapiens
acgccaaugucaagaucuu

SEQ ID NO: 982015 - RNA, 19 nt, Homo sapiens
uggcugcccugagcaaaca

SEQ ID NO: 982016 - RNA, 19 nt, Homo sapiens
cugcauauucugacugaug

SEQ ID NO: 982017 - RNA, 19 nt, Homo sapiens
ccacugauguuaauccuua

SEQ ID NO: 982018 - RNA, 19 nt, Homo sapiens
gcaaagaacuauccaccuu

SEQ ID NO: 982019 - RNA, 19 nt, Homo sapiens
gaguaaagcugcugcuaaa

SEQ ID NO: 982020 - RNA, 19 nt, Homo sapiens
ugaagaagauugagaaaga

SEQ ID NO: 982021 - RNA, 19 nt, Homo sapiens
uaaauuaaguggccugaaa

SEQ ID NO: 982022 - RNA, 19 nt, Homo sapiens
ugaagaaccuggaaacauu

SEQ ID NO: 982023 - RNA, 19 nt, Homo sapiens
gggaagcgguauacaauuu

SEQ ID NO: 982024 - RNA, 19 nt, Homo sapiens
gaaaugggauacugagaga

SEQ ID NO: 982025 - RNA, 19 nt, Homo sapiens
ugccagaacugaagaaaua

SEQ ID NO: 982026 - RNA, 19 nt, Homo sapiens
guacuggaaugccuauuaa

SEQ ID NO: 982027 - RNA, 19 nt, Homo sapiens
gggaaagccugacucaauu

SEQ ID NO: 982028 - RNA, 19 nt, Homo sapiens
ugaaggcgcuugagccaua

SEQ ID NO: 982029 - RNA, 19 nt, Homo sapiens
gaaagaaauccaacagaaa

SEQ ID NO: 982030 - RNA, 19 nt, Homo sapiens
ggaccuaaauagauugauu

SEQ ID NO: 982031 - RNA, 19 nt, Homo sapiens
guacuuggauuauggagaa

SEQ ID NO: 982032 - RNA, 19 nt, Homo sapiens
ggugauauauucaucugua

SEQ ID NO: 982033 - RNA, 19 nt, Homo sapiens
gauuuauccugguuucuua

SEQ ID NO: 982034 - RNA, 19 nt, Homo sapiens
ggaagaaaccaguguuaaa

SEQ ID NO: 982035 - RNA, 19 nt, Homo sapiens
gagguguacuuuauacuuu

SEQ ID NO: 982036 - RNA, 19 nt, Homo sapiens
gaagaagaccgacaaacaa

SEQ ID NO: 982037 - RNA, 19 nt, Homo sapiens
ggaacaaagugauaaaugg

SEQ ID NO: 982038 - RNA, 19 nt, Homo sapiens
ggucaaugcaucuaauuua

SEQ ID NO: 982039 - RNA, 19 nt, Homo sapiens
gaaaaugaaucgaggaauu

SEQ ID NO: 982040 - RNA, 19 nt, Homo sapiens
gaagaagauugagaaagaa

SEQ ID NO: 982041 - RNA, 19 nt, Homo sapiens
gacccaagcuauugacaaa

SEQ ID NO: 982042 - RNA, 19 nt, Homo sapiens
uaaguggccugaaagguaa

SEQ ID NO: 982043 - RNA, 19 nt, Homo sapiens
gcagaacauuggcuugauu

SEQ ID NO: 982044 - RNA, 19 nt, Homo sapiens
agaaagaaauccaacagaa

SEQ ID NO: 982045 - RNA, 19 nt, Homo sapiens
caacuaagaaccaauaaug

SEQ ID NO: 982046 - RNA, 19 nt, Homo sapiens
gagaugcacuuauuuacau

SEQ ID NO: 982047 - RNA, 19 nt, Homo sapiens
gacagaagguucaagaugu

SEQ ID NO: 982048 - RNA, 19 nt, Homo sapiens
ggaagaagaccgacaaaca

SEQ ID NO: 982049 - RNA, 19 nt, Homo sapiens
uguagaagaugccaacuuu

SEQ ID NO: 982050 - RNA, 19 nt, Homo sapiens
gaagagaauuggaagaaac

SEQ ID NO: 982051 - RNA, 19 nt, Homo sapiens
gaacugaagaaauacauga

SEQ ID NO: 982052 - RNA, 19 nt, Homo sapiens
uaaaggcacuggugugguu

SEQ ID NO: 982053 - RNA, 19 nt, Homo sapiens
ggauaaagcuaaaggaaaa

SEQ ID NO: 982054 - RNA, 19 nt, Homo sapiens
gcaaggagauaacugugau

SEQ ID NO: 982055 - RNA, 19 nt, Homo sapiens
ggaaagccugacucaauua

SEQ ID NO: 982056 - RNA, 19 nt, Homo sapiens
ggaagaaacagacaucuca

SEQ ID NO: 982057 - RNA, 19 nt, Homo sapiens
gaaauagagcuguaugguu

SEQ ID NO: 982058 - RNA, 19 nt, Homo sapiens
gaagaaagucaugccauuu

SEQ ID NO: 982059 - RNA, 19 nt, Homo sapiens
ugaagaaagucaugccauu

SEQ ID NO: 982060 - RNA, 19 nt, Homo sapiens
gaugagcaguggcugauug

SEQ ID NO: 982061 - RNA, 19 nt, Homo sapiens
gaacauuggcuugauuauu

SEQ ID NO: 982062 - RNA, 19 nt, Homo sapiens
acacauagaagucaaguuu

SEQ ID NO: 982063 - RNA, 19 nt, Homo sapiens
caacagaaaugggauacug

SEQ ID NO: 982064 - RNA, 19 nt, Homo sapiens
aaagagaaauagagcugua

SEQ ID NO: 982065 - RNA, 19 nt, Homo sapiens
gaauacuacuacucugauu

SEQ ID NO: 982066 - RNA, 19 nt, Homo sapiens
gaaaggaguacaccgagaa

SEQ ID NO: 982067 - RNA, 19 nt, Homo sapiens
cuaauucgcuugagcuaga

SEQ ID NO: 982068 - RNA, 19 nt, Homo sapiens
gaaguaacacaugaccuua

SEQ ID NO: 982069 - RNA, 19 nt, Homo sapiens
ggacagaagguucaagaug

SEQ ID NO: 982070 - RNA, 19 nt, Homo sapiens
gacggugaauggugauaua

SEQ ID NO: 982071 - RNA, 19 nt, Homo sapiens
gccauacccaucuaaauua

SEQ ID NO: 982072 - RNA, 19 nt, Homo sapiens
ggaagcgguauacaauuua

SEQ ID NO: 982073 - RNA, 19 nt, Homo sapiens
ugaaguacauuggauuuga

SEQ ID NO: 982074 - RNA, 19 nt, Homo sapiens
ggauaaggguggauauugg

SEQ ID NO: 982075 - RNA, 19 nt, Homo sapiens
ggaaguaacacaugaccuu

SEQ ID NO: 982076 - RNA, 19 nt, Homo sapiens
caaggaaguuugggauuau

SEQ ID NO: 982077 - RNA, 19 nt, Homo sapiens
guaaagaagacuauucaga

SEQ ID NO: 982078 - RNA, 19 nt, Homo sapiens
ggaaauucuuggugcauca

SEQ ID NO: 982079 - RNA, 19 nt, Homo sapiens
gauaugaaguacauuggau

SEQ ID NO: 982080 - RNA, 19 nt, Homo sapiens
gaggaagaaaccaguguua

SEQ ID NO: 982081 - RNA, 19 nt, Homo sapiens
guaguaaauuagcagcuuu

SEQ ID NO: 982082 - RNA, 19 nt, Homo sapiens
ggagauaacugugauucca

SEQ ID NO: 982083 - RNA, 19 nt, Homo sapiens
gaaaucaagcaaggagaua

SEQ ID NO: 982084 - RNA, 19 nt, Homo sapiens
gagaagagaauuggaagaa

SEQ ID NO: 982085 - RNA, 19 nt, Homo sapiens
acagaagguucaagaugua

SEQ ID NO: 982086 - RNA, 19 nt, Homo sapiens
gcacuggugugguuacaag

SEQ ID NO: 982087 - RNA, 19 nt, Homo sapiens
ccauacccaucuaaauuaa

SEQ ID NO: 982088 - RNA, 19 nt, Homo sapiens
ggcaugugcugauaaguug

SEQ ID NO: 982089 - RNA, 19 nt, Homo sapiens
aaucaggcguuuaaugaaa

SEQ ID NO: 982090 - RNA, 19 nt, Homo sapiens
gaggagaccaggaggaauu

SEQ ID NO: 982091 - RNA, 19 nt, Homo sapiens
aagcaaaggagaagauaua

SEQ ID NO: 982092 - RNA, 19 nt, Homo sapiens
ggacacacguuuucuuuau

SEQ ID NO: 982093 - RNA, 19 nt, Homo sapiens
gaacaaauagguccugcau

SEQ ID NO: 982094 - RNA, 19 nt, Homo sapiens
aaagauaaguaccgugaau

SEQ ID NO: 982095 - RNA, 19 nt, Homo sapiens
agacucagauugcaaagga

SEQ ID NO: 982096 - RNA, 19 nt, Homo sapiens
ggagauuuauccugguuuc

SEQ ID NO: 982097 - RNA, 19 nt, Homo sapiens
caaagucauugcuagugaa

SEQ ID NO: 982098 - RNA, 19 nt, Homo sapiens
gacuacgacucaagaacua

SEQ ID NO: 982099 - RNA, 19 nt, Homo sapiens
guugguggauggauuuaaa

SEQ ID NO: 982100 - RNA, 19 nt, Homo sapiens
aaauucaucugacugagaa

SEQ ID NO: 982101 - RNA, 19 nt, Homo sapiens
aagccugacucaauuauga

SEQ ID NO: 982102 - RNA, 19 nt, Homo sapiens
gccagcacuuucaaugaua

SEQ ID NO: 982103 - RNA, 19 nt, Homo sapiens
cccaagcuauugacaaauu

SEQ ID NO: 982104 - RNA, 19 nt, Homo sapiens
ucauugaaaucccagguuu

SEQ ID NO: 982105 - RNA, 19 nt, Homo sapiens
agauaacugugauuccaua

SEQ ID NO: 982106 - RNA, 19 nt, Homo sapiens
acaaagucauugcuaguga

SEQ ID NO: 982107 - RNA, 19 nt, Homo sapiens
cacaguaucuuauggaagu

SEQ ID NO: 982108 - RNA, 19 nt, Homo sapiens
ccaagcuauugacaaauuu

SEQ ID NO: 982109 - RNA, 19 nt, Homo sapiens
uaaagcaggaguuugaauu

SEQ ID NO: 982110 - RNA, 19 nt, Homo sapiens
gaaguuugggauuauguuu

SEQ ID NO: 982111 - RNA, 19 nt, Homo sapiens
uuacacaguugcacaccua

SEQ ID NO: 982112 - RNA, 19 nt, Homo sapiens
uuaaguggccugaaaggua

SEQ ID NO: 982113 - RNA, 19 nt, Homo sapiens
aagaauggguuugaaggua

SEQ ID NO: 982114 - RNA, 19 nt, Homo sapiens
aaagcuggaucuucuaaau

SEQ ID NO: 982115 - RNA, 19 nt, Homo sapiens
gaucuauguucucccaaug

SEQ ID NO: 982116 - RNA, 19 nt, Homo sapiens
aagugaaacugaugagauu

SEQ ID NO: 982117 - RNA, 19 nt, Homo sapiens
gaagucauguuccagcuua

SEQ ID NO: 982118 - RNA, 19 nt, Homo sapiens
cagacugacuuugaaauua

SEQ ID NO: 982119 - RNA, 19 nt, Homo sapiens
gaccacagacugacuuuga

SEQ ID NO: 982120 - RNA, 19 nt, Homo sapiens
auucaugccugcagguuua

SEQ ID NO: 982121 - RNA, 19 nt, Homo sapiens
agguaaaucucaaggguaa

SEQ ID NO: 982122 - RNA, 19 nt, Homo sapiens
uaccuuggcuggcauuaug

SEQ ID NO: 982123 - RNA, 19 nt, Homo sapiens
caucugacauuuuaccuaa

SEQ ID NO: 982124 - RNA, 19 nt, Homo sapiens
ucucaaggguaaaauguua

SEQ ID NO: 982125 - RNA, 19 nt, Homo sapiens
gaucauuggcuauguaaaa

SEQ ID NO: 982126 - RNA, 19 nt, Homo sapiens
ccacagacugacuuugaaa

SEQ ID NO: 982127 - RNA, 19 nt, Homo sapiens
uagcagaagucauguucca

SEQ ID NO: 982128 - RNA, 19 nt, Homo sapiens
gcugauggucgccaaaguu

SEQ ID NO: 982129 - RNA, 19 nt, Homo sapiens
gagaaauaagugcagcauu

SEQ ID NO: 982130 - RNA, 19 nt, Homo sapiens
ugggaucauuggcuaugua

SEQ ID NO: 982131 - RNA, 19 nt, Homo sapiens
gggaucauuggcuauguaa

SEQ ID NO: 982132 - RNA, 19 nt, Homo sapiens
aaaucugcaucuuccacua

SEQ ID NO: 982133 - RNA, 19 nt, Homo sapiens
gacugacuuugaaauuaug

SEQ ID NO: 982134 - RNA, 19 nt, Homo sapiens
acagacugacuuugaaauu

SEQ ID NO: 982135 - RNA, 19 nt, Homo sapiens
caguagugccuuugcauug

SEQ ID NO: 982136 - RNA, 19 nt, Homo sapiens
gcucaguagugccuuugca

SEQ ID NO: 982137 - RNA, 19 nt, Homo sapiens
caaggaacguuuggguuuu

SEQ ID NO: 982138 - RNA, 19 nt, Homo sapiens
gugcuuaccagcugucuca

SEQ ID NO: 982139 - RNA, 19 nt, Homo sapiens
uaauugcaggugccaguuu

SEQ ID NO: 982140 - RNA, 19 nt, Homo sapiens
guagugccuuugcauuggu

SEQ ID NO: 982141 - RNA, 19 nt, Homo sapiens
gcucaucuuagaccacaga

SEQ ID NO: 982142 - RNA, 19 nt, Homo sapiens
ucaguagugccuuugcauu

SEQ ID NO: 982143 - RNA, 19 nt, Homo sapiens
cuaccacucuggaaaauuc

SEQ ID NO: 982144 - RNA, 19 nt, Homo sapiens
caggauccaaggaacguuu

SEQ ID NO: 982145 - RNA, 19 nt, Homo sapiens
aauugcaggugccaguuug

SEQ ID NO: 982146 - RNA, 19 nt, Homo sapiens
gguggaaaaucagucauga

SEQ ID NO: 982147 - RNA, 19 nt, Homo sapiens
uggcuggcauuaugggaau

SEQ ID NO: 982148 - RNA, 19 nt, Homo sapiens
ugaaaguucuguucguuua

SEQ ID NO: 982149 - RNA, 19 nt, Homo sapiens
gaagagcggcagagccuua

SEQ ID NO: 982150 - RNA, 19 nt, Homo sapiens
cuaauaagcacuacuguaa

SEQ ID NO: 982151 - RNA, 19 nt, Homo sapiens
ccacucacguucauaaaga

SEQ ID NO: 982152 - RNA, 19 nt, Homo sapiens
gguaaagacgaaucuauaa

SEQ ID NO: 982153 - RNA, 19 nt, Homo sapiens
gaacaagagcgguaucauc

SEQ ID NO: 982154 - RNA, 19 nt, Homo sapiens
gcacuacuguaauuuagca

SEQ ID NO: 982155 - RNA, 19 nt, Homo sapiens
ggcaaagaauggacaauca

SEQ ID NO: 982156 - RNA, 19 nt, Homo sapiens
uaacuccacccucauuuaa

SEQ ID NO: 982157 - RNA, 19 nt, Homo sapiens
gagcagugcagcaguugua

SEQ ID NO: 982158 - RNA, 19 nt, Homo sapiens
gcuaauggcaacagaagaa

SEQ ID NO: 982159 - RNA, 19 nt, Homo sapiens
agacgaaucuauaaaguac

SEQ ID NO: 982160 - RNA, 19 nt, Homo sapiens
caagagcgguaucaucagu

SEQ ID NO: 982161 - RNA, 19 nt, Homo sapiens
ugaaauagugcauaguuug

SEQ ID NO: 982162 - RNA, 19 nt, Homo sapiens
caacccaggccucuucauu

SEQ ID NO: 982163 - RNA, 19 nt, Homo sapiens
gcauguuugugucacgaaa

SEQ ID NO: 982164 - RNA, 19 nt, Homo sapiens
uguagaagccgcucuguau

SEQ ID NO: 982165 - RNA, 19 nt, Homo sapiens
aaagcaacccuaccucaaa

SEQ ID NO: 982166 - RNA, 19 nt, Homo sapiens
caugaaauagugcauaguu

SEQ ID NO: 982167 - RNA, 19 nt, Homo sapiens
cgaugucgauguugucugu

SEQ ID NO: 982168 - RNA, 19 nt, Homo sapiens
gagguaaagacgaaucuau

SEQ ID NO: 982169 - RNA, 19 nt, Homo sapiens
gcacccgucuuuagaacca

SEQ ID NO: 982170 - RNA, 19 nt, Homo sapiens
aagaauggacaaucaguuu

SEQ ID NO: 982171 - RNA, 19 nt, Homo sapiens
gaaaguucuguucguuuau

SEQ ID NO: 982172 - RNA, 19 nt, Homo sapiens
gagaauccacucacguuca

SEQ ID NO: 982173 - RNA, 19 nt, Homo sapiens
ggaugcacccgucuuuaga

SEQ ID NO: 982174 - RNA, 19 nt, Homo sapiens
gaaagacuggccaucagau

SEQ ID NO: 982175 - RNA, 19 nt, Homo sapiens
caugcuguuuguauuguuu

SEQ ID NO: 982176 - RNA, 19 nt, Homo sapiens
gccaucagcuccggcaaga

SEQ ID NO: 982177 - RNA, 19 nt, Homo sapiens
gagacuuccugggcaaaga

SEQ ID NO: 982178 - RNA, 19 nt, Homo sapiens
ccacgucccuagcauaaaa

SEQ ID NO: 982179 - RNA, 19 nt, Homo sapiens
gcaguuguaggaaucgaaa

SEQ ID NO: 982180 - RNA, 19 nt, Homo sapiens
gugcagcaguuguaggaau

SEQ ID NO: 982181 - RNA, 19 nt, Homo sapiens
cggaaacgcugcggcaugu

SEQ ID NO: 982182 - RNA, 19 nt, Homo sapiens
guucauaaagagaauguug

SEQ ID NO: 982183 - RNA, 19 nt, Homo sapiens
gaaauagugcauaguuugc

SEQ ID NO: 982184 - RNA, 19 nt, Homo sapiens
ccaccaggcaucucuguug

SEQ ID NO: 982185 - RNA, 19 nt, Homo sapiens
aaugaaaguucuguucguu

SEQ ID NO: 982186 - RNA, 19 nt, Homo sapiens
uuaacuccacccucauuua

SEQ ID NO: 982187 - RNA, 19 nt, Homo sapiens
aacccaggccucuucauua

SEQ ID NO: 982188 - RNA, 19 nt, Homo sapiens
cagccucaguggcagauga

SEQ ID NO: 982189 - RNA, 19 nt, Homo sapiens
ucuguucguuuauccauug

SEQ ID NO: 982190 - RNA, 19 nt, Homo sapiens
cgaaagacuggccaucaga

SEQ ID NO: 982191 - RNA, 19 nt, Homo sapiens
acccaggccucuucauuau

SEQ ID NO: 982192 - RNA, 19 nt, Homo sapiens
aacaagagcgguaucauca

SEQ ID NO: 982193 - RNA, 19 nt, Homo sapiens
aagcacuacuguaauuuag

SEQ ID NO: 982194 - RNA, 19 nt, Homo sapiens
gaccaugaaauagugcaua

SEQ ID NO: 982195 - RNA, 19 nt, Homo sapiens
agguaaagacgaaucuaua

SEQ ID NO: 982196 - RNA, 19 nt, Homo sapiens
gaugcacccgucuuuagaa

SEQ ID NO: 982197 - RNA, 19 nt, Homo sapiens
uuccaauccuggcuacuuu

SEQ ID NO: 982198 - RNA, 19 nt, Homo sapiens
caaagaauggacaaucagu

SEQ ID NO: 982199 - RNA, 19 nt, Homo sapiens
cggagagucugcugacaag

SEQ ID NO: 982200 - RNA, 19 nt, Homo sapiens
agagcgguaucaucaguga

SEQ ID NO: 982201 - RNA, 19 nt, Homo sapiens
ucacguucauaaagagaau

SEQ ID NO: 982202 - RNA, 19 nt, Homo sapiens
gcaaagaauggacaaucag

SEQ ID NO: 982203 - RNA, 19 nt, Homo sapiens
agacuggccaucagauuug

SEQ ID NO: 982204 - RNA, 19 nt, Homo sapiens
aagcaacccuaccucaaag

SEQ ID NO: 982205 - RNA, 19 nt, Homo sapiens
gcggagagucugcugacaa

SEQ ID NO: 982206 - RNA, 19 nt, Homo sapiens
caccaggcaucucuguugu

SEQ ID NO: 982207 - RNA, 19 nt, Homo sapiens
cagcagggagcucacagaa

SEQ ID NO: 982208 - RNA, 19 nt, Homo sapiens
gggcaaagaauggacaauc

SEQ ID NO: 982209 - RNA, 19 nt, Homo sapiens
caucaacccaggccucuuc

SEQ ID NO: 982210 - RNA, 19 nt, Homo sapiens
aaaguucuguucguuuauc

SEQ ID NO: 982211 - RNA, 19 nt, Homo sapiens
ccgcugcucuggagaaggu

SEQ ID NO: 982212 - RNA, 19 nt, Homo sapiens
aagacuggccaucagauuu

SEQ ID NO: 982213 - RNA, 19 nt, Homo sapiens
caucagcuccggcaagaag

SEQ ID NO: 982214 - RNA, 19 nt, Homo sapiens
gaauaaaacgaaugcaugu

SEQ ID NO: 982215 - RNA, 19 nt, Homo sapiens
agaauccacucacguucau

SEQ ID NO: 982216 - RNA, 19 nt, Homo sapiens
gacaaucaguuuccuuccu

SEQ ID NO: 982217 - RNA, 19 nt, Homo sapiens
aaagaauggacaaucaguu

SEQ ID NO: 982218 - RNA, 19 nt, Homo sapiens
uuucuggccuugcuaaugg

SEQ ID NO: 982219 - RNA, 19 nt, Homo sapiens
aaaugaaaguucuguucgu

SEQ ID NO: 982220 - RNA, 19 nt, Homo sapiens
aaagacuggccaucagauu

SEQ ID NO: 982221 - RNA, 19 nt, Homo sapiens
ggccauggcgguggacaaa

SEQ ID NO: 982222 - RNA, 19 nt, Homo sapiens
guagaagccgcucuguauc

SEQ ID NO: 982223 - RNA, 19 nt, Homo sapiens
ccacccucauuuaaacuuc

SEQ ID NO: 982224 - RNA, 19 nt, Homo sapiens
acuaauaagcacuacugua

SEQ ID NO: 982225 - RNA, 19 nt, Homo sapiens
gugcuggccugccugacau

SEQ ID NO: 982226 - RNA, 19 nt, Homo sapiens
aauccacucacguucauaa

SEQ ID NO: 982227 - RNA, 19 nt, Homo sapiens
gcaagaagaagcggaaacg

SEQ ID NO: 982228 - RNA, 19 nt, Homo sapiens
ggcaggagcagcagacaag

SEQ ID NO: 982229 - RNA, 19 nt, Homo sapiens
cuggacaccugaccaugug

SEQ ID NO: 982230 - RNA, 19 nt, Homo sapiens
guguagaagccgcucugua

SEQ ID NO: 982231 - RNA, 19 nt, Homo sapiens
ccaucucgauauuuccaau

SEQ ID NO: 982232 - RNA, 19 nt, Homo sapiens
gagccgagugaagacauuu

SEQ ID NO: 982233 - RNA, 19 nt, Homo sapiens
guuuaacuccacccucauu

SEQ ID NO: 982234 - RNA, 19 nt, Homo sapiens
ucgaaagacuggccaucag

SEQ ID NO: 982235 - RNA, 19 nt, Homo sapiens
cgaaugcauguuuguguca

SEQ ID NO: 982236 - RNA, 19 nt, Homo sapiens
uuacuaauaagcacuacug

SEQ ID NO: 982237 - RNA, 19 nt, Homo sapiens
ucuguaaccuuuugaaauc

SEQ ID NO: 982238 - RNA, 19 nt, Homo sapiens
agagccgagugaagacauu

SEQ ID NO: 982239 - RNA, 19 nt, Homo sapiens
guuuauccauugcgaucug

SEQ ID NO: 982240 - RNA, 19 nt, Homo sapiens
ucucacagauuucauuccu

SEQ ID NO: 982241 - RNA, 19 nt, Homo sapiens
ggaacaagagcgguaucau

SEQ ID NO: 982242 - RNA, 19 nt, Homo sapiens
gcaacccuaccucaaagca

SEQ ID NO: 982243 - RNA, 19 nt, Homo sapiens
gaauggacaaucaguuucc

SEQ ID NO: 982244 - RNA, 19 nt, Homo sapiens
cggaugcacccgucuuuag

SEQ ID NO: 982245 - RNA, 19 nt, Homo sapiens
uggcagcaguggcccaaag

SEQ ID NO: 982246 - RNA, 19 nt, Homo sapiens
ggaaacagcucucauucaa

SEQ ID NO: 982247 - RNA, 19 nt, Homo sapiens
caaggaagguucagacuag

SEQ ID NO: 982248 - RNA, 19 nt, Homo sapiens
gcaaggaguucaugcaagu

SEQ ID NO: 982249 - RNA, 19 nt, Homo sapiens
gcaaacagcuggacuuucc

SEQ ID NO: 982250 - RNA, 19 nt, Homo sapiens
aaacagcucucauucaaag

SEQ ID NO: 982251 - RNA, 19 nt, Homo sapiens
caaaggaugcgaagaguga

SEQ ID NO: 982252 - RNA, 19 nt, Homo sapiens
ucacacugauggauacuuu

SEQ ID NO: 982253 - RNA, 19 nt, Homo sapiens
gcaguccucuucaacauca

SEQ ID NO: 982254 - RNA, 19 nt, Homo sapiens
gagacuagcagcaguguug

SEQ ID NO: 982255 - RNA, 19 nt, Homo sapiens
ccugacagcuguguacuuu

SEQ ID NO: 982256 - RNA, 19 nt, Homo sapiens
guacugcuacuucuauaaa

SEQ ID NO: 982257 - RNA, 19 nt, Homo sapiens
gaaacagcucucauucaaa

SEQ ID NO: 982258 - RNA, 19 nt, Homo sapiens
gauccucccucuugcacaa

SEQ ID NO: 982259 - RNA, 19 nt, Homo sapiens
gaucacaccgcagacauuu

SEQ ID NO: 982260 - RNA, 19 nt, Homo sapiens
ggacagauggacuucaaau

SEQ ID NO: 982261 - RNA, 19 nt, Homo sapiens
gcuguccuaugaccucuuu

SEQ ID NO: 982262 - RNA, 19 nt, Homo sapiens
guuacgugcuccugacuga

SEQ ID NO: 982263 - RNA, 19 nt, Homo sapiens
guucagcauucaagaagga

SEQ ID NO: 982264 - RNA, 19 nt, Homo sapiens
ccugauagaagccacauuu

SEQ ID NO: 982265 - RNA, 19 nt, Homo sapiens
ccgcagacauuuagauuuu

SEQ ID NO: 982266 - RNA, 19 nt, Homo sapiens
ccaaggaagguucagacua

SEQ ID NO: 982267 - RNA, 19 nt, Homo sapiens
ccaaaggaucucccaguga

SEQ ID NO: 982268 - RNA, 19 nt, Homo sapiens
ggauauugcaguccucuuc

SEQ ID NO: 982269 - RNA, 19 nt, Homo sapiens
gggaaacagcucucauuca

SEQ ID NO: 982270 - RNA, 19 nt, Homo sapiens
gggcaaacagcuggacuuu

SEQ ID NO: 982271 - RNA, 19 nt, Homo sapiens
ugacagcuguguacuuugc

SEQ ID NO: 982272 - RNA, 19 nt, Homo sapiens
ucucagaacugcuccaaaa

SEQ ID NO: 982273 - RNA, 19 nt, Homo sapiens
gauagaagccacauuugcu

SEQ ID NO: 982274 - RNA, 19 nt, Homo sapiens
ucaaccuccuauuccauaa

SEQ ID NO: 982275 - RNA, 19 nt, Homo sapiens
ggaggugcuugccuuagag

SEQ ID NO: 982276 - RNA, 19 nt, Homo sapiens
ccaaaagacuccugucauc

SEQ ID NO: 982277 - RNA, 19 nt, Homo sapiens
gaccaaaggaugcgaagag

SEQ ID NO: 982278 - RNA, 19 nt, Homo sapiens
augcgaagagugauaguua

SEQ ID NO: 982279 - RNA, 19 nt, Homo sapiens
uggaggugcuugccuuaga

SEQ ID NO: 982280 - RNA, 19 nt, Homo sapiens
gucaaccuccuauuccaua

SEQ ID NO: 982281 - RNA, 19 nt, Homo sapiens
ucacaccgcagacauuuag

SEQ ID NO: 982282 - RNA, 19 nt, Homo sapiens
aaacuccaacagcuucaua

SEQ ID NO: 982283 - RNA, 19 nt, Homo sapiens
gcgcaaggaguucaugcaa

SEQ ID NO: 982284 - RNA, 19 nt, Homo sapiens
cagauggacuucaaaugcu

SEQ ID NO: 982285 - RNA, 19 nt, Homo sapiens
acuaggcgauccucacuuc

SEQ ID NO: 982286 - RNA, 19 nt, Homo sapiens
ccuauuccauaaguucaaa

SEQ ID NO: 982287 - RNA, 19 nt, Homo sapiens
gacagauggacuucaaaug

SEQ ID NO: 982288 - RNA, 19 nt, Homo sapiens
cagcaucucccuucauguc

SEQ ID NO: 982289 - RNA, 19 nt, Homo sapiens
gauauugcaguccucuuca

SEQ ID NO: 982290 - RNA, 19 nt, Homo sapiens
cagcucucauucaaaggaa

SEQ ID NO: 982291 - RNA, 19 nt, Homo sapiens
uugugaagcuuuuccuuua

SEQ ID NO: 982292 - RNA, 19 nt, Homo sapiens
ccucccucuugcacaauua

SEQ ID NO: 982293 - RNA, 19 nt, Homo sapiens
cuucaacaccuucgucuuc

SEQ ID NO: 982294 - RNA, 19 nt, Homo sapiens
ucauccagcuugugcucuu

SEQ ID NO: 982295 - RNA, 19 nt, Homo sapiens
aagggaaacagcucucauu

SEQ ID NO: 982296 - RNA, 19 nt, Homo sapiens
aagaugcuccagaccagua

SEQ ID NO: 982297 - RNA, 19 nt, Homo sapiens
uaggcgauccucacuucua

SEQ ID NO: 982298 - RNA, 19 nt, Homo sapiens
acagauggacuucaaaugc

SEQ ID NO: 982299 - RNA, 19 nt, Homo sapiens
cagcuugugcucuucauca

SEQ ID NO: 982300 - RNA, 19 nt, Homo sapiens
ggugcucucucugcaguuc

SEQ ID NO: 982301 - RNA, 19 nt, Homo sapiens
caccgcagacauuuagauu

SEQ ID NO: 982302 - RNA, 19 nt, Homo sapiens
cauauggacagauggacuu

SEQ ID NO: 982303 - RNA, 19 nt, Homo sapiens
cucagcaucucccuucaug

SEQ ID NO: 982304 - RNA, 19 nt, Homo sapiens
gcaagggaaacagcucuca

SEQ ID NO: 982305 - RNA, 19 nt, Homo sapiens
guucaaagggaccaucauc

SEQ ID NO: 982306 - RNA, 19 nt, Homo sapiens
uuuccucucuguaccauuc

SEQ ID NO: 982307 - RNA, 19 nt, Homo sapiens
ucugggaacugugggaugu

SEQ ID NO: 982308 - RNA, 19 nt, Homo sapiens
guuguacugcuacuucuau

SEQ ID NO: 982309 - RNA, 19 nt, Homo sapiens
guucagacuagcuguguuc

SEQ ID NO: 982310 - RNA, 19 nt, Homo sapiens
cgagaaaacagaaggaaga

SEQ ID NO: 982311 - RNA, 19 nt, Homo sapiens
gacuagcagcaguguugua

SEQ ID NO: 982312 - RNA, 19 nt, Homo sapiens
caucaucauuuuccucaug

SEQ ID NO: 982313 - RNA, 19 nt, Homo sapiens
gaugcgaagagugauaguu

SEQ ID NO: 982314 - RNA, 19 nt, Homo sapiens
ucauucaaaggaacuagaa

SEQ ID NO: 982315 - RNA, 19 nt, Homo sapiens
gaacgaagauccacacuug

SEQ ID NO: 982316 - RNA, 19 nt, Homo sapiens
gcaagaagcuaauucauau

SEQ ID NO: 982317 - RNA, 19 nt, Homo sapiens
uguaagagauggcaugaua

SEQ ID NO: 982318 - RNA, 19 nt, Homo sapiens
gaaguuacaagacugauuu

SEQ ID NO: 982319 - RNA, 19 nt, Homo sapiens
gaacaucgauaaguagugu

SEQ ID NO: 982320 - RNA, 19 nt, Homo sapiens
uaacugcacuaaacauuug

SEQ ID NO: 982321 - RNA, 19 nt, Homo sapiens
caggcuacauggaguauua

SEQ ID NO: 982322 - RNA, 19 nt, Homo sapiens
gcacuaaacauuugucaug

SEQ ID NO: 982323 - RNA, 19 nt, Homo sapiens
ucacugugcuugcaauaaa

SEQ ID NO: 982324 - RNA, 19 nt, Homo sapiens
gaaaugauguacaccugau

SEQ ID NO: 982325 - RNA, 19 nt, Homo sapiens
gcagucaacucaagcacaa

SEQ ID NO: 982326 - RNA, 19 nt, Homo sapiens
acaggaacaucgauaagua

SEQ ID NO: 982327 - RNA, 19 nt, Homo sapiens
cuacuucucucgaugcuaa

SEQ ID NO: 982328 - RNA, 19 nt, Homo sapiens
aaugaaggcuugucaaaga

SEQ ID NO: 982329 - RNA, 19 nt, Homo sapiens
gauccacacuugaggacua

SEQ ID NO: 982330 - RNA, 19 nt, Homo sapiens
gagauggcaugauauggaa

SEQ ID NO: 982331 - RNA, 19 nt, Homo sapiens
ccagugaucucucugacuu

SEQ ID NO: 982332 - RNA, 19 nt, Homo sapiens
gcagugggcugggaauuuc

SEQ ID NO: 982333 - RNA, 19 nt, Homo sapiens
aaacauuugucaugcugua

SEQ ID NO: 982334 - RNA, 19 nt, Homo sapiens
ggcaugauauggaagugua

SEQ ID NO: 982335 - RNA, 19 nt, Homo sapiens
gcaaggaaugccaguguaa

SEQ ID NO: 982336 - RNA, 19 nt, Homo sapiens
ucaaucaguuuccaagcua

SEQ ID NO: 982337 - RNA, 19 nt, Homo sapiens
cccagaauauuagaaguua

SEQ ID NO: 982338 - RNA, 19 nt, Homo sapiens
ucucuugaguucuuacaua

SEQ ID NO: 982339 - RNA, 19 nt, Homo sapiens
ccacauggcagaaaugaug

SEQ ID NO: 982340 - RNA, 19 nt, Homo sapiens
guaaacaggaacaucgaua

SEQ ID NO: 982341 - RNA, 19 nt, Homo sapiens
ggaugaagaaaccauaauu

SEQ ID NO: 982342 - RNA, 19 nt, Homo sapiens
cuauaaagguuucucuugu

SEQ ID NO: 982343 - RNA, 19 nt, Homo sapiens
guaacugcacuaaacauuu

SEQ ID NO: 982344 - RNA, 19 nt, Homo sapiens
gcacaugcauaggcaagga

SEQ ID NO: 982345 - RNA, 19 nt, Homo sapiens
gcaguacaauagcgucuuc

SEQ ID NO: 982346 - RNA, 19 nt, Homo sapiens
ccuccaaaguuuauacauu

SEQ ID NO: 982347 - RNA, 19 nt, Homo sapiens
agccagagaucuaagguuu

SEQ ID NO: 982348 - RNA, 19 nt, Homo sapiens
uggaugaugugaccauuga

SEQ ID NO: 982349 - RNA, 19 nt, Homo sapiens
uaaacaggaacaucgauaa

SEQ ID NO: 982350 - RNA, 19 nt, Homo sapiens
cuccaaaguuuauacauug

SEQ ID NO: 982351 - RNA, 19 nt, Homo sapiens
cagaugauaccaaaccuaa

SEQ ID NO: 982352 - RNA, 19 nt, Homo sapiens
gaacagcaacagaugauac

SEQ ID NO: 982353 - RNA, 19 nt, Homo sapiens
uuuaaaccgucucugauuu

SEQ ID NO: 982354 - RNA, 19 nt, Homo sapiens
caucagagaguaagaagga

SEQ ID NO: 982355 - RNA, 19 nt, Homo sapiens
ccaaugaaggcuugucaaa

SEQ ID NO: 982356 - RNA, 19 nt, Homo sapiens
aaccgucucugauuuaaug

SEQ ID NO: 982357 - RNA, 19 nt, Homo sapiens
ucuacagacugcuuucaaa

SEQ ID NO: 982358 - RNA, 19 nt, Homo sapiens
uaagagauggcaugauaug

SEQ ID NO: 982359 - RNA, 19 nt, Homo sapiens
ggaaugccaguguaagaga

SEQ ID NO: 982360 - RNA, 19 nt, Homo sapiens
ccacaugugcaucuaaaga

SEQ ID NO: 982361 - RNA, 19 nt, Homo sapiens
guucuuacauacacuucaa

SEQ ID NO: 982362 - RNA, 19 nt, Homo sapiens
gaaugccaguguaagagau

SEQ ID NO: 982363 - RNA, 19 nt, Homo sapiens
cagacugacucaccugaug

SEQ ID NO: 982364 - RNA, 19 nt, Homo sapiens
caaggaaaguaaaauguga

SEQ ID NO: 982365 - RNA, 19 nt, Homo sapiens
cagauuuguuuaagguuug

SEQ ID NO: 982366 - RNA, 19 nt, Homo sapiens
ccaaggcucccaucagaga

SEQ ID NO: 982367 - RNA, 19 nt, Homo sapiens
gcgagcagaucaaagaaaa

SEQ ID NO: 982368 - RNA, 19 nt, Homo sapiens
uuucuuggcaucucaguua

SEQ ID NO: 982369 - RNA, 19 nt, Homo sapiens
gaaggcuugucaaagagau

SEQ ID NO: 982370 - RNA, 19 nt, Homo sapiens
gauguacaccugauagcaa

SEQ ID NO: 982371 - RNA, 19 nt, Homo sapiens
caaagccagugaucucucu

SEQ ID NO: 982372 - RNA, 19 nt, Homo sapiens
ggagaaggcacagguguca

SEQ ID NO: 982373 - RNA, 19 nt, Homo sapiens
gcaucucaguuaaucuuca

SEQ ID NO: 982374 - RNA, 19 nt, Homo sapiens
caaucaguuuccaagcuaa

SEQ ID NO: 982375 - RNA, 19 nt, Homo sapiens
agcaagaagcuaauucaua

SEQ ID NO: 982376 - RNA, 19 nt, Homo sapiens
gagacgcucugaacugacu

SEQ ID NO: 982377 - RNA, 19 nt, Homo sapiens
guacaauagcgucuucuuc

SEQ ID NO: 982378 - RNA, 19 nt, Homo sapiens
ugucagagcaccagucaga

SEQ ID NO: 982379 - RNA, 19 nt, Homo sapiens
cgaggaguguaaacaggaa

SEQ ID NO: 982380 - RNA, 19 nt, Homo sapiens
agcaacagaugauaccaaa

SEQ ID NO: 982381 - RNA, 19 nt, Homo sapiens
gcaguggguauaugguaaa

SEQ ID NO: 982382 - RNA, 19 nt, Homo sapiens
aaccacaugugcaucuaaa

SEQ ID NO: 982383 - RNA, 19 nt, Homo sapiens
ugauuuaaaccgucucuga

SEQ ID NO: 982384 - RNA, 19 nt, Homo sapiens
gcccagaauauuagaaguu

SEQ ID NO: 982385 - RNA, 19 nt, Homo sapiens
cauaugcuuuaaaccaaug

SEQ ID NO: 982386 - RNA, 19 nt, Homo sapiens
uuccaaggcucccaucaga

SEQ ID NO: 982387 - RNA, 19 nt, Homo sapiens
agaguucagugcaggagaa

SEQ ID NO: 982388 - RNA, 19 nt, Homo sapiens
guuuauacauugcaguaca

SEQ ID NO: 982389 - RNA, 19 nt, Homo sapiens
gaugauaccaaaccuaaaa

SEQ ID NO: 982390 - RNA, 19 nt, Homo sapiens
gccagagaucuaagguuua

SEQ ID NO: 982391 - RNA, 19 nt, Homo sapiens
cagcaguggguauauggua

SEQ ID NO: 982392 - RNA, 19 nt, Homo sapiens
guuaauggcagaccuugug

SEQ ID NO: 982393 - RNA, 19 nt, Homo sapiens
gcaccagucagaacagcaa

SEQ ID NO: 982394 - RNA, 19 nt, Homo sapiens
gauuuaaaccgucucugau

SEQ ID NO: 982395 - RNA, 19 nt, Homo sapiens
gcaggagaaagcucuacuu

SEQ ID NO: 982396 - RNA, 19 nt, Homo sapiens
gaaaccauaauuacuugag

SEQ ID NO: 982397 - RNA, 19 nt, Homo sapiens
uuucaggccugcagagugu

SEQ ID NO: 982398 - RNA, 19 nt, Homo sapiens
guaagagauggcaugauau

SEQ ID NO: 982399 - RNA, 19 nt, Homo sapiens
ucucugauuuaaugcaaga

SEQ ID NO: 982400 - RNA, 19 nt, Homo sapiens
agagauggcaugauaugga

SEQ ID NO: 982401 - RNA, 19 nt, Homo sapiens
gaggaggagagucuacaga

SEQ ID NO: 982402 - RNA, 19 nt, Homo sapiens
ugaucucucugacuuucaa

SEQ ID NO: 982403 - RNA, 19 nt, Homo sapiens
ucagaacagcaacagauga

SEQ ID NO: 982404 - RNA, 19 nt, Homo sapiens
caacagaugauaccaaacc

SEQ ID NO: 982405 - RNA, 19 nt, Homo sapiens
ucuauaaagguuucucuug

SEQ ID NO: 982406 - RNA, 19 nt, Homo sapiens
aaacuugcacaaugaaauc

SEQ ID NO: 982407 - RNA, 19 nt, Homo sapiens
cuucauccuccaaaguuua

SEQ ID NO: 982408 - RNA, 19 nt, Homo sapiens
gcucacugugcuugcaaua

SEQ ID NO: 982409 - RNA, 19 nt, Homo sapiens
ucccuuggcuccagaacga

SEQ ID NO: 982410 - RNA, 19 nt, Homo sapiens
caggagaaagcucuacuuc

SEQ ID NO: 982411 - RNA, 19 nt, Homo sapiens
cuaagucuccuguccuuca

SEQ ID NO: 982412 - RNA, 19 nt, Homo sapiens
guaguugccagcccagaau

SEQ ID NO: 982413 - RNA, 19 nt, Homo sapiens
cauuugucaugcuguaguu

SEQ ID NO: 982414 - RNA, 19 nt, Homo sapiens
uggcagaaaugauguacac

SEQ ID NO: 982415 - RNA, 19 nt, Homo sapiens
ccagguagaugaucauuua

SEQ ID NO: 982416 - RNA, 19 nt, Homo sapiens
aaacagauauugccuagaa

SEQ ID NO: 982417 - RNA, 19 nt, Homo sapiens
guaccuaacuauacacuuu

SEQ ID NO: 982418 - RNA, 19 nt, Homo sapiens
ugaaggaacugacaugaaa

SEQ ID NO: 982419 - RNA, 19 nt, Homo sapiens
gauguucucuuugcuguua

SEQ ID NO: 982420 - RNA, 19 nt, Homo sapiens
gcucgaagcugaagcaguu

SEQ ID NO: 982421 - RNA, 19 nt, Homo sapiens
gaaaagagauggacaguca

SEQ ID NO: 982422 - RNA, 19 nt, Homo sapiens
gaacugacaugaaagacau

SEQ ID NO: 982423 - RNA, 19 nt, Homo sapiens
gaaaaugcaucuuugguuu

SEQ ID NO: 982424 - RNA, 19 nt, Homo sapiens
gaaacgcacugcuucaaag

SEQ ID NO: 982425 - RNA, 19 nt, Homo sapiens
caacauguuugucucgaaa

SEQ ID NO: 982426 - RNA, 19 nt, Homo sapiens
gcacaguaauagaggaauu

SEQ ID NO: 982427 - RNA, 19 nt, Homo sapiens
uggcuucacuuaaucauuu

SEQ ID NO: 982428 - RNA, 19 nt, Homo sapiens
ggaauucacuggcuucacu

SEQ ID NO: 982429 - RNA, 19 nt, Homo sapiens
gaaacagucuacuccuugu

SEQ ID NO: 982430 - RNA, 19 nt, Homo sapiens
caaaggaaagaaacagaua

SEQ ID NO: 982431 - RNA, 19 nt, Homo sapiens
caucaagaauggaaacaga

SEQ ID NO: 982432 - RNA, 19 nt, Homo sapiens
uaaaugauguucucuuugc

SEQ ID NO: 982433 - RNA, 19 nt, Homo sapiens
ggaaacgcacugcuucaaa

SEQ ID NO: 982434 - RNA, 19 nt, Homo sapiens
gauguggccuauaucaaug

SEQ ID NO: 982435 - RNA, 19 nt, Homo sapiens
cggaugauguggccuauau

SEQ ID NO: 982436 - RNA, 19 nt, Homo sapiens
cugaagcaguuguaaauga

SEQ ID NO: 982437 - RNA, 19 nt, Homo sapiens
agaaguaccuaacuauaca

SEQ ID NO: 982438 - RNA, 19 nt, Homo sapiens
cauuucacaugucuucaua

SEQ ID NO: 982439 - RNA, 19 nt, Homo sapiens
cuaccagccuuauuggaaa

SEQ ID NO: 982440 - RNA, 19 nt, Homo sapiens
ggaaagaaacagauauugc

SEQ ID NO: 982441 - RNA, 19 nt, Homo sapiens
gaaacaaaggaaagaaaca

SEQ ID NO: 982442 - RNA, 19 nt, Homo sapiens
guacuggauucuugaucuu

SEQ ID NO: 982443 - RNA, 19 nt, Homo sapiens
ugucuuaguuucuguuuca

SEQ ID NO: 982444 - RNA, 19 nt, Homo sapiens
gcucagaagauuauugaau

SEQ ID NO: 982445 - RNA, 19 nt, Homo sapiens
ugaagcaguuguaaaugau

SEQ ID NO: 982446 - RNA, 19 nt, Homo sapiens
ccauggagcuaagcaguau

SEQ ID NO: 982447 - RNA, 19 nt, Homo sapiens
ccuaaucacuauuucauac

SEQ ID NO: 982448 - RNA, 19 nt, Homo sapiens
cuuaguuucuguuucagua

SEQ ID NO: 982449 - RNA, 19 nt, Homo sapiens
gcuaccagccuuauuggaa

SEQ ID NO: 982450 - RNA, 19 nt, Homo sapiens
uaagcaguaugucaggauu

SEQ ID NO: 982451 - RNA, 19 nt, Homo sapiens
cagacucccuaccaugaaa

SEQ ID NO: 982452 - RNA, 19 nt, Homo sapiens
ucacuggcuucacuuaauc

SEQ ID NO: 982453 - RNA, 19 nt, Homo sapiens
ggaaacaaaggaaagaaac

SEQ ID NO: 982454 - RNA, 19 nt, Homo sapiens
guaaaugauguucucuuug

SEQ ID NO: 982455 - RNA, 19 nt, Homo sapiens
gguagaugaucauuuacag

SEQ ID NO: 982456 - RNA, 19 nt, Homo sapiens
ggaacugacaugaaagaca

SEQ ID NO: 982457 - RNA, 19 nt, Homo sapiens
ggcuucacuuaaucauuua

SEQ ID NO: 982458 - RNA, 19 nt, Homo sapiens
gaagcugaagcaguuguaa

SEQ ID NO: 982459 - RNA, 19 nt, Homo sapiens
aaucagggguucaauacua

SEQ ID NO: 982460 - RNA, 19 nt, Homo sapiens
cuagauuugcacaguaaua

SEQ ID NO: 982461 - RNA, 19 nt, Homo sapiens
caucuuugguuuuguguuu

SEQ ID NO: 982462 - RNA, 19 nt, Homo sapiens
cauagaaaaugcaucuuug

SEQ ID NO: 982463 - RNA, 19 nt, Homo sapiens
ucacuugcuuccaacuuag

SEQ ID NO: 982464 - RNA, 19 nt, Homo sapiens
guaaucccauggagcuaag

SEQ ID NO: 982465 - RNA, 19 nt, Homo sapiens
ggagcuaagcaguauguca

SEQ ID NO: 982466 - RNA, 19 nt, Homo sapiens
gcugaacgguuuugaagga

SEQ ID NO: 982467 - RNA, 19 nt, Homo sapiens
uagaaguaccuaacuauac

SEQ ID NO: 982468 - RNA, 19 nt, Homo sapiens
aucacuugcuuccaacuua

SEQ ID NO: 982469 - RNA, 19 nt, Homo sapiens
guagaugaucauuuacaga

SEQ ID NO: 982470 - RNA, 19 nt, Homo sapiens
acaacuguuuggugaccua

SEQ ID NO: 982471 - RNA, 19 nt, Homo sapiens
gaagcaguuguaaaugaug

SEQ ID NO: 982472 - RNA, 19 nt, Homo sapiens
uacagacucccuaccauga

SEQ ID NO: 982473 - RNA, 19 nt, Homo sapiens
cagccuuauuggaaacaaa

SEQ ID NO: 982474 - RNA, 19 nt, Homo sapiens
uaugucaggauuugaagaa

SEQ ID NO: 982475 - RNA, 19 nt, Homo sapiens
aauacuagcuuggacaaac

SEQ ID NO: 982476 - RNA, 19 nt, Homo sapiens
ggcuggugcugguacagaa

SEQ ID NO: 982477 - RNA, 19 nt, Homo sapiens
agacuggaaagcuuugaaa

SEQ ID NO: 982478 - RNA, 19 nt, Homo sapiens
uucaaagacuggaaagcuu

SEQ ID NO: 982479 - RNA, 19 nt, Homo sapiens
gcucaaggugguaggcuau

SEQ ID NO: 982480 - RNA, 19 nt, Homo sapiens
cuauaucaauguggaaaca

SEQ ID NO: 982481 - RNA, 19 nt, Homo sapiens
ucucuuugcuguuaacaac

SEQ ID NO: 982482 - RNA, 19 nt, Homo sapiens
gaaggaacugacaugaaag

SEQ ID NO: 982483 - RNA, 19 nt, Homo sapiens
ccauuaaggacauuucaca

SEQ ID NO: 982484 - RNA, 19 nt, Homo sapiens
aaagagauggacagucaug

SEQ ID NO: 982485 - RNA, 19 nt, Homo sapiens
uggaaacaaaggaaagaaa

SEQ ID NO: 982486 - RNA, 19 nt, Homo sapiens
gucaggauuugaagaaggu

SEQ ID NO: 982487 - RNA, 19 nt, Homo sapiens
uaccauccauuaaggacau

SEQ ID NO: 982488 - RNA, 19 nt, Homo sapiens
caguaugucaggauuugaa

SEQ ID NO: 982489 - RNA, 19 nt, Homo sapiens
auucuagauuugcacagua

SEQ ID NO: 982490 - RNA, 19 nt, Homo sapiens
uggcucagaagauuauuga

SEQ ID NO: 982491 - RNA, 19 nt, Homo sapiens
aaacgcacugcuucaaaga

SEQ ID NO: 982492 - RNA, 19 nt, Homo sapiens
gucuacuccuuguuggaua

SEQ ID NO: 982493 - RNA, 19 nt, Homo sapiens
aagcaguuguaaaugaugu

SEQ ID NO: 982494 - RNA, 19 nt, Homo sapiens
cgaagcugaagcaguugua

SEQ ID NO: 982495 - RNA, 19 nt, Homo sapiens
uucuagauuugcacaguaa

SEQ ID NO: 982496 - RNA, 19 nt, Homo sapiens
caauguggaaacaaaggaa

SEQ ID NO: 982497 - RNA, 19 nt, Homo sapiens
ugauuugucuuaguuucug

SEQ ID NO: 982498 - RNA, 19 nt, Homo sapiens
cgagaagcauuuggaaacg

SEQ ID NO: 982499 - RNA, 19 nt, Homo sapiens
ccgagaagcauuuggaaac

SEQ ID NO: 982500 - RNA, 19 nt, Homo sapiens
gauuccuucccuucaagua

SEQ ID NO: 982501 - RNA, 19 nt, Homo sapiens
ucaauacuagcuuggacaa

SEQ ID NO: 982502 - RNA, 19 nt, Homo sapiens
gauuugcacaguaauagag

SEQ ID NO: 982503 - RNA, 19 nt, Homo sapiens
acaaaggaaagaaacagau

SEQ ID NO: 982504 - RNA, 19 nt, Homo sapiens
uucacuggcuucacuuaau

SEQ ID NO: 982505 - RNA, 19 nt, Homo sapiens
gaauucacuggcuucacuu

SEQ ID NO: 982506 - RNA, 19 nt, Homo sapiens
augaaacagucuacuccuu

SEQ ID NO: 982507 - RNA, 19 nt, Homo sapiens
ggugguaggcuaugcuuuu

SEQ ID NO: 982508 - RNA, 19 nt, Homo sapiens
gcugaagcaguuguaaaug

SEQ ID NO: 982509 - RNA, 19 nt, Homo sapiens
gcuuuuggcucagaagauu

SEQ ID NO: 982510 - RNA, 19 nt, Homo sapiens
agcaguaugucaggauuug

SEQ ID NO: 982511 - RNA, 19 nt, Homo sapiens
gugcugguacagaauguug

SEQ ID NO: 982512 - RNA, 19 nt, Homo sapiens
cuaccgagaagcauuugga

SEQ ID NO: 982513 - RNA, 19 nt, Homo sapiens
aagcugaagcaguuguaaa

SEQ ID NO: 982514 - RNA, 19 nt, Homo sapiens
gauuaucacaacuguuugg

SEQ ID NO: 982515 - RNA, 19 nt, Homo sapiens
guacguaccuguuguguuu

SEQ ID NO: 982516 - RNA, 19 nt, Homo sapiens
ggaagacccuauuauuuaa

SEQ ID NO: 982517 - RNA, 19 nt, Homo sapiens
gggaagacccuauuauuua

SEQ ID NO: 982518 - RNA, 19 nt, Homo sapiens
acacaucacugcauuauuu

SEQ ID NO: 982519 - RNA, 19 nt, Homo sapiens
gagaagugcuccuaauaaa

SEQ ID NO: 982520 - RNA, 19 nt, Homo sapiens
gaacgaaugcacagaaaua

SEQ ID NO: 982521 - RNA, 19 nt, Homo sapiens
gaagauugcauguggguua

SEQ ID NO: 982522 - RNA, 19 nt, Homo sapiens
guacaugucugcuucugaa

SEQ ID NO: 982523 - RNA, 19 nt, Homo sapiens
gcccauggcugucgauauu

SEQ ID NO: 982524 - RNA, 19 nt, Homo sapiens
cagaaucuccugaacuuua

SEQ ID NO: 982525 - RNA, 19 nt, Homo sapiens
gagaacgaaugcacagaaa

SEQ ID NO: 982526 - RNA, 19 nt, Homo sapiens
gaacugcuaugaucuucug

SEQ ID NO: 982527 - RNA, 19 nt, Homo sapiens
cagcaugccuuggacuuua

SEQ ID NO: 982528 - RNA, 19 nt, Homo sapiens
caugucugcuucugaaaua

SEQ ID NO: 982529 - RNA, 19 nt, Homo sapiens
gaguauugaugcuuucuga

SEQ ID NO: 982530 - RNA, 19 nt, Homo sapiens
uggcucaacugaaauauau

SEQ ID NO: 982531 - RNA, 19 nt, Homo sapiens
uaacaguggcguaauugua

SEQ ID NO: 982532 - RNA, 19 nt, Homo sapiens
guggaggccuuuuauauua

SEQ ID NO: 982533 - RNA, 19 nt, Homo sapiens
guauuuaugcugcacuuua

SEQ ID NO: 982534 - RNA, 19 nt, Homo sapiens
gcuauuaucaccuuacuug

SEQ ID NO: 982535 - RNA, 19 nt, Homo sapiens
uuacauugguucuucauug

SEQ ID NO: 982536 - RNA, 19 nt, Homo sapiens
cacagaaucuccugaacuu

SEQ ID NO: 982537 - RNA, 19 nt, Homo sapiens
cgaaugcacagaaauauug

SEQ ID NO: 982538 - RNA, 19 nt, Homo sapiens
ugagaagugcuccuaauaa

SEQ ID NO: 982539 - RNA, 19 nt, Homo sapiens
gcauucugcuugguauuaa

SEQ ID NO: 982540 - RNA, 19 nt, Homo sapiens
gguacacgaugcuuuacaa

SEQ ID NO: 982541 - RNA, 19 nt, Homo sapiens
uagauugguucaagauuug

SEQ ID NO: 982542 - RNA, 19 nt, Homo sapiens
gcaaaacucuguaauacuc

SEQ ID NO: 982543 - RNA, 19 nt, Homo sapiens
gaagccgucuacccacuau

SEQ ID NO: 982544 - RNA, 19 nt, Homo sapiens
cuccugaacuuuaugauug

SEQ ID NO: 982545 - RNA, 19 nt, Homo sapiens
ggauuauuguuccuguaaa

SEQ ID NO: 982546 - RNA, 19 nt, Homo sapiens
gcaaugcuuccucugguuu

SEQ ID NO: 982547 - RNA, 19 nt, Homo sapiens
cagauuacguuaccacagu

SEQ ID NO: 982548 - RNA, 19 nt, Homo sapiens
caacacaucacugcauuau

SEQ ID NO: 982549 - RNA, 19 nt, Homo sapiens
cuucaugccuauggaauaa

SEQ ID NO: 982550 - RNA, 19 nt, Homo sapiens
ugggaagacccuauuauuu

SEQ ID NO: 982551 - RNA, 19 nt, Homo sapiens
gauagcaaacauagaaaug

SEQ ID NO: 982552 - RNA, 19 nt, Homo sapiens
caguucagcuguucuuuag

SEQ ID NO: 982553 - RNA, 19 nt, Homo sapiens
uauauuacgccuucccaua

SEQ ID NO: 982554 - RNA, 19 nt, Homo sapiens
gagaacugcuaugaucuuc

SEQ ID NO: 982555 - RNA, 19 nt, Homo sapiens
gaucuagugcuucucgaaa

SEQ ID NO: 982556 - RNA, 19 nt, Homo sapiens
caguugguguucuuuauau

SEQ ID NO: 982557 - RNA, 19 nt, Homo sapiens
uacauugguucuucauuga

SEQ ID NO: 982558 - RNA, 19 nt, Homo sapiens
gauuauuguuccuguaaag

SEQ ID NO: 982559 - RNA, 19 nt, Homo sapiens
cguguaaucugcaguccuu

SEQ ID NO: 982560 - RNA, 19 nt, Homo sapiens
gguuagacuuacagacuug

SEQ ID NO: 982561 - RNA, 19 nt, Homo sapiens
uaacaguguaugagaacua

SEQ ID NO: 982562 - RNA, 19 nt, Homo sapiens
gcauguggguuagggaaau

SEQ ID NO: 982563 - RNA, 19 nt, Homo sapiens
ugucgaguauugaugcuuu

SEQ ID NO: 982564 - RNA, 19 nt, Homo sapiens
ccuuaacaguggcguaauu

SEQ ID NO: 982565 - RNA, 19 nt, Homo sapiens
caacccaaguccagauuac

SEQ ID NO: 982566 - RNA, 19 nt, Homo sapiens
ccaguugguguucuuuaua

SEQ ID NO: 982567 - RNA, 19 nt, Homo sapiens
agaaucuccugaacuuuau

SEQ ID NO: 982568 - RNA, 19 nt, Homo sapiens
ucgcuucucucaacaguuc

SEQ ID NO: 982569 - RNA, 19 nt, Homo sapiens
uaucauauaugggaacaag

SEQ ID NO: 982570 - RNA, 19 nt, Homo sapiens
gugggaagacccuauuauu

SEQ ID NO: 982571 - RNA, 19 nt, Homo sapiens
gcacagaaucuccugaacu

SEQ ID NO: 982572 - RNA, 19 nt, Homo sapiens
guucaagauuuguuuggau

SEQ ID NO: 982573 - RNA, 19 nt, Homo sapiens
guaauuguacguaccuguu

SEQ ID NO: 982574 - RNA, 19 nt, Homo sapiens
aggguaauauuaucugcua

SEQ ID NO: 982575 - RNA, 19 nt, Homo sapiens
ggacuuuauugugggaaga

SEQ ID NO: 982576 - RNA, 19 nt, Homo sapiens
ccaaguccagauuacguua

SEQ ID NO: 982577 - RNA, 19 nt, Homo sapiens
ucugauagcaaacauagaa

SEQ ID NO: 982578 - RNA, 19 nt, Homo sapiens
ggcaaugcuuccucugguu

SEQ ID NO: 982579 - RNA, 19 nt, Homo sapiens
cuucaaggauacucucaga

SEQ ID NO: 982580 - RNA, 19 nt, Homo sapiens
aaauggcucaacugaaaua

SEQ ID NO: 982581 - RNA, 19 nt, Homo sapiens
cagcauggcagcuauuauc

SEQ ID NO: 982582 - RNA, 19 nt, Homo sapiens
ccugagaagugcuccuaau

SEQ ID NO: 982583 - RNA, 19 nt, Homo sapiens
gcucuaucuuggauuuaug

SEQ ID NO: 982584 - RNA, 19 nt, Homo sapiens
gauuggcucuaucuuggau

SEQ ID NO: 982585 - RNA, 19 nt, Homo sapiens
guuuauagauugguucaag

SEQ ID NO: 982586 - RNA, 19 nt, Homo sapiens
ggucugauagcaaacauag

SEQ ID NO: 982587 - RNA, 19 nt, Homo sapiens
acucuguaauacucuguua

SEQ ID NO: 982588 - RNA, 19 nt, Homo sapiens
cugagaagugcuccuaaua

SEQ ID NO: 982589 - RNA, 19 nt, Homo sapiens
gaaaagacuuauuguucuc

SEQ ID NO: 982590 - RNA, 19 nt, Homo sapiens
ccauggcugucgauauuca

SEQ ID NO: 982591 - RNA, 19 nt, Homo sapiens
gguguucuuuauauucguu

SEQ ID NO: 982592 - RNA, 19 nt, Homo sapiens
uggcagcuauuaucaccuu

SEQ ID NO: 982593 - RNA, 19 nt, Homo sapiens
ccaacacaucacugcauua

SEQ ID NO: 982594 - RNA, 19 nt, Homo sapiens
cuuuacuucuucccaauuu

SEQ ID NO: 982595 - RNA, 19 nt, Homo sapiens
cccacuauauaccauugua

SEQ ID NO: 982596 - RNA, 19 nt, Homo sapiens
caagaggacagagaacgaa

SEQ ID NO: 982597 - RNA, 19 nt, Homo sapiens
ccuguuguguuucaguuug

SEQ ID NO: 982598 - RNA, 19 nt, Homo sapiens
ucaaggauacucucagaag

SEQ ID NO: 982599 - RNA, 19 nt, Homo sapiens
caucacugcauuauuugaa

SEQ ID NO: 982600 - RNA, 19 nt, Homo sapiens
gaaaaugcaaaacucugua

SEQ ID NO: 982601 - RNA, 19 nt, Homo sapiens
agauuacguuaccacagua

SEQ ID NO: 982602 - RNA, 19 nt, Homo sapiens
uccaacacaucacugcauu

SEQ ID NO: 982603 - RNA, 19 nt, Homo sapiens
ucuuaacaguguaugagaa

SEQ ID NO: 982604 - RNA, 19 nt, Homo sapiens
guaccuacaccagcccuuu

SEQ ID NO: 982605 - RNA, 19 nt, Homo sapiens
cagaguggauaaacuugag

SEQ ID NO: 982606 - RNA, 19 nt, Homo sapiens
gguucaagauuuguuugga

SEQ ID NO: 982607 - RNA, 19 nt, Homo sapiens
ucucuucagccacugguua

SEQ ID NO: 982608 - RNA, 19 nt, Homo sapiens
cgccuucccauacauuaua

SEQ ID NO: 982609 - RNA, 19 nt, Homo sapiens
ggcucuaucuuggauuuau

SEQ ID NO: 982610 - RNA, 19 nt, Homo sapiens
uaugauuggcucuaucuug

SEQ ID NO: 982611 - RNA, 19 nt, Homo sapiens
ccagaguggauaaacuuga

SEQ ID NO: 982612 - RNA, 19 nt, Homo sapiens
ucguucaugucgaguauug

SEQ ID NO: 982613 - RNA, 19 nt, Homo sapiens
gaaugcacagaaauauugu

SEQ ID NO: 982614 - RNA, 19 nt, Homo sapiens
uggauuauuguuccuguaa

SEQ ID NO: 982615 - RNA, 19 nt, Homo sapiens
ccaugaaggugaagauuaa

SEQ ID NO: 982616 - RNA, 19 nt, Homo sapiens
gcaacaagguggaaacaag

SEQ ID NO: 982617 - RNA, 19 nt, Homo sapiens
gccaugaaggugaagauua

SEQ ID NO: 982618 - RNA, 19 nt, Homo sapiens
ggccaacgaugagaacugu

SEQ ID NO: 982619 - RNA, 19 nt, Homo sapiens
ucugcaggauggcauuuaa

SEQ ID NO: 982620 - RNA, 19 nt, Homo sapiens
ggcuggagcugcguuuguu

SEQ ID NO: 982621 - RNA, 19 nt, Homo sapiens
aucacuauguugacacuuu

SEQ ID NO: 982622 - RNA, 19 nt, Homo sapiens
cgccaggaauggaaguuca

SEQ ID NO: 982623 - RNA, 19 nt, Homo sapiens
ugaaggugaagauuaagug

SEQ ID NO: 982624 - RNA, 19 nt, Homo sapiens
gaugcugcccugacugcaa

SEQ ID NO: 982625 - RNA, 19 nt, Homo sapiens
ucacuauguugacacuuuu

SEQ ID NO: 982626 - RNA, 19 nt, Homo sapiens
gggcuggagcugcguuugu

SEQ ID NO: 982627 - RNA, 19 nt, Homo sapiens
gcccauuugagaucuuuga

SEQ ID NO: 982628 - RNA, 19 nt, Homo sapiens
ggagauagcuggaaugaga

SEQ ID NO: 982629 - RNA, 19 nt, Homo sapiens
ggaacaaccuucauuggaa

SEQ ID NO: 982630 - RNA, 19 nt, Homo sapiens
gaacaaccuucauuggaau

SEQ ID NO: 982631 - RNA, 19 nt, Homo sapiens
gaucccaccucucagcaua

SEQ ID NO: 982632 - RNA, 19 nt, Homo sapiens
ccacgucacugccuguauu

SEQ ID NO: 982633 - RNA, 19 nt, Homo sapiens
ggagaaugguggaacugaa

SEQ ID NO: 982634 - RNA, 19 nt, Homo sapiens
ucaccgaacugaugagaga

SEQ ID NO: 982635 - RNA, 19 nt, Homo sapiens
caaauuaggcucagacauc

SEQ ID NO: 982636 - RNA, 19 nt, Homo sapiens
gaauaucacacuuggcaaa

SEQ ID NO: 982637 - RNA, 19 nt, Homo sapiens
aaagagcccuggucccauu

SEQ ID NO: 982638 - RNA, 19 nt, Homo sapiens
gaaaucaaggaaaguauuc

SEQ ID NO: 982639 - RNA, 19 nt, Homo sapiens
gcaugguucuguuaaagga

SEQ ID NO: 982640 - RNA, 19 nt, Homo sapiens
ggaugagccugcuauucuu

SEQ ID NO: 982641 - RNA, 19 nt, Homo sapiens
caagcaugguucuguuaaa

SEQ ID NO: 982642 - RNA, 19 nt, Homo sapiens
gggaaucucugugcucaug

SEQ ID NO: 982643 - RNA, 19 nt, Homo sapiens
gcuugaggcucucuaugaa

SEQ ID NO: 982644 - RNA, 19 nt, Homo sapiens
gcaagcaugguucuguuaa

SEQ ID NO: 982645 - RNA, 19 nt, Homo sapiens
ccacaucccagucaguuaa

SEQ ID NO: 982646 - RNA, 19 nt, Homo sapiens
gaagaaagccuuguguacu

SEQ ID NO: 982647 - RNA, 19 nt, Homo sapiens
agagagacccguuuccuuu

SEQ ID NO: 982648 - RNA, 19 nt, Homo sapiens
gugaauuccuagaucguuu

SEQ ID NO: 982649 - RNA, 19 nt, Homo sapiens
gugcugagcugaagaaagc

SEQ ID NO: 982650 - RNA, 19 nt, Homo sapiens
ggacucuucuauccuagga

SEQ ID NO: 982651 - RNA, 19 nt, Homo sapiens
uaucacacuuggcaaagaa

SEQ ID NO: 982652 - RNA, 19 nt, Homo sapiens
gcaaagaaagcagggagaa

SEQ ID NO: 982653 - RNA, 19 nt, Homo sapiens
gcuugaagaugaacuugau

SEQ ID NO: 982654 - RNA, 19 nt, Homo sapiens
guacugcccaugagaaguu

SEQ ID NO: 982655 - RNA, 19 nt, Homo sapiens
uagcagaguggaaacauuu

SEQ ID NO: 982656 - RNA, 19 nt, Homo sapiens
gcaaaggcagugaguguca

SEQ ID NO: 982657 - RNA, 19 nt, Homo sapiens
aagaaagccuuguguacug

SEQ ID NO: 982658 - RNA, 19 nt, Homo sapiens
acuaugacaguguguauua

SEQ ID NO: 982659 - RNA, 19 nt, Homo sapiens
cagcaagcaugguucuguu

SEQ ID NO: 982660 - RNA, 19 nt, Homo sapiens
gagccaggaugccacuuuc

SEQ ID NO: 982661 - RNA, 19 nt, Homo sapiens
augcagcucucccugauaa

SEQ ID NO: 982662 - RNA, 19 nt, Homo sapiens
ggcagugagugucaacuau

SEQ ID NO: 982663 - RNA, 19 nt, Homo sapiens
gaauuggggugcaguaguu

SEQ ID NO: 982664 - RNA, 19 nt, Homo sapiens
ggacuaugacaguguguau

SEQ ID NO: 982665 - RNA, 19 nt, Homo sapiens
uaacagacuagaaggaaga

SEQ ID NO: 982666 - RNA, 19 nt, Homo sapiens
ugagaaaucaaggaaagua

SEQ ID NO: 982667 - RNA, 19 nt, Homo sapiens
ucccgaagcuucuuugauc

SEQ ID NO: 982668 - RNA, 19 nt, Homo sapiens
caagugcucuagcugucaa

SEQ ID NO: 982669 - RNA, 19 nt, Homo sapiens
gagagagacccguuuccuu

SEQ ID NO: 982670 - RNA, 19 nt, Homo sapiens
ugacagauauaagcaacga

SEQ ID NO: 982671 - RNA, 19 nt, Homo sapiens
aaagaaagcagggagaaug

SEQ ID NO: 982672 - RNA, 19 nt, Homo sapiens
acaaccagcuuuugacuuu

SEQ ID NO: 982673 - RNA, 19 nt, Homo sapiens
gagaaaucaaggaaaguau

SEQ ID NO: 982674 - RNA, 19 nt, Homo sapiens
gcaguucggacacaucuuc

SEQ ID NO: 982675 - RNA, 19 nt, Homo sapiens
ggagccaggaugccacuuu

SEQ ID NO: 982676 - RNA, 19 nt, Homo sapiens
uacacuugcuugaagauga

SEQ ID NO: 982677 - RNA, 19 nt, Homo sapiens
guuagugaauuccuagauc

SEQ ID NO: 982678 - RNA, 19 nt, Homo sapiens
gagccugcuauucuuguua

SEQ ID NO: 982679 - RNA, 19 nt, Homo sapiens
aaugugauaugcucaagug

SEQ ID NO: 982680 - RNA, 19 nt, Homo sapiens
acacuugcuugaagaugaa

SEQ ID NO: 982681 - RNA, 19 nt, Homo sapiens
cugcuauucuuguuaguga

SEQ ID NO: 982682 - RNA, 19 nt, Homo sapiens
ccagucaguuaauggauca

SEQ ID NO: 982683 - RNA, 19 nt, Homo sapiens
guucugaggacucuucuau

SEQ ID NO: 982684 - RNA, 19 nt, Homo sapiens
gaccugaccacccauuuca

SEQ ID NO: 982685 - RNA, 19 nt, Homo sapiens
uccggcagcugauagauga

SEQ ID NO: 982686 - RNA, 19 nt, Homo sapiens
caaaggcagugagugucaa

SEQ ID NO: 982687 - RNA, 19 nt, Homo sapiens
ucugagaaaucaaggaaag

SEQ ID NO: 982688 - RNA, 19 nt, Homo sapiens
ggaaugugauaugcucaag

SEQ ID NO: 982689 - RNA, 19 nt, Homo sapiens
caaccuucauuggaaucua

SEQ ID NO: 982690 - RNA, 19 nt, Homo sapiens
ggaccugaccacccauuuc

SEQ ID NO: 982691 - RNA, 19 nt, Homo sapiens
agacuagaaggaagacuaa

SEQ ID NO: 982692 - RNA, 19 nt, Homo sapiens
gggcguguaguuccucuuu

SEQ ID NO: 982693 - RNA, 19 nt, Homo sapiens
cuaugacaguguguauuaa

SEQ ID NO: 982694 - RNA, 19 nt, Homo sapiens
gcagcaagcaugguucugu

SEQ ID NO: 982695 - RNA, 19 nt, Homo sapiens
gagagacccguuuccuuuc

SEQ ID NO: 982696 - RNA, 19 nt, Homo sapiens
uguucuggguuaaucauaa

SEQ ID NO: 982697 - RNA, 19 nt, Homo sapiens
ccaugcagcucucccugau

SEQ ID NO: 982698 - RNA, 19 nt, Homo sapiens
ccagaccgauuugggaugu

SEQ ID NO: 982699 - RNA, 19 nt, Homo sapiens
ggaaucuacaagcaaagaa

SEQ ID NO: 982700 - RNA, 19 nt, Homo sapiens
cagacuagaaggaagacua

SEQ ID NO: 982701 - RNA, 19 nt, Homo sapiens
uagcaaaggcagugagugu

SEQ ID NO: 982702 - RNA, 19 nt, Homo sapiens
gaacuugaucaccgaacug

SEQ ID NO: 982703 - RNA, 19 nt, Homo sapiens
gauaugcucaagugcucua

SEQ ID NO: 982704 - RNA, 19 nt, Homo sapiens
gaaaauccggcagcugaua

SEQ ID NO: 982705 - RNA, 19 nt, Homo sapiens
gcaguguucugaggacucu

SEQ ID NO: 982706 - RNA, 19 nt, Homo sapiens
guuaacagacuagaaggaa

SEQ ID NO: 982707 - RNA, 19 nt, Homo sapiens
ucucugugcucaugcugaa

SEQ ID NO: 982708 - RNA, 19 nt, Homo sapiens
cugauaacauguucgcaau

SEQ ID NO: 982709 - RNA, 19 nt, Homo sapiens
ugaagaaagccuuguguac

SEQ ID NO: 982710 - RNA, 19 nt, Homo sapiens
cggaacaaccuucauugga

SEQ ID NO: 982711 - RNA, 19 nt, Homo sapiens
gcagugagugucaacuauc

SEQ ID NO: 982712 - RNA, 19 nt, Homo sapiens
gcguguaguuccucuuugg

SEQ ID NO: 982713 - RNA, 19 nt, Homo sapiens
gaugagccugcuauucuug

SEQ ID NO: 982714 - RNA, 19 nt, Homo sapiens
gaugugcugagcugaagaa

SEQ ID NO: 982715 - RNA, 19 nt, Homo sapiens
uuagcagaguggaaacauu

SEQ ID NO: 982716 - RNA, 19 nt, Homo sapiens
agagacccguuuccuuuca

SEQ ID NO: 982717 - RNA, 19 nt, Homo sapiens
gcugaaacggacuccauga

SEQ ID NO: 982718 - RNA, 19 nt, Homo sapiens
cuagaaggaagacuaagga

SEQ ID NO: 982719 - RNA, 19 nt, Homo sapiens
caaagaaagcagggagaau

SEQ ID NO: 982720 - RNA, 19 nt, Homo sapiens
ucauuggaaucuacaagca

SEQ ID NO: 982721 - RNA, 19 nt, Homo sapiens
aagcaugguucuguuaaag

SEQ ID NO: 982722 - RNA, 19 nt, Homo sapiens
gaaucuacaagcaaagaag

SEQ ID NO: 982723 - RNA, 19 nt, Homo sapiens
ccggaggacuugaaaacua

SEQ ID NO: 982724 - RNA, 19 nt, Homo sapiens
uggaugagccugcuauucu

SEQ ID NO: 982725 - RNA, 19 nt, Homo sapiens
gcugauagaugaggggauu

SEQ ID NO: 982726 - RNA, 19 nt, Homo sapiens
uugaggcucucuaugaauc

SEQ ID NO: 982727 - RNA, 19 nt, Homo sapiens
guucuggguuaaucauaag

SEQ ID NO: 982728 - RNA, 19 nt, Homo sapiens
gguagaagguggagcuaua

SEQ ID NO: 982729 - RNA, 19 nt, Homo sapiens
gaucaggcgucauuuaaau

SEQ ID NO: 982730 - RNA, 19 nt, Homo sapiens
ggaaggagcagcagucuug

SEQ ID NO: 982731 - RNA, 19 nt, Homo sapiens
gcacuaagaggaaaccuaa

SEQ ID NO: 982732 - RNA, 19 nt, Homo sapiens
gagaagagcuuuucagaga

SEQ ID NO: 982733 - RNA, 19 nt, Homo sapiens
gagccucccucaugucuuu

SEQ ID NO: 982734 - RNA, 19 nt, Homo sapiens
gaacaaauuggcccauauu

SEQ ID NO: 982735 - RNA, 19 nt, Homo sapiens
gcaugucacuugcugguuu

SEQ ID NO: 982736 - RNA, 19 nt, Homo sapiens
acagagaaaucaccaaaug

SEQ ID NO: 982737 - RNA, 19 nt, Homo sapiens
agacagccauccauuugua

SEQ ID NO: 982738 - RNA, 19 nt, Homo sapiens
gcagcagucuugcaaggaa

SEQ ID NO: 982739 - RNA, 19 nt, Homo sapiens
caagacagccauccauuug

SEQ ID NO: 982740 - RNA, 19 nt, Homo sapiens
ggauguggcuuuuggauuu

SEQ ID NO: 982741 - RNA, 19 nt, Homo sapiens
acaagaagcuagaaagagu

SEQ ID NO: 982742 - RNA, 19 nt, Homo sapiens
gcagagagauauaaaauac

SEQ ID NO: 982743 - RNA, 19 nt, Homo sapiens
cuauauaccuuucuggaau

SEQ ID NO: 982744 - RNA, 19 nt, Homo sapiens
caagaaugguacuccaaga

SEQ ID NO: 982745 - RNA, 19 nt, Homo sapiens
aaacuuagcagagagauau

SEQ ID NO: 982746 - RNA, 19 nt, Homo sapiens
gagaagcaacacuuuguga

SEQ ID NO: 982747 - RNA, 19 nt, Homo sapiens
aagcaaagcgugccauuga

SEQ ID NO: 982748 - RNA, 19 nt, Homo sapiens
ccaagacagccauccauuu

SEQ ID NO: 982749 - RNA, 19 nt, Homo sapiens
agaaaucaccaaaugcuuu

SEQ ID NO: 982750 - RNA, 19 nt, Homo sapiens
gcagcucaguucacaagau

SEQ ID NO: 982751 - RNA, 19 nt, Homo sapiens
gaagcaacacuuugugauc

SEQ ID NO: 982752 - RNA, 19 nt, Homo sapiens
guacagacaagaagcuaga

SEQ ID NO: 982753 - RNA, 19 nt, Homo sapiens
aaaccuaaauguccugaag

SEQ ID NO: 982754 - RNA, 19 nt, Homo sapiens
uuugugaucucauggcuuu

SEQ ID NO: 982755 - RNA, 19 nt, Homo sapiens
cagcucaguucacaagaug

SEQ ID NO: 982756 - RNA, 19 nt, Homo sapiens
gaagcuagaaagaguggaa

SEQ ID NO: 982757 - RNA, 19 nt, Homo sapiens
gcagaggugcugaggauca

SEQ ID NO: 982758 - RNA, 19 nt, Homo sapiens
agagaaagguacagacaag

SEQ ID NO: 982759 - RNA, 19 nt, Homo sapiens
ucauggcuuugauugauuu

SEQ ID NO: 982760 - RNA, 19 nt, Homo sapiens
gaucucauggcuuugauug

SEQ ID NO: 982761 - RNA, 19 nt, Homo sapiens
cuucugagccuguucauau

SEQ ID NO: 982762 - RNA, 19 nt, Homo sapiens
aagaacaaauuggcccaua

SEQ ID NO: 982763 - RNA, 19 nt, Homo sapiens
ggagauagcaguggauuuu

SEQ ID NO: 982764 - RNA, 19 nt, Homo sapiens
agacaucaagcccuacaua

SEQ ID NO: 982765 - RNA, 19 nt, Homo sapiens
cagggaaucuuuuaacuga

SEQ ID NO: 982766 - RNA, 19 nt, Homo sapiens
gaaagguacagacaagaag

SEQ ID NO: 982767 - RNA, 19 nt, Homo sapiens
agaacaaauuggcccauau

SEQ ID NO: 982768 - RNA, 19 nt, Homo sapiens
gaagcaaagcgugccauug

SEQ ID NO: 982769 - RNA, 19 nt, Homo sapiens
ggagcuauauaccuuucug

SEQ ID NO: 982770 - RNA, 19 nt, Homo sapiens
ggaagcaaagcgugccauu

SEQ ID NO: 982771 - RNA, 19 nt, Homo sapiens
guugaucaggcgucauuua

SEQ ID NO: 982772 - RNA, 19 nt, Homo sapiens
uaagaggaaaccuaaaugu

SEQ ID NO: 982773 - RNA, 19 nt, Homo sapiens
ucucauggcuuugauugau

SEQ ID NO: 982774 - RNA, 19 nt, Homo sapiens
gcaacacuuugugaucuca

SEQ ID NO: 982775 - RNA, 19 nt, Homo sapiens
gaucuuuggauguggcuuu

SEQ ID NO: 982776 - RNA, 19 nt, Homo sapiens
gcuauauaccuuucuggaa

SEQ ID NO: 982777 - RNA, 19 nt, Homo sapiens
cgagccuguuugaggauua

SEQ ID NO: 982778 - RNA, 19 nt, Homo sapiens
gcuauucucgagccuguuu

SEQ ID NO: 982779 - RNA, 19 nt, Homo sapiens
ggagacagggaaucuuuua

SEQ ID NO: 982780 - RNA, 19 nt, Homo sapiens
ggaagcggaagguugaaug

SEQ ID NO: 982781 - RNA, 19 nt, Homo sapiens
caaggaagcagggcagaga

SEQ ID NO: 982782 - RNA, 19 nt, Homo sapiens
gcacacccguacuagacau

SEQ ID NO: 982783 - RNA, 19 nt, Homo sapiens
gaaaucaccaaaugcuuuu

SEQ ID NO: 982784 - RNA, 19 nt, Homo sapiens
gagaaaucaccaaaugcuu

SEQ ID NO: 982785 - RNA, 19 nt, Homo sapiens
ucauugaucuuuggaugug

SEQ ID NO: 982786 - RNA, 19 nt, Homo sapiens
ucuuuaagguagcaucauu

SEQ ID NO: 982787 - RNA, 19 nt, Homo sapiens
agacaagaagcuagaaaga

SEQ ID NO: 982788 - RNA, 19 nt, Homo sapiens
ccauagcacuaagaggaaa

SEQ ID NO: 982789 - RNA, 19 nt, Homo sapiens
uaaccaacauacaccaaac

SEQ ID NO: 982790 - RNA, 19 nt, Homo sapiens
ccagucggcuacuuggaau

SEQ ID NO: 982791 - RNA, 19 nt, Homo sapiens
ggaccgccuuuucuacuuu

SEQ ID NO: 982792 - RNA, 19 nt, Homo sapiens
agaaagguacagacaagaa

SEQ ID NO: 982793 - RNA, 19 nt, Homo sapiens
cagcguggcagaagaacaa

SEQ ID NO: 982794 - RNA, 19 nt, Homo sapiens
uugcagaggugcugaggau

SEQ ID NO: 982795 - RNA, 19 nt, Homo sapiens
gcucaguucacaagauguu

SEQ ID NO: 982796 - RNA, 19 nt, Homo sapiens
cagaauucagcaagcauuu

SEQ ID NO: 982797 - RNA, 19 nt, Homo sapiens
gcaagacugacagcuguga

SEQ ID NO: 982798 - RNA, 19 nt, Homo sapiens
uaaacuuagcagagagaua

SEQ ID NO: 982799 - RNA, 19 nt, Homo sapiens
aagcaacacuuugugaucu

SEQ ID NO: 982800 - RNA, 19 nt, Homo sapiens
ucaggcgucauuuaaauau

SEQ ID NO: 982801 - RNA, 19 nt, Homo sapiens
uagaagguggagcuauaua

SEQ ID NO: 982802 - RNA, 19 nt, Homo sapiens
ugaugggccuagaacaguu

SEQ ID NO: 982803 - RNA, 19 nt, Homo sapiens
auacagagaaaucaccaaa

SEQ ID NO: 982804 - RNA, 19 nt, Homo sapiens
gagaaagguacagacaaga

SEQ ID NO: 982805 - RNA, 19 nt, Homo sapiens
aaaaugugauggagccuuu

SEQ ID NO: 982806 - RNA, 19 nt, Homo sapiens
guagaagguggagcuauau

SEQ ID NO: 982807 - RNA, 19 nt, Homo sapiens
cagaggugcugaggaucaa

SEQ ID NO: 982808 - RNA, 19 nt, Homo sapiens
cauugaggcugugcuguca

SEQ ID NO: 982809 - RNA, 19 nt, Homo sapiens
caggcgucauuuaaauauu

SEQ ID NO: 982810 - RNA, 19 nt, Homo sapiens
ccagaauucagcaagcauu

SEQ ID NO: 982811 - RNA, 19 nt, Homo sapiens
gcuaauguugugucgagaa

SEQ ID NO: 982812 - RNA, 19 nt, Homo sapiens
caugucacuugcugguuug

SEQ ID NO: 982813 - RNA, 19 nt, Homo sapiens
uaauaauccugaacauucc

SEQ ID NO: 982814 - RNA, 19 nt, Homo sapiens
gaugggccuagaacaguuu

SEQ ID NO: 982815 - RNA, 19 nt, Homo sapiens
uugaucaggcgucauuuaa

SEQ ID NO: 982816 - RNA, 19 nt, Homo sapiens
gacaagaagcuagaaagag

SEQ ID NO: 982817 - RNA, 19 nt, Homo sapiens
ucagcaagcauuuccuaug

SEQ ID NO: 982818 - RNA, 19 nt, Homo sapiens
gacaucaagcccuacauag

SEQ ID NO: 982819 - RNA, 19 nt, Homo sapiens
gccagucggcuacuuggaa

SEQ ID NO: 982820 - RNA, 19 nt, Homo sapiens
gggcagcucaguucacaag

SEQ ID NO: 982821 - RNA, 19 nt, Homo sapiens
cuaagaggaaaccuaaaug

SEQ ID NO: 982822 - RNA, 19 nt, Homo sapiens
cagaauaaccaacauacac

SEQ ID NO: 982823 - RNA, 19 nt, Homo sapiens
gccuuuagcagacuuuaau

SEQ ID NO: 982824 - RNA, 19 nt, Homo sapiens
guggagcuauauaccuuuc

SEQ ID NO: 982825 - RNA, 19 nt, Homo sapiens
guucacaagauguugauca

SEQ ID NO: 982826 - RNA, 19 nt, Homo sapiens
gaagcagggcagagacaca

SEQ ID NO: 982827 - RNA, 19 nt, Homo sapiens
ucagagaaagguacagaca

SEQ ID NO: 982828 - RNA, 19 nt, Homo sapiens
gccagaaccuuccuuauua

SEQ ID NO: 982829 - RNA, 19 nt, Homo sapiens
gcaagugcauacagaaaua

SEQ ID NO: 982830 - RNA, 19 nt, Homo sapiens
gaggaaagcugcaucuuau

SEQ ID NO: 982831 - RNA, 19 nt, Homo sapiens
gaaccuuccuuauuagaaa

SEQ ID NO: 982832 - RNA, 19 nt, Homo sapiens
gaacauuucugcagagaca

SEQ ID NO: 982833 - RNA, 19 nt, Homo sapiens
ggaggaaagcugcaucuua

SEQ ID NO: 982834 - RNA, 19 nt, Homo sapiens
ggucgaacacguuuauuua

SEQ ID NO: 982835 - RNA, 19 nt, Homo sapiens
gaaauaugcccacacauca

SEQ ID NO: 982836 - RNA, 19 nt, Homo sapiens
ugaaacaacuugauaaucg

SEQ ID NO: 982837 - RNA, 19 nt, Homo sapiens
caacagaggcuuccaugga

SEQ ID NO: 982838 - RNA, 19 nt, Homo sapiens
gugcauuauuucugucuua

SEQ ID NO: 982839 - RNA, 19 nt, Homo sapiens
gaagacuuaucccaacaga

SEQ ID NO: 982840 - RNA, 19 nt, Homo sapiens
aaacaucgcccaacacaga

SEQ ID NO: 982841 - RNA, 19 nt, Homo sapiens
ggacugcuccucucuuaga

SEQ ID NO: 982842 - RNA, 19 nt, Homo sapiens
gaucuaacaguaagaaaug

SEQ ID NO: 982843 - RNA, 19 nt, Homo sapiens
ucaaauguccacaguguaa

SEQ ID NO: 982844 - RNA, 19 nt, Homo sapiens
ugacaaacaucgcccaaca

SEQ ID NO: 982845 - RNA, 19 nt, Homo sapiens
ggccagaaccuuccuuauu

SEQ ID NO: 982846 - RNA, 19 nt, Homo sapiens
gacaacaccuuggaagaga

SEQ ID NO: 982847 - RNA, 19 nt, Homo sapiens
ggagggagcaguccagaug

SEQ ID NO: 982848 - RNA, 19 nt, Homo sapiens
ggaaagcugcaucuuaugu

SEQ ID NO: 982849 - RNA, 19 nt, Homo sapiens
aaagggagcugcuaucaac

SEQ ID NO: 982850 - RNA, 19 nt, Homo sapiens
ucacccauguuuguuguua

SEQ ID NO: 982851 - RNA, 19 nt, Homo sapiens
caagaaaugcugagaaugg

SEQ ID NO: 982852 - RNA, 19 nt, Homo sapiens
cagcaaagcauuucuucaa

SEQ ID NO: 982853 - RNA, 19 nt, Homo sapiens
gaaggaaugccagagauug

SEQ ID NO: 982854 - RNA, 19 nt, Homo sapiens
gaaacaacuugauaaucgu

SEQ ID NO: 982855 - RNA, 19 nt, Homo sapiens
gaaagcugcaucuuauguu

SEQ ID NO: 982856 - RNA, 19 nt, Homo sapiens
aggaagaucugcuuugugu

SEQ ID NO: 982857 - RNA, 19 nt, Homo sapiens
gacuaaagcuccaguacag

SEQ ID NO: 982858 - RNA, 19 nt, Homo sapiens
uuucauaugccucuucuua

SEQ ID NO: 982859 - RNA, 19 nt, Homo sapiens
caacaaggaaaugcguuua

SEQ ID NO: 982860 - RNA, 19 nt, Homo sapiens
ccagugaaacaacuugaua

SEQ ID NO: 982861 - RNA, 19 nt, Homo sapiens
gcacagaauccuacucaag

SEQ ID NO: 982862 - RNA, 19 nt, Homo sapiens
gagacagcuuugaggauga

SEQ ID NO: 982863 - RNA, 19 nt, Homo sapiens
cuacauaccugaaaacuca

SEQ ID NO: 982864 - RNA, 19 nt, Homo sapiens
acagaaauaugcccacaca

SEQ ID NO: 982865 - RNA, 19 nt, Homo sapiens
cuuauguugugaagacuua

SEQ ID NO: 982866 - RNA, 19 nt, Homo sapiens
caacacagaacauccaaca

SEQ ID NO: 982867 - RNA, 19 nt, Homo sapiens
ggguugccuuucacaauuu

SEQ ID NO: 982868 - RNA, 19 nt, Homo sapiens
cagcaccuguccagugaaa

SEQ ID NO: 982869 - RNA, 19 nt, Homo sapiens
acacagaacauccaacaug

SEQ ID NO: 982870 - RNA, 19 nt, Homo sapiens
gaaugaagacuguaaaaga

SEQ ID NO: 982871 - RNA, 19 nt, Homo sapiens
gcuggaagagccuguauug

SEQ ID NO: 982872 - RNA, 19 nt, Homo sapiens
guggaagccucauuugcaa

SEQ ID NO: 982873 - RNA, 19 nt, Homo sapiens
ccagaaccuuccuuauuag

SEQ ID NO: 982874 - RNA, 19 nt, Homo sapiens
aaagcugcaucuuauguug

SEQ ID NO: 982875 - RNA, 19 nt, Homo sapiens
cagcgugcauuauuucugu

SEQ ID NO: 982876 - RNA, 19 nt, Homo sapiens
guaagaaaugggaguguga

SEQ ID NO: 982877 - RNA, 19 nt, Homo sapiens
cuucaaauguccacagugu

SEQ ID NO: 982878 - RNA, 19 nt, Homo sapiens
gaucagugccucagaaacu

SEQ ID NO: 982879 - RNA, 19 nt, Homo sapiens
acaaggaaaugcguuuaug

SEQ ID NO: 982880 - RNA, 19 nt, Homo sapiens
aguaacaccuucugaguag

SEQ ID NO: 982881 - RNA, 19 nt, Homo sapiens
gcagagacaacaccuugga

SEQ ID NO: 982882 - RNA, 19 nt, Homo sapiens
agggacugcuccucucuua

SEQ ID NO: 982883 - RNA, 19 nt, Homo sapiens
gagaaaaucugccaagacu

SEQ ID NO: 982884 - RNA, 19 nt, Homo sapiens
agacagcaccgaaugaaga

SEQ ID NO: 982885 - RNA, 19 nt, Homo sapiens
gagacaacaccuuggaaga

SEQ ID NO: 982886 - RNA, 19 nt, Homo sapiens
gagagacagcaccgaauga

SEQ ID NO: 982887 - RNA, 19 nt, Homo sapiens
agacuuauaucagcgcuau

SEQ ID NO: 982888 - RNA, 19 nt, Homo sapiens
gcugcugucccacacaaua

SEQ ID NO: 982889 - RNA, 19 nt, Homo sapiens
acacaucagcaaagcauuu

SEQ ID NO: 982890 - RNA, 19 nt, Homo sapiens
cuaggaagaucugcuuugu

SEQ ID NO: 982891 - RNA, 19 nt, Homo sapiens
gacaauaucagcgugcauu

SEQ ID NO: 982892 - RNA, 19 nt, Homo sapiens
caaguaacaccuucugagu

SEQ ID NO: 982893 - RNA, 19 nt, Homo sapiens
gggucgaacacguuuauuu

SEQ ID NO: 982894 - RNA, 19 nt, Homo sapiens
guccaagggugucagaauc

SEQ ID NO: 982895 - RNA, 19 nt, Homo sapiens
agcaaagcauuucuucaaa

SEQ ID NO: 982896 - RNA, 19 nt, Homo sapiens
cccagcaccuguccaguga

SEQ ID NO: 982897 - RNA, 19 nt, Homo sapiens
gcaccuguccagugaaaca

SEQ ID NO: 982898 - RNA, 19 nt, Homo sapiens
agaaauaugcccacacauc

SEQ ID NO: 982899 - RNA, 19 nt, Homo sapiens
agacuuaucccaacagagu

SEQ ID NO: 982900 - RNA, 19 nt, Homo sapiens
gaaaaucugccaagacuag

SEQ ID NO: 982901 - RNA, 19 nt, Homo sapiens
ccaacaaggaaaugcguuu

SEQ ID NO: 982902 - RNA, 19 nt, Homo sapiens
gcccagcgaugcaaagaac

SEQ ID NO: 982903 - RNA, 19 nt, Homo sapiens
ucauaugccucuucuuacu

SEQ ID NO: 982904 - RNA, 19 nt, Homo sapiens
gaagcagggccagcaguga

SEQ ID NO: 982905 - RNA, 19 nt, Homo sapiens
gugaagacuuaucccaaca

SEQ ID NO: 982906 - RNA, 19 nt, Homo sapiens
aaagaaggaaugccagaga

SEQ ID NO: 982907 - RNA, 19 nt, Homo sapiens
uggaagagccuguauuguc

SEQ ID NO: 982908 - RNA, 19 nt, Homo sapiens
cgugacgucuuguaacuag

SEQ ID NO: 982909 - RNA, 19 nt, Homo sapiens
ggaaugccagagauugaga

SEQ ID NO: 982910 - RNA, 19 nt, Homo sapiens
gaaguuucaagcuggaaga

SEQ ID NO: 982911 - RNA, 19 nt, Homo sapiens
cagugaaacaacuugauaa

SEQ ID NO: 982912 - RNA, 19 nt, Homo sapiens
ccaucugucuguaugaaca

SEQ ID NO: 982913 - RNA, 19 nt, Homo sapiens
caccgcaagugcauacaga

SEQ ID NO: 982914 - RNA, 19 nt, Homo sapiens
ggaagccucauuugcaaag

SEQ ID NO: 982915 - RNA, 19 nt, Homo sapiens
aaggaucagugccucagaa

SEQ ID NO: 982916 - RNA, 19 nt, Homo sapiens
acagaggcuuccauggauu

SEQ ID NO: 982917 - RNA, 19 nt, Homo sapiens
acaauaucagcgugcauua

SEQ ID NO: 982918 - RNA, 19 nt, Homo sapiens
aagaaggaaugccagagau

SEQ ID NO: 982919 - RNA, 19 nt, Homo sapiens
aacagaggcuuccauggau

SEQ ID NO: 982920 - RNA, 19 nt, Homo sapiens
uuacuucacccauguuugu

SEQ ID NO: 982921 - RNA, 19 nt, Homo sapiens
aaguaacaccuucugagua

SEQ ID NO: 982922 - RNA, 19 nt, Homo sapiens
gggguugccuuucacaauu

SEQ ID NO: 982923 - RNA, 19 nt, Homo sapiens
cgacuaaagcuccaguaca

SEQ ID NO: 982924 - RNA, 19 nt, Homo sapiens
auaucagcgugcauuauuu

SEQ ID NO: 982925 - RNA, 19 nt, Homo sapiens
agacagcuuugaggaugaa

SEQ ID NO: 982926 - RNA, 19 nt, Homo sapiens
cagaggcuuccauggauuu

SEQ ID NO: 982927 - RNA, 19 nt, Homo sapiens
gagagagacagcaccgaau

SEQ ID NO: 982928 - RNA, 19 nt, Homo sapiens
gccagaaccuuccuuauua

SEQ ID NO: 982929 - RNA, 19 nt, Homo sapiens
gcaagugcauacagaaaua

SEQ ID NO: 982930 - RNA, 19 nt, Homo sapiens
gaggaaagcugcaucuuau

SEQ ID NO: 982931 - RNA, 19 nt, Homo sapiens
gaaccuuccuuauuagaaa

SEQ ID NO: 982932 - RNA, 19 nt, Homo sapiens
gaacauuucugcagagaca

SEQ ID NO: 982933 - RNA, 19 nt, Homo sapiens
ggaggaaagcugcaucuua

SEQ ID NO: 982934 - RNA, 19 nt, Homo sapiens
ggucgaacacguuuauuua

SEQ ID NO: 982935 - RNA, 19 nt, Homo sapiens
gaaauaugcccacacauca

SEQ ID NO: 982936 - RNA, 19 nt, Homo sapiens
ugaaacaacuugauaaucg

SEQ ID NO: 982937 - RNA, 19 nt, Homo sapiens
caacagaggcuuccaugga

SEQ ID NO: 982938 - RNA, 19 nt, Homo sapiens
gugcauuauuucugucuua

SEQ ID NO: 982939 - RNA, 19 nt, Homo sapiens
gaagacuuaucccaacaga

SEQ ID NO: 982940 - RNA, 19 nt, Homo sapiens
aaacaucgcccaacacaga

SEQ ID NO: 982941 - RNA, 19 nt, Homo sapiens
ggacugcuccucucuuaga

SEQ ID NO: 982942 - RNA, 19 nt, Homo sapiens
gaucuaacaguaagaaaug

SEQ ID NO: 982943 - RNA, 19 nt, Homo sapiens
ucaaauguccacaguguaa

SEQ ID NO: 982944 - RNA, 19 nt, Homo sapiens
ugacaaacaucgcccaaca

SEQ ID NO: 982945 - RNA, 19 nt, Homo sapiens
ggccagaaccuuccuuauu

SEQ ID NO: 982946 - RNA, 19 nt, Homo sapiens
gacaacaccuuggaagaga

SEQ ID NO: 982947 - RNA, 19 nt, Homo sapiens
ggagggagcaguccagaug

SEQ ID NO: 982948 - RNA, 19 nt, Homo sapiens
ggaaagcugcaucuuaugu

SEQ ID NO: 982949 - RNA, 19 nt, Homo sapiens
aaagggagcugcuaucaac

SEQ ID NO: 982950 - RNA, 19 nt, Homo sapiens
ucacccauguuuguuguua

SEQ ID NO: 982951 - RNA, 19 nt, Homo sapiens
caagaaaugcugagaaugg

SEQ ID NO: 982952 - RNA, 19 nt, Homo sapiens
cagcaaagcauuucuucaa

SEQ ID NO: 982953 - RNA, 19 nt, Homo sapiens
gaaggaaugccagagauug

SEQ ID NO: 982954 - RNA, 19 nt, Homo sapiens
gaaacaacuugauaaucgu

SEQ ID NO: 982955 - RNA, 19 nt, Homo sapiens
gaaagcugcaucuuauguu

SEQ ID NO: 982956 - RNA, 19 nt, Homo sapiens
aggaagaucugcuuugugu

SEQ ID NO: 982957 - RNA, 19 nt, Homo sapiens
gacuaaagcuccaguacag

SEQ ID NO: 982958 - RNA, 19 nt, Homo sapiens
uuucauaugccucuucuua

SEQ ID NO: 982959 - RNA, 19 nt, Homo sapiens
caacaaggaaaugcguuua

SEQ ID NO: 982960 - RNA, 19 nt, Homo sapiens
ccagugaaacaacuugaua

SEQ ID NO: 982961 - RNA, 19 nt, Homo sapiens
gcacagaauccuacucaag

SEQ ID NO: 982962 - RNA, 19 nt, Homo sapiens
cuacauaccugaaaacuca

SEQ ID NO: 982963 - RNA, 19 nt, Homo sapiens
acagaaauaugcccacaca

SEQ ID NO: 982964 - RNA, 19 nt, Homo sapiens
cuuauguugugaagacuua

SEQ ID NO: 982965 - RNA, 19 nt, Homo sapiens
caacacagaacauccaaca

SEQ ID NO: 982966 - RNA, 19 nt, Homo sapiens
ggguugccuuucacaauuu

SEQ ID NO: 982967 - RNA, 19 nt, Homo sapiens
cagcaccuguccagugaaa

SEQ ID NO: 982968 - RNA, 19 nt, Homo sapiens
acacagaacauccaacaug

SEQ ID NO: 982969 - RNA, 19 nt, Homo sapiens
gaaugaagacuguaaaaga

SEQ ID NO: 982970 - RNA, 19 nt, Homo sapiens
gcuggaagagccuguauug

SEQ ID NO: 982971 - RNA, 19 nt, Homo sapiens
guggaagccucauuugcaa

SEQ ID NO: 982972 - RNA, 19 nt, Homo sapiens
ccagaaccuuccuuauuag

SEQ ID NO: 982973 - RNA, 19 nt, Homo sapiens
aaagcugcaucuuauguug

SEQ ID NO: 982974 - RNA, 19 nt, Homo sapiens
cagcgugcauuauuucugu

SEQ ID NO: 982975 - RNA, 19 nt, Homo sapiens
guaagaaaugggaguguga

SEQ ID NO: 982976 - RNA, 19 nt, Homo sapiens
cuucaaauguccacagugu

SEQ ID NO: 982977 - RNA, 19 nt, Homo sapiens
gaucagugccucagaaacu

SEQ ID NO: 982978 - RNA, 19 nt, Homo sapiens
acaaggaaaugcguuuaug

SEQ ID NO: 982979 - RNA, 19 nt, Homo sapiens
aguaacaccuucugaguag

SEQ ID NO: 982980 - RNA, 19 nt, Homo sapiens
gcagagacaacaccuugga

SEQ ID NO: 982981 - RNA, 19 nt, Homo sapiens
agggacugcuccucucuua

SEQ ID NO: 982982 - RNA, 19 nt, Homo sapiens
gagaaaaucugccaagacu

SEQ ID NO: 982983 - RNA, 19 nt, Homo sapiens
agacagcaccgaaugaaga

SEQ ID NO: 982984 - RNA, 19 nt, Homo sapiens
gagacaacaccuuggaaga

SEQ ID NO: 982985 - RNA, 19 nt, Homo sapiens
gagagacagcaccgaauga

SEQ ID NO: 982986 - RNA, 19 nt, Homo sapiens
gcugcugucccacacaaua

SEQ ID NO: 982987 - RNA, 19 nt, Homo sapiens
acacaucagcaaagcauuu

SEQ ID NO: 982988 - RNA, 19 nt, Homo sapiens
cuaggaagaucugcuuugu

SEQ ID NO: 982989 - RNA, 19 nt, Homo sapiens
gacaauaucagcgugcauu

SEQ ID NO: 982990 - RNA, 19 nt, Homo sapiens
caaguaacaccuucugagu

SEQ ID NO: 982991 - RNA, 19 nt, Homo sapiens
gggucgaacacguuuauuu

SEQ ID NO: 982992 - RNA, 19 nt, Homo sapiens
guccaagggugucagaauc

SEQ ID NO: 982993 - RNA, 19 nt, Homo sapiens
agcaaagcauuucuucaaa

SEQ ID NO: 982994 - RNA, 19 nt, Homo sapiens
gcaccuguccagugaaaca

SEQ ID NO: 982995 - RNA, 19 nt, Homo sapiens
agaaauaugcccacacauc

SEQ ID NO: 982996 - RNA, 19 nt, Homo sapiens
agacuuaucccaacagagu

SEQ ID NO: 982997 - RNA, 19 nt, Homo sapiens
cccagcaccuguccaguga

SEQ ID NO: 982998 - RNA, 19 nt, Homo sapiens
gaaaaucugccaagacuag

SEQ ID NO: 982999 - RNA, 19 nt, Homo sapiens
ccaacaaggaaaugcguuu

SEQ ID NO: 983000 - RNA, 19 nt, Homo sapiens
gcccagcgaugcaaagaac

SEQ ID NO: 983001 - RNA, 19 nt, Homo sapiens
ucauaugccucuucuuacu

SEQ ID NO: 983002 - RNA, 19 nt, Homo sapiens
gaagcagggccagcaguga

SEQ ID NO: 983003 - RNA, 19 nt, Homo sapiens
gugaagacuuaucccaaca

SEQ ID NO: 983004 - RNA, 19 nt, Homo sapiens
aaagaaggaaugccagaga

SEQ ID NO: 983005 - RNA, 19 nt, Homo sapiens
uggaagagccuguauuguc

SEQ ID NO: 983006 - RNA, 19 nt, Homo sapiens
cgugacgucuuguaacuag

SEQ ID NO: 983007 - RNA, 19 nt, Homo sapiens
ggaaugccagagauugaga

SEQ ID NO: 983008 - RNA, 19 nt, Homo sapiens
gaaguuucaagcuggaaga

SEQ ID NO: 983009 - RNA, 19 nt, Homo sapiens
cagugaaacaacuugauaa

SEQ ID NO: 983010 - RNA, 19 nt, Homo sapiens
caccgcaagugcauacaga

SEQ ID NO: 983011 - RNA, 19 nt, Homo sapiens
aaggaucagugccucagaa

SEQ ID NO: 983012 - RNA, 19 nt, Homo sapiens
acagaggcuuccauggauu

SEQ ID NO: 983013 - RNA, 19 nt, Homo sapiens
acaauaucagcgugcauua

SEQ ID NO: 983014 - RNA, 19 nt, Homo sapiens
ggaagccucauuugcaaag

SEQ ID NO: 983015 - RNA, 19 nt, Homo sapiens
aagaaggaaugccagagau

SEQ ID NO: 983016 - RNA, 19 nt, Homo sapiens
aacagaggcuuccauggau

SEQ ID NO: 983017 - RNA, 19 nt, Homo sapiens
uuacuucacccauguuugu

SEQ ID NO: 983018 - RNA, 19 nt, Homo sapiens
aaguaacaccuucugagua

SEQ ID NO: 983019 - RNA, 19 nt, Homo sapiens
gggguugccuuucacaauu

SEQ ID NO: 983020 - RNA, 19 nt, Homo sapiens
cgacuaaagcuccaguaca

SEQ ID NO: 983021 - RNA, 19 nt, Homo sapiens
auaucagcgugcauuauuu

SEQ ID NO: 983022 - RNA, 19 nt, Homo sapiens
cagaggcuuccauggauuu

SEQ ID NO: 983023 - RNA, 19 nt, Homo sapiens
gagagagacagcaccgaau

SEQ ID NO: 983024 - RNA, 19 nt, Homo sapiens
caaggaaaugcguuuaugg

SEQ ID NO: 983025 - RNA, 19 nt, Homo sapiens
ccagaugccaacaaggaaa

SEQ ID NO: 983026 - RNA, 19 nt, Homo sapiens
uagcugcugucccacacaa

SEQ ID NO: 983027 - RNA, 19 nt, Homo sapiens
ccacacaucagcaaagcau

SEQ ID NO: 983028 - RNA, 19 nt, Homo sapiens
caacauacauccauaauug

SEQ ID NO: 983029 - RNA, 19 nt, Homo sapiens
gaaugaagaucgauaguaa

SEQ ID NO: 983030 - RNA, 19 nt, Homo sapiens
gaauauggguguuucuaua

SEQ ID NO: 983031 - RNA, 19 nt, Homo sapiens
gaaugaagccuuuguauga

SEQ ID NO: 983032 - RNA, 19 nt, Homo sapiens
ggagauguguucugaugua

SEQ ID NO: 983033 - RNA, 19 nt, Homo sapiens
gcacagguguagcaaguaa

SEQ ID NO: 983034 - RNA, 19 nt, Homo sapiens
gggaggaaauagauaauaa

SEQ ID NO: 983035 - RNA, 19 nt, Homo sapiens
gaaacuuggugcuuuaaau

SEQ ID NO: 983036 - RNA, 19 nt, Homo sapiens
ggacaaacagaugauauua

SEQ ID NO: 983037 - RNA, 19 nt, Homo sapiens
gugcacauuuggagaauua

SEQ ID NO: 983038 - RNA, 19 nt, Homo sapiens
aggaugaccuuuaguguua

SEQ ID NO: 983039 - RNA, 19 nt, Homo sapiens
ccaaugcucuuuagaaugu

SEQ ID NO: 983040 - RNA, 19 nt, Homo sapiens
caagagguaugaacauuug

SEQ ID NO: 983041 - RNA, 19 nt, Homo sapiens
caaacaacaugccuccuaa

SEQ ID NO: 983042 - RNA, 19 nt, Homo sapiens
ggagaauuaugcuuugaaa

SEQ ID NO: 983043 - RNA, 19 nt, Homo sapiens
gcaguugggugauaaugaa

SEQ ID NO: 983044 - RNA, 19 nt, Homo sapiens
ggaaggagacaauauagaa

SEQ ID NO: 983045 - RNA, 19 nt, Homo sapiens
aaacaagccuacacucauu

SEQ ID NO: 983046 - RNA, 19 nt, Homo sapiens
gaaauccaaugcucuuuag

SEQ ID NO: 983047 - RNA, 19 nt, Homo sapiens
acaaaaggcucucaaguua

SEQ ID NO: 983048 - RNA, 19 nt, Homo sapiens
ggaaaucccaguugucuau

SEQ ID NO: 983049 - RNA, 19 nt, Homo sapiens
cuagccaucucaauaguua

SEQ ID NO: 983050 - RNA, 19 nt, Homo sapiens
gcagugcuuugcaguauga

SEQ ID NO: 983051 - RNA, 19 nt, Homo sapiens
agaaucacuuucagacuua

SEQ ID NO: 983052 - RNA, 19 nt, Homo sapiens
aaagauagccagaauauuc

SEQ ID NO: 983053 - RNA, 19 nt, Homo sapiens
guaaagagguagaaucacu

SEQ ID NO: 983054 - RNA, 19 nt, Homo sapiens
gagggaaggagacaauaua

SEQ ID NO: 983055 - RNA, 19 nt, Homo sapiens
guaaacgcaucaccuccua

SEQ ID NO: 983056 - RNA, 19 nt, Homo sapiens
guacuccucugcugcugua

SEQ ID NO: 983057 - RNA, 19 nt, Homo sapiens
gcacugcuguccagaaucu

SEQ ID NO: 983058 - RNA, 19 nt, Homo sapiens
ggaaugaagaucgauagua

SEQ ID NO: 983059 - RNA, 19 nt, Homo sapiens
guuaauggaucaguuagaa

SEQ ID NO: 983060 - RNA, 19 nt, Homo sapiens
caaaguuaauggaucaguu

SEQ ID NO: 983061 - RNA, 19 nt, Homo sapiens
gaaggagacaauauagaaa

SEQ ID NO: 983062 - RNA, 19 nt, Homo sapiens
uagaaucacuuucagacuu

SEQ ID NO: 983063 - RNA, 19 nt, Homo sapiens
gcucagaaguacugcaaau

SEQ ID NO: 983064 - RNA, 19 nt, Homo sapiens
gaaacaagccuacacucau

SEQ ID NO: 983065 - RNA, 19 nt, Homo sapiens
caucaucaucuucaacuua

SEQ ID NO: 983066 - RNA, 19 nt, Homo sapiens
acaguaggauuagcaauuu

SEQ ID NO: 983067 - RNA, 19 nt, Homo sapiens
ugauaugccuggacacuga

SEQ ID NO: 983068 - RNA, 19 nt, Homo sapiens
guauauagggcugauguua

SEQ ID NO: 983069 - RNA, 19 nt, Homo sapiens
cagaaguacugcaaauaug

SEQ ID NO: 983070 - RNA, 19 nt, Homo sapiens
ugauguaacaguaggauua

SEQ ID NO: 983071 - RNA, 19 nt, Homo sapiens
ugcuuuaccuuaucuguua

SEQ ID NO: 983072 - RNA, 19 nt, Homo sapiens
gagauguguucugauguaa

SEQ ID NO: 983073 - RNA, 19 nt, Homo sapiens
caugguagcauuucauaaa

SEQ ID NO: 983074 - RNA, 19 nt, Homo sapiens
aaucgucucugaguauaua

SEQ ID NO: 983075 - RNA, 19 nt, Homo sapiens
aguaaugccuggaaacuug

SEQ ID NO: 983076 - RNA, 19 nt, Homo sapiens
gacuauaccugccauugau

SEQ ID NO: 983077 - RNA, 19 nt, Homo sapiens
ccagauggaaggcaacaua

SEQ ID NO: 983078 - RNA, 19 nt, Homo sapiens
gcuacuauaugccugguau

SEQ ID NO: 983079 - RNA, 19 nt, Homo sapiens
gagacccugugguggcuua

SEQ ID NO: 983080 - RNA, 19 nt, Homo sapiens
gcuuauuacugucguuuau

SEQ ID NO: 983081 - RNA, 19 nt, Homo sapiens
gaccuuuaguguuacauga

SEQ ID NO: 983082 - RNA, 19 nt, Homo sapiens
guacaggguuugguagaau

SEQ ID NO: 983083 - RNA, 19 nt, Homo sapiens
gaaaacacaccucuauaaa

SEQ ID NO: 983084 - RNA, 19 nt, Homo sapiens
gcaacauacauccauaauu

SEQ ID NO: 983085 - RNA, 19 nt, Homo sapiens
uaggagauguguucugaug

SEQ ID NO: 983086 - RNA, 19 nt, Homo sapiens
ucaaucgucucugaguaua

SEQ ID NO: 983087 - RNA, 19 nt, Homo sapiens
acaaugaaaucugugugua

SEQ ID NO: 983088 - RNA, 19 nt, Homo sapiens
caacuauacuggaauacag

SEQ ID NO: 983089 - RNA, 19 nt, Homo sapiens
uuggagaacucacugauga

SEQ ID NO: 983090 - RNA, 19 nt, Homo sapiens
cuauaugccugguauuguu

SEQ ID NO: 983091 - RNA, 19 nt, Homo sapiens
ccaaacaacaugccuccua

SEQ ID NO: 983092 - RNA, 19 nt, Homo sapiens
gagaaugaagccuuuguau

SEQ ID NO: 983093 - RNA, 19 nt, Homo sapiens
gagacaauauagaaacuac

SEQ ID NO: 983094 - RNA, 19 nt, Homo sapiens
ggaauauggguguuucuau

SEQ ID NO: 983095 - RNA, 19 nt, Homo sapiens
ggcagagaaugaagccuuu

SEQ ID NO: 983096 - RNA, 19 nt, Homo sapiens
cagcacagguguagcaagu

SEQ ID NO: 983097 - RNA, 19 nt, Homo sapiens
ggagaacucacugaugaaa

SEQ ID NO: 983098 - RNA, 19 nt, Homo sapiens
gaagcuauuacucaagaaa

SEQ ID NO: 983099 - RNA, 19 nt, Homo sapiens
agaaauccaaugcucuuua

SEQ ID NO: 983100 - RNA, 19 nt, Homo sapiens
ggaauuaugaacuuacugu

SEQ ID NO: 983101 - RNA, 19 nt, Homo sapiens
auucuaaacugcuggauga

SEQ ID NO: 983102 - RNA, 19 nt, Homo sapiens
ggaaguaugccagauggaa

SEQ ID NO: 983103 - RNA, 19 nt, Homo sapiens
cuggaaacuuggugcuuua

SEQ ID NO: 983104 - RNA, 19 nt, Homo sapiens
uaacaguccauuacucuau

SEQ ID NO: 983105 - RNA, 19 nt, Homo sapiens
gaacuaacaguccauuacu

SEQ ID NO: 983106 - RNA, 19 nt, Homo sapiens
ucagaaguacugcaaauau

SEQ ID NO: 983107 - RNA, 19 nt, Homo sapiens
caacucagccaucaucauc

SEQ ID NO: 983108 - RNA, 19 nt, Homo sapiens
ugauagaugucauaacagu

SEQ ID NO: 983109 - RNA, 19 nt, Homo sapiens
aaagggaggaaauagauaa

SEQ ID NO: 983110 - RNA, 19 nt, Homo sapiens
uacaagagguaugaacauu

SEQ ID NO: 983111 - RNA, 19 nt, Homo sapiens
ggauagcuaugggugauuc

SEQ ID NO: 983112 - RNA, 19 nt, Homo sapiens
cuaaacugcuggaugaauc

SEQ ID NO: 983113 - RNA, 19 nt, Homo sapiens
aagaagcaguugggugaua

SEQ ID NO: 983114 - RNA, 19 nt, Homo sapiens
gaucaaguccuucuauacu

SEQ ID NO: 983115 - RNA, 19 nt, Homo sapiens
uacaguaccugaagugcuu

SEQ ID NO: 983116 - RNA, 19 nt, Homo sapiens
agaagcaguugggugauaa

SEQ ID NO: 983117 - RNA, 19 nt, Homo sapiens
ggaacuaacaguccauuac

SEQ ID NO: 983118 - RNA, 19 nt, Homo sapiens
aggcaacuauacuggaaua

SEQ ID NO: 983119 - RNA, 19 nt, Homo sapiens
ucaggcaacuauacuggaa

SEQ ID NO: 983120 - RNA, 19 nt, Homo sapiens
agccuacacucauucauuu

SEQ ID NO: 983121 - RNA, 19 nt, Homo sapiens
ccucauagaguuuacauuc

SEQ ID NO: 983122 - RNA, 19 nt, Homo sapiens
gagauacaguaccugaagu

SEQ ID NO: 983123 - RNA, 19 nt, Homo sapiens
gaagaucgauaguaaaacu

SEQ ID NO: 983124 - RNA, 19 nt, Homo sapiens
auagaaagauggccaggau

SEQ ID NO: 983125 - RNA, 19 nt, Homo sapiens
gcauuugugcugugugaaa

SEQ ID NO: 983126 - RNA, 19 nt, Homo sapiens
ccuggaaacuuggugcuuu

SEQ ID NO: 983127 - RNA, 19 nt, Homo sapiens
gaaucacuuucagacuuaa

SEQ ID NO: 983128 - RNA, 19 nt, Homo sapiens
gaaggcagcuuuauuaauu

SEQ ID NO: 983129 - RNA, 19 nt, Homo sapiens
gaaggaagcuacaauagau

SEQ ID NO: 983130 - RNA, 19 nt, Homo sapiens
gcagauuauugcuguguua

SEQ ID NO: 983131 - RNA, 19 nt, Homo sapiens
agagauggcuuuagaagaa

SEQ ID NO: 983132 - RNA, 19 nt, Homo sapiens
gaaaucagaugaaaguaac

SEQ ID NO: 983133 - RNA, 19 nt, Homo sapiens
caucaaagguguuagacaa

SEQ ID NO: 983134 - RNA, 19 nt, Homo sapiens
gcaagggaguguaaaggaa

SEQ ID NO: 983135 - RNA, 19 nt, Homo sapiens
guucauuacucacaaauug

SEQ ID NO: 983136 - RNA, 19 nt, Homo sapiens
agacagaccuggugaagga

SEQ ID NO: 983137 - RNA, 19 nt, Homo sapiens
caugagagauggcuuuaga

SEQ ID NO: 983138 - RNA, 19 nt, Homo sapiens
gaaaaggggugauguagga

SEQ ID NO: 983139 - RNA, 19 nt, Homo sapiens
gaaccugagucaaacacaa

SEQ ID NO: 983140 - RNA, 19 nt, Homo sapiens
gaggaacacugaaauggau

SEQ ID NO: 983141 - RNA, 19 nt, Homo sapiens
gguauucugucucuacuga

SEQ ID NO: 983142 - RNA, 19 nt, Homo sapiens
uaacuugccugaaauuucu

SEQ ID NO: 983143 - RNA, 19 nt, Homo sapiens
cgacaagacugugaaacuu

SEQ ID NO: 983144 - RNA, 19 nt, Homo sapiens
gcuaaccacucgcucuaaa

SEQ ID NO: 983145 - RNA, 19 nt, Homo sapiens
caagaugauuguaacaugu

SEQ ID NO: 983146 - RNA, 19 nt, Homo sapiens
caaagagauugaacagguu

SEQ ID NO: 983147 - RNA, 19 nt, Homo sapiens
gagcaaaucauacucuuuc

SEQ ID NO: 983148 - RNA, 19 nt, Homo sapiens
caagacugcucccugcaaa

SEQ ID NO: 983149 - RNA, 19 nt, Homo sapiens
cuaaagcaauagcaucaaa

SEQ ID NO: 983150 - RNA, 19 nt, Homo sapiens
aaacacaacacaugggaua

SEQ ID NO: 983151 - RNA, 19 nt, Homo sapiens
cagaaaggagcaaaucaua

SEQ ID NO: 983152 - RNA, 19 nt, Homo sapiens
gagaagcuauaaggaaaga

SEQ ID NO: 983153 - RNA, 19 nt, Homo sapiens
gaaaauuuguuccuugcua

SEQ ID NO: 983154 - RNA, 19 nt, Homo sapiens
gaacagguuuaccgacaag

SEQ ID NO: 983155 - RNA, 19 nt, Homo sapiens
ggacaugagagauggcuuu

SEQ ID NO: 983156 - RNA, 19 nt, Homo sapiens
aaauaccugugucagaaua

SEQ ID NO: 983157 - RNA, 19 nt, Homo sapiens
caacacaugggauagaauu

SEQ ID NO: 983158 - RNA, 19 nt, Homo sapiens
cuagagaaaucagaugaaa

SEQ ID NO: 983159 - RNA, 19 nt, Homo sapiens
gaaaggagcaaaucauacu

SEQ ID NO: 983160 - RNA, 19 nt, Homo sapiens
caaaauaccugugucagaa

SEQ ID NO: 983161 - RNA, 19 nt, Homo sapiens
ggaaauccugaaagagaua

SEQ ID NO: 983162 - RNA, 19 nt, Homo sapiens
gaauaugccaggaauagug

SEQ ID NO: 983163 - RNA, 19 nt, Homo sapiens
cagaggaaccugagucaaa

SEQ ID NO: 983164 - RNA, 19 nt, Homo sapiens
gguuauagauggacaagag

SEQ ID NO: 983165 - RNA, 19 nt, Homo sapiens
cauaugcucuaucucaaga

SEQ ID NO: 983166 - RNA, 19 nt, Homo sapiens
uaacugcuaugccugacaa

SEQ ID NO: 983167 - RNA, 19 nt, Homo sapiens
gauauuacagucauguuga

SEQ ID NO: 983168 - RNA, 19 nt, Homo sapiens
ggugaaggaagcuacaaua

SEQ ID NO: 983169 - RNA, 19 nt, Homo sapiens
caucuguacucgucaauca

SEQ ID NO: 983170 - RNA, 19 nt, Homo sapiens
ccacacagcagaucugguu

SEQ ID NO: 983171 - RNA, 19 nt, Homo sapiens
aggagaagcuauaaggaaa

SEQ ID NO: 983172 - RNA, 19 nt, Homo sapiens
gacaagacugugaaacuuu

SEQ ID NO: 983173 - RNA, 19 nt, Homo sapiens
gggauagaauuauuugaag

SEQ ID NO: 983174 - RNA, 19 nt, Homo sapiens
acaaaugguuccagccuau

SEQ ID NO: 983175 - RNA, 19 nt, Homo sapiens
caacaaaaccugaugcaaa

SEQ ID NO: 983176 - RNA, 19 nt, Homo sapiens
ugaaagaauuccgagagaa

SEQ ID NO: 983177 - RNA, 19 nt, Homo sapiens
ucaagugguucagcaguuu

SEQ ID NO: 983178 - RNA, 19 nt, Homo sapiens
gagauggcuuuagaagaaa

SEQ ID NO: 983179 - RNA, 19 nt, Homo sapiens
ggacaagagacgaucauuc

SEQ ID NO: 983180 - RNA, 19 nt, Homo sapiens
aaagaaaccaccacugcua

SEQ ID NO: 983181 - RNA, 19 nt, Homo sapiens
uguaggagauggucagguu

SEQ ID NO: 983182 - RNA, 19 nt, Homo sapiens
aggcagaauuuacaugaaa

SEQ ID NO: 983183 - RNA, 19 nt, Homo sapiens
gacaaacccaguaggcuaa

SEQ ID NO: 983184 - RNA, 19 nt, Homo sapiens
gaggcagaauuuacaugaa

SEQ ID NO: 983185 - RNA, 19 nt, Homo sapiens
cacaugggauagaauuauu

SEQ ID NO: 983186 - RNA, 19 nt, Homo sapiens
gacaagagacgaucauucu

SEQ ID NO: 983187 - RNA, 19 nt, Homo sapiens
ucaagaaacaagaugauug

SEQ ID NO: 983188 - RNA, 19 nt, Homo sapiens
gaagauagucagcuaacca

SEQ ID NO: 983189 - RNA, 19 nt, Homo sapiens
ugccugaaauuucugagua

SEQ ID NO: 983190 - RNA, 19 nt, Homo sapiens
gaauacuccuuucauccau

SEQ ID NO: 983191 - RNA, 19 nt, Homo sapiens
ucagaauacuccuuucauc

SEQ ID NO: 983192 - RNA, 19 nt, Homo sapiens
cgaaaggauucuccacaca

SEQ ID NO: 983193 - RNA, 19 nt, Homo sapiens
gaaagaauuccgagagaac

SEQ ID NO: 983194 - RNA, 19 nt, Homo sapiens
gagcggacggcugcauuua

SEQ ID NO: 983195 - RNA, 19 nt, Homo sapiens
agucguggcuuacagaaga

SEQ ID NO: 983196 - RNA, 19 nt, Homo sapiens
uaucaggacugcacucucu

SEQ ID NO: 983197 - RNA, 19 nt, Homo sapiens
ugaaggaagcuacaauaga

SEQ ID NO: 983198 - RNA, 19 nt, Homo sapiens
cagcaccauuguuuacuga

SEQ ID NO: 983199 - RNA, 19 nt, Homo sapiens
guucagcaguuucuucauc

SEQ ID NO: 983200 - RNA, 19 nt, Homo sapiens
agagcggucuccuuauaaa

SEQ ID NO: 983201 - RNA, 19 nt, Homo sapiens
guaacuugccugaaauuuc

SEQ ID NO: 983202 - RNA, 19 nt, Homo sapiens
ggagcaaaucauacucuuu

SEQ ID NO: 983203 - RNA, 19 nt, Homo sapiens
guccaugauuaaacuauug

SEQ ID NO: 983204 - RNA, 19 nt, Homo sapiens
gagagauggcuuuagaaga

SEQ ID NO: 983205 - RNA, 19 nt, Homo sapiens
ccaucagucucaacauaga

SEQ ID NO: 983206 - RNA, 19 nt, Homo sapiens
agaagcuacucuccagaaa

SEQ ID NO: 983207 - RNA, 19 nt, Homo sapiens
uuucuacucuucccauuau

SEQ ID NO: 983208 - RNA, 19 nt, Homo sapiens
gcccauaugcucuaucuca

SEQ ID NO: 983209 - RNA, 19 nt, Homo sapiens
agagaaaucagaugaaagu

SEQ ID NO: 983210 - RNA, 19 nt, Homo sapiens
uuccaucagucucaacaua

SEQ ID NO: 983211 - RNA, 19 nt, Homo sapiens
gcaagacugcucccugcaa

SEQ ID NO: 983212 - RNA, 19 nt, Homo sapiens
gcuaugcucucuguuguac

SEQ ID NO: 983213 - RNA, 19 nt, Homo sapiens
guuaauauugugccaaaga

SEQ ID NO: 983214 - RNA, 19 nt, Homo sapiens
cacaacacaugggauagaa

SEQ ID NO: 983215 - RNA, 19 nt, Homo sapiens
uuacagaagagacgaaaug

SEQ ID NO: 983216 - RNA, 19 nt, Homo sapiens
gaaauccugaaagagauaa

SEQ ID NO: 983217 - RNA, 19 nt, Homo sapiens
gcaacucacgcaaggaugu

SEQ ID NO: 983218 - RNA, 19 nt, Homo sapiens
caagugggcugcugaaaag

SEQ ID NO: 983219 - RNA, 19 nt, Homo sapiens
gacaugagagauggcuuua

SEQ ID NO: 983220 - RNA, 19 nt, Homo sapiens
cuucaggccuuugguauuc

SEQ ID NO: 983221 - RNA, 19 nt, Homo sapiens
guugguaggagaagcuaua

SEQ ID NO: 983222 - RNA, 19 nt, Homo sapiens
aacaaaaccugaugcaaaa

SEQ ID NO: 983223 - RNA, 19 nt, Homo sapiens
uaugcucuaucucaagaaa

SEQ ID NO: 983224 - RNA, 19 nt, Homo sapiens
uaggagaagcuauaaggaa

SEQ ID NO: 983225 - RNA, 19 nt, Homo sapiens
caaaucauacucuuuccau

SEQ ID NO: 983226 - RNA, 19 nt, Homo sapiens
caggaauaguggaauuuua

SEQ ID NO: 983227 - RNA, 19 nt, Homo sapiens
ggagauggucagguuggua

SEQ ID NO: 983228 - RNA, 19 nt, Homo sapiens
gcagacaacucagggagaa

SEQ ID NO: 983229 - RNA, 19 nt, Homo sapiens
gcccuucccugacccaaua

SEQ ID NO: 983230 - RNA, 19 nt, Homo sapiens
gacagaagcuuagagacaa

SEQ ID NO: 983231 - RNA, 19 nt, Homo sapiens
ggacagaagcuuagagaca

SEQ ID NO: 983232 - RNA, 19 nt, Homo sapiens
ggacaccucaggacagauu

SEQ ID NO: 983233 - RNA, 19 nt, Homo sapiens
gguuugagcuggacagaag

SEQ ID NO: 983234 - RNA, 19 nt, Homo sapiens
ucagggagggcaaggaaua

SEQ ID NO: 983235 - RNA, 19 nt, Homo sapiens
gagacaaaggcuucaagaa

SEQ ID NO: 983236 - RNA, 19 nt, Homo sapiens
ugguauggcugaacaagga

SEQ ID NO: 983237 - RNA, 19 nt, Homo sapiens
gcaaggaauaggcccaaga

SEQ ID NO: 983238 - RNA, 19 nt, Homo sapiens
gaacaaggagcggcagaca

SEQ ID NO: 983239 - RNA, 19 nt, Homo sapiens
gcgggagagucaugucaga

SEQ ID NO: 983240 - RNA, 19 nt, Homo sapiens
cccaauaaauccugaagag

SEQ ID NO: 983241 - RNA, 19 nt, Homo sapiens
gcgcaagucuacccaacag

SEQ ID NO: 983242 - RNA, 19 nt, Homo sapiens
uaccugggcuaugcaauga

SEQ ID NO: 983243 - RNA, 19 nt, Homo sapiens
ggaauaggcccaagaucac

SEQ ID NO: 983244 - RNA, 19 nt, Homo sapiens
acagaagcuuagagacaaa

SEQ ID NO: 983245 - RNA, 19 nt, Homo sapiens
gcaucggccuccugcuuca

SEQ ID NO: 983246 - RNA, 19 nt, Homo sapiens
caacucagggagaaacuca

SEQ ID NO: 983247 - RNA, 19 nt, Homo sapiens
caaggaauaggcccaagau

SEQ ID NO: 983248 - RNA, 19 nt, Homo sapiens
gcucagggagggcaaggaa

SEQ ID NO: 983249 - RNA, 19 nt, Homo sapiens
gcccagcuccuccugauca

SEQ ID NO: 983250 - RNA, 19 nt, Homo sapiens
aggaauaggcccaagauca

SEQ ID NO: 983251 - RNA, 19 nt, Homo sapiens
gcucccugguguccaaaga

SEQ ID NO: 983252 - RNA, 19 nt, Homo sapiens
gacgaaaaccagucuguaa

SEQ ID NO: 983253 - RNA, 19 nt, Homo sapiens
gccaguaccggcuguagug

SEQ ID NO: 983254 - RNA, 19 nt, Homo sapiens
gaaaaccagucuguaaaac

SEQ ID NO: 983255 - RNA, 19 nt, Homo sapiens
cgaaaaccagucuguaaaa

SEQ ID NO: 983256 - RNA, 19 nt, Homo sapiens
gcaggagcgagaucgucua

SEQ ID NO: 983257 - RNA, 19 nt, Homo sapiens
cggaugccauugacaaagg

SEQ ID NO: 983258 - RNA, 19 nt, Homo sapiens
gugcaucggccuccugcuu

SEQ ID NO: 983259 - RNA, 19 nt, Homo sapiens
gaggcuuuccgcucucuug

SEQ ID NO: 983260 - RNA, 19 nt, Homo sapiens
acaaggagcggcagacaac

SEQ ID NO: 983261 - RNA, 19 nt, Homo sapiens
ugacaggucgguggauuuc

SEQ ID NO: 983262 - RNA, 19 nt, Homo sapiens
cccaggugcuugacagagu

SEQ ID NO: 983263 - RNA, 19 nt, Homo sapiens
agagacaaaggcuucaaga

SEQ ID NO: 983264 - RNA, 19 nt, Homo sapiens
aagcccagcuccuccugau

SEQ ID NO: 983265 - RNA, 19 nt, Homo sapiens
auuccgggcuucaccauca

SEQ ID NO: 983266 - RNA, 19 nt, Homo sapiens
ugacuuaacuuguguauug

SEQ ID NO: 983267 - RNA, 19 nt, Homo sapiens
gaggagccauagaauauua

SEQ ID NO: 983268 - RNA, 19 nt, Homo sapiens
gaaagaaggagaagaagaa

SEQ ID NO: 983269 - RNA, 19 nt, Homo sapiens
gauaguagauguuggagau

SEQ ID NO: 983270 - RNA, 19 nt, Homo sapiens
ggauaagcccucugagaua

SEQ ID NO: 983271 - RNA, 19 nt, Homo sapiens
caagaaguguggcuguaaa

SEQ ID NO: 983272 - RNA, 19 nt, Homo sapiens
ccaugaagguugucaauca

SEQ ID NO: 983273 - RNA, 19 nt, Homo sapiens
uggaaagacucaauaguga

SEQ ID NO: 983274 - RNA, 19 nt, Homo sapiens
gcacaaggagugagaguau

SEQ ID NO: 983275 - RNA, 19 nt, Homo sapiens
caagaucauuguucuacuu

SEQ ID NO: 983276 - RNA, 19 nt, Homo sapiens
gauaagcccucugagauag

SEQ ID NO: 983277 - RNA, 19 nt, Homo sapiens
gaucauuguucuacuuugu

SEQ ID NO: 983278 - RNA, 19 nt, Homo sapiens
gcagcugccugaaugaguu

SEQ ID NO: 983279 - RNA, 19 nt, Homo sapiens
ggcagaagaucacccuuga

SEQ ID NO: 983280 - RNA, 19 nt, Homo sapiens
ucacccaacuuccuucauu

SEQ ID NO: 983281 - RNA, 19 nt, Homo sapiens
gauuggacccuuccuauug

SEQ ID NO: 983282 - RNA, 19 nt, Homo sapiens
agaagaagcacaagaagaa

SEQ ID NO: 983283 - RNA, 19 nt, Homo sapiens
aaagaaagaaggagaagaa

SEQ ID NO: 983284 - RNA, 19 nt, Homo sapiens
gacuaaauacucucugaua

SEQ ID NO: 983285 - RNA, 19 nt, Homo sapiens
gaggcugucuugaacacua

SEQ ID NO: 983286 - RNA, 19 nt, Homo sapiens
gggcaaggcacacaucaaa

SEQ ID NO: 983287 - RNA, 19 nt, Homo sapiens
uaacuuguguauugcauuc

SEQ ID NO: 983288 - RNA, 19 nt, Homo sapiens
ucugauaccugaugaggaa

SEQ ID NO: 983289 - RNA, 19 nt, Homo sapiens
gggacuaaauacucucuga

SEQ ID NO: 983290 - RNA, 19 nt, Homo sapiens
gcaagaaguguggcuguaa

SEQ ID NO: 983291 - RNA, 19 nt, Homo sapiens
gagauaaagugugggugaa

SEQ ID NO: 983292 - RNA, 19 nt, Homo sapiens
gaguucggcuguaguuaga

SEQ ID NO: 983293 - RNA, 19 nt, Homo sapiens
gcaaccaggugggacuaaa

SEQ ID NO: 983294 - RNA, 19 nt, Homo sapiens
aaacuugccugcucucuac

SEQ ID NO: 983295 - RNA, 19 nt, Homo sapiens
ccaucgaacucauauguca

SEQ ID NO: 983296 - RNA, 19 nt, Homo sapiens
ucagguccuugcuuaaauu

SEQ ID NO: 983297 - RNA, 19 nt, Homo sapiens
gcaaggcagcaaagaagaa

SEQ ID NO: 983298 - RNA, 19 nt, Homo sapiens
ucccauuccuccuaacaua

SEQ ID NO: 983299 - RNA, 19 nt, Homo sapiens
gagcuggauuccuguaaag

SEQ ID NO: 983300 - RNA, 19 nt, Homo sapiens
ggagugagaguauaaagag

SEQ ID NO: 983301 - RNA, 19 nt, Homo sapiens
uaguagauguuggagauaa

SEQ ID NO: 983302 - RNA, 19 nt, Homo sapiens
ggaggugaguucggcugua

SEQ ID NO: 983303 - RNA, 19 nt, Homo sapiens
agaagaagaagcacaagaa

SEQ ID NO: 983304 - RNA, 19 nt, Homo sapiens
ggcaaagucagcagaguuu

SEQ ID NO: 983305 - RNA, 19 nt, Homo sapiens
gaacacuaccugcaagaag

SEQ ID NO: 983306 - RNA, 19 nt, Homo sapiens
ccucugagauaguagaugu

SEQ ID NO: 983307 - RNA, 19 nt, Homo sapiens
uaagcccucugagauagua

SEQ ID NO: 983308 - RNA, 19 nt, Homo sapiens
gaagcaaggucugguccau

SEQ ID NO: 983309 - RNA, 19 nt, Homo sapiens
gcugacgccuagacacuug

SEQ ID NO: 983310 - RNA, 19 nt, Homo sapiens
gaagaagaagcacaagaag

SEQ ID NO: 983311 - RNA, 19 nt, Homo sapiens
caugaagguugucaaucaa

SEQ ID NO: 983312 - RNA, 19 nt, Homo sapiens
uggaggagccauagaauau

SEQ ID NO: 983313 - RNA, 19 nt, Homo sapiens
gaagaagcacaaggaguga

SEQ ID NO: 983314 - RNA, 19 nt, Homo sapiens
cgccuagacacuuguauua

SEQ ID NO: 983315 - RNA, 19 nt, Homo sapiens
uaucacuccuggucccuuu

SEQ ID NO: 983316 - RNA, 19 nt, Homo sapiens
cacaaggagugagaguaua

SEQ ID NO: 983317 - RNA, 19 nt, Homo sapiens
aaagaaacauagagauagg

SEQ ID NO: 983318 - RNA, 19 nt, Homo sapiens
ccugcucucuacacuauuu

SEQ ID NO: 983319 - RNA, 19 nt, Homo sapiens
gcagcucacccauucauuc

SEQ ID NO: 983320 - RNA, 19 nt, Homo sapiens
acaaggagugagaguauaa

SEQ ID NO: 983321 - RNA, 19 nt, Homo sapiens
ugagaagccugacccuaca

SEQ ID NO: 983322 - RNA, 19 nt, Homo sapiens
uacuucagguccuugcuua

SEQ ID NO: 983323 - RNA, 19 nt, Homo sapiens
aaaagcagcugccugaaug

SEQ ID NO: 983324 - RNA, 19 nt, Homo sapiens
auggaaauguguuugguuu

SEQ ID NO: 983325 - RNA, 19 nt, Homo sapiens
gaggugaguucggcuguag

SEQ ID NO: 983326 - RNA, 19 nt, Homo sapiens
ucagcaggaggcccuauua

SEQ ID NO: 983327 - RNA, 19 nt, Homo sapiens
aaacauagagauaggaagu

SEQ ID NO: 983328 - RNA, 19 nt, Homo sapiens
ggaggagccauagaauauu

SEQ ID NO: 983329 - RNA, 19 nt, Homo sapiens
ggacugggaaagaccuuga

SEQ ID NO: 983330 - RNA, 19 nt, Homo sapiens
cagcgaagccaagaucauu

SEQ ID NO: 983331 - RNA, 19 nt, Homo sapiens
ugaaugaguuguuguuucc

SEQ ID NO: 983332 - RNA, 19 nt, Homo sapiens
aaauuccugucacuaaaug

SEQ ID NO: 983333 - RNA, 19 nt, Homo sapiens
cuuaaauuccugucacuaa

SEQ ID NO: 983334 - RNA, 19 nt, Homo sapiens
acaagaagaagcacaagga

SEQ ID NO: 983335 - RNA, 19 nt, Homo sapiens
ccaaggagagguugcuaug

SEQ ID NO: 983336 - RNA, 19 nt, Homo sapiens
uguauuuacuacuguguga

SEQ ID NO: 983337 - RNA, 19 nt, Homo sapiens
agagcuggauuccuguaaa

SEQ ID NO: 983338 - RNA, 19 nt, Homo sapiens
aaaggaagaggcaaaguca

SEQ ID NO: 983339 - RNA, 19 nt, Homo sapiens
uaaauacucucugauaccu

SEQ ID NO: 983340 - RNA, 19 nt, Homo sapiens
ggauuacacugggcagaag

SEQ ID NO: 983341 - RNA, 19 nt, Homo sapiens
aaguaucccucuccaugaa

SEQ ID NO: 983342 - RNA, 19 nt, Homo sapiens
gaagccaagaucauuguuc

SEQ ID NO: 983343 - RNA, 19 nt, Homo sapiens
gagaguauaaagaguguag

SEQ ID NO: 983344 - RNA, 19 nt, Homo sapiens
cagugugacuuaacuugug

SEQ ID NO: 983345 - RNA, 19 nt, Homo sapiens
aaggagagguugcuauggu

SEQ ID NO: 983346 - RNA, 19 nt, Homo sapiens
caggcagguuugggaguua

SEQ ID NO: 983347 - RNA, 19 nt, Homo sapiens
gugagaguauaaagagugu

SEQ ID NO: 983348 - RNA, 19 nt, Homo sapiens
ugccugcucucuacacuau

SEQ ID NO: 983349 - RNA, 19 nt, Homo sapiens
agacacuuguauuagcuuu

SEQ ID NO: 983350 - RNA, 19 nt, Homo sapiens
gcagugugacuuaacuugu

SEQ ID NO: 983351 - RNA, 19 nt, Homo sapiens
ggcuguaguuagagugauu

SEQ ID NO: 983352 - RNA, 19 nt, Homo sapiens
cugaaugaguuguuguuuc

SEQ ID NO: 983353 - RNA, 19 nt, Homo sapiens
aaaguaucccucuccauga

SEQ ID NO: 983354 - RNA, 19 nt, Homo sapiens
aaagugugggugaagcuua

SEQ ID NO: 983355 - RNA, 19 nt, Homo sapiens
aaaacagucugcaguguga

SEQ ID NO: 983356 - RNA, 19 nt, Homo sapiens
cagcaaggcagcaaagaag

SEQ ID NO: 983357 - RNA, 19 nt, Homo sapiens
acauagagauaggaaguca

SEQ ID NO: 983358 - RNA, 19 nt, Homo sapiens
ggacuaaauacucucugau

SEQ ID NO: 983359 - RNA, 19 nt, Homo sapiens
gccauagaauauuaaggau

SEQ ID NO: 983360 - RNA, 19 nt, Homo sapiens
uggauaagcccucugagau

SEQ ID NO: 983361 - RNA, 19 nt, Homo sapiens
gucacuaaauggaaaugug

SEQ ID NO: 983362 - RNA, 19 nt, Homo sapiens
gggaacauggugagaagug

SEQ ID NO: 983363 - RNA, 19 nt, Homo sapiens
caacaugggagcagagacu

SEQ ID NO: 983364 - RNA, 19 nt, Homo sapiens
ggagauggcuuccccucau

SEQ ID NO: 983365 - RNA, 19 nt, Homo sapiens
agaaagaaggagaagaaga

SEQ ID NO: 983366 - RNA, 19 nt, Homo sapiens
gaugagaacuacuuuguga

SEQ ID NO: 983367 - RNA, 19 nt, Homo sapiens
ccaacgcagucauuuauua

SEQ ID NO: 983368 - RNA, 19 nt, Homo sapiens
ggaaagaugccauauauuc

SEQ ID NO: 983369 - RNA, 19 nt, Homo sapiens
gaaguuggcuagcauggaa

SEQ ID NO: 983370 - RNA, 19 nt, Homo sapiens
gcaagacacugcaagauac

SEQ ID NO: 983371 - RNA, 19 nt, Homo sapiens
gggaaagagucaucucgua

SEQ ID NO: 983372 - RNA, 19 nt, Homo sapiens
cgggaaagaugccauauau

SEQ ID NO: 983373 - RNA, 19 nt, Homo sapiens
ggacaagcuugaaggaaau

SEQ ID NO: 983374 - RNA, 19 nt, Homo sapiens
gagaugauccuuggacuuu

SEQ ID NO: 983375 - RNA, 19 nt, Homo sapiens
gaaagaugccauauauuca

SEQ ID NO: 983376 - RNA, 19 nt, Homo sapiens
ucaacgggaucacuacuuu

SEQ ID NO: 983377 - RNA, 19 nt, Homo sapiens
ggaguuccguguucucaga

SEQ ID NO: 983378 - RNA, 19 nt, Homo sapiens
ggcaagacacugcaagaua

SEQ ID NO: 983379 - RNA, 19 nt, Homo sapiens
cagcugacaucucucuuug

SEQ ID NO: 983380 - RNA, 19 nt, Homo sapiens
gaacccaacagaggcaaua

SEQ ID NO: 983381 - RNA, 19 nt, Homo sapiens
gaggagcucuuugcugaug

SEQ ID NO: 983382 - RNA, 19 nt, Homo sapiens
gagagaaguuggcuagcau

SEQ ID NO: 983383 - RNA, 19 nt, Homo sapiens
ucaaagaucggucacauuc

SEQ ID NO: 983384 - RNA, 19 nt, Homo sapiens
agaacuacuuugugaacua

SEQ ID NO: 983385 - RNA, 19 nt, Homo sapiens
gaacuacuuugugaacuac

SEQ ID NO: 983386 - RNA, 19 nt, Homo sapiens
aagccuggaucaacuuuaa

SEQ ID NO: 983387 - RNA, 19 nt, Homo sapiens
gaauuaaugaggugucaga

SEQ ID NO: 983388 - RNA, 19 nt, Homo sapiens
aggacaagcuugaaggaaa

SEQ ID NO: 983389 - RNA, 19 nt, Homo sapiens
acagugaucugagcucuau

SEQ ID NO: 983390 - RNA, 19 nt, Homo sapiens
gaucacuacuuuacuuagg

SEQ ID NO: 983391 - RNA, 19 nt, Homo sapiens
ccacuugcccaccggcuua

SEQ ID NO: 983392 - RNA, 19 nt, Homo sapiens
gcugacaucucucuuugag

SEQ ID NO: 983393 - RNA, 19 nt, Homo sapiens
gggaucacuacuuuacuua

SEQ ID NO: 983394 - RNA, 19 nt, Homo sapiens
caacgggaucacuacuuua

SEQ ID NO: 983395 - RNA, 19 nt, Homo sapiens
caacgcagucauuuauuau

SEQ ID NO: 983396 - RNA, 19 nt, Homo sapiens
cuugagaguugcaggaauu

SEQ ID NO: 983397 - RNA, 19 nt, Homo sapiens
ucgcguaggugauaaugug

SEQ ID NO: 983398 - RNA, 19 nt, Homo sapiens
gcaauagaagccuggauca

SEQ ID NO: 983399 - RNA, 19 nt, Homo sapiens
gcgagucuguuuccagcuu

SEQ ID NO: 983400 - RNA, 19 nt, Homo sapiens
uguaucagcugacaucucu

SEQ ID NO: 983401 - RNA, 19 nt, Homo sapiens
gagaguugcaggaauuaau

SEQ ID NO: 983402 - RNA, 19 nt, Homo sapiens
cgggaucacuacuuuacuu

SEQ ID NO: 983403 - RNA, 19 nt, Homo sapiens
gugcacauuuaccugauug

SEQ ID NO: 983404 - RNA, 19 nt, Homo sapiens
gaagccuggaucaacuuua

SEQ ID NO: 983405 - RNA, 19 nt, Homo sapiens
caaccuuucccgacuuuau

SEQ ID NO: 983406 - RNA, 19 nt, Homo sapiens
caaggcaucaugaaacugu

SEQ ID NO: 983407 - RNA, 19 nt, Homo sapiens
aaagaucggucacauucag

SEQ ID NO: 983408 - RNA, 19 nt, Homo sapiens
ucaugaaacugugucuaga

SEQ ID NO: 983409 - RNA, 19 nt, Homo sapiens
gccuggaucaacuuuaaua

SEQ ID NO: 983410 - RNA, 19 nt, Homo sapiens
ggagaugauccuuggacuu

SEQ ID NO: 983411 - RNA, 19 nt, Homo sapiens
gggaaagaugccauauauu

SEQ ID NO: 983412 - RNA, 19 nt, Homo sapiens
ugugaaacuucgagcuuga

SEQ ID NO: 983413 - RNA, 19 nt, Homo sapiens
ccaugggacuugugaaacu

SEQ ID NO: 983414 - RNA, 19 nt, Homo sapiens
gauccauguucacuuccaa

SEQ ID NO: 983415 - RNA, 19 nt, Homo sapiens
gcucaaggcaucaugaaac

SEQ ID NO: 983416 - RNA, 19 nt, Homo sapiens
ccaagcauuugugccaaga

SEQ ID NO: 983417 - RNA, 19 nt, Homo sapiens
gcaaguggaaacugcuuca

SEQ ID NO: 983418 - RNA, 19 nt, Homo sapiens
acuucgagcuugagaguug

SEQ ID NO: 983419 - RNA, 19 nt, Homo sapiens
gcagaauacagagaauuuc

SEQ ID NO: 983420 - RNA, 19 nt, Homo sapiens
ccaguuugcagaauacaga

SEQ ID NO: 983421 - RNA, 19 nt, Homo sapiens
agacauguaucagcugaca

SEQ ID NO: 983422 - RNA, 19 nt, Homo sapiens
ugauugugcuugcaaggau

SEQ ID NO: 983423 - RNA, 19 nt, Homo sapiens
uugcugaugucaccauuuc

SEQ ID NO: 983424 - RNA, 19 nt, Homo sapiens
gagaacuacuuugugaacu

SEQ ID NO: 983425 - RNA, 19 nt, Homo sapiens
agagagaaguuggcuagca

SEQ ID NO: 983426 - RNA, 19 nt, Homo sapiens
ucacucaggacaagcuuga

SEQ ID NO: 983427 - RNA, 19 nt, Homo sapiens
cagcuucugggugauaaua

SEQ ID NO: 983428 - RNA, 19 nt, Homo sapiens
agagacaacucagcuagag

SEQ ID NO: 983429 - RNA, 19 nt, Homo sapiens
ugcagaauacagagaauuu

SEQ ID NO: 983430 - RNA, 19 nt, Homo sapiens
ggaugagaacuacuuugug

SEQ ID NO: 983431 - RNA, 19 nt, Homo sapiens
ucagcugacaucucucuuu

SEQ ID NO: 983432 - RNA, 19 nt, Homo sapiens
gacagagacaacucagcua

SEQ ID NO: 983433 - RNA, 19 nt, Homo sapiens
ucuccaacgcagucauuua

SEQ ID NO: 983434 - RNA, 19 nt, Homo sapiens
ccgggaaagaugccauaua

SEQ ID NO: 983435 - RNA, 19 nt, Homo sapiens
cccaaccuuucccgacuuu

SEQ ID NO: 983436 - RNA, 19 nt, Homo sapiens
ggagcucuuugcugauguc

SEQ ID NO: 983437 - RNA, 19 nt, Homo sapiens
gaaggaaauuggggagaau

SEQ ID NO: 983438 - RNA, 19 nt, Homo sapiens
auagaagccuggaucaacu

SEQ ID NO: 983439 - RNA, 19 nt, Homo sapiens
caauagaagccuggaucaa

SEQ ID NO: 983440 - RNA, 19 nt, Homo sapiens
ggauggaguuccguguucu

SEQ ID NO: 983441 - RNA, 19 nt, Homo sapiens
caugggacuugugaaacuu

SEQ ID NO: 983442 - RNA, 19 nt, Homo sapiens
gcccacaaccgggugauug

SEQ ID NO: 983443 - RNA, 19 nt, Homo sapiens
caaagaucggucacauuca

SEQ ID NO: 983444 - RNA, 19 nt, Homo sapiens
cuggccaguuugcagaaua

SEQ ID NO: 983445 - RNA, 19 nt, Homo sapiens
gaccccaccuggccaguuu

SEQ ID NO: 983446 - RNA, 19 nt, Homo sapiens
auacggcugccaagcauuu

SEQ ID NO: 983447 - RNA, 19 nt, Homo sapiens
gaguugcaggaauuaauga

SEQ ID NO: 983448 - RNA, 19 nt, Homo sapiens
aaacuucgagcuugagagu

SEQ ID NO: 983449 - RNA, 19 nt, Homo sapiens
gcaugguggagacuuguau

SEQ ID NO: 983450 - RNA, 19 nt, Homo sapiens
cccaacagaggcaauagaa

SEQ ID NO: 983451 - RNA, 19 nt, Homo sapiens
cuauacggcugccaagcau

SEQ ID NO: 983452 - RNA, 19 nt, Homo sapiens
gcuugagaguugcaggaau

SEQ ID NO: 983453 - RNA, 19 nt, Homo sapiens
guaaguggccaaaacaguu

SEQ ID NO: 983454 - RNA, 19 nt, Homo sapiens
uggaugagaacuacuuugu

SEQ ID NO: 983455 - RNA, 19 nt, Homo sapiens
uuucaaagaucggucacau

SEQ ID NO: 983456 - RNA, 19 nt, Homo sapiens
ccauggaugagaacuacuu

SEQ ID NO: 983457 - RNA, 19 nt, Homo sapiens
cuccaacgcagucauuuau

SEQ ID NO: 983458 - RNA, 19 nt, Homo sapiens
ccggcuuacucacagauau

SEQ ID NO: 983459 - RNA, 19 nt, Homo sapiens
ccaccggcuuacucacaga

SEQ ID NO: 983460 - RNA, 19 nt, Homo sapiens
cagagacaacucagcuaga

SEQ ID NO: 983461 - RNA, 19 nt, Homo sapiens
uccgauccauguucacuuc

SEQ ID NO: 983462 - RNA, 19 nt, Homo sapiens
gcuggcagagagagaaguu

SEQ ID NO: 983463 - RNA, 19 nt, Homo sapiens
ggaucacuacuuuacuuag

SEQ ID NO: 983464 - RNA, 19 nt, Homo sapiens
gcauguggaagugcaacaa

SEQ ID NO: 983465 - RNA, 19 nt, Homo sapiens
gcaagcaugguggagacuu

SEQ ID NO: 983466 - RNA, 19 nt, Homo sapiens
gaagaaaggccaaggauau

SEQ ID NO: 983467 - RNA, 19 nt, Homo sapiens
gaagauagaauccaaguau

SEQ ID NO: 983468 - RNA, 19 nt, Homo sapiens
gaaaucagucagcgcauua

SEQ ID NO: 983469 - RNA, 19 nt, Homo sapiens
gaacguaggaaacuugauu

SEQ ID NO: 983470 - RNA, 19 nt, Homo sapiens
gaacugggcacgccuguug

SEQ ID NO: 983471 - RNA, 19 nt, Homo sapiens
caucacaugucgauauuug

SEQ ID NO: 983472 - RNA, 19 nt, Homo sapiens
ccaaggauauuauaaaugc

SEQ ID NO: 983473 - RNA, 19 nt, Homo sapiens
ggaagaaaggccaaggaua

SEQ ID NO: 983474 - RNA, 19 nt, Homo sapiens
gcggaaacacuuagcuuua

SEQ ID NO: 983475 - RNA, 19 nt, Homo sapiens
gaagagaauccaucugaau

SEQ ID NO: 983476 - RNA, 19 nt, Homo sapiens
ggggaaaccucaagauaua

SEQ ID NO: 983477 - RNA, 19 nt, Homo sapiens
gggaaagccucgcgaagau

SEQ ID NO: 983478 - RNA, 19 nt, Homo sapiens
ggacaagaacggaauuuca

SEQ ID NO: 983479 - RNA, 19 nt, Homo sapiens
ggccaaggauauuauaaau

SEQ ID NO: 983480 - RNA, 19 nt, Homo sapiens
gaaaggccaaggauauuau

SEQ ID NO: 983481 - RNA, 19 nt, Homo sapiens
gcuccaaccucgcugaguu

SEQ ID NO: 983482 - RNA, 19 nt, Homo sapiens
ggaaacacuuagcuuuauc

SEQ ID NO: 983483 - RNA, 19 nt, Homo sapiens
gaaagccucgcgaagauga

SEQ ID NO: 983484 - RNA, 19 nt, Homo sapiens
gauuggcgcacuuuauaua

SEQ ID NO: 983485 - RNA, 19 nt, Homo sapiens
gaaguuauccaggccauga

SEQ ID NO: 983486 - RNA, 19 nt, Homo sapiens
aggaaacacuugccagaaa

SEQ ID NO: 983487 - RNA, 19 nt, Homo sapiens
ggaaacacuugccagaaac

SEQ ID NO: 983488 - RNA, 19 nt, Homo sapiens
caaaugcuaucaugaacgu

SEQ ID NO: 983489 - RNA, 19 nt, Homo sapiens
acauagaaccgcccacaua

SEQ ID NO: 983490 - RNA, 19 nt, Homo sapiens
ggaagcagcgcguggaugu

SEQ ID NO: 983491 - RNA, 19 nt, Homo sapiens
cggaaacacuuagcuuuau

SEQ ID NO: 983492 - RNA, 19 nt, Homo sapiens
aagagaauccaucugaaua

SEQ ID NO: 983493 - RNA, 19 nt, Homo sapiens
ggcacugagucaaauaauu

SEQ ID NO: 983494 - RNA, 19 nt, Homo sapiens
ggagaggaaaguuuauaug

SEQ ID NO: 983495 - RNA, 19 nt, Homo sapiens
ugaauucggucagaagaga

SEQ ID NO: 983496 - RNA, 19 nt, Homo sapiens
acgaggacuuggugaauuu

SEQ ID NO: 983497 - RNA, 19 nt, Homo sapiens
agaggaaaguuuauaugga

SEQ ID NO: 983498 - RNA, 19 nt, Homo sapiens
gagaggaaaguuuauaugg

SEQ ID NO: 983499 - RNA, 19 nt, Homo sapiens
ugaaaucagucagcgcauu

SEQ ID NO: 983500 - RNA, 19 nt, Homo sapiens
ggaaaccucaagauauaau

SEQ ID NO: 983501 - RNA, 19 nt, Homo sapiens
agaaaggccaaggauauua

SEQ ID NO: 983502 - RNA, 19 nt, Homo sapiens
acaugucgauauuugcaua

SEQ ID NO: 983503 - RNA, 19 nt, Homo sapiens
ggaagauagaauccaagua

SEQ ID NO: 983504 - RNA, 19 nt, Homo sapiens
gcauaggaccgcccacaug

SEQ ID NO: 983505 - RNA, 19 nt, Homo sapiens
gggcacgccuguugugagu

SEQ ID NO: 983506 - RNA, 19 nt, Homo sapiens
agaagagaauccaucugaa

SEQ ID NO: 983507 - RNA, 19 nt, Homo sapiens
ucucuacccuaugcuauuu

SEQ ID NO: 983508 - RNA, 19 nt, Homo sapiens
ggaaaguuuauauggacua

SEQ ID NO: 983509 - RNA, 19 nt, Homo sapiens
ggcguggacuuccuuacaa

SEQ ID NO: 983510 - RNA, 19 nt, Homo sapiens
gccagaaacuaaauuaacg

SEQ ID NO: 983511 - RNA, 19 nt, Homo sapiens
aaucagggcugcgcacuuc

SEQ ID NO: 983512 - RNA, 19 nt, Homo sapiens
gaacugcgaggcuuaugag

SEQ ID NO: 983513 - RNA, 19 nt, Homo sapiens
ugucaugccugucccugaa

SEQ ID NO: 983514 - RNA, 19 nt, Homo sapiens
ggugaagcggaaacacuua

SEQ ID NO: 983515 - RNA, 19 nt, Homo sapiens
gaggaaacacuugccagaa

SEQ ID NO: 983516 - RNA, 19 nt, Homo sapiens
acauaggaccgcccacaua

SEQ ID NO: 983517 - RNA, 19 nt, Homo sapiens
cccaauaccuguaacuuuu

SEQ ID NO: 983518 - RNA, 19 nt, Homo sapiens
ggacaccaacgccgcauag

SEQ ID NO: 983519 - RNA, 19 nt, Homo sapiens
uggcagcggucaccuuugu

SEQ ID NO: 983520 - RNA, 19 nt, Homo sapiens
aggauuggcgcacuuuaua

SEQ ID NO: 983521 - RNA, 19 nt, Homo sapiens
uagaaccgcccacauagga

SEQ ID NO: 983522 - RNA, 19 nt, Homo sapiens
ggauuggcgcacuuuauau

SEQ ID NO: 983523 - RNA, 19 nt, Homo sapiens
cuuccugucuugucccuuu

SEQ ID NO: 983524 - RNA, 19 nt, Homo sapiens
gccaaaugcuaucaugaac

SEQ ID NO: 983525 - RNA, 19 nt, Homo sapiens
uacgaggacuuggugaauu

SEQ ID NO: 983526 - RNA, 19 nt, Homo sapiens
gggaaaccucaagauauaa

SEQ ID NO: 983527 - RNA, 19 nt, Homo sapiens
gcagaggauucuuuucuca

SEQ ID NO: 983528 - RNA, 19 nt, Homo sapiens
ucagccaaaugcuaucaug

SEQ ID NO: 983529 - RNA, 19 nt, Homo sapiens
cgccggagaggaaaguuua

SEQ ID NO: 983530 - RNA, 19 nt, Homo sapiens
cauagaaccgcccacauag

SEQ ID NO: 983531 - RNA, 19 nt, Homo sapiens
ccaucugaauagccaguuu

SEQ ID NO: 983532 - RNA, 19 nt, Homo sapiens
gagaauccaucugaauagc

SEQ ID NO: 983533 - RNA, 19 nt, Homo sapiens
ccaucaugcuggccaacaa

SEQ ID NO: 983534 - RNA, 19 nt, Homo sapiens
acgcaaaccagaccucaaa

SEQ ID NO: 983535 - RNA, 19 nt, Homo sapiens
auucuguggugaaacauuu

SEQ ID NO: 983536 - RNA, 19 nt, Homo sapiens
acacuugccagaaacuaaa

SEQ ID NO: 983537 - RNA, 19 nt, Homo sapiens
gauauuugcauaggaguca

SEQ ID NO: 983538 - RNA, 19 nt, Homo sapiens
ugagggacguccgcgacua

SEQ ID NO: 983539 - RNA, 19 nt, Homo sapiens
gacaagaacggaauuucag

SEQ ID NO: 983540 - RNA, 19 nt, Homo sapiens
gcguggacuuccuuacaau

SEQ ID NO: 983541 - RNA, 19 nt, Homo sapiens
aaaggccaaggauauuaua

SEQ ID NO: 983542 - RNA, 19 nt, Homo sapiens
cauaggaccgcccacauag

SEQ ID NO: 983543 - RNA, 19 nt, Homo sapiens
ggaaagccucgcgaagaug

SEQ ID NO: 983544 - RNA, 19 nt, Homo sapiens
gccaaggauauuauaaaug

SEQ ID NO: 983545 - RNA, 19 nt, Homo sapiens
acaacucgccggagaggaa

SEQ ID NO: 983546 - RNA, 19 nt, Homo sapiens
aagaaaggccaaggauauu

SEQ ID NO: 983547 - RNA, 19 nt, Homo sapiens
gcauuaaagcccugaacca

SEQ ID NO: 983548 - RNA, 19 nt, Homo sapiens
ggagucauuuucaguggaa

SEQ ID NO: 983549 - RNA, 19 nt, Homo sapiens
gcucuggcauuuggacaca

SEQ ID NO: 983550 - RNA, 19 nt, Homo sapiens
caugaacguaggaaacuug

SEQ ID NO: 983551 - RNA, 19 nt, Homo sapiens
uaacucauugucagccaaa

SEQ ID NO: 983552 - RNA, 19 nt, Homo sapiens
ucccaauaccuguaacuuu

SEQ ID NO: 983553 - RNA, 19 nt, Homo sapiens
gggcguggacuuccuuaca

SEQ ID NO: 983554 - RNA, 19 nt, Homo sapiens
gcaaaccagaccucaaagg

SEQ ID NO: 983555 - RNA, 19 nt, Homo sapiens
guauucagcaggaagaaag

SEQ ID NO: 983556 - RNA, 19 nt, Homo sapiens
gaaaccucaagauauaauc

SEQ ID NO: 983557 - RNA, 19 nt, Homo sapiens
gaggcuggaagcugaauuc

SEQ ID NO: 983558 - RNA, 19 nt, Homo sapiens
ggacagagaacaccccaau

SEQ ID NO: 983559 - RNA, 19 nt, Homo sapiens
cgggaaagccucgcgaaga

SEQ ID NO: 983560 - RNA, 19 nt, Homo sapiens
gccaagccccauuucauua

SEQ ID NO: 983561 - RNA, 19 nt, Homo sapiens
acaugcaccuuuccagagu

SEQ ID NO: 983562 - RNA, 19 nt, Homo sapiens
gaauucggucagaagagaa

SEQ ID NO: 983563 - RNA, 19 nt, Homo sapiens
caggauuggcgcacuuuau

SEQ ID NO: 983564 - RNA, 19 nt, Homo sapiens
uaggaccgcccacauagga

SEQ ID NO: 983565 - RNA, 19 nt, Homo sapiens
cccagcggcuucccaauac

SEQ ID NO: 983566 - RNA, 19 nt, Homo sapiens
guaaauagguuucauguug

SEQ ID NO: 983567 - RNA, 19 nt, Homo sapiens
ucacauagcugaaauauca

SEQ ID NO: 983568 - RNA, 19 nt, Homo sapiens
caacauagguggacuguau

SEQ ID NO: 983569 - RNA, 19 nt, Homo sapiens
gcaguuaucucacuuaaau

SEQ ID NO: 983570 - RNA, 19 nt, Homo sapiens
uaggaaagcuggcaaauaa

SEQ ID NO: 983571 - RNA, 19 nt, Homo sapiens
acacagagguggcuuauuu

SEQ ID NO: 983572 - RNA, 19 nt, Homo sapiens
ggacuaccaugaucacaua

SEQ ID NO: 983573 - RNA, 19 nt, Homo sapiens
gagccaagcuauuaaguuu

SEQ ID NO: 983574 - RNA, 19 nt, Homo sapiens
caugagagaugcaagaaua

SEQ ID NO: 983575 - RNA, 19 nt, Homo sapiens
gaagauugcuuuaccugaa

SEQ ID NO: 983576 - RNA, 19 nt, Homo sapiens
gaagagauuucacaacaga

SEQ ID NO: 983577 - RNA, 19 nt, Homo sapiens
ggacagaucuggagcaagu

SEQ ID NO: 983578 - RNA, 19 nt, Homo sapiens
gcacgaagcuauauuugau

SEQ ID NO: 983579 - RNA, 19 nt, Homo sapiens
gcacuuaccagaaauaauu

SEQ ID NO: 983580 - RNA, 19 nt, Homo sapiens
gaaaccagcugaaguucuu

SEQ ID NO: 983581 - RNA, 19 nt, Homo sapiens
agaaaugcaucuccaaaua

SEQ ID NO: 983582 - RNA, 19 nt, Homo sapiens
ggaaagcuggcaaauaaua

SEQ ID NO: 983583 - RNA, 19 nt, Homo sapiens
ccaaaggacuagagaauug

SEQ ID NO: 983584 - RNA, 19 nt, Homo sapiens
guacagguguuauuaucua

SEQ ID NO: 983585 - RNA, 19 nt, Homo sapiens
gaaggcauguuuauaagug

SEQ ID NO: 983586 - RNA, 19 nt, Homo sapiens
agaaugcucuguauacuuu

SEQ ID NO: 983587 - RNA, 19 nt, Homo sapiens
ugaucgagcugucaaauuu

SEQ ID NO: 983588 - RNA, 19 nt, Homo sapiens
gcaaagagcacacaucauc

SEQ ID NO: 983589 - RNA, 19 nt, Homo sapiens
guuauaaacuccacuugaa

SEQ ID NO: 983590 - RNA, 19 nt, Homo sapiens
gacacuaccucucaaagaa

SEQ ID NO: 983591 - RNA, 19 nt, Homo sapiens
gaagaggaaagacuaauau

SEQ ID NO: 983592 - RNA, 19 nt, Homo sapiens
gagcaaguaccuaagauuu

SEQ ID NO: 983593 - RNA, 19 nt, Homo sapiens
gcacagauugauaaaguaa

SEQ ID NO: 983594 - RNA, 19 nt, Homo sapiens
gaauauuuguccuccuaaa

SEQ ID NO: 983595 - RNA, 19 nt, Homo sapiens
agacuaauaucccuuguau

SEQ ID NO: 983596 - RNA, 19 nt, Homo sapiens
gcagugauguuuucuuuaa

SEQ ID NO: 983597 - RNA, 19 nt, Homo sapiens
caccagaucucucuacguu

SEQ ID NO: 983598 - RNA, 19 nt, Homo sapiens
uaacacagcuguaguugac

SEQ ID NO: 983599 - RNA, 19 nt, Homo sapiens
ucaggugucuauaacauuu

SEQ ID NO: 983600 - RNA, 19 nt, Homo sapiens
gaucaggugucuauaacau

SEQ ID NO: 983601 - RNA, 19 nt, Homo sapiens
gcauuggacuuaauagcaa

SEQ ID NO: 983602 - RNA, 19 nt, Homo sapiens
uugacaagcuguuaucuaa

SEQ ID NO: 983603 - RNA, 19 nt, Homo sapiens
aaacauugcucaccagauc

SEQ ID NO: 983604 - RNA, 19 nt, Homo sapiens
ggaagcagcagugauguuu

SEQ ID NO: 983605 - RNA, 19 nt, Homo sapiens
gaaucugacuucuucacaa

SEQ ID NO: 983606 - RNA, 19 nt, Homo sapiens
gacaagcuguuaucuaagu

SEQ ID NO: 983607 - RNA, 19 nt, Homo sapiens
ggaaccguauugcuguuaa

SEQ ID NO: 983608 - RNA, 19 nt, Homo sapiens
gagagugaaggcaacauua

SEQ ID NO: 983609 - RNA, 19 nt, Homo sapiens
gaaauagacacagauguug

SEQ ID NO: 983610 - RNA, 19 nt, Homo sapiens
cagaagaaauagacacaga

SEQ ID NO: 983611 - RNA, 19 nt, Homo sapiens
gaaaugcaucuccaaauag

SEQ ID NO: 983612 - RNA, 19 nt, Homo sapiens
agagguggcuuauuuaauc

SEQ ID NO: 983613 - RNA, 19 nt, Homo sapiens
ccucaaaguugcuucaaga

SEQ ID NO: 983614 - RNA, 19 nt, Homo sapiens
uaacugaucaggugucuau

SEQ ID NO: 983615 - RNA, 19 nt, Homo sapiens
gaagaaugcugcaaaagau

SEQ ID NO: 983616 - RNA, 19 nt, Homo sapiens
ccagaucucucuacguuca

SEQ ID NO: 983617 - RNA, 19 nt, Homo sapiens
gagagaugcaagaauauuu

SEQ ID NO: 983618 - RNA, 19 nt, Homo sapiens
ugacuagaaugcucuguau

SEQ ID NO: 983619 - RNA, 19 nt, Homo sapiens
gcuuaaagauuuggaccua

SEQ ID NO: 983620 - RNA, 19 nt, Homo sapiens
uucaagaaguugccaguua

SEQ ID NO: 983621 - RNA, 19 nt, Homo sapiens
cagcugaaguucuuauugu

SEQ ID NO: 983622 - RNA, 19 nt, Homo sapiens
ucagauauaugccaugauc

SEQ ID NO: 983623 - RNA, 19 nt, Homo sapiens
gaucagaugagaauguuga

SEQ ID NO: 983624 - RNA, 19 nt, Homo sapiens
gaagaaauagacacagaug

SEQ ID NO: 983625 - RNA, 19 nt, Homo sapiens
caaaguugcuucaagaaaa

SEQ ID NO: 983626 - RNA, 19 nt, Homo sapiens
gaaaguaaagcuguuugaa

SEQ ID NO: 983627 - RNA, 19 nt, Homo sapiens
aagaaaagcugagccauua

SEQ ID NO: 983628 - RNA, 19 nt, Homo sapiens
uggaagagauuucacaaca

SEQ ID NO: 983629 - RNA, 19 nt, Homo sapiens
gaaggaucacuccacauuu

SEQ ID NO: 983630 - RNA, 19 nt, Homo sapiens
caaggaacauuuuacagua

SEQ ID NO: 983631 - RNA, 19 nt, Homo sapiens
gcacuacauuccugugauc

SEQ ID NO: 983632 - RNA, 19 nt, Homo sapiens
cuucagagccaagcuauua

SEQ ID NO: 983633 - RNA, 19 nt, Homo sapiens
ucaaauuucucaugucaag

SEQ ID NO: 983634 - RNA, 19 nt, Homo sapiens
gaaagcuggcaaauaauau

SEQ ID NO: 983635 - RNA, 19 nt, Homo sapiens
gagcacacaucaucaucug

SEQ ID NO: 983636 - RNA, 19 nt, Homo sapiens
caaggaagcagcagugaug

SEQ ID NO: 983637 - RNA, 19 nt, Homo sapiens
gaaggcaacauuaaauauc

SEQ ID NO: 983638 - RNA, 19 nt, Homo sapiens
aagaauauuuguccuccua

SEQ ID NO: 983639 - RNA, 19 nt, Homo sapiens
gaagaacaaacacagaugu

SEQ ID NO: 983640 - RNA, 19 nt, Homo sapiens
aaauuuggcucuuucuuca

SEQ ID NO: 983641 - RNA, 19 nt, Homo sapiens
gugaaggcaacauuaaaua

SEQ ID NO: 983642 - RNA, 19 nt, Homo sapiens
uguggacacugaagucaua

SEQ ID NO: 983643 - RNA, 19 nt, Homo sapiens
gccaagcuauuaaguuugu

SEQ ID NO: 983644 - RNA, 19 nt, Homo sapiens
gacuguauaucauuccaaa

SEQ ID NO: 983645 - RNA, 19 nt, Homo sapiens
gaagcucgacuaccaccua

SEQ ID NO: 983646 - RNA, 19 nt, Homo sapiens
ucaagaaguugccaguuag

SEQ ID NO: 983647 - RNA, 19 nt, Homo sapiens
uaacaccuauagcaguuga

SEQ ID NO: 983648 - RNA, 19 nt, Homo sapiens
cagaugagaauguugaauu

SEQ ID NO: 983649 - RNA, 19 nt, Homo sapiens
gaaguuaauggccacugua

SEQ ID NO: 983650 - RNA, 19 nt, Homo sapiens
ucagugggaucuacaagga

SEQ ID NO: 983651 - RNA, 19 nt, Homo sapiens
ggaccuaaauauggcgaaa

SEQ ID NO: 983652 - RNA, 19 nt, Homo sapiens
gaagugaaggcuccuguuc

SEQ ID NO: 983653 - RNA, 19 nt, Homo sapiens
gcuguuaucuaaguaugaa

SEQ ID NO: 983654 - RNA, 19 nt, Homo sapiens
ucacuaaggacuaccauga

SEQ ID NO: 983655 - RNA, 19 nt, Homo sapiens
caggagguguggauauuau

SEQ ID NO: 983656 - RNA, 19 nt, Homo sapiens
guuuauaagugaugcauuc

SEQ ID NO: 983657 - RNA, 19 nt, Homo sapiens
ugaaggaucacuccacauu

SEQ ID NO: 983658 - RNA, 19 nt, Homo sapiens
ugccuuggaugauuccuua

SEQ ID NO: 983659 - RNA, 19 nt, Homo sapiens
caugggauguguuuguuau

SEQ ID NO: 983660 - RNA, 19 nt, Homo sapiens
ucacgauguuugcaguuaa

SEQ ID NO: 983661 - RNA, 19 nt, Homo sapiens
auaauucacuggacacaga

SEQ ID NO: 983662 - RNA, 19 nt, Homo sapiens
ugaauuuguuggagcauug

SEQ ID NO: 983663 - RNA, 19 nt, Homo sapiens
agucauaccuucauucuac

SEQ ID NO: 983664 - RNA, 19 nt, Homo sapiens
aaucugacuucuucacaaa

SEQ ID NO: 983665 - RNA, 19 nt, Homo sapiens
agacucagguuucuuugga

SEQ ID NO: 983666 - RNA, 19 nt, Homo sapiens
uaaagucucuggccucaua

SEQ ID NO: 983667 - RNA, 19 nt, Homo sapiens
gcucaagggucuucgagua

SEQ ID NO: 983668 - RNA, 19 nt, Homo sapiens
ugagacugaucaaacaaua

SEQ ID NO: 983669 - RNA, 19 nt, Homo sapiens
caaccaggccugagacuga

SEQ ID NO: 983670 - RNA, 19 nt, Homo sapiens
cuaaagauaucagcuguuc

SEQ ID NO: 983671 - RNA, 19 nt, Homo sapiens
acacugcccucgccgcuuu

SEQ ID NO: 983672 - RNA, 19 nt, Homo sapiens
ggaguccucuagccuaaag

SEQ ID NO: 983673 - RNA, 19 nt, Homo sapiens
gcacggcaccauuccauuc

SEQ ID NO: 983674 - RNA, 19 nt, Homo sapiens
gguaaagcccuucgagugu

SEQ ID NO: 983675 - RNA, 19 nt, Homo sapiens
gagcugagaugggaaugag

SEQ ID NO: 983676 - RNA, 19 nt, Homo sapiens
uaaagcccuucgaguguga

SEQ ID NO: 983677 - RNA, 19 nt, Homo sapiens
agaacacacugcagaaaca

SEQ ID NO: 983678 - RNA, 19 nt, Homo sapiens
gagacugaucaaacaauaa

SEQ ID NO: 983679 - RNA, 19 nt, Homo sapiens
ggagugugguguguaaagu

SEQ ID NO: 983680 - RNA, 19 nt, Homo sapiens
cccaaccacuaccugcuua

SEQ ID NO: 983681 - RNA, 19 nt, Homo sapiens
ggaggaauccgugaguaau

SEQ ID NO: 983682 - RNA, 19 nt, Homo sapiens
gaaggaggaauccgugagu

SEQ ID NO: 983683 - RNA, 19 nt, Homo sapiens
ggcagagccuugacuggau

SEQ ID NO: 983684 - RNA, 19 nt, Homo sapiens
ccagguaccacaggacuuu

SEQ ID NO: 983685 - RNA, 19 nt, Homo sapiens
guacauguccuaccuucag

SEQ ID NO: 983686 - RNA, 19 nt, Homo sapiens
accacuaccugcuuauuga

SEQ ID NO: 983687 - RNA, 19 nt, Homo sapiens
acacagagcagccgcaucu

SEQ ID NO: 983688 - RNA, 19 nt, Homo sapiens
gcccucagccucuggcauu

SEQ ID NO: 983689 - RNA, 19 nt, Homo sapiens
gccugagacugaucaaaca

SEQ ID NO: 983690 - RNA, 19 nt, Homo sapiens
ccucuagccuaaagauauc

SEQ ID NO: 983691 - RNA, 19 nt, Homo sapiens
ucaggaaucugcgccaucu

SEQ ID NO: 983692 - RNA, 19 nt, Homo sapiens
gaggaauccgugaguaauc

SEQ ID NO: 983693 - RNA, 19 nt, Homo sapiens
ucaagggucuucgaguaca

SEQ ID NO: 983694 - RNA, 19 nt, Homo sapiens
aaggaggaauccgugagua

SEQ ID NO: 983695 - RNA, 19 nt, Homo sapiens
cccuucggcuucucucuuu

SEQ ID NO: 983696 - RNA, 19 nt, Homo sapiens
caaccacuaccugcuuauu

SEQ ID NO: 983697 - RNA, 19 nt, Homo sapiens
aaagauaucagcuguucca

SEQ ID NO: 983698 - RNA, 19 nt, Homo sapiens
cagagcagccgcaucucaa

SEQ ID NO: 983699 - RNA, 19 nt, Homo sapiens
ggcugugggucgucaggaa

SEQ ID NO: 983700 - RNA, 19 nt, Homo sapiens
cuccaaggcccaaccacua

SEQ ID NO: 983701 - RNA, 19 nt, Homo sapiens
gagcagccgcaucucaaag

SEQ ID NO: 983702 - RNA, 19 nt, Homo sapiens
cuucgagugugacaucugu

SEQ ID NO: 983703 - RNA, 19 nt, Homo sapiens
caagggucuucgaguacau

SEQ ID NO: 983704 - RNA, 19 nt, Homo sapiens
ggccugagacugaucaaac

SEQ ID NO: 983705 - RNA, 19 nt, Homo sapiens
cacguuucccacucuguua

SEQ ID NO: 983706 - RNA, 19 nt, Homo sapiens
ggagcugagaugggaauga

SEQ ID NO: 983707 - RNA, 19 nt, Homo sapiens
auggaguccucuagccuaa

SEQ ID NO: 983708 - RNA, 19 nt, Homo sapiens
gaaugagccccuacacaga

SEQ ID NO: 983709 - RNA, 19 nt, Homo sapiens
cuucagguccuccguguuc

SEQ ID NO: 983710 - RNA, 19 nt, Homo sapiens
aggaggaauccgugaguaa

SEQ ID NO: 983711 - RNA, 19 nt, Homo sapiens
gaacggaacucggguuauu

SEQ ID NO: 983712 - RNA, 19 nt, Homo sapiens
ggaagaaagugacguaauc

SEQ ID NO: 983713 - RNA, 19 nt, Homo sapiens
gaagaacaguuggcacuuu

SEQ ID NO: 983714 - RNA, 19 nt, Homo sapiens
guaaucacgugcucgauga

SEQ ID NO: 983715 - RNA, 19 nt, Homo sapiens
gcacugcccuccacagaca

SEQ ID NO: 983716 - RNA, 19 nt, Homo sapiens
ggacacugcuucagaaagg

SEQ ID NO: 983717 - RNA, 19 nt, Homo sapiens
ggaagucgcugugcagaag

SEQ ID NO: 983718 - RNA, 19 nt, Homo sapiens
ggacaccauugugcacuuu

SEQ ID NO: 983719 - RNA, 19 nt, Homo sapiens
gaacauguacauugaaguc

SEQ ID NO: 983720 - RNA, 19 nt, Homo sapiens
ccacgccucuggugcauga

SEQ ID NO: 983721 - RNA, 19 nt, Homo sapiens
gagaacggaacucggguua

SEQ ID NO: 983722 - RNA, 19 nt, Homo sapiens
gaagcuacaugggaagugu

SEQ ID NO: 983723 - RNA, 19 nt, Homo sapiens
caccguauuucuacuacua

SEQ ID NO: 983724 - RNA, 19 nt, Homo sapiens
cagaaagggagaagcguua

SEQ ID NO: 983725 - RNA, 19 nt, Homo sapiens
gaagaaagugacguaauca

SEQ ID NO: 983726 - RNA, 19 nt, Homo sapiens
ggccgaagcuuuacaucgu

SEQ ID NO: 983727 - RNA, 19 nt, Homo sapiens
aagaacaguuggcacuuug

SEQ ID NO: 983728 - RNA, 19 nt, Homo sapiens
gggaacauguacauugaag

SEQ ID NO: 983729 - RNA, 19 nt, Homo sapiens
aaaggaagaaagugacgua

SEQ ID NO: 983730 - RNA, 19 nt, Homo sapiens
gagcaucacccgucugcau

SEQ ID NO: 983731 - RNA, 19 nt, Homo sapiens
uauagaauccucucuguac

SEQ ID NO: 983732 - RNA, 19 nt, Homo sapiens
acgggaacauguacauuga

SEQ ID NO: 983733 - RNA, 19 nt, Homo sapiens
gggccucaccguauuucua

SEQ ID NO: 983734 - RNA, 19 nt, Homo sapiens
uguggacacugcuucagaa

SEQ ID NO: 983735 - RNA, 19 nt, Homo sapiens
gaacaguuggcacuuugca

SEQ ID NO: 983736 - RNA, 19 nt, Homo sapiens
ccggaacgccaaauacuug

SEQ ID NO: 983737 - RNA, 19 nt, Homo sapiens
gggacaccauugugcacuu

SEQ ID NO: 983738 - RNA, 19 nt, Homo sapiens
gggaguacgugcggguguu

SEQ ID NO: 983739 - RNA, 19 nt, Homo sapiens
cauguacauugaagucugu

SEQ ID NO: 983740 - RNA, 19 nt, Homo sapiens
ucucagggccucaccguau

SEQ ID NO: 983741 - RNA, 19 nt, Homo sapiens
cagccgcaccuuucuguga

SEQ ID NO: 983742 - RNA, 19 nt, Homo sapiens
gaaagggagaagcguuagu

SEQ ID NO: 983743 - RNA, 19 nt, Homo sapiens
gugcggguguucgauguga

SEQ ID NO: 983744 - RNA, 19 nt, Homo sapiens
gcaucacccgucugcauga

SEQ ID NO: 983745 - RNA, 19 nt, Homo sapiens
gcucgaugaagaacaguug

SEQ ID NO: 983746 - RNA, 19 nt, Homo sapiens
ccugcgugcuggugaagaa

SEQ ID NO: 983747 - RNA, 19 nt, Homo sapiens
gguccagccugaagguucu

SEQ ID NO: 983748 - RNA, 19 nt, Homo sapiens
uagggagaacgaacucuuu

SEQ ID NO: 983749 - RNA, 19 nt, Homo sapiens
ucacgugcucgaugaagaa

SEQ ID NO: 983750 - RNA, 19 nt, Homo sapiens
cacgggaacauguacauug

SEQ ID NO: 983751 - RNA, 19 nt, Homo sapiens
gugugaacuuuauagaauc

SEQ ID NO: 983752 - RNA, 19 nt, Homo sapiens
uuuauagaauccucucugu

SEQ ID NO: 983753 - RNA, 19 nt, Homo sapiens
ugaagaaggcagccacagu

SEQ ID NO: 983754 - RNA, 19 nt, Homo sapiens
gagcuccacgggaacaugu

SEQ ID NO: 983755 - RNA, 19 nt, Homo sapiens
cagcauguggugucucaga

SEQ ID NO: 983756 - RNA, 19 nt, Homo sapiens
cuacaugggaagugugaug

SEQ ID NO: 983757 - RNA, 19 nt, Homo sapiens
uuauagaauccucucugua

SEQ ID NO: 983758 - RNA, 19 nt, Homo sapiens
ccucaccguauuucuacua

SEQ ID NO: 983759 - RNA, 19 nt, Homo sapiens
cucagggccucaccguauu

SEQ ID NO: 983760 - RNA, 19 nt, Homo sapiens
ccaacccucacccacauga

SEQ ID NO: 983761 - RNA, 19 nt, Homo sapiens
caaauacuuggucgucuac

SEQ ID NO: 983762 - RNA, 19 nt, Homo sapiens
aaagggagaagcguuagug

SEQ ID NO: 983763 - RNA, 19 nt, Homo sapiens
ggaagaaugugccaagugu

SEQ ID NO: 983764 - RNA, 19 nt, Homo sapiens
gaacauguuuguggaagaa

SEQ ID NO: 983765 - RNA, 19 nt, Homo sapiens
caacaagggaaacuuuauu

SEQ ID NO: 983766 - RNA, 19 nt, Homo sapiens
aagggaaacuuuauuguuc

SEQ ID NO: 983767 - RNA, 19 nt, Homo sapiens
caagggaaacuuuauuguu

SEQ ID NO: 983768 - RNA, 19 nt, Homo sapiens
ggucucacuuuguuacuug

SEQ ID NO: 983769 - RNA, 19 nt, Homo sapiens
ggaacauguuuguggaaga

SEQ ID NO: 983770 - RNA, 19 nt, Homo sapiens
gaaaaguccucaaugcaau

SEQ ID NO: 983771 - RNA, 19 nt, Homo sapiens
gaagaaugugccaagugua

SEQ ID NO: 983772 - RNA, 19 nt, Homo sapiens
cgaggaugucggugaauua

SEQ ID NO: 983773 - RNA, 19 nt, Homo sapiens
gaaugugccaaguguaaga

SEQ ID NO: 983774 - RNA, 19 nt, Homo sapiens
ccucugacuugcuguguug

SEQ ID NO: 983775 - RNA, 19 nt, Homo sapiens
caaguucgacaccaccuuu

SEQ ID NO: 983776 - RNA, 19 nt, Homo sapiens
aagaaugugccaaguguaa

SEQ ID NO: 983777 - RNA, 19 nt, Homo sapiens
ccgcauccauggcuacguu

SEQ ID NO: 983778 - RNA, 19 nt, Homo sapiens
ccaaguguaagacgcagua

SEQ ID NO: 983779 - RNA, 19 nt, Homo sapiens
ggaaaaguccucaaugcaa

SEQ ID NO: 983780 - RNA, 19 nt, Homo sapiens
ggagacccaccuugaagug

SEQ ID NO: 983781 - RNA, 19 nt, Homo sapiens
ccucaacaagggaaacuuu

SEQ ID NO: 983782 - RNA, 19 nt, Homo sapiens
ucgaggaugucggugaauu

SEQ ID NO: 983783 - RNA, 19 nt, Homo sapiens
ucaacaagggaaacuuuau

SEQ ID NO: 983784 - RNA, 19 nt, Homo sapiens
gcugagggacaccauccua

SEQ ID NO: 983785 - RNA, 19 nt, Homo sapiens
gcaguacguccgagacaca

SEQ ID NO: 983786 - RNA, 19 nt, Homo sapiens
ucacuuuguuacuuguuuc

SEQ ID NO: 983787 - RNA, 19 nt, Homo sapiens
gaaucucccacccggauca

SEQ ID NO: 983788 - RNA, 19 nt, Homo sapiens
gagcuccacgggaacaugu

SEQ ID NO: 983789 - RNA, 19 nt, Homo sapiens
agucgaggaugucggugaa

SEQ ID NO: 983790 - RNA, 19 nt, Homo sapiens
gcuccacgggaacauguuu

SEQ ID NO: 983791 - RNA, 19 nt, Homo sapiens
aacaagggaaacuuuauug

SEQ ID NO: 983792 - RNA, 19 nt, Homo sapiens
ugagggacaccauccuaga

SEQ ID NO: 983793 - RNA, 19 nt, Homo sapiens
gcagagcuccacgggaaca

SEQ ID NO: 983794 - RNA, 19 nt, Homo sapiens
aaaguccucaaugcaauaa

SEQ ID NO: 983795 - RNA, 19 nt, Homo sapiens
cucaacaagggaaacuuua

SEQ ID NO: 983796 - RNA, 19 nt, Homo sapiens
ccaucacgcuggguacauc

SEQ ID NO: 983797 - RNA, 19 nt, Homo sapiens
gaggaugucggugaauuac

SEQ ID NO: 983798 - RNA, 19 nt, Homo sapiens
gggagacccaccuugaagu

SEQ ID NO: 983799 - RNA, 19 nt, Homo sapiens
caagggaauuugugaacua

SEQ ID NO: 983800 - RNA, 19 nt, Homo sapiens
gaaaagcugucuucaacua

SEQ ID NO: 983801 - RNA, 19 nt, Homo sapiens
gggaauuugugaacuagaa

SEQ ID NO: 983802 - RNA, 19 nt, Homo sapiens
ggauaucuguggaccuuau

SEQ ID NO: 983803 - RNA, 19 nt, Homo sapiens
aaaccugucuuaucuguca

SEQ ID NO: 983804 - RNA, 19 nt, Homo sapiens
cuacaacccauuucuauga

SEQ ID NO: 983805 - RNA, 19 nt, Homo sapiens
gaaggaaaaugaagaaaag

SEQ ID NO: 983806 - RNA, 19 nt, Homo sapiens
gaacuguaacgcccagaaa

SEQ ID NO: 983807 - RNA, 19 nt, Homo sapiens
cauaagcucuuggagaugu

SEQ ID NO: 983808 - RNA, 19 nt, Homo sapiens
gaaaaggugugucuggaau

SEQ ID NO: 983809 - RNA, 19 nt, Homo sapiens
gaaaaccugucuuaucugu

SEQ ID NO: 983810 - RNA, 19 nt, Homo sapiens
cgugggugcuucagaguaa

SEQ ID NO: 983811 - RNA, 19 nt, Homo sapiens
cgcauaagcucuuggagau

SEQ ID NO: 983812 - RNA, 19 nt, Homo sapiens
cagaaaaccugucuuaucu

SEQ ID NO: 983813 - RNA, 19 nt, Homo sapiens
aggugugucuggaauauaa

SEQ ID NO: 983814 - RNA, 19 nt, Homo sapiens
aaaggugugucuggaauau

SEQ ID NO: 983815 - RNA, 19 nt, Homo sapiens
ugagcuaccuguccaugug

SEQ ID NO: 983816 - RNA, 19 nt, Homo sapiens
acaauuuaauccugaagug

SEQ ID NO: 983817 - RNA, 19 nt, Homo sapiens
ggaauuugugaacuagaaa

SEQ ID NO: 983818 - RNA, 19 nt, Homo sapiens
gaagugggaaacccucaau

SEQ ID NO: 983819 - RNA, 19 nt, Homo sapiens
gaagcugugugaggaacug

SEQ ID NO: 983820 - RNA, 19 nt, Homo sapiens
ucuuggagauguacaggaa

SEQ ID NO: 983821 - RNA, 19 nt, Homo sapiens
aagacaagauagaacuaga

SEQ ID NO: 983822 - RNA, 19 nt, Homo sapiens
cuagaaaacuaccauuaug

SEQ ID NO: 983823 - RNA, 19 nt, Homo sapiens
ucaacuaccaagggaauuu

SEQ ID NO: 983824 - RNA, 19 nt, Homo sapiens
ggagaagcugugugaggaa

SEQ ID NO: 983825 - RNA, 19 nt, Homo sapiens
ugggaaacccucaaugaug

SEQ ID NO: 983826 - RNA, 19 nt, Homo sapiens
gccuacaacccauuucuau

SEQ ID NO: 983827 - RNA, 19 nt, Homo sapiens
caacuaccaagggaauuug

SEQ ID NO: 983828 - RNA, 19 nt, Homo sapiens
ggaacuguaacgcccagaa

SEQ ID NO: 983829 - RNA, 19 nt, Homo sapiens
ucuggaauauaacgaggaa

SEQ ID NO: 983830 - RNA, 19 nt, Homo sapiens
gacaagauagaacuagaca

SEQ ID NO: 983831 - RNA, 19 nt, Homo sapiens
cuaccaagggaauuuguga

SEQ ID NO: 983832 - RNA, 19 nt, Homo sapiens
ggccuacaacccauuucua

SEQ ID NO: 983833 - RNA, 19 nt, Homo sapiens
gcccagaaaaccugucuua

SEQ ID NO: 983834 - RNA, 19 nt, Homo sapiens
ccaagggaauuugugaacu

SEQ ID NO: 983835 - RNA, 19 nt, Homo sapiens
caaaauacaggugaaaaug

SEQ ID NO: 983836 - RNA, 19 nt, Homo sapiens
uggaaaagcugucuucaac

SEQ ID NO: 983837 - RNA, 19 nt, Homo sapiens
acggauaucuguggaccuu

SEQ ID NO: 983838 - RNA, 19 nt, Homo sapiens
gugggaaacccucaaugau

SEQ ID NO: 983839 - RNA, 19 nt, Homo sapiens
gcgucuccuucuacggaua

SEQ ID NO: 983840 - RNA, 19 nt, Homo sapiens
acgaggaacuggagaagcu

SEQ ID NO: 983841 - RNA, 19 nt, Homo sapiens
cgaaggaaaaugaagaaaa

SEQ ID NO: 983842 - RNA, 19 nt, Homo sapiens
ggcacaauuuaauccugaa

SEQ ID NO: 983843 - RNA, 19 nt, Homo sapiens
aaauacaggugaaaaugga

SEQ ID NO: 983844 - RNA, 19 nt, Homo sapiens
ccagaaaaccugucuuauc

SEQ ID NO: 983845 - RNA, 19 nt, Homo sapiens
ggaauauaacgaggaacug

SEQ ID NO: 983846 - RNA, 19 nt, Homo sapiens
ccucaaugaugcagguuuu

SEQ ID NO: 983847 - RNA, 19 nt, Homo sapiens
agugggaaacccucaauga

SEQ ID NO: 983848 - RNA, 19 nt, Homo sapiens
gaacuagaaaacuaccauu

SEQ ID NO: 983849 - RNA, 19 nt, Homo sapiens
gaccuuauggaagcaaaga

SEQ ID NO: 983850 - RNA, 19 nt, Homo sapiens
gagauuugcuucugucuua

SEQ ID NO: 983851 - RNA, 19 nt, Homo sapiens
caacuacucuuacaucuuu

SEQ ID NO: 983852 - RNA, 19 nt, Homo sapiens
gaaagaaugugaaauccuu

SEQ ID NO: 983853 - RNA, 19 nt, Homo sapiens
ggugauaucuuaagccuuu

SEQ ID NO: 983854 - RNA, 19 nt, Homo sapiens
gaaauuacuucugauggua

SEQ ID NO: 983855 - RNA, 19 nt, Homo sapiens
ggagccagauucuaucaua

SEQ ID NO: 983856 - RNA, 19 nt, Homo sapiens
uaaaguaccuguaucuaga

SEQ ID NO: 983857 - RNA, 19 nt, Homo sapiens
guacaauguugaagucuuu

SEQ ID NO: 983858 - RNA, 19 nt, Homo sapiens
gauggaagcuuggaucuga

SEQ ID NO: 983859 - RNA, 19 nt, Homo sapiens
gauaauaacguguuugaug

SEQ ID NO: 983860 - RNA, 19 nt, Homo sapiens
guaccuguaucuagauuaa

SEQ ID NO: 983861 - RNA, 19 nt, Homo sapiens
gcaaguagaguaauaaauc

SEQ ID NO: 983862 - RNA, 19 nt, Homo sapiens
caugguaaaucuagacuuu

SEQ ID NO: 983863 - RNA, 19 nt, Homo sapiens
gcugugaaauuacuucuga

SEQ ID NO: 983864 - RNA, 19 nt, Homo sapiens
ucaaguaugucuguuguaa

SEQ ID NO: 983865 - RNA, 19 nt, Homo sapiens
guucacgucuagccaaaua

SEQ ID NO: 983866 - RNA, 19 nt, Homo sapiens
ccauugaucccguaucuua

SEQ ID NO: 983867 - RNA, 19 nt, Homo sapiens
caaauucgguaagacagua

SEQ ID NO: 983868 - RNA, 19 nt, Homo sapiens
ugaggaggccuucagauua

SEQ ID NO: 983869 - RNA, 19 nt, Homo sapiens
aaagagaggucuacguaug

SEQ ID NO: 983870 - RNA, 19 nt, Homo sapiens
ggaguagauugguauauuc

SEQ ID NO: 983871 - RNA, 19 nt, Homo sapiens
uaacguguuugauggagua

SEQ ID NO: 983872 - RNA, 19 nt, Homo sapiens
gaggaggccuucagauuag

SEQ ID NO: 983873 - RNA, 19 nt, Homo sapiens
aaaggcaaguagaguaaua

SEQ ID NO: 983874 - RNA, 19 nt, Homo sapiens
guaaucagguuaucaaagg

SEQ ID NO: 983875 - RNA, 19 nt, Homo sapiens
uagagcagauugucauauu

SEQ ID NO: 983876 - RNA, 19 nt, Homo sapiens
uaauagacccacagcuuua

SEQ ID NO: 983877 - RNA, 19 nt, Homo sapiens
guaauagacccacagcuuu

SEQ ID NO: 983878 - RNA, 19 nt, Homo sapiens
gaaucgaacuaacaauaca

SEQ ID NO: 983879 - RNA, 19 nt, Homo sapiens
ugaaagaugccuucuagaa

SEQ ID NO: 983880 - RNA, 19 nt, Homo sapiens
uaagauuucuggaguagau

SEQ ID NO: 983881 - RNA, 19 nt, Homo sapiens
gaaggaaucgaacuaacaa

SEQ ID NO: 983882 - RNA, 19 nt, Homo sapiens
ggauaaauuuccuguugug

SEQ ID NO: 983883 - RNA, 19 nt, Homo sapiens
ccacaucacuaaguaauag

SEQ ID NO: 983884 - RNA, 19 nt, Homo sapiens
ccacugaauuaauacugua

SEQ ID NO: 983885 - RNA, 19 nt, Homo sapiens
uaauaaaucucuccugcau

SEQ ID NO: 983886 - RNA, 19 nt, Homo sapiens
cuaaacugcuaaacaacua

SEQ ID NO: 983887 - RNA, 19 nt, Homo sapiens
caacugcaccauacaacua

SEQ ID NO: 983888 - RNA, 19 nt, Homo sapiens
acacucaggugcucacaaa

SEQ ID NO: 983889 - RNA, 19 nt, Homo sapiens
gcucuuauggucuaugaua

SEQ ID NO: 983890 - RNA, 19 nt, Homo sapiens
agaaggaugucaguaauug

SEQ ID NO: 983891 - RNA, 19 nt, Homo sapiens
gcucaacugcuguguuuaa

SEQ ID NO: 983892 - RNA, 19 nt, Homo sapiens
gcugauacaaaguaaguua

SEQ ID NO: 983893 - RNA, 19 nt, Homo sapiens
gauuaacacuagcagauuc

SEQ ID NO: 983894 - RNA, 19 nt, Homo sapiens
caaggaaucucaccaaucc

SEQ ID NO: 983895 - RNA, 19 nt, Homo sapiens
ccagaaggaugucaguaau

SEQ ID NO: 983896 - RNA, 19 nt, Homo sapiens
uuaccucccuucucaaauu

SEQ ID NO: 983897 - RNA, 19 nt, Homo sapiens
gguuuacuauugcacauuu

SEQ ID NO: 983898 - RNA, 19 nt, Homo sapiens
guacaagaauaaucgaagu

SEQ ID NO: 983899 - RNA, 19 nt, Homo sapiens
aaauagaucuuccaguaca

SEQ ID NO: 983900 - RNA, 19 nt, Homo sapiens
gaacuaacaauacauucug

SEQ ID NO: 983901 - RNA, 19 nt, Homo sapiens
caccauacaacuacucuua

SEQ ID NO: 983902 - RNA, 19 nt, Homo sapiens
gagcucuuauggucuauga

SEQ ID NO: 983903 - RNA, 19 nt, Homo sapiens
guaguacaauuucuuugga

SEQ ID NO: 983904 - RNA, 19 nt, Homo sapiens
guuggugguuuacacguua

SEQ ID NO: 983905 - RNA, 19 nt, Homo sapiens
uaacuguucuugugcaauc

SEQ ID NO: 983906 - RNA, 19 nt, Homo sapiens
caucagaggauuaacacua

SEQ ID NO: 983907 - RNA, 19 nt, Homo sapiens
gaaagaugccuucuagaac

SEQ ID NO: 983908 - RNA, 19 nt, Homo sapiens
cuguuaagcuucauacauu

SEQ ID NO: 983909 - RNA, 19 nt, Homo sapiens
gcagauugucauauuguaa

SEQ ID NO: 983910 - RNA, 19 nt, Homo sapiens
acccacagcuuuauucuug

SEQ ID NO: 983911 - RNA, 19 nt, Homo sapiens
guuaaagacuuacagugau

SEQ ID NO: 983912 - RNA, 19 nt, Homo sapiens
guagauugguauauucugu

SEQ ID NO: 983913 - RNA, 19 nt, Homo sapiens
ggucugcuguuaagggauu

SEQ ID NO: 983914 - RNA, 19 nt, Homo sapiens
acacaauacuaaacugcua

SEQ ID NO: 983915 - RNA, 19 nt, Homo sapiens
uacauuaccucccuucuca

SEQ ID NO: 983916 - RNA, 19 nt, Homo sapiens
gcacuguccauauucauug

SEQ ID NO: 983917 - RNA, 19 nt, Homo sapiens
gacuuacagugauccauuu

SEQ ID NO: 983918 - RNA, 19 nt, Homo sapiens
gggagagaauguagaagau

SEQ ID NO: 983919 - RNA, 19 nt, Homo sapiens
guuaauagagguaguacaa

SEQ ID NO: 983920 - RNA, 19 nt, Homo sapiens
gagccagauucuaucauau

SEQ ID NO: 983921 - RNA, 19 nt, Homo sapiens
gcagcacuguccauauuca

SEQ ID NO: 983922 - RNA, 19 nt, Homo sapiens
gcuguacucuucauuugau

SEQ ID NO: 983923 - RNA, 19 nt, Homo sapiens
uaacgagauuugcuucugu

SEQ ID NO: 983924 - RNA, 19 nt, Homo sapiens
auccuuaacuguucaagua

SEQ ID NO: 983925 - RNA, 19 nt, Homo sapiens
gcuaaacaacuagauguaa

SEQ ID NO: 983926 - RNA, 19 nt, Homo sapiens
caagaauaaucgaaguuag

SEQ ID NO: 983927 - RNA, 19 nt, Homo sapiens
ugaagaaaauggcuuauug

SEQ ID NO: 983928 - RNA, 19 nt, Homo sapiens
uggaguagauugguauauu

SEQ ID NO: 983929 - RNA, 19 nt, Homo sapiens
aaacuggaaugugcagaaa

SEQ ID NO: 983930 - RNA, 19 nt, Homo sapiens
gaaagagcuccuagcauca

SEQ ID NO: 983931 - RNA, 19 nt, Homo sapiens
gauaucacuagaagaagua

SEQ ID NO: 983932 - RNA, 19 nt, Homo sapiens
aaagaugccuucuagaacu

SEQ ID NO: 983933 - RNA, 19 nt, Homo sapiens
auaaagagaggucuacgua

SEQ ID NO: 983934 - RNA, 19 nt, Homo sapiens
guaccagaguauuguauag

SEQ ID NO: 983935 - RNA, 19 nt, Homo sapiens
ucaaaggcaaguagaguaa

SEQ ID NO: 983936 - RNA, 19 nt, Homo sapiens
gcuaagacuugaaacaaaa

SEQ ID NO: 983937 - RNA, 19 nt, Homo sapiens
ugaaauuacuucugauggu

SEQ ID NO: 983938 - RNA, 19 nt, Homo sapiens
gauguaaucagguuaucaa

SEQ ID NO: 983939 - RNA, 19 nt, Homo sapiens
guacauauaaccacuuaag

SEQ ID NO: 983940 - RNA, 19 nt, Homo sapiens
ccaaauaauuaccuuccau

SEQ ID NO: 983941 - RNA, 19 nt, Homo sapiens
cagcuuuauucuuguguuu

SEQ ID NO: 983942 - RNA, 19 nt, Homo sapiens
uugcagcacuguccauauu

SEQ ID NO: 983943 - RNA, 19 nt, Homo sapiens
ucagacugcuguacucuuc

SEQ ID NO: 983944 - RNA, 19 nt, Homo sapiens
guaugucaccaauauauga

SEQ ID NO: 983945 - RNA, 19 nt, Homo sapiens
gauaaguaugucaccaaua

SEQ ID NO: 983946 - RNA, 19 nt, Homo sapiens
gagguaguacaauuucuuu

SEQ ID NO: 983947 - RNA, 19 nt, Homo sapiens
uaucuucucucucgugcuu

SEQ ID NO: 983948 - RNA, 19 nt, Homo sapiens
uuggauaaauuuccuguug

SEQ ID NO: 983949 - RNA, 19 nt, Homo sapiens
guucaaguaugucuguugu

SEQ ID NO: 983950 - RNA, 19 nt, Homo sapiens
guaguacccuuucuuauua

SEQ ID NO: 983951 - RNA, 19 nt, Homo sapiens
ggaguuaggucauuugauu

SEQ ID NO: 983952 - RNA, 19 nt, Homo sapiens
caaagaagaugucagagaa

SEQ ID NO: 983953 - RNA, 19 nt, Homo sapiens
gaauaacacucugcuguaa

SEQ ID NO: 983954 - RNA, 19 nt, Homo sapiens
ucacucaacugccuuauaa

SEQ ID NO: 983955 - RNA, 19 nt, Homo sapiens
gaugucaacuuucuuacua

SEQ ID NO: 983956 - RNA, 19 nt, Homo sapiens
gaauaaguaugcagcagaa

SEQ ID NO: 983957 - RNA, 19 nt, Homo sapiens
gaagagcuuuguggugaua

SEQ ID NO: 983958 - RNA, 19 nt, Homo sapiens
guaaguuccuaaagacaua

SEQ ID NO: 983959 - RNA, 19 nt, Homo sapiens
cgauuucccugcauaauuu

SEQ ID NO: 983960 - RNA, 19 nt, Homo sapiens
gaauuuggcuguagcagau

SEQ ID NO: 983961 - RNA, 19 nt, Homo sapiens
gaaaguggccaagaaauau

SEQ ID NO: 983962 - RNA, 19 nt, Homo sapiens
gaucugcauuggauuugua

SEQ ID NO: 983963 - RNA, 19 nt, Homo sapiens
guaacuuccugugaauuua

SEQ ID NO: 983964 - RNA, 19 nt, Homo sapiens
uaacaggcauaagugaaua

SEQ ID NO: 983965 - RNA, 19 nt, Homo sapiens
gaagaugccaaacauuaaa

SEQ ID NO: 983966 - RNA, 19 nt, Homo sapiens
caaggacacucaugaagau

SEQ ID NO: 983967 - RNA, 19 nt, Homo sapiens
ucaacugccuuauaacauu

SEQ ID NO: 983968 - RNA, 19 nt, Homo sapiens
gaauggcacuuaugacuac

SEQ ID NO: 983969 - RNA, 19 nt, Homo sapiens
aaacauuccugguaaguuc

SEQ ID NO: 983970 - RNA, 19 nt, Homo sapiens
ugaaaguggccaagaaaua

SEQ ID NO: 983971 - RNA, 19 nt, Homo sapiens
acacagaacuauauacaca

SEQ ID NO: 983972 - RNA, 19 nt, Homo sapiens
gcaaggacacucaugaaga

SEQ ID NO: 983973 - RNA, 19 nt, Homo sapiens
caugacaaauguuagguuu

SEQ ID NO: 983974 - RNA, 19 nt, Homo sapiens
ugaaaugaauggcacuuau

SEQ ID NO: 983975 - RNA, 19 nt, Homo sapiens
gaacagaaccagucaacag

SEQ ID NO: 983976 - RNA, 19 nt, Homo sapiens
cagcagaacuccaacuauc

SEQ ID NO: 983977 - RNA, 19 nt, Homo sapiens
agacagauauguggcagua

SEQ ID NO: 983978 - RNA, 19 nt, Homo sapiens
auacaaaucuacacaagug

SEQ ID NO: 983979 - RNA, 19 nt, Homo sapiens
gaagaugucagagaauuug

SEQ ID NO: 983980 - RNA, 19 nt, Homo sapiens
gacaaaguguggaggaguu

SEQ ID NO: 983981 - RNA, 19 nt, Homo sapiens
cuagagaucugcauuggau

SEQ ID NO: 983982 - RNA, 19 nt, Homo sapiens
caacugccuuauaacauug

SEQ ID NO: 983983 - RNA, 19 nt, Homo sapiens
gaaaugaauggcacuuaug

SEQ ID NO: 983984 - RNA, 19 nt, Homo sapiens
ggaccacucuguaccaucu

SEQ ID NO: 983985 - RNA, 19 nt, Homo sapiens
ggacaucgccauccaaguc

SEQ ID NO: 983986 - RNA, 19 nt, Homo sapiens
gaacgauuucccugcauaa

SEQ ID NO: 983987 - RNA, 19 nt, Homo sapiens
gaagaggaaacaagauaau

SEQ ID NO: 983988 - RNA, 19 nt, Homo sapiens
gcaguggugcuuauacaaa

SEQ ID NO: 983989 - RNA, 19 nt, Homo sapiens
aaauauggguccuggagaa

SEQ ID NO: 983990 - RNA, 19 nt, Homo sapiens
gguguaauccucagacuau

SEQ ID NO: 983991 - RNA, 19 nt, Homo sapiens
cagaaccagucaacagauu

SEQ ID NO: 983992 - RNA, 19 nt, Homo sapiens
caugcuggaucaucuguuu

SEQ ID NO: 983993 - RNA, 19 nt, Homo sapiens
cagauuuacuccuucuauu

SEQ ID NO: 983994 - RNA, 19 nt, Homo sapiens
ccaagaagaggaaacaaga

SEQ ID NO: 983995 - RNA, 19 nt, Homo sapiens
ccaugguaguggcaauuua

SEQ ID NO: 983996 - RNA, 19 nt, Homo sapiens
aagaagaugucagagaauu

SEQ ID NO: 983997 - RNA, 19 nt, Homo sapiens
caaaucuacacaagugaua

SEQ ID NO: 983998 - RNA, 19 nt, Homo sapiens
gaagacagagacaaagugu

SEQ ID NO: 983999 - RNA, 19 nt, Homo sapiens
gcucacagucguuauaguu

SEQ ID NO: 984000 - RNA, 19 nt, Homo sapiens
ccugguaaguuccuaaaga

SEQ ID NO: 984001 - RNA, 19 nt, Homo sapiens
ccacuaugcuauaaguuag

SEQ ID NO: 984002 - RNA, 19 nt, Homo sapiens
gaaccagucaacagauuau

SEQ ID NO: 984003 - RNA, 19 nt, Homo sapiens
ugaauaacacucugcugua

SEQ ID NO: 984004 - RNA, 19 nt, Homo sapiens
ugaagaugccaaacauuaa

SEQ ID NO: 984005 - RNA, 19 nt, Homo sapiens
gauauguggcaguaacuaa

SEQ ID NO: 984006 - RNA, 19 nt, Homo sapiens
gcagauuuacuccuucuau

SEQ ID NO: 984007 - RNA, 19 nt, Homo sapiens
ccuaaagaauucaucuguu

SEQ ID NO: 984008 - RNA, 19 nt, Homo sapiens
gcagaacuccaacuaucuu

SEQ ID NO: 984009 - RNA, 19 nt, Homo sapiens
agaacgauuucccugcaua

SEQ ID NO: 984010 - RNA, 19 nt, Homo sapiens
aagaagaggaaacaagaua

SEQ ID NO: 984011 - RNA, 19 nt, Homo sapiens
caauaugaacugaucugua

SEQ ID NO: 984012 - RNA, 19 nt, Homo sapiens
gcauuauucugaaacucaa

SEQ ID NO: 984013 - RNA, 19 nt, Homo sapiens
ggaaaaccaugcuggauca

SEQ ID NO: 984014 - RNA, 19 nt, Homo sapiens
uaucaaagaagaugucaga

SEQ ID NO: 984015 - RNA, 19 nt, Homo sapiens
cauauauagucuaggugua

SEQ ID NO: 984016 - RNA, 19 nt, Homo sapiens
uguaguacccuuucuuauu

SEQ ID NO: 984017 - RNA, 19 nt, Homo sapiens
cuucuaugaugucaacuuu

SEQ ID NO: 984018 - RNA, 19 nt, Homo sapiens
gaacuauauacacacauug

SEQ ID NO: 984019 - RNA, 19 nt, Homo sapiens
uaugggagcaucuuucaaa

SEQ ID NO: 984020 - RNA, 19 nt, Homo sapiens
augaagaugccaaacauua

SEQ ID NO: 984021 - RNA, 19 nt, Homo sapiens
ucaaagaagaugucagaga

SEQ ID NO: 984022 - RNA, 19 nt, Homo sapiens
gcuaggugcauucccauuu

SEQ ID NO: 984023 - RNA, 19 nt, Homo sapiens
caaguucugccgagccaua

SEQ ID NO: 984024 - RNA, 19 nt, Homo sapiens
ucaugaagaugccaaacau

SEQ ID NO: 984025 - RNA, 19 nt, Homo sapiens
guaacaggcauaagugaau

SEQ ID NO: 984026 - RNA, 19 nt, Homo sapiens
ccuaggaacaucaaugaaa

SEQ ID NO: 984027 - RNA, 19 nt, Homo sapiens
caagaaacagagaaccaaa

SEQ ID NO: 984028 - RNA, 19 nt, Homo sapiens
caucugcauuauucugaaa

SEQ ID NO: 984029 - RNA, 19 nt, Homo sapiens
uuaugaaaguggccaagaa

SEQ ID NO: 984030 - RNA, 19 nt, Homo sapiens
cuaggaacaucaaugaaag

SEQ ID NO: 984031 - RNA, 19 nt, Homo sapiens
guuccaauuucuuaacuuc

SEQ ID NO: 984032 - RNA, 19 nt, Homo sapiens
ccagucaacagauuauuau

SEQ ID NO: 984033 - RNA, 19 nt, Homo sapiens
gaaauaaaagccaagaaga

SEQ ID NO: 984034 - RNA, 19 nt, Homo sapiens
gauuuacuccuucuauuca

SEQ ID NO: 984035 - RNA, 19 nt, Homo sapiens
cuacagagccaaccaguac

SEQ ID NO: 984036 - RNA, 19 nt, Homo sapiens
gagaagacagagacaaagu

SEQ ID NO: 984037 - RNA, 19 nt, Homo sapiens
ugaauggcacuuaugacua

SEQ ID NO: 984038 - RNA, 19 nt, Homo sapiens
gagccaaccaguacuuuua

SEQ ID NO: 984039 - RNA, 19 nt, Homo sapiens
cagaaagcaucgcacucuu

SEQ ID NO: 984040 - RNA, 19 nt, Homo sapiens
aaaccaugcuggaucaucu

SEQ ID NO: 984041 - RNA, 19 nt, Homo sapiens
cccacuaugcuauaaguua

SEQ ID NO: 984042 - RNA, 19 nt, Homo sapiens
aaaugaauggcacuuauga

SEQ ID NO: 984043 - RNA, 19 nt, Homo sapiens
cacaauaguuuucgucauu

SEQ ID NO: 984044 - RNA, 19 nt, Homo sapiens
uguagcagauuuacuccuu

SEQ ID NO: 984045 - RNA, 19 nt, Homo sapiens
ccaauuucuuaacuuccua

SEQ ID NO: 984046 - RNA, 19 nt, Homo sapiens
ugacacagaacuauauaca

SEQ ID NO: 984047 - RNA, 19 nt, Homo sapiens
cuacacaagugauaaaaug

SEQ ID NO: 984048 - RNA, 19 nt, Homo sapiens
caguggugcuuauacaaau

SEQ ID NO: 984049 - RNA, 19 nt, Homo sapiens
gugguugcaacuuauaaua

SEQ ID NO: 984050 - RNA, 19 nt, Homo sapiens
gaagaaaguuugaugguau

SEQ ID NO: 984051 - RNA, 19 nt, Homo sapiens
ggacuggccuggagcauuu

SEQ ID NO: 984052 - RNA, 19 nt, Homo sapiens
gaacauaguuugggccauu

SEQ ID NO: 984053 - RNA, 19 nt, Homo sapiens
gauuauagcuacccacaaa

SEQ ID NO: 984054 - RNA, 19 nt, Homo sapiens
ggaagaaaguuugauggua

SEQ ID NO: 984055 - RNA, 19 nt, Homo sapiens
gagaagcggucagcaauuu

SEQ ID NO: 984056 - RNA, 19 nt, Homo sapiens
gauauuacuuucacacuga

SEQ ID NO: 984057 - RNA, 19 nt, Homo sapiens
cuuaagagcuuucaacuug

SEQ ID NO: 984058 - RNA, 19 nt, Homo sapiens
ggagucagauacagaguuu

SEQ ID NO: 984059 - RNA, 19 nt, Homo sapiens
ggaggagucugcugaagaa

SEQ ID NO: 984060 - RNA, 19 nt, Homo sapiens
caacuuggauccuugaaga

SEQ ID NO: 984061 - RNA, 19 nt, Homo sapiens
gaacauaaguaagacacaa

SEQ ID NO: 984062 - RNA, 19 nt, Homo sapiens
gaacucagccucacuagau

SEQ ID NO: 984063 - RNA, 19 nt, Homo sapiens
gcuuaaaccuguuccaauu

SEQ ID NO: 984064 - RNA, 19 nt, Homo sapiens
acacagaucucaaccagaa

SEQ ID NO: 984065 - RNA, 19 nt, Homo sapiens
gaaugccagugauuucaua

SEQ ID NO: 984066 - RNA, 19 nt, Homo sapiens
uaaaguaacuguguguuga

SEQ ID NO: 984067 - RNA, 19 nt, Homo sapiens
gcaaacagaucuuuucauu

SEQ ID NO: 984068 - RNA, 19 nt, Homo sapiens
gauagaagagcaacacuuu

SEQ ID NO: 984069 - RNA, 19 nt, Homo sapiens
ugaccuggauguccucuua

SEQ ID NO: 984070 - RNA, 19 nt, Homo sapiens
gaacauuuagcaaguauug

SEQ ID NO: 984071 - RNA, 19 nt, Homo sapiens
ccagaggugcuuagaauua

SEQ ID NO: 984072 - RNA, 19 nt, Homo sapiens
guauagaaguuaucccauu

SEQ ID NO: 984073 - RNA, 19 nt, Homo sapiens
gagcaacacuuucaaacca

SEQ ID NO: 984074 - RNA, 19 nt, Homo sapiens
gagaagggauauuacuuuc

SEQ ID NO: 984075 - RNA, 19 nt, Homo sapiens
ggaagcgcauuacuuucua

SEQ ID NO: 984076 - RNA, 19 nt, Homo sapiens
uuaagagacucaagacaaa

SEQ ID NO: 984077 - RNA, 19 nt, Homo sapiens
gaugaagaccucgaaauaa

SEQ ID NO: 984078 - RNA, 19 nt, Homo sapiens
gaauugcgcucucucugau

SEQ ID NO: 984079 - RNA, 19 nt, Homo sapiens
ggaacuggauaucugagaa

SEQ ID NO: 984080 - RNA, 19 nt, Homo sapiens
ugagucggcuucagaauug

SEQ ID NO: 984081 - RNA, 19 nt, Homo sapiens
gaagagcaacacuuucaaa

SEQ ID NO: 984082 - RNA, 19 nt, Homo sapiens
uuucugaacugucuucuuu

SEQ ID NO: 984083 - RNA, 19 nt, Homo sapiens
ccagaggacuauucacuau

SEQ ID NO: 984084 - RNA, 19 nt, Homo sapiens
auaauaaucugcacuguuc

SEQ ID NO: 984085 - RNA, 19 nt, Homo sapiens
gaucaacggaccaaauaaa

SEQ ID NO: 984086 - RNA, 19 nt, Homo sapiens
ggugaaagauuuaagaacu

SEQ ID NO: 984087 - RNA, 19 nt, Homo sapiens
gaagaccucgaaauaauug

SEQ ID NO: 984088 - RNA, 19 nt, Homo sapiens
uagcaaguauugggaauuu

SEQ ID NO: 984089 - RNA, 19 nt, Homo sapiens
caagacaaaccaagauaaa

SEQ ID NO: 984090 - RNA, 19 nt, Homo sapiens
gaaagaauaauaccaguac

SEQ ID NO: 984091 - RNA, 19 nt, Homo sapiens
ugaugaagaccucgaaaua

SEQ ID NO: 984092 - RNA, 19 nt, Homo sapiens
gcaacacuuucaaaccaaa

SEQ ID NO: 984093 - RNA, 19 nt, Homo sapiens
gaaaagccccuccuuacua

SEQ ID NO: 984094 - RNA, 19 nt, Homo sapiens
guuaucccauucuucuuua

SEQ ID NO: 984095 - RNA, 19 nt, Homo sapiens
aaccaaaucucacugaaug

SEQ ID NO: 984096 - RNA, 19 nt, Homo sapiens
ugacauaaggcguaaauau

SEQ ID NO: 984097 - RNA, 19 nt, Homo sapiens
gaagaaaagccccuccuua

SEQ ID NO: 984098 - RNA, 19 nt, Homo sapiens
gacaaaccaagauaaagua

SEQ ID NO: 984099 - RNA, 19 nt, Homo sapiens
gcaauagcaaggccaguaa

SEQ ID NO: 984100 - RNA, 19 nt, Homo sapiens
ccacuuaguucuccacagu

SEQ ID NO: 984101 - RNA, 19 nt, Homo sapiens
gaugguaucgugauuucua

SEQ ID NO: 984102 - RNA, 19 nt, Homo sapiens
agacagacauugcuuaaac

SEQ ID NO: 984103 - RNA, 19 nt, Homo sapiens
uaaagacagacauugcuua

SEQ ID NO: 984104 - RNA, 19 nt, Homo sapiens
ugacacaucugaggaacuu

SEQ ID NO: 984105 - RNA, 19 nt, Homo sapiens
ugaauacucuuuccacaag

SEQ ID NO: 984106 - RNA, 19 nt, Homo sapiens
gugacgcucugaagaauug

SEQ ID NO: 984107 - RNA, 19 nt, Homo sapiens
gaagggauauuacuuucac

SEQ ID NO: 984108 - RNA, 19 nt, Homo sapiens
aagcagauacgaugacaua

SEQ ID NO: 984109 - RNA, 19 nt, Homo sapiens
aauaaucccugaucugugu

SEQ ID NO: 984110 - RNA, 19 nt, Homo sapiens
ugaagaaaccgaagcagaa

SEQ ID NO: 984111 - RNA, 19 nt, Homo sapiens
gcucugaagaauuggauua

SEQ ID NO: 984112 - RNA, 19 nt, Homo sapiens
caaaccaaaucucacugaa

SEQ ID NO: 984113 - RNA, 19 nt, Homo sapiens
ggaauuauaucuggaagcu

SEQ ID NO: 984114 - RNA, 19 nt, Homo sapiens
gaaggaauuauaucuggaa

SEQ ID NO: 984115 - RNA, 19 nt, Homo sapiens
ugauagcucuguucuggaa

SEQ ID NO: 984116 - RNA, 19 nt, Homo sapiens
gggacgauguuaaguuuca

SEQ ID NO: 984117 - RNA, 19 nt, Homo sapiens
caacggaccaaauaaacaa

SEQ ID NO: 984118 - RNA, 19 nt, Homo sapiens
caagauaaaguaacugugu

SEQ ID NO: 984119 - RNA, 19 nt, Homo sapiens
gcaaaaugcuaaucagaau

SEQ ID NO: 984120 - RNA, 19 nt, Homo sapiens
uagaucaacggaccaaaua

SEQ ID NO: 984121 - RNA, 19 nt, Homo sapiens
gcaagacugaacauaguuu

SEQ ID NO: 984122 - RNA, 19 nt, Homo sapiens
guaacuguguguugaauac

SEQ ID NO: 984123 - RNA, 19 nt, Homo sapiens
ucauauagcccaaggaaau

SEQ ID NO: 984124 - RNA, 19 nt, Homo sapiens
ugagaagggauauuacuuu

SEQ ID NO: 984125 - RNA, 19 nt, Homo sapiens
gaaaccaaaucggaagcaa

SEQ ID NO: 984126 - RNA, 19 nt, Homo sapiens
ggaccaaccagaacucuuc

SEQ ID NO: 984127 - RNA, 19 nt, Homo sapiens
gagcaauagaugcauuuaa

SEQ ID NO: 984128 - RNA, 19 nt, Homo sapiens
agucagagcccucaucaaa

SEQ ID NO: 984129 - RNA, 19 nt, Homo sapiens
guaaauauggcaaacagau

SEQ ID NO: 984130 - RNA, 19 nt, Homo sapiens
gcagaaaaguaaagaacaa

SEQ ID NO: 984131 - RNA, 19 nt, Homo sapiens
guauauagagucaaaguca

SEQ ID NO: 984132 - RNA, 19 nt, Homo sapiens
gcccucaguuugcaaagaa

SEQ ID NO: 984133 - RNA, 19 nt, Homo sapiens
cagauacaaccuaggaaua

SEQ ID NO: 984134 - RNA, 19 nt, Homo sapiens
cuagugagaagggauauua

SEQ ID NO: 984135 - RNA, 19 nt, Homo sapiens
uagcuaauccuaacaacuu

SEQ ID NO: 984136 - RNA, 19 nt, Homo sapiens
aaagcgcccucaacucuga

SEQ ID NO: 984137 - RNA, 19 nt, Homo sapiens
gaagucagagcccucauca

SEQ ID NO: 984138 - RNA, 19 nt, Homo sapiens
uauagaaguuaucccauuc

SEQ ID NO: 984139 - RNA, 19 nt, Homo sapiens
gaagaaaccgaagcagaau

SEQ ID NO: 984140 - RNA, 19 nt, Homo sapiens
cagauacgaugacauaagg

SEQ ID NO: 984141 - RNA, 19 nt, Homo sapiens
uaagagcuuucaacuugga

SEQ ID NO: 984142 - RNA, 19 nt, Homo sapiens
uaacccaggcggagaauga

SEQ ID NO: 984143 - RNA, 19 nt, Homo sapiens
aaccaaaucggaagcaaua

SEQ ID NO: 984144 - RNA, 19 nt, Homo sapiens
gcaggaagaaaguuugaug

SEQ ID NO: 984145 - RNA, 19 nt, Homo sapiens
augaagaccucgaaauaau

SEQ ID NO: 984146 - RNA, 19 nt, Homo sapiens
uaagaacucagccucacua

SEQ ID NO: 984147 - RNA, 19 nt, Homo sapiens
aaagacagacauugcuuaa

SEQ ID NO: 984148 - RNA, 19 nt, Homo sapiens
ugccagugauuucauauga

SEQ ID NO: 984149 - RNA, 19 nt, Homo sapiens
gauccuugaagaaagaaua

SEQ ID NO: 984150 - RNA, 19 nt, Homo sapiens
gacaacagcuguauauuua

SEQ ID NO: 984151 - RNA, 19 nt, Homo sapiens
gaauagagcucacaacuac

SEQ ID NO: 984152 - RNA, 19 nt, Homo sapiens
gaaagucacuaaaccauau

SEQ ID NO: 984153 - RNA, 19 nt, Homo sapiens
ggaaagaccugaagaagag

SEQ ID NO: 984154 - RNA, 19 nt, Homo sapiens
ggagaaaccuuuauucgau

SEQ ID NO: 984155 - RNA, 19 nt, Homo sapiens
agaaauagcugcagagaga

SEQ ID NO: 984156 - RNA, 19 nt, Homo sapiens
gcucacaacuacuccuuua

SEQ ID NO: 984157 - RNA, 19 nt, Homo sapiens
gagaaaccuuuauucgaua

SEQ ID NO: 984158 - RNA, 19 nt, Homo sapiens
gaacaggugucaaagaagu

SEQ ID NO: 984159 - RNA, 19 nt, Homo sapiens
gagccaaugucgagaguuu

SEQ ID NO: 984160 - RNA, 19 nt, Homo sapiens
cagaacaggugucaaagaa

SEQ ID NO: 984161 - RNA, 19 nt, Homo sapiens
aaacggauauguccaauuc

SEQ ID NO: 984162 - RNA, 19 nt, Homo sapiens
ucaaagaaguggcaaggaa

SEQ ID NO: 984163 - RNA, 19 nt, Homo sapiens
gagacaggcucuaggagaa

SEQ ID NO: 984164 - RNA, 19 nt, Homo sapiens
ccagaguuaucaaccuuua

SEQ ID NO: 984165 - RNA, 19 nt, Homo sapiens
ccucaacucucuucuagaa

SEQ ID NO: 984166 - RNA, 19 nt, Homo sapiens
guguugagaugaauaauga

SEQ ID NO: 984167 - RNA, 19 nt, Homo sapiens
guuggagaaugaagaaaua

SEQ ID NO: 984168 - RNA, 19 nt, Homo sapiens
aauaugaguuggagaauga

SEQ ID NO: 984169 - RNA, 19 nt, Homo sapiens
ugacaacagcuguauauuu

SEQ ID NO: 984170 - RNA, 19 nt, Homo sapiens
gcaagagugauaugugaua

SEQ ID NO: 984171 - RNA, 19 nt, Homo sapiens
caaaugucauggagagaaa

SEQ ID NO: 984172 - RNA, 19 nt, Homo sapiens
gaaguggcaaggaaauaua

SEQ ID NO: 984173 - RNA, 19 nt, Homo sapiens
gacuaucccugcacacuuu

SEQ ID NO: 984174 - RNA, 19 nt, Homo sapiens
gagguuaucuugaagugau

SEQ ID NO: 984175 - RNA, 19 nt, Homo sapiens
gaaguaggacugcugagaa

SEQ ID NO: 984176 - RNA, 19 nt, Homo sapiens
gaagugauaccaaauccaa

SEQ ID NO: 984177 - RNA, 19 nt, Homo sapiens
gaaaggcacccggauagaa

SEQ ID NO: 984178 - RNA, 19 nt, Homo sapiens
uaccagaucuugucaguca

SEQ ID NO: 984179 - RNA, 19 nt, Homo sapiens
cagcaacaauaacaagauu

SEQ ID NO: 984180 - RNA, 19 nt, Homo sapiens
caagguacauugcaaagag

SEQ ID NO: 984181 - RNA, 19 nt, Homo sapiens
ggaagaaagucacuaaacc

SEQ ID NO: 984182 - RNA, 19 nt, Homo sapiens
uggaauauuugacagauga

SEQ ID NO: 984183 - RNA, 19 nt, Homo sapiens
caaggaagaaagucacuaa

SEQ ID NO: 984184 - RNA, 19 nt, Homo sapiens
ucaacucucuucuagaaug

SEQ ID NO: 984185 - RNA, 19 nt, Homo sapiens
caacagcaugaacacauua

SEQ ID NO: 984186 - RNA, 19 nt, Homo sapiens
caaaggacaaugaaaugaa

SEQ ID NO: 984187 - RNA, 19 nt, Homo sapiens
ccaacagcaugaacacauu

SEQ ID NO: 984188 - RNA, 19 nt, Homo sapiens
gaagugggagaaacggaua

SEQ ID NO: 984189 - RNA, 19 nt, Homo sapiens
gaaagugagccaugguguu

SEQ ID NO: 984190 - RNA, 19 nt, Homo sapiens
caacucucuucuagaauga

SEQ ID NO: 984191 - RNA, 19 nt, Homo sapiens
gaagaaauagcugcagaga

SEQ ID NO: 984192 - RNA, 19 nt, Homo sapiens
gagaaaggcacccggauag

SEQ ID NO: 984193 - RNA, 19 nt, Homo sapiens
gcaggaggacucaacaaga

SEQ ID NO: 984194 - RNA, 19 nt, Homo sapiens
caaagaaguggcaaggaaa

SEQ ID NO: 984195 - RNA, 19 nt, Homo sapiens
gaagaaagucacuaaacca

SEQ ID NO: 984196 - RNA, 19 nt, Homo sapiens
gaagaagagugugccuaca

SEQ ID NO: 984197 - RNA, 19 nt, Homo sapiens
ggaugucgauaggaagaaa

SEQ ID NO: 984198 - RNA, 19 nt, Homo sapiens
ggauauguccaauucaaau

SEQ ID NO: 984199 - RNA, 19 nt, Homo sapiens
ggacucaacaagagaugaa

SEQ ID NO: 984200 - RNA, 19 nt, Homo sapiens
gagaaacggauauguccaa

SEQ ID NO: 984201 - RNA, 19 nt, Homo sapiens
caacagcaaacccuuacuu

SEQ ID NO: 984202 - RNA, 19 nt, Homo sapiens
ccucagaacaggugucaaa

SEQ ID NO: 984203 - RNA, 19 nt, Homo sapiens
cugcaagagugauauguga

SEQ ID NO: 984204 - RNA, 19 nt, Homo sapiens
caaauccaaaggacaauga

SEQ ID NO: 984205 - RNA, 19 nt, Homo sapiens
aacaagagaugaaggcaau

SEQ ID NO: 984206 - RNA, 19 nt, Homo sapiens
aaagugagccaugguguuu

SEQ ID NO: 984207 - RNA, 19 nt, Homo sapiens
caacuacuccuuuagacau

SEQ ID NO: 984208 - RNA, 19 nt, Homo sapiens
gcucuaggagaaaccuuua

SEQ ID NO: 984209 - RNA, 19 nt, Homo sapiens
guaauuaacaacagcaaca

SEQ ID NO: 984210 - RNA, 19 nt, Homo sapiens
ucacaacuacuccuuuaga

SEQ ID NO: 984211 - RNA, 19 nt, Homo sapiens
caggaggacucaacaagag

SEQ ID NO: 984212 - RNA, 19 nt, Homo sapiens
auaauuacauugccagcuu

SEQ ID NO: 984213 - RNA, 19 nt, Homo sapiens
gaacugcaagagugauaug

SEQ ID NO: 984214 - RNA, 19 nt, Homo sapiens
caccucaacucucuucuag

SEQ ID NO: 984215 - RNA, 19 nt, Homo sapiens
gaaacggauauguccaauu

SEQ ID NO: 984216 - RNA, 19 nt, Homo sapiens
gugaagcuauaauaugcaa

SEQ ID NO: 984217 - RNA, 19 nt, Homo sapiens
gaaggacaaggaagaaagu

SEQ ID NO: 984218 - RNA, 19 nt, Homo sapiens
agaaauaugaguuggagaa

SEQ ID NO: 984219 - RNA, 19 nt, Homo sapiens
ggacuucauagcaguaaug

SEQ ID NO: 984220 - RNA, 19 nt, Homo sapiens
cagcaacagcaaacccuua

SEQ ID NO: 984221 - RNA, 19 nt, Homo sapiens
gcacccggauagaaaauaa

SEQ ID NO: 984222 - RNA, 19 nt, Homo sapiens
guuaucaaccuuuagaguu

SEQ ID NO: 984223 - RNA, 19 nt, Homo sapiens
ccaaaggacaaugaaauga

SEQ ID NO: 984224 - RNA, 19 nt, Homo sapiens
caacugaagugggagaaac

SEQ ID NO: 984225 - RNA, 19 nt, Homo sapiens
ggugcuggcugcaacuguu

SEQ ID NO: 984226 - RNA, 19 nt, Homo sapiens
uaaacuaggcucagcaaca

SEQ ID NO: 984227 - RNA, 19 nt, Homo sapiens
aaaggcacccggauagaaa

SEQ ID NO: 984228 - RNA, 19 nt, Homo sapiens
gagacuggauuuugugauu

SEQ ID NO: 984229 - RNA, 19 nt, Homo sapiens
gcuuucugcuuucaucuau

SEQ ID NO: 984230 - RNA, 19 nt, Homo sapiens
uaugcaaacuuaccagauc

SEQ ID NO: 984231 - RNA, 19 nt, Homo sapiens
gcaacaauaacaagauuac

SEQ ID NO: 984232 - RNA, 19 nt, Homo sapiens
agagaaaggcacccggaua

SEQ ID NO: 984233 - RNA, 19 nt, Homo sapiens
auaacaagauuacgaaugc

SEQ ID NO: 984234 - RNA, 19 nt, Homo sapiens
agaauagagcucacaacua

SEQ ID NO: 984235 - RNA, 19 nt, Homo sapiens
gaaauaugaguuggagaau

SEQ ID NO: 984236 - RNA, 19 nt, Homo sapiens
agaaagucacuaaaccaua

SEQ ID NO: 984237 - RNA, 19 nt, Homo sapiens
aaacuaggcucagcaacag

SEQ ID NO: 984238 - RNA, 19 nt, Homo sapiens
gccgaaagcguuauuccaa

SEQ ID NO: 984239 - RNA, 19 nt, Homo sapiens
caacagcaacaauaacaag

SEQ ID NO: 984240 - RNA, 19 nt, Homo sapiens
cggcuuagauggacuucau

SEQ ID NO: 984241 - RNA, 19 nt, Homo sapiens
cagcaaacccuuacuuggu

SEQ ID NO: 984242 - RNA, 19 nt, Homo sapiens
uggcaggacucuugaagca

SEQ ID NO: 984243 - RNA, 19 nt, Homo sapiens
ucucuuuccugccugaauu

SEQ ID NO: 984244 - RNA, 19 nt, Homo sapiens
caagagaugaaggcaauga

SEQ ID NO: 984245 - RNA, 19 nt, Homo sapiens
agggacagcagucaaauuu

SEQ ID NO: 984246 - RNA, 19 nt, Homo sapiens
cugcagagagaaauaaauu

SEQ ID NO: 984247 - RNA, 19 nt, Homo sapiens
cagcaugaacacauuaaga

SEQ ID NO: 984248 - RNA, 19 nt, Homo sapiens
ugagaugaauaaugaagag

SEQ ID NO: 984249 - RNA, 19 nt, Homo sapiens
gcauuuacccucagaacag

SEQ ID NO: 984250 - RNA, 19 nt, Homo sapiens
ggaaagagcucucauggaa

SEQ ID NO: 984251 - RNA, 19 nt, Homo sapiens
ggaaguagguguugcuuaa

SEQ ID NO: 984252 - RNA, 19 nt, Homo sapiens
gaacauuuccugaacauuu

SEQ ID NO: 984253 - RNA, 19 nt, Homo sapiens
ggagagugcuugcuuauuc

SEQ ID NO: 984254 - RNA, 19 nt, Homo sapiens
gauccuggcuucucucuaa

SEQ ID NO: 984255 - RNA, 19 nt, Homo sapiens
ggaauguacuugugauauu

SEQ ID NO: 984256 - RNA, 19 nt, Homo sapiens
gaugagagcucuggucaaa

SEQ ID NO: 984257 - RNA, 19 nt, Homo sapiens
gaacacagccucccuggaa

SEQ ID NO: 984258 - RNA, 19 nt, Homo sapiens
guacaaagaugucaaggau

SEQ ID NO: 984259 - RNA, 19 nt, Homo sapiens
gaaacacgaugaagcaguu

SEQ ID NO: 984260 - RNA, 19 nt, Homo sapiens
gguaauaagugcacuguau

SEQ ID NO: 984261 - RNA, 19 nt, Homo sapiens
gggaaugucugcuguuauu

SEQ ID NO: 984262 - RNA, 19 nt, Homo sapiens
ggacuuaagugagaaagaa

SEQ ID NO: 984263 - RNA, 19 nt, Homo sapiens
ggaggcacaucccacuuua

SEQ ID NO: 984264 - RNA, 19 nt, Homo sapiens
cgaaggacauugaagcuaa

SEQ ID NO: 984265 - RNA, 19 nt, Homo sapiens
gaauuggaauccuguuaaa

SEQ ID NO: 984266 - RNA, 19 nt, Homo sapiens
gauccagaguguuguauuu

SEQ ID NO: 984267 - RNA, 19 nt, Homo sapiens
ucacagagaugcugaguca

SEQ ID NO: 984268 - RNA, 19 nt, Homo sapiens
gaccuugacuggcuuauug

SEQ ID NO: 984269 - RNA, 19 nt, Homo sapiens
ggagggaccuguucgaugu

SEQ ID NO: 984270 - RNA, 19 nt, Homo sapiens
guaguauccuucaauguaa

SEQ ID NO: 984271 - RNA, 19 nt, Homo sapiens
uaaugaagaucgaugcuuu

SEQ ID NO: 984272 - RNA, 19 nt, Homo sapiens
aaacguggcuuuugaaaua

SEQ ID NO: 984273 - RNA, 19 nt, Homo sapiens
ggaaugaaguacccuuaau

SEQ ID NO: 984274 - RNA, 19 nt, Homo sapiens
uguaaucaauucccaguua

SEQ ID NO: 984275 - RNA, 19 nt, Homo sapiens
guacuaaggcuuugacauu

SEQ ID NO: 984276 - RNA, 19 nt, Homo sapiens
ggaaggagaugcgagaaau

SEQ ID NO: 984277 - RNA, 19 nt, Homo sapiens
guugagaucucccauguga

SEQ ID NO: 984278 - RNA, 19 nt, Homo sapiens
ggaauaauguacagagcaa

SEQ ID NO: 984279 - RNA, 19 nt, Homo sapiens
gcauuggcacucuuaauua

SEQ ID NO: 984280 - RNA, 19 nt, Homo sapiens
gcacaucccacuuuauuau

SEQ ID NO: 984281 - RNA, 19 nt, Homo sapiens
gaagagaagcacagaagaa

SEQ ID NO: 984282 - RNA, 19 nt, Homo sapiens
cagcagaaaucaggaagua

SEQ ID NO: 984283 - RNA, 19 nt, Homo sapiens
uaacauaaaccacuugcua

SEQ ID NO: 984284 - RNA, 19 nt, Homo sapiens
gagaagcacagaagaauug

SEQ ID NO: 984285 - RNA, 19 nt, Homo sapiens
gcagagacugggcuaaaua

SEQ ID NO: 984286 - RNA, 19 nt, Homo sapiens
gcacaucacaucaaauaga

SEQ ID NO: 984287 - RNA, 19 nt, Homo sapiens
gaacacggagcaauacauu

SEQ ID NO: 984288 - RNA, 19 nt, Homo sapiens
acaaagaugucaaggauuc

SEQ ID NO: 984289 - RNA, 19 nt, Homo sapiens
cagcagccaucacaaauau

SEQ ID NO: 984290 - RNA, 19 nt, Homo sapiens
gaauagauaugaccuagcu

SEQ ID NO: 984291 - RNA, 19 nt, Homo sapiens
ggaaacaccaccugaguug

SEQ ID NO: 984292 - RNA, 19 nt, Homo sapiens
gcacagugaugggcaaaga

SEQ ID NO: 984293 - RNA, 19 nt, Homo sapiens
gagaaaugaccaagaguuu

SEQ ID NO: 984294 - RNA, 19 nt, Homo sapiens
acagugaccuggcggauuu

SEQ ID NO: 984295 - RNA, 19 nt, Homo sapiens
gaacccaaccuacuuccua

SEQ ID NO: 984296 - RNA, 19 nt, Homo sapiens
gcagaccuauuuauucuag

SEQ ID NO: 984297 - RNA, 19 nt, Homo sapiens
ugucugcuguuauuaguua

SEQ ID NO: 984298 - RNA, 19 nt, Homo sapiens
ggaagaauccuuaauugca

SEQ ID NO: 984299 - RNA, 19 nt, Homo sapiens
acaaagggaugaguuauau

SEQ ID NO: 984300 - RNA, 19 nt, Homo sapiens
gauugugccuguaugauau

SEQ ID NO: 984301 - RNA, 19 nt, Homo sapiens
gagaacaugcagaugaaua

SEQ ID NO: 984302 - RNA, 19 nt, Homo sapiens
gcuuagagcucccacuuuc

SEQ ID NO: 984303 - RNA, 19 nt, Homo sapiens
ccaaguagcugggauuaca

SEQ ID NO: 984304 - RNA, 19 nt, Homo sapiens
gaauugguuccuuccauua

SEQ ID NO: 984305 - RNA, 19 nt, Homo sapiens
caagcaggguaauuuauau

SEQ ID NO: 984306 - RNA, 19 nt, Homo sapiens
gaaugagaaaggugucuua

SEQ ID NO: 984307 - RNA, 19 nt, Homo sapiens
agaacaacaucgacuauga

SEQ ID NO: 984308 - RNA, 19 nt, Homo sapiens
gcacaguaguauguucuuu

SEQ ID NO: 984309 - RNA, 19 nt, Homo sapiens
gcaccuggauuuguaguau

SEQ ID NO: 984310 - RNA, 19 nt, Homo sapiens
gagggaagaauccuuaauu

SEQ ID NO: 984311 - RNA, 19 nt, Homo sapiens
uaaccaagcuuuucucauu

SEQ ID NO: 984312 - RNA, 19 nt, Homo sapiens
gacaaagggaugaguuaua

SEQ ID NO: 984313 - RNA, 19 nt, Homo sapiens
gaaacaguccuuugucuag

SEQ ID NO: 984314 - RNA, 19 nt, Homo sapiens
gaaaggcaagcuucacauu

SEQ ID NO: 984315 - RNA, 19 nt, Homo sapiens
cagcuaaccuuugacacua

SEQ ID NO: 984316 - RNA, 19 nt, Homo sapiens
gcuaaauacuggaacugaa

SEQ ID NO: 984317 - RNA, 19 nt, Homo sapiens
gcgguaacuuguauauauu

SEQ ID NO: 984318 - RNA, 19 nt, Homo sapiens
gauaugaccuagcuaacca

SEQ ID NO: 984319 - RNA, 19 nt, Homo sapiens
gcaggguaauuuauaugaa

SEQ ID NO: 984320 - RNA, 19 nt, Homo sapiens
gcagaaaucaggaaguaug

SEQ ID NO: 984321 - RNA, 19 nt, Homo sapiens
gcagcagccaucacaaaua

SEQ ID NO: 984322 - RNA, 19 nt, Homo sapiens
gggcaaagauuagcugcuu

SEQ ID NO: 984323 - RNA, 19 nt, Homo sapiens
aagccaaacuucuuuaaug

SEQ ID NO: 984324 - RNA, 19 nt, Homo sapiens
ucagacacuuguugaauau

SEQ ID NO: 984325 - RNA, 19 nt, Homo sapiens
acacaggguuccuugauug

SEQ ID NO: 984326 - RNA, 19 nt, Homo sapiens
gaagcagauucaggaagua

SEQ ID NO: 984327 - RNA, 19 nt, Homo sapiens
ccagauggcagaaacuuaa

SEQ ID NO: 984328 - RNA, 19 nt, Homo sapiens
gcgcuucgcugacaucuac

SEQ ID NO: 984329 - RNA, 19 nt, Homo sapiens
gagaggauccagaguguug

SEQ ID NO: 984330 - RNA, 19 nt, Homo sapiens
ugagaaaggugucuuacuc

SEQ ID NO: 984331 - RNA, 19 nt, Homo sapiens
ggccagauaggaaguauuu

SEQ ID NO: 984332 - RNA, 19 nt, Homo sapiens
gacacaggguuccuugauu

SEQ ID NO: 984333 - RNA, 19 nt, Homo sapiens
gcacgggaccuucucauca

SEQ ID NO: 984334 - RNA, 19 nt, Homo sapiens
gcuucucucuaaugaguua

SEQ ID NO: 984335 - RNA, 19 nt, Homo sapiens
gaaugaaguacccuuaaug

SEQ ID NO: 984336 - RNA, 19 nt, Homo sapiens
acaguaaucuuugacacua

SEQ ID NO: 984337 - RNA, 19 nt, Homo sapiens
gaacugaauuccacuuuuc

SEQ ID NO: 984338 - RNA, 19 nt, Homo sapiens
auaaaccacuugcuacuga

SEQ ID NO: 984339 - RNA, 19 nt, Homo sapiens
ggacuugcacagcugauuu

SEQ ID NO: 984340 - RNA, 19 nt, Homo sapiens
ggguaugaauaaugaguuu

SEQ ID NO: 984341 - RNA, 19 nt, Homo sapiens
guacagagcaauugaagca

SEQ ID NO: 984342 - RNA, 19 nt, Homo sapiens
gaaagagcucucauggaaa

SEQ ID NO: 984343 - RNA, 19 nt, Homo sapiens
gcugagaacaugcagauga

SEQ ID NO: 984344 - RNA, 19 nt, Homo sapiens
uggaaggacuuaagugaga

SEQ ID NO: 984345 - RNA, 19 nt, Homo sapiens
gcagccaucacaaauauga

SEQ ID NO: 984346 - RNA, 19 nt, Homo sapiens
gagagugcuugcuuauuca

SEQ ID NO: 984347 - RNA, 19 nt, Homo sapiens
gcagaaaggccagauauac

SEQ ID NO: 984348 - RNA, 19 nt, Homo sapiens
ugaaaucuauggcuucgau

SEQ ID NO: 984349 - RNA, 19 nt, Homo sapiens
gcaauucguggacuucauu

SEQ ID NO: 984350 - RNA, 19 nt, Homo sapiens
gggaagacgucucugauua

SEQ ID NO: 984351 - RNA, 19 nt, Homo sapiens
ucacaaaucucaacuccuu

SEQ ID NO: 984352 - RNA, 19 nt, Homo sapiens
agacggaccuggcugauaa

SEQ ID NO: 984353 - RNA, 19 nt, Homo sapiens
gaaccgaguuaucaagaug

SEQ ID NO: 984354 - RNA, 19 nt, Homo sapiens
gggaucacaucacucuuaa

SEQ ID NO: 984355 - RNA, 19 nt, Homo sapiens
ggagggaaccgaguuauca

SEQ ID NO: 984356 - RNA, 19 nt, Homo sapiens
ugacacuccuugcuuguug

SEQ ID NO: 984357 - RNA, 19 nt, Homo sapiens
ccuauuggcuagcuuccua

SEQ ID NO: 984358 - RNA, 19 nt, Homo sapiens
gcugauaagaggcagauaa

SEQ ID NO: 984359 - RNA, 19 nt, Homo sapiens
ggaaccgaguuaucaagau

SEQ ID NO: 984360 - RNA, 19 nt, Homo sapiens
gagcagagcgucgggaaga

SEQ ID NO: 984361 - RNA, 19 nt, Homo sapiens
ccaaagaacugagcgucau

SEQ ID NO: 984362 - RNA, 19 nt, Homo sapiens
gauaagaggcagauaacca

SEQ ID NO: 984363 - RNA, 19 nt, Homo sapiens
ggaauccacugagaaaauu

SEQ ID NO: 984364 - RNA, 19 nt, Homo sapiens
caucagggaucacaucacu

SEQ ID NO: 984365 - RNA, 19 nt, Homo sapiens
ccauugggauugacuucuu

SEQ ID NO: 984366 - RNA, 19 nt, Homo sapiens
ggaagacgucucugauuac

SEQ ID NO: 984367 - RNA, 19 nt, Homo sapiens
gaagacgucucugauuacg

SEQ ID NO: 984368 - RNA, 19 nt, Homo sapiens
gaucacaucacucuuaacg

SEQ ID NO: 984369 - RNA, 19 nt, Homo sapiens
agggaucacaucacucuua

SEQ ID NO: 984370 - RNA, 19 nt, Homo sapiens
uuacgagguucauguacga

SEQ ID NO: 984371 - RNA, 19 nt, Homo sapiens
gggaaccgaguuaucaaga

SEQ ID NO: 984372 - RNA, 19 nt, Homo sapiens
ggagaauguccaggagaaa

SEQ ID NO: 984373 - RNA, 19 nt, Homo sapiens
gaccuguggcuucccauga

SEQ ID NO: 984374 - RNA, 19 nt, Homo sapiens
uguacgacaucacaaaucu

SEQ ID NO: 984375 - RNA, 19 nt, Homo sapiens
uaucaagaugggaggauuu

SEQ ID NO: 984376 - RNA, 19 nt, Homo sapiens
gagggaaccgaguuaucaa

SEQ ID NO: 984377 - RNA, 19 nt, Homo sapiens
gagaggggcagugauguua

SEQ ID NO: 984378 - RNA, 19 nt, Homo sapiens
ugagcgucauguucauuga

SEQ ID NO: 984379 - RNA, 19 nt, Homo sapiens
cauugggauugacuucuug

SEQ ID NO: 984380 - RNA, 19 nt, Homo sapiens
ugauuacgagguucaugua

SEQ ID NO: 984381 - RNA, 19 nt, Homo sapiens
caaagaacugagcgucaug

SEQ ID NO: 984382 - RNA, 19 nt, Homo sapiens
ccaggcaaccauugggauu

SEQ ID NO: 984383 - RNA, 19 nt, Homo sapiens
acacauaccaggcaaccau

SEQ ID NO: 984384 - RNA, 19 nt, Homo sapiens
uacgacagcuucgacaaca

SEQ ID NO: 984385 - RNA, 19 nt, Homo sapiens
cuuguuguguugcuuccua

SEQ ID NO: 984386 - RNA, 19 nt, Homo sapiens
ggacagagaggggcaguga

SEQ ID NO: 984387 - RNA, 19 nt, Homo sapiens
aggcaaccauugggauuga

SEQ ID NO: 984388 - RNA, 19 nt, Homo sapiens
gugcgaagacuggcuacaa

SEQ ID NO: 984389 - RNA, 19 nt, Homo sapiens
cgggaagacgucucugauu

SEQ ID NO: 984390 - RNA, 19 nt, Homo sapiens
cgucucugauuacgagguu

SEQ ID NO: 984391 - RNA, 19 nt, Homo sapiens
cgacagcuucgacaacaca

SEQ ID NO: 984392 - RNA, 19 nt, Homo sapiens
gguguacgacaucacaaau

SEQ ID NO: 984393 - RNA, 19 nt, Homo sapiens
cgacaucacaaaucucaac

SEQ ID NO: 984394 - RNA, 19 nt, Homo sapiens
cagcuggucaggagagguu

SEQ ID NO: 984395 - RNA, 19 nt, Homo sapiens
ucagggaucacaucacucu

SEQ ID NO: 984396 - RNA, 19 nt, Homo sapiens
gacacuccuugcuuguugu

SEQ ID NO: 984397 - RNA, 19 nt, Homo sapiens
uacccggaauggagaaugu

SEQ ID NO: 984398 - RNA, 19 nt, Homo sapiens
gggcaucagggaucacauc

SEQ ID NO: 984399 - RNA, 19 nt, Homo sapiens
uuaucaagaugggaggauu

SEQ ID NO: 984400 - RNA, 19 nt, Homo sapiens
agaggcagauaaccaucga

SEQ ID NO: 984401 - RNA, 19 nt, Homo sapiens
guacgacagcuucgacaac

SEQ ID NO: 984402 - RNA, 19 nt, Homo sapiens
gggagggaaccgaguuauc

SEQ ID NO: 984403 - RNA, 19 nt, Homo sapiens
cgucggcucuacccggaau

SEQ ID NO: 984404 - RNA, 19 nt, Homo sapiens
acacauggaucuaagagaa

SEQ ID NO: 984405 - RNA, 19 nt, Homo sapiens
gagacgcgcugaacagaga

SEQ ID NO: 984406 - RNA, 19 nt, Homo sapiens
gccagcagcuuucacagaa

SEQ ID NO: 984407 - RNA, 19 nt, Homo sapiens
gcgcagagccagccagauu

SEQ ID NO: 984408 - RNA, 19 nt, Homo sapiens
gaagagacuacaaaugaug

SEQ ID NO: 984409 - RNA, 19 nt, Homo sapiens
gccaacagguuaauuaguc

SEQ ID NO: 984410 - RNA, 19 nt, Homo sapiens
gagaugaagagacuacaaa

SEQ ID NO: 984411 - RNA, 19 nt, Homo sapiens
caaacucggugaacaacug

SEQ ID NO: 984412 - RNA, 19 nt, Homo sapiens
caaaugauguuccccauau

SEQ ID NO: 984413 - RNA, 19 nt, Homo sapiens
gacaugugaugcugaccua

SEQ ID NO: 984414 - RNA, 19 nt, Homo sapiens
gagaagagggagaugaaga

SEQ ID NO: 984415 - RNA, 19 nt, Homo sapiens
ugagccaacagguuaauua

SEQ ID NO: 984416 - RNA, 19 nt, Homo sapiens
aauacugacugacauguga

SEQ ID NO: 984417 - RNA, 19 nt, Homo sapiens
ugaagagacuacaaaugau

SEQ ID NO: 984418 - RNA, 19 nt, Homo sapiens
ggaccugcauauguugaaa

SEQ ID NO: 984419 - RNA, 19 nt, Homo sapiens
gggaggauuauuuauugua

SEQ ID NO: 984420 - RNA, 19 nt, Homo sapiens
augaagagacuacaaauga

SEQ ID NO: 984421 - RNA, 19 nt, Homo sapiens
gaugaagagacuacaaaug

SEQ ID NO: 984422 - RNA, 19 nt, Homo sapiens
ccagcaaggccaagauaaa

SEQ ID NO: 984423 - RNA, 19 nt, Homo sapiens
cugcuaggaucggauauuu

SEQ ID NO: 984424 - RNA, 19 nt, Homo sapiens
gcagagccagccagauuug

SEQ ID NO: 984425 - RNA, 19 nt, Homo sapiens
gagagaaucaggcucaaag

SEQ ID NO: 984426 - RNA, 19 nt, Homo sapiens
gcucaaagcaaguggaagu

SEQ ID NO: 984427 - RNA, 19 nt, Homo sapiens
gagcuguaaugcugcuguu

SEQ ID NO: 984428 - RNA, 19 nt, Homo sapiens
gaagggaaauuuggggauu

SEQ ID NO: 984429 - RNA, 19 nt, Homo sapiens
gaacaacugagggaaccaa

SEQ ID NO: 984430 - RNA, 19 nt, Homo sapiens
gaagagggagaugaagaga

SEQ ID NO: 984431 - RNA, 19 nt, Homo sapiens
ccuaugauaagguugagua

SEQ ID NO: 984432 - RNA, 19 nt, Homo sapiens
agugggaccugcauauguu

SEQ ID NO: 984433 - RNA, 19 nt, Homo sapiens
ggagaugaagagacuacaa

SEQ ID NO: 984434 - RNA, 19 nt, Homo sapiens
cagccagauuugagaagaa

SEQ ID NO: 984435 - RNA, 19 nt, Homo sapiens
cagcaaggccaagauaaau

SEQ ID NO: 984436 - RNA, 19 nt, Homo sapiens
agucaguucugcuugcaaa

SEQ ID NO: 984437 - RNA, 19 nt, Homo sapiens
uaagagaagagggagauga

SEQ ID NO: 984438 - RNA, 19 nt, Homo sapiens
gcccagcaaggccaagaua

SEQ ID NO: 984439 - RNA, 19 nt, Homo sapiens
agagggagaugaagagacu

SEQ ID NO: 984440 - RNA, 19 nt, Homo sapiens
gugaugcugaccuaugaua

SEQ ID NO: 984441 - RNA, 19 nt, Homo sapiens
gagggaaccaaaccagaga

SEQ ID NO: 984442 - RNA, 19 nt, Homo sapiens
gagaaucaggcucaaagca

SEQ ID NO: 984443 - RNA, 19 nt, Homo sapiens
ccagccagauuugagaaga

SEQ ID NO: 984444 - RNA, 19 nt, Homo sapiens
uuacaaacucggugaacaa

SEQ ID NO: 984445 - RNA, 19 nt, Homo sapiens
gagccaacagguuaauuag

SEQ ID NO: 984446 - RNA, 19 nt, Homo sapiens
aaaggcagcagcucaagga

SEQ ID NO: 984447 - RNA, 19 nt, Homo sapiens
ggacacauggaucuaagag

SEQ ID NO: 984448 - RNA, 19 nt, Homo sapiens
gagccagccagauuugaga

SEQ ID NO: 984449 - RNA, 19 nt, Homo sapiens
uagaugggaagggaaauuu

SEQ ID NO: 984450 - RNA, 19 nt, Homo sapiens
agaaucaggcucaaagcaa

SEQ ID NO: 984451 - RNA, 19 nt, Homo sapiens
acauggaucuaagagaaga

SEQ ID NO: 984452 - RNA, 19 nt, Homo sapiens
aagagaagagggagaugaa

SEQ ID NO: 984453 - RNA, 19 nt, Homo sapiens
gaugcugaccuaugauaag

SEQ ID NO: 984454 - RNA, 19 nt, Homo sapiens
gauccaccagggucugauu

SEQ ID NO: 984455 - RNA, 19 nt, Homo sapiens
caguucugcuugcaaagga

SEQ ID NO: 984456 - RNA, 19 nt, Homo sapiens
gaugggaagggaaauuugg

SEQ ID NO: 984457 - RNA, 19 nt, Homo sapiens
uaccaauacugacugacau

SEQ ID NO: 984458 - RNA, 19 nt, Homo sapiens
gaagugggcagagauucca

SEQ ID NO: 984459 - RNA, 19 nt, Homo sapiens
uaugagaagcugcuaggau

SEQ ID NO: 984460 - RNA, 19 nt, Homo sapiens
gcgcugaacagagagaauc

SEQ ID NO: 984461 - RNA, 19 nt, Homo sapiens
caugugaugcugaccuaug

SEQ ID NO: 984462 - RNA, 19 nt, Homo sapiens
ucaaggauggcacucagau

SEQ ID NO: 984463 - RNA, 19 nt, Homo sapiens
ccuaaaggcagcagcucaa

SEQ ID NO: 984464 - RNA, 19 nt, Homo sapiens
uggggaggauuauuuauug

SEQ ID NO: 984465 - RNA, 19 nt, Homo sapiens
augugaugcugaccuauga

SEQ ID NO: 984466 - RNA, 19 nt, Homo sapiens
ccagagacgcgcugaacag

SEQ ID NO: 984467 - RNA, 19 nt, Homo sapiens
cccaaggacucagggacaa

SEQ ID NO: 984468 - RNA, 19 nt, Homo sapiens
aauuaccaauacugacuga

SEQ ID NO: 984469 - RNA, 19 nt, Homo sapiens
gcaacccugagucccuaaa

SEQ ID NO: 984470 - RNA, 19 nt, Homo sapiens
cagagacgcgcugaacaga

SEQ ID NO: 984471 - RNA, 19 nt, Homo sapiens
gcacaaagaaagugauuua

SEQ ID NO: 984472 - RNA, 19 nt, Homo sapiens
aaacuucagucuccgauua

SEQ ID NO: 984473 - RNA, 19 nt, Homo sapiens
gaaauugacagacgaauau

SEQ ID NO: 984474 - RNA, 19 nt, Homo sapiens
gaaagugauuuaagagaug

SEQ ID NO: 984475 - RNA, 19 nt, Homo sapiens
gaaggcaucucuccugaau

SEQ ID NO: 984476 - RNA, 19 nt, Homo sapiens
aacaauagauccagcuuua

SEQ ID NO: 984477 - RNA, 19 nt, Homo sapiens
gaagaacgacuacaaaaua

SEQ ID NO: 984478 - RNA, 19 nt, Homo sapiens
gacuagaccugaaggaauu

SEQ ID NO: 984479 - RNA, 19 nt, Homo sapiens
agacgaauaucugcauuua

SEQ ID NO: 984480 - RNA, 19 nt, Homo sapiens
gaaaauaguugugcaagaa

SEQ ID NO: 984481 - RNA, 19 nt, Homo sapiens
aaagcaagcugaaaucaau

SEQ ID NO: 984482 - RNA, 19 nt, Homo sapiens
caaacaagcccuccucaga

SEQ ID NO: 984483 - RNA, 19 nt, Homo sapiens
uaaucaggcuguagaagaa

SEQ ID NO: 984484 - RNA, 19 nt, Homo sapiens
caauagauccagcuuuaaa

SEQ ID NO: 984485 - RNA, 19 nt, Homo sapiens
gcacuugaacaacacauuu

SEQ ID NO: 984486 - RNA, 19 nt, Homo sapiens
gcaucucuccugaauauuu

SEQ ID NO: 984487 - RNA, 19 nt, Homo sapiens
cuagaguugugaauacaua

SEQ ID NO: 984488 - RNA, 19 nt, Homo sapiens
gaaagcaagcugaaaucaa

SEQ ID NO: 984489 - RNA, 19 nt, Homo sapiens
gaaagaaagcaagcugaaa

SEQ ID NO: 984490 - RNA, 19 nt, Homo sapiens
gcauguguaugaacuuguu

SEQ ID NO: 984491 - RNA, 19 nt, Homo sapiens
gaaaauuagugcccucaaa

SEQ ID NO: 984492 - RNA, 19 nt, Homo sapiens
cagaaguaguucagauaaa

SEQ ID NO: 984493 - RNA, 19 nt, Homo sapiens
ucugugaagucaagguuua

SEQ ID NO: 984494 - RNA, 19 nt, Homo sapiens
uggcugaacuugaugagaa

SEQ ID NO: 984495 - RNA, 19 nt, Homo sapiens
aggcaucucuccugaauau

SEQ ID NO: 984496 - RNA, 19 nt, Homo sapiens
gaacagaaauggggaacaa

SEQ ID NO: 984497 - RNA, 19 nt, Homo sapiens
gaaaauagcauuguuggaa

SEQ ID NO: 984498 - RNA, 19 nt, Homo sapiens
gagauaggaagaacagaaa

SEQ ID NO: 984499 - RNA, 19 nt, Homo sapiens
guaaucaggcuguagaaga

SEQ ID NO: 984500 - RNA, 19 nt, Homo sapiens
gauaaaggcuggaaaagca

SEQ ID NO: 984501 - RNA, 19 nt, Homo sapiens
ugcaagaacugaugcgauu

SEQ ID NO: 984502 - RNA, 19 nt, Homo sapiens
cagccugcauugcucuuua

SEQ ID NO: 984503 - RNA, 19 nt, Homo sapiens
aaacaagcccuccucagaa

SEQ ID NO: 984504 - RNA, 19 nt, Homo sapiens
aauguagacuucucuguga

SEQ ID NO: 984505 - RNA, 19 nt, Homo sapiens
uaagaugucaguauucaug

SEQ ID NO: 984506 - RNA, 19 nt, Homo sapiens
aacaagcccuccucagaaa

SEQ ID NO: 984507 - RNA, 19 nt, Homo sapiens
ccagaaguaguucagauaa

SEQ ID NO: 984508 - RNA, 19 nt, Homo sapiens
gagaugauguggugaaaau

SEQ ID NO: 984509 - RNA, 19 nt, Homo sapiens
gaugucaguauucauguaa

SEQ ID NO: 984510 - RNA, 19 nt, Homo sapiens
aaagaaagcaagcugaaau

SEQ ID NO: 984511 - RNA, 19 nt, Homo sapiens
gaagagauaggaagaacag

SEQ ID NO: 984512 - RNA, 19 nt, Homo sapiens
uaaaggagguauuuuggaa

SEQ ID NO: 984513 - RNA, 19 nt, Homo sapiens
ccaagagacauuuaucaga

SEQ ID NO: 984514 - RNA, 19 nt, Homo sapiens
gaagaaaagcacaaagaaa

SEQ ID NO: 984515 - RNA, 19 nt, Homo sapiens
caagugcugguacaucuuu

SEQ ID NO: 984516 - RNA, 19 nt, Homo sapiens
guaaaaguuucuagaguug

SEQ ID NO: 984517 - RNA, 19 nt, Homo sapiens
agaaauugacagacgaaua

SEQ ID NO: 984518 - RNA, 19 nt, Homo sapiens
gauaggaagaacagaaaug

SEQ ID NO: 984519 - RNA, 19 nt, Homo sapiens
ccggaaggaagauuuauuu

SEQ ID NO: 984520 - RNA, 19 nt, Homo sapiens
agaaguaguucagauaaag

SEQ ID NO: 984521 - RNA, 19 nt, Homo sapiens
gcucuuuagugcacuugaa

SEQ ID NO: 984522 - RNA, 19 nt, Homo sapiens
gaugauguggugaaaauua

SEQ ID NO: 984523 - RNA, 19 nt, Homo sapiens
agacacagauccauuuuga

SEQ ID NO: 984524 - RNA, 19 nt, Homo sapiens
ccaccggaaggaagauuua

SEQ ID NO: 984525 - RNA, 19 nt, Homo sapiens
aaacuccucucguccuugu

SEQ ID NO: 984526 - RNA, 19 nt, Homo sapiens
gaacgacuacaaaauauug

SEQ ID NO: 984527 - RNA, 19 nt, Homo sapiens
aaacaacgucagggaauuu

SEQ ID NO: 984528 - RNA, 19 nt, Homo sapiens
ugaaagaaagcaagcugaa

SEQ ID NO: 984529 - RNA, 19 nt, Homo sapiens
cagagaugauguggugaaa

SEQ ID NO: 984530 - RNA, 19 nt, Homo sapiens
cagcaugcuucgagacugu

SEQ ID NO: 984531 - RNA, 19 nt, Homo sapiens
gcagaaauugacagacgaa

SEQ ID NO: 984532 - RNA, 19 nt, Homo sapiens
uuagugcacuugaacaaca

SEQ ID NO: 984533 - RNA, 19 nt, Homo sapiens
ggaaggaagauuuauuuug

SEQ ID NO: 984534 - RNA, 19 nt, Homo sapiens
gcagcaaguaaucuucaaa

SEQ ID NO: 984535 - RNA, 19 nt, Homo sapiens
gugaagucaagguuuauuu

SEQ ID NO: 984536 - RNA, 19 nt, Homo sapiens
cuucaaauauuccaguaag

SEQ ID NO: 984537 - RNA, 19 nt, Homo sapiens
gcaagaacugaugcgauuu

SEQ ID NO: 984538 - RNA, 19 nt, Homo sapiens
ggaagaaaagcacaaagaa

SEQ ID NO: 984539 - RNA, 19 nt, Homo sapiens
ggccugagaagauauuaug

SEQ ID NO: 984540 - RNA, 19 nt, Homo sapiens
uacaagugcugguacaucu

SEQ ID NO: 984541 - RNA, 19 nt, Homo sapiens
ggcugaacuugaugagaaa

SEQ ID NO: 984542 - RNA, 19 nt, Homo sapiens
aaacaauagauccagcuuu

SEQ ID NO: 984543 - RNA, 19 nt, Homo sapiens
cagcuugaccucagagaug

SEQ ID NO: 984544 - RNA, 19 nt, Homo sapiens
cguaaaaguuucuagaguu

SEQ ID NO: 984545 - RNA, 19 nt, Homo sapiens
gaggugcucuacgaaaucu

SEQ ID NO: 984546 - RNA, 19 nt, Homo sapiens
agaugucaguauucaugua

SEQ ID NO: 984547 - RNA, 19 nt, Homo sapiens
ggaaggcaucucuccugaa

SEQ ID NO: 984548 - RNA, 19 nt, Homo sapiens
agagacauuuaucagagaa

SEQ ID NO: 984549 - RNA, 19 nt, Homo sapiens
aagagacauuuaucagaga

SEQ ID NO: 984550 - RNA, 19 nt, Homo sapiens
gaaaacaacgucagggaau

SEQ ID NO: 984551 - RNA, 19 nt, Homo sapiens
caagcugaaaucaaugaaa

SEQ ID NO: 984552 - RNA, 19 nt, Homo sapiens
cccaccaccuuccaugaaa

SEQ ID NO: 984553 - RNA, 19 nt, Homo sapiens
ucaaccaccucaacagaac

SEQ ID NO: 984554 - RNA, 19 nt, Homo sapiens
guucaaccaccucaacaga

SEQ ID NO: 984555 - RNA, 19 nt, Homo sapiens
ggugcucuacgaaaucuuu

SEQ ID NO: 984556 - RNA, 19 nt, Homo sapiens
cagcaaguaaucuucaaau

SEQ ID NO: 984557 - RNA, 19 nt, Homo sapiens
caagagaagcagaauccau

SEQ ID NO: 984558 - RNA, 19 nt, Homo sapiens
agagauaggaagaacagaa

SEQ ID NO: 984559 - RNA, 19 nt, Homo sapiens
ucuguaagcuuuucuggaa

SEQ ID NO: 984560 - RNA, 19 nt, Homo sapiens
uuaaagaggagaauacaac

SEQ ID NO: 984561 - RNA, 19 nt, Homo sapiens
gauuaaagaggagaauaca

SEQ ID NO: 984562 - RNA, 19 nt, Homo sapiens
gaaguaguucagauaaagg

SEQ ID NO: 984563 - RNA, 19 nt, Homo sapiens
ucagagaugauguggugaa

SEQ ID NO: 984564 - RNA, 19 nt, Homo sapiens
cauugauguuaaccaguuu

SEQ ID NO: 984565 - RNA, 19 nt, Homo sapiens
caccucaacagaacuauuc

SEQ ID NO: 984566 - RNA, 19 nt, Homo sapiens
ggagaauacaacugcuguu

SEQ ID NO: 984567 - RNA, 19 nt, Homo sapiens
agacuagaccugaaggaau

SEQ ID NO: 984568 - RNA, 19 nt, Homo sapiens
ccauuuugauccagaagua

SEQ ID NO: 984569 - RNA, 19 nt, Homo sapiens
uaauuuacaagugcuggua

SEQ ID NO: 984570 - RNA, 19 nt, Homo sapiens
caucucuccugaauauuuu

SEQ ID NO: 984571 - RNA, 19 nt, Homo sapiens
gaagaaggcuggaaacaga

SEQ ID NO: 984572 - RNA, 19 nt, Homo sapiens
ccacagggcugaucuauga

SEQ ID NO: 984573 - RNA, 19 nt, Homo sapiens
ggaccugguucucuucuaa

SEQ ID NO: 984574 - RNA, 19 nt, Homo sapiens
gagagaagauacagacaug

SEQ ID NO: 984575 - RNA, 19 nt, Homo sapiens
gccaagaggucccauauuc

SEQ ID NO: 984576 - RNA, 19 nt, Homo sapiens
ggugagggcuucaauguca

SEQ ID NO: 984577 - RNA, 19 nt, Homo sapiens
gcaagauccucauuguaga

SEQ ID NO: 984578 - RNA, 19 nt, Homo sapiens
ucacugaccucgccuucaa

SEQ ID NO: 984579 - RNA, 19 nt, Homo sapiens
ccacagggcucucgagaac

SEQ ID NO: 984580 - RNA, 19 nt, Homo sapiens
gagaacagccugccugcuu

SEQ ID NO: 984581 - RNA, 19 nt, Homo sapiens
gcuauaagcccaagaaguc

SEQ ID NO: 984582 - RNA, 19 nt, Homo sapiens
cugaagaccuggagacaga

SEQ ID NO: 984583 - RNA, 19 nt, Homo sapiens
ggaggaagaaccuaugaau

SEQ ID NO: 984584 - RNA, 19 nt, Homo sapiens
ccagcaagauccucauugu

SEQ ID NO: 984585 - RNA, 19 nt, Homo sapiens
gaagcuagcggaggugauu

SEQ ID NO: 984586 - RNA, 19 nt, Homo sapiens
cugaguaccuggcugcuuu

SEQ ID NO: 984587 - RNA, 19 nt, Homo sapiens
uagcggaggugauucugaa

SEQ ID NO: 984588 - RNA, 19 nt, Homo sapiens
gagauccugugggcaagua

SEQ ID NO: 984589 - RNA, 19 nt, Homo sapiens
ccuggugucugcuggauuu

SEQ ID NO: 984590 - RNA, 19 nt, Homo sapiens
ggaagaaccuaugaaucuc

SEQ ID NO: 984591 - RNA, 19 nt, Homo sapiens
gaaaaucccugggucuaga

SEQ ID NO: 984592 - RNA, 19 nt, Homo sapiens
agaacagccugccugcuuu

SEQ ID NO: 984593 - RNA, 19 nt, Homo sapiens
gacaagagcaagcgaagug

SEQ ID NO: 984594 - RNA, 19 nt, Homo sapiens
gagaagauacagacaugga

SEQ ID NO: 984595 - RNA, 19 nt, Homo sapiens
uggcugcucuucuggguaa

SEQ ID NO: 984596 - RNA, 19 nt, Homo sapiens
gagcaaggccagcaagauc

SEQ ID NO: 984597 - RNA, 19 nt, Homo sapiens
gcagauacccucggcugaa

SEQ ID NO: 984598 - RNA, 19 nt, Homo sapiens
gggcuucaaugucaaugug

SEQ ID NO: 984599 - RNA, 19 nt, Homo sapiens
ccacuuugcccaguccuua

SEQ ID NO: 984600 - RNA, 19 nt, Homo sapiens
gaacagccugccugcuuug

SEQ ID NO: 984601 - RNA, 19 nt, Homo sapiens
agaauccacugcuccgaaa

SEQ ID NO: 984602 - RNA, 19 nt, Homo sapiens
gcagcguggucaagcagaa

SEQ ID NO: 984603 - RNA, 19 nt, Homo sapiens
gagccaagaggucccauau

SEQ ID NO: 984604 - RNA, 19 nt, Homo sapiens
ccauguuucugccaaaugu

SEQ ID NO: 984605 - RNA, 19 nt, Homo sapiens
gcacccagcaaaccuucua

SEQ ID NO: 984606 - RNA, 19 nt, Homo sapiens
ccaugcagaucauucaaca

SEQ ID NO: 984607 - RNA, 19 nt, Homo sapiens
gcccuugcccuuccacuuu

SEQ ID NO: 984608 - RNA, 19 nt, Homo sapiens
gggaucaggcuguaucaug

SEQ ID NO: 984609 - RNA, 19 nt, Homo sapiens
gcaccaccaccucuuccua

SEQ ID NO: 984610 - RNA, 19 nt, Homo sapiens
ggagagaagauacagacau

SEQ ID NO: 984611 - RNA, 19 nt, Homo sapiens
cuggguggcuaccauguuu

SEQ ID NO: 984612 - RNA, 19 nt, Homo sapiens
cagcaagauccucauugua

SEQ ID NO: 984613 - RNA, 19 nt, Homo sapiens
gagugaggcguguguguga

SEQ ID NO: 984614 - RNA, 19 nt, Homo sapiens
gaggaagaaccuaugaauc

SEQ ID NO: 984615 - RNA, 19 nt, Homo sapiens
gaggaggaagaaccuauga

SEQ ID NO: 984616 - RNA, 19 nt, Homo sapiens
gccaugggcuucugcuucu

SEQ ID NO: 984617 - RNA, 19 nt, Homo sapiens
gcaggaccacgacaggauu

SEQ ID NO: 984618 - RNA, 19 nt, Homo sapiens
gaacaguccaucccaacag

SEQ ID NO: 984619 - RNA, 19 nt, Homo sapiens
aagaaccuaugaaucucua

SEQ ID NO: 984620 - RNA, 19 nt, Homo sapiens
ugaccucgccuucaaagug

SEQ ID NO: 984621 - RNA, 19 nt, Homo sapiens
gugugugucuuuccuagga

SEQ ID NO: 984622 - RNA, 19 nt, Homo sapiens
gaagaaccuaugaaucucu

SEQ ID NO: 984623 - RNA, 19 nt, Homo sapiens
cauccuggcugaagauagg

SEQ ID NO: 984624 - RNA, 19 nt, Homo sapiens
gcucacccuuaaccacuau

SEQ ID NO: 984625 - RNA, 19 nt, Homo sapiens
aggaagaaccuaugaaucu

SEQ ID NO: 984626 - RNA, 19 nt, Homo sapiens
acacugacaccaucuggaa

SEQ ID NO: 984627 - RNA, 19 nt, Homo sapiens
ggaaggccucccuggaaga

SEQ ID NO: 984628 - RNA, 19 nt, Homo sapiens
ggaggaggaagaaccuaug

SEQ ID NO: 984629 - RNA, 19 nt, Homo sapiens
gccaggggcugacaaagaa

SEQ ID NO: 984630 - RNA, 19 nt, Homo sapiens
acagaaacccaaccucaau

SEQ ID NO: 984631 - RNA, 19 nt, Homo sapiens
gcggugagggcuucaaugu

SEQ ID NO: 984632 - RNA, 19 nt, Homo sapiens
ccagcaaaccuucuaccaa

SEQ ID NO: 984633 - RNA, 19 nt, Homo sapiens
ugugugagcauguguguga

SEQ ID NO: 984634 - RNA, 19 nt, Homo sapiens
cagccugccugcuuugaca

SEQ ID NO: 984635 - RNA, 19 nt, Homo sapiens
gaagaaguggaggcaguga

SEQ ID NO: 984636 - RNA, 19 nt, Homo sapiens
acacgccgaugcccgaguu

SEQ ID NO: 984637 - RNA, 19 nt, Homo sapiens
accugaagcugcgcuauaa

SEQ ID NO: 984638 - RNA, 19 nt, Homo sapiens
ucucugagcccaaccugaa

SEQ ID NO: 984639 - RNA, 19 nt, Homo sapiens
cugccugcuuugacaguua

SEQ ID NO: 984640 - RNA, 19 nt, Homo sapiens
ggugucugcuggauuugau

SEQ ID NO: 984641 - RNA, 19 nt, Homo sapiens
ccagugugcucuacaucuc

SEQ ID NO: 984642 - RNA, 19 nt, Homo sapiens
ugcagucgguccacucuga

SEQ ID NO: 984643 - RNA, 19 nt, Homo sapiens
ggucagccaagccgaguga

SEQ ID NO: 984644 - RNA, 19 nt, Homo sapiens
ugugugagcguguguguga

SEQ ID NO: 984645 - RNA, 19 nt, Homo sapiens
caggaccacgacaggauua

SEQ ID NO: 984646 - RNA, 19 nt, Homo sapiens
ugauccgggugcacaguaa

SEQ ID NO: 984647 - RNA, 19 nt, Homo sapiens
ugacgcagcaacugaugaa

SEQ ID NO: 984648 - RNA, 19 nt, Homo sapiens
gcagagacccucggagacu

SEQ ID NO: 984649 - RNA, 19 nt, Homo sapiens
ggagccaagaggucccaua

SEQ ID NO: 984650 - RNA, 19 nt, Homo sapiens
gggaccugguucucuucua

SEQ ID NO: 984651 - RNA, 19 nt, Homo sapiens
gaaccuaugaaucucuaag

SEQ ID NO: 984652 - RNA, 19 nt, Homo sapiens
gaagaccuggagacagaug

SEQ ID NO: 984653 - RNA, 19 nt, Homo sapiens
ggaggcugcucuggcaaag

SEQ ID NO: 984654 - RNA, 19 nt, Homo sapiens
gagacgaagcucccugaca

SEQ ID NO: 984655 - RNA, 19 nt, Homo sapiens
ccgucgggcucacccuuaa

SEQ ID NO: 984656 - RNA, 19 nt, Homo sapiens
gaccacgacaggauuaagu

SEQ ID NO: 984657 - RNA, 19 nt, Homo sapiens
cagccaagccgagugagaa

SEQ ID NO: 984658 - RNA, 19 nt, Homo sapiens
gagugaggcgugugugugu

SEQ ID NO: 984659 - RNA, 19 nt, Homo sapiens
ggcagcuucuccacaagga

SEQ ID NO: 984660 - RNA, 19 nt, Homo sapiens
ggcucacccuuaaccacua

SEQ ID NO: 984661 - RNA, 19 nt, Homo sapiens
cagaaacccaaccucaaug

SEQ ID NO: 984662 - RNA, 19 nt, Homo sapiens
cuaccauguuucugccaaa

SEQ ID NO: 984663 - RNA, 19 nt, Homo sapiens
ccacgacaggauuaaguga

SEQ ID NO: 984664 - RNA, 19 nt, Homo sapiens
cagauacccucggcugaag

SEQ ID NO: 984665 - RNA, 19 nt, Homo sapiens
gggaggcugcucuggcaaa

SEQ ID NO: 984666 - RNA, 19 nt, Homo sapiens
ugacgacggcaacuucuuc

SEQ ID NO: 984667 - RNA, 19 nt, Homo sapiens
cucgugagcuaaagaaugg

SEQ ID NO: 984668 - RNA, 19 nt, Homo sapiens
gcucagccgccucaaacug

SEQ ID NO: 984669 - RNA, 19 nt, Homo sapiens
ggcaacggcacccagcaaa

SEQ ID NO: 984670 - RNA, 19 nt, Homo sapiens
agcaagauccucauuguag

SEQ ID NO: 984671 - RNA, 19 nt, Homo sapiens
gaagaaggcuggaaacaga

SEQ ID NO: 984672 - RNA, 19 nt, Homo sapiens
ccacagggcugaucuauga

SEQ ID NO: 984673 - RNA, 19 nt, Homo sapiens
ggaccugguucucuucuaa

SEQ ID NO: 984674 - RNA, 19 nt, Homo sapiens
gagagaagauacagacaug

SEQ ID NO: 984675 - RNA, 19 nt, Homo sapiens
gccaagaggucccauauuc

SEQ ID NO: 984676 - RNA, 19 nt, Homo sapiens
ggugagggcuucaauguca

SEQ ID NO: 984677 - RNA, 19 nt, Homo sapiens
gcaagauccucauuguaga

SEQ ID NO: 984678 - RNA, 19 nt, Homo sapiens
ucacugaccucgccuucaa

SEQ ID NO: 984679 - RNA, 19 nt, Homo sapiens
ccacagggcucucgagaac

SEQ ID NO: 984680 - RNA, 19 nt, Homo sapiens
gagaacagccugccugcuu

SEQ ID NO: 984681 - RNA, 19 nt, Homo sapiens
gcuauaagcccaagaaguc

SEQ ID NO: 984682 - RNA, 19 nt, Homo sapiens
cugaagaccuggagacaga

SEQ ID NO: 984683 - RNA, 19 nt, Homo sapiens
ggaggaagaaccuaugaau

SEQ ID NO: 984684 - RNA, 19 nt, Homo sapiens
ccagcaagauccucauugu

SEQ ID NO: 984685 - RNA, 19 nt, Homo sapiens
gaagcuagcggaggugauu

SEQ ID NO: 984686 - RNA, 19 nt, Homo sapiens
cugaguaccuggcugcuuu

SEQ ID NO: 984687 - RNA, 19 nt, Homo sapiens
uagcggaggugauucugaa

SEQ ID NO: 984688 - RNA, 19 nt, Homo sapiens
gagauccugugggcaagua

SEQ ID NO: 984689 - RNA, 19 nt, Homo sapiens
ccuggugucugcuggauuu

SEQ ID NO: 984690 - RNA, 19 nt, Homo sapiens
ggaagaaccuaugaaucuc

SEQ ID NO: 984691 - RNA, 19 nt, Homo sapiens
gaaaaucccugggucuaga

SEQ ID NO: 984692 - RNA, 19 nt, Homo sapiens
agaacagccugccugcuuu

SEQ ID NO: 984693 - RNA, 19 nt, Homo sapiens
gacaagagcaagcgaagug

SEQ ID NO: 984694 - RNA, 19 nt, Homo sapiens
gagaagauacagacaugga

SEQ ID NO: 984695 - RNA, 19 nt, Homo sapiens
uggcugcucuucuggguaa

SEQ ID NO: 984696 - RNA, 19 nt, Homo sapiens
gagcaaggccagcaagauc

SEQ ID NO: 984697 - RNA, 19 nt, Homo sapiens
gcagauacccucggcugaa

SEQ ID NO: 984698 - RNA, 19 nt, Homo sapiens
gggcuucaaugucaaugug

SEQ ID NO: 984699 - RNA, 19 nt, Homo sapiens
ccacuuugcccaguccuua

SEQ ID NO: 984700 - RNA, 19 nt, Homo sapiens
gaacagccugccugcuuug

SEQ ID NO: 984701 - RNA, 19 nt, Homo sapiens
agaauccacugcuccgaaa

SEQ ID NO: 984702 - RNA, 19 nt, Homo sapiens
gcagcguggucaagcagaa

SEQ ID NO: 984703 - RNA, 19 nt, Homo sapiens
gagccaagaggucccauau

SEQ ID NO: 984704 - RNA, 19 nt, Homo sapiens
ccauguuucugccaaaugu

SEQ ID NO: 984705 - RNA, 19 nt, Homo sapiens
gcacccagcaaaccuucua

SEQ ID NO: 984706 - RNA, 19 nt, Homo sapiens
ccaugcagaucauucaaca

SEQ ID NO: 984707 - RNA, 19 nt, Homo sapiens
gcccuugcccuuccacuuu

SEQ ID NO: 984708 - RNA, 19 nt, Homo sapiens
gggaucaggcuguaucaug

SEQ ID NO: 984709 - RNA, 19 nt, Homo sapiens
gcaccaccaccucuuccua

SEQ ID NO: 984710 - RNA, 19 nt, Homo sapiens
ggagagaagauacagacau

SEQ ID NO: 984711 - RNA, 19 nt, Homo sapiens
cuggguggcuaccauguuu

SEQ ID NO: 984712 - RNA, 19 nt, Homo sapiens
cagcaagauccucauugua

SEQ ID NO: 984713 - RNA, 19 nt, Homo sapiens
gagugaggcguguguguga

SEQ ID NO: 984714 - RNA, 19 nt, Homo sapiens
gaggaagaaccuaugaauc

SEQ ID NO: 984715 - RNA, 19 nt, Homo sapiens
gaggaggaagaaccuauga

SEQ ID NO: 984716 - RNA, 19 nt, Homo sapiens
gccaugggcuucugcuucu

SEQ ID NO: 984717 - RNA, 19 nt, Homo sapiens
gcaggaccacgacaggauu

SEQ ID NO: 984718 - RNA, 19 nt, Homo sapiens
gaacaguccaucccaacag

SEQ ID NO: 984719 - RNA, 19 nt, Homo sapiens
aagaaccuaugaaucucua

SEQ ID NO: 984720 - RNA, 19 nt, Homo sapiens
ugaccucgccuucaaagug

SEQ ID NO: 984721 - RNA, 19 nt, Homo sapiens
gugugugucuuuccuagga

SEQ ID NO: 984722 - RNA, 19 nt, Homo sapiens
gaagaaccuaugaaucucu

SEQ ID NO: 984723 - RNA, 19 nt, Homo sapiens
cauccuggcugaagauagg

SEQ ID NO: 984724 - RNA, 19 nt, Homo sapiens
gcucacccuuaaccacuau

SEQ ID NO: 984725 - RNA, 19 nt, Homo sapiens
aggaagaaccuaugaaucu

SEQ ID NO: 984726 - RNA, 19 nt, Homo sapiens
acacugacaccaucuggaa

SEQ ID NO: 984727 - RNA, 19 nt, Homo sapiens
ggaaggccucccuggaaga

SEQ ID NO: 984728 - RNA, 19 nt, Homo sapiens
ggaggaggaagaaccuaug

SEQ ID NO: 984729 - RNA, 19 nt, Homo sapiens
gccaggggcugacaaagaa

SEQ ID NO: 984730 - RNA, 19 nt, Homo sapiens
acagaaacccaaccucaau

SEQ ID NO: 984731 - RNA, 19 nt, Homo sapiens
gcggugagggcuucaaugu

SEQ ID NO: 984732 - RNA, 19 nt, Homo sapiens
ccagcaaaccuucuaccaa

SEQ ID NO: 984733 - RNA, 19 nt, Homo sapiens
ugugugagcauguguguga

SEQ ID NO: 984734 - RNA, 19 nt, Homo sapiens
cagccugccugcuuugaca

SEQ ID NO: 984735 - RNA, 19 nt, Homo sapiens
gaagaaguggaggcaguga

SEQ ID NO: 984736 - RNA, 19 nt, Homo sapiens
acacgccgaugcccgaguu

SEQ ID NO: 984737 - RNA, 19 nt, Homo sapiens
accugaagcugcgcuauaa

SEQ ID NO: 984738 - RNA, 19 nt, Homo sapiens
ucucugagcccaaccugaa

SEQ ID NO: 984739 - RNA, 19 nt, Homo sapiens
cugccugcuuugacaguua

SEQ ID NO: 984740 - RNA, 19 nt, Homo sapiens
ggugucugcuggauuugau

SEQ ID NO: 984741 - RNA, 19 nt, Homo sapiens
ccagugugcucuacaucuc

SEQ ID NO: 984742 - RNA, 19 nt, Homo sapiens
ugcagucgguccacucuga

SEQ ID NO: 984743 - RNA, 19 nt, Homo sapiens
ggucagccaagccgaguga

SEQ ID NO: 984744 - RNA, 19 nt, Homo sapiens
ugugugagcguguguguga

SEQ ID NO: 984745 - RNA, 19 nt, Homo sapiens
caggaccacgacaggauua

SEQ ID NO: 984746 - RNA, 19 nt, Homo sapiens
ugauccgggugcacaguaa

SEQ ID NO: 984747 - RNA, 19 nt, Homo sapiens
ugacgcagcaacugaugaa

SEQ ID NO: 984748 - RNA, 19 nt, Homo sapiens
gcagagacccucggagacu

SEQ ID NO: 984749 - RNA, 19 nt, Homo sapiens
ggagccaagaggucccaua

SEQ ID NO: 984750 - RNA, 19 nt, Homo sapiens
gggaccugguucucuucua

SEQ ID NO: 984751 - RNA, 19 nt, Homo sapiens
gaaccuaugaaucucuaag

SEQ ID NO: 984752 - RNA, 19 nt, Homo sapiens
gaagaccuggagacagaug

SEQ ID NO: 984753 - RNA, 19 nt, Homo sapiens
ggaggcugcucuggcaaag

SEQ ID NO: 984754 - RNA, 19 nt, Homo sapiens
gagacgaagcucccugaca

SEQ ID NO: 984755 - RNA, 19 nt, Homo sapiens
ccgucgggcucacccuuaa

SEQ ID NO: 984756 - RNA, 19 nt, Homo sapiens
gaccacgacaggauuaagu

SEQ ID NO: 984757 - RNA, 19 nt, Homo sapiens
cagccaagccgagugagaa

SEQ ID NO: 984758 - RNA, 19 nt, Homo sapiens
gagugaggcgugugugugu

SEQ ID NO: 984759 - RNA, 19 nt, Homo sapiens
ggcagcuucuccacaagga

SEQ ID NO: 984760 - RNA, 19 nt, Homo sapiens
ggcucacccuuaaccacua

SEQ ID NO: 984761 - RNA, 19 nt, Homo sapiens
cagaaacccaaccucaaug

SEQ ID NO: 984762 - RNA, 19 nt, Homo sapiens
cuaccauguuucugccaaa

SEQ ID NO: 984763 - RNA, 19 nt, Homo sapiens
ccacgacaggauuaaguga

SEQ ID NO: 984764 - RNA, 19 nt, Homo sapiens
cagauacccucggcugaag

SEQ ID NO: 984765 - RNA, 19 nt, Homo sapiens
gggaggcugcucuggcaaa

SEQ ID NO: 984766 - RNA, 19 nt, Homo sapiens
ugacgacggcaacuucuuc

SEQ ID NO: 984767 - RNA, 19 nt, Homo sapiens
cucgugagcuaaagaaugg

SEQ ID NO: 984768 - RNA, 19 nt, Homo sapiens
gcucagccgccucaaacug

SEQ ID NO: 984769 - RNA, 19 nt, Homo sapiens
ggcaacggcacccagcaaa

SEQ ID NO: 984770 - RNA, 19 nt, Homo sapiens
agcaagauccucauuguag

SEQ ID NO: 984771 - RNA, 19 nt, Homo sapiens
ggacugagauugcuuacaa

SEQ ID NO: 984772 - RNA, 19 nt, Homo sapiens
caacacacauuguaaacua

SEQ ID NO: 984773 - RNA, 19 nt, Homo sapiens
ucacugggcucccucuuua

SEQ ID NO: 984774 - RNA, 19 nt, Homo sapiens
gcaagaguauaguauggua

SEQ ID NO: 984775 - RNA, 19 nt, Homo sapiens
gaguuggucuuuagguuua

SEQ ID NO: 984776 - RNA, 19 nt, Homo sapiens
ggucauauuugagaacaua

SEQ ID NO: 984777 - RNA, 19 nt, Homo sapiens
cugaauaacuugaguguga

SEQ ID NO: 984778 - RNA, 19 nt, Homo sapiens
gaacucaucugugcagcuu

SEQ ID NO: 984779 - RNA, 19 nt, Homo sapiens
gcaaugagagcaagaguau

SEQ ID NO: 984780 - RNA, 19 nt, Homo sapiens
ugaguaagcucccuucugu

SEQ ID NO: 984781 - RNA, 19 nt, Homo sapiens
caaacuugcugaacauaug

SEQ ID NO: 984782 - RNA, 19 nt, Homo sapiens
gaauagaaagucaccauga

SEQ ID NO: 984783 - RNA, 19 nt, Homo sapiens
gaaggaaauugucccgaau

SEQ ID NO: 984784 - RNA, 19 nt, Homo sapiens
uaacaaugcugcuuaugca

SEQ ID NO: 984785 - RNA, 19 nt, Homo sapiens
uauaaugacuggucugaug

SEQ ID NO: 984786 - RNA, 19 nt, Homo sapiens
gaagcaacacacauuguaa

SEQ ID NO: 984787 - RNA, 19 nt, Homo sapiens
gaauaucacuacuuguucu

SEQ ID NO: 984788 - RNA, 19 nt, Homo sapiens
ucgcaaagauucucaauac

SEQ ID NO: 984789 - RNA, 19 nt, Homo sapiens
gcagguggcuccgcuugaa

SEQ ID NO: 984790 - RNA, 19 nt, Homo sapiens
uaagcucccuucugucauu

SEQ ID NO: 984791 - RNA, 19 nt, Homo sapiens
gagcaagaguauaguaugg

SEQ ID NO: 984792 - RNA, 19 nt, Homo sapiens
ugaaguggcugaagacgau

SEQ ID NO: 984793 - RNA, 19 nt, Homo sapiens
gaaaaucagcgcaggcuua

SEQ ID NO: 984794 - RNA, 19 nt, Homo sapiens
gaagaggaaggaauuuaau

SEQ ID NO: 984795 - RNA, 19 nt, Homo sapiens
gaaaagccuuauauucuug

SEQ ID NO: 984796 - RNA, 19 nt, Homo sapiens
gaaaacagaacaaggaaaa

SEQ ID NO: 984797 - RNA, 19 nt, Homo sapiens
ggaauaacaccuugauuuu

SEQ ID NO: 984798 - RNA, 19 nt, Homo sapiens
gcaaagauucucaauacuc

SEQ ID NO: 984799 - RNA, 19 nt, Homo sapiens
uagaaagucaccaugauuu

SEQ ID NO: 984800 - RNA, 19 nt, Homo sapiens
ugacuggucugaugaugau

SEQ ID NO: 984801 - RNA, 19 nt, Homo sapiens
ccaccuuguuuauauggua

SEQ ID NO: 984802 - RNA, 19 nt, Homo sapiens
cugccuagauugaaauauu

SEQ ID NO: 984803 - RNA, 19 nt, Homo sapiens
gagauugcuuacaaauaug

SEQ ID NO: 984804 - RNA, 19 nt, Homo sapiens
aaaugaaccuacucagaau

SEQ ID NO: 984805 - RNA, 19 nt, Homo sapiens
gaagaaaacagaacaagga

SEQ ID NO: 984806 - RNA, 19 nt, Homo sapiens
aggaauaacaccuugauuu

SEQ ID NO: 984807 - RNA, 19 nt, Homo sapiens
caaagagccaggaauaaca

SEQ ID NO: 984808 - RNA, 19 nt, Homo sapiens
ugauaagguucugggaaua

SEQ ID NO: 984809 - RNA, 19 nt, Homo sapiens
gaugaugacagcaaugaga

SEQ ID NO: 984810 - RNA, 19 nt, Homo sapiens
ugggcucccucuuuaauaa

SEQ ID NO: 984811 - RNA, 19 nt, Homo sapiens
gaaaugaagaaaccaaacu

SEQ ID NO: 984812 - RNA, 19 nt, Homo sapiens
cuaauuccauuucugacuu

SEQ ID NO: 984813 - RNA, 19 nt, Homo sapiens
guagagauuggaaagauug

SEQ ID NO: 984814 - RNA, 19 nt, Homo sapiens
auacaugaaucaagugugu

SEQ ID NO: 984815 - RNA, 19 nt, Homo sapiens
ggucugaugaugaugauga

SEQ ID NO: 984816 - RNA, 19 nt, Homo sapiens
gaaguuuccuccgaucagu

SEQ ID NO: 984817 - RNA, 19 nt, Homo sapiens
agaagaggaaggaauuuaa

SEQ ID NO: 984818 - RNA, 19 nt, Homo sapiens
uguuaaugcuggaaagaaa

SEQ ID NO: 984819 - RNA, 19 nt, Homo sapiens
gaaaaugaaccuacucaga

SEQ ID NO: 984820 - RNA, 19 nt, Homo sapiens
gagauuggaaagauuguug

SEQ ID NO: 984821 - RNA, 19 nt, Homo sapiens
gcacaugcuugcuaauucc

SEQ ID NO: 984822 - RNA, 19 nt, Homo sapiens
ggaagaggagaaggaaauu

SEQ ID NO: 984823 - RNA, 19 nt, Homo sapiens
gaagaggagaaggaaauug

SEQ ID NO: 984824 - RNA, 19 nt, Homo sapiens
ggucguuguucccgucuga

SEQ ID NO: 984825 - RNA, 19 nt, Homo sapiens
gaaccuacucagaaucaau

SEQ ID NO: 984826 - RNA, 19 nt, Homo sapiens
ccaauugucgcaaagauuc

SEQ ID NO: 984827 - RNA, 19 nt, Homo sapiens
caguagagauuggaaagau

SEQ ID NO: 984828 - RNA, 19 nt, Homo sapiens
cugcauaagugacagugaa

SEQ ID NO: 984829 - RNA, 19 nt, Homo sapiens
agaagcaacacacauugua

SEQ ID NO: 984830 - RNA, 19 nt, Homo sapiens
ggguaacaaugcugcuuau

SEQ ID NO: 984831 - RNA, 19 nt, Homo sapiens
uaauugcucuggguaacaa

SEQ ID NO: 984832 - RNA, 19 nt, Homo sapiens
gagagcaagaguauaguau

SEQ ID NO: 984833 - RNA, 19 nt, Homo sapiens
gagcugacgugugcagaag

SEQ ID NO: 984834 - RNA, 19 nt, Homo sapiens
ggccaaacuugcugaacau

SEQ ID NO: 984835 - RNA, 19 nt, Homo sapiens
aauagaaagucaccaugau

SEQ ID NO: 984836 - RNA, 19 nt, Homo sapiens
ucaagugugugcugauaag

SEQ ID NO: 984837 - RNA, 19 nt, Homo sapiens
gggcuacgccaggaaagua

SEQ ID NO: 984838 - RNA, 19 nt, Homo sapiens
guucuuugcuugguugaga

SEQ ID NO: 984839 - RNA, 19 nt, Homo sapiens
aagaagaggaaggaauuua

SEQ ID NO: 984840 - RNA, 19 nt, Homo sapiens
uaucacuacuuguucugaa

SEQ ID NO: 984841 - RNA, 19 nt, Homo sapiens
gaagcgagggaggaaguuu

SEQ ID NO: 984842 - RNA, 19 nt, Homo sapiens
cugauaagguucugggaau

SEQ ID NO: 984843 - RNA, 19 nt, Homo sapiens
aaacuucuggucauauuug

SEQ ID NO: 984844 - RNA, 19 nt, Homo sapiens
cagcgcaggcuuaaaguau

SEQ ID NO: 984845 - RNA, 19 nt, Homo sapiens
ugaauaacuugagugugaa

SEQ ID NO: 984846 - RNA, 19 nt, Homo sapiens
gcgaacugcuugucuugag

SEQ ID NO: 984847 - RNA, 19 nt, Homo sapiens
gauuugagggucugcugua

SEQ ID NO: 984848 - RNA, 19 nt, Homo sapiens
ucccaaagagccaggaaua

SEQ ID NO: 984849 - RNA, 19 nt, Homo sapiens
gaaaauucauggccaaacu

SEQ ID NO: 984850 - RNA, 19 nt, Homo sapiens
gcucagggcccaaguacca

SEQ ID NO: 984851 - RNA, 19 nt, Homo sapiens
acaaucacuucucgcuuga

SEQ ID NO: 984852 - RNA, 19 nt, Homo sapiens
gcgcaggcuuaaaguauac

SEQ ID NO: 984853 - RNA, 19 nt, Homo sapiens
uuucaagugugugcugaua

SEQ ID NO: 984854 - RNA, 19 nt, Homo sapiens
gaaaauccagccaugacua

SEQ ID NO: 984855 - RNA, 19 nt, Homo sapiens
gggaaaugaagaaaccaaa

SEQ ID NO: 984856 - RNA, 19 nt, Homo sapiens
gacugagauugcuuacaaa

SEQ ID NO: 984857 - RNA, 19 nt, Homo sapiens
gggcucggauugggacuga

SEQ ID NO: 984858 - RNA, 19 nt, Homo sapiens
gguggccagucuuucugua

SEQ ID NO: 984859 - RNA, 19 nt, Homo sapiens
gaucaguagagauuggaaa

SEQ ID NO: 984860 - RNA, 19 nt, Homo sapiens
ugaguuggucuuuagguuu

SEQ ID NO: 984861 - RNA, 19 nt, Homo sapiens
gcuggacugagauugcuua

SEQ ID NO: 984862 - RNA, 19 nt, Homo sapiens
gcuuuaauuguccugaaua

SEQ ID NO: 984863 - RNA, 19 nt, Homo sapiens
ugagagcaagaguauagua

SEQ ID NO: 984864 - RNA, 19 nt, Homo sapiens
caccuuguuuauaugguaa

SEQ ID NO: 984865 - RNA, 19 nt, Homo sapiens
uggccaaacuugcugaaca

SEQ ID NO: 984866 - RNA, 19 nt, Homo sapiens
ucuuaaacuucuggucaua

SEQ ID NO: 984867 - RNA, 19 nt, Homo sapiens
ggcuuaaaguauacaugaa

SEQ ID NO: 984868 - RNA, 19 nt, Homo sapiens
gggaucccauaguuaagga

SEQ ID NO: 984869 - RNA, 19 nt, Homo sapiens
guaacaaugcugcuuaugc

SEQ ID NO: 984870 - RNA, 19 nt, Homo sapiens
aaugagagcaagaguauag

SEQ ID NO: 984871 - RNA, 19 nt, Homo sapiens
caaaugaacucuaaucuug

SEQ ID NO: 984872 - RNA, 19 nt, Homo sapiens
gaaaugagcuuugccuuau

SEQ ID NO: 984873 - RNA, 19 nt, Homo sapiens
gaacucuaaucuuggaaua

SEQ ID NO: 984874 - RNA, 19 nt, Homo sapiens
gccaagagauuauuccuuu

SEQ ID NO: 984875 - RNA, 19 nt, Homo sapiens
gaugugaggccauuuaaua

SEQ ID NO: 984876 - RNA, 19 nt, Homo sapiens
ggaaaugagcuuugccuua

SEQ ID NO: 984877 - RNA, 19 nt, Homo sapiens
gcaccgaaauaguuaauau

SEQ ID NO: 984878 - RNA, 19 nt, Homo sapiens
gaagagacauagccuuuua

SEQ ID NO: 984879 - RNA, 19 nt, Homo sapiens
gaagaaaucaagagugaaa

SEQ ID NO: 984880 - RNA, 19 nt, Homo sapiens
gcacaaagccugucagagu

SEQ ID NO: 984881 - RNA, 19 nt, Homo sapiens
gggacuggauccuuuauuu

SEQ ID NO: 984882 - RNA, 19 nt, Homo sapiens
gaauaacugcugcuuguaa

SEQ ID NO: 984883 - RNA, 19 nt, Homo sapiens
gaagagggacacauuauuc

SEQ ID NO: 984884 - RNA, 19 nt, Homo sapiens
gcagaagagggacacauua

SEQ ID NO: 984885 - RNA, 19 nt, Homo sapiens
guacagcccagaugugaua

SEQ ID NO: 984886 - RNA, 19 nt, Homo sapiens
agagucagcuacaguuaua

SEQ ID NO: 984887 - RNA, 19 nt, Homo sapiens
gaacgaaugaaucaguuaa

SEQ ID NO: 984888 - RNA, 19 nt, Homo sapiens
gaugacagcuauucuacau

SEQ ID NO: 984889 - RNA, 19 nt, Homo sapiens
gaagauacucagcaagaaa

SEQ ID NO: 984890 - RNA, 19 nt, Homo sapiens
uuaaguagaugacagcuau

SEQ ID NO: 984891 - RNA, 19 nt, Homo sapiens
auugaaaccuuauggcuua

SEQ ID NO: 984892 - RNA, 19 nt, Homo sapiens
ugacagcuauucuacauca

SEQ ID NO: 984893 - RNA, 19 nt, Homo sapiens
ucucugagcuaauguuuau

SEQ ID NO: 984894 - RNA, 19 nt, Homo sapiens
cuaaagaagagaucaagua

SEQ ID NO: 984895 - RNA, 19 nt, Homo sapiens
caagaccuauguugaccua

SEQ ID NO: 984896 - RNA, 19 nt, Homo sapiens
gaaggauauuucacagcua

SEQ ID NO: 984897 - RNA, 19 nt, Homo sapiens
aaagggcucugaacuccua

SEQ ID NO: 984898 - RNA, 19 nt, Homo sapiens
gaggcaaaguuaagcuuga

SEQ ID NO: 984899 - RNA, 19 nt, Homo sapiens
cucauuaccuggaauauug

SEQ ID NO: 984900 - RNA, 19 nt, Homo sapiens
gaaaugcuuuacaggaagu

SEQ ID NO: 984901 - RNA, 19 nt, Homo sapiens
ucacagcuauaauguugaa

SEQ ID NO: 984902 - RNA, 19 nt, Homo sapiens
cacaaagccugucagaguu

SEQ ID NO: 984903 - RNA, 19 nt, Homo sapiens
ggaaauaauguacuagauc

SEQ ID NO: 984904 - RNA, 19 nt, Homo sapiens
ggaacgaaugaaucaguua

SEQ ID NO: 984905 - RNA, 19 nt, Homo sapiens
uggaaaugcuuuacaggaa

SEQ ID NO: 984906 - RNA, 19 nt, Homo sapiens
agacauagccuuuuaguuu

SEQ ID NO: 984907 - RNA, 19 nt, Homo sapiens
caacagaggcaaaguuaag

SEQ ID NO: 984908 - RNA, 19 nt, Homo sapiens
uuucacagcuauaauguug

SEQ ID NO: 984909 - RNA, 19 nt, Homo sapiens
uauuacaggucaugaagaa

SEQ ID NO: 984910 - RNA, 19 nt, Homo sapiens
gcaaaguuaagcuugauga

SEQ ID NO: 984911 - RNA, 19 nt, Homo sapiens
uggaauaacugcugcuugu

SEQ ID NO: 984912 - RNA, 19 nt, Homo sapiens
ccuaaacauugccaguaua

SEQ ID NO: 984913 - RNA, 19 nt, Homo sapiens
cagcccagaugugauauuu

SEQ ID NO: 984914 - RNA, 19 nt, Homo sapiens
uaagcuugaugaugguuaa

SEQ ID NO: 984915 - RNA, 19 nt, Homo sapiens
gaaauggaaaugcuuuaca

SEQ ID NO: 984916 - RNA, 19 nt, Homo sapiens
gcccagaugugauauuucu

SEQ ID NO: 984917 - RNA, 19 nt, Homo sapiens
uggaggaaauaauguacua

SEQ ID NO: 984918 - RNA, 19 nt, Homo sapiens
cagcuauaauguugaagaa

SEQ ID NO: 984919 - RNA, 19 nt, Homo sapiens
gaccugaaaccaucucuga

SEQ ID NO: 984920 - RNA, 19 nt, Homo sapiens
gucaacagaggcaaaguua

SEQ ID NO: 984921 - RNA, 19 nt, Homo sapiens
gauuaucugcaguuaagua

SEQ ID NO: 984922 - RNA, 19 nt, Homo sapiens
gggcgagccugaggugaaa

SEQ ID NO: 984923 - RNA, 19 nt, Homo sapiens
guuuggaccuucuuggauu

SEQ ID NO: 984924 - RNA, 19 nt, Homo sapiens
aauaacugcugcuuguaaa

SEQ ID NO: 984925 - RNA, 19 nt, Homo sapiens
ucuaagggaucgagagguu

SEQ ID NO: 984926 - RNA, 19 nt, Homo sapiens
gacauagccuuuuaguuuu

SEQ ID NO: 984927 - RNA, 19 nt, Homo sapiens
aaacuggacugugguagau

SEQ ID NO: 984928 - RNA, 19 nt, Homo sapiens
ggauauuucacagcuauaa

SEQ ID NO: 984929 - RNA, 19 nt, Homo sapiens
ugaagauacucagcaagaa

SEQ ID NO: 984930 - RNA, 19 nt, Homo sapiens
gaacacauuccugcauuca

SEQ ID NO: 984931 - RNA, 19 nt, Homo sapiens
gaggaaauaauguacuaga

SEQ ID NO: 984932 - RNA, 19 nt, Homo sapiens
ugagaaaccuuuuaugugu

SEQ ID NO: 984933 - RNA, 19 nt, Homo sapiens
guaccaaaaugaugagaaa

SEQ ID NO: 984934 - RNA, 19 nt, Homo sapiens
ccuggaauauugauggauu

SEQ ID NO: 984935 - RNA, 19 nt, Homo sapiens
caacugauuccaccacuuc

SEQ ID NO: 984936 - RNA, 19 nt, Homo sapiens
ggacuggauccuuuauuuc

SEQ ID NO: 984937 - RNA, 19 nt, Homo sapiens
ugugguagauuuccuagug

SEQ ID NO: 984938 - RNA, 19 nt, Homo sapiens
gaacgugucaggaaaugag

SEQ ID NO: 984939 - RNA, 19 nt, Homo sapiens
cuggauccuuuauuucaua

SEQ ID NO: 984940 - RNA, 19 nt, Homo sapiens
ggaauaacugcugcuugua

SEQ ID NO: 984941 - RNA, 19 nt, Homo sapiens
aaugagcuuugccuuauga

SEQ ID NO: 984942 - RNA, 19 nt, Homo sapiens
agcauguucucucucauua

SEQ ID NO: 984943 - RNA, 19 nt, Homo sapiens
ugaccuaaccaaugaagaa

SEQ ID NO: 984944 - RNA, 19 nt, Homo sapiens
gguaagcuauaauugaaac

SEQ ID NO: 984945 - RNA, 19 nt, Homo sapiens
gaaaaugccaugauuaucu

SEQ ID NO: 984946 - RNA, 19 nt, Homo sapiens
cuagaucauugucacagaa

SEQ ID NO: 984947 - RNA, 19 nt, Homo sapiens
ggucuucugugcaacuuag

SEQ ID NO: 984948 - RNA, 19 nt, Homo sapiens
ucucugagcccaagaccua

SEQ ID NO: 984949 - RNA, 19 nt, Homo sapiens
gagaucaaguaauuaugag

SEQ ID NO: 984950 - RNA, 19 nt, Homo sapiens
ccaugauuaucugcaguua

SEQ ID NO: 984951 - RNA, 19 nt, Homo sapiens
ucaggcaccgaaauaguua

SEQ ID NO: 984952 - RNA, 19 nt, Homo sapiens
ugugauauuucuacaggaa

SEQ ID NO: 984953 - RNA, 19 nt, Homo sapiens
ccaaugaagaaacaacuga

SEQ ID NO: 984954 - RNA, 19 nt, Homo sapiens
auaaaugcaugaagagaca

SEQ ID NO: 984955 - RNA, 19 nt, Homo sapiens
ccauucaggcaccgaaaua

SEQ ID NO: 984956 - RNA, 19 nt, Homo sapiens
caggaugugaggccauuua

SEQ ID NO: 984957 - RNA, 19 nt, Homo sapiens
cagaagagggacacauuau

SEQ ID NO: 984958 - RNA, 19 nt, Homo sapiens
ccagagucagcuacaguua

SEQ ID NO: 984959 - RNA, 19 nt, Homo sapiens
uacaugggauacacaaaug

SEQ ID NO: 984960 - RNA, 19 nt, Homo sapiens
ccuaaccaaugaagaaaca

SEQ ID NO: 984961 - RNA, 19 nt, Homo sapiens
aaggauauuucacagcuau

SEQ ID NO: 984962 - RNA, 19 nt, Homo sapiens
uacaggaaguaaaugcaaa

SEQ ID NO: 984963 - RNA, 19 nt, Homo sapiens
gaaaccuuauggcuuaaaa

SEQ ID NO: 984964 - RNA, 19 nt, Homo sapiens
gacuggauccuuuauuuca

SEQ ID NO: 984965 - RNA, 19 nt, Homo sapiens
cggaacgaaugaaucaguu

SEQ ID NO: 984966 - RNA, 19 nt, Homo sapiens
guuccuacuuagcuuugua

SEQ ID NO: 984967 - RNA, 19 nt, Homo sapiens
cuggaauauugauggauua

SEQ ID NO: 984968 - RNA, 19 nt, Homo sapiens
ggcagcauguucucucuca

SEQ ID NO: 984969 - RNA, 19 nt, Homo sapiens
cgaacacauuccugcauuc

SEQ ID NO: 984970 - RNA, 19 nt, Homo sapiens
ccaacuaugauuuaugguu

SEQ ID NO: 984971 - RNA, 19 nt, Homo sapiens
caaaugaacagcaggauua

SEQ ID NO: 984972 - RNA, 19 nt, Homo sapiens
gcaacaagugcaauuauua

SEQ ID NO: 984973 - RNA, 19 nt, Homo sapiens
gcagaagaauuuaaaguuc

SEQ ID NO: 984974 - RNA, 19 nt, Homo sapiens
gacauagucuuaaguagaa

SEQ ID NO: 984975 - RNA, 19 nt, Homo sapiens
cggaagugcugaugaguua

SEQ ID NO: 984976 - RNA, 19 nt, Homo sapiens
aaucaaagcccauuaauga

SEQ ID NO: 984977 - RNA, 19 nt, Homo sapiens
gaagaaggcaguuagagaa

SEQ ID NO: 984978 - RNA, 19 nt, Homo sapiens
aaauuugccugcuguguua

SEQ ID NO: 984979 - RNA, 19 nt, Homo sapiens
gaagaaaucaguaucuaug

SEQ ID NO: 984980 - RNA, 19 nt, Homo sapiens
gaagagggaaugcguauga

SEQ ID NO: 984981 - RNA, 19 nt, Homo sapiens
acagcaggauuaugaauua

SEQ ID NO: 984982 - RNA, 19 nt, Homo sapiens
gaauagacauaucagugaa

SEQ ID NO: 984983 - RNA, 19 nt, Homo sapiens
caccaggagucaaugauua

SEQ ID NO: 984984 - RNA, 19 nt, Homo sapiens
caaagaaugauguguguaa

SEQ ID NO: 984985 - RNA, 19 nt, Homo sapiens
ucacagcagucuuaaaguu

SEQ ID NO: 984986 - RNA, 19 nt, Homo sapiens
gaacugcggauuauuccua

SEQ ID NO: 984987 - RNA, 19 nt, Homo sapiens
gcagaaugauuugaaguau

SEQ ID NO: 984988 - RNA, 19 nt, Homo sapiens
uguaguggcuuucauuaaa

SEQ ID NO: 984989 - RNA, 19 nt, Homo sapiens
acauaucagugaacaguua

SEQ ID NO: 984990 - RNA, 19 nt, Homo sapiens
ugaauuagccaacuguuaa

SEQ ID NO: 984991 - RNA, 19 nt, Homo sapiens
gcaggauuaugaauuauca

SEQ ID NO: 984992 - RNA, 19 nt, Homo sapiens
gaucaccaggcuucuauua

SEQ ID NO: 984993 - RNA, 19 nt, Homo sapiens
gaagugcugaugaguuaua

SEQ ID NO: 984994 - RNA, 19 nt, Homo sapiens
gaauuaaggcuacuacugu

SEQ ID NO: 984995 - RNA, 19 nt, Homo sapiens
acaaguagcuucaagaaac

SEQ ID NO: 984996 - RNA, 19 nt, Homo sapiens
gugcaauuauuaccaauga

SEQ ID NO: 984997 - RNA, 19 nt, Homo sapiens
caguuuacaugcauuauug

SEQ ID NO: 984998 - RNA, 19 nt, Homo sapiens
caaagcccauuaaugauuc

SEQ ID NO: 984999 - RNA, 19 nt, Homo sapiens
guagcaaaguguuacagaa

SEQ ID NO: 985000 - RNA, 19 nt, Homo sapiens
acgauugccuuucagaaua

SEQ ID NO: 985001 - RNA, 19 nt, Homo sapiens
caagugcaauuauuaccaa

SEQ ID NO: 985002 - RNA, 19 nt, Homo sapiens
gaacacccauuuccugacu

SEQ ID NO: 985003 - RNA, 19 nt, Homo sapiens
uaaauagcauucaggaaca

SEQ ID NO: 985004 - RNA, 19 nt, Homo sapiens
gaagugaauagacauauca

SEQ ID NO: 985005 - RNA, 19 nt, Homo sapiens
caacagaaucagcauuuga

SEQ ID NO: 985006 - RNA, 19 nt, Homo sapiens
uaagaucagucacccaugu

SEQ ID NO: 985007 - RNA, 19 nt, Homo sapiens
gaaaucaaagcccauuaau

SEQ ID NO: 985008 - RNA, 19 nt, Homo sapiens
gaugcuaccucacaacaca

SEQ ID NO: 985009 - RNA, 19 nt, Homo sapiens
gggaaugcguaugaauuaa

SEQ ID NO: 985010 - RNA, 19 nt, Homo sapiens
ucaaagcccauuaaugauu

SEQ ID NO: 985011 - RNA, 19 nt, Homo sapiens
cgaaaucaaagcccauuaa

SEQ ID NO: 985012 - RNA, 19 nt, Homo sapiens
ggaagaaaucaguaucuau

SEQ ID NO: 985013 - RNA, 19 nt, Homo sapiens
cgauugccuuucagaauaa

SEQ ID NO: 985014 - RNA, 19 nt, Homo sapiens
guaguggcuuucauuaaau

SEQ ID NO: 985015 - RNA, 19 nt, Homo sapiens
gaaaucaguaucuaugcaa

SEQ ID NO: 985016 - RNA, 19 nt, Homo sapiens
gaggaaagcaacagaggaa

SEQ ID NO: 985017 - RNA, 19 nt, Homo sapiens
gcagacucauaauuugauu

SEQ ID NO: 985018 - RNA, 19 nt, Homo sapiens
caaaugaauuagccaacug

SEQ ID NO: 985019 - RNA, 19 nt, Homo sapiens
gacccuggauggcaauuug

SEQ ID NO: 985020 - RNA, 19 nt, Homo sapiens
gagggaaugcguaugaauu

SEQ ID NO: 985021 - RNA, 19 nt, Homo sapiens
gcaauuauuaccaaugaug

SEQ ID NO: 985022 - RNA, 19 nt, Homo sapiens
gaacagcaggauuaugaau

SEQ ID NO: 985023 - RNA, 19 nt, Homo sapiens
gugcugaugaguuauauuu

SEQ ID NO: 985024 - RNA, 19 nt, Homo sapiens
gcaaaugaauuagccaacu

SEQ ID NO: 985025 - RNA, 19 nt, Homo sapiens
gaucuguaauuucuuugug

SEQ ID NO: 985026 - RNA, 19 nt, Homo sapiens
cauuugaaguguaccauug

SEQ ID NO: 985027 - RNA, 19 nt, Homo sapiens
cggaagaaaucaguaucua

SEQ ID NO: 985028 - RNA, 19 nt, Homo sapiens
caaaauaccccuuaugaga

SEQ ID NO: 985029 - RNA, 19 nt, Homo sapiens
ugacauagucuuaaguaga

SEQ ID NO: 985030 - RNA, 19 nt, Homo sapiens
ucaccaggcuucuauuaag

SEQ ID NO: 985031 - RNA, 19 nt, Homo sapiens
gaucggaagugcugaugag

SEQ ID NO: 985032 - RNA, 19 nt, Homo sapiens
ucagaccucaguuauauaa

SEQ ID NO: 985033 - RNA, 19 nt, Homo sapiens
acuguuaacuggaagcuuu

SEQ ID NO: 985034 - RNA, 19 nt, Homo sapiens
uaaaguuccugcugcaaca

SEQ ID NO: 985035 - RNA, 19 nt, Homo sapiens
gaacauacgauugccuuuc

SEQ ID NO: 985036 - RNA, 19 nt, Homo sapiens
caacagaggaaacagugaa

SEQ ID NO: 985037 - RNA, 19 nt, Homo sapiens
gaaagcaacagaggaaaca

SEQ ID NO: 985038 - RNA, 19 nt, Homo sapiens
ugaauagacauaucaguga

SEQ ID NO: 985039 - RNA, 19 nt, Homo sapiens
gaugaagugaauagacaua

SEQ ID NO: 985040 - RNA, 19 nt, Homo sapiens
aaacaaguagcuucaagaa

SEQ ID NO: 985041 - RNA, 19 nt, Homo sapiens
ggaccuauagaauccagua

SEQ ID NO: 985042 - RNA, 19 nt, Homo sapiens
aaucuaacccuuaugugua

SEQ ID NO: 985043 - RNA, 19 nt, Homo sapiens
aggagucaaugauuaauga

SEQ ID NO: 985044 - RNA, 19 nt, Homo sapiens
ugaauaagaagccaggaaa

SEQ ID NO: 985045 - RNA, 19 nt, Homo sapiens
uuaaggaagugcuaagauc

SEQ ID NO: 985046 - RNA, 19 nt, Homo sapiens
auucagaccucaguuauau

SEQ ID NO: 985047 - RNA, 19 nt, Homo sapiens
gauucagaccucaguuaua

SEQ ID NO: 985048 - RNA, 19 nt, Homo sapiens
gaaugcguaugaauuaagg

SEQ ID NO: 985049 - RNA, 19 nt, Homo sapiens
gcccauuaaugauucagaa

SEQ ID NO: 985050 - RNA, 19 nt, Homo sapiens
uagcaaaguguuacagaaa

SEQ ID NO: 985051 - RNA, 19 nt, Homo sapiens
ucagugaacaguuaacuau

SEQ ID NO: 985052 - RNA, 19 nt, Homo sapiens
aaucagcauuugaagugua

SEQ ID NO: 985053 - RNA, 19 nt, Homo sapiens
uucaguaucuucucuauca

SEQ ID NO: 985054 - RNA, 19 nt, Homo sapiens
cuacuggccuugucaacau

SEQ ID NO: 985055 - RNA, 19 nt, Homo sapiens
caaaauacuugacauaguc

SEQ ID NO: 985056 - RNA, 19 nt, Homo sapiens
gaagugcuaagaucaguca

SEQ ID NO: 985057 - RNA, 19 nt, Homo sapiens
ggaaauacagaucggaagu

SEQ ID NO: 985058 - RNA, 19 nt, Homo sapiens
gcaccaccaugucgaaggu

SEQ ID NO: 985059 - RNA, 19 nt, Homo sapiens
guuggaaguuguuaauauc

SEQ ID NO: 985060 - RNA, 19 nt, Homo sapiens
gaaguguaguggcuuucau

SEQ ID NO: 985061 - RNA, 19 nt, Homo sapiens
uaagaagccaggaaaggaa

SEQ ID NO: 985062 - RNA, 19 nt, Homo sapiens
gauggaauaggaauaaauc

SEQ ID NO: 985063 - RNA, 19 nt, Homo sapiens
gagaucguguuggaaguug

SEQ ID NO: 985064 - RNA, 19 nt, Homo sapiens
ggugggaauuuacaguaga

SEQ ID NO: 985065 - RNA, 19 nt, Homo sapiens
ccuauagaauccaguacuu

SEQ ID NO: 985066 - RNA, 19 nt, Homo sapiens
ggaauaaauccugcacaga

SEQ ID NO: 985067 - RNA, 19 nt, Homo sapiens
acagacugcuggaaauguu

SEQ ID NO: 985068 - RNA, 19 nt, Homo sapiens
gaauuuaugaacacccauu

SEQ ID NO: 985069 - RNA, 19 nt, Homo sapiens
aagcaggaauuuaugaaca

SEQ ID NO: 985070 - RNA, 19 nt, Homo sapiens
ggaacagaguauuauugca

SEQ ID NO: 985071 - RNA, 19 nt, Homo sapiens
gaaaugggaugcucacaaa

SEQ ID NO: 985072 - RNA, 19 nt, Homo sapiens
gaugaaaccuauagugaua

SEQ ID NO: 985073 - RNA, 19 nt, Homo sapiens
agaagaagcuaguucauua

SEQ ID NO: 985074 - RNA, 19 nt, Homo sapiens
gaaagacucuguaguagga

SEQ ID NO: 985075 - RNA, 19 nt, Homo sapiens
gaugaaaguuccugggaua

SEQ ID NO: 985076 - RNA, 19 nt, Homo sapiens
guaaacaugugcaaucaaa

SEQ ID NO: 985077 - RNA, 19 nt, Homo sapiens
caaaacagcucuccucaua

SEQ ID NO: 985078 - RNA, 19 nt, Homo sapiens
gaaggaaaguucuguugga

SEQ ID NO: 985079 - RNA, 19 nt, Homo sapiens
ggacugauuugucucuuga

SEQ ID NO: 985080 - RNA, 19 nt, Homo sapiens
gagaagaaaucguguccuu

SEQ ID NO: 985081 - RNA, 19 nt, Homo sapiens
gaacaaauagccacaagug

SEQ ID NO: 985082 - RNA, 19 nt, Homo sapiens
gaaaguuccugggauaaug

SEQ ID NO: 985083 - RNA, 19 nt, Homo sapiens
gaucgcaauucacuucuaa

SEQ ID NO: 985084 - RNA, 19 nt, Homo sapiens
ggacggacauuucgagauc

SEQ ID NO: 985085 - RNA, 19 nt, Homo sapiens
aggaagaagugcacgauua

SEQ ID NO: 985086 - RNA, 19 nt, Homo sapiens
caugaaagacucuguagua

SEQ ID NO: 985087 - RNA, 19 nt, Homo sapiens
ccaaucagguguaaacaug

SEQ ID NO: 985088 - RNA, 19 nt, Homo sapiens
gggaagacuuggauagcua

SEQ ID NO: 985089 - RNA, 19 nt, Homo sapiens
aaucauauccugugcauuu

SEQ ID NO: 985090 - RNA, 19 nt, Homo sapiens
ugaagaaccuguagauagu

SEQ ID NO: 985091 - RNA, 19 nt, Homo sapiens
guacuugcauucaucauca

SEQ ID NO: 985092 - RNA, 19 nt, Homo sapiens
gaagaagcuaguucauuaa

SEQ ID NO: 985093 - RNA, 19 nt, Homo sapiens
caaagugcaaugugaauuu

SEQ ID NO: 985094 - RNA, 19 nt, Homo sapiens
guuagaagcccacuugaaa

SEQ ID NO: 985095 - RNA, 19 nt, Homo sapiens
aaacagcucuccucauaag

SEQ ID NO: 985096 - RNA, 19 nt, Homo sapiens
ggaucaaccucacaaucaa

SEQ ID NO: 985097 - RNA, 19 nt, Homo sapiens
gaagaaaucguguccuuac

SEQ ID NO: 985098 - RNA, 19 nt, Homo sapiens
guaaagagaguaauuaagg

SEQ ID NO: 985099 - RNA, 19 nt, Homo sapiens
gcaauucacuucuaaaaca

SEQ ID NO: 985100 - RNA, 19 nt, Homo sapiens
gcucacaaaucuccaaucu

SEQ ID NO: 985101 - RNA, 19 nt, Homo sapiens
caaccacauuuccaaagaa

SEQ ID NO: 985102 - RNA, 19 nt, Homo sapiens
gaagaugaaaccuauagug

SEQ ID NO: 985103 - RNA, 19 nt, Homo sapiens
aaaaucagcuaccuacaua

SEQ ID NO: 985104 - RNA, 19 nt, Homo sapiens
gaagacagaaguugaugga

SEQ ID NO: 985105 - RNA, 19 nt, Homo sapiens
gguguuggguuaucaaauc

SEQ ID NO: 985106 - RNA, 19 nt, Homo sapiens
uaaggaaucuaagaaggaa

SEQ ID NO: 985107 - RNA, 19 nt, Homo sapiens
gaagcgaacauuuggauca

SEQ ID NO: 985108 - RNA, 19 nt, Homo sapiens
gaacucugcuuuaaaacaa

SEQ ID NO: 985109 - RNA, 19 nt, Homo sapiens
uauggucacuucugauauu

SEQ ID NO: 985110 - RNA, 19 nt, Homo sapiens
uaaaaugacuguugucguu

SEQ ID NO: 985111 - RNA, 19 nt, Homo sapiens
gaaccuguagauagugaua

SEQ ID NO: 985112 - RNA, 19 nt, Homo sapiens
gagagaagacagaaguuga

SEQ ID NO: 985113 - RNA, 19 nt, Homo sapiens
gccauaugcuuguagagaa

SEQ ID NO: 985114 - RNA, 19 nt, Homo sapiens
ugaaugagaugaugcaaaa

SEQ ID NO: 985115 - RNA, 19 nt, Homo sapiens
gugguugguuugauacuaa

SEQ ID NO: 985116 - RNA, 19 nt, Homo sapiens
gcucuguggugguugguuu

SEQ ID NO: 985117 - RNA, 19 nt, Homo sapiens
gagcaggauuaagcuauga

SEQ ID NO: 985118 - RNA, 19 nt, Homo sapiens
gcagaugcuucauugucaa

SEQ ID NO: 985119 - RNA, 19 nt, Homo sapiens
gcuguaaagagaguaauua

SEQ ID NO: 985120 - RNA, 19 nt, Homo sapiens
ucaaccacauuuccaaaga

SEQ ID NO: 985121 - RNA, 19 nt, Homo sapiens
uauguaagauguguccuuu

SEQ ID NO: 985122 - RNA, 19 nt, Homo sapiens
ucauaagccugacgccaaa

SEQ ID NO: 985123 - RNA, 19 nt, Homo sapiens
ucaaguaauucucacaaca

SEQ ID NO: 985124 - RNA, 19 nt, Homo sapiens
uguaagauguguccuuuua

SEQ ID NO: 985125 - RNA, 19 nt, Homo sapiens
uacaugauccucagcauuu

SEQ ID NO: 985126 - RNA, 19 nt, Homo sapiens
aaacagaagaugaaaguuc

SEQ ID NO: 985127 - RNA, 19 nt, Homo sapiens
ugaagcccgucauguugua

SEQ ID NO: 985128 - RNA, 19 nt, Homo sapiens
gggauaauguugaguuagg

SEQ ID NO: 985129 - RNA, 19 nt, Homo sapiens
aaacaacagucaaccacau

SEQ ID NO: 985130 - RNA, 19 nt, Homo sapiens
caaguaauucucacaacaa

SEQ ID NO: 985131 - RNA, 19 nt, Homo sapiens
gaaaagcuauagagaaguc

SEQ ID NO: 985132 - RNA, 19 nt, Homo sapiens
uguaucaccagaacaaaua

SEQ ID NO: 985133 - RNA, 19 nt, Homo sapiens
ccacaggcauaugauguau

SEQ ID NO: 985134 - RNA, 19 nt, Homo sapiens
ggagagaagacagaaguug

SEQ ID NO: 985135 - RNA, 19 nt, Homo sapiens
ggagaaaaugcuacucuua

SEQ ID NO: 985136 - RNA, 19 nt, Homo sapiens
gcccuauggucacuucuga

SEQ ID NO: 985137 - RNA, 19 nt, Homo sapiens
cuacacaggccauagaaga

SEQ ID NO: 985138 - RNA, 19 nt, Homo sapiens
gaagcccacuugaaagacu

SEQ ID NO: 985139 - RNA, 19 nt, Homo sapiens
uguggugguugguuugaua

SEQ ID NO: 985140 - RNA, 19 nt, Homo sapiens
ugaaacagaagaugaaagu

SEQ ID NO: 985141 - RNA, 19 nt, Homo sapiens
ggaagaagugcacgauuac

SEQ ID NO: 985142 - RNA, 19 nt, Homo sapiens
caaauagccacaagugaca

SEQ ID NO: 985143 - RNA, 19 nt, Homo sapiens
ucacagagcaggauuaagc

SEQ ID NO: 985144 - RNA, 19 nt, Homo sapiens
ucaaagcauaguucuguuu

SEQ ID NO: 985145 - RNA, 19 nt, Homo sapiens
ggauaauguugaguuagga

SEQ ID NO: 985146 - RNA, 19 nt, Homo sapiens
cauaagcggccacacagaa

SEQ ID NO: 985147 - RNA, 19 nt, Homo sapiens
cuacugcugugaagagugu

SEQ ID NO: 985148 - RNA, 19 nt, Homo sapiens
agaaguugauggaggaaau

SEQ ID NO: 985149 - RNA, 19 nt, Homo sapiens
ggugguugguuugauacua

SEQ ID NO: 985150 - RNA, 19 nt, Homo sapiens
gaaaccacuucugaacaca

SEQ ID NO: 985151 - RNA, 19 nt, Homo sapiens
aagaugaaaccuauaguga

SEQ ID NO: 985152 - RNA, 19 nt, Homo sapiens
gagaguaauuaaggaaucu

SEQ ID NO: 985153 - RNA, 19 nt, Homo sapiens
acguguagcuguaaagaga

SEQ ID NO: 985154 - RNA, 19 nt, Homo sapiens
aaaaugacauccuugaaga

SEQ ID NO: 985155 - RNA, 19 nt, Homo sapiens
ccuauggucacuucugaua

SEQ ID NO: 985156 - RNA, 19 nt, Homo sapiens
gacagaaaaugaauuggaa

SEQ ID NO: 985157 - RNA, 19 nt, Homo sapiens
uagaagcccacuugaaaga

SEQ ID NO: 985158 - RNA, 19 nt, Homo sapiens
guuaugaaacagaagauga

SEQ ID NO: 985159 - RNA, 19 nt, Homo sapiens
cgaaaugggaugcucacaa

SEQ ID NO: 985160 - RNA, 19 nt, Homo sapiens
acaugauccucagcauuua

SEQ ID NO: 985161 - RNA, 19 nt, Homo sapiens
gaaguugauggaggaaauu

SEQ ID NO: 985162 - RNA, 19 nt, Homo sapiens
guguaaacaugugcaauca

SEQ ID NO: 985163 - RNA, 19 nt, Homo sapiens
uaagcggccacacagaaua

SEQ ID NO: 985164 - RNA, 19 nt, Homo sapiens
ccauaugcuuguagagaau

SEQ ID NO: 985165 - RNA, 19 nt, Homo sapiens
caauugcccuaaaacauuu

SEQ ID NO: 985166 - RNA, 19 nt, Homo sapiens
ccauagaagaugaaaccua

SEQ ID NO: 985167 - RNA, 19 nt, Homo sapiens
ugaaucauauccugugcau

SEQ ID NO: 985168 - RNA, 19 nt, Homo sapiens
ccacacagaauacagaaag

SEQ ID NO: 985169 - RNA, 19 nt, Homo sapiens
cgagaucgcaauucacuuc

SEQ ID NO: 985170 - RNA, 19 nt, Homo sapiens
gaaggaagaagugcacgau

SEQ ID NO: 985171 - RNA, 19 nt, Homo sapiens
ggauguauguuguguguuu

SEQ ID NO: 985172 - RNA, 19 nt, Homo sapiens
gaauacagaagcagauuua

SEQ ID NO: 985173 - RNA, 19 nt, Homo sapiens
gaauggcuguugaugauaa

SEQ ID NO: 985174 - RNA, 19 nt, Homo sapiens
ucaggugaauguaguauua

SEQ ID NO: 985175 - RNA, 19 nt, Homo sapiens
gaugacaaauccugccaua

SEQ ID NO: 985176 - RNA, 19 nt, Homo sapiens
gaugagaaguugcaagaga

SEQ ID NO: 985177 - RNA, 19 nt, Homo sapiens
gagacuaccuccaagcaaa

SEQ ID NO: 985178 - RNA, 19 nt, Homo sapiens
caucuaaggcagcuaauua

SEQ ID NO: 985179 - RNA, 19 nt, Homo sapiens
uuaaauccaugcugcaaua

SEQ ID NO: 985180 - RNA, 19 nt, Homo sapiens
gaaagguuguaucaaaguu

SEQ ID NO: 985181 - RNA, 19 nt, Homo sapiens
ggaccaaccuccuaauagu

SEQ ID NO: 985182 - RNA, 19 nt, Homo sapiens
gagguuagaagcagcauua

SEQ ID NO: 985183 - RNA, 19 nt, Homo sapiens
agaagaacauugagucgua

SEQ ID NO: 985184 - RNA, 19 nt, Homo sapiens
aaagaaugauggacaguuu

SEQ ID NO: 985185 - RNA, 19 nt, Homo sapiens
cagaggagcuggccacgaa

SEQ ID NO: 985186 - RNA, 19 nt, Homo sapiens
ggcaguagguccuuaaguu

SEQ ID NO: 985187 - RNA, 19 nt, Homo sapiens
gauggacaguuuauccuuu

SEQ ID NO: 985188 - RNA, 19 nt, Homo sapiens
ggaaacaccggaauacaga

SEQ ID NO: 985189 - RNA, 19 nt, Homo sapiens
ccacaaggccuguuuacuu

SEQ ID NO: 985190 - RNA, 19 nt, Homo sapiens
aauggugggugucauaaua

SEQ ID NO: 985191 - RNA, 19 nt, Homo sapiens
uaacuguguuguacaaaug

SEQ ID NO: 985192 - RNA, 19 nt, Homo sapiens
aaacugaggccuggaauuu

SEQ ID NO: 985193 - RNA, 19 nt, Homo sapiens
gaagaacauugagucguau

SEQ ID NO: 985194 - RNA, 19 nt, Homo sapiens
guuacacucugaagggaua

SEQ ID NO: 985195 - RNA, 19 nt, Homo sapiens
guuagaagcagcauuaaga

SEQ ID NO: 985196 - RNA, 19 nt, Homo sapiens
aagaauggcuguugaugau

SEQ ID NO: 985197 - RNA, 19 nt, Homo sapiens
gaacucaagaugacaaauc

SEQ ID NO: 985198 - RNA, 19 nt, Homo sapiens
gggaaucuucuuaaaguuu

SEQ ID NO: 985199 - RNA, 19 nt, Homo sapiens
guucaugucuaaagaaugg

SEQ ID NO: 985200 - RNA, 19 nt, Homo sapiens
gcuaaaacuuccaaaauug

SEQ ID NO: 985201 - RNA, 19 nt, Homo sapiens
gauguauguuguguguuua

SEQ ID NO: 985202 - RNA, 19 nt, Homo sapiens
cagaaugauuucagcuauu

SEQ ID NO: 985203 - RNA, 19 nt, Homo sapiens
ugacaaauccugccauaca

SEQ ID NO: 985204 - RNA, 19 nt, Homo sapiens
gaaagaaugauggacaguu

SEQ ID NO: 985205 - RNA, 19 nt, Homo sapiens
gcucucagguacacaacaa

SEQ ID NO: 985206 - RNA, 19 nt, Homo sapiens
guaucaaaguucuuaagga

SEQ ID NO: 985207 - RNA, 19 nt, Homo sapiens
ggaauacagaagcagauuu

SEQ ID NO: 985208 - RNA, 19 nt, Homo sapiens
gcuaguguaugcagaguca

SEQ ID NO: 985209 - RNA, 19 nt, Homo sapiens
gguaauggugggugucaua

SEQ ID NO: 985210 - RNA, 19 nt, Homo sapiens
uaaggcagcuaauuaugca

SEQ ID NO: 985211 - RNA, 19 nt, Homo sapiens
guaaggauguauguugugu

SEQ ID NO: 985212 - RNA, 19 nt, Homo sapiens
guuguguguuuaaccuuua

SEQ ID NO: 985213 - RNA, 19 nt, Homo sapiens
ccaagcaaauuaaauccau

SEQ ID NO: 985214 - RNA, 19 nt, Homo sapiens
ccacuaguaggcaaauuaa

SEQ ID NO: 985215 - RNA, 19 nt, Homo sapiens
gaaacugaggccuggaauu

SEQ ID NO: 985216 - RNA, 19 nt, Homo sapiens
agucugagaaggaaauuua

SEQ ID NO: 985217 - RNA, 19 nt, Homo sapiens
gaauauuacguaugcaugu

SEQ ID NO: 985218 - RNA, 19 nt, Homo sapiens
gccaaaaucaguaaaguua

SEQ ID NO: 985219 - RNA, 19 nt, Homo sapiens
gaagacaguauucugcaau

SEQ ID NO: 985220 - RNA, 19 nt, Homo sapiens
cugggagccuuaacaagua

SEQ ID NO: 985221 - RNA, 19 nt, Homo sapiens
ucuaaagaauggcuguuga

SEQ ID NO: 985222 - RNA, 19 nt, Homo sapiens
guagacagaagacaguauu

SEQ ID NO: 985223 - RNA, 19 nt, Homo sapiens
acagaaugauuucagcuau

SEQ ID NO: 985224 - RNA, 19 nt, Homo sapiens
cacaauggcuaguguaugc

SEQ ID NO: 985225 - RNA, 19 nt, Homo sapiens
gaaaauaccacagauuguu

SEQ ID NO: 985226 - RNA, 19 nt, Homo sapiens
gcaguagguccuuaaguuc

SEQ ID NO: 985227 - RNA, 19 nt, Homo sapiens
aaagaauggcuguugauga

SEQ ID NO: 985228 - RNA, 19 nt, Homo sapiens
acugaggccuggaauuuga

SEQ ID NO: 985229 - RNA, 19 nt, Homo sapiens
gauuaacucauucaagguu

SEQ ID NO: 985230 - RNA, 19 nt, Homo sapiens
caaaugguacccaacacaa

SEQ ID NO: 985231 - RNA, 19 nt, Homo sapiens
ugccuauucugcuauuuaa

SEQ ID NO: 985232 - RNA, 19 nt, Homo sapiens
caagguuacccaguugaua

SEQ ID NO: 985233 - RNA, 19 nt, Homo sapiens
ugagugaugccacaacaaa

SEQ ID NO: 985234 - RNA, 19 nt, Homo sapiens
uggcaaaucgaaugucuuu

SEQ ID NO: 985235 - RNA, 19 nt, Homo sapiens
gagaagaaagaaugaugga

SEQ ID NO: 985236 - RNA, 19 nt, Homo sapiens
gcugaaggccuccuguuuc

SEQ ID NO: 985237 - RNA, 19 nt, Homo sapiens
gacaaauccugccauacag

SEQ ID NO: 985238 - RNA, 19 nt, Homo sapiens
cagaugagaaguugcaaga

SEQ ID NO: 985239 - RNA, 19 nt, Homo sapiens
gauaucauccuuucaaacg

SEQ ID NO: 985240 - RNA, 19 nt, Homo sapiens
aauacucuaugaccacgua

SEQ ID NO: 985241 - RNA, 19 nt, Homo sapiens
cauucaagguuacccaguu

SEQ ID NO: 985242 - RNA, 19 nt, Homo sapiens
ucauucugcuugaggguaa

SEQ ID NO: 985243 - RNA, 19 nt, Homo sapiens
uacagaagcagauuuacaa

SEQ ID NO: 985244 - RNA, 19 nt, Homo sapiens
guuaaaagcugugaugugu

SEQ ID NO: 985245 - RNA, 19 nt, Homo sapiens
gcagagucaugcuggaaac

SEQ ID NO: 985246 - RNA, 19 nt, Homo sapiens
uaagcacaauggcuagugu

SEQ ID NO: 985247 - RNA, 19 nt, Homo sapiens
caaauccugccauacagaa

SEQ ID NO: 985248 - RNA, 19 nt, Homo sapiens
ggaagaggcaccagagacu

SEQ ID NO: 985249 - RNA, 19 nt, Homo sapiens
guccuuaaguuccuugcuu

SEQ ID NO: 985250 - RNA, 19 nt, Homo sapiens
uuccugcgcuuucuccuuu

SEQ ID NO: 985251 - RNA, 19 nt, Homo sapiens
gaaggacaaggacagaauc

SEQ ID NO: 985252 - RNA, 19 nt, Homo sapiens
gcauuggggucucuacuga

SEQ ID NO: 985253 - RNA, 19 nt, Homo sapiens
gguuguaucaaaguucuua

SEQ ID NO: 985254 - RNA, 19 nt, Homo sapiens
guugauagaaggacaagga

SEQ ID NO: 985255 - RNA, 19 nt, Homo sapiens
ugaauuggcaaaucgaaug

SEQ ID NO: 985256 - RNA, 19 nt, Homo sapiens
aaggauguauguugugugu

SEQ ID NO: 985257 - RNA, 19 nt, Homo sapiens
agacaguauucugcaauga

SEQ ID NO: 985258 - RNA, 19 nt, Homo sapiens
guaauggugggugucauaa

SEQ ID NO: 985259 - RNA, 19 nt, Homo sapiens
gaaacaccggaauacagaa

SEQ ID NO: 985260 - RNA, 19 nt, Homo sapiens
gcacaauggcuaguguaug

SEQ ID NO: 985261 - RNA, 19 nt, Homo sapiens
ugagucguaugaggauuaa

SEQ ID NO: 985262 - RNA, 19 nt, Homo sapiens
gggugcaguuguuccacua

SEQ ID NO: 985263 - RNA, 19 nt, Homo sapiens
ucugugacuugaacuaaau

SEQ ID NO: 985264 - RNA, 19 nt, Homo sapiens
aauccaugcugcaauaaca

SEQ ID NO: 985265 - RNA, 19 nt, Homo sapiens
uaccacagauuguuuaagc

SEQ ID NO: 985266 - RNA, 19 nt, Homo sapiens
cgaauuuucucagagguua

SEQ ID NO: 985267 - RNA, 19 nt, Homo sapiens
cuaguaggcaaauuaaaga

SEQ ID NO: 985268 - RNA, 19 nt, Homo sapiens
gaugaacucaagaugacaa

SEQ ID NO: 985269 - RNA, 19 nt, Homo sapiens
uaaaugcucucagguacac

SEQ ID NO: 985270 - RNA, 19 nt, Homo sapiens
auaaucaggugaauguagu

SEQ ID NO: 985271 - RNA, 19 nt, Homo sapiens
ggacaugcaugauaacuca

SEQ ID NO: 985272 - RNA, 19 nt, Homo sapiens
gaaccucacuucuagacuu

SEQ ID NO: 985273 - RNA, 19 nt, Homo sapiens
gauuggagcaugcauaaua

SEQ ID NO: 985274 - RNA, 19 nt, Homo sapiens
gugagaaccugacucuuaa

SEQ ID NO: 985275 - RNA, 19 nt, Homo sapiens
caucauauccuaaggcaua

SEQ ID NO: 985276 - RNA, 19 nt, Homo sapiens
ucacacaaaugcaauaguu

SEQ ID NO: 985277 - RNA, 19 nt, Homo sapiens
gagcaugcauaauaucuug

SEQ ID NO: 985278 - RNA, 19 nt, Homo sapiens
gcagagugccuaaaccaua

SEQ ID NO: 985279 - RNA, 19 nt, Homo sapiens
gaaaagaucccuacccuaa

SEQ ID NO: 985280 - RNA, 19 nt, Homo sapiens
aagcacagauugaauugua

SEQ ID NO: 985281 - RNA, 19 nt, Homo sapiens
gaaacuaaacucuguggaa

SEQ ID NO: 985282 - RNA, 19 nt, Homo sapiens
gauaagcacagauugaauu

SEQ ID NO: 985283 - RNA, 19 nt, Homo sapiens
cagagugccuaaaccauaa

SEQ ID NO: 985284 - RNA, 19 nt, Homo sapiens
ugacgggauuccugucuua

SEQ ID NO: 985285 - RNA, 19 nt, Homo sapiens
ggacgaaacggguucagaa

SEQ ID NO: 985286 - RNA, 19 nt, Homo sapiens
aaacuugccacacuuauuu

SEQ ID NO: 985287 - RNA, 19 nt, Homo sapiens
gcaauuagaacuggaagaa

SEQ ID NO: 985288 - RNA, 19 nt, Homo sapiens
guuguugguuggacuguua

SEQ ID NO: 985289 - RNA, 19 nt, Homo sapiens
guacucagcuauguuaaca

SEQ ID NO: 985290 - RNA, 19 nt, Homo sapiens
caucuugguuccagcuaua

SEQ ID NO: 985291 - RNA, 19 nt, Homo sapiens
gggaaaccacgcuaugaua

SEQ ID NO: 985292 - RNA, 19 nt, Homo sapiens
acaaacagaucgggaugua

SEQ ID NO: 985293 - RNA, 19 nt, Homo sapiens
ggaguuggacauugaguuu

SEQ ID NO: 985294 - RNA, 19 nt, Homo sapiens
gaaaagaguuacuacgaau

SEQ ID NO: 985295 - RNA, 19 nt, Homo sapiens
ggacugggcgauuguguga

SEQ ID NO: 985296 - RNA, 19 nt, Homo sapiens
ugaggaaacuaaacucugu

SEQ ID NO: 985297 - RNA, 19 nt, Homo sapiens
caucaaacuuguggccaua

SEQ ID NO: 985298 - RNA, 19 nt, Homo sapiens
gaaguggucagcuaaagga

SEQ ID NO: 985299 - RNA, 19 nt, Homo sapiens
gaagaaguggucagcuaaa

SEQ ID NO: 985300 - RNA, 19 nt, Homo sapiens
cuacugaggcucuaaagaa

SEQ ID NO: 985301 - RNA, 19 nt, Homo sapiens
agugagaaccugacucuua

SEQ ID NO: 985302 - RNA, 19 nt, Homo sapiens
gcaaugagccaugauuaca

SEQ ID NO: 985303 - RNA, 19 nt, Homo sapiens
gaggauaagcacagauuga

SEQ ID NO: 985304 - RNA, 19 nt, Homo sapiens
acauugaguuuacuucuga

SEQ ID NO: 985305 - RNA, 19 nt, Homo sapiens
guaccuguguggaauuuca

SEQ ID NO: 985306 - RNA, 19 nt, Homo sapiens
ugcauaauaucuuguggua

SEQ ID NO: 985307 - RNA, 19 nt, Homo sapiens
gcuaugauacuuucuggaa

SEQ ID NO: 985308 - RNA, 19 nt, Homo sapiens
caaaggccaugcacacaag

SEQ ID NO: 985309 - RNA, 19 nt, Homo sapiens
guagauaggacgacugaug

SEQ ID NO: 985310 - RNA, 19 nt, Homo sapiens
gcaggcagcuaagaaugga

SEQ ID NO: 985311 - RNA, 19 nt, Homo sapiens
cgaaacggguucagaaacu

SEQ ID NO: 985312 - RNA, 19 nt, Homo sapiens
uauagcaucuugaauagag

SEQ ID NO: 985313 - RNA, 19 nt, Homo sapiens
ccagugaggcuucagugua

SEQ ID NO: 985314 - RNA, 19 nt, Homo sapiens
gcguggaguuggacauuga

SEQ ID NO: 985315 - RNA, 19 nt, Homo sapiens
gaucauaggcaauuagaac

SEQ ID NO: 985316 - RNA, 19 nt, Homo sapiens
gaaacggguucagaaacug

SEQ ID NO: 985317 - RNA, 19 nt, Homo sapiens
aaacagaucgggauguaau

SEQ ID NO: 985318 - RNA, 19 nt, Homo sapiens
gcgauugugugauuugaca

SEQ ID NO: 985319 - RNA, 19 nt, Homo sapiens
ccucaaaagucacagcuua

SEQ ID NO: 985320 - RNA, 19 nt, Homo sapiens
cuaaaggaauccagguugu

SEQ ID NO: 985321 - RNA, 19 nt, Homo sapiens
ggaagggguugccucaaaa

SEQ ID NO: 985322 - RNA, 19 nt, Homo sapiens
ggauuuauagcaucuugaa

SEQ ID NO: 985323 - RNA, 19 nt, Homo sapiens
ggagacccagugaggauaa

SEQ ID NO: 985324 - RNA, 19 nt, Homo sapiens
uugaagaaguggucagcua

SEQ ID NO: 985325 - RNA, 19 nt, Homo sapiens
ugccagaaguuaucuacaa

SEQ ID NO: 985326 - RNA, 19 nt, Homo sapiens
gaaguucaaggcugcaaug

SEQ ID NO: 985327 - RNA, 19 nt, Homo sapiens
ccuaaggcauacggaauuu

SEQ ID NO: 985328 - RNA, 19 nt, Homo sapiens
aaacuuguggccauacuaa

SEQ ID NO: 985329 - RNA, 19 nt, Homo sapiens
ggacuguuaauaccuuuga

SEQ ID NO: 985330 - RNA, 19 nt, Homo sapiens
uacugaggcucuaaagaaa

SEQ ID NO: 985331 - RNA, 19 nt, Homo sapiens
caaauuaggaagcugaauc

SEQ ID NO: 985332 - RNA, 19 nt, Homo sapiens
gacauugaguuuacuucug

SEQ ID NO: 985333 - RNA, 19 nt, Homo sapiens
gaaaaucugggucugaaaa

SEQ ID NO: 985334 - RNA, 19 nt, Homo sapiens
cgggauuccugucuuaaug

SEQ ID NO: 985335 - RNA, 19 nt, Homo sapiens
ugaagaaguggucagcuaa

SEQ ID NO: 985336 - RNA, 19 nt, Homo sapiens
ggaaaccacgcuaugauac

SEQ ID NO: 985337 - RNA, 19 nt, Homo sapiens
cugcgaaccucacuucuag

SEQ ID NO: 985338 - RNA, 19 nt, Homo sapiens
aaaccacgcuaugauacuu

SEQ ID NO: 985339 - RNA, 19 nt, Homo sapiens
gaauuuccucaacuguaua

SEQ ID NO: 985340 - RNA, 19 nt, Homo sapiens
ucacaaucuucuuugaugu

SEQ ID NO: 985341 - RNA, 19 nt, Homo sapiens
uaaccucacaaucuucuuu

SEQ ID NO: 985342 - RNA, 19 nt, Homo sapiens
aaagaucccuacccuaagg

SEQ ID NO: 985343 - RNA, 19 nt, Homo sapiens
gguggugcaugccuguauu

SEQ ID NO: 985344 - RNA, 19 nt, Homo sapiens
gggaagggguugccucaaa

SEQ ID NO: 985345 - RNA, 19 nt, Homo sapiens
caaaugaggaaacuaaacu

SEQ ID NO: 985346 - RNA, 19 nt, Homo sapiens
ugaagccaaugagggauuu

SEQ ID NO: 985347 - RNA, 19 nt, Homo sapiens
gacgaaacggguucagaaa

SEQ ID NO: 985348 - RNA, 19 nt, Homo sapiens
aauuucagcuuuccucaug

SEQ ID NO: 985349 - RNA, 19 nt, Homo sapiens
gcagcaaaccacagacuca

SEQ ID NO: 985350 - RNA, 19 nt, Homo sapiens
ugugugauuugacauuuga

SEQ ID NO: 985351 - RNA, 19 nt, Homo sapiens
ccuuggagccuaagccaua

SEQ ID NO: 985352 - RNA, 19 nt, Homo sapiens
cacgauaacacaguagaua

SEQ ID NO: 985353 - RNA, 19 nt, Homo sapiens
auaauaguguggucuguuc

SEQ ID NO: 985354 - RNA, 19 nt, Homo sapiens
gggcagaguugcacuuuuc

SEQ ID NO: 985355 - RNA, 19 nt, Homo sapiens
uugccacacuuauuucaaa

SEQ ID NO: 985356 - RNA, 19 nt, Homo sapiens
ugaaaagaguuacuacgaa

SEQ ID NO: 985357 - RNA, 19 nt, Homo sapiens
guggucagcuaaaggaauc

SEQ ID NO: 985358 - RNA, 19 nt, Homo sapiens
gggauguaauaacagcauu

SEQ ID NO: 985359 - RNA, 19 nt, Homo sapiens
gaggugggaggaucacuug

SEQ ID NO: 985360 - RNA, 19 nt, Homo sapiens
ggacauugaguuuacuucu

SEQ ID NO: 985361 - RNA, 19 nt, Homo sapiens
aauuagaacuggaagaaac

SEQ ID NO: 985362 - RNA, 19 nt, Homo sapiens
gcaauccagugaggcuuca

SEQ ID NO: 985363 - RNA, 19 nt, Homo sapiens
ugccaagcaucauauccua

SEQ ID NO: 985364 - RNA, 19 nt, Homo sapiens
ugccagaguucaacacugu

SEQ ID NO: 985365 - RNA, 19 nt, Homo sapiens
aauaguuggucacugcauu

SEQ ID NO: 985366 - RNA, 19 nt, Homo sapiens
uguguggaauuucagcuuu

SEQ ID NO: 985367 - RNA, 19 nt, Homo sapiens
gagcaacaggcguggaguu

SEQ ID NO: 985368 - RNA, 19 nt, Homo sapiens
gccagaaguuaucuacaag

SEQ ID NO: 985369 - RNA, 19 nt, Homo sapiens
cagugaggcuucaguguac

SEQ ID NO: 985370 - RNA, 19 nt, Homo sapiens
gaguuggacauugaguuua

SEQ ID NO: 985371 - RNA, 19 nt, Homo sapiens
gagaagaaguuauaccauu

SEQ ID NO: 985372 - RNA, 19 nt, Homo sapiens
gcaauugaguuucuuaaca

SEQ ID NO: 985373 - RNA, 19 nt, Homo sapiens
gcgaauggauggauuugaa

SEQ ID NO: 985374 - RNA, 19 nt, Homo sapiens
ggaaacagacaguggagua

SEQ ID NO: 985375 - RNA, 19 nt, Homo sapiens
ggagaaaguuaaugcaaca

SEQ ID NO: 985376 - RNA, 19 nt, Homo sapiens
ugguagcacugcauaauua

SEQ ID NO: 985377 - RNA, 19 nt, Homo sapiens
caacaagcgaguaaacaua

SEQ ID NO: 985378 - RNA, 19 nt, Homo sapiens
agaaugccaugcuagauuu

SEQ ID NO: 985379 - RNA, 19 nt, Homo sapiens
gaaguuauaccauuaagag

SEQ ID NO: 985380 - RNA, 19 nt, Homo sapiens
gcagcaaucucagaaguuc

SEQ ID NO: 985381 - RNA, 19 nt, Homo sapiens
aagaaaaccuggcauauuu

SEQ ID NO: 985382 - RNA, 19 nt, Homo sapiens
uagcauggcuucuuuaaaa

SEQ ID NO: 985383 - RNA, 19 nt, Homo sapiens
gauacagaaugccaugcua

SEQ ID NO: 985384 - RNA, 19 nt, Homo sapiens
uaacaacccaccagaagaa

SEQ ID NO: 985385 - RNA, 19 nt, Homo sapiens
gaccaaaggaugaggauga

SEQ ID NO: 985386 - RNA, 19 nt, Homo sapiens
guucaccucuuaauacuuc

SEQ ID NO: 985387 - RNA, 19 nt, Homo sapiens
agauagcucucucuugaaa

SEQ ID NO: 985388 - RNA, 19 nt, Homo sapiens
caccaaagcugaaaagauu

SEQ ID NO: 985389 - RNA, 19 nt, Homo sapiens
ucaaaacacuggaaugaaa

SEQ ID NO: 985390 - RNA, 19 nt, Homo sapiens
gagaaguucagcuguugua

SEQ ID NO: 985391 - RNA, 19 nt, Homo sapiens
gagcuguucuugggagauu

SEQ ID NO: 985392 - RNA, 19 nt, Homo sapiens
ggaaacaaguccgggauac

SEQ ID NO: 985393 - RNA, 19 nt, Homo sapiens
cauuaagagugcuaucaaa

SEQ ID NO: 985394 - RNA, 19 nt, Homo sapiens
uaagaguuguggaagagaa

SEQ ID NO: 985395 - RNA, 19 nt, Homo sapiens
guggcaauguuguuuauau

SEQ ID NO: 985396 - RNA, 19 nt, Homo sapiens
gaaauguggcaauguuguu

SEQ ID NO: 985397 - RNA, 19 nt, Homo sapiens
gggaaagaccaaaggauga

SEQ ID NO: 985398 - RNA, 19 nt, Homo sapiens
uaagagugcuaucaaagag

SEQ ID NO: 985399 - RNA, 19 nt, Homo sapiens
aaaggauacuggagaucua

SEQ ID NO: 985400 - RNA, 19 nt, Homo sapiens
cagcuggauugaaagagua

SEQ ID NO: 985401 - RNA, 19 nt, Homo sapiens
agucagaaauggaaacaga

SEQ ID NO: 985402 - RNA, 19 nt, Homo sapiens
agugucaggugauuuagua

SEQ ID NO: 985403 - RNA, 19 nt, Homo sapiens
gaaguucagcuguuguaga

SEQ ID NO: 985404 - RNA, 19 nt, Homo sapiens
gcacccaggagaaaguuaa

SEQ ID NO: 985405 - RNA, 19 nt, Homo sapiens
ugaaagaguauuugggaaa

SEQ ID NO: 985406 - RNA, 19 nt, Homo sapiens
acaagcgaguaaacauaua

SEQ ID NO: 985407 - RNA, 19 nt, Homo sapiens
caaggaacacugcuggaaa

SEQ ID NO: 985408 - RNA, 19 nt, Homo sapiens
guucgugaguggagugauu

SEQ ID NO: 985409 - RNA, 19 nt, Homo sapiens
caagcgaguaaacauauaa

SEQ ID NO: 985410 - RNA, 19 nt, Homo sapiens
caaagguauuggcagaaga

SEQ ID NO: 985411 - RNA, 19 nt, Homo sapiens
gaaaagaggcacugaaaag

SEQ ID NO: 985412 - RNA, 19 nt, Homo sapiens
gcucaagcaguaauaaaug

SEQ ID NO: 985413 - RNA, 19 nt, Homo sapiens
cagaaugccaugcuagauu

SEQ ID NO: 985414 - RNA, 19 nt, Homo sapiens
cagaagaagcaccaagaaa

SEQ ID NO: 985415 - RNA, 19 nt, Homo sapiens
ggaaauguggcaauguugu

SEQ ID NO: 985416 - RNA, 19 nt, Homo sapiens
aagaggcacugaaaaguua

SEQ ID NO: 985417 - RNA, 19 nt, Homo sapiens
gaaugccaugcuagauuua

SEQ ID NO: 985418 - RNA, 19 nt, Homo sapiens
gguuugcguuuguggaauu

SEQ ID NO: 985419 - RNA, 19 nt, Homo sapiens
aaaccuggcauauuuccua

SEQ ID NO: 985420 - RNA, 19 nt, Homo sapiens
ugggaaauguggcaauguu

SEQ ID NO: 985421 - RNA, 19 nt, Homo sapiens
gcaccagaauccggaggaa

SEQ ID NO: 985422 - RNA, 19 nt, Homo sapiens
gcuagcauggcuucuuuaa

SEQ ID NO: 985423 - RNA, 19 nt, Homo sapiens
gucagugucaggugauuua

SEQ ID NO: 985424 - RNA, 19 nt, Homo sapiens
aaugggagaagaaguuaua

SEQ ID NO: 985425 - RNA, 19 nt, Homo sapiens
ggaaaaggauacuggagau

SEQ ID NO: 985426 - RNA, 19 nt, Homo sapiens
gcaguaauaaaugccuaua

SEQ ID NO: 985427 - RNA, 19 nt, Homo sapiens
gacaguggaguaccucaaa

SEQ ID NO: 985428 - RNA, 19 nt, Homo sapiens
uuguagagcuugauuugga

SEQ ID NO: 985429 - RNA, 19 nt, Homo sapiens
gcgaguaaacauauaagau

SEQ ID NO: 985430 - RNA, 19 nt, Homo sapiens
gaaauuaacaaggaacacu

SEQ ID NO: 985431 - RNA, 19 nt, Homo sapiens
guggagugauugugaagau

SEQ ID NO: 985432 - RNA, 19 nt, Homo sapiens
ugaguggagugauugugaa

SEQ ID NO: 985433 - RNA, 19 nt, Homo sapiens
caaaagcaauugaguuucu

SEQ ID NO: 985434 - RNA, 19 nt, Homo sapiens
cuugggagauucacuuuua

SEQ ID NO: 985435 - RNA, 19 nt, Homo sapiens
cagaagauuuugguugaua

SEQ ID NO: 985436 - RNA, 19 nt, Homo sapiens
ggaugaacgcacaguguau

SEQ ID NO: 985437 - RNA, 19 nt, Homo sapiens
gguagcacugcauaauuaa

SEQ ID NO: 985438 - RNA, 19 nt, Homo sapiens
ggcagaagauuuugguuga

SEQ ID NO: 985439 - RNA, 19 nt, Homo sapiens
gaggaugaacgcacagugu

SEQ ID NO: 985440 - RNA, 19 nt, Homo sapiens
ccagaagaagcaccaagaa

SEQ ID NO: 985441 - RNA, 19 nt, Homo sapiens
gaucacgaacaaagguauu

SEQ ID NO: 985442 - RNA, 19 nt, Homo sapiens
uaucaaagagcgaauggau

SEQ ID NO: 985443 - RNA, 19 nt, Homo sapiens
uuaagagugcuaucaaaga

SEQ ID NO: 985444 - RNA, 19 nt, Homo sapiens
gaaaggcagaagcuuccaa

SEQ ID NO: 985445 - RNA, 19 nt, Homo sapiens
aaacaguucaccucuuaau

SEQ ID NO: 985446 - RNA, 19 nt, Homo sapiens
gauagacaggcaaaacuua

SEQ ID NO: 985447 - RNA, 19 nt, Homo sapiens
gggauacuuuggcagcaau

SEQ ID NO: 985448 - RNA, 19 nt, Homo sapiens
gggagauucacuuuuauua

SEQ ID NO: 985449 - RNA, 19 nt, Homo sapiens
gguauuggcagaagauuuu

SEQ ID NO: 985450 - RNA, 19 nt, Homo sapiens
cgaauggauggauuugaaa

SEQ ID NO: 985451 - RNA, 19 nt, Homo sapiens
ggagaagaaguuauaccau

SEQ ID NO: 985452 - RNA, 19 nt, Homo sapiens
caagaaaaccuggcauauu

SEQ ID NO: 985453 - RNA, 19 nt, Homo sapiens
uagcacugcauaauuaaug

SEQ ID NO: 985454 - RNA, 19 nt, Homo sapiens
aagauuagacuggcaaaga

SEQ ID NO: 985455 - RNA, 19 nt, Homo sapiens
guuaaucaccaaagcugaa

SEQ ID NO: 985456 - RNA, 19 nt, Homo sapiens
caaaagaacaagcagcaaa

SEQ ID NO: 985457 - RNA, 19 nt, Homo sapiens
gugaguggagugauuguga

SEQ ID NO: 985458 - RNA, 19 nt, Homo sapiens
gaugaacgcacaguguaug

SEQ ID NO: 985459 - RNA, 19 nt, Homo sapiens
gggagaagaaguuauacca

SEQ ID NO: 985460 - RNA, 19 nt, Homo sapiens
ccuuaagaguuguggaaga

SEQ ID NO: 985461 - RNA, 19 nt, Homo sapiens
ggaaagaccaaaggaugag

SEQ ID NO: 985462 - RNA, 19 nt, Homo sapiens
uaaaaugggagaagaaguu

SEQ ID NO: 985463 - RNA, 19 nt, Homo sapiens
ucacagcuggauugaaaga

SEQ ID NO: 985464 - RNA, 19 nt, Homo sapiens
acaaagguauuggcagaag

SEQ ID NO: 985465 - RNA, 19 nt, Homo sapiens
cgagauccuuucuggugau

SEQ ID NO: 985466 - RNA, 19 nt, Homo sapiens
gcuggaaacucgagauccu

SEQ ID NO: 985467 - RNA, 19 nt, Homo sapiens
ugaagaucauuagcacaga

SEQ ID NO: 985468 - RNA, 19 nt, Homo sapiens
acaguucaccucuuaauac

SEQ ID NO: 985469 - RNA, 19 nt, Homo sapiens
uguagagcuugauuuggaa

SEQ ID NO: 985470 - RNA, 19 nt, Homo sapiens
uggcagcaaucucagaagu

SEQ ID NO: 985471 - RNA, 19 nt, Homo sapiens
caaaggagguguaauauuu

SEQ ID NO: 985472 - RNA, 19 nt, Homo sapiens
gaagaaggauagcaaagaa

SEQ ID NO: 985473 - RNA, 19 nt, Homo sapiens
gaaauggcuuugcuuauga

SEQ ID NO: 985474 - RNA, 19 nt, Homo sapiens
gaagagaaaugcaaucagu

SEQ ID NO: 985475 - RNA, 19 nt, Homo sapiens
caagauauauccuucagaa

SEQ ID NO: 985476 - RNA, 19 nt, Homo sapiens
gaacuucccucugauguug

SEQ ID NO: 985477 - RNA, 19 nt, Homo sapiens
ggaaacagcuaguaaaauu

SEQ ID NO: 985478 - RNA, 19 nt, Homo sapiens
guggaugacugacaaauuu

SEQ ID NO: 985479 - RNA, 19 nt, Homo sapiens
ggagagaauuagauaaaga

SEQ ID NO: 985480 - RNA, 19 nt, Homo sapiens
caggaggcauguuuaaaua

SEQ ID NO: 985481 - RNA, 19 nt, Homo sapiens
guagagcuauuaaguauuc

SEQ ID NO: 985482 - RNA, 19 nt, Homo sapiens
gaaggaugaugaagaacaa

SEQ ID NO: 985483 - RNA, 19 nt, Homo sapiens
ucaaacgacugaaguacua

SEQ ID NO: 985484 - RNA, 19 nt, Homo sapiens
agaaagcguuagugaaaua

SEQ ID NO: 985485 - RNA, 19 nt, Homo sapiens
gaaaggagaggaugaagga

SEQ ID NO: 985486 - RNA, 19 nt, Homo sapiens
ucagaaggaugaugaagaa

SEQ ID NO: 985487 - RNA, 19 nt, Homo sapiens
gaaacuaguucugaagaug

SEQ ID NO: 985488 - RNA, 19 nt, Homo sapiens
caaaggaaguccauugauc

SEQ ID NO: 985489 - RNA, 19 nt, Homo sapiens
gaagauagcaaagcauuga

SEQ ID NO: 985490 - RNA, 19 nt, Homo sapiens
gaggaugacuuugagguaa

SEQ ID NO: 985491 - RNA, 19 nt, Homo sapiens
ggacugggauagauuaaag

SEQ ID NO: 985492 - RNA, 19 nt, Homo sapiens
gggcguguguuauuuguuu

SEQ ID NO: 985493 - RNA, 19 nt, Homo sapiens
ugaaauggcuuugcuuaug

SEQ ID NO: 985494 - RNA, 19 nt, Homo sapiens
caguagagcuauuaaguau

SEQ ID NO: 985495 - RNA, 19 nt, Homo sapiens
caagagacagugaugguua

SEQ ID NO: 985496 - RNA, 19 nt, Homo sapiens
cuacagaucagucauaauu

SEQ ID NO: 985497 - RNA, 19 nt, Homo sapiens
gaacaucaacgguggaaau

SEQ ID NO: 985498 - RNA, 19 nt, Homo sapiens
gaaauuacaaguguuggua

SEQ ID NO: 985499 - RNA, 19 nt, Homo sapiens
caagaaggcuaaucacaag

SEQ ID NO: 985500 - RNA, 19 nt, Homo sapiens
gcaaagagaacggaaagaa

SEQ ID NO: 985501 - RNA, 19 nt, Homo sapiens
ucagaaagcguuagugaaa

SEQ ID NO: 985502 - RNA, 19 nt, Homo sapiens
ggaggaagauucagaaagc

SEQ ID NO: 985503 - RNA, 19 nt, Homo sapiens
gaaaaggaaucacaaagga

SEQ ID NO: 985504 - RNA, 19 nt, Homo sapiens
gaagugaauuuaacagcau

SEQ ID NO: 985505 - RNA, 19 nt, Homo sapiens
gaagugaugaggaaucuga

SEQ ID NO: 985506 - RNA, 19 nt, Homo sapiens
gaacuuacucaggcaauaa

SEQ ID NO: 985507 - RNA, 19 nt, Homo sapiens
uaaagaaagugcagaagag

SEQ ID NO: 985508 - RNA, 19 nt, Homo sapiens
gaacuaugccguggauaaa

SEQ ID NO: 985509 - RNA, 19 nt, Homo sapiens
ggaagcaggaggcauguuu

SEQ ID NO: 985510 - RNA, 19 nt, Homo sapiens
gcacaucuccagaagaaga

SEQ ID NO: 985511 - RNA, 19 nt, Homo sapiens
ugaaaugugugacaaagau

SEQ ID NO: 985512 - RNA, 19 nt, Homo sapiens
uugaagagcucgagaugaa

SEQ ID NO: 985513 - RNA, 19 nt, Homo sapiens
cuacuuagcuuccucuagu

SEQ ID NO: 985514 - RNA, 19 nt, Homo sapiens
uuacaaugcucaacaggaa

SEQ ID NO: 985515 - RNA, 19 nt, Homo sapiens
ggauguagccucagaagug

SEQ ID NO: 985516 - RNA, 19 nt, Homo sapiens
cgacugaaguacuauuaug

SEQ ID NO: 985517 - RNA, 19 nt, Homo sapiens
gggauggacuggaguugaa

SEQ ID NO: 985518 - RNA, 19 nt, Homo sapiens
uggucgagauuaagaauua

SEQ ID NO: 985519 - RNA, 19 nt, Homo sapiens
gcaggaggcauguuuaaau

SEQ ID NO: 985520 - RNA, 19 nt, Homo sapiens
gaagcaggaggcauguuua

SEQ ID NO: 985521 - RNA, 19 nt, Homo sapiens
gaaaucacuugggaugaga

SEQ ID NO: 985522 - RNA, 19 nt, Homo sapiens
gugauggccuggaauuuga

SEQ ID NO: 985523 - RNA, 19 nt, Homo sapiens
gaagugaagaugaugaaga

SEQ ID NO: 985524 - RNA, 19 nt, Homo sapiens
aggcagcucuugcagguua

SEQ ID NO: 985525 - RNA, 19 nt, Homo sapiens
ggaaaucacuugggaugag

SEQ ID NO: 985526 - RNA, 19 nt, Homo sapiens
gaaggaagagcaaguucaa

SEQ ID NO: 985527 - RNA, 19 nt, Homo sapiens
caaagaugcucuggaggaa

SEQ ID NO: 985528 - RNA, 19 nt, Homo sapiens
ggacgaggacaguaagaaa

SEQ ID NO: 985529 - RNA, 19 nt, Homo sapiens
gaaggaaaggauaaacuga

SEQ ID NO: 985530 - RNA, 19 nt, Homo sapiens
gauguagccucagaaguga

SEQ ID NO: 985531 - RNA, 19 nt, Homo sapiens
gaaggauagcaaagaauuu

SEQ ID NO: 985532 - RNA, 19 nt, Homo sapiens
gcugaaauggcuuugcuua

SEQ ID NO: 985533 - RNA, 19 nt, Homo sapiens
uggcacaucuccagaagaa

SEQ ID NO: 985534 - RNA, 19 nt, Homo sapiens
acagaaggcucuugcugaa

SEQ ID NO: 985535 - RNA, 19 nt, Homo sapiens
cagaggauuugaagcguuu

SEQ ID NO: 985536 - RNA, 19 nt, Homo sapiens
cauaaaggauggaagucaa

SEQ ID NO: 985537 - RNA, 19 nt, Homo sapiens
ggaaauggaaauuaaaugg

SEQ ID NO: 985538 - RNA, 19 nt, Homo sapiens
gaaaagaaaggcaaagaaa

SEQ ID NO: 985539 - RNA, 19 nt, Homo sapiens
gcuacaaggugaugaugga

SEQ ID NO: 985540 - RNA, 19 nt, Homo sapiens
gcuauuaaguauuccugaa

SEQ ID NO: 985541 - RNA, 19 nt, Homo sapiens
gagcaugcuuggagagaau

SEQ ID NO: 985542 - RNA, 19 nt, Homo sapiens
uaauagaggaugacuuuga

SEQ ID NO: 985543 - RNA, 19 nt, Homo sapiens
ccucugauguugauuugaa

SEQ ID NO: 985544 - RNA, 19 nt, Homo sapiens
acacgucgauuagcaguuu

SEQ ID NO: 985545 - RNA, 19 nt, Homo sapiens
gaagauucagaaagcguua

SEQ ID NO: 985546 - RNA, 19 nt, Homo sapiens
agacagugaugguuaugaa

SEQ ID NO: 985547 - RNA, 19 nt, Homo sapiens
gcaaaggacccgagauuuu

SEQ ID NO: 985548 - RNA, 19 nt, Homo sapiens
ccucugaaauugugaaauc

SEQ ID NO: 985549 - RNA, 19 nt, Homo sapiens
ccaagaaggcuaaucacaa

SEQ ID NO: 985550 - RNA, 19 nt, Homo sapiens
ccaguagagcuauuaagua

SEQ ID NO: 985551 - RNA, 19 nt, Homo sapiens
gcagauuuguuuccagaag

SEQ ID NO: 985552 - RNA, 19 nt, Homo sapiens
ggaggcauguuuaaauaac

SEQ ID NO: 985553 - RNA, 19 nt, Homo sapiens
guguaaauguuagggauaa

SEQ ID NO: 985554 - RNA, 19 nt, Homo sapiens
ggaaagaacaagaacuuac

SEQ ID NO: 985555 - RNA, 19 nt, Homo sapiens
gagauuacacgucgauuag

SEQ ID NO: 985556 - RNA, 19 nt, Homo sapiens
caacagauggugaaaugug

SEQ ID NO: 985557 - RNA, 19 nt, Homo sapiens
aaacauaaguccgaagaag

SEQ ID NO: 985558 - RNA, 19 nt, Homo sapiens
gaaagaacaagaacuuacu

SEQ ID NO: 985559 - RNA, 19 nt, Homo sapiens
ugagguaaauguuaacgau

SEQ ID NO: 985560 - RNA, 19 nt, Homo sapiens
ggaaggaaaggauaaacug

SEQ ID NO: 985561 - RNA, 19 nt, Homo sapiens
gaauuacaaugcucaacag

SEQ ID NO: 985562 - RNA, 19 nt, Homo sapiens
gacuggacgucuagagaaa

SEQ ID NO: 985563 - RNA, 19 nt, Homo sapiens
ugagauuacacgucgauua

SEQ ID NO: 985564 - RNA, 19 nt, Homo sapiens
ggaugaagaugaggauagu

SEQ ID NO: 985565 - RNA, 19 nt, Homo sapiens
aauaggaagugaugaggaa

SEQ ID NO: 985566 - RNA, 19 nt, Homo sapiens
ugagacugaucaugaaaga

SEQ ID NO: 985567 - RNA, 19 nt, Homo sapiens
ggccuggaauuugaaagua

SEQ ID NO: 985568 - RNA, 19 nt, Homo sapiens
gauccugcuuugucaaugu

SEQ ID NO: 985569 - RNA, 19 nt, Homo sapiens
ucacaaaggaaguccauug

SEQ ID NO: 985570 - RNA, 19 nt, Homo sapiens
ggauugugauggccuggaa

SEQ ID NO: 985571 - RNA, 19 nt, Homo sapiens
gaacaaggcucucauccau

SEQ ID NO: 985572 - RNA, 19 nt, Homo sapiens
uaaauuugcugcucacuuu

SEQ ID NO: 985573 - RNA, 19 nt, Homo sapiens
guacagaagucauauggaa

SEQ ID NO: 985574 - RNA, 19 nt, Homo sapiens
gauaaguacugaacaaaug

SEQ ID NO: 985575 - RNA, 19 nt, Homo sapiens
gaacuuuguuuaugccuuu

SEQ ID NO: 985576 - RNA, 19 nt, Homo sapiens
gggaagcuaugugaaauua

SEQ ID NO: 985577 - RNA, 19 nt, Homo sapiens
agacuuaucugcaaucaaa

SEQ ID NO: 985578 - RNA, 19 nt, Homo sapiens
ggugagugcuucaguuaua

SEQ ID NO: 985579 - RNA, 19 nt, Homo sapiens
caacagaaccaaauaaaga

SEQ ID NO: 985580 - RNA, 19 nt, Homo sapiens
ggacagaauuucacuccaa

SEQ ID NO: 985581 - RNA, 19 nt, Homo sapiens
gcaaaggccugcauauuuu

SEQ ID NO: 985582 - RNA, 19 nt, Homo sapiens
guagagagccuuaaguuga

SEQ ID NO: 985583 - RNA, 19 nt, Homo sapiens
ggaagacaguacuuuagaa

SEQ ID NO: 985584 - RNA, 19 nt, Homo sapiens
gaacuuacaggacagaauu

SEQ ID NO: 985585 - RNA, 19 nt, Homo sapiens
ggagaagaauucacaguca

SEQ ID NO: 985586 - RNA, 19 nt, Homo sapiens
gaacuaaccuaacagucau

SEQ ID NO: 985587 - RNA, 19 nt, Homo sapiens
gcauuuagcuauuaugagu

SEQ ID NO: 985588 - RNA, 19 nt, Homo sapiens
gaaaugcgaugguuguucu

SEQ ID NO: 985589 - RNA, 19 nt, Homo sapiens
gaacacaguauacuaucua

SEQ ID NO: 985590 - RNA, 19 nt, Homo sapiens
gcagcuguguuucugauaa

SEQ ID NO: 985591 - RNA, 19 nt, Homo sapiens
gcaauuugguguggcauuu

SEQ ID NO: 985592 - RNA, 19 nt, Homo sapiens
ggccuuaucuuucuuuguu

SEQ ID NO: 985593 - RNA, 19 nt, Homo sapiens
ccacguguguaauguuaua

SEQ ID NO: 985594 - RNA, 19 nt, Homo sapiens
gcacacauaaggcgaagua

SEQ ID NO: 985595 - RNA, 19 nt, Homo sapiens
gaagacaguacuuuagaaa

SEQ ID NO: 985596 - RNA, 19 nt, Homo sapiens
gaagucaaaucuugcaaag

SEQ ID NO: 985597 - RNA, 19 nt, Homo sapiens
ggacaagaaguaaauaaug

SEQ ID NO: 985598 - RNA, 19 nt, Homo sapiens
gcauggcacucccaagauu

SEQ ID NO: 985599 - RNA, 19 nt, Homo sapiens
uagacaugcuggucauuua

SEQ ID NO: 985600 - RNA, 19 nt, Homo sapiens
uaaauaauguggcuggaau

SEQ ID NO: 985601 - RNA, 19 nt, Homo sapiens
caaaugaaaugcgaugguu

SEQ ID NO: 985602 - RNA, 19 nt, Homo sapiens
gaaauguuccaagcuguua

SEQ ID NO: 985603 - RNA, 19 nt, Homo sapiens
guccaagaauguacuuaua

SEQ ID NO: 985604 - RNA, 19 nt, Homo sapiens
uaauguggcuggaauacaa

SEQ ID NO: 985605 - RNA, 19 nt, Homo sapiens
gauggaaguuacacaaaug

SEQ ID NO: 985606 - RNA, 19 nt, Homo sapiens
cucccaagauugauaauua

SEQ ID NO: 985607 - RNA, 19 nt, Homo sapiens
agagauggcuacauucauu

SEQ ID NO: 985608 - RNA, 19 nt, Homo sapiens
ggaaauagugaccaagaaa

SEQ ID NO: 985609 - RNA, 19 nt, Homo sapiens
gaaauguuugucacucuua

SEQ ID NO: 985610 - RNA, 19 nt, Homo sapiens
ccacuuaaacgacuuacua

SEQ ID NO: 985611 - RNA, 19 nt, Homo sapiens
gaauguaucuaugcucuca

SEQ ID NO: 985612 - RNA, 19 nt, Homo sapiens
ggcgcgaacuuguuugaua

SEQ ID NO: 985613 - RNA, 19 nt, Homo sapiens
acaaaaugcuguucaguua

SEQ ID NO: 985614 - RNA, 19 nt, Homo sapiens
ucugagagguucuaacauu

SEQ ID NO: 985615 - RNA, 19 nt, Homo sapiens
ugucacaacuccauaaaug

SEQ ID NO: 985616 - RNA, 19 nt, Homo sapiens
guacuuauccuucaugcaa

SEQ ID NO: 985617 - RNA, 19 nt, Homo sapiens
ugagcaaguuuauaccaua

SEQ ID NO: 985618 - RNA, 19 nt, Homo sapiens
ccacuuauucugaguagua

SEQ ID NO: 985619 - RNA, 19 nt, Homo sapiens
cuccuaaucuuguacauaa

SEQ ID NO: 985620 - RNA, 19 nt, Homo sapiens
gaauacaaguugaacaaac

SEQ ID NO: 985621 - RNA, 19 nt, Homo sapiens
agucagagauggcuacauu

SEQ ID NO: 985622 - RNA, 19 nt, Homo sapiens
gauaggaaauagugaccaa

SEQ ID NO: 985623 - RNA, 19 nt, Homo sapiens
gaaggucauuuguaaagca

SEQ ID NO: 985624 - RNA, 19 nt, Homo sapiens
ccacaaaugucuccuacuc

SEQ ID NO: 985625 - RNA, 19 nt, Homo sapiens
gcgcgaacuuguuugauau

SEQ ID NO: 985626 - RNA, 19 nt, Homo sapiens
uaacuuugguccgaaauga

SEQ ID NO: 985627 - RNA, 19 nt, Homo sapiens
uguagaagcugaaacuaug

SEQ ID NO: 985628 - RNA, 19 nt, Homo sapiens
aagcuugugugcucaguua

SEQ ID NO: 985629 - RNA, 19 nt, Homo sapiens
gugccagacuuaugacuuu

SEQ ID NO: 985630 - RNA, 19 nt, Homo sapiens
ccaauagguuguucucuuc

SEQ ID NO: 985631 - RNA, 19 nt, Homo sapiens
gacagaauuucacuccaaa

SEQ ID NO: 985632 - RNA, 19 nt, Homo sapiens
gcuuauuucuuguaccuuu

SEQ ID NO: 985633 - RNA, 19 nt, Homo sapiens
cugagucucugauccaaua

SEQ ID NO: 985634 - RNA, 19 nt, Homo sapiens
caaaucugcuccaaucauc

SEQ ID NO: 985635 - RNA, 19 nt, Homo sapiens
guaacuuccuacaguguuu

SEQ ID NO: 985636 - RNA, 19 nt, Homo sapiens
gaacaaacuagaagacaca

SEQ ID NO: 985637 - RNA, 19 nt, Homo sapiens
caaagguggcucuguuuaa

SEQ ID NO: 985638 - RNA, 19 nt, Homo sapiens
uaaauuguuugccagcauu

SEQ ID NO: 985639 - RNA, 19 nt, Homo sapiens
agacaguacuuuagaaaca

SEQ ID NO: 985640 - RNA, 19 nt, Homo sapiens
agacacaaaucuaacauag

SEQ ID NO: 985641 - RNA, 19 nt, Homo sapiens
gcaaucauuagcacacaua

SEQ ID NO: 985642 - RNA, 19 nt, Homo sapiens
cagcuaaacuuggaaggaa

SEQ ID NO: 985643 - RNA, 19 nt, Homo sapiens
guacugagcaucuccacaa

SEQ ID NO: 985644 - RNA, 19 nt, Homo sapiens
gagaguaugcuccguguug

SEQ ID NO: 985645 - RNA, 19 nt, Homo sapiens
uagagagccuuaaguugaa

SEQ ID NO: 985646 - RNA, 19 nt, Homo sapiens
caagaaaugcagcagcuaa

SEQ ID NO: 985647 - RNA, 19 nt, Homo sapiens
gaaauagugaccaagaaau

SEQ ID NO: 985648 - RNA, 19 nt, Homo sapiens
aaugugggauggaugguua

SEQ ID NO: 985649 - RNA, 19 nt, Homo sapiens
gagccacaguaccuuauga

SEQ ID NO: 985650 - RNA, 19 nt, Homo sapiens
gcuggaagacaguacuuua

SEQ ID NO: 985651 - RNA, 19 nt, Homo sapiens
guacagguguggagagagu

SEQ ID NO: 985652 - RNA, 19 nt, Homo sapiens
gguaguuauuucuguguuu

SEQ ID NO: 985653 - RNA, 19 nt, Homo sapiens
aaacagcgauggaaguuac

SEQ ID NO: 985654 - RNA, 19 nt, Homo sapiens
gagauggcuacauucauua

SEQ ID NO: 985655 - RNA, 19 nt, Homo sapiens
gaucagaaggagaagaauu

SEQ ID NO: 985656 - RNA, 19 nt, Homo sapiens
ccagauacuugcauguaga

SEQ ID NO: 985657 - RNA, 19 nt, Homo sapiens
uggcaacggugaugacauu

SEQ ID NO: 985658 - RNA, 19 nt, Homo sapiens
ucucauccaugugcauuua

SEQ ID NO: 985659 - RNA, 19 nt, Homo sapiens
ccacuucucucuuauaagc

SEQ ID NO: 985660 - RNA, 19 nt, Homo sapiens
gcgaacuuguuugauauuu

SEQ ID NO: 985661 - RNA, 19 nt, Homo sapiens
cuucaaaucugcuccaauc

SEQ ID NO: 985662 - RNA, 19 nt, Homo sapiens
gugguuaaaucaguuauug

SEQ ID NO: 985663 - RNA, 19 nt, Homo sapiens
ggucuaaggcuggaacuuu

SEQ ID NO: 985664 - RNA, 19 nt, Homo sapiens
acaaaugccagcacaaauu

SEQ ID NO: 985665 - RNA, 19 nt, Homo sapiens
ggagguuccuuugaaacaa

SEQ ID NO: 985666 - RNA, 19 nt, Homo sapiens
gacuaaucgugaaauguuu

SEQ ID NO: 985667 - RNA, 19 nt, Homo sapiens
ugacuaaucgugaaauguu

SEQ ID NO: 985668 - RNA, 19 nt, Homo sapiens
ucuaugcucucaugacuau

SEQ ID NO: 985669 - RNA, 19 nt, Homo sapiens
ucaaguucaugaccuuauu

SEQ ID NO: 985670 - RNA, 19 nt, Homo sapiens
aaccacguguguaauguua

SEQ ID NO: 985671 - RNA, 19 nt, Homo sapiens
gaaauuggcuuuacgauga

SEQ ID NO: 985672 - RNA, 19 nt, Homo sapiens
gaacaaaccuuggaaaugu

SEQ ID NO: 985673 - RNA, 19 nt, Homo sapiens
gaucugaaguugcagguua

SEQ ID NO: 985674 - RNA, 19 nt, Homo sapiens
ugacauggcuggagaaauu

SEQ ID NO: 985675 - RNA, 19 nt, Homo sapiens
ggaacuugauguccaaaua

SEQ ID NO: 985676 - RNA, 19 nt, Homo sapiens
gaaccagccuucauguauu

SEQ ID NO: 985677 - RNA, 19 nt, Homo sapiens
gccaaggucuuacuacaua

SEQ ID NO: 985678 - RNA, 19 nt, Homo sapiens
gagaagugcuguauagaga

SEQ ID NO: 985679 - RNA, 19 nt, Homo sapiens
gaagaugagccucuguuua

SEQ ID NO: 985680 - RNA, 19 nt, Homo sapiens
gcaaagaaucucaaguaua

SEQ ID NO: 985681 - RNA, 19 nt, Homo sapiens
ugaaauggcuuuagugcaa

SEQ ID NO: 985682 - RNA, 19 nt, Homo sapiens
gaauacggcugagaugaaa

SEQ ID NO: 985683 - RNA, 19 nt, Homo sapiens
uaaacugucugaggacuua

SEQ ID NO: 985684 - RNA, 19 nt, Homo sapiens
gaaagauugugaagaaaca

SEQ ID NO: 985685 - RNA, 19 nt, Homo sapiens
guggaaagcugucuucuuc

SEQ ID NO: 985686 - RNA, 19 nt, Homo sapiens
gaacuugauguccaaauaa

SEQ ID NO: 985687 - RNA, 19 nt, Homo sapiens
gcacuacccugaagaacug

SEQ ID NO: 985688 - RNA, 19 nt, Homo sapiens
gaugcaagaugcuggaauu

SEQ ID NO: 985689 - RNA, 19 nt, Homo sapiens
guaaccacaucccucuuua

SEQ ID NO: 985690 - RNA, 19 nt, Homo sapiens
gcaagugucucagauaaag

SEQ ID NO: 985691 - RNA, 19 nt, Homo sapiens
ggaagagguuaaucauguu

SEQ ID NO: 985692 - RNA, 19 nt, Homo sapiens
gagaugaaaggauuuauug

SEQ ID NO: 985693 - RNA, 19 nt, Homo sapiens
ggucuucacuucagaaauc

SEQ ID NO: 985694 - RNA, 19 nt, Homo sapiens
gaagagguuaaucauguua

SEQ ID NO: 985695 - RNA, 19 nt, Homo sapiens
uaauguaacccuuguauga

SEQ ID NO: 985696 - RNA, 19 nt, Homo sapiens
gcaaagaaaguuguugaaa

SEQ ID NO: 985697 - RNA, 19 nt, Homo sapiens
gaauguaguggcucagaua

SEQ ID NO: 985698 - RNA, 19 nt, Homo sapiens
guaggcaucucuuggaaug

SEQ ID NO: 985699 - RNA, 19 nt, Homo sapiens
caacucugcuccagcugua

SEQ ID NO: 985700 - RNA, 19 nt, Homo sapiens
gcaagaugcuggaauuacu

SEQ ID NO: 985701 - RNA, 19 nt, Homo sapiens
gagcagauucuuuccauga

SEQ ID NO: 985702 - RNA, 19 nt, Homo sapiens
ugaaggaucugguguuaag

SEQ ID NO: 985703 - RNA, 19 nt, Homo sapiens
ugaauauccugacauguga

SEQ ID NO: 985704 - RNA, 19 nt, Homo sapiens
cauuaacgcuucuuuagau

SEQ ID NO: 985705 - RNA, 19 nt, Homo sapiens
uggaagagguuaaucaugu

SEQ ID NO: 985706 - RNA, 19 nt, Homo sapiens
aagcaagugucucagauaa

SEQ ID NO: 985707 - RNA, 19 nt, Homo sapiens
gcaagcaagugucucagau

SEQ ID NO: 985708 - RNA, 19 nt, Homo sapiens
ggaauacggcugagaugaa

SEQ ID NO: 985709 - RNA, 19 nt, Homo sapiens
cauaguauuuguugaccua

SEQ ID NO: 985710 - RNA, 19 nt, Homo sapiens
ugccugcgcuguucuauuu

SEQ ID NO: 985711 - RNA, 19 nt, Homo sapiens
gaagaaacacagucaaugg

SEQ ID NO: 985712 - RNA, 19 nt, Homo sapiens
ccagaauuaucuugugauu

SEQ ID NO: 985713 - RNA, 19 nt, Homo sapiens
aaccagccuucauguauua

SEQ ID NO: 985714 - RNA, 19 nt, Homo sapiens
ggauuugcuuguuccagua

SEQ ID NO: 985715 - RNA, 19 nt, Homo sapiens
ggaacaaaccuuggaaaug

SEQ ID NO: 985716 - RNA, 19 nt, Homo sapiens
caaaauggaugacuuagug

SEQ ID NO: 985717 - RNA, 19 nt, Homo sapiens
gcauucagcugagccaaga

SEQ ID NO: 985718 - RNA, 19 nt, Homo sapiens
gcauuuacacucgcaguua

SEQ ID NO: 985719 - RNA, 19 nt, Homo sapiens
cuaugugucuucugcauuu

SEQ ID NO: 985720 - RNA, 19 nt, Homo sapiens
ccugaaggaucugguguua

SEQ ID NO: 985721 - RNA, 19 nt, Homo sapiens
ggaaugugcuaaggaacuu

SEQ ID NO: 985722 - RNA, 19 nt, Homo sapiens
cggcugagaugaaaggauu

SEQ ID NO: 985723 - RNA, 19 nt, Homo sapiens
gagugaauauccugacaug

SEQ ID NO: 985724 - RNA, 19 nt, Homo sapiens
guuuaugacuuucggcuuu

SEQ ID NO: 985725 - RNA, 19 nt, Homo sapiens
gauaaugggagauuuagau

SEQ ID NO: 985726 - RNA, 19 nt, Homo sapiens
ggacuuaaauaccauucca

SEQ ID NO: 985727 - RNA, 19 nt, Homo sapiens
gauaaaguaugcagcaaaa

SEQ ID NO: 985728 - RNA, 19 nt, Homo sapiens
uuggaaagauugugaagaa

SEQ ID NO: 985729 - RNA, 19 nt, Homo sapiens
uaggagaagugcuguauag

SEQ ID NO: 985730 - RNA, 19 nt, Homo sapiens
guauccagauuuaaaccua

SEQ ID NO: 985731 - RNA, 19 nt, Homo sapiens
ggaagaugagccucuguuu

SEQ ID NO: 985732 - RNA, 19 nt, Homo sapiens
uaaauuucccucuggagua

SEQ ID NO: 985733 - RNA, 19 nt, Homo sapiens
ccauggaggucuucacuuc

SEQ ID NO: 985734 - RNA, 19 nt, Homo sapiens
gagagcaguucgacuucaa

SEQ ID NO: 985735 - RNA, 19 nt, Homo sapiens
caacagaagauaauauugg

SEQ ID NO: 985736 - RNA, 19 nt, Homo sapiens
cauuuacacucgcaguuaa

SEQ ID NO: 985737 - RNA, 19 nt, Homo sapiens
ggaauuacuucagacucaa

SEQ ID NO: 985738 - RNA, 19 nt, Homo sapiens
guaaaguguuugguaaauc

SEQ ID NO: 985739 - RNA, 19 nt, Homo sapiens
ggauuuguguuuaaagucu

SEQ ID NO: 985740 - RNA, 19 nt, Homo sapiens
gcauuaacgcuucuuuaga

SEQ ID NO: 985741 - RNA, 19 nt, Homo sapiens
agaaauacaaggaagauga

SEQ ID NO: 985742 - RNA, 19 nt, Homo sapiens
uaaggaacuugauguccaa

SEQ ID NO: 985743 - RNA, 19 nt, Homo sapiens
gauaaagccauucuacaca

SEQ ID NO: 985744 - RNA, 19 nt, Homo sapiens
ugucuuuccugguuuauga

SEQ ID NO: 985745 - RNA, 19 nt, Homo sapiens
gaaauagauguguauaugg

SEQ ID NO: 985746 - RNA, 19 nt, Homo sapiens
caacaaaauggaugacuua

SEQ ID NO: 985747 - RNA, 19 nt, Homo sapiens
cagcuuucaucuauaauuc

SEQ ID NO: 985748 - RNA, 19 nt, Homo sapiens
gagccaagaagacagcuuu

SEQ ID NO: 985749 - RNA, 19 nt, Homo sapiens
cagacucaaugaugaagaa

SEQ ID NO: 985750 - RNA, 19 nt, Homo sapiens
gcuuuacgaugaacauguu

SEQ ID NO: 985751 - RNA, 19 nt, Homo sapiens
gaggguaacaugaaguuug

SEQ ID NO: 985752 - RNA, 19 nt, Homo sapiens
gcacguaaucacccaaaug

SEQ ID NO: 985753 - RNA, 19 nt, Homo sapiens
caagcaagugucucagaua

SEQ ID NO: 985754 - RNA, 19 nt, Homo sapiens
guaaauuugugcuuugaac

SEQ ID NO: 985755 - RNA, 19 nt, Homo sapiens
agacauugguggaggauuc

SEQ ID NO: 985756 - RNA, 19 nt, Homo sapiens
gaagaaaauugcacguaau

SEQ ID NO: 985757 - RNA, 19 nt, Homo sapiens
gugaauauccugacaugug

SEQ ID NO: 985758 - RNA, 19 nt, Homo sapiens
uguagcaguuuguugcaua

SEQ ID NO: 985759 - RNA, 19 nt, Homo sapiens
ugagagauguaucaguuuc

SEQ ID NO: 985760 - RNA, 19 nt, Homo sapiens
uuugagagauguaucaguu

SEQ ID NO: 985761 - RNA, 19 nt, Homo sapiens
uuccagagguucacaagaa

SEQ ID NO: 985762 - RNA, 19 nt, Homo sapiens
gaaugaugguguuuauggu

SEQ ID NO: 985763 - RNA, 19 nt, Homo sapiens
gguaaccacaucccucuuu

SEQ ID NO: 985764 - RNA, 19 nt, Homo sapiens
gggguuaaauuucauguuu

SEQ ID NO: 985765 - RNA, 19 nt, Homo sapiens
gaacuguaggcaucucuug

SEQ ID NO: 985766 - RNA, 19 nt, Homo sapiens
cagagguucacaagaaaua

SEQ ID NO: 985767 - RNA, 19 nt, Homo sapiens
gauaucuacuuuccugaag

SEQ ID NO: 985768 - RNA, 19 nt, Homo sapiens
gcaacagaagauaauauug

SEQ ID NO: 985769 - RNA, 19 nt, Homo sapiens
ugaagaaaauugcacguaa

SEQ ID NO: 985770 - RNA, 19 nt, Homo sapiens
gaaauccaagacucauauu

SEQ ID NO: 985771 - RNA, 19 nt, Homo sapiens
gaaauuggcuuuacgauga

SEQ ID NO: 985772 - RNA, 19 nt, Homo sapiens
gaacaaaccuuggaaaugu

SEQ ID NO: 985773 - RNA, 19 nt, Homo sapiens
gaucugaaguugcagguua

SEQ ID NO: 985774 - RNA, 19 nt, Homo sapiens
ugacauggcuggagaaauu

SEQ ID NO: 985775 - RNA, 19 nt, Homo sapiens
ggaacuugauguccaaaua

SEQ ID NO: 985776 - RNA, 19 nt, Homo sapiens
gaaccagccuucauguauu

SEQ ID NO: 985777 - RNA, 19 nt, Homo sapiens
gccaaggucuuacuacaua

SEQ ID NO: 985778 - RNA, 19 nt, Homo sapiens
gagaagugcuguauagaga

SEQ ID NO: 985779 - RNA, 19 nt, Homo sapiens
gaagaugagccucuguuua

SEQ ID NO: 985780 - RNA, 19 nt, Homo sapiens
gcaaagaaucucaaguaua

SEQ ID NO: 985781 - RNA, 19 nt, Homo sapiens
ugaaauggcuuuagugcaa

SEQ ID NO: 985782 - RNA, 19 nt, Homo sapiens
gaauacggcugagaugaaa

SEQ ID NO: 985783 - RNA, 19 nt, Homo sapiens
uaaacugucugaggacuua

SEQ ID NO: 985784 - RNA, 19 nt, Homo sapiens
gaaagauugugaagaaaca

SEQ ID NO: 985785 - RNA, 19 nt, Homo sapiens
guggaaagcugucuucuuc

SEQ ID NO: 985786 - RNA, 19 nt, Homo sapiens
gaacuugauguccaaauaa

SEQ ID NO: 985787 - RNA, 19 nt, Homo sapiens
gcacuacccugaagaacug

SEQ ID NO: 985788 - RNA, 19 nt, Homo sapiens
gaugcaagaugcuggaauu

SEQ ID NO: 985789 - RNA, 19 nt, Homo sapiens
guaaccacaucccucuuua

SEQ ID NO: 985790 - RNA, 19 nt, Homo sapiens
gcaagugucucagauaaag

SEQ ID NO: 985791 - RNA, 19 nt, Homo sapiens
ggaagagguuaaucauguu

SEQ ID NO: 985792 - RNA, 19 nt, Homo sapiens
gagaugaaaggauuuauug

SEQ ID NO: 985793 - RNA, 19 nt, Homo sapiens
gaagagguuaaucauguua

SEQ ID NO: 985794 - RNA, 19 nt, Homo sapiens
uaauguaacccuuguauga

SEQ ID NO: 985795 - RNA, 19 nt, Homo sapiens
gcaaagaaaguuguugaaa

SEQ ID NO: 985796 - RNA, 19 nt, Homo sapiens
gaauguaguggcucagaua

SEQ ID NO: 985797 - RNA, 19 nt, Homo sapiens
guaggcaucucuuggaaug

SEQ ID NO: 985798 - RNA, 19 nt, Homo sapiens
caacucugcuccagcugua

SEQ ID NO: 985799 - RNA, 19 nt, Homo sapiens
gcaagaugcuggaauuacu

SEQ ID NO: 985800 - RNA, 19 nt, Homo sapiens
gagcagauucuuuccauga

SEQ ID NO: 985801 - RNA, 19 nt, Homo sapiens
ugaaggaucugguguuaag

SEQ ID NO: 985802 - RNA, 19 nt, Homo sapiens
ugaauauccugacauguga

SEQ ID NO: 985803 - RNA, 19 nt, Homo sapiens
cauuaacgcuucuuuagau

SEQ ID NO: 985804 - RNA, 19 nt, Homo sapiens
uggaagagguuaaucaugu

SEQ ID NO: 985805 - RNA, 19 nt, Homo sapiens
aagcaagugucucagauaa

SEQ ID NO: 985806 - RNA, 19 nt, Homo sapiens
gcaagcaagugucucagau

SEQ ID NO: 985807 - RNA, 19 nt, Homo sapiens
ggaauacggcugagaugaa

SEQ ID NO: 985808 - RNA, 19 nt, Homo sapiens
cauaguauuuguugaccua

SEQ ID NO: 985809 - RNA, 19 nt, Homo sapiens
ugccugcgcuguucuauuu

SEQ ID NO: 985810 - RNA, 19 nt, Homo sapiens
gaagaaacacagucaaugg

SEQ ID NO: 985811 - RNA, 19 nt, Homo sapiens
aaccagccuucauguauua

SEQ ID NO: 985812 - RNA, 19 nt, Homo sapiens
ggauuugcuuguuccagua

SEQ ID NO: 985813 - RNA, 19 nt, Homo sapiens
ggaacaaaccuuggaaaug

SEQ ID NO: 985814 - RNA, 19 nt, Homo sapiens
caaaauggaugacuuagug

SEQ ID NO: 985815 - RNA, 19 nt, Homo sapiens
gcauucagcugagccaaga

SEQ ID NO: 985816 - RNA, 19 nt, Homo sapiens
gcauuuacacucgcaguua

SEQ ID NO: 985817 - RNA, 19 nt, Homo sapiens
cuaugugucuucugcauuu

SEQ ID NO: 985818 - RNA, 19 nt, Homo sapiens
ccugaaggaucugguguua

SEQ ID NO: 985819 - RNA, 19 nt, Homo sapiens
ggaaugugcuaaggaacuu

SEQ ID NO: 985820 - RNA, 19 nt, Homo sapiens
cggcugagaugaaaggauu

SEQ ID NO: 985821 - RNA, 19 nt, Homo sapiens
gagugaauauccugacaug

SEQ ID NO: 985822 - RNA, 19 nt, Homo sapiens
guuuaugacuuucggcuuu

SEQ ID NO: 985823 - RNA, 19 nt, Homo sapiens
gauaaugggagauuuagau

SEQ ID NO: 985824 - RNA, 19 nt, Homo sapiens
ggacuuaaauaccauucca

SEQ ID NO: 985825 - RNA, 19 nt, Homo sapiens
gauaaaguaugcagcaaaa

SEQ ID NO: 985826 - RNA, 19 nt, Homo sapiens
uuggaaagauugugaagaa

SEQ ID NO: 985827 - RNA, 19 nt, Homo sapiens
uaggagaagugcuguauag

SEQ ID NO: 985828 - RNA, 19 nt, Homo sapiens
guauccagauuuaaaccua

SEQ ID NO: 985829 - RNA, 19 nt, Homo sapiens
ggaagaugagccucuguuu

SEQ ID NO: 985830 - RNA, 19 nt, Homo sapiens
uaaauuucccucuggagua

SEQ ID NO: 985831 - RNA, 19 nt, Homo sapiens
gagagcaguucgacuucaa

SEQ ID NO: 985832 - RNA, 19 nt, Homo sapiens
caacagaagauaauauugg

SEQ ID NO: 985833 - RNA, 19 nt, Homo sapiens
cauuuacacucgcaguuaa

SEQ ID NO: 985834 - RNA, 19 nt, Homo sapiens
ggaauuacuucagacucaa

SEQ ID NO: 985835 - RNA, 19 nt, Homo sapiens
guaaaguguuugguaaauc

SEQ ID NO: 985836 - RNA, 19 nt, Homo sapiens
ggauuuguguuuaaagucu

SEQ ID NO: 985837 - RNA, 19 nt, Homo sapiens
gcauuaacgcuucuuuaga

SEQ ID NO: 985838 - RNA, 19 nt, Homo sapiens
agaaauacaaggaagauga

SEQ ID NO: 985839 - RNA, 19 nt, Homo sapiens
uaaggaacuugauguccaa

SEQ ID NO: 985840 - RNA, 19 nt, Homo sapiens
gauaaagccauucuacaca

SEQ ID NO: 985841 - RNA, 19 nt, Homo sapiens
ugucuuuccugguuuauga

SEQ ID NO: 985842 - RNA, 19 nt, Homo sapiens
gaaauagauguguauaugg

SEQ ID NO: 985843 - RNA, 19 nt, Homo sapiens
caacaaaauggaugacuua

SEQ ID NO: 985844 - RNA, 19 nt, Homo sapiens
cagcuuucaucuauaauuc

SEQ ID NO: 985845 - RNA, 19 nt, Homo sapiens
gagccaagaagacagcuuu

SEQ ID NO: 985846 - RNA, 19 nt, Homo sapiens
cagacucaaugaugaagaa

SEQ ID NO: 985847 - RNA, 19 nt, Homo sapiens
gcuuuacgaugaacauguu

SEQ ID NO: 985848 - RNA, 19 nt, Homo sapiens
gaggguaacaugaaguuug

SEQ ID NO: 985849 - RNA, 19 nt, Homo sapiens
gcacguaaucacccaaaug

SEQ ID NO: 985850 - RNA, 19 nt, Homo sapiens
caagcaagugucucagaua

SEQ ID NO: 985851 - RNA, 19 nt, Homo sapiens
guaaauuugugcuuugaac

SEQ ID NO: 985852 - RNA, 19 nt, Homo sapiens
agacauugguggaggauuc

SEQ ID NO: 985853 - RNA, 19 nt, Homo sapiens
gaagaaaauugcacguaau

SEQ ID NO: 985854 - RNA, 19 nt, Homo sapiens
gugaauauccugacaugug

SEQ ID NO: 985855 - RNA, 19 nt, Homo sapiens
ucucccaacuuguccauuu

SEQ ID NO: 985856 - RNA, 19 nt, Homo sapiens
uuccagagguucacaagaa

SEQ ID NO: 985857 - RNA, 19 nt, Homo sapiens
gaaugaugguguuuauggu

SEQ ID NO: 985858 - RNA, 19 nt, Homo sapiens
gggguuaaauuucauguuu

SEQ ID NO: 985859 - RNA, 19 nt, Homo sapiens
gaacuguaggcaucucuug

SEQ ID NO: 985860 - RNA, 19 nt, Homo sapiens
gguaaccacaucccucuuu

SEQ ID NO: 985861 - RNA, 19 nt, Homo sapiens
cagagguucacaagaaaua

SEQ ID NO: 985862 - RNA, 19 nt, Homo sapiens
gauaucuacuuuccugaag

SEQ ID NO: 985863 - RNA, 19 nt, Homo sapiens
gcaacagaagauaauauug

SEQ ID NO: 985864 - RNA, 19 nt, Homo sapiens
ugaagaaaauugcacguaa

SEQ ID NO: 985865 - RNA, 19 nt, Homo sapiens
gggagcagauucuuuccau

SEQ ID NO: 985866 - RNA, 19 nt, Homo sapiens
uugcaaagaaucucaagua

SEQ ID NO: 985867 - RNA, 19 nt, Homo sapiens
gugaagaggguaacaugaa

SEQ ID NO: 985868 - RNA, 19 nt, Homo sapiens
ggaaccggauuugcuuguu

SEQ ID NO: 985869 - RNA, 19 nt, Homo sapiens
ucucuugucuuuccugguu

SEQ ID NO: 985870 - RNA, 19 nt, Homo sapiens
gaccuaauguaacccuugu

SEQ ID NO: 985871 - RNA, 19 nt, Homo sapiens
gaaagaacuugaccaauua

SEQ ID NO: 985872 - RNA, 19 nt, Homo sapiens
caagagagauccaagauua

SEQ ID NO: 985873 - RNA, 19 nt, Homo sapiens
gcagagaucuccauucaau

SEQ ID NO: 985874 - RNA, 19 nt, Homo sapiens
agaaagaacuugaccaauu

SEQ ID NO: 985875 - RNA, 19 nt, Homo sapiens
gaugaaauauucccuuuga

SEQ ID NO: 985876 - RNA, 19 nt, Homo sapiens
gagcagagaucuccauuca

SEQ ID NO: 985877 - RNA, 19 nt, Homo sapiens
gcaggaaacauccaauuua

SEQ ID NO: 985878 - RNA, 19 nt, Homo sapiens
ugaaggacccaauaaauua

SEQ ID NO: 985879 - RNA, 19 nt, Homo sapiens
gaagacagaccguuauuug

SEQ ID NO: 985880 - RNA, 19 nt, Homo sapiens
caaagaugaugaugugaaa

SEQ ID NO: 985881 - RNA, 19 nt, Homo sapiens
gaacuugaccaauuagauu

SEQ ID NO: 985882 - RNA, 19 nt, Homo sapiens
cagagaagcuuccuguuau

SEQ ID NO: 985883 - RNA, 19 nt, Homo sapiens
ccagggagaucgaguacua

SEQ ID NO: 985884 - RNA, 19 nt, Homo sapiens
caaaucagcauucuacaaa

SEQ ID NO: 985885 - RNA, 19 nt, Homo sapiens
gauccugcuuggccuauua

SEQ ID NO: 985886 - RNA, 19 nt, Homo sapiens
ucagauuccuaaagaguua

SEQ ID NO: 985887 - RNA, 19 nt, Homo sapiens
gaaaucacccucaccuuug

SEQ ID NO: 985888 - RNA, 19 nt, Homo sapiens
gagcuaagcagucacauau

SEQ ID NO: 985889 - RNA, 19 nt, Homo sapiens
ggauaaagaugagcacaug

SEQ ID NO: 985890 - RNA, 19 nt, Homo sapiens
ggaccauccuuacaaauuc

SEQ ID NO: 985891 - RNA, 19 nt, Homo sapiens
gaaauauucccuuugaaga

SEQ ID NO: 985892 - RNA, 19 nt, Homo sapiens
agacagaaaugcuaagaga

SEQ ID NO: 985893 - RNA, 19 nt, Homo sapiens
aguaugagguugucugaua

SEQ ID NO: 985894 - RNA, 19 nt, Homo sapiens
ucagagaagcuuccuguua

SEQ ID NO: 985895 - RNA, 19 nt, Homo sapiens
gaaggacccaauaaauuaa

SEQ ID NO: 985896 - RNA, 19 nt, Homo sapiens
ccaugugaauccuaaauuu

SEQ ID NO: 985897 - RNA, 19 nt, Homo sapiens
caaugaucguuuccacuua

SEQ ID NO: 985898 - RNA, 19 nt, Homo sapiens
aaagacgagugaacguuua

SEQ ID NO: 985899 - RNA, 19 nt, Homo sapiens
gcacugaaccaaaggagaa

SEQ ID NO: 985900 - RNA, 19 nt, Homo sapiens
aaacgaaggcaaagaagua

SEQ ID NO: 985901 - RNA, 19 nt, Homo sapiens
gaagucauccgaacacaga

SEQ ID NO: 985902 - RNA, 19 nt, Homo sapiens
gaccugaccuucaauagca

SEQ ID NO: 985903 - RNA, 19 nt, Homo sapiens
uaagcgaccucgauaugaa

SEQ ID NO: 985904 - RNA, 19 nt, Homo sapiens
cagcaucgauuaaguguag

SEQ ID NO: 985905 - RNA, 19 nt, Homo sapiens
ggagaucgaguacuagaaa

SEQ ID NO: 985906 - RNA, 19 nt, Homo sapiens
gaacaagagagauccaaga

SEQ ID NO: 985907 - RNA, 19 nt, Homo sapiens
cgaaaucacccucaccuuu

SEQ ID NO: 985908 - RNA, 19 nt, Homo sapiens
gaaaucugguugggaagaa

SEQ ID NO: 985909 - RNA, 19 nt, Homo sapiens
gcaagccgcacaucaauau

SEQ ID NO: 985910 - RNA, 19 nt, Homo sapiens
gaacacagacuggcuggaa

SEQ ID NO: 985911 - RNA, 19 nt, Homo sapiens
gcaaagaugaugaugugaa

SEQ ID NO: 985912 - RNA, 19 nt, Homo sapiens
gcaacagcaucgauuaagu

SEQ ID NO: 985913 - RNA, 19 nt, Homo sapiens
gcagcaacagcaucgauua

SEQ ID NO: 985914 - RNA, 19 nt, Homo sapiens
aagucuaggucaccaauua

SEQ ID NO: 985915 - RNA, 19 nt, Homo sapiens
gcuaagcagucacauaugg

SEQ ID NO: 985916 - RNA, 19 nt, Homo sapiens
gaucugcaccauccaaauu

SEQ ID NO: 985917 - RNA, 19 nt, Homo sapiens
caggaaacauccaauuuag

SEQ ID NO: 985918 - RNA, 19 nt, Homo sapiens
ggucaccaauuauacauuc

SEQ ID NO: 985919 - RNA, 19 nt, Homo sapiens
ggaaacauccaauuuaggu

SEQ ID NO: 985920 - RNA, 19 nt, Homo sapiens
caauuuagguccuggaucu

SEQ ID NO: 985921 - RNA, 19 nt, Homo sapiens
ucaagaaggugugcgagaa

SEQ ID NO: 985922 - RNA, 19 nt, Homo sapiens
gaggagcgaccacaagaaa

SEQ ID NO: 985923 - RNA, 19 nt, Homo sapiens
uaagaccgauggcaaagau

SEQ ID NO: 985924 - RNA, 19 nt, Homo sapiens
gacagaccguuauuugaug

SEQ ID NO: 985925 - RNA, 19 nt, Homo sapiens
gagaaguacuaaacaggau

SEQ ID NO: 985926 - RNA, 19 nt, Homo sapiens
uggcaaagaugaugaugug

SEQ ID NO: 985927 - RNA, 19 nt, Homo sapiens
ggauaagaccgauggcaaa

SEQ ID NO: 985928 - RNA, 19 nt, Homo sapiens
gcauccaugugaauccuaa

SEQ ID NO: 985929 - RNA, 19 nt, Homo sapiens
gauacaaaucagcgacuua

SEQ ID NO: 985930 - RNA, 19 nt, Homo sapiens
cgacagcuauuucaguauc

SEQ ID NO: 985931 - RNA, 19 nt, Homo sapiens
gaggacgccugucgggauu

SEQ ID NO: 985932 - RNA, 19 nt, Homo sapiens
gucaagcacuaaaggaauu

SEQ ID NO: 985933 - RNA, 19 nt, Homo sapiens
aaucaagaaucggaaagua

SEQ ID NO: 985934 - RNA, 19 nt, Homo sapiens
caucuccacuccuccaauu

SEQ ID NO: 985935 - RNA, 19 nt, Homo sapiens
ugucagagucaauucauua

SEQ ID NO: 985936 - RNA, 19 nt, Homo sapiens
uacaugggaugaaauauuc

SEQ ID NO: 985937 - RNA, 19 nt, Homo sapiens
gaagcuuccuguuauguac

SEQ ID NO: 985938 - RNA, 19 nt, Homo sapiens
uuuagcaucuggugaaauu

SEQ ID NO: 985939 - RNA, 19 nt, Homo sapiens
gcaucaaauucgacagcua

SEQ ID NO: 985940 - RNA, 19 nt, Homo sapiens
ggagcuaagcagucacaua

SEQ ID NO: 985941 - RNA, 19 nt, Homo sapiens
guaugagguugucugauau

SEQ ID NO: 985942 - RNA, 19 nt, Homo sapiens
uaaaccagucugauacuaa

SEQ ID NO: 985943 - RNA, 19 nt, Homo sapiens
cagagucaauucauuagau

SEQ ID NO: 985944 - RNA, 19 nt, Homo sapiens
ucaauaugcugaccauucu

SEQ ID NO: 985945 - RNA, 19 nt, Homo sapiens
gaaacuacaaaucagcauu

SEQ ID NO: 985946 - RNA, 19 nt, Homo sapiens
gagguugucugauaugaac

SEQ ID NO: 985947 - RNA, 19 nt, Homo sapiens
ccauccaaauuacauguuu

SEQ ID NO: 985948 - RNA, 19 nt, Homo sapiens
gaaacuuuaugcccuggau

SEQ ID NO: 985949 - RNA, 19 nt, Homo sapiens
uuauguaccuuauggauuc

SEQ ID NO: 985950 - RNA, 19 nt, Homo sapiens
aaugaucguuuccacuuaa

SEQ ID NO: 985951 - RNA, 19 nt, Homo sapiens
gagagcuggucaagcacua

SEQ ID NO: 985952 - RNA, 19 nt, Homo sapiens
cacaagaaacuacaaauca

SEQ ID NO: 985953 - RNA, 19 nt, Homo sapiens
uaagagaaguacuaaacag

SEQ ID NO: 985954 - RNA, 19 nt, Homo sapiens
gaagacagaaaugcuaaga

SEQ ID NO: 985955 - RNA, 19 nt, Homo sapiens
uaaagcuccucaucagguu

SEQ ID NO: 985956 - RNA, 19 nt, Homo sapiens
uguuagaacuucagcagaa

SEQ ID NO: 985957 - RNA, 19 nt, Homo sapiens
acuaauaaggcaacaguua

SEQ ID NO: 985958 - RNA, 19 nt, Homo sapiens
cuacaugggaugaaauauu

SEQ ID NO: 985959 - RNA, 19 nt, Homo sapiens
caacagcaucgauuaagug

SEQ ID NO: 985960 - RNA, 19 nt, Homo sapiens
gcuaagagaaguacuaaac

SEQ ID NO: 985961 - RNA, 19 nt, Homo sapiens
accuaaagcuggaaagauu

SEQ ID NO: 985962 - RNA, 19 nt, Homo sapiens
gauaggcggucacccaaac

SEQ ID NO: 985963 - RNA, 19 nt, Homo sapiens
cagacuggcuggaaguaga

SEQ ID NO: 985964 - RNA, 19 nt, Homo sapiens
ucagauaaaccauuuguag

SEQ ID NO: 985965 - RNA, 19 nt, Homo sapiens
caaagaaguaugucuccaa

SEQ ID NO: 985966 - RNA, 19 nt, Homo sapiens
uuacauguuucacagauuc

SEQ ID NO: 985967 - RNA, 19 nt, Homo sapiens
gaauacgucuagcauccau

SEQ ID NO: 985968 - RNA, 19 nt, Homo sapiens
caagagauggcccaacgaa

SEQ ID NO: 985969 - RNA, 19 nt, Homo sapiens
gaaguacuaaacaggauau

SEQ ID NO: 985970 - RNA, 19 nt, Homo sapiens
gggaagacagaaaugcuaa

SEQ ID NO: 985971 - RNA, 19 nt, Homo sapiens
ugaagcagcugucgaagua

SEQ ID NO: 985972 - RNA, 19 nt, Homo sapiens
gaacaggcauggacguuuc

SEQ ID NO: 985973 - RNA, 19 nt, Homo sapiens
uggagaaacucaagaauga

SEQ ID NO: 985974 - RNA, 19 nt, Homo sapiens
ucaacaagaucgacaagaa

SEQ ID NO: 985975 - RNA, 19 nt, Homo sapiens
ggacauaggaaacccuuaa

SEQ ID NO: 985976 - RNA, 19 nt, Homo sapiens
gaacacagaggacauagga

SEQ ID NO: 985977 - RNA, 19 nt, Homo sapiens
ggcagaagcuggucaguca

SEQ ID NO: 985978 - RNA, 19 nt, Homo sapiens
gcagcagcaucuaauuaaa

SEQ ID NO: 985979 - RNA, 19 nt, Homo sapiens
gagaaggcccuccauguga

SEQ ID NO: 985980 - RNA, 19 nt, Homo sapiens
acaaggaccucccaagugu

SEQ ID NO: 985981 - RNA, 19 nt, Homo sapiens
cagcagcagcaucuaauua

SEQ ID NO: 985982 - RNA, 19 nt, Homo sapiens
uagguuagcuuuccugcuu

SEQ ID NO: 985983 - RNA, 19 nt, Homo sapiens
ggcguuggccgacuucuua

SEQ ID NO: 985984 - RNA, 19 nt, Homo sapiens
ucaccugucuucaaccauu

SEQ ID NO: 985985 - RNA, 19 nt, Homo sapiens
gguguuggcuuccuuagag

SEQ ID NO: 985986 - RNA, 19 nt, Homo sapiens
gcagacagcaguacagaca

SEQ ID NO: 985987 - RNA, 19 nt, Homo sapiens
gggauucucuggucacagu

SEQ ID NO: 985988 - RNA, 19 nt, Homo sapiens
ccaagacccgggacgaaua

SEQ ID NO: 985989 - RNA, 19 nt, Homo sapiens
gcucacagcccaacuccaa

SEQ ID NO: 985990 - RNA, 19 nt, Homo sapiens
ccaaacagcaguaccuaug

SEQ ID NO: 985991 - RNA, 19 nt, Homo sapiens
ccucagcccucacggcauu

SEQ ID NO: 985992 - RNA, 19 nt, Homo sapiens
gaaccaaccaucacaacuc

SEQ ID NO: 985993 - RNA, 19 nt, Homo sapiens
acacacgccuccugucaga

SEQ ID NO: 985994 - RNA, 19 nt, Homo sapiens
acacagaggacauaggaaa

SEQ ID NO: 985995 - RNA, 19 nt, Homo sapiens
cgacaagaacgaagacaga

SEQ ID NO: 985996 - RNA, 19 nt, Homo sapiens
gacaaggaccucccaagug

SEQ ID NO: 985997 - RNA, 19 nt, Homo sapiens
caaccaccacugaaauuug

SEQ ID NO: 985998 - RNA, 19 nt, Homo sapiens
gagcgucucgugugugcua

SEQ ID NO: 985999 - RNA, 19 nt, Homo sapiens
ggaacaggcauggacguuu

SEQ ID NO: 986000 - RNA, 19 nt, Homo sapiens
aacaagaaaucucaagcuu

SEQ ID NO: 986001 - RNA, 19 nt, Homo sapiens
cgucagugauccuaugaau

SEQ ID NO: 986002 - RNA, 19 nt, Homo sapiens
ccaggcucauuauccauuu

SEQ ID NO: 986003 - RNA, 19 nt, Homo sapiens
gagaaacucaagaaugaca

SEQ ID NO: 986004 - RNA, 19 nt, Homo sapiens
ugagaucgcccuggagaaa

SEQ ID NO: 986005 - RNA, 19 nt, Homo sapiens
ccaaagcccgcuguggaua

SEQ ID NO: 986006 - RNA, 19 nt, Homo sapiens
ccuacucguuccuauagaa

SEQ ID NO: 986007 - RNA, 19 nt, Homo sapiens
gaaacucaagaaugacaug

SEQ ID NO: 986008 - RNA, 19 nt, Homo sapiens
gcagcagcagcaucuaauu

SEQ ID NO: 986009 - RNA, 19 nt, Homo sapiens
gagacauucauaacaagaa

SEQ ID NO: 986010 - RNA, 19 nt, Homo sapiens
ugugaaggaugaagagcaa

SEQ ID NO: 986011 - RNA, 19 nt, Homo sapiens
ucugcaagcuggaugacaa

SEQ ID NO: 986012 - RNA, 19 nt, Homo sapiens
ccaaccaccacugaaauuu

SEQ ID NO: 986013 - RNA, 19 nt, Homo sapiens
cagcagcaucuaauuaaau

SEQ ID NO: 986014 - RNA, 19 nt, Homo sapiens
gcauggcugucgugucuac

SEQ ID NO: 986015 - RNA, 19 nt, Homo sapiens
guuagagcgucucgugugu

SEQ ID NO: 986016 - RNA, 19 nt, Homo sapiens
cagcagcagcagcaucuaa

SEQ ID NO: 986017 - RNA, 19 nt, Homo sapiens
ucagugauccuaugaaugc

SEQ ID NO: 986018 - RNA, 19 nt, Homo sapiens
gacauaggaaacccuuaaa

SEQ ID NO: 986019 - RNA, 19 nt, Homo sapiens
ccacaccuguacagaacug

SEQ ID NO: 986020 - RNA, 19 nt, Homo sapiens
cgaaaucccacaccuguac

SEQ ID NO: 986021 - RNA, 19 nt, Homo sapiens
cagaagcuggucagucaaa

SEQ ID NO: 986022 - RNA, 19 nt, Homo sapiens
ugacaaggaccucccaagu

SEQ ID NO: 986023 - RNA, 19 nt, Homo sapiens
caagaucgacaagaacgaa

SEQ ID NO: 986024 - RNA, 19 nt, Homo sapiens
aaccaccacugaaauuugu

SEQ ID NO: 986025 - RNA, 19 nt, Homo sapiens
uagagaaggcccuccaugu

SEQ ID NO: 986026 - RNA, 19 nt, Homo sapiens
gcucaccugucuucaacca

SEQ ID NO: 986027 - RNA, 19 nt, Homo sapiens
gacaagaacgaagacagaa

SEQ ID NO: 986028 - RNA, 19 nt, Homo sapiens
ucacaacucccgccacagu

SEQ ID NO: 986029 - RNA, 19 nt, Homo sapiens
gcagcaguuccaagcagua

SEQ ID NO: 986030 - RNA, 19 nt, Homo sapiens
gaccaaacagcaguaccua

SEQ ID NO: 986031 - RNA, 19 nt, Homo sapiens
gcaguuccaagcaguagug

SEQ ID NO: 986032 - RNA, 19 nt, Homo sapiens
agagaaggcccuccaugug

SEQ ID NO: 986033 - RNA, 19 nt, Homo sapiens
gaagcuggucagucaaauc

SEQ ID NO: 986034 - RNA, 19 nt, Homo sapiens
gacccagccuuugguguca

SEQ ID NO: 986035 - RNA, 19 nt, Homo sapiens
gaggaugccaugaggaaag

SEQ ID NO: 986036 - RNA, 19 nt, Homo sapiens
ggaccugccaaacgaaauc

SEQ ID NO: 986037 - RNA, 19 nt, Homo sapiens
aaaaggaccugaguaagau

SEQ ID NO: 986038 - RNA, 19 nt, Homo sapiens
caacaagaucgacaagaac

SEQ ID NO: 986039 - RNA, 19 nt, Homo sapiens
ucaccuggaccuuuaaaca

SEQ ID NO: 986040 - RNA, 19 nt, Homo sapiens
ccaaguuccugguaaaccu

SEQ ID NO: 986041 - RNA, 19 nt, Homo sapiens
uucgagacauucauaacaa

SEQ ID NO: 986042 - RNA, 19 nt, Homo sapiens
ugacuauccugcccaaagc

SEQ ID NO: 986043 - RNA, 19 nt, Homo sapiens
gcaagcuggaugacaagga

SEQ ID NO: 986044 - RNA, 19 nt, Homo sapiens
caagaacgaagacagaaaa

SEQ ID NO: 986045 - RNA, 19 nt, Homo sapiens
acaagaacgaagacagaaa

SEQ ID NO: 986046 - RNA, 19 nt, Homo sapiens
caagcucucccuggacaaa

SEQ ID NO: 986047 - RNA, 19 nt, Homo sapiens
aaacacacaugggauucuc

SEQ ID NO: 986048 - RNA, 19 nt, Homo sapiens
uaacaagaaaucucaagcu

SEQ ID NO: 986049 - RNA, 19 nt, Homo sapiens
gaccugaguaagaugaaga

SEQ ID NO: 986050 - RNA, 19 nt, Homo sapiens
ggaccugaguaagaugaag

SEQ ID NO: 986051 - RNA, 19 nt, Homo sapiens
ccacugugaaggaugaaga

SEQ ID NO: 986052 - RNA, 19 nt, Homo sapiens
aaagcccgcuguggauaga

SEQ ID NO: 986053 - RNA, 19 nt, Homo sapiens
caaagcccgcuguggauag

SEQ ID NO: 986054 - RNA, 19 nt, Homo sapiens
gccaggcucauuauccauu

SEQ ID NO: 986055 - RNA, 19 nt, Homo sapiens
ccgcucaccugucuucaac

SEQ ID NO: 986056 - RNA, 19 nt, Homo sapiens
aagcagcugucgaaguaca

SEQ ID NO: 986057 - RNA, 19 nt, Homo sapiens
agcagcagcaucuaauuaa

SEQ ID NO: 986058 - RNA, 19 nt, Homo sapiens
gaaaucccacaccuguaca

SEQ ID NO: 986059 - RNA, 19 nt, Homo sapiens
cuucaaccauucccuguac

SEQ ID NO: 986060 - RNA, 19 nt, Homo sapiens
cugaagaccuugcaaaagu

SEQ ID NO: 986061 - RNA, 19 nt, Homo sapiens
cgagacauucauaacaaga

SEQ ID NO: 986062 - RNA, 19 nt, Homo sapiens
auagaacacagaggacaua

SEQ ID NO: 986063 - RNA, 19 nt, Homo sapiens
ccucagagcaccacacacu

SEQ ID NO: 986064 - RNA, 19 nt, Homo sapiens
gcaggcccagccaccaauu

SEQ ID NO: 986065 - RNA, 19 nt, Homo sapiens
gauucucuggucacaguuu

SEQ ID NO: 986066 - RNA, 19 nt, Homo sapiens
gcacuguccaccugaucug

SEQ ID NO: 986067 - RNA, 19 nt, Homo sapiens
guuccaggcucagcagagu

SEQ ID NO: 986068 - RNA, 19 nt, Homo sapiens
gcgcaggcuugaggaugau

SEQ ID NO: 986069 - RNA, 19 nt, Homo sapiens
cuggagaaacucaagaaug

SEQ ID NO: 986070 - RNA, 19 nt, Homo sapiens
gggaacaggcauggacguu

SEQ ID NO: 986071 - RNA, 19 nt, Homo sapiens
gcaaggcacuggucaagga

SEQ ID NO: 986072 - RNA, 19 nt, Homo sapiens
gcccugagcuguucaagaa

SEQ ID NO: 986073 - RNA, 19 nt, Homo sapiens
caaccucacucaccucaug

SEQ ID NO: 986074 - RNA, 19 nt, Homo sapiens
caagacagguggaguugau

SEQ ID NO: 986075 - RNA, 19 nt, Homo sapiens
gcugaagcccaccgaauua

SEQ ID NO: 986076 - RNA, 19 nt, Homo sapiens
aagcugccguucuuuaaua

SEQ ID NO: 986077 - RNA, 19 nt, Homo sapiens
ggaggagugaccuuucuuu

SEQ ID NO: 986078 - RNA, 19 nt, Homo sapiens
gaauuagucccacagaaca

SEQ ID NO: 986079 - RNA, 19 nt, Homo sapiens
gugaagcugccguucuuua

SEQ ID NO: 986080 - RNA, 19 nt, Homo sapiens
gcuacucgguggcccugua

SEQ ID NO: 986081 - RNA, 19 nt, Homo sapiens
ggagagcccgugcaucuuc

SEQ ID NO: 986082 - RNA, 19 nt, Homo sapiens
ggaacuacggcaagagcua

SEQ ID NO: 986083 - RNA, 19 nt, Homo sapiens
ggaggaagacgaggacgaa

SEQ ID NO: 986084 - RNA, 19 nt, Homo sapiens
ugaagcugccguucuuuaa

SEQ ID NO: 986085 - RNA, 19 nt, Homo sapiens
gaagcugccguucuuuaau

SEQ ID NO: 986086 - RNA, 19 nt, Homo sapiens
agaagaagcccaccuggau

SEQ ID NO: 986087 - RNA, 19 nt, Homo sapiens
gaguaagaguggacugaag

SEQ ID NO: 986088 - RNA, 19 nt, Homo sapiens
ucuuuaauaugcuggauga

SEQ ID NO: 986089 - RNA, 19 nt, Homo sapiens
ccugagcuguucaagaaga

SEQ ID NO: 986090 - RNA, 19 nt, Homo sapiens
ggaagacgaggacgaagag

SEQ ID NO: 986091 - RNA, 19 nt, Homo sapiens
gagaagcugcgccuugauc

SEQ ID NO: 986092 - RNA, 19 nt, Homo sapiens
gcccgugcaucuucgcauu

SEQ ID NO: 986093 - RNA, 19 nt, Homo sapiens
gcucuacggaaaguacuua

SEQ ID NO: 986094 - RNA, 19 nt, Homo sapiens
ggaggaagaggaggaggaa

SEQ ID NO: 986095 - RNA, 19 nt, Homo sapiens
aggagaagcugcgccuuga

SEQ ID NO: 986096 - RNA, 19 nt, Homo sapiens
caggagagcccgugcaucu

SEQ ID NO: 986097 - RNA, 19 nt, Homo sapiens
gcuacuaccccuccaauaa

SEQ ID NO: 986098 - RNA, 19 nt, Homo sapiens
ccgaauuagucccacagaa

SEQ ID NO: 986099 - RNA, 19 nt, Homo sapiens
ggaguaagaguggacugaa

SEQ ID NO: 986100 - RNA, 19 nt, Homo sapiens
ucacucaccucauguaccu

SEQ ID NO: 986101 - RNA, 19 nt, Homo sapiens
gaagcccaccgaauuaguc

SEQ ID NO: 986102 - RNA, 19 nt, Homo sapiens
uggugaagcugccguucuu

SEQ ID NO: 986103 - RNA, 19 nt, Homo sapiens
ccucuggacucuccuaucg

SEQ ID NO: 986104 - RNA, 19 nt, Homo sapiens
ccaccaaccgcaucacugu

SEQ ID NO: 986105 - RNA, 19 nt, Homo sapiens
cgaauuagucccacagaac

SEQ ID NO: 986106 - RNA, 19 nt, Homo sapiens
gagacccgcuacgccaaga

SEQ ID NO: 986107 - RNA, 19 nt, Homo sapiens
gcagaugaacgagaagaag

SEQ ID NO: 986108 - RNA, 19 nt, Homo sapiens
gaagaucaaggagcuguac

SEQ ID NO: 986109 - RNA, 19 nt, Homo sapiens
gaagauccugagcgagugu

SEQ ID NO: 986110 - RNA, 19 nt, Homo sapiens
gacgggcuccucucgaaga

SEQ ID NO: 986111 - RNA, 19 nt, Homo sapiens
ucuucuaccugcagaugaa

SEQ ID NO: 986112 - RNA, 19 nt, Homo sapiens
ugaggacgccgacgagauc

SEQ ID NO: 986113 - RNA, 19 nt, Homo sapiens
ucuguccgcuggugaagau

SEQ ID NO: 986114 - RNA, 19 nt, Homo sapiens
gcgggugucccucaucugu

SEQ ID NO: 986115 - RNA, 19 nt, Homo sapiens
uucagaugcuccuggguuu

SEQ ID NO: 986116 - RNA, 19 nt, Homo sapiens
gagcuguucaagaagauca

SEQ ID NO: 986117 - RNA, 19 nt, Homo sapiens
cuacggaaaguacuuaaac

SEQ ID NO: 986118 - RNA, 19 nt, Homo sapiens
gagggaggagugaccuuuc

SEQ ID NO: 986119 - RNA, 19 nt, Homo sapiens
aggaagaggaggaggaaga

SEQ ID NO: 986120 - RNA, 19 nt, Homo sapiens
gugcgggugucccucaucu

SEQ ID NO: 986121 - RNA, 19 nt, Homo sapiens
ugcagaggcugaagaccau

SEQ ID NO: 986122 - RNA, 19 nt, Homo sapiens
gccaagacagguggaguug

SEQ ID NO: 986123 - RNA, 19 nt, Homo sapiens
ccgugcaucuucgcauuga

SEQ ID NO: 986124 - RNA, 19 nt, Homo sapiens
gaacaacgagaagcuucag

SEQ ID NO: 986125 - RNA, 19 nt, Homo sapiens
ugaccaugcacuccaccua

SEQ ID NO: 986126 - RNA, 19 nt, Homo sapiens
gaacagguauguacuaguu

SEQ ID NO: 986127 - RNA, 19 nt, Homo sapiens
ggaaagcaguugcauugua

SEQ ID NO: 986128 - RNA, 19 nt, Homo sapiens
ggacaaaccacauuaguaa

SEQ ID NO: 986129 - RNA, 19 nt, Homo sapiens
gcaagcgacugauuacuuu

SEQ ID NO: 986130 - RNA, 19 nt, Homo sapiens
gaacauagguaucaguuuu

SEQ ID NO: 986131 - RNA, 19 nt, Homo sapiens
ucacagagaucuacucaga

SEQ ID NO: 986132 - RNA, 19 nt, Homo sapiens
gaagauaaacucacagaga

SEQ ID NO: 986133 - RNA, 19 nt, Homo sapiens
caagaacugugaaagguuu

SEQ ID NO: 986134 - RNA, 19 nt, Homo sapiens
ucagaaugcugccagaaua

SEQ ID NO: 986135 - RNA, 19 nt, Homo sapiens
gaagaaagaagaugucuca

SEQ ID NO: 986136 - RNA, 19 nt, Homo sapiens
ggacucugaugaagacuuu

SEQ ID NO: 986137 - RNA, 19 nt, Homo sapiens
agauagaccuuguggauaa

SEQ ID NO: 986138 - RNA, 19 nt, Homo sapiens
ccagcaaguugguguaaua

SEQ ID NO: 986139 - RNA, 19 nt, Homo sapiens
gaggagugcuugcauguug

SEQ ID NO: 986140 - RNA, 19 nt, Homo sapiens
ugaaacaugugauagauug

SEQ ID NO: 986141 - RNA, 19 nt, Homo sapiens
gaaagcaguugcauuguac

SEQ ID NO: 986142 - RNA, 19 nt, Homo sapiens
gugaacgucuucugcuuua

SEQ ID NO: 986143 - RNA, 19 nt, Homo sapiens
gcacaugcaacaacaagua

SEQ ID NO: 986144 - RNA, 19 nt, Homo sapiens
cgaagcacaucaaagagua

SEQ ID NO: 986145 - RNA, 19 nt, Homo sapiens
caaccaaccugcaucuaga

SEQ ID NO: 986146 - RNA, 19 nt, Homo sapiens
gcaagaaccugggacugaa

SEQ ID NO: 986147 - RNA, 19 nt, Homo sapiens
gaugcuggcucaaguaguu

SEQ ID NO: 986148 - RNA, 19 nt, Homo sapiens
acaaguauaugcacagaaa

SEQ ID NO: 986149 - RNA, 19 nt, Homo sapiens
gaaaaucucucuuacaaca

SEQ ID NO: 986150 - RNA, 19 nt, Homo sapiens
ugugauagauugacaugua

SEQ ID NO: 986151 - RNA, 19 nt, Homo sapiens
ggaaagacagaugaaguua

SEQ ID NO: 986152 - RNA, 19 nt, Homo sapiens
gaugagagaccaguacaua

SEQ ID NO: 986153 - RNA, 19 nt, Homo sapiens
gaggagauggcaacaauaa

SEQ ID NO: 986154 - RNA, 19 nt, Homo sapiens
gcaguugcauuguacuuug

SEQ ID NO: 986155 - RNA, 19 nt, Homo sapiens
ggaagaugcuggcucaagu

SEQ ID NO: 986156 - RNA, 19 nt, Homo sapiens
ugagagaccaguacauaua

SEQ ID NO: 986157 - RNA, 19 nt, Homo sapiens
gcauuguacuuugaagaua

SEQ ID NO: 986158 - RNA, 19 nt, Homo sapiens
gacugaagaugaaauaugu

SEQ ID NO: 986159 - RNA, 19 nt, Homo sapiens
gaaaggaaaaucucucuua

SEQ ID NO: 986160 - RNA, 19 nt, Homo sapiens
uaacaaacguguagaacag

SEQ ID NO: 986161 - RNA, 19 nt, Homo sapiens
gcacagcacuacuauacag

SEQ ID NO: 986162 - RNA, 19 nt, Homo sapiens
aaacugaaccugcagauau

SEQ ID NO: 986163 - RNA, 19 nt, Homo sapiens
gagagaccaguacauauaa

SEQ ID NO: 986164 - RNA, 19 nt, Homo sapiens
gaagaugcuggcucaagua

SEQ ID NO: 986165 - RNA, 19 nt, Homo sapiens
gcagacagauagaccuugu

SEQ ID NO: 986166 - RNA, 19 nt, Homo sapiens
uaacugaggacucugauga

SEQ ID NO: 986167 - RNA, 19 nt, Homo sapiens
uaaagaugaugacccaaau

SEQ ID NO: 986168 - RNA, 19 nt, Homo sapiens
aaugaaagcugcaaacagu

SEQ ID NO: 986169 - RNA, 19 nt, Homo sapiens
guacacaacaccacaauca

SEQ ID NO: 986170 - RNA, 19 nt, Homo sapiens
uagagaauguuacaaagga

SEQ ID NO: 986171 - RNA, 19 nt, Homo sapiens
ggacugaagaugaaauaug

SEQ ID NO: 986172 - RNA, 19 nt, Homo sapiens
gcacaggucggcaaggauu

SEQ ID NO: 986173 - RNA, 19 nt, Homo sapiens
gcucaaguaguuuagauaa

SEQ ID NO: 986174 - RNA, 19 nt, Homo sapiens
gagcuaauccccucaguua

SEQ ID NO: 986175 - RNA, 19 nt, Homo sapiens
ugaagcauguuaugaacuu

SEQ ID NO: 986176 - RNA, 19 nt, Homo sapiens
cuacucaggugcagaauag

SEQ ID NO: 986177 - RNA, 19 nt, Homo sapiens
ccaagaaugcagacagaua

SEQ ID NO: 986178 - RNA, 19 nt, Homo sapiens
gaccaguacauauaaagua

SEQ ID NO: 986179 - RNA, 19 nt, Homo sapiens
uacaacagcuagagaaugu

SEQ ID NO: 986180 - RNA, 19 nt, Homo sapiens
ggagaguggcuauguaaga

SEQ ID NO: 986181 - RNA, 19 nt, Homo sapiens
gcagacacacaagagauua

SEQ ID NO: 986182 - RNA, 19 nt, Homo sapiens
caucagcaguugcaacaga

SEQ ID NO: 986183 - RNA, 19 nt, Homo sapiens
caacaaguauaugcacaga

SEQ ID NO: 986184 - RNA, 19 nt, Homo sapiens
gggacaaaccacauuagua

SEQ ID NO: 986185 - RNA, 19 nt, Homo sapiens
gaaagccagaaguugaaua

SEQ ID NO: 986186 - RNA, 19 nt, Homo sapiens
gaaagugaauuggaugcau

SEQ ID NO: 986187 - RNA, 19 nt, Homo sapiens
gcaaagaauguagucaauu

SEQ ID NO: 986188 - RNA, 19 nt, Homo sapiens
uaucgaagcacaucaaaga

SEQ ID NO: 986189 - RNA, 19 nt, Homo sapiens
aagauaaacucacagagau

SEQ ID NO: 986190 - RNA, 19 nt, Homo sapiens
agccagaaguugaauauga

SEQ ID NO: 986191 - RNA, 19 nt, Homo sapiens
caucuaacuugucauguuc

SEQ ID NO: 986192 - RNA, 19 nt, Homo sapiens
aaagugaauuggaugcauu

SEQ ID NO: 986193 - RNA, 19 nt, Homo sapiens
caaccugcaucuagaaagu

SEQ ID NO: 986194 - RNA, 19 nt, Homo sapiens
ggcaaagaauguagucaau

SEQ ID NO: 986195 - RNA, 19 nt, Homo sapiens
gaaaacgccuaaagucaga

SEQ ID NO: 986196 - RNA, 19 nt, Homo sapiens
ggagauggcaacaauaaag

SEQ ID NO: 986197 - RNA, 19 nt, Homo sapiens
gcaaagaggcaacaugaac

SEQ ID NO: 986198 - RNA, 19 nt, Homo sapiens
ugccaugaauuaaguauug

SEQ ID NO: 986199 - RNA, 19 nt, Homo sapiens
ggacuggauaugcacauuu

SEQ ID NO: 986200 - RNA, 19 nt, Homo sapiens
ucaucuaacuugucauguu

SEQ ID NO: 986201 - RNA, 19 nt, Homo sapiens
gcaacaauaaagaugauga

SEQ ID NO: 986202 - RNA, 19 nt, Homo sapiens
gagaagaagaauuauguuc

SEQ ID NO: 986203 - RNA, 19 nt, Homo sapiens
gcaguuggcuuuuguguag

SEQ ID NO: 986204 - RNA, 19 nt, Homo sapiens
acagagaucuacucagaca

SEQ ID NO: 986205 - RNA, 19 nt, Homo sapiens
gugauaauuugcaacauag

SEQ ID NO: 986206 - RNA, 19 nt, Homo sapiens
gaaguugaauaugauugug

SEQ ID NO: 986207 - RNA, 19 nt, Homo sapiens
aaacggaggagaucucuug

SEQ ID NO: 986208 - RNA, 19 nt, Homo sapiens
acagaaacaucagcaguug

SEQ ID NO: 986209 - RNA, 19 nt, Homo sapiens
aaagacagaugaaguuacu

SEQ ID NO: 986210 - RNA, 19 nt, Homo sapiens
gcuagagaauguuacaaag

SEQ ID NO: 986211 - RNA, 19 nt, Homo sapiens
gccagaaguugaauaugau

SEQ ID NO: 986212 - RNA, 19 nt, Homo sapiens
caacagccuccucgauuga

SEQ ID NO: 986213 - RNA, 19 nt, Homo sapiens
acaacagccuccucgauug

SEQ ID NO: 986214 - RNA, 19 nt, Homo sapiens
acacaaagaacauagguau

SEQ ID NO: 986215 - RNA, 19 nt, Homo sapiens
caucagguuuauccaauuc

SEQ ID NO: 986216 - RNA, 19 nt, Homo sapiens
ggagcaauacguuuccauu

SEQ ID NO: 986217 - RNA, 19 nt, Homo sapiens
guguagaacaggaaauuaa

SEQ ID NO: 986218 - RNA, 19 nt, Homo sapiens
uaaaugagacuaacaaacg

SEQ ID NO: 986219 - RNA, 19 nt, Homo sapiens
gcuauuggaacacaaagaa

SEQ ID NO: 986220 - RNA, 19 nt, Homo sapiens
caaacaagaacaguugaaa

SEQ ID NO: 986221 - RNA, 19 nt, Homo sapiens
gaaaugaugaaaguuguuc

SEQ ID NO: 986222 - RNA, 19 nt, Homo sapiens
uagaccuuguggauaauua

SEQ ID NO: 986223 - RNA, 19 nt, Homo sapiens
gaugaugacccaaaugaag

SEQ ID NO: 986224 - RNA, 19 nt, Homo sapiens
gagauggcaacaauaaaga

SEQ ID NO: 986225 - RNA, 19 nt, Homo sapiens
uggaggagauggcaacaau

SEQ ID NO: 986226 - RNA, 19 nt, Homo sapiens
gaacagguauguacuaguu

SEQ ID NO: 986227 - RNA, 19 nt, Homo sapiens
ggaaagcaguugcauugua

SEQ ID NO: 986228 - RNA, 19 nt, Homo sapiens
ggacaaaccacauuaguaa

SEQ ID NO: 986229 - RNA, 19 nt, Homo sapiens
gcaagcgacugauuacuuu

SEQ ID NO: 986230 - RNA, 19 nt, Homo sapiens
gaacauagguaucaguuuu

SEQ ID NO: 986231 - RNA, 19 nt, Homo sapiens
ucacagagaucuacucaga

SEQ ID NO: 986232 - RNA, 19 nt, Homo sapiens
gaagauaaacucacagaga

SEQ ID NO: 986233 - RNA, 19 nt, Homo sapiens
caagaacugugaaagguuu

SEQ ID NO: 986234 - RNA, 19 nt, Homo sapiens
ucagaaugcugccagaaua

SEQ ID NO: 986235 - RNA, 19 nt, Homo sapiens
gaagaaagaagaugucuca

SEQ ID NO: 986236 - RNA, 19 nt, Homo sapiens
ggacucugaugaagacuuu

SEQ ID NO: 986237 - RNA, 19 nt, Homo sapiens
agauagaccuuguggauaa

SEQ ID NO: 986238 - RNA, 19 nt, Homo sapiens
ccagcaaguugguguaaua

SEQ ID NO: 986239 - RNA, 19 nt, Homo sapiens
gaggagugcuugcauguug

SEQ ID NO: 986240 - RNA, 19 nt, Homo sapiens
ugaaacaugugauagauug

SEQ ID NO: 986241 - RNA, 19 nt, Homo sapiens
gaaagcaguugcauuguac

SEQ ID NO: 986242 - RNA, 19 nt, Homo sapiens
gugaacgucuucugcuuua

SEQ ID NO: 986243 - RNA, 19 nt, Homo sapiens
gcacaugcaacaacaagua

SEQ ID NO: 986244 - RNA, 19 nt, Homo sapiens
cgaagcacaucaaagagua

SEQ ID NO: 986245 - RNA, 19 nt, Homo sapiens
caaccaaccugcaucuaga

SEQ ID NO: 986246 - RNA, 19 nt, Homo sapiens
gcaagaaccugggacugaa

SEQ ID NO: 986247 - RNA, 19 nt, Homo sapiens
gaugcuggcucaaguaguu

SEQ ID NO: 986248 - RNA, 19 nt, Homo sapiens
acaaguauaugcacagaaa

SEQ ID NO: 986249 - RNA, 19 nt, Homo sapiens
gaaaaucucucuuacaaca

SEQ ID NO: 986250 - RNA, 19 nt, Homo sapiens
ugugauagauugacaugua

SEQ ID NO: 986251 - RNA, 19 nt, Homo sapiens
ggaaagacagaugaaguua

SEQ ID NO: 986252 - RNA, 19 nt, Homo sapiens
gaugagagaccaguacaua

SEQ ID NO: 986253 - RNA, 19 nt, Homo sapiens
gaggagauggcaacaauaa

SEQ ID NO: 986254 - RNA, 19 nt, Homo sapiens
gcaguugcauuguacuuug

SEQ ID NO: 986255 - RNA, 19 nt, Homo sapiens
ggaagaugcuggcucaagu

SEQ ID NO: 986256 - RNA, 19 nt, Homo sapiens
ugagagaccaguacauaua

SEQ ID NO: 986257 - RNA, 19 nt, Homo sapiens
gcauuguacuuugaagaua

SEQ ID NO: 986258 - RNA, 19 nt, Homo sapiens
gacugaagaugaaauaugu

SEQ ID NO: 986259 - RNA, 19 nt, Homo sapiens
gaaaggaaaaucucucuua

SEQ ID NO: 986260 - RNA, 19 nt, Homo sapiens
uaacaaacguguagaacag

SEQ ID NO: 986261 - RNA, 19 nt, Homo sapiens
gcacagcacuacuauacag

SEQ ID NO: 986262 - RNA, 19 nt, Homo sapiens
aaacugaaccugcagauau

SEQ ID NO: 986263 - RNA, 19 nt, Homo sapiens
gagagaccaguacauauaa

SEQ ID NO: 986264 - RNA, 19 nt, Homo sapiens
gaagaugcuggcucaagua

SEQ ID NO: 986265 - RNA, 19 nt, Homo sapiens
gcagacagauagaccuugu

SEQ ID NO: 986266 - RNA, 19 nt, Homo sapiens
uaacugaggacucugauga

SEQ ID NO: 986267 - RNA, 19 nt, Homo sapiens
uaaagaugaugacccaaau

SEQ ID NO: 986268 - RNA, 19 nt, Homo sapiens
aaugaaagcugcaaacagu

SEQ ID NO: 986269 - RNA, 19 nt, Homo sapiens
guacacaacaccacaauca

SEQ ID NO: 986270 - RNA, 19 nt, Homo sapiens
uagagaauguuacaaagga

SEQ ID NO: 986271 - RNA, 19 nt, Homo sapiens
ggacugaagaugaaauaug

SEQ ID NO: 986272 - RNA, 19 nt, Homo sapiens
gcacaggucggcaaggauu

SEQ ID NO: 986273 - RNA, 19 nt, Homo sapiens
gcucaaguaguuuagauaa

SEQ ID NO: 986274 - RNA, 19 nt, Homo sapiens
gagcuaauccccucaguua

SEQ ID NO: 986275 - RNA, 19 nt, Homo sapiens
ugaagcauguuaugaacuu

SEQ ID NO: 986276 - RNA, 19 nt, Homo sapiens
cuacucaggugcagaauag

SEQ ID NO: 986277 - RNA, 19 nt, Homo sapiens
ccaagaaugcagacagaua

SEQ ID NO: 986278 - RNA, 19 nt, Homo sapiens
gaccaguacauauaaagua

SEQ ID NO: 986279 - RNA, 19 nt, Homo sapiens
uacaacagcuagagaaugu

SEQ ID NO: 986280 - RNA, 19 nt, Homo sapiens
ggagaguggcuauguaaga

SEQ ID NO: 986281 - RNA, 19 nt, Homo sapiens
caucagcaguugcaacaga

SEQ ID NO: 986282 - RNA, 19 nt, Homo sapiens
caacaaguauaugcacaga

SEQ ID NO: 986283 - RNA, 19 nt, Homo sapiens
gggacaaaccacauuagua

SEQ ID NO: 986284 - RNA, 19 nt, Homo sapiens
gaaagccagaaguugaaua

SEQ ID NO: 986285 - RNA, 19 nt, Homo sapiens
gaaagugaauuggaugcau

SEQ ID NO: 986286 - RNA, 19 nt, Homo sapiens
gcaaagaauguagucaauu

SEQ ID NO: 986287 - RNA, 19 nt, Homo sapiens
uaucgaagcacaucaaaga

SEQ ID NO: 986288 - RNA, 19 nt, Homo sapiens
aagauaaacucacagagau

SEQ ID NO: 986289 - RNA, 19 nt, Homo sapiens
agccagaaguugaauauga

SEQ ID NO: 986290 - RNA, 19 nt, Homo sapiens
caucuaacuugucauguuc

SEQ ID NO: 986291 - RNA, 19 nt, Homo sapiens
aaagugaauuggaugcauu

SEQ ID NO: 986292 - RNA, 19 nt, Homo sapiens
caaccugcaucuagaaagu

SEQ ID NO: 986293 - RNA, 19 nt, Homo sapiens
ggcaaagaauguagucaau

SEQ ID NO: 986294 - RNA, 19 nt, Homo sapiens
gaaaacgccuaaagucaga

SEQ ID NO: 986295 - RNA, 19 nt, Homo sapiens
ggagauggcaacaauaaag

SEQ ID NO: 986296 - RNA, 19 nt, Homo sapiens
gcaaagaggcaacaugaac

SEQ ID NO: 986297 - RNA, 19 nt, Homo sapiens
ugccaugaauuaaguauug

SEQ ID NO: 986298 - RNA, 19 nt, Homo sapiens
ggacuggauaugcacauuu

SEQ ID NO: 986299 - RNA, 19 nt, Homo sapiens
ucaucuaacuugucauguu

SEQ ID NO: 986300 - RNA, 19 nt, Homo sapiens
gcaacaauaaagaugauga

SEQ ID NO: 986301 - RNA, 19 nt, Homo sapiens
gagaagaagaauuauguuc

SEQ ID NO: 986302 - RNA, 19 nt, Homo sapiens
gcaguuggcuuuuguguag

SEQ ID NO: 986303 - RNA, 19 nt, Homo sapiens
acagagaucuacucagaca

SEQ ID NO: 986304 - RNA, 19 nt, Homo sapiens
ugugaaagguuuaaugaag

SEQ ID NO: 986305 - RNA, 19 nt, Homo sapiens
gugauaauuugcaacauag

SEQ ID NO: 986306 - RNA, 19 nt, Homo sapiens
gaaguugaauaugauugug

SEQ ID NO: 986307 - RNA, 19 nt, Homo sapiens
aaacggaggagaucucuug

SEQ ID NO: 986308 - RNA, 19 nt, Homo sapiens
acagaaacaucagcaguug

SEQ ID NO: 986309 - RNA, 19 nt, Homo sapiens
aaagacagaugaaguuacu

SEQ ID NO: 986310 - RNA, 19 nt, Homo sapiens
gcuagagaauguuacaaag

SEQ ID NO: 986311 - RNA, 19 nt, Homo sapiens
gccagaaguugaauaugau

SEQ ID NO: 986312 - RNA, 19 nt, Homo sapiens
caacagccuccucgauuga

SEQ ID NO: 986313 - RNA, 19 nt, Homo sapiens
acaacagccuccucgauug

SEQ ID NO: 986314 - RNA, 19 nt, Homo sapiens
acacaaagaacauagguau

SEQ ID NO: 986315 - RNA, 19 nt, Homo sapiens
caucagguuuauccaauuc

SEQ ID NO: 986316 - RNA, 19 nt, Homo sapiens
ggagcaauacguuuccauu

SEQ ID NO: 986317 - RNA, 19 nt, Homo sapiens
guguagaacaggaaauuaa

SEQ ID NO: 986318 - RNA, 19 nt, Homo sapiens
uaaaugagacuaacaaacg

SEQ ID NO: 986319 - RNA, 19 nt, Homo sapiens
gcuauuggaacacaaagaa

SEQ ID NO: 986320 - RNA, 19 nt, Homo sapiens
caaacaagaacaguugaaa

SEQ ID NO: 986321 - RNA, 19 nt, Homo sapiens
gaaagacacaucugaagcu

SEQ ID NO: 986322 - RNA, 19 nt, Homo sapiens
uagaccuuguggauaauua

SEQ ID NO: 986323 - RNA, 19 nt, Homo sapiens
gaugaugacccaaaugaag

SEQ ID NO: 986324 - RNA, 19 nt, Homo sapiens
gagauggcaacaauaaaga

SEQ ID NO: 986325 - RNA, 19 nt, Homo sapiens
uggaggagauggcaacaau

SEQ ID NO: 986326 - RNA, 19 nt, Homo sapiens
gcaaacauaucuucaacaa

SEQ ID NO: 986327 - RNA, 19 nt, Homo sapiens
gagacuggcugguuugaua

SEQ ID NO: 986328 - RNA, 19 nt, Homo sapiens
agacaaagcugaugccauu

SEQ ID NO: 986329 - RNA, 19 nt, Homo sapiens
caacaagcaugcagagaaa

SEQ ID NO: 986330 - RNA, 19 nt, Homo sapiens
gcacagcucugacccauac

SEQ ID NO: 986331 - RNA, 19 nt, Homo sapiens
caagggccauuguggaaua

SEQ ID NO: 986332 - RNA, 19 nt, Homo sapiens
ggcaacagaugcaggauuu

SEQ ID NO: 986333 - RNA, 19 nt, Homo sapiens
gcaagcaggcugagaauga

SEQ ID NO: 986334 - RNA, 19 nt, Homo sapiens
ugaagaauaucaccgacua

SEQ ID NO: 986335 - RNA, 19 nt, Homo sapiens
gaaagaagacuccgagaag

SEQ ID NO: 986336 - RNA, 19 nt, Homo sapiens
guacuaccuuguccuauga

SEQ ID NO: 986337 - RNA, 19 nt, Homo sapiens
uggacaagcuccuccuuua

SEQ ID NO: 986338 - RNA, 19 nt, Homo sapiens
gaugagaaguugauuaagg

SEQ ID NO: 986339 - RNA, 19 nt, Homo sapiens
gaucaucucccuuuguaaa

SEQ ID NO: 986340 - RNA, 19 nt, Homo sapiens
gaagagagcgcagcgacua

SEQ ID NO: 986341 - RNA, 19 nt, Homo sapiens
gggaugagaaguugauuaa

SEQ ID NO: 986342 - RNA, 19 nt, Homo sapiens
uuaaagagaucuguuggaa

SEQ ID NO: 986343 - RNA, 19 nt, Homo sapiens
ccgaagcgcucaaggagaa

SEQ ID NO: 986344 - RNA, 19 nt, Homo sapiens
gugaauaucgggacuauga

SEQ ID NO: 986345 - RNA, 19 nt, Homo sapiens
gaaugacaguucuaaugau

SEQ ID NO: 986346 - RNA, 19 nt, Homo sapiens
gcuaugagaugcccuaugc

SEQ ID NO: 986347 - RNA, 19 nt, Homo sapiens
gagaaaggaagucgcguuu

SEQ ID NO: 986348 - RNA, 19 nt, Homo sapiens
gagcugagcccugguguga

SEQ ID NO: 986349 - RNA, 19 nt, Homo sapiens
ggacaaggaagagaagaaa

SEQ ID NO: 986350 - RNA, 19 nt, Homo sapiens
cuaugaagcucugagaauu

SEQ ID NO: 986351 - RNA, 19 nt, Homo sapiens
ggacauagacaaagcugau

SEQ ID NO: 986352 - RNA, 19 nt, Homo sapiens
gggcagcauugcagagauu

SEQ ID NO: 986353 - RNA, 19 nt, Homo sapiens
agacgauguugauuucuuu

SEQ ID NO: 986354 - RNA, 19 nt, Homo sapiens
cauggagacuggcugguuu

SEQ ID NO: 986355 - RNA, 19 nt, Homo sapiens
ggaagaggcccagaagaug

SEQ ID NO: 986356 - RNA, 19 nt, Homo sapiens
cgaccgcaguguuaacauu

SEQ ID NO: 986357 - RNA, 19 nt, Homo sapiens
gaggagugguuucggucua

SEQ ID NO: 986358 - RNA, 19 nt, Homo sapiens
ugcauuccuuggauuauua

SEQ ID NO: 986359 - RNA, 19 nt, Homo sapiens
gaaguugauuaaggucuug

SEQ ID NO: 986360 - RNA, 19 nt, Homo sapiens
gaagggaacccggcagaga

SEQ ID NO: 986361 - RNA, 19 nt, Homo sapiens
gaccgcaguguuaacauua

SEQ ID NO: 986362 - RNA, 19 nt, Homo sapiens
ugauuaaggucuuggacaa

SEQ ID NO: 986363 - RNA, 19 nt, Homo sapiens
ggagcgggaugagaaguug

SEQ ID NO: 986364 - RNA, 19 nt, Homo sapiens
gaugacaggacacagcuuu

SEQ ID NO: 986365 - RNA, 19 nt, Homo sapiens
cgacaaggaugagaagaag

SEQ ID NO: 986366 - RNA, 19 nt, Homo sapiens
gggaggcuauccugggaaa

SEQ ID NO: 986367 - RNA, 19 nt, Homo sapiens
cagccuuacugcuaauaaa

SEQ ID NO: 986368 - RNA, 19 nt, Homo sapiens
cgaucagccuuacugcuaa

SEQ ID NO: 986369 - RNA, 19 nt, Homo sapiens
gcgcaaacauaucuucaac

SEQ ID NO: 986370 - RNA, 19 nt, Homo sapiens
auucaaggguccugaguuu

SEQ ID NO: 986371 - RNA, 19 nt, Homo sapiens
gugcauuccuuggauuauu

SEQ ID NO: 986372 - RNA, 19 nt, Homo sapiens
cuaaguaccacccagauga

SEQ ID NO: 986373 - RNA, 19 nt, Homo sapiens
ucaacaagcaugcagagaa

SEQ ID NO: 986374 - RNA, 19 nt, Homo sapiens
cagacgauguugauuucuu

SEQ ID NO: 986375 - RNA, 19 nt, Homo sapiens
guuggaaccugcagaacau

SEQ ID NO: 986376 - RNA, 19 nt, Homo sapiens
ugacagugaugacgaguac

SEQ ID NO: 986377 - RNA, 19 nt, Homo sapiens
gcccagcucugccugagau

SEQ ID NO: 986378 - RNA, 19 nt, Homo sapiens
uuaacaacuuccucacuga

SEQ ID NO: 986379 - RNA, 19 nt, Homo sapiens
gaacugggcaaggauaagu

SEQ ID NO: 986380 - RNA, 19 nt, Homo sapiens
ggagaagcccaaggaagaa

SEQ ID NO: 986381 - RNA, 19 nt, Homo sapiens
gaaggaggcacggagaaug

SEQ ID NO: 986382 - RNA, 19 nt, Homo sapiens
gaucagccuuacugcuaau

SEQ ID NO: 986383 - RNA, 19 nt, Homo sapiens
gaaggagaagcccaaggaa

SEQ ID NO: 986384 - RNA, 19 nt, Homo sapiens
aaugacaguucuaaugaug

SEQ ID NO: 986385 - RNA, 19 nt, Homo sapiens
ggaaaccucgcaacaggau

SEQ ID NO: 986386 - RNA, 19 nt, Homo sapiens
gggacaaguucagaagaga

SEQ ID NO: 986387 - RNA, 19 nt, Homo sapiens
uaugaagcucugagaauuu

SEQ ID NO: 986388 - RNA, 19 nt, Homo sapiens
uguacuaccuuguccuaug

SEQ ID NO: 986389 - RNA, 19 nt, Homo sapiens
gcugagcccuggugugaac

SEQ ID NO: 986390 - RNA, 19 nt, Homo sapiens
ggaagaagaaugggagaag

SEQ ID NO: 986391 - RNA, 19 nt, Homo sapiens
acaaggaagagaagaaaga

SEQ ID NO: 986392 - RNA, 19 nt, Homo sapiens
guuccucaguccuguauca

SEQ ID NO: 986393 - RNA, 19 nt, Homo sapiens
gugcuggaguggcagaaga

SEQ ID NO: 986394 - RNA, 19 nt, Homo sapiens
ggacaagcuccuccuuuac

SEQ ID NO: 986395 - RNA, 19 nt, Homo sapiens
gaccugcucccucuucaug

SEQ ID NO: 986396 - RNA, 19 nt, Homo sapiens
agaaagaagacuccgagaa

SEQ ID NO: 986397 - RNA, 19 nt, Homo sapiens
caaggaagagaagaaagaa

SEQ ID NO: 986398 - RNA, 19 nt, Homo sapiens
ggaaggaggcacggagaau

SEQ ID NO: 986399 - RNA, 19 nt, Homo sapiens
caaagcugaugccauuguc

SEQ ID NO: 986400 - RNA, 19 nt, Homo sapiens
cccagacgauguugauuuc

SEQ ID NO: 986401 - RNA, 19 nt, Homo sapiens
uggaguggcagaagacuuu

SEQ ID NO: 986402 - RNA, 19 nt, Homo sapiens
caucgugcauuccuuggau

SEQ ID NO: 986403 - RNA, 19 nt, Homo sapiens
acaaagaugaggagugguu

SEQ ID NO: 986404 - RNA, 19 nt, Homo sapiens
agaaguugauuaaggucuu

SEQ ID NO: 986405 - RNA, 19 nt, Homo sapiens
gaaaauugaggaagugaga

SEQ ID NO: 986406 - RNA, 19 nt, Homo sapiens
gggugaauaucgggacuau

SEQ ID NO: 986407 - RNA, 19 nt, Homo sapiens
gaaggcgcagggacaaguu

SEQ ID NO: 986408 - RNA, 19 nt, Homo sapiens
aggagaagcccaaggaaga

SEQ ID NO: 986409 - RNA, 19 nt, Homo sapiens
aaaccaacgacaaggauga

SEQ ID NO: 986410 - RNA, 19 nt, Homo sapiens
gaugcagccgugauuaaga

SEQ ID NO: 986411 - RNA, 19 nt, Homo sapiens
gcgcuauaaugacuacaag

SEQ ID NO: 986412 - RNA, 19 nt, Homo sapiens
gcagggacaaguucagaag

SEQ ID NO: 986413 - RNA, 19 nt, Homo sapiens
agaaggagaagcccaagga

SEQ ID NO: 986414 - RNA, 19 nt, Homo sapiens
agcaggaaguggagaaguu

SEQ ID NO: 986415 - RNA, 19 nt, Homo sapiens
caaagacccagagcaggaa

SEQ ID NO: 986416 - RNA, 19 nt, Homo sapiens
uuacaacaccugugaguac

SEQ ID NO: 986417 - RNA, 19 nt, Homo sapiens
gaagcccaaggaagaagaa

SEQ ID NO: 986418 - RNA, 19 nt, Homo sapiens
aggaagagaagaaagaaga

SEQ ID NO: 986419 - RNA, 19 nt, Homo sapiens
gggacaaggaagagaagaa

SEQ ID NO: 986420 - RNA, 19 nt, Homo sapiens
acgaucagccuuacugcua

SEQ ID NO: 986421 - RNA, 19 nt, Homo sapiens
aaauugaggaagugagaaa

SEQ ID NO: 986422 - RNA, 19 nt, Homo sapiens
ucacgccguugcugagugu

SEQ ID NO: 986423 - RNA, 19 nt, Homo sapiens
cagcaagaaagaagaagga

SEQ ID NO: 986424 - RNA, 19 nt, Homo sapiens
caaagaugaggagugguuu

SEQ ID NO: 986425 - RNA, 19 nt, Homo sapiens
gcaggaaguggagaaguuc

SEQ ID NO: 986426 - RNA, 19 nt, Homo sapiens
guaaagagaugacuagaaa

SEQ ID NO: 986427 - RNA, 19 nt, Homo sapiens
ggaaagcuuugcagaagua

SEQ ID NO: 986428 - RNA, 19 nt, Homo sapiens
gaaagaggauauggugaua

SEQ ID NO: 986429 - RNA, 19 nt, Homo sapiens
acgaaaggcugcaguauua

SEQ ID NO: 986430 - RNA, 19 nt, Homo sapiens
gcuaaggauucuaaaguua

SEQ ID NO: 986431 - RNA, 19 nt, Homo sapiens
uaucagugcuucaccauua

SEQ ID NO: 986432 - RNA, 19 nt, Homo sapiens
caaugaagaucuagagaaa

SEQ ID NO: 986433 - RNA, 19 nt, Homo sapiens
ccaaagaacuaaucaagau

SEQ ID NO: 986434 - RNA, 19 nt, Homo sapiens
ccacaaagcuucaugacau

SEQ ID NO: 986435 - RNA, 19 nt, Homo sapiens
gaaagcgucuacagcauug

SEQ ID NO: 986436 - RNA, 19 nt, Homo sapiens
ggagaaguauuuccaacaa

SEQ ID NO: 986437 - RNA, 19 nt, Homo sapiens
gucaagagcucauggcuuu

SEQ ID NO: 986438 - RNA, 19 nt, Homo sapiens
gaaaggcuauuaagacagu

SEQ ID NO: 986439 - RNA, 19 nt, Homo sapiens
gcagaaguauugcugagaa

SEQ ID NO: 986440 - RNA, 19 nt, Homo sapiens
caucaggucuuaauuacaa

SEQ ID NO: 986441 - RNA, 19 nt, Homo sapiens
gagaaccgcuacugucuau

SEQ ID NO: 986442 - RNA, 19 nt, Homo sapiens
gcuaugagauauuuacaga

SEQ ID NO: 986443 - RNA, 19 nt, Homo sapiens
gaacaaauucucagugugu

SEQ ID NO: 986444 - RNA, 19 nt, Homo sapiens
gcacagcacuggguguuga

SEQ ID NO: 986445 - RNA, 19 nt, Homo sapiens
gagacuagcuacagugaug

SEQ ID NO: 986446 - RNA, 19 nt, Homo sapiens
gcagauacuuugaaucauc

SEQ ID NO: 986447 - RNA, 19 nt, Homo sapiens
gcacuucgcuuccaugacu

SEQ ID NO: 986448 - RNA, 19 nt, Homo sapiens
ggagcuagaucuuauccaa

SEQ ID NO: 986449 - RNA, 19 nt, Homo sapiens
gagaguacuucaauucuuc

SEQ ID NO: 986450 - RNA, 19 nt, Homo sapiens
agacauagcugacauugag

SEQ ID NO: 986451 - RNA, 19 nt, Homo sapiens
uuacagggcugaucccaaa

SEQ ID NO: 986452 - RNA, 19 nt, Homo sapiens
gcuaaccggugcuuugaaa

SEQ ID NO: 986453 - RNA, 19 nt, Homo sapiens
gcaagcugaugguuagauu

SEQ ID NO: 986454 - RNA, 19 nt, Homo sapiens
gcacgcaagcugaugguua

SEQ ID NO: 986455 - RNA, 19 nt, Homo sapiens
gcuaugaccuacuagaaug

SEQ ID NO: 986456 - RNA, 19 nt, Homo sapiens
aaaguuaccuaugcagaua

SEQ ID NO: 986457 - RNA, 19 nt, Homo sapiens
ggguagagauccugccuuu

SEQ ID NO: 986458 - RNA, 19 nt, Homo sapiens
acacaugucuagauucuga

SEQ ID NO: 986459 - RNA, 19 nt, Homo sapiens
gauguacgauggagaacaa

SEQ ID NO: 986460 - RNA, 19 nt, Homo sapiens
ugaaucaucuggagaaauc

SEQ ID NO: 986461 - RNA, 19 nt, Homo sapiens
aaacaugaguccucuugaa

SEQ ID NO: 986462 - RNA, 19 nt, Homo sapiens
ggcagaaacucuagaggaa

SEQ ID NO: 986463 - RNA, 19 nt, Homo sapiens
guauacacaugucuagauu

SEQ ID NO: 986464 - RNA, 19 nt, Homo sapiens
gaacuacagccaaugaaga

SEQ ID NO: 986465 - RNA, 19 nt, Homo sapiens
gacaugaccuuggcucuug

SEQ ID NO: 986466 - RNA, 19 nt, Homo sapiens
gcagagaguacuucaauuc

SEQ ID NO: 986467 - RNA, 19 nt, Homo sapiens
gaaaggcugcaguauuauu

SEQ ID NO: 986468 - RNA, 19 nt, Homo sapiens
ggacagguucuaauccuuu

SEQ ID NO: 986469 - RNA, 19 nt, Homo sapiens
gcuuacaacugauaacaga

SEQ ID NO: 986470 - RNA, 19 nt, Homo sapiens
gaaaaugugucgcucuuug

SEQ ID NO: 986471 - RNA, 19 nt, Homo sapiens
cagauaaacuggcauuugg

SEQ ID NO: 986472 - RNA, 19 nt, Homo sapiens
gaacugaagccauucucaa

SEQ ID NO: 986473 - RNA, 19 nt, Homo sapiens
ggaaagcgucuacagcauu

SEQ ID NO: 986474 - RNA, 19 nt, Homo sapiens
gcugagaacuggaaaauug

SEQ ID NO: 986475 - RNA, 19 nt, Homo sapiens
ggccacagguuauccuaaa

SEQ ID NO: 986476 - RNA, 19 nt, Homo sapiens
caagacauguuaacuaugc

SEQ ID NO: 986477 - RNA, 19 nt, Homo sapiens
gauaaacuggcauuuggua

SEQ ID NO: 986478 - RNA, 19 nt, Homo sapiens
ggacugguucgcuugguua

SEQ ID NO: 986479 - RNA, 19 nt, Homo sapiens
uagaaaggcuauuaagaca

SEQ ID NO: 986480 - RNA, 19 nt, Homo sapiens
ugaagaaguuuaagguugu

SEQ ID NO: 986481 - RNA, 19 nt, Homo sapiens
ggauguuuguagccaguua

SEQ ID NO: 986482 - RNA, 19 nt, Homo sapiens
gaagaauagugagcaggaa

SEQ ID NO: 986483 - RNA, 19 nt, Homo sapiens
gcacaacguuacagugucu

SEQ ID NO: 986484 - RNA, 19 nt, Homo sapiens
ccacaaguguuagaugcua

SEQ ID NO: 986485 - RNA, 19 nt, Homo sapiens
ccagauccaucaugaagga

SEQ ID NO: 986486 - RNA, 19 nt, Homo sapiens
ccaccuggcuggacagaug

SEQ ID NO: 986487 - RNA, 19 nt, Homo sapiens
gaucaacucugucuuugcu

SEQ ID NO: 986488 - RNA, 19 nt, Homo sapiens
gaaccgcuacugucuauuc

SEQ ID NO: 986489 - RNA, 19 nt, Homo sapiens
ccagagacagguagacaua

SEQ ID NO: 986490 - RNA, 19 nt, Homo sapiens
gaagcagccuccugucagu

SEQ ID NO: 986491 - RNA, 19 nt, Homo sapiens
gaaaugaucaacucugucu

SEQ ID NO: 986492 - RNA, 19 nt, Homo sapiens
aaacauggugcauccuuua

SEQ ID NO: 986493 - RNA, 19 nt, Homo sapiens
gaacgucuccuggauuuca

SEQ ID NO: 986494 - RNA, 19 nt, Homo sapiens
gugaagccuugccaaauga

SEQ ID NO: 986495 - RNA, 19 nt, Homo sapiens
gaaguagguguuccaggua

SEQ ID NO: 986496 - RNA, 19 nt, Homo sapiens
ggaucagucucaucaagga

SEQ ID NO: 986497 - RNA, 19 nt, Homo sapiens
gaagaaguuuaagguuguu

SEQ ID NO: 986498 - RNA, 19 nt, Homo sapiens
gcaauucagcugaccuauu

SEQ ID NO: 986499 - RNA, 19 nt, Homo sapiens
gcacuugguuuuacuuuug

SEQ ID NO: 986500 - RNA, 19 nt, Homo sapiens
gaacaucucaaccaaggau

SEQ ID NO: 986501 - RNA, 19 nt, Homo sapiens
gcaguuggccuucugaaca

SEQ ID NO: 986502 - RNA, 19 nt, Homo sapiens
gcacgaagccuggccugaa

SEQ ID NO: 986503 - RNA, 19 nt, Homo sapiens
cuaccaaccucacugauag

SEQ ID NO: 986504 - RNA, 19 nt, Homo sapiens
gguagaugcaguuacauuu

SEQ ID NO: 986505 - RNA, 19 nt, Homo sapiens
ccaguucuuucaagucaaa

SEQ ID NO: 986506 - RNA, 19 nt, Homo sapiens
ggagaacaaggaaggauug

SEQ ID NO: 986507 - RNA, 19 nt, Homo sapiens
cugguucgcuugguuaaua

SEQ ID NO: 986508 - RNA, 19 nt, Homo sapiens
gcagagugcaaucaugaaa

SEQ ID NO: 986509 - RNA, 19 nt, Homo sapiens
aaagagaaacuucaugaug

SEQ ID NO: 986510 - RNA, 19 nt, Homo sapiens
gacaagugccauccucuuu

SEQ ID NO: 986511 - RNA, 19 nt, Homo sapiens
gaccuuggcucuugcuuac

SEQ ID NO: 986512 - RNA, 19 nt, Homo sapiens
gcucauggcuuuugcuuug

SEQ ID NO: 986513 - RNA, 19 nt, Homo sapiens
gcaauucgagaucguuuau

SEQ ID NO: 986514 - RNA, 19 nt, Homo sapiens
ugcaagacauguuaacuau

SEQ ID NO: 986515 - RNA, 19 nt, Homo sapiens
agccacagcuucauccuuu

SEQ ID NO: 986516 - RNA, 19 nt, Homo sapiens
cagcugguauagcccauaa

SEQ ID NO: 986517 - RNA, 19 nt, Homo sapiens
gcaagcuccucguguucuu

SEQ ID NO: 986518 - RNA, 19 nt, Homo sapiens
ugaugaagcuguggcuauu

SEQ ID NO: 986519 - RNA, 19 nt, Homo sapiens
acaaagagaaacuucauga

SEQ ID NO: 986520 - RNA, 19 nt, Homo sapiens
gaaagcaauucgagaucgu

SEQ ID NO: 986521 - RNA, 19 nt, Homo sapiens
ccaagcugcuggugaagug

SEQ ID NO: 986522 - RNA, 19 nt, Homo sapiens
ggaagcccguaaagagaug

SEQ ID NO: 986523 - RNA, 19 nt, Homo sapiens
ggaguggcuucaugccuau

SEQ ID NO: 986524 - RNA, 19 nt, Homo sapiens
aaauagagcccaagaccuu

SEQ ID NO: 986525 - RNA, 19 nt, Homo sapiens
cagaaacucuagaggaaag

SEQ ID NO: 986526 - RNA, 19 nt, Homo sapiens
gaaaugagcuuuugcuuua

SEQ ID NO: 986527 - RNA, 19 nt, Homo sapiens
cccaauaaaucccgucuuu

SEQ ID NO: 986528 - RNA, 19 nt, Homo sapiens
guaauuuccugggcuguuu

SEQ ID NO: 986529 - RNA, 19 nt, Homo sapiens
ucacaguccugccaugaug

SEQ ID NO: 986530 - RNA, 19 nt, Homo sapiens
cgaaguggccgagguaauu

SEQ ID NO: 986531 - RNA, 19 nt, Homo sapiens
gaggugcugaugaugauua

SEQ ID NO: 986532 - RNA, 19 nt, Homo sapiens
gaagaucgaggaagacagu

SEQ ID NO: 986533 - RNA, 19 nt, Homo sapiens
gggcagagccugaggaucu

SEQ ID NO: 986534 - RNA, 19 nt, Homo sapiens
caauaaaucccgucuuugg

SEQ ID NO: 986535 - RNA, 19 nt, Homo sapiens
ccucucugcuccugucuuu

SEQ ID NO: 986536 - RNA, 19 nt, Homo sapiens
aagggaagaucgaggaaga

SEQ ID NO: 986537 - RNA, 19 nt, Homo sapiens
acagugaggugcugaugau

SEQ ID NO: 986538 - RNA, 19 nt, Homo sapiens
gaaagggaagaucgaggaa

SEQ ID NO: 986539 - RNA, 19 nt, Homo sapiens
aaccucaucccucagauua

SEQ ID NO: 986540 - RNA, 19 nt, Homo sapiens
gaaguggccgagguaauug

SEQ ID NO: 986541 - RNA, 19 nt, Homo sapiens
gugaggugcugaugaugau

SEQ ID NO: 986542 - RNA, 19 nt, Homo sapiens
acgagaaggucgccaagga

SEQ ID NO: 986543 - RNA, 19 nt, Homo sapiens
ggcagagccugaggaucua

SEQ ID NO: 986544 - RNA, 19 nt, Homo sapiens
ucccagcuuugacagauuu

SEQ ID NO: 986545 - RNA, 19 nt, Homo sapiens
ggucccagcuuugacagau

SEQ ID NO: 986546 - RNA, 19 nt, Homo sapiens
gaaggucgccaaggagauc

SEQ ID NO: 986547 - RNA, 19 nt, Homo sapiens
ccucaucccucagauuaca

SEQ ID NO: 986548 - RNA, 19 nt, Homo sapiens
guuccuuggucccagcuuu

SEQ ID NO: 986549 - RNA, 19 nt, Homo sapiens
cugcagccuuuguuacuug

SEQ ID NO: 986550 - RNA, 19 nt, Homo sapiens
caaccucaucccucagauu

SEQ ID NO: 986551 - RNA, 19 nt, Homo sapiens
uggccgagguaauugcauu

SEQ ID NO: 986552 - RNA, 19 nt, Homo sapiens
gugaggagagaucgaauuc

SEQ ID NO: 986553 - RNA, 19 nt, Homo sapiens
cuucaacgccuucugacuu

SEQ ID NO: 986554 - RNA, 19 nt, Homo sapiens
uuacgaaguggccgaggua

SEQ ID NO: 986555 - RNA, 19 nt, Homo sapiens
gacagugaggugcugauga

SEQ ID NO: 986556 - RNA, 19 nt, Homo sapiens
ccaauaaaucccgucuuug

SEQ ID NO: 986557 - RNA, 19 nt, Homo sapiens
uuuccaaguuucucucuca

SEQ ID NO: 986558 - RNA, 19 nt, Homo sapiens
auacuucaacgccuucuga

SEQ ID NO: 986559 - RNA, 19 nt, Homo sapiens
ugaaaugagcuuuugcuuu

SEQ ID NO: 986560 - RNA, 19 nt, Homo sapiens
uaucacaguccugccauga

SEQ ID NO: 986561 - RNA, 19 nt, Homo sapiens
gauuacauccaucuaugag

SEQ ID NO: 986562 - RNA, 19 nt, Homo sapiens
gcagagccugaggaucuaa

SEQ ID NO: 986563 - RNA, 19 nt, Homo sapiens
ugugcacccuuacgaagug

SEQ ID NO: 986564 - RNA, 19 nt, Homo sapiens
cucggucucugcagccuuu

SEQ ID NO: 986565 - RNA, 19 nt, Homo sapiens
ccugaggugugagugaaau

SEQ ID NO: 986566 - RNA, 19 nt, Homo sapiens
uucguucugugcacccuua

SEQ ID NO: 986567 - RNA, 19 nt, Homo sapiens
gggaagaucgaggaagaca

SEQ ID NO: 986568 - RNA, 19 nt, Homo sapiens
cuacguagcuuuuguauuu

SEQ ID NO: 986569 - RNA, 19 nt, Homo sapiens
agaaggagcuggccaacuu

SEQ ID NO: 986570 - RNA, 19 nt, Homo sapiens
gcaggucucccacgaguaa

SEQ ID NO: 986571 - RNA, 19 nt, Homo sapiens
gcugagcucuuaccugguu

SEQ ID NO: 986572 - RNA, 19 nt, Homo sapiens
ggauuaccaucaccggaaa

SEQ ID NO: 986573 - RNA, 19 nt, Homo sapiens
ggacagugguguguauuac

SEQ ID NO: 986574 - RNA, 19 nt, Homo sapiens
gggacagugguguguauua

SEQ ID NO: 986575 - RNA, 19 nt, Homo sapiens
gaaaugcugaccugaccuu

SEQ ID NO: 986576 - RNA, 19 nt, Homo sapiens
augcugaccugaccuuuga

SEQ ID NO: 986577 - RNA, 19 nt, Homo sapiens
ggaaguacaagucuuucug

SEQ ID NO: 986578 - RNA, 19 nt, Homo sapiens
ggaaaguuuagucgucuga

SEQ ID NO: 986579 - RNA, 19 nt, Homo sapiens
ccaugcggguccuguacua

SEQ ID NO: 986580 - RNA, 19 nt, Homo sapiens
gcaacaggacggacuugga

SEQ ID NO: 986581 - RNA, 19 nt, Homo sapiens
ggaggaagaggccuacuac

SEQ ID NO: 986582 - RNA, 19 nt, Homo sapiens
ggacgaccucuaugaccaa

SEQ ID NO: 986583 - RNA, 19 nt, Homo sapiens
gcucuucgugguuguggua

SEQ ID NO: 986584 - RNA, 19 nt, Homo sapiens
aggauacccuggagacguu

SEQ ID NO: 986585 - RNA, 19 nt, Homo sapiens
gcugugacccugggagauu

SEQ ID NO: 986586 - RNA, 19 nt, Homo sapiens
acaaggaggaggaggaaga

SEQ ID NO: 986587 - RNA, 19 nt, Homo sapiens
gaggacgacuggcgaucuc

SEQ ID NO: 986588 - RNA, 19 nt, Homo sapiens
cgcaguggcuacaggauuc

SEQ ID NO: 986589 - RNA, 19 nt, Homo sapiens
aaaguuuagucgucugauc

SEQ ID NO: 986590 - RNA, 19 nt, Homo sapiens
gaagaacuuggcccugagu

SEQ ID NO: 986591 - RNA, 19 nt, Homo sapiens
ggacuuggaguagggacaa

SEQ ID NO: 986592 - RNA, 19 nt, Homo sapiens
uaauuugaaggaacacuga

SEQ ID NO: 986593 - RNA, 19 nt, Homo sapiens
ccugugacccugcccugua

SEQ ID NO: 986594 - RNA, 19 nt, Homo sapiens
ccacaaggaggaggaggaa

SEQ ID NO: 986595 - RNA, 19 nt, Homo sapiens
gguguucccagcauuuaug

SEQ ID NO: 986596 - RNA, 19 nt, Homo sapiens
cagguguucccagcauuua

SEQ ID NO: 986597 - RNA, 19 nt, Homo sapiens
ggccggaggauuaccauca

SEQ ID NO: 986598 - RNA, 19 nt, Homo sapiens
cugugacccugggagauua

SEQ ID NO: 986599 - RNA, 19 nt, Homo sapiens
cugaugaagcccugccaua

SEQ ID NO: 986600 - RNA, 19 nt, Homo sapiens
uggaggaggcugugaggaa

SEQ ID NO: 986601 - RNA, 19 nt, Homo sapiens
cgaccucuaugaccaagac

SEQ ID NO: 986602 - RNA, 19 nt, Homo sapiens
cccuguaccuaccagauga

SEQ ID NO: 986603 - RNA, 19 nt, Homo sapiens
ucagguguucccagcauuu

SEQ ID NO: 986604 - RNA, 19 nt, Homo sapiens
acaggacggacuuggagua

SEQ ID NO: 986605 - RNA, 19 nt, Homo sapiens
ucuggaaguacaagucuuu

SEQ ID NO: 986606 - RNA, 19 nt, Homo sapiens
ggagacguugacaggagua

SEQ ID NO: 986607 - RNA, 19 nt, Homo sapiens
caugggcccugccuacaac

SEQ ID NO: 986608 - RNA, 19 nt, Homo sapiens
ccucagguguucccagcau

SEQ ID NO: 986609 - RNA, 19 nt, Homo sapiens
gccgggacgaccucuauga

SEQ ID NO: 986610 - RNA, 19 nt, Homo sapiens
cggguacccuggaggauac

SEQ ID NO: 986611 - RNA, 19 nt, Homo sapiens
ugaaggaacacugaugaag

SEQ ID NO: 986612 - RNA, 19 nt, Homo sapiens
agcgcaggcucaagaagaa

SEQ ID NO: 986613 - RNA, 19 nt, Homo sapiens
ccaugggcccugccuacaa

SEQ ID NO: 986614 - RNA, 19 nt, Homo sapiens
gcccugagucgggaaaguu

SEQ ID NO: 986615 - RNA, 19 nt, Homo sapiens
gaggaggcugugaggaaga

SEQ ID NO: 986616 - RNA, 19 nt, Homo sapiens
cagccgggacgaccucuau

SEQ ID NO: 986617 - RNA, 19 nt, Homo sapiens
gcucuuaccugguuuucag

SEQ ID NO: 986618 - RNA, 19 nt, Homo sapiens
ggaaauacgugacaaauua

SEQ ID NO: 986619 - RNA, 19 nt, Homo sapiens
ccaaagaacugcaaacuug

SEQ ID NO: 986620 - RNA, 19 nt, Homo sapiens
gaauguaaccugaaucuaa

SEQ ID NO: 986621 - RNA, 19 nt, Homo sapiens
ggaacagucuaccaugaua

SEQ ID NO: 986622 - RNA, 19 nt, Homo sapiens
uagcauaccuuccuuagug

SEQ ID NO: 986623 - RNA, 19 nt, Homo sapiens
gcaaaccaauucuauucuu

SEQ ID NO: 986624 - RNA, 19 nt, Homo sapiens
gauaaucacauucaccuaa

SEQ ID NO: 986625 - RNA, 19 nt, Homo sapiens
gaggaacagucuaccauga

SEQ ID NO: 986626 - RNA, 19 nt, Homo sapiens
gaaacuaccaugcuaacaa

SEQ ID NO: 986627 - RNA, 19 nt, Homo sapiens
aaacuaccaugcuaacaaa

SEQ ID NO: 986628 - RNA, 19 nt, Homo sapiens
ggacguucuugucuucuuu

SEQ ID NO: 986629 - RNA, 19 nt, Homo sapiens
ccacaagaccacaaacuaa

SEQ ID NO: 986630 - RNA, 19 nt, Homo sapiens
guucuugucuucuuugcua

SEQ ID NO: 986631 - RNA, 19 nt, Homo sapiens
ccauugcacuuuauuaugu

SEQ ID NO: 986632 - RNA, 19 nt, Homo sapiens
gaaggcaaaccaauucuau

SEQ ID NO: 986633 - RNA, 19 nt, Homo sapiens
gaccacaaacuaaacagua

SEQ ID NO: 986634 - RNA, 19 nt, Homo sapiens
uaaccugaaucuaaugaga

SEQ ID NO: 986635 - RNA, 19 nt, Homo sapiens
gaucauugguugccauugg

SEQ ID NO: 986636 - RNA, 19 nt, Homo sapiens
uaauaaacccaacggauga

SEQ ID NO: 986637 - RNA, 19 nt, Homo sapiens
aauggaauauucucuguga

SEQ ID NO: 986638 - RNA, 19 nt, Homo sapiens
uacagucaauuuccaauga

SEQ ID NO: 986639 - RNA, 19 nt, Homo sapiens
cuaccaugcuaacaaauau

SEQ ID NO: 986640 - RNA, 19 nt, Homo sapiens
cagucacacuuggaaauua

SEQ ID NO: 986641 - RNA, 19 nt, Homo sapiens
ugaagcaccugaucauugg

SEQ ID NO: 986642 - RNA, 19 nt, Homo sapiens
gaacagucacacuuggaaa

SEQ ID NO: 986643 - RNA, 19 nt, Homo sapiens
gaugggacguucuugucuu

SEQ ID NO: 986644 - RNA, 19 nt, Homo sapiens
gacugaaucucgcucuguu

SEQ ID NO: 986645 - RNA, 19 nt, Homo sapiens
gaacagucuaccaugauau

SEQ ID NO: 986646 - RNA, 19 nt, Homo sapiens
agucacacuuggaaauuaa

SEQ ID NO: 986647 - RNA, 19 nt, Homo sapiens
caagggaucaggagcaaug

SEQ ID NO: 986648 - RNA, 19 nt, Homo sapiens
ucauagacauaaagaaugg

SEQ ID NO: 986649 - RNA, 19 nt, Homo sapiens
guaauugguaggcaucaaa

SEQ ID NO: 986650 - RNA, 19 nt, Homo sapiens
ccgaguagcugagauuaca

SEQ ID NO: 986651 - RNA, 19 nt, Homo sapiens
uagcaaagccaaagaacug

SEQ ID NO: 986652 - RNA, 19 nt, Homo sapiens
gauuugaccuuuuacuuga

SEQ ID NO: 986653 - RNA, 19 nt, Homo sapiens
gagagaagaagguauaaaa

SEQ ID NO: 986654 - RNA, 19 nt, Homo sapiens
gaauucucccucuguugua

SEQ ID NO: 986655 - RNA, 19 nt, Homo sapiens
cacaagaccacaaacuaaa

SEQ ID NO: 986656 - RNA, 19 nt, Homo sapiens
aaugagagaagaagguaua

SEQ ID NO: 986657 - RNA, 19 nt, Homo sapiens
ucucauacuugcacauugu

SEQ ID NO: 986658 - RNA, 19 nt, Homo sapiens
ggaauauucucugugaaaa

SEQ ID NO: 986659 - RNA, 19 nt, Homo sapiens
caaacuaaacaguaaaugg

SEQ ID NO: 986660 - RNA, 19 nt, Homo sapiens
caagucuuauuggcaguaa

SEQ ID NO: 986661 - RNA, 19 nt, Homo sapiens
aaacuugggaguggauaua

SEQ ID NO: 986662 - RNA, 19 nt, Homo sapiens
ggaagccgcagacugaauc

SEQ ID NO: 986663 - RNA, 19 nt, Homo sapiens
cuaucaccauugcacuuua

SEQ ID NO: 986664 - RNA, 19 nt, Homo sapiens
accacaaacuaaacaguaa

SEQ ID NO: 986665 - RNA, 19 nt, Homo sapiens
caacggaugagacacuguu

SEQ ID NO: 986666 - RNA, 19 nt, Homo sapiens
uaucaccauugcacuuuau

SEQ ID NO: 986667 - RNA, 19 nt, Homo sapiens
aagaauugcuuccaguuac

SEQ ID NO: 986668 - RNA, 19 nt, Homo sapiens
uggaauauucucugugaaa

SEQ ID NO: 986669 - RNA, 19 nt, Homo sapiens
gaaaaggaucccacucuga

SEQ ID NO: 986670 - RNA, 19 nt, Homo sapiens
ucaccauugcacuuuauua

SEQ ID NO: 986671 - RNA, 19 nt, Homo sapiens
ccacaaacuaaacaguaaa

SEQ ID NO: 986672 - RNA, 19 nt, Homo sapiens
ccugugaaguacuaaugaa

SEQ ID NO: 986673 - RNA, 19 nt, Homo sapiens
gcuaaagagcccuuaccaa

SEQ ID NO: 986674 - RNA, 19 nt, Homo sapiens
cuagaaggcaaaccaauuc

SEQ ID NO: 986675 - RNA, 19 nt, Homo sapiens
uaaauagcaaagccaaaga

SEQ ID NO: 986676 - RNA, 19 nt, Homo sapiens
gugaaguacuaaugaaugc

SEQ ID NO: 986677 - RNA, 19 nt, Homo sapiens
guacugaugggacguucuu

SEQ ID NO: 986678 - RNA, 19 nt, Homo sapiens
caccauugcacuuuauuau

SEQ ID NO: 986679 - RNA, 19 nt, Homo sapiens
ggaauguaaccugaaucua

SEQ ID NO: 986680 - RNA, 19 nt, Homo sapiens
agacauaaagaauggaaga

SEQ ID NO: 986681 - RNA, 19 nt, Homo sapiens
uauaugaacagucacacuu

SEQ ID NO: 986682 - RNA, 19 nt, Homo sapiens
gccaaagaacugcaaacuu

SEQ ID NO: 986683 - RNA, 19 nt, Homo sapiens
ucugaccugugaaguacua

SEQ ID NO: 986684 - RNA, 19 nt, Homo sapiens
gggacguucuugucuucuu

SEQ ID NO: 986685 - RNA, 19 nt, Homo sapiens
uagaacauguccacaagac

SEQ ID NO: 986686 - RNA, 19 nt, Homo sapiens
ucuagaaggcaaaccaauu

SEQ ID NO: 986687 - RNA, 19 nt, Homo sapiens
caacugaaacuaccaugcu

SEQ ID NO: 986688 - RNA, 19 nt, Homo sapiens
uggaaauacgugacaaauu

SEQ ID NO: 986689 - RNA, 19 nt, Homo sapiens
aaugaaugcuguugcuaca

SEQ ID NO: 986690 - RNA, 19 nt, Homo sapiens
caagaccacaaacuaaaca

SEQ ID NO: 986691 - RNA, 19 nt, Homo sapiens
guacuaaugaaugcuguug

SEQ ID NO: 986692 - RNA, 19 nt, Homo sapiens
ugacuuucuuuacaaccaa

SEQ ID NO: 986693 - RNA, 19 nt, Homo sapiens
gaaucuaaugagagaagaa

SEQ ID NO: 986694 - RNA, 19 nt, Homo sapiens
gauccaugaccauaugaau

SEQ ID NO: 986695 - RNA, 19 nt, Homo sapiens
cuuagaacauguccacaag

SEQ ID NO: 986696 - RNA, 19 nt, Homo sapiens
uugaagcaccugaucauug

SEQ ID NO: 986697 - RNA, 19 nt, Homo sapiens
ggaguggauauauggcaaa

SEQ ID NO: 986698 - RNA, 19 nt, Homo sapiens
aaacuggcucggagaagaa

SEQ ID NO: 986699 - RNA, 19 nt, Homo sapiens
cuaaugagagaagaaggua

SEQ ID NO: 986700 - RNA, 19 nt, Homo sapiens
gaaucuagaaggcaaacca

SEQ ID NO: 986701 - RNA, 19 nt, Homo sapiens
aaauagcaaagccaaagaa

SEQ ID NO: 986702 - RNA, 19 nt, Homo sapiens
gaccugugaaguacuaaug

SEQ ID NO: 986703 - RNA, 19 nt, Homo sapiens
uuuacuugauggacaguuu

SEQ ID NO: 986704 - RNA, 19 nt, Homo sapiens
acuaccaugcuaacaaaua

SEQ ID NO: 986705 - RNA, 19 nt, Homo sapiens
aauacuuccuuucaugugu

SEQ ID NO: 986706 - RNA, 19 nt, Homo sapiens
uuacuugauggacaguuua

SEQ ID NO: 986707 - RNA, 19 nt, Homo sapiens
agaauucucccucuguugu

SEQ ID NO: 986708 - RNA, 19 nt, Homo sapiens
aggcaaaccaauucuauuc

SEQ ID NO: 986709 - RNA, 19 nt, Homo sapiens
gaccauaugaaucuagaag

SEQ ID NO: 986710 - RNA, 19 nt, Homo sapiens
gcaaacuugggaguggaua

SEQ ID NO: 986711 - RNA, 19 nt, Homo sapiens
aacugaaacuaccaugcua

SEQ ID NO: 986712 - RNA, 19 nt, Homo sapiens
ugaacagucacacuuggaa

SEQ ID NO: 986713 - RNA, 19 nt, Homo sapiens
cuggauccaugaccauaug

SEQ ID NO: 986714 - RNA, 19 nt, Homo sapiens
gauggacaguuuaaaaucu

SEQ ID NO: 986715 - RNA, 19 nt, Homo sapiens
gacauaaagaauggaagaa

SEQ ID NO: 986716 - RNA, 19 nt, Homo sapiens
uacuuccuuucauguguua

SEQ ID NO: 986717 - RNA, 19 nt, Homo sapiens
auacuuccuuucauguguu

SEQ ID NO: 986718 - RNA, 19 nt, Homo sapiens
ggaaauacgugacaaauua

SEQ ID NO: 986719 - RNA, 19 nt, Homo sapiens
ccaaagaacugcaaacuug

SEQ ID NO: 986720 - RNA, 19 nt, Homo sapiens
gaauguaaccugaaucuaa

SEQ ID NO: 986721 - RNA, 19 nt, Homo sapiens
ggaacagucuaccaugaua

SEQ ID NO: 986722 - RNA, 19 nt, Homo sapiens
uagcauaccuuccuuagug

SEQ ID NO: 986723 - RNA, 19 nt, Homo sapiens
gcaaaccaauucuauucuu

SEQ ID NO: 986724 - RNA, 19 nt, Homo sapiens
gauaaucacauucaccuaa

SEQ ID NO: 986725 - RNA, 19 nt, Homo sapiens
gaggaacagucuaccauga

SEQ ID NO: 986726 - RNA, 19 nt, Homo sapiens
gaagcaugcugaucccauu

SEQ ID NO: 986727 - RNA, 19 nt, Homo sapiens
gaaacuaccaugcuaacaa

SEQ ID NO: 986728 - RNA, 19 nt, Homo sapiens
aaacuaccaugcuaacaaa

SEQ ID NO: 986729 - RNA, 19 nt, Homo sapiens
ggacguucuugucuucuuu

SEQ ID NO: 986730 - RNA, 19 nt, Homo sapiens
ccacaagaccacaaacuaa

SEQ ID NO: 986731 - RNA, 19 nt, Homo sapiens
guucuugucuucuuugcua

SEQ ID NO: 986732 - RNA, 19 nt, Homo sapiens
ccauugcacuuuauuaugu

SEQ ID NO: 986733 - RNA, 19 nt, Homo sapiens
gaaggcaaaccaauucuau

SEQ ID NO: 986734 - RNA, 19 nt, Homo sapiens
gaccacaaacuaaacagua

SEQ ID NO: 986735 - RNA, 19 nt, Homo sapiens
uaaccugaaucuaaugaga

SEQ ID NO: 986736 - RNA, 19 nt, Homo sapiens
gaucauugguugccauugg

SEQ ID NO: 986737 - RNA, 19 nt, Homo sapiens
ggaagccgcaguucaguga

SEQ ID NO: 986738 - RNA, 19 nt, Homo sapiens
uaauaaacccaacggauga

SEQ ID NO: 986739 - RNA, 19 nt, Homo sapiens
gugcagagguagcgaagug

SEQ ID NO: 986740 - RNA, 19 nt, Homo sapiens
aauggaauauucucuguga

SEQ ID NO: 986741 - RNA, 19 nt, Homo sapiens
uacagucaauuuccaauga

SEQ ID NO: 986742 - RNA, 19 nt, Homo sapiens
cuaccaugcuaacaaauau

SEQ ID NO: 986743 - RNA, 19 nt, Homo sapiens
cagucacacuuggaaauua

SEQ ID NO: 986744 - RNA, 19 nt, Homo sapiens
ugaagcaccugaucauugg

SEQ ID NO: 986745 - RNA, 19 nt, Homo sapiens
guagcgaagugucccaaga

SEQ ID NO: 986746 - RNA, 19 nt, Homo sapiens
gaacagucacacuuggaaa

SEQ ID NO: 986747 - RNA, 19 nt, Homo sapiens
gaugggacguucuugucuu

SEQ ID NO: 986748 - RNA, 19 nt, Homo sapiens
gaacagucuaccaugauau

SEQ ID NO: 986749 - RNA, 19 nt, Homo sapiens
agucacacuuggaaauuaa

SEQ ID NO: 986750 - RNA, 19 nt, Homo sapiens
caagggaucaggagcaaug

SEQ ID NO: 986751 - RNA, 19 nt, Homo sapiens
ucauagacauaaagaaugg

SEQ ID NO: 986752 - RNA, 19 nt, Homo sapiens
guaauugguaggcaucaaa

SEQ ID NO: 986753 - RNA, 19 nt, Homo sapiens
uagcaaagccaaagaacug

SEQ ID NO: 986754 - RNA, 19 nt, Homo sapiens
gauuugaccuuuuacuuga

SEQ ID NO: 986755 - RNA, 19 nt, Homo sapiens
gagagaagaagguauaaaa

SEQ ID NO: 986756 - RNA, 19 nt, Homo sapiens
gaauucucccucuguugua

SEQ ID NO: 986757 - RNA, 19 nt, Homo sapiens
cacaagaccacaaacuaaa

SEQ ID NO: 986758 - RNA, 19 nt, Homo sapiens
aaugagagaagaagguaua

SEQ ID NO: 986759 - RNA, 19 nt, Homo sapiens
ucucauacuugcacauugu

SEQ ID NO: 986760 - RNA, 19 nt, Homo sapiens
ggaauauucucugugaaaa

SEQ ID NO: 986761 - RNA, 19 nt, Homo sapiens
caaacuaaacaguaaaugg

SEQ ID NO: 986762 - RNA, 19 nt, Homo sapiens
caagucuuauuggcaguaa

SEQ ID NO: 986763 - RNA, 19 nt, Homo sapiens
aaacuugggaguggauaua

SEQ ID NO: 986764 - RNA, 19 nt, Homo sapiens
cuaucaccauugcacuuua

SEQ ID NO: 986765 - RNA, 19 nt, Homo sapiens
accacaaacuaaacaguaa

SEQ ID NO: 986766 - RNA, 19 nt, Homo sapiens
caacggaugagacacuguu

SEQ ID NO: 986767 - RNA, 19 nt, Homo sapiens
uaucaccauugcacuuuau

SEQ ID NO: 986768 - RNA, 19 nt, Homo sapiens
aagaauugcuuccaguuac

SEQ ID NO: 986769 - RNA, 19 nt, Homo sapiens
uggaauauucucugugaaa

SEQ ID NO: 986770 - RNA, 19 nt, Homo sapiens
gaaaaggaucccacucuga

SEQ ID NO: 986771 - RNA, 19 nt, Homo sapiens
cgaagugucccaagaacau

SEQ ID NO: 986772 - RNA, 19 nt, Homo sapiens
ucaccauugcacuuuauua

SEQ ID NO: 986773 - RNA, 19 nt, Homo sapiens
ccacaaacuaaacaguaaa

SEQ ID NO: 986774 - RNA, 19 nt, Homo sapiens
ccugugaaguacuaaugaa

SEQ ID NO: 986775 - RNA, 19 nt, Homo sapiens
gcuaaagagcccuuaccaa

SEQ ID NO: 986776 - RNA, 19 nt, Homo sapiens
cuagaaggcaaaccaauuc

SEQ ID NO: 986777 - RNA, 19 nt, Homo sapiens
uaaauagcaaagccaaaga

SEQ ID NO: 986778 - RNA, 19 nt, Homo sapiens
gugaaguacuaaugaaugc

SEQ ID NO: 986779 - RNA, 19 nt, Homo sapiens
guacugaugggacguucuu

SEQ ID NO: 986780 - RNA, 19 nt, Homo sapiens
caccauugcacuuuauuau

SEQ ID NO: 986781 - RNA, 19 nt, Homo sapiens
ggaauguaaccugaaucua

SEQ ID NO: 986782 - RNA, 19 nt, Homo sapiens
agacauaaagaauggaaga

SEQ ID NO: 986783 - RNA, 19 nt, Homo sapiens
uauaugaacagucacacuu

SEQ ID NO: 986784 - RNA, 19 nt, Homo sapiens
gccaaagaacugcaaacuu

SEQ ID NO: 986785 - RNA, 19 nt, Homo sapiens
ucugaccugugaaguacua

SEQ ID NO: 986786 - RNA, 19 nt, Homo sapiens
gggacguucuugucuucuu

SEQ ID NO: 986787 - RNA, 19 nt, Homo sapiens
uagaacauguccacaagac

SEQ ID NO: 986788 - RNA, 19 nt, Homo sapiens
ucuagaaggcaaaccaauu

SEQ ID NO: 986789 - RNA, 19 nt, Homo sapiens
guuuggcagugcagaggua

SEQ ID NO: 986790 - RNA, 19 nt, Homo sapiens
caacugaaacuaccaugcu

SEQ ID NO: 986791 - RNA, 19 nt, Homo sapiens
uggaaauacgugacaaauu

SEQ ID NO: 986792 - RNA, 19 nt, Homo sapiens
aaugaaugcuguugcuaca

SEQ ID NO: 986793 - RNA, 19 nt, Homo sapiens
caagaccacaaacuaaaca

SEQ ID NO: 986794 - RNA, 19 nt, Homo sapiens
gauccaugaccauaugaau

SEQ ID NO: 986795 - RNA, 19 nt, Homo sapiens
guacuaaugaaugcuguug

SEQ ID NO: 986796 - RNA, 19 nt, Homo sapiens
ugacuuucuuuacaaccaa

SEQ ID NO: 986797 - RNA, 19 nt, Homo sapiens
gaaucuaaugagagaagaa

SEQ ID NO: 986798 - RNA, 19 nt, Homo sapiens
cuuagaacauguccacaag

SEQ ID NO: 986799 - RNA, 19 nt, Homo sapiens
uugaagcaccugaucauug

SEQ ID NO: 986800 - RNA, 19 nt, Homo sapiens
ggaguggauauauggcaaa

SEQ ID NO: 986801 - RNA, 19 nt, Homo sapiens
aaacuggcucggagaagaa

SEQ ID NO: 986802 - RNA, 19 nt, Homo sapiens
cuaaugagagaagaaggua

SEQ ID NO: 986803 - RNA, 19 nt, Homo sapiens
gaaucuagaaggcaaacca

SEQ ID NO: 986804 - RNA, 19 nt, Homo sapiens
uagcgaagugucccaagaa

SEQ ID NO: 986805 - RNA, 19 nt, Homo sapiens
aaauagcaaagccaaagaa

SEQ ID NO: 986806 - RNA, 19 nt, Homo sapiens
gaccugugaaguacuaaug

SEQ ID NO: 986807 - RNA, 19 nt, Homo sapiens
uuuacuugauggacaguuu

SEQ ID NO: 986808 - RNA, 19 nt, Homo sapiens
acuaccaugcuaacaaaua

SEQ ID NO: 986809 - RNA, 19 nt, Homo sapiens
aauacuuccuuucaugugu

SEQ ID NO: 986810 - RNA, 19 nt, Homo sapiens
uuacuugauggacaguuua

SEQ ID NO: 986811 - RNA, 19 nt, Homo sapiens
agaauucucccucuguugu

SEQ ID NO: 986812 - RNA, 19 nt, Homo sapiens
aggcaaaccaauucuauuc

SEQ ID NO: 986813 - RNA, 19 nt, Homo sapiens
gaccauaugaaucuagaag

SEQ ID NO: 986814 - RNA, 19 nt, Homo sapiens
gcaaacuugggaguggaua

SEQ ID NO: 986815 - RNA, 19 nt, Homo sapiens
gaagugucccaagaacaug

SEQ ID NO: 986816 - RNA, 19 nt, Homo sapiens
aacugaaacuaccaugcua

SEQ ID NO: 986817 - RNA, 19 nt, Homo sapiens
cuggauccaugaccauaug

SEQ ID NO: 986818 - RNA, 19 nt, Homo sapiens
ggaaauacgugacaaauua

SEQ ID NO: 986819 - RNA, 19 nt, Homo sapiens
ccaaagaacugcaaacuug

SEQ ID NO: 986820 - RNA, 19 nt, Homo sapiens
gaauguaaccugaaucuaa

SEQ ID NO: 986821 - RNA, 19 nt, Homo sapiens
ggaacagucuaccaugaua

SEQ ID NO: 986822 - RNA, 19 nt, Homo sapiens
uagcauaccuuccuuagug

SEQ ID NO: 986823 - RNA, 19 nt, Homo sapiens
gcaaaccaauucuauucuu

SEQ ID NO: 986824 - RNA, 19 nt, Homo sapiens
gauaaucacauucaccuaa

SEQ ID NO: 986825 - RNA, 19 nt, Homo sapiens
gaggaacagucuaccauga

SEQ ID NO: 986826 - RNA, 19 nt, Homo sapiens
gaaacuaccaugcuaacaa

SEQ ID NO: 986827 - RNA, 19 nt, Homo sapiens
aaacuaccaugcuaacaaa

SEQ ID NO: 986828 - RNA, 19 nt, Homo sapiens
ggacguucuugucuucuuu

SEQ ID NO: 986829 - RNA, 19 nt, Homo sapiens
gucaauaucuuggacuaua

SEQ ID NO: 986830 - RNA, 19 nt, Homo sapiens
ccacaagaccacaaacuaa

SEQ ID NO: 986831 - RNA, 19 nt, Homo sapiens
guucuugucuucuuugcua

SEQ ID NO: 986832 - RNA, 19 nt, Homo sapiens
ccauugcacuuuauuaugu

SEQ ID NO: 986833 - RNA, 19 nt, Homo sapiens
gaaggcaaaccaauucuau

SEQ ID NO: 986834 - RNA, 19 nt, Homo sapiens
gaccacaaacuaaacagua

SEQ ID NO: 986835 - RNA, 19 nt, Homo sapiens
uaaccugaaucuaaugaga

SEQ ID NO: 986836 - RNA, 19 nt, Homo sapiens
gaucauugguugccauugg

SEQ ID NO: 986837 - RNA, 19 nt, Homo sapiens
caagcaugcugaucccauu

SEQ ID NO: 986838 - RNA, 19 nt, Homo sapiens
uaauaaacccaacggauga

SEQ ID NO: 986839 - RNA, 19 nt, Homo sapiens
gaccaaagucaauaucuug

SEQ ID NO: 986840 - RNA, 19 nt, Homo sapiens
aauggaauauucucuguga

SEQ ID NO: 986841 - RNA, 19 nt, Homo sapiens
uacagucaauuuccaauga

SEQ ID NO: 986842 - RNA, 19 nt, Homo sapiens
cuaccaugcuaacaaauau

SEQ ID NO: 986843 - RNA, 19 nt, Homo sapiens
cagucacacuuggaaauua

SEQ ID NO: 986844 - RNA, 19 nt, Homo sapiens
ugaagcaccugaucauugg

SEQ ID NO: 986845 - RNA, 19 nt, Homo sapiens
gaacagucacacuuggaaa

SEQ ID NO: 986846 - RNA, 19 nt, Homo sapiens
gaugggacguucuugucuu

SEQ ID NO: 986847 - RNA, 19 nt, Homo sapiens
gaacagucuaccaugauau

SEQ ID NO: 986848 - RNA, 19 nt, Homo sapiens
gacugaaucucgcucuguu

SEQ ID NO: 986849 - RNA, 19 nt, Homo sapiens
agucacacuuggaaauuaa

SEQ ID NO: 986850 - RNA, 19 nt, Homo sapiens
caagggaucaggagcaaug

SEQ ID NO: 986851 - RNA, 19 nt, Homo sapiens
ucauagacauaaagaaugg

SEQ ID NO: 986852 - RNA, 19 nt, Homo sapiens
guaauugguaggcaucaaa

SEQ ID NO: 986853 - RNA, 19 nt, Homo sapiens
ccgaguagcugagauuaca

SEQ ID NO: 986854 - RNA, 19 nt, Homo sapiens
uagcaaagccaaagaacug

SEQ ID NO: 986855 - RNA, 19 nt, Homo sapiens
gauuugaccuuuuacuuga

SEQ ID NO: 986856 - RNA, 19 nt, Homo sapiens
gagagaagaagguauaaaa

SEQ ID NO: 986857 - RNA, 19 nt, Homo sapiens
gaauucucccucuguugua

SEQ ID NO: 986858 - RNA, 19 nt, Homo sapiens
cacaagaccacaaacuaaa

SEQ ID NO: 986859 - RNA, 19 nt, Homo sapiens
aaugagagaagaagguaua

SEQ ID NO: 986860 - RNA, 19 nt, Homo sapiens
ucucauacuugcacauugu

SEQ ID NO: 986861 - RNA, 19 nt, Homo sapiens
ggaauauucucugugaaaa

SEQ ID NO: 986862 - RNA, 19 nt, Homo sapiens
caaacuaaacaguaaaugg

SEQ ID NO: 986863 - RNA, 19 nt, Homo sapiens
caagucuuauuggcaguaa

SEQ ID NO: 986864 - RNA, 19 nt, Homo sapiens
aaacuugggaguggauaua

SEQ ID NO: 986865 - RNA, 19 nt, Homo sapiens
ggaagccgcagacugaauc

SEQ ID NO: 986866 - RNA, 19 nt, Homo sapiens
cuaucaccauugcacuuua

SEQ ID NO: 986867 - RNA, 19 nt, Homo sapiens
ucaauaucuuggacuauag

SEQ ID NO: 986868 - RNA, 19 nt, Homo sapiens
accacaaacuaaacaguaa

SEQ ID NO: 986869 - RNA, 19 nt, Homo sapiens
caacggaugagacacuguu

SEQ ID NO: 986870 - RNA, 19 nt, Homo sapiens
uaucaccauugcacuuuau

SEQ ID NO: 986871 - RNA, 19 nt, Homo sapiens
aagaauugcuuccaguuac

SEQ ID NO: 986872 - RNA, 19 nt, Homo sapiens
uggaauauucucugugaaa

SEQ ID NO: 986873 - RNA, 19 nt, Homo sapiens
gaaaaggaucccacucuga

SEQ ID NO: 986874 - RNA, 19 nt, Homo sapiens
ucaccauugcacuuuauua

SEQ ID NO: 986875 - RNA, 19 nt, Homo sapiens
ccacaaacuaaacaguaaa

SEQ ID NO: 986876 - RNA, 19 nt, Homo sapiens
ccugugaaguacuaaugaa

SEQ ID NO: 986877 - RNA, 19 nt, Homo sapiens
gcuaaagagcccuuaccaa

SEQ ID NO: 986878 - RNA, 19 nt, Homo sapiens
cuagaaggcaaaccaauuc

SEQ ID NO: 986879 - RNA, 19 nt, Homo sapiens
uaaauagcaaagccaaaga

SEQ ID NO: 986880 - RNA, 19 nt, Homo sapiens
gugaaguacuaaugaaugc

SEQ ID NO: 986881 - RNA, 19 nt, Homo sapiens
guacugaugggacguucuu

SEQ ID NO: 986882 - RNA, 19 nt, Homo sapiens
caccauugcacuuuauuau

SEQ ID NO: 986883 - RNA, 19 nt, Homo sapiens
ggaauguaaccugaaucua

SEQ ID NO: 986884 - RNA, 19 nt, Homo sapiens
agacauaaagaauggaaga

SEQ ID NO: 986885 - RNA, 19 nt, Homo sapiens
uauaugaacagucacacuu

SEQ ID NO: 986886 - RNA, 19 nt, Homo sapiens
gccaaagaacugcaaacuu

SEQ ID NO: 986887 - RNA, 19 nt, Homo sapiens
ucugaccugugaaguacua

SEQ ID NO: 986888 - RNA, 19 nt, Homo sapiens
gggacguucuugucuucuu

SEQ ID NO: 986889 - RNA, 19 nt, Homo sapiens
uagaacauguccacaagac

SEQ ID NO: 986890 - RNA, 19 nt, Homo sapiens
ucuagaaggcaaaccaauu

SEQ ID NO: 986891 - RNA, 19 nt, Homo sapiens
caacugaaacuaccaugcu

SEQ ID NO: 986892 - RNA, 19 nt, Homo sapiens
uggaaauacgugacaaauu

SEQ ID NO: 986893 - RNA, 19 nt, Homo sapiens
aaugaaugcuguugcuaca

SEQ ID NO: 986894 - RNA, 19 nt, Homo sapiens
caagaccacaaacuaaaca

SEQ ID NO: 986895 - RNA, 19 nt, Homo sapiens
guacuaaugaaugcuguug

SEQ ID NO: 986896 - RNA, 19 nt, Homo sapiens
ugacuuucuuuacaaccaa

SEQ ID NO: 986897 - RNA, 19 nt, Homo sapiens
gaaucuaaugagagaagaa

SEQ ID NO: 986898 - RNA, 19 nt, Homo sapiens
gauccaugaccauaugaau

SEQ ID NO: 986899 - RNA, 19 nt, Homo sapiens
cuuagaacauguccacaag

SEQ ID NO: 986900 - RNA, 19 nt, Homo sapiens
uugaagcaccugaucauug

SEQ ID NO: 986901 - RNA, 19 nt, Homo sapiens
ggaguggauauauggcaaa

SEQ ID NO: 986902 - RNA, 19 nt, Homo sapiens
aaacuggcucggagaagaa

SEQ ID NO: 986903 - RNA, 19 nt, Homo sapiens
cuaaugagagaagaaggua

SEQ ID NO: 986904 - RNA, 19 nt, Homo sapiens
gaaucuagaaggcaaacca

SEQ ID NO: 986905 - RNA, 19 nt, Homo sapiens
aaauagcaaagccaaagaa

SEQ ID NO: 986906 - RNA, 19 nt, Homo sapiens
gaccugugaaguacuaaug

SEQ ID NO: 986907 - RNA, 19 nt, Homo sapiens
uuuacuugauggacaguuu

SEQ ID NO: 986908 - RNA, 19 nt, Homo sapiens
acuaccaugcuaacaaaua

SEQ ID NO: 986909 - RNA, 19 nt, Homo sapiens
aauacuuccuuucaugugu

SEQ ID NO: 986910 - RNA, 19 nt, Homo sapiens
uuacuugauggacaguuua

SEQ ID NO: 986911 - RNA, 19 nt, Homo sapiens
agaauucucccucuguugu

SEQ ID NO: 986912 - RNA, 19 nt, Homo sapiens
aggcaaaccaauucuauuc

SEQ ID NO: 986913 - RNA, 19 nt, Homo sapiens
caccacgcccagagagaua

SEQ ID NO: 986914 - RNA, 19 nt, Homo sapiens
agagauauuuugagcacua

SEQ ID NO: 986915 - RNA, 19 nt, Homo sapiens
gcaaacuugggaguggaua

SEQ ID NO: 986916 - RNA, 19 nt, Homo sapiens
gaccauaugaaucuagaag

SEQ ID NO: 986917 - RNA, 19 nt, Homo sapiens
aacugaaacuaccaugcua

SEQ ID NO: 986918 - RNA, 19 nt, Homo sapiens
ggaaauacgugacaaauua

SEQ ID NO: 986919 - RNA, 19 nt, Homo sapiens
ccaaagaacugcaaacuug

SEQ ID NO: 986920 - RNA, 19 nt, Homo sapiens
gaauguaaccugaaucuaa

SEQ ID NO: 986921 - RNA, 19 nt, Homo sapiens
ggaacagucuaccaugaua

SEQ ID NO: 986922 - RNA, 19 nt, Homo sapiens
uagcauaccuuccuuagug

SEQ ID NO: 986923 - RNA, 19 nt, Homo sapiens
gcaaaccaauucuauucuu

SEQ ID NO: 986924 - RNA, 19 nt, Homo sapiens
gauaaucacauucaccuaa

SEQ ID NO: 986925 - RNA, 19 nt, Homo sapiens
gaggaacagucuaccauga

SEQ ID NO: 986926 - RNA, 19 nt, Homo sapiens
gaaacuaccaugcuaacaa

SEQ ID NO: 986927 - RNA, 19 nt, Homo sapiens
aaacuaccaugcuaacaaa

SEQ ID NO: 986928 - RNA, 19 nt, Homo sapiens
ggacguucuugucuucuuu

SEQ ID NO: 986929 - RNA, 19 nt, Homo sapiens
caaacaugcugaucccauu

SEQ ID NO: 986930 - RNA, 19 nt, Homo sapiens
ccacaagaccacaaacuaa

SEQ ID NO: 986931 - RNA, 19 nt, Homo sapiens
guucuugucuucuuugcua

SEQ ID NO: 986932 - RNA, 19 nt, Homo sapiens
ccauugcacuuuauuaugu

SEQ ID NO: 986933 - RNA, 19 nt, Homo sapiens
gaaggcaaaccaauucuau

SEQ ID NO: 986934 - RNA, 19 nt, Homo sapiens
gaccacaaacuaaacagua

SEQ ID NO: 986935 - RNA, 19 nt, Homo sapiens
uaaccugaaucuaaugaga

SEQ ID NO: 986936 - RNA, 19 nt, Homo sapiens
gaucauugguugccauugg

SEQ ID NO: 986937 - RNA, 19 nt, Homo sapiens
uaauaaacccaacggauga

SEQ ID NO: 986938 - RNA, 19 nt, Homo sapiens
aauggaauauucucuguga

SEQ ID NO: 986939 - RNA, 19 nt, Homo sapiens
uacagucaauuuccaauga

SEQ ID NO: 986940 - RNA, 19 nt, Homo sapiens
cuaccaugcuaacaaauau

SEQ ID NO: 986941 - RNA, 19 nt, Homo sapiens
cagucacacuuggaaauua

SEQ ID NO: 986942 - RNA, 19 nt, Homo sapiens
cggugucccugaaguauaa

SEQ ID NO: 986943 - RNA, 19 nt, Homo sapiens
ugaagcaccugaucauugg

SEQ ID NO: 986944 - RNA, 19 nt, Homo sapiens
gaacagucacacuuggaaa

SEQ ID NO: 986945 - RNA, 19 nt, Homo sapiens
gaugggacguucuugucuu

SEQ ID NO: 986946 - RNA, 19 nt, Homo sapiens
gaacagucuaccaugauau

SEQ ID NO: 986947 - RNA, 19 nt, Homo sapiens
gacugaaucucgcucuguu

SEQ ID NO: 986948 - RNA, 19 nt, Homo sapiens
agucacacuuggaaauuaa

SEQ ID NO: 986949 - RNA, 19 nt, Homo sapiens
caagggaucaggagcaaug

SEQ ID NO: 986950 - RNA, 19 nt, Homo sapiens
ucauagacauaaagaaugg

SEQ ID NO: 986951 - RNA, 19 nt, Homo sapiens
guaauugguaggcaucaaa

SEQ ID NO: 986952 - RNA, 19 nt, Homo sapiens
ccgaguagcugagauuaca

SEQ ID NO: 986953 - RNA, 19 nt, Homo sapiens
uagcaaagccaaagaacug

SEQ ID NO: 986954 - RNA, 19 nt, Homo sapiens
gauuugaccuuuuacuuga

SEQ ID NO: 986955 - RNA, 19 nt, Homo sapiens
gagagaagaagguauaaaa

SEQ ID NO: 986956 - RNA, 19 nt, Homo sapiens
gaauucucccucuguugua

SEQ ID NO: 986957 - RNA, 19 nt, Homo sapiens
cacaagaccacaaacuaaa

SEQ ID NO: 986958 - RNA, 19 nt, Homo sapiens
aaugagagaagaagguaua

SEQ ID NO: 986959 - RNA, 19 nt, Homo sapiens
ucucauacuugcacauugu

SEQ ID NO: 986960 - RNA, 19 nt, Homo sapiens
ggaauauucucugugaaaa

SEQ ID NO: 986961 - RNA, 19 nt, Homo sapiens
caaacuaaacaguaaaugg

SEQ ID NO: 986962 - RNA, 19 nt, Homo sapiens
caagucuuauuggcaguaa

SEQ ID NO: 986963 - RNA, 19 nt, Homo sapiens
aaacuugggaguggauaua

SEQ ID NO: 986964 - RNA, 19 nt, Homo sapiens
ggaagccgcagacugaauc

SEQ ID NO: 986965 - RNA, 19 nt, Homo sapiens
cuaucaccauugcacuuua

SEQ ID NO: 986966 - RNA, 19 nt, Homo sapiens
accacaaacuaaacaguaa

SEQ ID NO: 986967 - RNA, 19 nt, Homo sapiens
caacggaugagacacuguu

SEQ ID NO: 986968 - RNA, 19 nt, Homo sapiens
uaucaccauugcacuuuau

SEQ ID NO: 986969 - RNA, 19 nt, Homo sapiens
aagaauugcuuccaguuac

SEQ ID NO: 986970 - RNA, 19 nt, Homo sapiens
ccugaaguauaaauccaaa

SEQ ID NO: 986971 - RNA, 19 nt, Homo sapiens
uggaauauucucugugaaa

SEQ ID NO: 986972 - RNA, 19 nt, Homo sapiens
gaaaaggaucccacucuga

SEQ ID NO: 986973 - RNA, 19 nt, Homo sapiens
ucaccauugcacuuuauua

SEQ ID NO: 986974 - RNA, 19 nt, Homo sapiens
ggacaacaaacaugcugau

SEQ ID NO: 986975 - RNA, 19 nt, Homo sapiens
ccacaaacuaaacaguaaa

SEQ ID NO: 986976 - RNA, 19 nt, Homo sapiens
ccugugaaguacuaaugaa

SEQ ID NO: 986977 - RNA, 19 nt, Homo sapiens
gcuaaagagcccuuaccaa

SEQ ID NO: 986978 - RNA, 19 nt, Homo sapiens
cuagaaggcaaaccaauuc

SEQ ID NO: 986979 - RNA, 19 nt, Homo sapiens
uaaauagcaaagccaaaga

SEQ ID NO: 986980 - RNA, 19 nt, Homo sapiens
gugaaguacuaaugaaugc

SEQ ID NO: 986981 - RNA, 19 nt, Homo sapiens
guacugaugggacguucuu

SEQ ID NO: 986982 - RNA, 19 nt, Homo sapiens
caccauugcacuuuauuau

SEQ ID NO: 986983 - RNA, 19 nt, Homo sapiens
ggaauguaaccugaaucua

SEQ ID NO: 986984 - RNA, 19 nt, Homo sapiens
agacauaaagaauggaaga

SEQ ID NO: 986985 - RNA, 19 nt, Homo sapiens
uauaugaacagucacacuu

SEQ ID NO: 986986 - RNA, 19 nt, Homo sapiens
gccaaagaacugcaaacuu

SEQ ID NO: 986987 - RNA, 19 nt, Homo sapiens
ucugaccugugaaguacua

SEQ ID NO: 986988 - RNA, 19 nt, Homo sapiens
gggacguucuugucuucuu

SEQ ID NO: 986989 - RNA, 19 nt, Homo sapiens
uagaacauguccacaagac

SEQ ID NO: 986990 - RNA, 19 nt, Homo sapiens
ucuagaaggcaaaccaauu

SEQ ID NO: 986991 - RNA, 19 nt, Homo sapiens
gcggugucccugaaguaua

SEQ ID NO: 986992 - RNA, 19 nt, Homo sapiens
caacugaaacuaccaugcu

SEQ ID NO: 986993 - RNA, 19 nt, Homo sapiens
uggaaauacgugacaaauu

SEQ ID NO: 986994 - RNA, 19 nt, Homo sapiens
aaugaaugcuguugcuaca

SEQ ID NO: 986995 - RNA, 19 nt, Homo sapiens
aaacaugcugaucccauuu

SEQ ID NO: 986996 - RNA, 19 nt, Homo sapiens
caagaccacaaacuaaaca

SEQ ID NO: 986997 - RNA, 19 nt, Homo sapiens
guacuaaugaaugcuguug

SEQ ID NO: 986998 - RNA, 19 nt, Homo sapiens
ugacuuucuuuacaaccaa

SEQ ID NO: 986999 - RNA, 19 nt, Homo sapiens
gaaucuaaugagagaagaa

SEQ ID NO: 987000 - RNA, 19 nt, Homo sapiens
gauccaugaccauaugaau

SEQ ID NO: 987001 - RNA, 19 nt, Homo sapiens
cuuagaacauguccacaag

SEQ ID NO: 987002 - RNA, 19 nt, Homo sapiens
uugaagcaccugaucauug

SEQ ID NO: 987003 - RNA, 19 nt, Homo sapiens
ggaguggauauauggcaaa

SEQ ID NO: 987004 - RNA, 19 nt, Homo sapiens
aaacuggcucggagaagaa

SEQ ID NO: 987005 - RNA, 19 nt, Homo sapiens
cuaaugagagaagaaggua

SEQ ID NO: 987006 - RNA, 19 nt, Homo sapiens
gaaucuagaaggcaaacca

SEQ ID NO: 987007 - RNA, 19 nt, Homo sapiens
aaauagcaaagccaaagaa

SEQ ID NO: 987008 - RNA, 19 nt, Homo sapiens
gaccugugaaguacuaaug

SEQ ID NO: 987009 - RNA, 19 nt, Homo sapiens
uuuacuugauggacaguuu

SEQ ID NO: 987010 - RNA, 19 nt, Homo sapiens
acuaccaugcuaacaaaua

SEQ ID NO: 987011 - RNA, 19 nt, Homo sapiens
aauacuuccuuucaugugu

SEQ ID NO: 987012 - RNA, 19 nt, Homo sapiens
uuacuugauggacaguuua

SEQ ID NO: 987013 - RNA, 19 nt, Homo sapiens
agaauucucccucuguugu

SEQ ID NO: 987014 - RNA, 19 nt, Homo sapiens
aggcaaaccaauucuauuc

SEQ ID NO: 987015 - RNA, 19 nt, Homo sapiens
gcaaacuugggaguggaua

SEQ ID NO: 987016 - RNA, 19 nt, Homo sapiens
gaccauaugaaucuagaag

SEQ ID NO: 987017 - RNA, 19 nt, Homo sapiens
aacugaaacuaccaugcua

SEQ ID NO: 987018 - RNA, 19 nt, Homo sapiens
ggaaauacgugacaaauua

SEQ ID NO: 987019 - RNA, 19 nt, Homo sapiens
ccaaagaacugcaaacuug

SEQ ID NO: 987020 - RNA, 19 nt, Homo sapiens
gaauguaaccugaaucuaa

SEQ ID NO: 987021 - RNA, 19 nt, Homo sapiens
ggaacagucuaccaugaua

SEQ ID NO: 987022 - RNA, 19 nt, Homo sapiens
uagcauaccuuccuuagug

SEQ ID NO: 987023 - RNA, 19 nt, Homo sapiens
gcaaaccaauucuauucuu

SEQ ID NO: 987024 - RNA, 19 nt, Homo sapiens
gauaaucacauucaccuaa

SEQ ID NO: 987025 - RNA, 19 nt, Homo sapiens
gaggaacagucuaccauga

SEQ ID NO: 987026 - RNA, 19 nt, Homo sapiens
gaaacuaccaugcuaacaa

SEQ ID NO: 987027 - RNA, 19 nt, Homo sapiens
aaacuaccaugcuaacaaa

SEQ ID NO: 987028 - RNA, 19 nt, Homo sapiens
ggacguucuugucuucuuu

SEQ ID NO: 987029 - RNA, 19 nt, Homo sapiens
ccacaagaccacaaacuaa

SEQ ID NO: 987030 - RNA, 19 nt, Homo sapiens
guucuugucuucuuugcua

SEQ ID NO: 987031 - RNA, 19 nt, Homo sapiens
ccauugcacuuuauuaugu

SEQ ID NO: 987032 - RNA, 19 nt, Homo sapiens
gaaggcaaaccaauucuau

SEQ ID NO: 987033 - RNA, 19 nt, Homo sapiens
gaccacaaacuaaacagua

SEQ ID NO: 987034 - RNA, 19 nt, Homo sapiens
uaaccugaaucuaaugaga

SEQ ID NO: 987035 - RNA, 19 nt, Homo sapiens
gaucauugguugccauugg

SEQ ID NO: 987036 - RNA, 19 nt, Homo sapiens
uaauaaacccaacggauga

SEQ ID NO: 987037 - RNA, 19 nt, Homo sapiens
aauggaauauucucuguga

SEQ ID NO: 987038 - RNA, 19 nt, Homo sapiens
uacagucaauuuccaauga

SEQ ID NO: 987039 - RNA, 19 nt, Homo sapiens
cuaccaugcuaacaaauau

SEQ ID NO: 987040 - RNA, 19 nt, Homo sapiens
cagucacacuuggaaauua

SEQ ID NO: 987041 - RNA, 19 nt, Homo sapiens
ugaagcaccugaucauugg

SEQ ID NO: 987042 - RNA, 19 nt, Homo sapiens
gaacagucacacuuggaaa

SEQ ID NO: 987043 - RNA, 19 nt, Homo sapiens
gaugggacguucuugucuu

SEQ ID NO: 987044 - RNA, 19 nt, Homo sapiens
gaacagucuaccaugauau

SEQ ID NO: 987045 - RNA, 19 nt, Homo sapiens
agucacacuuggaaauuaa

SEQ ID NO: 987046 - RNA, 19 nt, Homo sapiens
caagggaucaggagcaaug

SEQ ID NO: 987047 - RNA, 19 nt, Homo sapiens
ucauagacauaaagaaugg

SEQ ID NO: 987048 - RNA, 19 nt, Homo sapiens
guaauugguaggcaucaaa

SEQ ID NO: 987049 - RNA, 19 nt, Homo sapiens
uagcaaagccaaagaacug

SEQ ID NO: 987050 - RNA, 19 nt, Homo sapiens
gauuugaccuuuuacuuga

SEQ ID NO: 987051 - RNA, 19 nt, Homo sapiens
gagagaagaagguauaaaa

SEQ ID NO: 987052 - RNA, 19 nt, Homo sapiens
gaauucucccucuguugua

SEQ ID NO: 987053 - RNA, 19 nt, Homo sapiens
cacaagaccacaaacuaaa

SEQ ID NO: 987054 - RNA, 19 nt, Homo sapiens
aaugagagaagaagguaua

SEQ ID NO: 987055 - RNA, 19 nt, Homo sapiens
ucucauacuugcacauugu

SEQ ID NO: 987056 - RNA, 19 nt, Homo sapiens
ggaauauucucugugaaaa

SEQ ID NO: 987057 - RNA, 19 nt, Homo sapiens
caaacuaaacaguaaaugg

SEQ ID NO: 987058 - RNA, 19 nt, Homo sapiens
caagucuuauuggcaguaa

SEQ ID NO: 987059 - RNA, 19 nt, Homo sapiens
aaacuugggaguggauaua

SEQ ID NO: 987060 - RNA, 19 nt, Homo sapiens
cuaucaccauugcacuuua

SEQ ID NO: 987061 - RNA, 19 nt, Homo sapiens
accacaaacuaaacaguaa

SEQ ID NO: 987062 - RNA, 19 nt, Homo sapiens
caacggaugagacacuguu

SEQ ID NO: 987063 - RNA, 19 nt, Homo sapiens
uaucaccauugcacuuuau

SEQ ID NO: 987064 - RNA, 19 nt, Homo sapiens
gcagaugcugaucccauuu

SEQ ID NO: 987065 - RNA, 19 nt, Homo sapiens
aagaauugcuuccaguuac

SEQ ID NO: 987066 - RNA, 19 nt, Homo sapiens
uggaauauucucugugaaa

SEQ ID NO: 987067 - RNA, 19 nt, Homo sapiens
gaaaaggaucccacucuga

SEQ ID NO: 987068 - RNA, 19 nt, Homo sapiens
ucaccauugcacuuuauua

SEQ ID NO: 987069 - RNA, 19 nt, Homo sapiens
ccacaaacuaaacaguaaa

SEQ ID NO: 987070 - RNA, 19 nt, Homo sapiens
ccugugaaguacuaaugaa

SEQ ID NO: 987071 - RNA, 19 nt, Homo sapiens
gcuaaagagcccuuaccaa

SEQ ID NO: 987072 - RNA, 19 nt, Homo sapiens
cuagaaggcaaaccaauuc

SEQ ID NO: 987073 - RNA, 19 nt, Homo sapiens
uaaauagcaaagccaaaga

SEQ ID NO: 987074 - RNA, 19 nt, Homo sapiens
gugaaguacuaaugaaugc

SEQ ID NO: 987075 - RNA, 19 nt, Homo sapiens
guacugaugggacguucuu

SEQ ID NO: 987076 - RNA, 19 nt, Homo sapiens
caccauugcacuuuauuau

SEQ ID NO: 987077 - RNA, 19 nt, Homo sapiens
ggaauguaaccugaaucua

SEQ ID NO: 987078 - RNA, 19 nt, Homo sapiens
agacauaaagaauggaaga

SEQ ID NO: 987079 - RNA, 19 nt, Homo sapiens
uauaugaacagucacacuu

SEQ ID NO: 987080 - RNA, 19 nt, Homo sapiens
gccaaagaacugcaaacuu

SEQ ID NO: 987081 - RNA, 19 nt, Homo sapiens
ucugaccugugaaguacua

SEQ ID NO: 987082 - RNA, 19 nt, Homo sapiens
gggacguucuugucuucuu

SEQ ID NO: 987083 - RNA, 19 nt, Homo sapiens
uagaacauguccacaagac

SEQ ID NO: 987084 - RNA, 19 nt, Homo sapiens
cgcagaugcugaucccauu

SEQ ID NO: 987085 - RNA, 19 nt, Homo sapiens
ucuagaaggcaaaccaauu

SEQ ID NO: 987086 - RNA, 19 nt, Homo sapiens
caacugaaacuaccaugcu

SEQ ID NO: 987087 - RNA, 19 nt, Homo sapiens
uggaaauacgugacaaauu

SEQ ID NO: 987088 - RNA, 19 nt, Homo sapiens
aaugaaugcuguugcuaca

SEQ ID NO: 987089 - RNA, 19 nt, Homo sapiens
caagaccacaaacuaaaca

SEQ ID NO: 987090 - RNA, 19 nt, Homo sapiens
gauccaugaccauaugaau

SEQ ID NO: 987091 - RNA, 19 nt, Homo sapiens
guacuaaugaaugcuguug

SEQ ID NO: 987092 - RNA, 19 nt, Homo sapiens
ugacuuucuuuacaaccaa

SEQ ID NO: 987093 - RNA, 19 nt, Homo sapiens
gaaucuaaugagagaagaa

SEQ ID NO: 987094 - RNA, 19 nt, Homo sapiens
gaaucuagaaggcaaacca

SEQ ID NO: 987095 - RNA, 19 nt, Homo sapiens
cuuagaacauguccacaag

SEQ ID NO: 987096 - RNA, 19 nt, Homo sapiens
uugaagcaccugaucauug

SEQ ID NO: 987097 - RNA, 19 nt, Homo sapiens
ggaguggauauauggcaaa

SEQ ID NO: 987098 - RNA, 19 nt, Homo sapiens
ggaagccgcagaugcugau

SEQ ID NO: 987099 - RNA, 19 nt, Homo sapiens
aaacuggcucggagaagaa

SEQ ID NO: 987100 - RNA, 19 nt, Homo sapiens
cuaaugagagaagaaggua

SEQ ID NO: 987101 - RNA, 19 nt, Homo sapiens
aaauagcaaagccaaagaa

SEQ ID NO: 987102 - RNA, 19 nt, Homo sapiens
gaccugugaaguacuaaug

SEQ ID NO: 987103 - RNA, 19 nt, Homo sapiens
uuuacuugauggacaguuu

SEQ ID NO: 987104 - RNA, 19 nt, Homo sapiens
acuaccaugcuaacaaaua

SEQ ID NO: 987105 - RNA, 19 nt, Homo sapiens
aggcaaaccaauucuauuc

SEQ ID NO: 987106 - RNA, 19 nt, Homo sapiens
aauacuuccuuucaugugu

SEQ ID NO: 987107 - RNA, 19 nt, Homo sapiens
uuacuugauggacaguuua

SEQ ID NO: 987108 - RNA, 19 nt, Homo sapiens
agaauucucccucuguugu

SEQ ID NO: 987109 - RNA, 19 nt, Homo sapiens
gaccauaugaaucuagaag

SEQ ID NO: 987110 - RNA, 19 nt, Homo sapiens
gcaaacuugggaguggaua

SEQ ID NO: 987111 - RNA, 19 nt, Homo sapiens
cuggauccaugaccauaug

SEQ ID NO: 987112 - RNA, 19 nt, Homo sapiens
aacugaaacuaccaugcua

SEQ ID NO: 987113 - RNA, 19 nt, Homo sapiens
ugaacagucacacuuggaa

SEQ ID NO: 987114 - RNA, 19 nt, Homo sapiens
gauggacaguuuaaaaucu

SEQ ID NO: 987115 - RNA, 19 nt, Homo sapiens
gacauaaagaauggaagaa

SEQ ID NO: 987116 - RNA, 19 nt, Homo sapiens
uacuuccuuucauguguua

SEQ ID NO: 987117 - RNA, 19 nt, Homo sapiens
auacuuccuuucauguguu

SEQ ID NO: 987118 - RNA, 19 nt, Homo sapiens
gaaagcagcugcagagaua

SEQ ID NO: 987119 - RNA, 19 nt, Homo sapiens
gaacagagguuucagaaga

SEQ ID NO: 987120 - RNA, 19 nt, Homo sapiens
gaacccagcucuaugaaua

SEQ ID NO: 987121 - RNA, 19 nt, Homo sapiens
gaacgaggauuaacagaaa

SEQ ID NO: 987122 - RNA, 19 nt, Homo sapiens
ggacacacaucaugcuuaa

SEQ ID NO: 987123 - RNA, 19 nt, Homo sapiens
gaagaaacaucugugaaga

SEQ ID NO: 987124 - RNA, 19 nt, Homo sapiens
gaacagagccaaauuagag

SEQ ID NO: 987125 - RNA, 19 nt, Homo sapiens
ggauacagcagaagcauua

SEQ ID NO: 987126 - RNA, 19 nt, Homo sapiens
gcaauauucugcaucuuug

SEQ ID NO: 987127 - RNA, 19 nt, Homo sapiens
gcaauuuccuuguuagaug

SEQ ID NO: 987128 - RNA, 19 nt, Homo sapiens
aaacaucugugaagaagaa

SEQ ID NO: 987129 - RNA, 19 nt, Homo sapiens
gggaugcucucuaacguaa

SEQ ID NO: 987130 - RNA, 19 nt, Homo sapiens
gaagacagagggauaagaa

SEQ ID NO: 987131 - RNA, 19 nt, Homo sapiens
ggaauucguucacaaaugg

SEQ ID NO: 987132 - RNA, 19 nt, Homo sapiens
cagaaaggaauuacgauua

SEQ ID NO: 987133 - RNA, 19 nt, Homo sapiens
gcauuucccugaauuagga

SEQ ID NO: 987134 - RNA, 19 nt, Homo sapiens
acaaauggauggauuaauc

SEQ ID NO: 987135 - RNA, 19 nt, Homo sapiens
ugacuuggauaaagaacua

SEQ ID NO: 987136 - RNA, 19 nt, Homo sapiens
gaagaagaaacaucuguga

SEQ ID NO: 987137 - RNA, 19 nt, Homo sapiens
caucaacucuguuaaccuu

SEQ ID NO: 987138 - RNA, 19 nt, Homo sapiens
ugaaaucucugaauaucga

SEQ ID NO: 987139 - RNA, 19 nt, Homo sapiens
uagaacagguagauaaaga

SEQ ID NO: 987140 - RNA, 19 nt, Homo sapiens
ucaggcaauuuccuuguua

SEQ ID NO: 987141 - RNA, 19 nt, Homo sapiens
agagagagaacgaggauua

SEQ ID NO: 987142 - RNA, 19 nt, Homo sapiens
agaaacacauuaaggaaga

SEQ ID NO: 987143 - RNA, 19 nt, Homo sapiens
uaccagggaugcucucuaa

SEQ ID NO: 987144 - RNA, 19 nt, Homo sapiens
cuaaguauggucucauuua

SEQ ID NO: 987145 - RNA, 19 nt, Homo sapiens
agaagaaguugaagcagaa

SEQ ID NO: 987146 - RNA, 19 nt, Homo sapiens
gagaggaauucguucacaa

SEQ ID NO: 987147 - RNA, 19 nt, Homo sapiens
gaacuuaugagaggaauuc

SEQ ID NO: 987148 - RNA, 19 nt, Homo sapiens
ugagaacagagccaaauua

SEQ ID NO: 987149 - RNA, 19 nt, Homo sapiens
ucagagcccucaaaucuag

SEQ ID NO: 987150 - RNA, 19 nt, Homo sapiens
ggauucaaguucugcaaug

SEQ ID NO: 987151 - RNA, 19 nt, Homo sapiens
uagaugacuuggauaaaga

SEQ ID NO: 987152 - RNA, 19 nt, Homo sapiens
guucacaaauggauggauu

SEQ ID NO: 987153 - RNA, 19 nt, Homo sapiens
gauaaaguagacacaauga

SEQ ID NO: 987154 - RNA, 19 nt, Homo sapiens
aagggaagguucaguaaga

SEQ ID NO: 987155 - RNA, 19 nt, Homo sapiens
ugaagaagaggaagaagaa

SEQ ID NO: 987156 - RNA, 19 nt, Homo sapiens
gcaaguguuuacagaaagu

SEQ ID NO: 987157 - RNA, 19 nt, Homo sapiens
caauuuccuuguuagauga

SEQ ID NO: 987158 - RNA, 19 nt, Homo sapiens
cuaaacaacuacauuaugc

SEQ ID NO: 987159 - RNA, 19 nt, Homo sapiens
gcagcuaugugucuuggau

SEQ ID NO: 987160 - RNA, 19 nt, Homo sapiens
aaucucaguuguauccaua

SEQ ID NO: 987161 - RNA, 19 nt, Homo sapiens
gaaacacauuaaggaagaa

SEQ ID NO: 987162 - RNA, 19 nt, Homo sapiens
gguagaaccacgugaaaug

SEQ ID NO: 987163 - RNA, 19 nt, Homo sapiens
uaacagaaaggaauuacga

SEQ ID NO: 987164 - RNA, 19 nt, Homo sapiens
guugauaguuuauggaaag

SEQ ID NO: 987165 - RNA, 19 nt, Homo sapiens
gagaacagagccaaauuag

SEQ ID NO: 987166 - RNA, 19 nt, Homo sapiens
aguauggucucauuuauca

SEQ ID NO: 987167 - RNA, 19 nt, Homo sapiens
gaggaugaaauuacugaaa

SEQ ID NO: 987168 - RNA, 19 nt, Homo sapiens
ugaaauggcagcuaugugu

SEQ ID NO: 987169 - RNA, 19 nt, Homo sapiens
gaggccagguugagaacuu

SEQ ID NO: 987170 - RNA, 19 nt, Homo sapiens
cugcaaguguuuacagaaa

SEQ ID NO: 987171 - RNA, 19 nt, Homo sapiens
acacacaucaugcuuaaga

SEQ ID NO: 987172 - RNA, 19 nt, Homo sapiens
gcucaugcagguucucuuu

SEQ ID NO: 987173 - RNA, 19 nt, Homo sapiens
ccagcucuaugaauaucua

SEQ ID NO: 987174 - RNA, 19 nt, Homo sapiens
cugccaagcuuucugaguu

SEQ ID NO: 987175 - RNA, 19 nt, Homo sapiens
cagccugucucgauauaga

SEQ ID NO: 987176 - RNA, 19 nt, Homo sapiens
ucaguaagacaaagugauu

SEQ ID NO: 987177 - RNA, 19 nt, Homo sapiens
gaugcucucuaacguaauc

SEQ ID NO: 987178 - RNA, 19 nt, Homo sapiens
ugaacugacucuacagcuu

SEQ ID NO: 987179 - RNA, 19 nt, Homo sapiens
ccauaguccuguuguuaau

SEQ ID NO: 987180 - RNA, 19 nt, Homo sapiens
gaagguucaguaagacaaa

SEQ ID NO: 987181 - RNA, 19 nt, Homo sapiens
ucaacucuguuaaccuuau

SEQ ID NO: 987182 - RNA, 19 nt, Homo sapiens
gagagaacgaggauuaaca

SEQ ID NO: 987183 - RNA, 19 nt, Homo sapiens
gagagagaacgaggauuaa

SEQ ID NO: 987184 - RNA, 19 nt, Homo sapiens
agaaacaucugugaagaag

SEQ ID NO: 987185 - RNA, 19 nt, Homo sapiens
gggaacagagguuucagaa

SEQ ID NO: 987186 - RNA, 19 nt, Homo sapiens
ggauaaagaacuaaacaac

SEQ ID NO: 987187 - RNA, 19 nt, Homo sapiens
ccauguuggugcuguuuga

SEQ ID NO: 987188 - RNA, 19 nt, Homo sapiens
gcuggcauuucccugaauu

SEQ ID NO: 987189 - RNA, 19 nt, Homo sapiens
aaccuuaugucaucauuuc

SEQ ID NO: 987190 - RNA, 19 nt, Homo sapiens
ggauuaacagaaaggaauu

SEQ ID NO: 987191 - RNA, 19 nt, Homo sapiens
gaagaagaggaagaagaaa

SEQ ID NO: 987192 - RNA, 19 nt, Homo sapiens
caaacacaaaggaaagauu

SEQ ID NO: 987193 - RNA, 19 nt, Homo sapiens
gaaguugaagcagaaguga

SEQ ID NO: 987194 - RNA, 19 nt, Homo sapiens
acagguagauaaagaggau

SEQ ID NO: 987195 - RNA, 19 nt, Homo sapiens
gcagaagcauuagcagcau

SEQ ID NO: 987196 - RNA, 19 nt, Homo sapiens
agacaagucccaaacacaa

SEQ ID NO: 987197 - RNA, 19 nt, Homo sapiens
uuagaugacuuggauaaag

SEQ ID NO: 987198 - RNA, 19 nt, Homo sapiens
ggacggcgagcgcauuugu

SEQ ID NO: 987199 - RNA, 19 nt, Homo sapiens
gaauuugaaacuccagaga

SEQ ID NO: 987200 - RNA, 19 nt, Homo sapiens
gaaucucaguuguauccau

SEQ ID NO: 987201 - RNA, 19 nt, Homo sapiens
ggaagguucaguaagacaa

SEQ ID NO: 987202 - RNA, 19 nt, Homo sapiens
ucaagggaagguucaguaa

SEQ ID NO: 987203 - RNA, 19 nt, Homo sapiens
gacaagucccaaacacaaa

SEQ ID NO: 987204 - RNA, 19 nt, Homo sapiens
ucaugcagguucucuuuua

SEQ ID NO: 987205 - RNA, 19 nt, Homo sapiens
cagaagaagauauuugcaa

SEQ ID NO: 987206 - RNA, 19 nt, Homo sapiens
cagaagcauuagcagcauu

SEQ ID NO: 987207 - RNA, 19 nt, Homo sapiens
ucacaaauggauggauuaa

SEQ ID NO: 987208 - RNA, 19 nt, Homo sapiens
caacucuguuaaccuuaug

SEQ ID NO: 987209 - RNA, 19 nt, Homo sapiens
auaguccuguuguuaauga

SEQ ID NO: 987210 - RNA, 19 nt, Homo sapiens
ugagaaauuucaggauaca

SEQ ID NO: 987211 - RNA, 19 nt, Homo sapiens
agauucaacugggagcaua

SEQ ID NO: 987212 - RNA, 19 nt, Homo sapiens
uaaaguugaagaagaggaa

SEQ ID NO: 987213 - RNA, 19 nt, Homo sapiens
ggaagacagagggauaaga

SEQ ID NO: 987214 - RNA, 19 nt, Homo sapiens
uuucagagcccucaaaucu

SEQ ID NO: 987215 - RNA, 19 nt, Homo sapiens
aacagagguuucagaagaa

SEQ ID NO: 987216 - RNA, 19 nt, Homo sapiens
acagaaaguuggcgauagg

SEQ ID NO: 987217 - RNA, 19 nt, Homo sapiens
gcaauugcuaguccagaga

SEQ ID NO: 987218 - RNA, 19 nt, Homo sapiens
gccagagaaugaagaaaua

SEQ ID NO: 987219 - RNA, 19 nt, Homo sapiens
gcaagcuccucaaauggua

SEQ ID NO: 987220 - RNA, 19 nt, Homo sapiens
gcuggaaacaucaaucuua

SEQ ID NO: 987221 - RNA, 19 nt, Homo sapiens
ggaugaaacugcugcugaa

SEQ ID NO: 987222 - RNA, 19 nt, Homo sapiens
gauaagaguuaccuguguu

SEQ ID NO: 987223 - RNA, 19 nt, Homo sapiens
cagauggccuggacuauau

SEQ ID NO: 987224 - RNA, 19 nt, Homo sapiens
gcagauggccuggacuaua

SEQ ID NO: 987225 - RNA, 19 nt, Homo sapiens
aaacgcagcuucggcagua

SEQ ID NO: 987226 - RNA, 19 nt, Homo sapiens
ugaaacugcugcugaaaug

SEQ ID NO: 987227 - RNA, 19 nt, Homo sapiens
uaaagucucuaguguuugu

SEQ ID NO: 987228 - RNA, 19 nt, Homo sapiens
uuagagaccuggcagacua

SEQ ID NO: 987229 - RNA, 19 nt, Homo sapiens
agaguaagguuucuauaga

SEQ ID NO: 987230 - RNA, 19 nt, Homo sapiens
ccaaaguccugcauugaug

SEQ ID NO: 987231 - RNA, 19 nt, Homo sapiens
ucacuuggcuggaaacauc

SEQ ID NO: 987232 - RNA, 19 nt, Homo sapiens
ggaaucugcuuacccacuu

SEQ ID NO: 987233 - RNA, 19 nt, Homo sapiens
ccucagaacucaagacauc

SEQ ID NO: 987234 - RNA, 19 nt, Homo sapiens
gagguugccugaagauuag

SEQ ID NO: 987235 - RNA, 19 nt, Homo sapiens
acaugaaccucuuaccuaa

SEQ ID NO: 987236 - RNA, 19 nt, Homo sapiens
uacaugcacugucucauuu

SEQ ID NO: 987237 - RNA, 19 nt, Homo sapiens
gcacacacugcaugccuua

SEQ ID NO: 987238 - RNA, 19 nt, Homo sapiens
gcuacgaugucauaauguu

SEQ ID NO: 987239 - RNA, 19 nt, Homo sapiens
ugagguugccugaagauua

SEQ ID NO: 987240 - RNA, 19 nt, Homo sapiens
acacguaugucuugucaga

SEQ ID NO: 987241 - RNA, 19 nt, Homo sapiens
ugaaugagauccuguucug

SEQ ID NO: 987242 - RNA, 19 nt, Homo sapiens
gaguaagguuucuauagau

SEQ ID NO: 987243 - RNA, 19 nt, Homo sapiens
ucagugagguugucaucaa

SEQ ID NO: 987244 - RNA, 19 nt, Homo sapiens
gaccauaaauagaguaagg

SEQ ID NO: 987245 - RNA, 19 nt, Homo sapiens
ucaagcaaaugaaggaaug

SEQ ID NO: 987246 - RNA, 19 nt, Homo sapiens
caccagagcuccuagaaac

SEQ ID NO: 987247 - RNA, 19 nt, Homo sapiens
cuggaaacaucaaucuuaa

SEQ ID NO: 987248 - RNA, 19 nt, Homo sapiens
uuuauugcgucucuacuua

SEQ ID NO: 987249 - RNA, 19 nt, Homo sapiens
gaacucaagacauccaaau

SEQ ID NO: 987250 - RNA, 19 nt, Homo sapiens
gaaauacaacgcacaguac

SEQ ID NO: 987251 - RNA, 19 nt, Homo sapiens
agaguuaccuguguuguga

SEQ ID NO: 987252 - RNA, 19 nt, Homo sapiens
gugagcaacuguaugaugu

SEQ ID NO: 987253 - RNA, 19 nt, Homo sapiens
caucuuguccucuucagua

SEQ ID NO: 987254 - RNA, 19 nt, Homo sapiens
caaaugaaggaauguaaug

SEQ ID NO: 987255 - RNA, 19 nt, Homo sapiens
guaggaacaugaaccucuu

SEQ ID NO: 987256 - RNA, 19 nt, Homo sapiens
agaaauacaacgcacagua

SEQ ID NO: 987257 - RNA, 19 nt, Homo sapiens
gaauugagggugaagugaa

SEQ ID NO: 987258 - RNA, 19 nt, Homo sapiens
ccagguugcugaaggaugu

SEQ ID NO: 987259 - RNA, 19 nt, Homo sapiens
gcaaaugaaggaauguaau

SEQ ID NO: 987260 - RNA, 19 nt, Homo sapiens
ugagugagcaacuguauga

SEQ ID NO: 987261 - RNA, 19 nt, Homo sapiens
uaucuaaacccaaaucuca

SEQ ID NO: 987262 - RNA, 19 nt, Homo sapiens
acguaugucuugucagaua

SEQ ID NO: 987263 - RNA, 19 nt, Homo sapiens
gaacugagugagcaacugu

SEQ ID NO: 987264 - RNA, 19 nt, Homo sapiens
ucagaaccauuaaaccaau

SEQ ID NO: 987265 - RNA, 19 nt, Homo sapiens
aaaauugugugacugcuua

SEQ ID NO: 987266 - RNA, 19 nt, Homo sapiens
caugcacugucucauuuaa

SEQ ID NO: 987267 - RNA, 19 nt, Homo sapiens
uaggagugaucucaaguga

SEQ ID NO: 987268 - RNA, 19 nt, Homo sapiens
uauugcgucucuacuuaua

SEQ ID NO: 987269 - RNA, 19 nt, Homo sapiens
caucuugacuccugaaggu

SEQ ID NO: 987270 - RNA, 19 nt, Homo sapiens
gaagagaagaccuuacaac

SEQ ID NO: 987271 - RNA, 19 nt, Homo sapiens
cuuacccacuucauuauuu

SEQ ID NO: 987272 - RNA, 19 nt, Homo sapiens
cugcuuacccacuucauua

SEQ ID NO: 987273 - RNA, 19 nt, Homo sapiens
cugcaugccuuaacaagug

SEQ ID NO: 987274 - RNA, 19 nt, Homo sapiens
uguuugauguugacaguaa

SEQ ID NO: 987275 - RNA, 19 nt, Homo sapiens
cagauggaguuuccugaug

SEQ ID NO: 987276 - RNA, 19 nt, Homo sapiens
ugggcaagcuccucaaaug

SEQ ID NO: 987277 - RNA, 19 nt, Homo sapiens
gaucgaucccuccauguug

SEQ ID NO: 987278 - RNA, 19 nt, Homo sapiens
gcugagaaacccagagcua

SEQ ID NO: 987279 - RNA, 19 nt, Homo sapiens
guauggaaccuaccuggaa

SEQ ID NO: 987280 - RNA, 19 nt, Homo sapiens
gaacaugaaccucuuaccu

SEQ ID NO: 987281 - RNA, 19 nt, Homo sapiens
gcaagcgugugugagauuc

SEQ ID NO: 987282 - RNA, 19 nt, Homo sapiens
acucaagacauccaaauuu

SEQ ID NO: 987283 - RNA, 19 nt, Homo sapiens
gucauaauguuugauguug

SEQ ID NO: 987284 - RNA, 19 nt, Homo sapiens
gaacaccacaaagccauga

SEQ ID NO: 987285 - RNA, 19 nt, Homo sapiens
ucacaaagcccagaagaag

SEQ ID NO: 987286 - RNA, 19 nt, Homo sapiens
ucaccgaggucagcaguau

SEQ ID NO: 987287 - RNA, 19 nt, Homo sapiens
ugacagaugaggaagagaa

SEQ ID NO: 987288 - RNA, 19 nt, Homo sapiens
ugauaagaguuaccugugu

SEQ ID NO: 987289 - RNA, 19 nt, Homo sapiens
uacuuaagcccaaacuaua

SEQ ID NO: 987290 - RNA, 19 nt, Homo sapiens
guuccaggcauucuucuaa

SEQ ID NO: 987291 - RNA, 19 nt, Homo sapiens
ggugguggcagaagugaaa

SEQ ID NO: 987292 - RNA, 19 nt, Homo sapiens
uugcuacgaugucauaaug

SEQ ID NO: 987293 - RNA, 19 nt, Homo sapiens
uaagguuucuauagaugug

SEQ ID NO: 987294 - RNA, 19 nt, Homo sapiens
cuauauguccggcgaauug

SEQ ID NO: 987295 - RNA, 19 nt, Homo sapiens
gagguugucaucaagcaaa

SEQ ID NO: 987296 - RNA, 19 nt, Homo sapiens
uuacaugcacugucucauu

SEQ ID NO: 987297 - RNA, 19 nt, Homo sapiens
gcugucggcuagagucaug

SEQ ID NO: 987298 - RNA, 19 nt, Homo sapiens
gauuggguguggcaacuca

SEQ ID NO: 987299 - RNA, 19 nt, Homo sapiens
ggguugggaugacacguau

SEQ ID NO: 987300 - RNA, 19 nt, Homo sapiens
auacaacgcacaguacuuu

SEQ ID NO: 987301 - RNA, 19 nt, Homo sapiens
gccuugcccugcugagaaa

SEQ ID NO: 987302 - RNA, 19 nt, Homo sapiens
gcaguccauugauaagagu

SEQ ID NO: 987303 - RNA, 19 nt, Homo sapiens
ggaagagaagaccuuacaa

SEQ ID NO: 987304 - RNA, 19 nt, Homo sapiens
ugagauagcagagcaagau

SEQ ID NO: 987305 - RNA, 19 nt, Homo sapiens
acaaaucaauguggcuguu

SEQ ID NO: 987306 - RNA, 19 nt, Homo sapiens
ggagaccgaguggcucuuu

SEQ ID NO: 987307 - RNA, 19 nt, Homo sapiens
uacaacagguggacaggau

SEQ ID NO: 987308 - RNA, 19 nt, Homo sapiens
gcagauggaguuuccugau

SEQ ID NO: 987309 - RNA, 19 nt, Homo sapiens
ggugcuacauaaauauauc

SEQ ID NO: 987310 - RNA, 19 nt, Homo sapiens
gcggggugcuacauaaaua

SEQ ID NO: 987311 - RNA, 19 nt, Homo sapiens
auacuuaagcccaaacuau

SEQ ID NO: 987312 - RNA, 19 nt, Homo sapiens
cccaaaccuuguagccuaa

SEQ ID NO: 987313 - RNA, 19 nt, Homo sapiens
ugucagauaugcucaagac

SEQ ID NO: 987314 - RNA, 19 nt, Homo sapiens
cagcauuuguggagcaauc

SEQ ID NO: 987315 - RNA, 19 nt, Homo sapiens
ccagagcuacuccuagaga

SEQ ID NO: 987316 - RNA, 19 nt, Homo sapiens
gaggucagcaguaugaaag

SEQ ID NO: 987317 - RNA, 19 nt, Homo sapiens
gagaccgaguggcucuuug

SEQ ID NO: 987318 - RNA, 19 nt, Homo sapiens
ggaaggagcucaguaaugu

SEQ ID NO: 987319 - RNA, 19 nt, Homo sapiens
gaaggcagaucgcuuguuc

SEQ ID NO: 987320 - RNA, 19 nt, Homo sapiens
gaagaccuaugccaucuau

SEQ ID NO: 987321 - RNA, 19 nt, Homo sapiens
ggacguagccgccacauuc

SEQ ID NO: 987322 - RNA, 19 nt, Homo sapiens
gaacaaaccaaguuacauc

SEQ ID NO: 987323 - RNA, 19 nt, Homo sapiens
cagcugaucuccaaguauu

SEQ ID NO: 987324 - RNA, 19 nt, Homo sapiens
ggauggaguuuacuguuug

SEQ ID NO: 987325 - RNA, 19 nt, Homo sapiens
ucacugauguggauaaauc

SEQ ID NO: 987326 - RNA, 19 nt, Homo sapiens
gugcauauccgcccuguuu

SEQ ID NO: 987327 - RNA, 19 nt, Homo sapiens
gaaggagugucccauuaca

SEQ ID NO: 987328 - RNA, 19 nt, Homo sapiens
caaguuacauccacuacca

SEQ ID NO: 987329 - RNA, 19 nt, Homo sapiens
aaccauggcuucuauguca

SEQ ID NO: 987330 - RNA, 19 nt, Homo sapiens
gucgguggcugcuguauug

SEQ ID NO: 987331 - RNA, 19 nt, Homo sapiens
ugauggcucuaacuacuuu

SEQ ID NO: 987332 - RNA, 19 nt, Homo sapiens
ccaaugacacugaccacua

SEQ ID NO: 987333 - RNA, 19 nt, Homo sapiens
uggauggaguuuacuguuu

SEQ ID NO: 987334 - RNA, 19 nt, Homo sapiens
gcacacugcuguacaacac

SEQ ID NO: 987335 - RNA, 19 nt, Homo sapiens
gcucaguaauguccucuca

SEQ ID NO: 987336 - RNA, 19 nt, Homo sapiens
gagcugcaccugucauuca

SEQ ID NO: 987337 - RNA, 19 nt, Homo sapiens
gagaacaaaccaaguuaca

SEQ ID NO: 987338 - RNA, 19 nt, Homo sapiens
guacaacacccacccauac

SEQ ID NO: 987339 - RNA, 19 nt, Homo sapiens
caaugacacugaccacuac

SEQ ID NO: 987340 - RNA, 19 nt, Homo sapiens
gacccugucaguuguauuu

SEQ ID NO: 987341 - RNA, 19 nt, Homo sapiens
gaaaugcacgcuguacuag

SEQ ID NO: 987342 - RNA, 19 nt, Homo sapiens
agaaaugcacgcuguacua

SEQ ID NO: 987343 - RNA, 19 nt, Homo sapiens
ggcagcugaucuccaagua

SEQ ID NO: 987344 - RNA, 19 nt, Homo sapiens
caagguuuccauccaguuu

SEQ ID NO: 987345 - RNA, 19 nt, Homo sapiens
agaccuaugccaucuauga

SEQ ID NO: 987346 - RNA, 19 nt, Homo sapiens
ggacaacgagacauuagag

SEQ ID NO: 987347 - RNA, 19 nt, Homo sapiens
ggacaucaccaccuacaac

SEQ ID NO: 987348 - RNA, 19 nt, Homo sapiens
ugacacugaccacuacuuu

SEQ ID NO: 987349 - RNA, 19 nt, Homo sapiens
gggaggaacuugucaucac

SEQ ID NO: 987350 - RNA, 19 nt, Homo sapiens
ggaaggagugucccauuac

SEQ ID NO: 987351 - RNA, 19 nt, Homo sapiens
ccaggacaacgagacauua

SEQ ID NO: 987352 - RNA, 19 nt, Homo sapiens
ggcagacccugucaguugu

SEQ ID NO: 987353 - RNA, 19 nt, Homo sapiens
gcaccugucauucacacaa

SEQ ID NO: 987354 - RNA, 19 nt, Homo sapiens
ggaagaccuaugccaucua

SEQ ID NO: 987355 - RNA, 19 nt, Homo sapiens
guuuacuguuuguggaaua

SEQ ID NO: 987356 - RNA, 19 nt, Homo sapiens
gauggaguuuacuguuugu

SEQ ID NO: 987357 - RNA, 19 nt, Homo sapiens
acagcuguguuguccagua

SEQ ID NO: 987358 - RNA, 19 nt, Homo sapiens
gccacuugcucuccucaga

SEQ ID NO: 987359 - RNA, 19 nt, Homo sapiens
ucaccaagguuuccaucca

SEQ ID NO: 987360 - RNA, 19 nt, Homo sapiens
gaucaacaacucucgaaac

SEQ ID NO: 987361 - RNA, 19 nt, Homo sapiens
ucagagagccgagucuaug

SEQ ID NO: 987362 - RNA, 19 nt, Homo sapiens
aggcagacccugucaguug

SEQ ID NO: 987363 - RNA, 19 nt, Homo sapiens
guauuggacagcacagaaa

SEQ ID NO: 987364 - RNA, 19 nt, Homo sapiens
caacucagucaccaagguu

SEQ ID NO: 987365 - RNA, 19 nt, Homo sapiens
gugcacacccucaccauca

SEQ ID NO: 987366 - RNA, 19 nt, Homo sapiens
ccugguaucugcggcugua

SEQ ID NO: 987367 - RNA, 19 nt, Homo sapiens
ccuaugccaucuaugacuu

SEQ ID NO: 987368 - RNA, 19 nt, Homo sapiens
ccucagaguuggcuuuuga

SEQ ID NO: 987369 - RNA, 19 nt, Homo sapiens
cuacggcuccuucuacaau

SEQ ID NO: 987370 - RNA, 19 nt, Homo sapiens
ccaacucagucaccaaggu

SEQ ID NO: 987371 - RNA, 19 nt, Homo sapiens
acaccgccaugaucaacaa

SEQ ID NO: 987372 - RNA, 19 nt, Homo sapiens
gcgccucucucaacuucau

SEQ ID NO: 987373 - RNA, 19 nt, Homo sapiens
uguaguggauggaguuuac

SEQ ID NO: 987374 - RNA, 19 nt, Homo sapiens
gcgcugggauucggagcuu

SEQ ID NO: 987375 - RNA, 19 nt, Homo sapiens
gcagacccugucaguugua

SEQ ID NO: 987376 - RNA, 19 nt, Homo sapiens
ccacuacuuucugcgcuau

SEQ ID NO: 987377 - RNA, 19 nt, Homo sapiens
ggagaacaaaccaaguuac

SEQ ID NO: 987378 - RNA, 19 nt, Homo sapiens
ucugauggcucuaacuacu

SEQ ID NO: 987379 - RNA, 19 nt, Homo sapiens
aaggagaacaaaccaaguu

SEQ ID NO: 987380 - RNA, 19 nt, Homo sapiens
gcagcugaucuccaaguau

SEQ ID NO: 987381 - RNA, 19 nt, Homo sapiens
cggaagaccuaugccaucu

SEQ ID NO: 987382 - RNA, 19 nt, Homo sapiens
ucucugauggcucuaacua

SEQ ID NO: 987383 - RNA, 19 nt, Homo sapiens
aggagaacaaaccaaguua

SEQ ID NO: 987384 - RNA, 19 nt, Homo sapiens
gaucuccaaguauucucua

SEQ ID NO: 987385 - RNA, 19 nt, Homo sapiens
aaugcacgcuguacuagca

SEQ ID NO: 987386 - RNA, 19 nt, Homo sapiens
gcacucggaagaccuaugc

SEQ ID NO: 987387 - RNA, 19 nt, Homo sapiens
acacugaccacuacuuucu

SEQ ID NO: 987388 - RNA, 19 nt, Homo sapiens
cccugggucuggccaauga

SEQ ID NO: 987389 - RNA, 19 nt, Homo sapiens
uggaaggagcucaguaaug

SEQ ID NO: 987390 - RNA, 19 nt, Homo sapiens
ccaagggcaaggagaacaa

SEQ ID NO: 987391 - RNA, 19 nt, Homo sapiens
ugccaucuaugacuugcuu

SEQ ID NO: 987392 - RNA, 19 nt, Homo sapiens
cuacauaucaggacgucau

SEQ ID NO: 987393 - RNA, 19 nt, Homo sapiens
ccugucaguuguauuugau

SEQ ID NO: 987394 - RNA, 19 nt, Homo sapiens
gcagaaaugcacgcuguac

SEQ ID NO: 987395 - RNA, 19 nt, Homo sapiens
gucauucacacaaggcuuu

SEQ ID NO: 987396 - RNA, 19 nt, Homo sapiens
gaguuuacuguuuguggaa

SEQ ID NO: 987397 - RNA, 19 nt, Homo sapiens
ggucgguggcugcuguauu

SEQ ID NO: 987398 - RNA, 19 nt, Homo sapiens
ugucacugauguggauaaa

SEQ ID NO: 987399 - RNA, 19 nt, Homo sapiens
gguaucugcggcuguaugu

SEQ ID NO: 987400 - RNA, 19 nt, Homo sapiens
cuuggaaggagcucaguaa

SEQ ID NO: 987401 - RNA, 19 nt, Homo sapiens
uguggcauuugaauuugaa

SEQ ID NO: 987402 - RNA, 19 nt, Homo sapiens
gggagcugcaccugucauu

SEQ ID NO: 987403 - RNA, 19 nt, Homo sapiens
uguacaacacccacccaua

SEQ ID NO: 987404 - RNA, 19 nt, Homo sapiens
caaccaggacaacgagaca

SEQ ID NO: 987405 - RNA, 19 nt, Homo sapiens
ggagccacgagccaaaugu

SEQ ID NO: 987406 - RNA, 19 nt, Homo sapiens
uuacaggcucuuucccaaa

SEQ ID NO: 987407 - RNA, 19 nt, Homo sapiens
caagggcaaggagaacaaa

SEQ ID NO: 987408 - RNA, 19 nt, Homo sapiens
cugcgccucucucaacuuc

SEQ ID NO: 987409 - RNA, 19 nt, Homo sapiens
cagcuguguuguccaguac

SEQ ID NO: 987410 - RNA, 19 nt, Homo sapiens
guggauggaguuuacuguu

SEQ ID NO: 987411 - RNA, 19 nt, Homo sapiens
gagccacgagccaaaugug

SEQ ID NO: 987412 - RNA, 19 nt, Homo sapiens
uccuggagaugcugauuca

SEQ ID NO: 987413 - RNA, 19 nt, Homo sapiens
caaggagaacaaaccaagu

SEQ ID NO: 987414 - RNA, 19 nt, Homo sapiens
cagagagccgagucuaugu

SEQ ID NO: 987415 - RNA, 19 nt, Homo sapiens
cccugucaguuguauuuga

SEQ ID NO: 987416 - RNA, 19 nt, Homo sapiens
gcaaauaucuugagaacuu

SEQ ID NO: 987417 - RNA, 19 nt, Homo sapiens
ggaaauaguucagcaguua

SEQ ID NO: 987418 - RNA, 19 nt, Homo sapiens
ggaaaguucugaguauuua

SEQ ID NO: 987419 - RNA, 19 nt, Homo sapiens
gaagaaauuuccucuguuc

SEQ ID NO: 987420 - RNA, 19 nt, Homo sapiens
aaaccuggcucagaaauua

SEQ ID NO: 987421 - RNA, 19 nt, Homo sapiens
gugagugugugauuuauua

SEQ ID NO: 987422 - RNA, 19 nt, Homo sapiens
gaaauuuccucuguucauu

SEQ ID NO: 987423 - RNA, 19 nt, Homo sapiens
gcucagaaauuaucagguu

SEQ ID NO: 987424 - RNA, 19 nt, Homo sapiens
gcagaugguuuaauuguag

SEQ ID NO: 987425 - RNA, 19 nt, Homo sapiens
ugaauucccucucaacaaa

SEQ ID NO: 987426 - RNA, 19 nt, Homo sapiens
gaaaggagggcaauucaug

SEQ ID NO: 987427 - RNA, 19 nt, Homo sapiens
ucaguggucuuuaugaauu

SEQ ID NO: 987428 - RNA, 19 nt, Homo sapiens
uaaaggagaggaaauaguu

SEQ ID NO: 987429 - RNA, 19 nt, Homo sapiens
gaaagaaacgcagaugguu

SEQ ID NO: 987430 - RNA, 19 nt, Homo sapiens
uaacaaaacuccucuaagu

SEQ ID NO: 987431 - RNA, 19 nt, Homo sapiens
acaccagccucaaaucuaa

SEQ ID NO: 987432 - RNA, 19 nt, Homo sapiens
ggacaagggcauuaaagga

SEQ ID NO: 987433 - RNA, 19 nt, Homo sapiens
gggaaaguucugaguauuu

SEQ ID NO: 987434 - RNA, 19 nt, Homo sapiens
ggaaacaauggaaacaauu

SEQ ID NO: 987435 - RNA, 19 nt, Homo sapiens
ggaacugcauuugaaguga

SEQ ID NO: 987436 - RNA, 19 nt, Homo sapiens
gaaauaguucagcaguuaa

SEQ ID NO: 987437 - RNA, 19 nt, Homo sapiens
gcacugauaaucgaaauau

SEQ ID NO: 987438 - RNA, 19 nt, Homo sapiens
agacagaauuugcccaaga

SEQ ID NO: 987439 - RNA, 19 nt, Homo sapiens
gcugaaacgugaagaugug

SEQ ID NO: 987440 - RNA, 19 nt, Homo sapiens
gaagccaucauuacuguug

SEQ ID NO: 987441 - RNA, 19 nt, Homo sapiens
gaaggacaagggcauuaaa

SEQ ID NO: 987442 - RNA, 19 nt, Homo sapiens
ugacacagaugcauuuggu

SEQ ID NO: 987443 - RNA, 19 nt, Homo sapiens
gaaaccuggcucagaaauu

SEQ ID NO: 987444 - RNA, 19 nt, Homo sapiens
ggacagucuucuacaugga

SEQ ID NO: 987445 - RNA, 19 nt, Homo sapiens
ugcaagcacuuuagaauca

SEQ ID NO: 987446 - RNA, 19 nt, Homo sapiens
gacagaauuugcccaagau

SEQ ID NO: 987447 - RNA, 19 nt, Homo sapiens
ggaaaucucagaaacuuac

SEQ ID NO: 987448 - RNA, 19 nt, Homo sapiens
caaaguggacagucuucua

SEQ ID NO: 987449 - RNA, 19 nt, Homo sapiens
gaaacuuacucaagaugac

SEQ ID NO: 987450 - RNA, 19 nt, Homo sapiens
uuauggaacugcauuugaa

SEQ ID NO: 987451 - RNA, 19 nt, Homo sapiens
gugcaaauaucuugagaac

SEQ ID NO: 987452 - RNA, 19 nt, Homo sapiens
ugaggagccugcagcuaaa

SEQ ID NO: 987453 - RNA, 19 nt, Homo sapiens
caucauuacuguugugaag

SEQ ID NO: 987454 - RNA, 19 nt, Homo sapiens
gugaagauguguuuaaagc

SEQ ID NO: 987455 - RNA, 19 nt, Homo sapiens
gaugggaaaucucagaaac

SEQ ID NO: 987456 - RNA, 19 nt, Homo sapiens
ggaauaauacaacguaacu

SEQ ID NO: 987457 - RNA, 19 nt, Homo sapiens
agacagugcuuugguugaa

SEQ ID NO: 987458 - RNA, 19 nt, Homo sapiens
gaagugaccaguggaggaa

SEQ ID NO: 987459 - RNA, 19 nt, Homo sapiens
guacaaguccagcggagaa

SEQ ID NO: 987460 - RNA, 19 nt, Homo sapiens
gcauagaaagguuuaguag

SEQ ID NO: 987461 - RNA, 19 nt, Homo sapiens
ggcauuauacaguuaguaa

SEQ ID NO: 987462 - RNA, 19 nt, Homo sapiens
gcagacaccagccucaaau

SEQ ID NO: 987463 - RNA, 19 nt, Homo sapiens
gcuccauuauucagcuaua

SEQ ID NO: 987464 - RNA, 19 nt, Homo sapiens
caugagauacgauacacua

SEQ ID NO: 987465 - RNA, 19 nt, Homo sapiens
agaauuugcccaagauaaa

SEQ ID NO: 987466 - RNA, 19 nt, Homo sapiens
cagaagaccaggaaacaau

SEQ ID NO: 987467 - RNA, 19 nt, Homo sapiens
uauaguugaugaugggaaa

SEQ ID NO: 987468 - RNA, 19 nt, Homo sapiens
gagggcaauucauggaaga

SEQ ID NO: 987469 - RNA, 19 nt, Homo sapiens
ucucaggcauuauacaguu

SEQ ID NO: 987470 - RNA, 19 nt, Homo sapiens
gacaccagccucaaaucua

SEQ ID NO: 987471 - RNA, 19 nt, Homo sapiens
cauuaaaggagaggaaaua

SEQ ID NO: 987472 - RNA, 19 nt, Homo sapiens
ucagaaacuuacucaagau

SEQ ID NO: 987473 - RNA, 19 nt, Homo sapiens
cucagaaacuuacucaaga

SEQ ID NO: 987474 - RNA, 19 nt, Homo sapiens
caacaaaguggacagucuu

SEQ ID NO: 987475 - RNA, 19 nt, Homo sapiens
uauccgugcuggcaacaaa

SEQ ID NO: 987476 - RNA, 19 nt, Homo sapiens
gcauuaauuugccaauacu

SEQ ID NO: 987477 - RNA, 19 nt, Homo sapiens
cuaccuggauaacgucauu

SEQ ID NO: 987478 - RNA, 19 nt, Homo sapiens
guauaugccuuuugucuau

SEQ ID NO: 987479 - RNA, 19 nt, Homo sapiens
aaacagaggagacaagaag

SEQ ID NO: 987480 - RNA, 19 nt, Homo sapiens
cagaauuugcccaagauaa

SEQ ID NO: 987481 - RNA, 19 nt, Homo sapiens
ugggaaaucucagaaacuu

SEQ ID NO: 987482 - RNA, 19 nt, Homo sapiens
uaaagaagcgggcacugau

SEQ ID NO: 987483 - RNA, 19 nt, Homo sapiens
gaacuucaacauccuaaaa

SEQ ID NO: 987484 - RNA, 19 nt, Homo sapiens
gacaagaagagcagaggaa

SEQ ID NO: 987485 - RNA, 19 nt, Homo sapiens
ucucaguggucuuuaugaa

SEQ ID NO: 987486 - RNA, 19 nt, Homo sapiens
gauaacgucauuggccaua

SEQ ID NO: 987487 - RNA, 19 nt, Homo sapiens
guacaacauuccgagacaa

SEQ ID NO: 987488 - RNA, 19 nt, Homo sapiens
cgaaauauaguugaugaug

SEQ ID NO: 987489 - RNA, 19 nt, Homo sapiens
ggcaauucauggaagaaau

SEQ ID NO: 987490 - RNA, 19 nt, Homo sapiens
uagaaucacacgagacuga

SEQ ID NO: 987491 - RNA, 19 nt, Homo sapiens
ccagaucgaagucauccua

SEQ ID NO: 987492 - RNA, 19 nt, Homo sapiens
cgcagaugguuuaauugua

SEQ ID NO: 987493 - RNA, 19 nt, Homo sapiens
gcaaugauggaacgaaugg

SEQ ID NO: 987494 - RNA, 19 nt, Homo sapiens
gggaaaucucagaaacuua

SEQ ID NO: 987495 - RNA, 19 nt, Homo sapiens
aaagaagcgggcacugaua

SEQ ID NO: 987496 - RNA, 19 nt, Homo sapiens
ggaagucuacagcccaaga

SEQ ID NO: 987497 - RNA, 19 nt, Homo sapiens
cuaggaaggaggaguauau

SEQ ID NO: 987498 - RNA, 19 nt, Homo sapiens
cugaggagccugcagcuaa

SEQ ID NO: 987499 - RNA, 19 nt, Homo sapiens
caaggccguuuguggucua

SEQ ID NO: 987500 - RNA, 19 nt, Homo sapiens
ucaacaaaguggacagucu

SEQ ID NO: 987501 - RNA, 19 nt, Homo sapiens
gugcaaugauggaacgaau

SEQ ID NO: 987502 - RNA, 19 nt, Homo sapiens
uaacgucauuggccauagu

SEQ ID NO: 987503 - RNA, 19 nt, Homo sapiens
gaagucuacagcccaagaa

SEQ ID NO: 987504 - RNA, 19 nt, Homo sapiens
gaagccauccacccguauu

SEQ ID NO: 987505 - RNA, 19 nt, Homo sapiens
caaauaucuugagaacuuc

SEQ ID NO: 987506 - RNA, 19 nt, Homo sapiens
ugucuuugcuggacuuugu

SEQ ID NO: 987507 - RNA, 19 nt, Homo sapiens
aggaaacaauggaaacaau

SEQ ID NO: 987508 - RNA, 19 nt, Homo sapiens
ggugcugggugcaaugaug

SEQ ID NO: 987509 - RNA, 19 nt, Homo sapiens
uagcccagauguugacguu

SEQ ID NO: 987510 - RNA, 19 nt, Homo sapiens
guggaauaauacaacguaa

SEQ ID NO: 987511 - RNA, 19 nt, Homo sapiens
cucaagauccagaacauaa

SEQ ID NO: 987512 - RNA, 19 nt, Homo sapiens
aagaagcgggcacugauaa

SEQ ID NO: 987513 - RNA, 19 nt, Homo sapiens
aaaacaggcuucugaacaa

SEQ ID NO: 987514 - RNA, 19 nt, Homo sapiens
gggcacugauaaucgaaau

SEQ ID NO: 987515 - RNA, 19 nt, Homo sapiens
gaccaacugcauuuaacaa

SEQ ID NO: 987516 - RNA, 19 nt, Homo sapiens
gagaauaugugcggcauua

SEQ ID NO: 987517 - RNA, 19 nt, Homo sapiens
ggaagcagcuggucaugaa

SEQ ID NO: 987518 - RNA, 19 nt, Homo sapiens
gcaaaguucugaaacaguu

SEQ ID NO: 987519 - RNA, 19 nt, Homo sapiens
cagcgaagauaucaaauuu

SEQ ID NO: 987520 - RNA, 19 nt, Homo sapiens
ggagaauuguugcaaagua

SEQ ID NO: 987521 - RNA, 19 nt, Homo sapiens
gaaguacgaugaugaagau

SEQ ID NO: 987522 - RNA, 19 nt, Homo sapiens
aaacauggccucucucuuu

SEQ ID NO: 987523 - RNA, 19 nt, Homo sapiens
ggaaggcagugacuuaaau

SEQ ID NO: 987524 - RNA, 19 nt, Homo sapiens
caauauggcuccuggcauu

SEQ ID NO: 987525 - RNA, 19 nt, Homo sapiens
gagaaacucgccaagaaua

SEQ ID NO: 987526 - RNA, 19 nt, Homo sapiens
gcagugacuuaaauuacua

SEQ ID NO: 987527 - RNA, 19 nt, Homo sapiens
ggaacagucucuucaagug

SEQ ID NO: 987528 - RNA, 19 nt, Homo sapiens
gaacuuaaaucuggaaggu

SEQ ID NO: 987529 - RNA, 19 nt, Homo sapiens
gcugugagguuaaaugaga

SEQ ID NO: 987530 - RNA, 19 nt, Homo sapiens
gaaagacauucaagauuac

SEQ ID NO: 987531 - RNA, 19 nt, Homo sapiens
gaccuuaguucauuugaug

SEQ ID NO: 987532 - RNA, 19 nt, Homo sapiens
gcgaagauaucaaauuucu

SEQ ID NO: 987533 - RNA, 19 nt, Homo sapiens
gauggaaggcagugacuua

SEQ ID NO: 987534 - RNA, 19 nt, Homo sapiens
caagaauuauugccaaguu

SEQ ID NO: 987535 - RNA, 19 nt, Homo sapiens
uaacuaugguggaugauau

SEQ ID NO: 987536 - RNA, 19 nt, Homo sapiens
aagagaaacucgccaagaa

SEQ ID NO: 987537 - RNA, 19 nt, Homo sapiens
gaugauuucugcugaagau

SEQ ID NO: 987538 - RNA, 19 nt, Homo sapiens
guaggugauucuguauuua

SEQ ID NO: 987539 - RNA, 19 nt, Homo sapiens
gaauaugcccuggcuauga

SEQ ID NO: 987540 - RNA, 19 nt, Homo sapiens
gagaauuguugcaaaguag

SEQ ID NO: 987541 - RNA, 19 nt, Homo sapiens
gcuuucagcuccaguauca

SEQ ID NO: 987542 - RNA, 19 nt, Homo sapiens
gaaggcagccagugugcua

SEQ ID NO: 987543 - RNA, 19 nt, Homo sapiens
ucacagaaacugcguggua

SEQ ID NO: 987544 - RNA, 19 nt, Homo sapiens
gcacuguguuuagaguuaa

SEQ ID NO: 987545 - RNA, 19 nt, Homo sapiens
agagaaugcugugagguua

SEQ ID NO: 987546 - RNA, 19 nt, Homo sapiens
gaacagucucuucaaguga

SEQ ID NO: 987547 - RNA, 19 nt, Homo sapiens
gaugauaugcugcaggaaa

SEQ ID NO: 987548 - RNA, 19 nt, Homo sapiens
ucagagguuugaaaugaaa

SEQ ID NO: 987549 - RNA, 19 nt, Homo sapiens
guacgaugaugaagauauc

SEQ ID NO: 987550 - RNA, 19 nt, Homo sapiens
gcagaaguacgaugaugaa

SEQ ID NO: 987551 - RNA, 19 nt, Homo sapiens
gagaaaguaacaagaauca

SEQ ID NO: 987552 - RNA, 19 nt, Homo sapiens
cauauggcagcaagaauua

SEQ ID NO: 987553 - RNA, 19 nt, Homo sapiens
aagagaugcuucaaacuga

SEQ ID NO: 987554 - RNA, 19 nt, Homo sapiens
aguagugaauggcaaauaa

SEQ ID NO: 987555 - RNA, 19 nt, Homo sapiens
aacauggccucucucuuua

SEQ ID NO: 987556 - RNA, 19 nt, Homo sapiens
gcuugcaauuucuguauuu

SEQ ID NO: 987557 - RNA, 19 nt, Homo sapiens
gagguuaaaugagaagaau

SEQ ID NO: 987558 - RNA, 19 nt, Homo sapiens
caggaucccuucacuguuc

SEQ ID NO: 987559 - RNA, 19 nt, Homo sapiens
aaaaguaggugauucugua

SEQ ID NO: 987560 - RNA, 19 nt, Homo sapiens
caagugauaguucgcagua

SEQ ID NO: 987561 - RNA, 19 nt, Homo sapiens
gauugugaguuuauucaga

SEQ ID NO: 987562 - RNA, 19 nt, Homo sapiens
gcugaagauugugaguuua

SEQ ID NO: 987563 - RNA, 19 nt, Homo sapiens
ucacgauguuggagaauau

SEQ ID NO: 987564 - RNA, 19 nt, Homo sapiens
gagagaaugcugugagguu

SEQ ID NO: 987565 - RNA, 19 nt, Homo sapiens
gacaggagacgccuacuug

SEQ ID NO: 987566 - RNA, 19 nt, Homo sapiens
uaaugggaguauugaguaa

SEQ ID NO: 987567 - RNA, 19 nt, Homo sapiens
gaaggcagugacuuaaauu

SEQ ID NO: 987568 - RNA, 19 nt, Homo sapiens
cauucaagauuacgaaguu

SEQ ID NO: 987569 - RNA, 19 nt, Homo sapiens
ugccaaggcugcagaaguu

SEQ ID NO: 987570 - RNA, 19 nt, Homo sapiens
caagagaugcuucaaacug

SEQ ID NO: 987571 - RNA, 19 nt, Homo sapiens
aguaggugauucuguauuu

SEQ ID NO: 987572 - RNA, 19 nt, Homo sapiens
aaaggauucucacuccaaa

SEQ ID NO: 987573 - RNA, 19 nt, Homo sapiens
cagcagguccgcuauaaug

SEQ ID NO: 987574 - RNA, 19 nt, Homo sapiens
ggaguccugugcacaaauc

SEQ ID NO: 987575 - RNA, 19 nt, Homo sapiens
ccgaggauuuguugaaaga

SEQ ID NO: 987576 - RNA, 19 nt, Homo sapiens
gaaaaucaucagcguguua

SEQ ID NO: 987577 - RNA, 19 nt, Homo sapiens
aaacgaagcccugaagaga

SEQ ID NO: 987578 - RNA, 19 nt, Homo sapiens
gaaacucgccaagaauaug

SEQ ID NO: 987579 - RNA, 19 nt, Homo sapiens
ugacucauaucugcaaaga

SEQ ID NO: 987580 - RNA, 19 nt, Homo sapiens
gauucucacuccaaacaug

SEQ ID NO: 987581 - RNA, 19 nt, Homo sapiens
gaggauuuguugaaagaca

SEQ ID NO: 987582 - RNA, 19 nt, Homo sapiens
uaugcaagauguagcaaga

SEQ ID NO: 987583 - RNA, 19 nt, Homo sapiens
gaaacgaagcccugaagag

SEQ ID NO: 987584 - RNA, 19 nt, Homo sapiens
caaagagaaaguaacaaga

SEQ ID NO: 987585 - RNA, 19 nt, Homo sapiens
gcacaacugggaauaccuu

SEQ ID NO: 987586 - RNA, 19 nt, Homo sapiens
gaauaugugcggcauuauc

SEQ ID NO: 987587 - RNA, 19 nt, Homo sapiens
ccaggaccuuaguucauuu

SEQ ID NO: 987588 - RNA, 19 nt, Homo sapiens
gaagauugugaguuuauuc

SEQ ID NO: 987589 - RNA, 19 nt, Homo sapiens
gugaauggcaaauaaaugu

SEQ ID NO: 987590 - RNA, 19 nt, Homo sapiens
caaaguagugaauggcaaa

SEQ ID NO: 987591 - RNA, 19 nt, Homo sapiens
ugagaagaauuaugaacuc

SEQ ID NO: 987592 - RNA, 19 nt, Homo sapiens
ggaccuuaguucauuugau

SEQ ID NO: 987593 - RNA, 19 nt, Homo sapiens
uaacaaguguggcuuucag

SEQ ID NO: 987594 - RNA, 19 nt, Homo sapiens
agaaguucgugcaaacaaa

SEQ ID NO: 987595 - RNA, 19 nt, Homo sapiens
ggagcacuguguuuagagu

SEQ ID NO: 987596 - RNA, 19 nt, Homo sapiens
gagaagaauuaugaacucu

SEQ ID NO: 987597 - RNA, 19 nt, Homo sapiens
gagaaugcugugagguuaa

SEQ ID NO: 987598 - RNA, 19 nt, Homo sapiens
cagcuccaguaucaaauga

SEQ ID NO: 987599 - RNA, 19 nt, Homo sapiens
ucauauggcagcaagaauu

SEQ ID NO: 987600 - RNA, 19 nt, Homo sapiens
caucagcguguuagcauuu

SEQ ID NO: 987601 - RNA, 19 nt, Homo sapiens
acucauaucugcaaagaac

SEQ ID NO: 987602 - RNA, 19 nt, Homo sapiens
gauuucugcugaagauugu

SEQ ID NO: 987603 - RNA, 19 nt, Homo sapiens
aaucauucuugcagcauuu

SEQ ID NO: 987604 - RNA, 19 nt, Homo sapiens
ucaggagucugucaaagag

SEQ ID NO: 987605 - RNA, 19 nt, Homo sapiens
guagugaauggcaaauaaa

SEQ ID NO: 987606 - RNA, 19 nt, Homo sapiens
cauauacugcuugcaauuu

SEQ ID NO: 987607 - RNA, 19 nt, Homo sapiens
agaaugcugugagguuaaa

SEQ ID NO: 987608 - RNA, 19 nt, Homo sapiens
ucagcugaguucacagaaa

SEQ ID NO: 987609 - RNA, 19 nt, Homo sapiens
acagaccguucaguauaua

SEQ ID NO: 987610 - RNA, 19 nt, Homo sapiens
ugcugaagauugugaguuu

SEQ ID NO: 987611 - RNA, 19 nt, Homo sapiens
uuacauauacugcuugcaa

SEQ ID NO: 987612 - RNA, 19 nt, Homo sapiens
gcuaauuuccaaacaacaa

SEQ ID NO: 987613 - RNA, 19 nt, Homo sapiens
cagcagaaguacgaugaug

SEQ ID NO: 987614 - RNA, 19 nt, Homo sapiens
guagcgguguugcuguuga

SEQ ID NO: 987615 - RNA, 19 nt, Homo sapiens
ggcagugacuuaaauuacu

SEQ ID NO: 987616 - RNA, 19 nt, Homo sapiens
gaagcgagguggacauguu

SEQ ID NO: 987617 - RNA, 19 nt, Homo sapiens
caauaaagcacaggccuua

SEQ ID NO: 987618 - RNA, 19 nt, Homo sapiens
ggagggcugugcagacaug

SEQ ID NO: 987619 - RNA, 19 nt, Homo sapiens
ggaaagaacaaaacuauug

SEQ ID NO: 987620 - RNA, 19 nt, Homo sapiens
cagacaugcugguggagua

SEQ ID NO: 987621 - RNA, 19 nt, Homo sapiens
cgagauuuacccacaauaa

SEQ ID NO: 987622 - RNA, 19 nt, Homo sapiens
gugggaagcugacgguguu

SEQ ID NO: 987623 - RNA, 19 nt, Homo sapiens
ccaagcagacgucuuccua

SEQ ID NO: 987624 - RNA, 19 nt, Homo sapiens
aaacagugcagcagacuug

SEQ ID NO: 987625 - RNA, 19 nt, Homo sapiens
gugagucgagguaucauuu

SEQ ID NO: 987626 - RNA, 19 nt, Homo sapiens
aaaucuggcuaaaguguuc

SEQ ID NO: 987627 - RNA, 19 nt, Homo sapiens
uggagccgcugcuuaacuu

SEQ ID NO: 987628 - RNA, 19 nt, Homo sapiens
gcauaggacagcuguucuu

SEQ ID NO: 987629 - RNA, 19 nt, Homo sapiens
gguguucacugugcugugu

SEQ ID NO: 987630 - RNA, 19 nt, Homo sapiens
ccaucgagcuggacugaac

SEQ ID NO: 987631 - RNA, 19 nt, Homo sapiens
guaccucgaccgcauagga

SEQ ID NO: 987632 - RNA, 19 nt, Homo sapiens
cgacguacacccagaagca

SEQ ID NO: 987633 - RNA, 19 nt, Homo sapiens
gaaaaucuggcuaaagugu

SEQ ID NO: 987634 - RNA, 19 nt, Homo sapiens
uggaaaaucuggcuaaagu

SEQ ID NO: 987635 - RNA, 19 nt, Homo sapiens
ggcguacccucucccacuu

SEQ ID NO: 987636 - RNA, 19 nt, Homo sapiens
ucgagaagggcgacuacua

SEQ ID NO: 987637 - RNA, 19 nt, Homo sapiens
gcgcaucgguggucuucac

SEQ ID NO: 987638 - RNA, 19 nt, Homo sapiens
cgagaagggcgacuacuac

SEQ ID NO: 987639 - RNA, 19 nt, Homo sapiens
cuacgaggcgcaccagaug

SEQ ID NO: 987640 - RNA, 19 nt, Homo sapiens
ggagggaccccauguacaa

SEQ ID NO: 987641 - RNA, 19 nt, Homo sapiens
cccgggagcucauguacuc

SEQ ID NO: 987642 - RNA, 19 nt, Homo sapiens
gcucaggccgugcuacagu

SEQ ID NO: 987643 - RNA, 19 nt, Homo sapiens
cuucagccauggccagcaa

SEQ ID NO: 987644 - RNA, 19 nt, Homo sapiens
guaccggacccuguucuuc

SEQ ID NO: 987645 - RNA, 19 nt, Homo sapiens
ccugagcgcgugaccuuug

SEQ ID NO: 987646 - RNA, 19 nt, Homo sapiens
gcuggagggacguuucaga

SEQ ID NO: 987647 - RNA, 19 nt, Homo sapiens
acgaggcgcaccagaugua

SEQ ID NO: 987648 - RNA, 19 nt, Homo sapiens
gagccgcugcuuaacuuca

SEQ ID NO: 987649 - RNA, 19 nt, Homo sapiens
cugacgagcugcuggaaaa

SEQ ID NO: 987650 - RNA, 19 nt, Homo sapiens
uaccggacccuguucuuca

SEQ ID NO: 987651 - RNA, 19 nt, Homo sapiens
ggagagacaguuucuauua

SEQ ID NO: 987652 - RNA, 19 nt, Homo sapiens
ggaauuccuuauagaguua

SEQ ID NO: 987653 - RNA, 19 nt, Homo sapiens
gagaagaaguggaacaaga

SEQ ID NO: 987654 - RNA, 19 nt, Homo sapiens
gaaaggugguaguuaagaa

SEQ ID NO: 987655 - RNA, 19 nt, Homo sapiens
gcggaaaggugguaguuaa

SEQ ID NO: 987656 - RNA, 19 nt, Homo sapiens
gaacaagaagcagauaaua

SEQ ID NO: 987657 - RNA, 19 nt, Homo sapiens
gauguaaauuucagccaua

SEQ ID NO: 987658 - RNA, 19 nt, Homo sapiens
gagagacaguuucuauuau

SEQ ID NO: 987659 - RNA, 19 nt, Homo sapiens
cacaaugccuccauaauga

SEQ ID NO: 987660 - RNA, 19 nt, Homo sapiens
gggaauuccuuauagaguu

SEQ ID NO: 987661 - RNA, 19 nt, Homo sapiens
aaacaggucuuuuggcuua

SEQ ID NO: 987662 - RNA, 19 nt, Homo sapiens
gaaccuccacgguauauga

SEQ ID NO: 987663 - RNA, 19 nt, Homo sapiens
ggagaagaaccagcaguua

SEQ ID NO: 987664 - RNA, 19 nt, Homo sapiens
caacaaagcugggaauucc

SEQ ID NO: 987665 - RNA, 19 nt, Homo sapiens
auagugagcuuucaugaga

SEQ ID NO: 987666 - RNA, 19 nt, Homo sapiens
ggauugauaugguuuggau

SEQ ID NO: 987667 - RNA, 19 nt, Homo sapiens
gcuguaggcugcugugguu

SEQ ID NO: 987668 - RNA, 19 nt, Homo sapiens
gaaaauagcucagaaucuc

SEQ ID NO: 987669 - RNA, 19 nt, Homo sapiens
acacagugaucuuguucua

SEQ ID NO: 987670 - RNA, 19 nt, Homo sapiens
ccagagaacuaccuacgau

SEQ ID NO: 987671 - RNA, 19 nt, Homo sapiens
gugugagaauggauuaaua

SEQ ID NO: 987672 - RNA, 19 nt, Homo sapiens
ggacuugggagaaccauug

SEQ ID NO: 987673 - RNA, 19 nt, Homo sapiens
gcaggcacuuuaaggcaaa

SEQ ID NO: 987674 - RNA, 19 nt, Homo sapiens
ucacaaugccuccauaaug

SEQ ID NO: 987675 - RNA, 19 nt, Homo sapiens
ucucggguauuucuucaua

SEQ ID NO: 987676 - RNA, 19 nt, Homo sapiens
guauaugaguguaaaccaa

SEQ ID NO: 987677 - RNA, 19 nt, Homo sapiens
ggaacaagaagcagauaau

SEQ ID NO: 987678 - RNA, 19 nt, Homo sapiens
ccaaggacaucacagucaa

SEQ ID NO: 987679 - RNA, 19 nt, Homo sapiens
ccaccgugauuguuaaguu

SEQ ID NO: 987680 - RNA, 19 nt, Homo sapiens
ggacuuugaacauagauau

SEQ ID NO: 987681 - RNA, 19 nt, Homo sapiens
agagacaguuucuauuaug

SEQ ID NO: 987682 - RNA, 19 nt, Homo sapiens
gcagugugagaauggauua

SEQ ID NO: 987683 - RNA, 19 nt, Homo sapiens
caauggacuuugaacauag

SEQ ID NO: 987684 - RNA, 19 nt, Homo sapiens
ggaagaaaauugguuguug

SEQ ID NO: 987685 - RNA, 19 nt, Homo sapiens
ugaaaugcuuuaucucauc

SEQ ID NO: 987686 - RNA, 19 nt, Homo sapiens
caugagaucugaugguuuu

SEQ ID NO: 987687 - RNA, 19 nt, Homo sapiens
gcugggaauuccuuauaga

SEQ ID NO: 987688 - RNA, 19 nt, Homo sapiens
gauauuuaccauugucuga

SEQ ID NO: 987689 - RNA, 19 nt, Homo sapiens
ggaaaggugguaguuaaga

SEQ ID NO: 987690 - RNA, 19 nt, Homo sapiens
gguagguaauugaaucaug

SEQ ID NO: 987691 - RNA, 19 nt, Homo sapiens
gguuguugcugauagagaa

SEQ ID NO: 987692 - RNA, 19 nt, Homo sapiens
ucaagggccuggaaguugu

SEQ ID NO: 987693 - RNA, 19 nt, Homo sapiens
caccgugauuguuaaguuu

SEQ ID NO: 987694 - RNA, 19 nt, Homo sapiens
gagcuuucaugagaucuga

SEQ ID NO: 987695 - RNA, 19 nt, Homo sapiens
ggaggcagcauacauccaa

SEQ ID NO: 987696 - RNA, 19 nt, Homo sapiens
gagaaccauugcauuccuu

SEQ ID NO: 987697 - RNA, 19 nt, Homo sapiens
cuaugaaccuccacgguau

SEQ ID NO: 987698 - RNA, 19 nt, Homo sapiens
acagugaucuuguucuaag

SEQ ID NO: 987699 - RNA, 19 nt, Homo sapiens
gagaagaaccagcaguuac

SEQ ID NO: 987700 - RNA, 19 nt, Homo sapiens
gcaacaaagcugggaauuc

SEQ ID NO: 987701 - RNA, 19 nt, Homo sapiens
uguaaaggccagagaacua

SEQ ID NO: 987702 - RNA, 19 nt, Homo sapiens
gagaucugaugguuuuaua

SEQ ID NO: 987703 - RNA, 19 nt, Homo sapiens
caucacaggaggcagcaua

SEQ ID NO: 987704 - RNA, 19 nt, Homo sapiens
ggugguaguuaagaauuug

SEQ ID NO: 987705 - RNA, 19 nt, Homo sapiens
caguuucccucaugcuauu

SEQ ID NO: 987706 - RNA, 19 nt, Homo sapiens
gcaguuucccucaugcuau

SEQ ID NO: 987707 - RNA, 19 nt, Homo sapiens
ggagaugcuaagucuguuu

SEQ ID NO: 987708 - RNA, 19 nt, Homo sapiens
caauggagauggagaugcu

SEQ ID NO: 987709 - RNA, 19 nt, Homo sapiens
ggaaggaagaucuaugaac

SEQ ID NO: 987710 - RNA, 19 nt, Homo sapiens
agaagaaguggaacaagaa

SEQ ID NO: 987711 - RNA, 19 nt, Homo sapiens
ggaagaguuuuauggaaga

SEQ ID NO: 987712 - RNA, 19 nt, Homo sapiens
ggagaaccauugcauuccu

SEQ ID NO: 987713 - RNA, 19 nt, Homo sapiens
gagacaguuucuauuaugc

SEQ ID NO: 987714 - RNA, 19 nt, Homo sapiens
caacacacagugaucuugu

SEQ ID NO: 987715 - RNA, 19 nt, Homo sapiens
uuuaaaggaugcugauauc

SEQ ID NO: 987716 - RNA, 19 nt, Homo sapiens
ggaagccuuggaagaguuu

SEQ ID NO: 987717 - RNA, 19 nt, Homo sapiens
ugauaugguuuggauguau

SEQ ID NO: 987718 - RNA, 19 nt, Homo sapiens
accauugucugauguaaau

SEQ ID NO: 987719 - RNA, 19 nt, Homo sapiens
ucaaagaauacgaggagaa

SEQ ID NO: 987720 - RNA, 19 nt, Homo sapiens
aaggagcagucuuuggaaa

SEQ ID NO: 987721 - RNA, 19 nt, Homo sapiens
ugauagagaagaaguggaa

SEQ ID NO: 987722 - RNA, 19 nt, Homo sapiens
aagaauacgaggagaagaa

SEQ ID NO: 987723 - RNA, 19 nt, Homo sapiens
uugacaaagugaagaagaa

SEQ ID NO: 987724 - RNA, 19 nt, Homo sapiens
ugugguuggugauccauuu

SEQ ID NO: 987725 - RNA, 19 nt, Homo sapiens
aagcugggaauuccuuaua

SEQ ID NO: 987726 - RNA, 19 nt, Homo sapiens
ugugguuggugauccauuu

SEQ ID NO: 987727 - RNA, 19 nt, Homo sapiens
agauggagaugcuaagucu

SEQ ID NO: 987728 - RNA, 19 nt, Homo sapiens
uaaggcaaaugugcacugu

SEQ ID NO: 987729 - RNA, 19 nt, Homo sapiens
gugaagaagaacagacaaa

SEQ ID NO: 987730 - RNA, 19 nt, Homo sapiens
gccuacaccucaguccuaa

SEQ ID NO: 987731 - RNA, 19 nt, Homo sapiens
caaagcugggaauuccuua

SEQ ID NO: 987732 - RNA, 19 nt, Homo sapiens
gaagaaguggaacaagaag

SEQ ID NO: 987733 - RNA, 19 nt, Homo sapiens
cagguguugugguagguaa

SEQ ID NO: 987734 - RNA, 19 nt, Homo sapiens
caaagaauacgaggagaag

SEQ ID NO: 987735 - RNA, 19 nt, Homo sapiens
gaacuaccuacgauucucu

SEQ ID NO: 987736 - RNA, 19 nt, Homo sapiens
gcucucauucucacucuug

SEQ ID NO: 987737 - RNA, 19 nt, Homo sapiens
gaaccauugcauuccuuga

SEQ ID NO: 987738 - RNA, 19 nt, Homo sapiens
ugugguagguaauugaauc

SEQ ID NO: 987739 - RNA, 19 nt, Homo sapiens
ccauugcauuccuugauca

SEQ ID NO: 987740 - RNA, 19 nt, Homo sapiens
gaagaagaacagacaaaau

SEQ ID NO: 987741 - RNA, 19 nt, Homo sapiens
gagcaacaaagcugggaau

SEQ ID NO: 987742 - RNA, 19 nt, Homo sapiens
gccaaggacaucacaguca

SEQ ID NO: 987743 - RNA, 19 nt, Homo sapiens
uauuuaccauugucugaug

SEQ ID NO: 987744 - RNA, 19 nt, Homo sapiens
cacgguauaugaguguaaa

SEQ ID NO: 987745 - RNA, 19 nt, Homo sapiens
ucuuuuggcuuaucuagua

SEQ ID NO: 987746 - RNA, 19 nt, Homo sapiens
guggaacugugagucgaaa

SEQ ID NO: 987747 - RNA, 19 nt, Homo sapiens
ucucucuucuccucaaguu

SEQ ID NO: 987748 - RNA, 19 nt, Homo sapiens
gaaucucaaagcaucaaug

SEQ ID NO: 987749 - RNA, 19 nt, Homo sapiens
gcucagaaucucaaagcau

SEQ ID NO: 987750 - RNA, 19 nt, Homo sapiens
aaugugcacuguggacuug

SEQ ID NO: 987751 - RNA, 19 nt, Homo sapiens
gagauaaacugaagaucaa

SEQ ID NO: 987752 - RNA, 19 nt, Homo sapiens
uguccgagcugcaguauua

SEQ ID NO: 987753 - RNA, 19 nt, Homo sapiens
ggacaaaucaguucucugu

SEQ ID NO: 987754 - RNA, 19 nt, Homo sapiens
gaagauaucaagugcugua

SEQ ID NO: 987755 - RNA, 19 nt, Homo sapiens
ucaauaagguggccggaaa

SEQ ID NO: 987756 - RNA, 19 nt, Homo sapiens
ggagauaaacugaagauca

SEQ ID NO: 987757 - RNA, 19 nt, Homo sapiens
acaaaucaguucucuguga

SEQ ID NO: 987758 - RNA, 19 nt, Homo sapiens
gauaucaagugcuguaaca

SEQ ID NO: 987759 - RNA, 19 nt, Homo sapiens
ggaggacuauccaggcauu

SEQ ID NO: 987760 - RNA, 19 nt, Homo sapiens
caacaugacccacuacauc

SEQ ID NO: 987761 - RNA, 19 nt, Homo sapiens
uaugagcucucgcccauga

SEQ ID NO: 987762 - RNA, 19 nt, Homo sapiens
gaccagacaugagaagguu

SEQ ID NO: 987763 - RNA, 19 nt, Homo sapiens
gaacccagauacuauugag

SEQ ID NO: 987764 - RNA, 19 nt, Homo sapiens
ccagguguauggcuucuug

SEQ ID NO: 987765 - RNA, 19 nt, Homo sapiens
caagaacccagauacuauu

SEQ ID NO: 987766 - RNA, 19 nt, Homo sapiens
ggcaugagcuugggaaagu

SEQ ID NO: 987767 - RNA, 19 nt, Homo sapiens
ggaggcauaucgccguaga

SEQ ID NO: 987768 - RNA, 19 nt, Homo sapiens
uaacaccugugaagaugug

SEQ ID NO: 987769 - RNA, 19 nt, Homo sapiens
ucaagaacccagauacuau

SEQ ID NO: 987770 - RNA, 19 nt, Homo sapiens
gcacgagccauccagaaga

SEQ ID NO: 987771 - RNA, 19 nt, Homo sapiens
gugccuaucugaguauuga

SEQ ID NO: 987772 - RNA, 19 nt, Homo sapiens
uaagguggccggaaacuuc

SEQ ID NO: 987773 - RNA, 19 nt, Homo sapiens
ccagguugauaaaucuauu

SEQ ID NO: 987774 - RNA, 19 nt, Homo sapiens
cacaguggcuggacucauc

SEQ ID NO: 987775 - RNA, 19 nt, Homo sapiens
ucaagcaacgacuagauaa

SEQ ID NO: 987776 - RNA, 19 nt, Homo sapiens
uggugaagcugacggagaa

SEQ ID NO: 987777 - RNA, 19 nt, Homo sapiens
gaguauugaugccauggau

SEQ ID NO: 987778 - RNA, 19 nt, Homo sapiens
cacgagccauccagaagaa

SEQ ID NO: 987779 - RNA, 19 nt, Homo sapiens
caagcaacgacuagauaaa

SEQ ID NO: 987780 - RNA, 19 nt, Homo sapiens
uggcuggacucaucgauuc

SEQ ID NO: 987781 - RNA, 19 nt, Homo sapiens
uguaacaccugugaagaug

SEQ ID NO: 987782 - RNA, 19 nt, Homo sapiens
gaggacaaaucaguucucu

SEQ ID NO: 987783 - RNA, 19 nt, Homo sapiens
ugcaggagcagaagaauga

SEQ ID NO: 987784 - RNA, 19 nt, Homo sapiens
ucgauucgcucaucuacca

SEQ ID NO: 987785 - RNA, 19 nt, Homo sapiens
ccuccaugauguuccagua

SEQ ID NO: 987786 - RNA, 19 nt, Homo sapiens
gcaacgacuagauaaagau

SEQ ID NO: 987787 - RNA, 19 nt, Homo sapiens
gagucuucguccucuauga

SEQ ID NO: 987788 - RNA, 19 nt, Homo sapiens
gcuuuggccuugacaacau

SEQ ID NO: 987789 - RNA, 19 nt, Homo sapiens
gugcugaggcagaagauau

SEQ ID NO: 987790 - RNA, 19 nt, Homo sapiens
caacgacuagauaaagaug

SEQ ID NO: 987791 - RNA, 19 nt, Homo sapiens
guauugaugccauggaugu

SEQ ID NO: 987792 - RNA, 19 nt, Homo sapiens
ggacuauccaggcauugug

SEQ ID NO: 987793 - RNA, 19 nt, Homo sapiens
acaucaacaugacccacua

SEQ ID NO: 987794 - RNA, 19 nt, Homo sapiens
gcagagcuuuggccuugac

SEQ ID NO: 987795 - RNA, 19 nt, Homo sapiens
ccuugugccuaucugagua

SEQ ID NO: 987796 - RNA, 19 nt, Homo sapiens
gauaaacugaagaucaaca

SEQ ID NO: 987797 - RNA, 19 nt, Homo sapiens
cuuccucugucuccucuuu

SEQ ID NO: 987798 - RNA, 19 nt, Homo sapiens
augagaagguugccaaugg

SEQ ID NO: 987799 - RNA, 19 nt, Homo sapiens
gcgccaccgugaccauugu

SEQ ID NO: 987800 - RNA, 19 nt, Homo sapiens
ccaugauguuccaguacuu

SEQ ID NO: 987801 - RNA, 19 nt, Homo sapiens
ggauguggccggagaacag

SEQ ID NO: 987802 - RNA, 19 nt, Homo sapiens
ggugugugcgccaucauug

SEQ ID NO: 987803 - RNA, 19 nt, Homo sapiens
agcaacgacuagauaaaga

SEQ ID NO: 987804 - RNA, 19 nt, Homo sapiens
gaagaugcaggagcagaag

SEQ ID NO: 987805 - RNA, 19 nt, Homo sapiens
gguguauggcuucuuggaa

SEQ ID NO: 987806 - RNA, 19 nt, Homo sapiens
agaagaugcaggagcagaa

SEQ ID NO: 987807 - RNA, 19 nt, Homo sapiens
caugauguuccaguacuuu

SEQ ID NO: 987808 - RNA, 19 nt, Homo sapiens
gcuguaacaccugugaaga

SEQ ID NO: 987809 - RNA, 19 nt, Homo sapiens
ucaguggccuucucaugcu

SEQ ID NO: 987810 - RNA, 19 nt, Homo sapiens
gauguuccaguacuuugug

SEQ ID NO: 987811 - RNA, 19 nt, Homo sapiens
gacuauccaggcauuguga

SEQ ID NO: 987812 - RNA, 19 nt, Homo sapiens
cuacauccagcaccuguca

SEQ ID NO: 987813 - RNA, 19 nt, Homo sapiens
uucaagaacccagauacua

SEQ ID NO: 987814 - RNA, 19 nt, Homo sapiens
aagaugugcgggaggcaua

SEQ ID NO: 987815 - RNA, 19 nt, Homo sapiens
uucaagcaacgacuagaua

SEQ ID NO: 987816 - RNA, 19 nt, Homo sapiens
acucaucgauucgcucauc

SEQ ID NO: 987817 - RNA, 19 nt, Homo sapiens
ggaccacaccaaugucacu

SEQ ID NO: 987818 - RNA, 19 nt, Homo sapiens
guucaagcaacgacuagau

SEQ ID NO: 987819 - RNA, 19 nt, Homo sapiens
cagcacgagccauccagaa

SEQ ID NO: 987820 - RNA, 19 nt, Homo sapiens
uggggaagcugaagcaguu

SEQ ID NO: 987821 - RNA, 19 nt, Homo sapiens
gcaugagcuugggaaaguc

SEQ ID NO: 987822 - RNA, 19 nt, Homo sapiens
gaagaaaugucucaaaugu

SEQ ID NO: 987823 - RNA, 19 nt, Homo sapiens
gagacuaguuccacgauua

SEQ ID NO: 987824 - RNA, 19 nt, Homo sapiens
gaccuuacuucaccucuua

SEQ ID NO: 987825 - RNA, 19 nt, Homo sapiens
gaaguuucaucuuaggaua

SEQ ID NO: 987826 - RNA, 19 nt, Homo sapiens
gaaagacacuaaugguuca

SEQ ID NO: 987827 - RNA, 19 nt, Homo sapiens
cugcauagguuucccaaua

SEQ ID NO: 987828 - RNA, 19 nt, Homo sapiens
ugauaacucuuccauguuu

SEQ ID NO: 987829 - RNA, 19 nt, Homo sapiens
gcauuuaaguuucagauuc

SEQ ID NO: 987830 - RNA, 19 nt, Homo sapiens
aaacucaacucccuuucua

SEQ ID NO: 987831 - RNA, 19 nt, Homo sapiens
aggcugaaguccuuaauua

SEQ ID NO: 987832 - RNA, 19 nt, Homo sapiens
gaacacagccaaugaagca

SEQ ID NO: 987833 - RNA, 19 nt, Homo sapiens
ggccauaccuggaauuuua

SEQ ID NO: 987834 - RNA, 19 nt, Homo sapiens
cagcauaauuucugaucua

SEQ ID NO: 987835 - RNA, 19 nt, Homo sapiens
guugauaacucuuccaugu

SEQ ID NO: 987836 - RNA, 19 nt, Homo sapiens
caaacccacugaagagaaa

SEQ ID NO: 987837 - RNA, 19 nt, Homo sapiens
gcuaagaaaccuaauguug

SEQ ID NO: 987838 - RNA, 19 nt, Homo sapiens
ucaaaugucucguaucagu

SEQ ID NO: 987839 - RNA, 19 nt, Homo sapiens
cagagaugcuguagcuuaa

SEQ ID NO: 987840 - RNA, 19 nt, Homo sapiens
ccaaaucucucaauauagg

SEQ ID NO: 987841 - RNA, 19 nt, Homo sapiens
gaagcaaacccacugaaga

SEQ ID NO: 987842 - RNA, 19 nt, Homo sapiens
cuuaacagcuccaaacuau

SEQ ID NO: 987843 - RNA, 19 nt, Homo sapiens
ggauguauuuguuucuuug

SEQ ID NO: 987844 - RNA, 19 nt, Homo sapiens
ugacuacaauucuggauga

SEQ ID NO: 987845 - RNA, 19 nt, Homo sapiens
gauguaacuugcauuuaug

SEQ ID NO: 987846 - RNA, 19 nt, Homo sapiens
gugacaagccaaagauuua

SEQ ID NO: 987847 - RNA, 19 nt, Homo sapiens
aguccuagcuccaucauuu

SEQ ID NO: 987848 - RNA, 19 nt, Homo sapiens
ggucaguuauauucaguuu

SEQ ID NO: 987849 - RNA, 19 nt, Homo sapiens
aaauagaccugaucaacau

SEQ ID NO: 987850 - RNA, 19 nt, Homo sapiens
ucucaaaugucucguauca

SEQ ID NO: 987851 - RNA, 19 nt, Homo sapiens
gcugaaguccuuaauuaaa

SEQ ID NO: 987852 - RNA, 19 nt, Homo sapiens
ccugauagauacugcuuaa

SEQ ID NO: 987853 - RNA, 19 nt, Homo sapiens
agaaaugucucaaaugucu

SEQ ID NO: 987854 - RNA, 19 nt, Homo sapiens
cuaagaaaguccaguaaca

SEQ ID NO: 987855 - RNA, 19 nt, Homo sapiens
gaugacgaguggcuggaua

SEQ ID NO: 987856 - RNA, 19 nt, Homo sapiens
ucaguaggcuucaauuaca

SEQ ID NO: 987857 - RNA, 19 nt, Homo sapiens
caagaacgcuccgagagau

SEQ ID NO: 987858 - RNA, 19 nt, Homo sapiens
cuaagaaaccuaauguuga

SEQ ID NO: 987859 - RNA, 19 nt, Homo sapiens
gaauuugcuuuccguuaug

SEQ ID NO: 987860 - RNA, 19 nt, Homo sapiens
gaaaguccaguaacagaga

SEQ ID NO: 987861 - RNA, 19 nt, Homo sapiens
uaacagcuccaaacuauag

SEQ ID NO: 987862 - RNA, 19 nt, Homo sapiens
ggaauuauugcauuuguuc

SEQ ID NO: 987863 - RNA, 19 nt, Homo sapiens
gagaauuuauagccaagga

SEQ ID NO: 987864 - RNA, 19 nt, Homo sapiens
uggaaaggauggauuuaga

SEQ ID NO: 987865 - RNA, 19 nt, Homo sapiens
ucauuaauguugaguccua

SEQ ID NO: 987866 - RNA, 19 nt, Homo sapiens
uaacagagaagaaaugucu

SEQ ID NO: 987867 - RNA, 19 nt, Homo sapiens
gcauagguuucccaauaau

SEQ ID NO: 987868 - RNA, 19 nt, Homo sapiens
gaaauguagcugcaguauu

SEQ ID NO: 987869 - RNA, 19 nt, Homo sapiens
uaaggaauauagucuaguc

SEQ ID NO: 987870 - RNA, 19 nt, Homo sapiens
ugaagaugaugaugacaau

SEQ ID NO: 987871 - RNA, 19 nt, Homo sapiens
gcaaacccacugaagagaa

SEQ ID NO: 987872 - RNA, 19 nt, Homo sapiens
guuccacgauuaaguguug

SEQ ID NO: 987873 - RNA, 19 nt, Homo sapiens
caacaucauaggagauaaa

SEQ ID NO: 987874 - RNA, 19 nt, Homo sapiens
ucacugauaguagcauuua

SEQ ID NO: 987875 - RNA, 19 nt, Homo sapiens
caaaaccacugaagaacaa

SEQ ID NO: 987876 - RNA, 19 nt, Homo sapiens
ggagacuaguuccacgauu

SEQ ID NO: 987877 - RNA, 19 nt, Homo sapiens
gauagauacugcuuaacag

SEQ ID NO: 987878 - RNA, 19 nt, Homo sapiens
ugucagagcaguuggguuu

SEQ ID NO: 987879 - RNA, 19 nt, Homo sapiens
ugcauagguuucccaauaa

SEQ ID NO: 987880 - RNA, 19 nt, Homo sapiens
gagaaaacaugaagaugau

SEQ ID NO: 987881 - RNA, 19 nt, Homo sapiens
ucaacucccuuucuagauc

SEQ ID NO: 987882 - RNA, 19 nt, Homo sapiens
caaaccaguuccugcaaca

SEQ ID NO: 987883 - RNA, 19 nt, Homo sapiens
cuauaugacuguaaggaau

SEQ ID NO: 987884 - RNA, 19 nt, Homo sapiens
ugugaggguucaauuggua

SEQ ID NO: 987885 - RNA, 19 nt, Homo sapiens
guucguaucauaauugaga

SEQ ID NO: 987886 - RNA, 19 nt, Homo sapiens
aaagucauauugggaaaga

SEQ ID NO: 987887 - RNA, 19 nt, Homo sapiens
uaccaacugugugaccuua

SEQ ID NO: 987888 - RNA, 19 nt, Homo sapiens
ucuauaaggccaacaaaga

SEQ ID NO: 987889 - RNA, 19 nt, Homo sapiens
ugaugcagaugaugugaga

SEQ ID NO: 987890 - RNA, 19 nt, Homo sapiens
ugccuaauguuucgugauu

SEQ ID NO: 987891 - RNA, 19 nt, Homo sapiens
guaauacagcucaguguca

SEQ ID NO: 987892 - RNA, 19 nt, Homo sapiens
acaaacaguuaaguacuug

SEQ ID NO: 987893 - RNA, 19 nt, Homo sapiens
ccaagaacgcuccgagaga

SEQ ID NO: 987894 - RNA, 19 nt, Homo sapiens
aaugguucauccucuauaa

SEQ ID NO: 987895 - RNA, 19 nt, Homo sapiens
aguauuguauuccaaguug

SEQ ID NO: 987896 - RNA, 19 nt, Homo sapiens
ccuaauguuucgugauuca

SEQ ID NO: 987897 - RNA, 19 nt, Homo sapiens
gaugaugaugacaaugaua

SEQ ID NO: 987898 - RNA, 19 nt, Homo sapiens
gcaacuccaaugucaguga

SEQ ID NO: 987899 - RNA, 19 nt, Homo sapiens
acuauaggcugaaguccuu

SEQ ID NO: 987900 - RNA, 19 nt, Homo sapiens
uaucuaagaaaguccagua

SEQ ID NO: 987901 - RNA, 19 nt, Homo sapiens
ggaucaaaccugaaagaca

SEQ ID NO: 987902 - RNA, 19 nt, Homo sapiens
cagaucauauuagcuuguu

SEQ ID NO: 987903 - RNA, 19 nt, Homo sapiens
gagaugcuguagcuuaaaa

SEQ ID NO: 987904 - RNA, 19 nt, Homo sapiens
uacugucacuagcuaauuu

SEQ ID NO: 987905 - RNA, 19 nt, Homo sapiens
cggugucugucccaaauaa

SEQ ID NO: 987906 - RNA, 19 nt, Homo sapiens
aaaugucucguaucaguuu

SEQ ID NO: 987907 - RNA, 19 nt, Homo sapiens
cuauaaggccaacaaagaa

SEQ ID NO: 987908 - RNA, 19 nt, Homo sapiens
gcauuuguuccaagguuaa

SEQ ID NO: 987909 - RNA, 19 nt, Homo sapiens
gaaaccuaauguugaugca

SEQ ID NO: 987910 - RNA, 19 nt, Homo sapiens
gcuauaugacuguaaggaa

SEQ ID NO: 987911 - RNA, 19 nt, Homo sapiens
cauagguuucccaauaaua

SEQ ID NO: 987912 - RNA, 19 nt, Homo sapiens
cauauaagacaggaucaaa

SEQ ID NO: 987913 - RNA, 19 nt, Homo sapiens
aagaugaugaugacaauga

SEQ ID NO: 987914 - RNA, 19 nt, Homo sapiens
uaaccaagggagacuaguu

SEQ ID NO: 987915 - RNA, 19 nt, Homo sapiens
gauaacucuuccauguuuc

SEQ ID NO: 987916 - RNA, 19 nt, Homo sapiens
acaguuaaguacuuguuuc

SEQ ID NO: 987917 - RNA, 19 nt, Homo sapiens
gcuuaacagcuccaaacua

SEQ ID NO: 987918 - RNA, 19 nt, Homo sapiens
ugauagauacugcuuaaca

SEQ ID NO: 987919 - RNA, 19 nt, Homo sapiens
cuuaggauaguguuugaua

SEQ ID NO: 987920 - RNA, 19 nt, Homo sapiens
uauaaggccaacaaagaaa

SEQ ID NO: 987921 - RNA, 19 nt, Homo sapiens
acuaaugguucauccucua

SEQ ID NO: 987922 - RNA, 19 nt, Homo sapiens
gcugagcgcuuuauaauuu

SEQ ID NO: 987923 - RNA, 19 nt, Homo sapiens
caaauuggcuugaaucuuc

SEQ ID NO: 987924 - RNA, 19 nt, Homo sapiens
ggaguugucugaaccgaua

SEQ ID NO: 987925 - RNA, 19 nt, Homo sapiens
gcacauaacccauagugaa

SEQ ID NO: 987926 - RNA, 19 nt, Homo sapiens
gccaaacgcucucaucuga

SEQ ID NO: 987927 - RNA, 19 nt, Homo sapiens
gagaauugguuauuugaga

SEQ ID NO: 987928 - RNA, 19 nt, Homo sapiens
gaccgggacuauuccauua

SEQ ID NO: 987929 - RNA, 19 nt, Homo sapiens
caaacgcucucaucugauu

SEQ ID NO: 987930 - RNA, 19 nt, Homo sapiens
ccaaagugcugauaacaau

SEQ ID NO: 987931 - RNA, 19 nt, Homo sapiens
ccaaaucguuucuaaagga

SEQ ID NO: 987932 - RNA, 19 nt, Homo sapiens
ggacaggcaugugacacua

SEQ ID NO: 987933 - RNA, 19 nt, Homo sapiens
gaaccaagccgccuucagu

SEQ ID NO: 987934 - RNA, 19 nt, Homo sapiens
ucugugggcuucuuagaua

SEQ ID NO: 987935 - RNA, 19 nt, Homo sapiens
gcgaggcgcuguccuuuca

SEQ ID NO: 987936 - RNA, 19 nt, Homo sapiens
ccagagggauucgucuaua

SEQ ID NO: 987937 - RNA, 19 nt, Homo sapiens
cagagggauucgucuauaa

SEQ ID NO: 987938 - RNA, 19 nt, Homo sapiens
uuacaaagccuucaccuau

SEQ ID NO: 987939 - RNA, 19 nt, Homo sapiens
uggugaagcugaacaguaa

SEQ ID NO: 987940 - RNA, 19 nt, Homo sapiens
cagccucccuggaugcuua

SEQ ID NO: 987941 - RNA, 19 nt, Homo sapiens
acaaagccuucaccuauga

SEQ ID NO: 987942 - RNA, 19 nt, Homo sapiens
ugcaacagcuggguaauaa

SEQ ID NO: 987943 - RNA, 19 nt, Homo sapiens
ggaaagaaacaaagaacau

SEQ ID NO: 987944 - RNA, 19 nt, Homo sapiens
gcuccaggguugcagagua

SEQ ID NO: 987945 - RNA, 19 nt, Homo sapiens
gaaagaaacaaagaacaug

SEQ ID NO: 987946 - RNA, 19 nt, Homo sapiens
ugagucaccuguaaauuca

SEQ ID NO: 987947 - RNA, 19 nt, Homo sapiens
caacagcuggguaauaaga

SEQ ID NO: 987948 - RNA, 19 nt, Homo sapiens
caaaucguuucuaaaggaa

SEQ ID NO: 987949 - RNA, 19 nt, Homo sapiens
caagaugagcacaaacuuu

SEQ ID NO: 987950 - RNA, 19 nt, Homo sapiens
ccacaaugccaaaucguuu

SEQ ID NO: 987951 - RNA, 19 nt, Homo sapiens
gcacgggacaggcauguga

SEQ ID NO: 987952 - RNA, 19 nt, Homo sapiens
gcuggccucuggugcauuu

SEQ ID NO: 987953 - RNA, 19 nt, Homo sapiens
aaaggcauguuucguguug

SEQ ID NO: 987954 - RNA, 19 nt, Homo sapiens
gagucaggcucauguacaa

SEQ ID NO: 987955 - RNA, 19 nt, Homo sapiens
acacuguacuccugggaua

SEQ ID NO: 987956 - RNA, 19 nt, Homo sapiens
ucuagaagcuccugacaag

SEQ ID NO: 987957 - RNA, 19 nt, Homo sapiens
gaaugcacauaacccauag

SEQ ID NO: 987958 - RNA, 19 nt, Homo sapiens
agauagaugugucugagaa

SEQ ID NO: 987959 - RNA, 19 nt, Homo sapiens
guugauuguucccauguaa

SEQ ID NO: 987960 - RNA, 19 nt, Homo sapiens
gacaggaaacaaauaaaga

SEQ ID NO: 987961 - RNA, 19 nt, Homo sapiens
acacagaccgggacuauuc

SEQ ID NO: 987962 - RNA, 19 nt, Homo sapiens
caaagcggaauaacaaguu

SEQ ID NO: 987963 - RNA, 19 nt, Homo sapiens
uagcagaggcggaaguauu

SEQ ID NO: 987964 - RNA, 19 nt, Homo sapiens
gguaauaagacuagcauag

SEQ ID NO: 987965 - RNA, 19 nt, Homo sapiens
cauaacccauagugaaaug

SEQ ID NO: 987966 - RNA, 19 nt, Homo sapiens
agaaccagcugggagaauu

SEQ ID NO: 987967 - RNA, 19 nt, Homo sapiens
caaccgaguucuagaagcu

SEQ ID NO: 987968 - RNA, 19 nt, Homo sapiens
ccaggagccucaagugaca

SEQ ID NO: 987969 - RNA, 19 nt, Homo sapiens
gacgguggguucugcauca

SEQ ID NO: 987970 - RNA, 19 nt, Homo sapiens
ugggagaauugguuauuug

SEQ ID NO: 987971 - RNA, 19 nt, Homo sapiens
ggaagaaaggcguaaggau

SEQ ID NO: 987972 - RNA, 19 nt, Homo sapiens
caaagugcugauaacaaua

SEQ ID NO: 987973 - RNA, 19 nt, Homo sapiens
ggaaggugcggcugcaaga

SEQ ID NO: 987974 - RNA, 19 nt, Homo sapiens
aagccaagcuccaguuaca

SEQ ID NO: 987975 - RNA, 19 nt, Homo sapiens
uacaaagccuucaccuaug

SEQ ID NO: 987976 - RNA, 19 nt, Homo sapiens
gaaccagcugggagaauug

SEQ ID NO: 987977 - RNA, 19 nt, Homo sapiens
gcaagaugagcacaaacuu

SEQ ID NO: 987978 - RNA, 19 nt, Homo sapiens
agaaugcacauaacccaua

SEQ ID NO: 987979 - RNA, 19 nt, Homo sapiens
uaaggauggugaagcugaa

SEQ ID NO: 987980 - RNA, 19 nt, Homo sapiens
agacaagaacggaauauca

SEQ ID NO: 987981 - RNA, 19 nt, Homo sapiens
cagaaaaggugauugugaa

SEQ ID NO: 987982 - RNA, 19 nt, Homo sapiens
ccaagccgccuucaguuga

SEQ ID NO: 987983 - RNA, 19 nt, Homo sapiens
gaaacaaagaacaugaaca

SEQ ID NO: 987984 - RNA, 19 nt, Homo sapiens
uggcuugaaucuucucuga

SEQ ID NO: 987985 - RNA, 19 nt, Homo sapiens
gaagacaagaacggaauau

SEQ ID NO: 987986 - RNA, 19 nt, Homo sapiens
cacauaacccauagugaaa

SEQ ID NO: 987987 - RNA, 19 nt, Homo sapiens
gagaucaucguaugcaaca

SEQ ID NO: 987988 - RNA, 19 nt, Homo sapiens
gggagaauugguuauuuga

SEQ ID NO: 987989 - RNA, 19 nt, Homo sapiens
cuuggagguuaaucacuua

SEQ ID NO: 987990 - RNA, 19 nt, Homo sapiens
gcugaggagugggcagauu

SEQ ID NO: 987991 - RNA, 19 nt, Homo sapiens
uaauaagacuagcauagcu

SEQ ID NO: 987992 - RNA, 19 nt, Homo sapiens
aaugccaaaucguuucuaa

SEQ ID NO: 987993 - RNA, 19 nt, Homo sapiens
ggagagaagagcugauuuu

SEQ ID NO: 987994 - RNA, 19 nt, Homo sapiens
aauaucagccggaacagaa

SEQ ID NO: 987995 - RNA, 19 nt, Homo sapiens
cacccugagucaccuguaa

SEQ ID NO: 987996 - RNA, 19 nt, Homo sapiens
caaacuauccugccaaacg

SEQ ID NO: 987997 - RNA, 19 nt, Homo sapiens
caagugacagccaggaaga

SEQ ID NO: 987998 - RNA, 19 nt, Homo sapiens
gcugauaacaauaacaaca

SEQ ID NO: 987999 - RNA, 19 nt, Homo sapiens
gaccgucccucucaucacu

SEQ ID NO: 988000 - RNA, 19 nt, Homo sapiens
ggagguuaaucacuuacag

SEQ ID NO: 988001 - RNA, 19 nt, Homo sapiens
gaauaucagccggaacaga

SEQ ID NO: 988002 - RNA, 19 nt, Homo sapiens
aaagcggaauaacaaguug

SEQ ID NO: 988003 - RNA, 19 nt, Homo sapiens
cagcugggagaauugguua

SEQ ID NO: 988004 - RNA, 19 nt, Homo sapiens
guucccauguaagauauuu

SEQ ID NO: 988005 - RNA, 19 nt, Homo sapiens
gauagaugugucugagaaa

SEQ ID NO: 988006 - RNA, 19 nt, Homo sapiens
uugcugagaucaucguaug

SEQ ID NO: 988007 - RNA, 19 nt, Homo sapiens
ccuuggagguuaaucacuu

SEQ ID NO: 988008 - RNA, 19 nt, Homo sapiens
uggccaagcuggagagaag

SEQ ID NO: 988009 - RNA, 19 nt, Homo sapiens
gcauguuucguguugauug

SEQ ID NO: 988010 - RNA, 19 nt, Homo sapiens
ugaagacaagaacggaaua

SEQ ID NO: 988011 - RNA, 19 nt, Homo sapiens
uaaagauagaugugucuga

SEQ ID NO: 988012 - RNA, 19 nt, Homo sapiens
ugacaggaaacaaauaaag

SEQ ID NO: 988013 - RNA, 19 nt, Homo sapiens
ggaaccguaucaggcauuc

SEQ ID NO: 988014 - RNA, 19 nt, Homo sapiens
aagaugagcacaaacuuuc

SEQ ID NO: 988015 - RNA, 19 nt, Homo sapiens
gcagcacagucugggaaga

SEQ ID NO: 988016 - RNA, 19 nt, Homo sapiens
guaugcaacagcuggguaa

SEQ ID NO: 988017 - RNA, 19 nt, Homo sapiens
gaauugguuauuugagaug

SEQ ID NO: 988018 - RNA, 19 nt, Homo sapiens
gugcugauaacaauaacaa

SEQ ID NO: 988019 - RNA, 19 nt, Homo sapiens
ugacacagaccgggacuau

SEQ ID NO: 988020 - RNA, 19 nt, Homo sapiens
ggugugugcuggaguuguc

SEQ ID NO: 988021 - RNA, 19 nt, Homo sapiens
gguagcagaggcggaagua

SEQ ID NO: 988022 - RNA, 19 nt, Homo sapiens
gcagagaggucuucccuua

SEQ ID NO: 988023 - RNA, 19 nt, Homo sapiens
gcaagagaguggacacaaa

SEQ ID NO: 988024 - RNA, 19 nt, Homo sapiens
uaugaaaccucuagagauu

SEQ ID NO: 988025 - RNA, 19 nt, Homo sapiens
gcaauucacucacaacucu

SEQ ID NO: 988026 - RNA, 19 nt, Homo sapiens
ccacauacccuuugccuuu

SEQ ID NO: 988027 - RNA, 19 nt, Homo sapiens
caaagagcaucaucuguuc

SEQ ID NO: 988028 - RNA, 19 nt, Homo sapiens
guuaugaucugcagucuuc

SEQ ID NO: 988029 - RNA, 19 nt, Homo sapiens
guaagugccuuggagguuu

SEQ ID NO: 988030 - RNA, 19 nt, Homo sapiens
agagaggucuucccuuaaa

SEQ ID NO: 988031 - RNA, 19 nt, Homo sapiens
ugaaaccucuagagauuug

SEQ ID NO: 988032 - RNA, 19 nt, Homo sapiens
ucaaagagcaucaucuguu

SEQ ID NO: 988033 - RNA, 19 nt, Homo sapiens
gaaugacaguccuuaccaa

SEQ ID NO: 988034 - RNA, 19 nt, Homo sapiens
uaaagcggauccagaagga

SEQ ID NO: 988035 - RNA, 19 nt, Homo sapiens
gggcagagcaggcuuuguu

SEQ ID NO: 988036 - RNA, 19 nt, Homo sapiens
ggucuucccuuaaaacuuu

SEQ ID NO: 988037 - RNA, 19 nt, Homo sapiens
caaaucagcaaccauuguu

SEQ ID NO: 988038 - RNA, 19 nt, Homo sapiens
aaaguucucuuguccaucu

SEQ ID NO: 988039 - RNA, 19 nt, Homo sapiens
ugaugaagauucucacuac

SEQ ID NO: 988040 - RNA, 19 nt, Homo sapiens
ccaaggagguguuuucuuc

SEQ ID NO: 988041 - RNA, 19 nt, Homo sapiens
gaaggaauuaaccgacuug

SEQ ID NO: 988042 - RNA, 19 nt, Homo sapiens
guacaacagacuagcaaga

SEQ ID NO: 988043 - RNA, 19 nt, Homo sapiens
caucaucuguucuucaaac

SEQ ID NO: 988044 - RNA, 19 nt, Homo sapiens
ggaauugggaacaguguca

SEQ ID NO: 988045 - RNA, 19 nt, Homo sapiens
uuucagcaauuacggcuuu

SEQ ID NO: 988046 - RNA, 19 nt, Homo sapiens
caagagaagcuggcagaga

SEQ ID NO: 988047 - RNA, 19 nt, Homo sapiens
ggauacaaagcacauaaca

SEQ ID NO: 988048 - RNA, 19 nt, Homo sapiens
caggauacaaagcacauaa

SEQ ID NO: 988049 - RNA, 19 nt, Homo sapiens
caagaagcagcaaguggaa

SEQ ID NO: 988050 - RNA, 19 nt, Homo sapiens
gacagugccaccucuuuga

SEQ ID NO: 988051 - RNA, 19 nt, Homo sapiens
gcagcauguuggugccauu

SEQ ID NO: 988052 - RNA, 19 nt, Homo sapiens
acaacagacuagcaagaga

SEQ ID NO: 988053 - RNA, 19 nt, Homo sapiens
ggagggaauugggaacagu

SEQ ID NO: 988054 - RNA, 19 nt, Homo sapiens
gaaguacaacagacuagca

SEQ ID NO: 988055 - RNA, 19 nt, Homo sapiens
ccacuuuccuacagauuac

SEQ ID NO: 988056 - RNA, 19 nt, Homo sapiens
gagccuacacuaaguccaa

SEQ ID NO: 988057 - RNA, 19 nt, Homo sapiens
gagcaucaucuguucuuca

SEQ ID NO: 988058 - RNA, 19 nt, Homo sapiens
ccuaauaucaacagcaaug

SEQ ID NO: 988059 - RNA, 19 nt, Homo sapiens
gaacacaaggagggagaga

SEQ ID NO: 988060 - RNA, 19 nt, Homo sapiens
agagauuugggucauguua

SEQ ID NO: 988061 - RNA, 19 nt, Homo sapiens
gaagcaagagcaaaauuau

SEQ ID NO: 988062 - RNA, 19 nt, Homo sapiens
ccaaaucagcaaccauugu

SEQ ID NO: 988063 - RNA, 19 nt, Homo sapiens
cagagaggucuucccuuaa

SEQ ID NO: 988064 - RNA, 19 nt, Homo sapiens
ggucauguuacuccauuug

SEQ ID NO: 988065 - RNA, 19 nt, Homo sapiens
agaaggaauuaaccgacuu

SEQ ID NO: 988066 - RNA, 19 nt, Homo sapiens
ugacagugccaccucuuug

SEQ ID NO: 988067 - RNA, 19 nt, Homo sapiens
cuagagauuugggucaugu

SEQ ID NO: 988068 - RNA, 19 nt, Homo sapiens
gcggauccagaaggaauua

SEQ ID NO: 988069 - RNA, 19 nt, Homo sapiens
acacaaggagggagagaga

SEQ ID NO: 988070 - RNA, 19 nt, Homo sapiens
gcacauaacaccccauaag

SEQ ID NO: 988071 - RNA, 19 nt, Homo sapiens
gagaaguacaacagacuag

SEQ ID NO: 988072 - RNA, 19 nt, Homo sapiens
caaaaguucucuuguccau

SEQ ID NO: 988073 - RNA, 19 nt, Homo sapiens
uuacuccauuugaugaaga

SEQ ID NO: 988074 - RNA, 19 nt, Homo sapiens
caauuacggcuuugacagu

SEQ ID NO: 988075 - RNA, 19 nt, Homo sapiens
ucauguuacuccauuugau

SEQ ID NO: 988076 - RNA, 19 nt, Homo sapiens
ugucggugaugacuuguuc

SEQ ID NO: 988077 - RNA, 19 nt, Homo sapiens
aaaugcaauucacucacaa

SEQ ID NO: 988078 - RNA, 19 nt, Homo sapiens
uggcauuucucgccucaca

SEQ ID NO: 988079 - RNA, 19 nt, Homo sapiens
caagagaguggacacaaaa

SEQ ID NO: 988080 - RNA, 19 nt, Homo sapiens
gagagaaguacaacagacu

SEQ ID NO: 988081 - RNA, 19 nt, Homo sapiens
cagcaucugccuugauauc

SEQ ID NO: 988082 - RNA, 19 nt, Homo sapiens
cauguuacuccauuugaug

SEQ ID NO: 988083 - RNA, 19 nt, Homo sapiens
ugggucauguuacuccauu

SEQ ID NO: 988084 - RNA, 19 nt, Homo sapiens
gcccgaaugacaguccuua

SEQ ID NO: 988085 - RNA, 19 nt, Homo sapiens
gagaggucuucccuuaaaa

SEQ ID NO: 988086 - RNA, 19 nt, Homo sapiens
ugccaaaucagcaaccauu

SEQ ID NO: 988087 - RNA, 19 nt, Homo sapiens
agcaucaucuguucuucaa

SEQ ID NO: 988088 - RNA, 19 nt, Homo sapiens
gaccauccacuuuccuaca

SEQ ID NO: 988089 - RNA, 19 nt, Homo sapiens
acccuaauaucaacagcaa

SEQ ID NO: 988090 - RNA, 19 nt, Homo sapiens
cgaaugacaguccuuacca

SEQ ID NO: 988091 - RNA, 19 nt, Homo sapiens
agaagcaagagcaaaauua

SEQ ID NO: 988092 - RNA, 19 nt, Homo sapiens
agagaaguacaacagacua

SEQ ID NO: 988093 - RNA, 19 nt, Homo sapiens
ucacagacuagaacacaag

SEQ ID NO: 988094 - RNA, 19 nt, Homo sapiens
guccaagugugagccauuc

SEQ ID NO: 988095 - RNA, 19 nt, Homo sapiens
cagagagaaguacaacaga

SEQ ID NO: 988096 - RNA, 19 nt, Homo sapiens
ccuacaaggccgacagaga

SEQ ID NO: 988097 - RNA, 19 nt, Homo sapiens
aaaaugcaauucacucaca

SEQ ID NO: 988098 - RNA, 19 nt, Homo sapiens
gcccugcacgucucuccua

SEQ ID NO: 988099 - RNA, 19 nt, Homo sapiens
cuacagauuacccguucaa

SEQ ID NO: 988100 - RNA, 19 nt, Homo sapiens
gauagcacacaccuacaag

SEQ ID NO: 988101 - RNA, 19 nt, Homo sapiens
uuaugaaaccucuagagau

SEQ ID NO: 988102 - RNA, 19 nt, Homo sapiens
ggccucaaauggugcuucu

SEQ ID NO: 988103 - RNA, 19 nt, Homo sapiens
aaccauuguuguuaugauc

SEQ ID NO: 988104 - RNA, 19 nt, Homo sapiens
uccacuuuccuacagauua

SEQ ID NO: 988105 - RNA, 19 nt, Homo sapiens
gcaucugccuugauauccu

SEQ ID NO: 988106 - RNA, 19 nt, Homo sapiens
ggauccuccugcccagugu

SEQ ID NO: 988107 - RNA, 19 nt, Homo sapiens
ccauccacuuuccuacaga

SEQ ID NO: 988108 - RNA, 19 nt, Homo sapiens
agauuugggucauguuacu

SEQ ID NO: 988109 - RNA, 19 nt, Homo sapiens
cauaacaccccauaagaga

SEQ ID NO: 988110 - RNA, 19 nt, Homo sapiens
cauccacuuuccuacagau

SEQ ID NO: 988111 - RNA, 19 nt, Homo sapiens
ccuuggagguuuuacauga

SEQ ID NO: 988112 - RNA, 19 nt, Homo sapiens
acagagagaaguacaacag

SEQ ID NO: 988113 - RNA, 19 nt, Homo sapiens
cgagaaaguuuacgggaaa

SEQ ID NO: 988114 - RNA, 19 nt, Homo sapiens
gaaagaagagagagaacuu

SEQ ID NO: 988115 - RNA, 19 nt, Homo sapiens
gaagagagagaacuugaug

SEQ ID NO: 988116 - RNA, 19 nt, Homo sapiens
ccucaggugucaaaguaaa

SEQ ID NO: 988117 - RNA, 19 nt, Homo sapiens
uaagaaagaagagagagaa

SEQ ID NO: 988118 - RNA, 19 nt, Homo sapiens
gcacacacacgggcgagaa

SEQ ID NO: 988119 - RNA, 19 nt, Homo sapiens
ggaaaucuucgcaccucaa

SEQ ID NO: 988120 - RNA, 19 nt, Homo sapiens
gagaaaguuuacgggaaau

SEQ ID NO: 988121 - RNA, 19 nt, Homo sapiens
gcgaccaccugaccaagca

SEQ ID NO: 988122 - RNA, 19 nt, Homo sapiens
ggccuuuccuuuuguuaua

SEQ ID NO: 988123 - RNA, 19 nt, Homo sapiens
gaaaguuuacgggaaaucu

SEQ ID NO: 988124 - RNA, 19 nt, Homo sapiens
gcagcgaccaccugaccaa

SEQ ID NO: 988125 - RNA, 19 nt, Homo sapiens
gaaaucuucgcaccucaag

SEQ ID NO: 988126 - RNA, 19 nt, Homo sapiens
gauccuagcggaccucaac

SEQ ID NO: 988127 - RNA, 19 nt, Homo sapiens
aagaagagagagaacuuga

SEQ ID NO: 988128 - RNA, 19 nt, Homo sapiens
ggacugcaacaagaaguuc

SEQ ID NO: 988129 - RNA, 19 nt, Homo sapiens
aaagaagagagagaacuug

SEQ ID NO: 988130 - RNA, 19 nt, Homo sapiens
ucaggugucaaaguaaauu

SEQ ID NO: 988131 - RNA, 19 nt, Homo sapiens
gaugccaaguccacgaaaa

SEQ ID NO: 988132 - RNA, 19 nt, Homo sapiens
ggacaaggguaaagcaaua

SEQ ID NO: 988133 - RNA, 19 nt, Homo sapiens
ggaagggauucuccaauaa

SEQ ID NO: 988134 - RNA, 19 nt, Homo sapiens
gcacaucgaaccugaguua

SEQ ID NO: 988135 - RNA, 19 nt, Homo sapiens
ccacugaaauuaagagauu

SEQ ID NO: 988136 - RNA, 19 nt, Homo sapiens
gagcagaaaugccaggaaa

SEQ ID NO: 988137 - RNA, 19 nt, Homo sapiens
gaggaaagccugaauauag

SEQ ID NO: 988138 - RNA, 19 nt, Homo sapiens
caggaaaucuucaacacua

SEQ ID NO: 988139 - RNA, 19 nt, Homo sapiens
caagaugacaugagaauuu

SEQ ID NO: 988140 - RNA, 19 nt, Homo sapiens
gauuagaaaugucggauug

SEQ ID NO: 988141 - RNA, 19 nt, Homo sapiens
gaacuguaaugcucaggaa

SEQ ID NO: 988142 - RNA, 19 nt, Homo sapiens
gaagaggucaagaaacuuu

SEQ ID NO: 988143 - RNA, 19 nt, Homo sapiens
ucacagugcuggccucuga

SEQ ID NO: 988144 - RNA, 19 nt, Homo sapiens
guuguucgguguccuauaa

SEQ ID NO: 988145 - RNA, 19 nt, Homo sapiens
gaagcuagaaccacaugua

SEQ ID NO: 988146 - RNA, 19 nt, Homo sapiens
acagacaguucuucaauga

SEQ ID NO: 988147 - RNA, 19 nt, Homo sapiens
ccucgugucucucuacuuu

SEQ ID NO: 988148 - RNA, 19 nt, Homo sapiens
ugaaggccaugagugauua

SEQ ID NO: 988149 - RNA, 19 nt, Homo sapiens
gaagagcacaguucacaug

SEQ ID NO: 988150 - RNA, 19 nt, Homo sapiens
gaaccucaaugauccagau

SEQ ID NO: 988151 - RNA, 19 nt, Homo sapiens
aggaagggauucuccaaua

SEQ ID NO: 988152 - RNA, 19 nt, Homo sapiens
gcaaguuaguggucauaug

SEQ ID NO: 988153 - RNA, 19 nt, Homo sapiens
ucaacacuauggaagauuu

SEQ ID NO: 988154 - RNA, 19 nt, Homo sapiens
gaagcuauuguacaguuua

SEQ ID NO: 988155 - RNA, 19 nt, Homo sapiens
caaguuaguggucauauga

SEQ ID NO: 988156 - RNA, 19 nt, Homo sapiens
agaacaagaugacaugaga

SEQ ID NO: 988157 - RNA, 19 nt, Homo sapiens
ggaggaaagccugaauaua

SEQ ID NO: 988158 - RNA, 19 nt, Homo sapiens
caaaugagguagaaaagaa

SEQ ID NO: 988159 - RNA, 19 nt, Homo sapiens
caacaacaucuucuucuug

SEQ ID NO: 988160 - RNA, 19 nt, Homo sapiens
gccugaauauagucaaaua

SEQ ID NO: 988161 - RNA, 19 nt, Homo sapiens
caacgcaguucaacaacau

SEQ ID NO: 988162 - RNA, 19 nt, Homo sapiens
augaagagcuccauuuaau

SEQ ID NO: 988163 - RNA, 19 nt, Homo sapiens
caucuggaguggauuagaa

SEQ ID NO: 988164 - RNA, 19 nt, Homo sapiens
gugaagcuauuguacaguu

SEQ ID NO: 988165 - RNA, 19 nt, Homo sapiens
uaaaugaagaggucaagaa

SEQ ID NO: 988166 - RNA, 19 nt, Homo sapiens
gagcuccauuuaaucguuu

SEQ ID NO: 988167 - RNA, 19 nt, Homo sapiens
gaaaugccaggaaaucuuc

SEQ ID NO: 988168 - RNA, 19 nt, Homo sapiens
gaaauucuuccaucgguau

SEQ ID NO: 988169 - RNA, 19 nt, Homo sapiens
gcaacgcaguucaacaaca

SEQ ID NO: 988170 - RNA, 19 nt, Homo sapiens
cuauaucgcuaucauuuca

SEQ ID NO: 988171 - RNA, 19 nt, Homo sapiens
gaaccccaguuuaaguuua

SEQ ID NO: 988172 - RNA, 19 nt, Homo sapiens
gugaacaguuuaacaucaa

SEQ ID NO: 988173 - RNA, 19 nt, Homo sapiens
gaagagcuccauuuaaucg

SEQ ID NO: 988174 - RNA, 19 nt, Homo sapiens
aaagguaguuggcuauauc

SEQ ID NO: 988175 - RNA, 19 nt, Homo sapiens
ggaugaagaugaggagauc

SEQ ID NO: 988176 - RNA, 19 nt, Homo sapiens
gcacaguucacaugaggaa

SEQ ID NO: 988177 - RNA, 19 nt, Homo sapiens
ucaacaacaucuucuucuu

SEQ ID NO: 988178 - RNA, 19 nt, Homo sapiens
caaaccugauugaaguaaa

SEQ ID NO: 988179 - RNA, 19 nt, Homo sapiens
gcacccggauuuaaugaag

SEQ ID NO: 988180 - RNA, 19 nt, Homo sapiens
ggacauuuagcccaucaaa

SEQ ID NO: 988181 - RNA, 19 nt, Homo sapiens
uaaagguaguuggcuauau

SEQ ID NO: 988182 - RNA, 19 nt, Homo sapiens
gagaagagcacaguucaca

SEQ ID NO: 988183 - RNA, 19 nt, Homo sapiens
ucaccgagagcauaucuaa

SEQ ID NO: 988184 - RNA, 19 nt, Homo sapiens
ucaaugauccagaugcaaa

SEQ ID NO: 988185 - RNA, 19 nt, Homo sapiens
gaacaagaugacaugagaa

SEQ ID NO: 988186 - RNA, 19 nt, Homo sapiens
ggaguggauuagaacaaga

SEQ ID NO: 988187 - RNA, 19 nt, Homo sapiens
gcucaucuggaguggauua

SEQ ID NO: 988188 - RNA, 19 nt, Homo sapiens
ccucauaagucaugucucu

SEQ ID NO: 988189 - RNA, 19 nt, Homo sapiens
gcaaaccugauugaaguaa

SEQ ID NO: 988190 - RNA, 19 nt, Homo sapiens
ugacaucaacagugacuuu

SEQ ID NO: 988191 - RNA, 19 nt, Homo sapiens
gcagaaaugccaggaaauc

SEQ ID NO: 988192 - RNA, 19 nt, Homo sapiens
ggcuauaucgcuaucauuu

SEQ ID NO: 988193 - RNA, 19 nt, Homo sapiens
gcggcugugugcuuuauga

SEQ ID NO: 988194 - RNA, 19 nt, Homo sapiens
auacagaugacacuuauga

SEQ ID NO: 988195 - RNA, 19 nt, Homo sapiens
gaagggauucuccaauaag

SEQ ID NO: 988196 - RNA, 19 nt, Homo sapiens
caucgaaccugaguuagca

SEQ ID NO: 988197 - RNA, 19 nt, Homo sapiens
ugaguuccacugaaauuaa

SEQ ID NO: 988198 - RNA, 19 nt, Homo sapiens
uuaugaagagcuccauuua

SEQ ID NO: 988199 - RNA, 19 nt, Homo sapiens
cagaugacacuuaugaaga

SEQ ID NO: 988200 - RNA, 19 nt, Homo sapiens
cagcucaucuggaguggau

SEQ ID NO: 988201 - RNA, 19 nt, Homo sapiens
gaaaauccaguccuuuauu

SEQ ID NO: 988202 - RNA, 19 nt, Homo sapiens
ggacuccuauguuauuuug

SEQ ID NO: 988203 - RNA, 19 nt, Homo sapiens
gacaucaacagugacuuua

SEQ ID NO: 988204 - RNA, 19 nt, Homo sapiens
ggguccaacuucugaaaga

SEQ ID NO: 988205 - RNA, 19 nt, Homo sapiens
gcauucaggacaaggguaa

SEQ ID NO: 988206 - RNA, 19 nt, Homo sapiens
gugcaacgcaguucaacaa

SEQ ID NO: 988207 - RNA, 19 nt, Homo sapiens
gcgggacuccuauguuauu

SEQ ID NO: 988208 - RNA, 19 nt, Homo sapiens
agaaagaaccccaguuuaa

SEQ ID NO: 988209 - RNA, 19 nt, Homo sapiens
uaugaagagcuccauuuaa

SEQ ID NO: 988210 - RNA, 19 nt, Homo sapiens
caguuuacaaggacauuua

SEQ ID NO: 988211 - RNA, 19 nt, Homo sapiens
guaaugcucaggaaaucuu

SEQ ID NO: 988212 - RNA, 19 nt, Homo sapiens
gaaaugucggauuguguga

SEQ ID NO: 988213 - RNA, 19 nt, Homo sapiens
aaaugaagaggucaagaaa

SEQ ID NO: 988214 - RNA, 19 nt, Homo sapiens
ucggugacaucaacaguga

SEQ ID NO: 988215 - RNA, 19 nt, Homo sapiens
caacaucuucuucuuggau

SEQ ID NO: 988216 - RNA, 19 nt, Homo sapiens
cggauugugugaagcuauu

SEQ ID NO: 988217 - RNA, 19 nt, Homo sapiens
gagaaagaaccccaguuua

SEQ ID NO: 988218 - RNA, 19 nt, Homo sapiens
gagugcggcugugugcuuu

SEQ ID NO: 988219 - RNA, 19 nt, Homo sapiens
ugaagcuauuguacaguuu

SEQ ID NO: 988220 - RNA, 19 nt, Homo sapiens
ggaaaucuucaacacuaug

SEQ ID NO: 988221 - RNA, 19 nt, Homo sapiens
guaggaaaccugagaugca

SEQ ID NO: 988222 - RNA, 19 nt, Homo sapiens
cggcugauguuuuaauuuu

SEQ ID NO: 988223 - RNA, 19 nt, Homo sapiens
augcaaaccugauugaagu

SEQ ID NO: 988224 - RNA, 19 nt, Homo sapiens
gugaaggccaugagugauu

SEQ ID NO: 988225 - RNA, 19 nt, Homo sapiens
ugugaacaguuuaacauca

SEQ ID NO: 988226 - RNA, 19 nt, Homo sapiens
gcagauuccccaaaauuuu

SEQ ID NO: 988227 - RNA, 19 nt, Homo sapiens
gaguuccacugaaauuaag

SEQ ID NO: 988228 - RNA, 19 nt, Homo sapiens
aggaaagccugaauauagu

SEQ ID NO: 988229 - RNA, 19 nt, Homo sapiens
caccucagccucccaagaa

SEQ ID NO: 988230 - RNA, 19 nt, Homo sapiens
cagaguggaugaagaugag

SEQ ID NO: 988231 - RNA, 19 nt, Homo sapiens
cuccugagcucaagcaauc

SEQ ID NO: 988232 - RNA, 19 nt, Homo sapiens
ggaaacaaaucgagcuuga

SEQ ID NO: 988233 - RNA, 19 nt, Homo sapiens
gaaacucucugggaaauug

SEQ ID NO: 988234 - RNA, 19 nt, Homo sapiens
gggaaagacuacuauuauu

SEQ ID NO: 988235 - RNA, 19 nt, Homo sapiens
ggucauaauuggaaguaaa

SEQ ID NO: 988236 - RNA, 19 nt, Homo sapiens
ggagcaucauuaauguuua

SEQ ID NO: 988237 - RNA, 19 nt, Homo sapiens
gcaagacacuucgauuugu

SEQ ID NO: 988238 - RNA, 19 nt, Homo sapiens
ggaaagacuacuauuauuc

SEQ ID NO: 988239 - RNA, 19 nt, Homo sapiens
cagaagcucuauuacuaaa

SEQ ID NO: 988240 - RNA, 19 nt, Homo sapiens
ggaauuaugccgaagauca

SEQ ID NO: 988241 - RNA, 19 nt, Homo sapiens
ggcaauaugugaagaaagu

SEQ ID NO: 988242 - RNA, 19 nt, Homo sapiens
gaaaugagacagaagaucu

SEQ ID NO: 988243 - RNA, 19 nt, Homo sapiens
cagcaggauuggauucuuu

SEQ ID NO: 988244 - RNA, 19 nt, Homo sapiens
caauauguguggaucagaa

SEQ ID NO: 988245 - RNA, 19 nt, Homo sapiens
uuaacacgcugaaagauau

SEQ ID NO: 988246 - RNA, 19 nt, Homo sapiens
caagacacuucgauuuguu

SEQ ID NO: 988247 - RNA, 19 nt, Homo sapiens
uaaaggacaagcuggauuu

SEQ ID NO: 988248 - RNA, 19 nt, Homo sapiens
gaagagaaagguaauaugc

SEQ ID NO: 988249 - RNA, 19 nt, Homo sapiens
aaccuuagcuuuggaauau

SEQ ID NO: 988250 - RNA, 19 nt, Homo sapiens
guagacaaagugauaauga

SEQ ID NO: 988251 - RNA, 19 nt, Homo sapiens
agagaaagguaauaugcaa

SEQ ID NO: 988252 - RNA, 19 nt, Homo sapiens
cuguauaucuugaagcuuu

SEQ ID NO: 988253 - RNA, 19 nt, Homo sapiens
gagaagagaaagguaauau

SEQ ID NO: 988254 - RNA, 19 nt, Homo sapiens
gagcugaaauugcagaaaa

SEQ ID NO: 988255 - RNA, 19 nt, Homo sapiens
aucagaagcucuauuacua

SEQ ID NO: 988256 - RNA, 19 nt, Homo sapiens
guagaaccacguguaauuu

SEQ ID NO: 988257 - RNA, 19 nt, Homo sapiens
ccauguagacaaagugaua

SEQ ID NO: 988258 - RNA, 19 nt, Homo sapiens
caaaagauaucgcucacuu

SEQ ID NO: 988259 - RNA, 19 nt, Homo sapiens
gaugagaugagaauucaga

SEQ ID NO: 988260 - RNA, 19 nt, Homo sapiens
gcaucucccuguauaucuu

SEQ ID NO: 988261 - RNA, 19 nt, Homo sapiens
gaaccucuuuauuggacuu

SEQ ID NO: 988262 - RNA, 19 nt, Homo sapiens
ugauggagcugaaauugca

SEQ ID NO: 988263 - RNA, 19 nt, Homo sapiens
gggaauuaauggaagugaa

SEQ ID NO: 988264 - RNA, 19 nt, Homo sapiens
ugaagucgaugagaugaga

SEQ ID NO: 988265 - RNA, 19 nt, Homo sapiens
gagcaucauuaauguuuac

SEQ ID NO: 988266 - RNA, 19 nt, Homo sapiens
ucaaggacccugcgagaga

SEQ ID NO: 988267 - RNA, 19 nt, Homo sapiens
guauuaacacgcugaaaga

SEQ ID NO: 988268 - RNA, 19 nt, Homo sapiens
gugaaacucucugggaaau

SEQ ID NO: 988269 - RNA, 19 nt, Homo sapiens
cgucgacgaugcccaguga

SEQ ID NO: 988270 - RNA, 19 nt, Homo sapiens
caaccuuagcuuuggaaua

SEQ ID NO: 988271 - RNA, 19 nt, Homo sapiens
uagugcaucucccuguaua

SEQ ID NO: 988272 - RNA, 19 nt, Homo sapiens
cgagagauccucaguaugc

SEQ ID NO: 988273 - RNA, 19 nt, Homo sapiens
gaugagaauucagaaggau

SEQ ID NO: 988274 - RNA, 19 nt, Homo sapiens
ucagaagcucuauuacuaa

SEQ ID NO: 988275 - RNA, 19 nt, Homo sapiens
ugcgagagauccucaguau

SEQ ID NO: 988276 - RNA, 19 nt, Homo sapiens
uauggagcaucauuaaugu

SEQ ID NO: 988277 - RNA, 19 nt, Homo sapiens
uguagaaccacguguaauu

SEQ ID NO: 988278 - RNA, 19 nt, Homo sapiens
ggaauuaauggaagugaag

SEQ ID NO: 988279 - RNA, 19 nt, Homo sapiens
aggacaagcuggauuucuu

SEQ ID NO: 988280 - RNA, 19 nt, Homo sapiens
ugaaggugauggagcugaa

SEQ ID NO: 988281 - RNA, 19 nt, Homo sapiens
ucgaugagaugagaauuca

SEQ ID NO: 988282 - RNA, 19 nt, Homo sapiens
ccaguuggcauuuggcauu

SEQ ID NO: 988283 - RNA, 19 nt, Homo sapiens
gaaagacaaaugcuaaagc

SEQ ID NO: 988284 - RNA, 19 nt, Homo sapiens
gggaaagacaaaugcuaaa

SEQ ID NO: 988285 - RNA, 19 nt, Homo sapiens
guaccucuggucauaauug

SEQ ID NO: 988286 - RNA, 19 nt, Homo sapiens
ggaaagacaaaugcuaaag

SEQ ID NO: 988287 - RNA, 19 nt, Homo sapiens
ucuacuaccuaccucuaaa

SEQ ID NO: 988288 - RNA, 19 nt, Homo sapiens
guaaaucagaagcucuauu

SEQ ID NO: 988289 - RNA, 19 nt, Homo sapiens
uaauggaagugaaggugau

SEQ ID NO: 988290 - RNA, 19 nt, Homo sapiens
gaauuaugccgaagaucau

SEQ ID NO: 988291 - RNA, 19 nt, Homo sapiens
gcuugauucuugaaccuau

SEQ ID NO: 988292 - RNA, 19 nt, Homo sapiens
caaggacccugcgagagau

SEQ ID NO: 988293 - RNA, 19 nt, Homo sapiens
uuauggagcaucauuaaug

SEQ ID NO: 988294 - RNA, 19 nt, Homo sapiens
uggagcaucauuaauguuu

SEQ ID NO: 988295 - RNA, 19 nt, Homo sapiens
guaauaugcaagacacuuc

SEQ ID NO: 988296 - RNA, 19 nt, Homo sapiens
ugggaaagacaaaugcuaa

SEQ ID NO: 988297 - RNA, 19 nt, Homo sapiens
uaaugaaacugggaaagac

SEQ ID NO: 988298 - RNA, 19 nt, Homo sapiens
uuaaucagcauacccauca

SEQ ID NO: 988299 - RNA, 19 nt, Homo sapiens
uccgguaccucuggucaua

SEQ ID NO: 988300 - RNA, 19 nt, Homo sapiens
ggugauggagcugaaauug

SEQ ID NO: 988301 - RNA, 19 nt, Homo sapiens
aaacugggaaagacaaaug

SEQ ID NO: 988302 - RNA, 19 nt, Homo sapiens
guggcaauaugugaagaaa

SEQ ID NO: 988303 - RNA, 19 nt, Homo sapiens
gaacaguacaaaagaaguu

SEQ ID NO: 988304 - RNA, 19 nt, Homo sapiens
ugcaaaagcugaaguggaa

SEQ ID NO: 988305 - RNA, 19 nt, Homo sapiens
guggaguuaucaaccaguu

SEQ ID NO: 988306 - RNA, 19 nt, Homo sapiens
agaaagguaauaugcaaga

SEQ ID NO: 988307 - RNA, 19 nt, Homo sapiens
gaauuaauugacccauuuc

SEQ ID NO: 988308 - RNA, 19 nt, Homo sapiens
gaaacaaaucgagcuugau

SEQ ID NO: 988309 - RNA, 19 nt, Homo sapiens
agaugagaauucagaagga

SEQ ID NO: 988310 - RNA, 19 nt, Homo sapiens
ccaccaaagaguauuaaca

SEQ ID NO: 988311 - RNA, 19 nt, Homo sapiens
ggauucuuucggucaaaua

SEQ ID NO: 988312 - RNA, 19 nt, Homo sapiens
uaucacagcaggauuggau

SEQ ID NO: 988313 - RNA, 19 nt, Homo sapiens
caguaaaucagaagcucua

SEQ ID NO: 988314 - RNA, 19 nt, Homo sapiens
gaaagguaauaugcaagac

SEQ ID NO: 988315 - RNA, 19 nt, Homo sapiens
ggggaaagacuacuauuau

SEQ ID NO: 988316 - RNA, 19 nt, Homo sapiens
uucgauuuguugcacauua

SEQ ID NO: 988317 - RNA, 19 nt, Homo sapiens
gcacaacacaccaaaagau

SEQ ID NO: 988318 - RNA, 19 nt, Homo sapiens
aaaugaagucgaugagaug

SEQ ID NO: 988319 - RNA, 19 nt, Homo sapiens
aaaaugaagucgaugagau

SEQ ID NO: 988320 - RNA, 19 nt, Homo sapiens
ucgauuuguugcacauuau

SEQ ID NO: 988321 - RNA, 19 nt, Homo sapiens
acuagugcaucucccugua

SEQ ID NO: 988322 - RNA, 19 nt, Homo sapiens
gagcuugauucuugaaccu

SEQ ID NO: 988323 - RNA, 19 nt, Homo sapiens
auuaacacgcugaaagaua

SEQ ID NO: 988324 - RNA, 19 nt, Homo sapiens
uauguguggaucagaauaa

SEQ ID NO: 988325 - RNA, 19 nt, Homo sapiens
ugcaagacacuucgauuug

SEQ ID NO: 988326 - RNA, 19 nt, Homo sapiens
ugagaagagaaagguaaua

SEQ ID NO: 988327 - RNA, 19 nt, Homo sapiens
gaaggugauggagcugaaa

SEQ ID NO: 988328 - RNA, 19 nt, Homo sapiens
gaaacugggaaagacaaau

SEQ ID NO: 988329 - RNA, 19 nt, Homo sapiens
uuacggacguuuucucuug

SEQ ID NO: 988330 - RNA, 19 nt, Homo sapiens
gguaauaugcaagacacuu

SEQ ID NO: 988331 - RNA, 19 nt, Homo sapiens
ucugagaagagaaagguaa

SEQ ID NO: 988332 - RNA, 19 nt, Homo sapiens
ggaagugccuccuguauug

SEQ ID NO: 988333 - RNA, 19 nt, Homo sapiens
gaucagcaccuaugaguuc

SEQ ID NO: 988334 - RNA, 19 nt, Homo sapiens
gucuaaagaugaugaacuu

SEQ ID NO: 988335 - RNA, 19 nt, Homo sapiens
ucucagcccuguacugguu

SEQ ID NO: 988336 - RNA, 19 nt, Homo sapiens
gugguuaccucucucuuca

SEQ ID NO: 988337 - RNA, 19 nt, Homo sapiens
ggagcugggugccuguguu

SEQ ID NO: 988338 - RNA, 19 nt, Homo sapiens
acuaugagcuggugaagag

SEQ ID NO: 988339 - RNA, 19 nt, Homo sapiens
gaggagacccagccaagug

SEQ ID NO: 988340 - RNA, 19 nt, Homo sapiens
ccacugcccuucgagaugu

SEQ ID NO: 988341 - RNA, 19 nt, Homo sapiens
gagccucuccuauaccaaa

SEQ ID NO: 988342 - RNA, 19 nt, Homo sapiens
gguuaccucucucuucaug

SEQ ID NO: 988343 - RNA, 19 nt, Homo sapiens
gacccuuguuaauuccuua

SEQ ID NO: 988344 - RNA, 19 nt, Homo sapiens
gucgagcccugaccucuga

SEQ ID NO: 988345 - RNA, 19 nt, Homo sapiens
uguacugguucaacuauga

SEQ ID NO: 988346 - RNA, 19 nt, Homo sapiens
cuacuucacugccuaugac

SEQ ID NO: 988347 - RNA, 19 nt, Homo sapiens
gggcugugguuaccucucu

SEQ ID NO: 988348 - RNA, 19 nt, Homo sapiens
gggcaccaagggacucuuu

SEQ ID NO: 988349 - RNA, 19 nt, Homo sapiens
uuccuuaagucuaaagaug

SEQ ID NO: 988350 - RNA, 19 nt, Homo sapiens
ccuuaagucuaaagaugau

SEQ ID NO: 988351 - RNA, 19 nt, Homo sapiens
cccugacccuuguuaauuc

SEQ ID NO: 988352 - RNA, 19 nt, Homo sapiens
ccucagacacaacuucuuc

SEQ ID NO: 988353 - RNA, 19 nt, Homo sapiens
uggaagugccuccuguauu

SEQ ID NO: 988354 - RNA, 19 nt, Homo sapiens
agugcugacucuacccuuu

SEQ ID NO: 988355 - RNA, 19 nt, Homo sapiens
gagcugggugccuguguuc

SEQ ID NO: 988356 - RNA, 19 nt, Homo sapiens
aggcucagcaugugucgua

SEQ ID NO: 988357 - RNA, 19 nt, Homo sapiens
ucccugacccuuguuaauu

SEQ ID NO: 988358 - RNA, 19 nt, Homo sapiens
gcacgagcaccagccuaga

SEQ ID NO: 988359 - RNA, 19 nt, Homo sapiens
ccugaccucugaccucuac

SEQ ID NO: 988360 - RNA, 19 nt, Homo sapiens
cagcuaccgccaucuacuu

SEQ ID NO: 988361 - RNA, 19 nt, Homo sapiens
ggaggagacccagccaagu

SEQ ID NO: 988362 - RNA, 19 nt, Homo sapiens
gaaccaggaccggcuucug

SEQ ID NO: 988363 - RNA, 19 nt, Homo sapiens
cgauggaggcugugagagu

SEQ ID NO: 988364 - RNA, 19 nt, Homo sapiens
gugcugacucuacccuuug

SEQ ID NO: 988365 - RNA, 19 nt, Homo sapiens
gcaccaagggacucuuugc

SEQ ID NO: 988366 - RNA, 19 nt, Homo sapiens
gcccuguacugguucaacu

SEQ ID NO: 988367 - RNA, 19 nt, Homo sapiens
ccauggaugccuucgugaa

SEQ ID NO: 988368 - RNA, 19 nt, Homo sapiens
gaacagaaguggccaagaa

SEQ ID NO: 988369 - RNA, 19 nt, Homo sapiens
gagagaagcuugaagaauu

SEQ ID NO: 988370 - RNA, 19 nt, Homo sapiens
caauauagcuuccauucua

SEQ ID NO: 988371 - RNA, 19 nt, Homo sapiens
gcugaucucuuuauucuuu

SEQ ID NO: 988372 - RNA, 19 nt, Homo sapiens
caaaggacauaaauacgua

SEQ ID NO: 988373 - RNA, 19 nt, Homo sapiens
gaggagaacucgauccaaa

SEQ ID NO: 988374 - RNA, 19 nt, Homo sapiens
gaaaguaauggaugaagua

SEQ ID NO: 988375 - RNA, 19 nt, Homo sapiens
ggacauaaauacguacuug

SEQ ID NO: 988376 - RNA, 19 nt, Homo sapiens
gaucugaacugaaccuguu

SEQ ID NO: 988377 - RNA, 19 nt, Homo sapiens
agagaagcuugaagaauua

SEQ ID NO: 988378 - RNA, 19 nt, Homo sapiens
caaauucagugaugacaga

SEQ ID NO: 988379 - RNA, 19 nt, Homo sapiens
gaauggaucuuggagaaug

SEQ ID NO: 988380 - RNA, 19 nt, Homo sapiens
ggaguuacguacuauuguu

SEQ ID NO: 988381 - RNA, 19 nt, Homo sapiens
ggaggaaucccagaaagua

SEQ ID NO: 988382 - RNA, 19 nt, Homo sapiens
gaaauugcauccaaagaac

SEQ ID NO: 988383 - RNA, 19 nt, Homo sapiens
guacauuucuucaguccuu

SEQ ID NO: 988384 - RNA, 19 nt, Homo sapiens
gacuuuguaucccuuaaua

SEQ ID NO: 988385 - RNA, 19 nt, Homo sapiens
guaauacaguucugaaagu

SEQ ID NO: 988386 - RNA, 19 nt, Homo sapiens
gcaccaaaggacauaaaua

SEQ ID NO: 988387 - RNA, 19 nt, Homo sapiens
cuaacuagcuguguacauu

SEQ ID NO: 988388 - RNA, 19 nt, Homo sapiens
cggcacaguucuagagaua

SEQ ID NO: 988389 - RNA, 19 nt, Homo sapiens
uagaauggaucuuggagaa

SEQ ID NO: 988390 - RNA, 19 nt, Homo sapiens
agucugcucugccuauuua

SEQ ID NO: 988391 - RNA, 19 nt, Homo sapiens
guaaugaccguuauagaga

SEQ ID NO: 988392 - RNA, 19 nt, Homo sapiens
uugcaaagauuccagauga

SEQ ID NO: 988393 - RNA, 19 nt, Homo sapiens
uaagagugcuagugaacaa

SEQ ID NO: 988394 - RNA, 19 nt, Homo sapiens
gagaagcagaggaaguuua

SEQ ID NO: 988395 - RNA, 19 nt, Homo sapiens
caaguaagagugcuaguga

SEQ ID NO: 988396 - RNA, 19 nt, Homo sapiens
gaaagcacgggcaaagaaa

SEQ ID NO: 988397 - RNA, 19 nt, Homo sapiens
caccugggauuuauugaaa

SEQ ID NO: 988398 - RNA, 19 nt, Homo sapiens
gaauugcuauguucaggau

SEQ ID NO: 988399 - RNA, 19 nt, Homo sapiens
uaccuacacucuccaauug

SEQ ID NO: 988400 - RNA, 19 nt, Homo sapiens
guaaaaugcugucuuccua

SEQ ID NO: 988401 - RNA, 19 nt, Homo sapiens
guaucuaacuugaucugaa

SEQ ID NO: 988402 - RNA, 19 nt, Homo sapiens
caucugcagucauucauug

SEQ ID NO: 988403 - RNA, 19 nt, Homo sapiens
gaaacgaagagaagagaga

SEQ ID NO: 988404 - RNA, 19 nt, Homo sapiens
uaagagagaagcuugaaga

SEQ ID NO: 988405 - RNA, 19 nt, Homo sapiens
aaacugcaccugggauuua

SEQ ID NO: 988406 - RNA, 19 nt, Homo sapiens
gaagucugcucugccuauu

SEQ ID NO: 988407 - RNA, 19 nt, Homo sapiens
gaggaaguuuaucggaauu

SEQ ID NO: 988408 - RNA, 19 nt, Homo sapiens
agagauuagugcugaagua

SEQ ID NO: 988409 - RNA, 19 nt, Homo sapiens
gauaagaagcgguccuaug

SEQ ID NO: 988410 - RNA, 19 nt, Homo sapiens
gacaggaguucaagagaca

SEQ ID NO: 988411 - RNA, 19 nt, Homo sapiens
ugaaauugcauccaaagaa

SEQ ID NO: 988412 - RNA, 19 nt, Homo sapiens
aagagcggauuaugaaauu

SEQ ID NO: 988413 - RNA, 19 nt, Homo sapiens
cauuuccucuauucuguua

SEQ ID NO: 988414 - RNA, 19 nt, Homo sapiens
aacuguaacuugucuagua

SEQ ID NO: 988415 - RNA, 19 nt, Homo sapiens
auaagaagcgguccuauga

SEQ ID NO: 988416 - RNA, 19 nt, Homo sapiens
auucagagaccaagacuua

SEQ ID NO: 988417 - RNA, 19 nt, Homo sapiens
gagaagagagagagagaga

SEQ ID NO: 988418 - RNA, 19 nt, Homo sapiens
gaaaagagaagcagaggaa

SEQ ID NO: 988419 - RNA, 19 nt, Homo sapiens
aaugugugcuggagaaauu

SEQ ID NO: 988420 - RNA, 19 nt, Homo sapiens
gauguacaguaucuaacuu

SEQ ID NO: 988421 - RNA, 19 nt, Homo sapiens
aagaagcgguccuaugaga

SEQ ID NO: 988422 - RNA, 19 nt, Homo sapiens
gcacaguucuagagauagg

SEQ ID NO: 988423 - RNA, 19 nt, Homo sapiens
gaagagagagagagagaag

SEQ ID NO: 988424 - RNA, 19 nt, Homo sapiens
gaaacucaagaagagauua

SEQ ID NO: 988425 - RNA, 19 nt, Homo sapiens
uggaucaucugcagucauu

SEQ ID NO: 988426 - RNA, 19 nt, Homo sapiens
gcuguugcauuacauacuu

SEQ ID NO: 988427 - RNA, 19 nt, Homo sapiens
uaaugaccguuauagagaa

SEQ ID NO: 988428 - RNA, 19 nt, Homo sapiens
uaggcuagauguacaguau

SEQ ID NO: 988429 - RNA, 19 nt, Homo sapiens
auacguacuugcaaagauu

SEQ ID NO: 988430 - RNA, 19 nt, Homo sapiens
gaggaaucccagaaaguaa

SEQ ID NO: 988431 - RNA, 19 nt, Homo sapiens
ggaacuagaauggaucuug

SEQ ID NO: 988432 - RNA, 19 nt, Homo sapiens
gaugacagaguaugcaaga

SEQ ID NO: 988433 - RNA, 19 nt, Homo sapiens
ucuauucuguuacgucauu

SEQ ID NO: 988434 - RNA, 19 nt, Homo sapiens
gcaccugggauuuauugaa

SEQ ID NO: 988435 - RNA, 19 nt, Homo sapiens
acuaggagcugaagggaau

SEQ ID NO: 988436 - RNA, 19 nt, Homo sapiens
uagcagaaacucaagaaga

SEQ ID NO: 988437 - RNA, 19 nt, Homo sapiens
gaucuuggagaaugucuga

SEQ ID NO: 988438 - RNA, 19 nt, Homo sapiens
ggagaacucgauccaaauc

SEQ ID NO: 988439 - RNA, 19 nt, Homo sapiens
gauuacaguucagagcauu

SEQ ID NO: 988440 - RNA, 19 nt, Homo sapiens
uaacuagcuguguacauuu

SEQ ID NO: 988441 - RNA, 19 nt, Homo sapiens
gcuaauggcagaucagaag

SEQ ID NO: 988442 - RNA, 19 nt, Homo sapiens
uaagagcggauuaugaaau

SEQ ID NO: 988443 - RNA, 19 nt, Homo sapiens
gaaguuuaucggaauucua

SEQ ID NO: 988444 - RNA, 19 nt, Homo sapiens
ggcauuuccucuauucugu

SEQ ID NO: 988445 - RNA, 19 nt, Homo sapiens
gggcagggaagcaauauag

SEQ ID NO: 988446 - RNA, 19 nt, Homo sapiens
uacaguaucuaacuugauc

SEQ ID NO: 988447 - RNA, 19 nt, Homo sapiens
gcagagaacgauccaagag

SEQ ID NO: 988448 - RNA, 19 nt, Homo sapiens
caugauguccuuucuggaa

SEQ ID NO: 988449 - RNA, 19 nt, Homo sapiens
agaaagcacgggcaaagaa

SEQ ID NO: 988450 - RNA, 19 nt, Homo sapiens
guaaauuguuagccaaggu

SEQ ID NO: 988451 - RNA, 19 nt, Homo sapiens
acuguaacuugucuaguaa

SEQ ID NO: 988452 - RNA, 19 nt, Homo sapiens
uuucuguucuguugaauug

SEQ ID NO: 988453 - RNA, 19 nt, Homo sapiens
uaagcuuccuacggaguua

SEQ ID NO: 988454 - RNA, 19 nt, Homo sapiens
gaccaagacuuagcaucau

SEQ ID NO: 988455 - RNA, 19 nt, Homo sapiens
gcaagagucaccuucucaa

SEQ ID NO: 988456 - RNA, 19 nt, Homo sapiens
agaggaaguuuaucggaau

SEQ ID NO: 988457 - RNA, 19 nt, Homo sapiens
gaucaucugcagucauuca

SEQ ID NO: 988458 - RNA, 19 nt, Homo sapiens
uggaaugugugcuggagaa

SEQ ID NO: 988459 - RNA, 19 nt, Homo sapiens
uuuaagagcggauuaugaa

SEQ ID NO: 988460 - RNA, 19 nt, Homo sapiens
gaagcgguccuaugagagu

SEQ ID NO: 988461 - RNA, 19 nt, Homo sapiens
acagacgacuggcugauca

SEQ ID NO: 988462 - RNA, 19 nt, Homo sapiens
gagaaagcacgggcaaaga

SEQ ID NO: 988463 - RNA, 19 nt, Homo sapiens
gagugcuagugaacaaauu

SEQ ID NO: 988464 - RNA, 19 nt, Homo sapiens
agagucaccuucucaacug

SEQ ID NO: 988465 - RNA, 19 nt, Homo sapiens
gauaggagcagagaacgau

SEQ ID NO: 988466 - RNA, 19 nt, Homo sapiens
cccagaaaguaauggauga

SEQ ID NO: 988467 - RNA, 19 nt, Homo sapiens
guaaacugcaccugggauu

SEQ ID NO: 988468 - RNA, 19 nt, Homo sapiens
gaaacuugcucaaauauug

SEQ ID NO: 988469 - RNA, 19 nt, Homo sapiens
aaagaaagcugcauuggaa

SEQ ID NO: 988470 - RNA, 19 nt, Homo sapiens
gagaggaacuggagcaauu

SEQ ID NO: 988471 - RNA, 19 nt, Homo sapiens
ggaagcagcucaccgaaga

SEQ ID NO: 988472 - RNA, 19 nt, Homo sapiens
gaaguacugugaagauauu

SEQ ID NO: 988473 - RNA, 19 nt, Homo sapiens
cagaagaauuucagaagua

SEQ ID NO: 988474 - RNA, 19 nt, Homo sapiens
gcuagacaguuagaaauua

SEQ ID NO: 988475 - RNA, 19 nt, Homo sapiens
gaagaucaacugaaagaaa

SEQ ID NO: 988476 - RNA, 19 nt, Homo sapiens
gaaauggaacagaaacaua

SEQ ID NO: 988477 - RNA, 19 nt, Homo sapiens
gcaaagagaagaaggaguu

SEQ ID NO: 988478 - RNA, 19 nt, Homo sapiens
aauugaagcugacuacuaa

SEQ ID NO: 988479 - RNA, 19 nt, Homo sapiens
gauggccacuguauguaua

SEQ ID NO: 988480 - RNA, 19 nt, Homo sapiens
ccagacauauggaaaguga

SEQ ID NO: 988481 - RNA, 19 nt, Homo sapiens
ggaagacuuucugccauuu

SEQ ID NO: 988482 - RNA, 19 nt, Homo sapiens
gcucaaauauuggcagcua

SEQ ID NO: 988483 - RNA, 19 nt, Homo sapiens
cauuauaguuggugaagaa

SEQ ID NO: 988484 - RNA, 19 nt, Homo sapiens
cagaaguacugugaagaua

SEQ ID NO: 988485 - RNA, 19 nt, Homo sapiens
gauagauucuguugcuguu

SEQ ID NO: 988486 - RNA, 19 nt, Homo sapiens
uaagauagauucuguugcu

SEQ ID NO: 988487 - RNA, 19 nt, Homo sapiens
ccgaagauguggccaaguu

SEQ ID NO: 988488 - RNA, 19 nt, Homo sapiens
guauaaagccauugaagau

SEQ ID NO: 988489 - RNA, 19 nt, Homo sapiens
gagaaggcaucgcaaagag

SEQ ID NO: 988490 - RNA, 19 nt, Homo sapiens
gaaggcaucgcaaagagaa

SEQ ID NO: 988491 - RNA, 19 nt, Homo sapiens
gcagauucuccucccauua

SEQ ID NO: 988492 - RNA, 19 nt, Homo sapiens
caaacuuggugcuugagaa

SEQ ID NO: 988493 - RNA, 19 nt, Homo sapiens
uagauucuguugcuguuaa

SEQ ID NO: 988494 - RNA, 19 nt, Homo sapiens
uaagagcucugucucacau

SEQ ID NO: 988495 - RNA, 19 nt, Homo sapiens
gcagcuagacaguuagaaa

SEQ ID NO: 988496 - RNA, 19 nt, Homo sapiens
caauugaagcugacuacua

SEQ ID NO: 988497 - RNA, 19 nt, Homo sapiens
agaaugcuguucccaagaa

SEQ ID NO: 988498 - RNA, 19 nt, Homo sapiens
gagacaugcauauggcuua

SEQ ID NO: 988499 - RNA, 19 nt, Homo sapiens
ccagaagaauuucagaagu

SEQ ID NO: 988500 - RNA, 19 nt, Homo sapiens
ggagcgagaagaacggaua

SEQ ID NO: 988501 - RNA, 19 nt, Homo sapiens
gagaaacuugcucaaauau

SEQ ID NO: 988502 - RNA, 19 nt, Homo sapiens
gcauauggcuuaggagaac

SEQ ID NO: 988503 - RNA, 19 nt, Homo sapiens
acaaacaccaauagagaua

SEQ ID NO: 988504 - RNA, 19 nt, Homo sapiens
ugacuacuaaggagaauaa

SEQ ID NO: 988505 - RNA, 19 nt, Homo sapiens
acagaaacauagagaggaa

SEQ ID NO: 988506 - RNA, 19 nt, Homo sapiens
guacugugaagauauugua

SEQ ID NO: 988507 - RNA, 19 nt, Homo sapiens
auaaagccauugaagauca

SEQ ID NO: 988508 - RNA, 19 nt, Homo sapiens
cgaagagcuugaugaggaa

SEQ ID NO: 988509 - RNA, 19 nt, Homo sapiens
gguuguuucuuaaaugcua

SEQ ID NO: 988510 - RNA, 19 nt, Homo sapiens
uuacaaacaccaauagaga

SEQ ID NO: 988511 - RNA, 19 nt, Homo sapiens
uauguauacuccagaagaa

SEQ ID NO: 988512 - RNA, 19 nt, Homo sapiens
gauaauacaggcagauucu

SEQ ID NO: 988513 - RNA, 19 nt, Homo sapiens
gugaagauauuguaaacac

SEQ ID NO: 988514 - RNA, 19 nt, Homo sapiens
gcaaagccauguggaagac

SEQ ID NO: 988515 - RNA, 19 nt, Homo sapiens
gaaaaggauugugcucuga

SEQ ID NO: 988516 - RNA, 19 nt, Homo sapiens
cuaaggagaauaagauaga

SEQ ID NO: 988517 - RNA, 19 nt, Homo sapiens
cagauucuccucccauuau

SEQ ID NO: 988518 - RNA, 19 nt, Homo sapiens
uggaagacuuucugccauu

SEQ ID NO: 988519 - RNA, 19 nt, Homo sapiens
auuggcagcuagacaguua

SEQ ID NO: 988520 - RNA, 19 nt, Homo sapiens
gaaucagccaccucggaua

SEQ ID NO: 988521 - RNA, 19 nt, Homo sapiens
agagcucugucucacauuu

SEQ ID NO: 988522 - RNA, 19 nt, Homo sapiens
cuacuaaggagaauaagau

SEQ ID NO: 988523 - RNA, 19 nt, Homo sapiens
gagauaauacaggcagauu

SEQ ID NO: 988524 - RNA, 19 nt, Homo sapiens
ggcagauucuccucccauu

SEQ ID NO: 988525 - RNA, 19 nt, Homo sapiens
guauacuccagaagaauuu

SEQ ID NO: 988526 - RNA, 19 nt, Homo sapiens
gguauugaccgaagagcuu

SEQ ID NO: 988527 - RNA, 19 nt, Homo sapiens
gaaugcuguucccaagaau

SEQ ID NO: 988528 - RNA, 19 nt, Homo sapiens
uaacaggagccagacauau

SEQ ID NO: 988529 - RNA, 19 nt, Homo sapiens
ggaaaaggagcgagaagaa

SEQ ID NO: 988530 - RNA, 19 nt, Homo sapiens
caaaagagacgggaaaaga

SEQ ID NO: 988531 - RNA, 19 nt, Homo sapiens
agauucuccucccauuaua

SEQ ID NO: 988532 - RNA, 19 nt, Homo sapiens
gaaggaguugcaagccaaa

SEQ ID NO: 988533 - RNA, 19 nt, Homo sapiens
gaagaacggauagcugaag

SEQ ID NO: 988534 - RNA, 19 nt, Homo sapiens
caaacaccaauagagauaa

SEQ ID NO: 988535 - RNA, 19 nt, Homo sapiens
gugguugccuugagaaguc

SEQ ID NO: 988536 - RNA, 19 nt, Homo sapiens
uggcuggaacugaguauuu

SEQ ID NO: 988537 - RNA, 19 nt, Homo sapiens
gcuuaggagaacauuauaa

SEQ ID NO: 988538 - RNA, 19 nt, Homo sapiens
ugagaaggcaucgcaaaga

SEQ ID NO: 988539 - RNA, 19 nt, Homo sapiens
gcugagaaggcaucgcaaa

SEQ ID NO: 988540 - RNA, 19 nt, Homo sapiens
ggagccagacauauggaaa

SEQ ID NO: 988541 - RNA, 19 nt, Homo sapiens
gcuguuaacauuucaaacu

SEQ ID NO: 988542 - RNA, 19 nt, Homo sapiens
agauauguauacuccagaa

SEQ ID NO: 988543 - RNA, 19 nt, Homo sapiens
ggaacuggagcaauugaag

SEQ ID NO: 988544 - RNA, 19 nt, Homo sapiens
ucagaaguacugugaagau

SEQ ID NO: 988545 - RNA, 19 nt, Homo sapiens
gcagcucaccgaagaugug

SEQ ID NO: 988546 - RNA, 19 nt, Homo sapiens
uguauaaagccauugaaga

SEQ ID NO: 988547 - RNA, 19 nt, Homo sapiens
aaauggaacagaaacauag

SEQ ID NO: 988548 - RNA, 19 nt, Homo sapiens
gcacaaaagagacgggaaa

SEQ ID NO: 988549 - RNA, 19 nt, Homo sapiens
gaggaacuggagcaauuga

SEQ ID NO: 988550 - RNA, 19 nt, Homo sapiens
ccaagaaugacaagaagag

SEQ ID NO: 988551 - RNA, 19 nt, Homo sapiens
gacugugguugccuugaga

SEQ ID NO: 988552 - RNA, 19 nt, Homo sapiens
cagcuagacaguuagaaau

SEQ ID NO: 988553 - RNA, 19 nt, Homo sapiens
ucaaauauuggcagcuaga

SEQ ID NO: 988554 - RNA, 19 nt, Homo sapiens
agacauauggaaagugaga

SEQ ID NO: 988555 - RNA, 19 nt, Homo sapiens
ggaaaagaaagcugcauug

SEQ ID NO: 988556 - RNA, 19 nt, Homo sapiens
guguugggguuguuucuua

SEQ ID NO: 988557 - RNA, 19 nt, Homo sapiens
uggcuuaggagaacauuau

SEQ ID NO: 988558 - RNA, 19 nt, Homo sapiens
guauguauaaagccauuga

SEQ ID NO: 988559 - RNA, 19 nt, Homo sapiens
uuaacaggagccagacaua

SEQ ID NO: 988560 - RNA, 19 nt, Homo sapiens
ucagccaccucggauauca

SEQ ID NO: 988561 - RNA, 19 nt, Homo sapiens
acaugcauauggcuuagga

SEQ ID NO: 988562 - RNA, 19 nt, Homo sapiens
agaaguacugugaagauau

SEQ ID NO: 988563 - RNA, 19 nt, Homo sapiens
agaagaauuucagaaguac

SEQ ID NO: 988564 - RNA, 19 nt, Homo sapiens
aaagccauguggaagacuu

SEQ ID NO: 988565 - RNA, 19 nt, Homo sapiens
ugaccgaagagcuugauga

SEQ ID NO: 988566 - RNA, 19 nt, Homo sapiens
uguauacuccagaagaauu

SEQ ID NO: 988567 - RNA, 19 nt, Homo sapiens
gguuggguaaacauaguua

SEQ ID NO: 988568 - RNA, 19 nt, Homo sapiens
ccaguggacuuccuguuua

SEQ ID NO: 988569 - RNA, 19 nt, Homo sapiens
gaaacccuguagccauuaa

SEQ ID NO: 988570 - RNA, 19 nt, Homo sapiens
uaacuaaggugaagcugau

SEQ ID NO: 988571 - RNA, 19 nt, Homo sapiens
gaacgaaugggauaggauu

SEQ ID NO: 988572 - RNA, 19 nt, Homo sapiens
cuugggaccuuuccaguua

SEQ ID NO: 988573 - RNA, 19 nt, Homo sapiens
uaaggacucagaagaaaua

SEQ ID NO: 988574 - RNA, 19 nt, Homo sapiens
gaacaauucaguggcauuu

SEQ ID NO: 988575 - RNA, 19 nt, Homo sapiens
agagggagcugaagaagga

SEQ ID NO: 988576 - RNA, 19 nt, Homo sapiens
ugagagcucugaagaugaa

SEQ ID NO: 988577 - RNA, 19 nt, Homo sapiens
ugggagggcuuccuuauga

SEQ ID NO: 988578 - RNA, 19 nt, Homo sapiens
gaagaaaagaccaggauua

SEQ ID NO: 988579 - RNA, 19 nt, Homo sapiens
gaucaugugucuaacuauc

SEQ ID NO: 988580 - RNA, 19 nt, Homo sapiens
cagaagaaauagaugaugu

SEQ ID NO: 988581 - RNA, 19 nt, Homo sapiens
gagcacaaguccucaagca

SEQ ID NO: 988582 - RNA, 19 nt, Homo sapiens
agagagagcucagaaguca

SEQ ID NO: 988583 - RNA, 19 nt, Homo sapiens
ggacagcgccuggaucuuc

SEQ ID NO: 988584 - RNA, 19 nt, Homo sapiens
gaguauguauccugaacuu

SEQ ID NO: 988585 - RNA, 19 nt, Homo sapiens
ucaguugggugguuacuau

SEQ ID NO: 988586 - RNA, 19 nt, Homo sapiens
gauaaaucccauaggcaua

SEQ ID NO: 988587 - RNA, 19 nt, Homo sapiens
gaagaaauagaugauguga

SEQ ID NO: 988588 - RNA, 19 nt, Homo sapiens
ggacucagaagaaauagau

SEQ ID NO: 988589 - RNA, 19 nt, Homo sapiens
caaauucaguugggugguu

SEQ ID NO: 988590 - RNA, 19 nt, Homo sapiens
gaaguaggagccgagauaa

SEQ ID NO: 988591 - RNA, 19 nt, Homo sapiens
ucaccaaguuugucugaga

SEQ ID NO: 988592 - RNA, 19 nt, Homo sapiens
ccuaaggacucagaagaaa

SEQ ID NO: 988593 - RNA, 19 nt, Homo sapiens
gaguggaucaugugucuaa

SEQ ID NO: 988594 - RNA, 19 nt, Homo sapiens
gaccagaggagcacaauuc

SEQ ID NO: 988595 - RNA, 19 nt, Homo sapiens
gaugugaacgaaugggaua

SEQ ID NO: 988596 - RNA, 19 nt, Homo sapiens
agaaguaggagccgagaua

SEQ ID NO: 988597 - RNA, 19 nt, Homo sapiens
ggacaucaucuguguguuc

SEQ ID NO: 988598 - RNA, 19 nt, Homo sapiens
guauguauccugaacuuug

SEQ ID NO: 988599 - RNA, 19 nt, Homo sapiens
gacuucagcugcacaguag

SEQ ID NO: 988600 - RNA, 19 nt, Homo sapiens
gaaagccgaccgggaggua

SEQ ID NO: 988601 - RNA, 19 nt, Homo sapiens
ucugagagcucugaagaug

SEQ ID NO: 988602 - RNA, 19 nt, Homo sapiens
uggaucaugugucuaacua

SEQ ID NO: 988603 - RNA, 19 nt, Homo sapiens
gcaagacaguaaaggaaaa

SEQ ID NO: 988604 - RNA, 19 nt, Homo sapiens
uagaugaugugaccagaca

SEQ ID NO: 988605 - RNA, 19 nt, Homo sapiens
ugggagggcugcaguuuca

SEQ ID NO: 988606 - RNA, 19 nt, Homo sapiens
aaauucaguugggugguua

SEQ ID NO: 988607 - RNA, 19 nt, Homo sapiens
gcacauucuagcugguaua

SEQ ID NO: 988608 - RNA, 19 nt, Homo sapiens
uaaaugcagucaaauucag

SEQ ID NO: 988609 - RNA, 19 nt, Homo sapiens
gagcaaccauccucuucgu

SEQ ID NO: 988610 - RNA, 19 nt, Homo sapiens
gaucaaaggaagaacuauc

SEQ ID NO: 988611 - RNA, 19 nt, Homo sapiens
caucaucuguguguucuca

SEQ ID NO: 988612 - RNA, 19 nt, Homo sapiens
gggagggcuuccuuaugaa

SEQ ID NO: 988613 - RNA, 19 nt, Homo sapiens
ggaugacacuggcccuaag

SEQ ID NO: 988614 - RNA, 19 nt, Homo sapiens
gaucaacgagcugaaugaa

SEQ ID NO: 988615 - RNA, 19 nt, Homo sapiens
gagggaggcaagagaagaa

SEQ ID NO: 988616 - RNA, 19 nt, Homo sapiens
gaauucuagucuucguguu

SEQ ID NO: 988617 - RNA, 19 nt, Homo sapiens
uaaaucccauaggcauaaa

SEQ ID NO: 988618 - RNA, 19 nt, Homo sapiens
uuggacagcuugaugugaa

SEQ ID NO: 988619 - RNA, 19 nt, Homo sapiens
cuaacuaucgggcuccuaa

SEQ ID NO: 988620 - RNA, 19 nt, Homo sapiens
augaaacccuguagccauu

SEQ ID NO: 988621 - RNA, 19 nt, Homo sapiens
acaauucaguggcauuugg

SEQ ID NO: 988622 - RNA, 19 nt, Homo sapiens
ggaacaauucaguggcauu

SEQ ID NO: 988623 - RNA, 19 nt, Homo sapiens
gcaggagggaggcaagaga

SEQ ID NO: 988624 - RNA, 19 nt, Homo sapiens
ggcagaagcuccccaaauc

SEQ ID NO: 988625 - RNA, 19 nt, Homo sapiens
cagcaagaacucagagaga

SEQ ID NO: 988626 - RNA, 19 nt, Homo sapiens
cagcugcacaguagauuug

SEQ ID NO: 988627 - RNA, 19 nt, Homo sapiens
agacuucagcugcacagua

SEQ ID NO: 988628 - RNA, 19 nt, Homo sapiens
caguggacuuccuguuuau

SEQ ID NO: 988629 - RNA, 19 nt, Homo sapiens
ggagggaggcaagagaaga

SEQ ID NO: 988630 - RNA, 19 nt, Homo sapiens
ggagguacaggcagagcaa

SEQ ID NO: 988631 - RNA, 19 nt, Homo sapiens
uuuauggguuugccuauuc

SEQ ID NO: 988632 - RNA, 19 nt, Homo sapiens
guuuauggguuugccuauu

SEQ ID NO: 988633 - RNA, 19 nt, Homo sapiens
cagaguauguauccugaac

SEQ ID NO: 988634 - RNA, 19 nt, Homo sapiens
auaaaucccauaggcauaa

SEQ ID NO: 988635 - RNA, 19 nt, Homo sapiens
gcacagcagcaagaacuca

SEQ ID NO: 988636 - RNA, 19 nt, Homo sapiens
gacaucaucuguguguucu

SEQ ID NO: 988637 - RNA, 19 nt, Homo sapiens
ccgaguggaucaugugucu

SEQ ID NO: 988638 - RNA, 19 nt, Homo sapiens
gaagaccagaggagcacaa

SEQ ID NO: 988639 - RNA, 19 nt, Homo sapiens
aggugaagcugaucaacga

SEQ ID NO: 988640 - RNA, 19 nt, Homo sapiens
cguguuagauguuuauagc

SEQ ID NO: 988641 - RNA, 19 nt, Homo sapiens
guucuucgaaucccaguga

SEQ ID NO: 988642 - RNA, 19 nt, Homo sapiens
uauagaaguagaaguagga

SEQ ID NO: 988643 - RNA, 19 nt, Homo sapiens
ucagagagagcucagaagu

SEQ ID NO: 988644 - RNA, 19 nt, Homo sapiens
gauucuguuuccucugcua

SEQ ID NO: 988645 - RNA, 19 nt, Homo sapiens
uauaaugggcguucugaag

SEQ ID NO: 988646 - RNA, 19 nt, Homo sapiens
gguauaaugggcguucuga

SEQ ID NO: 988647 - RNA, 19 nt, Homo sapiens
cauugccucugucuaguuc

SEQ ID NO: 988648 - RNA, 19 nt, Homo sapiens
guguaaccauugccucugu

SEQ ID NO: 988649 - RNA, 19 nt, Homo sapiens
acaguguuguguaaccauu

SEQ ID NO: 988650 - RNA, 19 nt, Homo sapiens
aauucuagucuucguguua

SEQ ID NO: 988651 - RNA, 19 nt, Homo sapiens
gaugacacuggcccuaaga

SEQ ID NO: 988652 - RNA, 19 nt, Homo sapiens
ggaccuuuccaguuacuag

SEQ ID NO: 988653 - RNA, 19 nt, Homo sapiens
gggcuuccuuaugaacuga

SEQ ID NO: 988654 - RNA, 19 nt, Homo sapiens
ggggagauuguuaacauua

SEQ ID NO: 988655 - RNA, 19 nt, Homo sapiens
auaugccucuuuccacauu

SEQ ID NO: 988656 - RNA, 19 nt, Homo sapiens
gugaacgaaugggauagga

SEQ ID NO: 988657 - RNA, 19 nt, Homo sapiens
aguaggagccgagauaaau

SEQ ID NO: 988658 - RNA, 19 nt, Homo sapiens
uagagagggagcugaagaa

SEQ ID NO: 988659 - RNA, 19 nt, Homo sapiens
agagagcucagaagucaga

SEQ ID NO: 988660 - RNA, 19 nt, Homo sapiens
cuaagaagcacagcagcaa

SEQ ID NO: 988661 - RNA, 19 nt, Homo sapiens
ggguuugccuauucuggau

SEQ ID NO: 988662 - RNA, 19 nt, Homo sapiens
uuaaagggaacaauucagu

SEQ ID NO: 988663 - RNA, 19 nt, Homo sapiens
uauguauccugaacuuugg

SEQ ID NO: 988664 - RNA, 19 nt, Homo sapiens
ucuguuuccucugcuauga

SEQ ID NO: 988665 - RNA, 19 nt, Homo sapiens
caagaaaacugggaaaucc

SEQ ID NO: 988666 - RNA, 19 nt, Homo sapiens
guaggagccgagauaaauc

SEQ ID NO: 988667 - RNA, 19 nt, Homo sapiens
cuagagagggagcugaaga

SEQ ID NO: 988668 - RNA, 19 nt, Homo sapiens
gaacagaacuugccacaua

SEQ ID NO: 988669 - RNA, 19 nt, Homo sapiens
gaaagaaguuuggaucuca

SEQ ID NO: 988670 - RNA, 19 nt, Homo sapiens
gaagaugccuagagaaugg

SEQ ID NO: 988671 - RNA, 19 nt, Homo sapiens
caaccuuucuuguuaguaa

SEQ ID NO: 988672 - RNA, 19 nt, Homo sapiens
gaaaacagcaaucuucuua

SEQ ID NO: 988673 - RNA, 19 nt, Homo sapiens
gaaagauuguuacugugaa

SEQ ID NO: 988674 - RNA, 19 nt, Homo sapiens
caaagacuauaggcaauaa

SEQ ID NO: 988675 - RNA, 19 nt, Homo sapiens
aaacagcaaucuucuuaug

SEQ ID NO: 988676 - RNA, 19 nt, Homo sapiens
caaauauuguggagaauuc

SEQ ID NO: 988677 - RNA, 19 nt, Homo sapiens
ggaaagauuguuacuguga

SEQ ID NO: 988678 - RNA, 19 nt, Homo sapiens
ccuagagaauggcaauuua

SEQ ID NO: 988679 - RNA, 19 nt, Homo sapiens
gaugcagacucuucuuauu

SEQ ID NO: 988680 - RNA, 19 nt, Homo sapiens
uaucauaucuguaccucuu

SEQ ID NO: 988681 - RNA, 19 nt, Homo sapiens
gauaugacuuugcuuccaa

SEQ ID NO: 988682 - RNA, 19 nt, Homo sapiens
gaaaagagcaccuguacuu

SEQ ID NO: 988683 - RNA, 19 nt, Homo sapiens
aaugggagcugacugauau

SEQ ID NO: 988684 - RNA, 19 nt, Homo sapiens
ggucaacaaugguggaaug

SEQ ID NO: 988685 - RNA, 19 nt, Homo sapiens
ugacuuugcuuccaacaug

SEQ ID NO: 988686 - RNA, 19 nt, Homo sapiens
gaaugggagcugacugaua

SEQ ID NO: 988687 - RNA, 19 nt, Homo sapiens
ggaccugugcaaucaaaua

SEQ ID NO: 988688 - RNA, 19 nt, Homo sapiens
aaggaaagauuguuacugu

SEQ ID NO: 988689 - RNA, 19 nt, Homo sapiens
ccaaugauuugaaagaagu

SEQ ID NO: 988690 - RNA, 19 nt, Homo sapiens
ggagaccagucccacaaga

SEQ ID NO: 988691 - RNA, 19 nt, Homo sapiens
cagcuuggaugucuacaga

SEQ ID NO: 988692 - RNA, 19 nt, Homo sapiens
gacaaaacaugacugaaaa

SEQ ID NO: 988693 - RNA, 19 nt, Homo sapiens
gcuuggaugucuacagaaa

SEQ ID NO: 988694 - RNA, 19 nt, Homo sapiens
cagcauggccaaugauuug

SEQ ID NO: 988695 - RNA, 19 nt, Homo sapiens
gugaggagcuggcuuacca

SEQ ID NO: 988696 - RNA, 19 nt, Homo sapiens
ugaauagcauccuggguau

SEQ ID NO: 988697 - RNA, 19 nt, Homo sapiens
gcuaauagagcuuaacuac

SEQ ID NO: 988698 - RNA, 19 nt, Homo sapiens
cgacacugguucccaugaa

SEQ ID NO: 988699 - RNA, 19 nt, Homo sapiens
gcaaucuucuuaugcuucu

SEQ ID NO: 988700 - RNA, 19 nt, Homo sapiens
ggccaaugauuugaaagaa

SEQ ID NO: 988701 - RNA, 19 nt, Homo sapiens
aaaagaagaugccuagaga

SEQ ID NO: 988702 - RNA, 19 nt, Homo sapiens
uaaucagcauggccaauga

SEQ ID NO: 988703 - RNA, 19 nt, Homo sapiens
aagcaaggaaagauuguua

SEQ ID NO: 988704 - RNA, 19 nt, Homo sapiens
gauaccagcuuggaugucu

SEQ ID NO: 988705 - RNA, 19 nt, Homo sapiens
cuucuuaugcuucugaaua

SEQ ID NO: 988706 - RNA, 19 nt, Homo sapiens
gcagacucuucuuauuuua

SEQ ID NO: 988707 - RNA, 19 nt, Homo sapiens
ggaugcagacucuucuuau

SEQ ID NO: 988708 - RNA, 19 nt, Homo sapiens
gaggaagcaaggaaagauu

SEQ ID NO: 988709 - RNA, 19 nt, Homo sapiens
cauggccaaugauuugaaa

SEQ ID NO: 988710 - RNA, 19 nt, Homo sapiens
uggcuuaccaguugucuaa

SEQ ID NO: 988711 - RNA, 19 nt, Homo sapiens
cacaaagacuauaggcaau

SEQ ID NO: 988712 - RNA, 19 nt, Homo sapiens
cuagagaauggcaauuuaa

SEQ ID NO: 988713 - RNA, 19 nt, Homo sapiens
ggauugagaacuuuaagag

SEQ ID NO: 988714 - RNA, 19 nt, Homo sapiens
cagaaugggagcugacuga

SEQ ID NO: 988715 - RNA, 19 nt, Homo sapiens
uuaauggccuucgaacaga

SEQ ID NO: 988716 - RNA, 19 nt, Homo sapiens
ccaugaagcggcuaccaaa

SEQ ID NO: 988717 - RNA, 19 nt, Homo sapiens
agaaaaggauugagaacuu

SEQ ID NO: 988718 - RNA, 19 nt, Homo sapiens
gaucucagaacaaccuuuc

SEQ ID NO: 988719 - RNA, 19 nt, Homo sapiens
ugaaagaaguuuggaucuc

SEQ ID NO: 988720 - RNA, 19 nt, Homo sapiens
gccaaugauuugaaagaag

SEQ ID NO: 988721 - RNA, 19 nt, Homo sapiens
guggauaaccaacaagaug

SEQ ID NO: 988722 - RNA, 19 nt, Homo sapiens
acaaagacuauaggcaaua

SEQ ID NO: 988723 - RNA, 19 nt, Homo sapiens
gaccugugcaaucaaauau

SEQ ID NO: 988724 - RNA, 19 nt, Homo sapiens
gagaggaagcaaggaaaga

SEQ ID NO: 988725 - RNA, 19 nt, Homo sapiens
aagaagaugccuagagaau

SEQ ID NO: 988726 - RNA, 19 nt, Homo sapiens
gaccagucccacaagauga

SEQ ID NO: 988727 - RNA, 19 nt, Homo sapiens
uaauggccuucgaacagaa

SEQ ID NO: 988728 - RNA, 19 nt, Homo sapiens
gaagcaaggaaagauuguu

SEQ ID NO: 988729 - RNA, 19 nt, Homo sapiens
ggaagcaaggaaagauugu

SEQ ID NO: 988730 - RNA, 19 nt, Homo sapiens
augcagacucuucuuauuu

SEQ ID NO: 988731 - RNA, 19 nt, Homo sapiens
gaaaagaagaugccuagag

SEQ ID NO: 988732 - RNA, 19 nt, Homo sapiens
gccuagagaauggcaauuu

SEQ ID NO: 988733 - RNA, 19 nt, Homo sapiens
cauccuggguaucauaucu

SEQ ID NO: 988734 - RNA, 19 nt, Homo sapiens
cuacagaaagcuaauagag

SEQ ID NO: 988735 - RNA, 19 nt, Homo sapiens
ccaggaguuugguagaauc

SEQ ID NO: 988736 - RNA, 19 nt, Homo sapiens
gcuucugaauaaucaaaga

SEQ ID NO: 988737 - RNA, 19 nt, Homo sapiens
ggaagaaaaggauugagaa

SEQ ID NO: 988738 - RNA, 19 nt, Homo sapiens
gacuauaggcaauaaugga

SEQ ID NO: 988739 - RNA, 19 nt, Homo sapiens
uagcauccuggguaucaua

SEQ ID NO: 988740 - RNA, 19 nt, Homo sapiens
acuaggaguuucucuugug

SEQ ID NO: 988741 - RNA, 19 nt, Homo sapiens
ggaugucuacagaaagcua

SEQ ID NO: 988742 - RNA, 19 nt, Homo sapiens
agacaaaacaugacugaaa

SEQ ID NO: 988743 - RNA, 19 nt, Homo sapiens
uggaugcagacucuucuua

SEQ ID NO: 988744 - RNA, 19 nt, Homo sapiens
gcaaggaaagauuguuacu

SEQ ID NO: 988745 - RNA, 19 nt, Homo sapiens
gaccugaccgacacugguu

SEQ ID NO: 988746 - RNA, 19 nt, Homo sapiens
gugugcggcugauguuaau

SEQ ID NO: 988747 - RNA, 19 nt, Homo sapiens
ggagaaauggaaaacauga

SEQ ID NO: 988748 - RNA, 19 nt, Homo sapiens
ccaacaagauggggaagaa

SEQ ID NO: 988749 - RNA, 19 nt, Homo sapiens
guaacauauuuguggcaau

SEQ ID NO: 988750 - RNA, 19 nt, Homo sapiens
gcauggccaaugauuugaa

SEQ ID NO: 988751 - RNA, 19 nt, Homo sapiens
ccagguauaauaguuucua

SEQ ID NO: 988752 - RNA, 19 nt, Homo sapiens
ucauaucuguaccucuuuc

SEQ ID NO: 988753 - RNA, 19 nt, Homo sapiens
gacacugguucccaugaag

SEQ ID NO: 988754 - RNA, 19 nt, Homo sapiens
gaugucuacagaaagcuaa

SEQ ID NO: 988755 - RNA, 19 nt, Homo sapiens
ugaagcggcuaccaaagcu

SEQ ID NO: 988756 - RNA, 19 nt, Homo sapiens
gaaguuuggaucucagaac

SEQ ID NO: 988757 - RNA, 19 nt, Homo sapiens
gagaauggcaauuuaaaag

SEQ ID NO: 988758 - RNA, 19 nt, Homo sapiens
uaagagugguguggaugca

SEQ ID NO: 988759 - RNA, 19 nt, Homo sapiens
ucagcauggccaaugauuu

SEQ ID NO: 988760 - RNA, 19 nt, Homo sapiens
gagaccagucccacaagau

SEQ ID NO: 988761 - RNA, 19 nt, Homo sapiens
gcuggagaagucacaaaga

SEQ ID NO: 988762 - RNA, 19 nt, Homo sapiens
gcuuaccaguugucuaaac

SEQ ID NO: 988763 - RNA, 19 nt, Homo sapiens
ugcagacucuucuuauuuu

SEQ ID NO: 988764 - RNA, 19 nt, Homo sapiens
gauugagaacuuuaagagu

SEQ ID NO: 988765 - RNA, 19 nt, Homo sapiens
acuggagccucgaguggaa

SEQ ID NO: 988766 - RNA, 19 nt, Homo sapiens
ucgacauucuggucaacaa

SEQ ID NO: 988767 - RNA, 19 nt, Homo sapiens
caaggaaagauuguuacug

SEQ ID NO: 988768 - RNA, 19 nt, Homo sapiens
gggcuuaccuguugcuuua

SEQ ID NO: 988769 - RNA, 19 nt, Homo sapiens
uaaugaagcugcucaaauu

SEQ ID NO: 988770 - RNA, 19 nt, Homo sapiens
gagaugcaguucuuaauga

SEQ ID NO: 988771 - RNA, 19 nt, Homo sapiens
gaagacagagggaauuuaa

SEQ ID NO: 988772 - RNA, 19 nt, Homo sapiens
ucagagagcuacagacaaa

SEQ ID NO: 988773 - RNA, 19 nt, Homo sapiens
aaagagggcuuaccuguug

SEQ ID NO: 988774 - RNA, 19 nt, Homo sapiens
gauguuaacuguccuuuca

SEQ ID NO: 988775 - RNA, 19 nt, Homo sapiens
gguauguucuagagauuua

SEQ ID NO: 988776 - RNA, 19 nt, Homo sapiens
gcuauugacuggcuucuug

SEQ ID NO: 988777 - RNA, 19 nt, Homo sapiens
uaacuguccuuucaagauu

SEQ ID NO: 988778 - RNA, 19 nt, Homo sapiens
gaugaacacuugaggacuu

SEQ ID NO: 988779 - RNA, 19 nt, Homo sapiens
gcaaagaugaaacagaauu

SEQ ID NO: 988780 - RNA, 19 nt, Homo sapiens
caccauugcuuauugcuuu

SEQ ID NO: 988781 - RNA, 19 nt, Homo sapiens
gauucaagaucgacaagaa

SEQ ID NO: 988782 - RNA, 19 nt, Homo sapiens
guuggaagaugaacacuug

SEQ ID NO: 988783 - RNA, 19 nt, Homo sapiens
cugcaaagaugaaacagaa

SEQ ID NO: 988784 - RNA, 19 nt, Homo sapiens
ugacuggcuucuugguuua

SEQ ID NO: 988785 - RNA, 19 nt, Homo sapiens
gacuucagcuucucaccua

SEQ ID NO: 988786 - RNA, 19 nt, Homo sapiens
gcacauagaggagcucaga

SEQ ID NO: 988787 - RNA, 19 nt, Homo sapiens
ggagaugcaguucuuaaug

SEQ ID NO: 988788 - RNA, 19 nt, Homo sapiens
gggaaaaguuggaagauga

SEQ ID NO: 988789 - RNA, 19 nt, Homo sapiens
cuacaagauugaagacaga

SEQ ID NO: 988790 - RNA, 19 nt, Homo sapiens
gauuuaccaccauugcuua

SEQ ID NO: 988791 - RNA, 19 nt, Homo sapiens
auacacuucuggcauguuu

SEQ ID NO: 988792 - RNA, 19 nt, Homo sapiens
uuaccaccauugcuuauug

SEQ ID NO: 988793 - RNA, 19 nt, Homo sapiens
cacaggagaugcaguucuu

SEQ ID NO: 988794 - RNA, 19 nt, Homo sapiens
caacgaagccauaguagcu

SEQ ID NO: 988795 - RNA, 19 nt, Homo sapiens
agacagagggaauuuaaga

SEQ ID NO: 988796 - RNA, 19 nt, Homo sapiens
aaucaacgaagccauagua

SEQ ID NO: 988797 - RNA, 19 nt, Homo sapiens
agacuugaauauggagaua

SEQ ID NO: 988798 - RNA, 19 nt, Homo sapiens
agacaaacauauucuuggu

SEQ ID NO: 988799 - RNA, 19 nt, Homo sapiens
cuucuugguuuagcuguua

SEQ ID NO: 988800 - RNA, 19 nt, Homo sapiens
agagggaauuuaagaaaca

SEQ ID NO: 988801 - RNA, 19 nt, Homo sapiens
cuagagauuuaccaccauu

SEQ ID NO: 988802 - RNA, 19 nt, Homo sapiens
ggaggaagcccagaaaauu

SEQ ID NO: 988803 - RNA, 19 nt, Homo sapiens
uggcuaaccugcuucagau

SEQ ID NO: 988804 - RNA, 19 nt, Homo sapiens
ugguuuagcuguuagacuu

SEQ ID NO: 988805 - RNA, 19 nt, Homo sapiens
caacugcaaagaugaaaca

SEQ ID NO: 988806 - RNA, 19 nt, Homo sapiens
gguaaugcuuaaggcaauu

SEQ ID NO: 988807 - RNA, 19 nt, Homo sapiens
uugacuggcuucuugguuu

SEQ ID NO: 988808 - RNA, 19 nt, Homo sapiens
acagagggaauuuaagaaa

SEQ ID NO: 988809 - RNA, 19 nt, Homo sapiens
gaaaauuggguauguucua

SEQ ID NO: 988810 - RNA, 19 nt, Homo sapiens
ggauuuaguaccugauaau

SEQ ID NO: 988811 - RNA, 19 nt, Homo sapiens
ugacggcucucgacuacca

SEQ ID NO: 988812 - RNA, 19 nt, Homo sapiens
ugacacaggagaugcaguu

SEQ ID NO: 988813 - RNA, 19 nt, Homo sapiens
caggagaugcaguucuuaa

SEQ ID NO: 988814 - RNA, 19 nt, Homo sapiens
caagaucgacaagaagcua

SEQ ID NO: 988815 - RNA, 19 nt, Homo sapiens
guugacggcucucgacuac

SEQ ID NO: 988816 - RNA, 19 nt, Homo sapiens
ugaagcugcucaaauucug

SEQ ID NO: 988817 - RNA, 19 nt, Homo sapiens
gcuuaccuguugcuuuaga

SEQ ID NO: 988818 - RNA, 19 nt, Homo sapiens
gcuguuagacuugaauaug

SEQ ID NO: 988819 - RNA, 19 nt, Homo sapiens
ggcuucaacugcaaagaug

SEQ ID NO: 988820 - RNA, 19 nt, Homo sapiens
ugaagacagagggaauuua

SEQ ID NO: 988821 - RNA, 19 nt, Homo sapiens
cagagggaauuuaagaaac

SEQ ID NO: 988822 - RNA, 19 nt, Homo sapiens
gacagagggaauuuaagaa

SEQ ID NO: 988823 - RNA, 19 nt, Homo sapiens
uuaaugaagcugcucaaau

SEQ ID NO: 988824 - RNA, 19 nt, Homo sapiens
agaugcaguucuuaaugaa

SEQ ID NO: 988825 - RNA, 19 nt, Homo sapiens
cuaaccugcuucagauuca

SEQ ID NO: 988826 - RNA, 19 nt, Homo sapiens
cgacuggcccaaguucuuu

SEQ ID NO: 988827 - RNA, 19 nt, Homo sapiens
cuaaggcaaaucaaacaaa

SEQ ID NO: 988828 - RNA, 19 nt, Homo sapiens
gcuaaccugcuucagauuc

SEQ ID NO: 988829 - RNA, 19 nt, Homo sapiens
auacaaggauuuaguaccu

SEQ ID NO: 988830 - RNA, 19 nt, Homo sapiens
cuucuggcauguuuggaaa

SEQ ID NO: 988831 - RNA, 19 nt, Homo sapiens
gacaaacauauucuugguu

SEQ ID NO: 988832 - RNA, 19 nt, Homo sapiens
uggcccaaguucuuugaaa

SEQ ID NO: 988833 - RNA, 19 nt, Homo sapiens
aauuauugcugauccaaag

SEQ ID NO: 988834 - RNA, 19 nt, Homo sapiens
cugcucaaauucugcgauu

SEQ ID NO: 988835 - RNA, 19 nt, Homo sapiens
gcgacuggcccaaguucuu

SEQ ID NO: 988836 - RNA, 19 nt, Homo sapiens
uggcauguuuggaaaucaa

SEQ ID NO: 988837 - RNA, 19 nt, Homo sapiens
ugcgauugcugcacauaga

SEQ ID NO: 988838 - RNA, 19 nt, Homo sapiens
gcuaaggcaaaucaaacaa

SEQ ID NO: 988839 - RNA, 19 nt, Homo sapiens
aggcuggugugauggcuuu

SEQ ID NO: 988840 - RNA, 19 nt, Homo sapiens
gcuuaaggcaauucggauu

SEQ ID NO: 988841 - RNA, 19 nt, Homo sapiens
gagggaauuuaagaaacau

SEQ ID NO: 988842 - RNA, 19 nt, Homo sapiens
cagauucagcgucaugaug

SEQ ID NO: 988843 - RNA, 19 nt, Homo sapiens
gaggaagcccagaaaauug

SEQ ID NO: 988844 - RNA, 19 nt, Homo sapiens
guugggaaccauacacuuc

SEQ ID NO: 988845 - RNA, 19 nt, Homo sapiens
gcucaaauucugcgauugc

SEQ ID NO: 988846 - RNA, 19 nt, Homo sapiens
cuuaaggcaauucggauuu

SEQ ID NO: 988847 - RNA, 19 nt, Homo sapiens
cugcugacaaugcaacuaa

SEQ ID NO: 988848 - RNA, 19 nt, Homo sapiens
aggauuuaguaccugauaa

SEQ ID NO: 988849 - RNA, 19 nt, Homo sapiens
gauugaagacagagggaau

SEQ ID NO: 988850 - RNA, 19 nt, Homo sapiens
auauggagauaaugcugaa

SEQ ID NO: 988851 - RNA, 19 nt, Homo sapiens
gaucgacaagaagcuauug

SEQ ID NO: 988852 - RNA, 19 nt, Homo sapiens
acauagaggagcucagaga

SEQ ID NO: 988853 - RNA, 19 nt, Homo sapiens
cacaggaugcaguugcuaa

SEQ ID NO: 988854 - RNA, 19 nt, Homo sapiens
ugguaaugcuuaaggcaau

SEQ ID NO: 988855 - RNA, 19 nt, Homo sapiens
ggcuuuggcuaaccugcuu

SEQ ID NO: 988856 - RNA, 19 nt, Homo sapiens
uguuagacuugaauaugga

SEQ ID NO: 988857 - RNA, 19 nt, Homo sapiens
guuuagcuguuagacuuga

SEQ ID NO: 988858 - RNA, 19 nt, Homo sapiens
uuaacuguccuuucaagau

SEQ ID NO: 988859 - RNA, 19 nt, Homo sapiens
gcagcgacuggcccaaguu

SEQ ID NO: 988860 - RNA, 19 nt, Homo sapiens
caagauucaagaucgacaa

SEQ ID NO: 988861 - RNA, 19 nt, Homo sapiens
uggguauguucuagagauu

SEQ ID NO: 988862 - RNA, 19 nt, Homo sapiens
guagcuguucaggcaauua

SEQ ID NO: 988863 - RNA, 19 nt, Homo sapiens
gcuuuagacaaacauauuc

SEQ ID NO: 988864 - RNA, 19 nt, Homo sapiens
ggcccaaguucuuugaaaa

SEQ ID NO: 988865 - RNA, 19 nt, Homo sapiens
cuguuagacuugaauaugg

SEQ ID NO: 988866 - RNA, 19 nt, Homo sapiens
gaaaaucaggcacuacaag

SEQ ID NO: 988867 - RNA, 19 nt, Homo sapiens
uaguagcuguucaggcaau

SEQ ID NO: 988868 - RNA, 19 nt, Homo sapiens
gaacacaccugaaacuaga

SEQ ID NO: 988869 - RNA, 19 nt, Homo sapiens
cagcuuauguggucuauga

SEQ ID NO: 988870 - RNA, 19 nt, Homo sapiens
aaucacagcugaagaaaug

SEQ ID NO: 988871 - RNA, 19 nt, Homo sapiens
gaagaaggaggaacaguug

SEQ ID NO: 988872 - RNA, 19 nt, Homo sapiens
gaaugcaugugaucaccua

SEQ ID NO: 988873 - RNA, 19 nt, Homo sapiens
ggagaaauauggcaucaac

SEQ ID NO: 988874 - RNA, 19 nt, Homo sapiens
ugaaguaaaucggauauug

SEQ ID NO: 988875 - RNA, 19 nt, Homo sapiens
uaacagauaccuugugguu

SEQ ID NO: 988876 - RNA, 19 nt, Homo sapiens
caacacagauccaccaaaa

SEQ ID NO: 988877 - RNA, 19 nt, Homo sapiens
gacuaaaucccacgaauga

SEQ ID NO: 988878 - RNA, 19 nt, Homo sapiens
gaaguaaaucggauauugu

SEQ ID NO: 988879 - RNA, 19 nt, Homo sapiens
gaaacuagaggaacagcuu

SEQ ID NO: 988880 - RNA, 19 nt, Homo sapiens
caacagggcauuucagaag

SEQ ID NO: 988881 - RNA, 19 nt, Homo sapiens
ggacuaaaucccacgaaug

SEQ ID NO: 988882 - RNA, 19 nt, Homo sapiens
gaagauggacacaaagaag

SEQ ID NO: 988883 - RNA, 19 nt, Homo sapiens
ggaccuauucgucaaauca

SEQ ID NO: 988884 - RNA, 19 nt, Homo sapiens
gcugaagaaauguaugaua

SEQ ID NO: 988885 - RNA, 19 nt, Homo sapiens
caaagaagaaggaggaaca

SEQ ID NO: 988886 - RNA, 19 nt, Homo sapiens
gaacagcuuauguggucua

SEQ ID NO: 988887 - RNA, 19 nt, Homo sapiens
ggaacacaccugaaacuag

SEQ ID NO: 988888 - RNA, 19 nt, Homo sapiens
caaaaugaccugcuugaaa

SEQ ID NO: 988889 - RNA, 19 nt, Homo sapiens
aaugacaacuaccaccuuu

SEQ ID NO: 988890 - RNA, 19 nt, Homo sapiens
acagauaccuugugguuuu

SEQ ID NO: 988891 - RNA, 19 nt, Homo sapiens
gaaauauggcaucaacaca

SEQ ID NO: 988892 - RNA, 19 nt, Homo sapiens
cuaucgggauucaauguuu

SEQ ID NO: 988893 - RNA, 19 nt, Homo sapiens
gaucaccuaucgggauuca

SEQ ID NO: 988894 - RNA, 19 nt, Homo sapiens
gugaucaccuaucgggauu

SEQ ID NO: 988895 - RNA, 19 nt, Homo sapiens
acacagauccaccaaaaua

SEQ ID NO: 988896 - RNA, 19 nt, Homo sapiens
uucagaagauggacacaaa

SEQ ID NO: 988897 - RNA, 19 nt, Homo sapiens
ggaauuucaguaucugcua

SEQ ID NO: 988898 - RNA, 19 nt, Homo sapiens
gcuugaaacuuugauacau

SEQ ID NO: 988899 - RNA, 19 nt, Homo sapiens
aauauggcaucaacacaga

SEQ ID NO: 988900 - RNA, 19 nt, Homo sapiens
gaacaguugaagcuucuca

SEQ ID NO: 988901 - RNA, 19 nt, Homo sapiens
ggucuaugaggacaucuuu

SEQ ID NO: 988902 - RNA, 19 nt, Homo sapiens
ggaggaauuucaguaucug

SEQ ID NO: 988903 - RNA, 19 nt, Homo sapiens
gaaugacaacuaccaccuu

SEQ ID NO: 988904 - RNA, 19 nt, Homo sapiens
aaacuagaggaacagcuua

SEQ ID NO: 988905 - RNA, 19 nt, Homo sapiens
gggaacacaccugaaacua

SEQ ID NO: 988906 - RNA, 19 nt, Homo sapiens
cagcugaagaaauguauga

SEQ ID NO: 988907 - RNA, 19 nt, Homo sapiens
caaaaucacagcugaagaa

SEQ ID NO: 988908 - RNA, 19 nt, Homo sapiens
agaagaaggaggaacaguu

SEQ ID NO: 988909 - RNA, 19 nt, Homo sapiens
cagaagauggacacaaaga

SEQ ID NO: 988910 - RNA, 19 nt, Homo sapiens
gccaagagggcgaacauuc

SEQ ID NO: 988911 - RNA, 19 nt, Homo sapiens
cggaggaauuucaguaucu

SEQ ID NO: 988912 - RNA, 19 nt, Homo sapiens
uaucgggauucaauguuug

SEQ ID NO: 988913 - RNA, 19 nt, Homo sapiens
gggauucaauguuuguaac

SEQ ID NO: 988914 - RNA, 19 nt, Homo sapiens
gguccuggauguugauguc

SEQ ID NO: 988915 - RNA, 19 nt, Homo sapiens
ucuaugaggacaucuuuga

SEQ ID NO: 988916 - RNA, 19 nt, Homo sapiens
ucacagcugaagaaaugua

SEQ ID NO: 988917 - RNA, 19 nt, Homo sapiens
ugaccugcuugaaacuuug

SEQ ID NO: 988918 - RNA, 19 nt, Homo sapiens
ggauguugauguccugcau

SEQ ID NO: 988919 - RNA, 19 nt, Homo sapiens
ucaccuaucgggauucaau

SEQ ID NO: 988920 - RNA, 19 nt, Homo sapiens
aaaaugaccugcuugaaac

SEQ ID NO: 988921 - RNA, 19 nt, Homo sapiens
cuaaaucccacgaaugaca

SEQ ID NO: 988922 - RNA, 19 nt, Homo sapiens
gccaacagggcauuucaga

SEQ ID NO: 988923 - RNA, 19 nt, Homo sapiens
gcgcuauuccgcuguaaca

SEQ ID NO: 988924 - RNA, 19 nt, Homo sapiens
uaaaucccacgaaugacaa

SEQ ID NO: 988925 - RNA, 19 nt, Homo sapiens
gaaggaggaacaguugaag

SEQ ID NO: 988926 - RNA, 19 nt, Homo sapiens
uagaggaacagcuuaugug

SEQ ID NO: 988927 - RNA, 19 nt, Homo sapiens
agaaggaggaacaguugaa

SEQ ID NO: 988928 - RNA, 19 nt, Homo sapiens
gagcuccggaggaauuuca

SEQ ID NO: 988929 - RNA, 19 nt, Homo sapiens
aacagggcauuucagaaga

SEQ ID NO: 988930 - RNA, 19 nt, Homo sapiens
ccaacagggcauuucagaa

SEQ ID NO: 988931 - RNA, 19 nt, Homo sapiens
ggcggguccuggauguuga

SEQ ID NO: 988932 - RNA, 19 nt, Homo sapiens
gggcauuucagaagaugga

SEQ ID NO: 988933 - RNA, 19 nt, Homo sapiens
ggaggaacaguugaagcuu

SEQ ID NO: 988934 - RNA, 19 nt, Homo sapiens
agaagauggacacaaagaa

SEQ ID NO: 988935 - RNA, 19 nt, Homo sapiens
acagggcauuucagaagau

SEQ ID NO: 988936 - RNA, 19 nt, Homo sapiens
ccaagaaugcaugugauca

SEQ ID NO: 988937 - RNA, 19 nt, Homo sapiens
uggacuaaaucccacgaau

SEQ ID NO: 988938 - RNA, 19 nt, Homo sapiens
aaggagaaauauggcauca

SEQ ID NO: 988939 - RNA, 19 nt, Homo sapiens
ccggaggaauuucaguauc

SEQ ID NO: 988940 - RNA, 19 nt, Homo sapiens
ccacgaaugacaacuacca

SEQ ID NO: 988941 - RNA, 19 nt, Homo sapiens
aagauggacacaaagaaga

SEQ ID NO: 988942 - RNA, 19 nt, Homo sapiens
uaucugcuacgguaacuuc

SEQ ID NO: 988943 - RNA, 19 nt, Homo sapiens
cuagaggaacagcuuaugu

SEQ ID NO: 988944 - RNA, 19 nt, Homo sapiens
augaccugcuugaaacuuu

SEQ ID NO: 988945 - RNA, 19 nt, Homo sapiens
cggcaauuuaguaguagua

SEQ ID NO: 988946 - RNA, 19 nt, Homo sapiens
gcaacucucucuccauuaa

SEQ ID NO: 988947 - RNA, 19 nt, Homo sapiens
gaagugagagccauuaauu

SEQ ID NO: 988948 - RNA, 19 nt, Homo sapiens
gagagaagcccaucuauuc

SEQ ID NO: 988949 - RNA, 19 nt, Homo sapiens
cagaagagcccaagaagaa

SEQ ID NO: 988950 - RNA, 19 nt, Homo sapiens
gcacuuaauuaaagcagaa

SEQ ID NO: 988951 - RNA, 19 nt, Homo sapiens
cuuguuaucuuccaucuaa

SEQ ID NO: 988952 - RNA, 19 nt, Homo sapiens
cgaggaaaguuaugcaaug

SEQ ID NO: 988953 - RNA, 19 nt, Homo sapiens
ggagagaagcccaucuauu

SEQ ID NO: 988954 - RNA, 19 nt, Homo sapiens
ccauagaaguguugcaguu

SEQ ID NO: 988955 - RNA, 19 nt, Homo sapiens
gguaaugcuuguuaucuuc

SEQ ID NO: 988956 - RNA, 19 nt, Homo sapiens
ugccauuucuuaccacuua

SEQ ID NO: 988957 - RNA, 19 nt, Homo sapiens
ccaaagcagucuuccugaa

SEQ ID NO: 988958 - RNA, 19 nt, Homo sapiens
auucaaagcucgaccagaa

SEQ ID NO: 988959 - RNA, 19 nt, Homo sapiens
gaagaacuguuggccaagu

SEQ ID NO: 988960 - RNA, 19 nt, Homo sapiens
ggacagauuaugaauaugg

SEQ ID NO: 988961 - RNA, 19 nt, Homo sapiens
gaagagcccaagaagaaga

SEQ ID NO: 988962 - RNA, 19 nt, Homo sapiens
ugaaggagcacacugaaga

SEQ ID NO: 988963 - RNA, 19 nt, Homo sapiens
ggccguuccuucaguguuu

SEQ ID NO: 988964 - RNA, 19 nt, Homo sapiens
ccaagaagaagaagggaaa

SEQ ID NO: 988965 - RNA, 19 nt, Homo sapiens
gcagaagagcccaagaaga

SEQ ID NO: 988966 - RNA, 19 nt, Homo sapiens
gaaggagcacacugaagaa

SEQ ID NO: 988967 - RNA, 19 nt, Homo sapiens
gcaagccuuuucucucuua

SEQ ID NO: 988968 - RNA, 19 nt, Homo sapiens
gauaugacccuggcagaga

SEQ ID NO: 988969 - RNA, 19 nt, Homo sapiens
ggggacagauuaugaauau

SEQ ID NO: 988970 - RNA, 19 nt, Homo sapiens
cugcaacucucucuccauu

SEQ ID NO: 988971 - RNA, 19 nt, Homo sapiens
auauucaucugacugcaua

SEQ ID NO: 988972 - RNA, 19 nt, Homo sapiens
uaugagguaaugcuuguua

SEQ ID NO: 988973 - RNA, 19 nt, Homo sapiens
ggagcacacugaagaagac

SEQ ID NO: 988974 - RNA, 19 nt, Homo sapiens
uaaagucgaggaaaguuau

SEQ ID NO: 988975 - RNA, 19 nt, Homo sapiens
caucugacugcauaugaua

SEQ ID NO: 988976 - RNA, 19 nt, Homo sapiens
ucuuaccacuuaccuauga

SEQ ID NO: 988977 - RNA, 19 nt, Homo sapiens
auaaguacccauucccaua

SEQ ID NO: 988978 - RNA, 19 nt, Homo sapiens
gugcuacguuugcagaaau

SEQ ID NO: 988979 - RNA, 19 nt, Homo sapiens
ccauuaaagucgaggaaag

SEQ ID NO: 988980 - RNA, 19 nt, Homo sapiens
ggaagugagagccauuaau

SEQ ID NO: 988981 - RNA, 19 nt, Homo sapiens
gcccaucuauucuguaggu

SEQ ID NO: 988982 - RNA, 19 nt, Homo sapiens
ccuaugagguaaugcuugu

SEQ ID NO: 988983 - RNA, 19 nt, Homo sapiens
gaggaaaguuaugcaaugc

SEQ ID NO: 988984 - RNA, 19 nt, Homo sapiens
cauauugagugccaaagag

SEQ ID NO: 988985 - RNA, 19 nt, Homo sapiens
guuaugcaaugccaaccaa

SEQ ID NO: 988986 - RNA, 19 nt, Homo sapiens
uuaaagucgaggaaaguua

SEQ ID NO: 988987 - RNA, 19 nt, Homo sapiens
agugagagccauuaauuug

SEQ ID NO: 988988 - RNA, 19 nt, Homo sapiens
agagcuuacuggguaguua

SEQ ID NO: 988989 - RNA, 19 nt, Homo sapiens
agagaguuaugcccaguau

SEQ ID NO: 988990 - RNA, 19 nt, Homo sapiens
caggagagaagcccaucua

SEQ ID NO: 988991 - RNA, 19 nt, Homo sapiens
guucagaucagcgguuuga

SEQ ID NO: 988992 - RNA, 19 nt, Homo sapiens
cagcaguggucauauugag

SEQ ID NO: 988993 - RNA, 19 nt, Homo sapiens
ugccagcaguggucauauu

SEQ ID NO: 988994 - RNA, 19 nt, Homo sapiens
gcgcagcagcaaaggauga

SEQ ID NO: 988995 - RNA, 19 nt, Homo sapiens
ccacggcauuggaaaguac

SEQ ID NO: 988996 - RNA, 19 nt, Homo sapiens
ccauucccauagccaguaa

SEQ ID NO: 988997 - RNA, 19 nt, Homo sapiens
uaaguacccauucccauag

SEQ ID NO: 988998 - RNA, 19 nt, Homo sapiens
agaguuaugcccaguaugu

SEQ ID NO: 988999 - RNA, 19 nt, Homo sapiens
gagguaaugcuuguuaucu

SEQ ID NO: 989000 - RNA, 19 nt, Homo sapiens
gagcgagugguucagauca

SEQ ID NO: 989001 - RNA, 19 nt, Homo sapiens
gcaggaccaaggcagcaaa

SEQ ID NO: 989002 - RNA, 19 nt, Homo sapiens
gaugagcggaaccuuggaa

SEQ ID NO: 989003 - RNA, 19 nt, Homo sapiens
aagcagaagagcccaagaa

SEQ ID NO: 989004 - RNA, 19 nt, Homo sapiens
gaagcccaucuauucugua

SEQ ID NO: 989005 - RNA, 19 nt, Homo sapiens
ggucauauugagugccaaa

SEQ ID NO: 989006 - RNA, 19 nt, Homo sapiens
cuccuggacucagugcuua

SEQ ID NO: 989007 - RNA, 19 nt, Homo sapiens
cugaggaacaauaccauuu

SEQ ID NO: 989008 - RNA, 19 nt, Homo sapiens
cgguuugagugcuacguuu

SEQ ID NO: 989009 - RNA, 19 nt, Homo sapiens
gccagcaguggucauauug

SEQ ID NO: 989010 - RNA, 19 nt, Homo sapiens
cuucaagggacgauucaaa

SEQ ID NO: 989011 - RNA, 19 nt, Homo sapiens
caacucucucuccauuaaa

SEQ ID NO: 989012 - RNA, 19 nt, Homo sapiens
cucuuaagguuuagaacuu

SEQ ID NO: 989013 - RNA, 19 nt, Homo sapiens
gagcuuacuggguaguuag

SEQ ID NO: 989014 - RNA, 19 nt, Homo sapiens
cauagaaguguugcaguug

SEQ ID NO: 989015 - RNA, 19 nt, Homo sapiens
gaagaagaagggaaaagug

SEQ ID NO: 989016 - RNA, 19 nt, Homo sapiens
agguaaugcuuguuaucuu

SEQ ID NO: 989017 - RNA, 19 nt, Homo sapiens
gauuucauaaguacccauu

SEQ ID NO: 989018 - RNA, 19 nt, Homo sapiens
ccaaagagaagagcuuacu

SEQ ID NO: 989019 - RNA, 19 nt, Homo sapiens
agaacuggaagaacuguug

SEQ ID NO: 989020 - RNA, 19 nt, Homo sapiens
ggaccaaggcagcaaaaug

SEQ ID NO: 989021 - RNA, 19 nt, Homo sapiens
aagcccaucuauucuguag

SEQ ID NO: 989022 - RNA, 19 nt, Homo sapiens
aagugagagccauuaauuu

SEQ ID NO: 989023 - RNA, 19 nt, Homo sapiens
guggaagugagagccauua

SEQ ID NO: 989024 - RNA, 19 nt, Homo sapiens
gaagaagggaaaaguggaa

SEQ ID NO: 989025 - RNA, 19 nt, Homo sapiens
caaagagaagagcuuacug

SEQ ID NO: 989026 - RNA, 19 nt, Homo sapiens
ccaaaaccauagaaguguu

SEQ ID NO: 989027 - RNA, 19 nt, Homo sapiens
guucacaaccucugcaacu

SEQ ID NO: 989028 - RNA, 19 nt, Homo sapiens
ucauauugagugccaaaga

SEQ ID NO: 989029 - RNA, 19 nt, Homo sapiens
caugccagcaguggucaua

SEQ ID NO: 989030 - RNA, 19 nt, Homo sapiens
uucuguagguggaauucua

SEQ ID NO: 989031 - RNA, 19 nt, Homo sapiens
ucagaucagcgguuugagu

SEQ ID NO: 989032 - RNA, 19 nt, Homo sapiens
gcuccuggacucagugcuu

SEQ ID NO: 989033 - RNA, 19 nt, Homo sapiens
uagguggaauucuacuaag

SEQ ID NO: 989034 - RNA, 19 nt, Homo sapiens
guuaugcccaguauguuca

SEQ ID NO: 989035 - RNA, 19 nt, Homo sapiens
gcauuggaaaguacaagca

SEQ ID NO: 989036 - RNA, 19 nt, Homo sapiens
gaguuaugcccaguauguu

SEQ ID NO: 989037 - RNA, 19 nt, Homo sapiens
cagagaguuaugcccagua

SEQ ID NO: 989038 - RNA, 19 nt, Homo sapiens
uaagaaggauuucagcaaa

SEQ ID NO: 989039 - RNA, 19 nt, Homo sapiens
gauuuaggaucucaguuaa

SEQ ID NO: 989040 - RNA, 19 nt, Homo sapiens
gauaauggaguuggucuua

SEQ ID NO: 989041 - RNA, 19 nt, Homo sapiens
ugagaguccugccuuaauu

SEQ ID NO: 989042 - RNA, 19 nt, Homo sapiens
cagcucaacugaagaacaa

SEQ ID NO: 989043 - RNA, 19 nt, Homo sapiens
guaauuggaagcaguauau

SEQ ID NO: 989044 - RNA, 19 nt, Homo sapiens
gcagggcuguuugcucuuu

SEQ ID NO: 989045 - RNA, 19 nt, Homo sapiens
ugauuuaggaucucaguua

SEQ ID NO: 989046 - RNA, 19 nt, Homo sapiens
acagugacuucaacaguuu

SEQ ID NO: 989047 - RNA, 19 nt, Homo sapiens
gaggacgacuucaacuaug

SEQ ID NO: 989048 - RNA, 19 nt, Homo sapiens
cacacucacugaugcauaa

SEQ ID NO: 989049 - RNA, 19 nt, Homo sapiens
ggaucucaguuaagagcua

SEQ ID NO: 989050 - RNA, 19 nt, Homo sapiens
cuacuuggauaucaucaau

SEQ ID NO: 989051 - RNA, 19 nt, Homo sapiens
gaagcaguauauagaaacu

SEQ ID NO: 989052 - RNA, 19 nt, Homo sapiens
cauaaacugucaccugaag

SEQ ID NO: 989053 - RNA, 19 nt, Homo sapiens
gagaguccugccuuaauuu

SEQ ID NO: 989054 - RNA, 19 nt, Homo sapiens
ggagguggagguugcauug

SEQ ID NO: 989055 - RNA, 19 nt, Homo sapiens
uggcaguuguuguuacuuu

SEQ ID NO: 989056 - RNA, 19 nt, Homo sapiens
uacagugacuucaacaguu

SEQ ID NO: 989057 - RNA, 19 nt, Homo sapiens
uaacuacagugacuucaac

SEQ ID NO: 989058 - RNA, 19 nt, Homo sapiens
ccuguaaucccaccacuuu

SEQ ID NO: 989059 - RNA, 19 nt, Homo sapiens
uggaagcaguauauagaaa

SEQ ID NO: 989060 - RNA, 19 nt, Homo sapiens
ccgaauggccuuucugaga

SEQ ID NO: 989061 - RNA, 19 nt, Homo sapiens
guuguuacuuucuaugaug

SEQ ID NO: 989062 - RNA, 19 nt, Homo sapiens
gaaaccccgucucuacuaa

SEQ ID NO: 989063 - RNA, 19 nt, Homo sapiens
uuuaggaucucaguuaaga

SEQ ID NO: 989064 - RNA, 19 nt, Homo sapiens
acaugagaguccugccuua

SEQ ID NO: 989065 - RNA, 19 nt, Homo sapiens
auagugagauaauggaguu

SEQ ID NO: 989066 - RNA, 19 nt, Homo sapiens
ugucaggauucuugaaguu

SEQ ID NO: 989067 - RNA, 19 nt, Homo sapiens
cgaggacgacuucaacuau

SEQ ID NO: 989068 - RNA, 19 nt, Homo sapiens
gaucucaguuaagagcuau

SEQ ID NO: 989069 - RNA, 19 nt, Homo sapiens
ucuggaagcaguuaauaaa

SEQ ID NO: 989070 - RNA, 19 nt, Homo sapiens
ucaguuaagagcuaucaaa

SEQ ID NO: 989071 - RNA, 19 nt, Homo sapiens
ucugcaagcuuucauacug

SEQ ID NO: 989072 - RNA, 19 nt, Homo sapiens
ccucggaucucuggguuug

SEQ ID NO: 989073 - RNA, 19 nt, Homo sapiens
ggauaucaucaaucuauuc

SEQ ID NO: 989074 - RNA, 19 nt, Homo sapiens
ugacacacacucacugaug

SEQ ID NO: 989075 - RNA, 19 nt, Homo sapiens
ugacagagcgagacucagu

SEQ ID NO: 989076 - RNA, 19 nt, Homo sapiens
aaaguaauuggaagcagua

SEQ ID NO: 989077 - RNA, 19 nt, Homo sapiens
gaguguaggcucccacguu

SEQ ID NO: 989078 - RNA, 19 nt, Homo sapiens
cugcaagcuuucauacuga

SEQ ID NO: 989079 - RNA, 19 nt, Homo sapiens
gagaaaagucuacagcauu

SEQ ID NO: 989080 - RNA, 19 nt, Homo sapiens
cuaagaaggauuucagcaa

SEQ ID NO: 989081 - RNA, 19 nt, Homo sapiens
cagguucucuuaacuacag

SEQ ID NO: 989082 - RNA, 19 nt, Homo sapiens
cuuaaccuguaccuacuuu

SEQ ID NO: 989083 - RNA, 19 nt, Homo sapiens
gaccgaggcagguggauca

SEQ ID NO: 989084 - RNA, 19 nt, Homo sapiens
ucacugaugcauaaacugu

SEQ ID NO: 989085 - RNA, 19 nt, Homo sapiens
ggaagcaguauauagaaac

SEQ ID NO: 989086 - RNA, 19 nt, Homo sapiens
gcauaaacugucaccugaa

SEQ ID NO: 989087 - RNA, 19 nt, Homo sapiens
gcuuucauacugacuacua

SEQ ID NO: 989088 - RNA, 19 nt, Homo sapiens
ggaucucuggguuugauuu

SEQ ID NO: 989089 - RNA, 19 nt, Homo sapiens
gcacauccgaauggccuuu

SEQ ID NO: 989090 - RNA, 19 nt, Homo sapiens
gaucgaggacgacuucaac

SEQ ID NO: 989091 - RNA, 19 nt, Homo sapiens
ccaucagccucuacuugga

SEQ ID NO: 989092 - RNA, 19 nt, Homo sapiens
caugagaguccugccuuaa

SEQ ID NO: 989093 - RNA, 19 nt, Homo sapiens
ucucuuaacuacagugacu

SEQ ID NO: 989094 - RNA, 19 nt, Homo sapiens
ggugacagagcgagacuca

SEQ ID NO: 989095 - RNA, 19 nt, Homo sapiens
caagaucacgccacugcau

SEQ ID NO: 989096 - RNA, 19 nt, Homo sapiens
uaauggaguuggucuuagc

SEQ ID NO: 989097 - RNA, 19 nt, Homo sapiens
agaaaagucuacagcauuc

SEQ ID NO: 989098 - RNA, 19 nt, Homo sapiens
gguagcuguugccaucaug

SEQ ID NO: 989099 - RNA, 19 nt, Homo sapiens
caguuguuguuacuuucua

SEQ ID NO: 989100 - RNA, 19 nt, Homo sapiens
caagcuuucauacugacua

SEQ ID NO: 989101 - RNA, 19 nt, Homo sapiens
ggcaguuguuguuacuuuc

SEQ ID NO: 989102 - RNA, 19 nt, Homo sapiens
uacggacauuuguacauga

SEQ ID NO: 989103 - RNA, 19 nt, Homo sapiens
ggccagagaaucgcuugaa

SEQ ID NO: 989104 - RNA, 19 nt, Homo sapiens
accugaagaguacguauua

SEQ ID NO: 989105 - RNA, 19 nt, Homo sapiens
ucaggauucuugaaguuuu

SEQ ID NO: 989106 - RNA, 19 nt, Homo sapiens
acacacucacugaugcaua

SEQ ID NO: 989107 - RNA, 19 nt, Homo sapiens
gcugcaggagcccuucuuu

SEQ ID NO: 989108 - RNA, 19 nt, Homo sapiens
cuacagugacuucaacagu

SEQ ID NO: 989109 - RNA, 19 nt, Homo sapiens
gccagagaaucgcuugaac

SEQ ID NO: 989110 - RNA, 19 nt, Homo sapiens
ucgaggacgacuucaacua

SEQ ID NO: 989111 - RNA, 19 nt, Homo sapiens
uaaacugucaccugaagag

SEQ ID NO: 989112 - RNA, 19 nt, Homo sapiens
ucuguggauucaucaucua

SEQ ID NO: 989113 - RNA, 19 nt, Homo sapiens
ggguagcuguugccaucau

SEQ ID NO: 989114 - RNA, 19 nt, Homo sapiens
caacugaagaacaacaaaa

SEQ ID NO: 989115 - RNA, 19 nt, Homo sapiens
ucuauuccugcaccuguua

SEQ ID NO: 989116 - RNA, 19 nt, Homo sapiens
uaugacacacacucacuga

SEQ ID NO: 989117 - RNA, 19 nt, Homo sapiens
acuuggauaucaucaaucu

SEQ ID NO: 989118 - RNA, 19 nt, Homo sapiens
gagucuguacggacauuug

SEQ ID NO: 989119 - RNA, 19 nt, Homo sapiens
caccugaagaguacguauu

SEQ ID NO: 989120 - RNA, 19 nt, Homo sapiens
acugaugcauaaacuguca

SEQ ID NO: 989121 - RNA, 19 nt, Homo sapiens
gcaguuguuguuacuuucu

SEQ ID NO: 989122 - RNA, 19 nt, Homo sapiens
cugcagguucucuuaacua

SEQ ID NO: 989123 - RNA, 19 nt, Homo sapiens
uaaacagacauaaguaucc

SEQ ID NO: 989124 - RNA, 19 nt, Homo sapiens
ggaagaggcuuugggaaua

SEQ ID NO: 989125 - RNA, 19 nt, Homo sapiens
gaguaaagcucccagcaua

SEQ ID NO: 989126 - RNA, 19 nt, Homo sapiens
gaaagaaugugcugagugu

SEQ ID NO: 989127 - RNA, 19 nt, Homo sapiens
gagcaaagccaguuccuaa

SEQ ID NO: 989128 - RNA, 19 nt, Homo sapiens
ggaagcacccucuuucuuu

SEQ ID NO: 989129 - RNA, 19 nt, Homo sapiens
gaagauggagaauggaaua

SEQ ID NO: 989130 - RNA, 19 nt, Homo sapiens
gaguggaacuuaugacuug

SEQ ID NO: 989131 - RNA, 19 nt, Homo sapiens
uagcuacacuucagauuaa

SEQ ID NO: 989132 - RNA, 19 nt, Homo sapiens
guagcuacacuucagauua

SEQ ID NO: 989133 - RNA, 19 nt, Homo sapiens
ggacaaugauggagaucga

SEQ ID NO: 989134 - RNA, 19 nt, Homo sapiens
gaaaaugagcugaugcuua

SEQ ID NO: 989135 - RNA, 19 nt, Homo sapiens
ccaggaagauggagaaugg

SEQ ID NO: 989136 - RNA, 19 nt, Homo sapiens
gaacagggcauauaaaaug

SEQ ID NO: 989137 - RNA, 19 nt, Homo sapiens
ggagagagaaagagaauuc

SEQ ID NO: 989138 - RNA, 19 nt, Homo sapiens
gcauauagcuucaaaacug

SEQ ID NO: 989139 - RNA, 19 nt, Homo sapiens
ccaaagaacagaucaagug

SEQ ID NO: 989140 - RNA, 19 nt, Homo sapiens
gaagaggcuuugggaauag

SEQ ID NO: 989141 - RNA, 19 nt, Homo sapiens
aaacugcucugugcaaaga

SEQ ID NO: 989142 - RNA, 19 nt, Homo sapiens
gggaaggaguggaacuuau

SEQ ID NO: 989143 - RNA, 19 nt, Homo sapiens
uaaaguaggagaaagaaug

SEQ ID NO: 989144 - RNA, 19 nt, Homo sapiens
gcaugucugcugugaauuu

SEQ ID NO: 989145 - RNA, 19 nt, Homo sapiens
aaaaugagcugaugcuuau

SEQ ID NO: 989146 - RNA, 19 nt, Homo sapiens
cgacaugcauuuacucucu

SEQ ID NO: 989147 - RNA, 19 nt, Homo sapiens
gaagggacaacauggaaga

SEQ ID NO: 989148 - RNA, 19 nt, Homo sapiens
guaaagcucccagcauauu

SEQ ID NO: 989149 - RNA, 19 nt, Homo sapiens
ggaugaaauuguagaugga

SEQ ID NO: 989150 - RNA, 19 nt, Homo sapiens
acucuugggucuaaucuuu

SEQ ID NO: 989151 - RNA, 19 nt, Homo sapiens
ggaaggaguggaacuuaug

SEQ ID NO: 989152 - RNA, 19 nt, Homo sapiens
uuucuuccauuccuucuua

SEQ ID NO: 989153 - RNA, 19 nt, Homo sapiens
gaguguccaucucuuaguu

SEQ ID NO: 989154 - RNA, 19 nt, Homo sapiens
gaaggaguggaacuuauga

SEQ ID NO: 989155 - RNA, 19 nt, Homo sapiens
ugaaauugcccucuuggaa

SEQ ID NO: 989156 - RNA, 19 nt, Homo sapiens
ugucaaagccauccugauu

SEQ ID NO: 989157 - RNA, 19 nt, Homo sapiens
gauuaaaguaggagaaaga

SEQ ID NO: 989158 - RNA, 19 nt, Homo sapiens
gagaaagaaugugcugagu

SEQ ID NO: 989159 - RNA, 19 nt, Homo sapiens
guucuuggcuguggaugaa

SEQ ID NO: 989160 - RNA, 19 nt, Homo sapiens
ggcuguggaugaaauugua

SEQ ID NO: 989161 - RNA, 19 nt, Homo sapiens
ucaaagccauccugauucu

SEQ ID NO: 989162 - RNA, 19 nt, Homo sapiens
gaucucuauuucuauguga

SEQ ID NO: 989163 - RNA, 19 nt, Homo sapiens
ccuuaacuguccacccuua

SEQ ID NO: 989164 - RNA, 19 nt, Homo sapiens
gaucuggcauauagcuuca

SEQ ID NO: 989165 - RNA, 19 nt, Homo sapiens
aaacuccauucuagucuug

SEQ ID NO: 989166 - RNA, 19 nt, Homo sapiens
aaacugcaguggcgagugu

SEQ ID NO: 989167 - RNA, 19 nt, Homo sapiens
aaagcucccagcauauuua

SEQ ID NO: 989168 - RNA, 19 nt, Homo sapiens
ggacaacauggaagaaaca

SEQ ID NO: 989169 - RNA, 19 nt, Homo sapiens
guauugaacagggcauaua

SEQ ID NO: 989170 - RNA, 19 nt, Homo sapiens
uaaauucugugcccuuugc

SEQ ID NO: 989171 - RNA, 19 nt, Homo sapiens
gauggagaauggaauacuc

SEQ ID NO: 989172 - RNA, 19 nt, Homo sapiens
gggaagcacccucuuucuu

SEQ ID NO: 989173 - RNA, 19 nt, Homo sapiens
uaaagcucccagcauauuu

SEQ ID NO: 989174 - RNA, 19 nt, Homo sapiens
gaaccuucccuguauacug

SEQ ID NO: 989175 - RNA, 19 nt, Homo sapiens
uaacuguccacccuuacua

SEQ ID NO: 989176 - RNA, 19 nt, Homo sapiens
aagaaugugcugaguguuu

SEQ ID NO: 989177 - RNA, 19 nt, Homo sapiens
ggaguggaacuuaugacuu

SEQ ID NO: 989178 - RNA, 19 nt, Homo sapiens
uauccaaucuaagcccuaa

SEQ ID NO: 989179 - RNA, 19 nt, Homo sapiens
aaaccuuccugagacuuaa

SEQ ID NO: 989180 - RNA, 19 nt, Homo sapiens
gaagaacauuuucaacaag

SEQ ID NO: 989181 - RNA, 19 nt, Homo sapiens
acccugaucuggcauauag

SEQ ID NO: 989182 - RNA, 19 nt, Homo sapiens
gggaagggacaacauggaa

SEQ ID NO: 989183 - RNA, 19 nt, Homo sapiens
gcaaagccaguuccuaaaa

SEQ ID NO: 989184 - RNA, 19 nt, Homo sapiens
uugcaugucugcugugaau

SEQ ID NO: 989185 - RNA, 19 nt, Homo sapiens
ugagccagaugcugaggaa

SEQ ID NO: 989186 - RNA, 19 nt, Homo sapiens
gaacugucucuucgacuca

SEQ ID NO: 989187 - RNA, 19 nt, Homo sapiens
uguaaauucugugcccuuu

SEQ ID NO: 989188 - RNA, 19 nt, Homo sapiens
gggacaacauggaagaaac

SEQ ID NO: 989189 - RNA, 19 nt, Homo sapiens
cagugaaauugcccucuug

SEQ ID NO: 989190 - RNA, 19 nt, Homo sapiens
auuggcagcuccuaugaaa

SEQ ID NO: 989191 - RNA, 19 nt, Homo sapiens
ugggaucguugccugguuu

SEQ ID NO: 989192 - RNA, 19 nt, Homo sapiens
cuuagugaccucaguguuu

SEQ ID NO: 989193 - RNA, 19 nt, Homo sapiens
caagauggaggcgcugauu

SEQ ID NO: 989194 - RNA, 19 nt, Homo sapiens
gcucuucauccucuucaaa

SEQ ID NO: 989195 - RNA, 19 nt, Homo sapiens
aaccuucccuguauacugu

SEQ ID NO: 989196 - RNA, 19 nt, Homo sapiens
gaggugcuuuucuucauaa

SEQ ID NO: 989197 - RNA, 19 nt, Homo sapiens
acagugaaauugcccucuu

SEQ ID NO: 989198 - RNA, 19 nt, Homo sapiens
gcucccagcauauuuagau

SEQ ID NO: 989199 - RNA, 19 nt, Homo sapiens
gcagucagccaaagaacag

SEQ ID NO: 989200 - RNA, 19 nt, Homo sapiens
ggaagauggagaauggaau

SEQ ID NO: 989201 - RNA, 19 nt, Homo sapiens
ugagagaggugcuuuucuu

SEQ ID NO: 989202 - RNA, 19 nt, Homo sapiens
ggcgaguguccaucucuua

SEQ ID NO: 989203 - RNA, 19 nt, Homo sapiens
uauugaacagggcauauaa

SEQ ID NO: 989204 - RNA, 19 nt, Homo sapiens
gagaagaacauuuucaaca

SEQ ID NO: 989205 - RNA, 19 nt, Homo sapiens
cauaaacugcucugugcaa

SEQ ID NO: 989206 - RNA, 19 nt, Homo sapiens
cccagcauauuuagauaau

SEQ ID NO: 989207 - RNA, 19 nt, Homo sapiens
auaaacugcucugugcaaa

SEQ ID NO: 989208 - RNA, 19 nt, Homo sapiens
ggagcaaagccaguuccua

SEQ ID NO: 989209 - RNA, 19 nt, Homo sapiens
cagauuaaaguaggagaaa

SEQ ID NO: 989210 - RNA, 19 nt, Homo sapiens
gauaacggggcauauuuaa

SEQ ID NO: 989211 - RNA, 19 nt, Homo sapiens
ucucuuaguuagcuaccuu

SEQ ID NO: 989212 - RNA, 19 nt, Homo sapiens
ggaaggccugacaguggua

SEQ ID NO: 989213 - RNA, 19 nt, Homo sapiens
aauggaauacucacucuug

SEQ ID NO: 989214 - RNA, 19 nt, Homo sapiens
uggaagaggcuuugggaau

SEQ ID NO: 989215 - RNA, 19 nt, Homo sapiens
gggugauccuagagaguga

SEQ ID NO: 989216 - RNA, 19 nt, Homo sapiens
gcaaagaggaauaaaacau

SEQ ID NO: 989217 - RNA, 19 nt, Homo sapiens
gaacuuccuccccacaaaa

SEQ ID NO: 989218 - RNA, 19 nt, Homo sapiens
gcugcaaccuacccucucu

SEQ ID NO: 989219 - RNA, 19 nt, Homo sapiens
ggggauggguagggauuua

SEQ ID NO: 989220 - RNA, 19 nt, Homo sapiens
gcacugagguggggcagau

SEQ ID NO: 989221 - RNA, 19 nt, Homo sapiens
agaauggaauacucacucu

SEQ ID NO: 989222 - RNA, 19 nt, Homo sapiens
aaaguaggagaaagaaugu

SEQ ID NO: 989223 - RNA, 19 nt, Homo sapiens
gcagauaacggggcauauu

SEQ ID NO: 989224 - RNA, 19 nt, Homo sapiens
ggaaggaaguuaauaccua

SEQ ID NO: 989225 - RNA, 19 nt, Homo sapiens
gcagaagcauugaccauuu

SEQ ID NO: 989226 - RNA, 19 nt, Homo sapiens
uaaccaaacuucuuccuaa

SEQ ID NO: 989227 - RNA, 19 nt, Homo sapiens
gugcaugucugcucugaua

SEQ ID NO: 989228 - RNA, 19 nt, Homo sapiens
gaaggaaguuaauaccuau

SEQ ID NO: 989229 - RNA, 19 nt, Homo sapiens
gcaaagccacauugaauuu

SEQ ID NO: 989230 - RNA, 19 nt, Homo sapiens
ugaaccagcuucuagauga

SEQ ID NO: 989231 - RNA, 19 nt, Homo sapiens
ccaaagaccuguaagaacu

SEQ ID NO: 989232 - RNA, 19 nt, Homo sapiens
ggaaguuaauaccuaugua

SEQ ID NO: 989233 - RNA, 19 nt, Homo sapiens
gaggagaaaucuguaguga

SEQ ID NO: 989234 - RNA, 19 nt, Homo sapiens
agaaugacauguaaugcua

SEQ ID NO: 989235 - RNA, 19 nt, Homo sapiens
aucaauaggugacuacuua

SEQ ID NO: 989236 - RNA, 19 nt, Homo sapiens
gagaagcgccacucaaguu

SEQ ID NO: 989237 - RNA, 19 nt, Homo sapiens
gcaaaggacagaccaugaa

SEQ ID NO: 989238 - RNA, 19 nt, Homo sapiens
ccacagaauuccaaaccaa

SEQ ID NO: 989239 - RNA, 19 nt, Homo sapiens
gaauguaugcaucucuaua

SEQ ID NO: 989240 - RNA, 19 nt, Homo sapiens
gggaauguaugcaucucua

SEQ ID NO: 989241 - RNA, 19 nt, Homo sapiens
ccaaggaggugacccaaca

SEQ ID NO: 989242 - RNA, 19 nt, Homo sapiens
gaauccuccuugagaagua

SEQ ID NO: 989243 - RNA, 19 nt, Homo sapiens
gaccaugaauccuccuuga

SEQ ID NO: 989244 - RNA, 19 nt, Homo sapiens
gagaagaggagaaaucugu

SEQ ID NO: 989245 - RNA, 19 nt, Homo sapiens
ccaagacuuuagagaaauu

SEQ ID NO: 989246 - RNA, 19 nt, Homo sapiens
gcacaaaugccccuguuua

SEQ ID NO: 989247 - RNA, 19 nt, Homo sapiens
ugaagaucauuaaggcaua

SEQ ID NO: 989248 - RNA, 19 nt, Homo sapiens
aaaggaagcagaagcauug

SEQ ID NO: 989249 - RNA, 19 nt, Homo sapiens
ugauauacgucgaacaaug

SEQ ID NO: 989250 - RNA, 19 nt, Homo sapiens
guaguacucucagaaagga

SEQ ID NO: 989251 - RNA, 19 nt, Homo sapiens
gcaugucugcucugauaua

SEQ ID NO: 989252 - RNA, 19 nt, Homo sapiens
ccaacaaucaaguuucuaa

SEQ ID NO: 989253 - RNA, 19 nt, Homo sapiens
gauauacgucgaacaaugu

SEQ ID NO: 989254 - RNA, 19 nt, Homo sapiens
uaggaggccuggcaucuug

SEQ ID NO: 989255 - RNA, 19 nt, Homo sapiens
gagaggaaggaaguuaaua

SEQ ID NO: 989256 - RNA, 19 nt, Homo sapiens
caugaauccuccuugagaa

SEQ ID NO: 989257 - RNA, 19 nt, Homo sapiens
gcauaggaauggugaaucg

SEQ ID NO: 989258 - RNA, 19 nt, Homo sapiens
gggaggagcaggagaggaa

SEQ ID NO: 989259 - RNA, 19 nt, Homo sapiens
acccaagacuuuagagaaa

SEQ ID NO: 989260 - RNA, 19 nt, Homo sapiens
ccauaaugcugcuucuugu

SEQ ID NO: 989261 - RNA, 19 nt, Homo sapiens
caaaccaaguagugucugu

SEQ ID NO: 989262 - RNA, 19 nt, Homo sapiens
ccacagaauuaucaaagac

SEQ ID NO: 989263 - RNA, 19 nt, Homo sapiens
aaacacauccaacaaucaa

SEQ ID NO: 989264 - RNA, 19 nt, Homo sapiens
ggaaguacauuuuaauagg

SEQ ID NO: 989265 - RNA, 19 nt, Homo sapiens
cauagaaugacauguaaug

SEQ ID NO: 989266 - RNA, 19 nt, Homo sapiens
ucauugugcuggagcugua

SEQ ID NO: 989267 - RNA, 19 nt, Homo sapiens
ggagaggaaggaaguuaau

SEQ ID NO: 989268 - RNA, 19 nt, Homo sapiens
uacuacacaugaaccauaa

SEQ ID NO: 989269 - RNA, 19 nt, Homo sapiens
gaaugacauguaaugcuaa

SEQ ID NO: 989270 - RNA, 19 nt, Homo sapiens
gaagaucauuaaggcauac

SEQ ID NO: 989271 - RNA, 19 nt, Homo sapiens
ucaaagacuucaugaucca

SEQ ID NO: 989272 - RNA, 19 nt, Homo sapiens
uguaagaacuuugcugagu

SEQ ID NO: 989273 - RNA, 19 nt, Homo sapiens
ccaugaauccuccuugaga

SEQ ID NO: 989274 - RNA, 19 nt, Homo sapiens
agaaaucuguagugagcaa

SEQ ID NO: 989275 - RNA, 19 nt, Homo sapiens
gaagaggagaaaucuguag

SEQ ID NO: 989276 - RNA, 19 nt, Homo sapiens
gaaccauaaugcugcuucu

SEQ ID NO: 989277 - RNA, 19 nt, Homo sapiens
uuacuacacaugaaccaua

SEQ ID NO: 989278 - RNA, 19 nt, Homo sapiens
gaacuucauccagacuuga

SEQ ID NO: 989279 - RNA, 19 nt, Homo sapiens
uagaugacauagaaugaca

SEQ ID NO: 989280 - RNA, 19 nt, Homo sapiens
gggcuggaauucucgcaau

SEQ ID NO: 989281 - RNA, 19 nt, Homo sapiens
ugucagcccucuuaacucu

SEQ ID NO: 989282 - RNA, 19 nt, Homo sapiens
cagaauuccaaaccaagua

SEQ ID NO: 989283 - RNA, 19 nt, Homo sapiens
ggcagccaguucuuuguga

SEQ ID NO: 989284 - RNA, 19 nt, Homo sapiens
gguggugcaucuaucuaug

SEQ ID NO: 989285 - RNA, 19 nt, Homo sapiens
caggagaggaaggaaguua

SEQ ID NO: 989286 - RNA, 19 nt, Homo sapiens
uuagagaaauuagguccaa

SEQ ID NO: 989287 - RNA, 19 nt, Homo sapiens
ccagagaagaggagaaauc

SEQ ID NO: 989288 - RNA, 19 nt, Homo sapiens
ugucauuucucagugguuu

SEQ ID NO: 989289 - RNA, 19 nt, Homo sapiens
ggugacuacuuacuacaca

SEQ ID NO: 989290 - RNA, 19 nt, Homo sapiens
ggagaagcgccacucaagu

SEQ ID NO: 989291 - RNA, 19 nt, Homo sapiens
caaaggacagaccaugaau

SEQ ID NO: 989292 - RNA, 19 nt, Homo sapiens
ggcagccacccaacguuua

SEQ ID NO: 989293 - RNA, 19 nt, Homo sapiens
cccaaauccugguaucgaa

SEQ ID NO: 989294 - RNA, 19 nt, Homo sapiens
gagauggaaguacauuuua

SEQ ID NO: 989295 - RNA, 19 nt, Homo sapiens
gaaccagcuucuagaugac

SEQ ID NO: 989296 - RNA, 19 nt, Homo sapiens
gcuaaucgacgccggaagu

SEQ ID NO: 989297 - RNA, 19 nt, Homo sapiens
cagccacugucauuucuca

SEQ ID NO: 989298 - RNA, 19 nt, Homo sapiens
uugcaagucaugaagcuua

SEQ ID NO: 989299 - RNA, 19 nt, Homo sapiens
cuacacagcaguccuugau

SEQ ID NO: 989300 - RNA, 19 nt, Homo sapiens
caaaugccccuguuuauca

SEQ ID NO: 989301 - RNA, 19 nt, Homo sapiens
ccagugaaccagcuucuag

SEQ ID NO: 989302 - RNA, 19 nt, Homo sapiens
uagacuugcuacccucuug

SEQ ID NO: 989303 - RNA, 19 nt, Homo sapiens
ccaguggcuugacggcaaa

SEQ ID NO: 989304 - RNA, 19 nt, Homo sapiens
gcaauuacuagacaagcau

SEQ ID NO: 989305 - RNA, 19 nt, Homo sapiens
cagaagcauugaccauuuu

SEQ ID NO: 989306 - RNA, 19 nt, Homo sapiens
acgcaaagccacauugaau

SEQ ID NO: 989307 - RNA, 19 nt, Homo sapiens
ccacgcaaagccacauuga

SEQ ID NO: 989308 - RNA, 19 nt, Homo sapiens
ccuaaggagauuuauauuc

SEQ ID NO: 989309 - RNA, 19 nt, Homo sapiens
caaagaccuguaagaacuu

SEQ ID NO: 989310 - RNA, 19 nt, Homo sapiens
gagaaauuagguccaagau

SEQ ID NO: 989311 - RNA, 19 nt, Homo sapiens
ccaaauccugguaucgaaa

SEQ ID NO: 989312 - RNA, 19 nt, Homo sapiens
ggaagcaugcuccaaagac

SEQ ID NO: 989313 - RNA, 19 nt, Homo sapiens
ggaauguaugcaucucuau

SEQ ID NO: 989314 - RNA, 19 nt, Homo sapiens
gcuccaaagaccuguaaga

SEQ ID NO: 989315 - RNA, 19 nt, Homo sapiens
ugaguuagagauggaagua

SEQ ID NO: 989316 - RNA, 19 nt, Homo sapiens
gaaucgcgugggaauggua

SEQ ID NO: 989317 - RNA, 19 nt, Homo sapiens
gagaccagcaugggaauca

SEQ ID NO: 989318 - RNA, 19 nt, Homo sapiens
guagugagcaaaggacaga

SEQ ID NO: 989319 - RNA, 19 nt, Homo sapiens
ugcuggagcuguacuggaa

SEQ ID NO: 989320 - RNA, 19 nt, Homo sapiens
caucuugggugaguuagag

SEQ ID NO: 989321 - RNA, 19 nt, Homo sapiens
ugggaaugguagaaacaaa

SEQ ID NO: 989322 - RNA, 19 nt, Homo sapiens
aauaggugacuacuuacua

SEQ ID NO: 989323 - RNA, 19 nt, Homo sapiens
gaugacauagaaugacaug

SEQ ID NO: 989324 - RNA, 19 nt, Homo sapiens
ggaauuaaaugacgguaaa

SEQ ID NO: 989325 - RNA, 19 nt, Homo sapiens
gaacucaucuccacucguu

SEQ ID NO: 989326 - RNA, 19 nt, Homo sapiens
gaagacagccagcgauaua

SEQ ID NO: 989327 - RNA, 19 nt, Homo sapiens
ugaaauaaguggacacaaa

SEQ ID NO: 989328 - RNA, 19 nt, Homo sapiens
aagcauagguaacugauua

SEQ ID NO: 989329 - RNA, 19 nt, Homo sapiens
gaaauuugccucaguugaa

SEQ ID NO: 989330 - RNA, 19 nt, Homo sapiens
ccuaauaguuuccaucaaa

SEQ ID NO: 989331 - RNA, 19 nt, Homo sapiens
gauggaaccuuucuuucuu

SEQ ID NO: 989332 - RNA, 19 nt, Homo sapiens
gcccaaagaugucaccauu

SEQ ID NO: 989333 - RNA, 19 nt, Homo sapiens
gagagaauauuaugcagau

SEQ ID NO: 989334 - RNA, 19 nt, Homo sapiens
gagcauguaccaucugaua

SEQ ID NO: 989335 - RNA, 19 nt, Homo sapiens
gaaccuuucuuucuuucuu

SEQ ID NO: 989336 - RNA, 19 nt, Homo sapiens
ccaaacuacuucuagauau

SEQ ID NO: 989337 - RNA, 19 nt, Homo sapiens
gagaguauuugauaagcaa

SEQ ID NO: 989338 - RNA, 19 nt, Homo sapiens
gaacugcuggguugucuuu

SEQ ID NO: 989339 - RNA, 19 nt, Homo sapiens
gagaacaacagcauucauu

SEQ ID NO: 989340 - RNA, 19 nt, Homo sapiens
ccaguuauuucacuugauu

SEQ ID NO: 989341 - RNA, 19 nt, Homo sapiens
uacauacacugucaccuua

SEQ ID NO: 989342 - RNA, 19 nt, Homo sapiens
gaacaacagcauucauuuc

SEQ ID NO: 989343 - RNA, 19 nt, Homo sapiens
gaaaacaguugaacagaau

SEQ ID NO: 989344 - RNA, 19 nt, Homo sapiens
ccauguaacuuaagcauag

SEQ ID NO: 989345 - RNA, 19 nt, Homo sapiens
ccacugggcuguugguuag

SEQ ID NO: 989346 - RNA, 19 nt, Homo sapiens
ccacauaauugguguugau

SEQ ID NO: 989347 - RNA, 19 nt, Homo sapiens
gcauucauuuccauucauu

SEQ ID NO: 989348 - RNA, 19 nt, Homo sapiens
aggccuagaucucuuauuu

SEQ ID NO: 989349 - RNA, 19 nt, Homo sapiens
aguaauaguuggaugcuuu

SEQ ID NO: 989350 - RNA, 19 nt, Homo sapiens
caaauuugaccugguguua

SEQ ID NO: 989351 - RNA, 19 nt, Homo sapiens
cuagaucucuuauuuagca

SEQ ID NO: 989352 - RNA, 19 nt, Homo sapiens
ggugagcuauguaaggaaa

SEQ ID NO: 989353 - RNA, 19 nt, Homo sapiens
gaagauacagagagaaauc

SEQ ID NO: 989354 - RNA, 19 nt, Homo sapiens
ggacacaaacuauccuuuc

SEQ ID NO: 989355 - RNA, 19 nt, Homo sapiens
gccuagaucucuuauuuag

SEQ ID NO: 989356 - RNA, 19 nt, Homo sapiens
aaacugggauggaucuaug

SEQ ID NO: 989357 - RNA, 19 nt, Homo sapiens
gguguugauuggaaacuuu

SEQ ID NO: 989358 - RNA, 19 nt, Homo sapiens
caaaggccuagaucucuua

SEQ ID NO: 989359 - RNA, 19 nt, Homo sapiens
gaaaugaagcaacuugucu

SEQ ID NO: 989360 - RNA, 19 nt, Homo sapiens
caucagagucggauuaaug

SEQ ID NO: 989361 - RNA, 19 nt, Homo sapiens
ggauggaucuaugaguuug

SEQ ID NO: 989362 - RNA, 19 nt, Homo sapiens
ugcauuugcugucacaaua

SEQ ID NO: 989363 - RNA, 19 nt, Homo sapiens
caacagcauucauuuccau

SEQ ID NO: 989364 - RNA, 19 nt, Homo sapiens
ggaaauuugccucaguuga

SEQ ID NO: 989365 - RNA, 19 nt, Homo sapiens
ugaagcaacuugucuaaaa

SEQ ID NO: 989366 - RNA, 19 nt, Homo sapiens
ucuaugaguuugccacuga

SEQ ID NO: 989367 - RNA, 19 nt, Homo sapiens
gaaauaaguggacacaaac

SEQ ID NO: 989368 - RNA, 19 nt, Homo sapiens
ugacuucugaguacaguua

SEQ ID NO: 989369 - RNA, 19 nt, Homo sapiens
cauuuaaucugcaucuguu

SEQ ID NO: 989370 - RNA, 19 nt, Homo sapiens
aagaggagaguauuugaua

SEQ ID NO: 989371 - RNA, 19 nt, Homo sapiens
uuaaugaacugcggaacaa

SEQ ID NO: 989372 - RNA, 19 nt, Homo sapiens
aauuugaccugguguuauu

SEQ ID NO: 989373 - RNA, 19 nt, Homo sapiens
cuacuuacauacacuguca

SEQ ID NO: 989374 - RNA, 19 nt, Homo sapiens
gcuguugguuagaagcaua

SEQ ID NO: 989375 - RNA, 19 nt, Homo sapiens
gaaagcauacuguugaaac

SEQ ID NO: 989376 - RNA, 19 nt, Homo sapiens
uaauugguguugauuggaa

SEQ ID NO: 989377 - RNA, 19 nt, Homo sapiens
acaguuaaguuccuccuau

SEQ ID NO: 989378 - RNA, 19 nt, Homo sapiens
guugaaacccgcaguguug

SEQ ID NO: 989379 - RNA, 19 nt, Homo sapiens
ggagaguauuugauaagca

SEQ ID NO: 989380 - RNA, 19 nt, Homo sapiens
agaggagaguauuugauaa

SEQ ID NO: 989381 - RNA, 19 nt, Homo sapiens
ccaaagaugucaccauucc

SEQ ID NO: 989382 - RNA, 19 nt, Homo sapiens
ucaaaggccuagaucucuu

SEQ ID NO: 989383 - RNA, 19 nt, Homo sapiens
cuguagagccuaauaguuu

SEQ ID NO: 989384 - RNA, 19 nt, Homo sapiens
cauaauugguguugauugg

SEQ ID NO: 989385 - RNA, 19 nt, Homo sapiens
cagcauucauuuccauuca

SEQ ID NO: 989386 - RNA, 19 nt, Homo sapiens
aaacuaaauugaccaugca

SEQ ID NO: 989387 - RNA, 19 nt, Homo sapiens
uagcaucagagucggauua

SEQ ID NO: 989388 - RNA, 19 nt, Homo sapiens
gugauacgauccugaccaa

SEQ ID NO: 989389 - RNA, 19 nt, Homo sapiens
gauuauaugcagauuccua

SEQ ID NO: 989390 - RNA, 19 nt, Homo sapiens
gacacaaacuauccuuucu

SEQ ID NO: 989391 - RNA, 19 nt, Homo sapiens
ucucagaaguucagcuguu

SEQ ID NO: 989392 - RNA, 19 nt, Homo sapiens
aaugaaagcauacuguuga

SEQ ID NO: 989393 - RNA, 19 nt, Homo sapiens
caccauuccuaguuauuug

SEQ ID NO: 989394 - RNA, 19 nt, Homo sapiens
gaugucaccauuccuaguu

SEQ ID NO: 989395 - RNA, 19 nt, Homo sapiens
guagagagaauauuaugca

SEQ ID NO: 989396 - RNA, 19 nt, Homo sapiens
gguaacugauuaaguaggu

SEQ ID NO: 989397 - RNA, 19 nt, Homo sapiens
ggccuagaucucuuauuua

SEQ ID NO: 989398 - RNA, 19 nt, Homo sapiens
acaagucuguagagccuaa

SEQ ID NO: 989399 - RNA, 19 nt, Homo sapiens
aaagaugucaccauuccua

SEQ ID NO: 989400 - RNA, 19 nt, Homo sapiens
cauuugcugucacaauaaa

SEQ ID NO: 989401 - RNA, 19 nt, Homo sapiens
gcauuugcugucacaauaa

SEQ ID NO: 989402 - RNA, 19 nt, Homo sapiens
caguuaaguuccuccuauu

SEQ ID NO: 989403 - RNA, 19 nt, Homo sapiens
uuucagcucuucucucaga

SEQ ID NO: 989404 - RNA, 19 nt, Homo sapiens
ugggauggaucuaugaguu

SEQ ID NO: 989405 - RNA, 19 nt, Homo sapiens
cuaaauugaccaugcauau

SEQ ID NO: 989406 - RNA, 19 nt, Homo sapiens
aaacuugggcuucauuuua

SEQ ID NO: 989407 - RNA, 19 nt, Homo sapiens
ccuggaacgugcucuaguu

SEQ ID NO: 989408 - RNA, 19 nt, Homo sapiens
guuaaguuccuccuauuug

SEQ ID NO: 989409 - RNA, 19 nt, Homo sapiens
guaguuaaccugcaguaca

SEQ ID NO: 989410 - RNA, 19 nt, Homo sapiens
cgcuaaaggcucaguguua

SEQ ID NO: 989411 - RNA, 19 nt, Homo sapiens
uagcaugccuuaccuacag

SEQ ID NO: 989412 - RNA, 19 nt, Homo sapiens
gggauggaucuaugaguuu

SEQ ID NO: 989413 - RNA, 19 nt, Homo sapiens
ggaaaugaagcaacuuguc

SEQ ID NO: 989414 - RNA, 19 nt, Homo sapiens
guggugagcuauguaagga

SEQ ID NO: 989415 - RNA, 19 nt, Homo sapiens
aaggaaauuugccucaguu

SEQ ID NO: 989416 - RNA, 19 nt, Homo sapiens
aaaggaaauuugccucagu

SEQ ID NO: 989417 - RNA, 19 nt, Homo sapiens
cccaaacuacuucuagaua

SEQ ID NO: 989418 - RNA, 19 nt, Homo sapiens
cauacaaagggaucaaauu

SEQ ID NO: 989419 - RNA, 19 nt, Homo sapiens
aaacugcaauagcaaacug

SEQ ID NO: 989420 - RNA, 19 nt, Homo sapiens
caucuccacucguuucaca

SEQ ID NO: 989421 - RNA, 19 nt, Homo sapiens
ucacuugauuugcuagcuu

SEQ ID NO: 989422 - RNA, 19 nt, Homo sapiens
gcuauguggugagcuaugu

SEQ ID NO: 989423 - RNA, 19 nt, Homo sapiens
agaacaacagcauucauuu

SEQ ID NO: 989424 - RNA, 19 nt, Homo sapiens
ggagaacacccaccucuug

SEQ ID NO: 989425 - RNA, 19 nt, Homo sapiens
cagcauggccacccuuauu

SEQ ID NO: 989426 - RNA, 19 nt, Homo sapiens
caagauggacgugcacauu

SEQ ID NO: 989427 - RNA, 19 nt, Homo sapiens
aagauggacgugcacauua

SEQ ID NO: 989428 - RNA, 19 nt, Homo sapiens
ucuuggagguugugaauca

SEQ ID NO: 989429 - RNA, 19 nt, Homo sapiens
ccucagagcaugcagugaa

SEQ ID NO: 989430 - RNA, 19 nt, Homo sapiens
uagaggaguugaacguagu

SEQ ID NO: 989431 - RNA, 19 nt, Homo sapiens
ggaguugaacguaguagag

SEQ ID NO: 989432 - RNA, 19 nt, Homo sapiens
ccagggcuguuaccguugu

SEQ ID NO: 989433 - RNA, 19 nt, Homo sapiens
caggugcggguucagguua

SEQ ID NO: 989434 - RNA, 19 nt, Homo sapiens
gcuagaggaguugaacgua

SEQ ID NO: 989435 - RNA, 19 nt, Homo sapiens
uuauuggucuguccaucaa

SEQ ID NO: 989436 - RNA, 19 nt, Homo sapiens
ccaucaaggucaagcuucu

SEQ ID NO: 989437 - RNA, 19 nt, Homo sapiens
gcaggugcggguucagguu

SEQ ID NO: 989438 - RNA, 19 nt, Homo sapiens
cacugacgcuagaggaguu

SEQ ID NO: 989439 - RNA, 19 nt, Homo sapiens
ucacaaugagaaacuaaca

SEQ ID NO: 989440 - RNA, 19 nt, Homo sapiens
cagcugcccuggagaacac

SEQ ID NO: 989441 - RNA, 19 nt, Homo sapiens
agauggacgugcacauuac

SEQ ID NO: 989442 - RNA, 19 nt, Homo sapiens
uuucuugaaucacucacaa

SEQ ID NO: 989443 - RNA, 19 nt, Homo sapiens
caucgacgcacgcgagauc

SEQ ID NO: 989444 - RNA, 19 nt, Homo sapiens
gcagcauggccacccuuau

SEQ ID NO: 989445 - RNA, 19 nt, Homo sapiens
uagagcaggugcggguuca

SEQ ID NO: 989446 - RNA, 19 nt, Homo sapiens
ugaaggaccuguauacugu

SEQ ID NO: 989447 - RNA, 19 nt, Homo sapiens
ugacguauaugacgccuuu

SEQ ID NO: 989448 - RNA, 19 nt, Homo sapiens
agaauucccuagcugcuua

SEQ ID NO: 989449 - RNA, 19 nt, Homo sapiens
gaaguuauuuguggaaaca

SEQ ID NO: 989450 - RNA, 19 nt, Homo sapiens
gacagaagcaguuauguga

SEQ ID NO: 989451 - RNA, 19 nt, Homo sapiens
ucacaaagcucaguaucau

SEQ ID NO: 989452 - RNA, 19 nt, Homo sapiens
aaacgagacucagaaagaa

SEQ ID NO: 989453 - RNA, 19 nt, Homo sapiens
guaugggucuggucaaaga

SEQ ID NO: 989454 - RNA, 19 nt, Homo sapiens
ccuagcugcuuauaaagua

SEQ ID NO: 989455 - RNA, 19 nt, Homo sapiens
ggcagaaggugucauuuua

SEQ ID NO: 989456 - RNA, 19 nt, Homo sapiens
agaaacagaugaagagaag

SEQ ID NO: 989457 - RNA, 19 nt, Homo sapiens
ggaaacagggaaggcuuua

SEQ ID NO: 989458 - RNA, 19 nt, Homo sapiens
ccaaagcucccauccaaga

SEQ ID NO: 989459 - RNA, 19 nt, Homo sapiens
cuugaucucuaagguauua

SEQ ID NO: 989460 - RNA, 19 nt, Homo sapiens
gagaaguuauuuguggaaa

SEQ ID NO: 989461 - RNA, 19 nt, Homo sapiens
acacugagcuacagaaacu

SEQ ID NO: 989462 - RNA, 19 nt, Homo sapiens
gcugaauguugagcuauuu

SEQ ID NO: 989463 - RNA, 19 nt, Homo sapiens
aaacagggaaggcuuuauu

SEQ ID NO: 989464 - RNA, 19 nt, Homo sapiens
gaaguacacugagcuacag

SEQ ID NO: 989465 - RNA, 19 nt, Homo sapiens
guugaacuguguaaauguu

SEQ ID NO: 989466 - RNA, 19 nt, Homo sapiens
acacggagguagucacguu

SEQ ID NO: 989467 - RNA, 19 nt, Homo sapiens
gagaaacagaugaagagaa

SEQ ID NO: 989468 - RNA, 19 nt, Homo sapiens
acagaaacuuggagaaaca

SEQ ID NO: 989469 - RNA, 19 nt, Homo sapiens
ccacgaggaucggauuaga

SEQ ID NO: 989470 - RNA, 19 nt, Homo sapiens
guaaauguuucuugaucuc

SEQ ID NO: 989471 - RNA, 19 nt, Homo sapiens
ugccuucucuuaguuauuu

SEQ ID NO: 989472 - RNA, 19 nt, Homo sapiens
aaacagaugaagagaaguu

SEQ ID NO: 989473 - RNA, 19 nt, Homo sapiens
ggagaaguacacugagcua

SEQ ID NO: 989474 - RNA, 19 nt, Homo sapiens
guguaaauguuucuugauc

SEQ ID NO: 989475 - RNA, 19 nt, Homo sapiens
agccaaagcucccauccaa

SEQ ID NO: 989476 - RNA, 19 nt, Homo sapiens
uaucaugguuugacagaag

SEQ ID NO: 989477 - RNA, 19 nt, Homo sapiens
gaaauccgaacacuugagu

SEQ ID NO: 989478 - RNA, 19 nt, Homo sapiens
cuacagaaacuuggagaaa

SEQ ID NO: 989479 - RNA, 19 nt, Homo sapiens
uucccuagcugcuuauaaa

SEQ ID NO: 989480 - RNA, 19 nt, Homo sapiens
cagaugaagagaaguuauu

SEQ ID NO: 989481 - RNA, 19 nt, Homo sapiens
cagaagcaguuaugugaac

SEQ ID NO: 989482 - RNA, 19 nt, Homo sapiens
ucuauucaauccaaacuuc

SEQ ID NO: 989483 - RNA, 19 nt, Homo sapiens
gaugaagagaaguuauuug

SEQ ID NO: 989484 - RNA, 19 nt, Homo sapiens
guacacugagcuacagaaa

SEQ ID NO: 989485 - RNA, 19 nt, Homo sapiens
ggcugaauguugagcuauu

SEQ ID NO: 989486 - RNA, 19 nt, Homo sapiens
gaagaaaacgagacucaga

SEQ ID NO: 989487 - RNA, 19 nt, Homo sapiens
gaccacagacugcguugga

SEQ ID NO: 989488 - RNA, 19 nt, Homo sapiens
gagcgaaguuuuauucagu

SEQ ID NO: 989489 - RNA, 19 nt, Homo sapiens
gguauuauguuugccuucu

SEQ ID NO: 989490 - RNA, 19 nt, Homo sapiens
ugacagaagcaguuaugug

SEQ ID NO: 989491 - RNA, 19 nt, Homo sapiens
ggagaaacagaugaagaga

SEQ ID NO: 989492 - RNA, 19 nt, Homo sapiens
gaaacuuggagaaacagau

SEQ ID NO: 989493 - RNA, 19 nt, Homo sapiens
guguaugggucuggucaaa

SEQ ID NO: 989494 - RNA, 19 nt, Homo sapiens
gcagaaggugucauuuuaa

SEQ ID NO: 989495 - RNA, 19 nt, Homo sapiens
ggauuagagcgaaguuuua

SEQ ID NO: 989496 - RNA, 19 nt, Homo sapiens
ccugugguuugacguauau

SEQ ID NO: 989497 - RNA, 19 nt, Homo sapiens
ucuacucacuggcugaaug

SEQ ID NO: 989498 - RNA, 19 nt, Homo sapiens
cuagcugcuuauaaaguaa

SEQ ID NO: 989499 - RNA, 19 nt, Homo sapiens
aauaaagaauucccuagcu

SEQ ID NO: 989500 - RNA, 19 nt, Homo sapiens
ucuaagguauuauguuugc

SEQ ID NO: 989501 - RNA, 19 nt, Homo sapiens
ugaacuguguaaauguuuc

SEQ ID NO: 989502 - RNA, 19 nt, Homo sapiens
gaaacagggaaggcuuuau

SEQ ID NO: 989503 - RNA, 19 nt, Homo sapiens
gucaacgguuuguggagaa

SEQ ID NO: 989504 - RNA, 19 nt, Homo sapiens
ccacaggaccagcauuugg

SEQ ID NO: 989505 - RNA, 19 nt, Homo sapiens
gagggagcccgucuuccaa

SEQ ID NO: 989506 - RNA, 19 nt, Homo sapiens
aaagcucaguaucaugguu

SEQ ID NO: 989507 - RNA, 19 nt, Homo sapiens
guaccacgaggaucggauu

SEQ ID NO: 989508 - RNA, 19 nt, Homo sapiens
cuguguaaauguuucuuga

SEQ ID NO: 989509 - RNA, 19 nt, Homo sapiens
cagacugcguuggaagaaa

SEQ ID NO: 989510 - RNA, 19 nt, Homo sapiens
aaacuuggagaaacagaug

SEQ ID NO: 989511 - RNA, 19 nt, Homo sapiens
cucacuggcugaauguuga

SEQ ID NO: 989512 - RNA, 19 nt, Homo sapiens
ucaguaucaugguuugaca

SEQ ID NO: 989513 - RNA, 19 nt, Homo sapiens
cuucaagucuaccugucaa

SEQ ID NO: 989514 - RNA, 19 nt, Homo sapiens
gaacuguguaaauguuucu

SEQ ID NO: 989515 - RNA, 19 nt, Homo sapiens
ggcauucacacucuacuca

SEQ ID NO: 989516 - RNA, 19 nt, Homo sapiens
gagaagccccugugguuug

SEQ ID NO: 989517 - RNA, 19 nt, Homo sapiens
uacagaaacuuggagaaac

SEQ ID NO: 989518 - RNA, 19 nt, Homo sapiens
gggagcccgucuuccaaag

SEQ ID NO: 989519 - RNA, 19 nt, Homo sapiens
gaucucuaagguauuaugu

SEQ ID NO: 989520 - RNA, 19 nt, Homo sapiens
aaaacgagacucagaaaga

SEQ ID NO: 989521 - RNA, 19 nt, Homo sapiens
ggaaauccgaacacuugag

SEQ ID NO: 989522 - RNA, 19 nt, Homo sapiens
ugaagagaaguuauuugug

SEQ ID NO: 989523 - RNA, 19 nt, Homo sapiens
guaccaggcgcagaucaug

SEQ ID NO: 989524 - RNA, 19 nt, Homo sapiens
agacugcguuggaagaaaa

SEQ ID NO: 989525 - RNA, 19 nt, Homo sapiens
gcgaagcaaggacucaaca

SEQ ID NO: 989526 - RNA, 19 nt, Homo sapiens
aacgguuuguggagaagua

SEQ ID NO: 989527 - RNA, 19 nt, Homo sapiens
guaucaugguuugacagaa

SEQ ID NO: 989528 - RNA, 19 nt, Homo sapiens
uuauguuugccuucucuua

SEQ ID NO: 989529 - RNA, 19 nt, Homo sapiens
agaaguacacugagcuaca

SEQ ID NO: 989530 - RNA, 19 nt, Homo sapiens
gguuugacagaagcaguua

SEQ ID NO: 989531 - RNA, 19 nt, Homo sapiens
ugagggagcccgucuucca

SEQ ID NO: 989532 - RNA, 19 nt, Homo sapiens
gucacaaagcucaguauca

SEQ ID NO: 989533 - RNA, 19 nt, Homo sapiens
ggagaagccccugugguuu

SEQ ID NO: 989534 - RNA, 19 nt, Homo sapiens
cugaaggaccuguauacug

SEQ ID NO: 989535 - RNA, 19 nt, Homo sapiens
cacaggaccagcauuugga

SEQ ID NO: 989536 - RNA, 19 nt, Homo sapiens
cgagugcgauauggcaaag

SEQ ID NO: 989537 - RNA, 19 nt, Homo sapiens
cccugugguuugacguaua

SEQ ID NO: 989538 - RNA, 19 nt, Homo sapiens
gaagaaagugcauuuauug

SEQ ID NO: 989539 - RNA, 19 nt, Homo sapiens
caagaaauguccucccuuu

SEQ ID NO: 989540 - RNA, 19 nt, Homo sapiens
uaaagaagcuucguggaaa

SEQ ID NO: 989541 - RNA, 19 nt, Homo sapiens
gaaagugcauuuauugucu

SEQ ID NO: 989542 - RNA, 19 nt, Homo sapiens
gaaggagacuuaugauugg

SEQ ID NO: 989543 - RNA, 19 nt, Homo sapiens
ccaagaagaaggagacuua

SEQ ID NO: 989544 - RNA, 19 nt, Homo sapiens
gaaaggagaaaccaaagaa

SEQ ID NO: 989545 - RNA, 19 nt, Homo sapiens
guggugggcugcagauuaa

SEQ ID NO: 989546 - RNA, 19 nt, Homo sapiens
gagaagaaagugcauuuau

SEQ ID NO: 989547 - RNA, 19 nt, Homo sapiens
gagagaagaaagugcauuu

SEQ ID NO: 989548 - RNA, 19 nt, Homo sapiens
gaagucaccaggccuacua

SEQ ID NO: 989549 - RNA, 19 nt, Homo sapiens
agaaggagacuuaugauug

SEQ ID NO: 989550 - RNA, 19 nt, Homo sapiens
cauuguggcugguuucuug

SEQ ID NO: 989551 - RNA, 19 nt, Homo sapiens
ggaacacagucaucuccuu

SEQ ID NO: 989552 - RNA, 19 nt, Homo sapiens
agaagaaggagacuuauga

SEQ ID NO: 989553 - RNA, 19 nt, Homo sapiens
ugaaaguggugaaacuguu

SEQ ID NO: 989554 - RNA, 19 nt, Homo sapiens
gguggugggcugcagauua

SEQ ID NO: 989555 - RNA, 19 nt, Homo sapiens
ggagacuuaugauugguau

SEQ ID NO: 989556 - RNA, 19 nt, Homo sapiens
uguccucccuuucagaaua

SEQ ID NO: 989557 - RNA, 19 nt, Homo sapiens
aaugucaucuuccuaaaug

SEQ ID NO: 989558 - RNA, 19 nt, Homo sapiens
ggaaaggagaaaccaaaga

SEQ ID NO: 989559 - RNA, 19 nt, Homo sapiens
aaucuaauccgguuacauu

SEQ ID NO: 989560 - RNA, 19 nt, Homo sapiens
aaagaaaggagaagggaaa

SEQ ID NO: 989561 - RNA, 19 nt, Homo sapiens
cuaaagaagcuucguggaa

SEQ ID NO: 989562 - RNA, 19 nt, Homo sapiens
gaagaaggagacuuaugau

SEQ ID NO: 989563 - RNA, 19 nt, Homo sapiens
ucaccaggccuacuaauuc

SEQ ID NO: 989564 - RNA, 19 nt, Homo sapiens
gaaugucaucuuccuaaau

SEQ ID NO: 989565 - RNA, 19 nt, Homo sapiens
ggagaaaccaaagaaagga

SEQ ID NO: 989566 - RNA, 19 nt, Homo sapiens
ucaccacacuuacgcugaa

SEQ ID NO: 989567 - RNA, 19 nt, Homo sapiens
uuaccugauucucuaauga

SEQ ID NO: 989568 - RNA, 19 nt, Homo sapiens
ccgcaugucucgucucagu

SEQ ID NO: 989569 - RNA, 19 nt, Homo sapiens
cuaauccgguuacauugug

SEQ ID NO: 989570 - RNA, 19 nt, Homo sapiens
gaaaucuaauccgguuaca

SEQ ID NO: 989571 - RNA, 19 nt, Homo sapiens
gaaaccaaagaaaggagaa

SEQ ID NO: 989572 - RNA, 19 nt, Homo sapiens
cuacuaauuccaagucuau

SEQ ID NO: 989573 - RNA, 19 nt, Homo sapiens
ucuccuuggugaaaucuaa

SEQ ID NO: 989574 - RNA, 19 nt, Homo sapiens
cacuuacgcugaacucaug

SEQ ID NO: 989575 - RNA, 19 nt, Homo sapiens
guggaaaggagaaaccaaa

SEQ ID NO: 989576 - RNA, 19 nt, Homo sapiens
gaaaggagaagggaaaaga

SEQ ID NO: 989577 - RNA, 19 nt, Homo sapiens
aaagaagcuucguggaaag

SEQ ID NO: 989578 - RNA, 19 nt, Homo sapiens
auccaaaucaccacacuua

SEQ ID NO: 989579 - RNA, 19 nt, Homo sapiens
cuucggcacuguagcuuug

SEQ ID NO: 989580 - RNA, 19 nt, Homo sapiens
uugaacacauucuaacugu

SEQ ID NO: 989581 - RNA, 19 nt, Homo sapiens
ugaaguuuauuuggaggaa

SEQ ID NO: 989582 - RNA, 19 nt, Homo sapiens
agagaagaaagugcauuua

SEQ ID NO: 989583 - RNA, 19 nt, Homo sapiens
ggagagaagaaagugcauu

SEQ ID NO: 989584 - RNA, 19 nt, Homo sapiens
cagacgcuccgauuucuug

SEQ ID NO: 989585 - RNA, 19 nt, Homo sapiens
ccuacuaauuccaagucua

SEQ ID NO: 989586 - RNA, 19 nt, Homo sapiens
aaaggagaaaccaaagaaa

SEQ ID NO: 989587 - RNA, 19 nt, Homo sapiens
gcugguuucuugaacacau

SEQ ID NO: 989588 - RNA, 19 nt, Homo sapiens
guuacauuguggcugguuu

SEQ ID NO: 989589 - RNA, 19 nt, Homo sapiens
cuaugaaaguggugaaacu

SEQ ID NO: 989590 - RNA, 19 nt, Homo sapiens
ggugggcugcagauuaauu

SEQ ID NO: 989591 - RNA, 19 nt, Homo sapiens
aagaaggagacuuaugauu

SEQ ID NO: 989592 - RNA, 19 nt, Homo sapiens
ucuaacuccuugccacuca

SEQ ID NO: 989593 - RNA, 19 nt, Homo sapiens
agaaagugcauuuauuguc

SEQ ID NO: 989594 - RNA, 19 nt, Homo sapiens
gugggcugcagauuaauuu

SEQ ID NO: 989595 - RNA, 19 nt, Homo sapiens
cuaauuccaagucuaugaa

SEQ ID NO: 989596 - RNA, 19 nt, Homo sapiens
ccuuggccguguaauguga

SEQ ID NO: 989597 - RNA, 19 nt, Homo sapiens
guccucccuuucagaauau

SEQ ID NO: 989598 - RNA, 19 nt, Homo sapiens
caagaagaaggagacuuau

SEQ ID NO: 989599 - RNA, 19 nt, Homo sapiens
acaguagaaggcucaguuu

SEQ ID NO: 989600 - RNA, 19 nt, Homo sapiens
gucaccaggccuacuaauu

SEQ ID NO: 989601 - RNA, 19 nt, Homo sapiens
uuggaggaaugucaucuuc

SEQ ID NO: 989602 - RNA, 19 nt, Homo sapiens
acacagucaucuccuuggu

SEQ ID NO: 989603 - RNA, 19 nt, Homo sapiens
gcagacgcuccgauuucuu

SEQ ID NO: 989604 - RNA, 19 nt, Homo sapiens
caugcagacgcuccgauuu

SEQ ID NO: 989605 - RNA, 19 nt, Homo sapiens
uuuguaaccaccuuaagaa

SEQ ID NO: 989606 - RNA, 19 nt, Homo sapiens
agucaucuccuuggugaaa

SEQ ID NO: 989607 - RNA, 19 nt, Homo sapiens
uaccugauucucuaaugaa

SEQ ID NO: 989608 - RNA, 19 nt, Homo sapiens
ggaggaacacagucaucuc

SEQ ID NO: 989609 - RNA, 19 nt, Homo sapiens
aaggagaaaccaaagaaag

SEQ ID NO: 989610 - RNA, 19 nt, Homo sapiens
ccaaaucaccacacuuacg

SEQ ID NO: 989611 - RNA, 19 nt, Homo sapiens
gaagaaagugcauuuauug

SEQ ID NO: 989612 - RNA, 19 nt, Homo sapiens
caagaaauguccucccuuu

SEQ ID NO: 989613 - RNA, 19 nt, Homo sapiens
uaaagaagcuucguggaaa

SEQ ID NO: 989614 - RNA, 19 nt, Homo sapiens
gaaagugcauuuauugucu

SEQ ID NO: 989615 - RNA, 19 nt, Homo sapiens
gaaggagacuuaugauugg

SEQ ID NO: 989616 - RNA, 19 nt, Homo sapiens
ccaagaagaaggagacuua

SEQ ID NO: 989617 - RNA, 19 nt, Homo sapiens
gaaaggagaaaccaaagaa

SEQ ID NO: 989618 - RNA, 19 nt, Homo sapiens
gagaagaaagugcauuuau

SEQ ID NO: 989619 - RNA, 19 nt, Homo sapiens
gagagaagaaagugcauuu

SEQ ID NO: 989620 - RNA, 19 nt, Homo sapiens
gaagucaccaggccuacua

SEQ ID NO: 989621 - RNA, 19 nt, Homo sapiens
agaaggagacuuaugauug

SEQ ID NO: 989622 - RNA, 19 nt, Homo sapiens
cauuguggcugguuucuug

SEQ ID NO: 989623 - RNA, 19 nt, Homo sapiens
ggaacacagucaucuccuu

SEQ ID NO: 989624 - RNA, 19 nt, Homo sapiens
agaagaaggagacuuauga

SEQ ID NO: 989625 - RNA, 19 nt, Homo sapiens
ugaaaguggugaaacuguu

SEQ ID NO: 989626 - RNA, 19 nt, Homo sapiens
ggagacuuaugauugguau

SEQ ID NO: 989627 - RNA, 19 nt, Homo sapiens
uguccucccuuucagaaua

SEQ ID NO: 989628 - RNA, 19 nt, Homo sapiens
aaugucaucuuccuaaaug

SEQ ID NO: 989629 - RNA, 19 nt, Homo sapiens
ggaaaggagaaaccaaaga

SEQ ID NO: 989630 - RNA, 19 nt, Homo sapiens
aaucuaauccgguuacauu

SEQ ID NO: 989631 - RNA, 19 nt, Homo sapiens
aaagaaaggagaagggaaa

SEQ ID NO: 989632 - RNA, 19 nt, Homo sapiens
cuaaagaagcuucguggaa

SEQ ID NO: 989633 - RNA, 19 nt, Homo sapiens
gaagaaggagacuuaugau

SEQ ID NO: 989634 - RNA, 19 nt, Homo sapiens
ucaccaggccuacuaauuc

SEQ ID NO: 989635 - RNA, 19 nt, Homo sapiens
gaaugucaucuuccuaaau

SEQ ID NO: 989636 - RNA, 19 nt, Homo sapiens
ggagaaaccaaagaaagga

SEQ ID NO: 989637 - RNA, 19 nt, Homo sapiens
ucaccacacuuacgcugaa

SEQ ID NO: 989638 - RNA, 19 nt, Homo sapiens
uuaccugauucucuaauga

SEQ ID NO: 989639 - RNA, 19 nt, Homo sapiens
ccgcaugucucgucucagu

SEQ ID NO: 989640 - RNA, 19 nt, Homo sapiens
cuaauccgguuacauugug

SEQ ID NO: 989641 - RNA, 19 nt, Homo sapiens
gaaaucuaauccgguuaca

SEQ ID NO: 989642 - RNA, 19 nt, Homo sapiens
ugaggaaggucaggucuag

SEQ ID NO: 989643 - RNA, 19 nt, Homo sapiens
gaaaccaaagaaaggagaa

SEQ ID NO: 989644 - RNA, 19 nt, Homo sapiens
cuacuaauuccaagucuau

SEQ ID NO: 989645 - RNA, 19 nt, Homo sapiens
ucuccuuggugaaaucuaa

SEQ ID NO: 989646 - RNA, 19 nt, Homo sapiens
cacuuacgcugaacucaug

SEQ ID NO: 989647 - RNA, 19 nt, Homo sapiens
guggaaaggagaaaccaaa

SEQ ID NO: 989648 - RNA, 19 nt, Homo sapiens
gaaaggagaagggaaaaga

SEQ ID NO: 989649 - RNA, 19 nt, Homo sapiens
aaagaagcuucguggaaag

SEQ ID NO: 989650 - RNA, 19 nt, Homo sapiens
auccaaaucaccacacuua

SEQ ID NO: 989651 - RNA, 19 nt, Homo sapiens
uugaacacauucuaacugu

SEQ ID NO: 989652 - RNA, 19 nt, Homo sapiens
ugaaguuuauuuggaggaa

SEQ ID NO: 989653 - RNA, 19 nt, Homo sapiens
agagaagaaagugcauuua

SEQ ID NO: 989654 - RNA, 19 nt, Homo sapiens
ggucaggucuaggaacucu

SEQ ID NO: 989655 - RNA, 19 nt, Homo sapiens
ccuacuaauuccaagucua

SEQ ID NO: 989656 - RNA, 19 nt, Homo sapiens
ggagagaagaaagugcauu

SEQ ID NO: 989657 - RNA, 19 nt, Homo sapiens
cagacgcuccgauuucuug

SEQ ID NO: 989658 - RNA, 19 nt, Homo sapiens
ucaggucuaggaacucuaa

SEQ ID NO: 989659 - RNA, 19 nt, Homo sapiens
aaaggagaaaccaaagaaa

SEQ ID NO: 989660 - RNA, 19 nt, Homo sapiens
gcugguuucuugaacacau

SEQ ID NO: 989661 - RNA, 19 nt, Homo sapiens
guuacauuguggcugguuu

SEQ ID NO: 989662 - RNA, 19 nt, Homo sapiens
ggaaggucaggucuaggaa

SEQ ID NO: 989663 - RNA, 19 nt, Homo sapiens
cuaugaaaguggugaaacu

SEQ ID NO: 989664 - RNA, 19 nt, Homo sapiens
aagaaggagacuuaugauu

SEQ ID NO: 989665 - RNA, 19 nt, Homo sapiens
ucuaacuccuugccacuca

SEQ ID NO: 989666 - RNA, 19 nt, Homo sapiens
cuaauuccaagucuaugaa

SEQ ID NO: 989667 - RNA, 19 nt, Homo sapiens
agaaagugcauuuauuguc

SEQ ID NO: 989668 - RNA, 19 nt, Homo sapiens
ccuuggccguguaauguga

SEQ ID NO: 989669 - RNA, 19 nt, Homo sapiens
guccucccuuucagaauau

SEQ ID NO: 989670 - RNA, 19 nt, Homo sapiens
caagaagaaggagacuuau

SEQ ID NO: 989671 - RNA, 19 nt, Homo sapiens
gucaccaggccuacuaauu

SEQ ID NO: 989672 - RNA, 19 nt, Homo sapiens
uuggaggaaugucaucuuc

SEQ ID NO: 989673 - RNA, 19 nt, Homo sapiens
acacagucaucuccuuggu

SEQ ID NO: 989674 - RNA, 19 nt, Homo sapiens
gcagacgcuccgauuucuu

SEQ ID NO: 989675 - RNA, 19 nt, Homo sapiens
caugcagacgcuccgauuu

SEQ ID NO: 989676 - RNA, 19 nt, Homo sapiens
agucaucuccuuggugaaa

SEQ ID NO: 989677 - RNA, 19 nt, Homo sapiens
uaccugauucucuaaugaa

SEQ ID NO: 989678 - RNA, 19 nt, Homo sapiens
ggucuaggaacucuaacuc

SEQ ID NO: 989679 - RNA, 19 nt, Homo sapiens
ggaggaacacagucaucuc

SEQ ID NO: 989680 - RNA, 19 nt, Homo sapiens
aaggagaaaccaaagaaag

SEQ ID NO: 989681 - RNA, 19 nt, Homo sapiens
ccaaaucaccacacuuacg

SEQ ID NO: 989682 - RNA, 19 nt, Homo sapiens
ggucaaagcuccugaugaa

SEQ ID NO: 989683 - RNA, 19 nt, Homo sapiens
gaaaggagguacuguagau

SEQ ID NO: 989684 - RNA, 19 nt, Homo sapiens
caaagucacuggucaccua

SEQ ID NO: 989685 - RNA, 19 nt, Homo sapiens
gggacugacuguaaguuua

SEQ ID NO: 989686 - RNA, 19 nt, Homo sapiens
agagguagcucacgcgaua

SEQ ID NO: 989687 - RNA, 19 nt, Homo sapiens
gcaccaggcucucaaacug

SEQ ID NO: 989688 - RNA, 19 nt, Homo sapiens
gaagaaacccugauugcau

SEQ ID NO: 989689 - RNA, 19 nt, Homo sapiens
caacuuaaauguucuugag

SEQ ID NO: 989690 - RNA, 19 nt, Homo sapiens
aagaagaaauccugaaaug

SEQ ID NO: 989691 - RNA, 19 nt, Homo sapiens
ggacugacuguaaguuuaa

SEQ ID NO: 989692 - RNA, 19 nt, Homo sapiens
caaagcuccugaugaagaa

SEQ ID NO: 989693 - RNA, 19 nt, Homo sapiens
cagcagaccuaauugacaa

SEQ ID NO: 989694 - RNA, 19 nt, Homo sapiens
gaagaaauccugaaaugcu

SEQ ID NO: 989695 - RNA, 19 nt, Homo sapiens
caaagaagaaauccugaaa

SEQ ID NO: 989696 - RNA, 19 nt, Homo sapiens
aagaaacccugauugcauu

SEQ ID NO: 989697 - RNA, 19 nt, Homo sapiens
ucacccaacuuaaauguuc

SEQ ID NO: 989698 - RNA, 19 nt, Homo sapiens
acacagauacugaaaguga

SEQ ID NO: 989699 - RNA, 19 nt, Homo sapiens
gaggaaaggagguacugua

SEQ ID NO: 989700 - RNA, 19 nt, Homo sapiens
ucaaagcuccugaugaaga

SEQ ID NO: 989701 - RNA, 19 nt, Homo sapiens
gaagggaaggcgcgaguga

SEQ ID NO: 989702 - RNA, 19 nt, Homo sapiens
acacacagauacugaaagu

SEQ ID NO: 989703 - RNA, 19 nt, Homo sapiens
cggcuuggcuguuggaguu

SEQ ID NO: 989704 - RNA, 19 nt, Homo sapiens
cugaaaugcucaaacaaug

SEQ ID NO: 989705 - RNA, 19 nt, Homo sapiens
uagguggacuuugauauga

SEQ ID NO: 989706 - RNA, 19 nt, Homo sapiens
acaagcagauucaaagaag

SEQ ID NO: 989707 - RNA, 19 nt, Homo sapiens
aauccuugguuauggaaua

SEQ ID NO: 989708 - RNA, 19 nt, Homo sapiens
ggaaaggagguacuguaga

SEQ ID NO: 989709 - RNA, 19 nt, Homo sapiens
ggaaggcgcgagugaggaa

SEQ ID NO: 989710 - RNA, 19 nt, Homo sapiens
cguguucgcuugcccagaa

SEQ ID NO: 989711 - RNA, 19 nt, Homo sapiens
guuugaagccugucagauu

SEQ ID NO: 989712 - RNA, 19 nt, Homo sapiens
caagcagauucaaagaaga

SEQ ID NO: 989713 - RNA, 19 nt, Homo sapiens
gcaagacacacacagauac

SEQ ID NO: 989714 - RNA, 19 nt, Homo sapiens
gaugaagaaacccugauug

SEQ ID NO: 989715 - RNA, 19 nt, Homo sapiens
gaaagugaagcaagcaucu

SEQ ID NO: 989716 - RNA, 19 nt, Homo sapiens
ggacuuugauaugacaaca

SEQ ID NO: 989717 - RNA, 19 nt, Homo sapiens
uuuacuagguggacuuuga

SEQ ID NO: 989718 - RNA, 19 nt, Homo sapiens
aaacccugauugcauuauu

SEQ ID NO: 989719 - RNA, 19 nt, Homo sapiens
gagcaagacacacacagau

SEQ ID NO: 989720 - RNA, 19 nt, Homo sapiens
gcaagacgagcaagacaca

SEQ ID NO: 989721 - RNA, 19 nt, Homo sapiens
caaacaaugggaauacugu

SEQ ID NO: 989722 - RNA, 19 nt, Homo sapiens
acacucggcuuggcuguug

SEQ ID NO: 989723 - RNA, 19 nt, Homo sapiens
gaacuuugucacccaggaa

SEQ ID NO: 989724 - RNA, 19 nt, Homo sapiens
caaacuguccuagggauug

SEQ ID NO: 989725 - RNA, 19 nt, Homo sapiens
gaccagcagaccuaauuga

SEQ ID NO: 989726 - RNA, 19 nt, Homo sapiens
gucagauucuaacaacaaa

SEQ ID NO: 989727 - RNA, 19 nt, Homo sapiens
gguucgaaaugacuuaaag

SEQ ID NO: 989728 - RNA, 19 nt, Homo sapiens
ccuugguuauggaauauuu

SEQ ID NO: 989729 - RNA, 19 nt, Homo sapiens
cacagauacugaaagugaa

SEQ ID NO: 989730 - RNA, 19 nt, Homo sapiens
uuugaagccugucagauuc

SEQ ID NO: 989731 - RNA, 19 nt, Homo sapiens
ggaccagcagaccuaauug

SEQ ID NO: 989732 - RNA, 19 nt, Homo sapiens
ggaguugcuuguggcaugu

SEQ ID NO: 989733 - RNA, 19 nt, Homo sapiens
uaaaaccuauucccauguu

SEQ ID NO: 989734 - RNA, 19 nt, Homo sapiens
guagcucacgcgauagaaa

SEQ ID NO: 989735 - RNA, 19 nt, Homo sapiens
agaccuaauugacaaaguc

SEQ ID NO: 989736 - RNA, 19 nt, Homo sapiens
agacacacacagauacuga

SEQ ID NO: 989737 - RNA, 19 nt, Homo sapiens
cuuaaauguucuugagaug

SEQ ID NO: 989738 - RNA, 19 nt, Homo sapiens
ucaaagaagaaauccugaa

SEQ ID NO: 989739 - RNA, 19 nt, Homo sapiens
ugaagccugucagauucua

SEQ ID NO: 989740 - RNA, 19 nt, Homo sapiens
gguggacuuugauaugaca

SEQ ID NO: 989741 - RNA, 19 nt, Homo sapiens
gccaggaccagcagaccua

SEQ ID NO: 989742 - RNA, 19 nt, Homo sapiens
gaugcuggacguacucaga

SEQ ID NO: 989743 - RNA, 19 nt, Homo sapiens
ucaagaugcuggacguacu

SEQ ID NO: 989744 - RNA, 19 nt, Homo sapiens
ccugaaaugcucaaacaau

SEQ ID NO: 989745 - RNA, 19 nt, Homo sapiens
guagaugcccuccaaaucc

SEQ ID NO: 989746 - RNA, 19 nt, Homo sapiens
ugucagauucuaacaacaa

SEQ ID NO: 989747 - RNA, 19 nt, Homo sapiens
ccaaggugguggucaaagc

SEQ ID NO: 989748 - RNA, 19 nt, Homo sapiens
caacaaaagcugaauuucu

SEQ ID NO: 989749 - RNA, 19 nt, Homo sapiens
cuagguggacuuugauaug

SEQ ID NO: 989750 - RNA, 19 nt, Homo sapiens
aagcagauucaaagaagaa

SEQ ID NO: 989751 - RNA, 19 nt, Homo sapiens
cuacaagcagauucaaaga

SEQ ID NO: 989752 - RNA, 19 nt, Homo sapiens
gcuggagccuucgaguaug

SEQ ID NO: 989753 - RNA, 19 nt, Homo sapiens
gaauuucuucacccaacuu

SEQ ID NO: 989754 - RNA, 19 nt, Homo sapiens
gcucaaacaaugggaauac

SEQ ID NO: 989755 - RNA, 19 nt, Homo sapiens
ccuauucccauguucuaaa

SEQ ID NO: 989756 - RNA, 19 nt, Homo sapiens
uuucuucacccaacuuaaa

SEQ ID NO: 989757 - RNA, 19 nt, Homo sapiens
gaagccugucagauucuaa

SEQ ID NO: 989758 - RNA, 19 nt, Homo sapiens
acacacacagauacugaaa

SEQ ID NO: 989759 - RNA, 19 nt, Homo sapiens
gcagauucaaagaagaaau

SEQ ID NO: 989760 - RNA, 19 nt, Homo sapiens
ucgaaaugacuuaaagaug

SEQ ID NO: 989761 - RNA, 19 nt, Homo sapiens
cgagcaagacacacacaga

SEQ ID NO: 989762 - RNA, 19 nt, Homo sapiens
ccugucagauucuaacaac

SEQ ID NO: 989763 - RNA, 19 nt, Homo sapiens
gaaacccugauugcauuau

SEQ ID NO: 989764 - RNA, 19 nt, Homo sapiens
agaaacccugauugcauua

SEQ ID NO: 989765 - RNA, 19 nt, Homo sapiens
ugaagaaacccugauugca

SEQ ID NO: 989766 - RNA, 19 nt, Homo sapiens
uacaagcagauucaaagaa

SEQ ID NO: 989767 - RNA, 19 nt, Homo sapiens
gggaguacaagaugauucu

SEQ ID NO: 989768 - RNA, 19 nt, Homo sapiens
caaauccuugguuauggaa

SEQ ID NO: 989769 - RNA, 19 nt, Homo sapiens
uacuguagaugcccuccaa

SEQ ID NO: 989770 - RNA, 19 nt, Homo sapiens
ugaugaagaaacccugauu

SEQ ID NO: 989771 - RNA, 19 nt, Homo sapiens
gaaauccugaaaugcucaa

SEQ ID NO: 989772 - RNA, 19 nt, Homo sapiens
gcucucaugcugcuguuuc

SEQ ID NO: 989773 - RNA, 19 nt, Homo sapiens
agcaagacacacacagaua

SEQ ID NO: 989774 - RNA, 19 nt, Homo sapiens
caacaaccccuccaucaca

SEQ ID NO: 989775 - RNA, 19 nt, Homo sapiens
aacccugauugcauuauug

SEQ ID NO: 989776 - RNA, 19 nt, Homo sapiens
ccuacaagcagauucaaag

SEQ ID NO: 989777 - RNA, 19 nt, Homo sapiens
cgagugaggaaaggaggua

SEQ ID NO: 989778 - RNA, 19 nt, Homo sapiens
ccagcagaccuaauugaca

SEQ ID NO: 989779 - RNA, 19 nt, Homo sapiens
ugaaaugcucaaacaaugg

SEQ ID NO: 989780 - RNA, 19 nt, Homo sapiens
guucgaaaugacuuaaaga

SEQ ID NO: 989781 - RNA, 19 nt, Homo sapiens
gcuggacguacucagauug

SEQ ID NO: 989782 - RNA, 19 nt, Homo sapiens
ccaaagaacuggucaauga

SEQ ID NO: 989783 - RNA, 19 nt, Homo sapiens
gaauaaagcuguuguaaac

SEQ ID NO: 989784 - RNA, 19 nt, Homo sapiens
gcaaagggauuguucuuau

SEQ ID NO: 989785 - RNA, 19 nt, Homo sapiens
ugagacagcuguaguacua

SEQ ID NO: 989786 - RNA, 19 nt, Homo sapiens
gugagaacauggaauauuu

SEQ ID NO: 989787 - RNA, 19 nt, Homo sapiens
caaagggauuguucuuaua

SEQ ID NO: 989788 - RNA, 19 nt, Homo sapiens
gaacauggaauauuugguu

SEQ ID NO: 989789 - RNA, 19 nt, Homo sapiens
ggaagaagcagaaauggaa

SEQ ID NO: 989790 - RNA, 19 nt, Homo sapiens
gaucauagaggagauguua

SEQ ID NO: 989791 - RNA, 19 nt, Homo sapiens
gaaagaugcugccaagaag

SEQ ID NO: 989792 - RNA, 19 nt, Homo sapiens
gaacuaaucaggcaggaaa

SEQ ID NO: 989793 - RNA, 19 nt, Homo sapiens
gaaaggaaaugagaguugu

SEQ ID NO: 989794 - RNA, 19 nt, Homo sapiens
ugacagaauucucuuugaa

SEQ ID NO: 989795 - RNA, 19 nt, Homo sapiens
aagcagaaauggaaauuga

SEQ ID NO: 989796 - RNA, 19 nt, Homo sapiens
uaagggauauccaaagaga

SEQ ID NO: 989797 - RNA, 19 nt, Homo sapiens
gaauaauacuccauugucu

SEQ ID NO: 989798 - RNA, 19 nt, Homo sapiens
uuacagagcucuuugacau

SEQ ID NO: 989799 - RNA, 19 nt, Homo sapiens
gcugguggcugcauuaugu

SEQ ID NO: 989800 - RNA, 19 nt, Homo sapiens
gaauaaauaccaagagcuu

SEQ ID NO: 989801 - RNA, 19 nt, Homo sapiens
gaagagcacagaagugaug

SEQ ID NO: 989802 - RNA, 19 nt, Homo sapiens
gcaaauaagggauauccaa

SEQ ID NO: 989803 - RNA, 19 nt, Homo sapiens
gauaagaaaggaaaugaga

SEQ ID NO: 989804 - RNA, 19 nt, Homo sapiens
cuucagugcuggaucauaa

SEQ ID NO: 989805 - RNA, 19 nt, Homo sapiens
gggcaaagcacccaguaaa

SEQ ID NO: 989806 - RNA, 19 nt, Homo sapiens
ggaggaagaagcagaaaug

SEQ ID NO: 989807 - RNA, 19 nt, Homo sapiens
uaaaucaguuguagguuca

SEQ ID NO: 989808 - RNA, 19 nt, Homo sapiens
ggucaugcaucauaaccaa

SEQ ID NO: 989809 - RNA, 19 nt, Homo sapiens
ugagggaguuguccaaaga

SEQ ID NO: 989810 - RNA, 19 nt, Homo sapiens
gcauaguucuggccaagga

SEQ ID NO: 989811 - RNA, 19 nt, Homo sapiens
ugaaagaugcugccaagaa

SEQ ID NO: 989812 - RNA, 19 nt, Homo sapiens
gagcuucagugcuggauca

SEQ ID NO: 989813 - RNA, 19 nt, Homo sapiens
gauucacucugguguugua

SEQ ID NO: 989814 - RNA, 19 nt, Homo sapiens
gauuucaucuucagagugu

SEQ ID NO: 989815 - RNA, 19 nt, Homo sapiens
uaaccaacauucacucauc

SEQ ID NO: 989816 - RNA, 19 nt, Homo sapiens
aauaagggauauccaaaga

SEQ ID NO: 989817 - RNA, 19 nt, Homo sapiens
caaauaagggauauccaaa

SEQ ID NO: 989818 - RNA, 19 nt, Homo sapiens
gagaugaucaggucaagga

SEQ ID NO: 989819 - RNA, 19 nt, Homo sapiens
gaaaugagaguuguugaca

SEQ ID NO: 989820 - RNA, 19 nt, Homo sapiens
uggcuucuuucacuuaaua

SEQ ID NO: 989821 - RNA, 19 nt, Homo sapiens
gcaaaauccugaaacaaug

SEQ ID NO: 989822 - RNA, 19 nt, Homo sapiens
ggaguuguccaaagaaaug

SEQ ID NO: 989823 - RNA, 19 nt, Homo sapiens
caaguuguaugugcacuga

SEQ ID NO: 989824 - RNA, 19 nt, Homo sapiens
gcacuacaccucuguugug

SEQ ID NO: 989825 - RNA, 19 nt, Homo sapiens
gcaaagcacccaguaaagu

SEQ ID NO: 989826 - RNA, 19 nt, Homo sapiens
gucauuucauggcuuaaua

SEQ ID NO: 989827 - RNA, 19 nt, Homo sapiens
caaaguccauaguuuacau

SEQ ID NO: 989828 - RNA, 19 nt, Homo sapiens
cacccaaaguccauaguuu

SEQ ID NO: 989829 - RNA, 19 nt, Homo sapiens
gaaauccaucugcucauga

SEQ ID NO: 989830 - RNA, 19 nt, Homo sapiens
gaagauaagaaaggaaaug

SEQ ID NO: 989831 - RNA, 19 nt, Homo sapiens
cccaguauguuauuccuuu

SEQ ID NO: 989832 - RNA, 19 nt, Homo sapiens
uaucagagaugggauucaa

SEQ ID NO: 989833 - RNA, 19 nt, Homo sapiens
gagcuucugucccuuccuu

SEQ ID NO: 989834 - RNA, 19 nt, Homo sapiens
gaguggucauugaagauaa

SEQ ID NO: 989835 - RNA, 19 nt, Homo sapiens
cucaagagcugccauuuua

SEQ ID NO: 989836 - RNA, 19 nt, Homo sapiens
cagaagagcacagaaguga

SEQ ID NO: 989837 - RNA, 19 nt, Homo sapiens
caagcuguaugcauccaaa

SEQ ID NO: 989838 - RNA, 19 nt, Homo sapiens
cagguaaacucgugacaag

SEQ ID NO: 989839 - RNA, 19 nt, Homo sapiens
cagcucaguuugggaagua

SEQ ID NO: 989840 - RNA, 19 nt, Homo sapiens
ggacaugggccuuccuauc

SEQ ID NO: 989841 - RNA, 19 nt, Homo sapiens
gugcaugugggucuauuua

SEQ ID NO: 989842 - RNA, 19 nt, Homo sapiens
gcacacacuccucucaaga

SEQ ID NO: 989843 - RNA, 19 nt, Homo sapiens
gacagaauucucuuugaaa

SEQ ID NO: 989844 - RNA, 19 nt, Homo sapiens
gaagaagcagaaauggaaa

SEQ ID NO: 989845 - RNA, 19 nt, Homo sapiens
gaaggaugucugcauaguu

SEQ ID NO: 989846 - RNA, 19 nt, Homo sapiens
uccauugucuagaugaaua

SEQ ID NO: 989847 - RNA, 19 nt, Homo sapiens
cagagugguacauuuguua

SEQ ID NO: 989848 - RNA, 19 nt, Homo sapiens
aaagugaaacgaucuguga

SEQ ID NO: 989849 - RNA, 19 nt, Homo sapiens
uaugugcacugaacuaauc

SEQ ID NO: 989850 - RNA, 19 nt, Homo sapiens
gaaugucgaagaucuacuu

SEQ ID NO: 989851 - RNA, 19 nt, Homo sapiens
gaaauggaaauugacagaa

SEQ ID NO: 989852 - RNA, 19 nt, Homo sapiens
aggaagaaauggaggaaga

SEQ ID NO: 989853 - RNA, 19 nt, Homo sapiens
caaggaaggcugugagcaa

SEQ ID NO: 989854 - RNA, 19 nt, Homo sapiens
aaggaugucugcauaguuc

SEQ ID NO: 989855 - RNA, 19 nt, Homo sapiens
guccauaguuuacaugaag

SEQ ID NO: 989856 - RNA, 19 nt, Homo sapiens
gagaauaggaguucaagac

SEQ ID NO: 989857 - RNA, 19 nt, Homo sapiens
ucacucaucugggacauuc

SEQ ID NO: 989858 - RNA, 19 nt, Homo sapiens
uuaggaguauagacagaua

SEQ ID NO: 989859 - RNA, 19 nt, Homo sapiens
caaagcacccaguaaagug

SEQ ID NO: 989860 - RNA, 19 nt, Homo sapiens
ggucauugaagauaagaaa

SEQ ID NO: 989861 - RNA, 19 nt, Homo sapiens
ccagagugguacauuuguu

SEQ ID NO: 989862 - RNA, 19 nt, Homo sapiens
guaguacuuuguauguguu

SEQ ID NO: 989863 - RNA, 19 nt, Homo sapiens
gguguggucaugcaucaua

SEQ ID NO: 989864 - RNA, 19 nt, Homo sapiens
ggacuaccauuuuggagaa

SEQ ID NO: 989865 - RNA, 19 nt, Homo sapiens
ucuagaaugucauauugga

SEQ ID NO: 989866 - RNA, 19 nt, Homo sapiens
ggacaugaucuuucuuugg

SEQ ID NO: 989867 - RNA, 19 nt, Homo sapiens
gaagauucacucugguguu

SEQ ID NO: 989868 - RNA, 19 nt, Homo sapiens
ggguacaugugcagguaaa

SEQ ID NO: 989869 - RNA, 19 nt, Homo sapiens
gacaugggccuuccuaucu

SEQ ID NO: 989870 - RNA, 19 nt, Homo sapiens
ccaagaagggccagaagga

SEQ ID NO: 989871 - RNA, 19 nt, Homo sapiens
guuguugacaggcaaauaa

SEQ ID NO: 989872 - RNA, 19 nt, Homo sapiens
aaacaucuuugugcagguu

SEQ ID NO: 989873 - RNA, 19 nt, Homo sapiens
uagauugcccugugcagua

SEQ ID NO: 989874 - RNA, 19 nt, Homo sapiens
gcagaaauggaaauugaca

SEQ ID NO: 989875 - RNA, 19 nt, Homo sapiens
uacgcgaucuuagucuuua

SEQ ID NO: 989876 - RNA, 19 nt, Homo sapiens
ccagauugcuucauuugcu

SEQ ID NO: 989877 - RNA, 19 nt, Homo sapiens
guugugaggacuaccauuu

SEQ ID NO: 989878 - RNA, 19 nt, Homo sapiens
uuaugugucucuugcacua

SEQ ID NO: 989879 - RNA, 19 nt, Homo sapiens
ggaagaaauggaggaagaa

SEQ ID NO: 989880 - RNA, 19 nt, Homo sapiens
guuuauccauucaccuauu

SEQ ID NO: 989881 - RNA, 19 nt, Homo sapiens
gcaauuaagguuccuccau

SEQ ID NO: 989882 - RNA, 19 nt, Homo sapiens
ggaguuaguucaccauauu

SEQ ID NO: 989883 - RNA, 19 nt, Homo sapiens
ggaaacaggucaugaaggu

SEQ ID NO: 989884 - RNA, 19 nt, Homo sapiens
caacaugggcuuccucuuu

SEQ ID NO: 989885 - RNA, 19 nt, Homo sapiens
cagaguagauccugaaaug

SEQ ID NO: 989886 - RNA, 19 nt, Homo sapiens
gaucaggucuccagaguag

SEQ ID NO: 989887 - RNA, 19 nt, Homo sapiens
gcauauugcugaccugaga

SEQ ID NO: 989888 - RNA, 19 nt, Homo sapiens
gaaaugaggauccguuuua

SEQ ID NO: 989889 - RNA, 19 nt, Homo sapiens
gagggacucuucugcauau

SEQ ID NO: 989890 - RNA, 19 nt, Homo sapiens
gaaaacgugucucuuuaaa

SEQ ID NO: 989891 - RNA, 19 nt, Homo sapiens
cuuuaaagcugcuauguga

SEQ ID NO: 989892 - RNA, 19 nt, Homo sapiens
gagaggagucggccuauug

SEQ ID NO: 989893 - RNA, 19 nt, Homo sapiens
gaccuaugcugaugucaug

SEQ ID NO: 989894 - RNA, 19 nt, Homo sapiens
gaagcaacuuuaugucagu

SEQ ID NO: 989895 - RNA, 19 nt, Homo sapiens
uggaggaacucaucacuau

SEQ ID NO: 989896 - RNA, 19 nt, Homo sapiens
ggaaugauggaaaccuuaa

SEQ ID NO: 989897 - RNA, 19 nt, Homo sapiens
ccaagaggcagaugugauu

SEQ ID NO: 989898 - RNA, 19 nt, Homo sapiens
gcuacugcauuguuccuuu

SEQ ID NO: 989899 - RNA, 19 nt, Homo sapiens
gagagaaaaugguagauau

SEQ ID NO: 989900 - RNA, 19 nt, Homo sapiens
ggauggagcucggaaggau

SEQ ID NO: 989901 - RNA, 19 nt, Homo sapiens
caugauggaugaacuucuu

SEQ ID NO: 989902 - RNA, 19 nt, Homo sapiens
ccaccucccuaucucauga

SEQ ID NO: 989903 - RNA, 19 nt, Homo sapiens
aaacgugucucuuuaaagc

SEQ ID NO: 989904 - RNA, 19 nt, Homo sapiens
gauauucaagagaagcuua

SEQ ID NO: 989905 - RNA, 19 nt, Homo sapiens
ggucagaauguuaauaguu

SEQ ID NO: 989906 - RNA, 19 nt, Homo sapiens
ggagaggagucggccuauu

SEQ ID NO: 989907 - RNA, 19 nt, Homo sapiens
gggcgaagcaacuuuaugu

SEQ ID NO: 989908 - RNA, 19 nt, Homo sapiens
gauagccugguccaucuua

SEQ ID NO: 989909 - RNA, 19 nt, Homo sapiens
gauggaggaugucaauaac

SEQ ID NO: 989910 - RNA, 19 nt, Homo sapiens
gcgaggcugugacaacaug

SEQ ID NO: 989911 - RNA, 19 nt, Homo sapiens
aaggugaucuucccugaug

SEQ ID NO: 989912 - RNA, 19 nt, Homo sapiens
ccuauugccuccauucuag

SEQ ID NO: 989913 - RNA, 19 nt, Homo sapiens
cuuaaagccuugaagacaa

SEQ ID NO: 989914 - RNA, 19 nt, Homo sapiens
agacauugccugccacuga

SEQ ID NO: 989915 - RNA, 19 nt, Homo sapiens
gcagcugauucaugagaga

SEQ ID NO: 989916 - RNA, 19 nt, Homo sapiens
gacgagaccuaugcugaug

SEQ ID NO: 989917 - RNA, 19 nt, Homo sapiens
ggaagacccaccucccuau

SEQ ID NO: 989918 - RNA, 19 nt, Homo sapiens
gcgaagcaacuuuauguca

SEQ ID NO: 989919 - RNA, 19 nt, Homo sapiens
gggacuaugugcuggugaa

SEQ ID NO: 989920 - RNA, 19 nt, Homo sapiens
gaguuaguucaccauauua

SEQ ID NO: 989921 - RNA, 19 nt, Homo sapiens
ggacucuucugcauauugc

SEQ ID NO: 989922 - RNA, 19 nt, Homo sapiens
aacaugggcuuccucuuug

SEQ ID NO: 989923 - RNA, 19 nt, Homo sapiens
caaucucagucguggcuuu

SEQ ID NO: 989924 - RNA, 19 nt, Homo sapiens
ggacgagaccuaugcugau

SEQ ID NO: 989925 - RNA, 19 nt, Homo sapiens
uggaaaacgugucucuuua

SEQ ID NO: 989926 - RNA, 19 nt, Homo sapiens
ucaugaagguggagauaag

SEQ ID NO: 989927 - RNA, 19 nt, Homo sapiens
agauggaggaugucaauaa

SEQ ID NO: 989928 - RNA, 19 nt, Homo sapiens
gcuuuaccaccaacuauaa

SEQ ID NO: 989929 - RNA, 19 nt, Homo sapiens
ggaaaacgugucucuuuaa

SEQ ID NO: 989930 - RNA, 19 nt, Homo sapiens
gaggaacucaucacuaucu

SEQ ID NO: 989931 - RNA, 19 nt, Homo sapiens
gaagucgcuuguguaugaa

SEQ ID NO: 989932 - RNA, 19 nt, Homo sapiens
ggaccgacuuuucaacauu

SEQ ID NO: 989933 - RNA, 19 nt, Homo sapiens
caacagagagaaaauggua

SEQ ID NO: 989934 - RNA, 19 nt, Homo sapiens
caggaaugauggaaaccuu

SEQ ID NO: 989935 - RNA, 19 nt, Homo sapiens
cgauuucauugcuggcuuu

SEQ ID NO: 989936 - RNA, 19 nt, Homo sapiens
gaguagauccugaaaugag

SEQ ID NO: 989937 - RNA, 19 nt, Homo sapiens
gaccaucuggaaccguuua

SEQ ID NO: 989938 - RNA, 19 nt, Homo sapiens
augcagagauggaggaugu

SEQ ID NO: 989939 - RNA, 19 nt, Homo sapiens
aagcuuauguggaguuagu

SEQ ID NO: 989940 - RNA, 19 nt, Homo sapiens
gcaaggaggacuucguuuu

SEQ ID NO: 989941 - RNA, 19 nt, Homo sapiens
gcugccagaugaaugugaa

SEQ ID NO: 989942 - RNA, 19 nt, Homo sapiens
ggucaugaagguggagaua

SEQ ID NO: 989943 - RNA, 19 nt, Homo sapiens
ugaggaaacaggucaugaa

SEQ ID NO: 989944 - RNA, 19 nt, Homo sapiens
agaagcuuauguggaguua

SEQ ID NO: 989945 - RNA, 19 nt, Homo sapiens
gaggggauauucaagagaa

SEQ ID NO: 989946 - RNA, 19 nt, Homo sapiens
gaugugauucuccuuguca

SEQ ID NO: 989947 - RNA, 19 nt, Homo sapiens
gacaacauguguagcuacu

SEQ ID NO: 989948 - RNA, 19 nt, Homo sapiens
ccaacgugcugcucucucu

SEQ ID NO: 989949 - RNA, 19 nt, Homo sapiens
cagaugugauucuccuugu

SEQ ID NO: 989950 - RNA, 19 nt, Homo sapiens
guaaacgcucugccacuga

SEQ ID NO: 989951 - RNA, 19 nt, Homo sapiens
gacagaagacacgggcaua

SEQ ID NO: 989952 - RNA, 19 nt, Homo sapiens
ggaaguucaguacaacaug

SEQ ID NO: 989953 - RNA, 19 nt, Homo sapiens
gagaagcuuauguggaguu

SEQ ID NO: 989954 - RNA, 19 nt, Homo sapiens
gugacaacauguguagcua

SEQ ID NO: 989955 - RNA, 19 nt, Homo sapiens
gaggaaacaggucaugaag

SEQ ID NO: 989956 - RNA, 19 nt, Homo sapiens
ugagggacucuucugcaua

SEQ ID NO: 989957 - RNA, 19 nt, Homo sapiens
gggcauaucauaggcugaa

SEQ ID NO: 989958 - RNA, 19 nt, Homo sapiens
gaagacacgggcauaucau

SEQ ID NO: 989959 - RNA, 19 nt, Homo sapiens
cgacuugccggcagaacuu

SEQ ID NO: 989960 - RNA, 19 nt, Homo sapiens
aggaugaugucccggaaga

SEQ ID NO: 989961 - RNA, 19 nt, Homo sapiens
ccucagcagcgauuucauu

SEQ ID NO: 989962 - RNA, 19 nt, Homo sapiens
gaagcagccguguguugga

SEQ ID NO: 989963 - RNA, 19 nt, Homo sapiens
uugcucaucuucuggauca

SEQ ID NO: 989964 - RNA, 19 nt, Homo sapiens
gaggaagugaagaagcuuu

SEQ ID NO: 989965 - RNA, 19 nt, Homo sapiens
uagaggaagugaagaagcu

SEQ ID NO: 989966 - RNA, 19 nt, Homo sapiens
acuaugugcuggugaagau

SEQ ID NO: 989967 - RNA, 19 nt, Homo sapiens
agaagacacgggcauauca

SEQ ID NO: 989968 - RNA, 19 nt, Homo sapiens
ggaucaggucuccagagua

SEQ ID NO: 989969 - RNA, 19 nt, Homo sapiens
cuacugcauuguuccuuuc

SEQ ID NO: 989970 - RNA, 19 nt, Homo sapiens
ccugguccaucuuacagaa

SEQ ID NO: 989971 - RNA, 19 nt, Homo sapiens
ggcuuuaccaccaacuaua

SEQ ID NO: 989972 - RNA, 19 nt, Homo sapiens
ggaccaguaaccuccaaga

SEQ ID NO: 989973 - RNA, 19 nt, Homo sapiens
ucugaggauuggaauucua

SEQ ID NO: 989974 - RNA, 19 nt, Homo sapiens
gaccgacuuuucaacauuu

SEQ ID NO: 989975 - RNA, 19 nt, Homo sapiens
gaacagcuuuuacagucau

SEQ ID NO: 989976 - RNA, 19 nt, Homo sapiens
aagaucaccucagccaguu

SEQ ID NO: 989977 - RNA, 19 nt, Homo sapiens
gagauggaggaugucaaua

SEQ ID NO: 989978 - RNA, 19 nt, Homo sapiens
guacccaguuggugcuagu

SEQ ID NO: 989979 - RNA, 19 nt, Homo sapiens
gugcagugccuaccaaucu

SEQ ID NO: 989980 - RNA, 19 nt, Homo sapiens
gaagacccaccucccuauc

SEQ ID NO: 989981 - RNA, 19 nt, Homo sapiens
uaaagcugcuaugugaaca

SEQ ID NO: 989982 - RNA, 19 nt, Homo sapiens
ggaguuaguucaccauauu

SEQ ID NO: 989983 - RNA, 19 nt, Homo sapiens
ggaaacaggucaugaaggu

SEQ ID NO: 989984 - RNA, 19 nt, Homo sapiens
caacaugggcuuccucuuu

SEQ ID NO: 989985 - RNA, 19 nt, Homo sapiens
cagaguagauccugaaaug

SEQ ID NO: 989986 - RNA, 19 nt, Homo sapiens
gaucaggucuccagaguag

SEQ ID NO: 989987 - RNA, 19 nt, Homo sapiens
gcauauugcugaccugaga

SEQ ID NO: 989988 - RNA, 19 nt, Homo sapiens
gaaaugaggauccguuuua

SEQ ID NO: 989989 - RNA, 19 nt, Homo sapiens
gagggacucuucugcauau

SEQ ID NO: 989990 - RNA, 19 nt, Homo sapiens
gcacacagcagucucucua

SEQ ID NO: 989991 - RNA, 19 nt, Homo sapiens
gaaaacgugucucuuuaaa

SEQ ID NO: 989992 - RNA, 19 nt, Homo sapiens
cuuuaaagcugcuauguga

SEQ ID NO: 989993 - RNA, 19 nt, Homo sapiens
gagaggagucggccuauug

SEQ ID NO: 989994 - RNA, 19 nt, Homo sapiens
gaccuaugcugaugucaug

SEQ ID NO: 989995 - RNA, 19 nt, Homo sapiens
gaagcaacuuuaugucagu

SEQ ID NO: 989996 - RNA, 19 nt, Homo sapiens
uggaggaacucaucacuau

SEQ ID NO: 989997 - RNA, 19 nt, Homo sapiens
ggaaugauggaaaccuuaa

SEQ ID NO: 989998 - RNA, 19 nt, Homo sapiens
ccaagaggcagaugugauu

SEQ ID NO: 989999 - RNA, 19 nt, Homo sapiens
gcuacugcauuguuccuuu

SEQ ID NO: 990000 - RNA, 19 nt, Homo sapiens
gagagaaaaugguagauau

SEQ ID NO: 990001 - RNA, 19 nt, Homo sapiens
caugauggaugaacuucuu

SEQ ID NO: 990002 - RNA, 19 nt, Homo sapiens
ggauggagcucggaaggau

SEQ ID NO: 990003 - RNA, 19 nt, Homo sapiens
ccaccucccuaucucauga

SEQ ID NO: 990004 - RNA, 19 nt, Homo sapiens
aaacgugucucuuuaaagc

SEQ ID NO: 990005 - RNA, 19 nt, Homo sapiens
gauauucaagagaagcuua

SEQ ID NO: 990006 - RNA, 19 nt, Homo sapiens
ggucagaauguuaauaguu

SEQ ID NO: 990007 - RNA, 19 nt, Homo sapiens
ggagaggagucggccuauu

SEQ ID NO: 990008 - RNA, 19 nt, Homo sapiens
gggcgaagcaacuuuaugu

SEQ ID NO: 990009 - RNA, 19 nt, Homo sapiens
gauagccugguccaucuua

SEQ ID NO: 990010 - RNA, 19 nt, Homo sapiens
gauggaggaugucaauaac

SEQ ID NO: 990011 - RNA, 19 nt, Homo sapiens
gcgaggcugugacaacaug

SEQ ID NO: 990012 - RNA, 19 nt, Homo sapiens
aaggugaucuucccugaug

SEQ ID NO: 990013 - RNA, 19 nt, Homo sapiens
gggagacugugggcuguuu

SEQ ID NO: 990014 - RNA, 19 nt, Homo sapiens
ccuauugccuccauucuag

SEQ ID NO: 990015 - RNA, 19 nt, Homo sapiens
cuuaaagccuugaagacaa

SEQ ID NO: 990016 - RNA, 19 nt, Homo sapiens
agacauugccugccacuga

SEQ ID NO: 990017 - RNA, 19 nt, Homo sapiens
gcagcugauucaugagaga

SEQ ID NO: 990018 - RNA, 19 nt, Homo sapiens
gacgagaccuaugcugaug

SEQ ID NO: 990019 - RNA, 19 nt, Homo sapiens
ggaagacccaccucccuau

SEQ ID NO: 990020 - RNA, 19 nt, Homo sapiens
gcgaagcaacuuuauguca

SEQ ID NO: 990021 - RNA, 19 nt, Homo sapiens
gggacuaugugcuggugaa

SEQ ID NO: 990022 - RNA, 19 nt, Homo sapiens
gaguuaguucaccauauua

SEQ ID NO: 990023 - RNA, 19 nt, Homo sapiens
ggacucuucugcauauugc

SEQ ID NO: 990024 - RNA, 19 nt, Homo sapiens
aacaugggcuuccucuuug

SEQ ID NO: 990025 - RNA, 19 nt, Homo sapiens
caaucucagucguggcuuu

SEQ ID NO: 990026 - RNA, 19 nt, Homo sapiens
ggacgagaccuaugcugau

SEQ ID NO: 990027 - RNA, 19 nt, Homo sapiens
uggaaaacgugucucuuua

SEQ ID NO: 990028 - RNA, 19 nt, Homo sapiens
ucaugaagguggagauaag

SEQ ID NO: 990029 - RNA, 19 nt, Homo sapiens
agauggaggaugucaauaa

SEQ ID NO: 990030 - RNA, 19 nt, Homo sapiens
gcuuuaccaccaacuauaa

SEQ ID NO: 990031 - RNA, 19 nt, Homo sapiens
ggaaaacgugucucuuuaa

SEQ ID NO: 990032 - RNA, 19 nt, Homo sapiens
gaggaacucaucacuaucu

SEQ ID NO: 990033 - RNA, 19 nt, Homo sapiens
gaagucgcuuguguaugaa

SEQ ID NO: 990034 - RNA, 19 nt, Homo sapiens
caacagagagaaaauggua

SEQ ID NO: 990035 - RNA, 19 nt, Homo sapiens
ggaccgacuuuucaacauu

SEQ ID NO: 990036 - RNA, 19 nt, Homo sapiens
caggaaugauggaaaccuu

SEQ ID NO: 990037 - RNA, 19 nt, Homo sapiens
cgauuucauugcuggcuuu

SEQ ID NO: 990038 - RNA, 19 nt, Homo sapiens
gaguagauccugaaaugag

SEQ ID NO: 990039 - RNA, 19 nt, Homo sapiens
gaccaucuggaaccguuua

SEQ ID NO: 990040 - RNA, 19 nt, Homo sapiens
augcagagauggaggaugu

SEQ ID NO: 990041 - RNA, 19 nt, Homo sapiens
aagcuuauguggaguuagu

SEQ ID NO: 990042 - RNA, 19 nt, Homo sapiens
gcaaggaggacuucguuuu

SEQ ID NO: 990043 - RNA, 19 nt, Homo sapiens
gcugccagaugaaugugaa

SEQ ID NO: 990044 - RNA, 19 nt, Homo sapiens
ggucaugaagguggagaua

SEQ ID NO: 990045 - RNA, 19 nt, Homo sapiens
ugaggaaacaggucaugaa

SEQ ID NO: 990046 - RNA, 19 nt, Homo sapiens
agaagcuuauguggaguua

SEQ ID NO: 990047 - RNA, 19 nt, Homo sapiens
gaggggauauucaagagaa

SEQ ID NO: 990048 - RNA, 19 nt, Homo sapiens
gaugugauucuccuuguca

SEQ ID NO: 990049 - RNA, 19 nt, Homo sapiens
caugcacccuuuacagugu

SEQ ID NO: 990050 - RNA, 19 nt, Homo sapiens
ggagacugugggcuguuua

SEQ ID NO: 990051 - RNA, 19 nt, Homo sapiens
gacaacauguguagcuacu

SEQ ID NO: 990052 - RNA, 19 nt, Homo sapiens
ccaacgugcugcucucucu

SEQ ID NO: 990053 - RNA, 19 nt, Homo sapiens
cagaugugauucuccuugu

SEQ ID NO: 990054 - RNA, 19 nt, Homo sapiens
guaaacgcucugccacuga

SEQ ID NO: 990055 - RNA, 19 nt, Homo sapiens
gacagaagacacgggcaua

SEQ ID NO: 990056 - RNA, 19 nt, Homo sapiens
ggaaguucaguacaacaug

SEQ ID NO: 990057 - RNA, 19 nt, Homo sapiens
gagaagcuuauguggaguu

SEQ ID NO: 990058 - RNA, 19 nt, Homo sapiens
gugacaacauguguagcua

SEQ ID NO: 990059 - RNA, 19 nt, Homo sapiens
gaggaaacaggucaugaag

SEQ ID NO: 990060 - RNA, 19 nt, Homo sapiens
ugagggacucuucugcaua

SEQ ID NO: 990061 - RNA, 19 nt, Homo sapiens
gggcauaucauaggcugaa

SEQ ID NO: 990062 - RNA, 19 nt, Homo sapiens
gaagacacgggcauaucau

SEQ ID NO: 990063 - RNA, 19 nt, Homo sapiens
acacagcagucucucuagu

SEQ ID NO: 990064 - RNA, 19 nt, Homo sapiens
cacagcagucucucuagua

SEQ ID NO: 990065 - RNA, 19 nt, Homo sapiens
cgacuugccggcagaacuu

SEQ ID NO: 990066 - RNA, 19 nt, Homo sapiens
aggaugaugucccggaaga

SEQ ID NO: 990067 - RNA, 19 nt, Homo sapiens
ccucagcagcgauuucauu

SEQ ID NO: 990068 - RNA, 19 nt, Homo sapiens
gaagcagccguguguugga

SEQ ID NO: 990069 - RNA, 19 nt, Homo sapiens
uugcucaucuucuggauca

SEQ ID NO: 990070 - RNA, 19 nt, Homo sapiens
gaggaagugaagaagcuuu

SEQ ID NO: 990071 - RNA, 19 nt, Homo sapiens
uagaggaagugaagaagcu

SEQ ID NO: 990072 - RNA, 19 nt, Homo sapiens
acuaugugcuggugaagau

SEQ ID NO: 990073 - RNA, 19 nt, Homo sapiens
agaagacacgggcauauca

SEQ ID NO: 990074 - RNA, 19 nt, Homo sapiens
ggaucaggucuccagagua

SEQ ID NO: 990075 - RNA, 19 nt, Homo sapiens
cuacugcauuguuccuuuc

SEQ ID NO: 990076 - RNA, 19 nt, Homo sapiens
ggcuuuaccaccaacuaua

SEQ ID NO: 990077 - RNA, 19 nt, Homo sapiens
ucugaggauuggaauucua

SEQ ID NO: 990078 - RNA, 19 nt, Homo sapiens
gaccgacuuuucaacauuu

SEQ ID NO: 990079 - RNA, 19 nt, Homo sapiens
ggaccaguaaccuccaaga

SEQ ID NO: 990080 - RNA, 19 nt, Homo sapiens
ccugguccaucuuacagaa

SEQ ID NO: 990081 - RNA, 19 nt, Homo sapiens
gaacagcuuuuacagucau

SEQ ID NO: 990082 - RNA, 19 nt, Homo sapiens
gggcgugggucaaaucaua

SEQ ID NO: 990083 - RNA, 19 nt, Homo sapiens
ugugaggucuuuaaaguua

SEQ ID NO: 990084 - RNA, 19 nt, Homo sapiens
ggcauuaucuugucuguga

SEQ ID NO: 990085 - RNA, 19 nt, Homo sapiens
ggagggaugugaaguuauc

SEQ ID NO: 990086 - RNA, 19 nt, Homo sapiens
gagugaaacugcacaaagg

SEQ ID NO: 990087 - RNA, 19 nt, Homo sapiens
caacauggacacgaacaaa

SEQ ID NO: 990088 - RNA, 19 nt, Homo sapiens
guggauuuaucuucucaaa

SEQ ID NO: 990089 - RNA, 19 nt, Homo sapiens
gaggguggauuuaucuucu

SEQ ID NO: 990090 - RNA, 19 nt, Homo sapiens
gaacacaaaacaaaacuug

SEQ ID NO: 990091 - RNA, 19 nt, Homo sapiens
guacacagcgaccucaugu

SEQ ID NO: 990092 - RNA, 19 nt, Homo sapiens
ugugugaggucuuuaaagu

SEQ ID NO: 990093 - RNA, 19 nt, Homo sapiens
ggccaagacugggacuauu

SEQ ID NO: 990094 - RNA, 19 nt, Homo sapiens
gaaagagaacgggccaaga

SEQ ID NO: 990095 - RNA, 19 nt, Homo sapiens
caaaggaacacaaaacaaa

SEQ ID NO: 990096 - RNA, 19 nt, Homo sapiens
agaaggcgcugcggaacaa

SEQ ID NO: 990097 - RNA, 19 nt, Homo sapiens
ggggagggaugugaaguua

SEQ ID NO: 990098 - RNA, 19 nt, Homo sapiens
gagaagggacggucaucug

SEQ ID NO: 990099 - RNA, 19 nt, Homo sapiens
gcgaugaucaagaagaugu

SEQ ID NO: 990100 - RNA, 19 nt, Homo sapiens
caucugcuccggaaggaaa

SEQ ID NO: 990101 - RNA, 19 nt, Homo sapiens
gcaaggucucggugcagua

SEQ ID NO: 990102 - RNA, 19 nt, Homo sapiens
gaaacugcacaaaggaaca

SEQ ID NO: 990103 - RNA, 19 nt, Homo sapiens
acagcgaccucauguacau

SEQ ID NO: 990104 - RNA, 19 nt, Homo sapiens
gugacuuguuuacauguga

SEQ ID NO: 990105 - RNA, 19 nt, Homo sapiens
ucaaaucauagccaaguga

SEQ ID NO: 990106 - RNA, 19 nt, Homo sapiens
ggucaaaucauagccaagu

SEQ ID NO: 990107 - RNA, 19 nt, Homo sapiens
aaggagcgcugcgucauca

SEQ ID NO: 990108 - RNA, 19 nt, Homo sapiens
ggacacgaacaaaaccuua

SEQ ID NO: 990109 - RNA, 19 nt, Homo sapiens
ccgcgaugaucaagaagau

SEQ ID NO: 990110 - RNA, 19 nt, Homo sapiens
cugcuaggcuucaagaaac

SEQ ID NO: 990111 - RNA, 19 nt, Homo sapiens
ccagguguuuauacugugu

SEQ ID NO: 990112 - RNA, 19 nt, Homo sapiens
cucaaagaccuaagaguga

SEQ ID NO: 990113 - RNA, 19 nt, Homo sapiens
ggguggauuuaucuucuca

SEQ ID NO: 990114 - RNA, 19 nt, Homo sapiens
gccaagacugggacuauuc

SEQ ID NO: 990115 - RNA, 19 nt, Homo sapiens
gcagccaggccaaggacaa

SEQ ID NO: 990116 - RNA, 19 nt, Homo sapiens
ucauguacauccgcgagaa

SEQ ID NO: 990117 - RNA, 19 nt, Homo sapiens
acacagcgaccucauguac

SEQ ID NO: 990118 - RNA, 19 nt, Homo sapiens
ccucugcccucccgaaacu

SEQ ID NO: 990119 - RNA, 19 nt, Homo sapiens
gugaggucuuuaaaguuau

SEQ ID NO: 990120 - RNA, 19 nt, Homo sapiens
gggccaagacugggacuau

SEQ ID NO: 990121 - RNA, 19 nt, Homo sapiens
ggucaucugcggcaacaag

SEQ ID NO: 990122 - RNA, 19 nt, Homo sapiens
gugaaacugcacaaaggaa

SEQ ID NO: 990123 - RNA, 19 nt, Homo sapiens
ugagugaaacugcacaaag

SEQ ID NO: 990124 - RNA, 19 nt, Homo sapiens
aaagagaacgggccaagac

SEQ ID NO: 990125 - RNA, 19 nt, Homo sapiens
caagggugaccgcgacuuc

SEQ ID NO: 990126 - RNA, 19 nt, Homo sapiens
gugugugugugaggucuuu

SEQ ID NO: 990127 - RNA, 19 nt, Homo sapiens
acccagguguuuauacugu

SEQ ID NO: 990128 - RNA, 19 nt, Homo sapiens
uuacccagguguuuauacu

SEQ ID NO: 990129 - RNA, 19 nt, Homo sapiens
guuccggugucaacaugga

SEQ ID NO: 990130 - RNA, 19 nt, Homo sapiens
ucugcuaggcuucaagaaa

SEQ ID NO: 990131 - RNA, 19 nt, Homo sapiens
gcacaaaggaacacaaaac

SEQ ID NO: 990132 - RNA, 19 nt, Homo sapiens
gucaaaucauagccaagug

SEQ ID NO: 990133 - RNA, 19 nt, Homo sapiens
gcauuaucuugucugugau

SEQ ID NO: 990134 - RNA, 19 nt, Homo sapiens
caaggagcgcugcgucauc

SEQ ID NO: 990135 - RNA, 19 nt, Homo sapiens
gaacaaaaccaaggagaac

SEQ ID NO: 990136 - RNA, 19 nt, Homo sapiens
uaguuccggugucaacaug

SEQ ID NO: 990137 - RNA, 19 nt, Homo sapiens
gcgcuggcgacacaaccua

SEQ ID NO: 990138 - RNA, 19 nt, Homo sapiens
ccacaugugucacuucauu

SEQ ID NO: 990139 - RNA, 19 nt, Homo sapiens
ccaacuaucucuguuuauu

SEQ ID NO: 990140 - RNA, 19 nt, Homo sapiens
ggagaagacuauccuugga

SEQ ID NO: 990141 - RNA, 19 nt, Homo sapiens
caucauagccuaccucaug

SEQ ID NO: 990142 - RNA, 19 nt, Homo sapiens
gucaaugucuccauggaua

SEQ ID NO: 990143 - RNA, 19 nt, Homo sapiens
ccacaaaacucuccagauu

SEQ ID NO: 990144 - RNA, 19 nt, Homo sapiens
ccagauucuucccuucuua

SEQ ID NO: 990145 - RNA, 19 nt, Homo sapiens
cggaaaggaugccugguuu

SEQ ID NO: 990146 - RNA, 19 nt, Homo sapiens
gagauuccaucacaaacau

SEQ ID NO: 990147 - RNA, 19 nt, Homo sapiens
aaucaaagcccaugucaau

SEQ ID NO: 990148 - RNA, 19 nt, Homo sapiens
acaaaacucuccagauuaa

SEQ ID NO: 990149 - RNA, 19 nt, Homo sapiens
ggucuucguuggcaauuuc

SEQ ID NO: 990150 - RNA, 19 nt, Homo sapiens
ccaaacccauuccuucugu

SEQ ID NO: 990151 - RNA, 19 nt, Homo sapiens
gggccuaugucaagaagug

SEQ ID NO: 990152 - RNA, 19 nt, Homo sapiens
caaaugggaguaugacgaa

SEQ ID NO: 990153 - RNA, 19 nt, Homo sapiens
uagccuaccucaugcauag

SEQ ID NO: 990154 - RNA, 19 nt, Homo sapiens
ggauguccguuccaaaugg

SEQ ID NO: 990155 - RNA, 19 nt, Homo sapiens
ucaaagcccaugucaaugu

SEQ ID NO: 990156 - RNA, 19 nt, Homo sapiens
cagaaggacuugaaaauca

SEQ ID NO: 990157 - RNA, 19 nt, Homo sapiens
ggaacuggaugcauuucag

SEQ ID NO: 990158 - RNA, 19 nt, Homo sapiens
caacuaucucuguuuauug

SEQ ID NO: 990159 - RNA, 19 nt, Homo sapiens
ggagauuccaucacaaaca

SEQ ID NO: 990160 - RNA, 19 nt, Homo sapiens
cagcagcacccuggagaua

SEQ ID NO: 990161 - RNA, 19 nt, Homo sapiens
gguaucagccgcaguugug

SEQ ID NO: 990162 - RNA, 19 nt, Homo sapiens
gaaguacugcgugguguau

SEQ ID NO: 990163 - RNA, 19 nt, Homo sapiens
caaagcccaugucaauguc

SEQ ID NO: 990164 - RNA, 19 nt, Homo sapiens
gaagaggacgggcuuuagg

SEQ ID NO: 990165 - RNA, 19 nt, Homo sapiens
ggaaaggaugccugguuug

SEQ ID NO: 990166 - RNA, 19 nt, Homo sapiens
caccuuggcucugucauuc

SEQ ID NO: 990167 - RNA, 19 nt, Homo sapiens
gaccucagccaaacccauu

SEQ ID NO: 990168 - RNA, 19 nt, Homo sapiens
gcacauccggauagaagau

SEQ ID NO: 990169 - RNA, 19 nt, Homo sapiens
cucaggaacuggaugcauu

SEQ ID NO: 990170 - RNA, 19 nt, Homo sapiens
gcagcacccuggagauacu

SEQ ID NO: 990171 - RNA, 19 nt, Homo sapiens
gcagagguccugggccuau

SEQ ID NO: 990172 - RNA, 19 nt, Homo sapiens
ggaagaggacgggcuuuag

SEQ ID NO: 990173 - RNA, 19 nt, Homo sapiens
gacgaaagccaugugauca

SEQ ID NO: 990174 - RNA, 19 nt, Homo sapiens
aaggaugccugguuugcuu

SEQ ID NO: 990175 - RNA, 19 nt, Homo sapiens
caucauggauccgcucuac

SEQ ID NO: 990176 - RNA, 19 nt, Homo sapiens
aacaacauguguccaaauc

SEQ ID NO: 990177 - RNA, 19 nt, Homo sapiens
gcucugucauucugaucuu

SEQ ID NO: 990178 - RNA, 19 nt, Homo sapiens
uggaugcauuucagccaua

SEQ ID NO: 990179 - RNA, 19 nt, Homo sapiens
gaaaggaugccugguuugc

SEQ ID NO: 990180 - RNA, 19 nt, Homo sapiens
guaacgagcagaccuugca

SEQ ID NO: 990181 - RNA, 19 nt, Homo sapiens
uaacagaccccaacuaucu

SEQ ID NO: 990182 - RNA, 19 nt, Homo sapiens
uuuacaacauccugaauca

SEQ ID NO: 990183 - RNA, 19 nt, Homo sapiens
ugacgaaagccaugugauc

SEQ ID NO: 990184 - RNA, 19 nt, Homo sapiens
agacuauccuuggagauuc

SEQ ID NO: 990185 - RNA, 19 nt, Homo sapiens
caguugugccgccaucaua

SEQ ID NO: 990186 - RNA, 19 nt, Homo sapiens
ucaggaacuggaugcauuu

SEQ ID NO: 990187 - RNA, 19 nt, Homo sapiens
cgaaagccaugugaucacu

SEQ ID NO: 990188 - RNA, 19 nt, Homo sapiens
cugacaagcuucugcacau

SEQ ID NO: 990189 - RNA, 19 nt, Homo sapiens
uggaagaggacgggcuuua

SEQ ID NO: 990190 - RNA, 19 nt, Homo sapiens
agaugaugaugaugauuca

SEQ ID NO: 990191 - RNA, 19 nt, Homo sapiens
aguacugcgugguguauga

SEQ ID NO: 990192 - RNA, 19 nt, Homo sapiens
ggacucugagcaucggaaa

SEQ ID NO: 990193 - RNA, 19 nt, Homo sapiens
aaacaacauguguccaaau

SEQ ID NO: 990194 - RNA, 19 nt, Homo sapiens
ggugauggcaaagaucuug

SEQ ID NO: 990195 - RNA, 19 nt, Homo sapiens
cccuggagauacucuuaaa

SEQ ID NO: 990196 - RNA, 19 nt, Homo sapiens
ugacaagcuucugcacauc

SEQ ID NO: 990197 - RNA, 19 nt, Homo sapiens
ugauggugauggcaaagau

SEQ ID NO: 990198 - RNA, 19 nt, Homo sapiens
ugaaguacugcguggugua

SEQ ID NO: 990199 - RNA, 19 nt, Homo sapiens
ggaccuggagugugugaag

SEQ ID NO: 990200 - RNA, 19 nt, Homo sapiens
caccgaaggguacugaaga

SEQ ID NO: 990201 - RNA, 19 nt, Homo sapiens
uggaaugggagaagacuau

SEQ ID NO: 990202 - RNA, 19 nt, Homo sapiens
ugugaucacugcccuucga

SEQ ID NO: 990203 - RNA, 19 nt, Homo sapiens
ccccaacuaucucuguuua

SEQ ID NO: 990204 - RNA, 19 nt, Homo sapiens
cacaaaacucuccagauua

SEQ ID NO: 990205 - RNA, 19 nt, Homo sapiens
caggguaucagccgcaguu

SEQ ID NO: 990206 - RNA, 19 nt, Homo sapiens
cgccacaugugucacuuca

SEQ ID NO: 990207 - RNA, 19 nt, Homo sapiens
aagaugaugaugaugauuc

SEQ ID NO: 990208 - RNA, 19 nt, Homo sapiens
guguuuggcuggguucuag

SEQ ID NO: 990209 - RNA, 19 nt, Homo sapiens
uggagugugugaaguacug

SEQ ID NO: 990210 - RNA, 19 nt, Homo sapiens
gaccuggagugugugaagu

SEQ ID NO: 990211 - RNA, 19 nt, Homo sapiens
ggagggccagaguguguau

SEQ ID NO: 990212 - RNA, 19 nt, Homo sapiens
ucauggauccgcucuacug

SEQ ID NO: 990213 - RNA, 19 nt, Homo sapiens
aagacuauccuuggagauu

SEQ ID NO: 990214 - RNA, 19 nt, Homo sapiens
ccuaccucaugcauaguaa

SEQ ID NO: 990215 - RNA, 19 nt, Homo sapiens
gccuaccucaugcauagua

SEQ ID NO: 990216 - RNA, 19 nt, Homo sapiens
ucaccuuggcucugucauu

SEQ ID NO: 990217 - RNA, 19 nt, Homo sapiens
aggcgaugcugacaagcuu

SEQ ID NO: 990218 - RNA, 19 nt, Homo sapiens
ccaagauucagaaggacuu

SEQ ID NO: 990219 - RNA, 19 nt, Homo sapiens
guuccaaaugggaguauga

SEQ ID NO: 990220 - RNA, 19 nt, Homo sapiens
aacuaucucuguuuauugg

SEQ ID NO: 990221 - RNA, 19 nt, Homo sapiens
gaagacuauccuuggagau

SEQ ID NO: 990222 - RNA, 19 nt, Homo sapiens
ugaugaugauucagacucu

SEQ ID NO: 990223 - RNA, 19 nt, Homo sapiens
cacccuggagauacucuua

SEQ ID NO: 990224 - RNA, 19 nt, Homo sapiens
guggagggccagagugugu

SEQ ID NO: 990225 - RNA, 19 nt, Homo sapiens
caucacaaacaucauggau

SEQ ID NO: 990226 - RNA, 19 nt, Homo sapiens
gauuccaucacaaacauca

SEQ ID NO: 990227 - RNA, 19 nt, Homo sapiens
acaugugucacuucauuga

SEQ ID NO: 990228 - RNA, 19 nt, Homo sapiens
ucaggcacguaccacuuuc

SEQ ID NO: 990229 - RNA, 19 nt, Homo sapiens
acugcgugguguaugauaa

SEQ ID NO: 990230 - RNA, 19 nt, Homo sapiens
cuguggaccuggagugugu

SEQ ID NO: 990231 - RNA, 19 nt, Homo sapiens
gcaguugugccgccaucau

SEQ ID NO: 990232 - RNA, 19 nt, Homo sapiens
ggaugcauuucagccauac

SEQ ID NO: 990233 - RNA, 19 nt, Homo sapiens
uuacgaagcuccuguuaaa

SEQ ID NO: 990234 - RNA, 19 nt, Homo sapiens
gcgauuaaccugaaacaaa

SEQ ID NO: 990235 - RNA, 19 nt, Homo sapiens
aaacacuucugaugcauga

SEQ ID NO: 990236 - RNA, 19 nt, Homo sapiens
gcacaugccaagcuggaua

SEQ ID NO: 990237 - RNA, 19 nt, Homo sapiens
gaauuuagacucucucaca

SEQ ID NO: 990238 - RNA, 19 nt, Homo sapiens
gcccagcccuuacuacaug

SEQ ID NO: 990239 - RNA, 19 nt, Homo sapiens
cgauuaaccugaaacaaag

SEQ ID NO: 990240 - RNA, 19 nt, Homo sapiens
gaccggugcuuauccucua

SEQ ID NO: 990241 - RNA, 19 nt, Homo sapiens
agagguggcucacagagaa

SEQ ID NO: 990242 - RNA, 19 nt, Homo sapiens
cgaagcuccuguuaaauca

SEQ ID NO: 990243 - RNA, 19 nt, Homo sapiens
ccugggacauucuucaauu

SEQ ID NO: 990244 - RNA, 19 nt, Homo sapiens
cagaguggauggauguaga

SEQ ID NO: 990245 - RNA, 19 nt, Homo sapiens
gaaacaaagacagaaaugu

SEQ ID NO: 990246 - RNA, 19 nt, Homo sapiens
ggacacucguauagccaaa

SEQ ID NO: 990247 - RNA, 19 nt, Homo sapiens
ucuaagcccugauccacaa

SEQ ID NO: 990248 - RNA, 19 nt, Homo sapiens
cacaagcgcucaaccacau

SEQ ID NO: 990249 - RNA, 19 nt, Homo sapiens
ggacaagaucuaccucauc

SEQ ID NO: 990250 - RNA, 19 nt, Homo sapiens
cagcgggacuuuccucaca

SEQ ID NO: 990251 - RNA, 19 nt, Homo sapiens
gaacgaaaggaagaaacuu

SEQ ID NO: 990252 - RNA, 19 nt, Homo sapiens
ccacuugggucuccugcau

SEQ ID NO: 990253 - RNA, 19 nt, Homo sapiens
uaaaucaugcuucagacaa

SEQ ID NO: 990254 - RNA, 19 nt, Homo sapiens
caacuucagucuggacaag

SEQ ID NO: 990255 - RNA, 19 nt, Homo sapiens
cauggaagccgucacacuu

SEQ ID NO: 990256 - RNA, 19 nt, Homo sapiens
cagcaggaguggccaugug

SEQ ID NO: 990257 - RNA, 19 nt, Homo sapiens
ccuguuaaaucaugcuuca

SEQ ID NO: 990258 - RNA, 19 nt, Homo sapiens
ugagggaucaugaacgaaa

SEQ ID NO: 990259 - RNA, 19 nt, Homo sapiens
cccuguggcuggcgauuaa

SEQ ID NO: 990260 - RNA, 19 nt, Homo sapiens
gggcagguguucagugacu

SEQ ID NO: 990261 - RNA, 19 nt, Homo sapiens
augccaagcuggauaacuu

SEQ ID NO: 990262 - RNA, 19 nt, Homo sapiens
uggagaagaugagggauca

SEQ ID NO: 990263 - RNA, 19 nt, Homo sapiens
ggauggauguagaaaaguu

SEQ ID NO: 990264 - RNA, 19 nt, Homo sapiens
ugaaacaaagacagaaaug

SEQ ID NO: 990265 - RNA, 19 nt, Homo sapiens
aagcccugauccacaauaa

SEQ ID NO: 990266 - RNA, 19 nt, Homo sapiens
guagaaaaguuggagaaga

SEQ ID NO: 990267 - RNA, 19 nt, Homo sapiens
ucaaccacauguacaaacu

SEQ ID NO: 990268 - RNA, 19 nt, Homo sapiens
gauaugugggacacucgua

SEQ ID NO: 990269 - RNA, 19 nt, Homo sapiens
uagaaaaguuggagaagau

SEQ ID NO: 990270 - RNA, 19 nt, Homo sapiens
gagggaucaugaacgaaag

SEQ ID NO: 990271 - RNA, 19 nt, Homo sapiens
acauggaacuuacgaagcu

SEQ ID NO: 990272 - RNA, 19 nt, Homo sapiens
uuccacaucuguuucuaga

SEQ ID NO: 990273 - RNA, 19 nt, Homo sapiens
aagcuccuguuaaaucaug

SEQ ID NO: 990274 - RNA, 19 nt, Homo sapiens
ugacugguagguguagaua

SEQ ID NO: 990275 - RNA, 19 nt, Homo sapiens
acacuucugaugcaugaaa

SEQ ID NO: 990276 - RNA, 19 nt, Homo sapiens
gcucaaccacauguacaaa

SEQ ID NO: 990277 - RNA, 19 nt, Homo sapiens
gccgagaaggagcugguua

SEQ ID NO: 990278 - RNA, 19 nt, Homo sapiens
acgaagcuccuguuaaauc

SEQ ID NO: 990279 - RNA, 19 nt, Homo sapiens
aaaauggacccaacucaaa

SEQ ID NO: 990280 - RNA, 19 nt, Homo sapiens
uugggcagguguucaguga

SEQ ID NO: 990281 - RNA, 19 nt, Homo sapiens
ggcuggcgauuaaccugaa

SEQ ID NO: 990282 - RNA, 19 nt, Homo sapiens
uaugugggacacucguaua

SEQ ID NO: 990283 - RNA, 19 nt, Homo sapiens
uguuaaaucaugcuucaga

SEQ ID NO: 990284 - RNA, 19 nt, Homo sapiens
gauggugcagccaacaaug

SEQ ID NO: 990285 - RNA, 19 nt, Homo sapiens
ccugaaacaaagacagaaa

SEQ ID NO: 990286 - RNA, 19 nt, Homo sapiens
gggacauucuucaauucca

SEQ ID NO: 990287 - RNA, 19 nt, Homo sapiens
gcuggcgauuaaccugaaa

SEQ ID NO: 990288 - RNA, 19 nt, Homo sapiens
gcgggacuuuccucacaca

SEQ ID NO: 990289 - RNA, 19 nt, Homo sapiens
cacaugccaagcuggauaa

SEQ ID NO: 990290 - RNA, 19 nt, Homo sapiens
gaaaaguuggagaagauga

SEQ ID NO: 990291 - RNA, 19 nt, Homo sapiens
gauuaaccugaaacaaaga

SEQ ID NO: 990292 - RNA, 19 nt, Homo sapiens
gcccugauccacaauaaaa

SEQ ID NO: 990293 - RNA, 19 nt, Homo sapiens
uaagcccugauccacaaua

SEQ ID NO: 990294 - RNA, 19 nt, Homo sapiens
guuugugauuaguccuuaa

SEQ ID NO: 990295 - RNA, 19 nt, Homo sapiens
guggauggauguagaaaag

SEQ ID NO: 990296 - RNA, 19 nt, Homo sapiens
cagagaaggauggcagaug

SEQ ID NO: 990297 - RNA, 19 nt, Homo sapiens
ucacacaagcgcucaacca

SEQ ID NO: 990298 - RNA, 19 nt, Homo sapiens
aaaucaugcuucagacaac

SEQ ID NO: 990299 - RNA, 19 nt, Homo sapiens
ccaacucucugcugccuua

SEQ ID NO: 990300 - RNA, 19 nt, Homo sapiens
uaaauagccucccuaagga

SEQ ID NO: 990301 - RNA, 19 nt, Homo sapiens
gagauuugccuacaaggua

SEQ ID NO: 990302 - RNA, 19 nt, Homo sapiens
gagaugcuguaacuuaaug

SEQ ID NO: 990303 - RNA, 19 nt, Homo sapiens
gaaaauacacugaaugcua

SEQ ID NO: 990304 - RNA, 19 nt, Homo sapiens
ggaacuggcuucuguuugc

SEQ ID NO: 990305 - RNA, 19 nt, Homo sapiens
gcaaggauuuccgggacua

SEQ ID NO: 990306 - RNA, 19 nt, Homo sapiens
gcacuuaaguacuccugau

SEQ ID NO: 990307 - RNA, 19 nt, Homo sapiens
guauuuccaugcaguguau

SEQ ID NO: 990308 - RNA, 19 nt, Homo sapiens
gggacuaccucaugaguac

SEQ ID NO: 990309 - RNA, 19 nt, Homo sapiens
ccucggaacuggcuucugu

SEQ ID NO: 990310 - RNA, 19 nt, Homo sapiens
ucaaacacgagaugacuaa

SEQ ID NO: 990311 - RNA, 19 nt, Homo sapiens
ccacgcaacaaaugaagua

SEQ ID NO: 990312 - RNA, 19 nt, Homo sapiens
gaugacauuugcccucugu

SEQ ID NO: 990313 - RNA, 19 nt, Homo sapiens
accaacagcuggccacgua

SEQ ID NO: 990314 - RNA, 19 nt, Homo sapiens
gcugcugagucacagauuu

SEQ ID NO: 990315 - RNA, 19 nt, Homo sapiens
uugagaugcuguaacuuaa

SEQ ID NO: 990316 - RNA, 19 nt, Homo sapiens
auaaauagccucccuaagg

SEQ ID NO: 990317 - RNA, 19 nt, Homo sapiens
uguaaccacuagcacuuaa

SEQ ID NO: 990318 - RNA, 19 nt, Homo sapiens
aagaguagcucaaaauaug

SEQ ID NO: 990319 - RNA, 19 nt, Homo sapiens
gaacuggcuucuguuugca

SEQ ID NO: 990320 - RNA, 19 nt, Homo sapiens
aauguuaccuguguauuuc

SEQ ID NO: 990321 - RNA, 19 nt, Homo sapiens
caugagauuugccuacaag

SEQ ID NO: 990322 - RNA, 19 nt, Homo sapiens
auugagaugcuguaacuua

SEQ ID NO: 990323 - RNA, 19 nt, Homo sapiens
uagaaauagcugagaguuu

SEQ ID NO: 990324 - RNA, 19 nt, Homo sapiens
caguguauauauugagaug

SEQ ID NO: 990325 - RNA, 19 nt, Homo sapiens
ccauaaagaguagcucaaa

SEQ ID NO: 990326 - RNA, 19 nt, Homo sapiens
ugagucacagauuucauua

SEQ ID NO: 990327 - RNA, 19 nt, Homo sapiens
uaaaacggcaucugcauaa

SEQ ID NO: 990328 - RNA, 19 nt, Homo sapiens
ucagugggcggaugacauu

SEQ ID NO: 990329 - RNA, 19 nt, Homo sapiens
ugaaguagcccagcucauc

SEQ ID NO: 990330 - RNA, 19 nt, Homo sapiens
uccaugcaguguauauauu

SEQ ID NO: 990331 - RNA, 19 nt, Homo sapiens
gcuauucuuugacauucau

SEQ ID NO: 990332 - RNA, 19 nt, Homo sapiens
caugcaguguauauauuga

SEQ ID NO: 990333 - RNA, 19 nt, Homo sapiens
cagcuggccacguacuuaa

SEQ ID NO: 990334 - RNA, 19 nt, Homo sapiens
ugacauuugcccucuguug

SEQ ID NO: 990335 - RNA, 19 nt, Homo sapiens
gcuguaacuuaauggcaau

SEQ ID NO: 990336 - RNA, 19 nt, Homo sapiens
ccacguacuuaaaauuuug

SEQ ID NO: 990337 - RNA, 19 nt, Homo sapiens
ccaugcaguguauauauug

SEQ ID NO: 990338 - RNA, 19 nt, Homo sapiens
cauaaagaguagcucaaaa

SEQ ID NO: 990339 - RNA, 19 nt, Homo sapiens
ucugcugccuuacaaguau

SEQ ID NO: 990340 - RNA, 19 nt, Homo sapiens
gcaugccacgcaacaaaug

SEQ ID NO: 990341 - RNA, 19 nt, Homo sapiens
auauugagaugcuguaacu

SEQ ID NO: 990342 - RNA, 19 nt, Homo sapiens
cauuugcccucuguugcua

SEQ ID NO: 990343 - RNA, 19 nt, Homo sapiens
aacggcaucugcauaacaa

SEQ ID NO: 990344 - RNA, 19 nt, Homo sapiens
aaguacuccugauucuuaa

SEQ ID NO: 990345 - RNA, 19 nt, Homo sapiens
uuauaaauagccucccuaa

SEQ ID NO: 990346 - RNA, 19 nt, Homo sapiens
ucaugagauuugccuacaa

SEQ ID NO: 990347 - RNA, 19 nt, Homo sapiens
cuuaaguacuccugauucu

SEQ ID NO: 990348 - RNA, 19 nt, Homo sapiens
guacuccugauucuuaaca

SEQ ID NO: 990349 - RNA, 19 nt, Homo sapiens
cacuagcacuuaaguacuc

SEQ ID NO: 990350 - RNA, 19 nt, Homo sapiens
guguauauauugagaugcu

SEQ ID NO: 990351 - RNA, 19 nt, Homo sapiens
aaacggcaucugcauaaca

SEQ ID NO: 990352 - RNA, 19 nt, Homo sapiens
gccacguacuuaaaauuuu

SEQ ID NO: 990353 - RNA, 19 nt, Homo sapiens
acagcuggccacguacuua

SEQ ID NO: 990354 - RNA, 19 nt, Homo sapiens
gaccacaagacaaccaaca

SEQ ID NO: 990355 - RNA, 19 nt, Homo sapiens
acucucugcugccuuacaa

SEQ ID NO: 990356 - RNA, 19 nt, Homo sapiens
ggaaaaggaagaacaaggu

SEQ ID NO: 990357 - RNA, 19 nt, Homo sapiens
uaaccacuagcacuuaagu

SEQ ID NO: 990358 - RNA, 19 nt, Homo sapiens
cugagucacagauuucauu

SEQ ID NO: 990359 - RNA, 19 nt, Homo sapiens
ucuuugacauucaugagau

SEQ ID NO: 990360 - RNA, 19 nt, Homo sapiens
ugcaguguauauauugaga

SEQ ID NO: 990361 - RNA, 19 nt, Homo sapiens
acuccugauucuuaacauu

SEQ ID NO: 990362 - RNA, 19 nt, Homo sapiens
guugcuauucuuugacauu

SEQ ID NO: 990363 - RNA, 19 nt, Homo sapiens
uuaaugaccacaagacaac

SEQ ID NO: 990364 - RNA, 19 nt, Homo sapiens
ugacauucaugagauuugc

SEQ ID NO: 990365 - RNA, 19 nt, Homo sapiens
gauguuuuaucugcaguaa

SEQ ID NO: 990366 - RNA, 19 nt, Homo sapiens
ggaauuagcauuucacuug

SEQ ID NO: 990367 - RNA, 19 nt, Homo sapiens
gaacaacccugcaugucuu

SEQ ID NO: 990368 - RNA, 19 nt, Homo sapiens
gaaaugcauguacuuguua

SEQ ID NO: 990369 - RNA, 19 nt, Homo sapiens
gaagggagaccuacuaaau

SEQ ID NO: 990370 - RNA, 19 nt, Homo sapiens
aaauagacauggacaauga

SEQ ID NO: 990371 - RNA, 19 nt, Homo sapiens
aaacuuaacuugcaggaau

SEQ ID NO: 990372 - RNA, 19 nt, Homo sapiens
gcauuucacuuguuuauac

SEQ ID NO: 990373 - RNA, 19 nt, Homo sapiens
ggaaugguaugacuguguu

SEQ ID NO: 990374 - RNA, 19 nt, Homo sapiens
ugaaaugcauguacuuguu

SEQ ID NO: 990375 - RNA, 19 nt, Homo sapiens
ggaaaggaaggcuauggua

SEQ ID NO: 990376 - RNA, 19 nt, Homo sapiens
ccaacacgaugaacuauag

SEQ ID NO: 990377 - RNA, 19 nt, Homo sapiens
gaauuagcauuucacuugu

SEQ ID NO: 990378 - RNA, 19 nt, Homo sapiens
guuaaagugccucauauuu

SEQ ID NO: 990379 - RNA, 19 nt, Homo sapiens
cgagauaaaccucuacuug

SEQ ID NO: 990380 - RNA, 19 nt, Homo sapiens
ggaaggcuaugguagucuu

SEQ ID NO: 990381 - RNA, 19 nt, Homo sapiens
ccagaaaacugcucuaaga

SEQ ID NO: 990382 - RNA, 19 nt, Homo sapiens
ggagagcaccgaagaagug

SEQ ID NO: 990383 - RNA, 19 nt, Homo sapiens
uaagaagaaugaccaugau

SEQ ID NO: 990384 - RNA, 19 nt, Homo sapiens
caagaagggagaccuacua

SEQ ID NO: 990385 - RNA, 19 nt, Homo sapiens
gaaaacugcucuaagacaa

SEQ ID NO: 990386 - RNA, 19 nt, Homo sapiens
uaaagugccucauauuuug

SEQ ID NO: 990387 - RNA, 19 nt, Homo sapiens
gcauguuaauauccaguuu

SEQ ID NO: 990388 - RNA, 19 nt, Homo sapiens
aaaguuaaagugccucaua

SEQ ID NO: 990389 - RNA, 19 nt, Homo sapiens
ggugauggcuucauuucuc

SEQ ID NO: 990390 - RNA, 19 nt, Homo sapiens
aaagacggcucgaaauucu

SEQ ID NO: 990391 - RNA, 19 nt, Homo sapiens
cuaaagacggcucgaaauu

SEQ ID NO: 990392 - RNA, 19 nt, Homo sapiens
gcauugagacauuuaaaca

SEQ ID NO: 990393 - RNA, 19 nt, Homo sapiens
cuacugcuuuauucuguaa

SEQ ID NO: 990394 - RNA, 19 nt, Homo sapiens
uuucccaacuuuaaccuua

SEQ ID NO: 990395 - RNA, 19 nt, Homo sapiens
acgaugaacuauagcauau

SEQ ID NO: 990396 - RNA, 19 nt, Homo sapiens
gaaaagcgaaaaguaguua

SEQ ID NO: 990397 - RNA, 19 nt, Homo sapiens
gagcaccgaagaagugaaa

SEQ ID NO: 990398 - RNA, 19 nt, Homo sapiens
aaccaugcauuucuuauuc

SEQ ID NO: 990399 - RNA, 19 nt, Homo sapiens
ucauuucucccaaggaaua

SEQ ID NO: 990400 - RNA, 19 nt, Homo sapiens
uuaagaagaaugaccauga

SEQ ID NO: 990401 - RNA, 19 nt, Homo sapiens
uaggaggacauguauagua

SEQ ID NO: 990402 - RNA, 19 nt, Homo sapiens
uaauaaaugugaggcuguu

SEQ ID NO: 990403 - RNA, 19 nt, Homo sapiens
agauaaaccucuacuugca

SEQ ID NO: 990404 - RNA, 19 nt, Homo sapiens
aggaggacauguauaguau

SEQ ID NO: 990405 - RNA, 19 nt, Homo sapiens
gagcauugagacauuuaaa

SEQ ID NO: 990406 - RNA, 19 nt, Homo sapiens
gcaggaaugguaugacugu

SEQ ID NO: 990407 - RNA, 19 nt, Homo sapiens
uaacaauacaugcgcagaa

SEQ ID NO: 990408 - RNA, 19 nt, Homo sapiens
gauaugugcccuggagaaa

SEQ ID NO: 990409 - RNA, 19 nt, Homo sapiens
uaaagacggcucgaaauuc

SEQ ID NO: 990410 - RNA, 19 nt, Homo sapiens
gaugagaagccacgugaca

SEQ ID NO: 990411 - RNA, 19 nt, Homo sapiens
auaaaccucuacuugcaaa

SEQ ID NO: 990412 - RNA, 19 nt, Homo sapiens
gauaaaccucuacuugcaa

SEQ ID NO: 990413 - RNA, 19 nt, Homo sapiens
gcuaaagacggcucgaaau

SEQ ID NO: 990414 - RNA, 19 nt, Homo sapiens
caaaggaccacggagcauu

SEQ ID NO: 990415 - RNA, 19 nt, Homo sapiens
caaauagacauggacaaug

SEQ ID NO: 990416 - RNA, 19 nt, Homo sapiens
gcucuaagacaagcaagaa

SEQ ID NO: 990417 - RNA, 19 nt, Homo sapiens
gacccaggaauuagcauuu

SEQ ID NO: 990418 - RNA, 19 nt, Homo sapiens
cuucauuucucccaaggaa

SEQ ID NO: 990419 - RNA, 19 nt, Homo sapiens
aaauauccuugucucaugu

SEQ ID NO: 990420 - RNA, 19 nt, Homo sapiens
aaguuaaagugccucauau

SEQ ID NO: 990421 - RNA, 19 nt, Homo sapiens
ugauggugauggcuucauu

SEQ ID NO: 990422 - RNA, 19 nt, Homo sapiens
ggaccacggagcauugaga

SEQ ID NO: 990423 - RNA, 19 nt, Homo sapiens
acauugcuaugacagauau

SEQ ID NO: 990424 - RNA, 19 nt, Homo sapiens
gacauugcuaugacagaua

SEQ ID NO: 990425 - RNA, 19 nt, Homo sapiens
auuaaggacccaggaauua

SEQ ID NO: 990426 - RNA, 19 nt, Homo sapiens
cauaaaaggccuagacauu

SEQ ID NO: 990427 - RNA, 19 nt, Homo sapiens
cauuaaggacccaggaauu

SEQ ID NO: 990428 - RNA, 19 nt, Homo sapiens
uguguuuccuacugcuuua

SEQ ID NO: 990429 - RNA, 19 nt, Homo sapiens
acaggcagcucucuaaagc

SEQ ID NO: 990430 - RNA, 19 nt, Homo sapiens
gguaugacuguguuuccua

SEQ ID NO: 990431 - RNA, 19 nt, Homo sapiens
cacgaugaacuauagcaua

SEQ ID NO: 990432 - RNA, 19 nt, Homo sapiens
cacggagcauugagacauu

SEQ ID NO: 990433 - RNA, 19 nt, Homo sapiens
gaauuguagcaccaugaaa

SEQ ID NO: 990434 - RNA, 19 nt, Homo sapiens
uaacuugcaggaaugguau

SEQ ID NO: 990435 - RNA, 19 nt, Homo sapiens
caauguauaccaacacgau

SEQ ID NO: 990436 - RNA, 19 nt, Homo sapiens
gauggugauggcuucauuu

SEQ ID NO: 990437 - RNA, 19 nt, Homo sapiens
gaggagagcaccgaagaag

SEQ ID NO: 990438 - RNA, 19 nt, Homo sapiens
ggacccaggaauuagcauu

SEQ ID NO: 990439 - RNA, 19 nt, Homo sapiens
ccgaagaagugaaaauaga

SEQ ID NO: 990440 - RNA, 19 nt, Homo sapiens
aagccgagauaaaccucua

SEQ ID NO: 990441 - RNA, 19 nt, Homo sapiens
acaaauagacauggacaau

SEQ ID NO: 990442 - RNA, 19 nt, Homo sapiens
ggagcauugagacauuuaa

SEQ ID NO: 990443 - RNA, 19 nt, Homo sapiens
acggcuaccuggcuaaaga

SEQ ID NO: 990444 - RNA, 19 nt, Homo sapiens
ggagaaaagcgaaaaguag

SEQ ID NO: 990445 - RNA, 19 nt, Homo sapiens
ggcuaaagacggcucgaaa

SEQ ID NO: 990446 - RNA, 19 nt, Homo sapiens
agacauugcuaugacagau

SEQ ID NO: 990447 - RNA, 19 nt, Homo sapiens
caagucauaucaggaugca

SEQ ID NO: 990448 - RNA, 19 nt, Homo sapiens
ugacaggcagcucucuaaa

SEQ ID NO: 990449 - RNA, 19 nt, Homo sapiens
aagaagggagaccuacuaa

SEQ ID NO: 990450 - RNA, 19 nt, Homo sapiens
uuaccagcauguuaauauc

SEQ ID NO: 990451 - RNA, 19 nt, Homo sapiens
aaccuuaccagcauguuaa

SEQ ID NO: 990452 - RNA, 19 nt, Homo sapiens
ccuacugcuuuauucugua

SEQ ID NO: 990453 - RNA, 19 nt, Homo sapiens
auaccaacacgaugaacua

SEQ ID NO: 990454 - RNA, 19 nt, Homo sapiens
aaaauauccuugucucaug

SEQ ID NO: 990455 - RNA, 19 nt, Homo sapiens
aaaggaaggcuaugguagu

SEQ ID NO: 990456 - RNA, 19 nt, Homo sapiens
uguaggaggacauguauag

SEQ ID NO: 990457 - RNA, 19 nt, Homo sapiens
aaaggaccacggagcauug

SEQ ID NO: 990458 - RNA, 19 nt, Homo sapiens
cuuaccagcauguuaauau

SEQ ID NO: 990459 - RNA, 19 nt, Homo sapiens
agggagaccuacuaaaugc

SEQ ID NO: 990460 - RNA, 19 nt, Homo sapiens
gagagcaccgaagaaguga

SEQ ID NO: 990461 - RNA, 19 nt, Homo sapiens
gcaagcuuuucccaacuuu

SEQ ID NO: 990462 - RNA, 19 nt, Homo sapiens
ugucucaugucacagaaca

SEQ ID NO: 990463 - RNA, 19 nt, Homo sapiens
ggccuagacauugcuauga

SEQ ID NO: 990464 - RNA, 19 nt, Homo sapiens
aagggagaccuacuaaaug

SEQ ID NO: 990465 - RNA, 19 nt, Homo sapiens
uuaacuugcaggaauggua

SEQ ID NO: 990466 - RNA, 19 nt, Homo sapiens
acacugacaucuccaauua

SEQ ID NO: 990467 - RNA, 19 nt, Homo sapiens
gaauggaaaugagacguua

SEQ ID NO: 990468 - RNA, 19 nt, Homo sapiens
caaaagaacuucaucauug

SEQ ID NO: 990469 - RNA, 19 nt, Homo sapiens
uaaagccucugcauaauug

SEQ ID NO: 990470 - RNA, 19 nt, Homo sapiens
gcauuugucucuaguguga

SEQ ID NO: 990471 - RNA, 19 nt, Homo sapiens
gaaaugagacguuaugaag

SEQ ID NO: 990472 - RNA, 19 nt, Homo sapiens
uaagugggcuaaccaauau

SEQ ID NO: 990473 - RNA, 19 nt, Homo sapiens
guaacuagcccuuaauuau

SEQ ID NO: 990474 - RNA, 19 nt, Homo sapiens
cuguaaaucuucaguguua

SEQ ID NO: 990475 - RNA, 19 nt, Homo sapiens
gaacaaagagggagaugau

SEQ ID NO: 990476 - RNA, 19 nt, Homo sapiens
ugacacuaguuguaaguua

SEQ ID NO: 990477 - RNA, 19 nt, Homo sapiens
uaaaggauuucauggaaga

SEQ ID NO: 990478 - RNA, 19 nt, Homo sapiens
cuagugcauugucuuauua

SEQ ID NO: 990479 - RNA, 19 nt, Homo sapiens
agagggagaugauaagaaa

SEQ ID NO: 990480 - RNA, 19 nt, Homo sapiens
guagaucuuuguacaguug

SEQ ID NO: 990481 - RNA, 19 nt, Homo sapiens
cuaaucaaguuugcuguua

SEQ ID NO: 990482 - RNA, 19 nt, Homo sapiens
caaaugagccaacguuuua

SEQ ID NO: 990483 - RNA, 19 nt, Homo sapiens
guacaacuaacaacaguaa

SEQ ID NO: 990484 - RNA, 19 nt, Homo sapiens
ccaaacagcuugcuuuuau

SEQ ID NO: 990485 - RNA, 19 nt, Homo sapiens
agagaaaccuucaaagaca

SEQ ID NO: 990486 - RNA, 19 nt, Homo sapiens
uaacuagugcauugucuua

SEQ ID NO: 990487 - RNA, 19 nt, Homo sapiens
ggaggagaauggaggaaga

SEQ ID NO: 990488 - RNA, 19 nt, Homo sapiens
uagcagugauguaaugaaa

SEQ ID NO: 990489 - RNA, 19 nt, Homo sapiens
caaguuugcuguuaguugu

SEQ ID NO: 990490 - RNA, 19 nt, Homo sapiens
ugauggaguugauggauuu

SEQ ID NO: 990491 - RNA, 19 nt, Homo sapiens
cuucagggauuauucuuaa

SEQ ID NO: 990492 - RNA, 19 nt, Homo sapiens
guacacagaugucauuuug

SEQ ID NO: 990493 - RNA, 19 nt, Homo sapiens
gaauguuucugcagaucuu

SEQ ID NO: 990494 - RNA, 19 nt, Homo sapiens
gaagaggagcguuggagaa

SEQ ID NO: 990495 - RNA, 19 nt, Homo sapiens
uaacuagcccuuaauuaug

SEQ ID NO: 990496 - RNA, 19 nt, Homo sapiens
ggaaaugagacguuaugaa

SEQ ID NO: 990497 - RNA, 19 nt, Homo sapiens
caucuuaccugcuuauguc

SEQ ID NO: 990498 - RNA, 19 nt, Homo sapiens
acagugagguugauaaagu

SEQ ID NO: 990499 - RNA, 19 nt, Homo sapiens
gaacaugagaagaacaaga

SEQ ID NO: 990500 - RNA, 19 nt, Homo sapiens
gggauuauucuuaaaggua

SEQ ID NO: 990501 - RNA, 19 nt, Homo sapiens
ggucugcaguccuguguga

SEQ ID NO: 990502 - RNA, 19 nt, Homo sapiens
uaagaaagagggagguaaa

SEQ ID NO: 990503 - RNA, 19 nt, Homo sapiens
gauguaaccucggguaugg

SEQ ID NO: 990504 - RNA, 19 nt, Homo sapiens
gagaauggaggaagaacaa

SEQ ID NO: 990505 - RNA, 19 nt, Homo sapiens
gauguaugcuucaguaaaa

SEQ ID NO: 990506 - RNA, 19 nt, Homo sapiens
aaugauguaugcuucagua

SEQ ID NO: 990507 - RNA, 19 nt, Homo sapiens
acacguagaucuuuguaca

SEQ ID NO: 990508 - RNA, 19 nt, Homo sapiens
gcuauggaguuacuaguag

SEQ ID NO: 990509 - RNA, 19 nt, Homo sapiens
aagcugggcuauggaguua

SEQ ID NO: 990510 - RNA, 19 nt, Homo sapiens
uauaagcccugagaaguau

SEQ ID NO: 990511 - RNA, 19 nt, Homo sapiens
ucagagaaaccuucaaaga

SEQ ID NO: 990512 - RNA, 19 nt, Homo sapiens
acaaagagggagaugauaa

SEQ ID NO: 990513 - RNA, 19 nt, Homo sapiens
ucuagcaacuauuacagua

SEQ ID NO: 990514 - RNA, 19 nt, Homo sapiens
gaggagcguuggagaaugg

SEQ ID NO: 990515 - RNA, 19 nt, Homo sapiens
gcucagagaaaccuucaaa

SEQ ID NO: 990516 - RNA, 19 nt, Homo sapiens
caaaacaugccaccauuua

SEQ ID NO: 990517 - RNA, 19 nt, Homo sapiens
gcuuaugucuccuacacaa

SEQ ID NO: 990518 - RNA, 19 nt, Homo sapiens
cagugagguugauaaagua

SEQ ID NO: 990519 - RNA, 19 nt, Homo sapiens
caacuaacaacaguaacua

SEQ ID NO: 990520 - RNA, 19 nt, Homo sapiens
gacauguacuggaggagaa

SEQ ID NO: 990521 - RNA, 19 nt, Homo sapiens
uaacagugagguugauaaa

SEQ ID NO: 990522 - RNA, 19 nt, Homo sapiens
gaacuucaucauuguacaa

SEQ ID NO: 990523 - RNA, 19 nt, Homo sapiens
aagaagagauagugaugga

SEQ ID NO: 990524 - RNA, 19 nt, Homo sapiens
gaacaugagggaaggagau

SEQ ID NO: 990525 - RNA, 19 nt, Homo sapiens
acugacaucuccaauuauu

SEQ ID NO: 990526 - RNA, 19 nt, Homo sapiens
ggaguuacuaguagagaaa

SEQ ID NO: 990527 - RNA, 19 nt, Homo sapiens
gagaaaccuucaaagacau

SEQ ID NO: 990528 - RNA, 19 nt, Homo sapiens
caacaguaacuagcccuua

SEQ ID NO: 990529 - RNA, 19 nt, Homo sapiens
caacaggaaacgaagaaga

SEQ ID NO: 990530 - RNA, 19 nt, Homo sapiens
gagaagaacaagaacaaag

SEQ ID NO: 990531 - RNA, 19 nt, Homo sapiens
gaaaugauguaugcuucag

SEQ ID NO: 990532 - RNA, 19 nt, Homo sapiens
ccagauaauuuacaguucu

SEQ ID NO: 990533 - RNA, 19 nt, Homo sapiens
aacaguaacuagcccuuaa

SEQ ID NO: 990534 - RNA, 19 nt, Homo sapiens
uuacugaacgugcuuuaaa

SEQ ID NO: 990535 - RNA, 19 nt, Homo sapiens
gaugaccguuauguaauga

SEQ ID NO: 990536 - RNA, 19 nt, Homo sapiens
ggaagaacaacaucauugg

SEQ ID NO: 990537 - RNA, 19 nt, Homo sapiens
uauauggucuugcaacagu

SEQ ID NO: 990538 - RNA, 19 nt, Homo sapiens
gggcauuugucucuagugu

SEQ ID NO: 990539 - RNA, 19 nt, Homo sapiens
caggaugugugcuucaguu

SEQ ID NO: 990540 - RNA, 19 nt, Homo sapiens
uguacaguguuagguauua

SEQ ID NO: 990541 - RNA, 19 nt, Homo sapiens
ccagauacacaaaguucua

SEQ ID NO: 990542 - RNA, 19 nt, Homo sapiens
agaaaugucaaccuuguuu

SEQ ID NO: 990543 - RNA, 19 nt, Homo sapiens
gagauuacucuagcaacua

SEQ ID NO: 990544 - RNA, 19 nt, Homo sapiens
cuucaucauuguacaacua

SEQ ID NO: 990545 - RNA, 19 nt, Homo sapiens
auaagugggcuaaccaaua

SEQ ID NO: 990546 - RNA, 19 nt, Homo sapiens
gugauggaguugauggauu

SEQ ID NO: 990547 - RNA, 19 nt, Homo sapiens
agauagaaaugucaaccuu

SEQ ID NO: 990548 - RNA, 19 nt, Homo sapiens
agagggagguaaagacaga

SEQ ID NO: 990549 - RNA, 19 nt, Homo sapiens
gaggaagaacaacaucauu

SEQ ID NO: 990550 - RNA, 19 nt, Homo sapiens
cugcaguccugugugauua

SEQ ID NO: 990551 - RNA, 19 nt, Homo sapiens
ugaugaccguuauguaaug

SEQ ID NO: 990552 - RNA, 19 nt, Homo sapiens
ggugacaguuccuuauugg

SEQ ID NO: 990553 - RNA, 19 nt, Homo sapiens
guacaguguuagguauuau

SEQ ID NO: 990554 - RNA, 19 nt, Homo sapiens
ucugaugaccguuauguaa

SEQ ID NO: 990555 - RNA, 19 nt, Homo sapiens
uuauaagcccugagaagua

SEQ ID NO: 990556 - RNA, 19 nt, Homo sapiens
gaaagagggagguaaagac

SEQ ID NO: 990557 - RNA, 19 nt, Homo sapiens
auauauguaugcucuggua

SEQ ID NO: 990558 - RNA, 19 nt, Homo sapiens
gacaaaacaugccaccauu

SEQ ID NO: 990559 - RNA, 19 nt, Homo sapiens
uguuauagaugguauccuu

SEQ ID NO: 990560 - RNA, 19 nt, Homo sapiens
cauugagacuccuugcauu

SEQ ID NO: 990561 - RNA, 19 nt, Homo sapiens
ccucggguauggugaaaga

SEQ ID NO: 990562 - RNA, 19 nt, Homo sapiens
gauaagaaagagggaggua

SEQ ID NO: 990563 - RNA, 19 nt, Homo sapiens
gcuuugaaaugauguaugc

SEQ ID NO: 990564 - RNA, 19 nt, Homo sapiens
cgaagaagagauagugaug

SEQ ID NO: 990565 - RNA, 19 nt, Homo sapiens
auagaaaugucaaccuugu

SEQ ID NO: 990566 - RNA, 19 nt, Homo sapiens
gaacugugcuucucuuuau

SEQ ID NO: 990567 - RNA, 19 nt, Homo sapiens
ggagguggcucaguuauug

SEQ ID NO: 990568 - RNA, 19 nt, Homo sapiens
gagaacagcaugguaaaua

SEQ ID NO: 990569 - RNA, 19 nt, Homo sapiens
uuucauagcugccaaauau

SEQ ID NO: 990570 - RNA, 19 nt, Homo sapiens
gaacaaugauaccguuuua

SEQ ID NO: 990571 - RNA, 19 nt, Homo sapiens
gaacaguccucgggugauu

SEQ ID NO: 990572 - RNA, 19 nt, Homo sapiens
ggacagaaaugcaguucau

SEQ ID NO: 990573 - RNA, 19 nt, Homo sapiens
gauuaaagccuucuaguau

SEQ ID NO: 990574 - RNA, 19 nt, Homo sapiens
gugcauaaauccaguuuga

SEQ ID NO: 990575 - RNA, 19 nt, Homo sapiens
gaaaugcucuugguugcaa

SEQ ID NO: 990576 - RNA, 19 nt, Homo sapiens
gaaacgugguccucaguga

SEQ ID NO: 990577 - RNA, 19 nt, Homo sapiens
ggaaggcgcagauuucaaa

SEQ ID NO: 990578 - RNA, 19 nt, Homo sapiens
gcugagaggcuuauacuaa

SEQ ID NO: 990579 - RNA, 19 nt, Homo sapiens
ggauuguucuuuauucuga

SEQ ID NO: 990580 - RNA, 19 nt, Homo sapiens
ccacaucccuauuaacaga

SEQ ID NO: 990581 - RNA, 19 nt, Homo sapiens
ugacuugucccucuucuua

SEQ ID NO: 990582 - RNA, 19 nt, Homo sapiens
ugaaggcccucaucaggua

SEQ ID NO: 990583 - RNA, 19 nt, Homo sapiens
ggacaacguugguaacucu

SEQ ID NO: 990584 - RNA, 19 nt, Homo sapiens
gaaugguguuuaugaagaa

SEQ ID NO: 990585 - RNA, 19 nt, Homo sapiens
aaggacagguuacagaaua

SEQ ID NO: 990586 - RNA, 19 nt, Homo sapiens
ggucauuccuccuggguuu

SEQ ID NO: 990587 - RNA, 19 nt, Homo sapiens
ugaaucacauuucgucauu

SEQ ID NO: 990588 - RNA, 19 nt, Homo sapiens
ggagaggaaugugcagauu

SEQ ID NO: 990589 - RNA, 19 nt, Homo sapiens
agaacagcaugguaaauaa

SEQ ID NO: 990590 - RNA, 19 nt, Homo sapiens
ggaagauacagcagacaua

SEQ ID NO: 990591 - RNA, 19 nt, Homo sapiens
gcucaguuauugaaccuuu

SEQ ID NO: 990592 - RNA, 19 nt, Homo sapiens
ggaacugugcuucucuuua

SEQ ID NO: 990593 - RNA, 19 nt, Homo sapiens
guuagaagcugugaugguu

SEQ ID NO: 990594 - RNA, 19 nt, Homo sapiens
gcauaaauccaguuugaga

SEQ ID NO: 990595 - RNA, 19 nt, Homo sapiens
gagauggccuggguuauca

SEQ ID NO: 990596 - RNA, 19 nt, Homo sapiens
caaguucucuguucuggau

SEQ ID NO: 990597 - RNA, 19 nt, Homo sapiens
gagguuugguaucuuguuu

SEQ ID NO: 990598 - RNA, 19 nt, Homo sapiens
gguauucgcauuucaagaa

SEQ ID NO: 990599 - RNA, 19 nt, Homo sapiens
caugugaccuccuuucuca

SEQ ID NO: 990600 - RNA, 19 nt, Homo sapiens
uaaguucgccugucucuga

SEQ ID NO: 990601 - RNA, 19 nt, Homo sapiens
cagaggacauguucaacuu

SEQ ID NO: 990602 - RNA, 19 nt, Homo sapiens
cagaagauguccucguaga

SEQ ID NO: 990603 - RNA, 19 nt, Homo sapiens
ggaugaaccuggaaugaac

SEQ ID NO: 990604 - RNA, 19 nt, Homo sapiens
acagugauguguggaauaa

SEQ ID NO: 990605 - RNA, 19 nt, Homo sapiens
ugaccuccuuucucacuua

SEQ ID NO: 990606 - RNA, 19 nt, Homo sapiens
ugaacuugcugguugguuu

SEQ ID NO: 990607 - RNA, 19 nt, Homo sapiens
ggugagaugugaagaugug

SEQ ID NO: 990608 - RNA, 19 nt, Homo sapiens
ucaagugauuggauagaaa

SEQ ID NO: 990609 - RNA, 19 nt, Homo sapiens
uagcuguggugcauguuua

SEQ ID NO: 990610 - RNA, 19 nt, Homo sapiens
gcaucacucguguuauuua

SEQ ID NO: 990611 - RNA, 19 nt, Homo sapiens
uuuacuggcuuacuguuua

SEQ ID NO: 990612 - RNA, 19 nt, Homo sapiens
uauggaacguuucaaguga

SEQ ID NO: 990613 - RNA, 19 nt, Homo sapiens
ugagaaugguguuuaugaa

SEQ ID NO: 990614 - RNA, 19 nt, Homo sapiens
gaaauucucagcagacagu

SEQ ID NO: 990615 - RNA, 19 nt, Homo sapiens
gaacagcaugguaaauaau

SEQ ID NO: 990616 - RNA, 19 nt, Homo sapiens
gcaaggacagguuacagaa

SEQ ID NO: 990617 - RNA, 19 nt, Homo sapiens
cagcugaggugacacuguu

SEQ ID NO: 990618 - RNA, 19 nt, Homo sapiens
gagccaaccugaaucuagu

SEQ ID NO: 990619 - RNA, 19 nt, Homo sapiens
gcaggagguggcucaguua

SEQ ID NO: 990620 - RNA, 19 nt, Homo sapiens
cgauggaggucucauagug

SEQ ID NO: 990621 - RNA, 19 nt, Homo sapiens
agaaugguguuuaugaaga

SEQ ID NO: 990622 - RNA, 19 nt, Homo sapiens
guugguaacucugagaauu

SEQ ID NO: 990623 - RNA, 19 nt, Homo sapiens
ggcagugucuggccauuau

SEQ ID NO: 990624 - RNA, 19 nt, Homo sapiens
gcagugaggucagaagucu

SEQ ID NO: 990625 - RNA, 19 nt, Homo sapiens
cugagaggcuuauacuaaa

SEQ ID NO: 990626 - RNA, 19 nt, Homo sapiens
uaaagagaaggaacaauug

SEQ ID NO: 990627 - RNA, 19 nt, Homo sapiens
ggucucagcuuuucauuug

SEQ ID NO: 990628 - RNA, 19 nt, Homo sapiens
cgauuaaagccuucuagua

SEQ ID NO: 990629 - RNA, 19 nt, Homo sapiens
gagaggaaugugcagauuu

SEQ ID NO: 990630 - RNA, 19 nt, Homo sapiens
ugcagaagauguccucgua

SEQ ID NO: 990631 - RNA, 19 nt, Homo sapiens
gcucgugguuuccaguuug

SEQ ID NO: 990632 - RNA, 19 nt, Homo sapiens
gaugaagucacauuuguuc

SEQ ID NO: 990633 - RNA, 19 nt, Homo sapiens
uugcaucacucguguuauu

SEQ ID NO: 990634 - RNA, 19 nt, Homo sapiens
gggauuggguccugcugaa

SEQ ID NO: 990635 - RNA, 19 nt, Homo sapiens
gaaucacauuucgucauuu

SEQ ID NO: 990636 - RNA, 19 nt, Homo sapiens
ggugagggguuuuagauaa

SEQ ID NO: 990637 - RNA, 19 nt, Homo sapiens
ggauuggccuccuggaagu

SEQ ID NO: 990638 - RNA, 19 nt, Homo sapiens
gaagauacagcagacauag

SEQ ID NO: 990639 - RNA, 19 nt, Homo sapiens
gcauugccuuccuucacua

SEQ ID NO: 990640 - RNA, 19 nt, Homo sapiens
gcaaacaccggcuucaucu

SEQ ID NO: 990641 - RNA, 19 nt, Homo sapiens
ggacguaccccaaauguug

SEQ ID NO: 990642 - RNA, 19 nt, Homo sapiens
ugucuagggucucagcuuu

SEQ ID NO: 990643 - RNA, 19 nt, Homo sapiens
ggaagcagcaccugggaau

SEQ ID NO: 990644 - RNA, 19 nt, Homo sapiens
aaucacauuucgucauuug

SEQ ID NO: 990645 - RNA, 19 nt, Homo sapiens
cacaugcgcuugucauaca

SEQ ID NO: 990646 - RNA, 19 nt, Homo sapiens
aaacaccggcuucaucuga

SEQ ID NO: 990647 - RNA, 19 nt, Homo sapiens
caaccugaaucuagugaag

SEQ ID NO: 990648 - RNA, 19 nt, Homo sapiens
ucacaucccaggagaauuc

SEQ ID NO: 990649 - RNA, 19 nt, Homo sapiens
gaagucacauuuguucaac

SEQ ID NO: 990650 - RNA, 19 nt, Homo sapiens
uaugagaacagcaugguaa

SEQ ID NO: 990651 - RNA, 19 nt, Homo sapiens
gcaagcagucuccaugugu

SEQ ID NO: 990652 - RNA, 19 nt, Homo sapiens
caugggaagcaauguguua

SEQ ID NO: 990653 - RNA, 19 nt, Homo sapiens
guggguagcuaaggucauu

SEQ ID NO: 990654 - RNA, 19 nt, Homo sapiens
gaaugaugauacggaaguu

SEQ ID NO: 990655 - RNA, 19 nt, Homo sapiens
ggaaugaugauacggaagu

SEQ ID NO: 990656 - RNA, 19 nt, Homo sapiens
caggagcuauagggaguua

SEQ ID NO: 990657 - RNA, 19 nt, Homo sapiens
ccgaggcgcugucuucugu

SEQ ID NO: 990658 - RNA, 19 nt, Homo sapiens
cguaguggcucgugguuuc

SEQ ID NO: 990659 - RNA, 19 nt, Homo sapiens
gcucuuuacuggcuuacug

SEQ ID NO: 990660 - RNA, 19 nt, Homo sapiens
ccugcacucuggcucuuua

SEQ ID NO: 990661 - RNA, 19 nt, Homo sapiens
uauagggaguuaaggaaug

SEQ ID NO: 990662 - RNA, 19 nt, Homo sapiens
gauucuagacuucagauau

SEQ ID NO: 990663 - RNA, 19 nt, Homo sapiens
gauccauggugauucuaga

SEQ ID NO: 990664 - RNA, 19 nt, Homo sapiens
ggauagcagugaggucaga

SEQ ID NO: 990665 - RNA, 19 nt, Homo sapiens
gaacgggcaccuagagagu

SEQ ID NO: 990666 - RNA, 19 nt, Homo sapiens
gaauauacccuccacaguu

SEQ ID NO: 990667 - RNA, 19 nt, Homo sapiens
acacacagcuuugcacuuu

SEQ ID NO: 990668 - RNA, 19 nt, Homo sapiens
gcaaauagauguggacacu

SEQ ID NO: 990669 - RNA, 19 nt, Homo sapiens
gaacauuacacaacagaug

SEQ ID NO: 990670 - RNA, 19 nt, Homo sapiens
cuacaaagccgaagucaau

SEQ ID NO: 990671 - RNA, 19 nt, Homo sapiens
caaggacucucaugcacuu

SEQ ID NO: 990672 - RNA, 19 nt, Homo sapiens
gaugaugacuuggagaaau

SEQ ID NO: 990673 - RNA, 19 nt, Homo sapiens
gcuaccagcuccuguugaa

SEQ ID NO: 990674 - RNA, 19 nt, Homo sapiens
ccaaguuaguuaagagaaa

SEQ ID NO: 990675 - RNA, 19 nt, Homo sapiens
uaagagaaauuuccuugag

SEQ ID NO: 990676 - RNA, 19 nt, Homo sapiens
gaagaugagaauaugguuu

SEQ ID NO: 990677 - RNA, 19 nt, Homo sapiens
ccaucucucugucuuguuu

SEQ ID NO: 990678 - RNA, 19 nt, Homo sapiens
agaagaacauuacacaaca

SEQ ID NO: 990679 - RNA, 19 nt, Homo sapiens
gaagagcuauccccgauga

SEQ ID NO: 990680 - RNA, 19 nt, Homo sapiens
guguuaagauccucuguga

SEQ ID NO: 990681 - RNA, 19 nt, Homo sapiens
ggaccacaaugcuacaauc

SEQ ID NO: 990682 - RNA, 19 nt, Homo sapiens
aaauagauguggacacugu

SEQ ID NO: 990683 - RNA, 19 nt, Homo sapiens
aagccaaucucauggauau

SEQ ID NO: 990684 - RNA, 19 nt, Homo sapiens
cuaaagcaauugaaguugu

SEQ ID NO: 990685 - RNA, 19 nt, Homo sapiens
ccagagggaauuauuuauu

SEQ ID NO: 990686 - RNA, 19 nt, Homo sapiens
gcaugcugcuugacuacaa

SEQ ID NO: 990687 - RNA, 19 nt, Homo sapiens
gcucaauugcuacuccuua

SEQ ID NO: 990688 - RNA, 19 nt, Homo sapiens
gaacacaaaguggagaaga

SEQ ID NO: 990689 - RNA, 19 nt, Homo sapiens
ggagcugccaaguuaguua

SEQ ID NO: 990690 - RNA, 19 nt, Homo sapiens
gaagaacauuacacaacag

SEQ ID NO: 990691 - RNA, 19 nt, Homo sapiens
gagaugacgacuuuaaauc

SEQ ID NO: 990692 - RNA, 19 nt, Homo sapiens
ccacaaugcuacaaucaac

SEQ ID NO: 990693 - RNA, 19 nt, Homo sapiens
augaugacuuggagaaaua

SEQ ID NO: 990694 - RNA, 19 nt, Homo sapiens
aauauacccuccacaguuc

SEQ ID NO: 990695 - RNA, 19 nt, Homo sapiens
gaagccaaucucauggaua

SEQ ID NO: 990696 - RNA, 19 nt, Homo sapiens
gaugacgacuuuaaaucuc

SEQ ID NO: 990697 - RNA, 19 nt, Homo sapiens
gagccagagggaauuauuu

SEQ ID NO: 990698 - RNA, 19 nt, Homo sapiens
uuacacaacagaugccaua

SEQ ID NO: 990699 - RNA, 19 nt, Homo sapiens
uugccuagcuauaaauuga

SEQ ID NO: 990700 - RNA, 19 nt, Homo sapiens
cagaugccauagagcaauu

SEQ ID NO: 990701 - RNA, 19 nt, Homo sapiens
uuaucgagaugugccauua

SEQ ID NO: 990702 - RNA, 19 nt, Homo sapiens
gagaugugccauuagaaga

SEQ ID NO: 990703 - RNA, 19 nt, Homo sapiens
cuacugggcccuccgcuuu

SEQ ID NO: 990704 - RNA, 19 nt, Homo sapiens
cacaacagaugccauagag

SEQ ID NO: 990705 - RNA, 19 nt, Homo sapiens
auacaggccugccauucuu

SEQ ID NO: 990706 - RNA, 19 nt, Homo sapiens
cgaagucaaugcccgagau

SEQ ID NO: 990707 - RNA, 19 nt, Homo sapiens
gagcugccaaguuaguuaa

SEQ ID NO: 990708 - RNA, 19 nt, Homo sapiens
uaaguggacacacagcuuu

SEQ ID NO: 990709 - RNA, 19 nt, Homo sapiens
ccauagagcaauuccuuug

SEQ ID NO: 990710 - RNA, 19 nt, Homo sapiens
ggacucucaugcacuuauc

SEQ ID NO: 990711 - RNA, 19 nt, Homo sapiens
gaaauggccaauguggauu

SEQ ID NO: 990712 - RNA, 19 nt, Homo sapiens
ugaaauggccaauguggau

SEQ ID NO: 990713 - RNA, 19 nt, Homo sapiens
ugcccgagaugacgacuuu

SEQ ID NO: 990714 - RNA, 19 nt, Homo sapiens
cagcgugaaugcccacaug

SEQ ID NO: 990715 - RNA, 19 nt, Homo sapiens
ggaaugucuucuggugcua

SEQ ID NO: 990716 - RNA, 19 nt, Homo sapiens
aucuggagcugccaaguua

SEQ ID NO: 990717 - RNA, 19 nt, Homo sapiens
gaagaccaacaaccaagau

SEQ ID NO: 990718 - RNA, 19 nt, Homo sapiens
cgagaugacgacuuuaaau

SEQ ID NO: 990719 - RNA, 19 nt, Homo sapiens
uguagucaaugccuaugaa

SEQ ID NO: 990720 - RNA, 19 nt, Homo sapiens
gcuuuaaggagcaggagua

SEQ ID NO: 990721 - RNA, 19 nt, Homo sapiens
gauacaggccugccauucu

SEQ ID NO: 990722 - RNA, 19 nt, Homo sapiens
cgaagccaaucucauggau

SEQ ID NO: 990723 - RNA, 19 nt, Homo sapiens
gaacaugaagaccaacaac

SEQ ID NO: 990724 - RNA, 19 nt, Homo sapiens
cucaauugcuacuccuuaa

SEQ ID NO: 990725 - RNA, 19 nt, Homo sapiens
gauccaaaggcaaauagau

SEQ ID NO: 990726 - RNA, 19 nt, Homo sapiens
guuacugguugccuagcua

SEQ ID NO: 990727 - RNA, 19 nt, Homo sapiens
gcaauugaaguuguaguca

SEQ ID NO: 990728 - RNA, 19 nt, Homo sapiens
cuugugaaauggccaaugu

SEQ ID NO: 990729 - RNA, 19 nt, Homo sapiens
agucgaagaugagaauaug

SEQ ID NO: 990730 - RNA, 19 nt, Homo sapiens
agccagagggaauuauuua

SEQ ID NO: 990731 - RNA, 19 nt, Homo sapiens
acaguuccauaaggugaua

SEQ ID NO: 990732 - RNA, 19 nt, Homo sapiens
ucagauggaacacaaagug

SEQ ID NO: 990733 - RNA, 19 nt, Homo sapiens
ccaaucucauggauaucaa

SEQ ID NO: 990734 - RNA, 19 nt, Homo sapiens
gaagucgaagaugagaaua

SEQ ID NO: 990735 - RNA, 19 nt, Homo sapiens
uagaagaacauuacacaac

SEQ ID NO: 990736 - RNA, 19 nt, Homo sapiens
caaugccuaugaacacauc

SEQ ID NO: 990737 - RNA, 19 nt, Homo sapiens
gaagucaaugcccgagaug

SEQ ID NO: 990738 - RNA, 19 nt, Homo sapiens
ugaagucgaagaugagaau

SEQ ID NO: 990739 - RNA, 19 nt, Homo sapiens
ccaaugacuucggaaaauu

SEQ ID NO: 990740 - RNA, 19 nt, Homo sapiens
gcugugcugccauccagua

SEQ ID NO: 990741 - RNA, 19 nt, Homo sapiens
gcugccaaguuaguuaaga

SEQ ID NO: 990742 - RNA, 19 nt, Homo sapiens
gccgcaugcugcuugacua

SEQ ID NO: 990743 - RNA, 19 nt, Homo sapiens
gaccacaaugcuacaauca

SEQ ID NO: 990744 - RNA, 19 nt, Homo sapiens
cuacuggaccacaaugcua

SEQ ID NO: 990745 - RNA, 19 nt, Homo sapiens
gccauuagaagaacauuac

SEQ ID NO: 990746 - RNA, 19 nt, Homo sapiens
caugcugcuugacuacaaa

SEQ ID NO: 990747 - RNA, 19 nt, Homo sapiens
caauugcuacuccuuaagu

SEQ ID NO: 990748 - RNA, 19 nt, Homo sapiens
cugguugccuagcuauaaa

SEQ ID NO: 990749 - RNA, 19 nt, Homo sapiens
gccaaucucauggauauca

SEQ ID NO: 990750 - RNA, 19 nt, Homo sapiens
cgagaugugccauuagaag

SEQ ID NO: 990751 - RNA, 19 nt, Homo sapiens
acaaaguggagaagagcua

SEQ ID NO: 990752 - RNA, 19 nt, Homo sapiens
aaucaacuguagacccaau

SEQ ID NO: 990753 - RNA, 19 nt, Homo sapiens
acacaacagaugccauaga

SEQ ID NO: 990754 - RNA, 19 nt, Homo sapiens
uuggagaaauacugggauu

SEQ ID NO: 990755 - RNA, 19 nt, Homo sapiens
cgaauauacccuccacagu

SEQ ID NO: 990756 - RNA, 19 nt, Homo sapiens
agaccaacaaccaagauga

SEQ ID NO: 990757 - RNA, 19 nt, Homo sapiens
ccacugccccugucacuaa

SEQ ID NO: 990758 - RNA, 19 nt, Homo sapiens
gaugugccauuagaagaac

SEQ ID NO: 990759 - RNA, 19 nt, Homo sapiens
ugcuguaacucuccaagga

SEQ ID NO: 990760 - RNA, 19 nt, Homo sapiens
uuaccacucucucuuuacu

SEQ ID NO: 990761 - RNA, 19 nt, Homo sapiens
ccgagaugacgacuuuaaa

SEQ ID NO: 990762 - RNA, 19 nt, Homo sapiens
ugaagaccaacaaccaaga

SEQ ID NO: 990763 - RNA, 19 nt, Homo sapiens
caugaagaccaacaaccaa

SEQ ID NO: 990764 - RNA, 19 nt, Homo sapiens
gccauagagcaauuccuuu

SEQ ID NO: 990765 - RNA, 19 nt, Homo sapiens
uugaggcgcuaaaguccaa

SEQ ID NO: 990766 - RNA, 19 nt, Homo sapiens
ccagaaaggugaauagugu

SEQ ID NO: 990767 - RNA, 19 nt, Homo sapiens
gaauauacccuccacaguu

SEQ ID NO: 990768 - RNA, 19 nt, Homo sapiens
acacacagcuuugcacuuu

SEQ ID NO: 990769 - RNA, 19 nt, Homo sapiens
gcauacauuugccaucuuu

SEQ ID NO: 990770 - RNA, 19 nt, Homo sapiens
gcaaauagauguggacacu

SEQ ID NO: 990771 - RNA, 19 nt, Homo sapiens
cagaaugacugaucuaaag

SEQ ID NO: 990772 - RNA, 19 nt, Homo sapiens
ugucugaaaucuccaagua

SEQ ID NO: 990773 - RNA, 19 nt, Homo sapiens
cuacaaagccgaagucaau

SEQ ID NO: 990774 - RNA, 19 nt, Homo sapiens
gcuaccagcuccuguugaa

SEQ ID NO: 990775 - RNA, 19 nt, Homo sapiens
ccaaguuaguuaagagaaa

SEQ ID NO: 990776 - RNA, 19 nt, Homo sapiens
uaagagaaauuuccuugag

SEQ ID NO: 990777 - RNA, 19 nt, Homo sapiens
ugaaagggccacccgauuu

SEQ ID NO: 990778 - RNA, 19 nt, Homo sapiens
gaagaugagaauaugguuu

SEQ ID NO: 990779 - RNA, 19 nt, Homo sapiens
ugugagagcuagaaugaga

SEQ ID NO: 990780 - RNA, 19 nt, Homo sapiens
ccaucucucugucuuguuu

SEQ ID NO: 990781 - RNA, 19 nt, Homo sapiens
gcacacuguuauaagcaaa

SEQ ID NO: 990782 - RNA, 19 nt, Homo sapiens
guguuaagauccucuguga

SEQ ID NO: 990783 - RNA, 19 nt, Homo sapiens
ggaccacaaugcuacaauc

SEQ ID NO: 990784 - RNA, 19 nt, Homo sapiens
aaauagauguggacacugu

SEQ ID NO: 990785 - RNA, 19 nt, Homo sapiens
ccaguuuaaugaaagcuaa

SEQ ID NO: 990786 - RNA, 19 nt, Homo sapiens
aagccaaucucauggauau

SEQ ID NO: 990787 - RNA, 19 nt, Homo sapiens
ucagccugcuuugaaauua

SEQ ID NO: 990788 - RNA, 19 nt, Homo sapiens
ggugugagagcuagaauga

SEQ ID NO: 990789 - RNA, 19 nt, Homo sapiens
gcaugcugcuugacuacaa

SEQ ID NO: 990790 - RNA, 19 nt, Homo sapiens
gcucaauugcuacuccuua

SEQ ID NO: 990791 - RNA, 19 nt, Homo sapiens
gcuuugaaauuagcuugua

SEQ ID NO: 990792 - RNA, 19 nt, Homo sapiens
ugacucagccugcuuugaa

SEQ ID NO: 990793 - RNA, 19 nt, Homo sapiens
ggagcugccaaguuaguua

SEQ ID NO: 990794 - RNA, 19 nt, Homo sapiens
gagaugacgacuuuaaauc

SEQ ID NO: 990795 - RNA, 19 nt, Homo sapiens
ccacaaugcuacaaucaac

SEQ ID NO: 990796 - RNA, 19 nt, Homo sapiens
aauauacccuccacaguuc

SEQ ID NO: 990797 - RNA, 19 nt, Homo sapiens
gaagccaaucucauggaua

SEQ ID NO: 990798 - RNA, 19 nt, Homo sapiens
gaugacgacuuuaaaucuc

SEQ ID NO: 990799 - RNA, 19 nt, Homo sapiens
agaaaggugaauaguguua

SEQ ID NO: 990800 - RNA, 19 nt, Homo sapiens
uugccuagcuauaaauuga

SEQ ID NO: 990801 - RNA, 19 nt, Homo sapiens
uaaacagaaugacugaucu

SEQ ID NO: 990802 - RNA, 19 nt, Homo sapiens
cuacugggcccuccgcuuu

SEQ ID NO: 990803 - RNA, 19 nt, Homo sapiens
gagcugccaaguuaguuaa

SEQ ID NO: 990804 - RNA, 19 nt, Homo sapiens
ccucuuugaccuuccauua

SEQ ID NO: 990805 - RNA, 19 nt, Homo sapiens
cgaagucaaugcccgagau

SEQ ID NO: 990806 - RNA, 19 nt, Homo sapiens
aaaggugaauaguguuaga

SEQ ID NO: 990807 - RNA, 19 nt, Homo sapiens
uaaguggacacacagcuuu

SEQ ID NO: 990808 - RNA, 19 nt, Homo sapiens
gaaagggccacccgauuuu

SEQ ID NO: 990809 - RNA, 19 nt, Homo sapiens
gacucagccugcuuugaaa

SEQ ID NO: 990810 - RNA, 19 nt, Homo sapiens
gaaauggccaauguggauu

SEQ ID NO: 990811 - RNA, 19 nt, Homo sapiens
ugaaauggccaauguggau

SEQ ID NO: 990812 - RNA, 19 nt, Homo sapiens
aucuggagcugccaaguua

SEQ ID NO: 990813 - RNA, 19 nt, Homo sapiens
ugcccgagaugacgacuuu

SEQ ID NO: 990814 - RNA, 19 nt, Homo sapiens
cagcgugaaugcccacaug

SEQ ID NO: 990815 - RNA, 19 nt, Homo sapiens
ggaaugucuucuggugcua

SEQ ID NO: 990816 - RNA, 19 nt, Homo sapiens
uaagcacacuguuauaagc

SEQ ID NO: 990817 - RNA, 19 nt, Homo sapiens
gucagcagguugaggaaga

SEQ ID NO: 990818 - RNA, 19 nt, Homo sapiens
gaagaccaacaaccaagau

SEQ ID NO: 990819 - RNA, 19 nt, Homo sapiens
agucuagguuugcuugaaa

SEQ ID NO: 990820 - RNA, 19 nt, Homo sapiens
cgagaugacgacuuuaaau

SEQ ID NO: 990821 - RNA, 19 nt, Homo sapiens
ucaaauggcagccuugucu

SEQ ID NO: 990822 - RNA, 19 nt, Homo sapiens
gcuuuaaggagcaggagua

SEQ ID NO: 990823 - RNA, 19 nt, Homo sapiens
cgaagccaaucucauggau

SEQ ID NO: 990824 - RNA, 19 nt, Homo sapiens
gaacaugaagaccaacaac

SEQ ID NO: 990825 - RNA, 19 nt, Homo sapiens
cucaauugcuacuccuuaa

SEQ ID NO: 990826 - RNA, 19 nt, Homo sapiens
gauccaaaggcaaauagau

SEQ ID NO: 990827 - RNA, 19 nt, Homo sapiens
guuacugguugccuagcua

SEQ ID NO: 990828 - RNA, 19 nt, Homo sapiens
aaacagaaugacugaucua

SEQ ID NO: 990829 - RNA, 19 nt, Homo sapiens
uagguuugcuugaaauugg

SEQ ID NO: 990830 - RNA, 19 nt, Homo sapiens
gaaaucuccaaguaacuca

SEQ ID NO: 990831 - RNA, 19 nt, Homo sapiens
agucgaagaugagaauaug

SEQ ID NO: 990832 - RNA, 19 nt, Homo sapiens
cuugugaaauggccaaugu

SEQ ID NO: 990833 - RNA, 19 nt, Homo sapiens
guuagacaggcauacauuu

SEQ ID NO: 990834 - RNA, 19 nt, Homo sapiens
ucugaaaucuccaaguaac

SEQ ID NO: 990835 - RNA, 19 nt, Homo sapiens
ccaaucucauggauaucaa

SEQ ID NO: 990836 - RNA, 19 nt, Homo sapiens
gaagucgaagaugagaaua

SEQ ID NO: 990837 - RNA, 19 nt, Homo sapiens
ugaagucgaagaugagaau

SEQ ID NO: 990838 - RNA, 19 nt, Homo sapiens
gaagucaaugcccgagaug

SEQ ID NO: 990839 - RNA, 19 nt, Homo sapiens
gcuaacguuuauuaaguac

SEQ ID NO: 990840 - RNA, 19 nt, Homo sapiens
ccaaugacuucggaaaauu

SEQ ID NO: 990841 - RNA, 19 nt, Homo sapiens
ucuuugaccuuccauuaca

SEQ ID NO: 990842 - RNA, 19 nt, Homo sapiens
gcagguugaggaagauuca

SEQ ID NO: 990843 - RNA, 19 nt, Homo sapiens
gcugugcugccauccagua

SEQ ID NO: 990844 - RNA, 19 nt, Homo sapiens
gccgcaugcugcuugacua

SEQ ID NO: 990845 - RNA, 19 nt, Homo sapiens
gaccacaaugcuacaauca

SEQ ID NO: 990846 - RNA, 19 nt, Homo sapiens
gcugccaaguuaguuaaga

SEQ ID NO: 990847 - RNA, 19 nt, Homo sapiens
cuacuggaccacaaugcua

SEQ ID NO: 990848 - RNA, 19 nt, Homo sapiens
acagaaugacugaucuaaa

SEQ ID NO: 990849 - RNA, 19 nt, Homo sapiens
uuagacaggcauacauuug

SEQ ID NO: 990850 - RNA, 19 nt, Homo sapiens
gaaaggugaauaguguuag

SEQ ID NO: 990851 - RNA, 19 nt, Homo sapiens
uuaaacagaaugacugauc

SEQ ID NO: 990852 - RNA, 19 nt, Homo sapiens
cugguugccuagcuauaaa

SEQ ID NO: 990853 - RNA, 19 nt, Homo sapiens
caugcugcuugacuacaaa

SEQ ID NO: 990854 - RNA, 19 nt, Homo sapiens
caauugcuacuccuuaagu

SEQ ID NO: 990855 - RNA, 19 nt, Homo sapiens
gaccuuccauuacauaccu

SEQ ID NO: 990856 - RNA, 19 nt, Homo sapiens
gccaaucucauggauauca

SEQ ID NO: 990857 - RNA, 19 nt, Homo sapiens
aaucaacuguagacccaau

SEQ ID NO: 990858 - RNA, 19 nt, Homo sapiens
cagccugcuuugaaauuag

SEQ ID NO: 990859 - RNA, 19 nt, Homo sapiens
gccagaaaggugaauagug

SEQ ID NO: 990860 - RNA, 19 nt, Homo sapiens
uaccucugauccucuuuga

SEQ ID NO: 990861 - RNA, 19 nt, Homo sapiens
uggcagccuugucugaaau

SEQ ID NO: 990862 - RNA, 19 nt, Homo sapiens
ccaguggucagcagguuga

SEQ ID NO: 990863 - RNA, 19 nt, Homo sapiens
cgaauauacccuccacagu

SEQ ID NO: 990864 - RNA, 19 nt, Homo sapiens
agaccaacaaccaagauga

SEQ ID NO: 990865 - RNA, 19 nt, Homo sapiens
ccacugccccugucacuaa

SEQ ID NO: 990866 - RNA, 19 nt, Homo sapiens
gaaaugauguagaggcuua

SEQ ID NO: 990867 - RNA, 19 nt, Homo sapiens
gaacaggaaaugacaauua

SEQ ID NO: 990868 - RNA, 19 nt, Homo sapiens
caaaauagcugaaaccuuu

SEQ ID NO: 990869 - RNA, 19 nt, Homo sapiens
gcacaucacuggcagagaa

SEQ ID NO: 990870 - RNA, 19 nt, Homo sapiens
caagagaggacuagaaaua

SEQ ID NO: 990871 - RNA, 19 nt, Homo sapiens
gaacagaaauagcgcuaau

SEQ ID NO: 990872 - RNA, 19 nt, Homo sapiens
gaagacaggauucaacuuu

SEQ ID NO: 990873 - RNA, 19 nt, Homo sapiens
ggaaagguuuaaaugcuaa

SEQ ID NO: 990874 - RNA, 19 nt, Homo sapiens
gagaggaacuggcccaaau

SEQ ID NO: 990875 - RNA, 19 nt, Homo sapiens
gaacugagguccaaaauag

SEQ ID NO: 990876 - RNA, 19 nt, Homo sapiens
gggaaagguuuaaaugcua

SEQ ID NO: 990877 - RNA, 19 nt, Homo sapiens
gaaagagaagguacuguuu

SEQ ID NO: 990878 - RNA, 19 nt, Homo sapiens
gcagagaacugagguccaa

SEQ ID NO: 990879 - RNA, 19 nt, Homo sapiens
gaagucagcaacaaagaaa

SEQ ID NO: 990880 - RNA, 19 nt, Homo sapiens
ggaaagagaagguacuguu

SEQ ID NO: 990881 - RNA, 19 nt, Homo sapiens
guuggacgcugacaaauau

SEQ ID NO: 990882 - RNA, 19 nt, Homo sapiens
agacauagcuaaccagaca

SEQ ID NO: 990883 - RNA, 19 nt, Homo sapiens
guaccuauccuauguagaa

SEQ ID NO: 990884 - RNA, 19 nt, Homo sapiens
ucaaugagauacuggaaga

SEQ ID NO: 990885 - RNA, 19 nt, Homo sapiens
ggaauagccuugccauguc

SEQ ID NO: 990886 - RNA, 19 nt, Homo sapiens
uaagagaccuaucagagau

SEQ ID NO: 990887 - RNA, 19 nt, Homo sapiens
gaaaucuucuauugaaugg

SEQ ID NO: 990888 - RNA, 19 nt, Homo sapiens
cagaguaccuauccuaugu

SEQ ID NO: 990889 - RNA, 19 nt, Homo sapiens
ucuggaagaugaagaaauu

SEQ ID NO: 990890 - RNA, 19 nt, Homo sapiens
ccucagauguggugguuaa

SEQ ID NO: 990891 - RNA, 19 nt, Homo sapiens
gaaaugacaccguacuuag

SEQ ID NO: 990892 - RNA, 19 nt, Homo sapiens
gcacuccucuguagaugug

SEQ ID NO: 990893 - RNA, 19 nt, Homo sapiens
agacagaggccgucaauga

SEQ ID NO: 990894 - RNA, 19 nt, Homo sapiens
gaacuggcccaaauaagga

SEQ ID NO: 990895 - RNA, 19 nt, Homo sapiens
caucaaaaguggacaauuu

SEQ ID NO: 990896 - RNA, 19 nt, Homo sapiens
ggugggaaauauauucaaa

SEQ ID NO: 990897 - RNA, 19 nt, Homo sapiens
ugaacucacugcuagcuaa

SEQ ID NO: 990898 - RNA, 19 nt, Homo sapiens
gaugauaccgauggaaaua

SEQ ID NO: 990899 - RNA, 19 nt, Homo sapiens
gcugaaaugcuccaacuuu

SEQ ID NO: 990900 - RNA, 19 nt, Homo sapiens
cgacaaccgucaagaaagu

SEQ ID NO: 990901 - RNA, 19 nt, Homo sapiens
uguagaggcuuaugaguau

SEQ ID NO: 990902 - RNA, 19 nt, Homo sapiens
gcugaaaccuuuggacuuc

SEQ ID NO: 990903 - RNA, 19 nt, Homo sapiens
gugucaggcuuuauauaua

SEQ ID NO: 990904 - RNA, 19 nt, Homo sapiens
gaaauugugggaaagagaa

SEQ ID NO: 990905 - RNA, 19 nt, Homo sapiens
uaaugcagcucuuucuguu

SEQ ID NO: 990906 - RNA, 19 nt, Homo sapiens
gcucagcaauccucagaug

SEQ ID NO: 990907 - RNA, 19 nt, Homo sapiens
gaagguacuguuucuaaga

SEQ ID NO: 990908 - RNA, 19 nt, Homo sapiens
ggacacaguggauaacuau

SEQ ID NO: 990909 - RNA, 19 nt, Homo sapiens
cagcauuccucauuacaga

SEQ ID NO: 990910 - RNA, 19 nt, Homo sapiens
gcagcucuuucuguucuua

SEQ ID NO: 990911 - RNA, 19 nt, Homo sapiens
gaucaugcggccacucaua

SEQ ID NO: 990912 - RNA, 19 nt, Homo sapiens
gcuaugggauaucaugaga

SEQ ID NO: 990913 - RNA, 19 nt, Homo sapiens
agacuagaaugcugugaaa

SEQ ID NO: 990914 - RNA, 19 nt, Homo sapiens
agaaggcacugacugaaga

SEQ ID NO: 990915 - RNA, 19 nt, Homo sapiens
ggaaaccuccauauacaga

SEQ ID NO: 990916 - RNA, 19 nt, Homo sapiens
acucaacucuggaagauga

SEQ ID NO: 990917 - RNA, 19 nt, Homo sapiens
gaaacuaucacaguggaaa

SEQ ID NO: 990918 - RNA, 19 nt, Homo sapiens
aagaaaagcccuuauguua

SEQ ID NO: 990919 - RNA, 19 nt, Homo sapiens
gcaaagagagcagcagaga

SEQ ID NO: 990920 - RNA, 19 nt, Homo sapiens
ggaaaacccuugaagaaca

SEQ ID NO: 990921 - RNA, 19 nt, Homo sapiens
gaggaacuggcccaaauaa

SEQ ID NO: 990922 - RNA, 19 nt, Homo sapiens
ugauaccgauggaaauaaa

SEQ ID NO: 990923 - RNA, 19 nt, Homo sapiens
ugaauuacaaguccucuuu

SEQ ID NO: 990924 - RNA, 19 nt, Homo sapiens
ggaagucagcaacaaagaa

SEQ ID NO: 990925 - RNA, 19 nt, Homo sapiens
cagauguggugguuaaaug

SEQ ID NO: 990926 - RNA, 19 nt, Homo sapiens
caaggcacgucagcucuuu

SEQ ID NO: 990927 - RNA, 19 nt, Homo sapiens
gaacaaggcguggcucaca

SEQ ID NO: 990928 - RNA, 19 nt, Homo sapiens
aaaguugguuuggcauuaa

SEQ ID NO: 990929 - RNA, 19 nt, Homo sapiens
ggaaaacauugaccgauug

SEQ ID NO: 990930 - RNA, 19 nt, Homo sapiens
gcccagaaaugcuuuaaaa

SEQ ID NO: 990931 - RNA, 19 nt, Homo sapiens
agaaaugacaccguacuua

SEQ ID NO: 990932 - RNA, 19 nt, Homo sapiens
uagacucugugcugucaua

SEQ ID NO: 990933 - RNA, 19 nt, Homo sapiens
gauugagugucaggcuuua

SEQ ID NO: 990934 - RNA, 19 nt, Homo sapiens
ggaacuggcccaaauaagg

SEQ ID NO: 990935 - RNA, 19 nt, Homo sapiens
uauguuagcuaugggauau

SEQ ID NO: 990936 - RNA, 19 nt, Homo sapiens
cgauggugcuugaacuaaa

SEQ ID NO: 990937 - RNA, 19 nt, Homo sapiens
gcacgucagcucuuuaaag

SEQ ID NO: 990938 - RNA, 19 nt, Homo sapiens
gaauagccuugccaugucu

SEQ ID NO: 990939 - RNA, 19 nt, Homo sapiens
acaggcagaucaaucagaa

SEQ ID NO: 990940 - RNA, 19 nt, Homo sapiens
gacuagaaauacuggcaaa

SEQ ID NO: 990941 - RNA, 19 nt, Homo sapiens
uaagaagcaacuacaacua

SEQ ID NO: 990942 - RNA, 19 nt, Homo sapiens
caaguccucuuugggugua

SEQ ID NO: 990943 - RNA, 19 nt, Homo sapiens
ggaaugccuugaugaugca

SEQ ID NO: 990944 - RNA, 19 nt, Homo sapiens
gauauagugugguguuacu

SEQ ID NO: 990945 - RNA, 19 nt, Homo sapiens
gaaaagcccuuauguuagc

SEQ ID NO: 990946 - RNA, 19 nt, Homo sapiens
gcaacuacaacuagggaaa

SEQ ID NO: 990947 - RNA, 19 nt, Homo sapiens
gaagacaggauggaucaug

SEQ ID NO: 990948 - RNA, 19 nt, Homo sapiens
gagacccgauugcacauca

SEQ ID NO: 990949 - RNA, 19 nt, Homo sapiens
ugacucaacucuggaagau

SEQ ID NO: 990950 - RNA, 19 nt, Homo sapiens
aaagagagcagcagagaca

SEQ ID NO: 990951 - RNA, 19 nt, Homo sapiens
gaaugggaaagguuuaaau

SEQ ID NO: 990952 - RNA, 19 nt, Homo sapiens
uauucagcauuccucauua

SEQ ID NO: 990953 - RNA, 19 nt, Homo sapiens
gguaauagaagaaauacgu

SEQ ID NO: 990954 - RNA, 19 nt, Homo sapiens
gcagaguaccuauccuaug

SEQ ID NO: 990955 - RNA, 19 nt, Homo sapiens
acgaagacauggagacaga

SEQ ID NO: 990956 - RNA, 19 nt, Homo sapiens
caagggauccgaaacuauc

SEQ ID NO: 990957 - RNA, 19 nt, Homo sapiens
ggaaauugugggaaagaga

SEQ ID NO: 990958 - RNA, 19 nt, Homo sapiens
gaaaacccuugaagaacaa

SEQ ID NO: 990959 - RNA, 19 nt, Homo sapiens
gcuaagcaguacucugaca

SEQ ID NO: 990960 - RNA, 19 nt, Homo sapiens
ggagacagaggccgucaau

SEQ ID NO: 990961 - RNA, 19 nt, Homo sapiens
gugguuaaaugauuccaau

SEQ ID NO: 990962 - RNA, 19 nt, Homo sapiens
cagcuggaaugccuugaug

SEQ ID NO: 990963 - RNA, 19 nt, Homo sapiens
gagagcugcuggacacagu

SEQ ID NO: 990964 - RNA, 19 nt, Homo sapiens
uagaaauacuggcaaagag

SEQ ID NO: 990965 - RNA, 19 nt, Homo sapiens
cuaagagaccuaucagaga

SEQ ID NO: 990966 - RNA, 19 nt, Homo sapiens
guacagaccuugaagauug

SEQ ID NO: 990967 - RNA, 19 nt, Homo sapiens
ucucaaaucuuuccucaua

SEQ ID NO: 990968 - RNA, 19 nt, Homo sapiens
ccacaaacauguaaggauu

SEQ ID NO: 990969 - RNA, 19 nt, Homo sapiens
gaacaguagucucaaaucu

SEQ ID NO: 990970 - RNA, 19 nt, Homo sapiens
cuaaagagccaguugauuu

SEQ ID NO: 990971 - RNA, 19 nt, Homo sapiens
acaguagucucaaaucuuu

SEQ ID NO: 990972 - RNA, 19 nt, Homo sapiens
ggaaguugucacugauaua

SEQ ID NO: 990973 - RNA, 19 nt, Homo sapiens
gaaaggcuuguaauccaaa

SEQ ID NO: 990974 - RNA, 19 nt, Homo sapiens
caugauggcuccgcuacuu

SEQ ID NO: 990975 - RNA, 19 nt, Homo sapiens
ugaaaggcuuguaauccaa

SEQ ID NO: 990976 - RNA, 19 nt, Homo sapiens
ugaaggguccgaagugauu

SEQ ID NO: 990977 - RNA, 19 nt, Homo sapiens
gcuacuuacuugagauuca

SEQ ID NO: 990978 - RNA, 19 nt, Homo sapiens
gaccaccacaggaauguuu

SEQ ID NO: 990979 - RNA, 19 nt, Homo sapiens
aacaggaaguugucacuga

SEQ ID NO: 990980 - RNA, 19 nt, Homo sapiens
ggcuuguaauccaaaguua

SEQ ID NO: 990981 - RNA, 19 nt, Homo sapiens
acaaacauguaaggauuga

SEQ ID NO: 990982 - RNA, 19 nt, Homo sapiens
gaaguugucacugauauac

SEQ ID NO: 990983 - RNA, 19 nt, Homo sapiens
cccaggaauucauuauuug

SEQ ID NO: 990984 - RNA, 19 nt, Homo sapiens
agaaggaacaguagucuca

SEQ ID NO: 990985 - RNA, 19 nt, Homo sapiens
ggaacaguagucucaaauc

SEQ ID NO: 990986 - RNA, 19 nt, Homo sapiens
aaggaacaguagucucaaa

SEQ ID NO: 990987 - RNA, 19 nt, Homo sapiens
uggcuccgcuacuuacuug

SEQ ID NO: 990988 - RNA, 19 nt, Homo sapiens
uacagaccuugaagauuga

SEQ ID NO: 990989 - RNA, 19 nt, Homo sapiens
gaaggguccgaagugauuu

SEQ ID NO: 990990 - RNA, 19 nt, Homo sapiens
gauuuuagcuacaucaagu

SEQ ID NO: 990991 - RNA, 19 nt, Homo sapiens
uugaaaggcuuguaaucca

SEQ ID NO: 990992 - RNA, 19 nt, Homo sapiens
acaggaaguugucacugau

SEQ ID NO: 990993 - RNA, 19 nt, Homo sapiens
uaaagagccaguugauuuu

SEQ ID NO: 990994 - RNA, 19 nt, Homo sapiens
ggauugaaaggcuuguaau

SEQ ID NO: 990995 - RNA, 19 nt, Homo sapiens
ccccaggaauucauuauuu

SEQ ID NO: 990996 - RNA, 19 nt, Homo sapiens
ucugaaggguccgaaguga

SEQ ID NO: 990997 - RNA, 19 nt, Homo sapiens
aggaaguugucacugauau

SEQ ID NO: 990998 - RNA, 19 nt, Homo sapiens
caggaaguugucacugaua

SEQ ID NO: 990999 - RNA, 19 nt, Homo sapiens
gaaggaacaguagucucaa

SEQ ID NO: 991000 - RNA, 19 nt, Homo sapiens
caaaucuuuccucauaaug

SEQ ID NO: 991001 - RNA, 19 nt, Homo sapiens
gucccagguuaaacacuuu

SEQ ID NO: 991002 - RNA, 19 nt, Homo sapiens
cucaaaucuuuccucauaa

SEQ ID NO: 991003 - RNA, 19 nt, Homo sapiens
aagauuugguacacacaga

SEQ ID NO: 991004 - RNA, 19 nt, Homo sapiens
aguugucacugauauacuu

SEQ ID NO: 991005 - RNA, 19 nt, Homo sapiens
gcagaaggaacaguagucu

SEQ ID NO: 991006 - RNA, 19 nt, Homo sapiens
gaagugauuuuagcuacau

SEQ ID NO: 991007 - RNA, 19 nt, Homo sapiens
ccaggaauucauuauuugu

SEQ ID NO: 991008 - RNA, 19 nt, Homo sapiens
cuacuuacuugagauucau

SEQ ID NO: 991009 - RNA, 19 nt, Homo sapiens
gcaucugugcauagcguuu

SEQ ID NO: 991010 - RNA, 19 nt, Homo sapiens
aggggcagcuucaaaauga

SEQ ID NO: 991011 - RNA, 19 nt, Homo sapiens
cgucuaaagagccaguuga

SEQ ID NO: 991012 - RNA, 19 nt, Homo sapiens
cacaaacauguaaggauug

SEQ ID NO: 991013 - RNA, 19 nt, Homo sapiens
gcucugaaggguccgaagu

SEQ ID NO: 991014 - RNA, 19 nt, Homo sapiens
agucccagguuaaacacuu

SEQ ID NO: 991015 - RNA, 19 nt, Homo sapiens
gaaugaagguguuguacua

SEQ ID NO: 991016 - RNA, 19 nt, Homo sapiens
gguuguagcugaugaguua

SEQ ID NO: 991017 - RNA, 19 nt, Homo sapiens
gaacgacccugacagaaug

SEQ ID NO: 991018 - RNA, 19 nt, Homo sapiens
guagaaaguuggagucaaa

SEQ ID NO: 991019 - RNA, 19 nt, Homo sapiens
uaacaugaguggauugauu

SEQ ID NO: 991020 - RNA, 19 nt, Homo sapiens
ggagauggccuucugguaa

SEQ ID NO: 991021 - RNA, 19 nt, Homo sapiens
ggacuuagauauugcauac

SEQ ID NO: 991022 - RNA, 19 nt, Homo sapiens
guaauagucuguuucaauc

SEQ ID NO: 991023 - RNA, 19 nt, Homo sapiens
ugaagguguuguacuaaua

SEQ ID NO: 991024 - RNA, 19 nt, Homo sapiens
gcagauguauauugcaguu

SEQ ID NO: 991025 - RNA, 19 nt, Homo sapiens
gcuugaaaccucuauauuu

SEQ ID NO: 991026 - RNA, 19 nt, Homo sapiens
ggacaacaaggauaugaaa

SEQ ID NO: 991027 - RNA, 19 nt, Homo sapiens
aauauuaccuucuguagga

SEQ ID NO: 991028 - RNA, 19 nt, Homo sapiens
aaaucaagcuuuggacuaa

SEQ ID NO: 991029 - RNA, 19 nt, Homo sapiens
gauguuugcuguucuucaa

SEQ ID NO: 991030 - RNA, 19 nt, Homo sapiens
ugaaagugaucauuacugu

SEQ ID NO: 991031 - RNA, 19 nt, Homo sapiens
gcggauuccuguaacauga

SEQ ID NO: 991032 - RNA, 19 nt, Homo sapiens
gaacuuggccugcagaaac

SEQ ID NO: 991033 - RNA, 19 nt, Homo sapiens
gggaacugguggaauacua

SEQ ID NO: 991034 - RNA, 19 nt, Homo sapiens
gcaguucucugugaaaucu

SEQ ID NO: 991035 - RNA, 19 nt, Homo sapiens
cuugggaacugguggaaua

SEQ ID NO: 991036 - RNA, 19 nt, Homo sapiens
cauaagagguaaaggucaa

SEQ ID NO: 991037 - RNA, 19 nt, Homo sapiens
ggaacgacccugacagaau

SEQ ID NO: 991038 - RNA, 19 nt, Homo sapiens
gcuaaaaguugauguguga

SEQ ID NO: 991039 - RNA, 19 nt, Homo sapiens
gaaaaggggauauucaaaa

SEQ ID NO: 991040 - RNA, 19 nt, Homo sapiens
gcacguggaauagggcuua

SEQ ID NO: 991041 - RNA, 19 nt, Homo sapiens
gcucugaagcuuugaauca

SEQ ID NO: 991042 - RNA, 19 nt, Homo sapiens
gguguuauguccaguguag

SEQ ID NO: 991043 - RNA, 19 nt, Homo sapiens
agaagguuguugugaauga

SEQ ID NO: 991044 - RNA, 19 nt, Homo sapiens
aggaaaagguggaaaauaa

SEQ ID NO: 991045 - RNA, 19 nt, Homo sapiens
uaaaucaagcuuuggacua

SEQ ID NO: 991046 - RNA, 19 nt, Homo sapiens
gcuauucgguauguucaaa

SEQ ID NO: 991047 - RNA, 19 nt, Homo sapiens
ucuagaagguuguugugaa

SEQ ID NO: 991048 - RNA, 19 nt, Homo sapiens
gcaacacccuucucagacu

SEQ ID NO: 991049 - RNA, 19 nt, Homo sapiens
gcuaauuugugaguucuga

SEQ ID NO: 991050 - RNA, 19 nt, Homo sapiens
gaauguugcugcgggaugu

SEQ ID NO: 991051 - RNA, 19 nt, Homo sapiens
gcacggcuuugccucuuuc

SEQ ID NO: 991052 - RNA, 19 nt, Homo sapiens
gaucgccuuuguagucuau

SEQ ID NO: 991053 - RNA, 19 nt, Homo sapiens
gcaugcaguucucugugaa

SEQ ID NO: 991054 - RNA, 19 nt, Homo sapiens
cuagaagguuguugugaau

SEQ ID NO: 991055 - RNA, 19 nt, Homo sapiens
gggcagcuauucgguaugu

SEQ ID NO: 991056 - RNA, 19 nt, Homo sapiens
ggugagcugugaaggcuau

SEQ ID NO: 991057 - RNA, 19 nt, Homo sapiens
agagguaaaggucaaauuu

SEQ ID NO: 991058 - RNA, 19 nt, Homo sapiens
gcucuuacccuccacuaug

SEQ ID NO: 991059 - RNA, 19 nt, Homo sapiens
gagauggccuucugguaac

SEQ ID NO: 991060 - RNA, 19 nt, Homo sapiens
uaagaaugaagguguugua

SEQ ID NO: 991061 - RNA, 19 nt, Homo sapiens
uggcuuggaguauaauuua

SEQ ID NO: 991062 - RNA, 19 nt, Homo sapiens
gcuaugaguccucugaaga

SEQ ID NO: 991063 - RNA, 19 nt, Homo sapiens
gaagguguuguacuaauag

SEQ ID NO: 991064 - RNA, 19 nt, Homo sapiens
gcccuaagaagcauuaaga

SEQ ID NO: 991065 - RNA, 19 nt, Homo sapiens
guugaugugugacaaaaua

SEQ ID NO: 991066 - RNA, 19 nt, Homo sapiens
uguagcugaugaguuauua

SEQ ID NO: 991067 - RNA, 19 nt, Homo sapiens
gguguuguacuaauagaaa

SEQ ID NO: 991068 - RNA, 19 nt, Homo sapiens
aaacuguggugagcuguga

SEQ ID NO: 991069 - RNA, 19 nt, Homo sapiens
aguacuaccuguuaacaau

SEQ ID NO: 991070 - RNA, 19 nt, Homo sapiens
acgauaaaguagaaaguug

SEQ ID NO: 991071 - RNA, 19 nt, Homo sapiens
gaucccaucccacaguuga

SEQ ID NO: 991072 - RNA, 19 nt, Homo sapiens
aaauaagcaucuagaaggu

SEQ ID NO: 991073 - RNA, 19 nt, Homo sapiens
aacacuggaugcagaaauu

SEQ ID NO: 991074 - RNA, 19 nt, Homo sapiens
uaccagagauucaccaacu

SEQ ID NO: 991075 - RNA, 19 nt, Homo sapiens
guacuaccuguuaacaauu

SEQ ID NO: 991076 - RNA, 19 nt, Homo sapiens
gcaucaggauaugguggua

SEQ ID NO: 991077 - RNA, 19 nt, Homo sapiens
aacaugaguggauugauua

SEQ ID NO: 991078 - RNA, 19 nt, Homo sapiens
aagacggacuuagauauug

SEQ ID NO: 991079 - RNA, 19 nt, Homo sapiens
ccagaacugcaucaggaua

SEQ ID NO: 991080 - RNA, 19 nt, Homo sapiens
gaaaauaagcaucuagaag

SEQ ID NO: 991081 - RNA, 19 nt, Homo sapiens
ucugaagcuuugaaucauu

SEQ ID NO: 991082 - RNA, 19 nt, Homo sapiens
cagcugguugugauucuua

SEQ ID NO: 991083 - RNA, 19 nt, Homo sapiens
aggagacgauaaaguagaa

SEQ ID NO: 991084 - RNA, 19 nt, Homo sapiens
ccucuuucucugauuauua

SEQ ID NO: 991085 - RNA, 19 nt, Homo sapiens
uuacaggacaacaaggaua

SEQ ID NO: 991086 - RNA, 19 nt, Homo sapiens
ggauggguaugauguacag

SEQ ID NO: 991087 - RNA, 19 nt, Homo sapiens
gauaaaguagaaaguugga

SEQ ID NO: 991088 - RNA, 19 nt, Homo sapiens
gacgauaaaguagaaaguu

SEQ ID NO: 991089 - RNA, 19 nt, Homo sapiens
accaggagacgauaaagua

SEQ ID NO: 991090 - RNA, 19 nt, Homo sapiens
cauacagugucagaacaaa

SEQ ID NO: 991091 - RNA, 19 nt, Homo sapiens
gcagcuauucgguauguuc

SEQ ID NO: 991092 - RNA, 19 nt, Homo sapiens
gauauuuguuuggcagcaa

SEQ ID NO: 991093 - RNA, 19 nt, Homo sapiens
ucacaggaccacagaauac

SEQ ID NO: 991094 - RNA, 19 nt, Homo sapiens
ggaaaaggggauauucaaa

SEQ ID NO: 991095 - RNA, 19 nt, Homo sapiens
uguguuguaugucagugua

SEQ ID NO: 991096 - RNA, 19 nt, Homo sapiens
cggcaacacccuucucaga

SEQ ID NO: 991097 - RNA, 19 nt, Homo sapiens
cuuguggcuuggaguauaa

SEQ ID NO: 991098 - RNA, 19 nt, Homo sapiens
ccuaagaagcauuaagaau

SEQ ID NO: 991099 - RNA, 19 nt, Homo sapiens
ucuuguggcuuggaguaua

SEQ ID NO: 991100 - RNA, 19 nt, Homo sapiens
uaugcuaauuugugaguuc

SEQ ID NO: 991101 - RNA, 19 nt, Homo sapiens
uacuaccuguuaacaauug

SEQ ID NO: 991102 - RNA, 19 nt, Homo sapiens
caaaggcugggauggguau

SEQ ID NO: 991103 - RNA, 19 nt, Homo sapiens
ggaacugguggaauacuag

SEQ ID NO: 991104 - RNA, 19 nt, Homo sapiens
ggaucgccuuuguagucua

SEQ ID NO: 991105 - RNA, 19 nt, Homo sapiens
uugccucuuucucugauua

SEQ ID NO: 991106 - RNA, 19 nt, Homo sapiens
ucaagcuuuggacuaauua

SEQ ID NO: 991107 - RNA, 19 nt, Homo sapiens
gguaccaggagacgauaaa

SEQ ID NO: 991108 - RNA, 19 nt, Homo sapiens
cagaacugcaucaggauau

SEQ ID NO: 991109 - RNA, 19 nt, Homo sapiens
cagcacggcuuugccucuu

SEQ ID NO: 991110 - RNA, 19 nt, Homo sapiens
ccuguaacaugaguggauu

SEQ ID NO: 991111 - RNA, 19 nt, Homo sapiens
guucauaagagguaaaggu

SEQ ID NO: 991112 - RNA, 19 nt, Homo sapiens
cguccuauccucccuccua

SEQ ID NO: 991113 - RNA, 19 nt, Homo sapiens
aaacugaaggagucuggaa

SEQ ID NO: 991114 - RNA, 19 nt, Homo sapiens
gagguaaaggucaaauuuu

SEQ ID NO: 991115 - RNA, 19 nt, Homo sapiens
gcaaagagccagccaaugu

SEQ ID NO: 991116 - RNA, 19 nt, Homo sapiens
gaggagagcuuccgcaagu

SEQ ID NO: 991117 - RNA, 19 nt, Homo sapiens
ggacaucgucuucuccaaa

SEQ ID NO: 991118 - RNA, 19 nt, Homo sapiens
caagguggcugacggaaag

SEQ ID NO: 991119 - RNA, 19 nt, Homo sapiens
cugcuugccucauauuuaa

SEQ ID NO: 991120 - RNA, 19 nt, Homo sapiens
uggaagagcuggcgaccaa

SEQ ID NO: 991121 - RNA, 19 nt, Homo sapiens
gaagugaggcuugggaaga

SEQ ID NO: 991122 - RNA, 19 nt, Homo sapiens
acccagaccucaauaaaga

SEQ ID NO: 991123 - RNA, 19 nt, Homo sapiens
ggagagcuuccgcaaguuu

SEQ ID NO: 991124 - RNA, 19 nt, Homo sapiens
acaaggagcgcuucgauga

SEQ ID NO: 991125 - RNA, 19 nt, Homo sapiens
gggccaagcugugcaagga

SEQ ID NO: 991126 - RNA, 19 nt, Homo sapiens
ccugacugcuugccucaua

SEQ ID NO: 991127 - RNA, 19 nt, Homo sapiens
uaacccagaccucaauaaa

SEQ ID NO: 991128 - RNA, 19 nt, Homo sapiens
gaagagcuggcgaccaaga

SEQ ID NO: 991129 - RNA, 19 nt, Homo sapiens
ucaagaaggcccuggaaga

SEQ ID NO: 991130 - RNA, 19 nt, Homo sapiens
gcaagguggcugacggaaa

SEQ ID NO: 991131 - RNA, 19 nt, Homo sapiens
gaagucugcucgggucauc

SEQ ID NO: 991132 - RNA, 19 nt, Homo sapiens
gacaucgucuucuccaaag

SEQ ID NO: 991133 - RNA, 19 nt, Homo sapiens
gcacguggagcaagagauc

SEQ ID NO: 991134 - RNA, 19 nt, Homo sapiens
ugacggacaccagcagaua

SEQ ID NO: 991135 - RNA, 19 nt, Homo sapiens
gaagaccgcccugccaagu

SEQ ID NO: 991136 - RNA, 19 nt, Homo sapiens
aaggagcgcuucgaugaga

SEQ ID NO: 991137 - RNA, 19 nt, Homo sapiens
ccaaugugggcgucacuaa

SEQ ID NO: 991138 - RNA, 19 nt, Homo sapiens
caaagagccagccaaugug

SEQ ID NO: 991139 - RNA, 19 nt, Homo sapiens
caaugugggcgucacuaaa

SEQ ID NO: 991140 - RNA, 19 nt, Homo sapiens
caagaaggcccuggaagag

SEQ ID NO: 991141 - RNA, 19 nt, Homo sapiens
cugcucgggucaucaacua

SEQ ID NO: 991142 - RNA, 19 nt, Homo sapiens
gcucaggccugggucuaag

SEQ ID NO: 991143 - RNA, 19 nt, Homo sapiens
cgugagcgccuacaagaau

SEQ ID NO: 991144 - RNA, 19 nt, Homo sapiens
gggcgucacuaaagcaaaa

SEQ ID NO: 991145 - RNA, 19 nt, Homo sapiens
gugagcgccuacaagaaug

SEQ ID NO: 991146 - RNA, 19 nt, Homo sapiens
ccacaaggagcgcuucgau

SEQ ID NO: 991147 - RNA, 19 nt, Homo sapiens
gccaagugccuaauuuuaa

SEQ ID NO: 991148 - RNA, 19 nt, Homo sapiens
cugcugcucuggccaagug

SEQ ID NO: 991149 - RNA, 19 nt, Homo sapiens
acuaugaggaguucaagaa

SEQ ID NO: 991150 - RNA, 19 nt, Homo sapiens
agagaugaauggcaagaac

SEQ ID NO: 991151 - RNA, 19 nt, Homo sapiens
ggccaagugccuaauuuua

SEQ ID NO: 991152 - RNA, 19 nt, Homo sapiens
cuggccaagugccuaauuu

SEQ ID NO: 991153 - RNA, 19 nt, Homo sapiens
gcucuggccaagugccuaa

SEQ ID NO: 991154 - RNA, 19 nt, Homo sapiens
gaaugcaggcaccuacgau

SEQ ID NO: 991155 - RNA, 19 nt, Homo sapiens
gagagcuuccgcaaguuug

SEQ ID NO: 991156 - RNA, 19 nt, Homo sapiens
ggacauccuggacgacagu

SEQ ID NO: 991157 - RNA, 19 nt, Homo sapiens
ccagugggcaagagaugaa

SEQ ID NO: 991158 - RNA, 19 nt, Homo sapiens
caagagaugaauggcaaga

SEQ ID NO: 991159 - RNA, 19 nt, Homo sapiens
gcucgggucaucaacuaug

SEQ ID NO: 991160 - RNA, 19 nt, Homo sapiens
acugcuugccucauauuua

SEQ ID NO: 991161 - RNA, 19 nt, Homo sapiens
augccaaggugaagaagug

SEQ ID NO: 991162 - RNA, 19 nt, Homo sapiens
uacgugagcgccuacaaga

SEQ ID NO: 991163 - RNA, 19 nt, Homo sapiens
ugacugcuugccucauauu

SEQ ID NO: 991164 - RNA, 19 nt, Homo sapiens
gauacacgggcucccacaa

SEQ ID NO: 991165 - RNA, 19 nt, Homo sapiens
guucaagaaggcccuggaa

SEQ ID NO: 991166 - RNA, 19 nt, Homo sapiens
gcaagaacugggccaagcu

SEQ ID NO: 991167 - RNA, 19 nt, Homo sapiens
gcaaagagccagccaaugu

SEQ ID NO: 991168 - RNA, 19 nt, Homo sapiens
caagaaaggcccuggaaga

SEQ ID NO: 991169 - RNA, 19 nt, Homo sapiens
ggacaucgucuucuccaaa

SEQ ID NO: 991170 - RNA, 19 nt, Homo sapiens
cugcuugccucauauuuaa

SEQ ID NO: 991171 - RNA, 19 nt, Homo sapiens
gaagugaggcuugggaaga

SEQ ID NO: 991172 - RNA, 19 nt, Homo sapiens
acccagaccucaauaaaga

SEQ ID NO: 991173 - RNA, 19 nt, Homo sapiens
gagcugcgaccaagagauu

SEQ ID NO: 991174 - RNA, 19 nt, Homo sapiens
acaaggagcgcuucgauga

SEQ ID NO: 991175 - RNA, 19 nt, Homo sapiens
gggccaagcugugcaagga

SEQ ID NO: 991176 - RNA, 19 nt, Homo sapiens
ccugacugcuugccucaua

SEQ ID NO: 991177 - RNA, 19 nt, Homo sapiens
uaacccagaccucaauaaa

SEQ ID NO: 991178 - RNA, 19 nt, Homo sapiens
gaagagcugcgaccaagag

SEQ ID NO: 991179 - RNA, 19 nt, Homo sapiens
gaagucugcucgggucauc

SEQ ID NO: 991180 - RNA, 19 nt, Homo sapiens
gacaucgucuucuccaaag

SEQ ID NO: 991181 - RNA, 19 nt, Homo sapiens
gcacguggagcaagagauc

SEQ ID NO: 991182 - RNA, 19 nt, Homo sapiens
ugacggacaccagcagaua

SEQ ID NO: 991183 - RNA, 19 nt, Homo sapiens
gaagaccgcccugccaagu

SEQ ID NO: 991184 - RNA, 19 nt, Homo sapiens
aaggagcgcuucgaugaga

SEQ ID NO: 991185 - RNA, 19 nt, Homo sapiens
ccaaugugggcgucacuaa

SEQ ID NO: 991186 - RNA, 19 nt, Homo sapiens
caaagagccagccaaugug

SEQ ID NO: 991187 - RNA, 19 nt, Homo sapiens
caaugugggcgucacuaaa

SEQ ID NO: 991188 - RNA, 19 nt, Homo sapiens
uaugaggaguucaagaaag

SEQ ID NO: 991189 - RNA, 19 nt, Homo sapiens
uaagguggccgacggaaag

SEQ ID NO: 991190 - RNA, 19 nt, Homo sapiens
cugcucgggucaucaacua

SEQ ID NO: 991191 - RNA, 19 nt, Homo sapiens
guaagguggccgacggaaa

SEQ ID NO: 991192 - RNA, 19 nt, Homo sapiens
gcucaggccugggucuaag

SEQ ID NO: 991193 - RNA, 19 nt, Homo sapiens
cgugagcgccuacaagaau

SEQ ID NO: 991194 - RNA, 19 nt, Homo sapiens
gggcgucacuaaagcaaaa

SEQ ID NO: 991195 - RNA, 19 nt, Homo sapiens
gugagcgccuacaagaaug

SEQ ID NO: 991196 - RNA, 19 nt, Homo sapiens
ccacaaggagcgcuucgau

SEQ ID NO: 991197 - RNA, 19 nt, Homo sapiens
ggaagagcugcgaccaaga

SEQ ID NO: 991198 - RNA, 19 nt, Homo sapiens
gccaagugccuaauuuuaa

SEQ ID NO: 991199 - RNA, 19 nt, Homo sapiens
cugcugcucuggccaagug

SEQ ID NO: 991200 - RNA, 19 nt, Homo sapiens
gcagcgagcacggacauag

SEQ ID NO: 991201 - RNA, 19 nt, Homo sapiens
agagaugaauggcaagaac

SEQ ID NO: 991202 - RNA, 19 nt, Homo sapiens
acuaugaggaguucaagaa

SEQ ID NO: 991203 - RNA, 19 nt, Homo sapiens
ggccaagugccuaauuuua

SEQ ID NO: 991204 - RNA, 19 nt, Homo sapiens
cuggccaagugccuaauuu

SEQ ID NO: 991205 - RNA, 19 nt, Homo sapiens
gcucuggccaagugccuaa

SEQ ID NO: 991206 - RNA, 19 nt, Homo sapiens
gaaugcaggcaccuacgau

SEQ ID NO: 991207 - RNA, 19 nt, Homo sapiens
ggacauccuggacgacagu

SEQ ID NO: 991208 - RNA, 19 nt, Homo sapiens
caagagaugaauggcaaga

SEQ ID NO: 991209 - RNA, 19 nt, Homo sapiens
gcucgggucaucaacuaug

SEQ ID NO: 991210 - RNA, 19 nt, Homo sapiens
acugcuugccucauauuua

SEQ ID NO: 991211 - RNA, 19 nt, Homo sapiens
augccaaggugaagaagug

SEQ ID NO: 991212 - RNA, 19 nt, Homo sapiens
uacgugagcgccuacaaga

SEQ ID NO: 991213 - RNA, 19 nt, Homo sapiens
cuaugaggaguucaagaaa

SEQ ID NO: 991214 - RNA, 19 nt, Homo sapiens
ugacugcuugccucauauu

SEQ ID NO: 991215 - RNA, 19 nt, Homo sapiens
gauacacgggcucccacaa

SEQ ID NO: 991216 - RNA, 19 nt, Homo sapiens
gcaagaacugggccaagcu

SEQ ID NO: 991217 - RNA, 19 nt, Homo sapiens
acaaagagcuggcugauga

SEQ ID NO: 991218 - RNA, 19 nt, Homo sapiens
gaugaucaauggacuuuaa

SEQ ID NO: 991219 - RNA, 19 nt, Homo sapiens
ccaacgagcugguggauga

SEQ ID NO: 991220 - RNA, 19 nt, Homo sapiens
ggaagagucugccuaugug

SEQ ID NO: 991221 - RNA, 19 nt, Homo sapiens
cagccaagauguucaugua

SEQ ID NO: 991222 - RNA, 19 nt, Homo sapiens
caaagagcauggagcugua

SEQ ID NO: 991223 - RNA, 19 nt, Homo sapiens
ccauagcucuggguucuua

SEQ ID NO: 991224 - RNA, 19 nt, Homo sapiens
ccaagauguucauguagua

SEQ ID NO: 991225 - RNA, 19 nt, Homo sapiens
gcugguggaugaucucuuu

SEQ ID NO: 991226 - RNA, 19 nt, Homo sapiens
aaucagagccuaccacaaa

SEQ ID NO: 991227 - RNA, 19 nt, Homo sapiens
gaagacauugugaccauuu

SEQ ID NO: 991228 - RNA, 19 nt, Homo sapiens
gaucaauggacuuuaauga

SEQ ID NO: 991229 - RNA, 19 nt, Homo sapiens
gaucuugguuggacguuug

SEQ ID NO: 991230 - RNA, 19 nt, Homo sapiens
ggaggcuggugcagaaauu

SEQ ID NO: 991231 - RNA, 19 nt, Homo sapiens
ccacaaacauccaaauucg

SEQ ID NO: 991232 - RNA, 19 nt, Homo sapiens
agccagcucuuccaucuua

SEQ ID NO: 991233 - RNA, 19 nt, Homo sapiens
gguggaugaucucuuuaaa

SEQ ID NO: 991234 - RNA, 19 nt, Homo sapiens
ggacaggugaacuuggaua

SEQ ID NO: 991235 - RNA, 19 nt, Homo sapiens
gaagccaaccugcucaaug

SEQ ID NO: 991236 - RNA, 19 nt, Homo sapiens
gaaguggacagcagauugu

SEQ ID NO: 991237 - RNA, 19 nt, Homo sapiens
gaacaaagagcuggcugau

SEQ ID NO: 991238 - RNA, 19 nt, Homo sapiens
ggacgaggacuuugugaag

SEQ ID NO: 991239 - RNA, 19 nt, Homo sapiens
gauaauggagaacucagaa

SEQ ID NO: 991240 - RNA, 19 nt, Homo sapiens
uggaugaucucuuuaaagg

SEQ ID NO: 991241 - RNA, 19 nt, Homo sapiens
gccaagauguucauguagu

SEQ ID NO: 991242 - RNA, 19 nt, Homo sapiens
ggauucagccuggauaaug

SEQ ID NO: 991243 - RNA, 19 nt, Homo sapiens
ugaccaagaugaagaugag

SEQ ID NO: 991244 - RNA, 19 nt, Homo sapiens
ugacuacuuucccgaacaa

SEQ ID NO: 991245 - RNA, 19 nt, Homo sapiens
gcucuuccaucuuaaucga

SEQ ID NO: 991246 - RNA, 19 nt, Homo sapiens
caggugaacuuggauaugg

SEQ ID NO: 991247 - RNA, 19 nt, Homo sapiens
guggacaggugaacuugga

SEQ ID NO: 991248 - RNA, 19 nt, Homo sapiens
gcucuggguucuuagaucu

SEQ ID NO: 991249 - RNA, 19 nt, Homo sapiens
aaagccagcucuuccaucu

SEQ ID NO: 991250 - RNA, 19 nt, Homo sapiens
gauucagccuggauaaugg

SEQ ID NO: 991251 - RNA, 19 nt, Homo sapiens
guauugaaacucuggaaga

SEQ ID NO: 991252 - RNA, 19 nt, Homo sapiens
gugcaacgucuccuccaua

SEQ ID NO: 991253 - RNA, 19 nt, Homo sapiens
uggccucccuccuguguuu

SEQ ID NO: 991254 - RNA, 19 nt, Homo sapiens
caucuuaaucgacgaauca

SEQ ID NO: 991255 - RNA, 19 nt, Homo sapiens
gaggaagagucugccuaug

SEQ ID NO: 991256 - RNA, 19 nt, Homo sapiens
cagccuggauaauggagaa

SEQ ID NO: 991257 - RNA, 19 nt, Homo sapiens
caguaaaccgagaccauuu

SEQ ID NO: 991258 - RNA, 19 nt, Homo sapiens
ccaguaaaccgagaccauu

SEQ ID NO: 991259 - RNA, 19 nt, Homo sapiens
cauguaguauugaaacucu

SEQ ID NO: 991260 - RNA, 19 nt, Homo sapiens
agauguucauguaguauug

SEQ ID NO: 991261 - RNA, 19 nt, Homo sapiens
gggcagcaccagaggaaga

SEQ ID NO: 991262 - RNA, 19 nt, Homo sapiens
caacgucuccuccauagcu

SEQ ID NO: 991263 - RNA, 19 nt, Homo sapiens
gauaauagagugacauccu

SEQ ID NO: 991264 - RNA, 19 nt, Homo sapiens
auaauagagugacauccuu

SEQ ID NO: 991265 - RNA, 19 nt, Homo sapiens
ggauaauggagaacucaga

SEQ ID NO: 991266 - RNA, 19 nt, Homo sapiens
agaugaagaugaggaggaa

SEQ ID NO: 991267 - RNA, 19 nt, Homo sapiens
ugaagacauugugaccauu

SEQ ID NO: 991268 - RNA, 19 nt, Homo sapiens
gagaaaagaggcagcauuc

SEQ ID NO: 991269 - RNA, 19 nt, Homo sapiens
ggaggugccagcagagcuu

SEQ ID NO: 991270 - RNA, 19 nt, Homo sapiens
agaaguggacagcagauug

SEQ ID NO: 991271 - RNA, 19 nt, Homo sapiens
gagaaguggacagcagauu

SEQ ID NO: 991272 - RNA, 19 nt, Homo sapiens
uaccacaaacauccaaauu

SEQ ID NO: 991273 - RNA, 19 nt, Homo sapiens
uaccaagacccauccaaug

SEQ ID NO: 991274 - RNA, 19 nt, Homo sapiens
cccauccaaugcccaguuu

SEQ ID NO: 991275 - RNA, 19 nt, Homo sapiens
auggagaacucagaagcua

SEQ ID NO: 991276 - RNA, 19 nt, Homo sapiens
gcuuuauccucaugacuac

SEQ ID NO: 991277 - RNA, 19 nt, Homo sapiens
ggcagaaaaugaagccaaa

SEQ ID NO: 991278 - RNA, 19 nt, Homo sapiens
aggaagagucugccuaugu

SEQ ID NO: 991279 - RNA, 19 nt, Homo sapiens
cgacauccgacucuucauc

SEQ ID NO: 991280 - RNA, 19 nt, Homo sapiens
gaaucagagccuaccacaa

SEQ ID NO: 991281 - RNA, 19 nt, Homo sapiens
gacaggugaacuuggauau

SEQ ID NO: 991282 - RNA, 19 nt, Homo sapiens
uagagugacauccuucaga

SEQ ID NO: 991283 - RNA, 19 nt, Homo sapiens
gacguuuguuuucuccuua

SEQ ID NO: 991284 - RNA, 19 nt, Homo sapiens
ggacguuuguuuucuccuu

SEQ ID NO: 991285 - RNA, 19 nt, Homo sapiens
caccagcuuuauccucaug

SEQ ID NO: 991286 - RNA, 19 nt, Homo sapiens
gaggaaggccagagguuuu

SEQ ID NO: 991287 - RNA, 19 nt, Homo sapiens
gggacgaggacuuugugaa

SEQ ID NO: 991288 - RNA, 19 nt, Homo sapiens
cuaccaagacccauccaau

SEQ ID NO: 991289 - RNA, 19 nt, Homo sapiens
gaaaagaggcagcauucca

SEQ ID NO: 991290 - RNA, 19 nt, Homo sapiens
agaggaaggccagagguuu

SEQ ID NO: 991291 - RNA, 19 nt, Homo sapiens
ugcaacgucuccuccauag

SEQ ID NO: 991292 - RNA, 19 nt, Homo sapiens
gagccagacccugaaggaa

SEQ ID NO: 991293 - RNA, 19 nt, Homo sapiens
caagauguucauguaguau

SEQ ID NO: 991294 - RNA, 19 nt, Homo sapiens
agaggaagagucugccuau

SEQ ID NO: 991295 - RNA, 19 nt, Homo sapiens
ucgugcagcgguuaacaua

SEQ ID NO: 991296 - RNA, 19 nt, Homo sapiens
gcauuccagccaagauguu

SEQ ID NO: 991297 - RNA, 19 nt, Homo sapiens
ggagaaaagaggcagcauu

SEQ ID NO: 991298 - RNA, 19 nt, Homo sapiens
aggaggcgcugagggaguu

SEQ ID NO: 991299 - RNA, 19 nt, Homo sapiens
aggcuggugcagaaauuua

SEQ ID NO: 991300 - RNA, 19 nt, Homo sapiens
cagcauuccagccaagaug

SEQ ID NO: 991301 - RNA, 19 nt, Homo sapiens
uaaaggugccaaagagcau

SEQ ID NO: 991302 - RNA, 19 nt, Homo sapiens
ggaagccaaccugcucaau

SEQ ID NO: 991303 - RNA, 19 nt, Homo sapiens
augaagacauugugaccau

SEQ ID NO: 991304 - RNA, 19 nt, Homo sapiens
ggcuggugcagaaauuuaa

SEQ ID NO: 991305 - RNA, 19 nt, Homo sapiens
gaggcuggugcagaaauuu

SEQ ID NO: 991306 - RNA, 19 nt, Homo sapiens
cggaggggaugaagacauu

SEQ ID NO: 991307 - RNA, 19 nt, Homo sapiens
cuucagagaccucauucau

SEQ ID NO: 991308 - RNA, 19 nt, Homo sapiens
ggagaagaaucauuuguuu

SEQ ID NO: 991309 - RNA, 19 nt, Homo sapiens
gaaaggccauugggaaaua

SEQ ID NO: 991310 - RNA, 19 nt, Homo sapiens
gggcagagcuugagguguu

SEQ ID NO: 991311 - RNA, 19 nt, Homo sapiens
uaaccucauuguugucuua

SEQ ID NO: 991312 - RNA, 19 nt, Homo sapiens
gaacaucgacgccuauauc

SEQ ID NO: 991313 - RNA, 19 nt, Homo sapiens
gcacgaggccgcauacuau

SEQ ID NO: 991314 - RNA, 19 nt, Homo sapiens
caacaaaucccgagagaca

SEQ ID NO: 991315 - RNA, 19 nt, Homo sapiens
gaacagaaugugucaagga

SEQ ID NO: 991316 - RNA, 19 nt, Homo sapiens
caggcaggcugauuagaua

SEQ ID NO: 991317 - RNA, 19 nt, Homo sapiens
gcacaucgccuccaagaag

SEQ ID NO: 991318 - RNA, 19 nt, Homo sapiens
ucaaggagaagaaucauuu

SEQ ID NO: 991319 - RNA, 19 nt, Homo sapiens
uuagauaccugaaauacga

SEQ ID NO: 991320 - RNA, 19 nt, Homo sapiens
gaacacaucgacagcuuug

SEQ ID NO: 991321 - RNA, 19 nt, Homo sapiens
ggagggcuuuguuaaguau

SEQ ID NO: 991322 - RNA, 19 nt, Homo sapiens
ccacuugacuucagagcuu

SEQ ID NO: 991323 - RNA, 19 nt, Homo sapiens
gcaguucugugaguucgua

SEQ ID NO: 991324 - RNA, 19 nt, Homo sapiens
cagaaugugucaaggagaa

SEQ ID NO: 991325 - RNA, 19 nt, Homo sapiens
caaguacggugcugacauc

SEQ ID NO: 991326 - RNA, 19 nt, Homo sapiens
ggacugggccgucaucaag

SEQ ID NO: 991327 - RNA, 19 nt, Homo sapiens
ugaagaccaugaucaagga

SEQ ID NO: 991328 - RNA, 19 nt, Homo sapiens
gauaaaggccaucaaggau

SEQ ID NO: 991329 - RNA, 19 nt, Homo sapiens
ccucauuguugucuuauau

SEQ ID NO: 991330 - RNA, 19 nt, Homo sapiens
gaaggcagaaccuccaaga

SEQ ID NO: 991331 - RNA, 19 nt, Homo sapiens
cucagacucuucuuacuaa

SEQ ID NO: 991332 - RNA, 19 nt, Homo sapiens
guacggugcugacaucaac

SEQ ID NO: 991333 - RNA, 19 nt, Homo sapiens
gaagacguggcccaaggua

SEQ ID NO: 991334 - RNA, 19 nt, Homo sapiens
ccaacaagaccaacaagga

SEQ ID NO: 991335 - RNA, 19 nt, Homo sapiens
gcucgcggcugaaggaaca

SEQ ID NO: 991336 - RNA, 19 nt, Homo sapiens
caacgcgucugcccucuac

SEQ ID NO: 991337 - RNA, 19 nt, Homo sapiens
gccugucgcugcucaaguu

SEQ ID NO: 991338 - RNA, 19 nt, Homo sapiens
ccggacaucuccaacaaau

SEQ ID NO: 991339 - RNA, 19 nt, Homo sapiens
ucgcagagcccaacaagga

SEQ ID NO: 991340 - RNA, 19 nt, Homo sapiens
gagaacagaaugugucaag

SEQ ID NO: 991341 - RNA, 19 nt, Homo sapiens
aaugucaccuugcuuccua

SEQ ID NO: 991342 - RNA, 19 nt, Homo sapiens
uggagggcuuuguuaagua

SEQ ID NO: 991343 - RNA, 19 nt, Homo sapiens
ggacaucuccaacaaaucc

SEQ ID NO: 991344 - RNA, 19 nt, Homo sapiens
ccucagacucuucuuacua

SEQ ID NO: 991345 - RNA, 19 nt, Homo sapiens
cugauuagauaccugaaau

SEQ ID NO: 991346 - RNA, 19 nt, Homo sapiens
agacaccgcucuacaaagc

SEQ ID NO: 991347 - RNA, 19 nt, Homo sapiens
ggaacacaucgacagcuuu

SEQ ID NO: 991348 - RNA, 19 nt, Homo sapiens
gagcagagaacagaaugug

SEQ ID NO: 991349 - RNA, 19 nt, Homo sapiens
cuacgaggccugcaagaau

SEQ ID NO: 991350 - RNA, 19 nt, Homo sapiens
aaacucaccacuugacuuc

SEQ ID NO: 991351 - RNA, 19 nt, Homo sapiens
ccuccugggugaagaaugu

SEQ ID NO: 991352 - RNA, 19 nt, Homo sapiens
uacgaggccugcaagaaug

SEQ ID NO: 991353 - RNA, 19 nt, Homo sapiens
ugaagaaugucaccuugcu

SEQ ID NO: 991354 - RNA, 19 nt, Homo sapiens
gaucaaggaagggaagaau

SEQ ID NO: 991355 - RNA, 19 nt, Homo sapiens
gaugaagaggccuugaaga

SEQ ID NO: 991356 - RNA, 19 nt, Homo sapiens
agggcuuuguuaaguauua

SEQ ID NO: 991357 - RNA, 19 nt, Homo sapiens
ccaaagacuaagaugaaga

SEQ ID NO: 991358 - RNA, 19 nt, Homo sapiens
ggccagagcagagaacaga

SEQ ID NO: 991359 - RNA, 19 nt, Homo sapiens
gaagaaugucaccuugcuu

SEQ ID NO: 991360 - RNA, 19 nt, Homo sapiens
ucaccuugcuuccuaucug

SEQ ID NO: 991361 - RNA, 19 nt, Homo sapiens
gauuagauaccugaaauac

SEQ ID NO: 991362 - RNA, 19 nt, Homo sapiens
ucaaggauggcgaugaaga

SEQ ID NO: 991363 - RNA, 19 nt, Homo sapiens
gcgaugaagaggccuugaa

SEQ ID NO: 991364 - RNA, 19 nt, Homo sapiens
ggucuuggagggcuuuguu

SEQ ID NO: 991365 - RNA, 19 nt, Homo sapiens
cuccaaagacuaagaugaa

SEQ ID NO: 991366 - RNA, 19 nt, Homo sapiens
ggaauggcagaaaccucua

SEQ ID NO: 991367 - RNA, 19 nt, Homo sapiens
caaggagaagaaucauuug

SEQ ID NO: 991368 - RNA, 19 nt, Homo sapiens
cuuccuaucugccucuuuc

SEQ ID NO: 991369 - RNA, 19 nt, Homo sapiens
ccaggcaggcugauuagau

SEQ ID NO: 991370 - RNA, 19 nt, Homo sapiens
ucgaaaggccauugggaaa

SEQ ID NO: 991371 - RNA, 19 nt, Homo sapiens
gguacagcuuggcuucuca

SEQ ID NO: 991372 - RNA, 19 nt, Homo sapiens
augaggaggugguggaguu

SEQ ID NO: 991373 - RNA, 19 nt, Homo sapiens
ugagguucuuagccaagua

SEQ ID NO: 991374 - RNA, 19 nt, Homo sapiens
gagucugugucucgcaaug

SEQ ID NO: 991375 - RNA, 19 nt, Homo sapiens
uccaacaaaucccgagaga

SEQ ID NO: 991376 - RNA, 19 nt, Homo sapiens
gaauggcagaaaccucuau

SEQ ID NO: 991377 - RNA, 19 nt, Homo sapiens
cgaaaggccauugggaaau

SEQ ID NO: 991378 - RNA, 19 nt, Homo sapiens
ucaaggaagggaagaaucu

SEQ ID NO: 991379 - RNA, 19 nt, Homo sapiens
gaucccagaccuucucuac

SEQ ID NO: 991380 - RNA, 19 nt, Homo sapiens
aauacgagaacacccagua

SEQ ID NO: 991381 - RNA, 19 nt, Homo sapiens
gcgaacaucgacgccuaua

SEQ ID NO: 991382 - RNA, 19 nt, Homo sapiens
ccaagaagggcaacuacag

SEQ ID NO: 991383 - RNA, 19 nt, Homo sapiens
gcggaggccgugaagauuc

SEQ ID NO: 991384 - RNA, 19 nt, Homo sapiens
gcagaucccagaccuucuc

SEQ ID NO: 991385 - RNA, 19 nt, Homo sapiens
gaagaccaugaucaaggaa

SEQ ID NO: 991386 - RNA, 19 nt, Homo sapiens
gcugauuagauaccugaaa

SEQ ID NO: 991387 - RNA, 19 nt, Homo sapiens
gggccgucaucaaggagaa

SEQ ID NO: 991388 - RNA, 19 nt, Homo sapiens
aggaacacaucgacagcuu

SEQ ID NO: 991389 - RNA, 19 nt, Homo sapiens
aaauacagcagcagcuugu

SEQ ID NO: 991390 - RNA, 19 nt, Homo sapiens
uuggagggcuuuguuaagu

SEQ ID NO: 991391 - RNA, 19 nt, Homo sapiens
caaagacuaagaugaagac

SEQ ID NO: 991392 - RNA, 19 nt, Homo sapiens
cuggaaaacucaccacuug

SEQ ID NO: 991393 - RNA, 19 nt, Homo sapiens
ccucugcuuugccaugaau

SEQ ID NO: 991394 - RNA, 19 nt, Homo sapiens
ucgcgguggucaacaacaa

SEQ ID NO: 991395 - RNA, 19 nt, Homo sapiens
ccggccaucugcuuugguu

SEQ ID NO: 991396 - RNA, 19 nt, Homo sapiens
ucauuguugucuuauaugg

SEQ ID NO: 991397 - RNA, 19 nt, Homo sapiens
aggagaagaaucauuuguu

SEQ ID NO: 991398 - RNA, 19 nt, Homo sapiens
gaaugugucaaggagaaga

SEQ ID NO: 991399 - RNA, 19 nt, Homo sapiens
ccagagcagagaacagaau

SEQ ID NO: 991400 - RNA, 19 nt, Homo sapiens
gagaaggcagaaccuccaa

SEQ ID NO: 991401 - RNA, 19 nt, Homo sapiens
ccuggacugucuccuguca

SEQ ID NO: 991402 - RNA, 19 nt, Homo sapiens
ggucaacaacaacguguac

SEQ ID NO: 991403 - RNA, 19 nt, Homo sapiens
uggaguuucugcugucaca

SEQ ID NO: 991404 - RNA, 19 nt, Homo sapiens
agccggacaucuccaacaa

SEQ ID NO: 991405 - RNA, 19 nt, Homo sapiens
ucccagaccuucucuaccu

SEQ ID NO: 991406 - RNA, 19 nt, Homo sapiens
cagagaacagaauguguca

SEQ ID NO: 991407 - RNA, 19 nt, Homo sapiens
guggugcaguucugugagu

SEQ ID NO: 991408 - RNA, 19 nt, Homo sapiens
gcaaccagcuggaguacaa

SEQ ID NO: 991409 - RNA, 19 nt, Homo sapiens
gggaggaccugaacaagaa

SEQ ID NO: 991410 - RNA, 19 nt, Homo sapiens
gcacacggcuuggcuggua

SEQ ID NO: 991411 - RNA, 19 nt, Homo sapiens
ggaaaccaccgcucuuuaa

SEQ ID NO: 991412 - RNA, 19 nt, Homo sapiens
gaaaaucccucaagacaga

SEQ ID NO: 991413 - RNA, 19 nt, Homo sapiens
gcccaaaucuagagcauug

SEQ ID NO: 991414 - RNA, 19 nt, Homo sapiens
ggaagcaguuggagagaga

SEQ ID NO: 991415 - RNA, 19 nt, Homo sapiens
gcaguacgauggcaaagug

SEQ ID NO: 991416 - RNA, 19 nt, Homo sapiens
gaaacauccugcugucaga

SEQ ID NO: 991417 - RNA, 19 nt, Homo sapiens
ccaccgcucuuuaacauga

SEQ ID NO: 991418 - RNA, 19 nt, Homo sapiens
gcaaggaacagcugaagga

SEQ ID NO: 991419 - RNA, 19 nt, Homo sapiens
ggcaagacaucaucaagga

SEQ ID NO: 991420 - RNA, 19 nt, Homo sapiens
gaggugcgguucuuacaga

SEQ ID NO: 991421 - RNA, 19 nt, Homo sapiens
gggaagcaguccaaugaga

SEQ ID NO: 991422 - RNA, 19 nt, Homo sapiens
caccuuagcuacaaucguu

SEQ ID NO: 991423 - RNA, 19 nt, Homo sapiens
cuacaaacuucgcaaggaa

SEQ ID NO: 991424 - RNA, 19 nt, Homo sapiens
gaaggauucugggaaagga

SEQ ID NO: 991425 - RNA, 19 nt, Homo sapiens
caccugcccuccagucuuu

SEQ ID NO: 991426 - RNA, 19 nt, Homo sapiens
ucaagaagauguccuacag

SEQ ID NO: 991427 - RNA, 19 nt, Homo sapiens
uggcugagcucuucuucaa

SEQ ID NO: 991428 - RNA, 19 nt, Homo sapiens
cgacuccugucuucagaaa

SEQ ID NO: 991429 - RNA, 19 nt, Homo sapiens
cgagcuggcugaacggaaa

SEQ ID NO: 991430 - RNA, 19 nt, Homo sapiens
gaagcaguccaaugagaaa

SEQ ID NO: 991431 - RNA, 19 nt, Homo sapiens
ggaagcaguccaaugagaa

SEQ ID NO: 991432 - RNA, 19 nt, Homo sapiens
gaaggaggaugagagucuu

SEQ ID NO: 991433 - RNA, 19 nt, Homo sapiens
gaagcggaccuacaaacuu

SEQ ID NO: 991434 - RNA, 19 nt, Homo sapiens
gcucugacaaccuauauga

SEQ ID NO: 991435 - RNA, 19 nt, Homo sapiens
uaucugagcggaacuguga

SEQ ID NO: 991436 - RNA, 19 nt, Homo sapiens
gagccugguugaugaggaa

SEQ ID NO: 991437 - RNA, 19 nt, Homo sapiens
gcacagaagcggaccuaca

SEQ ID NO: 991438 - RNA, 19 nt, Homo sapiens
ugaagaagauccuguucca

SEQ ID NO: 991439 - RNA, 19 nt, Homo sapiens
aaucagaaauccggaauuc

SEQ ID NO: 991440 - RNA, 19 nt, Homo sapiens
ucacccaccuuccucaguu

SEQ ID NO: 991441 - RNA, 19 nt, Homo sapiens
ggaaggaggaugagagucu

SEQ ID NO: 991442 - RNA, 19 nt, Homo sapiens
uaacaugaaugcgaugagu

SEQ ID NO: 991443 - RNA, 19 nt, Homo sapiens
gaaauggcaagacaucauc

SEQ ID NO: 991444 - RNA, 19 nt, Homo sapiens
gugggaagcaguccaauga

SEQ ID NO: 991445 - RNA, 19 nt, Homo sapiens
gcccaagagccucaaagua

SEQ ID NO: 991446 - RNA, 19 nt, Homo sapiens
acaagaagcagacccagaa

SEQ ID NO: 991447 - RNA, 19 nt, Homo sapiens
agaagauccuguuccaaga

SEQ ID NO: 991448 - RNA, 19 nt, Homo sapiens
cuacaaucguucagcuauu

SEQ ID NO: 991449 - RNA, 19 nt, Homo sapiens
cggcuuggcugguaaugga

SEQ ID NO: 991450 - RNA, 19 nt, Homo sapiens
caacacccauuagcucugu

SEQ ID NO: 991451 - RNA, 19 nt, Homo sapiens
gagcugagacggagaagag

SEQ ID NO: 991452 - RNA, 19 nt, Homo sapiens
guagagaucgcagcuguga

SEQ ID NO: 991453 - RNA, 19 nt, Homo sapiens
cuucaaggaugacccagaa

SEQ ID NO: 991454 - RNA, 19 nt, Homo sapiens
aagcggaccuacaaacuuc

SEQ ID NO: 991455 - RNA, 19 nt, Homo sapiens
ugugaaggcuggaaacauc

SEQ ID NO: 991456 - RNA, 19 nt, Homo sapiens
ccuccuaccugcuccuuug

SEQ ID NO: 991457 - RNA, 19 nt, Homo sapiens
ggaugagagucuucuggau

SEQ ID NO: 991458 - RNA, 19 nt, Homo sapiens
ucaaggaggugcgguucuu

SEQ ID NO: 991459 - RNA, 19 nt, Homo sapiens
ggucucuguuucauagauu

SEQ ID NO: 991460 - RNA, 19 nt, Homo sapiens
ggaggaggaagaagaggaa

SEQ ID NO: 991461 - RNA, 19 nt, Homo sapiens
cugacaaccuauaugauga

SEQ ID NO: 991462 - RNA, 19 nt, Homo sapiens
ggaggaagaaggcccugaa

SEQ ID NO: 991463 - RNA, 19 nt, Homo sapiens
uaucugcacucccacaaca

SEQ ID NO: 991464 - RNA, 19 nt, Homo sapiens
ggguuuagcaucccacuug

SEQ ID NO: 991465 - RNA, 19 nt, Homo sapiens
caggagaggagcauuguug

SEQ ID NO: 991466 - RNA, 19 nt, Homo sapiens
ugaccagccucgagaguag

SEQ ID NO: 991467 - RNA, 19 nt, Homo sapiens
cggaaaccaccgcucuuua

SEQ ID NO: 991468 - RNA, 19 nt, Homo sapiens
aaugagaaauggcaagaca

SEQ ID NO: 991469 - RNA, 19 nt, Homo sapiens
ggugggaagagucauguuu

SEQ ID NO: 991470 - RNA, 19 nt, Homo sapiens
ucccaaauuuccaggcuuu

SEQ ID NO: 991471 - RNA, 19 nt, Homo sapiens
ucucacagcuccauuaucc

SEQ ID NO: 991472 - RNA, 19 nt, Homo sapiens
acacuggucugaguacuuc

SEQ ID NO: 991473 - RNA, 19 nt, Homo sapiens
ucugaguacuuccggaauu

SEQ ID NO: 991474 - RNA, 19 nt, Homo sapiens
gcugucagagccaggguua

SEQ ID NO: 991475 - RNA, 19 nt, Homo sapiens
ccacgacucagugaaguuu

SEQ ID NO: 991476 - RNA, 19 nt, Homo sapiens
cuagagcauugagcacuuu

SEQ ID NO: 991477 - RNA, 19 nt, Homo sapiens
gaggagauagaggagcuua

SEQ ID NO: 991478 - RNA, 19 nt, Homo sapiens
gcauugagcacuuuaucuc

SEQ ID NO: 991479 - RNA, 19 nt, Homo sapiens
ccggguaacaguccucaua

SEQ ID NO: 991480 - RNA, 19 nt, Homo sapiens
gcuacaaucguucagcuau

SEQ ID NO: 991481 - RNA, 19 nt, Homo sapiens
augagagucuucuggauga

SEQ ID NO: 991482 - RNA, 19 nt, Homo sapiens
gcugggacguggagcuugu

SEQ ID NO: 991483 - RNA, 19 nt, Homo sapiens
ccuccuccuuucucagaua

SEQ ID NO: 991484 - RNA, 19 nt, Homo sapiens
ccuacaaacuucgcaagga

SEQ ID NO: 991485 - RNA, 19 nt, Homo sapiens
cacagaagcggaccuacaa

SEQ ID NO: 991486 - RNA, 19 nt, Homo sapiens
cugaguacuuccggaauuu

SEQ ID NO: 991487 - RNA, 19 nt, Homo sapiens
uauaccacauugcacagaa

SEQ ID NO: 991488 - RNA, 19 nt, Homo sapiens
caaggaggugcgguucuua

SEQ ID NO: 991489 - RNA, 19 nt, Homo sapiens
gcaguccaaugagaaaugg

SEQ ID NO: 991490 - RNA, 19 nt, Homo sapiens
cuuuggagccguauacuuu

SEQ ID NO: 991491 - RNA, 19 nt, Homo sapiens
gggcgaaagccgaggaaga

SEQ ID NO: 991492 - RNA, 19 nt, Homo sapiens
gcauaucucgacucugguu

SEQ ID NO: 991493 - RNA, 19 nt, Homo sapiens
agacggagcugggcaacca

SEQ ID NO: 991494 - RNA, 19 nt, Homo sapiens
gaaaccaccgcucuuuaac

SEQ ID NO: 991495 - RNA, 19 nt, Homo sapiens
uacaaucguucagcuauuc

SEQ ID NO: 991496 - RNA, 19 nt, Homo sapiens
gguaacaguccucauaguc

SEQ ID NO: 991497 - RNA, 19 nt, Homo sapiens
gagcauugagcacuuuauc

SEQ ID NO: 991498 - RNA, 19 nt, Homo sapiens
gaccgucagcagcaccuua

SEQ ID NO: 991499 - RNA, 19 nt, Homo sapiens
cccaagagccucaaaguac

SEQ ID NO: 991500 - RNA, 19 nt, Homo sapiens
ggaagaggaggaggaggaa

SEQ ID NO: 991501 - RNA, 19 nt, Homo sapiens
gaagaagauccuguuccaa

SEQ ID NO: 991502 - RNA, 19 nt, Homo sapiens
cagagguucuccugaagca

SEQ ID NO: 991503 - RNA, 19 nt, Homo sapiens
gaggucagauuagguuguc

SEQ ID NO: 991504 - RNA, 19 nt, Homo sapiens
gggucugccugaggagaua

SEQ ID NO: 991505 - RNA, 19 nt, Homo sapiens
gcaguuggagagagaagga

SEQ ID NO: 991506 - RNA, 19 nt, Homo sapiens
caacaagcggcgugagcaa

SEQ ID NO: 991507 - RNA, 19 nt, Homo sapiens
gaagauccuguuccaagag

SEQ ID NO: 991508 - RNA, 19 nt, Homo sapiens
gauaggagcucaaggugua

SEQ ID NO: 991509 - RNA, 19 nt, Homo sapiens
agacaucacuccucuaaua

SEQ ID NO: 991510 - RNA, 19 nt, Homo sapiens
gcuagaagauuccaaacua

SEQ ID NO: 991511 - RNA, 19 nt, Homo sapiens
caucacagauagaagauua

SEQ ID NO: 991512 - RNA, 19 nt, Homo sapiens
caaauaaaccuucuacuga

SEQ ID NO: 991513 - RNA, 19 nt, Homo sapiens
ucaguaagguuaacaauga

SEQ ID NO: 991514 - RNA, 19 nt, Homo sapiens
guuggaagguguacuaaua

SEQ ID NO: 991515 - RNA, 19 nt, Homo sapiens
ccuaauaccuugcaaagaa

SEQ ID NO: 991516 - RNA, 19 nt, Homo sapiens
gaagacaucacuccucuaa

SEQ ID NO: 991517 - RNA, 19 nt, Homo sapiens
gaacuacggugccauuuac

SEQ ID NO: 991518 - RNA, 19 nt, Homo sapiens
gagcauacaaccacuauuu

SEQ ID NO: 991519 - RNA, 19 nt, Homo sapiens
gaagaaagggauuugguaa

SEQ ID NO: 991520 - RNA, 19 nt, Homo sapiens
gaaaauacaucacagauag

SEQ ID NO: 991521 - RNA, 19 nt, Homo sapiens
gccaugagguuggaaauaa

SEQ ID NO: 991522 - RNA, 19 nt, Homo sapiens
gacaauaacuuggaauuag

SEQ ID NO: 991523 - RNA, 19 nt, Homo sapiens
gauggaagcagauauuaaa

SEQ ID NO: 991524 - RNA, 19 nt, Homo sapiens
gaagguaccagcucagauu

SEQ ID NO: 991525 - RNA, 19 nt, Homo sapiens
ccaaaggaauuacaagaau

SEQ ID NO: 991526 - RNA, 19 nt, Homo sapiens
ggacuugcauucuggaugu

SEQ ID NO: 991527 - RNA, 19 nt, Homo sapiens
ggaacuacggugccauuua

SEQ ID NO: 991528 - RNA, 19 nt, Homo sapiens
gucaugaaauccagauaua

SEQ ID NO: 991529 - RNA, 19 nt, Homo sapiens
gagaaaggcauuuguuaga

SEQ ID NO: 991530 - RNA, 19 nt, Homo sapiens
gaagagaaaggcauuuguu

SEQ ID NO: 991531 - RNA, 19 nt, Homo sapiens
ccagauauaugaggaggua

SEQ ID NO: 991532 - RNA, 19 nt, Homo sapiens
gaaaggcauuuguuagaag

SEQ ID NO: 991533 - RNA, 19 nt, Homo sapiens
ggacagccauuuccauuuu

SEQ ID NO: 991534 - RNA, 19 nt, Homo sapiens
ggaugaaagugcacggauu

SEQ ID NO: 991535 - RNA, 19 nt, Homo sapiens
gaaaugcguugaagcaaaa

SEQ ID NO: 991536 - RNA, 19 nt, Homo sapiens
gaaagggauuugguaacaa

SEQ ID NO: 991537 - RNA, 19 nt, Homo sapiens
gaaagugcacggauucaga

SEQ ID NO: 991538 - RNA, 19 nt, Homo sapiens
uaacaaaggacagccauuu

SEQ ID NO: 991539 - RNA, 19 nt, Homo sapiens
cacaagcacugaaaguauu

SEQ ID NO: 991540 - RNA, 19 nt, Homo sapiens
gaaggaaaucucuauggaa

SEQ ID NO: 991541 - RNA, 19 nt, Homo sapiens
ggaaauaauccaaaggaau

SEQ ID NO: 991542 - RNA, 19 nt, Homo sapiens
gacaaggucuacuucaugu

SEQ ID NO: 991543 - RNA, 19 nt, Homo sapiens
ugaaggaaaucucuaugga

SEQ ID NO: 991544 - RNA, 19 nt, Homo sapiens
gaagagacugggacaauuc

SEQ ID NO: 991545 - RNA, 19 nt, Homo sapiens
caaagaagcaggauugaag

SEQ ID NO: 991546 - RNA, 19 nt, Homo sapiens
agaaaugcguugaagcaaa

SEQ ID NO: 991547 - RNA, 19 nt, Homo sapiens
gcaaacugccauagagaaa

SEQ ID NO: 991548 - RNA, 19 nt, Homo sapiens
ggaagcagauauuaaagcu

SEQ ID NO: 991549 - RNA, 19 nt, Homo sapiens
cagcucagauuccauuguu

SEQ ID NO: 991550 - RNA, 19 nt, Homo sapiens
gagauggaagcagauauua

SEQ ID NO: 991551 - RNA, 19 nt, Homo sapiens
aggaagcgcuggucucauu

SEQ ID NO: 991552 - RNA, 19 nt, Homo sapiens
ucaagggaauuauggagaa

SEQ ID NO: 991553 - RNA, 19 nt, Homo sapiens
gagcugcccucgucuacug

SEQ ID NO: 991554 - RNA, 19 nt, Homo sapiens
uggaagguguacuaauaua

SEQ ID NO: 991555 - RNA, 19 nt, Homo sapiens
cagcuggguuuacugauga

SEQ ID NO: 991556 - RNA, 19 nt, Homo sapiens
ggaaaucucuauggaacca

SEQ ID NO: 991557 - RNA, 19 nt, Homo sapiens
cuaaacagcaggagagauu

SEQ ID NO: 991558 - RNA, 19 nt, Homo sapiens
caacagguauuugugaagu

SEQ ID NO: 991559 - RNA, 19 nt, Homo sapiens
caucacuccucuaauaaau

SEQ ID NO: 991560 - RNA, 19 nt, Homo sapiens
ggaauuauggagaauccua

SEQ ID NO: 991561 - RNA, 19 nt, Homo sapiens
agaaaggcauuuguuagaa

SEQ ID NO: 991562 - RNA, 19 nt, Homo sapiens
gaagcaggauugaaguuuu

SEQ ID NO: 991563 - RNA, 19 nt, Homo sapiens
ccacugggugugacauuua

SEQ ID NO: 991564 - RNA, 19 nt, Homo sapiens
gcaggagagauuucuguaa

SEQ ID NO: 991565 - RNA, 19 nt, Homo sapiens
guagaugccauucguauuc

SEQ ID NO: 991566 - RNA, 19 nt, Homo sapiens
ucacuccucuaauaaaugu

SEQ ID NO: 991567 - RNA, 19 nt, Homo sapiens
ggagaauccuauuguaaaa

SEQ ID NO: 991568 - RNA, 19 nt, Homo sapiens
cagaagaaauagaccuaau

SEQ ID NO: 991569 - RNA, 19 nt, Homo sapiens
ccacaagcacugaaaguau

SEQ ID NO: 991570 - RNA, 19 nt, Homo sapiens
caggagagauuucuguaag

SEQ ID NO: 991571 - RNA, 19 nt, Homo sapiens
cagauuccauuguucauca

SEQ ID NO: 991572 - RNA, 19 nt, Homo sapiens
agaaagggauuugguaaca

SEQ ID NO: 991573 - RNA, 19 nt, Homo sapiens
ggaaaguauuuggaacaug

SEQ ID NO: 991574 - RNA, 19 nt, Homo sapiens
ggaaaccaagggaagauga

SEQ ID NO: 991575 - RNA, 19 nt, Homo sapiens
uauggagaauccuauugua

SEQ ID NO: 991576 - RNA, 19 nt, Homo sapiens
ggaagguguacuaauauau

SEQ ID NO: 991577 - RNA, 19 nt, Homo sapiens
aaagugacugcaacaaaua

SEQ ID NO: 991578 - RNA, 19 nt, Homo sapiens
gaccgacucugacuugaag

SEQ ID NO: 991579 - RNA, 19 nt, Homo sapiens
gaauuugaucgucaugaaa

SEQ ID NO: 991580 - RNA, 19 nt, Homo sapiens
agaauuugaucgucaugaa

SEQ ID NO: 991581 - RNA, 19 nt, Homo sapiens
agaagagacugggacaauu

SEQ ID NO: 991582 - RNA, 19 nt, Homo sapiens
aagagaaaggcauuuguua

SEQ ID NO: 991583 - RNA, 19 nt, Homo sapiens
gcaaagaagcaggauugaa

SEQ ID NO: 991584 - RNA, 19 nt, Homo sapiens
caugugggagauauaauua

SEQ ID NO: 991585 - RNA, 19 nt, Homo sapiens
gacaucacuccucuaauaa

SEQ ID NO: 991586 - RNA, 19 nt, Homo sapiens
aaugauagaucgacaaggu

SEQ ID NO: 991587 - RNA, 19 nt, Homo sapiens
aaagauggccaggcauaua

SEQ ID NO: 991588 - RNA, 19 nt, Homo sapiens
uagagaaacugagaaugga

SEQ ID NO: 991589 - RNA, 19 nt, Homo sapiens
gccauuuacuucacggaaa

SEQ ID NO: 991590 - RNA, 19 nt, Homo sapiens
caugaaauccagauauaug

SEQ ID NO: 991591 - RNA, 19 nt, Homo sapiens
gaaaccaagggaagaugaa

SEQ ID NO: 991592 - RNA, 19 nt, Homo sapiens
gagaagagaaaggcauuug

SEQ ID NO: 991593 - RNA, 19 nt, Homo sapiens
cgacaaggucuacuucaug

SEQ ID NO: 991594 - RNA, 19 nt, Homo sapiens
auaaugaucugguaauugc

SEQ ID NO: 991595 - RNA, 19 nt, Homo sapiens
acaaauaaaccuucuacug

SEQ ID NO: 991596 - RNA, 19 nt, Homo sapiens
gaugaaagugcacggauuc

SEQ ID NO: 991597 - RNA, 19 nt, Homo sapiens
aaaggcauuuguuagaaga

SEQ ID NO: 991598 - RNA, 19 nt, Homo sapiens
agaagaaagggauuuggua

SEQ ID NO: 991599 - RNA, 19 nt, Homo sapiens
caacaaauaaaccuucuac

SEQ ID NO: 991600 - RNA, 19 nt, Homo sapiens
aaacagguucauaguauug

SEQ ID NO: 991601 - RNA, 19 nt, Homo sapiens
ggaggcccaugauauugug

SEQ ID NO: 991602 - RNA, 19 nt, Homo sapiens
gcagaagaaauagaccuaa

SEQ ID NO: 991603 - RNA, 19 nt, Homo sapiens
uacuggagcagaagaaaua

SEQ ID NO: 991604 - RNA, 19 nt, Homo sapiens
aauaaaccuucuacugaga

SEQ ID NO: 991605 - RNA, 19 nt, Homo sapiens
ccaaucagcuggguuuacu

SEQ ID NO: 991606 - RNA, 19 nt, Homo sapiens
ggaggaagcgcuggucuca

SEQ ID NO: 991607 - RNA, 19 nt, Homo sapiens
guggaagugucacccuaaa

SEQ ID NO: 991608 - RNA, 19 nt, Homo sapiens
ggacggcacuuuacauaua

SEQ ID NO: 991609 - RNA, 19 nt, Homo sapiens
uaacaucucuuucacuuug

SEQ ID NO: 991610 - RNA, 19 nt, Homo sapiens
ggaugggacuguuacaaua

SEQ ID NO: 991611 - RNA, 19 nt, Homo sapiens
gaugagagauccagccaaa

SEQ ID NO: 991612 - RNA, 19 nt, Homo sapiens
caacagaguccaugaguuu

SEQ ID NO: 991613 - RNA, 19 nt, Homo sapiens
gaguacagcuggccugaaa

SEQ ID NO: 991614 - RNA, 19 nt, Homo sapiens
gcagagaggugccaucagu

SEQ ID NO: 991615 - RNA, 19 nt, Homo sapiens
aacgagaucuccacaaaua

SEQ ID NO: 991616 - RNA, 19 nt, Homo sapiens
gugaagcucuuguuucuga

SEQ ID NO: 991617 - RNA, 19 nt, Homo sapiens
ggagaggacucgagaucaa

SEQ ID NO: 991618 - RNA, 19 nt, Homo sapiens
gaguugaccuuucgucuga

SEQ ID NO: 991619 - RNA, 19 nt, Homo sapiens
ggacuccacugaugagaga

SEQ ID NO: 991620 - RNA, 19 nt, Homo sapiens
ucaacgagaucuccacaaa

SEQ ID NO: 991621 - RNA, 19 nt, Homo sapiens
ggagagaccauauuugaga

SEQ ID NO: 991622 - RNA, 19 nt, Homo sapiens
gacaggguaucacacauuu

SEQ ID NO: 991623 - RNA, 19 nt, Homo sapiens
gagcguacaucugaaauuc

SEQ ID NO: 991624 - RNA, 19 nt, Homo sapiens
ccagaagccauguauauaa

SEQ ID NO: 991625 - RNA, 19 nt, Homo sapiens
uaaaagggcuagagcauuu

SEQ ID NO: 991626 - RNA, 19 nt, Homo sapiens
gaaaccgggugguauuuua

SEQ ID NO: 991627 - RNA, 19 nt, Homo sapiens
cuacugcccugaggacuua

SEQ ID NO: 991628 - RNA, 19 nt, Homo sapiens
gaagccauguauauaaugu

SEQ ID NO: 991629 - RNA, 19 nt, Homo sapiens
ccagugacuuccaguguaa

SEQ ID NO: 991630 - RNA, 19 nt, Homo sapiens
gagaauuuccuuuacugua

SEQ ID NO: 991631 - RNA, 19 nt, Homo sapiens
cgaagaguuuguagagaaa

SEQ ID NO: 991632 - RNA, 19 nt, Homo sapiens
ccgaagaguuuguagagaa

SEQ ID NO: 991633 - RNA, 19 nt, Homo sapiens
gacggcacuuuacauauaa

SEQ ID NO: 991634 - RNA, 19 nt, Homo sapiens
ccagaggaauucaaacuuc

SEQ ID NO: 991635 - RNA, 19 nt, Homo sapiens
gagagaggacccuuaaaga

SEQ ID NO: 991636 - RNA, 19 nt, Homo sapiens
cagaagccauguauauaau

SEQ ID NO: 991637 - RNA, 19 nt, Homo sapiens
ggacaggguaucacacauu

SEQ ID NO: 991638 - RNA, 19 nt, Homo sapiens
ggccuucgcuucgcucuuu

SEQ ID NO: 991639 - RNA, 19 nt, Homo sapiens
gaagccagccuaucucuag

SEQ ID NO: 991640 - RNA, 19 nt, Homo sapiens
cugcagaucucacaguuug

SEQ ID NO: 991641 - RNA, 19 nt, Homo sapiens
cauggacccugguuacaaa

SEQ ID NO: 991642 - RNA, 19 nt, Homo sapiens
gcugaccaguagagaauuu

SEQ ID NO: 991643 - RNA, 19 nt, Homo sapiens
gugcaggacuccacugaug

SEQ ID NO: 991644 - RNA, 19 nt, Homo sapiens
gcaaagucaugacaaugca

SEQ ID NO: 991645 - RNA, 19 nt, Homo sapiens
gaacaauuccucugaucau

SEQ ID NO: 991646 - RNA, 19 nt, Homo sapiens
ugacauggccaucacguuu

SEQ ID NO: 991647 - RNA, 19 nt, Homo sapiens
gcacagcccuuuggauaac

SEQ ID NO: 991648 - RNA, 19 nt, Homo sapiens
cuucguaccugcaauaugu

SEQ ID NO: 991649 - RNA, 19 nt, Homo sapiens
ccaucaagcucagaguuaa

SEQ ID NO: 991650 - RNA, 19 nt, Homo sapiens
ggacccugguuacaaauuc

SEQ ID NO: 991651 - RNA, 19 nt, Homo sapiens
caguagagaauuuccuuua

SEQ ID NO: 991652 - RNA, 19 nt, Homo sapiens
gagaggacccuuaaagaag

SEQ ID NO: 991653 - RNA, 19 nt, Homo sapiens
caccaggccuccuuuccua

SEQ ID NO: 991654 - RNA, 19 nt, Homo sapiens
guagaaaccgggugguauu

SEQ ID NO: 991655 - RNA, 19 nt, Homo sapiens
gcaagagagaguugacaaa

SEQ ID NO: 991656 - RNA, 19 nt, Homo sapiens
caauuccucugaucauguu

SEQ ID NO: 991657 - RNA, 19 nt, Homo sapiens
acaaaggcaucgagacaga

SEQ ID NO: 991658 - RNA, 19 nt, Homo sapiens
ggacugggguuucggauug

SEQ ID NO: 991659 - RNA, 19 nt, Homo sapiens
ugaagcaccuggucagcaa

SEQ ID NO: 991660 - RNA, 19 nt, Homo sapiens
ggauaacagugagucaaga

SEQ ID NO: 991661 - RNA, 19 nt, Homo sapiens
guagagaauuuccuuuacu

SEQ ID NO: 991662 - RNA, 19 nt, Homo sapiens
caggaggacugcagacuca

SEQ ID NO: 991663 - RNA, 19 nt, Homo sapiens
gugaauguacccuuucuuu

SEQ ID NO: 991664 - RNA, 19 nt, Homo sapiens
agaggacccuuaaagaaga

SEQ ID NO: 991665 - RNA, 19 nt, Homo sapiens
cgagaucuccacaaauaaa

SEQ ID NO: 991666 - RNA, 19 nt, Homo sapiens
cagcaaaccuguccuucca

SEQ ID NO: 991667 - RNA, 19 nt, Homo sapiens
gcaaagacacagagcagau

SEQ ID NO: 991668 - RNA, 19 nt, Homo sapiens
uaacagugagucaagaauu

SEQ ID NO: 991669 - RNA, 19 nt, Homo sapiens
agacucagcugcaauucug

SEQ ID NO: 991670 - RNA, 19 nt, Homo sapiens
gccuuucccuuuccucuuu

SEQ ID NO: 991671 - RNA, 19 nt, Homo sapiens
ggugagagaggacccuuaa

SEQ ID NO: 991672 - RNA, 19 nt, Homo sapiens
gcucuuguuucugacauuu

SEQ ID NO: 991673 - RNA, 19 nt, Homo sapiens
gaacuuucgcauucucuga

SEQ ID NO: 991674 - RNA, 19 nt, Homo sapiens
gcaaagacagccuggaaag

SEQ ID NO: 991675 - RNA, 19 nt, Homo sapiens
cuuccucucuguaaucuaa

SEQ ID NO: 991676 - RNA, 19 nt, Homo sapiens
ugagagauccagccaaaga

SEQ ID NO: 991677 - RNA, 19 nt, Homo sapiens
aaagcaaagucaugacaau

SEQ ID NO: 991678 - RNA, 19 nt, Homo sapiens
cuuaacaucucuuucacuu

SEQ ID NO: 991679 - RNA, 19 nt, Homo sapiens
uuaccgcuaucgucaagua

SEQ ID NO: 991680 - RNA, 19 nt, Homo sapiens
uggcacagcccuuuggaua

SEQ ID NO: 991681 - RNA, 19 nt, Homo sapiens
gcugcuggcuggugagaga

SEQ ID NO: 991682 - RNA, 19 nt, Homo sapiens
uuacaccucuucaaagcaa

SEQ ID NO: 991683 - RNA, 19 nt, Homo sapiens
cauccucccuguauccauu

SEQ ID NO: 991684 - RNA, 19 nt, Homo sapiens
gagagaccauauuugagau

SEQ ID NO: 991685 - RNA, 19 nt, Homo sapiens
ccucuuugccugcuauaua

SEQ ID NO: 991686 - RNA, 19 nt, Homo sapiens
gagaugaugagcacaugaa

SEQ ID NO: 991687 - RNA, 19 nt, Homo sapiens
ugucugcacugaagagcua

SEQ ID NO: 991688 - RNA, 19 nt, Homo sapiens
ucacuuagaugucguuucc

SEQ ID NO: 991689 - RNA, 19 nt, Homo sapiens
agagaggacccuuaaagaa

SEQ ID NO: 991690 - RNA, 19 nt, Homo sapiens
uggaguuccucucggguua

SEQ ID NO: 991691 - RNA, 19 nt, Homo sapiens
ggacaagugugaggaagac

SEQ ID NO: 991692 - RNA, 19 nt, Homo sapiens
guuggaggauuuagaagau

SEQ ID NO: 991693 - RNA, 19 nt, Homo sapiens
gauaacagugagucaagaa

SEQ ID NO: 991694 - RNA, 19 nt, Homo sapiens
gggccucccucccuaaauc

SEQ ID NO: 991695 - RNA, 19 nt, Homo sapiens
ccuaaucccucuccuuucu

SEQ ID NO: 991696 - RNA, 19 nt, Homo sapiens
cuguagggcugccuuacua

SEQ ID NO: 991697 - RNA, 19 nt, Homo sapiens
guccaugaguuuacaggaa

SEQ ID NO: 991698 - RNA, 19 nt, Homo sapiens
cugcaaagauguccagaag

SEQ ID NO: 991699 - RNA, 19 nt, Homo sapiens
ucaaacuucccaaagagua

SEQ ID NO: 991700 - RNA, 19 nt, Homo sapiens
uggaggauuuagaagauuu

SEQ ID NO: 991701 - RNA, 19 nt, Homo sapiens
aaccaguccugucccauuu

SEQ ID NO: 991702 - RNA, 19 nt, Homo sapiens
guccagaagccauguauau

SEQ ID NO: 991703 - RNA, 19 nt, Homo sapiens
cuaagugcauuaaacaucu

SEQ ID NO: 991704 - RNA, 19 nt, Homo sapiens
uagagaauuuccuuuacug

SEQ ID NO: 991705 - RNA, 19 nt, Homo sapiens
aauucaaacuucccaaaga

SEQ ID NO: 991706 - RNA, 19 nt, Homo sapiens
ggacuauguuagcauguac

SEQ ID NO: 991707 - RNA, 19 nt, Homo sapiens
aagacagccuggaaaguga

SEQ ID NO: 991708 - RNA, 19 nt, Homo sapiens
gcaagaggcugacaaugaa

SEQ ID NO: 991709 - RNA, 19 nt, Homo sapiens
ggaagaggauggagaugaa

SEQ ID NO: 991710 - RNA, 19 nt, Homo sapiens
gaagaaggaaguuguggaa

SEQ ID NO: 991711 - RNA, 19 nt, Homo sapiens
ugaaguagaugaagaacag

SEQ ID NO: 991712 - RNA, 19 nt, Homo sapiens
gaaggaaguuguggaagag

SEQ ID NO: 991713 - RNA, 19 nt, Homo sapiens
agaaggaaguuguggaaga

SEQ ID NO: 991714 - RNA, 19 nt, Homo sapiens
ggauggagaugaagaugag

SEQ ID NO: 991715 - RNA, 19 nt, Homo sapiens
acaaugaaguagaugaaga

SEQ ID NO: 991716 - RNA, 19 nt, Homo sapiens
gacaccagcuccgaaauca

SEQ ID NO: 991717 - RNA, 19 nt, Homo sapiens
gcgggcagcugaagaugau

SEQ ID NO: 991718 - RNA, 19 nt, Homo sapiens
caaugaaguagaugaagaa

SEQ ID NO: 991719 - RNA, 19 nt, Homo sapiens
uaaaggagaagaaggaagu

SEQ ID NO: 991720 - RNA, 19 nt, Homo sapiens
agaaggugauggugaggaa

SEQ ID NO: 991721 - RNA, 19 nt, Homo sapiens
ggaagaagguggggaggaa

SEQ ID NO: 991722 - RNA, 19 nt, Homo sapiens
guagacaccagcuccgaaa

SEQ ID NO: 991723 - RNA, 19 nt, Homo sapiens
ggagcaagaggcugacaau

SEQ ID NO: 991724 - RNA, 19 nt, Homo sapiens
cugaagaugaugaggauaa

SEQ ID NO: 991725 - RNA, 19 nt, Homo sapiens
ggacaagcgggcagcugaa

SEQ ID NO: 991726 - RNA, 19 nt, Homo sapiens
agcaagaggcugacaauga

SEQ ID NO: 991727 - RNA, 19 nt, Homo sapiens
ggagaagaaggaaguugug

SEQ ID NO: 991728 - RNA, 19 nt, Homo sapiens
ccaccgaggacuuaaagga

SEQ ID NO: 991729 - RNA, 19 nt, Homo sapiens
ugacaaugaaguagaugaa

SEQ ID NO: 991730 - RNA, 19 nt, Homo sapiens
ggaggaagaaggugauggu

SEQ ID NO: 991731 - RNA, 19 nt, Homo sapiens
ggacuuaaaggagaagaag

SEQ ID NO: 991732 - RNA, 19 nt, Homo sapiens
aaucaccaccgaggacuua

SEQ ID NO: 991733 - RNA, 19 nt, Homo sapiens
ccgaggacuuaaaggagaa

SEQ ID NO: 991734 - RNA, 19 nt, Homo sapiens
gggcagcugaagaugauga

SEQ ID NO: 991735 - RNA, 19 nt, Homo sapiens
caagcgggcagcugaagau

SEQ ID NO: 991736 - RNA, 19 nt, Homo sapiens
gaagaugagggagcugagu

SEQ ID NO: 991737 - RNA, 19 nt, Homo sapiens
ugaagaacaggaagaaggu

SEQ ID NO: 991738 - RNA, 19 nt, Homo sapiens
gagcaagaggcugacaaug

SEQ ID NO: 991739 - RNA, 19 nt, Homo sapiens
ggaagaggcggaaaaugga

SEQ ID NO: 991740 - RNA, 19 nt, Homo sapiens
ugagucagcuacggacaag

SEQ ID NO: 991741 - RNA, 19 nt, Homo sapiens
ggcugacaaugaaguagau

SEQ ID NO: 991742 - RNA, 19 nt, Homo sapiens
ugaggaagaggauggagau

SEQ ID NO: 991743 - RNA, 19 nt, Homo sapiens
ccuauuaccuuuacuguua

SEQ ID NO: 991744 - RNA, 19 nt, Homo sapiens
gggaggcacugaacugaaa

SEQ ID NO: 991745 - RNA, 19 nt, Homo sapiens
gacuuucacuuccgccuua

SEQ ID NO: 991746 - RNA, 19 nt, Homo sapiens
aagcaucacuuauaaggaa

SEQ ID NO: 991747 - RNA, 19 nt, Homo sapiens
agacaaauguggacucugu

SEQ ID NO: 991748 - RNA, 19 nt, Homo sapiens
ugacggugcuggcuacuga

SEQ ID NO: 991749 - RNA, 19 nt, Homo sapiens
cgucgacucuuccuggaua

SEQ ID NO: 991750 - RNA, 19 nt, Homo sapiens
gagaagaugcugccucguu

SEQ ID NO: 991751 - RNA, 19 nt, Homo sapiens
gaagacaaauguggacucu

SEQ ID NO: 991752 - RNA, 19 nt, Homo sapiens
ccaggacccaguacaguua

SEQ ID NO: 991753 - RNA, 19 nt, Homo sapiens
gaugcugccucguuguuau

SEQ ID NO: 991754 - RNA, 19 nt, Homo sapiens
ucuacucccuuucuuauau

SEQ ID NO: 991755 - RNA, 19 nt, Homo sapiens
gaucaaggcaaccgggaaa

SEQ ID NO: 991756 - RNA, 19 nt, Homo sapiens
ccauacgccuauuaccuuu

SEQ ID NO: 991757 - RNA, 19 nt, Homo sapiens
ggucaccauacgccuauua

SEQ ID NO: 991758 - RNA, 19 nt, Homo sapiens
ggcacggccuucucuguga

SEQ ID NO: 991759 - RNA, 19 nt, Homo sapiens
aaauguggacucuguguuu

SEQ ID NO: 991760 - RNA, 19 nt, Homo sapiens
uggaguacguggaagagaa

SEQ ID NO: 991761 - RNA, 19 nt, Homo sapiens
cgggaaaguuugacugcaa

SEQ ID NO: 991762 - RNA, 19 nt, Homo sapiens
guauucggcugggaacuug

SEQ ID NO: 991763 - RNA, 19 nt, Homo sapiens
ggaagaggaggacuugaca

SEQ ID NO: 991764 - RNA, 19 nt, Homo sapiens
acaguuagacuuucacuuc

SEQ ID NO: 991765 - RNA, 19 nt, Homo sapiens
gguaaccacgaccagcuua

SEQ ID NO: 991766 - RNA, 19 nt, Homo sapiens
uuugugaacuuccagaaug

SEQ ID NO: 991767 - RNA, 19 nt, Homo sapiens
uggaagagaagacaaaugu

SEQ ID NO: 991768 - RNA, 19 nt, Homo sapiens
ugacugcaacccuggagua

SEQ ID NO: 991769 - RNA, 19 nt, Homo sapiens
caaggcaaccgggaaaguu

SEQ ID NO: 991770 - RNA, 19 nt, Homo sapiens
ccacccaccugugaacuuc

SEQ ID NO: 991771 - RNA, 19 nt, Homo sapiens
ccagugagccuccuugaac

SEQ ID NO: 991772 - RNA, 19 nt, Homo sapiens
ccacgaccagcuuaaagaa

SEQ ID NO: 991773 - RNA, 19 nt, Homo sapiens
cuggaagccuugacacaug

SEQ ID NO: 991774 - RNA, 19 nt, Homo sapiens
cauaucaggccuuggauca

SEQ ID NO: 991775 - RNA, 19 nt, Homo sapiens
ucagcuacaugggcuuuga

SEQ ID NO: 991776 - RNA, 19 nt, Homo sapiens
gcuccugagucccuaguag

SEQ ID NO: 991777 - RNA, 19 nt, Homo sapiens
uaaggaagaggaggacuug

SEQ ID NO: 991778 - RNA, 19 nt, Homo sapiens
uaaccacgaccagcuuaaa

SEQ ID NO: 991779 - RNA, 19 nt, Homo sapiens
ggaagagaagacaaaugug

SEQ ID NO: 991780 - RNA, 19 nt, Homo sapiens
caguacaguuagacuuuca

SEQ ID NO: 991781 - RNA, 19 nt, Homo sapiens
ccaguacaguuagacuuuc

SEQ ID NO: 991782 - RNA, 19 nt, Homo sapiens
gaagaugcugccucguugu

SEQ ID NO: 991783 - RNA, 19 nt, Homo sapiens
caaauguggacucuguguu

SEQ ID NO: 991784 - RNA, 19 nt, Homo sapiens
guaaccacgaccagcuuaa

SEQ ID NO: 991785 - RNA, 19 nt, Homo sapiens
cagugagccuccuugaaca

SEQ ID NO: 991786 - RNA, 19 nt, Homo sapiens
cccaguacaguuagacuuu

SEQ ID NO: 991787 - RNA, 19 nt, Homo sapiens
cagcuuaaagaacuguauu

SEQ ID NO: 991788 - RNA, 19 nt, Homo sapiens
uaccuuuacuguuacaagu

SEQ ID NO: 991789 - RNA, 19 nt, Homo sapiens
aauguggacucuguguuug

SEQ ID NO: 991790 - RNA, 19 nt, Homo sapiens
ugucuacucccuuucuuau

SEQ ID NO: 991791 - RNA, 19 nt, Homo sapiens
gcaccgagcaggguaacca

SEQ ID NO: 991792 - RNA, 19 nt, Homo sapiens
acaaguaccggaucacucu

SEQ ID NO: 991793 - RNA, 19 nt, Homo sapiens
cuacucccuuucuuauauc

SEQ ID NO: 991794 - RNA, 19 nt, Homo sapiens
aaacacguaacuaccucua

SEQ ID NO: 991795 - RNA, 19 nt, Homo sapiens
acaaugucaucuuuauggu

SEQ ID NO: 991796 - RNA, 19 nt, Homo sapiens
uugugaacuuccagaauga

SEQ ID NO: 991797 - RNA, 19 nt, Homo sapiens
ggaguacguggaagagaag

SEQ ID NO: 991798 - RNA, 19 nt, Homo sapiens
cugcaacccuggaguacgu

SEQ ID NO: 991799 - RNA, 19 nt, Homo sapiens
gcuggaagccuugacacau

SEQ ID NO: 991800 - RNA, 19 nt, Homo sapiens
aaggcaaccgggaaaguuu

SEQ ID NO: 991801 - RNA, 19 nt, Homo sapiens
cauacgccuauuaccuuua

SEQ ID NO: 991802 - RNA, 19 nt, Homo sapiens
gcugccucguuguuauaaa

SEQ ID NO: 991803 - RNA, 19 nt, Homo sapiens
ccacagggaggcacugaac

SEQ ID NO: 991804 - RNA, 19 nt, Homo sapiens
cgaccagcuuaaagaacug

SEQ ID NO: 991805 - RNA, 19 nt, Homo sapiens
ccaaguacaucgacaagac

SEQ ID NO: 991806 - RNA, 19 nt, Homo sapiens
gagagcaucuuggacuugu

SEQ ID NO: 991807 - RNA, 19 nt, Homo sapiens
gacaagacgauccggguaa

SEQ ID NO: 991808 - RNA, 19 nt, Homo sapiens
cggauaaggagaagaagaa

SEQ ID NO: 991809 - RNA, 19 nt, Homo sapiens
acaagacgauccggguaaa

SEQ ID NO: 991810 - RNA, 19 nt, Homo sapiens
ggacggcaccauugaguac

SEQ ID NO: 991811 - RNA, 19 nt, Homo sapiens
gcaguaccgccuccuggaa

SEQ ID NO: 991812 - RNA, 19 nt, Homo sapiens
acggaagcauuucuccuuu

SEQ ID NO: 991813 - RNA, 19 nt, Homo sapiens
ggagagcaucuuggacuug

SEQ ID NO: 991814 - RNA, 19 nt, Homo sapiens
ggauaaggagaagaagaaa

SEQ ID NO: 991815 - RNA, 19 nt, Homo sapiens
gcggauaaggagaagaaga

SEQ ID NO: 991816 - RNA, 19 nt, Homo sapiens
ccgcgaagccaguggaauc

SEQ ID NO: 991817 - RNA, 19 nt, Homo sapiens
acaagauggcggauaagga

SEQ ID NO: 991818 - RNA, 19 nt, Homo sapiens
gacgauccggguaaaguuc

SEQ ID NO: 991819 - RNA, 19 nt, Homo sapiens
agacgauccggguaaaguu

SEQ ID NO: 991820 - RNA, 19 nt, Homo sapiens
uggcggauaaggagaagaa

SEQ ID NO: 991821 - RNA, 19 nt, Homo sapiens
ugacagagaugauuaguaa

SEQ ID NO: 991822 - RNA, 19 nt, Homo sapiens
ggaguuaucugaaucauug

SEQ ID NO: 991823 - RNA, 19 nt, Homo sapiens
guacuaggauuauacauug

SEQ ID NO: 991824 - RNA, 19 nt, Homo sapiens
gagcagaaccuuuaaauuc

SEQ ID NO: 991825 - RNA, 19 nt, Homo sapiens
ggacaucuguaaaucuuug

SEQ ID NO: 991826 - RNA, 19 nt, Homo sapiens
guacagaaacugauuauuc

SEQ ID NO: 991827 - RNA, 19 nt, Homo sapiens
ugaaagccaugaacgagua

SEQ ID NO: 991828 - RNA, 19 nt, Homo sapiens
gaacgaguauucagcucuu

SEQ ID NO: 991829 - RNA, 19 nt, Homo sapiens
gaauugacagagaugauua

SEQ ID NO: 991830 - RNA, 19 nt, Homo sapiens
agaaaucgaugaagaaaca

SEQ ID NO: 991831 - RNA, 19 nt, Homo sapiens
guaaaucuuugcuggaguu

SEQ ID NO: 991832 - RNA, 19 nt, Homo sapiens
gaccagaccauuaauuuga

SEQ ID NO: 991833 - RNA, 19 nt, Homo sapiens
uaaaucaggcauucaagua

SEQ ID NO: 991834 - RNA, 19 nt, Homo sapiens
uguaagaggugacaacguu

SEQ ID NO: 991835 - RNA, 19 nt, Homo sapiens
ggagaaaucgaugaagaaa

SEQ ID NO: 991836 - RNA, 19 nt, Homo sapiens
gacuaggaaugguagaauu

SEQ ID NO: 991837 - RNA, 19 nt, Homo sapiens
gaacaagugguacuaggau

SEQ ID NO: 991838 - RNA, 19 nt, Homo sapiens
ugggaacacugaaagguuu

SEQ ID NO: 991839 - RNA, 19 nt, Homo sapiens
gaaaaucacaggaggguaa

SEQ ID NO: 991840 - RNA, 19 nt, Homo sapiens
uuaguaaagucucuugaug

SEQ ID NO: 991841 - RNA, 19 nt, Homo sapiens
gagaaauuagugugcuaua

SEQ ID NO: 991842 - RNA, 19 nt, Homo sapiens
gguacuaggauuauacauu

SEQ ID NO: 991843 - RNA, 19 nt, Homo sapiens
acucuaaguuuguaucgaa

SEQ ID NO: 991844 - RNA, 19 nt, Homo sapiens
acaagugguacuaggauua

SEQ ID NO: 991845 - RNA, 19 nt, Homo sapiens
cacaggaggguaaaucuuu

SEQ ID NO: 991846 - RNA, 19 nt, Homo sapiens
ugagagguguggguaggua

SEQ ID NO: 991847 - RNA, 19 nt, Homo sapiens
cuacauacuuggacaucug

SEQ ID NO: 991848 - RNA, 19 nt, Homo sapiens
guaacaguaauacaggaua

SEQ ID NO: 991849 - RNA, 19 nt, Homo sapiens
uaaguuugguagcuugguu

SEQ ID NO: 991850 - RNA, 19 nt, Homo sapiens
ccagaccauuaauuugauu

SEQ ID NO: 991851 - RNA, 19 nt, Homo sapiens
gguuagguaugaaaguaau

SEQ ID NO: 991852 - RNA, 19 nt, Homo sapiens
gcauucaaguaacaguaau

SEQ ID NO: 991853 - RNA, 19 nt, Homo sapiens
gagaaugauugugggaaca

SEQ ID NO: 991854 - RNA, 19 nt, Homo sapiens
gaacuguugccguuauuac

SEQ ID NO: 991855 - RNA, 19 nt, Homo sapiens
cuauauaaaucaggcauuc

SEQ ID NO: 991856 - RNA, 19 nt, Homo sapiens
gauuuugacuccuuauuga

SEQ ID NO: 991857 - RNA, 19 nt, Homo sapiens
ucagaugggagaaugauug

SEQ ID NO: 991858 - RNA, 19 nt, Homo sapiens
aaucuuugcuggaguuauc

SEQ ID NO: 991859 - RNA, 19 nt, Homo sapiens
ccaauugguuagguaugaa

SEQ ID NO: 991860 - RNA, 19 nt, Homo sapiens
aaaucaggcauucaaguaa

SEQ ID NO: 991861 - RNA, 19 nt, Homo sapiens
caacguugcagucauugga

SEQ ID NO: 991862 - RNA, 19 nt, Homo sapiens
ggaugaaagccaugaacga

SEQ ID NO: 991863 - RNA, 19 nt, Homo sapiens
uccauguagucuucaauuu

SEQ ID NO: 991864 - RNA, 19 nt, Homo sapiens
cugaaucauuggcauuuau

SEQ ID NO: 991865 - RNA, 19 nt, Homo sapiens
ucugaaucauuggcauuua

SEQ ID NO: 991866 - RNA, 19 nt, Homo sapiens
acaggaggguaaaucuuug

SEQ ID NO: 991867 - RNA, 19 nt, Homo sapiens
aagagaaauuagugugcua

SEQ ID NO: 991868 - RNA, 19 nt, Homo sapiens
cgagcagaaccuuuaaauu

SEQ ID NO: 991869 - RNA, 19 nt, Homo sapiens
uuggagaaaucgaugaaga

SEQ ID NO: 991870 - RNA, 19 nt, Homo sapiens
cccaauugguuagguauga

SEQ ID NO: 991871 - RNA, 19 nt, Homo sapiens
gaugauuaguaaagucucu

SEQ ID NO: 991872 - RNA, 19 nt, Homo sapiens
ggcauucaaguaacaguaa

SEQ ID NO: 991873 - RNA, 19 nt, Homo sapiens
uauucgagcagaaccuuua

SEQ ID NO: 991874 - RNA, 19 nt, Homo sapiens
cagagaugauuaguaaagu

SEQ ID NO: 991875 - RNA, 19 nt, Homo sapiens
aaauguguuugcuugagaa

SEQ ID NO: 991876 - RNA, 19 nt, Homo sapiens
guaguuugcuagugcuucu

SEQ ID NO: 991877 - RNA, 19 nt, Homo sapiens
ucaaguaacaguaauacag

SEQ ID NO: 991878 - RNA, 19 nt, Homo sapiens
gguagaacaagugguacua

SEQ ID NO: 991879 - RNA, 19 nt, Homo sapiens
uugguuagguaugaaagua

SEQ ID NO: 991880 - RNA, 19 nt, Homo sapiens
agaaugacuaggaauggua

SEQ ID NO: 991881 - RNA, 19 nt, Homo sapiens
cuaacaagguuuugauaga

SEQ ID NO: 991882 - RNA, 19 nt, Homo sapiens
aggaugauauauggaguuu

SEQ ID NO: 991883 - RNA, 19 nt, Homo sapiens
ugaccagaccauuaauuug

SEQ ID NO: 991884 - RNA, 19 nt, Homo sapiens
ugucggcaccgcugcguua

SEQ ID NO: 991885 - RNA, 19 nt, Homo sapiens
uuggacaucuguaaaucuu

SEQ ID NO: 991886 - RNA, 19 nt, Homo sapiens
cagcaugacguccgcuuug

SEQ ID NO: 991887 - RNA, 19 nt, Homo sapiens
gagaugauuaguaaagucu

SEQ ID NO: 991888 - RNA, 19 nt, Homo sapiens
caagugguacuaggauuau

SEQ ID NO: 991889 - RNA, 19 nt, Homo sapiens
cuugaugcccaauugguua

SEQ ID NO: 991890 - RNA, 19 nt, Homo sapiens
cuacaucaaccgaacuguu

SEQ ID NO: 991891 - RNA, 19 nt, Homo sapiens
acagagaugauuaguaaag

SEQ ID NO: 991892 - RNA, 19 nt, Homo sapiens
gaggaugauauauggaguu

SEQ ID NO: 991893 - RNA, 19 nt, Homo sapiens
ccgaacuguugccguuauu

SEQ ID NO: 991894 - RNA, 19 nt, Homo sapiens
uuaagaaugacuaggaaug

SEQ ID NO: 991895 - RNA, 19 nt, Homo sapiens
gcccaaaauucuaacuuga

SEQ ID NO: 991896 - RNA, 19 nt, Homo sapiens
gaaacuaguggaaaagaga

SEQ ID NO: 991897 - RNA, 19 nt, Homo sapiens
gaaagccaugaacgaguau

SEQ ID NO: 991898 - RNA, 19 nt, Homo sapiens
cgaacuguugccguuauua

SEQ ID NO: 991899 - RNA, 19 nt, Homo sapiens
uugaccagaccauuaauuu

SEQ ID NO: 991900 - RNA, 19 nt, Homo sapiens
uauggaaacuaguggaaaa

SEQ ID NO: 991901 - RNA, 19 nt, Homo sapiens
ugacguccgcuuuggagaa

SEQ ID NO: 991902 - RNA, 19 nt, Homo sapiens
agaauugacagagaugauu

SEQ ID NO: 991903 - RNA, 19 nt, Homo sapiens
gagagguguggguagguaa

SEQ ID NO: 991904 - RNA, 19 nt, Homo sapiens
uugauuccauguagucuuc

SEQ ID NO: 991905 - RNA, 19 nt, Homo sapiens
agagaugauuaguaaaguc

SEQ ID NO: 991906 - RNA, 19 nt, Homo sapiens
cguccgcuuuggagaacua

SEQ ID NO: 991907 - RNA, 19 nt, Homo sapiens
gcuagugcuucuaaaaguu

SEQ ID NO: 991908 - RNA, 19 nt, Homo sapiens
uuucuuucccugauguuua

SEQ ID NO: 991909 - RNA, 19 nt, Homo sapiens
uuugguagcuugguuucuu

SEQ ID NO: 991910 - RNA, 19 nt, Homo sapiens
uggagaaaucgaugaagaa

SEQ ID NO: 991911 - RNA, 19 nt, Homo sapiens
caauugguuagguaugaaa

SEQ ID NO: 991912 - RNA, 19 nt, Homo sapiens
cauuggcauuuauccgauu

SEQ ID NO: 991913 - RNA, 19 nt, Homo sapiens
gugggaacacugaaagguu

SEQ ID NO: 991914 - RNA, 19 nt, Homo sapiens
ucacaggaggguaaaucuu

SEQ ID NO: 991915 - RNA, 19 nt, Homo sapiens
guaauacaggauauaugug

SEQ ID NO: 991916 - RNA, 19 nt, Homo sapiens
gaacuacaucaaccgaacu

SEQ ID NO: 991917 - RNA, 19 nt, Homo sapiens
cauacuuggacaucuguaa

SEQ ID NO: 991918 - RNA, 19 nt, Homo sapiens
gaaccuuuaaauucuguag

SEQ ID NO: 991919 - RNA, 19 nt, Homo sapiens
uaagaaugacuaggaaugg

SEQ ID NO: 991920 - RNA, 19 nt, Homo sapiens
gauugugggaacacugaaa

SEQ ID NO: 991921 - RNA, 19 nt, Homo sapiens
guaggaagaucauguauua

SEQ ID NO: 991922 - RNA, 19 nt, Homo sapiens
ggacagaaguuaccacuga

SEQ ID NO: 991923 - RNA, 19 nt, Homo sapiens
gcaaacagaucaacaucaa

SEQ ID NO: 991924 - RNA, 19 nt, Homo sapiens
gaaagcugguguacugaua

SEQ ID NO: 991925 - RNA, 19 nt, Homo sapiens
gaagacaaguuucaaagga

SEQ ID NO: 991926 - RNA, 19 nt, Homo sapiens
gaagaaaucacuacuaugu

SEQ ID NO: 991927 - RNA, 19 nt, Homo sapiens
gaagcaagauucuguaaca

SEQ ID NO: 991928 - RNA, 19 nt, Homo sapiens
gcaaacccuucuaaugaua

SEQ ID NO: 991929 - RNA, 19 nt, Homo sapiens
gcaaaccagugaauuuauu

SEQ ID NO: 991930 - RNA, 19 nt, Homo sapiens
gcagugaccuuaaacuuca

SEQ ID NO: 991931 - RNA, 19 nt, Homo sapiens
caacaucaauaaucccuuu

SEQ ID NO: 991932 - RNA, 19 nt, Homo sapiens
gaagaacauuuaugacuca

SEQ ID NO: 991933 - RNA, 19 nt, Homo sapiens
aaggaugacucuauucuua

SEQ ID NO: 991934 - RNA, 19 nt, Homo sapiens
gaaaccgccucaugugauu

SEQ ID NO: 991935 - RNA, 19 nt, Homo sapiens
cagcugaaauuccuaauau

SEQ ID NO: 991936 - RNA, 19 nt, Homo sapiens
ggaagaucauguauuauuc

SEQ ID NO: 991937 - RNA, 19 nt, Homo sapiens
gaauggaugcucuuccuua

SEQ ID NO: 991938 - RNA, 19 nt, Homo sapiens
gauggcuucuuucugauua

SEQ ID NO: 991939 - RNA, 19 nt, Homo sapiens
gaagauaggcacuuaaugg

SEQ ID NO: 991940 - RNA, 19 nt, Homo sapiens
ggagaagacuguguaagug

SEQ ID NO: 991941 - RNA, 19 nt, Homo sapiens
uaacaacugugauauugga

SEQ ID NO: 991942 - RNA, 19 nt, Homo sapiens
ucaagagcauggaucauuu

SEQ ID NO: 991943 - RNA, 19 nt, Homo sapiens
acaagaagauaggcacuua

SEQ ID NO: 991944 - RNA, 19 nt, Homo sapiens
gaaguaggaagaucaugua

SEQ ID NO: 991945 - RNA, 19 nt, Homo sapiens
guuaccagcugcagaaauu

SEQ ID NO: 991946 - RNA, 19 nt, Homo sapiens
ggacauauuuggagaagac

SEQ ID NO: 991947 - RNA, 19 nt, Homo sapiens
gaaaaugucuguugauuac

SEQ ID NO: 991948 - RNA, 19 nt, Homo sapiens
auagauggcuucuuucuga

SEQ ID NO: 991949 - RNA, 19 nt, Homo sapiens
ggagcuggcugcacagaga

SEQ ID NO: 991950 - RNA, 19 nt, Homo sapiens
agaaugaaauggccagauu

SEQ ID NO: 991951 - RNA, 19 nt, Homo sapiens
cagaagcagugaccuuaaa

SEQ ID NO: 991952 - RNA, 19 nt, Homo sapiens
gauccacccuggccuagaa

SEQ ID NO: 991953 - RNA, 19 nt, Homo sapiens
cagcaaaccagugaauuua

SEQ ID NO: 991954 - RNA, 19 nt, Homo sapiens
caucaugucugaaccugaa

SEQ ID NO: 991955 - RNA, 19 nt, Homo sapiens
ggacccauauccaugagaa

SEQ ID NO: 991956 - RNA, 19 nt, Homo sapiens
ugaaauggccagauugaaa

SEQ ID NO: 991957 - RNA, 19 nt, Homo sapiens
cgagacagauuuggaagaa

SEQ ID NO: 991958 - RNA, 19 nt, Homo sapiens
cuugcgaccuguccaauua

SEQ ID NO: 991959 - RNA, 19 nt, Homo sapiens
uaaaugccaugaaugacaa

SEQ ID NO: 991960 - RNA, 19 nt, Homo sapiens
uggcuuauccagagaauua

SEQ ID NO: 991961 - RNA, 19 nt, Homo sapiens
uggcaaacccuucuaauga

SEQ ID NO: 991962 - RNA, 19 nt, Homo sapiens
gaaauugacaggugaugug

SEQ ID NO: 991963 - RNA, 19 nt, Homo sapiens
caggugauguggaagaauu

SEQ ID NO: 991964 - RNA, 19 nt, Homo sapiens
cugaagaaaucacuacuau

SEQ ID NO: 991965 - RNA, 19 nt, Homo sapiens
guacacuggugauuucuca

SEQ ID NO: 991966 - RNA, 19 nt, Homo sapiens
uggaugcucuuccuuauau

SEQ ID NO: 991967 - RNA, 19 nt, Homo sapiens
uguaaaggaugacucuauu

SEQ ID NO: 991968 - RNA, 19 nt, Homo sapiens
guaacacuguccacgauau

SEQ ID NO: 991969 - RNA, 19 nt, Homo sapiens
gacacggacuguagaaugu

SEQ ID NO: 991970 - RNA, 19 nt, Homo sapiens
gcaagaaguaggaagauca

SEQ ID NO: 991971 - RNA, 19 nt, Homo sapiens
guucauaauccucggaaua

SEQ ID NO: 991972 - RNA, 19 nt, Homo sapiens
gaagauaacgaugaaguuc

SEQ ID NO: 991973 - RNA, 19 nt, Homo sapiens
gaaauggccagauugaaag

SEQ ID NO: 991974 - RNA, 19 nt, Homo sapiens
ggcaaacccuucuaaugau

SEQ ID NO: 991975 - RNA, 19 nt, Homo sapiens
ccuuuaauuugcucuguua

SEQ ID NO: 991976 - RNA, 19 nt, Homo sapiens
cuacaugacauuccaauau

SEQ ID NO: 991977 - RNA, 19 nt, Homo sapiens
gcagcugaaauuccuaaua

SEQ ID NO: 991978 - RNA, 19 nt, Homo sapiens
gcagacgacaugcuguaua

SEQ ID NO: 991979 - RNA, 19 nt, Homo sapiens
agaagacuguguaagugua

SEQ ID NO: 991980 - RNA, 19 nt, Homo sapiens
gcaagagguuggagaucau

SEQ ID NO: 991981 - RNA, 19 nt, Homo sapiens
ucacauagagguucauaau

SEQ ID NO: 991982 - RNA, 19 nt, Homo sapiens
gaugaguacuggcagaauc

SEQ ID NO: 991983 - RNA, 19 nt, Homo sapiens
gaucuccuauuaauuaguc

SEQ ID NO: 991984 - RNA, 19 nt, Homo sapiens
aguaacaacugugauauug

SEQ ID NO: 991985 - RNA, 19 nt, Homo sapiens
auacuggucccuuuaauuu

SEQ ID NO: 991986 - RNA, 19 nt, Homo sapiens
ccagcaaaccagugaauuu

SEQ ID NO: 991987 - RNA, 19 nt, Homo sapiens
uagccaagguuaugggauu

SEQ ID NO: 991988 - RNA, 19 nt, Homo sapiens
gaagacuguguaaguguaa

SEQ ID NO: 991989 - RNA, 19 nt, Homo sapiens
gaagcagacccaagccauu

SEQ ID NO: 991990 - RNA, 19 nt, Homo sapiens
ucacacggauuaccagcaa

SEQ ID NO: 991991 - RNA, 19 nt, Homo sapiens
caucaauaaucccuuuguu

SEQ ID NO: 991992 - RNA, 19 nt, Homo sapiens
agaaguguauggcagugua

SEQ ID NO: 991993 - RNA, 19 nt, Homo sapiens
gcagaaucacccagaacua

SEQ ID NO: 991994 - RNA, 19 nt, Homo sapiens
gaaucaaguuuugguguua

SEQ ID NO: 991995 - RNA, 19 nt, Homo sapiens
gaagaaagcauggacaaaa

SEQ ID NO: 991996 - RNA, 19 nt, Homo sapiens
agacugugccuguauauga

SEQ ID NO: 991997 - RNA, 19 nt, Homo sapiens
gaagugaagacgaugaauc

SEQ ID NO: 991998 - RNA, 19 nt, Homo sapiens
agaaaucacuacuaugucu

SEQ ID NO: 991999 - RNA, 19 nt, Homo sapiens
gcucuuccuuauauugauu

SEQ ID NO: 992000 - RNA, 19 nt, Homo sapiens
guaaaugccaugaaugaca

SEQ ID NO: 992001 - RNA, 19 nt, Homo sapiens
gccuguauaugaacuuuga

SEQ ID NO: 992002 - RNA, 19 nt, Homo sapiens
gaugaaucccuccgagaaa

SEQ ID NO: 992003 - RNA, 19 nt, Homo sapiens
gacagaaguuaccacugaa

SEQ ID NO: 992004 - RNA, 19 nt, Homo sapiens
gcucugcccugguuucuac

SEQ ID NO: 992005 - RNA, 19 nt, Homo sapiens
ggaagaaagcauggacaaa

SEQ ID NO: 992006 - RNA, 19 nt, Homo sapiens
agacagauuuggaagaaag

SEQ ID NO: 992007 - RNA, 19 nt, Homo sapiens
gacugugccuguauaugaa

SEQ ID NO: 992008 - RNA, 19 nt, Homo sapiens
uauuggaaguucagucaaa

SEQ ID NO: 992009 - RNA, 19 nt, Homo sapiens
gauauuggaaguucaguca

SEQ ID NO: 992010 - RNA, 19 nt, Homo sapiens
caacugugauauuggaagu

SEQ ID NO: 992011 - RNA, 19 nt, Homo sapiens
ugacauuggucccaguguu

SEQ ID NO: 992012 - RNA, 19 nt, Homo sapiens
ucucagcucacacggauua

SEQ ID NO: 992013 - RNA, 19 nt, Homo sapiens
uuugaaagcugguguacug

SEQ ID NO: 992014 - RNA, 19 nt, Homo sapiens
ccagagaauuauuugaaag

SEQ ID NO: 992015 - RNA, 19 nt, Homo sapiens
gacccaagccauuccauau

SEQ ID NO: 992016 - RNA, 19 nt, Homo sapiens
ucucaggaauacuuguuaa

SEQ ID NO: 992017 - RNA, 19 nt, Homo sapiens
gaaugaaauggccagauug

SEQ ID NO: 992018 - RNA, 19 nt, Homo sapiens
cuuaauggcagcugaaauu

SEQ ID NO: 992019 - RNA, 19 nt, Homo sapiens
ggugauuucucaagacaag

SEQ ID NO: 992020 - RNA, 19 nt, Homo sapiens
ccaugcaggucacguccua

SEQ ID NO: 992021 - RNA, 19 nt, Homo sapiens
gcaggcagcugugcauguu

SEQ ID NO: 992022 - RNA, 19 nt, Homo sapiens
gagcugaaguuccacuaca

SEQ ID NO: 992023 - RNA, 19 nt, Homo sapiens
ugacgucgaugaugauaca

SEQ ID NO: 992024 - RNA, 19 nt, Homo sapiens
cauguucucucaacuaaag

SEQ ID NO: 992025 - RNA, 19 nt, Homo sapiens
auacaggugugcugaguga

SEQ ID NO: 992026 - RNA, 19 nt, Homo sapiens
gcagggccuuugauaacau

SEQ ID NO: 992027 - RNA, 19 nt, Homo sapiens
ugcauguucucucaacuaa

SEQ ID NO: 992028 - RNA, 19 nt, Homo sapiens
aacuaaaggucuugugaga

SEQ ID NO: 992029 - RNA, 19 nt, Homo sapiens
ccagcagggccuuugauaa

SEQ ID NO: 992030 - RNA, 19 nt, Homo sapiens
acacagcccuucgagacaa

SEQ ID NO: 992031 - RNA, 19 nt, Homo sapiens
ugauugccaaggagaauua

SEQ ID NO: 992032 - RNA, 19 nt, Homo sapiens
ucaacuaaaggucuuguga

SEQ ID NO: 992033 - RNA, 19 nt, Homo sapiens
ggaagcuacacaacuccua

SEQ ID NO: 992034 - RNA, 19 nt, Homo sapiens
gugcauguucucucaacua

SEQ ID NO: 992035 - RNA, 19 nt, Homo sapiens
cagcagggccuuugauaac

SEQ ID NO: 992036 - RNA, 19 nt, Homo sapiens
gguugccucuuccugaaug

SEQ ID NO: 992037 - RNA, 19 nt, Homo sapiens
acuccaaggugaaguuugu

SEQ ID NO: 992038 - RNA, 19 nt, Homo sapiens
caaggugaaguuugucaug

SEQ ID NO: 992039 - RNA, 19 nt, Homo sapiens
ccacggaggacuacaaggu

SEQ ID NO: 992040 - RNA, 19 nt, Homo sapiens
gaaguuugucaugguggua

SEQ ID NO: 992041 - RNA, 19 nt, Homo sapiens
ggacgugguggaugagaag

SEQ ID NO: 992042 - RNA, 19 nt, Homo sapiens
cuacggagaacgagcugaa

SEQ ID NO: 992043 - RNA, 19 nt, Homo sapiens
cacggaggacuacaaggua

SEQ ID NO: 992044 - RNA, 19 nt, Homo sapiens
gguagauuccuccaacaca

SEQ ID NO: 992045 - RNA, 19 nt, Homo sapiens
gcugaaguuccacuacaug

SEQ ID NO: 992046 - RNA, 19 nt, Homo sapiens
ucucucaacuaaaggucuu

SEQ ID NO: 992047 - RNA, 19 nt, Homo sapiens
ugauacaggugugcugagu

SEQ ID NO: 992048 - RNA, 19 nt, Homo sapiens
auggugacgucgaugauga

SEQ ID NO: 992049 - RNA, 19 nt, Homo sapiens
ucgcggugauugccaagga

SEQ ID NO: 992050 - RNA, 19 nt, Homo sapiens
acggaggacuacaagguau

SEQ ID NO: 992051 - RNA, 19 nt, Homo sapiens
cggagaacgagcugaaguu

SEQ ID NO: 992052 - RNA, 19 nt, Homo sapiens
cugguugccucuuccugaa

SEQ ID NO: 992053 - RNA, 19 nt, Homo sapiens
cggaggacuacaagguaua

SEQ ID NO: 992054 - RNA, 19 nt, Homo sapiens
ggugacgucgaugaugaua

SEQ ID NO: 992055 - RNA, 19 nt, Homo sapiens
gaaggaaacucuuacuaaa

SEQ ID NO: 992056 - RNA, 19 nt, Homo sapiens
gggcagugaugauuuauua

SEQ ID NO: 992057 - RNA, 19 nt, Homo sapiens
gaaccaauguuauucacua

SEQ ID NO: 992058 - RNA, 19 nt, Homo sapiens
gaaaugcccacuuugauua

SEQ ID NO: 992059 - RNA, 19 nt, Homo sapiens
ggaaaggaauuugugguua

SEQ ID NO: 992060 - RNA, 19 nt, Homo sapiens
ggcauaagcugaacacuuu

SEQ ID NO: 992061 - RNA, 19 nt, Homo sapiens
gguagcagcuguugaguaa

SEQ ID NO: 992062 - RNA, 19 nt, Homo sapiens
gaaacauucugugacauua

SEQ ID NO: 992063 - RNA, 19 nt, Homo sapiens
gaaaggaauuugugguuau

SEQ ID NO: 992064 - RNA, 19 nt, Homo sapiens
gaagcagucuuaagaguga

SEQ ID NO: 992065 - RNA, 19 nt, Homo sapiens
ggaaggaaacucuuacuaa

SEQ ID NO: 992066 - RNA, 19 nt, Homo sapiens
ucaaaguucucgaagcuua

SEQ ID NO: 992067 - RNA, 19 nt, Homo sapiens
caagagauccaauuuguuu

SEQ ID NO: 992068 - RNA, 19 nt, Homo sapiens
gaaagacaguguaaauagu

SEQ ID NO: 992069 - RNA, 19 nt, Homo sapiens
gaacuaauuugcuaagucu

SEQ ID NO: 992070 - RNA, 19 nt, Homo sapiens
guucagaaaugcccacuuu

SEQ ID NO: 992071 - RNA, 19 nt, Homo sapiens
gauaggaguuggaaggaaa

SEQ ID NO: 992072 - RNA, 19 nt, Homo sapiens
ucucgaagcuuauugauga

SEQ ID NO: 992073 - RNA, 19 nt, Homo sapiens
ggaaggaagugaggagaaa

SEQ ID NO: 992074 - RNA, 19 nt, Homo sapiens
caugauaccuuacuguuga

SEQ ID NO: 992075 - RNA, 19 nt, Homo sapiens
ggaagacgaugcccaagug

SEQ ID NO: 992076 - RNA, 19 nt, Homo sapiens
ggaaaucuacugaccuuaa

SEQ ID NO: 992077 - RNA, 19 nt, Homo sapiens
cauaagagcaugaagcaua

SEQ ID NO: 992078 - RNA, 19 nt, Homo sapiens
aggcagaacucaaucauuu

SEQ ID NO: 992079 - RNA, 19 nt, Homo sapiens
gcaagacugaugcuuaaua

SEQ ID NO: 992080 - RNA, 19 nt, Homo sapiens
gaaaucuacugaccuuaau

SEQ ID NO: 992081 - RNA, 19 nt, Homo sapiens
gaaaccugcuuuauauugu

SEQ ID NO: 992082 - RNA, 19 nt, Homo sapiens
gugaaaggaugaugaagaa

SEQ ID NO: 992083 - RNA, 19 nt, Homo sapiens
aaacugaccuauaacagaa

SEQ ID NO: 992084 - RNA, 19 nt, Homo sapiens
ggaaagacaguguaaauag

SEQ ID NO: 992085 - RNA, 19 nt, Homo sapiens
acaaugaucugcuuuagug

SEQ ID NO: 992086 - RNA, 19 nt, Homo sapiens
gacauuauuucgaugcuaa

SEQ ID NO: 992087 - RNA, 19 nt, Homo sapiens
ggccauguuuaaccaauua

SEQ ID NO: 992088 - RNA, 19 nt, Homo sapiens
gaaucuaacuggugagcuu

SEQ ID NO: 992089 - RNA, 19 nt, Homo sapiens
agacagauauguaccuuau

SEQ ID NO: 992090 - RNA, 19 nt, Homo sapiens
gcagaacucaaucauuuaa

SEQ ID NO: 992091 - RNA, 19 nt, Homo sapiens
caccagaacuaauuugcua

SEQ ID NO: 992092 - RNA, 19 nt, Homo sapiens
gggaauaucuuuugccuuu

SEQ ID NO: 992093 - RNA, 19 nt, Homo sapiens
ugaagcaguugauauaaug

SEQ ID NO: 992094 - RNA, 19 nt, Homo sapiens
agugaaaccugcuuuauau

SEQ ID NO: 992095 - RNA, 19 nt, Homo sapiens
cagaacauguggacaaaga

SEQ ID NO: 992096 - RNA, 19 nt, Homo sapiens
gcaagcuccugaauuuaga

SEQ ID NO: 992097 - RNA, 19 nt, Homo sapiens
ggaaacauucugugacauu

SEQ ID NO: 992098 - RNA, 19 nt, Homo sapiens
ggauguuacuuaaagagaa

SEQ ID NO: 992099 - RNA, 19 nt, Homo sapiens
aaagaggauuguaagcaua

SEQ ID NO: 992100 - RNA, 19 nt, Homo sapiens
cguaauaccauuuggauuu

SEQ ID NO: 992101 - RNA, 19 nt, Homo sapiens
aaggagaacccaugaauaa

SEQ ID NO: 992102 - RNA, 19 nt, Homo sapiens
guaauuugccaguucauuu

SEQ ID NO: 992103 - RNA, 19 nt, Homo sapiens
gaggaaagacaguguaaau

SEQ ID NO: 992104 - RNA, 19 nt, Homo sapiens
ccucuucauucucuuguua

SEQ ID NO: 992105 - RNA, 19 nt, Homo sapiens
gauacaaugaucugcuuua

SEQ ID NO: 992106 - RNA, 19 nt, Homo sapiens
gaagugaggagaaaguguu

SEQ ID NO: 992107 - RNA, 19 nt, Homo sapiens
ugaagcauaucugggaaua

SEQ ID NO: 992108 - RNA, 19 nt, Homo sapiens
gagaguuacuuuguuguau

SEQ ID NO: 992109 - RNA, 19 nt, Homo sapiens
gauauuaguuacccaagag

SEQ ID NO: 992110 - RNA, 19 nt, Homo sapiens
aagcuguaguggugaauua

SEQ ID NO: 992111 - RNA, 19 nt, Homo sapiens
ggccauguguucagaaaug

SEQ ID NO: 992112 - RNA, 19 nt, Homo sapiens
ggaauugugugugguuuua

SEQ ID NO: 992113 - RNA, 19 nt, Homo sapiens
uaacccaguucaucucuau

SEQ ID NO: 992114 - RNA, 19 nt, Homo sapiens
cugcaagacugaugcuuaa

SEQ ID NO: 992115 - RNA, 19 nt, Homo sapiens
ggauauuaguuacccaaga

SEQ ID NO: 992116 - RNA, 19 nt, Homo sapiens
ucugcaaacuugucuuuaa

SEQ ID NO: 992117 - RNA, 19 nt, Homo sapiens
aaucuuugaugcagcuuua

SEQ ID NO: 992118 - RNA, 19 nt, Homo sapiens
ggagaguuacuuuguugua

SEQ ID NO: 992119 - RNA, 19 nt, Homo sapiens
gaaccuggacuaccacuuc

SEQ ID NO: 992120 - RNA, 19 nt, Homo sapiens
augaugagaucgaauauga

SEQ ID NO: 992121 - RNA, 19 nt, Homo sapiens
gacaugaugagaucgaaua

SEQ ID NO: 992122 - RNA, 19 nt, Homo sapiens
cagauaagacagauaugua

SEQ ID NO: 992123 - RNA, 19 nt, Homo sapiens
gagaggacaauuucugauu

SEQ ID NO: 992124 - RNA, 19 nt, Homo sapiens
gguguuugaucaucugaaa

SEQ ID NO: 992125 - RNA, 19 nt, Homo sapiens
caagaaggcagaacucaau

SEQ ID NO: 992126 - RNA, 19 nt, Homo sapiens
gaauauuccggguaauuga

SEQ ID NO: 992127 - RNA, 19 nt, Homo sapiens
cccaagagauccaauuugu

SEQ ID NO: 992128 - RNA, 19 nt, Homo sapiens
ucaacaccaugaagauaaa

SEQ ID NO: 992129 - RNA, 19 nt, Homo sapiens
ggacauuauuucgaugcua

SEQ ID NO: 992130 - RNA, 19 nt, Homo sapiens
caagacugaugcuuaauac

SEQ ID NO: 992131 - RNA, 19 nt, Homo sapiens
ggaguugggugaauuaucc

SEQ ID NO: 992132 - RNA, 19 nt, Homo sapiens
gcaaacuugucuuuaaugc

SEQ ID NO: 992133 - RNA, 19 nt, Homo sapiens
caauauugcacgugaguuu

SEQ ID NO: 992134 - RNA, 19 nt, Homo sapiens
uaaggagaacccaugaaua

SEQ ID NO: 992135 - RNA, 19 nt, Homo sapiens
ggagacucaugcaucugua

SEQ ID NO: 992136 - RNA, 19 nt, Homo sapiens
gaaguucauuuucugagua

SEQ ID NO: 992137 - RNA, 19 nt, Homo sapiens
guucugaagcuuacaauug

SEQ ID NO: 992138 - RNA, 19 nt, Homo sapiens
gaaguagaaagucauugaa

SEQ ID NO: 992139 - RNA, 19 nt, Homo sapiens
gggaagaaaugcauaaaau

SEQ ID NO: 992140 - RNA, 19 nt, Homo sapiens
caccacacccggcuaauuu

SEQ ID NO: 992141 - RNA, 19 nt, Homo sapiens
gcacgugaguuucaguucu

SEQ ID NO: 992142 - RNA, 19 nt, Homo sapiens
aaaguguucuuguuuagug

SEQ ID NO: 992143 - RNA, 19 nt, Homo sapiens
aaaugaagcagucuuaaga

SEQ ID NO: 992144 - RNA, 19 nt, Homo sapiens
ucauucaucuuucaguuug

SEQ ID NO: 992145 - RNA, 19 nt, Homo sapiens
gcauacccuuauagaauug

SEQ ID NO: 992146 - RNA, 19 nt, Homo sapiens
cgcauacccuuauagaauu

SEQ ID NO: 992147 - RNA, 19 nt, Homo sapiens
gaaggacacagacugguau

SEQ ID NO: 992148 - RNA, 19 nt, Homo sapiens
aauaugauguuccuuguca

SEQ ID NO: 992149 - RNA, 19 nt, Homo sapiens
gaugagaucgaauaugaug

SEQ ID NO: 992150 - RNA, 19 nt, Homo sapiens
ugaaaccugcuuuauauug

SEQ ID NO: 992151 - RNA, 19 nt, Homo sapiens
ucagaaaugcccacuuuga

SEQ ID NO: 992152 - RNA, 19 nt, Homo sapiens
gaggguuucuguuugugaa

SEQ ID NO: 992153 - RNA, 19 nt, Homo sapiens
ccaaagugcugggauuaca

SEQ ID NO: 992154 - RNA, 19 nt, Homo sapiens
uaaacugaccuauaacaga

SEQ ID NO: 992155 - RNA, 19 nt, Homo sapiens
guaaguaucuucaaaguug

SEQ ID NO: 992156 - RNA, 19 nt, Homo sapiens
gaaaguagaacgaaucgaa

SEQ ID NO: 992157 - RNA, 19 nt, Homo sapiens
caaagagaguuaugacuau

SEQ ID NO: 992158 - RNA, 19 nt, Homo sapiens
gcuccaagcuuccuguaaa

SEQ ID NO: 992159 - RNA, 19 nt, Homo sapiens
gagaugaugugaaaguaga

SEQ ID NO: 992160 - RNA, 19 nt, Homo sapiens
gaaucuagacuuucuugua

SEQ ID NO: 992161 - RNA, 19 nt, Homo sapiens
aauaccaucuucucuguua

SEQ ID NO: 992162 - RNA, 19 nt, Homo sapiens
ccaaagagaguuaugacua

SEQ ID NO: 992163 - RNA, 19 nt, Homo sapiens
aguaauuggucacuuguua

SEQ ID NO: 992164 - RNA, 19 nt, Homo sapiens
gaggagacuucgaugagaa

SEQ ID NO: 992165 - RNA, 19 nt, Homo sapiens
ggagaaagaaucuagacuu

SEQ ID NO: 992166 - RNA, 19 nt, Homo sapiens
ucgaugagaaucugaauua

SEQ ID NO: 992167 - RNA, 19 nt, Homo sapiens
ggacacacacacaaauuug

SEQ ID NO: 992168 - RNA, 19 nt, Homo sapiens
caucuucucuguuaauaca

SEQ ID NO: 992169 - RNA, 19 nt, Homo sapiens
ccacaccggugcaacaguu

SEQ ID NO: 992170 - RNA, 19 nt, Homo sapiens
caagugaaacuacggauau

SEQ ID NO: 992171 - RNA, 19 nt, Homo sapiens
caagcuuccuguaaacuau

SEQ ID NO: 992172 - RNA, 19 nt, Homo sapiens
cuacaguggucaccuaugu

SEQ ID NO: 992173 - RNA, 19 nt, Homo sapiens
uauaaugccuuggaaacaa

SEQ ID NO: 992174 - RNA, 19 nt, Homo sapiens
ggauguugguguugguauu

SEQ ID NO: 992175 - RNA, 19 nt, Homo sapiens
cgacggugguggugacuga

SEQ ID NO: 992176 - RNA, 19 nt, Homo sapiens
ucauuuguguugauggaua

SEQ ID NO: 992177 - RNA, 19 nt, Homo sapiens
ugaauuauccagaacagaa

SEQ ID NO: 992178 - RNA, 19 nt, Homo sapiens
aauuggagaugaugugaaa

SEQ ID NO: 992179 - RNA, 19 nt, Homo sapiens
gaacgaaucgaauacaaaa

SEQ ID NO: 992180 - RNA, 19 nt, Homo sapiens
gggacacacacacaaauuu

SEQ ID NO: 992181 - RNA, 19 nt, Homo sapiens
gaauuauccagaacagaaa

SEQ ID NO: 992182 - RNA, 19 nt, Homo sapiens
gauguugguguugguauua

SEQ ID NO: 992183 - RNA, 19 nt, Homo sapiens
cacauucucugcacaggaa

SEQ ID NO: 992184 - RNA, 19 nt, Homo sapiens
guaauuggucacuuguuaa

SEQ ID NO: 992185 - RNA, 19 nt, Homo sapiens
cacaguaauuggucacuug

SEQ ID NO: 992186 - RNA, 19 nt, Homo sapiens
caggaaaccuuugcaccaa

SEQ ID NO: 992187 - RNA, 19 nt, Homo sapiens
gugaaacuacggauauaaa

SEQ ID NO: 992188 - RNA, 19 nt, Homo sapiens
uagaacgaaucgaauacaa

SEQ ID NO: 992189 - RNA, 19 nt, Homo sapiens
gcaccaaagagaguuauga

SEQ ID NO: 992190 - RNA, 19 nt, Homo sapiens
gaugagaaucugaauuauc

SEQ ID NO: 992191 - RNA, 19 nt, Homo sapiens
gacgagaugaccuuucaaa

SEQ ID NO: 992192 - RNA, 19 nt, Homo sapiens
ccaagugaaacuacggaua

SEQ ID NO: 992193 - RNA, 19 nt, Homo sapiens
aggccugucuugaugauuu

SEQ ID NO: 992194 - RNA, 19 nt, Homo sapiens
uuucucuucuccaguaaua

SEQ ID NO: 992195 - RNA, 19 nt, Homo sapiens
gagaggagacuucgaugag

SEQ ID NO: 992196 - RNA, 19 nt, Homo sapiens
ccaagcuuccuguaaacua

SEQ ID NO: 992197 - RNA, 19 nt, Homo sapiens
auaaugccuuggaaacaaa

SEQ ID NO: 992198 - RNA, 19 nt, Homo sapiens
gacucuggcuggugauguu

SEQ ID NO: 992199 - RNA, 19 nt, Homo sapiens
uggacgagaugaccuuuca

SEQ ID NO: 992200 - RNA, 19 nt, Homo sapiens
auaauaccaucuucucugu

SEQ ID NO: 992201 - RNA, 19 nt, Homo sapiens
aagugaaacuacggauaua

SEQ ID NO: 992202 - RNA, 19 nt, Homo sapiens
uggagaugaugugaaagua

SEQ ID NO: 992203 - RNA, 19 nt, Homo sapiens
gacacacacacaaauuuga

SEQ ID NO: 992204 - RNA, 19 nt, Homo sapiens
ccuuguaaguaucuucaaa

SEQ ID NO: 992205 - RNA, 19 nt, Homo sapiens
cacacaaauuugaagcauu

SEQ ID NO: 992206 - RNA, 19 nt, Homo sapiens
gcagaggcaauuugaugug

SEQ ID NO: 992207 - RNA, 19 nt, Homo sapiens
ucauuguccuguugaaauc

SEQ ID NO: 992208 - RNA, 19 nt, Homo sapiens
ggagaugaugugaaaguag

SEQ ID NO: 992209 - RNA, 19 nt, Homo sapiens
cgaugagaaucugaauuau

SEQ ID NO: 992210 - RNA, 19 nt, Homo sapiens
gugacaggauguugguguu

SEQ ID NO: 992211 - RNA, 19 nt, Homo sapiens
cuauguguaucagcuaauu

SEQ ID NO: 992212 - RNA, 19 nt, Homo sapiens
auuggucacuuguuaagaa

SEQ ID NO: 992213 - RNA, 19 nt, Homo sapiens
ccacaacacaguaauuggu

SEQ ID NO: 992214 - RNA, 19 nt, Homo sapiens
aaguagaacgaaucgaaua

SEQ ID NO: 992215 - RNA, 19 nt, Homo sapiens
uugaagcauuugagcauga

SEQ ID NO: 992216 - RNA, 19 nt, Homo sapiens
agaggagacuucgaugaga

SEQ ID NO: 992217 - RNA, 19 nt, Homo sapiens
gaggaaccaagugaaacua

SEQ ID NO: 992218 - RNA, 19 nt, Homo sapiens
acaguuugccagcuaaauu

SEQ ID NO: 992219 - RNA, 19 nt, Homo sapiens
caguauauggauucuauga

SEQ ID NO: 992220 - RNA, 19 nt, Homo sapiens
aaagagaguuaugacuauc

SEQ ID NO: 992221 - RNA, 19 nt, Homo sapiens
ugaagcauuugagcaugaa

SEQ ID NO: 992222 - RNA, 19 nt, Homo sapiens
uagugcauguggagaaaga

SEQ ID NO: 992223 - RNA, 19 nt, Homo sapiens
agaacgaaucgaauacaaa

SEQ ID NO: 992224 - RNA, 19 nt, Homo sapiens
cuucuacaguggucaccua

SEQ ID NO: 992225 - RNA, 19 nt, Homo sapiens
acacacacacaaauuugaa

SEQ ID NO: 992226 - RNA, 19 nt, Homo sapiens
cuggugauguucauauugu

SEQ ID NO: 992227 - RNA, 19 nt, Homo sapiens
ggcuggugauguucauauu

SEQ ID NO: 992228 - RNA, 19 nt, Homo sapiens
gaugugaaaguagaacgaa

SEQ ID NO: 992229 - RNA, 19 nt, Homo sapiens
acacacaaauuugaagcau

SEQ ID NO: 992230 - RNA, 19 nt, Homo sapiens
ggugauguucauauuguga

SEQ ID NO: 992231 - RNA, 19 nt, Homo sapiens
ugagaggagacuucgauga

SEQ ID NO: 992232 - RNA, 19 nt, Homo sapiens
ucucuucuccaguaauaaa

SEQ ID NO: 992233 - RNA, 19 nt, Homo sapiens
agccaggccugucuugaug

SEQ ID NO: 992234 - RNA, 19 nt, Homo sapiens
cauuuguguugauggauau

SEQ ID NO: 992235 - RNA, 19 nt, Homo sapiens
cuacauuaauccagguucu

SEQ ID NO: 992236 - RNA, 19 nt, Homo sapiens
cagaaaguugugacuguug

SEQ ID NO: 992237 - RNA, 19 nt, Homo sapiens
caacaguuugccagcuaaa

SEQ ID NO: 992238 - RNA, 19 nt, Homo sapiens
aaugaggaaccaagugaaa

SEQ ID NO: 992239 - RNA, 19 nt, Homo sapiens
ucuagacuuucuuguauac

SEQ ID NO: 992240 - RNA, 19 nt, Homo sapiens
ucagcuaauuggagaugau

SEQ ID NO: 992241 - RNA, 19 nt, Homo sapiens
gccuuggaaacaaacauua

SEQ ID NO: 992242 - RNA, 19 nt, Homo sapiens
gaaaguugugacuguugga

SEQ ID NO: 992243 - RNA, 19 nt, Homo sapiens
agacuucgaugagaaucug

SEQ ID NO: 992244 - RNA, 19 nt, Homo sapiens
aguuaugacuaucucaaga

SEQ ID NO: 992245 - RNA, 19 nt, Homo sapiens
gcuaauuggagaugaugug

SEQ ID NO: 992246 - RNA, 19 nt, Homo sapiens
cauauaaugccuuggaaac

SEQ ID NO: 992247 - RNA, 19 nt, Homo sapiens
guccacaacacaguaauug

SEQ ID NO: 992248 - RNA, 19 nt, Homo sapiens
gcuggugauguucauauug

SEQ ID NO: 992249 - RNA, 19 nt, Homo sapiens
augagaaucugaauuaucc

SEQ ID NO: 992250 - RNA, 19 nt, Homo sapiens
acacaguaauuggucacuu

SEQ ID NO: 992251 - RNA, 19 nt, Homo sapiens
ccaggccugucuugaugau

SEQ ID NO: 992252 - RNA, 19 nt, Homo sapiens
uaaagccaggccugucuug

SEQ ID NO: 992253 - RNA, 19 nt, Homo sapiens
guagaacgaaucgaauaca

SEQ ID NO: 992254 - RNA, 19 nt, Homo sapiens
auauuaaaguggacgagau

SEQ ID NO: 992255 - RNA, 19 nt, Homo sapiens
guaaguaucuucaaaguug

SEQ ID NO: 992256 - RNA, 19 nt, Homo sapiens
gaaaguagaacgaaucgaa

SEQ ID NO: 992257 - RNA, 19 nt, Homo sapiens
caaagagaguuaugacuau

SEQ ID NO: 992258 - RNA, 19 nt, Homo sapiens
gcuccaagcuuccuguaaa

SEQ ID NO: 992259 - RNA, 19 nt, Homo sapiens
gagaugaugugaaaguaga

SEQ ID NO: 992260 - RNA, 19 nt, Homo sapiens
gaaucuagacuuucuugua

SEQ ID NO: 992261 - RNA, 19 nt, Homo sapiens
aauaccaucuucucuguua

SEQ ID NO: 992262 - RNA, 19 nt, Homo sapiens
ccaaagagaguuaugacua

SEQ ID NO: 992263 - RNA, 19 nt, Homo sapiens
aguaauuggucacuuguua

SEQ ID NO: 992264 - RNA, 19 nt, Homo sapiens
gaggagacuucgaugagaa

SEQ ID NO: 992265 - RNA, 19 nt, Homo sapiens
ggagaaagaaucuagacuu

SEQ ID NO: 992266 - RNA, 19 nt, Homo sapiens
ucgaugagaaucugaauua

SEQ ID NO: 992267 - RNA, 19 nt, Homo sapiens
ggacacacacacaaauuug

SEQ ID NO: 992268 - RNA, 19 nt, Homo sapiens
caucuucucuguuaauaca

SEQ ID NO: 992269 - RNA, 19 nt, Homo sapiens
ccacaccggugcaacaguu

SEQ ID NO: 992270 - RNA, 19 nt, Homo sapiens
caagugaaacuacggauau

SEQ ID NO: 992271 - RNA, 19 nt, Homo sapiens
caagcuuccuguaaacuau

SEQ ID NO: 992272 - RNA, 19 nt, Homo sapiens
cuacaguggucaccuaugu

SEQ ID NO: 992273 - RNA, 19 nt, Homo sapiens
uauaaugccuuggaaacaa

SEQ ID NO: 992274 - RNA, 19 nt, Homo sapiens
cgacggugguggugacuga

SEQ ID NO: 992275 - RNA, 19 nt, Homo sapiens
ucauuuguguugauggaua

SEQ ID NO: 992276 - RNA, 19 nt, Homo sapiens
ugaauuauccagaacagaa

SEQ ID NO: 992277 - RNA, 19 nt, Homo sapiens
gcacagauugguguuggua

SEQ ID NO: 992278 - RNA, 19 nt, Homo sapiens
aauuggagaugaugugaaa

SEQ ID NO: 992279 - RNA, 19 nt, Homo sapiens
gaacgaaucgaauacaaaa

SEQ ID NO: 992280 - RNA, 19 nt, Homo sapiens
gggacacacacacaaauuu

SEQ ID NO: 992281 - RNA, 19 nt, Homo sapiens
gaauuauccagaacagaaa

SEQ ID NO: 992282 - RNA, 19 nt, Homo sapiens
cacauucucugcacaggaa

SEQ ID NO: 992283 - RNA, 19 nt, Homo sapiens
guaauuggucacuuguuaa

SEQ ID NO: 992284 - RNA, 19 nt, Homo sapiens
cacaguaauuggucacuug

SEQ ID NO: 992285 - RNA, 19 nt, Homo sapiens
caggaaaccuuugcaccaa

SEQ ID NO: 992286 - RNA, 19 nt, Homo sapiens
gugaaacuacggauauaaa

SEQ ID NO: 992287 - RNA, 19 nt, Homo sapiens
uagaacgaaucgaauacaa

SEQ ID NO: 992288 - RNA, 19 nt, Homo sapiens
gcaccaaagagaguuauga

SEQ ID NO: 992289 - RNA, 19 nt, Homo sapiens
acagauugguguugguauu

SEQ ID NO: 992290 - RNA, 19 nt, Homo sapiens
caggauggcugggcacaga

SEQ ID NO: 992291 - RNA, 19 nt, Homo sapiens
gaugagaaucugaauuauc

SEQ ID NO: 992292 - RNA, 19 nt, Homo sapiens
gacgagaugaccuuucaaa

SEQ ID NO: 992293 - RNA, 19 nt, Homo sapiens
ccaagugaaacuacggaua

SEQ ID NO: 992294 - RNA, 19 nt, Homo sapiens
aggccugucuugaugauuu

SEQ ID NO: 992295 - RNA, 19 nt, Homo sapiens
uuucucuucuccaguaaua

SEQ ID NO: 992296 - RNA, 19 nt, Homo sapiens
cagauugguguugguauua

SEQ ID NO: 992297 - RNA, 19 nt, Homo sapiens
gagaggagacuucgaugag

SEQ ID NO: 992298 - RNA, 19 nt, Homo sapiens
ccaagcuuccuguaaacua

SEQ ID NO: 992299 - RNA, 19 nt, Homo sapiens
auaaugccuuggaaacaaa

SEQ ID NO: 992300 - RNA, 19 nt, Homo sapiens
gacucuggcuggugauguu

SEQ ID NO: 992301 - RNA, 19 nt, Homo sapiens
uggacgagaugaccuuuca

SEQ ID NO: 992302 - RNA, 19 nt, Homo sapiens
auaauaccaucuucucugu

SEQ ID NO: 992303 - RNA, 19 nt, Homo sapiens
aagugaaacuacggauaua

SEQ ID NO: 992304 - RNA, 19 nt, Homo sapiens
uggagaugaugugaaagua

SEQ ID NO: 992305 - RNA, 19 nt, Homo sapiens
gacacacacacaaauuuga

SEQ ID NO: 992306 - RNA, 19 nt, Homo sapiens
ccuuguaaguaucuucaaa

SEQ ID NO: 992307 - RNA, 19 nt, Homo sapiens
cacacaaauuugaagcauu

SEQ ID NO: 992308 - RNA, 19 nt, Homo sapiens
gcagaggcaauuugaugug

SEQ ID NO: 992309 - RNA, 19 nt, Homo sapiens
ucauuguccuguugaaauc

SEQ ID NO: 992310 - RNA, 19 nt, Homo sapiens
ggagaugaugugaaaguag

SEQ ID NO: 992311 - RNA, 19 nt, Homo sapiens
cgaugagaaucugaauuau

SEQ ID NO: 992312 - RNA, 19 nt, Homo sapiens
cuauguguaucagcuaauu

SEQ ID NO: 992313 - RNA, 19 nt, Homo sapiens
auuggucacuuguuaagaa

SEQ ID NO: 992314 - RNA, 19 nt, Homo sapiens
ccacaacacaguaauuggu

SEQ ID NO: 992315 - RNA, 19 nt, Homo sapiens
aaguagaacgaaucgaaua

SEQ ID NO: 992316 - RNA, 19 nt, Homo sapiens
uugaagcauuugagcauga

SEQ ID NO: 992317 - RNA, 19 nt, Homo sapiens
agaggagacuucgaugaga

SEQ ID NO: 992318 - RNA, 19 nt, Homo sapiens
gaggaaccaagugaaacua

SEQ ID NO: 992319 - RNA, 19 nt, Homo sapiens
caguauauggauucuauga

SEQ ID NO: 992320 - RNA, 19 nt, Homo sapiens
acaguuugccagcuaaauu

SEQ ID NO: 992321 - RNA, 19 nt, Homo sapiens
aaagagaguuaugacuauc

SEQ ID NO: 992322 - RNA, 19 nt, Homo sapiens
ugaagcauuugagcaugaa

SEQ ID NO: 992323 - RNA, 19 nt, Homo sapiens
uagugcauguggagaaaga

SEQ ID NO: 992324 - RNA, 19 nt, Homo sapiens
agaacgaaucgaauacaaa

SEQ ID NO: 992325 - RNA, 19 nt, Homo sapiens
cuucuacaguggucaccua

SEQ ID NO: 992326 - RNA, 19 nt, Homo sapiens
acacacacacaaauuugaa

SEQ ID NO: 992327 - RNA, 19 nt, Homo sapiens
cuggugauguucauauugu

SEQ ID NO: 992328 - RNA, 19 nt, Homo sapiens
ggcuggugauguucauauu

SEQ ID NO: 992329 - RNA, 19 nt, Homo sapiens
gaugugaaaguagaacgaa

SEQ ID NO: 992330 - RNA, 19 nt, Homo sapiens
acacacaaauuugaagcau

SEQ ID NO: 992331 - RNA, 19 nt, Homo sapiens
ugagaggagacuucgauga

SEQ ID NO: 992332 - RNA, 19 nt, Homo sapiens
ggugauguucauauuguga

SEQ ID NO: 992333 - RNA, 19 nt, Homo sapiens
ucucuucuccaguaauaaa

SEQ ID NO: 992334 - RNA, 19 nt, Homo sapiens
agccaggccugucuugaug

SEQ ID NO: 992335 - RNA, 19 nt, Homo sapiens
cauuuguguugauggauau

SEQ ID NO: 992336 - RNA, 19 nt, Homo sapiens
cuacauuaauccagguucu

SEQ ID NO: 992337 - RNA, 19 nt, Homo sapiens
cagaaaguugugacuguug

SEQ ID NO: 992338 - RNA, 19 nt, Homo sapiens
aaugaggaaccaagugaaa

SEQ ID NO: 992339 - RNA, 19 nt, Homo sapiens
ucuagacuuucuuguauac

SEQ ID NO: 992340 - RNA, 19 nt, Homo sapiens
caacaguuugccagcuaaa

SEQ ID NO: 992341 - RNA, 19 nt, Homo sapiens
ucagcuaauuggagaugau

SEQ ID NO: 992342 - RNA, 19 nt, Homo sapiens
gccuuggaaacaaacauua

SEQ ID NO: 992343 - RNA, 19 nt, Homo sapiens
gaaaguugugacuguugga

SEQ ID NO: 992344 - RNA, 19 nt, Homo sapiens
agacuucgaugagaaucug

SEQ ID NO: 992345 - RNA, 19 nt, Homo sapiens
aguuaugacuaucucaaga

SEQ ID NO: 992346 - RNA, 19 nt, Homo sapiens
ggauggcugggcacagauu

SEQ ID NO: 992347 - RNA, 19 nt, Homo sapiens
gcuaauuggagaugaugug

SEQ ID NO: 992348 - RNA, 19 nt, Homo sapiens
cauauaaugccuuggaaac

SEQ ID NO: 992349 - RNA, 19 nt, Homo sapiens
guccacaacacaguaauug

SEQ ID NO: 992350 - RNA, 19 nt, Homo sapiens
gcuggugauguucauauug

SEQ ID NO: 992351 - RNA, 19 nt, Homo sapiens
augagaaucugaauuaucc

SEQ ID NO: 992352 - RNA, 19 nt, Homo sapiens
acacaguaauuggucacuu

SEQ ID NO: 992353 - RNA, 19 nt, Homo sapiens
ccaggccugucuugaugau

SEQ ID NO: 992354 - RNA, 19 nt, Homo sapiens
uaaagccaggccugucuug

SEQ ID NO: 992355 - RNA, 19 nt, Homo sapiens
gaaaagagcuugaagaaau

SEQ ID NO: 992356 - RNA, 19 nt, Homo sapiens
gaagaugacucaguauuug

SEQ ID NO: 992357 - RNA, 19 nt, Homo sapiens
ggaagaugacucaguauuu

SEQ ID NO: 992358 - RNA, 19 nt, Homo sapiens
gaggauaucuuggucagaa

SEQ ID NO: 992359 - RNA, 19 nt, Homo sapiens
gugggaagaugacucagua

SEQ ID NO: 992360 - RNA, 19 nt, Homo sapiens
cagaguaaguucaauuuca

SEQ ID NO: 992361 - RNA, 19 nt, Homo sapiens
ggagagagccaaucaccuu

SEQ ID NO: 992362 - RNA, 19 nt, Homo sapiens
gaccagaccagacgaguga

SEQ ID NO: 992363 - RNA, 19 nt, Homo sapiens
ggaccuaauuauaaagauc

SEQ ID NO: 992364 - RNA, 19 nt, Homo sapiens
uaacaaacaccuccaugug

SEQ ID NO: 992365 - RNA, 19 nt, Homo sapiens
ccaaguacccgcugccauu

SEQ ID NO: 992366 - RNA, 19 nt, Homo sapiens
gagagagccaaucaccuua

SEQ ID NO: 992367 - RNA, 19 nt, Homo sapiens
guaacuauguccagcucuu

SEQ ID NO: 992368 - RNA, 19 nt, Homo sapiens
guacagcucaggcuucguu

SEQ ID NO: 992369 - RNA, 19 nt, Homo sapiens
ggacucacccagaccaguu

SEQ ID NO: 992370 - RNA, 19 nt, Homo sapiens
aaaagugccuugccaugua

SEQ ID NO: 992371 - RNA, 19 nt, Homo sapiens
gggaagaugacucaguauu

SEQ ID NO: 992372 - RNA, 19 nt, Homo sapiens
aaacucaaguacaaagcaa

SEQ ID NO: 992373 - RNA, 19 nt, Homo sapiens
uggagaagcuggguuauac

SEQ ID NO: 992374 - RNA, 19 nt, Homo sapiens
gagagccaaucaccuuaca

SEQ ID NO: 992375 - RNA, 19 nt, Homo sapiens
gacagaggaggauaucuug

SEQ ID NO: 992376 - RNA, 19 nt, Homo sapiens
gagcuccauuucaguaucu

SEQ ID NO: 992377 - RNA, 19 nt, Homo sapiens
cacacugguucuccucuuu

SEQ ID NO: 992378 - RNA, 19 nt, Homo sapiens
ugccauugauugagaaaga

SEQ ID NO: 992379 - RNA, 19 nt, Homo sapiens
ucacugugcucguguuggu

SEQ ID NO: 992380 - RNA, 19 nt, Homo sapiens
agacagaggaggauaucuu

SEQ ID NO: 992381 - RNA, 19 nt, Homo sapiens
ccgcugccauugauugaga

SEQ ID NO: 992382 - RNA, 19 nt, Homo sapiens
gcagcucauucgccacauc

SEQ ID NO: 992383 - RNA, 19 nt, Homo sapiens
cccauuggcuggaaguaca

SEQ ID NO: 992384 - RNA, 19 nt, Homo sapiens
guauuuggagaacaugaaa

SEQ ID NO: 992385 - RNA, 19 nt, Homo sapiens
gaugaugacagaggcuuug

SEQ ID NO: 992386 - RNA, 19 nt, Homo sapiens
gguuauacccaggacauga

SEQ ID NO: 992387 - RNA, 19 nt, Homo sapiens
cagaaaagagcuugaagaa

SEQ ID NO: 992388 - RNA, 19 nt, Homo sapiens
gccgaucaccugggaauga

SEQ ID NO: 992389 - RNA, 19 nt, Homo sapiens
ccagacgagugagccuaaa

SEQ ID NO: 992390 - RNA, 19 nt, Homo sapiens
ccacggaaucuuggaauca

SEQ ID NO: 992391 - RNA, 19 nt, Homo sapiens
cuaacaaacaccuccaugu

SEQ ID NO: 992392 - RNA, 19 nt, Homo sapiens
ugacucaguauuuggagaa

SEQ ID NO: 992393 - RNA, 19 nt, Homo sapiens
guaucuuucuccgugguuu

SEQ ID NO: 992394 - RNA, 19 nt, Homo sapiens
ugucuuagggcuuccugua

SEQ ID NO: 992395 - RNA, 19 nt, Homo sapiens
gagaaaaucagccacaaca

SEQ ID NO: 992396 - RNA, 19 nt, Homo sapiens
caaguacccgcugccauug

SEQ ID NO: 992397 - RNA, 19 nt, Homo sapiens
cugccgacaugaucaagga

SEQ ID NO: 992398 - RNA, 19 nt, Homo sapiens
acacacugguucuccucuu

SEQ ID NO: 992399 - RNA, 19 nt, Homo sapiens
aaagugccuugccauguac

SEQ ID NO: 992400 - RNA, 19 nt, Homo sapiens
ucaauuucaccacgguaaa

SEQ ID NO: 992401 - RNA, 19 nt, Homo sapiens
guggaggagaggcaacuuu

SEQ ID NO: 992402 - RNA, 19 nt, Homo sapiens
cuuuguggaccuaauuaua

SEQ ID NO: 992403 - RNA, 19 nt, Homo sapiens
cagaggcuuuguggaccua

SEQ ID NO: 992404 - RNA, 19 nt, Homo sapiens
agaguaaguucaauuucac

SEQ ID NO: 992405 - RNA, 19 nt, Homo sapiens
cuucguuacugccgacaug

SEQ ID NO: 992406 - RNA, 19 nt, Homo sapiens
gccacggaaucuuggaauc

SEQ ID NO: 992407 - RNA, 19 nt, Homo sapiens
cuccagugaugaugacaga

SEQ ID NO: 992408 - RNA, 19 nt, Homo sapiens
uaacuauguccagcucuug

SEQ ID NO: 992409 - RNA, 19 nt, Homo sapiens
uaaacucaaguacaaagca

SEQ ID NO: 992410 - RNA, 19 nt, Homo sapiens
ggcuuuguggaccuaauua

SEQ ID NO: 992411 - RNA, 19 nt, Homo sapiens
gcaugucccuuuucaucug

SEQ ID NO: 992412 - RNA, 19 nt, Homo sapiens
cuggagaagcuggguuaua

SEQ ID NO: 992413 - RNA, 19 nt, Homo sapiens
cagaggaggauaucuuggu

SEQ ID NO: 992414 - RNA, 19 nt, Homo sapiens
aggcaucacacccauguug

SEQ ID NO: 992415 - RNA, 19 nt, Homo sapiens
caugggccacggaaucuug

SEQ ID NO: 992416 - RNA, 19 nt, Homo sapiens
guggaccuaauuauaaaga

SEQ ID NO: 992417 - RNA, 19 nt, Homo sapiens
gaggcuuuguggaccuaau

SEQ ID NO: 992418 - RNA, 19 nt, Homo sapiens
agaacuagcuugcacauuu

SEQ ID NO: 992419 - RNA, 19 nt, Homo sapiens
ugaucaagcccuauaauua

SEQ ID NO: 992420 - RNA, 19 nt, Homo sapiens
gaagauaauguacuacuga

SEQ ID NO: 992421 - RNA, 19 nt, Homo sapiens
gguggaagauaauguacua

SEQ ID NO: 992422 - RNA, 19 nt, Homo sapiens
gguguugucuggucaguaa

SEQ ID NO: 992423 - RNA, 19 nt, Homo sapiens
ggugaugugugcugucuaa

SEQ ID NO: 992424 - RNA, 19 nt, Homo sapiens
gaagauguaauguagcuuu

SEQ ID NO: 992425 - RNA, 19 nt, Homo sapiens
caacuguguucuaaagauu

SEQ ID NO: 992426 - RNA, 19 nt, Homo sapiens
gagaaugaguuugugacua

SEQ ID NO: 992427 - RNA, 19 nt, Homo sapiens
aaaggacagucauacauuu

SEQ ID NO: 992428 - RNA, 19 nt, Homo sapiens
cagcucagaucaugucaaa

SEQ ID NO: 992429 - RNA, 19 nt, Homo sapiens
ggccagaguggaagaauua

SEQ ID NO: 992430 - RNA, 19 nt, Homo sapiens
ccaguuugcuuuccaauca

SEQ ID NO: 992431 - RNA, 19 nt, Homo sapiens
gaucaagcccuauaauuag

SEQ ID NO: 992432 - RNA, 19 nt, Homo sapiens
caaauuugaugacacuuuc

SEQ ID NO: 992433 - RNA, 19 nt, Homo sapiens
gcaacuguguucuaaagau

SEQ ID NO: 992434 - RNA, 19 nt, Homo sapiens
gaacuacuaggacgaagaa

SEQ ID NO: 992435 - RNA, 19 nt, Homo sapiens
cagaauugaugcagaguga

SEQ ID NO: 992436 - RNA, 19 nt, Homo sapiens
ggacgaagaauauuguuuc

SEQ ID NO: 992437 - RNA, 19 nt, Homo sapiens
gaauuuagugcagcuguua

SEQ ID NO: 992438 - RNA, 19 nt, Homo sapiens
gauaauguacuacugaaga

SEQ ID NO: 992439 - RNA, 19 nt, Homo sapiens
caaaggacagucauacauu

SEQ ID NO: 992440 - RNA, 19 nt, Homo sapiens
ccacucagcucagaucaug

SEQ ID NO: 992441 - RNA, 19 nt, Homo sapiens
gaacuagcuugcacauuuu

SEQ ID NO: 992442 - RNA, 19 nt, Homo sapiens
ggaagauaauguacuacug

SEQ ID NO: 992443 - RNA, 19 nt, Homo sapiens
gcaggauguuggucuuuga

SEQ ID NO: 992444 - RNA, 19 nt, Homo sapiens
gcagagugaccuacauaaa

SEQ ID NO: 992445 - RNA, 19 nt, Homo sapiens
gagugaugguggaagauaa

SEQ ID NO: 992446 - RNA, 19 nt, Homo sapiens
agaaugaguuugugacuag

SEQ ID NO: 992447 - RNA, 19 nt, Homo sapiens
uaaagaaucuaggaaccuu

SEQ ID NO: 992448 - RNA, 19 nt, Homo sapiens
gaaagagaguagcgcucaa

SEQ ID NO: 992449 - RNA, 19 nt, Homo sapiens
ggcaacaacagccauauuu

SEQ ID NO: 992450 - RNA, 19 nt, Homo sapiens
aaucaugcuuguacuguaa

SEQ ID NO: 992451 - RNA, 19 nt, Homo sapiens
caucagcacucgcaucauc

SEQ ID NO: 992452 - RNA, 19 nt, Homo sapiens
ucaccaaucccaaauuuga

SEQ ID NO: 992453 - RNA, 19 nt, Homo sapiens
ugucaccaaucccaaauuu

SEQ ID NO: 992454 - RNA, 19 nt, Homo sapiens
ccauucagcuggcauuuua

SEQ ID NO: 992455 - RNA, 19 nt, Homo sapiens
guagagagaaugaguuugu

SEQ ID NO: 992456 - RNA, 19 nt, Homo sapiens
cagcaacuguguucuaaag

SEQ ID NO: 992457 - RNA, 19 nt, Homo sapiens
cagggaaucuccuugugaa

SEQ ID NO: 992458 - RNA, 19 nt, Homo sapiens
gcucagaucaugucaaagu

SEQ ID NO: 992459 - RNA, 19 nt, Homo sapiens
ccacuggagucugggauuu

SEQ ID NO: 992460 - RNA, 19 nt, Homo sapiens
gagccauuccuaaagauuu

SEQ ID NO: 992461 - RNA, 19 nt, Homo sapiens
uaaucaugcuuguacugua

SEQ ID NO: 992462 - RNA, 19 nt, Homo sapiens
gaugguggaagauaaugua

SEQ ID NO: 992463 - RNA, 19 nt, Homo sapiens
gaagggcgacuacgauauc

SEQ ID NO: 992464 - RNA, 19 nt, Homo sapiens
cuacuaggacgaagaauau

SEQ ID NO: 992465 - RNA, 19 nt, Homo sapiens
cuccacacauugacuauuu

SEQ ID NO: 992466 - RNA, 19 nt, Homo sapiens
ggagugaugguggaagaua

SEQ ID NO: 992467 - RNA, 19 nt, Homo sapiens
gacgaagaauauuguuuca

SEQ ID NO: 992468 - RNA, 19 nt, Homo sapiens
ucauaugacucaggaaguu

SEQ ID NO: 992469 - RNA, 19 nt, Homo sapiens
guuaaacccugggcaacaa

SEQ ID NO: 992470 - RNA, 19 nt, Homo sapiens
caaaagaaucccaauauug

SEQ ID NO: 992471 - RNA, 19 nt, Homo sapiens
uuucugggcuaauuucaaa

SEQ ID NO: 992472 - RNA, 19 nt, Homo sapiens
gaaccuugccugcgaccaa

SEQ ID NO: 992473 - RNA, 19 nt, Homo sapiens
aaccacuacuuguaugaua

SEQ ID NO: 992474 - RNA, 19 nt, Homo sapiens
cuacugaagauguaaugua

SEQ ID NO: 992475 - RNA, 19 nt, Homo sapiens
aagauccucuaacuuguuu

SEQ ID NO: 992476 - RNA, 19 nt, Homo sapiens
uuuauuaguuccacuguug

SEQ ID NO: 992477 - RNA, 19 nt, Homo sapiens
ccaaauuugaugacacuuu

SEQ ID NO: 992478 - RNA, 19 nt, Homo sapiens
ccauucagcaguuggauuu

SEQ ID NO: 992479 - RNA, 19 nt, Homo sapiens
ggauguaucuuugcagaac

SEQ ID NO: 992480 - RNA, 19 nt, Homo sapiens
gcaacaacagccauauuuc

SEQ ID NO: 992481 - RNA, 19 nt, Homo sapiens
ccucuaacuuguuuggauu

SEQ ID NO: 992482 - RNA, 19 nt, Homo sapiens
caccaucacuggaagcaau

SEQ ID NO: 992483 - RNA, 19 nt, Homo sapiens
gaauugaagauguuguguu

SEQ ID NO: 992484 - RNA, 19 nt, Homo sapiens
cuaaugaucaagcccuaua

SEQ ID NO: 992485 - RNA, 19 nt, Homo sapiens
ggagguuaaucaugcuugu

SEQ ID NO: 992486 - RNA, 19 nt, Homo sapiens
gaagaguuuauaccaguga

SEQ ID NO: 992487 - RNA, 19 nt, Homo sapiens
gguuugaaauaucuccauu

SEQ ID NO: 992488 - RNA, 19 nt, Homo sapiens
uauuggauauggagccuuu

SEQ ID NO: 992489 - RNA, 19 nt, Homo sapiens
gagguggagugagugguuu

SEQ ID NO: 992490 - RNA, 19 nt, Homo sapiens
ggaaucuccuugugaacag

SEQ ID NO: 992491 - RNA, 19 nt, Homo sapiens
uguuauggcucaccucaga

SEQ ID NO: 992492 - RNA, 19 nt, Homo sapiens
cgacagguuaaagaaauua

SEQ ID NO: 992493 - RNA, 19 nt, Homo sapiens
gaugacacuuucgagaaga

SEQ ID NO: 992494 - RNA, 19 nt, Homo sapiens
acaccaagauccucuaacu

SEQ ID NO: 992495 - RNA, 19 nt, Homo sapiens
ccaauauugcuguauagaa

SEQ ID NO: 992496 - RNA, 19 nt, Homo sapiens
gaaucccaauauugcugua

SEQ ID NO: 992497 - RNA, 19 nt, Homo sapiens
ggguagagagaaugaguuu

SEQ ID NO: 992498 - RNA, 19 nt, Homo sapiens
gauauuugagccauuccua

SEQ ID NO: 992499 - RNA, 19 nt, Homo sapiens
cacacacgcucacccgaaa

SEQ ID NO: 992500 - RNA, 19 nt, Homo sapiens
cgacuacgauaucacacau

SEQ ID NO: 992501 - RNA, 19 nt, Homo sapiens
ggacagucauacauuuuga

SEQ ID NO: 992502 - RNA, 19 nt, Homo sapiens
uugcaauucuggagguuaa

SEQ ID NO: 992503 - RNA, 19 nt, Homo sapiens
gaugugugcugucuaaaau

SEQ ID NO: 992504 - RNA, 19 nt, Homo sapiens
gggcacaccaucacuggaa

SEQ ID NO: 992505 - RNA, 19 nt, Homo sapiens
gcagaacuacuaggacgaa

SEQ ID NO: 992506 - RNA, 19 nt, Homo sapiens
uaacuuguuuggauugacu

SEQ ID NO: 992507 - RNA, 19 nt, Homo sapiens
gaugaagggcgacuacgau

SEQ ID NO: 992508 - RNA, 19 nt, Homo sapiens
ccaaaagaauauccgcuaa

SEQ ID NO: 992509 - RNA, 19 nt, Homo sapiens
cauaaacagccaucucuuc

SEQ ID NO: 992510 - RNA, 19 nt, Homo sapiens
gcaaugaggacagcuugug

SEQ ID NO: 992511 - RNA, 19 nt, Homo sapiens
uaucuuugcagaacuacua

SEQ ID NO: 992512 - RNA, 19 nt, Homo sapiens
aguaacagauccaagagau

SEQ ID NO: 992513 - RNA, 19 nt, Homo sapiens
gcgcaagagccaacgcaaa

SEQ ID NO: 992514 - RNA, 19 nt, Homo sapiens
gauguaauguagcuuucca

SEQ ID NO: 992515 - RNA, 19 nt, Homo sapiens
ccaaucaaagggcauuuau

SEQ ID NO: 992516 - RNA, 19 nt, Homo sapiens
gggcaacaacagccauauu

SEQ ID NO: 992517 - RNA, 19 nt, Homo sapiens
ugacugaugaagacauaaa

SEQ ID NO: 992518 - RNA, 19 nt, Homo sapiens
ugaaggaccucauuucuua

SEQ ID NO: 992519 - RNA, 19 nt, Homo sapiens
auaaagaccucaucaacua

SEQ ID NO: 992520 - RNA, 19 nt, Homo sapiens
gcacaggucuuccacaucu

SEQ ID NO: 992521 - RNA, 19 nt, Homo sapiens
aagauaagguguccuauga

SEQ ID NO: 992522 - RNA, 19 nt, Homo sapiens
gaggaaggauccaugauuc

SEQ ID NO: 992523 - RNA, 19 nt, Homo sapiens
cgacagccauguucagauu

SEQ ID NO: 992524 - RNA, 19 nt, Homo sapiens
ggacugaaccacugaauuc

SEQ ID NO: 992525 - RNA, 19 nt, Homo sapiens
caaugagaguugucccuua

SEQ ID NO: 992526 - RNA, 19 nt, Homo sapiens
gcaugucgcugcagagaau

SEQ ID NO: 992527 - RNA, 19 nt, Homo sapiens
cuacaucucucccaacaug

SEQ ID NO: 992528 - RNA, 19 nt, Homo sapiens
uaauacacaugguugacua

SEQ ID NO: 992529 - RNA, 19 nt, Homo sapiens
guugacaucucucuggauu

SEQ ID NO: 992530 - RNA, 19 nt, Homo sapiens
uuccaucacucgcuaauaa

SEQ ID NO: 992531 - RNA, 19 nt, Homo sapiens
uaagguguccuaugaggua

SEQ ID NO: 992532 - RNA, 19 nt, Homo sapiens
caacacaacccauggagau

SEQ ID NO: 992533 - RNA, 19 nt, Homo sapiens
ggaacauggugcccugaga

SEQ ID NO: 992534 - RNA, 19 nt, Homo sapiens
gacaggaacuuuguagaca

SEQ ID NO: 992535 - RNA, 19 nt, Homo sapiens
ggagagauucuuccuaaag

SEQ ID NO: 992536 - RNA, 19 nt, Homo sapiens
gauccaugauucugcuuug

SEQ ID NO: 992537 - RNA, 19 nt, Homo sapiens
cugcagcccucuuugauga

SEQ ID NO: 992538 - RNA, 19 nt, Homo sapiens
gaaaaguaguucccauaau

SEQ ID NO: 992539 - RNA, 19 nt, Homo sapiens
uauagccucuccugugauu

SEQ ID NO: 992540 - RNA, 19 nt, Homo sapiens
ggcagagugugacaucauu

SEQ ID NO: 992541 - RNA, 19 nt, Homo sapiens
guacaagggugaaaaguag

SEQ ID NO: 992542 - RNA, 19 nt, Homo sapiens
gaccucaucaacuacaaua

SEQ ID NO: 992543 - RNA, 19 nt, Homo sapiens
ggauuucccuuacaaaaga

SEQ ID NO: 992544 - RNA, 19 nt, Homo sapiens
gggcacaggucuuccacau

SEQ ID NO: 992545 - RNA, 19 nt, Homo sapiens
gcagaaauccagccuuguc

SEQ ID NO: 992546 - RNA, 19 nt, Homo sapiens
gagagauucuuccuaaagc

SEQ ID NO: 992547 - RNA, 19 nt, Homo sapiens
cuuauagccucuccuguga

SEQ ID NO: 992548 - RNA, 19 nt, Homo sapiens
gaacugugaccgugaugau

SEQ ID NO: 992549 - RNA, 19 nt, Homo sapiens
cagaaauguuugaggucua

SEQ ID NO: 992550 - RNA, 19 nt, Homo sapiens
caggugcucuccaauaaag

SEQ ID NO: 992551 - RNA, 19 nt, Homo sapiens
ucaagaccaucuccaucaa

SEQ ID NO: 992552 - RNA, 19 nt, Homo sapiens
gcugcaagcugaccaucug

SEQ ID NO: 992553 - RNA, 19 nt, Homo sapiens
ggucucaggcucucuguug

SEQ ID NO: 992554 - RNA, 19 nt, Homo sapiens
gaucagggcggaaccaucu

SEQ ID NO: 992555 - RNA, 19 nt, Homo sapiens
cuagaaacauccacguauc

SEQ ID NO: 992556 - RNA, 19 nt, Homo sapiens
caauaaagaccucaucaac

SEQ ID NO: 992557 - RNA, 19 nt, Homo sapiens
accaggugcucuccaauaa

SEQ ID NO: 992558 - RNA, 19 nt, Homo sapiens
caagauaagguguccuaug

SEQ ID NO: 992559 - RNA, 19 nt, Homo sapiens
ggacaggaacuuuguagac

SEQ ID NO: 992560 - RNA, 19 nt, Homo sapiens
gaaacauccacguaucuca

SEQ ID NO: 992561 - RNA, 19 nt, Homo sapiens
gaguugucccuuagccuua

SEQ ID NO: 992562 - RNA, 19 nt, Homo sapiens
ugucaugccucaccugcaa

SEQ ID NO: 992563 - RNA, 19 nt, Homo sapiens
gcaucuugcuggugaacug

SEQ ID NO: 992564 - RNA, 19 nt, Homo sapiens
ggaaaacucugggacugaa

SEQ ID NO: 992565 - RNA, 19 nt, Homo sapiens
agaaauguuugaggucuau

SEQ ID NO: 992566 - RNA, 19 nt, Homo sapiens
ugagggcacagaaauguuu

SEQ ID NO: 992567 - RNA, 19 nt, Homo sapiens
ggaugaguuucugagcuuu

SEQ ID NO: 992568 - RNA, 19 nt, Homo sapiens
ucaaccaggugcucuccaa

SEQ ID NO: 992569 - RNA, 19 nt, Homo sapiens
uugaugacuucacuccaua

SEQ ID NO: 992570 - RNA, 19 nt, Homo sapiens
gcugcugccuggaggagaa

SEQ ID NO: 992571 - RNA, 19 nt, Homo sapiens
acacaugguugacuauggu

SEQ ID NO: 992572 - RNA, 19 nt, Homo sapiens
ccacugcaccuucauugau

SEQ ID NO: 992573 - RNA, 19 nt, Homo sapiens
ccaauaaagaccucaucaa

SEQ ID NO: 992574 - RNA, 19 nt, Homo sapiens
uggaugaguuucugagcuu

SEQ ID NO: 992575 - RNA, 19 nt, Homo sapiens
guguaugugugccguguga

SEQ ID NO: 992576 - RNA, 19 nt, Homo sapiens
guggcacccuggaucauga

SEQ ID NO: 992577 - RNA, 19 nt, Homo sapiens
ggacgacuccaacgaggau

SEQ ID NO: 992578 - RNA, 19 nt, Homo sapiens
gccaagauaagguguccua

SEQ ID NO: 992579 - RNA, 19 nt, Homo sapiens
ugacaucucucuggauugc

SEQ ID NO: 992580 - RNA, 19 nt, Homo sapiens
aaugagaguugucccuuag

SEQ ID NO: 992581 - RNA, 19 nt, Homo sapiens
ccaagcuccugcccagaug

SEQ ID NO: 992582 - RNA, 19 nt, Homo sapiens
gcaggacaggaacuuugua

SEQ ID NO: 992583 - RNA, 19 nt, Homo sapiens
aauccagccuuguccagaa

SEQ ID NO: 992584 - RNA, 19 nt, Homo sapiens
gcauguggaagcaaugaga

SEQ ID NO: 992585 - RNA, 19 nt, Homo sapiens
ggaaggauccaugauucug

SEQ ID NO: 992586 - RNA, 19 nt, Homo sapiens
agaggaaggauccaugauu

SEQ ID NO: 992587 - RNA, 19 nt, Homo sapiens
gaaggaccucauuucuuau

SEQ ID NO: 992588 - RNA, 19 nt, Homo sapiens
caaccugccugggucaagu

SEQ ID NO: 992589 - RNA, 19 nt, Homo sapiens
gugaugauccgagcuguga

SEQ ID NO: 992590 - RNA, 19 nt, Homo sapiens
cauaguaggagcuucuaga

SEQ ID NO: 992591 - RNA, 19 nt, Homo sapiens
aaagggagcuguggaucca

SEQ ID NO: 992592 - RNA, 19 nt, Homo sapiens
agacccucguggacauuua

SEQ ID NO: 992593 - RNA, 19 nt, Homo sapiens
gaaggcaggacaggaacuu

SEQ ID NO: 992594 - RNA, 19 nt, Homo sapiens
cagagaaucgugcgugugu

SEQ ID NO: 992595 - RNA, 19 nt, Homo sapiens
guaguucccauaauacaca

SEQ ID NO: 992596 - RNA, 19 nt, Homo sapiens
gcaggauuucccuuacaaa

SEQ ID NO: 992597 - RNA, 19 nt, Homo sapiens
ggccuguccuucccugaug

SEQ ID NO: 992598 - RNA, 19 nt, Homo sapiens
ggaugugugugaggccuau

SEQ ID NO: 992599 - RNA, 19 nt, Homo sapiens
ugcaagaccuggaagacau

SEQ ID NO: 992600 - RNA, 19 nt, Homo sapiens
ggugaacugugaccgugau

SEQ ID NO: 992601 - RNA, 19 nt, Homo sapiens
ggacaggcaggagagauuc

SEQ ID NO: 992602 - RNA, 19 nt, Homo sapiens
uaucucaucagccaucuug

SEQ ID NO: 992603 - RNA, 19 nt, Homo sapiens
gccaggugguggagacaga

SEQ ID NO: 992604 - RNA, 19 nt, Homo sapiens
gucaagaccaucuccauca

SEQ ID NO: 992605 - RNA, 19 nt, Homo sapiens
gcaagaccuggaagacaug

SEQ ID NO: 992606 - RNA, 19 nt, Homo sapiens
uuaggugucuggagaaggu

SEQ ID NO: 992607 - RNA, 19 nt, Homo sapiens
ggaccucauuucuuauagc

SEQ ID NO: 992608 - RNA, 19 nt, Homo sapiens
aaggaccucauuucuuaua

SEQ ID NO: 992609 - RNA, 19 nt, Homo sapiens
ccaugugguucucagacuu

SEQ ID NO: 992610 - RNA, 19 nt, Homo sapiens
gggacugaaccacugaauu

SEQ ID NO: 992611 - RNA, 19 nt, Homo sapiens
gaacgauaagcaccaagag

SEQ ID NO: 992612 - RNA, 19 nt, Homo sapiens
gaugauccgagcugugaug

SEQ ID NO: 992613 - RNA, 19 nt, Homo sapiens
gcuuggaggacgaaaguau

SEQ ID NO: 992614 - RNA, 19 nt, Homo sapiens
cacugcaccuucauugaug

SEQ ID NO: 992615 - RNA, 19 nt, Homo sapiens
gcagagugugacaucauug

SEQ ID NO: 992616 - RNA, 19 nt, Homo sapiens
aaccaggugcucuccaaua

SEQ ID NO: 992617 - RNA, 19 nt, Homo sapiens
ggaugaggagcgcuucuuc

SEQ ID NO: 992618 - RNA, 19 nt, Homo sapiens
gaggagagcuuuccaaaua

SEQ ID NO: 992619 - RNA, 19 nt, Homo sapiens
gaaagaaaguggccuuaaa

SEQ ID NO: 992620 - RNA, 19 nt, Homo sapiens
gcaaagagcacuucagaaa

SEQ ID NO: 992621 - RNA, 19 nt, Homo sapiens
gaagaacaaugaccuaaca

SEQ ID NO: 992622 - RNA, 19 nt, Homo sapiens
caaccaguguuacaaauuu

SEQ ID NO: 992623 - RNA, 19 nt, Homo sapiens
ccaacagucucuaugcuua

SEQ ID NO: 992624 - RNA, 19 nt, Homo sapiens
gauagggaauguagagaaa

SEQ ID NO: 992625 - RNA, 19 nt, Homo sapiens
caacaugccugucuucaag

SEQ ID NO: 992626 - RNA, 19 nt, Homo sapiens
guuaaacucuaaagccaua

SEQ ID NO: 992627 - RNA, 19 nt, Homo sapiens
guacaaacguguucaaagg

SEQ ID NO: 992628 - RNA, 19 nt, Homo sapiens
ccacacaacaggcuuauuu

SEQ ID NO: 992629 - RNA, 19 nt, Homo sapiens
aaacauaacuugccaacag

SEQ ID NO: 992630 - RNA, 19 nt, Homo sapiens
acaaugaccuaacaaguug

SEQ ID NO: 992631 - RNA, 19 nt, Homo sapiens
gaacuacuuuacagugaau

SEQ ID NO: 992632 - RNA, 19 nt, Homo sapiens
guaugaagcuuauggucaa

SEQ ID NO: 992633 - RNA, 19 nt, Homo sapiens
ccacuucagucaugacauu

SEQ ID NO: 992634 - RNA, 19 nt, Homo sapiens
gaacaggucaaagccauuu

SEQ ID NO: 992635 - RNA, 19 nt, Homo sapiens
gagcuuacggucauccuua

SEQ ID NO: 992636 - RNA, 19 nt, Homo sapiens
gaagcaagcacugaauaaa

SEQ ID NO: 992637 - RNA, 19 nt, Homo sapiens
ucacucaugucaaucauau

SEQ ID NO: 992638 - RNA, 19 nt, Homo sapiens
gaucuuaucccuauaugau

SEQ ID NO: 992639 - RNA, 19 nt, Homo sapiens
gaagccaucguacauauug

SEQ ID NO: 992640 - RNA, 19 nt, Homo sapiens
gaacaaugaccuaacaagu

SEQ ID NO: 992641 - RNA, 19 nt, Homo sapiens
gaguaaaucugucccuaca

SEQ ID NO: 992642 - RNA, 19 nt, Homo sapiens
uuaacaggaucuacgauaa

SEQ ID NO: 992643 - RNA, 19 nt, Homo sapiens
gaguggaauugagaucuua

SEQ ID NO: 992644 - RNA, 19 nt, Homo sapiens
cagaagccaucguacauau

SEQ ID NO: 992645 - RNA, 19 nt, Homo sapiens
guuccugucucuugcauaa

SEQ ID NO: 992646 - RNA, 19 nt, Homo sapiens
acaaacaggugucugauag

SEQ ID NO: 992647 - RNA, 19 nt, Homo sapiens
caaacguguucaaaggaua

SEQ ID NO: 992648 - RNA, 19 nt, Homo sapiens
ggaaagaaaguggccuuaa

SEQ ID NO: 992649 - RNA, 19 nt, Homo sapiens
cggaaggguucguguaauu

SEQ ID NO: 992650 - RNA, 19 nt, Homo sapiens
ggaaugcuguucuuaaagc

SEQ ID NO: 992651 - RNA, 19 nt, Homo sapiens
gaaggacccugagaagaca

SEQ ID NO: 992652 - RNA, 19 nt, Homo sapiens
gaugaugaccugaagcaaa

SEQ ID NO: 992653 - RNA, 19 nt, Homo sapiens
aaggaaugcuguucuuaaa

SEQ ID NO: 992654 - RNA, 19 nt, Homo sapiens
gagaagaguggaauugaga

SEQ ID NO: 992655 - RNA, 19 nt, Homo sapiens
ccacaaaccacuaaaauuu

SEQ ID NO: 992656 - RNA, 19 nt, Homo sapiens
agccauagcuuuuguuuua

SEQ ID NO: 992657 - RNA, 19 nt, Homo sapiens
gugcacugcuugugagaaa

SEQ ID NO: 992658 - RNA, 19 nt, Homo sapiens
caagcaagaugcccacaca

SEQ ID NO: 992659 - RNA, 19 nt, Homo sapiens
ccgaugcucuucugcguaa

SEQ ID NO: 992660 - RNA, 19 nt, Homo sapiens
cagauguacuucccucauu

SEQ ID NO: 992661 - RNA, 19 nt, Homo sapiens
gaagaucaucgaccguaaa

SEQ ID NO: 992662 - RNA, 19 nt, Homo sapiens
ggagaagaguggaauugag

SEQ ID NO: 992663 - RNA, 19 nt, Homo sapiens
ccagugaacuuuuccagua

SEQ ID NO: 992664 - RNA, 19 nt, Homo sapiens
gggacaagcucaucuuugc

SEQ ID NO: 992665 - RNA, 19 nt, Homo sapiens
caagaucccaguuuauguu

SEQ ID NO: 992666 - RNA, 19 nt, Homo sapiens
gaucuacgauaagguacaa

SEQ ID NO: 992667 - RNA, 19 nt, Homo sapiens
caaaccagcccuacagaug

SEQ ID NO: 992668 - RNA, 19 nt, Homo sapiens
caacccgucuuaccucuuc

SEQ ID NO: 992669 - RNA, 19 nt, Homo sapiens
gaacugggaacaaagaucu

SEQ ID NO: 992670 - RNA, 19 nt, Homo sapiens
gacaugaacuacuuuacag

SEQ ID NO: 992671 - RNA, 19 nt, Homo sapiens
gagcugccaucuucuugug

SEQ ID NO: 992672 - RNA, 19 nt, Homo sapiens
aaaggaaugcuguucuuaa

SEQ ID NO: 992673 - RNA, 19 nt, Homo sapiens
cagucucuaugcuuauuua

SEQ ID NO: 992674 - RNA, 19 nt, Homo sapiens
gcaagaugcccacacaaca

SEQ ID NO: 992675 - RNA, 19 nt, Homo sapiens
ucuccgaauuggcuuguua

SEQ ID NO: 992676 - RNA, 19 nt, Homo sapiens
cuaguuagauaucugacuu

SEQ ID NO: 992677 - RNA, 19 nt, Homo sapiens
ugaagaucaucgaccguaa

SEQ ID NO: 992678 - RNA, 19 nt, Homo sapiens
ccaaacauuuccuaaacuc

SEQ ID NO: 992679 - RNA, 19 nt, Homo sapiens
ugaagcaagcacugaauaa

SEQ ID NO: 992680 - RNA, 19 nt, Homo sapiens
gcucuucugcguaauuaaa

SEQ ID NO: 992681 - RNA, 19 nt, Homo sapiens
aggaagcccuggacaguga

SEQ ID NO: 992682 - RNA, 19 nt, Homo sapiens
uaccaaacauuuccuaaac

SEQ ID NO: 992683 - RNA, 19 nt, Homo sapiens
ggagagcuuuccaaauacu

SEQ ID NO: 992684 - RNA, 19 nt, Homo sapiens
agauguacuucccucauuu

SEQ ID NO: 992685 - RNA, 19 nt, Homo sapiens
ugaauuuccugcugcuguu

SEQ ID NO: 992686 - RNA, 19 nt, Homo sapiens
gagaucuuaucccuauaug

SEQ ID NO: 992687 - RNA, 19 nt, Homo sapiens
gccuaucacucaugucaau

SEQ ID NO: 992688 - RNA, 19 nt, Homo sapiens
ggauuaggauaagguacuu

SEQ ID NO: 992689 - RNA, 19 nt, Homo sapiens
gcgaggagagcuuuccaaa

SEQ ID NO: 992690 - RNA, 19 nt, Homo sapiens
acaccaacauugaaagcaa

SEQ ID NO: 992691 - RNA, 19 nt, Homo sapiens
gcucuugacaccaacauug

SEQ ID NO: 992692 - RNA, 19 nt, Homo sapiens
ugaacuacuuuacagugaa

SEQ ID NO: 992693 - RNA, 19 nt, Homo sapiens
uggcugacaugaacuacuu

SEQ ID NO: 992694 - RNA, 19 nt, Homo sapiens
ucagguguaugaagcuuau

SEQ ID NO: 992695 - RNA, 19 nt, Homo sapiens
cugacgacaugaagacuuu

SEQ ID NO: 992696 - RNA, 19 nt, Homo sapiens
gaacuuuuccaguaaauga

SEQ ID NO: 992697 - RNA, 19 nt, Homo sapiens
uaucugacuugggaguaua

SEQ ID NO: 992698 - RNA, 19 nt, Homo sapiens
cucaugauuuccaaccuua

SEQ ID NO: 992699 - RNA, 19 nt, Homo sapiens
caccaacauugaaagcaaa

SEQ ID NO: 992700 - RNA, 19 nt, Homo sapiens
caagcuggcccaaggagaa

SEQ ID NO: 992701 - RNA, 19 nt, Homo sapiens
gaaggguucguguaauugu

SEQ ID NO: 992702 - RNA, 19 nt, Homo sapiens
ggaaggguucguguaauug

SEQ ID NO: 992703 - RNA, 19 nt, Homo sapiens
gcugcugccuuucucaaau

SEQ ID NO: 992704 - RNA, 19 nt, Homo sapiens
ccagaagccaucguacaua

SEQ ID NO: 992705 - RNA, 19 nt, Homo sapiens
caaucagucugugggaauu

SEQ ID NO: 992706 - RNA, 19 nt, Homo sapiens
gcagaaaauugggaaagaa

SEQ ID NO: 992707 - RNA, 19 nt, Homo sapiens
agacacccuugaagaaguu

SEQ ID NO: 992708 - RNA, 19 nt, Homo sapiens
caggaucuacgauaaggua

SEQ ID NO: 992709 - RNA, 19 nt, Homo sapiens
auugagaucuuaucccuau

SEQ ID NO: 992710 - RNA, 19 nt, Homo sapiens
caaaaggaaugcuguucuu

SEQ ID NO: 992711 - RNA, 19 nt, Homo sapiens
ccucugugccuucuucuuu

SEQ ID NO: 992712 - RNA, 19 nt, Homo sapiens
gaucccaguuuauguucug

SEQ ID NO: 992713 - RNA, 19 nt, Homo sapiens
gaaggagaggucugcauca

SEQ ID NO: 992714 - RNA, 19 nt, Homo sapiens
gggcagcaaugggauguca

SEQ ID NO: 992715 - RNA, 19 nt, Homo sapiens
guguggagcaugcuuauga

SEQ ID NO: 992716 - RNA, 19 nt, Homo sapiens
gacaagcucaucuuugcaa

SEQ ID NO: 992717 - RNA, 19 nt, Homo sapiens
uaaaugaagcaagcacuga

SEQ ID NO: 992718 - RNA, 19 nt, Homo sapiens
gaauuucucuuaccgauuu

SEQ ID NO: 992719 - RNA, 19 nt, Homo sapiens
gcaagucauuccuuuguua

SEQ ID NO: 992720 - RNA, 19 nt, Homo sapiens
gaacagaaccaaauucaca

SEQ ID NO: 992721 - RNA, 19 nt, Homo sapiens
cauaagccuuuaaccuuua

SEQ ID NO: 992722 - RNA, 19 nt, Homo sapiens
ccauaagccuuuaaccuuu

SEQ ID NO: 992723 - RNA, 19 nt, Homo sapiens
ggagaaaucgguaacaguu

SEQ ID NO: 992724 - RNA, 19 nt, Homo sapiens
guauuaggcucacuggaaa

SEQ ID NO: 992725 - RNA, 19 nt, Homo sapiens
cauguucucugcacuguuu

SEQ ID NO: 992726 - RNA, 19 nt, Homo sapiens
gaacacugacgaacugaaa

SEQ ID NO: 992727 - RNA, 19 nt, Homo sapiens
gaacaucucggccauucaa

SEQ ID NO: 992728 - RNA, 19 nt, Homo sapiens
guagagccauagaaauauu

SEQ ID NO: 992729 - RNA, 19 nt, Homo sapiens
gcagauacucuaaucacua

SEQ ID NO: 992730 - RNA, 19 nt, Homo sapiens
gaggguuucuuguugcuuu

SEQ ID NO: 992731 - RNA, 19 nt, Homo sapiens
ccacuaggaugcagagaug

SEQ ID NO: 992732 - RNA, 19 nt, Homo sapiens
caaccacuguuccuucuau

SEQ ID NO: 992733 - RNA, 19 nt, Homo sapiens
gaacacgcccaacuacuuc

SEQ ID NO: 992734 - RNA, 19 nt, Homo sapiens
ggcauggaauguauaaaug

SEQ ID NO: 992735 - RNA, 19 nt, Homo sapiens
caaugcagcucuccgaaca

SEQ ID NO: 992736 - RNA, 19 nt, Homo sapiens
caaagcuaauugcaaauag

SEQ ID NO: 992737 - RNA, 19 nt, Homo sapiens
caaacuaaagcaaagcuaa

SEQ ID NO: 992738 - RNA, 19 nt, Homo sapiens
cgucugagcugaguauguu

SEQ ID NO: 992739 - RNA, 19 nt, Homo sapiens
gggccuauauggagaacaa

SEQ ID NO: 992740 - RNA, 19 nt, Homo sapiens
gcgaugaugucaccuagca

SEQ ID NO: 992741 - RNA, 19 nt, Homo sapiens
gggcagcagucccuucuuc

SEQ ID NO: 992742 - RNA, 19 nt, Homo sapiens
ggacugaccgcuucauaag

SEQ ID NO: 992743 - RNA, 19 nt, Homo sapiens
gagcaagucauuccuuugu

SEQ ID NO: 992744 - RNA, 19 nt, Homo sapiens
gcauggaauguauaaauga

SEQ ID NO: 992745 - RNA, 19 nt, Homo sapiens
gaauguucguggcaucaga

SEQ ID NO: 992746 - RNA, 19 nt, Homo sapiens
ucaaggagaaggagaagaa

SEQ ID NO: 992747 - RNA, 19 nt, Homo sapiens
ccaaggggauuucguguaa

SEQ ID NO: 992748 - RNA, 19 nt, Homo sapiens
caacugcuccgccaaguca

SEQ ID NO: 992749 - RNA, 19 nt, Homo sapiens
ccucuagcaucgauucaaa

SEQ ID NO: 992750 - RNA, 19 nt, Homo sapiens
aaacuacccauaagccuuu

SEQ ID NO: 992751 - RNA, 19 nt, Homo sapiens
gagcugaguauguuucaau

SEQ ID NO: 992752 - RNA, 19 nt, Homo sapiens
gguagccucuuggagauga

SEQ ID NO: 992753 - RNA, 19 nt, Homo sapiens
acaugaggguuucuuguug

SEQ ID NO: 992754 - RNA, 19 nt, Homo sapiens
gguagaacagaaccaaauu

SEQ ID NO: 992755 - RNA, 19 nt, Homo sapiens
gaggacugaccgcuucaua

SEQ ID NO: 992756 - RNA, 19 nt, Homo sapiens
cagauacucuaaucacuac

SEQ ID NO: 992757 - RNA, 19 nt, Homo sapiens
ccaagcccauuguuucugu

SEQ ID NO: 992758 - RNA, 19 nt, Homo sapiens
uuguagagccauagaaaua

SEQ ID NO: 992759 - RNA, 19 nt, Homo sapiens
ccuggugguuugcacauuu

SEQ ID NO: 992760 - RNA, 19 nt, Homo sapiens
ccacacacacagacacgua

SEQ ID NO: 992761 - RNA, 19 nt, Homo sapiens
gguaacaguugccgaacca

SEQ ID NO: 992762 - RNA, 19 nt, Homo sapiens
ucuaaucacuacauugcuu

SEQ ID NO: 992763 - RNA, 19 nt, Homo sapiens
ccucacagccaggaaauuu

SEQ ID NO: 992764 - RNA, 19 nt, Homo sapiens
cggcuugccuggugguuug

SEQ ID NO: 992765 - RNA, 19 nt, Homo sapiens
gagaaaucgguaacaguug

SEQ ID NO: 992766 - RNA, 19 nt, Homo sapiens
caucacagccuuccucucu

SEQ ID NO: 992767 - RNA, 19 nt, Homo sapiens
gcccauuguuucugucaug

SEQ ID NO: 992768 - RNA, 19 nt, Homo sapiens
gagaugaccguugcguuga

SEQ ID NO: 992769 - RNA, 19 nt, Homo sapiens
gcaaacuaaagcaaagcua

SEQ ID NO: 992770 - RNA, 19 nt, Homo sapiens
ggagaacacgcccaacuac

SEQ ID NO: 992771 - RNA, 19 nt, Homo sapiens
ggaugaccauguaccucuu

SEQ ID NO: 992772 - RNA, 19 nt, Homo sapiens
cauaaccucuagcaucgau

SEQ ID NO: 992773 - RNA, 19 nt, Homo sapiens
ccucaucuacgacauggua

SEQ ID NO: 992774 - RNA, 19 nt, Homo sapiens
gcccauggacuuugugaug

SEQ ID NO: 992775 - RNA, 19 nt, Homo sapiens
cugagcaagucauuccuuu

SEQ ID NO: 992776 - RNA, 19 nt, Homo sapiens
gauggaauggaucacauga

SEQ ID NO: 992777 - RNA, 19 nt, Homo sapiens
uccaaauccucucccaauu

SEQ ID NO: 992778 - RNA, 19 nt, Homo sapiens
uuccagagaaucagaauuu

SEQ ID NO: 992779 - RNA, 19 nt, Homo sapiens
agacccagcgcuccguuua

SEQ ID NO: 992780 - RNA, 19 nt, Homo sapiens
uggccuggaugaccaugua

SEQ ID NO: 992781 - RNA, 19 nt, Homo sapiens
cagguagccucuuggagau

SEQ ID NO: 992782 - RNA, 19 nt, Homo sapiens
guacgucugagcugaguau

SEQ ID NO: 992783 - RNA, 19 nt, Homo sapiens
cauaagccaguacgucuga

SEQ ID NO: 992784 - RNA, 19 nt, Homo sapiens
cccauaagccuuuaaccuu

SEQ ID NO: 992785 - RNA, 19 nt, Homo sapiens
cggcauggaauguauaaau

SEQ ID NO: 992786 - RNA, 19 nt, Homo sapiens
gaccaucacauuuggaaag

SEQ ID NO: 992787 - RNA, 19 nt, Homo sapiens
uagaacagaaccaaauuca

SEQ ID NO: 992788 - RNA, 19 nt, Homo sapiens
ggguagaacagaaccaaau

SEQ ID NO: 992789 - RNA, 19 nt, Homo sapiens
gggcugacguuugccuuca

SEQ ID NO: 992790 - RNA, 19 nt, Homo sapiens
ugugaacacugacgaacug

SEQ ID NO: 992791 - RNA, 19 nt, Homo sapiens
gcugaguauguuucaauaa

SEQ ID NO: 992792 - RNA, 19 nt, Homo sapiens
guagaacagaaccaaauuc

SEQ ID NO: 992793 - RNA, 19 nt, Homo sapiens
ucgaacaucucggccauuc

SEQ ID NO: 992794 - RNA, 19 nt, Homo sapiens
caagucauuccuuuguuau

SEQ ID NO: 992795 - RNA, 19 nt, Homo sapiens
cauuguuucugucaugguu

SEQ ID NO: 992796 - RNA, 19 nt, Homo sapiens
ucuaaugucuauggugaga

SEQ ID NO: 992797 - RNA, 19 nt, Homo sapiens
cuccauggaugaacacaau

SEQ ID NO: 992798 - RNA, 19 nt, Homo sapiens
agaacacgcccaacuacuu

SEQ ID NO: 992799 - RNA, 19 nt, Homo sapiens
uuacggguguaucuccaaa

SEQ ID NO: 992800 - RNA, 19 nt, Homo sapiens
caggagaguuaaggagguu

SEQ ID NO: 992801 - RNA, 19 nt, Homo sapiens
guucguggcaucagagaga

SEQ ID NO: 992802 - RNA, 19 nt, Homo sapiens
ugccagcccugcaggagaa

SEQ ID NO: 992803 - RNA, 19 nt, Homo sapiens
gcacuguuuggccagcaua

SEQ ID NO: 992804 - RNA, 19 nt, Homo sapiens
caaggugaggcccaacuga

SEQ ID NO: 992805 - RNA, 19 nt, Homo sapiens
caacguguaucagccaacu

SEQ ID NO: 992806 - RNA, 19 nt, Homo sapiens
cauggaauguauaaaugag

SEQ ID NO: 992807 - RNA, 19 nt, Homo sapiens
cacaugaggguuucuuguu

SEQ ID NO: 992808 - RNA, 19 nt, Homo sapiens
gaggacaaauggggacuuu

SEQ ID NO: 992809 - RNA, 19 nt, Homo sapiens
acacagacacguaauacca

SEQ ID NO: 992810 - RNA, 19 nt, Homo sapiens
gacggcauggaauguauaa

SEQ ID NO: 992811 - RNA, 19 nt, Homo sapiens
cuucuucccuugaucaucu

SEQ ID NO: 992812 - RNA, 19 nt, Homo sapiens
aguauuaggcucacuggaa

SEQ ID NO: 992813 - RNA, 19 nt, Homo sapiens
gguggguccuucugcagau

SEQ ID NO: 992814 - RNA, 19 nt, Homo sapiens
uaaaugaggguggguccuu

SEQ ID NO: 992815 - RNA, 19 nt, Homo sapiens
uaaugucuauggugagaac

SEQ ID NO: 992816 - RNA, 19 nt, Homo sapiens
ggauggaauggaucacaug

SEQ ID NO: 992817 - RNA, 19 nt, Homo sapiens
ucuccgaacagcaggauuu

SEQ ID NO: 992818 - RNA, 19 nt, Homo sapiens
ggaauucucuccacaccua

SEQ ID NO: 992819 - RNA, 19 nt, Homo sapiens
gcaauaauuugauggaauc

SEQ ID NO: 992820 - RNA, 19 nt, Homo sapiens
cagcugacaugcaauaauu

SEQ ID NO: 992821 - RNA, 19 nt, Homo sapiens
gaacaaucaccaaugaauu

SEQ ID NO: 992822 - RNA, 19 nt, Homo sapiens
gcaaccagccggucuuauu

SEQ ID NO: 992823 - RNA, 19 nt, Homo sapiens
gaacugacagcuugaggaa

SEQ ID NO: 992824 - RNA, 19 nt, Homo sapiens
caugaagacuuuccuacuu

SEQ ID NO: 992825 - RNA, 19 nt, Homo sapiens
gaggugggcucgcugauag

SEQ ID NO: 992826 - RNA, 19 nt, Homo sapiens
ccuguucucucacauuuaa

SEQ ID NO: 992827 - RNA, 19 nt, Homo sapiens
ccagaugcaucaccuucua

SEQ ID NO: 992828 - RNA, 19 nt, Homo sapiens
ucucgguguucuuauauua

SEQ ID NO: 992829 - RNA, 19 nt, Homo sapiens
agaaaguccugcagaauca

SEQ ID NO: 992830 - RNA, 19 nt, Homo sapiens
aaguaaagaugaaggauug

SEQ ID NO: 992831 - RNA, 19 nt, Homo sapiens
aaucauaccaugcuacuuu

SEQ ID NO: 992832 - RNA, 19 nt, Homo sapiens
gguuauugcuuugauugua

SEQ ID NO: 992833 - RNA, 19 nt, Homo sapiens
ggaacaaucaccaaugaau

SEQ ID NO: 992834 - RNA, 19 nt, Homo sapiens
guucuuauauuaccuacug

SEQ ID NO: 992835 - RNA, 19 nt, Homo sapiens
gagaauuugugagcaguga

SEQ ID NO: 992836 - RNA, 19 nt, Homo sapiens
cagaaucaaucccgacuuc

SEQ ID NO: 992837 - RNA, 19 nt, Homo sapiens
gagaaaguccugcagaauc

SEQ ID NO: 992838 - RNA, 19 nt, Homo sapiens
acugacagcuugaggaauu

SEQ ID NO: 992839 - RNA, 19 nt, Homo sapiens
uaacaacaccaaacacaga

SEQ ID NO: 992840 - RNA, 19 nt, Homo sapiens
gcaugacuuuccuuaaugu

SEQ ID NO: 992841 - RNA, 19 nt, Homo sapiens
ggcaugacuuuccuuaaug

SEQ ID NO: 992842 - RNA, 19 nt, Homo sapiens
aaggaacaaucaccaauga

SEQ ID NO: 992843 - RNA, 19 nt, Homo sapiens
uaacuacuguacucaauac

SEQ ID NO: 992844 - RNA, 19 nt, Homo sapiens
gacaauuucucaugagucu

SEQ ID NO: 992845 - RNA, 19 nt, Homo sapiens
ugaagcuucuuaccguuaa

SEQ ID NO: 992846 - RNA, 19 nt, Homo sapiens
gacaugcaauaauuugaug

SEQ ID NO: 992847 - RNA, 19 nt, Homo sapiens
agaggcagcuaauaauuca

SEQ ID NO: 992848 - RNA, 19 nt, Homo sapiens
ccauggaacugcuucaagu

SEQ ID NO: 992849 - RNA, 19 nt, Homo sapiens
ucucugaugucaacagcua

SEQ ID NO: 992850 - RNA, 19 nt, Homo sapiens
ggaggugggcucgcugaua

SEQ ID NO: 992851 - RNA, 19 nt, Homo sapiens
cucacagucucaaguaaua

SEQ ID NO: 992852 - RNA, 19 nt, Homo sapiens
caaguaaagaugaaggauu

SEQ ID NO: 992853 - RNA, 19 nt, Homo sapiens
aguugcacguguauuauua

SEQ ID NO: 992854 - RNA, 19 nt, Homo sapiens
caacuggaacaacuccuaa

SEQ ID NO: 992855 - RNA, 19 nt, Homo sapiens
gggaaaaguugcacgugua

SEQ ID NO: 992856 - RNA, 19 nt, Homo sapiens
augaagacuuuccuacuuu

SEQ ID NO: 992857 - RNA, 19 nt, Homo sapiens
aggcaugacuuuccuuaau

SEQ ID NO: 992858 - RNA, 19 nt, Homo sapiens
cacagaaucauuacagaaa

SEQ ID NO: 992859 - RNA, 19 nt, Homo sapiens
ggagaaaguccugcagaau

SEQ ID NO: 992860 - RNA, 19 nt, Homo sapiens
ggagaaagaagauauugac

SEQ ID NO: 992861 - RNA, 19 nt, Homo sapiens
gauccgggcacaccagaaa

SEQ ID NO: 992862 - RNA, 19 nt, Homo sapiens
aagaagauauugacaccau

SEQ ID NO: 992863 - RNA, 19 nt, Homo sapiens
agacgucugucccaguaaa

SEQ ID NO: 992864 - RNA, 19 nt, Homo sapiens
gugaagcuucuuaccguua

SEQ ID NO: 992865 - RNA, 19 nt, Homo sapiens
ccaguuacaauuccagaaa

SEQ ID NO: 992866 - RNA, 19 nt, Homo sapiens
aaacguaacaguaacaagu

SEQ ID NO: 992867 - RNA, 19 nt, Homo sapiens
ccacaccuaggcaauaauu

SEQ ID NO: 992868 - RNA, 19 nt, Homo sapiens
guuccaaacccaagacuga

SEQ ID NO: 992869 - RNA, 19 nt, Homo sapiens
caugcuacuuuguacauau

SEQ ID NO: 992870 - RNA, 19 nt, Homo sapiens
guuaagacaauuucucaug

SEQ ID NO: 992871 - RNA, 19 nt, Homo sapiens
caaccagccggucuuauuc

SEQ ID NO: 992872 - RNA, 19 nt, Homo sapiens
gaaaucauaccaugcuacu

SEQ ID NO: 992873 - RNA, 19 nt, Homo sapiens
aaaaguugcacguguauua

SEQ ID NO: 992874 - RNA, 19 nt, Homo sapiens
ugagcacucugcacaagga

SEQ ID NO: 992875 - RNA, 19 nt, Homo sapiens
uaagacaauuucucaugag

SEQ ID NO: 992876 - RNA, 19 nt, Homo sapiens
cccaguauuugcagcagua

SEQ ID NO: 992877 - RNA, 19 nt, Homo sapiens
uaaaaugucucugauguca

SEQ ID NO: 992878 - RNA, 19 nt, Homo sapiens
uauuccugcuuucguguua

SEQ ID NO: 992879 - RNA, 19 nt, Homo sapiens
uaaaggaacaaucaccaau

SEQ ID NO: 992880 - RNA, 19 nt, Homo sapiens
accaaacacagaaucauua

SEQ ID NO: 992881 - RNA, 19 nt, Homo sapiens
cuacuguacucaauacucu

SEQ ID NO: 992882 - RNA, 19 nt, Homo sapiens
uagaaaucauaccaugcua

SEQ ID NO: 992883 - RNA, 19 nt, Homo sapiens
aggcaauaauuacgcuuaa

SEQ ID NO: 992884 - RNA, 19 nt, Homo sapiens
gagagcgugaagcuucuua

SEQ ID NO: 992885 - RNA, 19 nt, Homo sapiens
ucaauaccaguuacaauuc

SEQ ID NO: 992886 - RNA, 19 nt, Homo sapiens
caccaaacacagaaucauu

SEQ ID NO: 992887 - RNA, 19 nt, Homo sapiens
ccaugcuacuuuguacaua

SEQ ID NO: 992888 - RNA, 19 nt, Homo sapiens
gcugacaugcaauaauuug

SEQ ID NO: 992889 - RNA, 19 nt, Homo sapiens
ggugguuauugcuuugauu

SEQ ID NO: 992890 - RNA, 19 nt, Homo sapiens
ugaaagccacaaccacuga

SEQ ID NO: 992891 - RNA, 19 nt, Homo sapiens
gaauuugugagcagugaau

SEQ ID NO: 992892 - RNA, 19 nt, Homo sapiens
gggcucuccuguucucuca

SEQ ID NO: 992893 - RNA, 19 nt, Homo sapiens
guaaagaugaaggauugaa

SEQ ID NO: 992894 - RNA, 19 nt, Homo sapiens
ggugagcacucugcacaag

SEQ ID NO: 992895 - RNA, 19 nt, Homo sapiens
ggaaaugaucaaccucagu

SEQ ID NO: 992896 - RNA, 19 nt, Homo sapiens
cauaccaugcuacuuugua

SEQ ID NO: 992897 - RNA, 19 nt, Homo sapiens
guagaaaucauaccaugcu

SEQ ID NO: 992898 - RNA, 19 nt, Homo sapiens
uauuuguucugguggguuu

SEQ ID NO: 992899 - RNA, 19 nt, Homo sapiens
gagaaagaagauauugaca

SEQ ID NO: 992900 - RNA, 19 nt, Homo sapiens
cucaauaccaguuacaauu

SEQ ID NO: 992901 - RNA, 19 nt, Homo sapiens
cuccaucauuucaaacgua

SEQ ID NO: 992902 - RNA, 19 nt, Homo sapiens
acacagaaucauuacagaa

SEQ ID NO: 992903 - RNA, 19 nt, Homo sapiens
aaaugucucugaugucaac

SEQ ID NO: 992904 - RNA, 19 nt, Homo sapiens
uagaggcagcuaauaauuc

SEQ ID NO: 992905 - RNA, 19 nt, Homo sapiens
cuccuguucucucacauuu

SEQ ID NO: 992906 - RNA, 19 nt, Homo sapiens
gcucuccuguucucucaca

SEQ ID NO: 992907 - RNA, 19 nt, Homo sapiens
cuccacaccuaggcaauaa

SEQ ID NO: 992908 - RNA, 19 nt, Homo sapiens
aaacacagaaucauuacag

SEQ ID NO: 992909 - RNA, 19 nt, Homo sapiens
ggucuuauuccaguauuau

SEQ ID NO: 992910 - RNA, 19 nt, Homo sapiens
uauaacaacaccaaacaca

SEQ ID NO: 992911 - RNA, 19 nt, Homo sapiens
gaaucaaucccgacuucca

SEQ ID NO: 992912 - RNA, 19 nt, Homo sapiens
gaauugucccugccugcuu

SEQ ID NO: 992913 - RNA, 19 nt, Homo sapiens
cagcaaccagccggucuua

SEQ ID NO: 992914 - RNA, 19 nt, Homo sapiens
aaaggaacaaucaccaaug

SEQ ID NO: 992915 - RNA, 19 nt, Homo sapiens
caacaccaaacacagaauc

SEQ ID NO: 992916 - RNA, 19 nt, Homo sapiens
uaggcaauaauuacgcuua

SEQ ID NO: 992917 - RNA, 19 nt, Homo sapiens
gcaagcacuucagcaacca

SEQ ID NO: 992918 - RNA, 19 nt, Homo sapiens
ggaaacagcuacugauaau

SEQ ID NO: 992919 - RNA, 19 nt, Homo sapiens
caagaaaucuccaccagaa

SEQ ID NO: 992920 - RNA, 19 nt, Homo sapiens
gagggaagaugucucagua

SEQ ID NO: 992921 - RNA, 19 nt, Homo sapiens
gauaguaccugcaggaaca

SEQ ID NO: 992922 - RNA, 19 nt, Homo sapiens
aaacugggcuacucacaaa

SEQ ID NO: 992923 - RNA, 19 nt, Homo sapiens
aaaggagucugaaauauca

SEQ ID NO: 992924 - RNA, 19 nt, Homo sapiens
gaaagucccugaagaucca

SEQ ID NO: 992925 - RNA, 19 nt, Homo sapiens
gcugaaaucuggauaguac

SEQ ID NO: 992926 - RNA, 19 nt, Homo sapiens
caagcggguugcucacuua

SEQ ID NO: 992927 - RNA, 19 nt, Homo sapiens
gaagaaacugggaaugauu

SEQ ID NO: 992928 - RNA, 19 nt, Homo sapiens
gaguauaaguugagcauag

SEQ ID NO: 992929 - RNA, 19 nt, Homo sapiens
ucaaaggagucugaaauau

SEQ ID NO: 992930 - RNA, 19 nt, Homo sapiens
gcuguucgcugcaguuguu

SEQ ID NO: 992931 - RNA, 19 nt, Homo sapiens
caucaguacucaagcacua

SEQ ID NO: 992932 - RNA, 19 nt, Homo sapiens
gggaaacagcuacugauaa

SEQ ID NO: 992933 - RNA, 19 nt, Homo sapiens
cgaagaaacugggaaugau

SEQ ID NO: 992934 - RNA, 19 nt, Homo sapiens
gagguggucuuauggagau

SEQ ID NO: 992935 - RNA, 19 nt, Homo sapiens
caaaggagucugaaauauc

SEQ ID NO: 992936 - RNA, 19 nt, Homo sapiens
uuauggagauggcaagaaa

SEQ ID NO: 992937 - RNA, 19 nt, Homo sapiens
gcgaagaaacugggaauga

SEQ ID NO: 992938 - RNA, 19 nt, Homo sapiens
caagaaaggaggaaaugau

SEQ ID NO: 992939 - RNA, 19 nt, Homo sapiens
guuccuugauagcaucuua

SEQ ID NO: 992940 - RNA, 19 nt, Homo sapiens
gagcugaaaucuggauagu

SEQ ID NO: 992941 - RNA, 19 nt, Homo sapiens
ggacaaacugggcuacuca

SEQ ID NO: 992942 - RNA, 19 nt, Homo sapiens
gcaagaaaggaggaaauga

SEQ ID NO: 992943 - RNA, 19 nt, Homo sapiens
uuagauuccuuuccucaga

SEQ ID NO: 992944 - RNA, 19 nt, Homo sapiens
aaacuucacuguucaaccu

SEQ ID NO: 992945 - RNA, 19 nt, Homo sapiens
ccaagcggguugcucacuu

SEQ ID NO: 992946 - RNA, 19 nt, Homo sapiens
uacuuaaacuucacuguuc

SEQ ID NO: 992947 - RNA, 19 nt, Homo sapiens
ggccugccaucccaacuug

SEQ ID NO: 992948 - RNA, 19 nt, Homo sapiens
gaaggaagggagcauguac

SEQ ID NO: 992949 - RNA, 19 nt, Homo sapiens
ccuaugagcaaaucuguau

SEQ ID NO: 992950 - RNA, 19 nt, Homo sapiens
accaagagguuccgcuuug

SEQ ID NO: 992951 - RNA, 19 nt, Homo sapiens
aagaaaggaggaaaugauu

SEQ ID NO: 992952 - RNA, 19 nt, Homo sapiens
caaacugggcuacucacaa

SEQ ID NO: 992953 - RNA, 19 nt, Homo sapiens
acccagugcuuucugcuuu

SEQ ID NO: 992954 - RNA, 19 nt, Homo sapiens
cucaaaggagucugaaaua

SEQ ID NO: 992955 - RNA, 19 nt, Homo sapiens
uuccagagguggucuuaug

SEQ ID NO: 992956 - RNA, 19 nt, Homo sapiens
uggauggccuccuaaaucu

SEQ ID NO: 992957 - RNA, 19 nt, Homo sapiens
agaaaaggauaucaucuug

SEQ ID NO: 992958 - RNA, 19 nt, Homo sapiens
ggacaggaaucaccccaau

SEQ ID NO: 992959 - RNA, 19 nt, Homo sapiens
acauucagcccaacaagaa

SEQ ID NO: 992960 - RNA, 19 nt, Homo sapiens
guaccuggauagccugaag

SEQ ID NO: 992961 - RNA, 19 nt, Homo sapiens
guaccugcaggaacaauau

SEQ ID NO: 992962 - RNA, 19 nt, Homo sapiens
ccucagaguuucagguuuu

SEQ ID NO: 992963 - RNA, 19 nt, Homo sapiens
aaacagcuacugauaaucg

SEQ ID NO: 992964 - RNA, 19 nt, Homo sapiens
gauccaacccagugcuuuc

SEQ ID NO: 992965 - RNA, 19 nt, Homo sapiens
ggaucaaggcuauguggau

SEQ ID NO: 992966 - RNA, 19 nt, Homo sapiens
ucucaaaggagucugaaau

SEQ ID NO: 992967 - RNA, 19 nt, Homo sapiens
gaaaaggcgcuccgucaug

SEQ ID NO: 992968 - RNA, 19 nt, Homo sapiens
ggagggaagaugucucagu

SEQ ID NO: 992969 - RNA, 19 nt, Homo sapiens
cuauguggaucuugucauc

SEQ ID NO: 992970 - RNA, 19 nt, Homo sapiens
ucaguacucaagcacuaua

SEQ ID NO: 992971 - RNA, 19 nt, Homo sapiens
gcgggaggacuuagaggaa

SEQ ID NO: 992972 - RNA, 19 nt, Homo sapiens
ucaaggcuauguggaucuu

SEQ ID NO: 992973 - RNA, 19 nt, Homo sapiens
gagggaaacagcuacugau

SEQ ID NO: 992974 - RNA, 19 nt, Homo sapiens
guaugugugaguauaaguu

SEQ ID NO: 992975 - RNA, 19 nt, Homo sapiens
aaaucuguaugugugagua

SEQ ID NO: 992976 - RNA, 19 nt, Homo sapiens
agggaaacagcuacugaua

SEQ ID NO: 992977 - RNA, 19 nt, Homo sapiens
aagaaacugggaaugauug

SEQ ID NO: 992978 - RNA, 19 nt, Homo sapiens
ggcaagaaaggaggaaaug

SEQ ID NO: 992979 - RNA, 19 nt, Homo sapiens
caucuugcgggaggacuua

SEQ ID NO: 992980 - RNA, 19 nt, Homo sapiens
cagcuacugauaaucgaaa

SEQ ID NO: 992981 - RNA, 19 nt, Homo sapiens
caaccuaugagcaaaucug

SEQ ID NO: 992982 - RNA, 19 nt, Homo sapiens
ccugaaagucccugaagau

SEQ ID NO: 992983 - RNA, 19 nt, Homo sapiens
agagggaaacagcuacuga

SEQ ID NO: 992984 - RNA, 19 nt, Homo sapiens
caagauuggcuaguuccuu

SEQ ID NO: 992985 - RNA, 19 nt, Homo sapiens
cuccuuggauggccuccua

SEQ ID NO: 992986 - RNA, 19 nt, Homo sapiens
gaaacagcuacugauaauc

SEQ ID NO: 992987 - RNA, 19 nt, Homo sapiens
uaugagcaaaucuguaugu

SEQ ID NO: 992988 - RNA, 19 nt, Homo sapiens
cuugauagcaucuuacucu

SEQ ID NO: 992989 - RNA, 19 nt, Homo sapiens
gaugcgauucaccuacuga

SEQ ID NO: 992990 - RNA, 19 nt, Homo sapiens
gcggguugcucacuuacac

SEQ ID NO: 992991 - RNA, 19 nt, Homo sapiens
auaaguugagcauagcaua

SEQ ID NO: 992992 - RNA, 19 nt, Homo sapiens
agaaggaagggagcaugua

SEQ ID NO: 992993 - RNA, 19 nt, Homo sapiens
cgauucaccuacugagcau

SEQ ID NO: 992994 - RNA, 19 nt, Homo sapiens
cagcaagggcuuugugacu

SEQ ID NO: 992995 - RNA, 19 nt, Homo sapiens
gggaggacuuagaggaacu

SEQ ID NO: 992996 - RNA, 19 nt, Homo sapiens
caccaagagguuccgcuuu

SEQ ID NO: 992997 - RNA, 19 nt, Homo sapiens
gccacaacaccaagagguu

SEQ ID NO: 992998 - RNA, 19 nt, Homo sapiens
gccugaagguugggcaugu

SEQ ID NO: 992999 - RNA, 19 nt, Homo sapiens
gauuucuucagaucucaaa

SEQ ID NO: 993000 - RNA, 19 nt, Homo sapiens
aaugauuucuucagaucuc

SEQ ID NO: 993001 - RNA, 19 nt, Homo sapiens
ccagagguggucuuaugga

SEQ ID NO: 993002 - RNA, 19 nt, Homo sapiens
gagcagucucuuccaugga

SEQ ID NO: 993003 - RNA, 19 nt, Homo sapiens
uuggauggccuccuaaauc

SEQ ID NO: 993004 - RNA, 19 nt, Homo sapiens
cuaccucuccacccgaauu

SEQ ID NO: 993005 - RNA, 19 nt, Homo sapiens
gaaagaaacccuaugauug

SEQ ID NO: 993006 - RNA, 19 nt, Homo sapiens
gaagacauaugguaguaaa

SEQ ID NO: 993007 - RNA, 19 nt, Homo sapiens
gagcaacccuauaaaugua

SEQ ID NO: 993008 - RNA, 19 nt, Homo sapiens
gagaaacccuauacaugua

SEQ ID NO: 993009 - RNA, 19 nt, Homo sapiens
gggaaagccuucaguguuu

SEQ ID NO: 993010 - RNA, 19 nt, Homo sapiens
ggacaucugugguggcuuu

SEQ ID NO: 993011 - RNA, 19 nt, Homo sapiens
gaaagacccuaugaaugua

SEQ ID NO: 993012 - RNA, 19 nt, Homo sapiens
ggaaagaaacccuaugauu

SEQ ID NO: 993013 - RNA, 19 nt, Homo sapiens
ucaguuaucugcagucuuu

SEQ ID NO: 993014 - RNA, 19 nt, Homo sapiens
gagaagccauauaaaugua

SEQ ID NO: 993015 - RNA, 19 nt, Homo sapiens
gggaaaggcuuaaguuauc

SEQ ID NO: 993016 - RNA, 19 nt, Homo sapiens
gagagaagccauauaaaug

SEQ ID NO: 993017 - RNA, 19 nt, Homo sapiens
ggagauggcccucauaaau

SEQ ID NO: 993018 - RNA, 19 nt, Homo sapiens
gagaagucauauacacaua

SEQ ID NO: 993019 - RNA, 19 nt, Homo sapiens
gagagaagcccuaugaaug

SEQ ID NO: 993020 - RNA, 19 nt, Homo sapiens
gguaaagccuucagucguu

SEQ ID NO: 993021 - RNA, 19 nt, Homo sapiens
gagaaacccuaugaaugua

SEQ ID NO: 993022 - RNA, 19 nt, Homo sapiens
gagagaaacccuacaaaug

SEQ ID NO: 993023 - RNA, 19 nt, Homo sapiens
cuaaagccuucccugauua

SEQ ID NO: 993024 - RNA, 19 nt, Homo sapiens
ggagaaaccguaugaaugu

SEQ ID NO: 993025 - RNA, 19 nt, Homo sapiens
ggagagaagccauauaaau

SEQ ID NO: 993026 - RNA, 19 nt, Homo sapiens
ggagaaagacccuaugaau

SEQ ID NO: 993027 - RNA, 19 nt, Homo sapiens
ugaaggaacucacacucua

SEQ ID NO: 993028 - RNA, 19 nt, Homo sapiens
ucucagaaaucauauggua

SEQ ID NO: 993029 - RNA, 19 nt, Homo sapiens
gggaaagccuucagucguu

SEQ ID NO: 993030 - RNA, 19 nt, Homo sapiens
ggagauggaccuuauaaau

SEQ ID NO: 993031 - RNA, 19 nt, Homo sapiens
gacacaaacuguauaagug

SEQ ID NO: 993032 - RNA, 19 nt, Homo sapiens
gagagaaacccuaugaaug

SEQ ID NO: 993033 - RNA, 19 nt, Homo sapiens
ggagauggaccucauaaau

SEQ ID NO: 993034 - RNA, 19 nt, Homo sapiens
gagagaaacccuauacaug

SEQ ID NO: 993035 - RNA, 19 nt, Homo sapiens
ucuaaagccuucccuguuu

SEQ ID NO: 993036 - RNA, 19 nt, Homo sapiens
ccucauaaaugcacaguau

SEQ ID NO: 993037 - RNA, 19 nt, Homo sapiens
gagauggaccuuauaaaug

SEQ ID NO: 993038 - RNA, 19 nt, Homo sapiens
gggaaacccuucaguuauc

SEQ ID NO: 993039 - RNA, 19 nt, Homo sapiens
gagaaagacccuaugaaug

SEQ ID NO: 993040 - RNA, 19 nt, Homo sapiens
gaacucacacucuagagaa

SEQ ID NO: 993041 - RNA, 19 nt, Homo sapiens
gagaaaccauaugaaugua

SEQ ID NO: 993042 - RNA, 19 nt, Homo sapiens
ggagagaaaccauaugaau

SEQ ID NO: 993043 - RNA, 19 nt, Homo sapiens
gaauggagaagucauaaug

SEQ ID NO: 993044 - RNA, 19 nt, Homo sapiens
ggaaagccuucagucguuu

SEQ ID NO: 993045 - RNA, 19 nt, Homo sapiens
agaaagacccuaugaaugu

SEQ ID NO: 993046 - RNA, 19 nt, Homo sapiens
gagagcaacccuauaaaug

SEQ ID NO: 993047 - RNA, 19 nt, Homo sapiens
gagauggaccucauaaaug

SEQ ID NO: 993048 - RNA, 19 nt, Homo sapiens
gagaagccauaugaaugua

SEQ ID NO: 993049 - RNA, 19 nt, Homo sapiens
gcagagaagccauaugaau

SEQ ID NO: 993050 - RNA, 19 nt, Homo sapiens
ggagagaaacccuaugaau

SEQ ID NO: 993051 - RNA, 19 nt, Homo sapiens
ggagagaaacccuacaaau

SEQ ID NO: 993052 - RNA, 19 nt, Homo sapiens
gagaaaccguaugaaugua

SEQ ID NO: 993053 - RNA, 19 nt, Homo sapiens
gaaaccauaugaauguaag

SEQ ID NO: 993054 - RNA, 19 nt, Homo sapiens
ggaaaccuucgaagacaua

SEQ ID NO: 993055 - RNA, 19 nt, Homo sapiens
gugggaaacccuucaguua

SEQ ID NO: 993056 - RNA, 19 nt, Homo sapiens
gcagagaagucauauacac

SEQ ID NO: 993057 - RNA, 19 nt, Homo sapiens
uuaggaaccugaacuguau

SEQ ID NO: 993058 - RNA, 19 nt, Homo sapiens
gaauguaaacacuguggua

SEQ ID NO: 993059 - RNA, 19 nt, Homo sapiens
gggaaagcauuuaguucuu

SEQ ID NO: 993060 - RNA, 19 nt, Homo sapiens
gaagaggagccuuaugaau

SEQ ID NO: 993061 - RNA, 19 nt, Homo sapiens
gagauggcccucauaaaug

SEQ ID NO: 993062 - RNA, 19 nt, Homo sapiens
ucuaaagccuucccugauu

SEQ ID NO: 993063 - RNA, 19 nt, Homo sapiens
gagagaaaccauaugaaug

SEQ ID NO: 993064 - RNA, 19 nt, Homo sapiens
gaagucauauacacauaag

SEQ ID NO: 993065 - RNA, 19 nt, Homo sapiens
gaaccuggccacuauagga

SEQ ID NO: 993066 - RNA, 19 nt, Homo sapiens
ggaauggacuuugcuggau

SEQ ID NO: 993067 - RNA, 19 nt, Homo sapiens
ggagagaagcccuaugaau

SEQ ID NO: 993068 - RNA, 19 nt, Homo sapiens
gaaacccuauacauguaaa

SEQ ID NO: 993069 - RNA, 19 nt, Homo sapiens
agauggaccuuauaaaugu

SEQ ID NO: 993070 - RNA, 19 nt, Homo sapiens
aaagaaacccuaugauugu

SEQ ID NO: 993071 - RNA, 19 nt, Homo sapiens
gagacucugugaaaguaaa

SEQ ID NO: 993072 - RNA, 19 nt, Homo sapiens
gaacaugaaagaacucaca

SEQ ID NO: 993073 - RNA, 19 nt, Homo sapiens
ggagagcaacccuauaaau

SEQ ID NO: 993074 - RNA, 19 nt, Homo sapiens
guagagagauuugguaaaa

SEQ ID NO: 993075 - RNA, 19 nt, Homo sapiens
ggagaaauccaagguguga

SEQ ID NO: 993076 - RNA, 19 nt, Homo sapiens
gaaagcaguguauguggaa

SEQ ID NO: 993077 - RNA, 19 nt, Homo sapiens
ggauguggcugugaacuuc

SEQ ID NO: 993078 - RNA, 19 nt, Homo sapiens
ucgaguacaugaaagaauu

SEQ ID NO: 993079 - RNA, 19 nt, Homo sapiens
ggaggaaagcuuugggaaa

SEQ ID NO: 993080 - RNA, 19 nt, Homo sapiens
gaacuucacccaggaggaa

SEQ ID NO: 993081 - RNA, 19 nt, Homo sapiens
gugaagaggagccuuauga

SEQ ID NO: 993082 - RNA, 19 nt, Homo sapiens
ccucauaaauguaagagau

SEQ ID NO: 993083 - RNA, 19 nt, Homo sapiens
agauggaccucauaaaugu

SEQ ID NO: 993084 - RNA, 19 nt, Homo sapiens
gggagaaaccguaugaaug

SEQ ID NO: 993085 - RNA, 19 nt, Homo sapiens
guuuacaguuccuaucuaa

SEQ ID NO: 993086 - RNA, 19 nt, Homo sapiens
guauaagugucaggaauau

SEQ ID NO: 993087 - RNA, 19 nt, Homo sapiens
agagaaacccuaugaaugu

SEQ ID NO: 993088 - RNA, 19 nt, Homo sapiens
ggagagaaacccuauacau

SEQ ID NO: 993089 - RNA, 19 nt, Homo sapiens
agagaaacccuacaaaugu

SEQ ID NO: 993090 - RNA, 19 nt, Homo sapiens
gaaccugaacuguauagga

SEQ ID NO: 993091 - RNA, 19 nt, Homo sapiens
agagaagcccuaugaauga

SEQ ID NO: 993092 - RNA, 19 nt, Homo sapiens
agaggagccuuaugaaugu

SEQ ID NO: 993093 - RNA, 19 nt, Homo sapiens
ucucaucgcucaagcuuuc

SEQ ID NO: 993094 - RNA, 19 nt, Homo sapiens
acaggcacauuagaucuua

SEQ ID NO: 993095 - RNA, 19 nt, Homo sapiens
gcuggauccuucacagaaa

SEQ ID NO: 993096 - RNA, 19 nt, Homo sapiens
ucagugaccuuugaagaug

SEQ ID NO: 993097 - RNA, 19 nt, Homo sapiens
aaccugaacuguauaggaa

SEQ ID NO: 993098 - RNA, 19 nt, Homo sapiens
gaauguaagcaguguucua

SEQ ID NO: 993099 - RNA, 19 nt, Homo sapiens
gaauguaagcaguguucua

SEQ ID NO: 993100 - RNA, 19 nt, Homo sapiens
gaagccauaugaauguaag

SEQ ID NO: 993101 - RNA, 19 nt, Homo sapiens
cagagaagccauaugaaug

SEQ ID NO: 993102 - RNA, 19 nt, Homo sapiens
gcaacccuauaaauguaaa

SEQ ID NO: 993103 - RNA, 19 nt, Homo sapiens
acagaagaaucucuacaga

SEQ ID NO: 993104 - RNA, 19 nt, Homo sapiens
uaucgccacuccuuucaaa

SEQ ID NO: 993105 - RNA, 19 nt, Homo sapiens
ggaaaucacuccuccauau

SEQ ID NO: 993106 - RNA, 19 nt, Homo sapiens
gcaaacugaugaccuaaua

SEQ ID NO: 993107 - RNA, 19 nt, Homo sapiens
ggagagagaccuuauguuu

SEQ ID NO: 993108 - RNA, 19 nt, Homo sapiens
ggagaaaccuuuugaauau

SEQ ID NO: 993109 - RNA, 19 nt, Homo sapiens
gaagagccauggauaguag

SEQ ID NO: 993110 - RNA, 19 nt, Homo sapiens
aaugaaagcugaugaaugu

SEQ ID NO: 993111 - RNA, 19 nt, Homo sapiens
gagguaauguuccugguaa

SEQ ID NO: 993112 - RNA, 19 nt, Homo sapiens
gaagagagagguaauguuc

SEQ ID NO: 993113 - RNA, 19 nt, Homo sapiens
ucaaacaccuuguacauca

SEQ ID NO: 993114 - RNA, 19 nt, Homo sapiens
agagaaaccuuacgaaugu

SEQ ID NO: 993115 - RNA, 19 nt, Homo sapiens
gagagaagcccuaugaaug

SEQ ID NO: 993116 - RNA, 19 nt, Homo sapiens
gaaaugaagcccuaugaau

SEQ ID NO: 993117 - RNA, 19 nt, Homo sapiens
gaauguaguuauuguggaa

SEQ ID NO: 993118 - RNA, 19 nt, Homo sapiens
agagaacccuuucaguaua

SEQ ID NO: 993119 - RNA, 19 nt, Homo sapiens
gagaagcccuaugaaugua

SEQ ID NO: 993120 - RNA, 19 nt, Homo sapiens
gagaagcccuaugaaugua

SEQ ID NO: 993121 - RNA, 19 nt, Homo sapiens
gauggaagcuaugcaagaa

SEQ ID NO: 993122 - RNA, 19 nt, Homo sapiens
ggacguggcuguggacuuc

SEQ ID NO: 993123 - RNA, 19 nt, Homo sapiens
caacagccaucagagaauu

SEQ ID NO: 993124 - RNA, 19 nt, Homo sapiens
ucagacaucucauauggaa

SEQ ID NO: 993125 - RNA, 19 nt, Homo sapiens
gagagaaaccguaugaaug

SEQ ID NO: 993126 - RNA, 19 nt, Homo sapiens
agagagaccuuauguuugu

SEQ ID NO: 993127 - RNA, 19 nt, Homo sapiens
ggagaagcccuaugaaugu

SEQ ID NO: 993128 - RNA, 19 nt, Homo sapiens
gagagaaaccuuacgaaug

SEQ ID NO: 993129 - RNA, 19 nt, Homo sapiens
ucagagaacccuuucagua

SEQ ID NO: 993130 - RNA, 19 nt, Homo sapiens
gaugaagucuggcaaacug

SEQ ID NO: 993131 - RNA, 19 nt, Homo sapiens
caucagacaucucauaugg

SEQ ID NO: 993132 - RNA, 19 nt, Homo sapiens
gauaguagaaggagaauuc

SEQ ID NO: 993133 - RNA, 19 nt, Homo sapiens
ggaaaucuaucaguauaag

SEQ ID NO: 993134 - RNA, 19 nt, Homo sapiens
gagaaacccuaugagugua

SEQ ID NO: 993135 - RNA, 19 nt, Homo sapiens
guacaucagacaucucaua

SEQ ID NO: 993136 - RNA, 19 nt, Homo sapiens
gaaaucacuccuccauauu

SEQ ID NO: 993137 - RNA, 19 nt, Homo sapiens
gagaaaccguaugaaugua

SEQ ID NO: 993138 - RNA, 19 nt, Homo sapiens
ggagagaaaccguaugaau

SEQ ID NO: 993139 - RNA, 19 nt, Homo sapiens
gaccuuauguuugucauga

SEQ ID NO: 993140 - RNA, 19 nt, Homo sapiens
gggagaagcccuaugaaug

SEQ ID NO: 993141 - RNA, 19 nt, Homo sapiens
caaacuguguucauugaga

SEQ ID NO: 993142 - RNA, 19 nt, Homo sapiens
ggcaaacuguguucauuga

SEQ ID NO: 993143 - RNA, 19 nt, Homo sapiens
gaagucagaccucauuuua

SEQ ID NO: 993144 - RNA, 19 nt, Homo sapiens
ggagagaagcccuaugaau

SEQ ID NO: 993145 - RNA, 19 nt, Homo sapiens
gaaugaaagcugaugaaug

SEQ ID NO: 993146 - RNA, 19 nt, Homo sapiens
gcauaucagggaaaucaua

SEQ ID NO: 993147 - RNA, 19 nt, Homo sapiens
gaaaccguaugaauguaau

SEQ ID NO: 993148 - RNA, 19 nt, Homo sapiens
gagaucaagcuuaugaauu

SEQ ID NO: 993149 - RNA, 19 nt, Homo sapiens
gagaacccuuucaguauag

SEQ ID NO: 993150 - RNA, 19 nt, Homo sapiens
gagagagaccuuauguuug

SEQ ID NO: 993151 - RNA, 19 nt, Homo sapiens
caacaucagagaacacauu

SEQ ID NO: 993152 - RNA, 19 nt, Homo sapiens
ggagagaaaccuuacgaau

SEQ ID NO: 993153 - RNA, 19 nt, Homo sapiens
ggaaaugaagcccuaugaa

SEQ ID NO: 993154 - RNA, 19 nt, Homo sapiens
gaaagcugaugaauguagu

SEQ ID NO: 993155 - RNA, 19 nt, Homo sapiens
cuucagagcuauccagaug

SEQ ID NO: 993156 - RNA, 19 nt, Homo sapiens
ggagaauuccuacuucaga

SEQ ID NO: 993157 - RNA, 19 nt, Homo sapiens
cagagaacccuuucaguau

SEQ ID NO: 993158 - RNA, 19 nt, Homo sapiens
agacacaccucacacaaca

SEQ ID NO: 993159 - RNA, 19 nt, Homo sapiens
gaagacacaccucacacaa

SEQ ID NO: 993160 - RNA, 19 nt, Homo sapiens
aaaucacuccuccauauua

SEQ ID NO: 993161 - RNA, 19 nt, Homo sapiens
gagaggcaauaugaaugua

SEQ ID NO: 993162 - RNA, 19 nt, Homo sapiens
caucagagaauucauagga

SEQ ID NO: 993163 - RNA, 19 nt, Homo sapiens
ggagagaaacccuaugagu

SEQ ID NO: 993164 - RNA, 19 nt, Homo sapiens
gagaaaccuuacgaaugua

SEQ ID NO: 993165 - RNA, 19 nt, Homo sapiens
aaucacuccuccauauuaa

SEQ ID NO: 993166 - RNA, 19 nt, Homo sapiens
ucagagcuauccagaugaa

SEQ ID NO: 993167 - RNA, 19 nt, Homo sapiens
gaagacauaauccuuugga

SEQ ID NO: 993168 - RNA, 19 nt, Homo sapiens
gaggcaauaugaauguaau

SEQ ID NO: 993169 - RNA, 19 nt, Homo sapiens
ugucauaucucacuguaca

SEQ ID NO: 993170 - RNA, 19 nt, Homo sapiens
ggggaaaucuaucaguaua

SEQ ID NO: 993171 - RNA, 19 nt, Homo sapiens
aaaugaagcccuaugaaug

SEQ ID NO: 993172 - RNA, 19 nt, Homo sapiens
agucagaccucauuuuaua

SEQ ID NO: 993173 - RNA, 19 nt, Homo sapiens
ggagaggcaauaugaaugu

SEQ ID NO: 993174 - RNA, 19 nt, Homo sapiens
ggaagaacuuuuaccagaa

SEQ ID NO: 993175 - RNA, 19 nt, Homo sapiens
gggaaauccuucuguaaaa

SEQ ID NO: 993176 - RNA, 19 nt, Homo sapiens
uaaguggaauggaucugaa

SEQ ID NO: 993177 - RNA, 19 nt, Homo sapiens
gggaugugaugcuggagaa

SEQ ID NO: 993178 - RNA, 19 nt, Homo sapiens
guaugaauguaaugagugu

SEQ ID NO: 993179 - RNA, 19 nt, Homo sapiens
gugugaaacucuacaagug

SEQ ID NO: 993180 - RNA, 19 nt, Homo sapiens
caggagagaagcccuauga

SEQ ID NO: 993181 - RNA, 19 nt, Homo sapiens
ggagaacuacagcaaucua

SEQ ID NO: 993182 - RNA, 19 nt, Homo sapiens
gagcagaagauaacuuaca

SEQ ID NO: 993183 - RNA, 19 nt, Homo sapiens
cuacagcaaucuaguuucu

SEQ ID NO: 993184 - RNA, 19 nt, Homo sapiens
agagaaaccguaugaaugu

SEQ ID NO: 993185 - RNA, 19 nt, Homo sapiens
gaagcccuaugaauguaau

SEQ ID NO: 993186 - RNA, 19 nt, Homo sapiens
ggagaucaagcuuaugaau

SEQ ID NO: 993187 - RNA, 19 nt, Homo sapiens
caggagaucaagcuuauga

SEQ ID NO: 993188 - RNA, 19 nt, Homo sapiens
gcugaugaauguaguggau

SEQ ID NO: 993189 - RNA, 19 nt, Homo sapiens
ggagaagagccauggauag

SEQ ID NO: 993190 - RNA, 19 nt, Homo sapiens
uggaagacauaauccuuug

SEQ ID NO: 993191 - RNA, 19 nt, Homo sapiens
agagaaacccuaugagugu

SEQ ID NO: 993192 - RNA, 19 nt, Homo sapiens
ggaccucacuguacaucag

SEQ ID NO: 993193 - RNA, 19 nt, Homo sapiens
gagaagagccauggauagu

SEQ ID NO: 993194 - RNA, 19 nt, Homo sapiens
gauacaauagcaaacuuga

SEQ ID NO: 993195 - RNA, 19 nt, Homo sapiens
guugucauaucucacugua

SEQ ID NO: 993196 - RNA, 19 nt, Homo sapiens
ggacuucacccaggaggaa

SEQ ID NO: 993197 - RNA, 19 nt, Homo sapiens
acacaggagagaaaccuua

SEQ ID NO: 993198 - RNA, 19 nt, Homo sapiens
agacauaauccuuuggaaa

SEQ ID NO: 993199 - RNA, 19 nt, Homo sapiens
cucauaaucugaagacuca

SEQ ID NO: 993200 - RNA, 19 nt, Homo sapiens
ccacaaaucagcauucaac

SEQ ID NO: 993201 - RNA, 19 nt, Homo sapiens
uggaauggaucugaaauag

SEQ ID NO: 993202 - RNA, 19 nt, Homo sapiens
gagaauccaggaagaggaa

SEQ ID NO: 993203 - RNA, 19 nt, Homo sapiens
uagagagaauccaggaaga

SEQ ID NO: 993204 - RNA, 19 nt, Homo sapiens
gacauaauccuuuggaaac

SEQ ID NO: 993205 - RNA, 19 nt, Homo sapiens
cgaaguggcuggcucauuu

SEQ ID NO: 993206 - RNA, 19 nt, Homo sapiens
ggagugcaauaauacugua

SEQ ID NO: 993207 - RNA, 19 nt, Homo sapiens
gcauugaaggagagaauua

SEQ ID NO: 993208 - RNA, 19 nt, Homo sapiens
uuucagugcuggcauauuu

SEQ ID NO: 993209 - RNA, 19 nt, Homo sapiens
cauagcaucuuuccuguca

SEQ ID NO: 993210 - RNA, 19 nt, Homo sapiens
uuaccucccucaaccaaua

SEQ ID NO: 993211 - RNA, 19 nt, Homo sapiens
gaaguggcuggcucauuua

SEQ ID NO: 993212 - RNA, 19 nt, Homo sapiens
cagcgugacugacauuaug

SEQ ID NO: 993213 - RNA, 19 nt, Homo sapiens
gcuggaaucuggucaccuu

SEQ ID NO: 993214 - RNA, 19 nt, Homo sapiens
caaccaauauauagacaca

SEQ ID NO: 993215 - RNA, 19 nt, Homo sapiens
guacagaccagaugcuuuc

SEQ ID NO: 993216 - RNA, 19 nt, Homo sapiens
cagaccagaugcuuucuug

SEQ ID NO: 993217 - RNA, 19 nt, Homo sapiens
guggcuggcucauuuaaga

SEQ ID NO: 993218 - RNA, 19 nt, Homo sapiens
gaguacaugcggguuauua

SEQ ID NO: 993219 - RNA, 19 nt, Homo sapiens
ggaguuacauuuggauuuu

SEQ ID NO: 993220 - RNA, 19 nt, Homo sapiens
gaagcucaaugugcauaug

SEQ ID NO: 993221 - RNA, 19 nt, Homo sapiens
acaaugaaaugaagcucaa

SEQ ID NO: 993222 - RNA, 19 nt, Homo sapiens
gagaaccaguguaugucaa

SEQ ID NO: 993223 - RNA, 19 nt, Homo sapiens
ugagcaacaugauugagaa

SEQ ID NO: 993224 - RNA, 19 nt, Homo sapiens
gaggaguacaugcggguua

SEQ ID NO: 993225 - RNA, 19 nt, Homo sapiens
gcaagagcagcgugacuga

SEQ ID NO: 993226 - RNA, 19 nt, Homo sapiens
gcaacaugauugagaacca

SEQ ID NO: 993227 - RNA, 19 nt, Homo sapiens
aaaccucaaugcaagauag

SEQ ID NO: 993228 - RNA, 19 nt, Homo sapiens
auagacacauagcaucuuu

SEQ ID NO: 993229 - RNA, 19 nt, Homo sapiens
cugcucaaguuccagauuu

SEQ ID NO: 993230 - RNA, 19 nt, Homo sapiens
gcaagagauuaaagaugca

SEQ ID NO: 993231 - RNA, 19 nt, Homo sapiens
uucauggagugcaauaaua

SEQ ID NO: 993232 - RNA, 19 nt, Homo sapiens
caacuuguucaaauucuug

SEQ ID NO: 993233 - RNA, 19 nt, Homo sapiens
guuauaggcggguguuuga

SEQ ID NO: 993234 - RNA, 19 nt, Homo sapiens
acaggugcauuugagauaa

SEQ ID NO: 993235 - RNA, 19 nt, Homo sapiens
gaaccaguguaugucaaca

SEQ ID NO: 993236 - RNA, 19 nt, Homo sapiens
uaagguuuaugcauguaug

SEQ ID NO: 993237 - RNA, 19 nt, Homo sapiens
uaugaaggccuguacugaa

SEQ ID NO: 993238 - RNA, 19 nt, Homo sapiens
caacaggugcauuugagau

SEQ ID NO: 993239 - RNA, 19 nt, Homo sapiens
guguuucagugcuggcaua

SEQ ID NO: 993240 - RNA, 19 nt, Homo sapiens
gagcagcgugacugacauu

SEQ ID NO: 993241 - RNA, 19 nt, Homo sapiens
ucaaugugcauauggauuc

SEQ ID NO: 993242 - RNA, 19 nt, Homo sapiens
ccagacauccgcauugaag

SEQ ID NO: 993243 - RNA, 19 nt, Homo sapiens
ucaaugcaagauaguguuu

SEQ ID NO: 993244 - RNA, 19 nt, Homo sapiens
caucuuuccugucagucuu

SEQ ID NO: 993245 - RNA, 19 nt, Homo sapiens
ccacaaaaucacccaguua

SEQ ID NO: 993246 - RNA, 19 nt, Homo sapiens
gcagcgugacugacauuau

SEQ ID NO: 993247 - RNA, 19 nt, Homo sapiens
uaugucaacaggugcauuu

SEQ ID NO: 993248 - RNA, 19 nt, Homo sapiens
caaaaucacccaguuaaug

SEQ ID NO: 993249 - RNA, 19 nt, Homo sapiens
cagcaagagauuaaagaug

SEQ ID NO: 993250 - RNA, 19 nt, Homo sapiens
gugcauuugagauaacuuu

SEQ ID NO: 993251 - RNA, 19 nt, Homo sapiens
gagaauuaccucccucaac

SEQ ID NO: 993252 - RNA, 19 nt, Homo sapiens
guagaaaauuggaguuaca

SEQ ID NO: 993253 - RNA, 19 nt, Homo sapiens
aaugcaagauaguguuuca

SEQ ID NO: 993254 - RNA, 19 nt, Homo sapiens
gaaggccuguacugaagac

SEQ ID NO: 993255 - RNA, 19 nt, Homo sapiens
ugauugagaaccaguguau

SEQ ID NO: 993256 - RNA, 19 nt, Homo sapiens
uaauaauuguuggcaagga

SEQ ID NO: 993257 - RNA, 19 nt, Homo sapiens
uagcaucuuuccugucagu

SEQ ID NO: 993258 - RNA, 19 nt, Homo sapiens
guaccuguguggucuaagc

SEQ ID NO: 993259 - RNA, 19 nt, Homo sapiens
uguguuuccugagguuaua

SEQ ID NO: 993260 - RNA, 19 nt, Homo sapiens
ucacccaguuaaugugugu

SEQ ID NO: 993261 - RNA, 19 nt, Homo sapiens
ugaaaugaagcucaaugug

SEQ ID NO: 993262 - RNA, 19 nt, Homo sapiens
gccaagaaaauaagguuua

SEQ ID NO: 993263 - RNA, 19 nt, Homo sapiens
gaugaggcuucugcugcuu

SEQ ID NO: 993264 - RNA, 19 nt, Homo sapiens
ggcggguguuugaggagua

SEQ ID NO: 993265 - RNA, 19 nt, Homo sapiens
aauaauuguuggcaaggau

SEQ ID NO: 993266 - RNA, 19 nt, Homo sapiens
gcuggcauauuuuggaauu

SEQ ID NO: 993267 - RNA, 19 nt, Homo sapiens
guacccagacauccgcauu

SEQ ID NO: 993268 - RNA, 19 nt, Homo sapiens
caaugugcauauggauuca

SEQ ID NO: 993269 - RNA, 19 nt, Homo sapiens
aacaggugcauuugagaua

SEQ ID NO: 993270 - RNA, 19 nt, Homo sapiens
gguuauaggcggguguuug

SEQ ID NO: 993271 - RNA, 19 nt, Homo sapiens
uaugaugguuuucuucuug

SEQ ID NO: 993272 - RNA, 19 nt, Homo sapiens
gccagcaagagauuaaaga

SEQ ID NO: 993273 - RNA, 19 nt, Homo sapiens
uggaguuacauuuggauuu

SEQ ID NO: 993274 - RNA, 19 nt, Homo sapiens
ugagaaccaguguauguca

SEQ ID NO: 993275 - RNA, 19 nt, Homo sapiens
ccugucagucuucaaacua

SEQ ID NO: 993276 - RNA, 19 nt, Homo sapiens
augaaggccuguacugaag

SEQ ID NO: 993277 - RNA, 19 nt, Homo sapiens
gcauuaagggaucauugca

SEQ ID NO: 993278 - RNA, 19 nt, Homo sapiens
agacauccgcauugaagga

SEQ ID NO: 993279 - RNA, 19 nt, Homo sapiens
ucaaguuccagauuugugu

SEQ ID NO: 993280 - RNA, 19 nt, Homo sapiens
agagauuaaagaugcagua

SEQ ID NO: 993281 - RNA, 19 nt, Homo sapiens
acccagacauccgcauuga

SEQ ID NO: 993282 - RNA, 19 nt, Homo sapiens
ccaguuaaugugugugugu

SEQ ID NO: 993283 - RNA, 19 nt, Homo sapiens
ccagcaagagauuaaagau

SEQ ID NO: 993284 - RNA, 19 nt, Homo sapiens
gcaguggggccaagaaaau

SEQ ID NO: 993285 - RNA, 19 nt, Homo sapiens
cguuguaccucuuggaaaa

SEQ ID NO: 993286 - RNA, 19 nt, Homo sapiens
uaagggaucauugcaagag

SEQ ID NO: 993287 - RNA, 19 nt, Homo sapiens
gguuuaugcauguaugaug

SEQ ID NO: 993288 - RNA, 19 nt, Homo sapiens
cacaaaaucacccaguuaa

SEQ ID NO: 993289 - RNA, 19 nt, Homo sapiens
cauuuaagaugaggcuucu

SEQ ID NO: 993290 - RNA, 19 nt, Homo sapiens
gaagguaugugcaguauuu

SEQ ID NO: 993291 - RNA, 19 nt, Homo sapiens
gaacccagcuuugaacuua

SEQ ID NO: 993292 - RNA, 19 nt, Homo sapiens
gaaagaagaucuaaaugug

SEQ ID NO: 993293 - RNA, 19 nt, Homo sapiens
gaacaucagugaaagaaga

SEQ ID NO: 993294 - RNA, 19 nt, Homo sapiens
ggaguaagcugaagguaug

SEQ ID NO: 993295 - RNA, 19 nt, Homo sapiens
gguaaacccuuaaaucuug

SEQ ID NO: 993296 - RNA, 19 nt, Homo sapiens
gaacuaacgcauucaagua

SEQ ID NO: 993297 - RNA, 19 nt, Homo sapiens
ccacauaccagaaucauuu

SEQ ID NO: 993298 - RNA, 19 nt, Homo sapiens
gcuuugaacuuacaagauu

SEQ ID NO: 993299 - RNA, 19 nt, Homo sapiens
cagcacaucugcagucauu

SEQ ID NO: 993300 - RNA, 19 nt, Homo sapiens
gaagaugucagacuaaugu

SEQ ID NO: 993301 - RNA, 19 nt, Homo sapiens
caaguaugauucagcgaua

SEQ ID NO: 993302 - RNA, 19 nt, Homo sapiens
gauuaucacucaucaaugg

SEQ ID NO: 993303 - RNA, 19 nt, Homo sapiens
ggaaagauagcaagcauuc

SEQ ID NO: 993304 - RNA, 19 nt, Homo sapiens
gugacagacuuaaauauug

SEQ ID NO: 993305 - RNA, 19 nt, Homo sapiens
ggaagucacuccggucaga

SEQ ID NO: 993306 - RNA, 19 nt, Homo sapiens
gagcgacaaauucaaguua

SEQ ID NO: 993307 - RNA, 19 nt, Homo sapiens
ggaagucgccauaaagaug

SEQ ID NO: 993308 - RNA, 19 nt, Homo sapiens
cagcugucaugguauguua

SEQ ID NO: 993309 - RNA, 19 nt, Homo sapiens
gaaaguaguagccgaagug

SEQ ID NO: 993310 - RNA, 19 nt, Homo sapiens
caauaucuguguaauguag

SEQ ID NO: 993311 - RNA, 19 nt, Homo sapiens
ugaugaagaugucagacua

SEQ ID NO: 993312 - RNA, 19 nt, Homo sapiens
aaaaugagcuuggguuuaa

SEQ ID NO: 993313 - RNA, 19 nt, Homo sapiens
gaauucagguacccucaau

SEQ ID NO: 993314 - RNA, 19 nt, Homo sapiens
cuacagaacaucagugaaa

SEQ ID NO: 993315 - RNA, 19 nt, Homo sapiens
ggaugauucuuguauaaag

SEQ ID NO: 993316 - RNA, 19 nt, Homo sapiens
gaaguguggugaugcaucu

SEQ ID NO: 993317 - RNA, 19 nt, Homo sapiens
aaagaggaguauaggaauu

SEQ ID NO: 993318 - RNA, 19 nt, Homo sapiens
ccuguggacuccuuuaauu

SEQ ID NO: 993319 - RNA, 19 nt, Homo sapiens
ccuaauggcucucugaaag

SEQ ID NO: 993320 - RNA, 19 nt, Homo sapiens
ggagauauaccaacuguac

SEQ ID NO: 993321 - RNA, 19 nt, Homo sapiens
uagcauacccuaagauguu

SEQ ID NO: 993322 - RNA, 19 nt, Homo sapiens
uaauacaucugguggaagu

SEQ ID NO: 993323 - RNA, 19 nt, Homo sapiens
gaauuagaguugguacaga

SEQ ID NO: 993324 - RNA, 19 nt, Homo sapiens
gaacuugugcaauaucugu

SEQ ID NO: 993325 - RNA, 19 nt, Homo sapiens
acaaacaaaggaccaauaa

SEQ ID NO: 993326 - RNA, 19 nt, Homo sapiens
gaacuuacaagauuacacu

SEQ ID NO: 993327 - RNA, 19 nt, Homo sapiens
ggaggaagauauggaaguc

SEQ ID NO: 993328 - RNA, 19 nt, Homo sapiens
uguauagccuuucucaaga

SEQ ID NO: 993329 - RNA, 19 nt, Homo sapiens
cuaacgcauucaaguagua

SEQ ID NO: 993330 - RNA, 19 nt, Homo sapiens
ucaaucacuucaacauuuc

SEQ ID NO: 993331 - RNA, 19 nt, Homo sapiens
acacaucuuuguaugguau

SEQ ID NO: 993332 - RNA, 19 nt, Homo sapiens
gcacaucugcagucauuca

SEQ ID NO: 993333 - RNA, 19 nt, Homo sapiens
ugcaauaucuguguaaugu

SEQ ID NO: 993334 - RNA, 19 nt, Homo sapiens
acaaauagcugaggaucca

SEQ ID NO: 993335 - RNA, 19 nt, Homo sapiens
gaugucagacuaauguuau

SEQ ID NO: 993336 - RNA, 19 nt, Homo sapiens
gcgacaaauucaaguuaau

SEQ ID NO: 993337 - RNA, 19 nt, Homo sapiens
acucaucaauggcuuuauu

SEQ ID NO: 993338 - RNA, 19 nt, Homo sapiens
ucacugagaacccagcuuu

SEQ ID NO: 993339 - RNA, 19 nt, Homo sapiens
cagacugcauuagguauuu

SEQ ID NO: 993340 - RNA, 19 nt, Homo sapiens
guuaggaccucugguggaa

SEQ ID NO: 993341 - RNA, 19 nt, Homo sapiens
cuggaugauucuuguauaa

SEQ ID NO: 993342 - RNA, 19 nt, Homo sapiens
gugcuuuacuaucagaauu

SEQ ID NO: 993343 - RNA, 19 nt, Homo sapiens
caacuguacuugugcaaaa

SEQ ID NO: 993344 - RNA, 19 nt, Homo sapiens
ugaugcaucuaacaccuuu

SEQ ID NO: 993345 - RNA, 19 nt, Homo sapiens
aaagcuuucuuccugguuu

SEQ ID NO: 993346 - RNA, 19 nt, Homo sapiens
uacauuagacgaaagcuuu

SEQ ID NO: 993347 - RNA, 19 nt, Homo sapiens
gaugaagaugucagacuaa

SEQ ID NO: 993348 - RNA, 19 nt, Homo sapiens
gguguguccuuguuaagug

SEQ ID NO: 993349 - RNA, 19 nt, Homo sapiens
caagauuacacuaaccauu

SEQ ID NO: 993350 - RNA, 19 nt, Homo sapiens
guaagcaguuuucaucuga

SEQ ID NO: 993351 - RNA, 19 nt, Homo sapiens
guacuccuuuuguguuuua

SEQ ID NO: 993352 - RNA, 19 nt, Homo sapiens
gauggugguuguagggaau

SEQ ID NO: 993353 - RNA, 19 nt, Homo sapiens
auaaugcccugcaacucua

SEQ ID NO: 993354 - RNA, 19 nt, Homo sapiens
ggaauggagcaguuggaaa

SEQ ID NO: 993355 - RNA, 19 nt, Homo sapiens
aauuagaguugguacagaa

SEQ ID NO: 993356 - RNA, 19 nt, Homo sapiens
gaauggagcaguuggaaaa

SEQ ID NO: 993357 - RNA, 19 nt, Homo sapiens
cagaaacucaaacaacaaa

SEQ ID NO: 993358 - RNA, 19 nt, Homo sapiens
gcaauaucuguguaaugua

SEQ ID NO: 993359 - RNA, 19 nt, Homo sapiens
gcuguagcauacccuaaga

SEQ ID NO: 993360 - RNA, 19 nt, Homo sapiens
caaacaaaggaccaauaaa

SEQ ID NO: 993361 - RNA, 19 nt, Homo sapiens
gaguauaggaauuugaaug

SEQ ID NO: 993362 - RNA, 19 nt, Homo sapiens
gaagguacacagcacaucu

SEQ ID NO: 993363 - RNA, 19 nt, Homo sapiens
gaucaaggaaagauagcaa

SEQ ID NO: 993364 - RNA, 19 nt, Homo sapiens
ugacagacuuaaauauugc

SEQ ID NO: 993365 - RNA, 19 nt, Homo sapiens
gaagugggagauauaccaa

SEQ ID NO: 993366 - RNA, 19 nt, Homo sapiens
agggaaugcuauuaagaaa

SEQ ID NO: 993367 - RNA, 19 nt, Homo sapiens
uaauggcucucugaaagug

SEQ ID NO: 993368 - RNA, 19 nt, Homo sapiens
gcauucaaguaguaacaag

SEQ ID NO: 993369 - RNA, 19 nt, Homo sapiens
ucuggaugauucuuguaua

SEQ ID NO: 993370 - RNA, 19 nt, Homo sapiens
uauaccaacuguacuugug

SEQ ID NO: 993371 - RNA, 19 nt, Homo sapiens
uugaagcaguuuccaguug

SEQ ID NO: 993372 - RNA, 19 nt, Homo sapiens
guuggaaaaucaaguauga

SEQ ID NO: 993373 - RNA, 19 nt, Homo sapiens
ucaaguaguaacaagauug

SEQ ID NO: 993374 - RNA, 19 nt, Homo sapiens
uuacaaaggccuacuaucg

SEQ ID NO: 993375 - RNA, 19 nt, Homo sapiens
cgacaaauucaaguuaaug

SEQ ID NO: 993376 - RNA, 19 nt, Homo sapiens
gagcugucagucccacaua

SEQ ID NO: 993377 - RNA, 19 nt, Homo sapiens
uaaaagaggaguauaggaa

SEQ ID NO: 993378 - RNA, 19 nt, Homo sapiens
gcugaagguaugugcagua

SEQ ID NO: 993379 - RNA, 19 nt, Homo sapiens
gaagaucuaaaugugaaug

SEQ ID NO: 993380 - RNA, 19 nt, Homo sapiens
cagaacaucagugaaagaa

SEQ ID NO: 993381 - RNA, 19 nt, Homo sapiens
auaauugcgugaacucugu

SEQ ID NO: 993382 - RNA, 19 nt, Homo sapiens
gauccagaacuaacgcauu

SEQ ID NO: 993383 - RNA, 19 nt, Homo sapiens
uaagauaauugcgugaacu

SEQ ID NO: 993384 - RNA, 19 nt, Homo sapiens
guauagccuuucucaagag

SEQ ID NO: 993385 - RNA, 19 nt, Homo sapiens
guaaaagggaaugcuauua

SEQ ID NO: 993386 - RNA, 19 nt, Homo sapiens
uuuaauacaucugguggaa

SEQ ID NO: 993387 - RNA, 19 nt, Homo sapiens
gaucuaaaugugaaugaag

SEQ ID NO: 993388 - RNA, 19 nt, Homo sapiens
ggagcgacaaauucaaguu

SEQ ID NO: 993389 - RNA, 19 nt, Homo sapiens
caauuacaaaggccuacua

SEQ ID NO: 993390 - RNA, 19 nt, Homo sapiens
gaagaaaggugaugucaag

SEQ ID NO: 993391 - RNA, 19 nt, Homo sapiens
gggaaagcauccaaauuua

SEQ ID NO: 993392 - RNA, 19 nt, Homo sapiens
gaaagugucucuguucuug

SEQ ID NO: 993393 - RNA, 19 nt, Homo sapiens
gaacauuccucucaagcuu

SEQ ID NO: 993394 - RNA, 19 nt, Homo sapiens
ucucagagcuauuuacaaa

SEQ ID NO: 993395 - RNA, 19 nt, Homo sapiens
ggaaagcauccaaauuuaa

SEQ ID NO: 993396 - RNA, 19 nt, Homo sapiens
guacauaggaggagagaaa

SEQ ID NO: 993397 - RNA, 19 nt, Homo sapiens
uagaaagugucaccuauga

SEQ ID NO: 993398 - RNA, 19 nt, Homo sapiens
aggaauagaugaauagcua

SEQ ID NO: 993399 - RNA, 19 nt, Homo sapiens
gggcagacgucauccuuug

SEQ ID NO: 993400 - RNA, 19 nt, Homo sapiens
gcagagccguggagcuuug

SEQ ID NO: 993401 - RNA, 19 nt, Homo sapiens
gaaaugggcagacgucauc

SEQ ID NO: 993402 - RNA, 19 nt, Homo sapiens
gggcagugauggugucuug

SEQ ID NO: 993403 - RNA, 19 nt, Homo sapiens
ggauuucgguagauuugaa

SEQ ID NO: 993404 - RNA, 19 nt, Homo sapiens
ccaguggcauggaggauuu

SEQ ID NO: 993405 - RNA, 19 nt, Homo sapiens
augaauagcuacagaauca

SEQ ID NO: 993406 - RNA, 19 nt, Homo sapiens
caaaugagaaggauugcuu

SEQ ID NO: 993407 - RNA, 19 nt, Homo sapiens
gagaauucacucauugauu

SEQ ID NO: 993408 - RNA, 19 nt, Homo sapiens
ugaagaaugccaccuugua

SEQ ID NO: 993409 - RNA, 19 nt, Homo sapiens
gauggugucuugugucucu

SEQ ID NO: 993410 - RNA, 19 nt, Homo sapiens
gcaguuaaucucagagcua

SEQ ID NO: 993411 - RNA, 19 nt, Homo sapiens
gauacccugucucuacaaa

SEQ ID NO: 993412 - RNA, 19 nt, Homo sapiens
gaccaaaugagaaggauug

SEQ ID NO: 993413 - RNA, 19 nt, Homo sapiens
gggaaggcuugcuuggaaa

SEQ ID NO: 993414 - RNA, 19 nt, Homo sapiens
cagaaucacacaacuagaa

SEQ ID NO: 993415 - RNA, 19 nt, Homo sapiens
aggaagaggugaucgauag

SEQ ID NO: 993416 - RNA, 19 nt, Homo sapiens
caacaaaacuaggugacua

SEQ ID NO: 993417 - RNA, 19 nt, Homo sapiens
uagcuaauguucuccuaga

SEQ ID NO: 993418 - RNA, 19 nt, Homo sapiens
gaagaaugccaccuuguac

SEQ ID NO: 993419 - RNA, 19 nt, Homo sapiens
ggggaaagcauccaaauuu

SEQ ID NO: 993420 - RNA, 19 nt, Homo sapiens
guugaaagccaaaggaaga

SEQ ID NO: 993421 - RNA, 19 nt, Homo sapiens
guuaaucucagagcuauuu

SEQ ID NO: 993422 - RNA, 19 nt, Homo sapiens
gagcagugaaggugaggua

SEQ ID NO: 993423 - RNA, 19 nt, Homo sapiens
gugacuaagugaaggcaaa

SEQ ID NO: 993424 - RNA, 19 nt, Homo sapiens
gaucagcgucccaguuuca

SEQ ID NO: 993425 - RNA, 19 nt, Homo sapiens
caagcuuucugaagacugu

SEQ ID NO: 993426 - RNA, 19 nt, Homo sapiens
uguaaucccugcaauuugg

SEQ ID NO: 993427 - RNA, 19 nt, Homo sapiens
agggaaggcuugcuuggaa

SEQ ID NO: 993428 - RNA, 19 nt, Homo sapiens
gaggauuucgguagauuug

SEQ ID NO: 993429 - RNA, 19 nt, Homo sapiens
uuacacuccugcugacuug

SEQ ID NO: 993430 - RNA, 19 nt, Homo sapiens
cauggaggauuucgguaga

SEQ ID NO: 993431 - RNA, 19 nt, Homo sapiens
acagcagaaucuaaagaaa

SEQ ID NO: 993432 - RNA, 19 nt, Homo sapiens
cuacagaaucacacaacua

SEQ ID NO: 993433 - RNA, 19 nt, Homo sapiens
ccuguaaucccugcaauuu

SEQ ID NO: 993434 - RNA, 19 nt, Homo sapiens
gaaucuaaagaaagcauug

SEQ ID NO: 993435 - RNA, 19 nt, Homo sapiens
ugaccacacuccaccuaug

SEQ ID NO: 993436 - RNA, 19 nt, Homo sapiens
ggaggauuucgguagauuu

SEQ ID NO: 993437 - RNA, 19 nt, Homo sapiens
ccuggagaauucacucauu

SEQ ID NO: 993438 - RNA, 19 nt, Homo sapiens
guugguuccuggagaauuc

SEQ ID NO: 993439 - RNA, 19 nt, Homo sapiens
gcucuaugcuccugaaucc

SEQ ID NO: 993440 - RNA, 19 nt, Homo sapiens
gugauacccugucucuaca

SEQ ID NO: 993441 - RNA, 19 nt, Homo sapiens
gaagaggugaucgauagga

SEQ ID NO: 993442 - RNA, 19 nt, Homo sapiens
acuagaaagugucaccuau

SEQ ID NO: 993443 - RNA, 19 nt, Homo sapiens
caguuaaucucagagcuau

SEQ ID NO: 993444 - RNA, 19 nt, Homo sapiens
gaauagcuacagaaucaca

SEQ ID NO: 993445 - RNA, 19 nt, Homo sapiens
cuggagaauucacucauug

SEQ ID NO: 993446 - RNA, 19 nt, Homo sapiens
ggacaccgugcauggcaaa

SEQ ID NO: 993447 - RNA, 19 nt, Homo sapiens
ggagaauucacucauugau

SEQ ID NO: 993448 - RNA, 19 nt, Homo sapiens
gguuguagcuaauguucuc

SEQ ID NO: 993449 - RNA, 19 nt, Homo sapiens
gacugucuuuaccucaaua

SEQ ID NO: 993450 - RNA, 19 nt, Homo sapiens
ccagggcaacaaagugaua

SEQ ID NO: 993451 - RNA, 19 nt, Homo sapiens
ggccagagcaggcagaaca

SEQ ID NO: 993452 - RNA, 19 nt, Homo sapiens
ccacagcagaaucuaaaga

SEQ ID NO: 993453 - RNA, 19 nt, Homo sapiens
aaaacuaggugacuaagug

SEQ ID NO: 993454 - RNA, 19 nt, Homo sapiens
gcagugauggugucuugug

SEQ ID NO: 993455 - RNA, 19 nt, Homo sapiens
gaauagaugaauagcuaca

SEQ ID NO: 993456 - RNA, 19 nt, Homo sapiens
ccacacugagcgccugaua

SEQ ID NO: 993457 - RNA, 19 nt, Homo sapiens
ggagaccaaaugagaagga

SEQ ID NO: 993458 - RNA, 19 nt, Homo sapiens
ccguggagcuuugugaaga

SEQ ID NO: 993459 - RNA, 19 nt, Homo sapiens
aagaggugaucgauaggaa

SEQ ID NO: 993460 - RNA, 19 nt, Homo sapiens
ggaggacgcaucccaaucg

SEQ ID NO: 993461 - RNA, 19 nt, Homo sapiens
gcguggcccucacuucugu

SEQ ID NO: 993462 - RNA, 19 nt, Homo sapiens
gaccagccagggcaacaaa

SEQ ID NO: 993463 - RNA, 19 nt, Homo sapiens
caaaggaagaggugaucga

SEQ ID NO: 993464 - RNA, 19 nt, Homo sapiens
cagcagaaucuaaagaaag

SEQ ID NO: 993465 - RNA, 19 nt, Homo sapiens
cagugaaggugagguacuu

SEQ ID NO: 993466 - RNA, 19 nt, Homo sapiens
auagaugaauagcuacaga

SEQ ID NO: 993467 - RNA, 19 nt, Homo sapiens
ggcccuugcugcccaugaa

SEQ ID NO: 993468 - RNA, 19 nt, Homo sapiens
ggagggagagacagagaca

SEQ ID NO: 993469 - RNA, 19 nt, Homo sapiens
ggagcuuugugaagaaugc

SEQ ID NO: 993470 - RNA, 19 nt, Homo sapiens
gaccacacuccaccuaugu

SEQ ID NO: 993471 - RNA, 19 nt, Homo sapiens
ugugguugguuguagcuaa

SEQ ID NO: 993472 - RNA, 19 nt, Homo sapiens
aagugucucuguucuuguu

SEQ ID NO: 993473 - RNA, 19 nt, Homo sapiens
gagaccaaaugagaaggau

SEQ ID NO: 993474 - RNA, 19 nt, Homo sapiens
cuuguacccuccuauguuc

SEQ ID NO: 993475 - RNA, 19 nt, Homo sapiens
ccauugaccagacuuaagu

SEQ ID NO: 993476 - RNA, 19 nt, Homo sapiens
gaggugaucgauaggaauc

SEQ ID NO: 993477 - RNA, 19 nt, Homo sapiens
gcaaggauuuugucaucau

SEQ ID NO: 993478 - RNA, 19 nt, Homo sapiens
cacagcagaaucuaaagaa

SEQ ID NO: 993479 - RNA, 19 nt, Homo sapiens
agaaucacacaacuagaaa

SEQ ID NO: 993480 - RNA, 19 nt, Homo sapiens
gugauggugucuugugucu

SEQ ID NO: 993481 - RNA, 19 nt, Homo sapiens
caccgugcauggcaaagug

SEQ ID NO: 993482 - RNA, 19 nt, Homo sapiens
gcgaggagacaccuugauc

SEQ ID NO: 993483 - RNA, 19 nt, Homo sapiens
gcccuuggcugagguaggu

SEQ ID NO: 993484 - RNA, 19 nt, Homo sapiens
acaaagugauacccugucu

SEQ ID NO: 993485 - RNA, 19 nt, Homo sapiens
ucagagcuauuuacaaacc

SEQ ID NO: 993486 - RNA, 19 nt, Homo sapiens
gaugaauagcuacagaauc

SEQ ID NO: 993487 - RNA, 19 nt, Homo sapiens
cguggagcuuugugaagaa

SEQ ID NO: 993488 - RNA, 19 nt, Homo sapiens
ggagcacggcgaguacuga

SEQ ID NO: 993489 - RNA, 19 nt, Homo sapiens
aaacuaggugacuaaguga

SEQ ID NO: 993490 - RNA, 19 nt, Homo sapiens
gagaagaccuauuuaguua

SEQ ID NO: 993491 - RNA, 19 nt, Homo sapiens
agacacaacuucacaauua

SEQ ID NO: 993492 - RNA, 19 nt, Homo sapiens
gaaaauagcuccagaaaau

SEQ ID NO: 993493 - RNA, 19 nt, Homo sapiens
guaugaaucuccagaaaua

SEQ ID NO: 993494 - RNA, 19 nt, Homo sapiens
gcgaauaaauugauacuga

SEQ ID NO: 993495 - RNA, 19 nt, Homo sapiens
gcagaggaauguuauugua

SEQ ID NO: 993496 - RNA, 19 nt, Homo sapiens
gagcauggcuguucuggaa

SEQ ID NO: 993497 - RNA, 19 nt, Homo sapiens
gaucacaacuaacaacuga

SEQ ID NO: 993498 - RNA, 19 nt, Homo sapiens
caacacugcuucaagguuu

SEQ ID NO: 993499 - RNA, 19 nt, Homo sapiens
gaagcuuaaucuccaauaa

SEQ ID NO: 993500 - RNA, 19 nt, Homo sapiens
gaaccaggccaaacucaua

SEQ ID NO: 993501 - RNA, 19 nt, Homo sapiens
gcaagacauuucugauaaa

SEQ ID NO: 993502 - RNA, 19 nt, Homo sapiens
ucacagcuuucuagaauuu

SEQ ID NO: 993503 - RNA, 19 nt, Homo sapiens
ugacauagcuucagaugca

SEQ ID NO: 993504 - RNA, 19 nt, Homo sapiens
ggaaagagggcacugauau

SEQ ID NO: 993505 - RNA, 19 nt, Homo sapiens
gcucaagaacucuauaaua

SEQ ID NO: 993506 - RNA, 19 nt, Homo sapiens
cagcagacauugugaagaa

SEQ ID NO: 993507 - RNA, 19 nt, Homo sapiens
uaaagaagccucauaagau

SEQ ID NO: 993508 - RNA, 19 nt, Homo sapiens
gaacuccuacuguugaaua

SEQ ID NO: 993509 - RNA, 19 nt, Homo sapiens
guaaagaagccucauaaga

SEQ ID NO: 993510 - RNA, 19 nt, Homo sapiens
uagaacagcuuccacuuug

SEQ ID NO: 993511 - RNA, 19 nt, Homo sapiens
gcaguuacuuaaugugauu

SEQ ID NO: 993512 - RNA, 19 nt, Homo sapiens
gcucuaaauuguggaauaa

SEQ ID NO: 993513 - RNA, 19 nt, Homo sapiens
gaaauaaggcaaucuaguc

SEQ ID NO: 993514 - RNA, 19 nt, Homo sapiens
gaucagggauuugaagaga

SEQ ID NO: 993515 - RNA, 19 nt, Homo sapiens
uaaguaacccaguacaaua

SEQ ID NO: 993516 - RNA, 19 nt, Homo sapiens
guaaaccaguccuuuguau

SEQ ID NO: 993517 - RNA, 19 nt, Homo sapiens
guacagcagaggaauguua

SEQ ID NO: 993518 - RNA, 19 nt, Homo sapiens
ggaacagcauuaugauaga

SEQ ID NO: 993519 - RNA, 19 nt, Homo sapiens
gagaaugcaucagacauga

SEQ ID NO: 993520 - RNA, 19 nt, Homo sapiens
gaggaauguuauuguagua

SEQ ID NO: 993521 - RNA, 19 nt, Homo sapiens
gcuguuaagugaacgguuu

SEQ ID NO: 993522 - RNA, 19 nt, Homo sapiens
ugaggaacauuacugcuaa

SEQ ID NO: 993523 - RNA, 19 nt, Homo sapiens
gaagagaccagcucagcaa

SEQ ID NO: 993524 - RNA, 19 nt, Homo sapiens
uuaaacagaucagggauuu

SEQ ID NO: 993525 - RNA, 19 nt, Homo sapiens
gauaugaagaucacaacua

SEQ ID NO: 993526 - RNA, 19 nt, Homo sapiens
gauaucagauuagaccuau

SEQ ID NO: 993527 - RNA, 19 nt, Homo sapiens
aaagaagccucauaagauc

SEQ ID NO: 993528 - RNA, 19 nt, Homo sapiens
gaaacuuagcaacuucuua

SEQ ID NO: 993529 - RNA, 19 nt, Homo sapiens
gagaccagcucagcaagaa

SEQ ID NO: 993530 - RNA, 19 nt, Homo sapiens
cuauuggccuuauucauuu

SEQ ID NO: 993531 - RNA, 19 nt, Homo sapiens
cgagaagaccuauuuaguu

SEQ ID NO: 993532 - RNA, 19 nt, Homo sapiens
caucagacaugaaccacuu

SEQ ID NO: 993533 - RNA, 19 nt, Homo sapiens
ccagaaauagcucuaaauu

SEQ ID NO: 993534 - RNA, 19 nt, Homo sapiens
caugugggcuuucucuuga

SEQ ID NO: 993535 - RNA, 19 nt, Homo sapiens
gaacagcauuaugauagau

SEQ ID NO: 993536 - RNA, 19 nt, Homo sapiens
guucagacuucguggguuu

SEQ ID NO: 993537 - RNA, 19 nt, Homo sapiens
acuaacaacugacaaauca

SEQ ID NO: 993538 - RNA, 19 nt, Homo sapiens
gaugugguguccuggcuuu

SEQ ID NO: 993539 - RNA, 19 nt, Homo sapiens
guugaaggguauuuguuaa

SEQ ID NO: 993540 - RNA, 19 nt, Homo sapiens
cuaaucugcuguuaaguga

SEQ ID NO: 993541 - RNA, 19 nt, Homo sapiens
ggugaacuacuacuagaua

SEQ ID NO: 993542 - RNA, 19 nt, Homo sapiens
cagugaauaugagaaguua

SEQ ID NO: 993543 - RNA, 19 nt, Homo sapiens
cuucagauaugucgaaaug

SEQ ID NO: 993544 - RNA, 19 nt, Homo sapiens
ccagaucugugaaugauag

SEQ ID NO: 993545 - RNA, 19 nt, Homo sapiens
agcaagacauuucugauaa

SEQ ID NO: 993546 - RNA, 19 nt, Homo sapiens
gaagaugacgcagagcuuu

SEQ ID NO: 993547 - RNA, 19 nt, Homo sapiens
ggacggaggaugagcaguu

SEQ ID NO: 993548 - RNA, 19 nt, Homo sapiens
aaaguugacaugcgaauaa

SEQ ID NO: 993549 - RNA, 19 nt, Homo sapiens
gcacucuuauugauucaug

SEQ ID NO: 993550 - RNA, 19 nt, Homo sapiens
gagaaccucaaauuaauga

SEQ ID NO: 993551 - RNA, 19 nt, Homo sapiens
gaaauucuguauggcacaa

SEQ ID NO: 993552 - RNA, 19 nt, Homo sapiens
aaucagaguuugccaguuc

SEQ ID NO: 993553 - RNA, 19 nt, Homo sapiens
gauuagaccuauguguuug

SEQ ID NO: 993554 - RNA, 19 nt, Homo sapiens
uauaauagugggcuccuua

SEQ ID NO: 993555 - RNA, 19 nt, Homo sapiens
uuucacagcuuucuagaau

SEQ ID NO: 993556 - RNA, 19 nt, Homo sapiens
gacacaacuucacaauuau

SEQ ID NO: 993557 - RNA, 19 nt, Homo sapiens
gaaauagcucuaaauugug

SEQ ID NO: 993558 - RNA, 19 nt, Homo sapiens
ggguaugaaucuccagaaa

SEQ ID NO: 993559 - RNA, 19 nt, Homo sapiens
gcaaucuagucuccuugaa

SEQ ID NO: 993560 - RNA, 19 nt, Homo sapiens
ggcugcagcugauuaagaa

SEQ ID NO: 993561 - RNA, 19 nt, Homo sapiens
caucauaauuggcauuucu

SEQ ID NO: 993562 - RNA, 19 nt, Homo sapiens
ccuauuggccuuauucauu

SEQ ID NO: 993563 - RNA, 19 nt, Homo sapiens
ucaauaagcugcgauacag

SEQ ID NO: 993564 - RNA, 19 nt, Homo sapiens
ggaauguuauuguaguagu

SEQ ID NO: 993565 - RNA, 19 nt, Homo sapiens
gaaagagggcacugauauc

SEQ ID NO: 993566 - RNA, 19 nt, Homo sapiens
aaacagaucagggauuuga

SEQ ID NO: 993567 - RNA, 19 nt, Homo sapiens
ucagauaugucgaaauguc

SEQ ID NO: 993568 - RNA, 19 nt, Homo sapiens
gagaacuccuacuguugaa

SEQ ID NO: 993569 - RNA, 19 nt, Homo sapiens
aagcaagacauuucugaua

SEQ ID NO: 993570 - RNA, 19 nt, Homo sapiens
gagcaccuuuucuuucuua

SEQ ID NO: 993571 - RNA, 19 nt, Homo sapiens
gaaccucaaauuaaugaug

SEQ ID NO: 993572 - RNA, 19 nt, Homo sapiens
ggcuggcccuguaauuuaa

SEQ ID NO: 993573 - RNA, 19 nt, Homo sapiens
gaacuuacacaucuagaac

SEQ ID NO: 993574 - RNA, 19 nt, Homo sapiens
uaauuggcauuucucaaga

SEQ ID NO: 993575 - RNA, 19 nt, Homo sapiens
cgagaacuccuacuguuga

SEQ ID NO: 993576 - RNA, 19 nt, Homo sapiens
gcaucaggcacucuuauug

SEQ ID NO: 993577 - RNA, 19 nt, Homo sapiens
gacggaggaugagcaguuu

SEQ ID NO: 993578 - RNA, 19 nt, Homo sapiens
guuaagagaaugcaucaga

SEQ ID NO: 993579 - RNA, 19 nt, Homo sapiens
gcacccugguagcugauuu

SEQ ID NO: 993580 - RNA, 19 nt, Homo sapiens
ucucuuggauguuuaggaa

SEQ ID NO: 993581 - RNA, 19 nt, Homo sapiens
gaaucugugugaaauaagg

SEQ ID NO: 993582 - RNA, 19 nt, Homo sapiens
uuuaauguccuguuccuua

SEQ ID NO: 993583 - RNA, 19 nt, Homo sapiens
gacaugaaccacuugcaaa

SEQ ID NO: 993584 - RNA, 19 nt, Homo sapiens
uggcuggcccuguaauuua

SEQ ID NO: 993585 - RNA, 19 nt, Homo sapiens
gcuagccucucuuacuaau

SEQ ID NO: 993586 - RNA, 19 nt, Homo sapiens
uagacuaaguaacccagua

SEQ ID NO: 993587 - RNA, 19 nt, Homo sapiens
uguauucaguuaccuaaug

SEQ ID NO: 993588 - RNA, 19 nt, Homo sapiens
cucauaagaucauaaggaa

SEQ ID NO: 993589 - RNA, 19 nt, Homo sapiens
ucauagaguuccucagcaa

SEQ ID NO: 993590 - RNA, 19 nt, Homo sapiens
gcagagagaugcagaguuc

SEQ ID NO: 993591 - RNA, 19 nt, Homo sapiens
guaaaucccuggucccauu

SEQ ID NO: 993592 - RNA, 19 nt, Homo sapiens
gaaaauggguugcagaaaa

SEQ ID NO: 993593 - RNA, 19 nt, Homo sapiens
agaggcagcuccuuaauaa

SEQ ID NO: 993594 - RNA, 19 nt, Homo sapiens
gcacaagacuucagaugca

SEQ ID NO: 993595 - RNA, 19 nt, Homo sapiens
aagagaagcuuaguccuua

SEQ ID NO: 993596 - RNA, 19 nt, Homo sapiens
gcugaaagccugaauaguu

SEQ ID NO: 993597 - RNA, 19 nt, Homo sapiens
gaaugaauguggccaagga

SEQ ID NO: 993598 - RNA, 19 nt, Homo sapiens
gaggaugcauucauuguga

SEQ ID NO: 993599 - RNA, 19 nt, Homo sapiens
gaccaaugcuuuccaccua

SEQ ID NO: 993600 - RNA, 19 nt, Homo sapiens
cagaagaaaucacuguuug

SEQ ID NO: 993601 - RNA, 19 nt, Homo sapiens
guaccuccaucacuguuua

SEQ ID NO: 993602 - RNA, 19 nt, Homo sapiens
caucaagucuucagaaaca

SEQ ID NO: 993603 - RNA, 19 nt, Homo sapiens
ggaaagccauugcugaaag

SEQ ID NO: 993604 - RNA, 19 nt, Homo sapiens
caggaaagcucaauuaaaa

SEQ ID NO: 993605 - RNA, 19 nt, Homo sapiens
ccaaggagauggaccugaa

SEQ ID NO: 993606 - RNA, 19 nt, Homo sapiens
ggaagaugcugagaaggaa

SEQ ID NO: 993607 - RNA, 19 nt, Homo sapiens
cagcuaaguuccucugaaa

SEQ ID NO: 993608 - RNA, 19 nt, Homo sapiens
ggugggccauguucuauaa

SEQ ID NO: 993609 - RNA, 19 nt, Homo sapiens
caaggaagaugcugagaag

SEQ ID NO: 993610 - RNA, 19 nt, Homo sapiens
gauggagucagaauaauaa

SEQ ID NO: 993611 - RNA, 19 nt, Homo sapiens
gacaucaagucuucagaaa

SEQ ID NO: 993612 - RNA, 19 nt, Homo sapiens
ggaagagcauguucaacug

SEQ ID NO: 993613 - RNA, 19 nt, Homo sapiens
gaguagacccuaaccagua

SEQ ID NO: 993614 - RNA, 19 nt, Homo sapiens
aaacgaggcugaggaaaga

SEQ ID NO: 993615 - RNA, 19 nt, Homo sapiens
gaagaaggauguggaaacu

SEQ ID NO: 993616 - RNA, 19 nt, Homo sapiens
ggauggagucagaauaaua

SEQ ID NO: 993617 - RNA, 19 nt, Homo sapiens
uaugggagaugaagacaaa

SEQ ID NO: 993618 - RNA, 19 nt, Homo sapiens
gcucagaggcagcuccuua

SEQ ID NO: 993619 - RNA, 19 nt, Homo sapiens
gcagaagaaaucacuguuu

SEQ ID NO: 993620 - RNA, 19 nt, Homo sapiens
uuuaaaggcucacauauca

SEQ ID NO: 993621 - RNA, 19 nt, Homo sapiens
cagaagauaugggagauga

SEQ ID NO: 993622 - RNA, 19 nt, Homo sapiens
gacagaagaagaacaguuu

SEQ ID NO: 993623 - RNA, 19 nt, Homo sapiens
guacugcaauggucugaug

SEQ ID NO: 993624 - RNA, 19 nt, Homo sapiens
ggacacaucuaggcacugu

SEQ ID NO: 993625 - RNA, 19 nt, Homo sapiens
gaggagcucuugaggaaag

SEQ ID NO: 993626 - RNA, 19 nt, Homo sapiens
gcagacaacuguguauucu

SEQ ID NO: 993627 - RNA, 19 nt, Homo sapiens
acaagaaugagaaguguua

SEQ ID NO: 993628 - RNA, 19 nt, Homo sapiens
agacuucucuagacauuga

SEQ ID NO: 993629 - RNA, 19 nt, Homo sapiens
ccaagggauuguugaagaa

SEQ ID NO: 993630 - RNA, 19 nt, Homo sapiens
gaaacgaggcugaggaaag

SEQ ID NO: 993631 - RNA, 19 nt, Homo sapiens
cugaaagccugaauaguug

SEQ ID NO: 993632 - RNA, 19 nt, Homo sapiens
gaggaaagccauugcugaa

SEQ ID NO: 993633 - RNA, 19 nt, Homo sapiens
uuaaagaagucuccgaauc

SEQ ID NO: 993634 - RNA, 19 nt, Homo sapiens
agacaacuguguauucugu

SEQ ID NO: 993635 - RNA, 19 nt, Homo sapiens
gagaaguguuaccucugua

SEQ ID NO: 993636 - RNA, 19 nt, Homo sapiens
ccagacuucucuagacauu

SEQ ID NO: 993637 - RNA, 19 nt, Homo sapiens
gagaaggaaguagcuauuu

SEQ ID NO: 993638 - RNA, 19 nt, Homo sapiens
caaaagagccugaaaaugg

SEQ ID NO: 993639 - RNA, 19 nt, Homo sapiens
uaucuuggauggagucaga

SEQ ID NO: 993640 - RNA, 19 nt, Homo sapiens
uagcagagauaucuuggau

SEQ ID NO: 993641 - RNA, 19 nt, Homo sapiens
gaaccaguguuaccuagac

SEQ ID NO: 993642 - RNA, 19 nt, Homo sapiens
cgucgugacuuaaaugaau

SEQ ID NO: 993643 - RNA, 19 nt, Homo sapiens
ggacagcugcccagacuuc

SEQ ID NO: 993644 - RNA, 19 nt, Homo sapiens
ggagguugguaacaaggaa

SEQ ID NO: 993645 - RNA, 19 nt, Homo sapiens
gaaccaacaaccagucaug

SEQ ID NO: 993646 - RNA, 19 nt, Homo sapiens
ccaggaaagcucaauuaaa

SEQ ID NO: 993647 - RNA, 19 nt, Homo sapiens
gaagaaaucacuguuuguc

SEQ ID NO: 993648 - RNA, 19 nt, Homo sapiens
cagaggcagcuccuuaaua

SEQ ID NO: 993649 - RNA, 19 nt, Homo sapiens
ugagaaguguuaccucugu

SEQ ID NO: 993650 - RNA, 19 nt, Homo sapiens
ucgcacagaugacagaaga

SEQ ID NO: 993651 - RNA, 19 nt, Homo sapiens
ggacuccugucuccagcuu

SEQ ID NO: 993652 - RNA, 19 nt, Homo sapiens
gauggaggaagauacagua

SEQ ID NO: 993653 - RNA, 19 nt, Homo sapiens
agaaggaaguagcuauuuc

SEQ ID NO: 993654 - RNA, 19 nt, Homo sapiens
cagauaaggagguugguaa

SEQ ID NO: 993655 - RNA, 19 nt, Homo sapiens
uaaagaagucuccgaaucu

SEQ ID NO: 993656 - RNA, 19 nt, Homo sapiens
aaaugaaucucccgucaag

SEQ ID NO: 993657 - RNA, 19 nt, Homo sapiens
ugcaaaggcugaccaagga

SEQ ID NO: 993658 - RNA, 19 nt, Homo sapiens
ggagucagaauaauaaugg

SEQ ID NO: 993659 - RNA, 19 nt, Homo sapiens
ugacaagaaugagaagugu

SEQ ID NO: 993660 - RNA, 19 nt, Homo sapiens
agaaggauguggaaacuac

SEQ ID NO: 993661 - RNA, 19 nt, Homo sapiens
gaaggaaguagcuauuucu

SEQ ID NO: 993662 - RNA, 19 nt, Homo sapiens
cccaagggauuguugaaga

SEQ ID NO: 993663 - RNA, 19 nt, Homo sapiens
uugagaaugugaacguuaa

SEQ ID NO: 993664 - RNA, 19 nt, Homo sapiens
cgaauagagcaaaguguuu

SEQ ID NO: 993665 - RNA, 19 nt, Homo sapiens
acaacuguguauucuguuu

SEQ ID NO: 993666 - RNA, 19 nt, Homo sapiens
ggaacagucugagcacaag

SEQ ID NO: 993667 - RNA, 19 nt, Homo sapiens
gaagaggaagcguagacuu

SEQ ID NO: 993668 - RNA, 19 nt, Homo sapiens
ggagaagaaggauguggaa

SEQ ID NO: 993669 - RNA, 19 nt, Homo sapiens
gaaugugaacguuaaaucu

SEQ ID NO: 993670 - RNA, 19 nt, Homo sapiens
ccagucccaucaagagaaa

SEQ ID NO: 993671 - RNA, 19 nt, Homo sapiens
cgauagugauggagaggaa

SEQ ID NO: 993672 - RNA, 19 nt, Homo sapiens
gagagaugcagaguucuuu

SEQ ID NO: 993673 - RNA, 19 nt, Homo sapiens
gaagagcauguucaacugu

SEQ ID NO: 993674 - RNA, 19 nt, Homo sapiens
auaaggagguugguaacaa

SEQ ID NO: 993675 - RNA, 19 nt, Homo sapiens
gaaagccauugcugaaagc

SEQ ID NO: 993676 - RNA, 19 nt, Homo sapiens
uaaggagguugguaacaag

SEQ ID NO: 993677 - RNA, 19 nt, Homo sapiens
agagcaggcuagugagaaa

SEQ ID NO: 993678 - RNA, 19 nt, Homo sapiens
gaucuaugcagacaacugu

SEQ ID NO: 993679 - RNA, 19 nt, Homo sapiens
gagcacaagacuucagaug

SEQ ID NO: 993680 - RNA, 19 nt, Homo sapiens
cugaagaacccaaaggaaa

SEQ ID NO: 993681 - RNA, 19 nt, Homo sapiens
gcccagacuucucuagaca

SEQ ID NO: 993682 - RNA, 19 nt, Homo sapiens
gcuaugugaccaaugcuuu

SEQ ID NO: 993683 - RNA, 19 nt, Homo sapiens
gcagauaaggagguuggua

SEQ ID NO: 993684 - RNA, 19 nt, Homo sapiens
guaccugcuucacaaagug

SEQ ID NO: 993685 - RNA, 19 nt, Homo sapiens
gaagauaugggagaugaag

SEQ ID NO: 993686 - RNA, 19 nt, Homo sapiens
caagccagccaguguuuga

SEQ ID NO: 993687 - RNA, 19 nt, Homo sapiens
gaacagccaggaggaggaa

SEQ ID NO: 993688 - RNA, 19 nt, Homo sapiens
ccauaguggucccuaguuc

SEQ ID NO: 993689 - RNA, 19 nt, Homo sapiens
aaggagagcaggcuaguga

SEQ ID NO: 993690 - RNA, 19 nt, Homo sapiens
gaaaugaccucaauacacu

SEQ ID NO: 993691 - RNA, 19 nt, Homo sapiens
gcaaaggacuauaacaugu

SEQ ID NO: 993692 - RNA, 19 nt, Homo sapiens
gaauauggcugcccucugu

SEQ ID NO: 993693 - RNA, 19 nt, Homo sapiens
ccacauugaugacuuguuu

SEQ ID NO: 993694 - RNA, 19 nt, Homo sapiens
caaaggagacaccauauuu

SEQ ID NO: 993695 - RNA, 19 nt, Homo sapiens
ggagagagacuuuguuuau

SEQ ID NO: 993696 - RNA, 19 nt, Homo sapiens
gaagauacgucuccuaaaa

SEQ ID NO: 993697 - RNA, 19 nt, Homo sapiens
uaaacugccuauuugcuua

SEQ ID NO: 993698 - RNA, 19 nt, Homo sapiens
gaauaucugugccacuuug

SEQ ID NO: 993699 - RNA, 19 nt, Homo sapiens
gaaguacauugcuggguuu

SEQ ID NO: 993700 - RNA, 19 nt, Homo sapiens
ccagggagaucacaccuuu

SEQ ID NO: 993701 - RNA, 19 nt, Homo sapiens
gaaaccacccuucaugaaa

SEQ ID NO: 993702 - RNA, 19 nt, Homo sapiens
gcacaaaacugacccgauu

SEQ ID NO: 993703 - RNA, 19 nt, Homo sapiens
caaaucagaucucaucaag

SEQ ID NO: 993704 - RNA, 19 nt, Homo sapiens
gaugagagagcacgaaauu

SEQ ID NO: 993705 - RNA, 19 nt, Homo sapiens
gagaugccauguugaguug

SEQ ID NO: 993706 - RNA, 19 nt, Homo sapiens
acacgaggccuaagaauuu

SEQ ID NO: 993707 - RNA, 19 nt, Homo sapiens
ggccaaauguggacucuga

SEQ ID NO: 993708 - RNA, 19 nt, Homo sapiens
gaaauuccauaaccaguac

SEQ ID NO: 993709 - RNA, 19 nt, Homo sapiens
acacagacauucagucaug

SEQ ID NO: 993710 - RNA, 19 nt, Homo sapiens
gcaggaaagccuugauaaa

SEQ ID NO: 993711 - RNA, 19 nt, Homo sapiens
ucaagaauguccacacaga

SEQ ID NO: 993712 - RNA, 19 nt, Homo sapiens
gagagagacuuuguuuaug

SEQ ID NO: 993713 - RNA, 19 nt, Homo sapiens
aaacagcuguggaugcaaa

SEQ ID NO: 993714 - RNA, 19 nt, Homo sapiens
ggaaagcgagcucgacuug

SEQ ID NO: 993715 - RNA, 19 nt, Homo sapiens
ggaaagccuugauaaaucg

SEQ ID NO: 993716 - RNA, 19 nt, Homo sapiens
gcacgaaauuccauaacca

SEQ ID NO: 993717 - RNA, 19 nt, Homo sapiens
gccaggagcucaagaccuu

SEQ ID NO: 993718 - RNA, 19 nt, Homo sapiens
gagcuuagucuccaccuuu

SEQ ID NO: 993719 - RNA, 19 nt, Homo sapiens
ucaagaccuuugccauuaa

SEQ ID NO: 993720 - RNA, 19 nt, Homo sapiens
cucaagaccuuugccauua

SEQ ID NO: 993721 - RNA, 19 nt, Homo sapiens
caacaccuccugccuggua

SEQ ID NO: 993722 - RNA, 19 nt, Homo sapiens
aaaggagacaccauauuua

SEQ ID NO: 993723 - RNA, 19 nt, Homo sapiens
gacucagccuguuccauua

SEQ ID NO: 993724 - RNA, 19 nt, Homo sapiens
ucucggaguuccugaagua

SEQ ID NO: 993725 - RNA, 19 nt, Homo sapiens
gcaggaugguguucuggaa

SEQ ID NO: 993726 - RNA, 19 nt, Homo sapiens
gaacacaaggcaguggaua

SEQ ID NO: 993727 - RNA, 19 nt, Homo sapiens
gaagaugggcccaauuucu

SEQ ID NO: 993728 - RNA, 19 nt, Homo sapiens
ucuguaaacugccuauuug

SEQ ID NO: 993729 - RNA, 19 nt, Homo sapiens
agagagaucuggcaguuca

SEQ ID NO: 993730 - RNA, 19 nt, Homo sapiens
gagcuaagaagcaagaaga

SEQ ID NO: 993731 - RNA, 19 nt, Homo sapiens
gauggacuguucauggauu

SEQ ID NO: 993732 - RNA, 19 nt, Homo sapiens
gaugccauguugaguugua

SEQ ID NO: 993733 - RNA, 19 nt, Homo sapiens
caaaggacuauaacaugua

SEQ ID NO: 993734 - RNA, 19 nt, Homo sapiens
gaggaggaaccaacuauga

SEQ ID NO: 993735 - RNA, 19 nt, Homo sapiens
gcagaaaugggaucacaga

SEQ ID NO: 993736 - RNA, 19 nt, Homo sapiens
uaucugaaaugaccucaau

SEQ ID NO: 993737 - RNA, 19 nt, Homo sapiens
gaugcacccuucuuggauu

SEQ ID NO: 993738 - RNA, 19 nt, Homo sapiens
ggagaugccauguugaguu

SEQ ID NO: 993739 - RNA, 19 nt, Homo sapiens
aaagcgagcucgacuugga

SEQ ID NO: 993740 - RNA, 19 nt, Homo sapiens
gaaggaagaacaaccaucu

SEQ ID NO: 993741 - RNA, 19 nt, Homo sapiens
gcucaagaccuuugccauu

SEQ ID NO: 993742 - RNA, 19 nt, Homo sapiens
acauaacgguucccugaaa

SEQ ID NO: 993743 - RNA, 19 nt, Homo sapiens
gcuagaaucuuggcaacau

SEQ ID NO: 993744 - RNA, 19 nt, Homo sapiens
cgaaauuccauaaccagua

SEQ ID NO: 993745 - RNA, 19 nt, Homo sapiens
caagaaugacuccgagaaa

SEQ ID NO: 993746 - RNA, 19 nt, Homo sapiens
caggaaagccuugauaaau

SEQ ID NO: 993747 - RNA, 19 nt, Homo sapiens
aaucagaucucaucaagac

SEQ ID NO: 993748 - RNA, 19 nt, Homo sapiens
gcuggaggcucaggaaguu

SEQ ID NO: 993749 - RNA, 19 nt, Homo sapiens
gguaacaaacagugaauau

SEQ ID NO: 993750 - RNA, 19 nt, Homo sapiens
ugacucagccuguuccauu

SEQ ID NO: 993751 - RNA, 19 nt, Homo sapiens
gaaaacaucaugaaagaga

SEQ ID NO: 993752 - RNA, 19 nt, Homo sapiens
gucaccaacuuacuuugua

SEQ ID NO: 993753 - RNA, 19 nt, Homo sapiens
aggaaagccuugauaaauc

SEQ ID NO: 993754 - RNA, 19 nt, Homo sapiens
uaacacagccugacauagg

SEQ ID NO: 993755 - RNA, 19 nt, Homo sapiens
guuuacaccuucaaaguuc

SEQ ID NO: 993756 - RNA, 19 nt, Homo sapiens
aaagaaagaaccacaggaa

SEQ ID NO: 993757 - RNA, 19 nt, Homo sapiens
gaaugacuccgagaaagaa

SEQ ID NO: 993758 - RNA, 19 nt, Homo sapiens
uggaaccgcuggccaaaug

SEQ ID NO: 993759 - RNA, 19 nt, Homo sapiens
agccaugucuuguaccaua

SEQ ID NO: 993760 - RNA, 19 nt, Homo sapiens
gaaguaggacagagugugu

SEQ ID NO: 993761 - RNA, 19 nt, Homo sapiens
gcugggaguuuaaugaagu

SEQ ID NO: 993762 - RNA, 19 nt, Homo sapiens
aucaagagcugggaguuua

SEQ ID NO: 993763 - RNA, 19 nt, Homo sapiens
aaagagguauucccaugga

SEQ ID NO: 993764 - RNA, 19 nt, Homo sapiens
uaucugugccacuuuguua

SEQ ID NO: 993765 - RNA, 19 nt, Homo sapiens
ccugugagcuacuguggaa

SEQ ID NO: 993766 - RNA, 19 nt, Homo sapiens
gaaaacagcuguggaugca

SEQ ID NO: 993767 - RNA, 19 nt, Homo sapiens
agagcuaagucaagaagaa

SEQ ID NO: 993768 - RNA, 19 nt, Homo sapiens
cuagaaucuuggcaacaua

SEQ ID NO: 993769 - RNA, 19 nt, Homo sapiens
ugaggacucccuucuguaa

SEQ ID NO: 993770 - RNA, 19 nt, Homo sapiens
agagagacuuuguuuaugg

SEQ ID NO: 993771 - RNA, 19 nt, Homo sapiens
gggcagaaaugggaucaca

SEQ ID NO: 993772 - RNA, 19 nt, Homo sapiens
gaagacaccacaggccaaa

SEQ ID NO: 993773 - RNA, 19 nt, Homo sapiens
guaaacugccuauuugcuu

SEQ ID NO: 993774 - RNA, 19 nt, Homo sapiens
ggaagauacgucuccuaaa

SEQ ID NO: 993775 - RNA, 19 nt, Homo sapiens
gagcugggaguuuaaugaa

SEQ ID NO: 993776 - RNA, 19 nt, Homo sapiens
uggcagagcuaagucaaga

SEQ ID NO: 993777 - RNA, 19 nt, Homo sapiens
gagcauggcagccuugaag

SEQ ID NO: 993778 - RNA, 19 nt, Homo sapiens
ggcccaauuucuuaaguga

SEQ ID NO: 993779 - RNA, 19 nt, Homo sapiens
uaaguaauuugaggccauu

SEQ ID NO: 993780 - RNA, 19 nt, Homo sapiens
guaccauagugccacauug

SEQ ID NO: 993781 - RNA, 19 nt, Homo sapiens
cuacuugggauguacauuu

SEQ ID NO: 993782 - RNA, 19 nt, Homo sapiens
ucagaugccugcuuguaca

SEQ ID NO: 993783 - RNA, 19 nt, Homo sapiens
ggucagaugccugcuugua

SEQ ID NO: 993784 - RNA, 19 nt, Homo sapiens
gauacacuuuggucagaug

SEQ ID NO: 993785 - RNA, 19 nt, Homo sapiens
ggaggaaccaacuaugaau

SEQ ID NO: 993786 - RNA, 19 nt, Homo sapiens
gacuuaagggucaagauuu

SEQ ID NO: 993787 - RNA, 19 nt, Homo sapiens
ccaaaggagacaccauauu

SEQ ID NO: 993788 - RNA, 19 nt, Homo sapiens
gaaguccuguccuuucaac

SEQ ID NO: 993789 - RNA, 19 nt, Homo sapiens
ucaaaguuccugugagcua

SEQ ID NO: 993790 - RNA, 19 nt, Homo sapiens
gcaaggauauugagaguga

SEQ ID NO: 993791 - RNA, 19 nt, Homo sapiens
ggaaguaguuagaaacaaa

SEQ ID NO: 993792 - RNA, 19 nt, Homo sapiens
guacauauuucccgggaua

SEQ ID NO: 993793 - RNA, 19 nt, Homo sapiens
ggacgagauuucuauaaga

SEQ ID NO: 993794 - RNA, 19 nt, Homo sapiens
gagcgaagcuauggaagaa

SEQ ID NO: 993795 - RNA, 19 nt, Homo sapiens
gagaggagaugauuuguac

SEQ ID NO: 993796 - RNA, 19 nt, Homo sapiens
ucaaacagcuacugaaaca

SEQ ID NO: 993797 - RNA, 19 nt, Homo sapiens
acaauggacugcaaggaua

SEQ ID NO: 993798 - RNA, 19 nt, Homo sapiens
cgaaugcccuaaugucaaa

SEQ ID NO: 993799 - RNA, 19 nt, Homo sapiens
gaagaaggauuaaaagaug

SEQ ID NO: 993800 - RNA, 19 nt, Homo sapiens
gugacaaucucauuaguug

SEQ ID NO: 993801 - RNA, 19 nt, Homo sapiens
gaaaggagaggagaugauu

SEQ ID NO: 993802 - RNA, 19 nt, Homo sapiens
gaagaaguauaugcaggaa

SEQ ID NO: 993803 - RNA, 19 nt, Homo sapiens
agacagaaauauuccaaga

SEQ ID NO: 993804 - RNA, 19 nt, Homo sapiens
ggucacaagguacauauuu

SEQ ID NO: 993805 - RNA, 19 nt, Homo sapiens
gaaucaaaguugucaagca

SEQ ID NO: 993806 - RNA, 19 nt, Homo sapiens
ccaagaggaagugauauua

SEQ ID NO: 993807 - RNA, 19 nt, Homo sapiens
guacgauacuuauggugaa

SEQ ID NO: 993808 - RNA, 19 nt, Homo sapiens
ccugggcgcuuccaaauga

SEQ ID NO: 993809 - RNA, 19 nt, Homo sapiens
agaaguauaugcaggaaau

SEQ ID NO: 993810 - RNA, 19 nt, Homo sapiens
gaacaggacccgggacaga

SEQ ID NO: 993811 - RNA, 19 nt, Homo sapiens
cgaagugccucuauaaagg

SEQ ID NO: 993812 - RNA, 19 nt, Homo sapiens
gacgagauuucuauaagau

SEQ ID NO: 993813 - RNA, 19 nt, Homo sapiens
gagagaagguaucaaacag

SEQ ID NO: 993814 - RNA, 19 nt, Homo sapiens
ggauauuacucacuuggau

SEQ ID NO: 993815 - RNA, 19 nt, Homo sapiens
ggagaggagaugauuugua

SEQ ID NO: 993816 - RNA, 19 nt, Homo sapiens
gaaacuagcccugcagcuu

SEQ ID NO: 993817 - RNA, 19 nt, Homo sapiens
caagggcucuuugauaauc

SEQ ID NO: 993818 - RNA, 19 nt, Homo sapiens
gcaaaagguuuacuaauac

SEQ ID NO: 993819 - RNA, 19 nt, Homo sapiens
gccugaguuucaagaauua

SEQ ID NO: 993820 - RNA, 19 nt, Homo sapiens
gaauuuguccauuugcauu

SEQ ID NO: 993821 - RNA, 19 nt, Homo sapiens
ggucagugcagaagguaua

SEQ ID NO: 993822 - RNA, 19 nt, Homo sapiens
gcgaagcuauggaagaaag

SEQ ID NO: 993823 - RNA, 19 nt, Homo sapiens
gguauacaauggacugcaa

SEQ ID NO: 993824 - RNA, 19 nt, Homo sapiens
gaacgaacgcuggaaguag

SEQ ID NO: 993825 - RNA, 19 nt, Homo sapiens
aaacggaagugcaauuguc

SEQ ID NO: 993826 - RNA, 19 nt, Homo sapiens
gugagaaacggaaacagua

SEQ ID NO: 993827 - RNA, 19 nt, Homo sapiens
gaacccugaugauccacaa

SEQ ID NO: 993828 - RNA, 19 nt, Homo sapiens
gcuuugagauggauauuac

SEQ ID NO: 993829 - RNA, 19 nt, Homo sapiens
gcaaacggaagugcaauug

SEQ ID NO: 993830 - RNA, 19 nt, Homo sapiens
cagcaagacagaaauauuc

SEQ ID NO: 993831 - RNA, 19 nt, Homo sapiens
aaacggaaacaguacgaua

SEQ ID NO: 993832 - RNA, 19 nt, Homo sapiens
caagaggaagugauauuau

SEQ ID NO: 993833 - RNA, 19 nt, Homo sapiens
cgccugaguuucaagaauu

SEQ ID NO: 993834 - RNA, 19 nt, Homo sapiens
uaacagaggaagcgagaga

SEQ ID NO: 993835 - RNA, 19 nt, Homo sapiens
gaagugccucuauaaagga

SEQ ID NO: 993836 - RNA, 19 nt, Homo sapiens
acuaauacgucucccuuug

SEQ ID NO: 993837 - RNA, 19 nt, Homo sapiens
ggaaaagaaugaccagcaa

SEQ ID NO: 993838 - RNA, 19 nt, Homo sapiens
uaucaaacagcuacugaaa

SEQ ID NO: 993839 - RNA, 19 nt, Homo sapiens
caaaagaacaguuaacaga

SEQ ID NO: 993840 - RNA, 19 nt, Homo sapiens
ugucaagcacccaauauuu

SEQ ID NO: 993841 - RNA, 19 nt, Homo sapiens
ucaaacuagugaaugaaga

SEQ ID NO: 993842 - RNA, 19 nt, Homo sapiens
gcaauugucggcaagagau

SEQ ID NO: 993843 - RNA, 19 nt, Homo sapiens
ggaucugggugcugcuuau

SEQ ID NO: 993844 - RNA, 19 nt, Homo sapiens
caaacuagugaaugaagaa

SEQ ID NO: 993845 - RNA, 19 nt, Homo sapiens
caacuggagaagucuguuu

SEQ ID NO: 993846 - RNA, 19 nt, Homo sapiens
ggagcgaagcuauggaaga

SEQ ID NO: 993847 - RNA, 19 nt, Homo sapiens
uauuguagaucuagaaguc

SEQ ID NO: 993848 - RNA, 19 nt, Homo sapiens
ggauuuugguuucauguuu

SEQ ID NO: 993849 - RNA, 19 nt, Homo sapiens
gaaccauggcuccgcagaa

SEQ ID NO: 993850 - RNA, 19 nt, Homo sapiens
ccucgaagugccucuauaa

SEQ ID NO: 993851 - RNA, 19 nt, Homo sapiens
gucaagcacccaauauuug

SEQ ID NO: 993852 - RNA, 19 nt, Homo sapiens
gcagaagguauacaaugga

SEQ ID NO: 993853 - RNA, 19 nt, Homo sapiens
cgagagaagguaucaaaca

SEQ ID NO: 993854 - RNA, 19 nt, Homo sapiens
ugagagacggcauggagua

SEQ ID NO: 993855 - RNA, 19 nt, Homo sapiens
ggaagugauauuauuguag

SEQ ID NO: 993856 - RNA, 19 nt, Homo sapiens
gcccuaaugucaaacuagu

SEQ ID NO: 993857 - RNA, 19 nt, Homo sapiens
cggacgagauuucuauaag

SEQ ID NO: 993858 - RNA, 19 nt, Homo sapiens
gacgaaugcccuaauguca

SEQ ID NO: 993859 - RNA, 19 nt, Homo sapiens
cacaagcccaggagaaauu

SEQ ID NO: 993860 - RNA, 19 nt, Homo sapiens
gguuggaguuguuagcaau

SEQ ID NO: 993861 - RNA, 19 nt, Homo sapiens
gcuuaagaauuuguccauu

SEQ ID NO: 993862 - RNA, 19 nt, Homo sapiens
gaggaagugauauuauugu

SEQ ID NO: 993863 - RNA, 19 nt, Homo sapiens
caagacagaaauauuccaa

SEQ ID NO: 993864 - RNA, 19 nt, Homo sapiens
gagcaaaagaaacacaaua

SEQ ID NO: 993865 - RNA, 19 nt, Homo sapiens
caacuuugacaacaacaau

SEQ ID NO: 993866 - RNA, 19 nt, Homo sapiens
agauggauauuacucacuu

SEQ ID NO: 993867 - RNA, 19 nt, Homo sapiens
aacgaacgcuggaaguaga

SEQ ID NO: 993868 - RNA, 19 nt, Homo sapiens
cgauacuuauggugaagaa

SEQ ID NO: 993869 - RNA, 19 nt, Homo sapiens
gugcagaagguauacaaug

SEQ ID NO: 993870 - RNA, 19 nt, Homo sapiens
aaacagcuacugaaacaag

SEQ ID NO: 993871 - RNA, 19 nt, Homo sapiens
gucacaagguacauauuuc

SEQ ID NO: 993872 - RNA, 19 nt, Homo sapiens
ggagguggucugcgacgaa

SEQ ID NO: 993873 - RNA, 19 nt, Homo sapiens
guuguuagcaauuucauuc

SEQ ID NO: 993874 - RNA, 19 nt, Homo sapiens
gguaucaaacagcuacuga

SEQ ID NO: 993875 - RNA, 19 nt, Homo sapiens
gauggauauuacucacuug

SEQ ID NO: 993876 - RNA, 19 nt, Homo sapiens
ucagcaagacagaaauauu

SEQ ID NO: 993877 - RNA, 19 nt, Homo sapiens
cgucagcaagacagaaaua

SEQ ID NO: 993878 - RNA, 19 nt, Homo sapiens
auagaggguuggaguuguu

SEQ ID NO: 993879 - RNA, 19 nt, Homo sapiens
gaagcgagagaagguauca

SEQ ID NO: 993880 - RNA, 19 nt, Homo sapiens
gagguggucugcgacgaau

SEQ ID NO: 993881 - RNA, 19 nt, Homo sapiens
aauaugcaaguuaggcuua

SEQ ID NO: 993882 - RNA, 19 nt, Homo sapiens
aaggagaggagaugauuug

SEQ ID NO: 993883 - RNA, 19 nt, Homo sapiens
ccuaaugucaaacuaguga

SEQ ID NO: 993884 - RNA, 19 nt, Homo sapiens
gccucgaagugccucuaua

SEQ ID NO: 993885 - RNA, 19 nt, Homo sapiens
gauggucacaagguacaua

SEQ ID NO: 993886 - RNA, 19 nt, Homo sapiens
gugccucuauaaaggauau

SEQ ID NO: 993887 - RNA, 19 nt, Homo sapiens
ggaguuguuagcaauuuca

SEQ ID NO: 993888 - RNA, 19 nt, Homo sapiens
ugcagaagguauacaaugg

SEQ ID NO: 993889 - RNA, 19 nt, Homo sapiens
gggugcugcuuaugagguu

SEQ ID NO: 993890 - RNA, 19 nt, Homo sapiens
gcacuuacaucauuuggua

SEQ ID NO: 993891 - RNA, 19 nt, Homo sapiens
ucaaacagcucuaguauga

SEQ ID NO: 993892 - RNA, 19 nt, Homo sapiens
gaaagcaaccuuaaaguuu

SEQ ID NO: 993893 - RNA, 19 nt, Homo sapiens
ggaaugaguucuuaucuag

SEQ ID NO: 993894 - RNA, 19 nt, Homo sapiens
gggcaaggaucacaucuaa

SEQ ID NO: 993895 - RNA, 19 nt, Homo sapiens
gaacccagauucacaguau

SEQ ID NO: 993896 - RNA, 19 nt, Homo sapiens
gaacagaaaccaagaaaca

SEQ ID NO: 993897 - RNA, 19 nt, Homo sapiens
caacauacuugccauuaga

SEQ ID NO: 993898 - RNA, 19 nt, Homo sapiens
gagcauuccuacucacaua

SEQ ID NO: 993899 - RNA, 19 nt, Homo sapiens
ggaaauggaucagacaaug

SEQ ID NO: 993900 - RNA, 19 nt, Homo sapiens
caaggaaggcuaauucuaa

SEQ ID NO: 993901 - RNA, 19 nt, Homo sapiens
guauauaucccucuaguaa

SEQ ID NO: 993902 - RNA, 19 nt, Homo sapiens
ccaagaaacaugguaauua

SEQ ID NO: 993903 - RNA, 19 nt, Homo sapiens
gaagaagacugaugagacu

SEQ ID NO: 993904 - RNA, 19 nt, Homo sapiens
ggaaauaggacaaguuaau

SEQ ID NO: 993905 - RNA, 19 nt, Homo sapiens
gacagugaauucagguuua

SEQ ID NO: 993906 - RNA, 19 nt, Homo sapiens
gcaaggaucacaucuaaug

SEQ ID NO: 993907 - RNA, 19 nt, Homo sapiens
ggaguugauugagauaaua

SEQ ID NO: 993908 - RNA, 19 nt, Homo sapiens
caagaaacaugguaauuac

SEQ ID NO: 993909 - RNA, 19 nt, Homo sapiens
gaauucagguuuaacuuca

SEQ ID NO: 993910 - RNA, 19 nt, Homo sapiens
ggucaaauagggcaaauaa

SEQ ID NO: 993911 - RNA, 19 nt, Homo sapiens
ggaccaaauuucaaaggaa

SEQ ID NO: 993912 - RNA, 19 nt, Homo sapiens
gaagagauaggaaugaguu

SEQ ID NO: 993913 - RNA, 19 nt, Homo sapiens
agaagaagcaaucuaguua

SEQ ID NO: 993914 - RNA, 19 nt, Homo sapiens
gaaagcauccuugaaauca

SEQ ID NO: 993915 - RNA, 19 nt, Homo sapiens
gaagaagcaaucuaguuaa

SEQ ID NO: 993916 - RNA, 19 nt, Homo sapiens
ugagauaaccaucaguuua

SEQ ID NO: 993917 - RNA, 19 nt, Homo sapiens
uauccgagguucuuaauau

SEQ ID NO: 993918 - RNA, 19 nt, Homo sapiens
gaucacaucuaaugcuugu

SEQ ID NO: 993919 - RNA, 19 nt, Homo sapiens
gaaaguacaugguaaaaca

SEQ ID NO: 993920 - RNA, 19 nt, Homo sapiens
gcauguggcuagauuuaug

SEQ ID NO: 993921 - RNA, 19 nt, Homo sapiens
ccaaugcucagaagaauaa

SEQ ID NO: 993922 - RNA, 19 nt, Homo sapiens
auacagaggugguuuaauc

SEQ ID NO: 993923 - RNA, 19 nt, Homo sapiens
cgaaggguaucagcuauuu

SEQ ID NO: 993924 - RNA, 19 nt, Homo sapiens
gaaagauuguaccaguuga

SEQ ID NO: 993925 - RNA, 19 nt, Homo sapiens
gagacuaggugcuuugcuu

SEQ ID NO: 993926 - RNA, 19 nt, Homo sapiens
gaagcaagaguaaagacua

SEQ ID NO: 993927 - RNA, 19 nt, Homo sapiens
ggaaagauuguaccaguug

SEQ ID NO: 993928 - RNA, 19 nt, Homo sapiens
cgagaaauauggcuacaca

SEQ ID NO: 993929 - RNA, 19 nt, Homo sapiens
gaaauaggacaaguuaaug

SEQ ID NO: 993930 - RNA, 19 nt, Homo sapiens
uaacugaccauuugcugua

SEQ ID NO: 993931 - RNA, 19 nt, Homo sapiens
gaaaggaagaacccagauu

SEQ ID NO: 993932 - RNA, 19 nt, Homo sapiens
caaauacagaggugguuua

SEQ ID NO: 993933 - RNA, 19 nt, Homo sapiens
gauuguaccaguugagaua

SEQ ID NO: 993934 - RNA, 19 nt, Homo sapiens
ccaagaauguuuugaguuu

SEQ ID NO: 993935 - RNA, 19 nt, Homo sapiens
caccaauucuuccuuuaaa

SEQ ID NO: 993936 - RNA, 19 nt, Homo sapiens
gcucuaguaugaagcaaga

SEQ ID NO: 993937 - RNA, 19 nt, Homo sapiens
uaaagucacuggaaauagg

SEQ ID NO: 993938 - RNA, 19 nt, Homo sapiens
gcuauagaguccaaaggaa

SEQ ID NO: 993939 - RNA, 19 nt, Homo sapiens
guggcuagauuuaugcuaa

SEQ ID NO: 993940 - RNA, 19 nt, Homo sapiens
aaacagcucuaguaugaag

SEQ ID NO: 993941 - RNA, 19 nt, Homo sapiens
cagaggugguuuaaucaaa

SEQ ID NO: 993942 - RNA, 19 nt, Homo sapiens
gcuggaaaguacaugguaa

SEQ ID NO: 993943 - RNA, 19 nt, Homo sapiens
ggaagaacccagauucaca

SEQ ID NO: 993944 - RNA, 19 nt, Homo sapiens
caacagagagagcuuggaa

SEQ ID NO: 993945 - RNA, 19 nt, Homo sapiens
aagcaagaguaaagacuaa

SEQ ID NO: 993946 - RNA, 19 nt, Homo sapiens
uuucagcacuuacaucauu

SEQ ID NO: 993947 - RNA, 19 nt, Homo sapiens
gagaacagaaaccaagaaa

SEQ ID NO: 993948 - RNA, 19 nt, Homo sapiens
ugaaagcaaccuuaaaguu

SEQ ID NO: 993949 - RNA, 19 nt, Homo sapiens
ggaauuuguuuucgccuua

SEQ ID NO: 993950 - RNA, 19 nt, Homo sapiens
gaauauugcuuugauagcu

SEQ ID NO: 993951 - RNA, 19 nt, Homo sapiens
agauaggaaugaguucuua

SEQ ID NO: 993952 - RNA, 19 nt, Homo sapiens
uuacaccaauucuuccuuu

SEQ ID NO: 993953 - RNA, 19 nt, Homo sapiens
ugacagggcauauucuuug

SEQ ID NO: 993954 - RNA, 19 nt, Homo sapiens
aaggaaggcuaauucuaaa

SEQ ID NO: 993955 - RNA, 19 nt, Homo sapiens
cuaaaucuguugaugaagu

SEQ ID NO: 993956 - RNA, 19 nt, Homo sapiens
gcuuuagucugacauaauc

SEQ ID NO: 993957 - RNA, 19 nt, Homo sapiens
gaguaaagacuaagguuuc

SEQ ID NO: 993958 - RNA, 19 nt, Homo sapiens
gagagcugcuucgugauga

SEQ ID NO: 993959 - RNA, 19 nt, Homo sapiens
gcaguggaaccuugaaaug

SEQ ID NO: 993960 - RNA, 19 nt, Homo sapiens
uggcagaauugucagcuuu

SEQ ID NO: 993961 - RNA, 19 nt, Homo sapiens
aaacgaaggguaucagcua

SEQ ID NO: 993962 - RNA, 19 nt, Homo sapiens
ccugaaagcauccuugaaa

SEQ ID NO: 993963 - RNA, 19 nt, Homo sapiens
uaguaacacuucaaagguu

SEQ ID NO: 993964 - RNA, 19 nt, Homo sapiens
ugagaaaacuuaagcuuug

SEQ ID NO: 993965 - RNA, 19 nt, Homo sapiens
guagucaguucuugcacaa

SEQ ID NO: 993966 - RNA, 19 nt, Homo sapiens
gaaaucaagacaaccuuca

SEQ ID NO: 993967 - RNA, 19 nt, Homo sapiens
uaaucaaacagcucuagua

SEQ ID NO: 993968 - RNA, 19 nt, Homo sapiens
gcaaauacagaggugguuu

SEQ ID NO: 993969 - RNA, 19 nt, Homo sapiens
uaacauauuggccacuaaa

SEQ ID NO: 993970 - RNA, 19 nt, Homo sapiens
cagcugaucuuaacaaaau

SEQ ID NO: 993971 - RNA, 19 nt, Homo sapiens
ggaaagaguagugguagga

SEQ ID NO: 993972 - RNA, 19 nt, Homo sapiens
cuucaaggauggaacaaga

SEQ ID NO: 993973 - RNA, 19 nt, Homo sapiens
uauagaguccaaaggaaua

SEQ ID NO: 993974 - RNA, 19 nt, Homo sapiens
ugacaaggaaggcuaauuc

SEQ ID NO: 993975 - RNA, 19 nt, Homo sapiens
ucagugauguuggauguau

SEQ ID NO: 993976 - RNA, 19 nt, Homo sapiens
aagauacagucaccaagaa

SEQ ID NO: 993977 - RNA, 19 nt, Homo sapiens
uauaacauauuggccacua

SEQ ID NO: 993978 - RNA, 19 nt, Homo sapiens
ugaagccgcuggucguguu

SEQ ID NO: 993979 - RNA, 19 nt, Homo sapiens
ggagagcugcuucgugaug

SEQ ID NO: 993980 - RNA, 19 nt, Homo sapiens
acaguauggugaacuuauu

SEQ ID NO: 993981 - RNA, 19 nt, Homo sapiens
gaauucagaccuaccuuca

SEQ ID NO: 993982 - RNA, 19 nt, Homo sapiens
ggagugaugacaacagaga

SEQ ID NO: 993983 - RNA, 19 nt, Homo sapiens
aggaaugaguucuuaucua

SEQ ID NO: 993984 - RNA, 19 nt, Homo sapiens
aaaugcauguggcuagauu

SEQ ID NO: 993985 - RNA, 19 nt, Homo sapiens
ugacauaaucuaaggguau

SEQ ID NO: 993986 - RNA, 19 nt, Homo sapiens
ggauaccugcuuccucuuu

SEQ ID NO: 993987 - RNA, 19 nt, Homo sapiens
gauguuggauguauaucag

SEQ ID NO: 993988 - RNA, 19 nt, Homo sapiens
guucuuaucuaguguugca

SEQ ID NO: 993989 - RNA, 19 nt, Homo sapiens
ucacaaugcuaagugguau

SEQ ID NO: 993990 - RNA, 19 nt, Homo sapiens
ggacaccgcuggagggauu

SEQ ID NO: 993991 - RNA, 19 nt, Homo sapiens
guacaugucccuaaauauu

SEQ ID NO: 993992 - RNA, 19 nt, Homo sapiens
caacaucacccgcaaggua

SEQ ID NO: 993993 - RNA, 19 nt, Homo sapiens
ugaaagaaguggaugaugu

SEQ ID NO: 993994 - RNA, 19 nt, Homo sapiens
cuaaauaugcucuguguaa

SEQ ID NO: 993995 - RNA, 19 nt, Homo sapiens
agacagagacccauaacua

SEQ ID NO: 993996 - RNA, 19 nt, Homo sapiens
uaguacaugucccuaaaua

SEQ ID NO: 993997 - RNA, 19 nt, Homo sapiens
gacagagacccauaacuaa

SEQ ID NO: 993998 - RNA, 19 nt, Homo sapiens
gaaagaaguggaugaugug

SEQ ID NO: 993999 - RNA, 19 nt, Homo sapiens
agagacccauaacuaaaua

SEQ ID NO: 994000 - RNA, 19 nt, Homo sapiens
cuagugugguggaaagaua

SEQ ID NO: 994001 - RNA, 19 nt, Homo sapiens
gcgaacauccucgugcuua

SEQ ID NO: 994002 - RNA, 19 nt, Homo sapiens
caggaaauauggccuaucu

SEQ ID NO: 994003 - RNA, 19 nt, Homo sapiens
gggagaauguugacucuac

SEQ ID NO: 994004 - RNA, 19 nt, Homo sapiens
gcagagucgugucccaaau

SEQ ID NO: 994005 - RNA, 19 nt, Homo sapiens
ccaaucaacacucuuaaau

SEQ ID NO: 994006 - RNA, 19 nt, Homo sapiens
ucuuucaucuuccacuuua

SEQ ID NO: 994007 - RNA, 19 nt, Homo sapiens
agaaguggaugaugugcuu

SEQ ID NO: 994008 - RNA, 19 nt, Homo sapiens
gaggagacagagacccaua

SEQ ID NO: 994009 - RNA, 19 nt, Homo sapiens
acagagacccauaacuaaa

SEQ ID NO: 994010 - RNA, 19 nt, Homo sapiens
gcagcugccugggagaaug

SEQ ID NO: 994011 - RNA, 19 nt, Homo sapiens
gguaacaaaucggaaguac

SEQ ID NO: 994012 - RNA, 19 nt, Homo sapiens
ccacuuuauuggcaguuga

SEQ ID NO: 994013 - RNA, 19 nt, Homo sapiens
caaaucggaaguacccaaa

SEQ ID NO: 994014 - RNA, 19 nt, Homo sapiens
guccuauucuuucaucuuc

SEQ ID NO: 994015 - RNA, 19 nt, Homo sapiens
cagagacccauaacuaaau

SEQ ID NO: 994016 - RNA, 19 nt, Homo sapiens
augcuuagcuggcaguaug

SEQ ID NO: 994017 - RNA, 19 nt, Homo sapiens
gugcugcaaugcucagugu

SEQ ID NO: 994018 - RNA, 19 nt, Homo sapiens
ggagaauguugacucuacu

SEQ ID NO: 994019 - RNA, 19 nt, Homo sapiens
aauaugcucuguguaaagu

SEQ ID NO: 994020 - RNA, 19 nt, Homo sapiens
uguguaaaguccuauucuu

SEQ ID NO: 994021 - RNA, 19 nt, Homo sapiens
gaugaccaccuucuacaag

SEQ ID NO: 994022 - RNA, 19 nt, Homo sapiens
ucaugaaugucugggaguu

SEQ ID NO: 994023 - RNA, 19 nt, Homo sapiens
ugaccaccuucuacaagug

SEQ ID NO: 994024 - RNA, 19 nt, Homo sapiens
ggaaguacccaaaacugaa

SEQ ID NO: 994025 - RNA, 19 nt, Homo sapiens
gcaguugacauucccuuac

SEQ ID NO: 994026 - RNA, 19 nt, Homo sapiens
ggcaguugacauucccuua

SEQ ID NO: 994027 - RNA, 19 nt, Homo sapiens
aacuaaauaugcucugugu

SEQ ID NO: 994028 - RNA, 19 nt, Homo sapiens
gagcagcugccugggagaa

SEQ ID NO: 994029 - RNA, 19 nt, Homo sapiens
uuuauuggcaguugacauu

SEQ ID NO: 994030 - RNA, 19 nt, Homo sapiens
gaaguacccaaaacugaaa

SEQ ID NO: 994031 - RNA, 19 nt, Homo sapiens
gacccgcucugcagaugag

SEQ ID NO: 994032 - RNA, 19 nt, Homo sapiens
guccugagggucuuugcua

SEQ ID NO: 994033 - RNA, 19 nt, Homo sapiens
gaacauccucgugcuuacu

SEQ ID NO: 994034 - RNA, 19 nt, Homo sapiens
cgaacauccucgugcuuac

SEQ ID NO: 994035 - RNA, 19 nt, Homo sapiens
agaccaugcugcuguucug

SEQ ID NO: 994036 - RNA, 19 nt, Homo sapiens
aacaucacccgcaagguaa

SEQ ID NO: 994037 - RNA, 19 nt, Homo sapiens
guuggagccugcggaguuc

SEQ ID NO: 994038 - RNA, 19 nt, Homo sapiens
ggagacagagacccauaac

SEQ ID NO: 994039 - RNA, 19 nt, Homo sapiens
cagagucgugucccaaaug

SEQ ID NO: 994040 - RNA, 19 nt, Homo sapiens
caguugacauucccuuacu

SEQ ID NO: 994041 - RNA, 19 nt, Homo sapiens
ucgagaccaugcugcuguu

SEQ ID NO: 994042 - RNA, 19 nt, Homo sapiens
caggcaggguggaugaagu

SEQ ID NO: 994043 - RNA, 19 nt, Homo sapiens
cugagggucuuugcuagug

SEQ ID NO: 994044 - RNA, 19 nt, Homo sapiens
ugaaagagcugcuuccauu

SEQ ID NO: 994045 - RNA, 19 nt, Homo sapiens
gaucuuaguugcuuauuug

SEQ ID NO: 994046 - RNA, 19 nt, Homo sapiens
gaagacauguuauauaguc

SEQ ID NO: 994047 - RNA, 19 nt, Homo sapiens
ggacauggaucaagauaag

SEQ ID NO: 994048 - RNA, 19 nt, Homo sapiens
caaaucagauggagaaagu

SEQ ID NO: 994049 - RNA, 19 nt, Homo sapiens
gagcacagcagaaguguuu

SEQ ID NO: 994050 - RNA, 19 nt, Homo sapiens
guaaugaaauggaucacaa

SEQ ID NO: 994051 - RNA, 19 nt, Homo sapiens
gaagagggcucaacuuagc

SEQ ID NO: 994052 - RNA, 19 nt, Homo sapiens
ggacggagaucuacaucau

SEQ ID NO: 994053 - RNA, 19 nt, Homo sapiens
gcagauguauggccguaaa

SEQ ID NO: 994054 - RNA, 19 nt, Homo sapiens
cagaagagggcucaacuua

SEQ ID NO: 994055 - RNA, 19 nt, Homo sapiens
uaacauccauucccuuuca

SEQ ID NO: 994056 - RNA, 19 nt, Homo sapiens
ugagaaagcuagaaguaga

SEQ ID NO: 994057 - RNA, 19 nt, Homo sapiens
gaagagagaauuaaagaag

SEQ ID NO: 994058 - RNA, 19 nt, Homo sapiens
ccacugaccuaaacuuuca

SEQ ID NO: 994059 - RNA, 19 nt, Homo sapiens
gagaugaagacauguuaua

SEQ ID NO: 994060 - RNA, 19 nt, Homo sapiens
ggaacugacuccucuucaa

SEQ ID NO: 994061 - RNA, 19 nt, Homo sapiens
uggaugaaauggaguuuaa

SEQ ID NO: 994062 - RNA, 19 nt, Homo sapiens
gaccuaaacuuucagugau

SEQ ID NO: 994063 - RNA, 19 nt, Homo sapiens
cgacaaaucagauggagaa

SEQ ID NO: 994064 - RNA, 19 nt, Homo sapiens
gcacuggaguagagauuuc

SEQ ID NO: 994065 - RNA, 19 nt, Homo sapiens
ggacgaugaugaagaugau

SEQ ID NO: 994066 - RNA, 19 nt, Homo sapiens
ggaucuuaguugcuuauuu

SEQ ID NO: 994067 - RNA, 19 nt, Homo sapiens
cgugaaaccuuugaacgua

SEQ ID NO: 994068 - RNA, 19 nt, Homo sapiens
ugaaauggaucacaauguc

SEQ ID NO: 994069 - RNA, 19 nt, Homo sapiens
gacaugguguuccacguuu

SEQ ID NO: 994070 - RNA, 19 nt, Homo sapiens
gaacaaguaaaccauacaa

SEQ ID NO: 994071 - RNA, 19 nt, Homo sapiens
gcacauccacugcuucuuc

SEQ ID NO: 994072 - RNA, 19 nt, Homo sapiens
gaaguagaauaugaacaga

SEQ ID NO: 994073 - RNA, 19 nt, Homo sapiens
ggagaaauuggaugaaaug

SEQ ID NO: 994074 - RNA, 19 nt, Homo sapiens
aggcagagauuacucgauu

SEQ ID NO: 994075 - RNA, 19 nt, Homo sapiens
caacagccacaauuaaaug

SEQ ID NO: 994076 - RNA, 19 nt, Homo sapiens
gaaagucagaggaugauuc

SEQ ID NO: 994077 - RNA, 19 nt, Homo sapiens
gcuaacauccauucccuuu

SEQ ID NO: 994078 - RNA, 19 nt, Homo sapiens
gcagagauuacucgauuug

SEQ ID NO: 994079 - RNA, 19 nt, Homo sapiens
agaaaguacugaaagacaa

SEQ ID NO: 994080 - RNA, 19 nt, Homo sapiens
gaauuugugcaccgugaua

SEQ ID NO: 994081 - RNA, 19 nt, Homo sapiens
cagccacccucuauccuaa

SEQ ID NO: 994082 - RNA, 19 nt, Homo sapiens
gcaacagccacaauuaaau

SEQ ID NO: 994083 - RNA, 19 nt, Homo sapiens
ccaguucuuuggaaauuug

SEQ ID NO: 994084 - RNA, 19 nt, Homo sapiens
gaacugacuccucuucaag

SEQ ID NO: 994085 - RNA, 19 nt, Homo sapiens
gaaagagcugcuuccauug

SEQ ID NO: 994086 - RNA, 19 nt, Homo sapiens
gauggaagggcuacuguga

SEQ ID NO: 994087 - RNA, 19 nt, Homo sapiens
caaagcagcacccaaaucu

SEQ ID NO: 994088 - RNA, 19 nt, Homo sapiens
gagaguacgucgggagaau

SEQ ID NO: 994089 - RNA, 19 nt, Homo sapiens
caacuuagccaauauuuug

SEQ ID NO: 994090 - RNA, 19 nt, Homo sapiens
gggaagaauauguacaauu

SEQ ID NO: 994091 - RNA, 19 nt, Homo sapiens
gacgggaaguagaggaauu

SEQ ID NO: 994092 - RNA, 19 nt, Homo sapiens
gcgagaugaagacauguua

SEQ ID NO: 994093 - RNA, 19 nt, Homo sapiens
ggacaugguguuccacguu

SEQ ID NO: 994094 - RNA, 19 nt, Homo sapiens
ggaagagagaauuaaagaa

SEQ ID NO: 994095 - RNA, 19 nt, Homo sapiens
aaacuaaggaugaugucua

SEQ ID NO: 994096 - RNA, 19 nt, Homo sapiens
gagaaaguacugaaagaca

SEQ ID NO: 994097 - RNA, 19 nt, Homo sapiens
gguucgagcugcaguuuua

SEQ ID NO: 994098 - RNA, 19 nt, Homo sapiens
cuaaggaugaugucuauga

SEQ ID NO: 994099 - RNA, 19 nt, Homo sapiens
caaaucugguccuucuguu

SEQ ID NO: 994100 - RNA, 19 nt, Homo sapiens
cagugaagaugauggcuau

SEQ ID NO: 994101 - RNA, 19 nt, Homo sapiens
gugcaacagccacaauuaa

SEQ ID NO: 994102 - RNA, 19 nt, Homo sapiens
gaaauggaucacaauguca

SEQ ID NO: 994103 - RNA, 19 nt, Homo sapiens
caucuugccuuuuguguuu

SEQ ID NO: 994104 - RNA, 19 nt, Homo sapiens
cagaauuuacugcacauaa

SEQ ID NO: 994105 - RNA, 19 nt, Homo sapiens
aaagaaagucagaggauga

SEQ ID NO: 994106 - RNA, 19 nt, Homo sapiens
gagaagaaagccacagcaa

SEQ ID NO: 994107 - RNA, 19 nt, Homo sapiens
gaaaagcaaucacaaaagc

SEQ ID NO: 994108 - RNA, 19 nt, Homo sapiens
ugaaaccuuugaacguauu

SEQ ID NO: 994109 - RNA, 19 nt, Homo sapiens
uccgagacauggagaaauu

SEQ ID NO: 994110 - RNA, 19 nt, Homo sapiens
ccuaaacuuucagugauuu

SEQ ID NO: 994111 - RNA, 19 nt, Homo sapiens
gaguacgucgggagaauaa

SEQ ID NO: 994112 - RNA, 19 nt, Homo sapiens
caaggcggaugauacaagu

SEQ ID NO: 994113 - RNA, 19 nt, Homo sapiens
gagagacaacaaugaagaa

SEQ ID NO: 994114 - RNA, 19 nt, Homo sapiens
ugagagagacaacaaugaa

SEQ ID NO: 994115 - RNA, 19 nt, Homo sapiens
gaaagcuagaaguagaaua

SEQ ID NO: 994116 - RNA, 19 nt, Homo sapiens
gagaaagcuagaaguagaa

SEQ ID NO: 994117 - RNA, 19 nt, Homo sapiens
ugaccuaaacuuucaguga

SEQ ID NO: 994118 - RNA, 19 nt, Homo sapiens
gaacaugaaggaacugacu

SEQ ID NO: 994119 - RNA, 19 nt, Homo sapiens
gaggacauggaucaagaua

SEQ ID NO: 994120 - RNA, 19 nt, Homo sapiens
gcuagaaguagaauaugaa

SEQ ID NO: 994121 - RNA, 19 nt, Homo sapiens
gugaaaccuuugaacguau

SEQ ID NO: 994122 - RNA, 19 nt, Homo sapiens
ccaagccacagaucacuaa

SEQ ID NO: 994123 - RNA, 19 nt, Homo sapiens
cagccaccauugagaagaa

SEQ ID NO: 994124 - RNA, 19 nt, Homo sapiens
gaagaugauucugaugacu

SEQ ID NO: 994125 - RNA, 19 nt, Homo sapiens
agaggacgaugaugaagau

SEQ ID NO: 994126 - RNA, 19 nt, Homo sapiens
cagccacaauuaaaugaga

SEQ ID NO: 994127 - RNA, 19 nt, Homo sapiens
ccuaauacaaggcaggaua

SEQ ID NO: 994128 - RNA, 19 nt, Homo sapiens
ccacagaccaagcccgaaa

SEQ ID NO: 994129 - RNA, 19 nt, Homo sapiens
ugaugaagaugauucugau

SEQ ID NO: 994130 - RNA, 19 nt, Homo sapiens
uauggcaggucaagaaauc

SEQ ID NO: 994131 - RNA, 19 nt, Homo sapiens
uugcagauaugccuggaaa

SEQ ID NO: 994132 - RNA, 19 nt, Homo sapiens
agaccaagcccgaaaggaa

SEQ ID NO: 994133 - RNA, 19 nt, Homo sapiens
caggauaugugggaagaau

SEQ ID NO: 994134 - RNA, 19 nt, Homo sapiens
agagauuacucgauuugug

SEQ ID NO: 994135 - RNA, 19 nt, Homo sapiens
caagugcagccaccauuga

SEQ ID NO: 994136 - RNA, 19 nt, Homo sapiens
cauguuauauaguccugaa

SEQ ID NO: 994137 - RNA, 19 nt, Homo sapiens
caaagaauugagaaagcua

SEQ ID NO: 994138 - RNA, 19 nt, Homo sapiens
cggaagagagaauuaaaga

SEQ ID NO: 994139 - RNA, 19 nt, Homo sapiens
aaauuuagccuuguucaga

SEQ ID NO: 994140 - RNA, 19 nt, Homo sapiens
ccaaagaaagucagaggau

SEQ ID NO: 994141 - RNA, 19 nt, Homo sapiens
ggcagagauuacucgauuu

SEQ ID NO: 994142 - RNA, 19 nt, Homo sapiens
gaaaggaagcccggaagag

SEQ ID NO: 994143 - RNA, 19 nt, Homo sapiens
agaagaacaugaaggaacu

SEQ ID NO: 994144 - RNA, 19 nt, Homo sapiens
gaacagagcuaaggguuuc

SEQ ID NO: 994145 - RNA, 19 nt, Homo sapiens
ggaagucgcuggaggaaug

SEQ ID NO: 994146 - RNA, 19 nt, Homo sapiens
gcagguggauuugagguua

SEQ ID NO: 994147 - RNA, 19 nt, Homo sapiens
gcagggauaugccuuugaa

SEQ ID NO: 994148 - RNA, 19 nt, Homo sapiens
ucacagaguuuagacauga

SEQ ID NO: 994149 - RNA, 19 nt, Homo sapiens
gucagaagcuggcgaagaa

SEQ ID NO: 994150 - RNA, 19 nt, Homo sapiens
ccacugaauuuguauacuu

SEQ ID NO: 994151 - RNA, 19 nt, Homo sapiens
gaaguccauucccaauuga

SEQ ID NO: 994152 - RNA, 19 nt, Homo sapiens
cgagucaacuuacuacaug

SEQ ID NO: 994153 - RNA, 19 nt, Homo sapiens
gggagugacuucuuaaugg

SEQ ID NO: 994154 - RNA, 19 nt, Homo sapiens
agaaguccauucccaauug

SEQ ID NO: 994155 - RNA, 19 nt, Homo sapiens
guaauucaaucagacacua

SEQ ID NO: 994156 - RNA, 19 nt, Homo sapiens
gaagucaauuccuugcaau

SEQ ID NO: 994157 - RNA, 19 nt, Homo sapiens
ucacugaagucaauuccuu

SEQ ID NO: 994158 - RNA, 19 nt, Homo sapiens
gcauaaaggcuaucguaga

SEQ ID NO: 994159 - RNA, 19 nt, Homo sapiens
cauaaaggcuaucguagag

SEQ ID NO: 994160 - RNA, 19 nt, Homo sapiens
gaagcugccuccagagaag

SEQ ID NO: 994161 - RNA, 19 nt, Homo sapiens
gcaaggaacucaggaagcu

SEQ ID NO: 994162 - RNA, 19 nt, Homo sapiens
gcacuucccgaacgaguuu

SEQ ID NO: 994163 - RNA, 19 nt, Homo sapiens
ggaucgcggugaacauuug

SEQ ID NO: 994164 - RNA, 19 nt, Homo sapiens
gucaauuccuugcaauaaa

SEQ ID NO: 994165 - RNA, 19 nt, Homo sapiens
gacagaauuugcugaguca

SEQ ID NO: 994166 - RNA, 19 nt, Homo sapiens
uacaaucacugaagucaau

SEQ ID NO: 994167 - RNA, 19 nt, Homo sapiens
uugcuaagcucgaccuaaa

SEQ ID NO: 994168 - RNA, 19 nt, Homo sapiens
ccaggacuuuggcuacuuu

SEQ ID NO: 994169 - RNA, 19 nt, Homo sapiens
guauuucugugaagguauu

SEQ ID NO: 994170 - RNA, 19 nt, Homo sapiens
ugaaugaugucuggaacuu

SEQ ID NO: 994171 - RNA, 19 nt, Homo sapiens
ugaagucaauuccuugcaa

SEQ ID NO: 994172 - RNA, 19 nt, Homo sapiens
ccaauugacuaaguaagug

SEQ ID NO: 994173 - RNA, 19 nt, Homo sapiens
agagguggcugcaaugugu

SEQ ID NO: 994174 - RNA, 19 nt, Homo sapiens
gaagguauuuuguagaugu

SEQ ID NO: 994175 - RNA, 19 nt, Homo sapiens
acacuaaucuagguauuuc

SEQ ID NO: 994176 - RNA, 19 nt, Homo sapiens
gaguuuaccucgggagaug

SEQ ID NO: 994177 - RNA, 19 nt, Homo sapiens
gaagcuuccuuggacagaa

SEQ ID NO: 994178 - RNA, 19 nt, Homo sapiens
agaggugaauguacuaaau

SEQ ID NO: 994179 - RNA, 19 nt, Homo sapiens
gucuggaacuucaagauga

SEQ ID NO: 994180 - RNA, 19 nt, Homo sapiens
gccagcaggugaaugaugu

SEQ ID NO: 994181 - RNA, 19 nt, Homo sapiens
gaauacagccguggugauc

SEQ ID NO: 994182 - RNA, 19 nt, Homo sapiens
ucagaaggccuaaagaaca

SEQ ID NO: 994183 - RNA, 19 nt, Homo sapiens
ccaccaucgugaaagagua

SEQ ID NO: 994184 - RNA, 19 nt, Homo sapiens
ucaacuggcuuauguacag

SEQ ID NO: 994185 - RNA, 19 nt, Homo sapiens
gaacucaggaagcuugauc

SEQ ID NO: 994186 - RNA, 19 nt, Homo sapiens
gggacuagguagaggugaa

SEQ ID NO: 994187 - RNA, 19 nt, Homo sapiens
cuaaguaagugagauuauc

SEQ ID NO: 994188 - RNA, 19 nt, Homo sapiens
caagaugacgggcagguau

SEQ ID NO: 994189 - RNA, 19 nt, Homo sapiens
aaugaugucuggaacuuca

SEQ ID NO: 994190 - RNA, 19 nt, Homo sapiens
acuuugaacugcagggaua

SEQ ID NO: 994191 - RNA, 19 nt, Homo sapiens
cagagaagacuuugaacug

SEQ ID NO: 994192 - RNA, 19 nt, Homo sapiens
ucaaucagacacuaaucua

SEQ ID NO: 994193 - RNA, 19 nt, Homo sapiens
gauuugagguuaggcagau

SEQ ID NO: 994194 - RNA, 19 nt, Homo sapiens
cuuuggaugugucagcuua

SEQ ID NO: 994195 - RNA, 19 nt, Homo sapiens
caccaguaauucaaucaga

SEQ ID NO: 994196 - RNA, 19 nt, Homo sapiens
gaggugaauguacuaaaug

SEQ ID NO: 994197 - RNA, 19 nt, Homo sapiens
cagaaggccuaaagaacag

SEQ ID NO: 994198 - RNA, 19 nt, Homo sapiens
cagagugggugauuucaac

SEQ ID NO: 994199 - RNA, 19 nt, Homo sapiens
cuagccagcuccuacaauc

SEQ ID NO: 994200 - RNA, 19 nt, Homo sapiens
uagccugccucacagaguu

SEQ ID NO: 994201 - RNA, 19 nt, Homo sapiens
ggcgagaguuccugacagu

SEQ ID NO: 994202 - RNA, 19 nt, Homo sapiens
gacacuaaucuagguauuu

SEQ ID NO: 994203 - RNA, 19 nt, Homo sapiens
agacacuaaucuagguauu

SEQ ID NO: 994204 - RNA, 19 nt, Homo sapiens
ccgaagcugucaaguccaa

SEQ ID NO: 994205 - RNA, 19 nt, Homo sapiens
ggaaggaucgcggugaaca

SEQ ID NO: 994206 - RNA, 19 nt, Homo sapiens
ugacuaaguaagugagauu

SEQ ID NO: 994207 - RNA, 19 nt, Homo sapiens
guacuaaaugccacugaau

SEQ ID NO: 994208 - RNA, 19 nt, Homo sapiens
ccagguugguuuuaaaauu

SEQ ID NO: 994209 - RNA, 19 nt, Homo sapiens
ggccagaaacgcagccauu

SEQ ID NO: 994210 - RNA, 19 nt, Homo sapiens
ucaacgagucaacuuacua

SEQ ID NO: 994211 - RNA, 19 nt, Homo sapiens
ggcuuaacauguccagguu

SEQ ID NO: 994212 - RNA, 19 nt, Homo sapiens
cucgggagauggaaagaaa

SEQ ID NO: 994213 - RNA, 19 nt, Homo sapiens
cagaaguccauucccaauu

SEQ ID NO: 994214 - RNA, 19 nt, Homo sapiens
gggauaugccuuugaagca

SEQ ID NO: 994215 - RNA, 19 nt, Homo sapiens
gcaaguguggcaggcuuaa

SEQ ID NO: 994216 - RNA, 19 nt, Homo sapiens
gggcagguaugagauguac

SEQ ID NO: 994217 - RNA, 19 nt, Homo sapiens
ggggauguuuuguggaaua

SEQ ID NO: 994218 - RNA, 19 nt, Homo sapiens
gugaagcgcguucucuaug

SEQ ID NO: 994219 - RNA, 19 nt, Homo sapiens
ugaagcgcguucucuaugg

SEQ ID NO: 994220 - RNA, 19 nt, Homo sapiens
uggcuuauguacagcauca

SEQ ID NO: 994221 - RNA, 19 nt, Homo sapiens
gaagugaagcgcguucucu

SEQ ID NO: 994222 - RNA, 19 nt, Homo sapiens
gacuaaguaagugagauua

SEQ ID NO: 994223 - RNA, 19 nt, Homo sapiens
cauggggagugacuucuua

SEQ ID NO: 994224 - RNA, 19 nt, Homo sapiens
ggagcaguccugggaaaga

SEQ ID NO: 994225 - RNA, 19 nt, Homo sapiens
ggaauacagccguggugau

SEQ ID NO: 994226 - RNA, 19 nt, Homo sapiens
ucugauagccugccucaca

SEQ ID NO: 994227 - RNA, 19 nt, Homo sapiens
acagucugcccuucugaua

SEQ ID NO: 994228 - RNA, 19 nt, Homo sapiens
uguacuaaaugccacugaa

SEQ ID NO: 994229 - RNA, 19 nt, Homo sapiens
aagaguagccggcuucagu

SEQ ID NO: 994230 - RNA, 19 nt, Homo sapiens
cuuacuacauggagggaaa

SEQ ID NO: 994231 - RNA, 19 nt, Homo sapiens
gagcaguccugggaaagac

SEQ ID NO: 994232 - RNA, 19 nt, Homo sapiens
gggcaaagggcaggcaguu

SEQ ID NO: 994233 - RNA, 19 nt, Homo sapiens
gcugucaaguccaacuaca

SEQ ID NO: 994234 - RNA, 19 nt, Homo sapiens
cgaagcugccuccagagaa

SEQ ID NO: 994235 - RNA, 19 nt, Homo sapiens
caacgagucaacuuacuac

SEQ ID NO: 994236 - RNA, 19 nt, Homo sapiens
acgcauaaaggcuaucgua

SEQ ID NO: 994237 - RNA, 19 nt, Homo sapiens
ccggagcaguccugggaaa

SEQ ID NO: 994238 - RNA, 19 nt, Homo sapiens
ggucucugcccuucauaga

SEQ ID NO: 994239 - RNA, 19 nt, Homo sapiens
gguagaggugaauguacua

SEQ ID NO: 994240 - RNA, 19 nt, Homo sapiens
cgggauggacugcuaguug

SEQ ID NO: 994241 - RNA, 19 nt, Homo sapiens
agucaauuccuugcaauaa

SEQ ID NO: 994242 - RNA, 19 nt, Homo sapiens
gccacagucaccaguaauu

SEQ ID NO: 994243 - RNA, 19 nt, Homo sapiens
cacugaauuuguauacuuc

SEQ ID NO: 994244 - RNA, 19 nt, Homo sapiens
ggaaauccauagacaaaug

SEQ ID NO: 994245 - RNA, 19 nt, Homo sapiens
ggaaguagcuugccucacu

SEQ ID NO: 994246 - RNA, 19 nt, Homo sapiens
gaacaagaccuuuucguuu

SEQ ID NO: 994247 - RNA, 19 nt, Homo sapiens
gaaauccauagacaaauga

SEQ ID NO: 994248 - RNA, 19 nt, Homo sapiens
ggaguaaucagguggaaau

SEQ ID NO: 994249 - RNA, 19 nt, Homo sapiens
gggugcagcuggucucuga

SEQ ID NO: 994250 - RNA, 19 nt, Homo sapiens
gagggugggugaugcugaa

SEQ ID NO: 994251 - RNA, 19 nt, Homo sapiens
gcgcagugguugaaacauc

SEQ ID NO: 994252 - RNA, 19 nt, Homo sapiens
gcugaaguuugucccuaaa

SEQ ID NO: 994253 - RNA, 19 nt, Homo sapiens
gcagcuggucucugaauga

SEQ ID NO: 994254 - RNA, 19 nt, Homo sapiens
aagcggcuguugcuccaua

SEQ ID NO: 994255 - RNA, 19 nt, Homo sapiens
ggagcacaauagaucugaa

SEQ ID NO: 994256 - RNA, 19 nt, Homo sapiens
ggugggugaugcugaaauc

SEQ ID NO: 994257 - RNA, 19 nt, Homo sapiens
gaaaagagacucauuugcu

SEQ ID NO: 994258 - RNA, 19 nt, Homo sapiens
ccucacuucugcuuaggaa

SEQ ID NO: 994259 - RNA, 19 nt, Homo sapiens
guuacacccucaccuucuu

SEQ ID NO: 994260 - RNA, 19 nt, Homo sapiens
uuacgugugugccaagugu

SEQ ID NO: 994261 - RNA, 19 nt, Homo sapiens
gcagggcgcagugguugaa

SEQ ID NO: 994262 - RNA, 19 nt, Homo sapiens
cacacugucggcugacuua

SEQ ID NO: 994263 - RNA, 19 nt, Homo sapiens
ugaaguuugucccuaaagg

SEQ ID NO: 994264 - RNA, 19 nt, Homo sapiens
gacugugccuuacuguaca

SEQ ID NO: 994265 - RNA, 19 nt, Homo sapiens
gggcagucccgauucugaa

SEQ ID NO: 994266 - RNA, 19 nt, Homo sapiens
ugacugugccuuacuguac

SEQ ID NO: 994267 - RNA, 19 nt, Homo sapiens
cgcugaaguuugucccuaa

SEQ ID NO: 994268 - RNA, 19 nt, Homo sapiens
cccaagguguggugacugu

SEQ ID NO: 994269 - RNA, 19 nt, Homo sapiens
cgcagugguugaaacauca

SEQ ID NO: 994270 - RNA, 19 nt, Homo sapiens
gguguccuguggcaagugu

SEQ ID NO: 994271 - RNA, 19 nt, Homo sapiens
ggcagccuuuggucaguug

SEQ ID NO: 994272 - RNA, 19 nt, Homo sapiens
gagcacaauagaucugaag

SEQ ID NO: 994273 - RNA, 19 nt, Homo sapiens
gaguggggauggucuguga

SEQ ID NO: 994274 - RNA, 19 nt, Homo sapiens
gacguuacacccucaccuu

SEQ ID NO: 994275 - RNA, 19 nt, Homo sapiens
guccggagcacaauagauc

SEQ ID NO: 994276 - RNA, 19 nt, Homo sapiens
ucacuucugcuuaggaaag

SEQ ID NO: 994277 - RNA, 19 nt, Homo sapiens
ccaagcguccggagcacaa

SEQ ID NO: 994278 - RNA, 19 nt, Homo sapiens
gaggcccaauuccaagaca

SEQ ID NO: 994279 - RNA, 19 nt, Homo sapiens
guugaaacaucaggacacu

SEQ ID NO: 994280 - RNA, 19 nt, Homo sapiens
cuuaggagacagaauggaa

SEQ ID NO: 994281 - RNA, 19 nt, Homo sapiens
aacaagaccuuuucguuuc

SEQ ID NO: 994282 - RNA, 19 nt, Homo sapiens
cuaaaggcaaagaaacuuc

SEQ ID NO: 994283 - RNA, 19 nt, Homo sapiens
uuaggagacagaauggaaa

SEQ ID NO: 994284 - RNA, 19 nt, Homo sapiens
cucauuugcugaugguuca

SEQ ID NO: 994285 - RNA, 19 nt, Homo sapiens
agacucauuugcugauggu

SEQ ID NO: 994286 - RNA, 19 nt, Homo sapiens
caaaguagaugguuuagua

SEQ ID NO: 994287 - RNA, 19 nt, Homo sapiens
gaacuucaauuccauguuu

SEQ ID NO: 994288 - RNA, 19 nt, Homo sapiens
ggucaaagaugaugcauaa

SEQ ID NO: 994289 - RNA, 19 nt, Homo sapiens
ggaaaugacuccaaaguag

SEQ ID NO: 994290 - RNA, 19 nt, Homo sapiens
gaacaucagcuuagauuaa

SEQ ID NO: 994291 - RNA, 19 nt, Homo sapiens
gagaagggauuugguauuu

SEQ ID NO: 994292 - RNA, 19 nt, Homo sapiens
uaucauggguguuguaaua

SEQ ID NO: 994293 - RNA, 19 nt, Homo sapiens
gagaagaaaugaggacaua

SEQ ID NO: 994294 - RNA, 19 nt, Homo sapiens
caaggaaggugaagcagua

SEQ ID NO: 994295 - RNA, 19 nt, Homo sapiens
ggacuaaaguagaugauug

SEQ ID NO: 994296 - RNA, 19 nt, Homo sapiens
ggagagcgccaaaccauua

SEQ ID NO: 994297 - RNA, 19 nt, Homo sapiens
gaagacgaauuugacuuua

SEQ ID NO: 994298 - RNA, 19 nt, Homo sapiens
gaagagggagaaauuguua

SEQ ID NO: 994299 - RNA, 19 nt, Homo sapiens
gguaggagauguagauuug

SEQ ID NO: 994300 - RNA, 19 nt, Homo sapiens
gauaugacauuucuacaug

SEQ ID NO: 994301 - RNA, 19 nt, Homo sapiens
caaaucagcucaaacgaau

SEQ ID NO: 994302 - RNA, 19 nt, Homo sapiens
gaaaggaaguaagaaaguu

SEQ ID NO: 994303 - RNA, 19 nt, Homo sapiens
gaggagaaguuccagauga

SEQ ID NO: 994304 - RNA, 19 nt, Homo sapiens
cuagaaacauggcaaagua

SEQ ID NO: 994305 - RNA, 19 nt, Homo sapiens
gugcagaggucaaagauga

SEQ ID NO: 994306 - RNA, 19 nt, Homo sapiens
gaaaagggcuugauugugu

SEQ ID NO: 994307 - RNA, 19 nt, Homo sapiens
gaaauagaccugaguuaug

SEQ ID NO: 994308 - RNA, 19 nt, Homo sapiens
aggaacaacugaagaaaua

SEQ ID NO: 994309 - RNA, 19 nt, Homo sapiens
caaaguugcuacauuauca

SEQ ID NO: 994310 - RNA, 19 nt, Homo sapiens
guauggcacucuuaauuaa

SEQ ID NO: 994311 - RNA, 19 nt, Homo sapiens
ucacaaagguuacacacuu

SEQ ID NO: 994312 - RNA, 19 nt, Homo sapiens
gaaacguggugaucagauu

SEQ ID NO: 994313 - RNA, 19 nt, Homo sapiens
caccacagcuaaagaagua

SEQ ID NO: 994314 - RNA, 19 nt, Homo sapiens
gauaggagaucauagucaa

SEQ ID NO: 994315 - RNA, 19 nt, Homo sapiens
ugaagaugcucaagaacua

SEQ ID NO: 994316 - RNA, 19 nt, Homo sapiens
ggaaaucagucauccagau

SEQ ID NO: 994317 - RNA, 19 nt, Homo sapiens
gaaagaggagcuggaguua

SEQ ID NO: 994318 - RNA, 19 nt, Homo sapiens
uaugaaagccguugaaauu

SEQ ID NO: 994319 - RNA, 19 nt, Homo sapiens
gacacggauuguauuauua

SEQ ID NO: 994320 - RNA, 19 nt, Homo sapiens
gggagaaauuguuauggua

SEQ ID NO: 994321 - RNA, 19 nt, Homo sapiens
gaacucugcucagugauga

SEQ ID NO: 994322 - RNA, 19 nt, Homo sapiens
gguauggcacucuuaauua

SEQ ID NO: 994323 - RNA, 19 nt, Homo sapiens
caucgaagauuguaacuca

SEQ ID NO: 994324 - RNA, 19 nt, Homo sapiens
ggacccagcuaugauguuu

SEQ ID NO: 994325 - RNA, 19 nt, Homo sapiens
gaucaguucuccaaauuag

SEQ ID NO: 994326 - RNA, 19 nt, Homo sapiens
guaaagacaccacagcuaa

SEQ ID NO: 994327 - RNA, 19 nt, Homo sapiens
ccaaagcuauuuagugaug

SEQ ID NO: 994328 - RNA, 19 nt, Homo sapiens
ugacacggauuguauuauu

SEQ ID NO: 994329 - RNA, 19 nt, Homo sapiens
ggauccaacuuauauagaa

SEQ ID NO: 994330 - RNA, 19 nt, Homo sapiens
guaagaagcauacagaaga

SEQ ID NO: 994331 - RNA, 19 nt, Homo sapiens
gaacuagaccggaguggaa

SEQ ID NO: 994332 - RNA, 19 nt, Homo sapiens
caauguaggucucaguuug

SEQ ID NO: 994333 - RNA, 19 nt, Homo sapiens
gcauagcccagcaagauua

SEQ ID NO: 994334 - RNA, 19 nt, Homo sapiens
gaaaugggagggaguaguu

SEQ ID NO: 994335 - RNA, 19 nt, Homo sapiens
aaacagaagucaucuuuac

SEQ ID NO: 994336 - RNA, 19 nt, Homo sapiens
gcuaugauguuucgacaga

SEQ ID NO: 994337 - RNA, 19 nt, Homo sapiens
gaaagacgagggagaaaug

SEQ ID NO: 994338 - RNA, 19 nt, Homo sapiens
gaauggucaucuccgguua

SEQ ID NO: 994339 - RNA, 19 nt, Homo sapiens
ggagaaauguuuuguuuga

SEQ ID NO: 994340 - RNA, 19 nt, Homo sapiens
gaacuugugggcaguguaa

SEQ ID NO: 994341 - RNA, 19 nt, Homo sapiens
ugaaggaaaugacuccaaa

SEQ ID NO: 994342 - RNA, 19 nt, Homo sapiens
agaggaagaugaagagauu

SEQ ID NO: 994343 - RNA, 19 nt, Homo sapiens
gaaaugaggacauaucagu

SEQ ID NO: 994344 - RNA, 19 nt, Homo sapiens
gaagccaucucuaaucaag

SEQ ID NO: 994345 - RNA, 19 nt, Homo sapiens
gaggucagcuggccaaaca

SEQ ID NO: 994346 - RNA, 19 nt, Homo sapiens
gaagagguuugaggacauu

SEQ ID NO: 994347 - RNA, 19 nt, Homo sapiens
acaaggcacuguaggcaua

SEQ ID NO: 994348 - RNA, 19 nt, Homo sapiens
ggagaaaggaaguaagaaa

SEQ ID NO: 994349 - RNA, 19 nt, Homo sapiens
gagcuugacucaugguaug

SEQ ID NO: 994350 - RNA, 19 nt, Homo sapiens
gaacaauugcuggaguuua

SEQ ID NO: 994351 - RNA, 19 nt, Homo sapiens
gagguuaacagcuaucuuu

SEQ ID NO: 994352 - RNA, 19 nt, Homo sapiens
cagaaaugauugucucuug

SEQ ID NO: 994353 - RNA, 19 nt, Homo sapiens
uuacagaggugauaugcuu

SEQ ID NO: 994354 - RNA, 19 nt, Homo sapiens
ccaaacagaagucaucuuu

SEQ ID NO: 994355 - RNA, 19 nt, Homo sapiens
ggauaccagucuccacuuu

SEQ ID NO: 994356 - RNA, 19 nt, Homo sapiens
cacaaagguuacacacuua

SEQ ID NO: 994357 - RNA, 19 nt, Homo sapiens
ucagggaggugcucacaaa

SEQ ID NO: 994358 - RNA, 19 nt, Homo sapiens
uaagaaugauuuccaagga

SEQ ID NO: 994359 - RNA, 19 nt, Homo sapiens
gcaaaucagcucaaacgaa

SEQ ID NO: 994360 - RNA, 19 nt, Homo sapiens
cagaucaguucuccaaauu

SEQ ID NO: 994361 - RNA, 19 nt, Homo sapiens
cgacacauauucucucugu

SEQ ID NO: 994362 - RNA, 19 nt, Homo sapiens
gaagaaauaagugguaaga

SEQ ID NO: 994363 - RNA, 19 nt, Homo sapiens
ggaagaagggacaaacaaa

SEQ ID NO: 994364 - RNA, 19 nt, Homo sapiens
gagggacuuugauuuguuu

SEQ ID NO: 994365 - RNA, 19 nt, Homo sapiens
caagagaaaucugguguuc

SEQ ID NO: 994366 - RNA, 19 nt, Homo sapiens
cagaaacgauugccagaug

SEQ ID NO: 994367 - RNA, 19 nt, Homo sapiens
caauggaagguauuacuua

SEQ ID NO: 994368 - RNA, 19 nt, Homo sapiens
ccaccaguauguuggauuu

SEQ ID NO: 994369 - RNA, 19 nt, Homo sapiens
gaauaauacucaucuugca

SEQ ID NO: 994370 - RNA, 19 nt, Homo sapiens
gccaaaccauuacugauga

SEQ ID NO: 994371 - RNA, 19 nt, Homo sapiens
gugauugucuuguauuaga

SEQ ID NO: 994372 - RNA, 19 nt, Homo sapiens
gaaaguauagauccaacaa

SEQ ID NO: 994373 - RNA, 19 nt, Homo sapiens
gagcauaucauuauagaag

SEQ ID NO: 994374 - RNA, 19 nt, Homo sapiens
ggugccagcuguuaauuug

SEQ ID NO: 994375 - RNA, 19 nt, Homo sapiens
gaaaugacuccaaaguaga

SEQ ID NO: 994376 - RNA, 19 nt, Homo sapiens
gcacuucauugucgagaau

SEQ ID NO: 994377 - RNA, 19 nt, Homo sapiens
gagcuggaguuacagaaau

SEQ ID NO: 994378 - RNA, 19 nt, Homo sapiens
agaaauaagugguaagaag

SEQ ID NO: 994379 - RNA, 19 nt, Homo sapiens
ggucaucuccgguuauuga

SEQ ID NO: 994380 - RNA, 19 nt, Homo sapiens
gaagauacaaagaugaaug

SEQ ID NO: 994381 - RNA, 19 nt, Homo sapiens
gaaggugacccugcuauga

SEQ ID NO: 994382 - RNA, 19 nt, Homo sapiens
ggaucaaacuauuggaaug

SEQ ID NO: 994383 - RNA, 19 nt, Homo sapiens
gcaagauuauuggagaauu

SEQ ID NO: 994384 - RNA, 19 nt, Homo sapiens
uaacagcuaucuuucucuu

SEQ ID NO: 994385 - RNA, 19 nt, Homo sapiens
gaacagcucauugcuacaa

SEQ ID NO: 994386 - RNA, 19 nt, Homo sapiens
ucaccucucucuaaguuua

SEQ ID NO: 994387 - RNA, 19 nt, Homo sapiens
gcgaauaaauguucaaacu

SEQ ID NO: 994388 - RNA, 19 nt, Homo sapiens
ggcagaggaugaacuggaa

SEQ ID NO: 994389 - RNA, 19 nt, Homo sapiens
gacaagugaucgcccacaa

SEQ ID NO: 994390 - RNA, 19 nt, Homo sapiens
agauggaggucaagcagaa

SEQ ID NO: 994391 - RNA, 19 nt, Homo sapiens
agagaaaggagucgaagaa

SEQ ID NO: 994392 - RNA, 19 nt, Homo sapiens
acucaccucucucuaaguu

SEQ ID NO: 994393 - RNA, 19 nt, Homo sapiens
ggaggcgaauaaauguuca

SEQ ID NO: 994394 - RNA, 19 nt, Homo sapiens
cagcaacucccacgacugu

SEQ ID NO: 994395 - RNA, 19 nt, Homo sapiens
gcucaggaggcgaauaaau

SEQ ID NO: 994396 - RNA, 19 nt, Homo sapiens
uuacucaccucucucuaag

SEQ ID NO: 994397 - RNA, 19 nt, Homo sapiens
aagcucaggaggcgaauaa

SEQ ID NO: 994398 - RNA, 19 nt, Homo sapiens
cgaauaaauguucaaacug

SEQ ID NO: 994399 - RNA, 19 nt, Homo sapiens
ucaggaggcgaauaaaugu

SEQ ID NO: 994400 - RNA, 19 nt, Homo sapiens
ucccacgacuguuguacaa

SEQ ID NO: 994401 - RNA, 19 nt, Homo sapiens
ggaagauggaggucaagca

SEQ ID NO: 994402 - RNA, 19 nt, Homo sapiens
ccagagaguccagcagaga

SEQ ID NO: 994403 - RNA, 19 nt, Homo sapiens
gagaaaggagucgaagaag

SEQ ID NO: 994404 - RNA, 19 nt, Homo sapiens
cagagaguccagcagagaa

SEQ ID NO: 994405 - RNA, 19 nt, Homo sapiens
cuuacucaccucucucuaa

SEQ ID NO: 994406 - RNA, 19 nt, Homo sapiens
cucaggaggcgaauaaaug

SEQ ID NO: 994407 - RNA, 19 nt, Homo sapiens
agagaguccagcagagaaa

SEQ ID NO: 994408 - RNA, 19 nt, Homo sapiens
cagagaaaggagucgaaga

SEQ ID NO: 994409 - RNA, 19 nt, Homo sapiens
cccggaagauggaggucaa

SEQ ID NO: 994410 - RNA, 19 nt, Homo sapiens
gcccugaacaccagagagu

SEQ ID NO: 994411 - RNA, 19 nt, Homo sapiens
gcaaaguacuugucauaga

SEQ ID NO: 994412 - RNA, 19 nt, Homo sapiens
gcauaggucucuuugcuuu

SEQ ID NO: 994413 - RNA, 19 nt, Homo sapiens
ggagauaauuguuucauuc

SEQ ID NO: 994414 - RNA, 19 nt, Homo sapiens
gaaauaugauguacuccaa

SEQ ID NO: 994415 - RNA, 19 nt, Homo sapiens
gggcgaugcuggcuuauaa

SEQ ID NO: 994416 - RNA, 19 nt, Homo sapiens
gaagcagugucacgcauuu

SEQ ID NO: 994417 - RNA, 19 nt, Homo sapiens
gagaccaccuuucaaguga

SEQ ID NO: 994418 - RNA, 19 nt, Homo sapiens
gcgagaggcugauccaaga

SEQ ID NO: 994419 - RNA, 19 nt, Homo sapiens
gaaugugccucuucaugug

SEQ ID NO: 994420 - RNA, 19 nt, Homo sapiens
acacagauccgcaagagua

SEQ ID NO: 994421 - RNA, 19 nt, Homo sapiens
ucccaucgauuuacagaua

SEQ ID NO: 994422 - RNA, 19 nt, Homo sapiens
gcauaaagccaagguagaa

SEQ ID NO: 994423 - RNA, 19 nt, Homo sapiens
agacaaaucucagaaccuu

SEQ ID NO: 994424 - RNA, 19 nt, Homo sapiens
gcucuacccuggagucuca

SEQ ID NO: 994425 - RNA, 19 nt, Homo sapiens
agaacaugcuugaauauca

SEQ ID NO: 994426 - RNA, 19 nt, Homo sapiens
ggagggauguacuucaaca

SEQ ID NO: 994427 - RNA, 19 nt, Homo sapiens
caaaguacuugucauagac

SEQ ID NO: 994428 - RNA, 19 nt, Homo sapiens
caacacagauccgcaagag

SEQ ID NO: 994429 - RNA, 19 nt, Homo sapiens
gcaacauccucuucuccaa

SEQ ID NO: 994430 - RNA, 19 nt, Homo sapiens
acaagaaacugaugagaac

SEQ ID NO: 994431 - RNA, 19 nt, Homo sapiens
caaccacccggcaaagaua

SEQ ID NO: 994432 - RNA, 19 nt, Homo sapiens
gaugagaacggacaagugu

SEQ ID NO: 994433 - RNA, 19 nt, Homo sapiens
gaacaagaaacugaugaga

SEQ ID NO: 994434 - RNA, 19 nt, Homo sapiens
gcuuucacauuguacuuaa

SEQ ID NO: 994435 - RNA, 19 nt, Homo sapiens
gucauagacuccuuugcua

SEQ ID NO: 994436 - RNA, 19 nt, Homo sapiens
gcaauucucuuucuuuuac

SEQ ID NO: 994437 - RNA, 19 nt, Homo sapiens
ggugguggccuguuugaaa

SEQ ID NO: 994438 - RNA, 19 nt, Homo sapiens
ggauguacuucaacaacug

SEQ ID NO: 994439 - RNA, 19 nt, Homo sapiens
ggagaccaccuuucaagug

SEQ ID NO: 994440 - RNA, 19 nt, Homo sapiens
cagcaccacugccauggaa

SEQ ID NO: 994441 - RNA, 19 nt, Homo sapiens
ccaggugccuccacaguca

SEQ ID NO: 994442 - RNA, 19 nt, Homo sapiens
gcauugauccaggagauaa

SEQ ID NO: 994443 - RNA, 19 nt, Homo sapiens
gcaagaguaaaggaaauaa

SEQ ID NO: 994444 - RNA, 19 nt, Homo sapiens
gaugggaacaagaaacuga

SEQ ID NO: 994445 - RNA, 19 nt, Homo sapiens
ggaagcguauauacuuaag

SEQ ID NO: 994446 - RNA, 19 nt, Homo sapiens
gggaagcguauauacuuaa

SEQ ID NO: 994447 - RNA, 19 nt, Homo sapiens
ugagaacggacaaguguuu

SEQ ID NO: 994448 - RNA, 19 nt, Homo sapiens
agggaagcguauauacuua

SEQ ID NO: 994449 - RNA, 19 nt, Homo sapiens
gaagggaagcguauauacu

SEQ ID NO: 994450 - RNA, 19 nt, Homo sapiens
gggaguagaauacgcagaa

SEQ ID NO: 994451 - RNA, 19 nt, Homo sapiens
acacacugcuguuuaccuu

SEQ ID NO: 994452 - RNA, 19 nt, Homo sapiens
ucagagucccaucgauuua

SEQ ID NO: 994453 - RNA, 19 nt, Homo sapiens
ccuggagucucaccaaaga

SEQ ID NO: 994454 - RNA, 19 nt, Homo sapiens
uggcaaaguacuugucaua

SEQ ID NO: 994455 - RNA, 19 nt, Homo sapiens
ccagugaggaugacaguga

SEQ ID NO: 994456 - RNA, 19 nt, Homo sapiens
gcagugcauccuggaaaua

SEQ ID NO: 994457 - RNA, 19 nt, Homo sapiens
ccaagacugagccagcuua

SEQ ID NO: 994458 - RNA, 19 nt, Homo sapiens
uuagaagaauggcauaaag

SEQ ID NO: 994459 - RNA, 19 nt, Homo sapiens
ccacugccauggaaauucu

SEQ ID NO: 994460 - RNA, 19 nt, Homo sapiens
acuaccagguggcaaagua

SEQ ID NO: 994461 - RNA, 19 nt, Homo sapiens
gcuccuugcugcauugauc

SEQ ID NO: 994462 - RNA, 19 nt, Homo sapiens
ggagaagcaccagcaauuc

SEQ ID NO: 994463 - RNA, 19 nt, Homo sapiens
gacccaagacuggcguuua

SEQ ID NO: 994464 - RNA, 19 nt, Homo sapiens
ggaagggaagcguauauac

SEQ ID NO: 994465 - RNA, 19 nt, Homo sapiens
cguuuacuguggaugauaa

SEQ ID NO: 994466 - RNA, 19 nt, Homo sapiens
uaaaagaaccaccuacuug

SEQ ID NO: 994467 - RNA, 19 nt, Homo sapiens
ccagcaauucucuuucuuu

SEQ ID NO: 994468 - RNA, 19 nt, Homo sapiens
uggagaagcaccagcaauu

SEQ ID NO: 994469 - RNA, 19 nt, Homo sapiens
gcaggaagggaagcguaua

SEQ ID NO: 994470 - RNA, 19 nt, Homo sapiens
cagcaauucucuuucuuuu

SEQ ID NO: 994471 - RNA, 19 nt, Homo sapiens
gguggccuguuugaaagua

SEQ ID NO: 994472 - RNA, 19 nt, Homo sapiens
guguguagguuccguaucu

SEQ ID NO: 994473 - RNA, 19 nt, Homo sapiens
gagcugccaccaccgugua

SEQ ID NO: 994474 - RNA, 19 nt, Homo sapiens
ccaaggacggcuggguuua

SEQ ID NO: 994475 - RNA, 19 nt, Homo sapiens
caaaugucccuccaacaca

SEQ ID NO: 994476 - RNA, 19 nt, Homo sapiens
gggauguacuucaacaacu

SEQ ID NO: 994477 - RNA, 19 nt, Homo sapiens
ccaaucacaccgaggagaa

SEQ ID NO: 994478 - RNA, 19 nt, Homo sapiens
uuccuuagauaccuugaaa

SEQ ID NO: 994479 - RNA, 19 nt, Homo sapiens
caaaucauuccuuagauac

SEQ ID NO: 994480 - RNA, 19 nt, Homo sapiens
ucauagacuccuuugcuaa

SEQ ID NO: 994481 - RNA, 19 nt, Homo sapiens
ccgcaagaguaaaggaaau

SEQ ID NO: 994482 - RNA, 19 nt, Homo sapiens
gcaccacugccauggaaau

SEQ ID NO: 994483 - RNA, 19 nt, Homo sapiens
ucucaguucucuugcuuuc

SEQ ID NO: 994484 - RNA, 19 nt, Homo sapiens
caccagcaauucucuuucu

SEQ ID NO: 994485 - RNA, 19 nt, Homo sapiens
gggaacaagaaacugauga

SEQ ID NO: 994486 - RNA, 19 nt, Homo sapiens
aauaugauguacuccaaca

SEQ ID NO: 994487 - RNA, 19 nt, Homo sapiens
ccucagagucccaucgauu

SEQ ID NO: 994488 - RNA, 19 nt, Homo sapiens
aagggaagcguauauacuu

SEQ ID NO: 994489 - RNA, 19 nt, Homo sapiens
cauagacuccuuugcuaau

SEQ ID NO: 994490 - RNA, 19 nt, Homo sapiens
agacugagccagcuuagca

SEQ ID NO: 994491 - RNA, 19 nt, Homo sapiens
ugggagggauguacuucaa

SEQ ID NO: 994492 - RNA, 19 nt, Homo sapiens
ccaucgauuuacagauauu

SEQ ID NO: 994493 - RNA, 19 nt, Homo sapiens
ucgaaaccgccaagucuuu

SEQ ID NO: 994494 - RNA, 19 nt, Homo sapiens
aacaagaaacugaugagaa

SEQ ID NO: 994495 - RNA, 19 nt, Homo sapiens
aguagaauacgcagaacua

SEQ ID NO: 994496 - RNA, 19 nt, Homo sapiens
gugguggccuguuugaaag

SEQ ID NO: 994497 - RNA, 19 nt, Homo sapiens
agaaugugccucuucaugu

SEQ ID NO: 994498 - RNA, 19 nt, Homo sapiens
aacguuaguuaaucccuuu

SEQ ID NO: 994499 - RNA, 19 nt, Homo sapiens
gugcauccuggaaauauga

SEQ ID NO: 994500 - RNA, 19 nt, Homo sapiens
auugggcgaugcuggcuua

SEQ ID NO: 994501 - RNA, 19 nt, Homo sapiens
aaagaaccaccuacuugga

SEQ ID NO: 994502 - RNA, 19 nt, Homo sapiens
uccaggagauaauuguuuc

SEQ ID NO: 994503 - RNA, 19 nt, Homo sapiens
gggcuggccuucuccuacu

SEQ ID NO: 994504 - RNA, 19 nt, Homo sapiens
caagacuggcguuuacugu

SEQ ID NO: 994505 - RNA, 19 nt, Homo sapiens
aaaccugcuugguguguag

SEQ ID NO: 994506 - RNA, 19 nt, Homo sapiens
gcuaggcauaggucucuuu

SEQ ID NO: 994507 - RNA, 19 nt, Homo sapiens
ccaaaugucccuccaacac

SEQ ID NO: 994508 - RNA, 19 nt, Homo sapiens
cuggaaauaugauguacuc

SEQ ID NO: 994509 - RNA, 19 nt, Homo sapiens
ucauuguggucuccucaga

SEQ ID NO: 994510 - RNA, 19 nt, Homo sapiens
guucgaaaccgccaagucu

SEQ ID NO: 994511 - RNA, 19 nt, Homo sapiens
gaaauaugauguacuccaa

SEQ ID NO: 994512 - RNA, 19 nt, Homo sapiens
gggcgaugcuggcuuauaa

SEQ ID NO: 994513 - RNA, 19 nt, Homo sapiens
gaagcagugucacgcauuu

SEQ ID NO: 994514 - RNA, 19 nt, Homo sapiens
ggaggucacuucugauugu

SEQ ID NO: 994515 - RNA, 19 nt, Homo sapiens
gagaccaccuuucaaguga

SEQ ID NO: 994516 - RNA, 19 nt, Homo sapiens
gaaugugccucuucaugug

SEQ ID NO: 994517 - RNA, 19 nt, Homo sapiens
ucccaucgauuuacagaua

SEQ ID NO: 994518 - RNA, 19 nt, Homo sapiens
gcauaaagccaagguagaa

SEQ ID NO: 994519 - RNA, 19 nt, Homo sapiens
ugagcugagugcugaaaua

SEQ ID NO: 994520 - RNA, 19 nt, Homo sapiens
ccaaguccaugguuucaga

SEQ ID NO: 994521 - RNA, 19 nt, Homo sapiens
gcucuacccuggagucuca

SEQ ID NO: 994522 - RNA, 19 nt, Homo sapiens
gcaacauccucuucuccaa

SEQ ID NO: 994523 - RNA, 19 nt, Homo sapiens
gagcugagugcugaaauaa

SEQ ID NO: 994524 - RNA, 19 nt, Homo sapiens
acaagaaacugaugagaac

SEQ ID NO: 994525 - RNA, 19 nt, Homo sapiens
caaccacccggcaaagaua

SEQ ID NO: 994526 - RNA, 19 nt, Homo sapiens
gaugagaacggacaagugu

SEQ ID NO: 994527 - RNA, 19 nt, Homo sapiens
gaacaagaaacugaugaga

SEQ ID NO: 994528 - RNA, 19 nt, Homo sapiens
gcugagugcugaaauaaaa

SEQ ID NO: 994529 - RNA, 19 nt, Homo sapiens
ggagaccaccuuucaagug

SEQ ID NO: 994530 - RNA, 19 nt, Homo sapiens
cagcaccacugccauggaa

SEQ ID NO: 994531 - RNA, 19 nt, Homo sapiens
ccaggugccuccacaguca

SEQ ID NO: 994532 - RNA, 19 nt, Homo sapiens
gaugggaacaagaaacuga

SEQ ID NO: 994533 - RNA, 19 nt, Homo sapiens
ugagaacggacaaguguuu

SEQ ID NO: 994534 - RNA, 19 nt, Homo sapiens
acacacugcuguuuaccuu

SEQ ID NO: 994535 - RNA, 19 nt, Homo sapiens
ucagagucccaucgauuua

SEQ ID NO: 994536 - RNA, 19 nt, Homo sapiens
ccuggagucucaccaaaga

SEQ ID NO: 994537 - RNA, 19 nt, Homo sapiens
gcagugcauccuggaaaua

SEQ ID NO: 994538 - RNA, 19 nt, Homo sapiens
uuagaagaauggcauaaag

SEQ ID NO: 994539 - RNA, 19 nt, Homo sapiens
ccacugccauggaaauucu

SEQ ID NO: 994540 - RNA, 19 nt, Homo sapiens
gacccaagacuggcguuua

SEQ ID NO: 994541 - RNA, 19 nt, Homo sapiens
cguuuacuguggaugauaa

SEQ ID NO: 994542 - RNA, 19 nt, Homo sapiens
uaaaagaaccaccuacuug

SEQ ID NO: 994543 - RNA, 19 nt, Homo sapiens
ccaaggacggcuggguuua

SEQ ID NO: 994544 - RNA, 19 nt, Homo sapiens
gcaccacugccauggaaau

SEQ ID NO: 994545 - RNA, 19 nt, Homo sapiens
ccaaucacaccgaggagaa

SEQ ID NO: 994546 - RNA, 19 nt, Homo sapiens
aauaugauguacuccaaca

SEQ ID NO: 994547 - RNA, 19 nt, Homo sapiens
ccucagagucccaucgauu

SEQ ID NO: 994548 - RNA, 19 nt, Homo sapiens
aagccaagguagaaacaau

SEQ ID NO: 994549 - RNA, 19 nt, Homo sapiens
gggaacaagaaacugauga

SEQ ID NO: 994550 - RNA, 19 nt, Homo sapiens
gguuucagacugccuggua

SEQ ID NO: 994551 - RNA, 19 nt, Homo sapiens
ccaucgauuuacagauauu

SEQ ID NO: 994552 - RNA, 19 nt, Homo sapiens
ucgaaaccgccaagucuuu

SEQ ID NO: 994553 - RNA, 19 nt, Homo sapiens
agaaugugccucuucaugu

SEQ ID NO: 994554 - RNA, 19 nt, Homo sapiens
aacaagaaacugaugagaa

SEQ ID NO: 994555 - RNA, 19 nt, Homo sapiens
gugcauccuggaaauauga

SEQ ID NO: 994556 - RNA, 19 nt, Homo sapiens
gccaagguagaaacaauga

SEQ ID NO: 994557 - RNA, 19 nt, Homo sapiens
auugggcgaugcuggcuua

SEQ ID NO: 994558 - RNA, 19 nt, Homo sapiens
cuggaaauaugauguacuc

SEQ ID NO: 994559 - RNA, 19 nt, Homo sapiens
ucauuguggucuccucaga

SEQ ID NO: 994560 - RNA, 19 nt, Homo sapiens
guucgaaaccgccaagucu

SEQ ID NO: 994561 - RNA, 19 nt, Homo sapiens
caagacuggcguuuacugu

SEQ ID NO: 994562 - RNA, 19 nt, Homo sapiens
aaagaaccaccuacuugga

SEQ ID NO: 994563 - RNA, 19 nt, Homo sapiens
gcgaggccuuucaccaagu

SEQ ID NO: 994564 - RNA, 19 nt, Homo sapiens
ggaacaagaaacugaugag

SEQ ID NO: 994565 - RNA, 19 nt, Homo sapiens
ggacggcuggguuuacuac

SEQ ID NO: 994566 - RNA, 19 nt, Homo sapiens
ggcauaaagccaagguaga

SEQ ID NO: 994567 - RNA, 19 nt, Homo sapiens
ucaggaauaggguucgaaa

SEQ ID NO: 994568 - RNA, 19 nt, Homo sapiens
ccaaccacccggcaaagau

SEQ ID NO: 994569 - RNA, 19 nt, Homo sapiens
cauaaagccaagguagaaa

SEQ ID NO: 994570 - RNA, 19 nt, Homo sapiens
aaggaggucacuucugauu

SEQ ID NO: 994571 - RNA, 19 nt, Homo sapiens
auacggaugggaacaagaa

SEQ ID NO: 994572 - RNA, 19 nt, Homo sapiens
gcaggagauuugccauacg

SEQ ID NO: 994573 - RNA, 19 nt, Homo sapiens
uguacacacugcuguuuac

SEQ ID NO: 994574 - RNA, 19 nt, Homo sapiens
gcgaugcuggcuuauaaca

SEQ ID NO: 994575 - RNA, 19 nt, Homo sapiens
uaaagccaagguagaaaca

SEQ ID NO: 994576 - RNA, 19 nt, Homo sapiens
gggaggagagaaccaccaa

SEQ ID NO: 994577 - RNA, 19 nt, Homo sapiens
uccguagcgugcagcauuu

SEQ ID NO: 994578 - RNA, 19 nt, Homo sapiens
uguggucacuggagcuaau

SEQ ID NO: 994579 - RNA, 19 nt, Homo sapiens
cucagagucccaucgauuu

SEQ ID NO: 994580 - RNA, 19 nt, Homo sapiens
ugaagcagugucacgcauu

SEQ ID NO: 994581 - RNA, 19 nt, Homo sapiens
cgcagugcauccuggaaau

SEQ ID NO: 994582 - RNA, 19 nt, Homo sapiens
gcucugcaacauccucuuc

SEQ ID NO: 994583 - RNA, 19 nt, Homo sapiens
acgaguggcaggagauuug

SEQ ID NO: 994584 - RNA, 19 nt, Homo sapiens
uggcgaggccuuucaccaa

SEQ ID NO: 994585 - RNA, 19 nt, Homo sapiens
acccaagacuggcguuuac

SEQ ID NO: 994586 - RNA, 19 nt, Homo sapiens
ggacccaagacuggcguuu

SEQ ID NO: 994587 - RNA, 19 nt, Homo sapiens
acaccgaggagaagacuca

SEQ ID NO: 994588 - RNA, 19 nt, Homo sapiens
gcaaaguacuugucauaga

SEQ ID NO: 994589 - RNA, 19 nt, Homo sapiens
gcauaggucucuuugcuuu

SEQ ID NO: 994590 - RNA, 19 nt, Homo sapiens
ggagauaauuguuucauuc

SEQ ID NO: 994591 - RNA, 19 nt, Homo sapiens
gaagcagugucacgcauuu

SEQ ID NO: 994592 - RNA, 19 nt, Homo sapiens
gcgagaggcugauccaaga

SEQ ID NO: 994593 - RNA, 19 nt, Homo sapiens
acacagauccgcaagagua

SEQ ID NO: 994594 - RNA, 19 nt, Homo sapiens
agacaaaucucagaaccuu

SEQ ID NO: 994595 - RNA, 19 nt, Homo sapiens
agaacaugcuugaauauca

SEQ ID NO: 994596 - RNA, 19 nt, Homo sapiens
ggagggauguacuucaaca

SEQ ID NO: 994597 - RNA, 19 nt, Homo sapiens
caaaguacuugucauagac

SEQ ID NO: 994598 - RNA, 19 nt, Homo sapiens
caacacagauccgcaagag

SEQ ID NO: 994599 - RNA, 19 nt, Homo sapiens
acaagaaacugaugagaac

SEQ ID NO: 994600 - RNA, 19 nt, Homo sapiens
caaccacccggcaaagaua

SEQ ID NO: 994601 - RNA, 19 nt, Homo sapiens
gaugagaacggacaagugu

SEQ ID NO: 994602 - RNA, 19 nt, Homo sapiens
gaacaagaaacugaugaga

SEQ ID NO: 994603 - RNA, 19 nt, Homo sapiens
gcuuucacauuguacuuaa

SEQ ID NO: 994604 - RNA, 19 nt, Homo sapiens
gucauagacuccuuugcua

SEQ ID NO: 994605 - RNA, 19 nt, Homo sapiens
gcaauucucuuucuuuuac

SEQ ID NO: 994606 - RNA, 19 nt, Homo sapiens
ggugguggccuguuugaaa

SEQ ID NO: 994607 - RNA, 19 nt, Homo sapiens
ggauguacuucaacaacug

SEQ ID NO: 994608 - RNA, 19 nt, Homo sapiens
cagcaccacugccauggaa

SEQ ID NO: 994609 - RNA, 19 nt, Homo sapiens
ccaggugccuccacaguca

SEQ ID NO: 994610 - RNA, 19 nt, Homo sapiens
gcauugauccaggagauaa

SEQ ID NO: 994611 - RNA, 19 nt, Homo sapiens
gcaagaguaaaggaaauaa

SEQ ID NO: 994612 - RNA, 19 nt, Homo sapiens
gaugggaacaagaaacuga

SEQ ID NO: 994613 - RNA, 19 nt, Homo sapiens
ggaagcguauauacuuaag

SEQ ID NO: 994614 - RNA, 19 nt, Homo sapiens
gggaagcguauauacuuaa

SEQ ID NO: 994615 - RNA, 19 nt, Homo sapiens
ugagaacggacaaguguuu

SEQ ID NO: 994616 - RNA, 19 nt, Homo sapiens
agggaagcguauauacuua

SEQ ID NO: 994617 - RNA, 19 nt, Homo sapiens
gaagggaagcguauauacu

SEQ ID NO: 994618 - RNA, 19 nt, Homo sapiens
gggaguagaauacgcagaa

SEQ ID NO: 994619 - RNA, 19 nt, Homo sapiens
uggcaaaguacuugucaua

SEQ ID NO: 994620 - RNA, 19 nt, Homo sapiens
ccagugaggaugacaguga

SEQ ID NO: 994621 - RNA, 19 nt, Homo sapiens
ccaagacugagccagcuua

SEQ ID NO: 994622 - RNA, 19 nt, Homo sapiens
ccacugccauggaaauucu

SEQ ID NO: 994623 - RNA, 19 nt, Homo sapiens
acuaccagguggcaaagua

SEQ ID NO: 994624 - RNA, 19 nt, Homo sapiens
gcuccuugcugcauugauc

SEQ ID NO: 994625 - RNA, 19 nt, Homo sapiens
ggagaagcaccagcaauuc

SEQ ID NO: 994626 - RNA, 19 nt, Homo sapiens
gacccaagacuggcguuua

SEQ ID NO: 994627 - RNA, 19 nt, Homo sapiens
ggaagggaagcguauauac

SEQ ID NO: 994628 - RNA, 19 nt, Homo sapiens
cguuuacuguggaugauaa

SEQ ID NO: 994629 - RNA, 19 nt, Homo sapiens
uaaaagaaccaccuacuug

SEQ ID NO: 994630 - RNA, 19 nt, Homo sapiens
ccagcaauucucuuucuuu

SEQ ID NO: 994631 - RNA, 19 nt, Homo sapiens
uggagaagcaccagcaauu

SEQ ID NO: 994632 - RNA, 19 nt, Homo sapiens
gcaggaagggaagcguaua

SEQ ID NO: 994633 - RNA, 19 nt, Homo sapiens
cagcaauucucuuucuuuu

SEQ ID NO: 994634 - RNA, 19 nt, Homo sapiens
gguggccuguuugaaagua

SEQ ID NO: 994635 - RNA, 19 nt, Homo sapiens
guguguagguuccguaucu

SEQ ID NO: 994636 - RNA, 19 nt, Homo sapiens
gagcugccaccaccgugua

SEQ ID NO: 994637 - RNA, 19 nt, Homo sapiens
caaaugucccuccaacaca

SEQ ID NO: 994638 - RNA, 19 nt, Homo sapiens
gggauguacuucaacaacu

SEQ ID NO: 994639 - RNA, 19 nt, Homo sapiens
ccaaggacggcuggguuua

SEQ ID NO: 994640 - RNA, 19 nt, Homo sapiens
uuccuuagauaccuugaaa

SEQ ID NO: 994641 - RNA, 19 nt, Homo sapiens
caaaucauuccuuagauac

SEQ ID NO: 994642 - RNA, 19 nt, Homo sapiens
ucauagacuccuuugcuaa

SEQ ID NO: 994643 - RNA, 19 nt, Homo sapiens
ccaaucacaccgaggagaa

SEQ ID NO: 994644 - RNA, 19 nt, Homo sapiens
ccgcaagaguaaaggaaau

SEQ ID NO: 994645 - RNA, 19 nt, Homo sapiens
gcaccacugccauggaaau

SEQ ID NO: 994646 - RNA, 19 nt, Homo sapiens
ucucaguucucuugcuuuc

SEQ ID NO: 994647 - RNA, 19 nt, Homo sapiens
caccagcaauucucuuucu

SEQ ID NO: 994648 - RNA, 19 nt, Homo sapiens
gggaacaagaaacugauga

SEQ ID NO: 994649 - RNA, 19 nt, Homo sapiens
aagggaagcguauauacuu

SEQ ID NO: 994650 - RNA, 19 nt, Homo sapiens
cauagacuccuuugcuaau

SEQ ID NO: 994651 - RNA, 19 nt, Homo sapiens
agacugagccagcuuagca

SEQ ID NO: 994652 - RNA, 19 nt, Homo sapiens
ugggagggauguacuucaa

SEQ ID NO: 994653 - RNA, 19 nt, Homo sapiens
ucgaaaccgccaagucuuu

SEQ ID NO: 994654 - RNA, 19 nt, Homo sapiens
aacaagaaacugaugagaa

SEQ ID NO: 994655 - RNA, 19 nt, Homo sapiens
aguagaauacgcagaacua

SEQ ID NO: 994656 - RNA, 19 nt, Homo sapiens
gugguggccuguuugaaag

SEQ ID NO: 994657 - RNA, 19 nt, Homo sapiens
aacguuaguuaaucccuuu

SEQ ID NO: 994658 - RNA, 19 nt, Homo sapiens
aaagaaccaccuacuugga

SEQ ID NO: 994659 - RNA, 19 nt, Homo sapiens
uccaggagauaauuguuuc

SEQ ID NO: 994660 - RNA, 19 nt, Homo sapiens
gggcuggccuucuccuacu

SEQ ID NO: 994661 - RNA, 19 nt, Homo sapiens
aaaccugcuugguguguag

SEQ ID NO: 994662 - RNA, 19 nt, Homo sapiens
caagacuggcguuuacugu

SEQ ID NO: 994663 - RNA, 19 nt, Homo sapiens
gcuaggcauaggucucuuu

SEQ ID NO: 994664 - RNA, 19 nt, Homo sapiens
ccaaaugucccuccaacac

SEQ ID NO: 994665 - RNA, 19 nt, Homo sapiens
guucgaaaccgccaagucu

SEQ ID NO: 994666 - RNA, 19 nt, Homo sapiens
cuuaagaauacacaggaua

SEQ ID NO: 994667 - RNA, 19 nt, Homo sapiens
gaagcguauauacuuaaga

SEQ ID NO: 994668 - RNA, 19 nt, Homo sapiens
ggaacaagaaacugaugag

SEQ ID NO: 994669 - RNA, 19 nt, Homo sapiens
ggacggcuggguuuacuac

SEQ ID NO: 994670 - RNA, 19 nt, Homo sapiens
gauccaggagauaauuguu

SEQ ID NO: 994671 - RNA, 19 nt, Homo sapiens
gcuggccuucuccuacuua

SEQ ID NO: 994672 - RNA, 19 nt, Homo sapiens
ucaggaauaggguucgaaa

SEQ ID NO: 994673 - RNA, 19 nt, Homo sapiens
ccaaccacccggcaaagau

SEQ ID NO: 994674 - RNA, 19 nt, Homo sapiens
ggcagagaauaaaacguua

SEQ ID NO: 994675 - RNA, 19 nt, Homo sapiens
agaacuaccagguggcaaa

SEQ ID NO: 994676 - RNA, 19 nt, Homo sapiens
ugagccagcuuagcaacug

SEQ ID NO: 994677 - RNA, 19 nt, Homo sapiens
ucauucauccugaccaaga

SEQ ID NO: 994678 - RNA, 19 nt, Homo sapiens
gagcggaugggcacacaca

SEQ ID NO: 994679 - RNA, 19 nt, Homo sapiens
cacagucucaguucucuug

SEQ ID NO: 994680 - RNA, 19 nt, Homo sapiens
gucaaucacagucucaguu

SEQ ID NO: 994681 - RNA, 19 nt, Homo sapiens
caggaagggaagcguauau

SEQ ID NO: 994682 - RNA, 19 nt, Homo sapiens
gcaccagcaauucucuuuc

SEQ ID NO: 994683 - RNA, 19 nt, Homo sapiens
aggcauaggucucuuugcu

SEQ ID NO: 994684 - RNA, 19 nt, Homo sapiens
ucaaucacagucucaguuc

SEQ ID NO: 994685 - RNA, 19 nt, Homo sapiens
gggcagagaauaaaacguu

SEQ ID NO: 994686 - RNA, 19 nt, Homo sapiens
gcaggagauuugccauacg

SEQ ID NO: 994687 - RNA, 19 nt, Homo sapiens
gaacuaccagguggcaaag

SEQ ID NO: 994688 - RNA, 19 nt, Homo sapiens
gcaaaguacuugucauaga

SEQ ID NO: 994689 - RNA, 19 nt, Homo sapiens
gcauaggucucuuugcuuu

SEQ ID NO: 994690 - RNA, 19 nt, Homo sapiens
ggagauaauuguuucauuc

SEQ ID NO: 994691 - RNA, 19 nt, Homo sapiens
gcgagaggcugauccaaga

SEQ ID NO: 994692 - RNA, 19 nt, Homo sapiens
acacagauccgcaagagua

SEQ ID NO: 994693 - RNA, 19 nt, Homo sapiens
agacaaaucucagaaccuu

SEQ ID NO: 994694 - RNA, 19 nt, Homo sapiens
agaacaugcuugaauauca

SEQ ID NO: 994695 - RNA, 19 nt, Homo sapiens
ggagggauguacuucaaca

SEQ ID NO: 994696 - RNA, 19 nt, Homo sapiens
caaaguacuugucauagac

SEQ ID NO: 994697 - RNA, 19 nt, Homo sapiens
caacacagauccgcaagag

SEQ ID NO: 994698 - RNA, 19 nt, Homo sapiens
acaagaaacugaugagaac

SEQ ID NO: 994699 - RNA, 19 nt, Homo sapiens
caaccacccggcaaagaua

SEQ ID NO: 994700 - RNA, 19 nt, Homo sapiens
gaugagaacggacaagugu

SEQ ID NO: 994701 - RNA, 19 nt, Homo sapiens
gaacaagaaacugaugaga

SEQ ID NO: 994702 - RNA, 19 nt, Homo sapiens
gcuuucacauuguacuuaa

SEQ ID NO: 994703 - RNA, 19 nt, Homo sapiens
gucauagacuccuuugcua

SEQ ID NO: 994704 - RNA, 19 nt, Homo sapiens
gcaauucucuuucuuuuac

SEQ ID NO: 994705 - RNA, 19 nt, Homo sapiens
ggugguggccuguuugaaa

SEQ ID NO: 994706 - RNA, 19 nt, Homo sapiens
ggauguacuucaacaacug

SEQ ID NO: 994707 - RNA, 19 nt, Homo sapiens
cagcaccacugccauggaa

SEQ ID NO: 994708 - RNA, 19 nt, Homo sapiens
ccaggugccuccacaguca

SEQ ID NO: 994709 - RNA, 19 nt, Homo sapiens
gcauugauccaggagauaa

SEQ ID NO: 994710 - RNA, 19 nt, Homo sapiens
gcaagaguaaaggaaauaa

SEQ ID NO: 994711 - RNA, 19 nt, Homo sapiens
gaugggaacaagaaacuga

SEQ ID NO: 994712 - RNA, 19 nt, Homo sapiens
ggaagcguauauacuuaag

SEQ ID NO: 994713 - RNA, 19 nt, Homo sapiens
gggaagcguauauacuuaa

SEQ ID NO: 994714 - RNA, 19 nt, Homo sapiens
ugagaacggacaaguguuu

SEQ ID NO: 994715 - RNA, 19 nt, Homo sapiens
agggaagcguauauacuua

SEQ ID NO: 994716 - RNA, 19 nt, Homo sapiens
gaagggaagcguauauacu

SEQ ID NO: 994717 - RNA, 19 nt, Homo sapiens
gggaguagaauacgcagaa

SEQ ID NO: 994718 - RNA, 19 nt, Homo sapiens
uggcaaaguacuugucaua

SEQ ID NO: 994719 - RNA, 19 nt, Homo sapiens
ccagugaggaugacaguga

SEQ ID NO: 994720 - RNA, 19 nt, Homo sapiens
ccaagacugagccagcuua

SEQ ID NO: 994721 - RNA, 19 nt, Homo sapiens
ccacugccauggaaauucu

SEQ ID NO: 994722 - RNA, 19 nt, Homo sapiens
acuaccagguggcaaagua

SEQ ID NO: 994723 - RNA, 19 nt, Homo sapiens
gcuccuugcugcauugauc

SEQ ID NO: 994724 - RNA, 19 nt, Homo sapiens
ggagaagcaccagcaauuc

SEQ ID NO: 994725 - RNA, 19 nt, Homo sapiens
gacccaagacuggcguuua

SEQ ID NO: 994726 - RNA, 19 nt, Homo sapiens
ggaagggaagcguauauac

SEQ ID NO: 994727 - RNA, 19 nt, Homo sapiens
cguuuacuguggaugauaa

SEQ ID NO: 994728 - RNA, 19 nt, Homo sapiens
uaaaagaaccaccuacuug

SEQ ID NO: 994729 - RNA, 19 nt, Homo sapiens
ccagcaauucucuuucuuu

SEQ ID NO: 994730 - RNA, 19 nt, Homo sapiens
uggagaagcaccagcaauu

SEQ ID NO: 994731 - RNA, 19 nt, Homo sapiens
gcaggaagggaagcguaua

SEQ ID NO: 994732 - RNA, 19 nt, Homo sapiens
cagcaauucucuuucuuuu

SEQ ID NO: 994733 - RNA, 19 nt, Homo sapiens
gguggccuguuugaaagua

SEQ ID NO: 994734 - RNA, 19 nt, Homo sapiens
guguguagguuccguaucu

SEQ ID NO: 994735 - RNA, 19 nt, Homo sapiens
gagcugccaccaccgugua

SEQ ID NO: 994736 - RNA, 19 nt, Homo sapiens
caaaugucccuccaacaca

SEQ ID NO: 994737 - RNA, 19 nt, Homo sapiens
gggauguacuucaacaacu

SEQ ID NO: 994738 - RNA, 19 nt, Homo sapiens
ccaaggacggcuggguuua

SEQ ID NO: 994739 - RNA, 19 nt, Homo sapiens
uuccuuagauaccuugaaa

SEQ ID NO: 994740 - RNA, 19 nt, Homo sapiens
caaaucauuccuuagauac

SEQ ID NO: 994741 - RNA, 19 nt, Homo sapiens
ucauagacuccuuugcuaa

SEQ ID NO: 994742 - RNA, 19 nt, Homo sapiens
ccaaucacaccgaggagaa

SEQ ID NO: 994743 - RNA, 19 nt, Homo sapiens
ccgcaagaguaaaggaaau

SEQ ID NO: 994744 - RNA, 19 nt, Homo sapiens
gcaccacugccauggaaau

SEQ ID NO: 994745 - RNA, 19 nt, Homo sapiens
ucucaguucucuugcuuuc

SEQ ID NO: 994746 - RNA, 19 nt, Homo sapiens
gggaacaagaaacugauga

SEQ ID NO: 994747 - RNA, 19 nt, Homo sapiens
caccagcaauucucuuucu

SEQ ID NO: 994748 - RNA, 19 nt, Homo sapiens
aagggaagcguauauacuu

SEQ ID NO: 994749 - RNA, 19 nt, Homo sapiens
cauagacuccuuugcuaau

SEQ ID NO: 994750 - RNA, 19 nt, Homo sapiens
agacugagccagcuuagca

SEQ ID NO: 994751 - RNA, 19 nt, Homo sapiens
ugggagggauguacuucaa

SEQ ID NO: 994752 - RNA, 19 nt, Homo sapiens
aguagaauacgcagaacua

SEQ ID NO: 994753 - RNA, 19 nt, Homo sapiens
gugguggccuguuugaaag

SEQ ID NO: 994754 - RNA, 19 nt, Homo sapiens
aacaagaaacugaugagaa

SEQ ID NO: 994755 - RNA, 19 nt, Homo sapiens
aacguuaguuaaucccuuu

SEQ ID NO: 994756 - RNA, 19 nt, Homo sapiens
aaagaaccaccuacuugga

SEQ ID NO: 994757 - RNA, 19 nt, Homo sapiens
uccaggagauaauuguuuc

SEQ ID NO: 994758 - RNA, 19 nt, Homo sapiens
gggcuggccuucuccuacu

SEQ ID NO: 994759 - RNA, 19 nt, Homo sapiens
aaaccugcuugguguguag

SEQ ID NO: 994760 - RNA, 19 nt, Homo sapiens
gcuaggcauaggucucuuu

SEQ ID NO: 994761 - RNA, 19 nt, Homo sapiens
ccaaaugucccuccaacac

SEQ ID NO: 994762 - RNA, 19 nt, Homo sapiens
caagacuggcguuuacugu

SEQ ID NO: 994763 - RNA, 19 nt, Homo sapiens
cuuaagaauacacaggaua

SEQ ID NO: 994764 - RNA, 19 nt, Homo sapiens
gaagcguauauacuuaaga

SEQ ID NO: 994765 - RNA, 19 nt, Homo sapiens
ggaacaagaaacugaugag

SEQ ID NO: 994766 - RNA, 19 nt, Homo sapiens
gauccaggagauaauuguu

SEQ ID NO: 994767 - RNA, 19 nt, Homo sapiens
gcuggccuucuccuacuua

SEQ ID NO: 994768 - RNA, 19 nt, Homo sapiens
ggacggcuggguuuacuac

SEQ ID NO: 994769 - RNA, 19 nt, Homo sapiens
ccaaccacccggcaaagau

SEQ ID NO: 994770 - RNA, 19 nt, Homo sapiens
ggcagagaauaaaacguua

SEQ ID NO: 994771 - RNA, 19 nt, Homo sapiens
agaacuaccagguggcaaa

SEQ ID NO: 994772 - RNA, 19 nt, Homo sapiens
ugagccagcuuagcaacug

SEQ ID NO: 994773 - RNA, 19 nt, Homo sapiens
ucauucauccugaccaaga

SEQ ID NO: 994774 - RNA, 19 nt, Homo sapiens
gagcggaugggcacacaca

SEQ ID NO: 994775 - RNA, 19 nt, Homo sapiens
cacagucucaguucucuug

SEQ ID NO: 994776 - RNA, 19 nt, Homo sapiens
gucaaucacagucucaguu

SEQ ID NO: 994777 - RNA, 19 nt, Homo sapiens
caggaagggaagcguauau

SEQ ID NO: 994778 - RNA, 19 nt, Homo sapiens
gcaccagcaauucucuuuc

SEQ ID NO: 994779 - RNA, 19 nt, Homo sapiens
aggcauaggucucuuugcu

SEQ ID NO: 994780 - RNA, 19 nt, Homo sapiens
ucaaucacagucucaguuc

SEQ ID NO: 994781 - RNA, 19 nt, Homo sapiens
gggcagagaauaaaacguu

SEQ ID NO: 994782 - RNA, 19 nt, Homo sapiens
auacggaugggaacaagaa

SEQ ID NO: 994783 - RNA, 19 nt, Homo sapiens
gaacuaccagguggcaaag

SEQ ID NO: 994784 - RNA, 19 nt, Homo sapiens
gcaggagauuugccauacg

SEQ ID NO: 994785 - RNA, 19 nt, Homo sapiens
ucucuugcuuucacauugu

SEQ ID NO: 994786 - RNA, 19 nt, Homo sapiens
ucaguucucuugcuuucac

SEQ ID NO: 994787 - RNA, 19 nt, Homo sapiens
uuaaucccuuugucuguca

SEQ ID NO: 994788 - RNA, 19 nt, Homo sapiens
gaagcagugucacgcauuu

SEQ ID NO: 994789 - RNA, 19 nt, Homo sapiens
ccagaaaagugcagaauaa

SEQ ID NO: 994790 - RNA, 19 nt, Homo sapiens
acaagaaacugaugagaac

SEQ ID NO: 994791 - RNA, 19 nt, Homo sapiens
caaccacccggcaaagaua

SEQ ID NO: 994792 - RNA, 19 nt, Homo sapiens
gaugagaacggacaagugu

SEQ ID NO: 994793 - RNA, 19 nt, Homo sapiens
gaacaagaaacugaugaga

SEQ ID NO: 994794 - RNA, 19 nt, Homo sapiens
gaucuugaauagucucauc

SEQ ID NO: 994795 - RNA, 19 nt, Homo sapiens
cagcaccacugccauggaa

SEQ ID NO: 994796 - RNA, 19 nt, Homo sapiens
ccaggugccuccacaguca

SEQ ID NO: 994797 - RNA, 19 nt, Homo sapiens
gaugggaacaagaaacuga

SEQ ID NO: 994798 - RNA, 19 nt, Homo sapiens
ugagaacggacaaguguuu

SEQ ID NO: 994799 - RNA, 19 nt, Homo sapiens
ccacugccauggaaauucu

SEQ ID NO: 994800 - RNA, 19 nt, Homo sapiens
gacccaagacuggcguuua

SEQ ID NO: 994801 - RNA, 19 nt, Homo sapiens
cguuuacuguggaugauaa

SEQ ID NO: 994802 - RNA, 19 nt, Homo sapiens
uaaaagaaccaccuacuug

SEQ ID NO: 994803 - RNA, 19 nt, Homo sapiens
ccaaggacggcuggguuua

SEQ ID NO: 994804 - RNA, 19 nt, Homo sapiens
gcaccacugccauggaaau

SEQ ID NO: 994805 - RNA, 19 nt, Homo sapiens
ccaaucacaccgaggagaa

SEQ ID NO: 994806 - RNA, 19 nt, Homo sapiens
gggaacaagaaacugauga

SEQ ID NO: 994807 - RNA, 19 nt, Homo sapiens
ucgaaaccgccaagucuuu

SEQ ID NO: 994808 - RNA, 19 nt, Homo sapiens
aacaagaaacugaugagaa

SEQ ID NO: 994809 - RNA, 19 nt, Homo sapiens
guucgaaaccgccaagucu

SEQ ID NO: 994810 - RNA, 19 nt, Homo sapiens
caagacuggcguuuacugu

SEQ ID NO: 994811 - RNA, 19 nt, Homo sapiens
aaagaaccaccuacuugga

SEQ ID NO: 994812 - RNA, 19 nt, Homo sapiens
ucaggaauaggguucgaaa

SEQ ID NO: 994813 - RNA, 19 nt, Homo sapiens
ggacggcuggguuuacuac

SEQ ID NO: 994814 - RNA, 19 nt, Homo sapiens
ccaaccacccggcaaagau

SEQ ID NO: 994815 - RNA, 19 nt, Homo sapiens
ggaacaagaaacugaugag

SEQ ID NO: 994816 - RNA, 19 nt, Homo sapiens
auacggaugggaacaagaa

SEQ ID NO: 994817 - RNA, 19 nt, Homo sapiens
gcaggagauuugccauacg

SEQ ID NO: 994818 - RNA, 19 nt, Homo sapiens
uguggucacuggagcuaau

SEQ ID NO: 994819 - RNA, 19 nt, Homo sapiens
gggaggagagaaccaccaa

SEQ ID NO: 994820 - RNA, 19 nt, Homo sapiens
ugaagcagugucacgcauu

SEQ ID NO: 994821 - RNA, 19 nt, Homo sapiens
acccaagacuggcguuuac

SEQ ID NO: 994822 - RNA, 19 nt, Homo sapiens
ggacccaagacuggcguuu

SEQ ID NO: 994823 - RNA, 19 nt, Homo sapiens
acaccgaggagaagacuca

SEQ ID NO: 994824 - RNA, 19 nt, Homo sapiens
acgaguggcaggagauuug

SEQ ID NO: 994825 - RNA, 19 nt, Homo sapiens
gcaaaguacuugucauaga

SEQ ID NO: 994826 - RNA, 19 nt, Homo sapiens
gcauaggucucuuugcuuu

SEQ ID NO: 994827 - RNA, 19 nt, Homo sapiens
ggagauaauuguuucauuc

SEQ ID NO: 994828 - RNA, 19 nt, Homo sapiens
gcgagaggcugauccaaga

SEQ ID NO: 994829 - RNA, 19 nt, Homo sapiens
acacagauccgcaagagua

SEQ ID NO: 994830 - RNA, 19 nt, Homo sapiens
ggaggacacucaagcauac

SEQ ID NO: 994831 - RNA, 19 nt, Homo sapiens
gcauacccguguagaagaa

SEQ ID NO: 994832 - RNA, 19 nt, Homo sapiens
agacaaaucucagaaccuu

SEQ ID NO: 994833 - RNA, 19 nt, Homo sapiens
aaagccagcugccauguug

SEQ ID NO: 994834 - RNA, 19 nt, Homo sapiens
agaacaugcuugaauauca

SEQ ID NO: 994835 - RNA, 19 nt, Homo sapiens
ggagggauguacuucaaca

SEQ ID NO: 994836 - RNA, 19 nt, Homo sapiens
caaaguacuugucauagac

SEQ ID NO: 994837 - RNA, 19 nt, Homo sapiens
caacacagauccgcaagag

SEQ ID NO: 994838 - RNA, 19 nt, Homo sapiens
acaagaaacugaugagaac

SEQ ID NO: 994839 - RNA, 19 nt, Homo sapiens
gggaggacacucaagcaua

SEQ ID NO: 994840 - RNA, 19 nt, Homo sapiens
caaccacccggcaaagaua

SEQ ID NO: 994841 - RNA, 19 nt, Homo sapiens
gaugagaacggacaagugu

SEQ ID NO: 994842 - RNA, 19 nt, Homo sapiens
gaacaagaaacugaugaga

SEQ ID NO: 994843 - RNA, 19 nt, Homo sapiens
gcuuucacauuguacuuaa

SEQ ID NO: 994844 - RNA, 19 nt, Homo sapiens
gucauagacuccuuugcua

SEQ ID NO: 994845 - RNA, 19 nt, Homo sapiens
gcaauucucuuucuuuuac

SEQ ID NO: 994846 - RNA, 19 nt, Homo sapiens
ggauguacuucaacaacug

SEQ ID NO: 994847 - RNA, 19 nt, Homo sapiens
cagcaccacugccauggaa

SEQ ID NO: 994848 - RNA, 19 nt, Homo sapiens
ccaggugccuccacaguca

SEQ ID NO: 994849 - RNA, 19 nt, Homo sapiens
gcauugauccaggagauaa

SEQ ID NO: 994850 - RNA, 19 nt, Homo sapiens
gcaagaguaaaggaaauaa

SEQ ID NO: 994851 - RNA, 19 nt, Homo sapiens
ggugguggcccguuugaaa

SEQ ID NO: 994852 - RNA, 19 nt, Homo sapiens
gaugggaacaagaaacuga

SEQ ID NO: 994853 - RNA, 19 nt, Homo sapiens
ggaagcguauauacuuaag

SEQ ID NO: 994854 - RNA, 19 nt, Homo sapiens
gggaagcguauauacuuaa

SEQ ID NO: 994855 - RNA, 19 nt, Homo sapiens
ugagaacggacaaguguuu

SEQ ID NO: 994856 - RNA, 19 nt, Homo sapiens
agggaagcguauauacuua

SEQ ID NO: 994857 - RNA, 19 nt, Homo sapiens
gaagggaagcguauauacu

SEQ ID NO: 994858 - RNA, 19 nt, Homo sapiens
gggaguagaauacgcagaa

SEQ ID NO: 994859 - RNA, 19 nt, Homo sapiens
uggcaaaguacuugucaua

SEQ ID NO: 994860 - RNA, 19 nt, Homo sapiens
ccagugaggaugacaguga

SEQ ID NO: 994861 - RNA, 19 nt, Homo sapiens
ccaagacugagccagcuua

SEQ ID NO: 994862 - RNA, 19 nt, Homo sapiens
ccacugccauggaaauucu

SEQ ID NO: 994863 - RNA, 19 nt, Homo sapiens
acuaccagguggcaaagua

SEQ ID NO: 994864 - RNA, 19 nt, Homo sapiens
gcuccuugcugcauugauc

SEQ ID NO: 994865 - RNA, 19 nt, Homo sapiens
ggagaagcaccagcaauuc

SEQ ID NO: 994866 - RNA, 19 nt, Homo sapiens
gacccaagacuggcguuua

SEQ ID NO: 994867 - RNA, 19 nt, Homo sapiens
ggaagggaagcguauauac

SEQ ID NO: 994868 - RNA, 19 nt, Homo sapiens
cguuuacuguggaugauaa

SEQ ID NO: 994869 - RNA, 19 nt, Homo sapiens
uaaaagaaccaccuacuug

SEQ ID NO: 994870 - RNA, 19 nt, Homo sapiens
ccagcaauucucuuucuuu

SEQ ID NO: 994871 - RNA, 19 nt, Homo sapiens
uggagaagcaccagcaauu

SEQ ID NO: 994872 - RNA, 19 nt, Homo sapiens
gcaggaagggaagcguaua

SEQ ID NO: 994873 - RNA, 19 nt, Homo sapiens
cagcaauucucuuucuuuu

SEQ ID NO: 994874 - RNA, 19 nt, Homo sapiens
guguguagguuccguaucu

SEQ ID NO: 994875 - RNA, 19 nt, Homo sapiens
gagcugccaccaccgugua

SEQ ID NO: 994876 - RNA, 19 nt, Homo sapiens
ccaaggacggcuggguuua

SEQ ID NO: 994877 - RNA, 19 nt, Homo sapiens
caaaugucccuccaacaca

SEQ ID NO: 994878 - RNA, 19 nt, Homo sapiens
gggauguacuucaacaacu

SEQ ID NO: 994879 - RNA, 19 nt, Homo sapiens
uuccuuagauaccuugaaa

SEQ ID NO: 994880 - RNA, 19 nt, Homo sapiens
caaaucauuccuuagauac

SEQ ID NO: 994881 - RNA, 19 nt, Homo sapiens
ucauagacuccuuugcuaa

SEQ ID NO: 994882 - RNA, 19 nt, Homo sapiens
gguggcccguuugaaagua

SEQ ID NO: 994883 - RNA, 19 nt, Homo sapiens
ccgcaagaguaaaggaaau

SEQ ID NO: 994884 - RNA, 19 nt, Homo sapiens
gcaccacugccauggaaau

SEQ ID NO: 994885 - RNA, 19 nt, Homo sapiens
ccaaucacaccgaggagaa

SEQ ID NO: 994886 - RNA, 19 nt, Homo sapiens
ucucaguucucuugcuuuc

SEQ ID NO: 994887 - RNA, 19 nt, Homo sapiens
caccagcaauucucuuucu

SEQ ID NO: 994888 - RNA, 19 nt, Homo sapiens
gggaacaagaaacugauga

SEQ ID NO: 994889 - RNA, 19 nt, Homo sapiens
aagggaagcguauauacuu

SEQ ID NO: 994890 - RNA, 19 nt, Homo sapiens
cauagacuccuuugcuaau

SEQ ID NO: 994891 - RNA, 19 nt, Homo sapiens
agacugagccagcuuagca

SEQ ID NO: 994892 - RNA, 19 nt, Homo sapiens
ugggagggauguacuucaa

SEQ ID NO: 994893 - RNA, 19 nt, Homo sapiens
caagcauacccguguagaa

SEQ ID NO: 994894 - RNA, 19 nt, Homo sapiens
aacaagaaacugaugagaa

SEQ ID NO: 994895 - RNA, 19 nt, Homo sapiens
aguagaauacgcagaacua

SEQ ID NO: 994896 - RNA, 19 nt, Homo sapiens
aacguuaguuaaucccuuu

SEQ ID NO: 994897 - RNA, 19 nt, Homo sapiens
uccaggagauaauuguuuc

SEQ ID NO: 994898 - RNA, 19 nt, Homo sapiens
gggcuggccuucuccuacu

SEQ ID NO: 994899 - RNA, 19 nt, Homo sapiens
caagacuggcguuuacugu

SEQ ID NO: 994900 - RNA, 19 nt, Homo sapiens
aaaccugcuugguguguag

SEQ ID NO: 994901 - RNA, 19 nt, Homo sapiens
gcuaggcauaggucucuuu

SEQ ID NO: 994902 - RNA, 19 nt, Homo sapiens
ccaaaugucccuccaacac

SEQ ID NO: 994903 - RNA, 19 nt, Homo sapiens
aaagaaccaccuacuugga

SEQ ID NO: 994904 - RNA, 19 nt, Homo sapiens
cuuaagaauacacaggaua

SEQ ID NO: 994905 - RNA, 19 nt, Homo sapiens
gaagcguauauacuuaaga

SEQ ID NO: 994906 - RNA, 19 nt, Homo sapiens
gauccaggagauaauuguu

SEQ ID NO: 994907 - RNA, 19 nt, Homo sapiens
gcuggccuucuccuacuua

SEQ ID NO: 994908 - RNA, 19 nt, Homo sapiens
guggcccguuugaaaguaa

SEQ ID NO: 994909 - RNA, 19 nt, Homo sapiens
ggaacaagaaacugaugag

SEQ ID NO: 994910 - RNA, 19 nt, Homo sapiens
ggacggcuggguuuacuac

SEQ ID NO: 994911 - RNA, 19 nt, Homo sapiens
ccaaccacccggcaaagau

SEQ ID NO: 994912 - RNA, 19 nt, Homo sapiens
ggcagagaauaaaacguua

SEQ ID NO: 994913 - RNA, 19 nt, Homo sapiens
agaacuaccagguggcaaa

SEQ ID NO: 994914 - RNA, 19 nt, Homo sapiens
ugagccagcuuagcaacug

SEQ ID NO: 994915 - RNA, 19 nt, Homo sapiens
ucauucauccugaccaaga

SEQ ID NO: 994916 - RNA, 19 nt, Homo sapiens
gagcggaugggcacacaca

SEQ ID NO: 994917 - RNA, 19 nt, Homo sapiens
acucaagcauacccgugua

SEQ ID NO: 994918 - RNA, 19 nt, Homo sapiens
cacagucucaguucucuug

SEQ ID NO: 994919 - RNA, 19 nt, Homo sapiens
gucaaucacagucucaguu

SEQ ID NO: 994920 - RNA, 19 nt, Homo sapiens
caggaagggaagcguauau

SEQ ID NO: 994921 - RNA, 19 nt, Homo sapiens
gcaccagcaauucucuuuc

SEQ ID NO: 994922 - RNA, 19 nt, Homo sapiens
aggcauaggucucuuugcu

SEQ ID NO: 994923 - RNA, 19 nt, Homo sapiens
ucaaucacagucucaguuc

SEQ ID NO: 994924 - RNA, 19 nt, Homo sapiens
gggcagagaauaaaacguu

SEQ ID NO: 994925 - RNA, 19 nt, Homo sapiens
uuaaggagcuucagggaaa

SEQ ID NO: 994926 - RNA, 19 nt, Homo sapiens
ccaggugccuccacaguca

SEQ ID NO: 994927 - RNA, 19 nt, Homo sapiens
gcaaagugaaaguaacugu

SEQ ID NO: 994928 - RNA, 19 nt, Homo sapiens
gguccaggguucccaguag

SEQ ID NO: 994929 - RNA, 19 nt, Homo sapiens
caaagugaaaguaacuguu

SEQ ID NO: 994930 - RNA, 19 nt, Homo sapiens
ccaaggacggcuggguuua

SEQ ID NO: 994931 - RNA, 19 nt, Homo sapiens
cgcgugcggugcaaaguga

SEQ ID NO: 994932 - RNA, 19 nt, Homo sapiens
ggacggcuggguuuacuac

SEQ ID NO: 994933 - RNA, 19 nt, Homo sapiens
gcccucugcuguucaggau

SEQ ID NO: 994934 - RNA, 19 nt, Homo sapiens
ggugcaaagugaaaguaac

SEQ ID NO: 994935 - RNA, 19 nt, Homo sapiens
gggaggagagaaccaccaa

SEQ ID NO: 994936 - RNA, 19 nt, Homo sapiens
gcggugcaaagugaaagua

SEQ ID NO: 994937 - RNA, 19 nt, Homo sapiens
ggaagaagaucuaaucaua

SEQ ID NO: 994938 - RNA, 19 nt, Homo sapiens
gaaauuacuucgauccuua

SEQ ID NO: 994939 - RNA, 19 nt, Homo sapiens
gaaaggaugucaagaagga

SEQ ID NO: 994940 - RNA, 19 nt, Homo sapiens
ggagaaagcguuuaaagaa

SEQ ID NO: 994941 - RNA, 19 nt, Homo sapiens
aaagaugucuggucaagua

SEQ ID NO: 994942 - RNA, 19 nt, Homo sapiens
ggaaacaagucuaccaaga

SEQ ID NO: 994943 - RNA, 19 nt, Homo sapiens
ggaauugugugucugguaa

SEQ ID NO: 994944 - RNA, 19 nt, Homo sapiens
guacuuggauaucgaaauu

SEQ ID NO: 994945 - RNA, 19 nt, Homo sapiens
gaauggaacuacuguacuu

SEQ ID NO: 994946 - RNA, 19 nt, Homo sapiens
gagauacgaugaauggauu

SEQ ID NO: 994947 - RNA, 19 nt, Homo sapiens
gguagaagcugaggaagaa

SEQ ID NO: 994948 - RNA, 19 nt, Homo sapiens
gaacauguuuacagguuug

SEQ ID NO: 994949 - RNA, 19 nt, Homo sapiens
gcaaagaugacaccaacua

SEQ ID NO: 994950 - RNA, 19 nt, Homo sapiens
ugacaaagaugaugacaca

SEQ ID NO: 994951 - RNA, 19 nt, Homo sapiens
guagaacuauuccugcuaa

SEQ ID NO: 994952 - RNA, 19 nt, Homo sapiens
gguaggagcuauuguggaa

SEQ ID NO: 994953 - RNA, 19 nt, Homo sapiens
ucaggaagcuguuaucaau

SEQ ID NO: 994954 - RNA, 19 nt, Homo sapiens
gaaaagauguccaugaaau

SEQ ID NO: 994955 - RNA, 19 nt, Homo sapiens
gagaaaggaugucaagaag

SEQ ID NO: 994956 - RNA, 19 nt, Homo sapiens
ccagaaagauuaaggaaag

SEQ ID NO: 994957 - RNA, 19 nt, Homo sapiens
acacaaacuuggaggauuu

SEQ ID NO: 994958 - RNA, 19 nt, Homo sapiens
aagcaaaggcucugaaaua

SEQ ID NO: 994959 - RNA, 19 nt, Homo sapiens
gaaacagauugaugagcua

SEQ ID NO: 994960 - RNA, 19 nt, Homo sapiens
gaaaauggcuaauaaacug

SEQ ID NO: 994961 - RNA, 19 nt, Homo sapiens
gcuggaacauuugauauuu

SEQ ID NO: 994962 - RNA, 19 nt, Homo sapiens
guauauguauucccuugua

SEQ ID NO: 994963 - RNA, 19 nt, Homo sapiens
gaaagaauggugauaagga

SEQ ID NO: 994964 - RNA, 19 nt, Homo sapiens
caaacgaccuguacuugga

SEQ ID NO: 994965 - RNA, 19 nt, Homo sapiens
gucagaacauguuaagaua

SEQ ID NO: 994966 - RNA, 19 nt, Homo sapiens
aaacaaaguucaugcagau

SEQ ID NO: 994967 - RNA, 19 nt, Homo sapiens
gagaugaaacgaauaaaga

SEQ ID NO: 994968 - RNA, 19 nt, Homo sapiens
caaaggcucugaaauaaaa

SEQ ID NO: 994969 - RNA, 19 nt, Homo sapiens
uaggguggcuuuaauugua

SEQ ID NO: 994970 - RNA, 19 nt, Homo sapiens
gugaugagauugcuguaaa

SEQ ID NO: 994971 - RNA, 19 nt, Homo sapiens
gaaagcguuuaaagaagaa

SEQ ID NO: 994972 - RNA, 19 nt, Homo sapiens
ugaagaagaugaagucaca

SEQ ID NO: 994973 - RNA, 19 nt, Homo sapiens
gagaggugcucaagacaug

SEQ ID NO: 994974 - RNA, 19 nt, Homo sapiens
aguaagaccugcugauaaa

SEQ ID NO: 994975 - RNA, 19 nt, Homo sapiens
uaaagauucugaugucgaa

SEQ ID NO: 994976 - RNA, 19 nt, Homo sapiens
gauaggaacugucucaaaa

SEQ ID NO: 994977 - RNA, 19 nt, Homo sapiens
gagaaagcguuuaaagaag

SEQ ID NO: 994978 - RNA, 19 nt, Homo sapiens
gaacgcaucacaauucuuc

SEQ ID NO: 994979 - RNA, 19 nt, Homo sapiens
caacagugguaaacaacaa

SEQ ID NO: 994980 - RNA, 19 nt, Homo sapiens
caauugagguggauagugu

SEQ ID NO: 994981 - RNA, 19 nt, Homo sapiens
guaauucagugcuaaauac

SEQ ID NO: 994982 - RNA, 19 nt, Homo sapiens
ggaaaaggcacaaauagua

SEQ ID NO: 994983 - RNA, 19 nt, Homo sapiens
cgaagauacugauuaugaa

SEQ ID NO: 994984 - RNA, 19 nt, Homo sapiens
cucaagacauggauaauaa

SEQ ID NO: 994985 - RNA, 19 nt, Homo sapiens
acaaauccaucuccugaaa

SEQ ID NO: 994986 - RNA, 19 nt, Homo sapiens
gcaaaggcucugaaauaaa

SEQ ID NO: 994987 - RNA, 19 nt, Homo sapiens
gaagaaagagagagaaagu

SEQ ID NO: 994988 - RNA, 19 nt, Homo sapiens
gaacuuucuucagcaauug

SEQ ID NO: 994989 - RNA, 19 nt, Homo sapiens
uaauagcagugaagaagaa

SEQ ID NO: 994990 - RNA, 19 nt, Homo sapiens
gcagcagucuucuguaaca

SEQ ID NO: 994991 - RNA, 19 nt, Homo sapiens
gaaacaagucuaccaagau

SEQ ID NO: 994992 - RNA, 19 nt, Homo sapiens
gcacuccagucauaggaaa

SEQ ID NO: 994993 - RNA, 19 nt, Homo sapiens
cauaguuugugaauccuua

SEQ ID NO: 994994 - RNA, 19 nt, Homo sapiens
agaaagcguuuaaagaaga

SEQ ID NO: 994995 - RNA, 19 nt, Homo sapiens
ggacaacugguuucuauuc

SEQ ID NO: 994996 - RNA, 19 nt, Homo sapiens
gaugaaucccucaacauaa

SEQ ID NO: 994997 - RNA, 19 nt, Homo sapiens
gcugcaggauacaauguua

SEQ ID NO: 994998 - RNA, 19 nt, Homo sapiens
caacuugucugggaauugu

SEQ ID NO: 994999 - RNA, 19 nt, Homo sapiens
ugacaccaacuaagaaaua

SEQ ID NO: 995000 - RNA, 19 nt, Homo sapiens
agaugaagaugaagaagaa

SEQ ID NO: 995001 - RNA, 19 nt, Homo sapiens
guggagagguccuuuacuu

SEQ ID NO: 995002 - RNA, 19 nt, Homo sapiens
agaugaagaugaugaagaa

SEQ ID NO: 995003 - RNA, 19 nt, Homo sapiens
agaagaagaugaagaugau

SEQ ID NO: 995004 - RNA, 19 nt, Homo sapiens
uccaaucucuguucuguuu

SEQ ID NO: 995005 - RNA, 19 nt, Homo sapiens
gaagagguucgaaguauca

SEQ ID NO: 995006 - RNA, 19 nt, Homo sapiens
aaagcagaauuuccaagua

SEQ ID NO: 995007 - RNA, 19 nt, Homo sapiens
gcucaagacauggauaaua

SEQ ID NO: 995008 - RNA, 19 nt, Homo sapiens
caacuaggguagaugaauc

SEQ ID NO: 995009 - RNA, 19 nt, Homo sapiens
ggaauauaauaccaagaga

SEQ ID NO: 995010 - RNA, 19 nt, Homo sapiens
aaacaagucuaccaagauc

SEQ ID NO: 995011 - RNA, 19 nt, Homo sapiens
aaacuuggaggauuugaua

SEQ ID NO: 995012 - RNA, 19 nt, Homo sapiens
gcaguuaacaggauauuag

SEQ ID NO: 995013 - RNA, 19 nt, Homo sapiens
agugugagcucaagcagua

SEQ ID NO: 995014 - RNA, 19 nt, Homo sapiens
ucaugcagauuugguaaua

SEQ ID NO: 995015 - RNA, 19 nt, Homo sapiens
uggaaucccugucuuaaau

SEQ ID NO: 995016 - RNA, 19 nt, Homo sapiens
guuuggcacuuguauuuaa

SEQ ID NO: 995017 - RNA, 19 nt, Homo sapiens
uaucagacaagcacuauuu

SEQ ID NO: 995018 - RNA, 19 nt, Homo sapiens
caagaagagguucgaagua

SEQ ID NO: 995019 - RNA, 19 nt, Homo sapiens
cggcagcagucuucuguaa

SEQ ID NO: 995020 - RNA, 19 nt, Homo sapiens
ccgaagauacugauuauga

SEQ ID NO: 995021 - RNA, 19 nt, Homo sapiens
gaaucuauaccuacacauu

SEQ ID NO: 995022 - RNA, 19 nt, Homo sapiens
gaaacagagaucaaagaaa

SEQ ID NO: 995023 - RNA, 19 nt, Homo sapiens
gaaaacaaauagaggaaga

SEQ ID NO: 995024 - RNA, 19 nt, Homo sapiens
gaaucuugauggugcauau

SEQ ID NO: 995025 - RNA, 19 nt, Homo sapiens
ggucagaacauguuaagau

SEQ ID NO: 995026 - RNA, 19 nt, Homo sapiens
gagagaaagugcugcuaca

SEQ ID NO: 995027 - RNA, 19 nt, Homo sapiens
gaaggacacaacagauaaa

SEQ ID NO: 995028 - RNA, 19 nt, Homo sapiens
gaggaggagaggaauauaa

SEQ ID NO: 995029 - RNA, 19 nt, Homo sapiens
gaacaggcacuugaauuuc

SEQ ID NO: 995030 - RNA, 19 nt, Homo sapiens
ugaacaggcacuugaauuu

SEQ ID NO: 995031 - RNA, 19 nt, Homo sapiens
uaacagaugcgaguuggua

SEQ ID NO: 995032 - RNA, 19 nt, Homo sapiens
agcaaaggcucugaaauaa

SEQ ID NO: 995033 - RNA, 19 nt, Homo sapiens
cgaggaaggugcagcugaa

SEQ ID NO: 995034 - RNA, 19 nt, Homo sapiens
ccacuggaaugaagucuca

SEQ ID NO: 995035 - RNA, 19 nt, Homo sapiens
aagaagagguucgaaguau

SEQ ID NO: 995036 - RNA, 19 nt, Homo sapiens
ccauagaaauuacuucgau

SEQ ID NO: 995037 - RNA, 19 nt, Homo sapiens
ggaagaagaucuaaucaua

SEQ ID NO: 995038 - RNA, 19 nt, Homo sapiens
gaaauuacuucgauccuua

SEQ ID NO: 995039 - RNA, 19 nt, Homo sapiens
gaaaggaugucaagaagga

SEQ ID NO: 995040 - RNA, 19 nt, Homo sapiens
ggagaaagcguuuaaagaa

SEQ ID NO: 995041 - RNA, 19 nt, Homo sapiens
aaagaugucuggucaagua

SEQ ID NO: 995042 - RNA, 19 nt, Homo sapiens
ggaaacaagucuaccaaga

SEQ ID NO: 995043 - RNA, 19 nt, Homo sapiens
ggaauugugugucugguaa

SEQ ID NO: 995044 - RNA, 19 nt, Homo sapiens
guacuuggauaucgaaauu

SEQ ID NO: 995045 - RNA, 19 nt, Homo sapiens
gaauggaacuacuguacuu

SEQ ID NO: 995046 - RNA, 19 nt, Homo sapiens
gguagaagcugaggaagaa

SEQ ID NO: 995047 - RNA, 19 nt, Homo sapiens
gaacauguuuacagguuug

SEQ ID NO: 995048 - RNA, 19 nt, Homo sapiens
gcaaagaugacaccaacua

SEQ ID NO: 995049 - RNA, 19 nt, Homo sapiens
ugacaaagaugaugacaca

SEQ ID NO: 995050 - RNA, 19 nt, Homo sapiens
guagaacuauuccugcuaa

SEQ ID NO: 995051 - RNA, 19 nt, Homo sapiens
gguaggagcuauuguggaa

SEQ ID NO: 995052 - RNA, 19 nt, Homo sapiens
ucaggaagcuguuaucaau

SEQ ID NO: 995053 - RNA, 19 nt, Homo sapiens
gaaaagauguccaugaaau

SEQ ID NO: 995054 - RNA, 19 nt, Homo sapiens
gagaaaggaugucaagaag

SEQ ID NO: 995055 - RNA, 19 nt, Homo sapiens
ccagaaagauuaaggaaag

SEQ ID NO: 995056 - RNA, 19 nt, Homo sapiens
acacaaacuuggaggauuu

SEQ ID NO: 995057 - RNA, 19 nt, Homo sapiens
aagcaaaggcucugaaaua

SEQ ID NO: 995058 - RNA, 19 nt, Homo sapiens
gaaacagauugaugagcua

SEQ ID NO: 995059 - RNA, 19 nt, Homo sapiens
gaaaauggcuaauaaacug

SEQ ID NO: 995060 - RNA, 19 nt, Homo sapiens
gcuggaacauuugauauuu

SEQ ID NO: 995061 - RNA, 19 nt, Homo sapiens
guauauguauucccuugua

SEQ ID NO: 995062 - RNA, 19 nt, Homo sapiens
gaaagaauggugauaagga

SEQ ID NO: 995063 - RNA, 19 nt, Homo sapiens
caaacgaccuguacuugga

SEQ ID NO: 995064 - RNA, 19 nt, Homo sapiens
gucagaacauguuaagaua

SEQ ID NO: 995065 - RNA, 19 nt, Homo sapiens
aaacaaaguucaugcagau

SEQ ID NO: 995066 - RNA, 19 nt, Homo sapiens
caaaggcucugaaauaaaa

SEQ ID NO: 995067 - RNA, 19 nt, Homo sapiens
uaggguggcuuuaauugua

SEQ ID NO: 995068 - RNA, 19 nt, Homo sapiens
gugaugagauugcuguaaa

SEQ ID NO: 995069 - RNA, 19 nt, Homo sapiens
gaaagcguuuaaagaagaa

SEQ ID NO: 995070 - RNA, 19 nt, Homo sapiens
ugaagaagaugaagucaca

SEQ ID NO: 995071 - RNA, 19 nt, Homo sapiens
gagaggugcucaagacaug

SEQ ID NO: 995072 - RNA, 19 nt, Homo sapiens
aguaagaccugcugauaaa

SEQ ID NO: 995073 - RNA, 19 nt, Homo sapiens
gauaggaacugucucaaaa

SEQ ID NO: 995074 - RNA, 19 nt, Homo sapiens
gagaaagcguuuaaagaag

SEQ ID NO: 995075 - RNA, 19 nt, Homo sapiens
gaacgcaucacaauucuuc

SEQ ID NO: 995076 - RNA, 19 nt, Homo sapiens
caacagugguaaacaacaa

SEQ ID NO: 995077 - RNA, 19 nt, Homo sapiens
caauugagguggauagugu

SEQ ID NO: 995078 - RNA, 19 nt, Homo sapiens
guaauucagugcuaaauac

SEQ ID NO: 995079 - RNA, 19 nt, Homo sapiens
ggaaaaggcacaaauagua

SEQ ID NO: 995080 - RNA, 19 nt, Homo sapiens
cgaagauacugauuaugaa

SEQ ID NO: 995081 - RNA, 19 nt, Homo sapiens
cucaagacauggauaauaa

SEQ ID NO: 995082 - RNA, 19 nt, Homo sapiens
acaaauccaucuccugaaa

SEQ ID NO: 995083 - RNA, 19 nt, Homo sapiens
gcaaaggcucugaaauaaa

SEQ ID NO: 995084 - RNA, 19 nt, Homo sapiens
gaagaaagagagagaaagu

SEQ ID NO: 995085 - RNA, 19 nt, Homo sapiens
gaacuuucuucagcaauug

SEQ ID NO: 995086 - RNA, 19 nt, Homo sapiens
uaauagcagugaagaagaa

SEQ ID NO: 995087 - RNA, 19 nt, Homo sapiens
gcagcagucuucuguaaca

SEQ ID NO: 995088 - RNA, 19 nt, Homo sapiens
gaaacaagucuaccaagau

SEQ ID NO: 995089 - RNA, 19 nt, Homo sapiens
gcacuccagucauaggaaa

SEQ ID NO: 995090 - RNA, 19 nt, Homo sapiens
cauaguuugugaauccuua

SEQ ID NO: 995091 - RNA, 19 nt, Homo sapiens
agaaagcguuuaaagaaga

SEQ ID NO: 995092 - RNA, 19 nt, Homo sapiens
ggacaacugguuucuauuc

SEQ ID NO: 995093 - RNA, 19 nt, Homo sapiens
gaugaaucccucaacauaa

SEQ ID NO: 995094 - RNA, 19 nt, Homo sapiens
gcugcaggauacaauguua

SEQ ID NO: 995095 - RNA, 19 nt, Homo sapiens
caacuugucugggaauugu

SEQ ID NO: 995096 - RNA, 19 nt, Homo sapiens
ugacaccaacuaagaaaua

SEQ ID NO: 995097 - RNA, 19 nt, Homo sapiens
agaugaagaugaagaagaa

SEQ ID NO: 995098 - RNA, 19 nt, Homo sapiens
uccaaucucuguucuguuu

SEQ ID NO: 995099 - RNA, 19 nt, Homo sapiens
gaagagguucgaaguauca

SEQ ID NO: 995100 - RNA, 19 nt, Homo sapiens
aaagcagaauuuccaagua

SEQ ID NO: 995101 - RNA, 19 nt, Homo sapiens
gcucaagacauggauaaua

SEQ ID NO: 995102 - RNA, 19 nt, Homo sapiens
caacuaggguagaugaauc

SEQ ID NO: 995103 - RNA, 19 nt, Homo sapiens
ggaauauaauaccaagaga

SEQ ID NO: 995104 - RNA, 19 nt, Homo sapiens
aaacaagucuaccaagauc

SEQ ID NO: 995105 - RNA, 19 nt, Homo sapiens
aaacuuggaggauuugaua

SEQ ID NO: 995106 - RNA, 19 nt, Homo sapiens
gcaguuaacaggauauuag

SEQ ID NO: 995107 - RNA, 19 nt, Homo sapiens
agugugagcucaagcagua

SEQ ID NO: 995108 - RNA, 19 nt, Homo sapiens
ucaugcagauuugguaaua

SEQ ID NO: 995109 - RNA, 19 nt, Homo sapiens
uggaaucccugucuuaaau

SEQ ID NO: 995110 - RNA, 19 nt, Homo sapiens
guuuggcacuuguauuuaa

SEQ ID NO: 995111 - RNA, 19 nt, Homo sapiens
uaucagacaagcacuauuu

SEQ ID NO: 995112 - RNA, 19 nt, Homo sapiens
caagaagagguucgaagua

SEQ ID NO: 995113 - RNA, 19 nt, Homo sapiens
cggcagcagucuucuguaa

SEQ ID NO: 995114 - RNA, 19 nt, Homo sapiens
ccgaagauacugauuauga

SEQ ID NO: 995115 - RNA, 19 nt, Homo sapiens
gaaucuauaccuacacauu

SEQ ID NO: 995116 - RNA, 19 nt, Homo sapiens
gaaacagagaucaaagaaa

SEQ ID NO: 995117 - RNA, 19 nt, Homo sapiens
gaaaacaaauagaggaaga

SEQ ID NO: 995118 - RNA, 19 nt, Homo sapiens
gaaucuugauggugcauau

SEQ ID NO: 995119 - RNA, 19 nt, Homo sapiens
ggucagaacauguuaagau

SEQ ID NO: 995120 - RNA, 19 nt, Homo sapiens
gagagaaagugcugcuaca

SEQ ID NO: 995121 - RNA, 19 nt, Homo sapiens
gaaggacacaacagauaaa

SEQ ID NO: 995122 - RNA, 19 nt, Homo sapiens
gaggaggagaggaauauaa

SEQ ID NO: 995123 - RNA, 19 nt, Homo sapiens
gaacaggcacuugaauuuc

SEQ ID NO: 995124 - RNA, 19 nt, Homo sapiens
ugaacaggcacuugaauuu

SEQ ID NO: 995125 - RNA, 19 nt, Homo sapiens
uaacagaugcgaguuggua

SEQ ID NO: 995126 - RNA, 19 nt, Homo sapiens
agcaaaggcucugaaauaa

SEQ ID NO: 995127 - RNA, 19 nt, Homo sapiens
cgaggaaggugcagcugaa

SEQ ID NO: 995128 - RNA, 19 nt, Homo sapiens
ccacuggaaugaagucuca

SEQ ID NO: 995129 - RNA, 19 nt, Homo sapiens
aagaagagguucgaaguau

SEQ ID NO: 995130 - RNA, 19 nt, Homo sapiens
ccauagaaauuacuucgau

SEQ ID NO: 995131 - RNA, 19 nt, Homo sapiens
ggaucucacugaugccaaa

SEQ ID NO: 995132 - RNA, 19 nt, Homo sapiens
guagaugaaucccucaaca

SEQ ID NO: 995133 - RNA, 19 nt, Homo sapiens
ggaggagaggaauauaaua

SEQ ID NO: 995134 - RNA, 19 nt, Homo sapiens
uaaauucagcugcaggaua

SEQ ID NO: 995135 - RNA, 19 nt, Homo sapiens
gaacuauuccugcuaacug

SEQ ID NO: 995136 - RNA, 19 nt, Homo sapiens
gaugauaggaaacagauug

SEQ ID NO: 995137 - RNA, 19 nt, Homo sapiens
gagcaaggcuguuaaauaa

SEQ ID NO: 995138 - RNA, 19 nt, Homo sapiens
gcaaagagcuggagaacuu

SEQ ID NO: 995139 - RNA, 19 nt, Homo sapiens
gcaaggcuguuaaauaaua

SEQ ID NO: 995140 - RNA, 19 nt, Homo sapiens
gggagugccucuucaguua

SEQ ID NO: 995141 - RNA, 19 nt, Homo sapiens
gagaggauauggaaauuug

SEQ ID NO: 995142 - RNA, 19 nt, Homo sapiens
gaagacgcauuguuagaaa

SEQ ID NO: 995143 - RNA, 19 nt, Homo sapiens
gcacaggagucucuauaga

SEQ ID NO: 995144 - RNA, 19 nt, Homo sapiens
aaacagcccuccucugaaa

SEQ ID NO: 995145 - RNA, 19 nt, Homo sapiens
gauaagagcaaggcuguua

SEQ ID NO: 995146 - RNA, 19 nt, Homo sapiens
gcacaaagccugguucuuc

SEQ ID NO: 995147 - RNA, 19 nt, Homo sapiens
ggagaacuuugauguuuau

SEQ ID NO: 995148 - RNA, 19 nt, Homo sapiens
gcaagaggaaggaaugaua

SEQ ID NO: 995149 - RNA, 19 nt, Homo sapiens
gagaguagauggugcaaag

SEQ ID NO: 995150 - RNA, 19 nt, Homo sapiens
gaaccugcauauacauuau

SEQ ID NO: 995151 - RNA, 19 nt, Homo sapiens
ccagaacccugcucgauug

SEQ ID NO: 995152 - RNA, 19 nt, Homo sapiens
ccacagcccuuccuucaau

SEQ ID NO: 995153 - RNA, 19 nt, Homo sapiens
guuaacagccucuaauuga

SEQ ID NO: 995154 - RNA, 19 nt, Homo sapiens
gcaauucucaccuuucuug

SEQ ID NO: 995155 - RNA, 19 nt, Homo sapiens
ggagaaagaggaaggagaa

SEQ ID NO: 995156 - RNA, 19 nt, Homo sapiens
ccaaguauuuguaaucuag

SEQ ID NO: 995157 - RNA, 19 nt, Homo sapiens
acaagaaccugcauauaca

SEQ ID NO: 995158 - RNA, 19 nt, Homo sapiens
ggaaggagaagcagucaga

SEQ ID NO: 995159 - RNA, 19 nt, Homo sapiens
acgaggagguugacauuaa

SEQ ID NO: 995160 - RNA, 19 nt, Homo sapiens
gggaucagcugaccaugug

SEQ ID NO: 995161 - RNA, 19 nt, Homo sapiens
gaaaguguuauguaaguga

SEQ ID NO: 995162 - RNA, 19 nt, Homo sapiens
gaacuuugauguuuauucc

SEQ ID NO: 995163 - RNA, 19 nt, Homo sapiens
ggaaagagucaaccuaaag

SEQ ID NO: 995164 - RNA, 19 nt, Homo sapiens
uaauggcacucacacauau

SEQ ID NO: 995165 - RNA, 19 nt, Homo sapiens
ccauuuggcuucuucauag

SEQ ID NO: 995166 - RNA, 19 nt, Homo sapiens
uggagaacuuugauguuua

SEQ ID NO: 995167 - RNA, 19 nt, Homo sapiens
agaaacagcccuccucuga

SEQ ID NO: 995168 - RNA, 19 nt, Homo sapiens
caagaggaaggaaugauaa

SEQ ID NO: 995169 - RNA, 19 nt, Homo sapiens
ggaaauuuguucuuguucu

SEQ ID NO: 995170 - RNA, 19 nt, Homo sapiens
ggccugggcuuuacucaau

SEQ ID NO: 995171 - RNA, 19 nt, Homo sapiens
gcaaguggucacccucaua

SEQ ID NO: 995172 - RNA, 19 nt, Homo sapiens
ggagcaccaucuacucuau

SEQ ID NO: 995173 - RNA, 19 nt, Homo sapiens
ggacgaggagguugacauu

SEQ ID NO: 995174 - RNA, 19 nt, Homo sapiens
uccaauacuuccaaugaua

SEQ ID NO: 995175 - RNA, 19 nt, Homo sapiens
guuggaaucuagacacuau

SEQ ID NO: 995176 - RNA, 19 nt, Homo sapiens
gaaugauaauggugacuca

SEQ ID NO: 995177 - RNA, 19 nt, Homo sapiens
agagcaaggcuguuaaaua

SEQ ID NO: 995178 - RNA, 19 nt, Homo sapiens
gagaggacuuacucagaga

SEQ ID NO: 995179 - RNA, 19 nt, Homo sapiens
uuaugaagacgcauuguua

SEQ ID NO: 995180 - RNA, 19 nt, Homo sapiens
cuggagaacuuugauguuu

SEQ ID NO: 995181 - RNA, 19 nt, Homo sapiens
uuacgaagaugucaaggau

SEQ ID NO: 995182 - RNA, 19 nt, Homo sapiens
gaaacagcccuccucugaa

SEQ ID NO: 995183 - RNA, 19 nt, Homo sapiens
gagauucccuccaccugau

SEQ ID NO: 995184 - RNA, 19 nt, Homo sapiens
gaaagaggaaggagaagca

SEQ ID NO: 995185 - RNA, 19 nt, Homo sapiens
gcauacagacgaagguuga

SEQ ID NO: 995186 - RNA, 19 nt, Homo sapiens
ggccagacauuucaacaag

SEQ ID NO: 995187 - RNA, 19 nt, Homo sapiens
ucuaugaagugauuggaaa

SEQ ID NO: 995188 - RNA, 19 nt, Homo sapiens
ccaaugauagauucaguuu

SEQ ID NO: 995189 - RNA, 19 nt, Homo sapiens
gacgaagguugacagcauu

SEQ ID NO: 995190 - RNA, 19 nt, Homo sapiens
caaccaaacagcauacaga

SEQ ID NO: 995191 - RNA, 19 nt, Homo sapiens
gaugcagucugaauuccuu

SEQ ID NO: 995192 - RNA, 19 nt, Homo sapiens
aagccugguucuucaauuu

SEQ ID NO: 995193 - RNA, 19 nt, Homo sapiens
caaacagcauacagacgaa

SEQ ID NO: 995194 - RNA, 19 nt, Homo sapiens
cacaaagccugguucuuca

SEQ ID NO: 995195 - RNA, 19 nt, Homo sapiens
gcacaugcugaccugauaa

SEQ ID NO: 995196 - RNA, 19 nt, Homo sapiens
gaaugaggcaguuggaauc

SEQ ID NO: 995197 - RNA, 19 nt, Homo sapiens
gcugucacuuguuuccuuu

SEQ ID NO: 995198 - RNA, 19 nt, Homo sapiens
ucacaagaaccugcauaua

SEQ ID NO: 995199 - RNA, 19 nt, Homo sapiens
cgaggagguugacauuaau

SEQ ID NO: 995200 - RNA, 19 nt, Homo sapiens
uuacucaauugcagagaaa

SEQ ID NO: 995201 - RNA, 19 nt, Homo sapiens
ggccacauuccaaguauuu

SEQ ID NO: 995202 - RNA, 19 nt, Homo sapiens
ggagaggauauggaaauuu

SEQ ID NO: 995203 - RNA, 19 nt, Homo sapiens
uggaaagagucaaccuaaa

SEQ ID NO: 995204 - RNA, 19 nt, Homo sapiens
cacaagaaccugcauauac

SEQ ID NO: 995205 - RNA, 19 nt, Homo sapiens
caucaggaauucagauuuu

SEQ ID NO: 995206 - RNA, 19 nt, Homo sapiens
gaaucucacucaggacugu

SEQ ID NO: 995207 - RNA, 19 nt, Homo sapiens
agacgaagguugacagcau

SEQ ID NO: 995208 - RNA, 19 nt, Homo sapiens
uuacagaucagacaugaau

SEQ ID NO: 995209 - RNA, 19 nt, Homo sapiens
acucaggacugucagaaug

SEQ ID NO: 995210 - RNA, 19 nt, Homo sapiens
ggcaauguguccuaugcuu

SEQ ID NO: 995211 - RNA, 19 nt, Homo sapiens
gcaggacaguggccucuac

SEQ ID NO: 995212 - RNA, 19 nt, Homo sapiens
cagcaauucucaccuuucu

SEQ ID NO: 995213 - RNA, 19 nt, Homo sapiens
caagguguaucagggcaaa

SEQ ID NO: 995214 - RNA, 19 nt, Homo sapiens
ggaaagccacacccugaau

SEQ ID NO: 995215 - RNA, 19 nt, Homo sapiens
ucacacauauaccugcaau

SEQ ID NO: 995216 - RNA, 19 nt, Homo sapiens
gaggaaggaaugauaaugg

SEQ ID NO: 995217 - RNA, 19 nt, Homo sapiens
uaagagcaaggcuguuaaa

SEQ ID NO: 995218 - RNA, 19 nt, Homo sapiens
gaggauauggaaauuuguu

SEQ ID NO: 995219 - RNA, 19 nt, Homo sapiens
gaaagccacacccugaauc

SEQ ID NO: 995220 - RNA, 19 nt, Homo sapiens
uuaauggcacucacacaua

SEQ ID NO: 995221 - RNA, 19 nt, Homo sapiens
caguauaucuggaaaaguu

SEQ ID NO: 995222 - RNA, 19 nt, Homo sapiens
gggagaggacuuacucaga

SEQ ID NO: 995223 - RNA, 19 nt, Homo sapiens
uggauuucaucacauauug

SEQ ID NO: 995224 - RNA, 19 nt, Homo sapiens
ugaagacgcauuguuagaa

SEQ ID NO: 995225 - RNA, 19 nt, Homo sapiens
uggguugacugcauuucua

SEQ ID NO: 995226 - RNA, 19 nt, Homo sapiens
gaauuggcacaguggauga

SEQ ID NO: 995227 - RNA, 19 nt, Homo sapiens
ucaccuuucuugcacauca

SEQ ID NO: 995228 - RNA, 19 nt, Homo sapiens
agaaguugcugcccucaca

SEQ ID NO: 995229 - RNA, 19 nt, Homo sapiens
ucagaaugcccaucaggaa

SEQ ID NO: 995230 - RNA, 19 nt, Homo sapiens
ggaggucaccaguauaucu

SEQ ID NO: 995231 - RNA, 19 nt, Homo sapiens
ugaggcaguuggaaucuag

SEQ ID NO: 995232 - RNA, 19 nt, Homo sapiens
gaaagagucaaccuaaagc

SEQ ID NO: 995233 - RNA, 19 nt, Homo sapiens
gcucuuugccuuccaauac

SEQ ID NO: 995234 - RNA, 19 nt, Homo sapiens
caaaggaugccagggauca

SEQ ID NO: 995235 - RNA, 19 nt, Homo sapiens
gcaaagcaagcccaucucu

SEQ ID NO: 995236 - RNA, 19 nt, Homo sapiens
cacaggagucucuauagaa

SEQ ID NO: 995237 - RNA, 19 nt, Homo sapiens
ggaaagcaauguaagguua

SEQ ID NO: 995238 - RNA, 19 nt, Homo sapiens
ggacagacaccuucaauuu

SEQ ID NO: 995239 - RNA, 19 nt, Homo sapiens
gcaacagauugaagaauua

SEQ ID NO: 995240 - RNA, 19 nt, Homo sapiens
gaagagcucucguuucaug

SEQ ID NO: 995241 - RNA, 19 nt, Homo sapiens
gaaggaagcaccaugauuu

SEQ ID NO: 995242 - RNA, 19 nt, Homo sapiens
ucaaagaacugaugcacua

SEQ ID NO: 995243 - RNA, 19 nt, Homo sapiens
ccaauuaguugauuuguug

SEQ ID NO: 995244 - RNA, 19 nt, Homo sapiens
aaacuuagguccuguauca

SEQ ID NO: 995245 - RNA, 19 nt, Homo sapiens
gaaaggaaguaccaauuag

SEQ ID NO: 995246 - RNA, 19 nt, Homo sapiens
ucaaggauguuucuaguuu

SEQ ID NO: 995247 - RNA, 19 nt, Homo sapiens
gaugugaccuaccagauuu

SEQ ID NO: 995248 - RNA, 19 nt, Homo sapiens
gauaagaccucagaucaga

SEQ ID NO: 995249 - RNA, 19 nt, Homo sapiens
ggccaacacuuucucauaa

SEQ ID NO: 995250 - RNA, 19 nt, Homo sapiens
gugaagacauuaaaucuga

SEQ ID NO: 995251 - RNA, 19 nt, Homo sapiens
gaaagaaggcggagcagaa

SEQ ID NO: 995252 - RNA, 19 nt, Homo sapiens
gcagagacauaugcuuuaa

SEQ ID NO: 995253 - RNA, 19 nt, Homo sapiens
acugaugccuugauaauua

SEQ ID NO: 995254 - RNA, 19 nt, Homo sapiens
gcaauucucaagucuauaa

SEQ ID NO: 995255 - RNA, 19 nt, Homo sapiens
ggacagagaacaagauaga

SEQ ID NO: 995256 - RNA, 19 nt, Homo sapiens
ccugugaucuuuacgcuua

SEQ ID NO: 995257 - RNA, 19 nt, Homo sapiens
gaagagagagaacugcuaa

SEQ ID NO: 995258 - RNA, 19 nt, Homo sapiens
guguaggguuuaugaauua

SEQ ID NO: 995259 - RNA, 19 nt, Homo sapiens
ggaaagugauacuaagaau

SEQ ID NO: 995260 - RNA, 19 nt, Homo sapiens
cgagagcguuuguaaauau

SEQ ID NO: 995261 - RNA, 19 nt, Homo sapiens
gaaggaaagugauacuaag

SEQ ID NO: 995262 - RNA, 19 nt, Homo sapiens
gaaaguuggcuaugaaaga

SEQ ID NO: 995263 - RNA, 19 nt, Homo sapiens
guacacauguuaauuagca

SEQ ID NO: 995264 - RNA, 19 nt, Homo sapiens
ugaaaggaaguaccaauua

SEQ ID NO: 995265 - RNA, 19 nt, Homo sapiens
gaacugaugcacuauauag

SEQ ID NO: 995266 - RNA, 19 nt, Homo sapiens
gguaugugcuuaauauuuc

SEQ ID NO: 995267 - RNA, 19 nt, Homo sapiens
agaaagggcucgugacaga

SEQ ID NO: 995268 - RNA, 19 nt, Homo sapiens
ugaaguauguggagccuuu

SEQ ID NO: 995269 - RNA, 19 nt, Homo sapiens
ccacacugaugccuugaua

SEQ ID NO: 995270 - RNA, 19 nt, Homo sapiens
guaaguguauuguuucuca

SEQ ID NO: 995271 - RNA, 19 nt, Homo sapiens
ggaaguuugugaaguaugu

SEQ ID NO: 995272 - RNA, 19 nt, Homo sapiens
agagguaaguguauuguuu

SEQ ID NO: 995273 - RNA, 19 nt, Homo sapiens
aagugaagaucgacauuua

SEQ ID NO: 995274 - RNA, 19 nt, Homo sapiens
ggacuacuguucgaagauu

SEQ ID NO: 995275 - RNA, 19 nt, Homo sapiens
gcuauugccugugaucuuu

SEQ ID NO: 995276 - RNA, 19 nt, Homo sapiens
gcaagaaagagaagaaaga

SEQ ID NO: 995277 - RNA, 19 nt, Homo sapiens
gaagguuccagaaucaaua

SEQ ID NO: 995278 - RNA, 19 nt, Homo sapiens
ggaggcacauguuggacua

SEQ ID NO: 995279 - RNA, 19 nt, Homo sapiens
aaacacagaucucgaaguc

SEQ ID NO: 995280 - RNA, 19 nt, Homo sapiens
ggacugaugugaccuacca

SEQ ID NO: 995281 - RNA, 19 nt, Homo sapiens
agagguaugugcuuaauau

SEQ ID NO: 995282 - RNA, 19 nt, Homo sapiens
gcagugguggccagaauua

SEQ ID NO: 995283 - RNA, 19 nt, Homo sapiens
ggauuaaacguuaguauuc

SEQ ID NO: 995284 - RNA, 19 nt, Homo sapiens
caugaaaguuggcuaugaa

SEQ ID NO: 995285 - RNA, 19 nt, Homo sapiens
ggaaguaccaauuaguuga

SEQ ID NO: 995286 - RNA, 19 nt, Homo sapiens
cauauuauucgccuuguua

SEQ ID NO: 995287 - RNA, 19 nt, Homo sapiens
ggaaguguaggguuuauga

SEQ ID NO: 995288 - RNA, 19 nt, Homo sapiens
guaauauagucgccauuga

SEQ ID NO: 995289 - RNA, 19 nt, Homo sapiens
aauggaaguuugugaagua

SEQ ID NO: 995290 - RNA, 19 nt, Homo sapiens
ugaaugcuauugccuguga

SEQ ID NO: 995291 - RNA, 19 nt, Homo sapiens
gaucgaaagucauauaagc

SEQ ID NO: 995292 - RNA, 19 nt, Homo sapiens
ggaagaaagagaaaggaaa

SEQ ID NO: 995293 - RNA, 19 nt, Homo sapiens
cgaagaaccugaucgugau

SEQ ID NO: 995294 - RNA, 19 nt, Homo sapiens
gaauuagggucugaaggaa

SEQ ID NO: 995295 - RNA, 19 nt, Homo sapiens
gcacauguuggacuacuuu

SEQ ID NO: 995296 - RNA, 19 nt, Homo sapiens
gguauuaaguccaucuugu

SEQ ID NO: 995297 - RNA, 19 nt, Homo sapiens
cgaaggaaagugauacuaa

SEQ ID NO: 995298 - RNA, 19 nt, Homo sapiens
gaaagaagaaagagaaguc

SEQ ID NO: 995299 - RNA, 19 nt, Homo sapiens
agaaagcuauaguggcaua

SEQ ID NO: 995300 - RNA, 19 nt, Homo sapiens
guaagguuaugucugugua

SEQ ID NO: 995301 - RNA, 19 nt, Homo sapiens
uaaagcagcagugugaaua

SEQ ID NO: 995302 - RNA, 19 nt, Homo sapiens
gaaguccgguagucgagaa

SEQ ID NO: 995303 - RNA, 19 nt, Homo sapiens
gaaagagaagaaagagaaa

SEQ ID NO: 995304 - RNA, 19 nt, Homo sapiens
aaaguuagguacuguaagu

SEQ ID NO: 995305 - RNA, 19 nt, Homo sapiens
acagacaccuucaauuugu

SEQ ID NO: 995306 - RNA, 19 nt, Homo sapiens
gagagcguuuguaaauauu

SEQ ID NO: 995307 - RNA, 19 nt, Homo sapiens
guacauuggcagagacaua

SEQ ID NO: 995308 - RNA, 19 nt, Homo sapiens
gagcagaaguagagaucga

SEQ ID NO: 995309 - RNA, 19 nt, Homo sapiens
ggaagaggaagaaagagaa

SEQ ID NO: 995310 - RNA, 19 nt, Homo sapiens
caaauugggcguuguagga

SEQ ID NO: 995311 - RNA, 19 nt, Homo sapiens
acgcuuaacuguuguguau

SEQ ID NO: 995312 - RNA, 19 nt, Homo sapiens
gaagaggaagaaagagaaa

SEQ ID NO: 995313 - RNA, 19 nt, Homo sapiens
gaaagggaagaaagagaaa

SEQ ID NO: 995314 - RNA, 19 nt, Homo sapiens
gaagcaagaaagagaagaa

SEQ ID NO: 995315 - RNA, 19 nt, Homo sapiens
gccaacacuuucucauaaa

SEQ ID NO: 995316 - RNA, 19 nt, Homo sapiens
ccuguaaacuucauucugu

SEQ ID NO: 995317 - RNA, 19 nt, Homo sapiens
gcaguuguuggaugaguua

SEQ ID NO: 995318 - RNA, 19 nt, Homo sapiens
gagagaaagggaagaaaga

SEQ ID NO: 995319 - RNA, 19 nt, Homo sapiens
gaaguagaacguaggauca

SEQ ID NO: 995320 - RNA, 19 nt, Homo sapiens
gacacucaguccaauuaaa

SEQ ID NO: 995321 - RNA, 19 nt, Homo sapiens
gaggggaucugaugauaaa

SEQ ID NO: 995322 - RNA, 19 nt, Homo sapiens
cacaaaaggucacgaagua

SEQ ID NO: 995323 - RNA, 19 nt, Homo sapiens
ugcaacagauugaagaauu

SEQ ID NO: 995324 - RNA, 19 nt, Homo sapiens
uguaugucauucacacuua

SEQ ID NO: 995325 - RNA, 19 nt, Homo sapiens
gacagacaccuucaauuug

SEQ ID NO: 995326 - RNA, 19 nt, Homo sapiens
uaaugcaguuuguucugua

SEQ ID NO: 995327 - RNA, 19 nt, Homo sapiens
agaaagagaagaaagagaa

SEQ ID NO: 995328 - RNA, 19 nt, Homo sapiens
ccggguagaugaccauuug

SEQ ID NO: 995329 - RNA, 19 nt, Homo sapiens
ccacaacgucgacaauuga

SEQ ID NO: 995330 - RNA, 19 nt, Homo sapiens
aaauucagguucuaacaga

SEQ ID NO: 995331 - RNA, 19 nt, Homo sapiens
gggccaacacuuucucaua

SEQ ID NO: 995332 - RNA, 19 nt, Homo sapiens
ugauggaaguguaggguuu

SEQ ID NO: 995333 - RNA, 19 nt, Homo sapiens
uuaaguccaucuuguguug

SEQ ID NO: 995334 - RNA, 19 nt, Homo sapiens
gcccacauuuguaauauag

SEQ ID NO: 995335 - RNA, 19 nt, Homo sapiens
agacagagguaaguguauu

SEQ ID NO: 995336 - RNA, 19 nt, Homo sapiens
gaaagugauacuaagaaug

SEQ ID NO: 995337 - RNA, 19 nt, Homo sapiens
guacagcgauuacgucaag

SEQ ID NO: 995338 - RNA, 19 nt, Homo sapiens
ccugguacauuccuaauaa

SEQ ID NO: 995339 - RNA, 19 nt, Homo sapiens
gagagggucuuagcaggua

SEQ ID NO: 995340 - RNA, 19 nt, Homo sapiens
guacauuccuaauaaagca

SEQ ID NO: 995341 - RNA, 19 nt, Homo sapiens
ccaccaagauguccauaca

SEQ ID NO: 995342 - RNA, 19 nt, Homo sapiens
gcgauuacgucaagaggau

SEQ ID NO: 995343 - RNA, 19 nt, Homo sapiens
ggagaaauggcacuaaugg

SEQ ID NO: 995344 - RNA, 19 nt, Homo sapiens
gaggaagacucgggaaucu

SEQ ID NO: 995345 - RNA, 19 nt, Homo sapiens
gguaccaccugacgacgaa

SEQ ID NO: 995346 - RNA, 19 nt, Homo sapiens
cggcugaggucucgugguu

SEQ ID NO: 995347 - RNA, 19 nt, Homo sapiens
guagcagcauacaggauuu

SEQ ID NO: 995348 - RNA, 19 nt, Homo sapiens
ucaaguagaggcuguguug

SEQ ID NO: 995349 - RNA, 19 nt, Homo sapiens
ccaggauuaugucugcuaa

SEQ ID NO: 995350 - RNA, 19 nt, Homo sapiens
gguagcagcauacaggauu

SEQ ID NO: 995351 - RNA, 19 nt, Homo sapiens
ggaaauggagacggagaaa

SEQ ID NO: 995352 - RNA, 19 nt, Homo sapiens
aaauggagacggagaaaug

SEQ ID NO: 995353 - RNA, 19 nt, Homo sapiens
ggacaucuuuucaaguaga

SEQ ID NO: 995354 - RNA, 19 nt, Homo sapiens
agucucagcugcuuacauc

SEQ ID NO: 995355 - RNA, 19 nt, Homo sapiens
cucaaucccugguacauuc

SEQ ID NO: 995356 - RNA, 19 nt, Homo sapiens
gaaauggagacggagaaau

SEQ ID NO: 995357 - RNA, 19 nt, Homo sapiens
caugcuaggugcuguguac

SEQ ID NO: 995358 - RNA, 19 nt, Homo sapiens
ggagggacaucuuuucaag

SEQ ID NO: 995359 - RNA, 19 nt, Homo sapiens
aaucuccacuggugccuau

SEQ ID NO: 995360 - RNA, 19 nt, Homo sapiens
acaggaugcuggagagaag

SEQ ID NO: 995361 - RNA, 19 nt, Homo sapiens
gcuuggugguagcagcaua

SEQ ID NO: 995362 - RNA, 19 nt, Homo sapiens
ggagugccucucucuagga

SEQ ID NO: 995363 - RNA, 19 nt, Homo sapiens
agggacaucuuuucaagua

SEQ ID NO: 995364 - RNA, 19 nt, Homo sapiens
acacaauguacagcgauua

SEQ ID NO: 995365 - RNA, 19 nt, Homo sapiens
acggagaaauggcacuaau

SEQ ID NO: 995366 - RNA, 19 nt, Homo sapiens
ccuuuccucuccagacuga

SEQ ID NO: 995367 - RNA, 19 nt, Homo sapiens
cugguacauuccuaauaaa

SEQ ID NO: 995368 - RNA, 19 nt, Homo sapiens
uagcagcauacaggauuua

SEQ ID NO: 995369 - RNA, 19 nt, Homo sapiens
aggauuaugucugcuaaca

SEQ ID NO: 995370 - RNA, 19 nt, Homo sapiens
gcacaggaugcuggagaga

SEQ ID NO: 995371 - RNA, 19 nt, Homo sapiens
uaaagcaguuuugaggaaa

SEQ ID NO: 995372 - RNA, 19 nt, Homo sapiens
ucuccagacugaggaauca

SEQ ID NO: 995373 - RNA, 19 nt, Homo sapiens
guggagugccucucucuag

SEQ ID NO: 995374 - RNA, 19 nt, Homo sapiens
auaaagcaguuuugaggaa

SEQ ID NO: 995375 - RNA, 19 nt, Homo sapiens
gcuauuacauugugcauua

SEQ ID NO: 995376 - RNA, 19 nt, Homo sapiens
ggcaaucccuuuauaauuu

SEQ ID NO: 995377 - RNA, 19 nt, Homo sapiens
uaagggaccucauugauaa

SEQ ID NO: 995378 - RNA, 19 nt, Homo sapiens
ggagguagaugcuuuaaau

SEQ ID NO: 995379 - RNA, 19 nt, Homo sapiens
gcagaaggcuauuucagaa

SEQ ID NO: 995380 - RNA, 19 nt, Homo sapiens
ggaaugaucuuuggcuaaa

SEQ ID NO: 995381 - RNA, 19 nt, Homo sapiens
ggaaaccacuucagagaug

SEQ ID NO: 995382 - RNA, 19 nt, Homo sapiens
gaacuuggcucaucuucca

SEQ ID NO: 995383 - RNA, 19 nt, Homo sapiens
gcuacuagaugaaagcuuu

SEQ ID NO: 995384 - RNA, 19 nt, Homo sapiens
gggcaagucucauuaacaa

SEQ ID NO: 995385 - RNA, 19 nt, Homo sapiens
gagucaagguuucuguuua

SEQ ID NO: 995386 - RNA, 19 nt, Homo sapiens
aaacaaugcuauuccauga

SEQ ID NO: 995387 - RNA, 19 nt, Homo sapiens
gaaccugccuucaaagcaa

SEQ ID NO: 995388 - RNA, 19 nt, Homo sapiens
caagauaaaucaagcagau

SEQ ID NO: 995389 - RNA, 19 nt, Homo sapiens
gauaguauggcaaguauuu

SEQ ID NO: 995390 - RNA, 19 nt, Homo sapiens
caggaaagcuaaagaacuu

SEQ ID NO: 995391 - RNA, 19 nt, Homo sapiens
ugaauaagcaugccuguuu

SEQ ID NO: 995392 - RNA, 19 nt, Homo sapiens
gguauacggugucagguuu

SEQ ID NO: 995393 - RNA, 19 nt, Homo sapiens
ugccaucacuuaacuauaa

SEQ ID NO: 995394 - RNA, 19 nt, Homo sapiens
gagagaggcuaucggaaga

SEQ ID NO: 995395 - RNA, 19 nt, Homo sapiens
aaacugcccucucaaaugu

SEQ ID NO: 995396 - RNA, 19 nt, Homo sapiens
gcacaaugccaucacuuaa

SEQ ID NO: 995397 - RNA, 19 nt, Homo sapiens
caaauaagaugugcugcuu

SEQ ID NO: 995398 - RNA, 19 nt, Homo sapiens
ugccugaucuuccuaauaa

SEQ ID NO: 995399 - RNA, 19 nt, Homo sapiens
ucucggcucuucugaaaua

SEQ ID NO: 995400 - RNA, 19 nt, Homo sapiens
caaacggaauggaagcaua

SEQ ID NO: 995401 - RNA, 19 nt, Homo sapiens
gaguguggcugcaaaguga

SEQ ID NO: 995402 - RNA, 19 nt, Homo sapiens
gggaagcuguccauugaaa

SEQ ID NO: 995403 - RNA, 19 nt, Homo sapiens
uaagggagcuuguauucug

SEQ ID NO: 995404 - RNA, 19 nt, Homo sapiens
gcaaucccuuuauaauuug

SEQ ID NO: 995405 - RNA, 19 nt, Homo sapiens
ggagauguuugaugauguu

SEQ ID NO: 995406 - RNA, 19 nt, Homo sapiens
gcaaucaugucauuucuac

SEQ ID NO: 995407 - RNA, 19 nt, Homo sapiens
caauggagguagaugcuuu

SEQ ID NO: 995408 - RNA, 19 nt, Homo sapiens
ccucacagcauguaaauaa

SEQ ID NO: 995409 - RNA, 19 nt, Homo sapiens
gugaaaagcuugaacauga

SEQ ID NO: 995410 - RNA, 19 nt, Homo sapiens
ugaaugaaguggaaacuca

SEQ ID NO: 995411 - RNA, 19 nt, Homo sapiens
gcaggaacccaguaggaua

SEQ ID NO: 995412 - RNA, 19 nt, Homo sapiens
cagaagagguggaauggau

SEQ ID NO: 995413 - RNA, 19 nt, Homo sapiens
aaagugguauuguacagua

SEQ ID NO: 995414 - RNA, 19 nt, Homo sapiens
caaagcaaguuucucaauc

SEQ ID NO: 995415 - RNA, 19 nt, Homo sapiens
gauggcagcagcaaguuua

SEQ ID NO: 995416 - RNA, 19 nt, Homo sapiens
gguaauggguacaacaaau

SEQ ID NO: 995417 - RNA, 19 nt, Homo sapiens
gaaaaggccuuggauuuau

SEQ ID NO: 995418 - RNA, 19 nt, Homo sapiens
gaucuaugcuuugaguuug

SEQ ID NO: 995419 - RNA, 19 nt, Homo sapiens
gcuguggucuccuugguaa

SEQ ID NO: 995420 - RNA, 19 nt, Homo sapiens
gcacuguucucaaccaaag

SEQ ID NO: 995421 - RNA, 19 nt, Homo sapiens
ccacuggccuggcaauuuc

SEQ ID NO: 995422 - RNA, 19 nt, Homo sapiens
gauaagggagcuuguauuc

SEQ ID NO: 995423 - RNA, 19 nt, Homo sapiens
gggcaaucccuuuauaauu

SEQ ID NO: 995424 - RNA, 19 nt, Homo sapiens
gagcugauuccuauguaua

SEQ ID NO: 995425 - RNA, 19 nt, Homo sapiens
gggauaguauggcaaguau

SEQ ID NO: 995426 - RNA, 19 nt, Homo sapiens
ccuauggucuggaaauuug

SEQ ID NO: 995427 - RNA, 19 nt, Homo sapiens
gaaaagcaaugaauaagca

SEQ ID NO: 995428 - RNA, 19 nt, Homo sapiens
ugaauaaguucuagugagu

SEQ ID NO: 995429 - RNA, 19 nt, Homo sapiens
gcacagaaggcugggauuu

SEQ ID NO: 995430 - RNA, 19 nt, Homo sapiens
ccagaagcauagcuauaaa

SEQ ID NO: 995431 - RNA, 19 nt, Homo sapiens
caauauugaugcugagguu

SEQ ID NO: 995432 - RNA, 19 nt, Homo sapiens
cuaagggaccucauugaua

SEQ ID NO: 995433 - RNA, 19 nt, Homo sapiens
gaucgggcaagucucauua

SEQ ID NO: 995434 - RNA, 19 nt, Homo sapiens
aaucugcucuguuguuuga

SEQ ID NO: 995435 - RNA, 19 nt, Homo sapiens
aaagcaaguuucucaauca

SEQ ID NO: 995436 - RNA, 19 nt, Homo sapiens
ucucaaauguugcuaggaa

SEQ ID NO: 995437 - RNA, 19 nt, Homo sapiens
aaacaugacgauuccauaa

SEQ ID NO: 995438 - RNA, 19 nt, Homo sapiens
uguaaaagcucaaacauga

SEQ ID NO: 995439 - RNA, 19 nt, Homo sapiens
ggugaaaucugugacuguu

SEQ ID NO: 995440 - RNA, 19 nt, Homo sapiens
gcaaguuucucaaucaaaa

SEQ ID NO: 995441 - RNA, 19 nt, Homo sapiens
gaacugaggauacuagcau

SEQ ID NO: 995442 - RNA, 19 nt, Homo sapiens
ucaauuaucaggaaagcua

SEQ ID NO: 995443 - RNA, 19 nt, Homo sapiens
ccagguagguagagcaaga

SEQ ID NO: 995444 - RNA, 19 nt, Homo sapiens
gcacuuuauugcacuuuca

SEQ ID NO: 995445 - RNA, 19 nt, Homo sapiens
acaaaucaauucuccacaa

SEQ ID NO: 995446 - RNA, 19 nt, Homo sapiens
gaauuugcccucugcagaa

SEQ ID NO: 995447 - RNA, 19 nt, Homo sapiens
ucuuagcgcugacgcauuu

SEQ ID NO: 995448 - RNA, 19 nt, Homo sapiens
gacuauguguacaauguuu

SEQ ID NO: 995449 - RNA, 19 nt, Homo sapiens
gaagcaagagcacuacaug

SEQ ID NO: 995450 - RNA, 19 nt, Homo sapiens
gcacugaagcaucuccaaa

SEQ ID NO: 995451 - RNA, 19 nt, Homo sapiens
gauacuagcaucaacacaa

SEQ ID NO: 995452 - RNA, 19 nt, Homo sapiens
gcuauuccaugacguuugu

SEQ ID NO: 995453 - RNA, 19 nt, Homo sapiens
gagguggaauggaucaaau

SEQ ID NO: 995454 - RNA, 19 nt, Homo sapiens
gagaaucugcucuguuguu

SEQ ID NO: 995455 - RNA, 19 nt, Homo sapiens
gacaacauauagagaaucu

SEQ ID NO: 995456 - RNA, 19 nt, Homo sapiens
ggagucaagguuucuguuu

SEQ ID NO: 995457 - RNA, 19 nt, Homo sapiens
ucacuaugcuggcaaucuu

SEQ ID NO: 995458 - RNA, 19 nt, Homo sapiens
gaauaagcaugccuguuuu

SEQ ID NO: 995459 - RNA, 19 nt, Homo sapiens
caaaucaauucuccacaag

SEQ ID NO: 995460 - RNA, 19 nt, Homo sapiens
ccacaaauucuuacacuca

SEQ ID NO: 995461 - RNA, 19 nt, Homo sapiens
acacagcagucagcaguaa

SEQ ID NO: 995462 - RNA, 19 nt, Homo sapiens
aaaccaugaugaacacuug

SEQ ID NO: 995463 - RNA, 19 nt, Homo sapiens
gaggaccugugggauagua

SEQ ID NO: 995464 - RNA, 19 nt, Homo sapiens
ucaggaguuuccacaaauu

SEQ ID NO: 995465 - RNA, 19 nt, Homo sapiens
gggcaugaauggcuauuac

SEQ ID NO: 995466 - RNA, 19 nt, Homo sapiens
ugaauaugcuaagggagua

SEQ ID NO: 995467 - RNA, 19 nt, Homo sapiens
cugaaggacucauagaaga

SEQ ID NO: 995468 - RNA, 19 nt, Homo sapiens
gcuaaacugcccucucaaa

SEQ ID NO: 995469 - RNA, 19 nt, Homo sapiens
caaauggucccuugcaauc

SEQ ID NO: 995470 - RNA, 19 nt, Homo sapiens
caaacaugacgauuccaua

SEQ ID NO: 995471 - RNA, 19 nt, Homo sapiens
uugggaagcuguccauuga

SEQ ID NO: 995472 - RNA, 19 nt, Homo sapiens
ugaggauuauuucagcaua

SEQ ID NO: 995473 - RNA, 19 nt, Homo sapiens
gcaccuagccaucuccaau

SEQ ID NO: 995474 - RNA, 19 nt, Homo sapiens
acacaguugucauucacua

SEQ ID NO: 995475 - RNA, 19 nt, Homo sapiens
gcaacgagcuggacaccuu

SEQ ID NO: 995476 - RNA, 19 nt, Homo sapiens
gcaccgagcucuuccacuu

SEQ ID NO: 995477 - RNA, 19 nt, Homo sapiens
gcagugaccuguuccaaag

SEQ ID NO: 995478 - RNA, 19 nt, Homo sapiens
ggacgucgcugugcugguu

SEQ ID NO: 995479 - RNA, 19 nt, Homo sapiens
aaacugucaugcauagaua

SEQ ID NO: 995480 - RNA, 19 nt, Homo sapiens
ucaagggucuccaggauga

SEQ ID NO: 995481 - RNA, 19 nt, Homo sapiens
gaaccgccaucccuuggaa

SEQ ID NO: 995482 - RNA, 19 nt, Homo sapiens
gcacacacaauuaucugua

SEQ ID NO: 995483 - RNA, 19 nt, Homo sapiens
gcuggaagcugcagucuac

SEQ ID NO: 995484 - RNA, 19 nt, Homo sapiens
cagaugcgcucaccuaugg

SEQ ID NO: 995485 - RNA, 19 nt, Homo sapiens
gcccaggccugaacuccua

SEQ ID NO: 995486 - RNA, 19 nt, Homo sapiens
gcucagcccuguacaaggu

SEQ ID NO: 995487 - RNA, 19 nt, Homo sapiens
uaagacacauuggaguaaa

SEQ ID NO: 995488 - RNA, 19 nt, Homo sapiens
gguggugucugcaucuuau

SEQ ID NO: 995489 - RNA, 19 nt, Homo sapiens
acacauuccuggcuguuug

SEQ ID NO: 995490 - RNA, 19 nt, Homo sapiens
guaagacacauuggaguaa

SEQ ID NO: 995491 - RNA, 19 nt, Homo sapiens
guucuuggcugcccaccuu

SEQ ID NO: 995492 - RNA, 19 nt, Homo sapiens
aaagugugacuguguauuu

SEQ ID NO: 995493 - RNA, 19 nt, Homo sapiens
gggaaugucugugccuuca

SEQ ID NO: 995494 - RNA, 19 nt, Homo sapiens
gcaccucaggcaucuuuaa

SEQ ID NO: 995495 - RNA, 19 nt, Homo sapiens
ccacuucuacaucuucuuu

SEQ ID NO: 995496 - RNA, 19 nt, Homo sapiens
caccuucucuguccacuuc

SEQ ID NO: 995497 - RNA, 19 nt, Homo sapiens
gaaugucugugccuucacu

SEQ ID NO: 995498 - RNA, 19 nt, Homo sapiens
gugcccagcuucacuuaca

SEQ ID NO: 995499 - RNA, 19 nt, Homo sapiens
caaacugucaugcauagau

SEQ ID NO: 995500 - RNA, 19 nt, Homo sapiens
gcagaugcgcucaccuaug

SEQ ID NO: 995501 - RNA, 19 nt, Homo sapiens
gugcagaugcgcucaccua

SEQ ID NO: 995502 - RNA, 19 nt, Homo sapiens
gaccaaagugugacugugu

SEQ ID NO: 995503 - RNA, 19 nt, Homo sapiens
gcaagcugcugcgcacaca

SEQ ID NO: 995504 - RNA, 19 nt, Homo sapiens
uguaagacacauuggagua

SEQ ID NO: 995505 - RNA, 19 nt, Homo sapiens
ugucaagggucuccaggau

SEQ ID NO: 995506 - RNA, 19 nt, Homo sapiens
ggaaccucaucaucuucaa

SEQ ID NO: 995507 - RNA, 19 nt, Homo sapiens
cccaaacugucaugcauag

SEQ ID NO: 995508 - RNA, 19 nt, Homo sapiens
gcucuuccacuuccauguu

SEQ ID NO: 995509 - RNA, 19 nt, Homo sapiens
ugucaugcauagauaaugg

SEQ ID NO: 995510 - RNA, 19 nt, Homo sapiens
uuuggaaccucaucaucuu

SEQ ID NO: 995511 - RNA, 19 nt, Homo sapiens
gucuacaccuucaccaugu

SEQ ID NO: 995512 - RNA, 19 nt, Homo sapiens
gagucgauaugugcuggaa

SEQ ID NO: 995513 - RNA, 19 nt, Homo sapiens
accaaagugugacugugua

SEQ ID NO: 995514 - RNA, 19 nt, Homo sapiens
ccucaggcaucuuuaacgu

SEQ ID NO: 995515 - RNA, 19 nt, Homo sapiens
ccacugcccagaccaaagu

SEQ ID NO: 995516 - RNA, 19 nt, Homo sapiens
cccgcaagcugaguccuuu

SEQ ID NO: 995517 - RNA, 19 nt, Homo sapiens
caaagugugacuguguauu

SEQ ID NO: 995518 - RNA, 19 nt, Homo sapiens
ggaccacugcccagaccaa

SEQ ID NO: 995519 - RNA, 19 nt, Homo sapiens
ggacacauuccuggcuguu

SEQ ID NO: 995520 - RNA, 19 nt, Homo sapiens
aagcugcagucuacaccuu

SEQ ID NO: 995521 - RNA, 19 nt, Homo sapiens
cuacgugcguguggaaaca

SEQ ID NO: 995522 - RNA, 19 nt, Homo sapiens
ccgcaccucaggcaucuuu

SEQ ID NO: 995523 - RNA, 19 nt, Homo sapiens
aagacacauuggaguaaau

SEQ ID NO: 995524 - RNA, 19 nt, Homo sapiens
gcugcagucuacaccuuca

SEQ ID NO: 995525 - RNA, 19 nt, Homo sapiens
ccagcugugugugcaguug

SEQ ID NO: 995526 - RNA, 19 nt, Homo sapiens
gaaccucaucaucuucaag

SEQ ID NO: 995527 - RNA, 19 nt, Homo sapiens
cacacacaauuaucuguac

SEQ ID NO: 995528 - RNA, 19 nt, Homo sapiens
cugcugcgcacacacaauu

SEQ ID NO: 995529 - RNA, 19 nt, Homo sapiens
gccuuuuccugacugauua

SEQ ID NO: 995530 - RNA, 19 nt, Homo sapiens
ggucuacgugcguguggaa

SEQ ID NO: 995531 - RNA, 19 nt, Homo sapiens
ccaaagugugacuguguau

SEQ ID NO: 995532 - RNA, 19 nt, Homo sapiens
gccauucggagucgauaug

SEQ ID NO: 995533 - RNA, 19 nt, Homo sapiens
gcugcgcacacacaauuau

SEQ ID NO: 995534 - RNA, 19 nt, Homo sapiens
gacacauuccuggcuguuu

SEQ ID NO: 995535 - RNA, 19 nt, Homo sapiens
gaacugaucagccgacuuu

SEQ ID NO: 995536 - RNA, 19 nt, Homo sapiens
gaaagaagacaaacagaaa

SEQ ID NO: 995537 - RNA, 19 nt, Homo sapiens
ggacaaguuugacauuauu

SEQ ID NO: 995538 - RNA, 19 nt, Homo sapiens
ccaguucucugaaucuuua

SEQ ID NO: 995539 - RNA, 19 nt, Homo sapiens
gcacaguuaucaaaccuuu

SEQ ID NO: 995540 - RNA, 19 nt, Homo sapiens
ccaagaaccugggauaauu

SEQ ID NO: 995541 - RNA, 19 nt, Homo sapiens
guacugagccugugaagaa

SEQ ID NO: 995542 - RNA, 19 nt, Homo sapiens
guaccgaccuccagaacua

SEQ ID NO: 995543 - RNA, 19 nt, Homo sapiens
cagcaaagauggauggaaa

SEQ ID NO: 995544 - RNA, 19 nt, Homo sapiens
aaagagggcuucccaauca

SEQ ID NO: 995545 - RNA, 19 nt, Homo sapiens
uaacacaucuaaacacaga

SEQ ID NO: 995546 - RNA, 19 nt, Homo sapiens
gcaggcgacuuaggaaaua

SEQ ID NO: 995547 - RNA, 19 nt, Homo sapiens
ggaacuggcucagcuagaa

SEQ ID NO: 995548 - RNA, 19 nt, Homo sapiens
ugacauggccuucaaacua

SEQ ID NO: 995549 - RNA, 19 nt, Homo sapiens
gaaacuaccucagggacaa

SEQ ID NO: 995550 - RNA, 19 nt, Homo sapiens
ggacaaagacacaggagaa

SEQ ID NO: 995551 - RNA, 19 nt, Homo sapiens
guucaaagcguucgaauga

SEQ ID NO: 995552 - RNA, 19 nt, Homo sapiens
gaaccugggauaauucuuu

SEQ ID NO: 995553 - RNA, 19 nt, Homo sapiens
ucucauaccucgagcaauu

SEQ ID NO: 995554 - RNA, 19 nt, Homo sapiens
gcaaagcuguccguuguau

SEQ ID NO: 995555 - RNA, 19 nt, Homo sapiens
cagcugacaugcagaauau

SEQ ID NO: 995556 - RNA, 19 nt, Homo sapiens
gaaggaaauugucacagau

SEQ ID NO: 995557 - RNA, 19 nt, Homo sapiens
cgagaagcaucuuguuaaa

SEQ ID NO: 995558 - RNA, 19 nt, Homo sapiens
gagaggaucauuacauuga

SEQ ID NO: 995559 - RNA, 19 nt, Homo sapiens
gaagagagaaagaacaguu

SEQ ID NO: 995560 - RNA, 19 nt, Homo sapiens
caacucagucuucugcuua

SEQ ID NO: 995561 - RNA, 19 nt, Homo sapiens
ugaauuggcaguguuauua

SEQ ID NO: 995562 - RNA, 19 nt, Homo sapiens
ggaaagggaaugcccaauu

SEQ ID NO: 995563 - RNA, 19 nt, Homo sapiens
ugaaggaaauugucacaga

SEQ ID NO: 995564 - RNA, 19 nt, Homo sapiens
gcuauagccagaacauuua

SEQ ID NO: 995565 - RNA, 19 nt, Homo sapiens
gagguaaucaucugcauuu

SEQ ID NO: 995566 - RNA, 19 nt, Homo sapiens
gaaccuauggccaaguaua

SEQ ID NO: 995567 - RNA, 19 nt, Homo sapiens
agacauucaucuucucaua

SEQ ID NO: 995568 - RNA, 19 nt, Homo sapiens
gcacaaagaccggaguaaa

SEQ ID NO: 995569 - RNA, 19 nt, Homo sapiens
caagaagucuccagcaagu

SEQ ID NO: 995570 - RNA, 19 nt, Homo sapiens
ccgaagaacucccacaaug

SEQ ID NO: 995571 - RNA, 19 nt, Homo sapiens
cagaacagaugacccuuga

SEQ ID NO: 995572 - RNA, 19 nt, Homo sapiens
cuacagagcgacuuccuua

SEQ ID NO: 995573 - RNA, 19 nt, Homo sapiens
ggaaagaacgggagcugaa

SEQ ID NO: 995574 - RNA, 19 nt, Homo sapiens
cauccaagcuccacaagga

SEQ ID NO: 995575 - RNA, 19 nt, Homo sapiens
aagaacaguuucaguauug

SEQ ID NO: 995576 - RNA, 19 nt, Homo sapiens
caaaauccuucgucaguua

SEQ ID NO: 995577 - RNA, 19 nt, Homo sapiens
uaaacaagaugcacuggau

SEQ ID NO: 995578 - RNA, 19 nt, Homo sapiens
auacugaacuggugaaugu

SEQ ID NO: 995579 - RNA, 19 nt, Homo sapiens
gcacauaaagcagguugua

SEQ ID NO: 995580 - RNA, 19 nt, Homo sapiens
guagaaguccugcauauuc

SEQ ID NO: 995581 - RNA, 19 nt, Homo sapiens
cauaucaagucguucauga

SEQ ID NO: 995582 - RNA, 19 nt, Homo sapiens
caaagacacaggagaacua

SEQ ID NO: 995583 - RNA, 19 nt, Homo sapiens
cuucaacucuaccuuagua

SEQ ID NO: 995584 - RNA, 19 nt, Homo sapiens
aaacaggacuuauggaaac

SEQ ID NO: 995585 - RNA, 19 nt, Homo sapiens
gaacagaugacccuugaag

SEQ ID NO: 995586 - RNA, 19 nt, Homo sapiens
gaaagagggcuucccaauc

SEQ ID NO: 995587 - RNA, 19 nt, Homo sapiens
gcaauuaugacuccuacaa

SEQ ID NO: 995588 - RNA, 19 nt, Homo sapiens
gacauggccuucaaacuag

SEQ ID NO: 995589 - RNA, 19 nt, Homo sapiens
gaggaucauuacauugaaa

SEQ ID NO: 995590 - RNA, 19 nt, Homo sapiens
gcagagaccaaauugcaaa

SEQ ID NO: 995591 - RNA, 19 nt, Homo sapiens
gaagagagucgcccuuaca

SEQ ID NO: 995592 - RNA, 19 nt, Homo sapiens
guggacaaguuugacauua

SEQ ID NO: 995593 - RNA, 19 nt, Homo sapiens
gaaguagaaguccugcaua

SEQ ID NO: 995594 - RNA, 19 nt, Homo sapiens
ugaggagacugaugacuau

SEQ ID NO: 995595 - RNA, 19 nt, Homo sapiens
cacaacagcugaaucaaag

SEQ ID NO: 995596 - RNA, 19 nt, Homo sapiens
cugcagcacuugauuuauu

SEQ ID NO: 995597 - RNA, 19 nt, Homo sapiens
gaauaacagugggcaaauc

SEQ ID NO: 995598 - RNA, 19 nt, Homo sapiens
agaguggccuggcugauuu

SEQ ID NO: 995599 - RNA, 19 nt, Homo sapiens
cagaauauauuggcaguuc

SEQ ID NO: 995600 - RNA, 19 nt, Homo sapiens
gaauuggcaguguuauuaa

SEQ ID NO: 995601 - RNA, 19 nt, Homo sapiens
gaacagaggacacgucacu

SEQ ID NO: 995602 - RNA, 19 nt, Homo sapiens
aagcagcaauucuguggua

SEQ ID NO: 995603 - RNA, 19 nt, Homo sapiens
ggacuuauggaaacacuga

SEQ ID NO: 995604 - RNA, 19 nt, Homo sapiens
cgaaugaggagacugauga

SEQ ID NO: 995605 - RNA, 19 nt, Homo sapiens
gagacuagacaaugagaaa

SEQ ID NO: 995606 - RNA, 19 nt, Homo sapiens
gcugaagucugggcacaaa

SEQ ID NO: 995607 - RNA, 19 nt, Homo sapiens
gaacauuuacuucaacucu

SEQ ID NO: 995608 - RNA, 19 nt, Homo sapiens
caaauggcacagcugcuua

SEQ ID NO: 995609 - RNA, 19 nt, Homo sapiens
gccaugaguuguggaguaa

SEQ ID NO: 995610 - RNA, 19 nt, Homo sapiens
gagagucgcccuuacacaa

SEQ ID NO: 995611 - RNA, 19 nt, Homo sapiens
ucaagucguucaugaaaca

SEQ ID NO: 995612 - RNA, 19 nt, Homo sapiens
ggaaauugucacagauaaa

SEQ ID NO: 995613 - RNA, 19 nt, Homo sapiens
gaacuaguggcucugaaga

SEQ ID NO: 995614 - RNA, 19 nt, Homo sapiens
ucaaagacaucugcugugu

SEQ ID NO: 995615 - RNA, 19 nt, Homo sapiens
gaaagcacagggaacaaga

SEQ ID NO: 995616 - RNA, 19 nt, Homo sapiens
ggaaaguaaaguuggauga

SEQ ID NO: 995617 - RNA, 19 nt, Homo sapiens
uggagaggaucauuacauu

SEQ ID NO: 995618 - RNA, 19 nt, Homo sapiens
gccagaacauuuacuucaa

SEQ ID NO: 995619 - RNA, 19 nt, Homo sapiens
cugcaaagcuguccguugu

SEQ ID NO: 995620 - RNA, 19 nt, Homo sapiens
ucagauacagggaaaguaa

SEQ ID NO: 995621 - RNA, 19 nt, Homo sapiens
gccaagaagucuccagcaa

SEQ ID NO: 995622 - RNA, 19 nt, Homo sapiens
caaacaggacuuauggaaa

SEQ ID NO: 995623 - RNA, 19 nt, Homo sapiens
ugaaaccgaagaagcaaua

SEQ ID NO: 995624 - RNA, 19 nt, Homo sapiens
ugaagaaggugagacuaga

SEQ ID NO: 995625 - RNA, 19 nt, Homo sapiens
uccaugaaguccagaagua

SEQ ID NO: 995626 - RNA, 19 nt, Homo sapiens
caaagugaauuggcagugu

SEQ ID NO: 995627 - RNA, 19 nt, Homo sapiens
guuuggagcuguggaugua

SEQ ID NO: 995628 - RNA, 19 nt, Homo sapiens
ggacuugcucggcucuaua

SEQ ID NO: 995629 - RNA, 19 nt, Homo sapiens
acagaggacacgucacuua

SEQ ID NO: 995630 - RNA, 19 nt, Homo sapiens
caaaggagacagaaacauc

SEQ ID NO: 995631 - RNA, 19 nt, Homo sapiens
ccgagaagcaucuuguuaa

SEQ ID NO: 995632 - RNA, 19 nt, Homo sapiens
guccaaggguucaccugua

SEQ ID NO: 995633 - RNA, 19 nt, Homo sapiens
uagaaguccugcauauuca

SEQ ID NO: 995634 - RNA, 19 nt, Homo sapiens
gggaaacacccaaaaguua

SEQ ID NO: 995635 - RNA, 19 nt, Homo sapiens
guacagaacuugaggaaga

SEQ ID NO: 995636 - RNA, 19 nt, Homo sapiens
gaaggcaacugaugacuau

SEQ ID NO: 995637 - RNA, 19 nt, Homo sapiens
caacauggcugugaauuau

SEQ ID NO: 995638 - RNA, 19 nt, Homo sapiens
gaugaucccuuucagauga

SEQ ID NO: 995639 - RNA, 19 nt, Homo sapiens
cuacuuaccugcuggauuu

SEQ ID NO: 995640 - RNA, 19 nt, Homo sapiens
gcagaggacugucuuuaug

SEQ ID NO: 995641 - RNA, 19 nt, Homo sapiens
ggaaagggaucguggaaca

SEQ ID NO: 995642 - RNA, 19 nt, Homo sapiens
gcaaagauaagaucaguga

SEQ ID NO: 995643 - RNA, 19 nt, Homo sapiens
gagagaauguacaagauga

SEQ ID NO: 995644 - RNA, 19 nt, Homo sapiens
gagccgagauugcaccuuu

SEQ ID NO: 995645 - RNA, 19 nt, Homo sapiens
ccagauagguacagaacuu

SEQ ID NO: 995646 - RNA, 19 nt, Homo sapiens
ugaaguacauugagacaga

SEQ ID NO: 995647 - RNA, 19 nt, Homo sapiens
ugaagaaacugaaggaaag

SEQ ID NO: 995648 - RNA, 19 nt, Homo sapiens
agacagagcuaaagaagag

SEQ ID NO: 995649 - RNA, 19 nt, Homo sapiens
ggaagagaccagauaggua

SEQ ID NO: 995650 - RNA, 19 nt, Homo sapiens
gagcucaacugcgcccaua

SEQ ID NO: 995651 - RNA, 19 nt, Homo sapiens
caucaugucuucugcuuuc

SEQ ID NO: 995652 - RNA, 19 nt, Homo sapiens
cagaggagguucgauuaaa

SEQ ID NO: 995653 - RNA, 19 nt, Homo sapiens
ggaugaggaugcagacaug

SEQ ID NO: 995654 - RNA, 19 nt, Homo sapiens
ccaacauggcugugaauua

SEQ ID NO: 995655 - RNA, 19 nt, Homo sapiens
cuauaucccucccaugaaa

SEQ ID NO: 995656 - RNA, 19 nt, Homo sapiens
ggacugucuuuaugaacuu

SEQ ID NO: 995657 - RNA, 19 nt, Homo sapiens
augcagacaugaugaagua

SEQ ID NO: 995658 - RNA, 19 nt, Homo sapiens
caaagaagaccgaggagau

SEQ ID NO: 995659 - RNA, 19 nt, Homo sapiens
ggugugauaauacucuuua

SEQ ID NO: 995660 - RNA, 19 nt, Homo sapiens
gggagagaauguacaagau

SEQ ID NO: 995661 - RNA, 19 nt, Homo sapiens
ggacaguuccagaaacaga

SEQ ID NO: 995662 - RNA, 19 nt, Homo sapiens
gggcaaagauaagaucagu

SEQ ID NO: 995663 - RNA, 19 nt, Homo sapiens
ggcaaacucuauucuugug

SEQ ID NO: 995664 - RNA, 19 nt, Homo sapiens
gcggacaguuccagaaaca

SEQ ID NO: 995665 - RNA, 19 nt, Homo sapiens
ccgaggagaugcuuuccaa

SEQ ID NO: 995666 - RNA, 19 nt, Homo sapiens
ggagagaauguacaagaug

SEQ ID NO: 995667 - RNA, 19 nt, Homo sapiens
gaugagaucagaaggauac

SEQ ID NO: 995668 - RNA, 19 nt, Homo sapiens
caugaggaacagaaaguua

SEQ ID NO: 995669 - RNA, 19 nt, Homo sapiens
gcaggagaauugcuugaac

SEQ ID NO: 995670 - RNA, 19 nt, Homo sapiens
guacugaguugugcagagu

SEQ ID NO: 995671 - RNA, 19 nt, Homo sapiens
cagagcagcagaacaagaa

SEQ ID NO: 995672 - RNA, 19 nt, Homo sapiens
gaaaguuaagccaaagaau

SEQ ID NO: 995673 - RNA, 19 nt, Homo sapiens
ucagaaggauacugguguu

SEQ ID NO: 995674 - RNA, 19 nt, Homo sapiens
gcagagugggauguaaaua

SEQ ID NO: 995675 - RNA, 19 nt, Homo sapiens
aaaguuaagccaaagaaug

SEQ ID NO: 995676 - RNA, 19 nt, Homo sapiens
aacagaaaguuaagccaaa

SEQ ID NO: 995677 - RNA, 19 nt, Homo sapiens
gaacaugaggaacagaaag

SEQ ID NO: 995678 - RNA, 19 nt, Homo sapiens
gaucguggaacaugaggaa

SEQ ID NO: 995679 - RNA, 19 nt, Homo sapiens
gaaggauacugguguuuuc

SEQ ID NO: 995680 - RNA, 19 nt, Homo sapiens
agagugggauguaaauauc

SEQ ID NO: 995681 - RNA, 19 nt, Homo sapiens
cagagugggauguaaauau

SEQ ID NO: 995682 - RNA, 19 nt, Homo sapiens
gaauaggcgguacugaguu

SEQ ID NO: 995683 - RNA, 19 nt, Homo sapiens
gcaagcguccugcuaacga

SEQ ID NO: 995684 - RNA, 19 nt, Homo sapiens
agaggacugucuuuaugaa

SEQ ID NO: 995685 - RNA, 19 nt, Homo sapiens
ggaacaugaggaacagaaa

SEQ ID NO: 995686 - RNA, 19 nt, Homo sapiens
gaggaaagggaucguggaa

SEQ ID NO: 995687 - RNA, 19 nt, Homo sapiens
gcagagcagcagaacaaga

SEQ ID NO: 995688 - RNA, 19 nt, Homo sapiens
aauaggcgguacugaguug

SEQ ID NO: 995689 - RNA, 19 nt, Homo sapiens
cuaccaacauggcugugaa

SEQ ID NO: 995690 - RNA, 19 nt, Homo sapiens
auagaugcaucaugucuuc

SEQ ID NO: 995691 - RNA, 19 nt, Homo sapiens
aaacuaccacacaaagaaa

SEQ ID NO: 995692 - RNA, 19 nt, Homo sapiens
gagaccagccugaccaaca

SEQ ID NO: 995693 - RNA, 19 nt, Homo sapiens
uggcagagcagcagaacaa

SEQ ID NO: 995694 - RNA, 19 nt, Homo sapiens
ucagaggagguucgauuaa

SEQ ID NO: 995695 - RNA, 19 nt, Homo sapiens
gagaccagauagguacaga

SEQ ID NO: 995696 - RNA, 19 nt, Homo sapiens
cagaggacugucuuuauga

SEQ ID NO: 995697 - RNA, 19 nt, Homo sapiens
gggcaaacucuauucuugu

SEQ ID NO: 995698 - RNA, 19 nt, Homo sapiens
gagacagagcuaaagaaga

SEQ ID NO: 995699 - RNA, 19 nt, Homo sapiens
gacaugaugaaguacauug

SEQ ID NO: 995700 - RNA, 19 nt, Homo sapiens
caacagauuuuaucaugag

SEQ ID NO: 995701 - RNA, 19 nt, Homo sapiens
guacauugagacagagcua

SEQ ID NO: 995702 - RNA, 19 nt, Homo sapiens
gcaaacucuauucuuguga

SEQ ID NO: 995703 - RNA, 19 nt, Homo sapiens
cuaacgagaaggcaacuga

SEQ ID NO: 995704 - RNA, 19 nt, Homo sapiens
gugguaugguggauaugaa

SEQ ID NO: 995705 - RNA, 19 nt, Homo sapiens
ggggcaaacucuauucuug

SEQ ID NO: 995706 - RNA, 19 nt, Homo sapiens
gugcagagugggauguaaa

SEQ ID NO: 995707 - RNA, 19 nt, Homo sapiens
gagaauguacaagaugaga

SEQ ID NO: 995708 - RNA, 19 nt, Homo sapiens
ugaauaggcgguacugagu

SEQ ID NO: 995709 - RNA, 19 nt, Homo sapiens
uaugguggauaugaagaaa

SEQ ID NO: 995710 - RNA, 19 nt, Homo sapiens
cacaacagauuuuaucaug

SEQ ID NO: 995711 - RNA, 19 nt, Homo sapiens
gagcagcagaacaagaaga

SEQ ID NO: 995712 - RNA, 19 nt, Homo sapiens
ugaagacagugugguaugg

SEQ ID NO: 995713 - RNA, 19 nt, Homo sapiens
gaggaugcagacaugauga

SEQ ID NO: 995714 - RNA, 19 nt, Homo sapiens
cuguuaguccuucuacuua

SEQ ID NO: 995715 - RNA, 19 nt, Homo sapiens
ccuguaaucccagcacuuu

SEQ ID NO: 995716 - RNA, 19 nt, Homo sapiens
agaaggcaacugaugacua

SEQ ID NO: 995717 - RNA, 19 nt, Homo sapiens
gcagacaugaugaaguaca

SEQ ID NO: 995718 - RNA, 19 nt, Homo sapiens
gaugaagacagugugguau

SEQ ID NO: 995719 - RNA, 19 nt, Homo sapiens
agaccagccugaccaacau

SEQ ID NO: 995720 - RNA, 19 nt, Homo sapiens
gaauguacaagaugagacu

SEQ ID NO: 995721 - RNA, 19 nt, Homo sapiens
cagcagaacaagaagaaag

SEQ ID NO: 995722 - RNA, 19 nt, Homo sapiens
gaugaaguacauugagaca

SEQ ID NO: 995723 - RNA, 19 nt, Homo sapiens
ggauacugguguuuucuga

SEQ ID NO: 995724 - RNA, 19 nt, Homo sapiens
ggaugagaucagaaggaua

SEQ ID NO: 995725 - RNA, 19 nt, Homo sapiens
agaugaagacaguguggua

SEQ ID NO: 995726 - RNA, 19 nt, Homo sapiens
aaagaagaccgaggagaug

SEQ ID NO: 995727 - RNA, 19 nt, Homo sapiens
gaaugcagaggacugucuu

SEQ ID NO: 995728 - RNA, 19 nt, Homo sapiens
ucuauucuugugagcauua

SEQ ID NO: 995729 - RNA, 19 nt, Homo sapiens
guggauaugaagaaacuga

SEQ ID NO: 995730 - RNA, 19 nt, Homo sapiens
cagacaugaugaaguacau

SEQ ID NO: 995731 - RNA, 19 nt, Homo sapiens
gaaaggggcaaagauaaga

SEQ ID NO: 995732 - RNA, 19 nt, Homo sapiens
ucgccuuccucucccuaua

SEQ ID NO: 995733 - RNA, 19 nt, Homo sapiens
ggugggagagaauguacaa

SEQ ID NO: 995734 - RNA, 19 nt, Homo sapiens
gaagaccgaggagaugcuu

SEQ ID NO: 995735 - RNA, 19 nt, Homo sapiens
guacagaacuugaggaaga

SEQ ID NO: 995736 - RNA, 19 nt, Homo sapiens
gaaggcaacugaugacuau

SEQ ID NO: 995737 - RNA, 19 nt, Homo sapiens
caacauggcugugaauuau

SEQ ID NO: 995738 - RNA, 19 nt, Homo sapiens
gaugaucccuuucagauga

SEQ ID NO: 995739 - RNA, 19 nt, Homo sapiens
cuacuuaccugcuggauuu

SEQ ID NO: 995740 - RNA, 19 nt, Homo sapiens
gcagaggacugucuuuaug

SEQ ID NO: 995741 - RNA, 19 nt, Homo sapiens
ggaaagggaucguggaaca

SEQ ID NO: 995742 - RNA, 19 nt, Homo sapiens
gcaaagauaagaucaguga

SEQ ID NO: 995743 - RNA, 19 nt, Homo sapiens
gagccgagauugcaccuuu

SEQ ID NO: 995744 - RNA, 19 nt, Homo sapiens
ugaaguacauugagacaga

SEQ ID NO: 995745 - RNA, 19 nt, Homo sapiens
ugaagaaacugaaggaaag

SEQ ID NO: 995746 - RNA, 19 nt, Homo sapiens
agacagagcuaaagaagag

SEQ ID NO: 995747 - RNA, 19 nt, Homo sapiens
ccagagagguacagaacuu

SEQ ID NO: 995748 - RNA, 19 nt, Homo sapiens
caucaugucuucugcuuuc

SEQ ID NO: 995749 - RNA, 19 nt, Homo sapiens
ggaagagaccagagaggua

SEQ ID NO: 995750 - RNA, 19 nt, Homo sapiens
cagaggagguucgauuaaa

SEQ ID NO: 995751 - RNA, 19 nt, Homo sapiens
ggaugaggaugcagacaug

SEQ ID NO: 995752 - RNA, 19 nt, Homo sapiens
ccaacauggcugugaauua

SEQ ID NO: 995753 - RNA, 19 nt, Homo sapiens
cuauaucccucccaugaaa

SEQ ID NO: 995754 - RNA, 19 nt, Homo sapiens
ggacugucuuuaugaacuu

SEQ ID NO: 995755 - RNA, 19 nt, Homo sapiens
augcagacaugaugaagua

SEQ ID NO: 995756 - RNA, 19 nt, Homo sapiens
caaagaagaccgaggagau

SEQ ID NO: 995757 - RNA, 19 nt, Homo sapiens
ggugugauaauacucuuua

SEQ ID NO: 995758 - RNA, 19 nt, Homo sapiens
gcacagugggauguaaaua

SEQ ID NO: 995759 - RNA, 19 nt, Homo sapiens
ggacaguuccagaaacaga

SEQ ID NO: 995760 - RNA, 19 nt, Homo sapiens
gggcaaagauaagaucagu

SEQ ID NO: 995761 - RNA, 19 nt, Homo sapiens
gcggacaguuccagaaaca

SEQ ID NO: 995762 - RNA, 19 nt, Homo sapiens
ccgaggagaugcuuuccaa

SEQ ID NO: 995763 - RNA, 19 nt, Homo sapiens
gaugagaucagaaggauac

SEQ ID NO: 995764 - RNA, 19 nt, Homo sapiens
caugaggaacagaaaguua

SEQ ID NO: 995765 - RNA, 19 nt, Homo sapiens
gcaggagaauugcuugaac

SEQ ID NO: 995766 - RNA, 19 nt, Homo sapiens
cagagcagcagaacaagaa

SEQ ID NO: 995767 - RNA, 19 nt, Homo sapiens
gaaaguuaagccaaagaau

SEQ ID NO: 995768 - RNA, 19 nt, Homo sapiens
ucagaaggauacugguguu

SEQ ID NO: 995769 - RNA, 19 nt, Homo sapiens
aaaguuaagccaaagaaug

SEQ ID NO: 995770 - RNA, 19 nt, Homo sapiens
aacagaaaguuaagccaaa

SEQ ID NO: 995771 - RNA, 19 nt, Homo sapiens
gaacaugaggaacagaaag

SEQ ID NO: 995772 - RNA, 19 nt, Homo sapiens
gaucguggaacaugaggaa

SEQ ID NO: 995773 - RNA, 19 nt, Homo sapiens
gaaggauacugguguuuuc

SEQ ID NO: 995774 - RNA, 19 nt, Homo sapiens
acagugggauguaaauauc

SEQ ID NO: 995775 - RNA, 19 nt, Homo sapiens
gaauaggcgguacugaguu

SEQ ID NO: 995776 - RNA, 19 nt, Homo sapiens
gcaagcguccugcuaacga

SEQ ID NO: 995777 - RNA, 19 nt, Homo sapiens
agaggacugucuuuaugaa

SEQ ID NO: 995778 - RNA, 19 nt, Homo sapiens
ggaacaugaggaacagaaa

SEQ ID NO: 995779 - RNA, 19 nt, Homo sapiens
gaggaaagggaucguggaa

SEQ ID NO: 995780 - RNA, 19 nt, Homo sapiens
caggugguaugguggauau

SEQ ID NO: 995781 - RNA, 19 nt, Homo sapiens
gcagagcagcagaacaaga

SEQ ID NO: 995782 - RNA, 19 nt, Homo sapiens
aauaggcgguacugaguug

SEQ ID NO: 995783 - RNA, 19 nt, Homo sapiens
cuaccaacauggcugugaa

SEQ ID NO: 995784 - RNA, 19 nt, Homo sapiens
auagaugcaucaugucuuc

SEQ ID NO: 995785 - RNA, 19 nt, Homo sapiens
gagaccagccugaccaaca

SEQ ID NO: 995786 - RNA, 19 nt, Homo sapiens
uggcagagcagcagaacaa

SEQ ID NO: 995787 - RNA, 19 nt, Homo sapiens
ucagaggagguucgauuaa

SEQ ID NO: 995788 - RNA, 19 nt, Homo sapiens
ggugagcauuauuaaaucu

SEQ ID NO: 995789 - RNA, 19 nt, Homo sapiens
gaugaagacaggugguaug

SEQ ID NO: 995790 - RNA, 19 nt, Homo sapiens
cagaggacugucuuuauga

SEQ ID NO: 995791 - RNA, 19 nt, Homo sapiens
gagacagagcuaaagaaga

SEQ ID NO: 995792 - RNA, 19 nt, Homo sapiens
gacaugaugaaguacauug

SEQ ID NO: 995793 - RNA, 19 nt, Homo sapiens
caacagauuuuaucaugag

SEQ ID NO: 995794 - RNA, 19 nt, Homo sapiens
guacauugagacagagcua

SEQ ID NO: 995795 - RNA, 19 nt, Homo sapiens
ucuauucuggugagcauua

SEQ ID NO: 995796 - RNA, 19 nt, Homo sapiens
cuaacgagaaggcaacuga

SEQ ID NO: 995797 - RNA, 19 nt, Homo sapiens
gugguaugguggauaugaa

SEQ ID NO: 995798 - RNA, 19 nt, Homo sapiens
cuggugagcauuauuaaau

SEQ ID NO: 995799 - RNA, 19 nt, Homo sapiens
cacagugggauguaaauau

SEQ ID NO: 995800 - RNA, 19 nt, Homo sapiens
ugaauaggcgguacugagu

SEQ ID NO: 995801 - RNA, 19 nt, Homo sapiens
uaugguggauaugaagaaa

SEQ ID NO: 995802 - RNA, 19 nt, Homo sapiens
cacaacagauuuuaucaug

SEQ ID NO: 995803 - RNA, 19 nt, Homo sapiens
gagcagcagaacaagaaga

SEQ ID NO: 995804 - RNA, 19 nt, Homo sapiens
gaggaugcagacaugauga

SEQ ID NO: 995805 - RNA, 19 nt, Homo sapiens
cuguuaguccuucuacuua

SEQ ID NO: 995806 - RNA, 19 nt, Homo sapiens
ccuguaaucccagcacuuu

SEQ ID NO: 995807 - RNA, 19 nt, Homo sapiens
agaaggcaacugaugacua

SEQ ID NO: 995808 - RNA, 19 nt, Homo sapiens
gcccauacggagaaacaaa

SEQ ID NO: 995809 - RNA, 19 nt, Homo sapiens
gaccagagagguacagaac

SEQ ID NO: 995810 - RNA, 19 nt, Homo sapiens
gcagacaugaugaaguaca

SEQ ID NO: 995811 - RNA, 19 nt, Homo sapiens
agaccagccugaccaacau

SEQ ID NO: 995812 - RNA, 19 nt, Homo sapiens
cagcagaacaagaagaaag

SEQ ID NO: 995813 - RNA, 19 nt, Homo sapiens
gaugaaguacauugagaca

SEQ ID NO: 995814 - RNA, 19 nt, Homo sapiens
ggauacugguguuuucuga

SEQ ID NO: 995815 - RNA, 19 nt, Homo sapiens
ggaugagaucagaaggaua

SEQ ID NO: 995816 - RNA, 19 nt, Homo sapiens
aaagaagaccgaggagaug

SEQ ID NO: 995817 - RNA, 19 nt, Homo sapiens
gaaugcagaggacugucuu

SEQ ID NO: 995818 - RNA, 19 nt, Homo sapiens
guggauaugaagaaacuga

SEQ ID NO: 995819 - RNA, 19 nt, Homo sapiens
ggugguaugguggauauga

SEQ ID NO: 995820 - RNA, 19 nt, Homo sapiens
cagacaugaugaaguacau

SEQ ID NO: 995821 - RNA, 19 nt, Homo sapiens
aaaacucugucucaaagaa

SEQ ID NO: 995822 - RNA, 19 nt, Homo sapiens
ucgccuuccucucccuaua

SEQ ID NO: 995823 - RNA, 19 nt, Homo sapiens
gaagaccgaggagaugcuu

SEQ ID NO: 995824 - RNA, 19 nt, Homo sapiens
gaaaggggcaaagauaaga

SEQ ID NO: 995825 - RNA, 19 nt, Homo sapiens
agaaaguuaagccaaagaa

SEQ ID NO: 995826 - RNA, 19 nt, Homo sapiens
aaacucugucucaaagaaa

SEQ ID NO: 995827 - RNA, 19 nt, Homo sapiens
cgagauugcaccuuuguac

SEQ ID NO: 995828 - RNA, 19 nt, Homo sapiens
gcaggacucagaggagguu

SEQ ID NO: 995829 - RNA, 19 nt, Homo sapiens
gaaagggaucguggaacau

SEQ ID NO: 995830 - RNA, 19 nt, Homo sapiens
gagcuaaagaagaggaaag

SEQ ID NO: 995831 - RNA, 19 nt, Homo sapiens
auucuggugagcauuauua

SEQ ID NO: 995832 - RNA, 19 nt, Homo sapiens
cccuauaucccucccauga

SEQ ID NO: 995833 - RNA, 19 nt, Homo sapiens
cagaugaagacagguggua

SEQ ID NO: 995834 - RNA, 19 nt, Homo sapiens
cuucgugccuaccaacaug

SEQ ID NO: 995835 - RNA, 19 nt, Homo sapiens
gaaggcagcuuucauuugu

SEQ ID NO: 995836 - RNA, 19 nt, Homo sapiens
ggaaggcagcuuucauuug

SEQ ID NO: 995837 - RNA, 19 nt, Homo sapiens
caauugauccuuucuacaa

SEQ ID NO: 995838 - RNA, 19 nt, Homo sapiens
gcucuccacucaucgauau

SEQ ID NO: 995839 - RNA, 19 nt, Homo sapiens
ggaugaaguugaaauucug

SEQ ID NO: 995840 - RNA, 19 nt, Homo sapiens
ugacaaggauggugacucu

SEQ ID NO: 995841 - RNA, 19 nt, Homo sapiens
caagugaggaugaaguuga

SEQ ID NO: 995842 - RNA, 19 nt, Homo sapiens
gcuggugcauggacucaaa

SEQ ID NO: 995843 - RNA, 19 nt, Homo sapiens
gcacaauugauccuuucua

SEQ ID NO: 995844 - RNA, 19 nt, Homo sapiens
gggaaggcagcuuucauuu

SEQ ID NO: 995845 - RNA, 19 nt, Homo sapiens
gugcauggacucaaacuug

SEQ ID NO: 995846 - RNA, 19 nt, Homo sapiens
gcagcuuucauuuguuuaa

SEQ ID NO: 995847 - RNA, 19 nt, Homo sapiens
acacauccaagucuacaua

SEQ ID NO: 995848 - RNA, 19 nt, Homo sapiens
gauccuuucuacaaugaau

SEQ ID NO: 995849 - RNA, 19 nt, Homo sapiens
gggcacaauugauccuuuc

SEQ ID NO: 995850 - RNA, 19 nt, Homo sapiens
aggcagcuuucauuuguuu

SEQ ID NO: 995851 - RNA, 19 nt, Homo sapiens
cggaggauuucgagucuug

SEQ ID NO: 995852 - RNA, 19 nt, Homo sapiens
caagcaacuucuucagaca

SEQ ID NO: 995853 - RNA, 19 nt, Homo sapiens
cccagaagcccguguuuga

SEQ ID NO: 995854 - RNA, 19 nt, Homo sapiens
gaucgucauuggccaguac

SEQ ID NO: 995855 - RNA, 19 nt, Homo sapiens
gcuggcagacugaauguug

SEQ ID NO: 995856 - RNA, 19 nt, Homo sapiens
gugcucagacggaccuaua

SEQ ID NO: 995857 - RNA, 19 nt, Homo sapiens
gagcugcuucugucacuga

SEQ ID NO: 995858 - RNA, 19 nt, Homo sapiens
cgucccagcucuccacuca

SEQ ID NO: 995859 - RNA, 19 nt, Homo sapiens
gaaaaugccagccuagugu

SEQ ID NO: 995860 - RNA, 19 nt, Homo sapiens
cacaauugauccuuucuac

SEQ ID NO: 995861 - RNA, 19 nt, Homo sapiens
caagaaggagcccauccaa

SEQ ID NO: 995862 - RNA, 19 nt, Homo sapiens
cugcuucugucacugaauu

SEQ ID NO: 995863 - RNA, 19 nt, Homo sapiens
uggcguacauucaguugga

SEQ ID NO: 995864 - RNA, 19 nt, Homo sapiens
gagccaagcaacuucuuca

SEQ ID NO: 995865 - RNA, 19 nt, Homo sapiens
uaaguucucccgccacugu

SEQ ID NO: 995866 - RNA, 19 nt, Homo sapiens
gcgacgauguggacucucu

SEQ ID NO: 995867 - RNA, 19 nt, Homo sapiens
gauuucgagucuugaguca

SEQ ID NO: 995868 - RNA, 19 nt, Homo sapiens
agccuaguguuuacaguuu

SEQ ID NO: 995869 - RNA, 19 nt, Homo sapiens
ccagucaagugaggaugaa

SEQ ID NO: 995870 - RNA, 19 nt, Homo sapiens
gccaagcaacuucuucaga

SEQ ID NO: 995871 - RNA, 19 nt, Homo sapiens
gcuguugccagucaaguga

SEQ ID NO: 995872 - RNA, 19 nt, Homo sapiens
guccagcuguugccaguca

SEQ ID NO: 995873 - RNA, 19 nt, Homo sapiens
gcgcuacaccuucgagauc

SEQ ID NO: 995874 - RNA, 19 nt, Homo sapiens
gaggaugaaguugaaauuc

SEQ ID NO: 995875 - RNA, 19 nt, Homo sapiens
acauucaguuggaaccauu

SEQ ID NO: 995876 - RNA, 19 nt, Homo sapiens
ugaggaugaaguugaaauu

SEQ ID NO: 995877 - RNA, 19 nt, Homo sapiens
aggaugaaguugaaauucu

SEQ ID NO: 995878 - RNA, 19 nt, Homo sapiens
gcagacugaauguugaugu

SEQ ID NO: 995879 - RNA, 19 nt, Homo sapiens
aagugaggaugaaguugaa

SEQ ID NO: 995880 - RNA, 19 nt, Homo sapiens
caacuucuucagacagaug

SEQ ID NO: 995881 - RNA, 19 nt, Homo sapiens
gcacuucagcacucaguac

SEQ ID NO: 995882 - RNA, 19 nt, Homo sapiens
caacaugaagagcagcaau

SEQ ID NO: 995883 - RNA, 19 nt, Homo sapiens
aagaagaacuggaaaaugc

SEQ ID NO: 995884 - RNA, 19 nt, Homo sapiens
aaaccaagaagacguccuu

SEQ ID NO: 995885 - RNA, 19 nt, Homo sapiens
cggcacugcugucagaagu

SEQ ID NO: 995886 - RNA, 19 nt, Homo sapiens
cagaccagaagaacucaaa

SEQ ID NO: 995887 - RNA, 19 nt, Homo sapiens
aguacgaccugcugcacaa

SEQ ID NO: 995888 - RNA, 19 nt, Homo sapiens
ucccagcucuccacucauc

SEQ ID NO: 995889 - RNA, 19 nt, Homo sapiens
uccuucagcuucaaaguuc

SEQ ID NO: 995890 - RNA, 19 nt, Homo sapiens
uugaaauucugggaccuuu

SEQ ID NO: 995891 - RNA, 19 nt, Homo sapiens
gggagcugcuucugucacu

SEQ ID NO: 995892 - RNA, 19 nt, Homo sapiens
ucuccacucaucgauauua

SEQ ID NO: 995893 - RNA, 19 nt, Homo sapiens
ggaucgucauuggccagua

SEQ ID NO: 995894 - RNA, 19 nt, Homo sapiens
ggaaaaugccagccuagug

SEQ ID NO: 995895 - RNA, 19 nt, Homo sapiens
cuucaaaguuccccaagaa

SEQ ID NO: 995896 - RNA, 19 nt, Homo sapiens
ugcauggacucaaacuugu

SEQ ID NO: 995897 - RNA, 19 nt, Homo sapiens
gacugaauguugaugucau

SEQ ID NO: 995898 - RNA, 19 nt, Homo sapiens
cagacugaauguugauguc

SEQ ID NO: 995899 - RNA, 19 nt, Homo sapiens
auauuaaacccaucgaguu

SEQ ID NO: 995900 - RNA, 19 nt, Homo sapiens
ccacucaucgauauuaaac

SEQ ID NO: 995901 - RNA, 19 nt, Homo sapiens
gcagggaaggcagcuuuca

SEQ ID NO: 995902 - RNA, 19 nt, Homo sapiens
caaaguuccccaagaagaa

SEQ ID NO: 995903 - RNA, 19 nt, Homo sapiens
uugauccuuucuacaauga

SEQ ID NO: 995904 - RNA, 19 nt, Homo sapiens
ugccggcacugcugucaga

SEQ ID NO: 995905 - RNA, 19 nt, Homo sapiens
agggaaggcagcuuucauu

SEQ ID NO: 995906 - RNA, 19 nt, Homo sapiens
acaaggauggugacucugu

SEQ ID NO: 995907 - RNA, 19 nt, Homo sapiens
cagcgacgauguggacucu

SEQ ID NO: 995908 - RNA, 19 nt, Homo sapiens
uguacucccucgacuccaa

SEQ ID NO: 995909 - RNA, 19 nt, Homo sapiens
cagccuaguguuuacaguu

SEQ ID NO: 995910 - RNA, 19 nt, Homo sapiens
aaugccagccuaguguuua

SEQ ID NO: 995911 - RNA, 19 nt, Homo sapiens
cauggacucaaacuuguga

SEQ ID NO: 995912 - RNA, 19 nt, Homo sapiens
ggaccuuucccugcucaga

SEQ ID NO: 995913 - RNA, 19 nt, Homo sapiens
ccaagugcuggcagacuga

SEQ ID NO: 995914 - RNA, 19 nt, Homo sapiens
ggagauccuguccaaguac

SEQ ID NO: 995915 - RNA, 19 nt, Homo sapiens
cuccacucaucgauauuaa

SEQ ID NO: 995916 - RNA, 19 nt, Homo sapiens
ggacucaaacuugugaaaa

SEQ ID NO: 995917 - RNA, 19 nt, Homo sapiens
gccagucaagugaggauga

SEQ ID NO: 995918 - RNA, 19 nt, Homo sapiens
cuggcagacugaauguuga

SEQ ID NO: 995919 - RNA, 19 nt, Homo sapiens
gacccagaagcccguguuu

SEQ ID NO: 995920 - RNA, 19 nt, Homo sapiens
gcuacgaguccagcuguug

SEQ ID NO: 995921 - RNA, 19 nt, Homo sapiens
gaaggagcccauccaaccu

SEQ ID NO: 995922 - RNA, 19 nt, Homo sapiens
ggaggcgcaugcucaacac

SEQ ID NO: 995923 - RNA, 19 nt, Homo sapiens
acaugaagagcagcaauga

SEQ ID NO: 995924 - RNA, 19 nt, Homo sapiens
aaaugccagccuaguguuu

SEQ ID NO: 995925 - RNA, 19 nt, Homo sapiens
uuucugugccuuuguguga

SEQ ID NO: 995926 - RNA, 19 nt, Homo sapiens
ucaaacgcaagacccagaa

SEQ ID NO: 995927 - RNA, 19 nt, Homo sapiens
ggaaagagauucaguuugu

SEQ ID NO: 995928 - RNA, 19 nt, Homo sapiens
gcacugaccuugggaauuu

SEQ ID NO: 995929 - RNA, 19 nt, Homo sapiens
gaacaggucucauggugaa

SEQ ID NO: 995930 - RNA, 19 nt, Homo sapiens
ucaaagagauuguagaaga

SEQ ID NO: 995931 - RNA, 19 nt, Homo sapiens
caucaaaccuuaaugaaga

SEQ ID NO: 995932 - RNA, 19 nt, Homo sapiens
gaaaagaacugguacauca

SEQ ID NO: 995933 - RNA, 19 nt, Homo sapiens
gaaauggcaugucuauugu

SEQ ID NO: 995934 - RNA, 19 nt, Homo sapiens
guacacagcuuagaaauac

SEQ ID NO: 995935 - RNA, 19 nt, Homo sapiens
ggacacagauauguauuau

SEQ ID NO: 995936 - RNA, 19 nt, Homo sapiens
ggacaucaaaccuuaauga

SEQ ID NO: 995937 - RNA, 19 nt, Homo sapiens
gccaggacaucaaaccuua

SEQ ID NO: 995938 - RNA, 19 nt, Homo sapiens
ugacuucacuggaaacuug

SEQ ID NO: 995939 - RNA, 19 nt, Homo sapiens
ugaaauggcaugucuauug

SEQ ID NO: 995940 - RNA, 19 nt, Homo sapiens
gcaguuuguuaguuacaua

SEQ ID NO: 995941 - RNA, 19 nt, Homo sapiens
gaccacagcuuggacuaaa

SEQ ID NO: 995942 - RNA, 19 nt, Homo sapiens
gauacaaccuacugacguu

SEQ ID NO: 995943 - RNA, 19 nt, Homo sapiens
gcaaacacgugaaguucug

SEQ ID NO: 995944 - RNA, 19 nt, Homo sapiens
gaaagagauucaguuuguu

SEQ ID NO: 995945 - RNA, 19 nt, Homo sapiens
ugaaacagcuaaucuggau

SEQ ID NO: 995946 - RNA, 19 nt, Homo sapiens
gcuaaugccuucuuucucu

SEQ ID NO: 995947 - RNA, 19 nt, Homo sapiens
ugacguucaucaucuuaua

SEQ ID NO: 995948 - RNA, 19 nt, Homo sapiens
gugaaguucugaugaaguu

SEQ ID NO: 995949 - RNA, 19 nt, Homo sapiens
ucucuucauugccuuauua

SEQ ID NO: 995950 - RNA, 19 nt, Homo sapiens
caaagagauuguagaagau

SEQ ID NO: 995951 - RNA, 19 nt, Homo sapiens
acaccaaacucaugcagaa

SEQ ID NO: 995952 - RNA, 19 nt, Homo sapiens
cucaagagaucaaauguug

SEQ ID NO: 995953 - RNA, 19 nt, Homo sapiens
ggcaauguguuauguugaa

SEQ ID NO: 995954 - RNA, 19 nt, Homo sapiens
agaaauccaggaagaaaua

SEQ ID NO: 995955 - RNA, 19 nt, Homo sapiens
ggagcaugauacuguguuu

SEQ ID NO: 995956 - RNA, 19 nt, Homo sapiens
ggacaccaccucagauaau

SEQ ID NO: 995957 - RNA, 19 nt, Homo sapiens
caacucgucugcagugcuu

SEQ ID NO: 995958 - RNA, 19 nt, Homo sapiens
gaagaagucauccgugcuu

SEQ ID NO: 995959 - RNA, 19 nt, Homo sapiens
gcaucggccuguacaaugu

SEQ ID NO: 995960 - RNA, 19 nt, Homo sapiens
gaacgugguccuguauauu

SEQ ID NO: 995961 - RNA, 19 nt, Homo sapiens
gcaggugaaauaucucuuu

SEQ ID NO: 995962 - RNA, 19 nt, Homo sapiens
acacauauguuguuguuac

SEQ ID NO: 995963 - RNA, 19 nt, Homo sapiens
gaagauugugugugugaaa

SEQ ID NO: 995964 - RNA, 19 nt, Homo sapiens
gacaccaccucagauaauu

SEQ ID NO: 995965 - RNA, 19 nt, Homo sapiens
gguacacagcuuagaaaua

SEQ ID NO: 995966 - RNA, 19 nt, Homo sapiens
aaccgcaucucaacaaauu

SEQ ID NO: 995967 - RNA, 19 nt, Homo sapiens
ccaccaacaacucggauua

SEQ ID NO: 995968 - RNA, 19 nt, Homo sapiens
caucaaagagauuguagaa

SEQ ID NO: 995969 - RNA, 19 nt, Homo sapiens
ugacauuucuaccucgauu

SEQ ID NO: 995970 - RNA, 19 nt, Homo sapiens
guuaagcaguuuguuaguu

SEQ ID NO: 995971 - RNA, 19 nt, Homo sapiens
uggcaugucuauuguaaau

SEQ ID NO: 995972 - RNA, 19 nt, Homo sapiens
uuuaagaagugcagcauug

SEQ ID NO: 995973 - RNA, 19 nt, Homo sapiens
gacaagacuggaacgcuua

SEQ ID NO: 995974 - RNA, 19 nt, Homo sapiens
gggacacagauauguauua

SEQ ID NO: 995975 - RNA, 19 nt, Homo sapiens
ccaaacucaugcagaauuc

SEQ ID NO: 995976 - RNA, 19 nt, Homo sapiens
gcaauguguuauguugaaa

SEQ ID NO: 995977 - RNA, 19 nt, Homo sapiens
acacaucuuugucagagaa

SEQ ID NO: 995978 - RNA, 19 nt, Homo sapiens
auaagaacgugguccugua

SEQ ID NO: 995979 - RNA, 19 nt, Homo sapiens
ucacacugcugacaugcaa

SEQ ID NO: 995980 - RNA, 19 nt, Homo sapiens
gaagucauccgugcuuaug

SEQ ID NO: 995981 - RNA, 19 nt, Homo sapiens
aauggcaugucuauuguaa

SEQ ID NO: 995982 - RNA, 19 nt, Homo sapiens
ggacacgacaccaaacuca

SEQ ID NO: 995983 - RNA, 19 nt, Homo sapiens
gaaguucugaugaaguuau

SEQ ID NO: 995984 - RNA, 19 nt, Homo sapiens
caggcaauguguuauguug

SEQ ID NO: 995985 - RNA, 19 nt, Homo sapiens
gcauucaacugugcucugu

SEQ ID NO: 995986 - RNA, 19 nt, Homo sapiens
gaaauccaggaagaaauaa

SEQ ID NO: 995987 - RNA, 19 nt, Homo sapiens
gggaaucagugggaaugaa

SEQ ID NO: 995988 - RNA, 19 nt, Homo sapiens
ucauagaagcggugaguaa

SEQ ID NO: 995989 - RNA, 19 nt, Homo sapiens
gaacaccauucucagucau

SEQ ID NO: 995990 - RNA, 19 nt, Homo sapiens
agacaaugcaguuaacaaa

SEQ ID NO: 995991 - RNA, 19 nt, Homo sapiens
ccuacugccuguuugauug

SEQ ID NO: 995992 - RNA, 19 nt, Homo sapiens
gcuaccgacuauuuauuug

SEQ ID NO: 995993 - RNA, 19 nt, Homo sapiens
gauaguggauguggugaag

SEQ ID NO: 995994 - RNA, 19 nt, Homo sapiens
gugcagcauugccggagua

SEQ ID NO: 995995 - RNA, 19 nt, Homo sapiens
acgcuuacaugcaauauca

SEQ ID NO: 995996 - RNA, 19 nt, Homo sapiens
cuacugacguucaucaucu

SEQ ID NO: 995997 - RNA, 19 nt, Homo sapiens
gagguacacagcuuagaaa

SEQ ID NO: 995998 - RNA, 19 nt, Homo sapiens
cuggugccauugaucauua

SEQ ID NO: 995999 - RNA, 19 nt, Homo sapiens
agagaagacuggcguccaa

SEQ ID NO: 996000 - RNA, 19 nt, Homo sapiens
aaagaaauccaggaagaaa

SEQ ID NO: 996001 - RNA, 19 nt, Homo sapiens
guuggugacucuugagguu

SEQ ID NO: 996002 - RNA, 19 nt, Homo sapiens
ggaacgcuuacaugcaaua

SEQ ID NO: 996003 - RNA, 19 nt, Homo sapiens
cugaugaaguuaucuggaa

SEQ ID NO: 996004 - RNA, 19 nt, Homo sapiens
uaggaaagagauucaguuu

SEQ ID NO: 996005 - RNA, 19 nt, Homo sapiens
ggaagaaauaagacaugaa

SEQ ID NO: 996006 - RNA, 19 nt, Homo sapiens
ccacagcuuggacuaaauu

SEQ ID NO: 996007 - RNA, 19 nt, Homo sapiens
guacagcguguugacauuu

SEQ ID NO: 996008 - RNA, 19 nt, Homo sapiens
aacgugguccuguauauua

SEQ ID NO: 996009 - RNA, 19 nt, Homo sapiens
ugagaaggauggagauaac

SEQ ID NO: 996010 - RNA, 19 nt, Homo sapiens
gaacugguacaucaagaag

SEQ ID NO: 996011 - RNA, 19 nt, Homo sapiens
ccaaccgcaucucaacaaa

SEQ ID NO: 996012 - RNA, 19 nt, Homo sapiens
ugcaggagcuggaaaccaa

SEQ ID NO: 996013 - RNA, 19 nt, Homo sapiens
agaacgugguccuguauau

SEQ ID NO: 996014 - RNA, 19 nt, Homo sapiens
ccuccucccuguagugauu

SEQ ID NO: 996015 - RNA, 19 nt, Homo sapiens
acagcaaauuccagaugua

SEQ ID NO: 996016 - RNA, 19 nt, Homo sapiens
gagcuuugguucgccuuug

SEQ ID NO: 996017 - RNA, 19 nt, Homo sapiens
uaguggauguggugaagaa

SEQ ID NO: 996018 - RNA, 19 nt, Homo sapiens
uauggucacuucccagaau

SEQ ID NO: 996019 - RNA, 19 nt, Homo sapiens
ggaguaaccuauggucacu

SEQ ID NO: 996020 - RNA, 19 nt, Homo sapiens
cuggaacgcuuacaugcaa

SEQ ID NO: 996021 - RNA, 19 nt, Homo sapiens
gacaucaaaccuuaaugaa

SEQ ID NO: 996022 - RNA, 19 nt, Homo sapiens
ggccugaccagaucuuauu

SEQ ID NO: 996023 - RNA, 19 nt, Homo sapiens
cacgugaaguucugaugaa

SEQ ID NO: 996024 - RNA, 19 nt, Homo sapiens
ggagacgaaccuuaaaaua

SEQ ID NO: 996025 - RNA, 19 nt, Homo sapiens
cuaccucgauucuuguaug

SEQ ID NO: 996026 - RNA, 19 nt, Homo sapiens
cauauguuguuguuacugu

SEQ ID NO: 996027 - RNA, 19 nt, Homo sapiens
gcaauugacuaugggauua

SEQ ID NO: 996028 - RNA, 19 nt, Homo sapiens
gggagaagcuagcaauuga

SEQ ID NO: 996029 - RNA, 19 nt, Homo sapiens
gaucaaagaagaccaguuu

SEQ ID NO: 996030 - RNA, 19 nt, Homo sapiens
gaacuuagaccucucaaca

SEQ ID NO: 996031 - RNA, 19 nt, Homo sapiens
gcaaugaaguggagacaca

SEQ ID NO: 996032 - RNA, 19 nt, Homo sapiens
gcacaaucuuagacucaua

SEQ ID NO: 996033 - RNA, 19 nt, Homo sapiens
gagcaccacugaacuuaga

SEQ ID NO: 996034 - RNA, 19 nt, Homo sapiens
gguaacaaaugugauauga

SEQ ID NO: 996035 - RNA, 19 nt, Homo sapiens
agaacuagauggaaagaaa

SEQ ID NO: 996036 - RNA, 19 nt, Homo sapiens
cuacuuugaugaacucuuu

SEQ ID NO: 996037 - RNA, 19 nt, Homo sapiens
ugacaaaacucaacagaaa

SEQ ID NO: 996038 - RNA, 19 nt, Homo sapiens
ucuaugacaucacaaauga

SEQ ID NO: 996039 - RNA, 19 nt, Homo sapiens
ggacacagcgggucaggaa

SEQ ID NO: 996040 - RNA, 19 nt, Homo sapiens
cgauagaacuagauggaaa

SEQ ID NO: 996041 - RNA, 19 nt, Homo sapiens
gaaaaccgaucaaagaaga

SEQ ID NO: 996042 - RNA, 19 nt, Homo sapiens
gaagcuagcaauugacuau

SEQ ID NO: 996043 - RNA, 19 nt, Homo sapiens
aaagaaugauccuggguaa

SEQ ID NO: 996044 - RNA, 19 nt, Homo sapiens
aaauauuacugccuuggua

SEQ ID NO: 996045 - RNA, 19 nt, Homo sapiens
gugaaguucuagacaaauu

SEQ ID NO: 996046 - RNA, 19 nt, Homo sapiens
cagcagagguuaauauacu

SEQ ID NO: 996047 - RNA, 19 nt, Homo sapiens
acucauauuugcacacuuu

SEQ ID NO: 996048 - RNA, 19 nt, Homo sapiens
gauccuggguaacaaaugu

SEQ ID NO: 996049 - RNA, 19 nt, Homo sapiens
uggcgaagacguacgauua

SEQ ID NO: 996050 - RNA, 19 nt, Homo sapiens
gacguacgauuaucucuuc

SEQ ID NO: 996051 - RNA, 19 nt, Homo sapiens
gagagcaccacugaacuua

SEQ ID NO: 996052 - RNA, 19 nt, Homo sapiens
cacgagauauaaugacaaa

SEQ ID NO: 996053 - RNA, 19 nt, Homo sapiens
uuuauuaccuguugcagaa

SEQ ID NO: 996054 - RNA, 19 nt, Homo sapiens
gaaguucuagacaaauuug

SEQ ID NO: 996055 - RNA, 19 nt, Homo sapiens
gcgagaagauggcgaagac

SEQ ID NO: 996056 - RNA, 19 nt, Homo sapiens
gaaugauccuggguaacaa

SEQ ID NO: 996057 - RNA, 19 nt, Homo sapiens
gcagagguuaauauacuaa

SEQ ID NO: 996058 - RNA, 19 nt, Homo sapiens
gcauuuauuuaagggcuuu

SEQ ID NO: 996059 - RNA, 19 nt, Homo sapiens
gaucagaaacauugaagag

SEQ ID NO: 996060 - RNA, 19 nt, Homo sapiens
gaggagccaugggcauuau

SEQ ID NO: 996061 - RNA, 19 nt, Homo sapiens
caacacaguaugccaagug

SEQ ID NO: 996062 - RNA, 19 nt, Homo sapiens
uuucguugcucgcuacuuu

SEQ ID NO: 996063 - RNA, 19 nt, Homo sapiens
guacgauuaucucuucaag

SEQ ID NO: 996064 - RNA, 19 nt, Homo sapiens
gcauuuacagcagagguua

SEQ ID NO: 996065 - RNA, 19 nt, Homo sapiens
gaagcgguuaucuuucuuu

SEQ ID NO: 996066 - RNA, 19 nt, Homo sapiens
ucacccagccucagaauca

SEQ ID NO: 996067 - RNA, 19 nt, Homo sapiens
ugcagaagcgguuaucuuu

SEQ ID NO: 996068 - RNA, 19 nt, Homo sapiens
uuagaacgauagaacuaga

SEQ ID NO: 996069 - RNA, 19 nt, Homo sapiens
ugcaggaccuaacucguuu

SEQ ID NO: 996070 - RNA, 19 nt, Homo sapiens
gcgaagacguacgauuauc

SEQ ID NO: 996071 - RNA, 19 nt, Homo sapiens
uguuagccuuucccuauuu

SEQ ID NO: 996072 - RNA, 19 nt, Homo sapiens
guguuagccuuucccuauu

SEQ ID NO: 996073 - RNA, 19 nt, Homo sapiens
gcagaagcgguuaucuuuc

SEQ ID NO: 996074 - RNA, 19 nt, Homo sapiens
uuucaaacauggaagcaau

SEQ ID NO: 996075 - RNA, 19 nt, Homo sapiens
gcuggucuaugacaucaca

SEQ ID NO: 996076 - RNA, 19 nt, Homo sapiens
uacagcagagguuaauaua

SEQ ID NO: 996077 - RNA, 19 nt, Homo sapiens
uuacagcagagguuaauau

SEQ ID NO: 996078 - RNA, 19 nt, Homo sapiens
ucgugaaguucuagacaaa

SEQ ID NO: 996079 - RNA, 19 nt, Homo sapiens
aaacauggaagcaaugaag

SEQ ID NO: 996080 - RNA, 19 nt, Homo sapiens
acacuugcacgagauauaa

SEQ ID NO: 996081 - RNA, 19 nt, Homo sapiens
guugcucgcuacuuugaug

SEQ ID NO: 996082 - RNA, 19 nt, Homo sapiens
gcacgagauauaaugacaa

SEQ ID NO: 996083 - RNA, 19 nt, Homo sapiens
gcaugccucuuccgauguc

SEQ ID NO: 996084 - RNA, 19 nt, Homo sapiens
cagaaacauugaagagcau

SEQ ID NO: 996085 - RNA, 19 nt, Homo sapiens
acgauuaucucuucaagcu

SEQ ID NO: 996086 - RNA, 19 nt, Homo sapiens
agagggcccuuuccugcuu

SEQ ID NO: 996087 - RNA, 19 nt, Homo sapiens
uuacugccuugguagcauu

SEQ ID NO: 996088 - RNA, 19 nt, Homo sapiens
uuagaccucucaacacagu

SEQ ID NO: 996089 - RNA, 19 nt, Homo sapiens
gcugagagcaccacugaac

SEQ ID NO: 996090 - RNA, 19 nt, Homo sapiens
agaagauggcgaagacgua

SEQ ID NO: 996091 - RNA, 19 nt, Homo sapiens
gaagacguacgauuaucuc

SEQ ID NO: 996092 - RNA, 19 nt, Homo sapiens
agaaugauccuggguaaca

SEQ ID NO: 996093 - RNA, 19 nt, Homo sapiens
cagcgggucaggaaagauu

SEQ ID NO: 996094 - RNA, 19 nt, Homo sapiens
gucgugaaguucuagacaa

SEQ ID NO: 996095 - RNA, 19 nt, Homo sapiens
cuauuucagcacaaucuua

SEQ ID NO: 996096 - RNA, 19 nt, Homo sapiens
acuuagaccucucaacaca

SEQ ID NO: 996097 - RNA, 19 nt, Homo sapiens
ugagagcaccacugaacuu

SEQ ID NO: 996098 - RNA, 19 nt, Homo sapiens
gauagaacuagauggaaag

SEQ ID NO: 996099 - RNA, 19 nt, Homo sapiens
aaaauccagugcaaaugua

SEQ ID NO: 996100 - RNA, 19 nt, Homo sapiens
aaggguauuuggucugguu

SEQ ID NO: 996101 - RNA, 19 nt, Homo sapiens
gaacuagauggaaagaaaa

SEQ ID NO: 996102 - RNA, 19 nt, Homo sapiens
ggcgaagacguacgauuau

SEQ ID NO: 996103 - RNA, 19 nt, Homo sapiens
caagaccugccuccuguuc

SEQ ID NO: 996104 - RNA, 19 nt, Homo sapiens
cagcacaaucuuagacuca

SEQ ID NO: 996105 - RNA, 19 nt, Homo sapiens
aguguuagccuuucccuau

SEQ ID NO: 996106 - RNA, 19 nt, Homo sapiens
acagaaaaccgaucaaaga

SEQ ID NO: 996107 - RNA, 19 nt, Homo sapiens
caauugacuaugggauuaa

SEQ ID NO: 996108 - RNA, 19 nt, Homo sapiens
cacgacagcguacuacaga

SEQ ID NO: 996109 - RNA, 19 nt, Homo sapiens
cagaggagccaugggcauu

SEQ ID NO: 996110 - RNA, 19 nt, Homo sapiens
ucaaacauggaagcaauga

SEQ ID NO: 996111 - RNA, 19 nt, Homo sapiens
caaucacgacagcguacua

SEQ ID NO: 996112 - RNA, 19 nt, Homo sapiens
gagaagcuagcaauugacu

SEQ ID NO: 996113 - RNA, 19 nt, Homo sapiens
cuuccgaugucgaaagaau

SEQ ID NO: 996114 - RNA, 19 nt, Homo sapiens
agaggagccaugggcauua

SEQ ID NO: 996115 - RNA, 19 nt, Homo sapiens
guuagccuuucccuauuuc

SEQ ID NO: 996116 - RNA, 19 nt, Homo sapiens
cgaagacguacgauuaucu

SEQ ID NO: 996117 - RNA, 19 nt, Homo sapiens
ggagcagguggaccaguga

SEQ ID NO: 996118 - RNA, 19 nt, Homo sapiens
cuggguaacaaaugugaua

SEQ ID NO: 996119 - RNA, 19 nt, Homo sapiens
agcagagguuaauauacua

SEQ ID NO: 996120 - RNA, 19 nt, Homo sapiens
caucuccaccaucggaauu

SEQ ID NO: 996121 - RNA, 19 nt, Homo sapiens
aauuggaucagaaacauug

SEQ ID NO: 996122 - RNA, 19 nt, Homo sapiens
ccagugcaaauguagaaga

SEQ ID NO: 996123 - RNA, 19 nt, Homo sapiens
caaaauccagugcaaaugu

SEQ ID NO: 996124 - RNA, 19 nt, Homo sapiens
cuaugggauuaaauucuug

SEQ ID NO: 996125 - RNA, 19 nt, Homo sapiens
ugacuaugggauuaaauuc

SEQ ID NO: 996126 - RNA, 19 nt, Homo sapiens
gccuugguagcauuuauuu

SEQ ID NO: 996127 - RNA, 19 nt, Homo sapiens
ggaauuagccgcuuaaaua

SEQ ID NO: 996128 - RNA, 19 nt, Homo sapiens
gcacaggccugcauucuug

SEQ ID NO: 996129 - RNA, 19 nt, Homo sapiens
gaacaaagguggagucaac

SEQ ID NO: 996130 - RNA, 19 nt, Homo sapiens
gaaaccagcuaguguguca

SEQ ID NO: 996131 - RNA, 19 nt, Homo sapiens
cuacucaucucuggaauua

SEQ ID NO: 996132 - RNA, 19 nt, Homo sapiens
gaauugaacucugggauca

SEQ ID NO: 996133 - RNA, 19 nt, Homo sapiens
ggucugggauuucugcuuu

SEQ ID NO: 996134 - RNA, 19 nt, Homo sapiens
gcaagccuguguaugaaga

SEQ ID NO: 996135 - RNA, 19 nt, Homo sapiens
agaaccagcucaagacauu

SEQ ID NO: 996136 - RNA, 19 nt, Homo sapiens
gcuagugugucaacaguga

SEQ ID NO: 996137 - RNA, 19 nt, Homo sapiens
gcucuaaccaggcucauuu

SEQ ID NO: 996138 - RNA, 19 nt, Homo sapiens
gcaauaucccuaccacuga

SEQ ID NO: 996139 - RNA, 19 nt, Homo sapiens
gcucagcauugccaagaaa

SEQ ID NO: 996140 - RNA, 19 nt, Homo sapiens
gcaguuuccucauggaugu

SEQ ID NO: 996141 - RNA, 19 nt, Homo sapiens
gaagcuuuauggcuacuau

SEQ ID NO: 996142 - RNA, 19 nt, Homo sapiens
gggagaugcucacauuugu

SEQ ID NO: 996143 - RNA, 19 nt, Homo sapiens
guuaugagcagguugauga

SEQ ID NO: 996144 - RNA, 19 nt, Homo sapiens
ggauuggacuguacaaggu

SEQ ID NO: 996145 - RNA, 19 nt, Homo sapiens
uaucagcauuugcccuaua

SEQ ID NO: 996146 - RNA, 19 nt, Homo sapiens
gcaggaggcucagcauaca

SEQ ID NO: 996147 - RNA, 19 nt, Homo sapiens
caauaucccuaccacugaa

SEQ ID NO: 996148 - RNA, 19 nt, Homo sapiens
caaccuuccucccuacuca

SEQ ID NO: 996149 - RNA, 19 nt, Homo sapiens
ggacuggauuggacuguac

SEQ ID NO: 996150 - RNA, 19 nt, Homo sapiens
ucucauuucuggauuccua

SEQ ID NO: 996151 - RNA, 19 nt, Homo sapiens
gaauuagccgcuuaaauac

SEQ ID NO: 996152 - RNA, 19 nt, Homo sapiens
ggaacuccaacgacuauga

SEQ ID NO: 996153 - RNA, 19 nt, Homo sapiens
gaagggagaaccagcucaa

SEQ ID NO: 996154 - RNA, 19 nt, Homo sapiens
ggagaugcucacauuugua

SEQ ID NO: 996155 - RNA, 19 nt, Homo sapiens
acaucugccugaagcuuua

SEQ ID NO: 996156 - RNA, 19 nt, Homo sapiens
gaacaaccggaaccucaau

SEQ ID NO: 996157 - RNA, 19 nt, Homo sapiens
gaggggagaugcucacauu

SEQ ID NO: 996158 - RNA, 19 nt, Homo sapiens
augaguuucuccucuguua

SEQ ID NO: 996159 - RNA, 19 nt, Homo sapiens
gacuuuggguugcacuuug

SEQ ID NO: 996160 - RNA, 19 nt, Homo sapiens
gccuguguaugaagaauug

SEQ ID NO: 996161 - RNA, 19 nt, Homo sapiens
gaaggaccagcucagcauu

SEQ ID NO: 996162 - RNA, 19 nt, Homo sapiens
ccgcaagccuguguaugaa

SEQ ID NO: 996163 - RNA, 19 nt, Homo sapiens
agagagaacugggaaggau

SEQ ID NO: 996164 - RNA, 19 nt, Homo sapiens
gcucuuacgccaugguuau

SEQ ID NO: 996165 - RNA, 19 nt, Homo sapiens
ccacuacucaucucuggaa

SEQ ID NO: 996166 - RNA, 19 nt, Homo sapiens
ggacuuuggguugcacuuu

SEQ ID NO: 996167 - RNA, 19 nt, Homo sapiens
ggaccacgaccucauuauc

SEQ ID NO: 996168 - RNA, 19 nt, Homo sapiens
gggacuggauuggacugua

SEQ ID NO: 996169 - RNA, 19 nt, Homo sapiens
ggcgagacaucccaaacau

SEQ ID NO: 996170 - RNA, 19 nt, Homo sapiens
guggagcaguuuccucaug

SEQ ID NO: 996171 - RNA, 19 nt, Homo sapiens
ccuccacccugccaucuga

SEQ ID NO: 996172 - RNA, 19 nt, Homo sapiens
guuauugguuugcaggaau

SEQ ID NO: 996173 - RNA, 19 nt, Homo sapiens
gaugcugccuuuaaugacu

SEQ ID NO: 996174 - RNA, 19 nt, Homo sapiens
gagaugcucacauuuguac

SEQ ID NO: 996175 - RNA, 19 nt, Homo sapiens
ggacaguucugcgucucau

SEQ ID NO: 996176 - RNA, 19 nt, Homo sapiens
acuuggagcugaagccauu

SEQ ID NO: 996177 - RNA, 19 nt, Homo sapiens
cgaccucauuaucugguuu

SEQ ID NO: 996178 - RNA, 19 nt, Homo sapiens
ucaucaaggucucccaugu

SEQ ID NO: 996179 - RNA, 19 nt, Homo sapiens
cagcuagugugucaacagu

SEQ ID NO: 996180 - RNA, 19 nt, Homo sapiens
gcauugccaagaaacauga

SEQ ID NO: 996181 - RNA, 19 nt, Homo sapiens
cagguucgcuuccguuggu

SEQ ID NO: 996182 - RNA, 19 nt, Homo sapiens
ggagcaguuuccucaugga

SEQ ID NO: 996183 - RNA, 19 nt, Homo sapiens
gaccacgaccucauuaucu

SEQ ID NO: 996184 - RNA, 19 nt, Homo sapiens
uccuggagaugcagaauug

SEQ ID NO: 996185 - RNA, 19 nt, Homo sapiens
gaucauaagccuccuuucc

SEQ ID NO: 996186 - RNA, 19 nt, Homo sapiens
auugaacucugggaucaua

SEQ ID NO: 996187 - RNA, 19 nt, Homo sapiens
gccaagugucguccacaua

SEQ ID NO: 996188 - RNA, 19 nt, Homo sapiens
gagccaggaugggagugaa

SEQ ID NO: 996189 - RNA, 19 nt, Homo sapiens
gaaccagcucaagacauuu

SEQ ID NO: 996190 - RNA, 19 nt, Homo sapiens
ggagaaccagcucaagaca

SEQ ID NO: 996191 - RNA, 19 nt, Homo sapiens
ccgaugcugccuuuaauga

SEQ ID NO: 996192 - RNA, 19 nt, Homo sapiens
uaucugguuuggagacaug

SEQ ID NO: 996193 - RNA, 19 nt, Homo sapiens
gggaucauaagccuccuuu

SEQ ID NO: 996194 - RNA, 19 nt, Homo sapiens
acaguucugcgucucauuu

SEQ ID NO: 996195 - RNA, 19 nt, Homo sapiens
gagugaaaccagcuagugu

SEQ ID NO: 996196 - RNA, 19 nt, Homo sapiens
gcugagaugugagugaaac

SEQ ID NO: 996197 - RNA, 19 nt, Homo sapiens
aaacaguccgcgacagcua

SEQ ID NO: 996198 - RNA, 19 nt, Homo sapiens
aaccggaaccucaaucuug

SEQ ID NO: 996199 - RNA, 19 nt, Homo sapiens
cuuuauggcuacuauguca

SEQ ID NO: 996200 - RNA, 19 nt, Homo sapiens
caacaucugccugaagcuu

SEQ ID NO: 996201 - RNA, 19 nt, Homo sapiens
ggagucuuggcaucucaua

SEQ ID NO: 996202 - RNA, 19 nt, Homo sapiens
guucgggaauccauuaaaa

SEQ ID NO: 996203 - RNA, 19 nt, Homo sapiens
ggucucccauguccguaug

SEQ ID NO: 996204 - RNA, 19 nt, Homo sapiens
cccgcaagccuguguauga

SEQ ID NO: 996205 - RNA, 19 nt, Homo sapiens
gcucuguguugcauacucu

SEQ ID NO: 996206 - RNA, 19 nt, Homo sapiens
cauuugcucucuccacuac

SEQ ID NO: 996207 - RNA, 19 nt, Homo sapiens
ugaagagacagccaagugu

SEQ ID NO: 996208 - RNA, 19 nt, Homo sapiens
ccacauuuccaacaauuac

SEQ ID NO: 996209 - RNA, 19 nt, Homo sapiens
ccacugaagaugaguuucu

SEQ ID NO: 996210 - RNA, 19 nt, Homo sapiens
ccaccuacaaguuugauag

SEQ ID NO: 996211 - RNA, 19 nt, Homo sapiens
gggcgagacaucccaaaca

SEQ ID NO: 996212 - RNA, 19 nt, Homo sapiens
uuacuggucuuugccaagu

SEQ ID NO: 996213 - RNA, 19 nt, Homo sapiens
caaccggaaccucaaucuu

SEQ ID NO: 996214 - RNA, 19 nt, Homo sapiens
ccaagugucguccacauac

SEQ ID NO: 996215 - RNA, 19 nt, Homo sapiens
gaagcacagccacagaucu

SEQ ID NO: 996216 - RNA, 19 nt, Homo sapiens
ugcgggacguuaaugacua

SEQ ID NO: 996217 - RNA, 19 nt, Homo sapiens
uaggaacuccaacgacuau

SEQ ID NO: 996218 - RNA, 19 nt, Homo sapiens
gaaguuccagauccugaca

SEQ ID NO: 996219 - RNA, 19 nt, Homo sapiens
uuauugguuugcaggaauu

SEQ ID NO: 996220 - RNA, 19 nt, Homo sapiens
acaucgacaucagcaauau

SEQ ID NO: 996221 - RNA, 19 nt, Homo sapiens
gauggucagcuacucuuca

SEQ ID NO: 996222 - RNA, 19 nt, Homo sapiens
gaacuccaacgacuaugac

SEQ ID NO: 996223 - RNA, 19 nt, Homo sapiens
caaagguggagucaacauc

SEQ ID NO: 996224 - RNA, 19 nt, Homo sapiens
uacaucgacaucagcaaua

SEQ ID NO: 996225 - RNA, 19 nt, Homo sapiens
gacuaugacaccagugaga

SEQ ID NO: 996226 - RNA, 19 nt, Homo sapiens
ggcaggaggcucagcauac

SEQ ID NO: 996227 - RNA, 19 nt, Homo sapiens
ggaauuagccgcuuaaaua

SEQ ID NO: 996228 - RNA, 19 nt, Homo sapiens
gcacaggccugcauucuug

SEQ ID NO: 996229 - RNA, 19 nt, Homo sapiens
gaacaaagguggagucaac

SEQ ID NO: 996230 - RNA, 19 nt, Homo sapiens
gaaaccagcuaguguguca

SEQ ID NO: 996231 - RNA, 19 nt, Homo sapiens
cuacucaucucuggaauua

SEQ ID NO: 996232 - RNA, 19 nt, Homo sapiens
gaauugaacucugggauca

SEQ ID NO: 996233 - RNA, 19 nt, Homo sapiens
ggucugggauuucugcuuu

SEQ ID NO: 996234 - RNA, 19 nt, Homo sapiens
gcaagccuguguaugaaga

SEQ ID NO: 996235 - RNA, 19 nt, Homo sapiens
agaaccagcucaagacauu

SEQ ID NO: 996236 - RNA, 19 nt, Homo sapiens
gcuagugugucaacaguga

SEQ ID NO: 996237 - RNA, 19 nt, Homo sapiens
gcucuaaccaggcucauuu

SEQ ID NO: 996238 - RNA, 19 nt, Homo sapiens
gcaauaucccuaccacuga

SEQ ID NO: 996239 - RNA, 19 nt, Homo sapiens
gcucagcauugccaagaaa

SEQ ID NO: 996240 - RNA, 19 nt, Homo sapiens
gcaguuuccucauggaugu

SEQ ID NO: 996241 - RNA, 19 nt, Homo sapiens
gaagcuuuauggcuacuau

SEQ ID NO: 996242 - RNA, 19 nt, Homo sapiens
gggagaugcucacauuugu

SEQ ID NO: 996243 - RNA, 19 nt, Homo sapiens
guuaugagcagguugauga

SEQ ID NO: 996244 - RNA, 19 nt, Homo sapiens
gaacaagaaauccggacuu

SEQ ID NO: 996245 - RNA, 19 nt, Homo sapiens
ggauuggacuguacaaggu

SEQ ID NO: 996246 - RNA, 19 nt, Homo sapiens
uaucagcauuugcccuaua

SEQ ID NO: 996247 - RNA, 19 nt, Homo sapiens
gcaggaggcucagcauaca

SEQ ID NO: 996248 - RNA, 19 nt, Homo sapiens
caauaucccuaccacugaa

SEQ ID NO: 996249 - RNA, 19 nt, Homo sapiens
caaccuuccucccuacuca

SEQ ID NO: 996250 - RNA, 19 nt, Homo sapiens
ggacuggauuggacuguac

SEQ ID NO: 996251 - RNA, 19 nt, Homo sapiens
ucucauuucuggauuccua

SEQ ID NO: 996252 - RNA, 19 nt, Homo sapiens
gacuuagccuggucucuug

SEQ ID NO: 996253 - RNA, 19 nt, Homo sapiens
gaauuagccgcuuaaauac

SEQ ID NO: 996254 - RNA, 19 nt, Homo sapiens
ggaacuccaacgacuauga

SEQ ID NO: 996255 - RNA, 19 nt, Homo sapiens
gaagggagaaccagcucaa

SEQ ID NO: 996256 - RNA, 19 nt, Homo sapiens
ggagaugcucacauuugua

SEQ ID NO: 996257 - RNA, 19 nt, Homo sapiens
acaucugccugaagcuuua

SEQ ID NO: 996258 - RNA, 19 nt, Homo sapiens
gaacaaccggaaccucaau

SEQ ID NO: 996259 - RNA, 19 nt, Homo sapiens
aacaagaaauccggacuuu

SEQ ID NO: 996260 - RNA, 19 nt, Homo sapiens
gaggggagaugcucacauu

SEQ ID NO: 996261 - RNA, 19 nt, Homo sapiens
caagaaauccggacuuuug

SEQ ID NO: 996262 - RNA, 19 nt, Homo sapiens
augaguuucuccucuguua

SEQ ID NO: 996263 - RNA, 19 nt, Homo sapiens
gacuuuggguugcacuuug

SEQ ID NO: 996264 - RNA, 19 nt, Homo sapiens
gccuguguaugaagaauug

SEQ ID NO: 996265 - RNA, 19 nt, Homo sapiens
gaaggaccagcucagcauu

SEQ ID NO: 996266 - RNA, 19 nt, Homo sapiens
ccgcaagccuguguaugaa

SEQ ID NO: 996267 - RNA, 19 nt, Homo sapiens
agagagaacugggaaggau

SEQ ID NO: 996268 - RNA, 19 nt, Homo sapiens
gcucuuacgccaugguuau

SEQ ID NO: 996269 - RNA, 19 nt, Homo sapiens
ccacuacucaucucuggaa

SEQ ID NO: 996270 - RNA, 19 nt, Homo sapiens
ggacuuuggguugcacuuu

SEQ ID NO: 996271 - RNA, 19 nt, Homo sapiens
ggaccacgaccucauuauc

SEQ ID NO: 996272 - RNA, 19 nt, Homo sapiens
ucucuugccugcucuuuca

SEQ ID NO: 996273 - RNA, 19 nt, Homo sapiens
gggacuggauuggacugua

SEQ ID NO: 996274 - RNA, 19 nt, Homo sapiens
ggcgagacaucccaaacau

SEQ ID NO: 996275 - RNA, 19 nt, Homo sapiens
guggagcaguuuccucaug

SEQ ID NO: 996276 - RNA, 19 nt, Homo sapiens
ccuccacccugccaucuga

SEQ ID NO: 996277 - RNA, 19 nt, Homo sapiens
gaugcugccuuuaaugacu

SEQ ID NO: 996278 - RNA, 19 nt, Homo sapiens
guuauugguuugcaggaau

SEQ ID NO: 996279 - RNA, 19 nt, Homo sapiens
gagaugcucacauuuguac

SEQ ID NO: 996280 - RNA, 19 nt, Homo sapiens
ggacaguucugcgucucau

SEQ ID NO: 996281 - RNA, 19 nt, Homo sapiens
acuuggagcugaagccauu

SEQ ID NO: 996282 - RNA, 19 nt, Homo sapiens
cgaccucauuaucugguuu

SEQ ID NO: 996283 - RNA, 19 nt, Homo sapiens
ucaucaaggucucccaugu

SEQ ID NO: 996284 - RNA, 19 nt, Homo sapiens
uuugagaguuggaacaaga

SEQ ID NO: 996285 - RNA, 19 nt, Homo sapiens
cagcuagugugucaacagu

SEQ ID NO: 996286 - RNA, 19 nt, Homo sapiens
gcauugccaagaaacauga

SEQ ID NO: 996287 - RNA, 19 nt, Homo sapiens
cagguucgcuuccguuggu

SEQ ID NO: 996288 - RNA, 19 nt, Homo sapiens
gaccacgaccucauuaucu

SEQ ID NO: 996289 - RNA, 19 nt, Homo sapiens
uccuggagaugcagaauug

SEQ ID NO: 996290 - RNA, 19 nt, Homo sapiens
ggagcaguuuccucaugga

SEQ ID NO: 996291 - RNA, 19 nt, Homo sapiens
gccaagugucguccacaua

SEQ ID NO: 996292 - RNA, 19 nt, Homo sapiens
gagccaggaugggagugaa

SEQ ID NO: 996293 - RNA, 19 nt, Homo sapiens
gaucauaagccuccuuucc

SEQ ID NO: 996294 - RNA, 19 nt, Homo sapiens
auugaacucugggaucaua

SEQ ID NO: 996295 - RNA, 19 nt, Homo sapiens
gaaccagcucaagacauuu

SEQ ID NO: 996296 - RNA, 19 nt, Homo sapiens
ggagaaccagcucaagaca

SEQ ID NO: 996297 - RNA, 19 nt, Homo sapiens
uaucugguuuggagacaug

SEQ ID NO: 996298 - RNA, 19 nt, Homo sapiens
ccgaugcugccuuuaauga

SEQ ID NO: 996299 - RNA, 19 nt, Homo sapiens
caacgcuaaucgcccacuu

SEQ ID NO: 996300 - RNA, 19 nt, Homo sapiens
acaguucugcgucucauuu

SEQ ID NO: 996301 - RNA, 19 nt, Homo sapiens
gagugaaaccagcuagugu

SEQ ID NO: 996302 - RNA, 19 nt, Homo sapiens
gcugagaugugagugaaac

SEQ ID NO: 996303 - RNA, 19 nt, Homo sapiens
aaacaguccgcgacagcua

SEQ ID NO: 996304 - RNA, 19 nt, Homo sapiens
ugacuuagccuggucucuu

SEQ ID NO: 996305 - RNA, 19 nt, Homo sapiens
cuuuauggcuacuauguca

SEQ ID NO: 996306 - RNA, 19 nt, Homo sapiens
caacaucugccugaagcuu

SEQ ID NO: 996307 - RNA, 19 nt, Homo sapiens
gggaucauaagccuccuuu

SEQ ID NO: 996308 - RNA, 19 nt, Homo sapiens
aaccggaaccucaaucuug

SEQ ID NO: 996309 - RNA, 19 nt, Homo sapiens
ggagucuuggcaucucaua

SEQ ID NO: 996310 - RNA, 19 nt, Homo sapiens
guucgggaauccauuaaaa

SEQ ID NO: 996311 - RNA, 19 nt, Homo sapiens
uaagauccuuuagggaagu

SEQ ID NO: 996312 - RNA, 19 nt, Homo sapiens
ccgggaauccgaaaucaga

SEQ ID NO: 996313 - RNA, 19 nt, Homo sapiens
ggucucccauguccguaug

SEQ ID NO: 996314 - RNA, 19 nt, Homo sapiens
aaguuacgaugcuuggauu

SEQ ID NO: 996315 - RNA, 19 nt, Homo sapiens
cccgcaagccuguguauga

SEQ ID NO: 996316 - RNA, 19 nt, Homo sapiens
gcucuguguugcauacucu

SEQ ID NO: 996317 - RNA, 19 nt, Homo sapiens
cauuugcucucuccacuac

SEQ ID NO: 996318 - RNA, 19 nt, Homo sapiens
ugaagagacagccaagugu

SEQ ID NO: 996319 - RNA, 19 nt, Homo sapiens
ccacauuuccaacaauuac

SEQ ID NO: 996320 - RNA, 19 nt, Homo sapiens
ccacugaagaugaguuucu

SEQ ID NO: 996321 - RNA, 19 nt, Homo sapiens
ccaccuacaaguuugauag

SEQ ID NO: 996322 - RNA, 19 nt, Homo sapiens
gcuuggauuugcugcuaau

SEQ ID NO: 996323 - RNA, 19 nt, Homo sapiens
gggcgagacaucccaaaca

SEQ ID NO: 996324 - RNA, 19 nt, Homo sapiens
uuacuggucuuugccaagu

SEQ ID NO: 996325 - RNA, 19 nt, Homo sapiens
ccaagugucguccacauac

SEQ ID NO: 996326 - RNA, 19 nt, Homo sapiens
gaagcacagccacagaucu

SEQ ID NO: 996327 - RNA, 19 nt, Homo sapiens
gcacaggguugucauuguc

SEQ ID NO: 996328 - RNA, 19 nt, Homo sapiens
caaaugcaccauccuguga

SEQ ID NO: 996329 - RNA, 19 nt, Homo sapiens
ugccacagaugaagaaaga

SEQ ID NO: 996330 - RNA, 19 nt, Homo sapiens
caggcuggcugcuucagaa

SEQ ID NO: 996331 - RNA, 19 nt, Homo sapiens
ccacucacuccaucuugua

SEQ ID NO: 996332 - RNA, 19 nt, Homo sapiens
ggcacaggguugucauugu

SEQ ID NO: 996333 - RNA, 19 nt, Homo sapiens
ccacucccaccaucuugua

SEQ ID NO: 996334 - RNA, 19 nt, Homo sapiens
aaagagguggagagccuua

SEQ ID NO: 996335 - RNA, 19 nt, Homo sapiens
ucccuccgcugucaccuuu

SEQ ID NO: 996336 - RNA, 19 nt, Homo sapiens
ccacucacaccauccuaug

SEQ ID NO: 996337 - RNA, 19 nt, Homo sapiens
uggagagccuuaaguacca

SEQ ID NO: 996338 - RNA, 19 nt, Homo sapiens
ggacgugccacagaugaag

SEQ ID NO: 996339 - RNA, 19 nt, Homo sapiens
ccgagcugcugaaguggau

SEQ ID NO: 996340 - RNA, 19 nt, Homo sapiens
gaacaaagauccaucauuu

SEQ ID NO: 996341 - RNA, 19 nt, Homo sapiens
ggaagaagcuauuaaacua

SEQ ID NO: 996342 - RNA, 19 nt, Homo sapiens
uaacauagcugauccagaa

SEQ ID NO: 996343 - RNA, 19 nt, Homo sapiens
gaaagaagccugauccaaa

SEQ ID NO: 996344 - RNA, 19 nt, Homo sapiens
ccaggcagcucaaugauua

SEQ ID NO: 996345 - RNA, 19 nt, Homo sapiens
caacucauguuauggguua

SEQ ID NO: 996346 - RNA, 19 nt, Homo sapiens
gaagcacaauuacaguuua

SEQ ID NO: 996347 - RNA, 19 nt, Homo sapiens
gaagcauacuccaguguuu

SEQ ID NO: 996348 - RNA, 19 nt, Homo sapiens
ccacacaaagguuaaauua

SEQ ID NO: 996349 - RNA, 19 nt, Homo sapiens
aaaccuacgucaagauuaa

SEQ ID NO: 996350 - RNA, 19 nt, Homo sapiens
guagaagucuggagauaau

SEQ ID NO: 996351 - RNA, 19 nt, Homo sapiens
gaauaacgcuagcaggaau

SEQ ID NO: 996352 - RNA, 19 nt, Homo sapiens
gauaaucacaccugcauuu

SEQ ID NO: 996353 - RNA, 19 nt, Homo sapiens
ugugacagcucauauguaa

SEQ ID NO: 996354 - RNA, 19 nt, Homo sapiens
agaaauaacugucuugagu

SEQ ID NO: 996355 - RNA, 19 nt, Homo sapiens
acaaggagauguuaaacuu

SEQ ID NO: 996356 - RNA, 19 nt, Homo sapiens
ggaagccgaagaugaaaua

SEQ ID NO: 996357 - RNA, 19 nt, Homo sapiens
caaagaaaguacagaaugg

SEQ ID NO: 996358 - RNA, 19 nt, Homo sapiens
aaggauagguguuugguaa

SEQ ID NO: 996359 - RNA, 19 nt, Homo sapiens
gggaauuacugcuauugaa

SEQ ID NO: 996360 - RNA, 19 nt, Homo sapiens
uagaagacauucagcaaga

SEQ ID NO: 996361 - RNA, 19 nt, Homo sapiens
gaaaguuguugugguguug

SEQ ID NO: 996362 - RNA, 19 nt, Homo sapiens
caacagguaugaauauaac

SEQ ID NO: 996363 - RNA, 19 nt, Homo sapiens
cauacuaucugcuuggauu

SEQ ID NO: 996364 - RNA, 19 nt, Homo sapiens
caacuaaaaucccauacua

SEQ ID NO: 996365 - RNA, 19 nt, Homo sapiens
guuuggaucugcacaguuu

SEQ ID NO: 996366 - RNA, 19 nt, Homo sapiens
gcugacagauacacagauu

SEQ ID NO: 996367 - RNA, 19 nt, Homo sapiens
gaucaacagguaugaauau

SEQ ID NO: 996368 - RNA, 19 nt, Homo sapiens
ugacagauacacagauuaa

SEQ ID NO: 996369 - RNA, 19 nt, Homo sapiens
gaagccugauccaaagaaa

SEQ ID NO: 996370 - RNA, 19 nt, Homo sapiens
ccagauugcuaccaugcua

SEQ ID NO: 996371 - RNA, 19 nt, Homo sapiens
uaaguuacgaggaugaaua

SEQ ID NO: 996372 - RNA, 19 nt, Homo sapiens
ggauagguguuugguaaug

SEQ ID NO: 996373 - RNA, 19 nt, Homo sapiens
gguguuguaugccaagaaa

SEQ ID NO: 996374 - RNA, 19 nt, Homo sapiens
gaugauuucuguccacaca

SEQ ID NO: 996375 - RNA, 19 nt, Homo sapiens
gaucauuuacccaaggaua

SEQ ID NO: 996376 - RNA, 19 nt, Homo sapiens
aaagaagccugauccaaag

SEQ ID NO: 996377 - RNA, 19 nt, Homo sapiens
gaucugcacaguuugguuu

SEQ ID NO: 996378 - RNA, 19 nt, Homo sapiens
gaguuagucuggcuucaug

SEQ ID NO: 996379 - RNA, 19 nt, Homo sapiens
gaacugauagaucguuuua

SEQ ID NO: 996380 - RNA, 19 nt, Homo sapiens
ggucuggacuaucugcauu

SEQ ID NO: 996381 - RNA, 19 nt, Homo sapiens
gaagacauucagcaagaaa

SEQ ID NO: 996382 - RNA, 19 nt, Homo sapiens
cacaauugcaucccaaaua

SEQ ID NO: 996383 - RNA, 19 nt, Homo sapiens
ccaaagaaaguacagaaug

SEQ ID NO: 996384 - RNA, 19 nt, Homo sapiens
ugagaguucuguuucuuau

SEQ ID NO: 996385 - RNA, 19 nt, Homo sapiens
uauuaugccugccuaaguu

SEQ ID NO: 996386 - RNA, 19 nt, Homo sapiens
cuaauaagcaucaguuugu

SEQ ID NO: 996387 - RNA, 19 nt, Homo sapiens
ugaggaagccgaagaugaa

SEQ ID NO: 996388 - RNA, 19 nt, Homo sapiens
uugcaacacugaagauuug

SEQ ID NO: 996389 - RNA, 19 nt, Homo sapiens
gugcaaacccugaguuguu

SEQ ID NO: 996390 - RNA, 19 nt, Homo sapiens
gagcugguccauuugauga

SEQ ID NO: 996391 - RNA, 19 nt, Homo sapiens
aaacaauccuccaacucuu

SEQ ID NO: 996392 - RNA, 19 nt, Homo sapiens
agaguucuguuucuuauuc

SEQ ID NO: 996393 - RNA, 19 nt, Homo sapiens
cgauaugcauccaaugaga

SEQ ID NO: 996394 - RNA, 19 nt, Homo sapiens
gauggcuccugaaguuauu

SEQ ID NO: 996395 - RNA, 19 nt, Homo sapiens
ugccugggaugcagaauaa

SEQ ID NO: 996396 - RNA, 19 nt, Homo sapiens
aagcaucaguuuguuguuu

SEQ ID NO: 996397 - RNA, 19 nt, Homo sapiens
gaaaauucaccgagacaua

SEQ ID NO: 996398 - RNA, 19 nt, Homo sapiens
aaauaacugucuugaguca

SEQ ID NO: 996399 - RNA, 19 nt, Homo sapiens
ucaccuguauucuaguaaa

SEQ ID NO: 996400 - RNA, 19 nt, Homo sapiens
acacagugaugaugaaucu

SEQ ID NO: 996401 - RNA, 19 nt, Homo sapiens
gcagaaggacacagugaug

SEQ ID NO: 996402 - RNA, 19 nt, Homo sapiens
aaucauagaccuugaggaa

SEQ ID NO: 996403 - RNA, 19 nt, Homo sapiens
guaaaaguauugacucuuc

SEQ ID NO: 996404 - RNA, 19 nt, Homo sapiens
gauugaagaacucgagaaa

SEQ ID NO: 996405 - RNA, 19 nt, Homo sapiens
agccgaagaugaaauagaa

SEQ ID NO: 996406 - RNA, 19 nt, Homo sapiens
ucacagcgcucggcguuca

SEQ ID NO: 996407 - RNA, 19 nt, Homo sapiens
uuacgaggaugaauaccuu

SEQ ID NO: 996408 - RNA, 19 nt, Homo sapiens
caaaccuacgucaagauua

SEQ ID NO: 996409 - RNA, 19 nt, Homo sapiens
gaagaacucgagaaaagua

SEQ ID NO: 996410 - RNA, 19 nt, Homo sapiens
gaacuucugaaacacaaau

SEQ ID NO: 996411 - RNA, 19 nt, Homo sapiens
gauccaucauuucguccua

SEQ ID NO: 996412 - RNA, 19 nt, Homo sapiens
uuggauggcuccugaaguu

SEQ ID NO: 996413 - RNA, 19 nt, Homo sapiens
uaaaaggucuggacuaucu

SEQ ID NO: 996414 - RNA, 19 nt, Homo sapiens
ucuucgagcugguccauuu

SEQ ID NO: 996415 - RNA, 19 nt, Homo sapiens
acaauugcaucccaaauac

SEQ ID NO: 996416 - RNA, 19 nt, Homo sapiens
auaaucaucuguagaaguc

SEQ ID NO: 996417 - RNA, 19 nt, Homo sapiens
gaucuuuaguugacucuac

SEQ ID NO: 996418 - RNA, 19 nt, Homo sapiens
gaaucuaccagcagggaaa

SEQ ID NO: 996419 - RNA, 19 nt, Homo sapiens
gauguuaaacuugcugauu

SEQ ID NO: 996420 - RNA, 19 nt, Homo sapiens
cauguuauggguuaaauga

SEQ ID NO: 996421 - RNA, 19 nt, Homo sapiens
ugauuucuguccacacaaa

SEQ ID NO: 996422 - RNA, 19 nt, Homo sapiens
gauagguguuugguaaugu

SEQ ID NO: 996423 - RNA, 19 nt, Homo sapiens
gguagaagaggcaauuuua

SEQ ID NO: 996424 - RNA, 19 nt, Homo sapiens
cauuugagacccuguguuu

SEQ ID NO: 996425 - RNA, 19 nt, Homo sapiens
aaacauacaggucuuucaa

SEQ ID NO: 996426 - RNA, 19 nt, Homo sapiens
ccaaaccuacgucaagauu

SEQ ID NO: 996427 - RNA, 19 nt, Homo sapiens
ugcauuugcugaacuuaaa

SEQ ID NO: 996428 - RNA, 19 nt, Homo sapiens
ccaaugagaguucuguuuc

SEQ ID NO: 996429 - RNA, 19 nt, Homo sapiens
ugacagcucauauguaaca

SEQ ID NO: 996430 - RNA, 19 nt, Homo sapiens
agacauucagcaagaaaua

SEQ ID NO: 996431 - RNA, 19 nt, Homo sapiens
ugaagcacaauuacaguuu

SEQ ID NO: 996432 - RNA, 19 nt, Homo sapiens
uaaagcugauugucaugug

SEQ ID NO: 996433 - RNA, 19 nt, Homo sapiens
cauaaaagcugccaauguc

SEQ ID NO: 996434 - RNA, 19 nt, Homo sapiens
cauagcugauccagaagaa

SEQ ID NO: 996435 - RNA, 19 nt, Homo sapiens
ucuaguaaauguugagaca

SEQ ID NO: 996436 - RNA, 19 nt, Homo sapiens
uacuauaguuucaccugua

SEQ ID NO: 996437 - RNA, 19 nt, Homo sapiens
caccaaaccuacgucaaga

SEQ ID NO: 996438 - RNA, 19 nt, Homo sapiens
cagauaaaauggugaagaa

SEQ ID NO: 996439 - RNA, 19 nt, Homo sapiens
uuaaacagcaggacgagaa

SEQ ID NO: 996440 - RNA, 19 nt, Homo sapiens
gaauacaacuguuuccuuu

SEQ ID NO: 996441 - RNA, 19 nt, Homo sapiens
ccacagagcuuucacaaau

SEQ ID NO: 996442 - RNA, 19 nt, Homo sapiens
ggagggaguuuauuauuga

SEQ ID NO: 996443 - RNA, 19 nt, Homo sapiens
ggaguucgauuuagauauu

SEQ ID NO: 996444 - RNA, 19 nt, Homo sapiens
caacaaggauuuccacaga

SEQ ID NO: 996445 - RNA, 19 nt, Homo sapiens
gacaguauuuggagauuua

SEQ ID NO: 996446 - RNA, 19 nt, Homo sapiens
gcgagggucuuauugaauu

SEQ ID NO: 996447 - RNA, 19 nt, Homo sapiens
uuaaagggcucuuccagaa

SEQ ID NO: 996448 - RNA, 19 nt, Homo sapiens
uaagagaucaggcauauau

SEQ ID NO: 996449 - RNA, 19 nt, Homo sapiens
gaauauggcuauccuacuc

SEQ ID NO: 996450 - RNA, 19 nt, Homo sapiens
cuacaucacuuugaacgua

SEQ ID NO: 996451 - RNA, 19 nt, Homo sapiens
ugacaccuaucaaguauga

SEQ ID NO: 996452 - RNA, 19 nt, Homo sapiens
gacccugucucgagaaauu

SEQ ID NO: 996453 - RNA, 19 nt, Homo sapiens
gggauuaggaugauuguaa

SEQ ID NO: 996454 - RNA, 19 nt, Homo sapiens
gaacgccuuugcuucugua

SEQ ID NO: 996455 - RNA, 19 nt, Homo sapiens
gaggcucuauggccgauua

SEQ ID NO: 996456 - RNA, 19 nt, Homo sapiens
ccacauuccuccauugaga

SEQ ID NO: 996457 - RNA, 19 nt, Homo sapiens
ccacaagccuuuccuacau

SEQ ID NO: 996458 - RNA, 19 nt, Homo sapiens
cacauacgcuugcagcuuu

SEQ ID NO: 996459 - RNA, 19 nt, Homo sapiens
agagagcgcucaacaagga

SEQ ID NO: 996460 - RNA, 19 nt, Homo sapiens
uugcauagcuauccucauu

SEQ ID NO: 996461 - RNA, 19 nt, Homo sapiens
uuacaagacugacaccuau

SEQ ID NO: 996462 - RNA, 19 nt, Homo sapiens
aauaagagaucaggcauau

SEQ ID NO: 996463 - RNA, 19 nt, Homo sapiens
gugcaagucuaauaagaga

SEQ ID NO: 996464 - RNA, 19 nt, Homo sapiens
guucaugccuggagugguu

SEQ ID NO: 996465 - RNA, 19 nt, Homo sapiens
gacccuagcuaccacauuc

SEQ ID NO: 996466 - RNA, 19 nt, Homo sapiens
gaagcuauuuugcaugaua

SEQ ID NO: 996467 - RNA, 19 nt, Homo sapiens
gguggagguugcaguauga

SEQ ID NO: 996468 - RNA, 19 nt, Homo sapiens
caugauauuucaagcaaug

SEQ ID NO: 996469 - RNA, 19 nt, Homo sapiens
cagcgagggucuuauugaa

SEQ ID NO: 996470 - RNA, 19 nt, Homo sapiens
gauauugaucccaacauuu

SEQ ID NO: 996471 - RNA, 19 nt, Homo sapiens
cggagggaguuuauuauug

SEQ ID NO: 996472 - RNA, 19 nt, Homo sapiens
caagagagcgcucaacaag

SEQ ID NO: 996473 - RNA, 19 nt, Homo sapiens
caucaugggauucuucuuu

SEQ ID NO: 996474 - RNA, 19 nt, Homo sapiens
ggacugguuuucauccuua

SEQ ID NO: 996475 - RNA, 19 nt, Homo sapiens
guaagagaaugagaaagau

SEQ ID NO: 996476 - RNA, 19 nt, Homo sapiens
ggauuaggaugauuguaag

SEQ ID NO: 996477 - RNA, 19 nt, Homo sapiens
gaucaggcauauauaucug

SEQ ID NO: 996478 - RNA, 19 nt, Homo sapiens
ccuaacagcuaaugauaag

SEQ ID NO: 996479 - RNA, 19 nt, Homo sapiens
guaauuuggaguucgauuu

SEQ ID NO: 996480 - RNA, 19 nt, Homo sapiens
cgacucuccuuuccaauuc

SEQ ID NO: 996481 - RNA, 19 nt, Homo sapiens
ugaagcaucugcagaggau

SEQ ID NO: 996482 - RNA, 19 nt, Homo sapiens
uaaguggaauuacguuaca

SEQ ID NO: 996483 - RNA, 19 nt, Homo sapiens
gagauuuagggauuugaua

SEQ ID NO: 996484 - RNA, 19 nt, Homo sapiens
auacuuaggccuuugaauu

SEQ ID NO: 996485 - RNA, 19 nt, Homo sapiens
ugggacccguuucuaaaua

SEQ ID NO: 996486 - RNA, 19 nt, Homo sapiens
uguaagagaaugagaaaga

SEQ ID NO: 996487 - RNA, 19 nt, Homo sapiens
uauggugcccuuauugaua

SEQ ID NO: 996488 - RNA, 19 nt, Homo sapiens
cugcuugguuucuucauuu

SEQ ID NO: 996489 - RNA, 19 nt, Homo sapiens
gacugacaccuaucaagua

SEQ ID NO: 996490 - RNA, 19 nt, Homo sapiens
caaggugucauauacaaug

SEQ ID NO: 996491 - RNA, 19 nt, Homo sapiens
gaaggccagugcucucaag

SEQ ID NO: 996492 - RNA, 19 nt, Homo sapiens
agauauugaucccaacauu

SEQ ID NO: 996493 - RNA, 19 nt, Homo sapiens
ugacaguauuuggagauuu

SEQ ID NO: 996494 - RNA, 19 nt, Homo sapiens
gauauaugguaagggugua

SEQ ID NO: 996495 - RNA, 19 nt, Homo sapiens
cuacauuccugcucacaca

SEQ ID NO: 996496 - RNA, 19 nt, Homo sapiens
gagcagaguacaugcacuu

SEQ ID NO: 996497 - RNA, 19 nt, Homo sapiens
gaccagagcagaguacaug

SEQ ID NO: 996498 - RNA, 19 nt, Homo sapiens
gcuaccacauuccuccauu

SEQ ID NO: 996499 - RNA, 19 nt, Homo sapiens
acagagcuuucacaaaugu

SEQ ID NO: 996500 - RNA, 19 nt, Homo sapiens
cuggagcccugaagauuga

SEQ ID NO: 996501 - RNA, 19 nt, Homo sapiens
gaagcaagccagacauggu

SEQ ID NO: 996502 - RNA, 19 nt, Homo sapiens
gcaagucuaauaagagauc

SEQ ID NO: 996503 - RNA, 19 nt, Homo sapiens
cgagggucuuauugaauuu

SEQ ID NO: 996504 - RNA, 19 nt, Homo sapiens
gcugugugguggcgauuug

SEQ ID NO: 996505 - RNA, 19 nt, Homo sapiens
gagagagagcgccgaguga

SEQ ID NO: 996506 - RNA, 19 nt, Homo sapiens
uacuuaggccuuugaauuu

SEQ ID NO: 996507 - RNA, 19 nt, Homo sapiens
ugagaaagaugaccaaaag

SEQ ID NO: 996508 - RNA, 19 nt, Homo sapiens
uaggaugauuguaagagaa

SEQ ID NO: 996509 - RNA, 19 nt, Homo sapiens
cugggaaaccuaaagauuu

SEQ ID NO: 996510 - RNA, 19 nt, Homo sapiens
ggugucauauacaauguca

SEQ ID NO: 996511 - RNA, 19 nt, Homo sapiens
cugaggagauguugcugaa

SEQ ID NO: 996512 - RNA, 19 nt, Homo sapiens
ggagguugcaguaugaugu

SEQ ID NO: 996513 - RNA, 19 nt, Homo sapiens
gagaagcaagccagacaug

SEQ ID NO: 996514 - RNA, 19 nt, Homo sapiens
gagaucaggcauauauauc

SEQ ID NO: 996515 - RNA, 19 nt, Homo sapiens
uaauaagagaucaggcaua

SEQ ID NO: 996516 - RNA, 19 nt, Homo sapiens
ggagagagaacgccuuugc

SEQ ID NO: 996517 - RNA, 19 nt, Homo sapiens
aagcgucgguggaauguuc

SEQ ID NO: 996518 - RNA, 19 nt, Homo sapiens
cagaguacaugcacuuggu

SEQ ID NO: 996519 - RNA, 19 nt, Homo sapiens
uuucggagggaguuuauua

SEQ ID NO: 996520 - RNA, 19 nt, Homo sapiens
gcucuguguuggacuagug

SEQ ID NO: 996521 - RNA, 19 nt, Homo sapiens
uucauaggcuuuaucauca

SEQ ID NO: 996522 - RNA, 19 nt, Homo sapiens
gauauuucaagcaauguga

SEQ ID NO: 996523 - RNA, 19 nt, Homo sapiens
cagcaaaccuaggcuaugc

SEQ ID NO: 996524 - RNA, 19 nt, Homo sapiens
uuaggaugauuguaagaga

SEQ ID NO: 996525 - RNA, 19 nt, Homo sapiens
uucaugggcugccuaagaa

SEQ ID NO: 996526 - RNA, 19 nt, Homo sapiens
ccuggaggcuguaauuugg

SEQ ID NO: 996527 - RNA, 19 nt, Homo sapiens
cagugagccuugauugugu

SEQ ID NO: 996528 - RNA, 19 nt, Homo sapiens
cacagagcuuucacaaaug

SEQ ID NO: 996529 - RNA, 19 nt, Homo sapiens
caugggcugccuaagaaua

SEQ ID NO: 996530 - RNA, 19 nt, Homo sapiens
uacaucugcugccuacauu

SEQ ID NO: 996531 - RNA, 19 nt, Homo sapiens
ggacccguuucuaaauaca

SEQ ID NO: 996532 - RNA, 19 nt, Homo sapiens
gcuguaauuuggaguucga

SEQ ID NO: 996533 - RNA, 19 nt, Homo sapiens
uacaugcacuugguacuug

SEQ ID NO: 996534 - RNA, 19 nt, Homo sapiens
gauuguaagagaaugagaa

SEQ ID NO: 996535 - RNA, 19 nt, Homo sapiens
uuacagauucgaagagaga

SEQ ID NO: 996536 - RNA, 19 nt, Homo sapiens
cuaagaauacugaacauac

SEQ ID NO: 996537 - RNA, 19 nt, Homo sapiens
gcauagcuauccucauucc

SEQ ID NO: 996538 - RNA, 19 nt, Homo sapiens
acugacaccuaucaaguau

SEQ ID NO: 996539 - RNA, 19 nt, Homo sapiens
ccagguggagguugcagua

SEQ ID NO: 996540 - RNA, 19 nt, Homo sapiens
gaaaggaggucaacaagaa

SEQ ID NO: 996541 - RNA, 19 nt, Homo sapiens
ugacugaccuuguugauua

SEQ ID NO: 996542 - RNA, 19 nt, Homo sapiens
ggaaagacaucucuacuau

SEQ ID NO: 996543 - RNA, 19 nt, Homo sapiens
ggaaacagcugguaaaugg

SEQ ID NO: 996544 - RNA, 19 nt, Homo sapiens
gaaagagggcaucaaauua

SEQ ID NO: 996545 - RNA, 19 nt, Homo sapiens
gcacaaagauugaguccaa

SEQ ID NO: 996546 - RNA, 19 nt, Homo sapiens
uaaaugaucuggacaguga

SEQ ID NO: 996547 - RNA, 19 nt, Homo sapiens
gaaaugaagugcucaguuc

SEQ ID NO: 996548 - RNA, 19 nt, Homo sapiens
guucaagucuguacuguua

SEQ ID NO: 996549 - RNA, 19 nt, Homo sapiens
uggcauagaugaugauuua

SEQ ID NO: 996550 - RNA, 19 nt, Homo sapiens
gaacagaguccuuaaauuc

SEQ ID NO: 996551 - RNA, 19 nt, Homo sapiens
aagaagaucuccaagaaua

SEQ ID NO: 996552 - RNA, 19 nt, Homo sapiens
gagauaaccacacuuaaua

SEQ ID NO: 996553 - RNA, 19 nt, Homo sapiens
gaaguuguaucucaaaguu

SEQ ID NO: 996554 - RNA, 19 nt, Homo sapiens
ggacuuaccuucaaccaau

SEQ ID NO: 996555 - RNA, 19 nt, Homo sapiens
gaauauagcuuugguugug

SEQ ID NO: 996556 - RNA, 19 nt, Homo sapiens
uagcagaguuucuuguuua

SEQ ID NO: 996557 - RNA, 19 nt, Homo sapiens
ggauuuggauguugccuua

SEQ ID NO: 996558 - RNA, 19 nt, Homo sapiens
gcaaagccauugagaacuu

SEQ ID NO: 996559 - RNA, 19 nt, Homo sapiens
ggaacagaguccuuaaauu

SEQ ID NO: 996560 - RNA, 19 nt, Homo sapiens
gaaauuaaacugagugaug

SEQ ID NO: 996561 - RNA, 19 nt, Homo sapiens
guuuaaaucugcacuagua

SEQ ID NO: 996562 - RNA, 19 nt, Homo sapiens
gauagaaagugaugaggaa

SEQ ID NO: 996563 - RNA, 19 nt, Homo sapiens
uaagccaucucuugaauuu

SEQ ID NO: 996564 - RNA, 19 nt, Homo sapiens
gcaacaugauaccaacuua

SEQ ID NO: 996565 - RNA, 19 nt, Homo sapiens
aaagauaucuccaccauca

SEQ ID NO: 996566 - RNA, 19 nt, Homo sapiens
cuacagauuugaugaguuu

SEQ ID NO: 996567 - RNA, 19 nt, Homo sapiens
gaagaaacugagaaacuua

SEQ ID NO: 996568 - RNA, 19 nt, Homo sapiens
ugagaaaucuacugaagaa

SEQ ID NO: 996569 - RNA, 19 nt, Homo sapiens
gaacagaaagaaagugaaa

SEQ ID NO: 996570 - RNA, 19 nt, Homo sapiens
gaagaagagucaacagcuu

SEQ ID NO: 996571 - RNA, 19 nt, Homo sapiens
caggugagcuugagaaaga

SEQ ID NO: 996572 - RNA, 19 nt, Homo sapiens
uuaagaagaucuccaagaa

SEQ ID NO: 996573 - RNA, 19 nt, Homo sapiens
gaauuugguggcaauauua

SEQ ID NO: 996574 - RNA, 19 nt, Homo sapiens
gaggaaagaugcagauagu

SEQ ID NO: 996575 - RNA, 19 nt, Homo sapiens
gagagugacugaccuuguu

SEQ ID NO: 996576 - RNA, 19 nt, Homo sapiens
gauguugccuuaaagaaga

SEQ ID NO: 996577 - RNA, 19 nt, Homo sapiens
aaacuucucuugauucuuc

SEQ ID NO: 996578 - RNA, 19 nt, Homo sapiens
caagaacucugaagaugau

SEQ ID NO: 996579 - RNA, 19 nt, Homo sapiens
gcagaaagagggcaucaaa

SEQ ID NO: 996580 - RNA, 19 nt, Homo sapiens
uaacagccuuugugaaaug

SEQ ID NO: 996581 - RNA, 19 nt, Homo sapiens
gaagaaguuccaaagagua

SEQ ID NO: 996582 - RNA, 19 nt, Homo sapiens
guccuuaaauucugucaua

SEQ ID NO: 996583 - RNA, 19 nt, Homo sapiens
gaaagaaagugaaaagaug

SEQ ID NO: 996584 - RNA, 19 nt, Homo sapiens
gaaagagcgugccgaacga

SEQ ID NO: 996585 - RNA, 19 nt, Homo sapiens
gaaaggguagcuccaaauu

SEQ ID NO: 996586 - RNA, 19 nt, Homo sapiens
caacaaauccugaagucuu

SEQ ID NO: 996587 - RNA, 19 nt, Homo sapiens
caaagaagacucagaaagu

SEQ ID NO: 996588 - RNA, 19 nt, Homo sapiens
ggaggaaucugaggagaau

SEQ ID NO: 996589 - RNA, 19 nt, Homo sapiens
gaggaugaauucaagauca

SEQ ID NO: 996590 - RNA, 19 nt, Homo sapiens
ucacaaagguagaaaugga

SEQ ID NO: 996591 - RNA, 19 nt, Homo sapiens
guacacaagcgaagacuuu

SEQ ID NO: 996592 - RNA, 19 nt, Homo sapiens
aaaugugggucguacuuua

SEQ ID NO: 996593 - RNA, 19 nt, Homo sapiens
aaagagggcaucaaauuaa

SEQ ID NO: 996594 - RNA, 19 nt, Homo sapiens
ugacgagaaucauuucaaa

SEQ ID NO: 996595 - RNA, 19 nt, Homo sapiens
gacaaaggguucuaugcaa

SEQ ID NO: 996596 - RNA, 19 nt, Homo sapiens
ggagauaaccacacuuaau

SEQ ID NO: 996597 - RNA, 19 nt, Homo sapiens
caagaagcccuaccggaua

SEQ ID NO: 996598 - RNA, 19 nt, Homo sapiens
gaaauggaaacuucucuug

SEQ ID NO: 996599 - RNA, 19 nt, Homo sapiens
gcugguaaauggagaaguu

SEQ ID NO: 996600 - RNA, 19 nt, Homo sapiens
ugaagaaacugagaaacuu

SEQ ID NO: 996601 - RNA, 19 nt, Homo sapiens
gaaaucuacugaagaaacu

SEQ ID NO: 996602 - RNA, 19 nt, Homo sapiens
cgaauuugguggcaauauu

SEQ ID NO: 996603 - RNA, 19 nt, Homo sapiens
gagcagauccuaaagauac

SEQ ID NO: 996604 - RNA, 19 nt, Homo sapiens
gaaggaauguagagcagau

SEQ ID NO: 996605 - RNA, 19 nt, Homo sapiens
ccaauaagguauaaagaag

SEQ ID NO: 996606 - RNA, 19 nt, Homo sapiens
gaacuuguuuacuauugga

SEQ ID NO: 996607 - RNA, 19 nt, Homo sapiens
ggaaagaugcagauaguuc

SEQ ID NO: 996608 - RNA, 19 nt, Homo sapiens
ggagcagccuauggauuua

SEQ ID NO: 996609 - RNA, 19 nt, Homo sapiens
aaacuccacuacagaauga

SEQ ID NO: 996610 - RNA, 19 nt, Homo sapiens
gcacagacgaguauucaga

SEQ ID NO: 996611 - RNA, 19 nt, Homo sapiens
ugagcuagcuaaagaauca

SEQ ID NO: 996612 - RNA, 19 nt, Homo sapiens
uaaguugguuccugaagaa

SEQ ID NO: 996613 - RNA, 19 nt, Homo sapiens
caaauauagucuucuggaa

SEQ ID NO: 996614 - RNA, 19 nt, Homo sapiens
uaagaaagugccaauguuu

SEQ ID NO: 996615 - RNA, 19 nt, Homo sapiens
gaggaacaguugcaggauu

SEQ ID NO: 996616 - RNA, 19 nt, Homo sapiens
agaaagagggcaucaaauu

SEQ ID NO: 996617 - RNA, 19 nt, Homo sapiens
ggaaacuucucuugauucu

SEQ ID NO: 996618 - RNA, 19 nt, Homo sapiens
gaacaagagagcaccaaga

SEQ ID NO: 996619 - RNA, 19 nt, Homo sapiens
gaaauaaggcgaguacaca

SEQ ID NO: 996620 - RNA, 19 nt, Homo sapiens
cgaaggcggucaaggagaa

SEQ ID NO: 996621 - RNA, 19 nt, Homo sapiens
gagcgaggaugaauucaag

SEQ ID NO: 996622 - RNA, 19 nt, Homo sapiens
gaagggaaacagcugguaa

SEQ ID NO: 996623 - RNA, 19 nt, Homo sapiens
ccugagcucuccugacuuu

SEQ ID NO: 996624 - RNA, 19 nt, Homo sapiens
gaagaaagaccccaaagaa

SEQ ID NO: 996625 - RNA, 19 nt, Homo sapiens
gaaagacaucucuacuauu

SEQ ID NO: 996626 - RNA, 19 nt, Homo sapiens
ucaaauauccaaugacaga

SEQ ID NO: 996627 - RNA, 19 nt, Homo sapiens
gguggcauuugauaaagua

SEQ ID NO: 996628 - RNA, 19 nt, Homo sapiens
guacuaacuucugaaaugu

SEQ ID NO: 996629 - RNA, 19 nt, Homo sapiens
gaagaggacuuugaaaaug

SEQ ID NO: 996630 - RNA, 19 nt, Homo sapiens
ugacaaugcucauggagau

SEQ ID NO: 996631 - RNA, 19 nt, Homo sapiens
gaaaagaacgcuuggugua

SEQ ID NO: 996632 - RNA, 19 nt, Homo sapiens
aacauaaacugcucuguga

SEQ ID NO: 996633 - RNA, 19 nt, Homo sapiens
uagcuuugguuguguuuaa

SEQ ID NO: 996634 - RNA, 19 nt, Homo sapiens
acaaaggguucuaugcaaa

SEQ ID NO: 996635 - RNA, 19 nt, Homo sapiens
caugaaaggugaagagaag

SEQ ID NO: 996636 - RNA, 19 nt, Homo sapiens
ggaaugcagucuguauaau

SEQ ID NO: 996637 - RNA, 19 nt, Homo sapiens
guaauaggauaugggcuuu

SEQ ID NO: 996638 - RNA, 19 nt, Homo sapiens
ggacagagcccuggcaaag

SEQ ID NO: 996639 - RNA, 19 nt, Homo sapiens
gaagauccgccauccaaug

SEQ ID NO: 996640 - RNA, 19 nt, Homo sapiens
ggaaauaccuucuaauuga

SEQ ID NO: 996641 - RNA, 19 nt, Homo sapiens
gaacugaucuggcuuguca

SEQ ID NO: 996642 - RNA, 19 nt, Homo sapiens
ccaaaggaaugcauuauuu

SEQ ID NO: 996643 - RNA, 19 nt, Homo sapiens
gaaguggauuguaggaaua

SEQ ID NO: 996644 - RNA, 19 nt, Homo sapiens
gaaagacguuuaaagaugu

SEQ ID NO: 996645 - RNA, 19 nt, Homo sapiens
gcacuaaacauguccauuu

SEQ ID NO: 996646 - RNA, 19 nt, Homo sapiens
gaaauuaacccaugauuac

SEQ ID NO: 996647 - RNA, 19 nt, Homo sapiens
ggaaaguucuacaggguuu

SEQ ID NO: 996648 - RNA, 19 nt, Homo sapiens
gguaguauaucacucaauu

SEQ ID NO: 996649 - RNA, 19 nt, Homo sapiens
ggagugcacugucacauau

SEQ ID NO: 996650 - RNA, 19 nt, Homo sapiens
gaagauacccuggaaaguu

SEQ ID NO: 996651 - RNA, 19 nt, Homo sapiens
ggauauggaucacauuaug

SEQ ID NO: 996652 - RNA, 19 nt, Homo sapiens
gaauugaacuacauagcuu

SEQ ID NO: 996653 - RNA, 19 nt, Homo sapiens
aaacaacgcuccauaaagg

SEQ ID NO: 996654 - RNA, 19 nt, Homo sapiens
gaucauaacuaggcuugaa

SEQ ID NO: 996655 - RNA, 19 nt, Homo sapiens
cagcagagaugaguguaua

SEQ ID NO: 996656 - RNA, 19 nt, Homo sapiens
ggaguaagacaguaaauau

SEQ ID NO: 996657 - RNA, 19 nt, Homo sapiens
guauaucacucaauucuuc

SEQ ID NO: 996658 - RNA, 19 nt, Homo sapiens
gaacaaaaccucaggauga

SEQ ID NO: 996659 - RNA, 19 nt, Homo sapiens
agaaagacguuuaaagaug

SEQ ID NO: 996660 - RNA, 19 nt, Homo sapiens
ggagguggcuguaaagaag

SEQ ID NO: 996661 - RNA, 19 nt, Homo sapiens
acacagagcaagacaauaa

SEQ ID NO: 996662 - RNA, 19 nt, Homo sapiens
gcagguaccucacucaucu

SEQ ID NO: 996663 - RNA, 19 nt, Homo sapiens
cgagaaagacguuuaaaga

SEQ ID NO: 996664 - RNA, 19 nt, Homo sapiens
gaagugaggagauggauau

SEQ ID NO: 996665 - RNA, 19 nt, Homo sapiens
uaaagaagcuccucaaaau

SEQ ID NO: 996666 - RNA, 19 nt, Homo sapiens
acaauaacaucacaagcua

SEQ ID NO: 996667 - RNA, 19 nt, Homo sapiens
gaagaagaccugaaagaca

SEQ ID NO: 996668 - RNA, 19 nt, Homo sapiens
gcaaggcacuguuacugau

SEQ ID NO: 996669 - RNA, 19 nt, Homo sapiens
gcaagcuuguuuaaagaaa

SEQ ID NO: 996670 - RNA, 19 nt, Homo sapiens
ggaagacgauguguauugu

SEQ ID NO: 996671 - RNA, 19 nt, Homo sapiens
ggaagcugaugccaagaaa

SEQ ID NO: 996672 - RNA, 19 nt, Homo sapiens
gaagaucugugacuuuggu

SEQ ID NO: 996673 - RNA, 19 nt, Homo sapiens
uaacagaagugaggagaug

SEQ ID NO: 996674 - RNA, 19 nt, Homo sapiens
agagaaagaggcagaaaua

SEQ ID NO: 996675 - RNA, 19 nt, Homo sapiens
ggauccaacuugugaaaug

SEQ ID NO: 996676 - RNA, 19 nt, Homo sapiens
cgacugcuuucaaauacua

SEQ ID NO: 996677 - RNA, 19 nt, Homo sapiens
uaugaucccuucagauuga

SEQ ID NO: 996678 - RNA, 19 nt, Homo sapiens
gaaauaccuucuaauugag

SEQ ID NO: 996679 - RNA, 19 nt, Homo sapiens
gaacuggcccacaggauug

SEQ ID NO: 996680 - RNA, 19 nt, Homo sapiens
gaaauugaggcaacucuug

SEQ ID NO: 996681 - RNA, 19 nt, Homo sapiens
acaaggagguggcuguaaa

SEQ ID NO: 996682 - RNA, 19 nt, Homo sapiens
uaacuaggcuugaaaauca

SEQ ID NO: 996683 - RNA, 19 nt, Homo sapiens
gaagaggacagcaaaguca

SEQ ID NO: 996684 - RNA, 19 nt, Homo sapiens
ggaggaagaagaccugaaa

SEQ ID NO: 996685 - RNA, 19 nt, Homo sapiens
gggaaauaccuucuaauug

SEQ ID NO: 996686 - RNA, 19 nt, Homo sapiens
gaaagaggcagaaauacuc

SEQ ID NO: 996687 - RNA, 19 nt, Homo sapiens
gcaagacaauaacaucaca

SEQ ID NO: 996688 - RNA, 19 nt, Homo sapiens
ccacugauauucugguuag

SEQ ID NO: 996689 - RNA, 19 nt, Homo sapiens
acagaaacaucauccaguu

SEQ ID NO: 996690 - RNA, 19 nt, Homo sapiens
ucauuuagcuugauuaucg

SEQ ID NO: 996691 - RNA, 19 nt, Homo sapiens
gagaaagacguuuaaagau

SEQ ID NO: 996692 - RNA, 19 nt, Homo sapiens
gaguggaggugcgaaauug

SEQ ID NO: 996693 - RNA, 19 nt, Homo sapiens
aaacuucucuucccuacau

SEQ ID NO: 996694 - RNA, 19 nt, Homo sapiens
gcaauaaccuacauaaaag

SEQ ID NO: 996695 - RNA, 19 nt, Homo sapiens
caagucagccauugagaaa

SEQ ID NO: 996696 - RNA, 19 nt, Homo sapiens
gagcagcugugggcaaaga

SEQ ID NO: 996697 - RNA, 19 nt, Homo sapiens
caaaggagcaaagaggaua

SEQ ID NO: 996698 - RNA, 19 nt, Homo sapiens
ggaacuggcccacaggauu

SEQ ID NO: 996699 - RNA, 19 nt, Homo sapiens
uaugcaagcuuguuuaaag

SEQ ID NO: 996700 - RNA, 19 nt, Homo sapiens
ccaagaaacggccaucauu

SEQ ID NO: 996701 - RNA, 19 nt, Homo sapiens
caagaaacguuguuauagc

SEQ ID NO: 996702 - RNA, 19 nt, Homo sapiens
gucaagaaacguuguuaua

SEQ ID NO: 996703 - RNA, 19 nt, Homo sapiens
ucacagagaccucaaguca

SEQ ID NO: 996704 - RNA, 19 nt, Homo sapiens
caacacacauguccuuggu

SEQ ID NO: 996705 - RNA, 19 nt, Homo sapiens
gugaggagauggauaugga

SEQ ID NO: 996706 - RNA, 19 nt, Homo sapiens
guaccucacucaucucauc

SEQ ID NO: 996707 - RNA, 19 nt, Homo sapiens
ggacggaagacgaugugua

SEQ ID NO: 996708 - RNA, 19 nt, Homo sapiens
acagagaccucaagucaag

SEQ ID NO: 996709 - RNA, 19 nt, Homo sapiens
cagcgacugcuuucaaaua

SEQ ID NO: 996710 - RNA, 19 nt, Homo sapiens
gauugccagugguuagaua

SEQ ID NO: 996711 - RNA, 19 nt, Homo sapiens
ugacaaguguaacucauuc

SEQ ID NO: 996712 - RNA, 19 nt, Homo sapiens
cuacaggguuucucaguca

SEQ ID NO: 996713 - RNA, 19 nt, Homo sapiens
gacagaagcaggaacaaau

SEQ ID NO: 996714 - RNA, 19 nt, Homo sapiens
uccagaagcucgucuccua

SEQ ID NO: 996715 - RNA, 19 nt, Homo sapiens
ugaaagacaugggcauugu

SEQ ID NO: 996716 - RNA, 19 nt, Homo sapiens
cuaaacauguccauuugau

SEQ ID NO: 996717 - RNA, 19 nt, Homo sapiens
gggaugaaauugcaauaac

SEQ ID NO: 996718 - RNA, 19 nt, Homo sapiens
agucagccauugagaaauu

SEQ ID NO: 996719 - RNA, 19 nt, Homo sapiens
aagaagaccugaaagacau

SEQ ID NO: 996720 - RNA, 19 nt, Homo sapiens
uauagcugcugauggagua

SEQ ID NO: 996721 - RNA, 19 nt, Homo sapiens
gcuaaaagccagagaaauu

SEQ ID NO: 996722 - RNA, 19 nt, Homo sapiens
aauaugaucccuucagauu

SEQ ID NO: 996723 - RNA, 19 nt, Homo sapiens
ucacucaauucuucuccua

SEQ ID NO: 996724 - RNA, 19 nt, Homo sapiens
aaacauguccauuugauuc

SEQ ID NO: 996725 - RNA, 19 nt, Homo sapiens
gaugacaaagccaccauuu

SEQ ID NO: 996726 - RNA, 19 nt, Homo sapiens
gagcgugaucucagcuuua

SEQ ID NO: 996727 - RNA, 19 nt, Homo sapiens
gggcauaucauucacuuca

SEQ ID NO: 996728 - RNA, 19 nt, Homo sapiens
uuaaagaugugggagcaaa

SEQ ID NO: 996729 - RNA, 19 nt, Homo sapiens
agaggaagauacaguggaa

SEQ ID NO: 996730 - RNA, 19 nt, Homo sapiens
cacuaaacauguccauuug

SEQ ID NO: 996731 - RNA, 19 nt, Homo sapiens
agaaguggauuguaggaau

SEQ ID NO: 996732 - RNA, 19 nt, Homo sapiens
gcauaucauucacuucaag

SEQ ID NO: 996733 - RNA, 19 nt, Homo sapiens
guauaugcaagcuuguuua

SEQ ID NO: 996734 - RNA, 19 nt, Homo sapiens
aacgagagauuaaccauuc

SEQ ID NO: 996735 - RNA, 19 nt, Homo sapiens
uguuauagcugcugaugga

SEQ ID NO: 996736 - RNA, 19 nt, Homo sapiens
gagcaagacaauaacauca

SEQ ID NO: 996737 - RNA, 19 nt, Homo sapiens
aagauacccuggaaaguuc

SEQ ID NO: 996738 - RNA, 19 nt, Homo sapiens
aaacugcgguggaggaagu

SEQ ID NO: 996739 - RNA, 19 nt, Homo sapiens
ggaagcagguccgacucaa

SEQ ID NO: 996740 - RNA, 19 nt, Homo sapiens
ggaccuaacuuuaucauua

SEQ ID NO: 996741 - RNA, 19 nt, Homo sapiens
gcaggucacuuucccauua

SEQ ID NO: 996742 - RNA, 19 nt, Homo sapiens
gaaaggacaucaucauaga

SEQ ID NO: 996743 - RNA, 19 nt, Homo sapiens
gaacaaacauucuuaacuc

SEQ ID NO: 996744 - RNA, 19 nt, Homo sapiens
ccaaaggaaugcauuauuu

SEQ ID NO: 996745 - RNA, 19 nt, Homo sapiens
gaaaggagugucauuauuu

SEQ ID NO: 996746 - RNA, 19 nt, Homo sapiens
caaauguggugccugauua

SEQ ID NO: 996747 - RNA, 19 nt, Homo sapiens
gaauuaagccaaagaagua

SEQ ID NO: 996748 - RNA, 19 nt, Homo sapiens
gcaaaugcaucauauguuc

SEQ ID NO: 996749 - RNA, 19 nt, Homo sapiens
gaagauagcuagaugaaaa

SEQ ID NO: 996750 - RNA, 19 nt, Homo sapiens
gaaagacguuuaaagaugu

SEQ ID NO: 996751 - RNA, 19 nt, Homo sapiens
gcaauacguuuagaacaua

SEQ ID NO: 996752 - RNA, 19 nt, Homo sapiens
ggucauagcucauuacucu

SEQ ID NO: 996753 - RNA, 19 nt, Homo sapiens
gaacauaugaacugaauga

SEQ ID NO: 996754 - RNA, 19 nt, Homo sapiens
gagugaagaucgaugauaa

SEQ ID NO: 996755 - RNA, 19 nt, Homo sapiens
gcagagaugucaugucaga

SEQ ID NO: 996756 - RNA, 19 nt, Homo sapiens
gcucagacauagagaagua

SEQ ID NO: 996757 - RNA, 19 nt, Homo sapiens
ugagauagcuacaguucua

SEQ ID NO: 996758 - RNA, 19 nt, Homo sapiens
gcagaaagcaaaguaauaa

SEQ ID NO: 996759 - RNA, 19 nt, Homo sapiens
gcaaagauagucauucauu

SEQ ID NO: 996760 - RNA, 19 nt, Homo sapiens
gaaacccuguugcuacuaa

SEQ ID NO: 996761 - RNA, 19 nt, Homo sapiens
ccaagcaccuacauuaauu

SEQ ID NO: 996762 - RNA, 19 nt, Homo sapiens
ggauauggaucacauuaug

SEQ ID NO: 996763 - RNA, 19 nt, Homo sapiens
gcacaaaguccacagugua

SEQ ID NO: 996764 - RNA, 19 nt, Homo sapiens
gcacagguccuuuccauau

SEQ ID NO: 996765 - RNA, 19 nt, Homo sapiens
gcacagcugcucaaaguaa

SEQ ID NO: 996766 - RNA, 19 nt, Homo sapiens
agaaugaccucccagaauu

SEQ ID NO: 996767 - RNA, 19 nt, Homo sapiens
gaggauugcuugagaccua

SEQ ID NO: 996768 - RNA, 19 nt, Homo sapiens
gaaagcagaaagcaaagua

SEQ ID NO: 996769 - RNA, 19 nt, Homo sapiens
guaaagaucauuuggaaga

SEQ ID NO: 996770 - RNA, 19 nt, Homo sapiens
uccagaagcuuuagaguuu

SEQ ID NO: 996771 - RNA, 19 nt, Homo sapiens
gcaggaggauugcuugaga

SEQ ID NO: 996772 - RNA, 19 nt, Homo sapiens
agaaagacguuuaaagaug

SEQ ID NO: 996773 - RNA, 19 nt, Homo sapiens
ggagguggcuguaaagaag

SEQ ID NO: 996774 - RNA, 19 nt, Homo sapiens
ggagaaauaacuaguagaa

SEQ ID NO: 996775 - RNA, 19 nt, Homo sapiens
cgagaaagacguuuaaaga

SEQ ID NO: 996776 - RNA, 19 nt, Homo sapiens
gaacuggacuauugaucau

SEQ ID NO: 996777 - RNA, 19 nt, Homo sapiens
caacaacaauacugagaug

SEQ ID NO: 996778 - RNA, 19 nt, Homo sapiens
guaauucugugacauacuu

SEQ ID NO: 996779 - RNA, 19 nt, Homo sapiens
gugcagagaugucauguca

SEQ ID NO: 996780 - RNA, 19 nt, Homo sapiens
gaagugaggagauggauau

SEQ ID NO: 996781 - RNA, 19 nt, Homo sapiens
uaaagaagcuccucaaaau

SEQ ID NO: 996782 - RNA, 19 nt, Homo sapiens
gguaagacuauuucaguua

SEQ ID NO: 996783 - RNA, 19 nt, Homo sapiens
caggaaaucuagaagacua

SEQ ID NO: 996784 - RNA, 19 nt, Homo sapiens
gaaugaccucccagaauua

SEQ ID NO: 996785 - RNA, 19 nt, Homo sapiens
acaacacacugucauuuaa

SEQ ID NO: 996786 - RNA, 19 nt, Homo sapiens
cagcagauguugcaaacuu

SEQ ID NO: 996787 - RNA, 19 nt, Homo sapiens
caaacauucuuaacuccua

SEQ ID NO: 996788 - RNA, 19 nt, Homo sapiens
guagcagaguuucaucaua

SEQ ID NO: 996789 - RNA, 19 nt, Homo sapiens
gacguuggcucuauuacuu

SEQ ID NO: 996790 - RNA, 19 nt, Homo sapiens
agaaaggagugucauuauu

SEQ ID NO: 996791 - RNA, 19 nt, Homo sapiens
ggaagcugaugccaagaaa

SEQ ID NO: 996792 - RNA, 19 nt, Homo sapiens
gaagaucugugacuuuggu

SEQ ID NO: 996793 - RNA, 19 nt, Homo sapiens
gcagagaggcggaauguuc

SEQ ID NO: 996794 - RNA, 19 nt, Homo sapiens
gaaacagugagaaauguaa

SEQ ID NO: 996795 - RNA, 19 nt, Homo sapiens
guucaugccucuccuguau

SEQ ID NO: 996796 - RNA, 19 nt, Homo sapiens
uaacagaagugaggagaug

SEQ ID NO: 996797 - RNA, 19 nt, Homo sapiens
agagaaagaggcagaaaua

SEQ ID NO: 996798 - RNA, 19 nt, Homo sapiens
gaagagagagccaauagca

SEQ ID NO: 996799 - RNA, 19 nt, Homo sapiens
gacuucgucucuacuaaua

SEQ ID NO: 996800 - RNA, 19 nt, Homo sapiens
gagcaaguccuaugccaaa

SEQ ID NO: 996801 - RNA, 19 nt, Homo sapiens
acaaggagguggcuguaaa

SEQ ID NO: 996802 - RNA, 19 nt, Homo sapiens
guugagacauucuggcuuu

SEQ ID NO: 996803 - RNA, 19 nt, Homo sapiens
ggaggaggauaaugacaug

SEQ ID NO: 996804 - RNA, 19 nt, Homo sapiens
gaaauugaggcaacucuug

SEQ ID NO: 996805 - RNA, 19 nt, Homo sapiens
caaguccuaugccaaauau

SEQ ID NO: 996806 - RNA, 19 nt, Homo sapiens
uagauggcauuaucacuuu

SEQ ID NO: 996807 - RNA, 19 nt, Homo sapiens
guuccaagcaccuacauua

SEQ ID NO: 996808 - RNA, 19 nt, Homo sapiens
gcagugagcugagauugca

SEQ ID NO: 996809 - RNA, 19 nt, Homo sapiens
ugucucaccuuucaucuuu

SEQ ID NO: 996810 - RNA, 19 nt, Homo sapiens
gaauuagaauacagcagaa

SEQ ID NO: 996811 - RNA, 19 nt, Homo sapiens
caaagauagucauucauuc

SEQ ID NO: 996812 - RNA, 19 nt, Homo sapiens
ggggauaucuucucaauga

SEQ ID NO: 996813 - RNA, 19 nt, Homo sapiens
gcaaguccuaugccaaaua

SEQ ID NO: 996814 - RNA, 19 nt, Homo sapiens
guacuggaccuaacuuuau

SEQ ID NO: 996815 - RNA, 19 nt, Homo sapiens
aaagagaacaugcuuagaa

SEQ ID NO: 996816 - RNA, 19 nt, Homo sapiens
gaaugucugaggagucuua

SEQ ID NO: 996817 - RNA, 19 nt, Homo sapiens
gaaagaggcagaaauacuc

SEQ ID NO: 996818 - RNA, 19 nt, Homo sapiens
gcaauguuauucugagcaa

SEQ ID NO: 996819 - RNA, 19 nt, Homo sapiens
gaauuggccucagugaaga

SEQ ID NO: 996820 - RNA, 19 nt, Homo sapiens
ugacauggauaauagugaa

SEQ ID NO: 996821 - RNA, 19 nt, Homo sapiens
acagaaacaucauccaguu

SEQ ID NO: 996822 - RNA, 19 nt, Homo sapiens
cuacaguucuauagguuaa

SEQ ID NO: 996823 - RNA, 19 nt, Homo sapiens
cagcauacgaccugaauuu

SEQ ID NO: 996824 - RNA, 19 nt, Homo sapiens
ucguagaacuggacuauug

SEQ ID NO: 996825 - RNA, 19 nt, Homo sapiens
caaauagggccaaagagaa

SEQ ID NO: 996826 - RNA, 19 nt, Homo sapiens
gauaaagagaacaugcuua

SEQ ID NO: 996827 - RNA, 19 nt, Homo sapiens
aaaggagugucauuauuug

SEQ ID NO: 996828 - RNA, 19 nt, Homo sapiens
gcaaauguggugccugauu

SEQ ID NO: 996829 - RNA, 19 nt, Homo sapiens
ugaggagucuuacuuugaa

SEQ ID NO: 996830 - RNA, 19 nt, Homo sapiens
gagaaagacguuuaaagau

SEQ ID NO: 996831 - RNA, 19 nt, Homo sapiens
gaguggaggugcgaaauug

SEQ ID NO: 996832 - RNA, 19 nt, Homo sapiens
ggagcuuucuggcauguga

SEQ ID NO: 996833 - RNA, 19 nt, Homo sapiens
ccaaauagggccaaagaga

SEQ ID NO: 996834 - RNA, 19 nt, Homo sapiens
uaacccugcuuaauaaugu

SEQ ID NO: 996835 - RNA, 19 nt, Homo sapiens
uuucguggcuuuaucuuaa

SEQ ID NO: 996836 - RNA, 19 nt, Homo sapiens
ccaacuacuugauuuacaa

SEQ ID NO: 996837 - RNA, 19 nt, Homo sapiens
gcuugggacuccugucuuu

SEQ ID NO: 996838 - RNA, 19 nt, Homo sapiens
uaacaacacacugucauuu

SEQ ID NO: 996839 - RNA, 19 nt, Homo sapiens
caacaauacugagaugauc

SEQ ID NO: 996840 - RNA, 19 nt, Homo sapiens
gcacauaucuaucguaaua

SEQ ID NO: 996841 - RNA, 19 nt, Homo sapiens
gaaaguaucugaaagcaau

SEQ ID NO: 996842 - RNA, 19 nt, Homo sapiens
gaagaaaugucucaucaau

SEQ ID NO: 996843 - RNA, 19 nt, Homo sapiens
gaagaccuauucagaguuu

SEQ ID NO: 996844 - RNA, 19 nt, Homo sapiens
ggagagauaugaagaccua

SEQ ID NO: 996845 - RNA, 19 nt, Homo sapiens
ucacuugucuucauucaua

SEQ ID NO: 996846 - RNA, 19 nt, Homo sapiens
caacauugcuccaggauau

SEQ ID NO: 996847 - RNA, 19 nt, Homo sapiens
caaauaaaguacaccguaa

SEQ ID NO: 996848 - RNA, 19 nt, Homo sapiens
ggaagaugauguacaaaug

SEQ ID NO: 996849 - RNA, 19 nt, Homo sapiens
ccacagcugucccuaagua

SEQ ID NO: 996850 - RNA, 19 nt, Homo sapiens
gcuaacagaucccagguuu

SEQ ID NO: 996851 - RNA, 19 nt, Homo sapiens
ggcagacgguccuuuaaua

SEQ ID NO: 996852 - RNA, 19 nt, Homo sapiens
gaaggacuguguguaguaa

SEQ ID NO: 996853 - RNA, 19 nt, Homo sapiens
agaaaugucucaucaauag

SEQ ID NO: 996854 - RNA, 19 nt, Homo sapiens
caaagaagaucugacaaau

SEQ ID NO: 996855 - RNA, 19 nt, Homo sapiens
caacagccaucaugaagga

SEQ ID NO: 996856 - RNA, 19 nt, Homo sapiens
ggauggauaucugagaaua

SEQ ID NO: 996857 - RNA, 19 nt, Homo sapiens
gaagaauuaucccaucuca

SEQ ID NO: 996858 - RNA, 19 nt, Homo sapiens
ugaaagcuauggaagauga

SEQ ID NO: 996859 - RNA, 19 nt, Homo sapiens
gcacaaauaaaucacagua

SEQ ID NO: 996860 - RNA, 19 nt, Homo sapiens
gaugaaagcuauggaagau

SEQ ID NO: 996861 - RNA, 19 nt, Homo sapiens
gagaauauuccuauaguga

SEQ ID NO: 996862 - RNA, 19 nt, Homo sapiens
caaguggaaucuagaauca

SEQ ID NO: 996863 - RNA, 19 nt, Homo sapiens
gaaaguggauggaaguaac

SEQ ID NO: 996864 - RNA, 19 nt, Homo sapiens
aagaagaucugacaaauac

SEQ ID NO: 996865 - RNA, 19 nt, Homo sapiens
gaagaaggacuguguguag

SEQ ID NO: 996866 - RNA, 19 nt, Homo sapiens
ggaaagaguaaguaauuug

SEQ ID NO: 996867 - RNA, 19 nt, Homo sapiens
ucaaggagacugagaauga

SEQ ID NO: 996868 - RNA, 19 nt, Homo sapiens
gguaauuuauucuggauga

SEQ ID NO: 996869 - RNA, 19 nt, Homo sapiens
auaccaaguugcaacauua

SEQ ID NO: 996870 - RNA, 19 nt, Homo sapiens
uagcacauaucuaucguaa

SEQ ID NO: 996871 - RNA, 19 nt, Homo sapiens
gggaguacaugcuuuagga

SEQ ID NO: 996872 - RNA, 19 nt, Homo sapiens
caaccgaaccuacagauga

SEQ ID NO: 996873 - RNA, 19 nt, Homo sapiens
uaagaugcgucaaagaaga

SEQ ID NO: 996874 - RNA, 19 nt, Homo sapiens
uaacucacuugucuucauu

SEQ ID NO: 996875 - RNA, 19 nt, Homo sapiens
ggaaguccauggaaaugau

SEQ ID NO: 996876 - RNA, 19 nt, Homo sapiens
ugaaggaaguccauggaaa

SEQ ID NO: 996877 - RNA, 19 nt, Homo sapiens
aaaccaugcuaucacauaa

SEQ ID NO: 996878 - RNA, 19 nt, Homo sapiens
uaacagaucccagguuuau

SEQ ID NO: 996879 - RNA, 19 nt, Homo sapiens
gaaggaaguccauggaaau

SEQ ID NO: 996880 - RNA, 19 nt, Homo sapiens
ugaauuggcagcuuucuuu

SEQ ID NO: 996881 - RNA, 19 nt, Homo sapiens
ccacgaagcccuccaaauc

SEQ ID NO: 996882 - RNA, 19 nt, Homo sapiens
uauggaagaugauguacaa

SEQ ID NO: 996883 - RNA, 19 nt, Homo sapiens
ucaauucaguuaagacuuc

SEQ ID NO: 996884 - RNA, 19 nt, Homo sapiens
caaucuagagcacaaauaa

SEQ ID NO: 996885 - RNA, 19 nt, Homo sapiens
caucauguuggaagaauua

SEQ ID NO: 996886 - RNA, 19 nt, Homo sapiens
uggcaucugugauaaacua

SEQ ID NO: 996887 - RNA, 19 nt, Homo sapiens
gaagaugauguacaaaugu

SEQ ID NO: 996888 - RNA, 19 nt, Homo sapiens
gaagaccuaugaaaagaaa

SEQ ID NO: 996889 - RNA, 19 nt, Homo sapiens
ucaaagaagaucugacaaa

SEQ ID NO: 996890 - RNA, 19 nt, Homo sapiens
caaagggcaugaaaguauc

SEQ ID NO: 996891 - RNA, 19 nt, Homo sapiens
aaacaaagggcaugaaagu

SEQ ID NO: 996892 - RNA, 19 nt, Homo sapiens
gcccagaauucaaguuuca

SEQ ID NO: 996893 - RNA, 19 nt, Homo sapiens
ggaagaaggacugugugua

SEQ ID NO: 996894 - RNA, 19 nt, Homo sapiens
aguuaagacuucugugaua

SEQ ID NO: 996895 - RNA, 19 nt, Homo sapiens
acaaagggcaugaaaguau

SEQ ID NO: 996896 - RNA, 19 nt, Homo sapiens
cuguuaagauccucaagua

SEQ ID NO: 996897 - RNA, 19 nt, Homo sapiens
gaaggaaagaguaaguaau

SEQ ID NO: 996898 - RNA, 19 nt, Homo sapiens
gcaagcaacagccaucaug

SEQ ID NO: 996899 - RNA, 19 nt, Homo sapiens
ggaaaguggauggaaguaa

SEQ ID NO: 996900 - RNA, 19 nt, Homo sapiens
gagaaggaaagaguaagua

SEQ ID NO: 996901 - RNA, 19 nt, Homo sapiens
cuuuaugugugcauucuua

SEQ ID NO: 996902 - RNA, 19 nt, Homo sapiens
gcaugaaaguaucugaaag

SEQ ID NO: 996903 - RNA, 19 nt, Homo sapiens
gauaacaaccgaaccuaca

SEQ ID NO: 996904 - RNA, 19 nt, Homo sapiens
gcaaugauccggagcuuuu

SEQ ID NO: 996905 - RNA, 19 nt, Homo sapiens
ggaugaaagcuauggaaga

SEQ ID NO: 996906 - RNA, 19 nt, Homo sapiens
caaaauacagggagagaua

SEQ ID NO: 996907 - RNA, 19 nt, Homo sapiens
aaaaguugcuguucuacua

SEQ ID NO: 996908 - RNA, 19 nt, Homo sapiens
gaucugacaaauacacauu

SEQ ID NO: 996909 - RNA, 19 nt, Homo sapiens
gaauuaucccaucucagua

SEQ ID NO: 996910 - RNA, 19 nt, Homo sapiens
gaaaguaacaaugacaaag

SEQ ID NO: 996911 - RNA, 19 nt, Homo sapiens
ggaaguuggugacuguuuu

SEQ ID NO: 996912 - RNA, 19 nt, Homo sapiens
cgucauaguaccauaguuu

SEQ ID NO: 996913 - RNA, 19 nt, Homo sapiens
accaugcuaucacauaaua

SEQ ID NO: 996914 - RNA, 19 nt, Homo sapiens
gaaaaguaauugacagcuu

SEQ ID NO: 996915 - RNA, 19 nt, Homo sapiens
gagcuacuauugcuaacag

SEQ ID NO: 996916 - RNA, 19 nt, Homo sapiens
agacuucugugauagaugu

SEQ ID NO: 996917 - RNA, 19 nt, Homo sapiens
gcagcuuucuuugcuaaau

SEQ ID NO: 996918 - RNA, 19 nt, Homo sapiens
guacaccguaauauacaua

SEQ ID NO: 996919 - RNA, 19 nt, Homo sapiens
gcagacgguccuuuaauag

SEQ ID NO: 996920 - RNA, 19 nt, Homo sapiens
aguggaaucuagaaucaaa

SEQ ID NO: 996921 - RNA, 19 nt, Homo sapiens
agaaucagaagaccuauga

SEQ ID NO: 996922 - RNA, 19 nt, Homo sapiens
ugauaccacuguaccagaa

SEQ ID NO: 996923 - RNA, 19 nt, Homo sapiens
ggagcaagccauuagcaau

SEQ ID NO: 996924 - RNA, 19 nt, Homo sapiens
ccauggaaaugauguugau

SEQ ID NO: 996925 - RNA, 19 nt, Homo sapiens
guaucaaucuagagcacaa

SEQ ID NO: 996926 - RNA, 19 nt, Homo sapiens
ugagagaaggaaagaguaa

SEQ ID NO: 996927 - RNA, 19 nt, Homo sapiens
gagauaugaagaccuauuc

SEQ ID NO: 996928 - RNA, 19 nt, Homo sapiens
gcaacaauagcaauuuagu

SEQ ID NO: 996929 - RNA, 19 nt, Homo sapiens
ccacauaaaacucugaaua

SEQ ID NO: 996930 - RNA, 19 nt, Homo sapiens
uuagaggcuuuauauccua

SEQ ID NO: 996931 - RNA, 19 nt, Homo sapiens
ggaaggugguucgcagcaa

SEQ ID NO: 996932 - RNA, 19 nt, Homo sapiens
guauugcuaugcagaaugg

SEQ ID NO: 996933 - RNA, 19 nt, Homo sapiens
uggcagcuuucuuugcuaa

SEQ ID NO: 996934 - RNA, 19 nt, Homo sapiens
gcugugcauugauuauguu

SEQ ID NO: 996935 - RNA, 19 nt, Homo sapiens
ccuaagggauggauaucug

SEQ ID NO: 996936 - RNA, 19 nt, Homo sapiens
agaauuaucccaucucagu

SEQ ID NO: 996937 - RNA, 19 nt, Homo sapiens
caccacagcugucccuaag

SEQ ID NO: 996938 - RNA, 19 nt, Homo sapiens
gugccaggcuauuuaagau

SEQ ID NO: 996939 - RNA, 19 nt, Homo sapiens
aauguuggcaucugugaua

SEQ ID NO: 996940 - RNA, 19 nt, Homo sapiens
gaacaaaucuguauugaga

SEQ ID NO: 996941 - RNA, 19 nt, Homo sapiens
gcacagcucuuuacaauau

SEQ ID NO: 996942 - RNA, 19 nt, Homo sapiens
caacaaaucuucacuuaga

SEQ ID NO: 996943 - RNA, 19 nt, Homo sapiens
gaacacagcccuuucagua

SEQ ID NO: 996944 - RNA, 19 nt, Homo sapiens
gaaaucagcuacccauuau

SEQ ID NO: 996945 - RNA, 19 nt, Homo sapiens
gaaaggcacauuacauuua

SEQ ID NO: 996946 - RNA, 19 nt, Homo sapiens
gagaaacaguuaaugcuuu

SEQ ID NO: 996947 - RNA, 19 nt, Homo sapiens
ggacacaccugcaucuuuc

SEQ ID NO: 996948 - RNA, 19 nt, Homo sapiens
ggaaaucacauaacuggua

SEQ ID NO: 996949 - RNA, 19 nt, Homo sapiens
gcugaaagauguaagcaaa

SEQ ID NO: 996950 - RNA, 19 nt, Homo sapiens
gcaagaugauucuacugua

SEQ ID NO: 996951 - RNA, 19 nt, Homo sapiens
gaagaaggguggcucuaug

SEQ ID NO: 996952 - RNA, 19 nt, Homo sapiens
ggaagggucucuuguaugg

SEQ ID NO: 996953 - RNA, 19 nt, Homo sapiens
cuaccuagcuacuuuguaa

SEQ ID NO: 996954 - RNA, 19 nt, Homo sapiens
ugaagaagcugaagcaauc

SEQ ID NO: 996955 - RNA, 19 nt, Homo sapiens
ucacauaacugguacaagu

SEQ ID NO: 996956 - RNA, 19 nt, Homo sapiens
gaagauagaagaguuggua

SEQ ID NO: 996957 - RNA, 19 nt, Homo sapiens
ucagaaggcuaaagaagaa

SEQ ID NO: 996958 - RNA, 19 nt, Homo sapiens
ggagauaaaccgcaacauu

SEQ ID NO: 996959 - RNA, 19 nt, Homo sapiens
ggagucugauuaaggauuu

SEQ ID NO: 996960 - RNA, 19 nt, Homo sapiens
ggaacuuugucacaucuaa

SEQ ID NO: 996961 - RNA, 19 nt, Homo sapiens
ggaaaggcacauuacauuu

SEQ ID NO: 996962 - RNA, 19 nt, Homo sapiens
gaacaucauuuaccaugca

SEQ ID NO: 996963 - RNA, 19 nt, Homo sapiens
guucugggcucagcucuua

SEQ ID NO: 996964 - RNA, 19 nt, Homo sapiens
guauaucucuccagcugua

SEQ ID NO: 996965 - RNA, 19 nt, Homo sapiens
ggacuccucuuaauguuuc

SEQ ID NO: 996966 - RNA, 19 nt, Homo sapiens
gaaggaacuuugucacauc

SEQ ID NO: 996967 - RNA, 19 nt, Homo sapiens
ggucggugcucaauaaaga

SEQ ID NO: 996968 - RNA, 19 nt, Homo sapiens
aaacaacucucuucaacau

SEQ ID NO: 996969 - RNA, 19 nt, Homo sapiens
ggagaugugugaugugugu

SEQ ID NO: 996970 - RNA, 19 nt, Homo sapiens
gaagaagagagaaagcaua

SEQ ID NO: 996971 - RNA, 19 nt, Homo sapiens
ggauuuccauguucuuauu

SEQ ID NO: 996972 - RNA, 19 nt, Homo sapiens
gcacgugaccucugacaaa

SEQ ID NO: 996973 - RNA, 19 nt, Homo sapiens
gauaacagcagaagauaga

SEQ ID NO: 996974 - RNA, 19 nt, Homo sapiens
aaagcaaacugcccuugua

SEQ ID NO: 996975 - RNA, 19 nt, Homo sapiens
cagaagagaugggugauga

SEQ ID NO: 996976 - RNA, 19 nt, Homo sapiens
ggaacaugcugcacugaga

SEQ ID NO: 996977 - RNA, 19 nt, Homo sapiens
gcacaagugucgugaaugc

SEQ ID NO: 996978 - RNA, 19 nt, Homo sapiens
ggaaggagccaguccaaug

SEQ ID NO: 996979 - RNA, 19 nt, Homo sapiens
gagauaaaccgcaacauuc

SEQ ID NO: 996980 - RNA, 19 nt, Homo sapiens
ccacagagaacaaaccuuu

SEQ ID NO: 996981 - RNA, 19 nt, Homo sapiens
caggaacugugcuauaauu

SEQ ID NO: 996982 - RNA, 19 nt, Homo sapiens
gagcaccucucccuaguuc

SEQ ID NO: 996983 - RNA, 19 nt, Homo sapiens
ggaaagaagaagagagaaa

SEQ ID NO: 996984 - RNA, 19 nt, Homo sapiens
gugcaaggcugggcuauug

SEQ ID NO: 996985 - RNA, 19 nt, Homo sapiens
ggacacaggcauacccuuu

SEQ ID NO: 996986 - RNA, 19 nt, Homo sapiens
gcaaacugcccuuguauca

SEQ ID NO: 996987 - RNA, 19 nt, Homo sapiens
agaaaucagcuacccauua

SEQ ID NO: 996988 - RNA, 19 nt, Homo sapiens
agagaugggugaugaagaa

SEQ ID NO: 996989 - RNA, 19 nt, Homo sapiens
gcccauagguacauuggaa

SEQ ID NO: 996990 - RNA, 19 nt, Homo sapiens
aaacaugccugguggaagu

SEQ ID NO: 996991 - RNA, 19 nt, Homo sapiens
gaucauaugcaaacgacua

SEQ ID NO: 996992 - RNA, 19 nt, Homo sapiens
gcuaguaucugguguucug

SEQ ID NO: 996993 - RNA, 19 nt, Homo sapiens
aagcaacacuccuggguaa

SEQ ID NO: 996994 - RNA, 19 nt, Homo sapiens
caucuaagcuguggugugu

SEQ ID NO: 996995 - RNA, 19 nt, Homo sapiens
gaugggugaugaagaaguu

SEQ ID NO: 996996 - RNA, 19 nt, Homo sapiens
ugaaauaccacaguuguuu

SEQ ID NO: 996997 - RNA, 19 nt, Homo sapiens
gaauauaccaaacgagaug

SEQ ID NO: 996998 - RNA, 19 nt, Homo sapiens
gcacugguuggcagauuua

SEQ ID NO: 996999 - RNA, 19 nt, Homo sapiens
uggcacagcucuuuacaau

SEQ ID NO: 997000 - RNA, 19 nt, Homo sapiens
gaaccauuuucaccuauua

SEQ ID NO: 997001 - RNA, 19 nt, Homo sapiens
gaagagguacucaagacaa

SEQ ID NO: 997002 - RNA, 19 nt, Homo sapiens
gaacugugcuauaauuucc

SEQ ID NO: 997003 - RNA, 19 nt, Homo sapiens
gggucugccuugacuguua

SEQ ID NO: 997004 - RNA, 19 nt, Homo sapiens
gcagaggauucaugaugga

SEQ ID NO: 997005 - RNA, 19 nt, Homo sapiens
gaugguguauguugggauu

SEQ ID NO: 997006 - RNA, 19 nt, Homo sapiens
uugaagaucugauggagaa

SEQ ID NO: 997007 - RNA, 19 nt, Homo sapiens
aaacgaaacuaccuucucu

SEQ ID NO: 997008 - RNA, 19 nt, Homo sapiens
cacauuacauuuagucuuc

SEQ ID NO: 997009 - RNA, 19 nt, Homo sapiens
caacucagaaggcuaaaga

SEQ ID NO: 997010 - RNA, 19 nt, Homo sapiens
gagcgguaccggaaguuua

SEQ ID NO: 997011 - RNA, 19 nt, Homo sapiens
gggagagaauucaagaaau

SEQ ID NO: 997012 - RNA, 19 nt, Homo sapiens
gcaaacgacuacggucaga

SEQ ID NO: 997013 - RNA, 19 nt, Homo sapiens
gcuauaauuuccgauguga

SEQ ID NO: 997014 - RNA, 19 nt, Homo sapiens
caucauugccucaguggua

SEQ ID NO: 997015 - RNA, 19 nt, Homo sapiens
caucaaauagcaauaguga

SEQ ID NO: 997016 - RNA, 19 nt, Homo sapiens
ucagguagcuccucuucug

SEQ ID NO: 997017 - RNA, 19 nt, Homo sapiens
guaacuacuucacuacugu

SEQ ID NO: 997018 - RNA, 19 nt, Homo sapiens
caucgcaaccuuugacuuu

SEQ ID NO: 997019 - RNA, 19 nt, Homo sapiens
gccaauggguugcaucugu

SEQ ID NO: 997020 - RNA, 19 nt, Homo sapiens
ugaagaacaucauuuacca

SEQ ID NO: 997021 - RNA, 19 nt, Homo sapiens
gaagaacaaggccaagaga

SEQ ID NO: 997022 - RNA, 19 nt, Homo sapiens
ccgaaagguuggagaagaa

SEQ ID NO: 997023 - RNA, 19 nt, Homo sapiens
gccugcaacuugacugaua

SEQ ID NO: 997024 - RNA, 19 nt, Homo sapiens
caauaaagagucucauuca

SEQ ID NO: 997025 - RNA, 19 nt, Homo sapiens
gaacaggagcaagaugauu

SEQ ID NO: 997026 - RNA, 19 nt, Homo sapiens
gcgcagugcugagcuguug

SEQ ID NO: 997027 - RNA, 19 nt, Homo sapiens
gaguuuggcugaugauucu

SEQ ID NO: 997028 - RNA, 19 nt, Homo sapiens
gaagagagaaagcauagag

SEQ ID NO: 997029 - RNA, 19 nt, Homo sapiens
gaaggacaguugauuucca

SEQ ID NO: 997030 - RNA, 19 nt, Homo sapiens
caaaugggaaggacaguug

SEQ ID NO: 997031 - RNA, 19 nt, Homo sapiens
uauaaggaaaggcacauua

SEQ ID NO: 997032 - RNA, 19 nt, Homo sapiens
gaaagaagaagagagaaag

SEQ ID NO: 997033 - RNA, 19 nt, Homo sapiens
ccaacugaguggagucuga

SEQ ID NO: 997034 - RNA, 19 nt, Homo sapiens
ugagggaacagucauauga

SEQ ID NO: 997035 - RNA, 19 nt, Homo sapiens
ugcaggaacugugcuauaa

SEQ ID NO: 997036 - RNA, 19 nt, Homo sapiens
uagcaauagugaacugaaa

SEQ ID NO: 997037 - RNA, 19 nt, Homo sapiens
ggugugacccugcaucaaa

SEQ ID NO: 997038 - RNA, 19 nt, Homo sapiens
acuccaagcuccucuguga

SEQ ID NO: 997039 - RNA, 19 nt, Homo sapiens
gcagaagacuuuguaucuc

SEQ ID NO: 997040 - RNA, 19 nt, Homo sapiens
gcaaacagccaguuccuua

SEQ ID NO: 997041 - RNA, 19 nt, Homo sapiens
cagaacugcucccuuauua

SEQ ID NO: 997042 - RNA, 19 nt, Homo sapiens
gcaagcaaaucuacuguga

SEQ ID NO: 997043 - RNA, 19 nt, Homo sapiens
gcaaaccugucuucugaaa

SEQ ID NO: 997044 - RNA, 19 nt, Homo sapiens
caagggacaugaggauuua

SEQ ID NO: 997045 - RNA, 19 nt, Homo sapiens
cuucagaacugcucccuua

SEQ ID NO: 997046 - RNA, 19 nt, Homo sapiens
ggaagcacauuuacaagug

SEQ ID NO: 997047 - RNA, 19 nt, Homo sapiens
gugaagaccuggaaacaga

SEQ ID NO: 997048 - RNA, 19 nt, Homo sapiens
ucaaggagcucuacaagca

SEQ ID NO: 997049 - RNA, 19 nt, Homo sapiens
uaaugaugcuggacucuaa

SEQ ID NO: 997050 - RNA, 19 nt, Homo sapiens
ucaguaagcucaagcacuu

SEQ ID NO: 997051 - RNA, 19 nt, Homo sapiens
ggaguucuguugaauggaa

SEQ ID NO: 997052 - RNA, 19 nt, Homo sapiens
gcaagggacaugaggauuu

SEQ ID NO: 997053 - RNA, 19 nt, Homo sapiens
gaagcacauuuacaaguga

SEQ ID NO: 997054 - RNA, 19 nt, Homo sapiens
ggaaaggagccugguauuu

SEQ ID NO: 997055 - RNA, 19 nt, Homo sapiens
caucaaacauugugagcaa

SEQ ID NO: 997056 - RNA, 19 nt, Homo sapiens
gcaacaaguagcuuaauga

SEQ ID NO: 997057 - RNA, 19 nt, Homo sapiens
cuacaccagugcaaauuaa

SEQ ID NO: 997058 - RNA, 19 nt, Homo sapiens
gagaaggcauucaaacagu

SEQ ID NO: 997059 - RNA, 19 nt, Homo sapiens
gaaaggagccugguauuuu

SEQ ID NO: 997060 - RNA, 19 nt, Homo sapiens
gauggaagcacauuuacaa

SEQ ID NO: 997061 - RNA, 19 nt, Homo sapiens
gcacugaggugaaaagaga

SEQ ID NO: 997062 - RNA, 19 nt, Homo sapiens
gcuaagauaucauuaagcu

SEQ ID NO: 997063 - RNA, 19 nt, Homo sapiens
gcaaguacuucaccugucu

SEQ ID NO: 997064 - RNA, 19 nt, Homo sapiens
gcgaggagacgguguauug

SEQ ID NO: 997065 - RNA, 19 nt, Homo sapiens
uagcuaacaugaaagagaa

SEQ ID NO: 997066 - RNA, 19 nt, Homo sapiens
caaucagaaugcacaagua

SEQ ID NO: 997067 - RNA, 19 nt, Homo sapiens
ucagauggaagcacauuua

SEQ ID NO: 997068 - RNA, 19 nt, Homo sapiens
ucaccugucuuccuuaaug

SEQ ID NO: 997069 - RNA, 19 nt, Homo sapiens
caacaaauuggaaaugcua

SEQ ID NO: 997070 - RNA, 19 nt, Homo sapiens
ccaguggaguuauccuuaa

SEQ ID NO: 997071 - RNA, 19 nt, Homo sapiens
ccacuggccuccucauuag

SEQ ID NO: 997072 - RNA, 19 nt, Homo sapiens
gcaaaucuacugugacauc

SEQ ID NO: 997073 - RNA, 19 nt, Homo sapiens
gagggucuguagugacuuu

SEQ ID NO: 997074 - RNA, 19 nt, Homo sapiens
ucaaaguccuccagaguuc

SEQ ID NO: 997075 - RNA, 19 nt, Homo sapiens
gguaauaucucaguaagcu

SEQ ID NO: 997076 - RNA, 19 nt, Homo sapiens
gagagcaaagcaacaagua

SEQ ID NO: 997077 - RNA, 19 nt, Homo sapiens
gaacugcucccuuauuacu

SEQ ID NO: 997078 - RNA, 19 nt, Homo sapiens
augcaaaccugucuucuga

SEQ ID NO: 997079 - RNA, 19 nt, Homo sapiens
ugucuuagauggcaugguu

SEQ ID NO: 997080 - RNA, 19 nt, Homo sapiens
gagcuaaaccgcgacauug

SEQ ID NO: 997081 - RNA, 19 nt, Homo sapiens
gauggagggucuguaguga

SEQ ID NO: 997082 - RNA, 19 nt, Homo sapiens
guauacacgguuccuaaua

SEQ ID NO: 997083 - RNA, 19 nt, Homo sapiens
caagguaauaucucaguaa

SEQ ID NO: 997084 - RNA, 19 nt, Homo sapiens
gauuaaaugugggaaauac

SEQ ID NO: 997085 - RNA, 19 nt, Homo sapiens
gaagauaugcaagacuuau

SEQ ID NO: 997086 - RNA, 19 nt, Homo sapiens
gaaacaggaaggcuuggaa

SEQ ID NO: 997087 - RNA, 19 nt, Homo sapiens
aagcaaaucuacugugaca

SEQ ID NO: 997088 - RNA, 19 nt, Homo sapiens
caggaaggcuuggaaagga

SEQ ID NO: 997089 - RNA, 19 nt, Homo sapiens
aggagacgguguauuguuu

SEQ ID NO: 997090 - RNA, 19 nt, Homo sapiens
caacuccacucggaacuuc

SEQ ID NO: 997091 - RNA, 19 nt, Homo sapiens
caaacagccaguuccuuaa

SEQ ID NO: 997092 - RNA, 19 nt, Homo sapiens
gaaaagagaaggcauucaa

SEQ ID NO: 997093 - RNA, 19 nt, Homo sapiens
ccagcuggaugaagauaug

SEQ ID NO: 997094 - RNA, 19 nt, Homo sapiens
gacuauaggaucugugaaa

SEQ ID NO: 997095 - RNA, 19 nt, Homo sapiens
cagugcaaauuaaccagua

SEQ ID NO: 997096 - RNA, 19 nt, Homo sapiens
ggauuaaaugugggaaaua

SEQ ID NO: 997097 - RNA, 19 nt, Homo sapiens
gucaagaccuauugucagu

SEQ ID NO: 997098 - RNA, 19 nt, Homo sapiens
gccgauagccaaccaaugu

SEQ ID NO: 997099 - RNA, 19 nt, Homo sapiens
gucagcaacugguucaaga

SEQ ID NO: 997100 - RNA, 19 nt, Homo sapiens
caacaaguagcuuaaugau

SEQ ID NO: 997101 - RNA, 19 nt, Homo sapiens
cagcaacacuaacuaugca

SEQ ID NO: 997102 - RNA, 19 nt, Homo sapiens
gaggagacgguguauuguu

SEQ ID NO: 997103 - RNA, 19 nt, Homo sapiens
guagcuaacaugaaagaga

SEQ ID NO: 997104 - RNA, 19 nt, Homo sapiens
guuaauguaucuccaacuc

SEQ ID NO: 997105 - RNA, 19 nt, Homo sapiens
gagacgguguauuguuuca

SEQ ID NO: 997106 - RNA, 19 nt, Homo sapiens
gcaacaaauuggaaaugcu

SEQ ID NO: 997107 - RNA, 19 nt, Homo sapiens
cagcaguacaucaggauuu

SEQ ID NO: 997108 - RNA, 19 nt, Homo sapiens
acaagguaauaucucagua

SEQ ID NO: 997109 - RNA, 19 nt, Homo sapiens
cccaggacgugaaggaauu

SEQ ID NO: 997110 - RNA, 19 nt, Homo sapiens
gcaacgagagccugcugaa

SEQ ID NO: 997111 - RNA, 19 nt, Homo sapiens
ucagaaugcacaaguaaau

SEQ ID NO: 997112 - RNA, 19 nt, Homo sapiens
uauacacgguuccuaauac

SEQ ID NO: 997113 - RNA, 19 nt, Homo sapiens
caagauggagggucuguag

SEQ ID NO: 997114 - RNA, 19 nt, Homo sapiens
uuagauggcaugguugaua

SEQ ID NO: 997115 - RNA, 19 nt, Homo sapiens
uaauacaggccagacuaua

SEQ ID NO: 997116 - RNA, 19 nt, Homo sapiens
aacaguggcuucccaagau

SEQ ID NO: 997117 - RNA, 19 nt, Homo sapiens
guauauccaugacugacau

SEQ ID NO: 997118 - RNA, 19 nt, Homo sapiens
auuaagcucuucuggaguu

SEQ ID NO: 997119 - RNA, 19 nt, Homo sapiens
ucagaacugcucccuuauu

SEQ ID NO: 997120 - RNA, 19 nt, Homo sapiens
uaucuccaacucacaauuu

SEQ ID NO: 997121 - RNA, 19 nt, Homo sapiens
aaucagaaugcacaaguaa

SEQ ID NO: 997122 - RNA, 19 nt, Homo sapiens
aaacaguggcuucccaaga

SEQ ID NO: 997123 - RNA, 19 nt, Homo sapiens
caagugagucuaccacagu

SEQ ID NO: 997124 - RNA, 19 nt, Homo sapiens
gcugggagccguagacaag

SEQ ID NO: 997125 - RNA, 19 nt, Homo sapiens
uggaaaugcuaagauauca

SEQ ID NO: 997126 - RNA, 19 nt, Homo sapiens
caaauuggaaaugcuaaga

SEQ ID NO: 997127 - RNA, 19 nt, Homo sapiens
aaucuacugugacaucugu

SEQ ID NO: 997128 - RNA, 19 nt, Homo sapiens
aaacaggaaggcuuggaaa

SEQ ID NO: 997129 - RNA, 19 nt, Homo sapiens
gacgguguauuguuucaag

SEQ ID NO: 997130 - RNA, 19 nt, Homo sapiens
uaaccaguauggcauuguc

SEQ ID NO: 997131 - RNA, 19 nt, Homo sapiens
cagugucccugucucauuc

SEQ ID NO: 997132 - RNA, 19 nt, Homo sapiens
ucaccaaccucagccuuuc

SEQ ID NO: 997133 - RNA, 19 nt, Homo sapiens
uaaaugcaaaccugucuuc

SEQ ID NO: 997134 - RNA, 19 nt, Homo sapiens
cuucaccugucuuccuuaa

SEQ ID NO: 997135 - RNA, 19 nt, Homo sapiens
ugggagccguagacaagua

SEQ ID NO: 997136 - RNA, 19 nt, Homo sapiens
gccaguauauaugcaacaa

SEQ ID NO: 997137 - RNA, 19 nt, Homo sapiens
ugaagauaugcaagacuua

SEQ ID NO: 997138 - RNA, 19 nt, Homo sapiens
augaagauaugcaagacuu

SEQ ID NO: 997139 - RNA, 19 nt, Homo sapiens
ggaugaagauaugcaagac

SEQ ID NO: 997140 - RNA, 19 nt, Homo sapiens
gaauaaagaguuucaggua

SEQ ID NO: 997141 - RNA, 19 nt, Homo sapiens
ggaagagacugcagaaaca

SEQ ID NO: 997142 - RNA, 19 nt, Homo sapiens
gagagagaaucaugaagaa

SEQ ID NO: 997143 - RNA, 19 nt, Homo sapiens
ggaaucaaauggucuguca

SEQ ID NO: 997144 - RNA, 19 nt, Homo sapiens
caaauggucugucaguuca

SEQ ID NO: 997145 - RNA, 19 nt, Homo sapiens
aaacacaacuuuccuaugc

SEQ ID NO: 997146 - RNA, 19 nt, Homo sapiens
gugcugcugucaaguguua

SEQ ID NO: 997147 - RNA, 19 nt, Homo sapiens
gcuguuaacugaaccucua

SEQ ID NO: 997148 - RNA, 19 nt, Homo sapiens
gaccugagggugccauuua

SEQ ID NO: 997149 - RNA, 19 nt, Homo sapiens
gcuaaugccugcaccaauc

SEQ ID NO: 997150 - RNA, 19 nt, Homo sapiens
uggaagagauuguggaaga

SEQ ID NO: 997151 - RNA, 19 nt, Homo sapiens
ucaguggacucuacagauu

SEQ ID NO: 997152 - RNA, 19 nt, Homo sapiens
guggugggcuguuaacuga

SEQ ID NO: 997153 - RNA, 19 nt, Homo sapiens
caauuuauccuuugagaga

SEQ ID NO: 997154 - RNA, 19 nt, Homo sapiens
gaaucgacccuguggauga

SEQ ID NO: 997155 - RNA, 19 nt, Homo sapiens
gaauacagaaccauauguu

SEQ ID NO: 997156 - RNA, 19 nt, Homo sapiens
ggaggauaaugccggaauu

SEQ ID NO: 997157 - RNA, 19 nt, Homo sapiens
ggugguucuuuauucauua

SEQ ID NO: 997158 - RNA, 19 nt, Homo sapiens
gauaaugccggaauuccaa

SEQ ID NO: 997159 - RNA, 19 nt, Homo sapiens
gcuuggauaucugauguuu

SEQ ID NO: 997160 - RNA, 19 nt, Homo sapiens
ggaugaacaaggaguauau

SEQ ID NO: 997161 - RNA, 19 nt, Homo sapiens
uggaggugcuguugcuaua

SEQ ID NO: 997162 - RNA, 19 nt, Homo sapiens
gaacaugugauugaucuag

SEQ ID NO: 997163 - RNA, 19 nt, Homo sapiens
gaaguuguagaacauguga

SEQ ID NO: 997164 - RNA, 19 nt, Homo sapiens
ugagagagaaucaugaaga

SEQ ID NO: 997165 - RNA, 19 nt, Homo sapiens
ugguaggaaugcucuauaa

SEQ ID NO: 997166 - RNA, 19 nt, Homo sapiens
caaagcugcgcgucccuua

SEQ ID NO: 997167 - RNA, 19 nt, Homo sapiens
caaugaauacagaaccaua

SEQ ID NO: 997168 - RNA, 19 nt, Homo sapiens
gcacaaugccauaaaucau

SEQ ID NO: 997169 - RNA, 19 nt, Homo sapiens
gggcuucaguuauuggaau

SEQ ID NO: 997170 - RNA, 19 nt, Homo sapiens
uagaacaugugauugaucu

SEQ ID NO: 997171 - RNA, 19 nt, Homo sapiens
uagggacaaucuucugaaa

SEQ ID NO: 997172 - RNA, 19 nt, Homo sapiens
uugaaaagcugaagaaaug

SEQ ID NO: 997173 - RNA, 19 nt, Homo sapiens
gaaaauaccagccuuaacu

SEQ ID NO: 997174 - RNA, 19 nt, Homo sapiens
gaagagauuguggaagaga

SEQ ID NO: 997175 - RNA, 19 nt, Homo sapiens
guauaugcaccucuucauu

SEQ ID NO: 997176 - RNA, 19 nt, Homo sapiens
gaggugcuguugcuauagu

SEQ ID NO: 997177 - RNA, 19 nt, Homo sapiens
ucaaauggucugucaguuc

SEQ ID NO: 997178 - RNA, 19 nt, Homo sapiens
cugagggugccauuuauua

SEQ ID NO: 997179 - RNA, 19 nt, Homo sapiens
ggcccuggcucacaaaugg

SEQ ID NO: 997180 - RNA, 19 nt, Homo sapiens
guugcaagcaggaggauaa

SEQ ID NO: 997181 - RNA, 19 nt, Homo sapiens
gagagaaucaugaagaaaa

SEQ ID NO: 997182 - RNA, 19 nt, Homo sapiens
gaaauccaggguccaggaa

SEQ ID NO: 997183 - RNA, 19 nt, Homo sapiens
gauaagagaauagaguaca

SEQ ID NO: 997184 - RNA, 19 nt, Homo sapiens
caaauggugggaugaacaa

SEQ ID NO: 997185 - RNA, 19 nt, Homo sapiens
gcaagcaggaggauaaugc

SEQ ID NO: 997186 - RNA, 19 nt, Homo sapiens
cgacagcggugagguaaaa

SEQ ID NO: 997187 - RNA, 19 nt, Homo sapiens
ggaagagauuguggaagag

SEQ ID NO: 997188 - RNA, 19 nt, Homo sapiens
aaacagcacaaugccauaa

SEQ ID NO: 997189 - RNA, 19 nt, Homo sapiens
ccucggcgguuuaugugaa

SEQ ID NO: 997190 - RNA, 19 nt, Homo sapiens
gaacagaauaaagaguuuc

SEQ ID NO: 997191 - RNA, 19 nt, Homo sapiens
caguggacucuacagauua

SEQ ID NO: 997192 - RNA, 19 nt, Homo sapiens
uauaugcaccucuucauuc

SEQ ID NO: 997193 - RNA, 19 nt, Homo sapiens
aguggacucuacagauuaa

SEQ ID NO: 997194 - RNA, 19 nt, Homo sapiens
agaauagaguacagagugu

SEQ ID NO: 997195 - RNA, 19 nt, Homo sapiens
ggacgaucuuuuccuguuu

SEQ ID NO: 997196 - RNA, 19 nt, Homo sapiens
gaaacacuagagagcauuc

SEQ ID NO: 997197 - RNA, 19 nt, Homo sapiens
ugugauugaucuagaaaca

SEQ ID NO: 997198 - RNA, 19 nt, Homo sapiens
gggaugaacaaggaguaua

SEQ ID NO: 997199 - RNA, 19 nt, Homo sapiens
ucagguuacuggcauugga

SEQ ID NO: 997200 - RNA, 19 nt, Homo sapiens
uuaauuuccucggcgguuu

SEQ ID NO: 997201 - RNA, 19 nt, Homo sapiens
auaguaauauggcuuggau

SEQ ID NO: 997202 - RNA, 19 nt, Homo sapiens
gcugaagaaaugaauuguu

SEQ ID NO: 997203 - RNA, 19 nt, Homo sapiens
aauccagcgugcauugaaa

SEQ ID NO: 997204 - RNA, 19 nt, Homo sapiens
ucaaacagugguaggaaug

SEQ ID NO: 997205 - RNA, 19 nt, Homo sapiens
caaauugcagguauuguac

SEQ ID NO: 997206 - RNA, 19 nt, Homo sapiens
uggauaagagaauagagua

SEQ ID NO: 997207 - RNA, 19 nt, Homo sapiens
acagcacaaugccauaaau

SEQ ID NO: 997208 - RNA, 19 nt, Homo sapiens
gcugcgcgucccuuaauuu

SEQ ID NO: 997209 - RNA, 19 nt, Homo sapiens
acaugugauugaucuagaa

SEQ ID NO: 997210 - RNA, 19 nt, Homo sapiens
agagacugcagaaacauuu

SEQ ID NO: 997211 - RNA, 19 nt, Homo sapiens
cggugguucuuuauucauu

SEQ ID NO: 997212 - RNA, 19 nt, Homo sapiens
gaagagacugcagaaacau

SEQ ID NO: 997213 - RNA, 19 nt, Homo sapiens
uaauuuccucggcgguuua

SEQ ID NO: 997214 - RNA, 19 nt, Homo sapiens
uggcuuggauaucugaugu

SEQ ID NO: 997215 - RNA, 19 nt, Homo sapiens
guacuucccaaaccacugu

SEQ ID NO: 997216 - RNA, 19 nt, Homo sapiens
gcuuggggcuucaguuauu

SEQ ID NO: 997217 - RNA, 19 nt, Homo sapiens
caaaagguacucauacaug

SEQ ID NO: 997218 - RNA, 19 nt, Homo sapiens
cuaaucaccagccaggaaa

SEQ ID NO: 997219 - RNA, 19 nt, Homo sapiens
ucacaaauggugggaugaa

SEQ ID NO: 997220 - RNA, 19 nt, Homo sapiens
ggauaaugccggaauucca

SEQ ID NO: 997221 - RNA, 19 nt, Homo sapiens
gaaaagcugaagaaaugaa

SEQ ID NO: 997222 - RNA, 19 nt, Homo sapiens
gugguaggaaugcucuaua

SEQ ID NO: 997223 - RNA, 19 nt, Homo sapiens
gcgcgucccuuaauuuccu

SEQ ID NO: 997224 - RNA, 19 nt, Homo sapiens
gcucaguggacucuacaga

SEQ ID NO: 997225 - RNA, 19 nt, Homo sapiens
gaggauaaugccggaauuc

SEQ ID NO: 997226 - RNA, 19 nt, Homo sapiens
aagcugaagaaaugaauug

SEQ ID NO: 997227 - RNA, 19 nt, Homo sapiens
gaguauaugcaccucuuca

SEQ ID NO: 997228 - RNA, 19 nt, Homo sapiens
uaaagggagaaacagaaga

SEQ ID NO: 997229 - RNA, 19 nt, Homo sapiens
auaccagccuuaacuaugc

SEQ ID NO: 997230 - RNA, 19 nt, Homo sapiens
uaagagaauagaguacaga

SEQ ID NO: 997231 - RNA, 19 nt, Homo sapiens
ccuaaucaccagccaggaa

SEQ ID NO: 997232 - RNA, 19 nt, Homo sapiens
gaaaacaauuccuaaucac

SEQ ID NO: 997233 - RNA, 19 nt, Homo sapiens
gggacaaucuucugaaaac

SEQ ID NO: 997234 - RNA, 19 nt, Homo sapiens
gaugaacaaggaguauaug

SEQ ID NO: 997235 - RNA, 19 nt, Homo sapiens
caugggagaaguuuguuuc

SEQ ID NO: 997236 - RNA, 19 nt, Homo sapiens
uguagaacaugugauugau

SEQ ID NO: 997237 - RNA, 19 nt, Homo sapiens
ggugggcuguuaacugaac

SEQ ID NO: 997238 - RNA, 19 nt, Homo sapiens
aaauaccagccuuaacuau

SEQ ID NO: 997239 - RNA, 19 nt, Homo sapiens
aauggucugucaguucaaa

SEQ ID NO: 997240 - RNA, 19 nt, Homo sapiens
gcauugaucuaaauaaagg

SEQ ID NO: 997241 - RNA, 19 nt, Homo sapiens
ccgcauugaucuaaauaaa

SEQ ID NO: 997242 - RNA, 19 nt, Homo sapiens
ggaaacggcaccaucaaug

SEQ ID NO: 997243 - RNA, 19 nt, Homo sapiens
auaaaggacugccgaguuc

SEQ ID NO: 997244 - RNA, 19 nt, Homo sapiens
ggaggaggcccaguacaaa

SEQ ID NO: 997245 - RNA, 19 nt, Homo sapiens
gaaacucaucuccgagguu

SEQ ID NO: 997246 - RNA, 19 nt, Homo sapiens
cuucagaccuugggcagaa

SEQ ID NO: 997247 - RNA, 19 nt, Homo sapiens
gaaacggcaccaucaaugc

SEQ ID NO: 997248 - RNA, 19 nt, Homo sapiens
aauaaaggacugccgaguu

SEQ ID NO: 997249 - RNA, 19 nt, Homo sapiens
ucugagagcagcagguuga

SEQ ID NO: 997250 - RNA, 19 nt, Homo sapiens
gaugcucgcccaggaguga

SEQ ID NO: 997251 - RNA, 19 nt, Homo sapiens
ggagcuggacgccaugauc

SEQ ID NO: 997252 - RNA, 19 nt, Homo sapiens
ccuuugcccugcaguggaa

SEQ ID NO: 997253 - RNA, 19 nt, Homo sapiens
ggaggcccagcuaaggaaa

SEQ ID NO: 997254 - RNA, 19 nt, Homo sapiens
cugaggaggaggcccagua

SEQ ID NO: 997255 - RNA, 19 nt, Homo sapiens
ggagaaggauuaugaagaa

SEQ ID NO: 997256 - RNA, 19 nt, Homo sapiens
gcaggaaccuugacauuga

SEQ ID NO: 997257 - RNA, 19 nt, Homo sapiens
gaacgccucucccuggauu

SEQ ID NO: 997258 - RNA, 19 nt, Homo sapiens
gauggaagaaggagaauuu

SEQ ID NO: 997259 - RNA, 19 nt, Homo sapiens
cgagaaagccuaucacgaa

SEQ ID NO: 997260 - RNA, 19 nt, Homo sapiens
ggcugugucucuuuauuua

SEQ ID NO: 997261 - RNA, 19 nt, Homo sapiens
gaaggauuaugaagaagug

SEQ ID NO: 997262 - RNA, 19 nt, Homo sapiens
ggacaacgaagccaucuau

SEQ ID NO: 997263 - RNA, 19 nt, Homo sapiens
ccucauacacacauaaaua

SEQ ID NO: 997264 - RNA, 19 nt, Homo sapiens
acugagagcuggagaguug

SEQ ID NO: 997265 - RNA, 19 nt, Homo sapiens
caagaggaccauccaguuu

SEQ ID NO: 997266 - RNA, 19 nt, Homo sapiens
caaagcacauguucaagag

SEQ ID NO: 997267 - RNA, 19 nt, Homo sapiens
ggacugauucguuugaaga

SEQ ID NO: 997268 - RNA, 19 nt, Homo sapiens
cuagcaagaucaacgauga

SEQ ID NO: 997269 - RNA, 19 nt, Homo sapiens
ucacaugagugggucuaua

SEQ ID NO: 997270 - RNA, 19 nt, Homo sapiens
ggaugugaaugucgcuauu

SEQ ID NO: 997271 - RNA, 19 nt, Homo sapiens
ucacuucucugcugaugga

SEQ ID NO: 997272 - RNA, 19 nt, Homo sapiens
ucacugaguuccagaccaa

SEQ ID NO: 997273 - RNA, 19 nt, Homo sapiens
cacauuuccugcccucaua

SEQ ID NO: 997274 - RNA, 19 nt, Homo sapiens
gaaagccuaucacgaacag

SEQ ID NO: 997275 - RNA, 19 nt, Homo sapiens
gagcagcuuugugucacua

SEQ ID NO: 997276 - RNA, 19 nt, Homo sapiens
gguaggagcagcuuugugu

SEQ ID NO: 997277 - RNA, 19 nt, Homo sapiens
uaagcgagacgaacacauu

SEQ ID NO: 997278 - RNA, 19 nt, Homo sapiens
gagcggacguucacaugag

SEQ ID NO: 997279 - RNA, 19 nt, Homo sapiens
aagcacauguucaagagaa

SEQ ID NO: 997280 - RNA, 19 nt, Homo sapiens
ucaaagcacauguucaaga

SEQ ID NO: 997281 - RNA, 19 nt, Homo sapiens
gauaaccagcuccugcuuu

SEQ ID NO: 997282 - RNA, 19 nt, Homo sapiens
ggaugcagccaacaacuau

SEQ ID NO: 997283 - RNA, 19 nt, Homo sapiens
gcuggagaguuggugauaa

SEQ ID NO: 997284 - RNA, 19 nt, Homo sapiens
uagcugcccuggagaagga

SEQ ID NO: 997285 - RNA, 19 nt, Homo sapiens
gcagcuuugugucacuaaa

SEQ ID NO: 997286 - RNA, 19 nt, Homo sapiens
acaccacacuggaacauuc

SEQ ID NO: 997287 - RNA, 19 nt, Homo sapiens
ccaagaggaccauccaguu

SEQ ID NO: 997288 - RNA, 19 nt, Homo sapiens
gaaccuaccgccagcucuu

SEQ ID NO: 997289 - RNA, 19 nt, Homo sapiens
cagccugauuccugccuua

SEQ ID NO: 997290 - RNA, 19 nt, Homo sapiens
auaaccagcuccugcuuug

SEQ ID NO: 997291 - RNA, 19 nt, Homo sapiens
cuaaucaggaguuucaauu

SEQ ID NO: 997292 - RNA, 19 nt, Homo sapiens
caacgaagccaucuaugac

SEQ ID NO: 997293 - RNA, 19 nt, Homo sapiens
acaacgaagccaucuauga

SEQ ID NO: 997294 - RNA, 19 nt, Homo sapiens
gggccuuugugcauuggua

SEQ ID NO: 997295 - RNA, 19 nt, Homo sapiens
gaagccaucuaugacaucu

SEQ ID NO: 997296 - RNA, 19 nt, Homo sapiens
gagcagcugaucacaggaa

SEQ ID NO: 997297 - RNA, 19 nt, Homo sapiens
ccuuggcugugucucuuua

SEQ ID NO: 997298 - RNA, 19 nt, Homo sapiens
gaacauucagauugugcuu

SEQ ID NO: 997299 - RNA, 19 nt, Homo sapiens
caaguucgaccucauguac

SEQ ID NO: 997300 - RNA, 19 nt, Homo sapiens
ucaaccgccucaucaguca

SEQ ID NO: 997301 - RNA, 19 nt, Homo sapiens
ggccuaaucaggaguuuca

SEQ ID NO: 997302 - RNA, 19 nt, Homo sapiens
cugauucguuugaagaaga

SEQ ID NO: 997303 - RNA, 19 nt, Homo sapiens
gcacugagagcuggagagu

SEQ ID NO: 997304 - RNA, 19 nt, Homo sapiens
ccacaaguucgaccucaug

SEQ ID NO: 997305 - RNA, 19 nt, Homo sapiens
acauucagauugugcuuuc

SEQ ID NO: 997306 - RNA, 19 nt, Homo sapiens
cgggcaucaucuagacuua

SEQ ID NO: 997307 - RNA, 19 nt, Homo sapiens
gugggaacacucagagaaa

SEQ ID NO: 997308 - RNA, 19 nt, Homo sapiens
caagcgggaguucagauug

SEQ ID NO: 997309 - RNA, 19 nt, Homo sapiens
gagaaggauuaugaagaag

SEQ ID NO: 997310 - RNA, 19 nt, Homo sapiens
caucuagacuuagcaugca

SEQ ID NO: 997311 - RNA, 19 nt, Homo sapiens
agaggaccauccaguuugu

SEQ ID NO: 997312 - RNA, 19 nt, Homo sapiens
acagccagauggugaagug

SEQ ID NO: 997313 - RNA, 19 nt, Homo sapiens
ccaagcgggaguucagauu

SEQ ID NO: 997314 - RNA, 19 nt, Homo sapiens
ccgcaggaaccuugacauu

SEQ ID NO: 997315 - RNA, 19 nt, Homo sapiens
gcauacggaagcugacaga

SEQ ID NO: 997316 - RNA, 19 nt, Homo sapiens
uggagaaggauuaugaaga

SEQ ID NO: 997317 - RNA, 19 nt, Homo sapiens
ucaaggugggcaucaacua

SEQ ID NO: 997318 - RNA, 19 nt, Homo sapiens
gaugugaaugucgcuauug

SEQ ID NO: 997319 - RNA, 19 nt, Homo sapiens
gcccaaggaugugaauguc

SEQ ID NO: 997320 - RNA, 19 nt, Homo sapiens
acauugagcgcccuaccua

SEQ ID NO: 997321 - RNA, 19 nt, Homo sapiens
acuggaacauucagauugu

SEQ ID NO: 997322 - RNA, 19 nt, Homo sapiens
cugugucucuuuauuuaug

SEQ ID NO: 997323 - RNA, 19 nt, Homo sapiens
ugauucguuugaagaagaa

SEQ ID NO: 997324 - RNA, 19 nt, Homo sapiens
gaagaaguggggacugauu

SEQ ID NO: 997325 - RNA, 19 nt, Homo sapiens
cugcuucucuccgcuuuga

SEQ ID NO: 997326 - RNA, 19 nt, Homo sapiens
ccuggauuauggcaagaaa

SEQ ID NO: 997327 - RNA, 19 nt, Homo sapiens
gugauaagcgagacgaaca

SEQ ID NO: 997328 - RNA, 19 nt, Homo sapiens
cuggagaguuggugauaag

SEQ ID NO: 997329 - RNA, 19 nt, Homo sapiens
uaaucaggaguuucaauuc

SEQ ID NO: 997330 - RNA, 19 nt, Homo sapiens
auucaaagcacauguucaa

SEQ ID NO: 997331 - RNA, 19 nt, Homo sapiens
ggaccauccaguuuguaga

SEQ ID NO: 997332 - RNA, 19 nt, Homo sapiens
aagaggaccauccaguuug

SEQ ID NO: 997333 - RNA, 19 nt, Homo sapiens
ucaauguggaccucacuga

SEQ ID NO: 997334 - RNA, 19 nt, Homo sapiens
acacuggaacauucagauu

SEQ ID NO: 997335 - RNA, 19 nt, Homo sapiens
uggcugugucucuuuauuu

SEQ ID NO: 997336 - RNA, 19 nt, Homo sapiens
ugaggccagggaagacuua

SEQ ID NO: 997337 - RNA, 19 nt, Homo sapiens
ccucaucagucagauugug

SEQ ID NO: 997338 - RNA, 19 nt, Homo sapiens
auugagcgcccuaccuaua

SEQ ID NO: 997339 - RNA, 19 nt, Homo sapiens
gggacugauucguuugaag

SEQ ID NO: 997340 - RNA, 19 nt, Homo sapiens
gaagugcgacccgagacau

SEQ ID NO: 997341 - RNA, 19 nt, Homo sapiens
gugcuuucaugguggacaa

SEQ ID NO: 997342 - RNA, 19 nt, Homo sapiens
gcccucauacacacauaaa

SEQ ID NO: 997343 - RNA, 19 nt, Homo sapiens
aagcgagacgaacacauuu

SEQ ID NO: 997344 - RNA, 19 nt, Homo sapiens
auacggaagcugacagaug

SEQ ID NO: 997345 - RNA, 19 nt, Homo sapiens
gcuccgggcaucaucuaga

SEQ ID NO: 997346 - RNA, 19 nt, Homo sapiens
gcucaagcuagcaagauca

SEQ ID NO: 997347 - RNA, 19 nt, Homo sapiens
caaggugggcaucaacuac

SEQ ID NO: 997348 - RNA, 19 nt, Homo sapiens
gcuggaguuugccaucuac

SEQ ID NO: 997349 - RNA, 19 nt, Homo sapiens
cacaugagugggucuauag

SEQ ID NO: 997350 - RNA, 19 nt, Homo sapiens
ggaggccuaaucaggaguu

SEQ ID NO: 997351 - RNA, 19 nt, Homo sapiens
ggagcagcuuugugucacu

SEQ ID NO: 997352 - RNA, 19 nt, Homo sapiens
cccgagacauggcaaguac

SEQ ID NO: 997353 - RNA, 19 nt, Homo sapiens
caaccucaaccgccucauc

SEQ ID NO: 997354 - RNA, 19 nt, Homo sapiens
aaucaggaguuucaauucc

SEQ ID NO: 997355 - RNA, 19 nt, Homo sapiens
gcaaguaaguuaagcauuu

SEQ ID NO: 997356 - RNA, 19 nt, Homo sapiens
gaaaggaauucacaaacua

SEQ ID NO: 997357 - RNA, 19 nt, Homo sapiens
ggacauaucuaccgucuug

SEQ ID NO: 997358 - RNA, 19 nt, Homo sapiens
caaaucaacucaugcagua

SEQ ID NO: 997359 - RNA, 19 nt, Homo sapiens
gcaaugaacugugcaugua

SEQ ID NO: 997360 - RNA, 19 nt, Homo sapiens
gcagugugguggcaaauua

SEQ ID NO: 997361 - RNA, 19 nt, Homo sapiens
gaacugugcauguaaauuu

SEQ ID NO: 997362 - RNA, 19 nt, Homo sapiens
caucaaagguucauucuga

SEQ ID NO: 997363 - RNA, 19 nt, Homo sapiens
gcacagauuuacucauauu

SEQ ID NO: 997364 - RNA, 19 nt, Homo sapiens
ggcaguaucucacauuuaa

SEQ ID NO: 997365 - RNA, 19 nt, Homo sapiens
uaagaaagguggcaaugaa

SEQ ID NO: 997366 - RNA, 19 nt, Homo sapiens
ggacauugauaaacuguga

SEQ ID NO: 997367 - RNA, 19 nt, Homo sapiens
ucaagaaccugcacagauu

SEQ ID NO: 997368 - RNA, 19 nt, Homo sapiens
ccaauaaccuaccuacuga

SEQ ID NO: 997369 - RNA, 19 nt, Homo sapiens
gaauuuaugugcugccauu

SEQ ID NO: 997370 - RNA, 19 nt, Homo sapiens
gcucagagguccugcauca

SEQ ID NO: 997371 - RNA, 19 nt, Homo sapiens
cuccaacucugaagaauua

SEQ ID NO: 997372 - RNA, 19 nt, Homo sapiens
caagaagaaugcaaguauu

SEQ ID NO: 997373 - RNA, 19 nt, Homo sapiens
gcaauucaagccagcauua

SEQ ID NO: 997374 - RNA, 19 nt, Homo sapiens
agagagaauugguacuuua

SEQ ID NO: 997375 - RNA, 19 nt, Homo sapiens
gaaaugaccauauggaaca

SEQ ID NO: 997376 - RNA, 19 nt, Homo sapiens
gaaaccugcugcaacuauu

SEQ ID NO: 997377 - RNA, 19 nt, Homo sapiens
ccacugacauuugggauuu

SEQ ID NO: 997378 - RNA, 19 nt, Homo sapiens
cugcacagauuuacucaua

SEQ ID NO: 997379 - RNA, 19 nt, Homo sapiens
cagaauggcaaguaaguua

SEQ ID NO: 997380 - RNA, 19 nt, Homo sapiens
gggauuaugugccauugaa

SEQ ID NO: 997381 - RNA, 19 nt, Homo sapiens
ggcaacacauaugaaauua

SEQ ID NO: 997382 - RNA, 19 nt, Homo sapiens
gaaagaagggaagguuuaa

SEQ ID NO: 997383 - RNA, 19 nt, Homo sapiens
guaaccagacuuucauaua

SEQ ID NO: 997384 - RNA, 19 nt, Homo sapiens
aaacagaguuaaagcaugu

SEQ ID NO: 997385 - RNA, 19 nt, Homo sapiens
ugaauaacauccauagugu

SEQ ID NO: 997386 - RNA, 19 nt, Homo sapiens
cgaaacugcuuacugcauu

SEQ ID NO: 997387 - RNA, 19 nt, Homo sapiens
gaaaucagaggcuucgaaa

SEQ ID NO: 997388 - RNA, 19 nt, Homo sapiens
gcaaguauuggcauuauga

SEQ ID NO: 997389 - RNA, 19 nt, Homo sapiens
cagaagauuuguuuggauu

SEQ ID NO: 997390 - RNA, 19 nt, Homo sapiens
gguaauaucacuaugcauu

SEQ ID NO: 997391 - RNA, 19 nt, Homo sapiens
ggaaccuccugaucaguuu

SEQ ID NO: 997392 - RNA, 19 nt, Homo sapiens
ggaaucagcuuuucagaau

SEQ ID NO: 997393 - RNA, 19 nt, Homo sapiens
ugaaagaagggaagguuua

SEQ ID NO: 997394 - RNA, 19 nt, Homo sapiens
guaggcugcuuuggaaaua

SEQ ID NO: 997395 - RNA, 19 nt, Homo sapiens
ccuguugugucuuuauuua

SEQ ID NO: 997396 - RNA, 19 nt, Homo sapiens
uggaagaaauagcuuauga

SEQ ID NO: 997397 - RNA, 19 nt, Homo sapiens
gaaggacauugauaaacug

SEQ ID NO: 997398 - RNA, 19 nt, Homo sapiens
ggaaaugaauaacauccau

SEQ ID NO: 997399 - RNA, 19 nt, Homo sapiens
ggagauucccagaaagaua

SEQ ID NO: 997400 - RNA, 19 nt, Homo sapiens
ucccaaggcugucccauaa

SEQ ID NO: 997401 - RNA, 19 nt, Homo sapiens
gaaacugcuuacugcauug

SEQ ID NO: 997402 - RNA, 19 nt, Homo sapiens
ggaggaagaugaggcugaa

SEQ ID NO: 997403 - RNA, 19 nt, Homo sapiens
cagaaucaaugaagcaaau

SEQ ID NO: 997404 - RNA, 19 nt, Homo sapiens
ggaauggccuagugaaggu

SEQ ID NO: 997405 - RNA, 19 nt, Homo sapiens
ggacuccaaggaaauauuu

SEQ ID NO: 997406 - RNA, 19 nt, Homo sapiens
gcccagggauccucgguaa

SEQ ID NO: 997407 - RNA, 19 nt, Homo sapiens
gaggcaguaucucacauuu

SEQ ID NO: 997408 - RNA, 19 nt, Homo sapiens
aaacaacugugaugaugug

SEQ ID NO: 997409 - RNA, 19 nt, Homo sapiens
uaacaaacgugaaacuacu

SEQ ID NO: 997410 - RNA, 19 nt, Homo sapiens
gcacugccacagguuauua

SEQ ID NO: 997411 - RNA, 19 nt, Homo sapiens
uaaagcauguugucuucuu

SEQ ID NO: 997412 - RNA, 19 nt, Homo sapiens
gauccaagucuccagauuu

SEQ ID NO: 997413 - RNA, 19 nt, Homo sapiens
gaagggaagguuuaauuca

SEQ ID NO: 997414 - RNA, 19 nt, Homo sapiens
ccauauccuugcuuuguaa

SEQ ID NO: 997415 - RNA, 19 nt, Homo sapiens
gagagaauugguacuuuaa

SEQ ID NO: 997416 - RNA, 19 nt, Homo sapiens
gaagcacugccacagguua

SEQ ID NO: 997417 - RNA, 19 nt, Homo sapiens
uggaggagauucccagaaa

SEQ ID NO: 997418 - RNA, 19 nt, Homo sapiens
cgagaguucuucuuugaau

SEQ ID NO: 997419 - RNA, 19 nt, Homo sapiens
gcaaauggucaauucgauu

SEQ ID NO: 997420 - RNA, 19 nt, Homo sapiens
guuaaagcauguugucuuc

SEQ ID NO: 997421 - RNA, 19 nt, Homo sapiens
gaagaucacaacugccaaa

SEQ ID NO: 997422 - RNA, 19 nt, Homo sapiens
ucagaaggcuaaacuugga

SEQ ID NO: 997423 - RNA, 19 nt, Homo sapiens
ccaagaagaaugcaaguau

SEQ ID NO: 997424 - RNA, 19 nt, Homo sapiens
acuaagacaguaccuauua

SEQ ID NO: 997425 - RNA, 19 nt, Homo sapiens
ugaaggacauugauaaacu

SEQ ID NO: 997426 - RNA, 19 nt, Homo sapiens
gaauggcaguacuucaaga

SEQ ID NO: 997427 - RNA, 19 nt, Homo sapiens
ugaagcaaaucaacucaug

SEQ ID NO: 997428 - RNA, 19 nt, Homo sapiens
gagaguucuucuuugaauu

SEQ ID NO: 997429 - RNA, 19 nt, Homo sapiens
gacauuaucugcacguuuu

SEQ ID NO: 997430 - RNA, 19 nt, Homo sapiens
gccauuugcuauaaaguug

SEQ ID NO: 997431 - RNA, 19 nt, Homo sapiens
gagaacaguccacagugua

SEQ ID NO: 997432 - RNA, 19 nt, Homo sapiens
ggaccagaauucaaacaag

SEQ ID NO: 997433 - RNA, 19 nt, Homo sapiens
gcaccaugcuggaggagau

SEQ ID NO: 997434 - RNA, 19 nt, Homo sapiens
ugaaaucuauaggauggua

SEQ ID NO: 997435 - RNA, 19 nt, Homo sapiens
uuuagugccucuuucauuu

SEQ ID NO: 997436 - RNA, 19 nt, Homo sapiens
ggaaaccugcugcaacuau

SEQ ID NO: 997437 - RNA, 19 nt, Homo sapiens
aaagacuacuucuaugcua

SEQ ID NO: 997438 - RNA, 19 nt, Homo sapiens
gagauucccagaaagauau

SEQ ID NO: 997439 - RNA, 19 nt, Homo sapiens
ugaauugggucucuaugau

SEQ ID NO: 997440 - RNA, 19 nt, Homo sapiens
uaaaaggacuccaaggaaa

SEQ ID NO: 997441 - RNA, 19 nt, Homo sapiens
gauccucgguaacuuugaa

SEQ ID NO: 997442 - RNA, 19 nt, Homo sapiens
guauucaucuccaauugug

SEQ ID NO: 997443 - RNA, 19 nt, Homo sapiens
ggaugaauauaaagacuac

SEQ ID NO: 997444 - RNA, 19 nt, Homo sapiens
uaaauggcaacacauauga

SEQ ID NO: 997445 - RNA, 19 nt, Homo sapiens
ggucaacccucaugagaac

SEQ ID NO: 997446 - RNA, 19 nt, Homo sapiens
gagagaaagccaagccauu

SEQ ID NO: 997447 - RNA, 19 nt, Homo sapiens
gugcugccauuugcuauaa

SEQ ID NO: 997448 - RNA, 19 nt, Homo sapiens
gugaugaaaucuauaggau

SEQ ID NO: 997449 - RNA, 19 nt, Homo sapiens
uaaccuaccuacugacaag

SEQ ID NO: 997450 - RNA, 19 nt, Homo sapiens
ggauauaucggagcugaaa

SEQ ID NO: 997451 - RNA, 19 nt, Homo sapiens
gcucagaaggcuaaacuug

SEQ ID NO: 997452 - RNA, 19 nt, Homo sapiens
cauuuaagccucagacauu

SEQ ID NO: 997453 - RNA, 19 nt, Homo sapiens
gaugaaaacuugcucacuu

SEQ ID NO: 997454 - RNA, 19 nt, Homo sapiens
guauuggcauuaugaugaa

SEQ ID NO: 997455 - RNA, 19 nt, Homo sapiens
ggaaguagcucagaaguuu

SEQ ID NO: 997456 - RNA, 19 nt, Homo sapiens
gaucagaguuccacccuua

SEQ ID NO: 997457 - RNA, 19 nt, Homo sapiens
gcgaguaguuggaauuaua

SEQ ID NO: 997458 - RNA, 19 nt, Homo sapiens
gcauacagcauccgauuua

SEQ ID NO: 997459 - RNA, 19 nt, Homo sapiens
uaaaucaggucacuccuuu

SEQ ID NO: 997460 - RNA, 19 nt, Homo sapiens
ugagagaagucaaguguuu

SEQ ID NO: 997461 - RNA, 19 nt, Homo sapiens
ucaaacagcuggccaugaa

SEQ ID NO: 997462 - RNA, 19 nt, Homo sapiens
ggauucugcuggaggauua

SEQ ID NO: 997463 - RNA, 19 nt, Homo sapiens
gcaaauucauccucuggaa

SEQ ID NO: 997464 - RNA, 19 nt, Homo sapiens
gagaugggauaaguucaua

SEQ ID NO: 997465 - RNA, 19 nt, Homo sapiens
ccaaaggcuuguccuauga

SEQ ID NO: 997466 - RNA, 19 nt, Homo sapiens
ucucuggucucauccauua

SEQ ID NO: 997467 - RNA, 19 nt, Homo sapiens
gaacgucacugaguuugau

SEQ ID NO: 997468 - RNA, 19 nt, Homo sapiens
ccaaagugcuggaauuaca

SEQ ID NO: 997469 - RNA, 19 nt, Homo sapiens
cggcucagcucuauccaua

SEQ ID NO: 997470 - RNA, 19 nt, Homo sapiens
gaagagaugggauaaguuc

SEQ ID NO: 997471 - RNA, 19 nt, Homo sapiens
caaggaagcucugaugauc

SEQ ID NO: 997472 - RNA, 19 nt, Homo sapiens
gcaccaccaugcccggaua

SEQ ID NO: 997473 - RNA, 19 nt, Homo sapiens
gaagaguggucagugaaga

SEQ ID NO: 997474 - RNA, 19 nt, Homo sapiens
aggaggagcuggccaauga

SEQ ID NO: 997475 - RNA, 19 nt, Homo sapiens
gcccaaagcuaguuaguac

SEQ ID NO: 997476 - RNA, 19 nt, Homo sapiens
gccaaaggcuuguccuaug

SEQ ID NO: 997477 - RNA, 19 nt, Homo sapiens
gcucagaaguuuguggaaa

SEQ ID NO: 997478 - RNA, 19 nt, Homo sapiens
gaucaugcaguucagauuu

SEQ ID NO: 997479 - RNA, 19 nt, Homo sapiens
gggcgcaucuguuguugaa

SEQ ID NO: 997480 - RNA, 19 nt, Homo sapiens
gcuaguuaguacucaauaa

SEQ ID NO: 997481 - RNA, 19 nt, Homo sapiens
caucaugccucuaaucaca

SEQ ID NO: 997482 - RNA, 19 nt, Homo sapiens
ucccauagcuggugaagga

SEQ ID NO: 997483 - RNA, 19 nt, Homo sapiens
ugaaaucaauggccucugu

SEQ ID NO: 997484 - RNA, 19 nt, Homo sapiens
gccaugaacucuaucaagu

SEQ ID NO: 997485 - RNA, 19 nt, Homo sapiens
ggaagaagagaugggauaa

SEQ ID NO: 997486 - RNA, 19 nt, Homo sapiens
gacgaagaguggucaguga

SEQ ID NO: 997487 - RNA, 19 nt, Homo sapiens
caccaugcccggauaauuu

SEQ ID NO: 997488 - RNA, 19 nt, Homo sapiens
ggccuauucuggucucuuu

SEQ ID NO: 997489 - RNA, 19 nt, Homo sapiens
caccaugccuggccuauuc

SEQ ID NO: 997490 - RNA, 19 nt, Homo sapiens
gcagaacgucacugaguuu

SEQ ID NO: 997491 - RNA, 19 nt, Homo sapiens
gauggagucucgcucuguu

SEQ ID NO: 997492 - RNA, 19 nt, Homo sapiens
ggcaggcgcucaugauugu

SEQ ID NO: 997493 - RNA, 19 nt, Homo sapiens
gaagcuagccagcccucua

SEQ ID NO: 997494 - RNA, 19 nt, Homo sapiens
ggccauggauuugcuuuga

SEQ ID NO: 997495 - RNA, 19 nt, Homo sapiens
caaauguccucggcucuau

SEQ ID NO: 997496 - RNA, 19 nt, Homo sapiens
ccaaagcacugggauuaca

SEQ ID NO: 997497 - RNA, 19 nt, Homo sapiens
gaagugcugggauuacuga

SEQ ID NO: 997498 - RNA, 19 nt, Homo sapiens
guccugggcucucuucuau

SEQ ID NO: 997499 - RNA, 19 nt, Homo sapiens
ucaggaagccuugcucuuu

SEQ ID NO: 997500 - RNA, 19 nt, Homo sapiens
gagagaagucaaguguuua

SEQ ID NO: 997501 - RNA, 19 nt, Homo sapiens
gcgcaucuguuguugaaag

SEQ ID NO: 997502 - RNA, 19 nt, Homo sapiens
caaauuaaaucaggucacu

SEQ ID NO: 997503 - RNA, 19 nt, Homo sapiens
uuaacucucuccucuuuau

SEQ ID NO: 997504 - RNA, 19 nt, Homo sapiens
guacaauggugcgaucuca

SEQ ID NO: 997505 - RNA, 19 nt, Homo sapiens
gaaaucaauggccucugua

SEQ ID NO: 997506 - RNA, 19 nt, Homo sapiens
ccaaagauguggcugucau

SEQ ID NO: 997507 - RNA, 19 nt, Homo sapiens
cuaccugucuguaccugua

SEQ ID NO: 997508 - RNA, 19 nt, Homo sapiens
caucuguuguugaaagaaa

SEQ ID NO: 997509 - RNA, 19 nt, Homo sapiens
acaacagccuccucacuga

SEQ ID NO: 997510 - RNA, 19 nt, Homo sapiens
gaaacuggugucugacuug

SEQ ID NO: 997511 - RNA, 19 nt, Homo sapiens
ggacaacgugcucuacaug

SEQ ID NO: 997512 - RNA, 19 nt, Homo sapiens
aaacugaugagguacaauu

SEQ ID NO: 997513 - RNA, 19 nt, Homo sapiens
aagaagagaugggauaagu

SEQ ID NO: 997514 - RNA, 19 nt, Homo sapiens
gcucugaugcugaacacua

SEQ ID NO: 997515 - RNA, 19 nt, Homo sapiens
cuuuaacucucuccucuuu

SEQ ID NO: 997516 - RNA, 19 nt, Homo sapiens
gcugaacacuaccagaauc

SEQ ID NO: 997517 - RNA, 19 nt, Homo sapiens
gaaauuugaaaccaucuuc

SEQ ID NO: 997518 - RNA, 19 nt, Homo sapiens
agauguggcuacaaaguga

SEQ ID NO: 997519 - RNA, 19 nt, Homo sapiens
ucaggucacuccuuugcuu

SEQ ID NO: 997520 - RNA, 19 nt, Homo sapiens
cuucuauucuggucucuuu

SEQ ID NO: 997521 - RNA, 19 nt, Homo sapiens
cggaggugauuuacacaaa

SEQ ID NO: 997522 - RNA, 19 nt, Homo sapiens
uaucuugccuucugguaau

SEQ ID NO: 997523 - RNA, 19 nt, Homo sapiens
gcuguuggcuguggcaaug

SEQ ID NO: 997524 - RNA, 19 nt, Homo sapiens
gauuguuucugauuguuuc

SEQ ID NO: 997525 - RNA, 19 nt, Homo sapiens
aaggacaccuccauccauu

SEQ ID NO: 997526 - RNA, 19 nt, Homo sapiens
ccaccacacucagcccuuu

SEQ ID NO: 997527 - RNA, 19 nt, Homo sapiens
cucagucucuucccuuuaa

SEQ ID NO: 997528 - RNA, 19 nt, Homo sapiens
ccugggcucucuucuauuc

SEQ ID NO: 997529 - RNA, 19 nt, Homo sapiens
ucugaucucugugcuguuu

SEQ ID NO: 997530 - RNA, 19 nt, Homo sapiens
aguggucagugaagacuua

SEQ ID NO: 997531 - RNA, 19 nt, Homo sapiens
ggaagcgggugcagaacgu

SEQ ID NO: 997532 - RNA, 19 nt, Homo sapiens
gaaggacaccuccauccau

SEQ ID NO: 997533 - RNA, 19 nt, Homo sapiens
ucacaggaaucucagaaac

SEQ ID NO: 997534 - RNA, 19 nt, Homo sapiens
ggccauuucuuccaguuuc

SEQ ID NO: 997535 - RNA, 19 nt, Homo sapiens
gacauugacccucuugguu

SEQ ID NO: 997536 - RNA, 19 nt, Homo sapiens
caaauucauccucuggaaa

SEQ ID NO: 997537 - RNA, 19 nt, Homo sapiens
caugaacucuaucaaguac

SEQ ID NO: 997538 - RNA, 19 nt, Homo sapiens
ccaugaacucuaucaagua

SEQ ID NO: 997539 - RNA, 19 nt, Homo sapiens
ggucgaaauuugaaaccau

SEQ ID NO: 997540 - RNA, 19 nt, Homo sapiens
guuccacccuuaaaucugu

SEQ ID NO: 997541 - RNA, 19 nt, Homo sapiens
gcaucagccucgcgaguag

SEQ ID NO: 997542 - RNA, 19 nt, Homo sapiens
cuggaaauauucucucuca

SEQ ID NO: 997543 - RNA, 19 nt, Homo sapiens
auggaaaucuggaagaaga

SEQ ID NO: 997544 - RNA, 19 nt, Homo sapiens
gcaggguacuuccauagac

SEQ ID NO: 997545 - RNA, 19 nt, Homo sapiens
gagagcaccaugacgaaga

SEQ ID NO: 997546 - RNA, 19 nt, Homo sapiens
gcucaugauuguuucugau

SEQ ID NO: 997547 - RNA, 19 nt, Homo sapiens
cauacagcauccgauuuaa

SEQ ID NO: 997548 - RNA, 19 nt, Homo sapiens
gggcauacagcauccgauu

SEQ ID NO: 997549 - RNA, 19 nt, Homo sapiens
ucucuucccuuuaaaccuu

SEQ ID NO: 997550 - RNA, 19 nt, Homo sapiens
aaacuggugucugacuuga

SEQ ID NO: 997551 - RNA, 19 nt, Homo sapiens
caaaaucgcugagaugaag

SEQ ID NO: 997552 - RNA, 19 nt, Homo sapiens
gggcaggcgcucaugauug

SEQ ID NO: 997553 - RNA, 19 nt, Homo sapiens
acucagcccuuuaaaccuu

SEQ ID NO: 997554 - RNA, 19 nt, Homo sapiens
uuggagagcucacaggaau

SEQ ID NO: 997555 - RNA, 19 nt, Homo sapiens
ggaacuagguuaccgcuua

SEQ ID NO: 997556 - RNA, 19 nt, Homo sapiens
gaaagaaguucacaucaga

SEQ ID NO: 997557 - RNA, 19 nt, Homo sapiens
gaaauuagugccacaaaua

SEQ ID NO: 997558 - RNA, 19 nt, Homo sapiens
acagaacacucauggauua

SEQ ID NO: 997559 - RNA, 19 nt, Homo sapiens
gaaaugggcaggagaugua

SEQ ID NO: 997560 - RNA, 19 nt, Homo sapiens
gaacacucauggauuaaga

SEQ ID NO: 997561 - RNA, 19 nt, Homo sapiens
guacuuacaucaggaaauu

SEQ ID NO: 997562 - RNA, 19 nt, Homo sapiens
gguguuugcuuguucuuua

SEQ ID NO: 997563 - RNA, 19 nt, Homo sapiens
ccagagagcucaagaugug

SEQ ID NO: 997564 - RNA, 19 nt, Homo sapiens
cuaacugucugacuuauaa

SEQ ID NO: 997565 - RNA, 19 nt, Homo sapiens
gaaaccagccaaccuaauu

SEQ ID NO: 997566 - RNA, 19 nt, Homo sapiens
gcaagacguucaaauuuca

SEQ ID NO: 997567 - RNA, 19 nt, Homo sapiens
gcucaaagaucccuuccuu

SEQ ID NO: 997568 - RNA, 19 nt, Homo sapiens
ggaugacgauuguuuauca

SEQ ID NO: 997569 - RNA, 19 nt, Homo sapiens
gcaucaagcucgagaagga

SEQ ID NO: 997570 - RNA, 19 nt, Homo sapiens
gggaauaaaucauagcaau

SEQ ID NO: 997571 - RNA, 19 nt, Homo sapiens
ggaaagaaguucacaucag

SEQ ID NO: 997572 - RNA, 19 nt, Homo sapiens
gaacuagguuaccgcuuau

SEQ ID NO: 997573 - RNA, 19 nt, Homo sapiens
aaagugugcuuaacauuga

SEQ ID NO: 997574 - RNA, 19 nt, Homo sapiens
gaacagacaaucacagcaa

SEQ ID NO: 997575 - RNA, 19 nt, Homo sapiens
caauaaauguuggagcuuu

SEQ ID NO: 997576 - RNA, 19 nt, Homo sapiens
gaccaucgcugucaugagu

SEQ ID NO: 997577 - RNA, 19 nt, Homo sapiens
gcaaugcucuauuccuuag

SEQ ID NO: 997578 - RNA, 19 nt, Homo sapiens
gaaauuauaggaggaaaga

SEQ ID NO: 997579 - RNA, 19 nt, Homo sapiens
ugacggcucucccacaauu

SEQ ID NO: 997580 - RNA, 19 nt, Homo sapiens
ggcaagacguucaaauuuc

SEQ ID NO: 997581 - RNA, 19 nt, Homo sapiens
gaagagaauuagaaacaac

SEQ ID NO: 997582 - RNA, 19 nt, Homo sapiens
gcacagaacacucauggau

SEQ ID NO: 997583 - RNA, 19 nt, Homo sapiens
gugaaaagauagccaaaua

SEQ ID NO: 997584 - RNA, 19 nt, Homo sapiens
acacauagcagauaaacuu

SEQ ID NO: 997585 - RNA, 19 nt, Homo sapiens
acaaugaggcugcuuauga

SEQ ID NO: 997586 - RNA, 19 nt, Homo sapiens
caaugaggcugcuuaugau

SEQ ID NO: 997587 - RNA, 19 nt, Homo sapiens
gcgagaagcccuacaagug

SEQ ID NO: 997588 - RNA, 19 nt, Homo sapiens
gcagacaaacaaacauaaa

SEQ ID NO: 997589 - RNA, 19 nt, Homo sapiens
cagaugaacuucccauugg

SEQ ID NO: 997590 - RNA, 19 nt, Homo sapiens
gugaauuauuuccugcuua

SEQ ID NO: 997591 - RNA, 19 nt, Homo sapiens
uagauuaccuagcuuagug

SEQ ID NO: 997592 - RNA, 19 nt, Homo sapiens
ccaguuaauuugcacagaa

SEQ ID NO: 997593 - RNA, 19 nt, Homo sapiens
cgccaucuuuguauuauuu

SEQ ID NO: 997594 - RNA, 19 nt, Homo sapiens
aaacagacccacauuggaa

SEQ ID NO: 997595 - RNA, 19 nt, Homo sapiens
gguuaccgcuuaucagaug

SEQ ID NO: 997596 - RNA, 19 nt, Homo sapiens
caaccuaauuaccuguauu

SEQ ID NO: 997597 - RNA, 19 nt, Homo sapiens
ggauucauauugcagacaa

SEQ ID NO: 997598 - RNA, 19 nt, Homo sapiens
cagaagagaauuagaaaca

SEQ ID NO: 997599 - RNA, 19 nt, Homo sapiens
ggugauaaaugucaguagu

SEQ ID NO: 997600 - RNA, 19 nt, Homo sapiens
ucaaagaucccuuccuuag

SEQ ID NO: 997601 - RNA, 19 nt, Homo sapiens
cggcaagacguucaaauuu

SEQ ID NO: 997602 - RNA, 19 nt, Homo sapiens
cuaaagaaggugauaaaug

SEQ ID NO: 997603 - RNA, 19 nt, Homo sapiens
aagaauaccaggaucagua

SEQ ID NO: 997604 - RNA, 19 nt, Homo sapiens
aaaccagccaaccuaauua

SEQ ID NO: 997605 - RNA, 19 nt, Homo sapiens
cgagagcccuuaaguucug

SEQ ID NO: 997606 - RNA, 19 nt, Homo sapiens
gagauccagaagagaauua

SEQ ID NO: 997607 - RNA, 19 nt, Homo sapiens
ucccaaaccuucaggaaau

SEQ ID NO: 997608 - RNA, 19 nt, Homo sapiens
gacaguagccuccaagaag

SEQ ID NO: 997609 - RNA, 19 nt, Homo sapiens
cagcgacacuuguucuuca

SEQ ID NO: 997610 - RNA, 19 nt, Homo sapiens
gagcacaaacggaaacaau

SEQ ID NO: 997611 - RNA, 19 nt, Homo sapiens
gaggaaagaaguucacauc

SEQ ID NO: 997612 - RNA, 19 nt, Homo sapiens
cauagacgauggcacuguu

SEQ ID NO: 997613 - RNA, 19 nt, Homo sapiens
ggacgacgaggaagaggaa

SEQ ID NO: 997614 - RNA, 19 nt, Homo sapiens
ggcgagcgguaaauccuaa

SEQ ID NO: 997615 - RNA, 19 nt, Homo sapiens
gcggcaagacguucaaauu

SEQ ID NO: 997616 - RNA, 19 nt, Homo sapiens
gguaaauccuaaagaaggu

SEQ ID NO: 997617 - RNA, 19 nt, Homo sapiens
gaggaacagauuugagaaa

SEQ ID NO: 997618 - RNA, 19 nt, Homo sapiens
aaagaucccuuccuuagcu

SEQ ID NO: 997619 - RNA, 19 nt, Homo sapiens
caggguauuuguaaagaug

SEQ ID NO: 997620 - RNA, 19 nt, Homo sapiens
gccagaggaugacgauugu

SEQ ID NO: 997621 - RNA, 19 nt, Homo sapiens
agaaauuagugccacaaau

SEQ ID NO: 997622 - RNA, 19 nt, Homo sapiens
ccaugcaggauuugaauuu

SEQ ID NO: 997623 - RNA, 19 nt, Homo sapiens
uggcuaccaugcaggauuu

SEQ ID NO: 997624 - RNA, 19 nt, Homo sapiens
caugacggcucucccacaa

SEQ ID NO: 997625 - RNA, 19 nt, Homo sapiens
cagggacacuugcgacgaa

SEQ ID NO: 997626 - RNA, 19 nt, Homo sapiens
gcaggguauuuguaaagau

SEQ ID NO: 997627 - RNA, 19 nt, Homo sapiens
gaugacgauuguuuaucaa

SEQ ID NO: 997628 - RNA, 19 nt, Homo sapiens
cagaggaugacgauuguuu

SEQ ID NO: 997629 - RNA, 19 nt, Homo sapiens
ccagaugaacuucccauug

SEQ ID NO: 997630 - RNA, 19 nt, Homo sapiens
ccacaaauaaguuacaucu

SEQ ID NO: 997631 - RNA, 19 nt, Homo sapiens
caagauguguggcaguuuu

SEQ ID NO: 997632 - RNA, 19 nt, Homo sapiens
ccuuuaaccugcuaagaau

SEQ ID NO: 997633 - RNA, 19 nt, Homo sapiens
ugggaugagugcagaauau

SEQ ID NO: 997634 - RNA, 19 nt, Homo sapiens
aggaacacauagcagauaa

SEQ ID NO: 997635 - RNA, 19 nt, Homo sapiens
gaggaugacgauuguuuau

SEQ ID NO: 997636 - RNA, 19 nt, Homo sapiens
ccgcuuaucagauggcaua

SEQ ID NO: 997637 - RNA, 19 nt, Homo sapiens
agacgcacaugcacaaauc

SEQ ID NO: 997638 - RNA, 19 nt, Homo sapiens
gugcugcgguugaauccaa

SEQ ID NO: 997639 - RNA, 19 nt, Homo sapiens
gcacaaacggaaacaaugc

SEQ ID NO: 997640 - RNA, 19 nt, Homo sapiens
caaauaauuggcaugugaa

SEQ ID NO: 997641 - RNA, 19 nt, Homo sapiens
gaacacauagcagauaaac

SEQ ID NO: 997642 - RNA, 19 nt, Homo sapiens
gaaccuaaguggggaaaau

SEQ ID NO: 997643 - RNA, 19 nt, Homo sapiens
caaaccuucaggaaauaua

SEQ ID NO: 997644 - RNA, 19 nt, Homo sapiens
ggaggaacagauuugagaa

SEQ ID NO: 997645 - RNA, 19 nt, Homo sapiens
gguaggaggaacagauuug

SEQ ID NO: 997646 - RNA, 19 nt, Homo sapiens
gugaaucagucccauagag

SEQ ID NO: 997647 - RNA, 19 nt, Homo sapiens
cccaaaccuucaggaaaua

SEQ ID NO: 997648 - RNA, 19 nt, Homo sapiens
gcacauggagcucuaaucc

SEQ ID NO: 997649 - RNA, 19 nt, Homo sapiens
ccucuugaagccauucuua

SEQ ID NO: 997650 - RNA, 19 nt, Homo sapiens
aaacggaaacaaugcaaug

SEQ ID NO: 997651 - RNA, 19 nt, Homo sapiens
guguuugcuuguucuuuaa

SEQ ID NO: 997652 - RNA, 19 nt, Homo sapiens
caggaucaguaucgagaga

SEQ ID NO: 997653 - RNA, 19 nt, Homo sapiens
aggacuaggugcagaaugu

SEQ ID NO: 997654 - RNA, 19 nt, Homo sapiens
ccugugugcuguagauuca

SEQ ID NO: 997655 - RNA, 19 nt, Homo sapiens
ggaagaggauucauuguuu

SEQ ID NO: 997656 - RNA, 19 nt, Homo sapiens
gaacagguauauaagcuaa

SEQ ID NO: 997657 - RNA, 19 nt, Homo sapiens
ggaaggacguuuacaaaug

SEQ ID NO: 997658 - RNA, 19 nt, Homo sapiens
uaagugcacuguacaauuu

SEQ ID NO: 997659 - RNA, 19 nt, Homo sapiens
aaauaaaccugcucagaua

SEQ ID NO: 997660 - RNA, 19 nt, Homo sapiens
cagcauguaugguauguua

SEQ ID NO: 997661 - RNA, 19 nt, Homo sapiens
acagaacacucauggauua

SEQ ID NO: 997662 - RNA, 19 nt, Homo sapiens
ggaagaggcugacaauaag

SEQ ID NO: 997663 - RNA, 19 nt, Homo sapiens
gcacagugaucgaguguug

SEQ ID NO: 997664 - RNA, 19 nt, Homo sapiens
gaaggacguuuacaaaugu

SEQ ID NO: 997665 - RNA, 19 nt, Homo sapiens
gaacacucauggauuaaga

SEQ ID NO: 997666 - RNA, 19 nt, Homo sapiens
aaacagaggcacuuaauuu

SEQ ID NO: 997667 - RNA, 19 nt, Homo sapiens
ggaaacagaauacacuuaa

SEQ ID NO: 997668 - RNA, 19 nt, Homo sapiens
gaaauucuaugccuuggau

SEQ ID NO: 997669 - RNA, 19 nt, Homo sapiens
gcaagacguucaaauuuca

SEQ ID NO: 997670 - RNA, 19 nt, Homo sapiens
guuuacaggucuauacuua

SEQ ID NO: 997671 - RNA, 19 nt, Homo sapiens
gcacaacgugguacuauuu

SEQ ID NO: 997672 - RNA, 19 nt, Homo sapiens
cuaaaugucugucucuaaa

SEQ ID NO: 997673 - RNA, 19 nt, Homo sapiens
gaucgaguguugaauaaug

SEQ ID NO: 997674 - RNA, 19 nt, Homo sapiens
gcucaaagaucccuuccuu

SEQ ID NO: 997675 - RNA, 19 nt, Homo sapiens
ggaugacgauuguuuauca

SEQ ID NO: 997676 - RNA, 19 nt, Homo sapiens
gggaaagguuuaagauuau

SEQ ID NO: 997677 - RNA, 19 nt, Homo sapiens
ggggaaagguuuaagauua

SEQ ID NO: 997678 - RNA, 19 nt, Homo sapiens
gcauuaaccuguucauaca

SEQ ID NO: 997679 - RNA, 19 nt, Homo sapiens
guuaggcacuauaguauuu

SEQ ID NO: 997680 - RNA, 19 nt, Homo sapiens
uaacgaagcuaagaauaug

SEQ ID NO: 997681 - RNA, 19 nt, Homo sapiens
gcgaaaggccuuauaaaug

SEQ ID NO: 997682 - RNA, 19 nt, Homo sapiens
gcaucaagcucgagaagga

SEQ ID NO: 997683 - RNA, 19 nt, Homo sapiens
cgaaaggccuuauaaaugc

SEQ ID NO: 997684 - RNA, 19 nt, Homo sapiens
cuuaggaacuagcauauaa

SEQ ID NO: 997685 - RNA, 19 nt, Homo sapiens
gguacuauuugccauuuaa

SEQ ID NO: 997686 - RNA, 19 nt, Homo sapiens
ggugagagcuuaaaagaaa

SEQ ID NO: 997687 - RNA, 19 nt, Homo sapiens
ccacaucgaugguucuuuc

SEQ ID NO: 997688 - RNA, 19 nt, Homo sapiens
gggagucacuauuuauuau

SEQ ID NO: 997689 - RNA, 19 nt, Homo sapiens
cuauugagcuuacuuacuu

SEQ ID NO: 997690 - RNA, 19 nt, Homo sapiens
gaugagaagccauauaaug

SEQ ID NO: 997691 - RNA, 19 nt, Homo sapiens
ucacaacaauggcuaccua

SEQ ID NO: 997692 - RNA, 19 nt, Homo sapiens
cagaugagaagccauauaa

SEQ ID NO: 997693 - RNA, 19 nt, Homo sapiens
gcucagauaggacaauuaa

SEQ ID NO: 997694 - RNA, 19 nt, Homo sapiens
cagaauagauagcacugaa

SEQ ID NO: 997695 - RNA, 19 nt, Homo sapiens
ugacggcucucccacaauu

SEQ ID NO: 997696 - RNA, 19 nt, Homo sapiens
ggcaagacguucaaauuuc

SEQ ID NO: 997697 - RNA, 19 nt, Homo sapiens
gcacagaacacucauggau

SEQ ID NO: 997698 - RNA, 19 nt, Homo sapiens
gccauuuacuugacuauug

SEQ ID NO: 997699 - RNA, 19 nt, Homo sapiens
acacauagcagauaaacuu

SEQ ID NO: 997700 - RNA, 19 nt, Homo sapiens
gaccuuguauaccauauug

SEQ ID NO: 997701 - RNA, 19 nt, Homo sapiens
gauuaacccucuauagaca

SEQ ID NO: 997702 - RNA, 19 nt, Homo sapiens
aaacuuugccagccauuua

SEQ ID NO: 997703 - RNA, 19 nt, Homo sapiens
ggucuauacuuaagggaaa

SEQ ID NO: 997704 - RNA, 19 nt, Homo sapiens
ggaacuagcauauaauucu

SEQ ID NO: 997705 - RNA, 19 nt, Homo sapiens
guaacgaagcuaagaauau

SEQ ID NO: 997706 - RNA, 19 nt, Homo sapiens
caucuuaccuucauaugca

SEQ ID NO: 997707 - RNA, 19 nt, Homo sapiens
acacaccgcucuucagguu

SEQ ID NO: 997708 - RNA, 19 nt, Homo sapiens
gaugacccauuauguccua

SEQ ID NO: 997709 - RNA, 19 nt, Homo sapiens
gugaucgaguguugaauaa

SEQ ID NO: 997710 - RNA, 19 nt, Homo sapiens
gcgagaagcccuacaagug

SEQ ID NO: 997711 - RNA, 19 nt, Homo sapiens
ugaaagcuguuugucguaa

SEQ ID NO: 997712 - RNA, 19 nt, Homo sapiens
cagaugaacuucccauugg

SEQ ID NO: 997713 - RNA, 19 nt, Homo sapiens
cuaugggagucacuauuua

SEQ ID NO: 997714 - RNA, 19 nt, Homo sapiens
aaucagagauacagagguu

SEQ ID NO: 997715 - RNA, 19 nt, Homo sapiens
aggaagaggcugacaauaa

SEQ ID NO: 997716 - RNA, 19 nt, Homo sapiens
gccuuucucuugugcaaua

SEQ ID NO: 997717 - RNA, 19 nt, Homo sapiens
gaaguaacgaagcuaagaa

SEQ ID NO: 997718 - RNA, 19 nt, Homo sapiens
uaaauggcaaugcagaaua

SEQ ID NO: 997719 - RNA, 19 nt, Homo sapiens
cgccaucuuuguauuauuu

SEQ ID NO: 997720 - RNA, 19 nt, Homo sapiens
ccauuuacuugacuauuga

SEQ ID NO: 997721 - RNA, 19 nt, Homo sapiens
gaagaggauucauuguuuu

SEQ ID NO: 997722 - RNA, 19 nt, Homo sapiens
gaaaggaagaggcugacaa

SEQ ID NO: 997723 - RNA, 19 nt, Homo sapiens
acacucauguugauuccua

SEQ ID NO: 997724 - RNA, 19 nt, Homo sapiens
uaaaagaaaugggcuguuu

SEQ ID NO: 997725 - RNA, 19 nt, Homo sapiens
aaacuuagacagcauguau

SEQ ID NO: 997726 - RNA, 19 nt, Homo sapiens
ggauucauauugcagacaa

SEQ ID NO: 997727 - RNA, 19 nt, Homo sapiens
cagaggcacuuaauuugau

SEQ ID NO: 997728 - RNA, 19 nt, Homo sapiens
gcaaagcauauuaaagaga

SEQ ID NO: 997729 - RNA, 19 nt, Homo sapiens
guaauaaaccuuaggaacu

SEQ ID NO: 997730 - RNA, 19 nt, Homo sapiens
ucaaagaucccuuccuuag

SEQ ID NO: 997731 - RNA, 19 nt, Homo sapiens
cggcaagacguucaaauuu

SEQ ID NO: 997732 - RNA, 19 nt, Homo sapiens
aaauggcaaugcagaauau

SEQ ID NO: 997733 - RNA, 19 nt, Homo sapiens
aagacaggcugccacagua

SEQ ID NO: 997734 - RNA, 19 nt, Homo sapiens
cagaauacacuuaacauag

SEQ ID NO: 997735 - RNA, 19 nt, Homo sapiens
cccaguugguguucaaaua

SEQ ID NO: 997736 - RNA, 19 nt, Homo sapiens
cccauuauguccuaguuaa

SEQ ID NO: 997737 - RNA, 19 nt, Homo sapiens
aagaauaccaggaucagua

SEQ ID NO: 997738 - RNA, 19 nt, Homo sapiens
gaaacagaauacacuuaac

SEQ ID NO: 997739 - RNA, 19 nt, Homo sapiens
gaacgcaauuaaauacacu

SEQ ID NO: 997740 - RNA, 19 nt, Homo sapiens
gcuaaaugucugucucuaa

SEQ ID NO: 997741 - RNA, 19 nt, Homo sapiens
cuaauaacguugguuuguu

SEQ ID NO: 997742 - RNA, 19 nt, Homo sapiens
acaauuaagugcacuguac

SEQ ID NO: 997743 - RNA, 19 nt, Homo sapiens
gacaauaagguuugacaga

SEQ ID NO: 997744 - RNA, 19 nt, Homo sapiens
caaguggacaaucaaauga

SEQ ID NO: 997745 - RNA, 19 nt, Homo sapiens
gagcacaaacggaaacaau

SEQ ID NO: 997746 - RNA, 19 nt, Homo sapiens
guaaggaguucauuuuaug

SEQ ID NO: 997747 - RNA, 19 nt, Homo sapiens
ggcgaaaggccuuauaaau

SEQ ID NO: 997748 - RNA, 19 nt, Homo sapiens
cauagacgauggcacuguu

SEQ ID NO: 997749 - RNA, 19 nt, Homo sapiens
ggacgacgaggaagaggaa

SEQ ID NO: 997750 - RNA, 19 nt, Homo sapiens
caagcgcugugaauggaaa

SEQ ID NO: 997751 - RNA, 19 nt, Homo sapiens
gagauacagagguugagua

SEQ ID NO: 997752 - RNA, 19 nt, Homo sapiens
cgaugguucuuucuacuug

SEQ ID NO: 997753 - RNA, 19 nt, Homo sapiens
uaugguauguuauggcuau

SEQ ID NO: 997754 - RNA, 19 nt, Homo sapiens
uuagacagcauguauggua

SEQ ID NO: 997755 - RNA, 19 nt, Homo sapiens
ggaacuagguuaccgcuua

SEQ ID NO: 997756 - RNA, 19 nt, Homo sapiens
gaaagaaguucacaucaga

SEQ ID NO: 997757 - RNA, 19 nt, Homo sapiens
gaaauuagugccacaaaua

SEQ ID NO: 997758 - RNA, 19 nt, Homo sapiens
acagaacacucauggauua

SEQ ID NO: 997759 - RNA, 19 nt, Homo sapiens
gaaaugggcaggagaugua

SEQ ID NO: 997760 - RNA, 19 nt, Homo sapiens
gaacacucauggauuaaga

SEQ ID NO: 997761 - RNA, 19 nt, Homo sapiens
guacuuacaucaggaaauu

SEQ ID NO: 997762 - RNA, 19 nt, Homo sapiens
gguguuugcuuguucuuua

SEQ ID NO: 997763 - RNA, 19 nt, Homo sapiens
ccagagagcucaagaugug

SEQ ID NO: 997764 - RNA, 19 nt, Homo sapiens
cuaacugucugacuuauaa

SEQ ID NO: 997765 - RNA, 19 nt, Homo sapiens
gaaaccagccaaccuaauu

SEQ ID NO: 997766 - RNA, 19 nt, Homo sapiens
gcucaaagaucccuuccuu

SEQ ID NO: 997767 - RNA, 19 nt, Homo sapiens
ggaugacgauuguuuauca

SEQ ID NO: 997768 - RNA, 19 nt, Homo sapiens
gcaucaagcucgagaagga

SEQ ID NO: 997769 - RNA, 19 nt, Homo sapiens
gggaauaaaucauagcaau

SEQ ID NO: 997770 - RNA, 19 nt, Homo sapiens
ggaaagaaguucacaucag

SEQ ID NO: 997771 - RNA, 19 nt, Homo sapiens
gaacuagguuaccgcuuau

SEQ ID NO: 997772 - RNA, 19 nt, Homo sapiens
aaagugugcuuaacauuga

SEQ ID NO: 997773 - RNA, 19 nt, Homo sapiens
gaacagacaaucacagcaa

SEQ ID NO: 997774 - RNA, 19 nt, Homo sapiens
caauaaauguuggagcuuu

SEQ ID NO: 997775 - RNA, 19 nt, Homo sapiens
gaccaucgcugucaugagu

SEQ ID NO: 997776 - RNA, 19 nt, Homo sapiens
gcaaugcucuauuccuuag

SEQ ID NO: 997777 - RNA, 19 nt, Homo sapiens
gaaauuauaggaggaaaga

SEQ ID NO: 997778 - RNA, 19 nt, Homo sapiens
ugacggcucucccacaauu

SEQ ID NO: 997779 - RNA, 19 nt, Homo sapiens
ggcaagacguugaaauuuc

SEQ ID NO: 997780 - RNA, 19 nt, Homo sapiens
gaagagaauuagaaacaac

SEQ ID NO: 997781 - RNA, 19 nt, Homo sapiens
gcacagaacacucauggau

SEQ ID NO: 997782 - RNA, 19 nt, Homo sapiens
gugaaaagauagccaaaua

SEQ ID NO: 997783 - RNA, 19 nt, Homo sapiens
acacauagcagauaaacuu

SEQ ID NO: 997784 - RNA, 19 nt, Homo sapiens
acaaugaggcugcuuauga

SEQ ID NO: 997785 - RNA, 19 nt, Homo sapiens
caaugaggcugcuuaugau

SEQ ID NO: 997786 - RNA, 19 nt, Homo sapiens
gcgagaagcccuacaagug

SEQ ID NO: 997787 - RNA, 19 nt, Homo sapiens
gcagacaaacaaacauaaa

SEQ ID NO: 997788 - RNA, 19 nt, Homo sapiens
cagaugaacuucccauugg

SEQ ID NO: 997789 - RNA, 19 nt, Homo sapiens
gugaauuauuuccugcuua

SEQ ID NO: 997790 - RNA, 19 nt, Homo sapiens
uagauuaccuagcuuagug

SEQ ID NO: 997791 - RNA, 19 nt, Homo sapiens
ccaguuaauuugcacagaa

SEQ ID NO: 997792 - RNA, 19 nt, Homo sapiens
cgccaucuuuguauuauuu

SEQ ID NO: 997793 - RNA, 19 nt, Homo sapiens
aaacagacccacauuggaa

SEQ ID NO: 997794 - RNA, 19 nt, Homo sapiens
gguuaccgcuuaucagaug

SEQ ID NO: 997795 - RNA, 19 nt, Homo sapiens
caaccuaauuaccuguauu

SEQ ID NO: 997796 - RNA, 19 nt, Homo sapiens
ggauucauauugcagacaa

SEQ ID NO: 997797 - RNA, 19 nt, Homo sapiens
cagaagagaauuagaaaca

SEQ ID NO: 997798 - RNA, 19 nt, Homo sapiens
ggugauaaaugucaguagu

SEQ ID NO: 997799 - RNA, 19 nt, Homo sapiens
ucaaagaucccuuccuuag

SEQ ID NO: 997800 - RNA, 19 nt, Homo sapiens
cuaaagaaggugauaaaug

SEQ ID NO: 997801 - RNA, 19 nt, Homo sapiens
aagaauaccaggaucagua

SEQ ID NO: 997802 - RNA, 19 nt, Homo sapiens
aaaccagccaaccuaauua

SEQ ID NO: 997803 - RNA, 19 nt, Homo sapiens
cgagagcccuuaaguucug

SEQ ID NO: 997804 - RNA, 19 nt, Homo sapiens
gagauccagaagagaauua

SEQ ID NO: 997805 - RNA, 19 nt, Homo sapiens
ucccaaaccuucaggaaau

SEQ ID NO: 997806 - RNA, 19 nt, Homo sapiens
gacaguagccuccaagaag

SEQ ID NO: 997807 - RNA, 19 nt, Homo sapiens
cagcgacacuuguucuuca

SEQ ID NO: 997808 - RNA, 19 nt, Homo sapiens
gagcacaaacggaaacaau

SEQ ID NO: 997809 - RNA, 19 nt, Homo sapiens
gaggaaagaaguucacauc

SEQ ID NO: 997810 - RNA, 19 nt, Homo sapiens
cauagacgauggcacuguu

SEQ ID NO: 997811 - RNA, 19 nt, Homo sapiens
ggacgacgaggaagaggaa

SEQ ID NO: 997812 - RNA, 19 nt, Homo sapiens
ggcgagcgguaaauccuaa

SEQ ID NO: 997813 - RNA, 19 nt, Homo sapiens
gcggcaagacguugaaauu

SEQ ID NO: 997814 - RNA, 19 nt, Homo sapiens
gguaaauccuaaagaaggu

SEQ ID NO: 997815 - RNA, 19 nt, Homo sapiens
gaggaacagauuugagaaa

SEQ ID NO: 997816 - RNA, 19 nt, Homo sapiens
aaagaucccuuccuuagcu

SEQ ID NO: 997817 - RNA, 19 nt, Homo sapiens
caggguauuuguaaagaug

SEQ ID NO: 997818 - RNA, 19 nt, Homo sapiens
gccagaggaugacgauugu

SEQ ID NO: 997819 - RNA, 19 nt, Homo sapiens
agaaauuagugccacaaau

SEQ ID NO: 997820 - RNA, 19 nt, Homo sapiens
ccaugcaggauuugaauuu

SEQ ID NO: 997821 - RNA, 19 nt, Homo sapiens
uggcuaccaugcaggauuu

SEQ ID NO: 997822 - RNA, 19 nt, Homo sapiens
caugacggcucucccacaa

SEQ ID NO: 997823 - RNA, 19 nt, Homo sapiens
cagggacacuugcgacgaa

SEQ ID NO: 997824 - RNA, 19 nt, Homo sapiens
gcaggguauuuguaaagau

SEQ ID NO: 997825 - RNA, 19 nt, Homo sapiens
gaugacgauuguuuaucaa

SEQ ID NO: 997826 - RNA, 19 nt, Homo sapiens
cagaggaugacgauuguuu

SEQ ID NO: 997827 - RNA, 19 nt, Homo sapiens
ccagaugaacuucccauug

SEQ ID NO: 997828 - RNA, 19 nt, Homo sapiens
ccacaaauaaguuacaucu

SEQ ID NO: 997829 - RNA, 19 nt, Homo sapiens
caagauguguggcaguuuu

SEQ ID NO: 997830 - RNA, 19 nt, Homo sapiens
ccuuuaaccugcuaagaau

SEQ ID NO: 997831 - RNA, 19 nt, Homo sapiens
ugggaugagugcagaauau

SEQ ID NO: 997832 - RNA, 19 nt, Homo sapiens
aggaacacauagcagauaa

SEQ ID NO: 997833 - RNA, 19 nt, Homo sapiens
gaggaugacgauuguuuau

SEQ ID NO: 997834 - RNA, 19 nt, Homo sapiens
ccgcuuaucagauggcaua

SEQ ID NO: 997835 - RNA, 19 nt, Homo sapiens
agacgcacaugcacaaauc

SEQ ID NO: 997836 - RNA, 19 nt, Homo sapiens
gugcugcgguugaauccaa

SEQ ID NO: 997837 - RNA, 19 nt, Homo sapiens
gcacaaacggaaacaaugc

SEQ ID NO: 997838 - RNA, 19 nt, Homo sapiens
caaauaauuggcaugugaa

SEQ ID NO: 997839 - RNA, 19 nt, Homo sapiens
gaacacauagcagauaaac

SEQ ID NO: 997840 - RNA, 19 nt, Homo sapiens
gaaccuaaguggggaaaau

SEQ ID NO: 997841 - RNA, 19 nt, Homo sapiens
caaaccuucaggaaauaua

SEQ ID NO: 997842 - RNA, 19 nt, Homo sapiens
ggaggaacagauuugagaa

SEQ ID NO: 997843 - RNA, 19 nt, Homo sapiens
gguaggaggaacagauuug

SEQ ID NO: 997844 - RNA, 19 nt, Homo sapiens
gugaaucagucccauagag

SEQ ID NO: 997845 - RNA, 19 nt, Homo sapiens
cccaaaccuucaggaaaua

SEQ ID NO: 997846 - RNA, 19 nt, Homo sapiens
gcacauggagcucuaaucc

SEQ ID NO: 997847 - RNA, 19 nt, Homo sapiens
cggcaagacguugaaauuu

SEQ ID NO: 997848 - RNA, 19 nt, Homo sapiens
ccucuugaagccauucuua

SEQ ID NO: 997849 - RNA, 19 nt, Homo sapiens
aaacggaaacaaugcaaug

SEQ ID NO: 997850 - RNA, 19 nt, Homo sapiens
guguuugcuuguucuuuaa

SEQ ID NO: 997851 - RNA, 19 nt, Homo sapiens
caggaucaguaucgagaga

SEQ ID NO: 997852 - RNA, 19 nt, Homo sapiens
aggacuaggugcagaaugu

SEQ ID NO: 997853 - RNA, 19 nt, Homo sapiens
ccugugugcuguagauuca

SEQ ID NO: 997854 - RNA, 19 nt, Homo sapiens
ggaagaagaggaggaagag

SEQ ID NO: 997855 - RNA, 19 nt, Homo sapiens
ggaacuagguuaccgcuua

SEQ ID NO: 997856 - RNA, 19 nt, Homo sapiens
gaaagaaguucacaucaga

SEQ ID NO: 997857 - RNA, 19 nt, Homo sapiens
gaaauuagugccacaaaua

SEQ ID NO: 997858 - RNA, 19 nt, Homo sapiens
acagaacacucauggauua

SEQ ID NO: 997859 - RNA, 19 nt, Homo sapiens
gaaaugggcaggagaugua

SEQ ID NO: 997860 - RNA, 19 nt, Homo sapiens
gaacacucauggauuaaga

SEQ ID NO: 997861 - RNA, 19 nt, Homo sapiens
guacuuacaucaggaaauu

SEQ ID NO: 997862 - RNA, 19 nt, Homo sapiens
gguguuugcuuguucuuua

SEQ ID NO: 997863 - RNA, 19 nt, Homo sapiens
ccagagagcucaagaugug

SEQ ID NO: 997864 - RNA, 19 nt, Homo sapiens
cuaacugucugacuuauaa

SEQ ID NO: 997865 - RNA, 19 nt, Homo sapiens
gaaaccagccaaccuaauu

SEQ ID NO: 997866 - RNA, 19 nt, Homo sapiens
gcaagacguucaaauuuca

SEQ ID NO: 997867 - RNA, 19 nt, Homo sapiens
gcucaaagaucccuuccuu

SEQ ID NO: 997868 - RNA, 19 nt, Homo sapiens
ggaugacgauuguuuauca

SEQ ID NO: 997869 - RNA, 19 nt, Homo sapiens
gcaucaagcucgagaagga

SEQ ID NO: 997870 - RNA, 19 nt, Homo sapiens
gggaauaaaucauagcaau

SEQ ID NO: 997871 - RNA, 19 nt, Homo sapiens
ggaaagaaguucacaucag

SEQ ID NO: 997872 - RNA, 19 nt, Homo sapiens
gaacuagguuaccgcuuau

SEQ ID NO: 997873 - RNA, 19 nt, Homo sapiens
aaagugugcuuaacauuga

SEQ ID NO: 997874 - RNA, 19 nt, Homo sapiens
gaacagacaaucacagcaa

SEQ ID NO: 997875 - RNA, 19 nt, Homo sapiens
caauaaauguuggagcuuu

SEQ ID NO: 997876 - RNA, 19 nt, Homo sapiens
gaccaucgcugucaugagu

SEQ ID NO: 997877 - RNA, 19 nt, Homo sapiens
gcaaugcucuauuccuuag

SEQ ID NO: 997878 - RNA, 19 nt, Homo sapiens
gaaauuauaggaggaaaga

SEQ ID NO: 997879 - RNA, 19 nt, Homo sapiens
ugacggcucucccacaauu

SEQ ID NO: 997880 - RNA, 19 nt, Homo sapiens
ggcaagacguucaaauuuc

SEQ ID NO: 997881 - RNA, 19 nt, Homo sapiens
gaagagaauuagaaacaac

SEQ ID NO: 997882 - RNA, 19 nt, Homo sapiens
gcacagaacacucauggau

SEQ ID NO: 997883 - RNA, 19 nt, Homo sapiens
gugaaaagauagccaaaua

SEQ ID NO: 997884 - RNA, 19 nt, Homo sapiens
acacauagcagauaaacuu

SEQ ID NO: 997885 - RNA, 19 nt, Homo sapiens
acaaugaggcugcuuauga

SEQ ID NO: 997886 - RNA, 19 nt, Homo sapiens
caaugaggcugcuuaugau

SEQ ID NO: 997887 - RNA, 19 nt, Homo sapiens
gcgagaagcccuacaagug

SEQ ID NO: 997888 - RNA, 19 nt, Homo sapiens
gcagacaaacaaacauaaa

SEQ ID NO: 997889 - RNA, 19 nt, Homo sapiens
cagaugaacuucccauugg

SEQ ID NO: 997890 - RNA, 19 nt, Homo sapiens
gugaauuauuuccugcuua

SEQ ID NO: 997891 - RNA, 19 nt, Homo sapiens
uagauuaccuagcuuagug

SEQ ID NO: 997892 - RNA, 19 nt, Homo sapiens
ccaguuaauuugcacagaa

SEQ ID NO: 997893 - RNA, 19 nt, Homo sapiens
cgccaucuuuguauuauuu

SEQ ID NO: 997894 - RNA, 19 nt, Homo sapiens
aaacagacccacauuggaa

SEQ ID NO: 997895 - RNA, 19 nt, Homo sapiens
gguuaccgcuuaucagaug

SEQ ID NO: 997896 - RNA, 19 nt, Homo sapiens
caaccuaauuaccuguauu

SEQ ID NO: 997897 - RNA, 19 nt, Homo sapiens
ggauucauauugcagacaa

SEQ ID NO: 997898 - RNA, 19 nt, Homo sapiens
cagaagagaauuagaaaca

SEQ ID NO: 997899 - RNA, 19 nt, Homo sapiens
ggugauaaaugucaguagu

SEQ ID NO: 997900 - RNA, 19 nt, Homo sapiens
ucaaagaucccuuccuuag

SEQ ID NO: 997901 - RNA, 19 nt, Homo sapiens
cggcaagacguucaaauuu

SEQ ID NO: 997902 - RNA, 19 nt, Homo sapiens
cuaaagaaggugauaaaug

SEQ ID NO: 997903 - RNA, 19 nt, Homo sapiens
aagaauaccaggaucagua

SEQ ID NO: 997904 - RNA, 19 nt, Homo sapiens
aaaccagccaaccuaauua

SEQ ID NO: 997905 - RNA, 19 nt, Homo sapiens
cgagagcccuuaaguucug

SEQ ID NO: 997906 - RNA, 19 nt, Homo sapiens
gagauccagaagagaauua

SEQ ID NO: 997907 - RNA, 19 nt, Homo sapiens
ucccaaaccuucaggaaau

SEQ ID NO: 997908 - RNA, 19 nt, Homo sapiens
gacaguagccuccaagaag

SEQ ID NO: 997909 - RNA, 19 nt, Homo sapiens
gagcacaaacggaaacaau

SEQ ID NO: 997910 - RNA, 19 nt, Homo sapiens
gaggaaagaaguucacauc

SEQ ID NO: 997911 - RNA, 19 nt, Homo sapiens
cauagacgauggcacuguu

SEQ ID NO: 997912 - RNA, 19 nt, Homo sapiens
ggacgacgaggaagaggaa

SEQ ID NO: 997913 - RNA, 19 nt, Homo sapiens
ggcgagcgguaaauccuaa

SEQ ID NO: 997914 - RNA, 19 nt, Homo sapiens
gcggcaagacguucaaauu

SEQ ID NO: 997915 - RNA, 19 nt, Homo sapiens
gguaaauccuaaagaaggu

SEQ ID NO: 997916 - RNA, 19 nt, Homo sapiens
gaggaacagauuugagaaa

SEQ ID NO: 997917 - RNA, 19 nt, Homo sapiens
aaagaucccuuccuuagcu

SEQ ID NO: 997918 - RNA, 19 nt, Homo sapiens
caggguauuuguaaagaug

SEQ ID NO: 997919 - RNA, 19 nt, Homo sapiens
gccagaggaugacgauugu

SEQ ID NO: 997920 - RNA, 19 nt, Homo sapiens
agaaauuagugccacaaau

SEQ ID NO: 997921 - RNA, 19 nt, Homo sapiens
ccaugcaggauuugaauuu

SEQ ID NO: 997922 - RNA, 19 nt, Homo sapiens
uggcuaccaugcaggauuu

SEQ ID NO: 997923 - RNA, 19 nt, Homo sapiens
caugacggcucucccacaa

SEQ ID NO: 997924 - RNA, 19 nt, Homo sapiens
cagggacacuugcgacgaa

SEQ ID NO: 997925 - RNA, 19 nt, Homo sapiens
gcaggguauuuguaaagau

SEQ ID NO: 997926 - RNA, 19 nt, Homo sapiens
gaugacgauuguuuaucaa

SEQ ID NO: 997927 - RNA, 19 nt, Homo sapiens
cagaggaugacgauuguuu

SEQ ID NO: 997928 - RNA, 19 nt, Homo sapiens
ccagaugaacuucccauug

SEQ ID NO: 997929 - RNA, 19 nt, Homo sapiens
ccacaaauaaguuacaucu

SEQ ID NO: 997930 - RNA, 19 nt, Homo sapiens
caagauguguggcaguuuu

SEQ ID NO: 997931 - RNA, 19 nt, Homo sapiens
ccuuuaaccugcuaagaau

SEQ ID NO: 997932 - RNA, 19 nt, Homo sapiens
ugggaugagugcagaauau

SEQ ID NO: 997933 - RNA, 19 nt, Homo sapiens
aggaacacauagcagauaa

SEQ ID NO: 997934 - RNA, 19 nt, Homo sapiens
gaggaugacgauuguuuau

SEQ ID NO: 997935 - RNA, 19 nt, Homo sapiens
ccgcuuaucagauggcaua

SEQ ID NO: 997936 - RNA, 19 nt, Homo sapiens
agacgcacaugcacaaauc

SEQ ID NO: 997937 - RNA, 19 nt, Homo sapiens
gugcugcgguugaauccaa

SEQ ID NO: 997938 - RNA, 19 nt, Homo sapiens
gcacaaacggaaacaaugc

SEQ ID NO: 997939 - RNA, 19 nt, Homo sapiens
caaauaauuggcaugugaa

SEQ ID NO: 997940 - RNA, 19 nt, Homo sapiens
gcagacgcagcgacacuuu

SEQ ID NO: 997941 - RNA, 19 nt, Homo sapiens
gaacacauagcagauaaac

SEQ ID NO: 997942 - RNA, 19 nt, Homo sapiens
gaaccuaaguggggaaaau

SEQ ID NO: 997943 - RNA, 19 nt, Homo sapiens
caaaccuucaggaaauaua

SEQ ID NO: 997944 - RNA, 19 nt, Homo sapiens
ggaggaacagauuugagaa

SEQ ID NO: 997945 - RNA, 19 nt, Homo sapiens
gguaggaggaacagauuug

SEQ ID NO: 997946 - RNA, 19 nt, Homo sapiens
gugaaucagucccauagag

SEQ ID NO: 997947 - RNA, 19 nt, Homo sapiens
cccaaaccuucaggaaaua

SEQ ID NO: 997948 - RNA, 19 nt, Homo sapiens
gcacauggagcucuaaucc

SEQ ID NO: 997949 - RNA, 19 nt, Homo sapiens
ccucuugaagccauucuua

SEQ ID NO: 997950 - RNA, 19 nt, Homo sapiens
aaacggaaacaaugcaaug

SEQ ID NO: 997951 - RNA, 19 nt, Homo sapiens
guguuugcuuguucuuuaa

SEQ ID NO: 997952 - RNA, 19 nt, Homo sapiens
caggaucaguaucgagaga

SEQ ID NO: 997953 - RNA, 19 nt, Homo sapiens
aggacuaggugcagaaugu

SEQ ID NO: 997954 - RNA, 19 nt, Homo sapiens
ccugugugcuguagauuca

SEQ ID NO: 997955 - RNA, 19 nt, Homo sapiens
ggaacuagguuaccgcuua

SEQ ID NO: 997956 - RNA, 19 nt, Homo sapiens
gaaagaaguucacaucaga

SEQ ID NO: 997957 - RNA, 19 nt, Homo sapiens
gaaauuagugccacaaaua

SEQ ID NO: 997958 - RNA, 19 nt, Homo sapiens
acagaacacucauggauua

SEQ ID NO: 997959 - RNA, 19 nt, Homo sapiens
gaaaugggcaggagaugua

SEQ ID NO: 997960 - RNA, 19 nt, Homo sapiens
gaacacucauggauuaaga

SEQ ID NO: 997961 - RNA, 19 nt, Homo sapiens
guacuuacaucaggaaauu

SEQ ID NO: 997962 - RNA, 19 nt, Homo sapiens
gguguuugcuuguucuuua

SEQ ID NO: 997963 - RNA, 19 nt, Homo sapiens
ccagagagcucaagaugug

SEQ ID NO: 997964 - RNA, 19 nt, Homo sapiens
cuaacugucugacuuauaa

SEQ ID NO: 997965 - RNA, 19 nt, Homo sapiens
gaaaccagccaaccuaauu

SEQ ID NO: 997966 - RNA, 19 nt, Homo sapiens
ggaugacgauuguuuauca

SEQ ID NO: 997967 - RNA, 19 nt, Homo sapiens
gggaauaaaucauagcaau

SEQ ID NO: 997968 - RNA, 19 nt, Homo sapiens
ggaaagaaguucacaucag

SEQ ID NO: 997969 - RNA, 19 nt, Homo sapiens
gaacuagguuaccgcuuau

SEQ ID NO: 997970 - RNA, 19 nt, Homo sapiens
aaagugugcuuaacauuga

SEQ ID NO: 997971 - RNA, 19 nt, Homo sapiens
gaacagacaaucacagcaa

SEQ ID NO: 997972 - RNA, 19 nt, Homo sapiens
caauaaauguuggagcuuu

SEQ ID NO: 997973 - RNA, 19 nt, Homo sapiens
gaccaucgcugucaugagu

SEQ ID NO: 997974 - RNA, 19 nt, Homo sapiens
gcaaugcucuauuccuuag

SEQ ID NO: 997975 - RNA, 19 nt, Homo sapiens
gaaauuauaggaggaaaga

SEQ ID NO: 997976 - RNA, 19 nt, Homo sapiens
ugacggcucucccacaauu

SEQ ID NO: 997977 - RNA, 19 nt, Homo sapiens
gaagagaauuagaaacaac

SEQ ID NO: 997978 - RNA, 19 nt, Homo sapiens
gcacagaacacucauggau

SEQ ID NO: 997979 - RNA, 19 nt, Homo sapiens
gugaaaagauagccaaaua

SEQ ID NO: 997980 - RNA, 19 nt, Homo sapiens
acacauagcagauaaacuu

SEQ ID NO: 997981 - RNA, 19 nt, Homo sapiens
acaaugaggcugcuuauga

SEQ ID NO: 997982 - RNA, 19 nt, Homo sapiens
caaugaggcugcuuaugau

SEQ ID NO: 997983 - RNA, 19 nt, Homo sapiens
gcagacaaacaaacauaaa

SEQ ID NO: 997984 - RNA, 19 nt, Homo sapiens
cagaugaacuucccauugg

SEQ ID NO: 997985 - RNA, 19 nt, Homo sapiens
gugaauuauuuccugcuua

SEQ ID NO: 997986 - RNA, 19 nt, Homo sapiens
uagauuaccuagcuuagug

SEQ ID NO: 997987 - RNA, 19 nt, Homo sapiens
ccaguuaauuugcacagaa

SEQ ID NO: 997988 - RNA, 19 nt, Homo sapiens
cgccaucuuuguauuauuu

SEQ ID NO: 997989 - RNA, 19 nt, Homo sapiens
aaacagacccacauuggaa

SEQ ID NO: 997990 - RNA, 19 nt, Homo sapiens
gguuaccgcuuaucagaug

SEQ ID NO: 997991 - RNA, 19 nt, Homo sapiens
caaccuaauuaccuguauu

SEQ ID NO: 997992 - RNA, 19 nt, Homo sapiens
cagaagagaauuagaaaca

SEQ ID NO: 997993 - RNA, 19 nt, Homo sapiens
ggugauaaaugucaguagu

SEQ ID NO: 997994 - RNA, 19 nt, Homo sapiens
cuaaagaaggugauaaaug

SEQ ID NO: 997995 - RNA, 19 nt, Homo sapiens
aaaccagccaaccuaauua

SEQ ID NO: 997996 - RNA, 19 nt, Homo sapiens
cgagagcccuuaaguucug

SEQ ID NO: 997997 - RNA, 19 nt, Homo sapiens
gagauccagaagagaauua

SEQ ID NO: 997998 - RNA, 19 nt, Homo sapiens
ucccaaaccuucaggaaau

SEQ ID NO: 997999 - RNA, 19 nt, Homo sapiens
gacaguagccuccaagaag

SEQ ID NO: 998000 - RNA, 19 nt, Homo sapiens
gagcacaaacggaaacaau

SEQ ID NO: 998001 - RNA, 19 nt, Homo sapiens
gaggaaagaaguucacauc

SEQ ID NO: 998002 - RNA, 19 nt, Homo sapiens
ggcgagcgguaaauccuaa

SEQ ID NO: 998003 - RNA, 19 nt, Homo sapiens
gguaaauccuaaagaaggu

SEQ ID NO: 998004 - RNA, 19 nt, Homo sapiens
gaggaacagauuugagaaa

SEQ ID NO: 998005 - RNA, 19 nt, Homo sapiens
caggguauuuguaaagaug

SEQ ID NO: 998006 - RNA, 19 nt, Homo sapiens
gccagaggaugacgauugu

SEQ ID NO: 998007 - RNA, 19 nt, Homo sapiens
agaaauuagugccacaaau

SEQ ID NO: 998008 - RNA, 19 nt, Homo sapiens
ccaugcaggauuugaauuu

SEQ ID NO: 998009 - RNA, 19 nt, Homo sapiens
uggcuaccaugcaggauuu

SEQ ID NO: 998010 - RNA, 19 nt, Homo sapiens
caugacggcucucccacaa

SEQ ID NO: 998011 - RNA, 19 nt, Homo sapiens
gcaggguauuuguaaagau

SEQ ID NO: 998012 - RNA, 19 nt, Homo sapiens
gaugacgauuguuuaucaa

SEQ ID NO: 998013 - RNA, 19 nt, Homo sapiens
cagaggaugacgauuguuu

SEQ ID NO: 998014 - RNA, 19 nt, Homo sapiens
ccagaugaacuucccauug

SEQ ID NO: 998015 - RNA, 19 nt, Homo sapiens
ccacaaauaaguuacaucu

SEQ ID NO: 998016 - RNA, 19 nt, Homo sapiens
caagauguguggcaguuuu

SEQ ID NO: 998017 - RNA, 19 nt, Homo sapiens
ugggaugagugcagaauau

SEQ ID NO: 998018 - RNA, 19 nt, Homo sapiens
aggaacacauagcagauaa

SEQ ID NO: 998019 - RNA, 19 nt, Homo sapiens
gaggaugacgauuguuuau

SEQ ID NO: 998020 - RNA, 19 nt, Homo sapiens
ccgcuuaucagauggcaua

SEQ ID NO: 998021 - RNA, 19 nt, Homo sapiens
gcacaaacggaaacaaugc

SEQ ID NO: 998022 - RNA, 19 nt, Homo sapiens
caaauaauuggcaugugaa

SEQ ID NO: 998023 - RNA, 19 nt, Homo sapiens
gaacacauagcagauaaac

SEQ ID NO: 998024 - RNA, 19 nt, Homo sapiens
gaaccuaaguggggaaaau

SEQ ID NO: 998025 - RNA, 19 nt, Homo sapiens
caaaccuucaggaaauaua

SEQ ID NO: 998026 - RNA, 19 nt, Homo sapiens
ggaggaacagauuugagaa

SEQ ID NO: 998027 - RNA, 19 nt, Homo sapiens
gguaggaggaacagauuug

SEQ ID NO: 998028 - RNA, 19 nt, Homo sapiens
gugaaucagucccauagag

SEQ ID NO: 998029 - RNA, 19 nt, Homo sapiens
cccaaaccuucaggaaaua

SEQ ID NO: 998030 - RNA, 19 nt, Homo sapiens
gcacauggagcucuaaucc

SEQ ID NO: 998031 - RNA, 19 nt, Homo sapiens
ccucuugaagccauucuua

SEQ ID NO: 998032 - RNA, 19 nt, Homo sapiens
aaacggaaacaaugcaaug

SEQ ID NO: 998033 - RNA, 19 nt, Homo sapiens
guguuugcuuguucuuuaa

SEQ ID NO: 998034 - RNA, 19 nt, Homo sapiens
aagccauucuuacagauga

SEQ ID NO: 998035 - RNA, 19 nt, Homo sapiens
ccugugugcuguagauuca

SEQ ID NO: 998036 - RNA, 19 nt, Homo sapiens
gaagccauucuuacagaug

SEQ ID NO: 998037 - RNA, 19 nt, Homo sapiens
ggaacacauagcagauaaa

SEQ ID NO: 998038 - RNA, 19 nt, Homo sapiens
agaggaugacgauuguuua

SEQ ID NO: 998039 - RNA, 19 nt, Homo sapiens
caugcaggauuugaauuug

SEQ ID NO: 998040 - RNA, 19 nt, Homo sapiens
uugaagccauucuuacaga

SEQ ID NO: 998041 - RNA, 19 nt, Homo sapiens
caggaacacauagcagaua

SEQ ID NO: 998042 - RNA, 19 nt, Homo sapiens
aaaaggcacugaugaagau

SEQ ID NO: 998043 - RNA, 19 nt, Homo sapiens
gcacugaugaagauauuuu

SEQ ID NO: 998044 - RNA, 19 nt, Homo sapiens
ugaaucagucccauagaga

SEQ ID NO: 998045 - RNA, 19 nt, Homo sapiens
gcgccaucuuuguauuauu

SEQ ID NO: 998046 - RNA, 19 nt, Homo sapiens
uuaccuguauuguggaaau

SEQ ID NO: 998047 - RNA, 19 nt, Homo sapiens
ccaaccuaauuaccuguau

SEQ ID NO: 998048 - RNA, 19 nt, Homo sapiens
ccaucgcugucaugaguga

SEQ ID NO: 998049 - RNA, 19 nt, Homo sapiens
ugacaguagccuccaagaa

SEQ ID NO: 998050 - RNA, 19 nt, Homo sapiens
auacaggccgugaaccuaa

SEQ ID NO: 998051 - RNA, 19 nt, Homo sapiens
gggaaauuauaggaggaaa

SEQ ID NO: 998052 - RNA, 19 nt, Homo sapiens
uaauauggcacgccgaauc

SEQ ID NO: 998053 - RNA, 19 nt, Homo sapiens
ccugcuaguuugugauguu

SEQ ID NO: 998054 - RNA, 19 nt, Homo sapiens
caugguuucucuugcaaca

SEQ ID NO: 998055 - RNA, 19 nt, Homo sapiens
gaaugaagauaaacuguga

SEQ ID NO: 998056 - RNA, 19 nt, Homo sapiens
caaaucaacugacacuaaa

SEQ ID NO: 998057 - RNA, 19 nt, Homo sapiens
gcaaaucaacugacacuaa

SEQ ID NO: 998058 - RNA, 19 nt, Homo sapiens
cacaagcccuuaaaugaua

SEQ ID NO: 998059 - RNA, 19 nt, Homo sapiens
uaucagaccugucaucuau

SEQ ID NO: 998060 - RNA, 19 nt, Homo sapiens
gagagagccauaacauuua

SEQ ID NO: 998061 - RNA, 19 nt, Homo sapiens
cgagagagccauaacauuu

SEQ ID NO: 998062 - RNA, 19 nt, Homo sapiens
gaaaggaacacaaacuaau

SEQ ID NO: 998063 - RNA, 19 nt, Homo sapiens
cgaaugagaaugaagauaa

SEQ ID NO: 998064 - RNA, 19 nt, Homo sapiens
guagaaaccaacccaauaa

SEQ ID NO: 998065 - RNA, 19 nt, Homo sapiens
gaugaguucuccuacuaaa

SEQ ID NO: 998066 - RNA, 19 nt, Homo sapiens
gaaaccaacccaauaaaca

SEQ ID NO: 998067 - RNA, 19 nt, Homo sapiens
gguagaaaccaacccaaua

SEQ ID NO: 998068 - RNA, 19 nt, Homo sapiens
aaauguagauuccgugcua

SEQ ID NO: 998069 - RNA, 19 nt, Homo sapiens
gaaguaugauucuccaucu

SEQ ID NO: 998070 - RNA, 19 nt, Homo sapiens
gagauaagaaguaugauuc

SEQ ID NO: 998071 - RNA, 19 nt, Homo sapiens
caaauaguuucacccauca

SEQ ID NO: 998072 - RNA, 19 nt, Homo sapiens
ggagagucccauuuauuaa

SEQ ID NO: 998073 - RNA, 19 nt, Homo sapiens
gcaaacaauuuccccauaa

SEQ ID NO: 998074 - RNA, 19 nt, Homo sapiens
ugacauauauccauaccau

SEQ ID NO: 998075 - RNA, 19 nt, Homo sapiens
uggagagucccauuuauua

SEQ ID NO: 998076 - RNA, 19 nt, Homo sapiens
gagaugaaagcaaacaauu

SEQ ID NO: 998077 - RNA, 19 nt, Homo sapiens
gcugcagggugucagaaua

SEQ ID NO: 998078 - RNA, 19 nt, Homo sapiens
agacaaaguucuaccaagu

SEQ ID NO: 998079 - RNA, 19 nt, Homo sapiens
ccaaguguuuccagagauu

SEQ ID NO: 998080 - RNA, 19 nt, Homo sapiens
ugacuaagauagcaaacau

SEQ ID NO: 998081 - RNA, 19 nt, Homo sapiens
gaagugauacagcuggaaa

SEQ ID NO: 998082 - RNA, 19 nt, Homo sapiens
ugaaauaucagaccuguca

SEQ ID NO: 998083 - RNA, 19 nt, Homo sapiens
uaacagucaugagauaaga

SEQ ID NO: 998084 - RNA, 19 nt, Homo sapiens
ucagaccugucaucuauau

SEQ ID NO: 998085 - RNA, 19 nt, Homo sapiens
ugucacagauacaaauuga

SEQ ID NO: 998086 - RNA, 19 nt, Homo sapiens
gaaaauuggucucucacaa

SEQ ID NO: 998087 - RNA, 19 nt, Homo sapiens
gaagcagccagucauacua

SEQ ID NO: 998088 - RNA, 19 nt, Homo sapiens
ucugaaauguucuccauau

SEQ ID NO: 998089 - RNA, 19 nt, Homo sapiens
acagcgagcucgaaacaga

SEQ ID NO: 998090 - RNA, 19 nt, Homo sapiens
gucauacuauccucaaauu

SEQ ID NO: 998091 - RNA, 19 nt, Homo sapiens
uuacugcauuucagccuua

SEQ ID NO: 998092 - RNA, 19 nt, Homo sapiens
gaccugucaucuauauuga

SEQ ID NO: 998093 - RNA, 19 nt, Homo sapiens
aaaaugagccuccuaauga

SEQ ID NO: 998094 - RNA, 19 nt, Homo sapiens
gagauucugcuacauguau

SEQ ID NO: 998095 - RNA, 19 nt, Homo sapiens
cagaaaggaacacaaacua

SEQ ID NO: 998096 - RNA, 19 nt, Homo sapiens
ucacaaacaccaauaaugg

SEQ ID NO: 998097 - RNA, 19 nt, Homo sapiens
caugagauaagaaguauga

SEQ ID NO: 998098 - RNA, 19 nt, Homo sapiens
cagggaaaguugagaugaa

SEQ ID NO: 998099 - RNA, 19 nt, Homo sapiens
uaauaguaccucucaguaa

SEQ ID NO: 998100 - RNA, 19 nt, Homo sapiens
caacauucaugcagcucuu

SEQ ID NO: 998101 - RNA, 19 nt, Homo sapiens
ucaccgaauuacugcauuu

SEQ ID NO: 998102 - RNA, 19 nt, Homo sapiens
cugaaauguucuccauaua

SEQ ID NO: 998103 - RNA, 19 nt, Homo sapiens
gagagaaugacaucaggaa

SEQ ID NO: 998104 - RNA, 19 nt, Homo sapiens
gaaaaugagccuccuaaug

SEQ ID NO: 998105 - RNA, 19 nt, Homo sapiens
aaaguucuaccaaguguuu

SEQ ID NO: 998106 - RNA, 19 nt, Homo sapiens
ugaguucuccuacuaaaga

SEQ ID NO: 998107 - RNA, 19 nt, Homo sapiens
agaaaggaacacaaacuaa

SEQ ID NO: 998108 - RNA, 19 nt, Homo sapiens
gaucacaaacaccaauaau

SEQ ID NO: 998109 - RNA, 19 nt, Homo sapiens
aaguugagaugaaagcaaa

SEQ ID NO: 998110 - RNA, 19 nt, Homo sapiens
ucacaagcccuuaaaugau

SEQ ID NO: 998111 - RNA, 19 nt, Homo sapiens
acaaaguucuaccaagugu

SEQ ID NO: 998112 - RNA, 19 nt, Homo sapiens
aauaguaccucucaguaag

SEQ ID NO: 998113 - RNA, 19 nt, Homo sapiens
cuaauaguaccucucagua

SEQ ID NO: 998114 - RNA, 19 nt, Homo sapiens
uagcagaaaggaacacaaa

SEQ ID NO: 998115 - RNA, 19 nt, Homo sapiens
cuucgagggugcacuacua

SEQ ID NO: 998116 - RNA, 19 nt, Homo sapiens
cuucaguucucaccgaauu

SEQ ID NO: 998117 - RNA, 19 nt, Homo sapiens
gcagaaaggaacacaaacu

SEQ ID NO: 998118 - RNA, 19 nt, Homo sapiens
caauaaugguuggaaauac

SEQ ID NO: 998119 - RNA, 19 nt, Homo sapiens
acauauauccauaccauga

SEQ ID NO: 998120 - RNA, 19 nt, Homo sapiens
ggaugaguucuccuacuaa

SEQ ID NO: 998121 - RNA, 19 nt, Homo sapiens
uaucugaaauguucuccau

SEQ ID NO: 998122 - RNA, 19 nt, Homo sapiens
uaccaaguguuuccagaga

SEQ ID NO: 998123 - RNA, 19 nt, Homo sapiens
ggagugaggaaacaucugu

SEQ ID NO: 998124 - RNA, 19 nt, Homo sapiens
gcagcucuucugggaauua

SEQ ID NO: 998125 - RNA, 19 nt, Homo sapiens
ugugaggucugugcucuuu

SEQ ID NO: 998126 - RNA, 19 nt, Homo sapiens
uagaugaccuccagcaacu

SEQ ID NO: 998127 - RNA, 19 nt, Homo sapiens
gaaaacagcgagcucgaaa

SEQ ID NO: 998128 - RNA, 19 nt, Homo sapiens
ugaagcacaccuuuccuaa

SEQ ID NO: 998129 - RNA, 19 nt, Homo sapiens
uauauugagucagcauuug

SEQ ID NO: 998130 - RNA, 19 nt, Homo sapiens
gacacuaaagggaaaugua

SEQ ID NO: 998131 - RNA, 19 nt, Homo sapiens
caaacaauuuccccauaaa

SEQ ID NO: 998132 - RNA, 19 nt, Homo sapiens
gugcaucugacaagccuua

SEQ ID NO: 998133 - RNA, 19 nt, Homo sapiens
uaccaugaauguuaugauc

SEQ ID NO: 998134 - RNA, 19 nt, Homo sapiens
gucaugagauaagaaguau

SEQ ID NO: 998135 - RNA, 19 nt, Homo sapiens
ucaacgagaagaagaucua

SEQ ID NO: 998136 - RNA, 19 nt, Homo sapiens
aaacagcgagcucgaaaca

SEQ ID NO: 998137 - RNA, 19 nt, Homo sapiens
ugagaagcagccagucaua

SEQ ID NO: 998138 - RNA, 19 nt, Homo sapiens
gagaaugaagauaaacugu

SEQ ID NO: 998139 - RNA, 19 nt, Homo sapiens
auccauaccaugaauguua

SEQ ID NO: 998140 - RNA, 19 nt, Homo sapiens
uaaagggaaauguagauuc

SEQ ID NO: 998141 - RNA, 19 nt, Homo sapiens
ccauguggguaaagcgaaa

SEQ ID NO: 998142 - RNA, 19 nt, Homo sapiens
ugacgaaugagaaugaaga

SEQ ID NO: 998143 - RNA, 19 nt, Homo sapiens
uaaagaaggaagugauaca

SEQ ID NO: 998144 - RNA, 19 nt, Homo sapiens
gugaagcacaccuuuccua

SEQ ID NO: 998145 - RNA, 19 nt, Homo sapiens
ugucaucuauauugaguca

SEQ ID NO: 998146 - RNA, 19 nt, Homo sapiens
cagcucuucugggaauuaa

SEQ ID NO: 998147 - RNA, 19 nt, Homo sapiens
ugaggucugugcucuuugu

SEQ ID NO: 998148 - RNA, 19 nt, Homo sapiens
gcgaaaauauauagcaugu

SEQ ID NO: 998149 - RNA, 19 nt, Homo sapiens
gagcuucuucuacuucaga

SEQ ID NO: 998150 - RNA, 19 nt, Homo sapiens
gagaagaagaucuaaaaga

SEQ ID NO: 998151 - RNA, 19 nt, Homo sapiens
gacauagagucuccaucug

SEQ ID NO: 998152 - RNA, 19 nt, Homo sapiens
gagaaagcauaagggaucu

SEQ ID NO: 998153 - RNA, 19 nt, Homo sapiens
gaagauguuguuccucaag

SEQ ID NO: 998154 - RNA, 19 nt, Homo sapiens
ugauacagcuggaaaugcu

SEQ ID NO: 998155 - RNA, 19 nt, Homo sapiens
gcagaaggguuuacugaua

SEQ ID NO: 998156 - RNA, 19 nt, Homo sapiens
guaaagagauccaacagaa

SEQ ID NO: 998157 - RNA, 19 nt, Homo sapiens
gaacuggguuuaaugguuu

SEQ ID NO: 998158 - RNA, 19 nt, Homo sapiens
caacugcucugacauugua

SEQ ID NO: 998159 - RNA, 19 nt, Homo sapiens
gauauaagccucaguuaaa

SEQ ID NO: 998160 - RNA, 19 nt, Homo sapiens
gaagcugacuuuauauuug

SEQ ID NO: 998161 - RNA, 19 nt, Homo sapiens
aaacauaaauggccacaaa

SEQ ID NO: 998162 - RNA, 19 nt, Homo sapiens
guaaaccucuuucuucauu

SEQ ID NO: 998163 - RNA, 19 nt, Homo sapiens
gcugaggucucuugaaauu

SEQ ID NO: 998164 - RNA, 19 nt, Homo sapiens
gaaaguggaguuuaaggua

SEQ ID NO: 998165 - RNA, 19 nt, Homo sapiens
ucacuaaacugcaccacua

SEQ ID NO: 998166 - RNA, 19 nt, Homo sapiens
agaaggaucucuauaguug

SEQ ID NO: 998167 - RNA, 19 nt, Homo sapiens
gaaaagagaugggucagua

SEQ ID NO: 998168 - RNA, 19 nt, Homo sapiens
gaacagccaucacuucaac

SEQ ID NO: 998169 - RNA, 19 nt, Homo sapiens
ugaaguaucuuguuguuag

SEQ ID NO: 998170 - RNA, 19 nt, Homo sapiens
gaaaagaacuggguuuaau

SEQ ID NO: 998171 - RNA, 19 nt, Homo sapiens
uaauggcacuucaauagaa

SEQ ID NO: 998172 - RNA, 19 nt, Homo sapiens
ggauuuggcuuguauggau

SEQ ID NO: 998173 - RNA, 19 nt, Homo sapiens
ggauauaagccucaguuaa

SEQ ID NO: 998174 - RNA, 19 nt, Homo sapiens
ugaaauugcuaaagggaaa

SEQ ID NO: 998175 - RNA, 19 nt, Homo sapiens
gacuuagggucuuucaaua

SEQ ID NO: 998176 - RNA, 19 nt, Homo sapiens
agacaacaauuaccuguga

SEQ ID NO: 998177 - RNA, 19 nt, Homo sapiens
gauacacucugugcaguuu

SEQ ID NO: 998178 - RNA, 19 nt, Homo sapiens
cauacaaucuagugucaaa

SEQ ID NO: 998179 - RNA, 19 nt, Homo sapiens
ugaagaaaguagugcauga

SEQ ID NO: 998180 - RNA, 19 nt, Homo sapiens
cagaaggguuuacugauau

SEQ ID NO: 998181 - RNA, 19 nt, Homo sapiens
uaggugagaugggcaaaua

SEQ ID NO: 998182 - RNA, 19 nt, Homo sapiens
caucuuggcuaaauaauac

SEQ ID NO: 998183 - RNA, 19 nt, Homo sapiens
cgaccaagaugcugucuca

SEQ ID NO: 998184 - RNA, 19 nt, Homo sapiens
gcugagauuucuauauuca

SEQ ID NO: 998185 - RNA, 19 nt, Homo sapiens
gaaaauacuucugccuuaa

SEQ ID NO: 998186 - RNA, 19 nt, Homo sapiens
guuaugaccacucuuuaua

SEQ ID NO: 998187 - RNA, 19 nt, Homo sapiens
cugcugagauuucuauauu

SEQ ID NO: 998188 - RNA, 19 nt, Homo sapiens
cagaaucacuccugcugaa

SEQ ID NO: 998189 - RNA, 19 nt, Homo sapiens
uaacaacugcucugacauu

SEQ ID NO: 998190 - RNA, 19 nt, Homo sapiens
ggacaaauuccagaaauca

SEQ ID NO: 998191 - RNA, 19 nt, Homo sapiens
ucaaauugguccagaaaca

SEQ ID NO: 998192 - RNA, 19 nt, Homo sapiens
uggcugaggucucuugaaa

SEQ ID NO: 998193 - RNA, 19 nt, Homo sapiens
gggcaaauaggcuuaacua

SEQ ID NO: 998194 - RNA, 19 nt, Homo sapiens
gaaaguagugcaugagaca

SEQ ID NO: 998195 - RNA, 19 nt, Homo sapiens
ucaccuucaucuuguauaa

SEQ ID NO: 998196 - RNA, 19 nt, Homo sapiens
guaaagaagguagguauau

SEQ ID NO: 998197 - RNA, 19 nt, Homo sapiens
gagagagacacacucagua

SEQ ID NO: 998198 - RNA, 19 nt, Homo sapiens
cacaauggaugcaauaagu

SEQ ID NO: 998199 - RNA, 19 nt, Homo sapiens
gagaugaguuaguguuucu

SEQ ID NO: 998200 - RNA, 19 nt, Homo sapiens
gcaagaaaccgaauaaaau

SEQ ID NO: 998201 - RNA, 19 nt, Homo sapiens
gauaccggcuuuaguugug

SEQ ID NO: 998202 - RNA, 19 nt, Homo sapiens
ugauauagauacacucugu

SEQ ID NO: 998203 - RNA, 19 nt, Homo sapiens
aguaaacacucuguaguaa

SEQ ID NO: 998204 - RNA, 19 nt, Homo sapiens
gcugaugauucccaagauu

SEQ ID NO: 998205 - RNA, 19 nt, Homo sapiens
gggaaccucucuacaacug

SEQ ID NO: 998206 - RNA, 19 nt, Homo sapiens
caguaaacacucuguagua

SEQ ID NO: 998207 - RNA, 19 nt, Homo sapiens
aaaguggaguuuaagguau

SEQ ID NO: 998208 - RNA, 19 nt, Homo sapiens
ggacacugcugaugauucc

SEQ ID NO: 998209 - RNA, 19 nt, Homo sapiens
gguuugaaguaucuuguug

SEQ ID NO: 998210 - RNA, 19 nt, Homo sapiens
agaacuggguuuaaugguu

SEQ ID NO: 998211 - RNA, 19 nt, Homo sapiens
caccuacacauuucuauuu

SEQ ID NO: 998212 - RNA, 19 nt, Homo sapiens
gugaauauacagaucauug

SEQ ID NO: 998213 - RNA, 19 nt, Homo sapiens
gauauaaacaggaucuaag

SEQ ID NO: 998214 - RNA, 19 nt, Homo sapiens
gcauuuauagagaaggaua

SEQ ID NO: 998215 - RNA, 19 nt, Homo sapiens
gagagacacacucaguauu

SEQ ID NO: 998216 - RNA, 19 nt, Homo sapiens
uacucaggcucgauuauuu

SEQ ID NO: 998217 - RNA, 19 nt, Homo sapiens
gcgcuucgccuuccucuuc

SEQ ID NO: 998218 - RNA, 19 nt, Homo sapiens
aaagaagguagguauauug

SEQ ID NO: 998219 - RNA, 19 nt, Homo sapiens
ucuaacaacugcucugaca

SEQ ID NO: 998220 - RNA, 19 nt, Homo sapiens
uggauucccugucacuaaa

SEQ ID NO: 998221 - RNA, 19 nt, Homo sapiens
aauaauggcacuucaauag

SEQ ID NO: 998222 - RNA, 19 nt, Homo sapiens
gcaauaauaauggcacuuc

SEQ ID NO: 998223 - RNA, 19 nt, Homo sapiens
caauagauuccagcaagua

SEQ ID NO: 998224 - RNA, 19 nt, Homo sapiens
uuaauccgguucccacuga

SEQ ID NO: 998225 - RNA, 19 nt, Homo sapiens
aaguggaguuuaagguaua

SEQ ID NO: 998226 - RNA, 19 nt, Homo sapiens
agccaucacuucaacauug

SEQ ID NO: 998227 - RNA, 19 nt, Homo sapiens
guaguaguauaguaaugug

SEQ ID NO: 998228 - RNA, 19 nt, Homo sapiens
ggucaguauuccuacagaa

SEQ ID NO: 998229 - RNA, 19 nt, Homo sapiens
uagggucuuucaauaguuu

SEQ ID NO: 998230 - RNA, 19 nt, Homo sapiens
ucaaggaacccauagagau

SEQ ID NO: 998231 - RNA, 19 nt, Homo sapiens
ccucaucuguuguacugaa

SEQ ID NO: 998232 - RNA, 19 nt, Homo sapiens
gaauuucucaccaaacauc

SEQ ID NO: 998233 - RNA, 19 nt, Homo sapiens
ugacuuagggucuuucaau

SEQ ID NO: 998234 - RNA, 19 nt, Homo sapiens
ucauagauuggcugacuua

SEQ ID NO: 998235 - RNA, 19 nt, Homo sapiens
caauaauaauggcacuuca

SEQ ID NO: 998236 - RNA, 19 nt, Homo sapiens
gcgggaaccucucuacaac

SEQ ID NO: 998237 - RNA, 19 nt, Homo sapiens
aaagagauccaacagaauc

SEQ ID NO: 998238 - RNA, 19 nt, Homo sapiens
ucagugcauuuauagagaa

SEQ ID NO: 998239 - RNA, 19 nt, Homo sapiens
cuaauaaaaugcccaagaa

SEQ ID NO: 998240 - RNA, 19 nt, Homo sapiens
aaacaguuaugaccacucu

SEQ ID NO: 998241 - RNA, 19 nt, Homo sapiens
uagagauccugcccaaugu

SEQ ID NO: 998242 - RNA, 19 nt, Homo sapiens
caaggaacccauagagauc

SEQ ID NO: 998243 - RNA, 19 nt, Homo sapiens
ugggacagcuaacacauuc

SEQ ID NO: 998244 - RNA, 19 nt, Homo sapiens
ucaagugaauauacagauc

SEQ ID NO: 998245 - RNA, 19 nt, Homo sapiens
gugcagaaggguuuacuga

SEQ ID NO: 998246 - RNA, 19 nt, Homo sapiens
cagaacuguuuacuaacuu

SEQ ID NO: 998247 - RNA, 19 nt, Homo sapiens
gcugcaagcaagacuguuu

SEQ ID NO: 998248 - RNA, 19 nt, Homo sapiens
acagaaugauaccggcuuu

SEQ ID NO: 998249 - RNA, 19 nt, Homo sapiens
ugguaaaccucuuucuuca

SEQ ID NO: 998250 - RNA, 19 nt, Homo sapiens
caggcucgauuauuugaug

SEQ ID NO: 998251 - RNA, 19 nt, Homo sapiens
gcacaauggaugcaauaag

SEQ ID NO: 998252 - RNA, 19 nt, Homo sapiens
gaacuguuuacuaacuuug

SEQ ID NO: 998253 - RNA, 19 nt, Homo sapiens
guacugaacaauugaaacu

SEQ ID NO: 998254 - RNA, 19 nt, Homo sapiens
guuaguguuucuugacguu

SEQ ID NO: 998255 - RNA, 19 nt, Homo sapiens
gaaggaagauuugauguug

SEQ ID NO: 998256 - RNA, 19 nt, Homo sapiens
gaauaaauccucucuauca

SEQ ID NO: 998257 - RNA, 19 nt, Homo sapiens
caagaagagucucagauau

SEQ ID NO: 998258 - RNA, 19 nt, Homo sapiens
acagagaucucagagguua

SEQ ID NO: 998259 - RNA, 19 nt, Homo sapiens
ccaucaaccuucuuauuaa

SEQ ID NO: 998260 - RNA, 19 nt, Homo sapiens
gcaagaaccaccugagaaa

SEQ ID NO: 998261 - RNA, 19 nt, Homo sapiens
caacuuugauccagcagaa

SEQ ID NO: 998262 - RNA, 19 nt, Homo sapiens
acccuuggauuuagaauua

SEQ ID NO: 998263 - RNA, 19 nt, Homo sapiens
gaaaagugauccuaaacaa

SEQ ID NO: 998264 - RNA, 19 nt, Homo sapiens
gagagcaaccggacaauau

SEQ ID NO: 998265 - RNA, 19 nt, Homo sapiens
ucucagagguuauguguuc

SEQ ID NO: 998266 - RNA, 19 nt, Homo sapiens
gagaucaugaguuuguuua

SEQ ID NO: 998267 - RNA, 19 nt, Homo sapiens
ggaaggaagauuugauguu

SEQ ID NO: 998268 - RNA, 19 nt, Homo sapiens
acaagaagagucucagaua

SEQ ID NO: 998269 - RNA, 19 nt, Homo sapiens
gucaugagcauuuguuuaa

SEQ ID NO: 998270 - RNA, 19 nt, Homo sapiens
gaagaugucgauuccauuc

SEQ ID NO: 998271 - RNA, 19 nt, Homo sapiens
gaucaugaguuuguuuaca

SEQ ID NO: 998272 - RNA, 19 nt, Homo sapiens
aaagugauccuaaacaaga

SEQ ID NO: 998273 - RNA, 19 nt, Homo sapiens
gaaacaugccacuugaaga

SEQ ID NO: 998274 - RNA, 19 nt, Homo sapiens
uccaucaaccuucuuauua

SEQ ID NO: 998275 - RNA, 19 nt, Homo sapiens
ccagagaggaggcaaagaa

SEQ ID NO: 998276 - RNA, 19 nt, Homo sapiens
uaaauccucucuaucacau

SEQ ID NO: 998277 - RNA, 19 nt, Homo sapiens
uauagagacccuuggauuu

SEQ ID NO: 998278 - RNA, 19 nt, Homo sapiens
agagguugcugcugucaaa

SEQ ID NO: 998279 - RNA, 19 nt, Homo sapiens
auagagacccuuggauuua

SEQ ID NO: 998280 - RNA, 19 nt, Homo sapiens
gagcauuuguuuaauaagc

SEQ ID NO: 998281 - RNA, 19 nt, Homo sapiens
gacaucagucaccaucuua

SEQ ID NO: 998282 - RNA, 19 nt, Homo sapiens
caacacccacuaccgaauu

SEQ ID NO: 998283 - RNA, 19 nt, Homo sapiens
ccaagaagaugucgauucc

SEQ ID NO: 998284 - RNA, 19 nt, Homo sapiens
gagaaaggagguuccauag

SEQ ID NO: 998285 - RNA, 19 nt, Homo sapiens
ccaaauccaucaaccuucu

SEQ ID NO: 998286 - RNA, 19 nt, Homo sapiens
gagcaagaaccaccugaga

SEQ ID NO: 998287 - RNA, 19 nt, Homo sapiens
agagaaaggagguuccaua

SEQ ID NO: 998288 - RNA, 19 nt, Homo sapiens
gaaaaucugucaugagcau

SEQ ID NO: 998289 - RNA, 19 nt, Homo sapiens
agacaucagucaccaucuu

SEQ ID NO: 998290 - RNA, 19 nt, Homo sapiens
acaugccacuugaagauuu

SEQ ID NO: 998291 - RNA, 19 nt, Homo sapiens
gaggaaggaagauuugaug

SEQ ID NO: 998292 - RNA, 19 nt, Homo sapiens
aaacaugccacuugaagau

SEQ ID NO: 998293 - RNA, 19 nt, Homo sapiens
cuauaacaaucaugcauuc

SEQ ID NO: 998294 - RNA, 19 nt, Homo sapiens
gaucucagagguuaugugu

SEQ ID NO: 998295 - RNA, 19 nt, Homo sapiens
cauaggcaguucuuaccaa

SEQ ID NO: 998296 - RNA, 19 nt, Homo sapiens
gaagauuugauguugugaa

SEQ ID NO: 998297 - RNA, 19 nt, Homo sapiens
cuuagacucuucugaggaa

SEQ ID NO: 998298 - RNA, 19 nt, Homo sapiens
ggaaggaggaagagacauc

SEQ ID NO: 998299 - RNA, 19 nt, Homo sapiens
cagagguuauguguucuaa

SEQ ID NO: 998300 - RNA, 19 nt, Homo sapiens
aagaagaugucgauuccau

SEQ ID NO: 998301 - RNA, 19 nt, Homo sapiens
agaagagucucagauaucu

SEQ ID NO: 998302 - RNA, 19 nt, Homo sapiens
cuauagagacccuuggauu

SEQ ID NO: 998303 - RNA, 19 nt, Homo sapiens
ugagaaaagugauccuaaa

SEQ ID NO: 998304 - RNA, 19 nt, Homo sapiens
cggacaauauaccagcuuu

SEQ ID NO: 998305 - RNA, 19 nt, Homo sapiens
agagcaaccggacaauaua

SEQ ID NO: 998306 - RNA, 19 nt, Homo sapiens
gaaggaggaagagacauca

SEQ ID NO: 998307 - RNA, 19 nt, Homo sapiens
cuaccgaauuccacaagga

SEQ ID NO: 998308 - RNA, 19 nt, Homo sapiens
ugucaugagcauuuguuua

SEQ ID NO: 998309 - RNA, 19 nt, Homo sapiens
uagagacccuuggauuuag

SEQ ID NO: 998310 - RNA, 19 nt, Homo sapiens
cagagaggaggcaaagaaa

SEQ ID NO: 998311 - RNA, 19 nt, Homo sapiens
gagagaaaaccaacuuuga

SEQ ID NO: 998312 - RNA, 19 nt, Homo sapiens
uuugagagccuucuagaga

SEQ ID NO: 998313 - RNA, 19 nt, Homo sapiens
cacgcgagauucugagaga

SEQ ID NO: 998314 - RNA, 19 nt, Homo sapiens
gcaccagcucggagagaaa

SEQ ID NO: 998315 - RNA, 19 nt, Homo sapiens
aggaagauuugauguugug

SEQ ID NO: 998316 - RNA, 19 nt, Homo sapiens
ccgaauuccacaaggauuu

SEQ ID NO: 998317 - RNA, 19 nt, Homo sapiens
gaggaagagacaucaguca

SEQ ID NO: 998318 - RNA, 19 nt, Homo sapiens
ugagagagcaaccggacaa

SEQ ID NO: 998319 - RNA, 19 nt, Homo sapiens
ggcaccagcucggagagaa

SEQ ID NO: 998320 - RNA, 19 nt, Homo sapiens
ugaaacaugccacuugaag

SEQ ID NO: 998321 - RNA, 19 nt, Homo sapiens
auugaaacaugccacuuga

SEQ ID NO: 998322 - RNA, 19 nt, Homo sapiens
cauugaaacaugccacuug

SEQ ID NO: 998323 - RNA, 19 nt, Homo sapiens
aagaagagucucagauauc

SEQ ID NO: 998324 - RNA, 19 nt, Homo sapiens
auucguuacuguugugaaa

SEQ ID NO: 998325 - RNA, 19 nt, Homo sapiens
aaauccaucaaccuucuua

SEQ ID NO: 998326 - RNA, 19 nt, Homo sapiens
aaacaagaagagucucaga

SEQ ID NO: 998327 - RNA, 19 nt, Homo sapiens
ugucucaagccuaucuaua

SEQ ID NO: 998328 - RNA, 19 nt, Homo sapiens
ugaguuuguuuacacuugu

SEQ ID NO: 998329 - RNA, 19 nt, Homo sapiens
gagcaaccggacaauauac

SEQ ID NO: 998330 - RNA, 19 nt, Homo sapiens
agagacccuuggauuuaga

SEQ ID NO: 998331 - RNA, 19 nt, Homo sapiens
agagagcaaccggacaaua

SEQ ID NO: 998332 - RNA, 19 nt, Homo sapiens
ugaauaaauccucucuauc

SEQ ID NO: 998333 - RNA, 19 nt, Homo sapiens
agaacuaaaguaucugaga

SEQ ID NO: 998334 - RNA, 19 nt, Homo sapiens
ucugagaucaugaguuugu

SEQ ID NO: 998335 - RNA, 19 nt, Homo sapiens
gagguuccauaggcaguuc

SEQ ID NO: 998336 - RNA, 19 nt, Homo sapiens
gagaggaggcaaagaaaau

SEQ ID NO: 998337 - RNA, 19 nt, Homo sapiens
caucagucaccaucuuaga

SEQ ID NO: 998338 - RNA, 19 nt, Homo sapiens
ucgauuccauucuccaaca

SEQ ID NO: 998339 - RNA, 19 nt, Homo sapiens
gaccgcuucuauaacaauc

SEQ ID NO: 998340 - RNA, 19 nt, Homo sapiens
ugagaucaugaguuuguuu

SEQ ID NO: 998341 - RNA, 19 nt, Homo sapiens
gaagagguugcugcuguca

SEQ ID NO: 998342 - RNA, 19 nt, Homo sapiens
gcagcagccuauuuugaga

SEQ ID NO: 998343 - RNA, 19 nt, Homo sapiens
aaggaagauuugauguugu

SEQ ID NO: 998344 - RNA, 19 nt, Homo sapiens
gacccuuggauuuagaauu

SEQ ID NO: 998345 - RNA, 19 nt, Homo sapiens
cgaauuccacaaggauuug

SEQ ID NO: 998346 - RNA, 19 nt, Homo sapiens
ucagagguuauguguucua

SEQ ID NO: 998347 - RNA, 19 nt, Homo sapiens
caugccacuugaagauuuc

SEQ ID NO: 998348 - RNA, 19 nt, Homo sapiens
agcauaccauugaaacaug

SEQ ID NO: 998349 - RNA, 19 nt, Homo sapiens
uaucugggaaggaggaaga

SEQ ID NO: 998350 - RNA, 19 nt, Homo sapiens
gggcugacacgcgagauuc

SEQ ID NO: 998351 - RNA, 19 nt, Homo sapiens
gagaaaaccaacuuugauc

SEQ ID NO: 998352 - RNA, 19 nt, Homo sapiens
cuaaacaagaagagucuca

SEQ ID NO: 998353 - RNA, 19 nt, Homo sapiens
aagugauccuaaacaagaa

SEQ ID NO: 998354 - RNA, 19 nt, Homo sapiens
gagcuacucuguuacauuu

SEQ ID NO: 998355 - RNA, 19 nt, Homo sapiens
guuaagagguggugagaua

SEQ ID NO: 998356 - RNA, 19 nt, Homo sapiens
gguauuggcuuaguuguaa

SEQ ID NO: 998357 - RNA, 19 nt, Homo sapiens
gaaagucugucucugaaca

SEQ ID NO: 998358 - RNA, 19 nt, Homo sapiens
gcuggaagcugaugggaaa

SEQ ID NO: 998359 - RNA, 19 nt, Homo sapiens
gcuaagaguuccaaagauc

SEQ ID NO: 998360 - RNA, 19 nt, Homo sapiens
gcgacuauauaccuacuuu

SEQ ID NO: 998361 - RNA, 19 nt, Homo sapiens
uguaagggcuuuaggauca

SEQ ID NO: 998362 - RNA, 19 nt, Homo sapiens
gggcaucccuggcuugcuu

SEQ ID NO: 998363 - RNA, 19 nt, Homo sapiens
gaaauggacacgucucauc

SEQ ID NO: 998364 - RNA, 19 nt, Homo sapiens
gcugggugcuugccaaaga

SEQ ID NO: 998365 - RNA, 19 nt, Homo sapiens
cagcuaagaguuccaaaga

SEQ ID NO: 998366 - RNA, 19 nt, Homo sapiens
aaagagauagggacgcaua

SEQ ID NO: 998367 - RNA, 19 nt, Homo sapiens
gcaccgagcaaaccaagug

SEQ ID NO: 998368 - RNA, 19 nt, Homo sapiens
ucucaaacucgcacaauuu

SEQ ID NO: 998369 - RNA, 19 nt, Homo sapiens
cauaaacagucucaaacuc

SEQ ID NO: 998370 - RNA, 19 nt, Homo sapiens
gcagguauuggcuuaguug

SEQ ID NO: 998371 - RNA, 19 nt, Homo sapiens
aagcauaauuggaauccuu

SEQ ID NO: 998372 - RNA, 19 nt, Homo sapiens
aaagaggcuugcugaagga

SEQ ID NO: 998373 - RNA, 19 nt, Homo sapiens
aguggaacgugacaucuuu

SEQ ID NO: 998374 - RNA, 19 nt, Homo sapiens
ugacaucuuugccaguugu

SEQ ID NO: 998375 - RNA, 19 nt, Homo sapiens
aggcagagcuauuuuauau

SEQ ID NO: 998376 - RNA, 19 nt, Homo sapiens
gaagaauccaagcagguau

SEQ ID NO: 998377 - RNA, 19 nt, Homo sapiens
accgauggcugacugauga

SEQ ID NO: 998378 - RNA, 19 nt, Homo sapiens
uugaaagucugucucugaa

SEQ ID NO: 998379 - RNA, 19 nt, Homo sapiens
ggugagauaagaaguggaa

SEQ ID NO: 998380 - RNA, 19 nt, Homo sapiens
gaauacauaaacagucuca

SEQ ID NO: 998381 - RNA, 19 nt, Homo sapiens
gauagggacgcauaugcuu

SEQ ID NO: 998382 - RNA, 19 nt, Homo sapiens
gcuacucuguuacauuucu

SEQ ID NO: 998383 - RNA, 19 nt, Homo sapiens
agaagaauccaagcaggua

SEQ ID NO: 998384 - RNA, 19 nt, Homo sapiens
cgugacaucuuugccaguu

SEQ ID NO: 998385 - RNA, 19 nt, Homo sapiens
ggaagcugaugggaaacga

SEQ ID NO: 998386 - RNA, 19 nt, Homo sapiens
gagcuagguccuugaucuu

SEQ ID NO: 998387 - RNA, 19 nt, Homo sapiens
gucucaaacucgcacaauu

SEQ ID NO: 998388 - RNA, 19 nt, Homo sapiens
uggccugggucucugaauu

SEQ ID NO: 998389 - RNA, 19 nt, Homo sapiens
agagcuagguccuugaucu

SEQ ID NO: 998390 - RNA, 19 nt, Homo sapiens
caacuccagcaucgacaaa

SEQ ID NO: 998391 - RNA, 19 nt, Homo sapiens
gccaauuugugguuaagag

SEQ ID NO: 998392 - RNA, 19 nt, Homo sapiens
gcuagguccuugaucuuuu

SEQ ID NO: 998393 - RNA, 19 nt, Homo sapiens
ggcugaauaugaggacaaa

SEQ ID NO: 998394 - RNA, 19 nt, Homo sapiens
ccacucuuccuuccacuga

SEQ ID NO: 998395 - RNA, 19 nt, Homo sapiens
ggugcuugccaaagagaua

SEQ ID NO: 998396 - RNA, 19 nt, Homo sapiens
ucuggaggcuucuguuucu

SEQ ID NO: 998397 - RNA, 19 nt, Homo sapiens
gguccuugaucuuuucuuu

SEQ ID NO: 998398 - RNA, 19 nt, Homo sapiens
gagauagggacgcauaugc

SEQ ID NO: 998399 - RNA, 19 nt, Homo sapiens
gaggcuugcugaaggaaaa

SEQ ID NO: 998400 - RNA, 19 nt, Homo sapiens
aggcuucuguuucugcauu

SEQ ID NO: 998401 - RNA, 19 nt, Homo sapiens
ggacgcagacagcaucaac

SEQ ID NO: 998402 - RNA, 19 nt, Homo sapiens
uugaauagaggcagagcua

SEQ ID NO: 998403 - RNA, 19 nt, Homo sapiens
gaaguggaacgugacaucu

SEQ ID NO: 998404 - RNA, 19 nt, Homo sapiens
aagagguggugagauaaga

SEQ ID NO: 998405 - RNA, 19 nt, Homo sapiens
ugaauaugaggacaaagug

SEQ ID NO: 998406 - RNA, 19 nt, Homo sapiens
gucugucucugaacacaau

SEQ ID NO: 998407 - RNA, 19 nt, Homo sapiens
gagauaagaaguggaacgu

SEQ ID NO: 998408 - RNA, 19 nt, Homo sapiens
ggccugggucucugaauuc

SEQ ID NO: 998409 - RNA, 19 nt, Homo sapiens
ccgcauggaggguuuggaa

SEQ ID NO: 998410 - RNA, 19 nt, Homo sapiens
aaucuggaggcuucuguuu

SEQ ID NO: 998411 - RNA, 19 nt, Homo sapiens
uaagagguggugagauaag

SEQ ID NO: 998412 - RNA, 19 nt, Homo sapiens
auggacacgucucaucuga

SEQ ID NO: 998413 - RNA, 19 nt, Homo sapiens
ccuacagaaucuccuacga

SEQ ID NO: 998414 - RNA, 19 nt, Homo sapiens
gcauggaggguuuggaaaa

SEQ ID NO: 998415 - RNA, 19 nt, Homo sapiens
gaaagccacuggggccaau

SEQ ID NO: 998416 - RNA, 19 nt, Homo sapiens
gauggcugacugaugaaau

SEQ ID NO: 998417 - RNA, 19 nt, Homo sapiens
ggaaagcgguggacucuua

SEQ ID NO: 998418 - RNA, 19 nt, Homo sapiens
ggaagcauaucuuacaauu

SEQ ID NO: 998419 - RNA, 19 nt, Homo sapiens
gaagccagguuccuaauga

SEQ ID NO: 998420 - RNA, 19 nt, Homo sapiens
gaacuaccaugacgaaaca

SEQ ID NO: 998421 - RNA, 19 nt, Homo sapiens
gaaagacuguggagaaugg

SEQ ID NO: 998422 - RNA, 19 nt, Homo sapiens
ggauagcaguggaaauaaa

SEQ ID NO: 998423 - RNA, 19 nt, Homo sapiens
gcuagaagcuggagaugau

SEQ ID NO: 998424 - RNA, 19 nt, Homo sapiens
gagcaagaauggccuguau

SEQ ID NO: 998425 - RNA, 19 nt, Homo sapiens
ggaauacacugcagucucu

SEQ ID NO: 998426 - RNA, 19 nt, Homo sapiens
cgaaacaggugagauaaug

SEQ ID NO: 998427 - RNA, 19 nt, Homo sapiens
gcaagaauggccuguauga

SEQ ID NO: 998428 - RNA, 19 nt, Homo sapiens
ugaguaagaugaacuggaa

SEQ ID NO: 998429 - RNA, 19 nt, Homo sapiens
caggugagauaauggauaa

SEQ ID NO: 998430 - RNA, 19 nt, Homo sapiens
gaagagagaaauagaggaa

SEQ ID NO: 998431 - RNA, 19 nt, Homo sapiens
aaagugggcuggcuuguug

SEQ ID NO: 998432 - RNA, 19 nt, Homo sapiens
gcucucaacuccuuacaga

SEQ ID NO: 998433 - RNA, 19 nt, Homo sapiens
cagaauaacaugaguaaga

SEQ ID NO: 998434 - RNA, 19 nt, Homo sapiens
ugaaauggguggacaucaa

SEQ ID NO: 998435 - RNA, 19 nt, Homo sapiens
ugacgaaacaggugagaua

SEQ ID NO: 998436 - RNA, 19 nt, Homo sapiens
ccacuuggccuauuuacuu

SEQ ID NO: 998437 - RNA, 19 nt, Homo sapiens
acuauaagccuguggaaua

SEQ ID NO: 998438 - RNA, 19 nt, Homo sapiens
uaagggauauguugaugau

SEQ ID NO: 998439 - RNA, 19 nt, Homo sapiens
ucuaaugguuccaaagaaa

SEQ ID NO: 998440 - RNA, 19 nt, Homo sapiens
aagaugaacuggaacacaa

SEQ ID NO: 998441 - RNA, 19 nt, Homo sapiens
ccaagaccaccuagugaua

SEQ ID NO: 998442 - RNA, 19 nt, Homo sapiens
gcucuugaucugugauuua

SEQ ID NO: 998443 - RNA, 19 nt, Homo sapiens
caauuugcauuuagagugu

SEQ ID NO: 998444 - RNA, 19 nt, Homo sapiens
gccagucacucucaauuca

SEQ ID NO: 998445 - RNA, 19 nt, Homo sapiens
caacuaaugcucuuugaag

SEQ ID NO: 998446 - RNA, 19 nt, Homo sapiens
gaaauggguggacaucaau

SEQ ID NO: 998447 - RNA, 19 nt, Homo sapiens
ggaugggcauguugagaga

SEQ ID NO: 998448 - RNA, 19 nt, Homo sapiens
gaaagugggcuggcuuguu

SEQ ID NO: 998449 - RNA, 19 nt, Homo sapiens
gauccaggagagaagauua

SEQ ID NO: 998450 - RNA, 19 nt, Homo sapiens
cgucaugucugguucuaau

SEQ ID NO: 998451 - RNA, 19 nt, Homo sapiens
gguuucaucuuaauaccaa

SEQ ID NO: 998452 - RNA, 19 nt, Homo sapiens
gaacuggaacacaaaauuu

SEQ ID NO: 998453 - RNA, 19 nt, Homo sapiens
agaauggccuguaugagau

SEQ ID NO: 998454 - RNA, 19 nt, Homo sapiens
ucagaucagugaaaguaau

SEQ ID NO: 998455 - RNA, 19 nt, Homo sapiens
ccagguuccuaaugagaaa

SEQ ID NO: 998456 - RNA, 19 nt, Homo sapiens
gagcauauacugaaaagaa

SEQ ID NO: 998457 - RNA, 19 nt, Homo sapiens
aagaccaccuagugauaua

SEQ ID NO: 998458 - RNA, 19 nt, Homo sapiens
aagaauggccuguaugaga

SEQ ID NO: 998459 - RNA, 19 nt, Homo sapiens
gagagaaagagcaagaaug

SEQ ID NO: 998460 - RNA, 19 nt, Homo sapiens
cagaggagcauauacugaa

SEQ ID NO: 998461 - RNA, 19 nt, Homo sapiens
gcugauggucuccguguaa

SEQ ID NO: 998462 - RNA, 19 nt, Homo sapiens
ccucagaucagugaaagua

SEQ ID NO: 998463 - RNA, 19 nt, Homo sapiens
gaccaccuagugauauaua

SEQ ID NO: 998464 - RNA, 19 nt, Homo sapiens
ucucaacuccuuacagaaa

SEQ ID NO: 998465 - RNA, 19 nt, Homo sapiens
cuucuugguuucaucuuaa

SEQ ID NO: 998466 - RNA, 19 nt, Homo sapiens
guguuucgcaucagaauaa

SEQ ID NO: 998467 - RNA, 19 nt, Homo sapiens
gauccucgaaacacugaua

SEQ ID NO: 998468 - RNA, 19 nt, Homo sapiens
gcagaucccauuauaacca

SEQ ID NO: 998469 - RNA, 19 nt, Homo sapiens
gaaaauggaagaccgagaa

SEQ ID NO: 998470 - RNA, 19 nt, Homo sapiens
ucgaaacacugauaaugca

SEQ ID NO: 998471 - RNA, 19 nt, Homo sapiens
uauaagggauauguugaug

SEQ ID NO: 998472 - RNA, 19 nt, Homo sapiens
aagagaauuuggugaggaa

SEQ ID NO: 998473 - RNA, 19 nt, Homo sapiens
aaacaacuaaugcucuuug

SEQ ID NO: 998474 - RNA, 19 nt, Homo sapiens
ucaaacuuguggcugagaa

SEQ ID NO: 998475 - RNA, 19 nt, Homo sapiens
cagaagcugugaacuacca

SEQ ID NO: 998476 - RNA, 19 nt, Homo sapiens
ggaaagacuguggagaaug

SEQ ID NO: 998477 - RNA, 19 nt, Homo sapiens
agggauagcaguggaaaua

SEQ ID NO: 998478 - RNA, 19 nt, Homo sapiens
cuugaucugugauuuauag

SEQ ID NO: 998479 - RNA, 19 nt, Homo sapiens
gaaagcgguggacucuuau

SEQ ID NO: 998480 - RNA, 19 nt, Homo sapiens
cacuuggccuauuuacuuu

SEQ ID NO: 998481 - RNA, 19 nt, Homo sapiens
agaggagcauauacugaaa

SEQ ID NO: 998482 - RNA, 19 nt, Homo sapiens
caagaccaccuagugauau

SEQ ID NO: 998483 - RNA, 19 nt, Homo sapiens
cauuauaaccagauggaaa

SEQ ID NO: 998484 - RNA, 19 nt, Homo sapiens
guucuaaugguuccaaaga

SEQ ID NO: 998485 - RNA, 19 nt, Homo sapiens
caucagaauaacaugagua

SEQ ID NO: 998486 - RNA, 19 nt, Homo sapiens
gacgaaacaggugagauaa

SEQ ID NO: 998487 - RNA, 19 nt, Homo sapiens
gaaaaccagugcugagaag

SEQ ID NO: 998488 - RNA, 19 nt, Homo sapiens
aaggaaagacuguggagaa

SEQ ID NO: 998489 - RNA, 19 nt, Homo sapiens
gcauccaggcguucagaaa

SEQ ID NO: 998490 - RNA, 19 nt, Homo sapiens
ccacagaggagcauauacu

SEQ ID NO: 998491 - RNA, 19 nt, Homo sapiens
gcggaggcaccaacuaaga

SEQ ID NO: 998492 - RNA, 19 nt, Homo sapiens
gggauagcaguggaaauaa

SEQ ID NO: 998493 - RNA, 19 nt, Homo sapiens
cgcugcagaucccauuaua

SEQ ID NO: 998494 - RNA, 19 nt, Homo sapiens
agagaaagagcaagaaugg

SEQ ID NO: 998495 - RNA, 19 nt, Homo sapiens
uagaguguuucgcaucaga

SEQ ID NO: 998496 - RNA, 19 nt, Homo sapiens
aaucaugcauccuguuucu

SEQ ID NO: 998497 - RNA, 19 nt, Homo sapiens
gaauggccuguaugagauu

SEQ ID NO: 998498 - RNA, 19 nt, Homo sapiens
uaacaugaguaagaugaac

SEQ ID NO: 998499 - RNA, 19 nt, Homo sapiens
ucuucuugguuucaucuua

SEQ ID NO: 998500 - RNA, 19 nt, Homo sapiens
gaauaacaugaguaagaug

SEQ ID NO: 998501 - RNA, 19 nt, Homo sapiens
gcccacagaggagcauaua

SEQ ID NO: 998502 - RNA, 19 nt, Homo sapiens
gaaacaggugagauaaugg

SEQ ID NO: 998503 - RNA, 19 nt, Homo sapiens
augcauggauggagacaga

SEQ ID NO: 998504 - RNA, 19 nt, Homo sapiens
ugggagggcucuugaucug

SEQ ID NO: 998505 - RNA, 19 nt, Homo sapiens
aaacaggugagauaaugga

SEQ ID NO: 998506 - RNA, 19 nt, Homo sapiens
cuauaagccuguggaauac

SEQ ID NO: 998507 - RNA, 19 nt, Homo sapiens
cagccaagaccaccuagug

SEQ ID NO: 998508 - RNA, 19 nt, Homo sapiens
gcugcagaucccauuauaa

SEQ ID NO: 998509 - RNA, 19 nt, Homo sapiens
cagaucagugaaaguaauu

SEQ ID NO: 998510 - RNA, 19 nt, Homo sapiens
gcaucagaauaacaugagu

SEQ ID NO: 998511 - RNA, 19 nt, Homo sapiens
ugacugccaugcguuguag

SEQ ID NO: 998512 - RNA, 19 nt, Homo sapiens
agaaauagaggaaaaguug

SEQ ID NO: 998513 - RNA, 19 nt, Homo sapiens
agagagaaauagaggaaaa

SEQ ID NO: 998514 - RNA, 19 nt, Homo sapiens
ggaagcucucaacuccuua

SEQ ID NO: 998515 - RNA, 19 nt, Homo sapiens
aggaaagacuguggagaau

SEQ ID NO: 998516 - RNA, 19 nt, Homo sapiens
acacugcagucucugucuu

SEQ ID NO: 998517 - RNA, 19 nt, Homo sapiens
gagaagaccauuugauuua

SEQ ID NO: 998518 - RNA, 19 nt, Homo sapiens
ggagcaagauggaaucauu

SEQ ID NO: 998519 - RNA, 19 nt, Homo sapiens
uaaaggauccugcugcuua

SEQ ID NO: 998520 - RNA, 19 nt, Homo sapiens
cgaaagaccugcugagaag

SEQ ID NO: 998521 - RNA, 19 nt, Homo sapiens
ccucaaagguuauucaaga

SEQ ID NO: 998522 - RNA, 19 nt, Homo sapiens
uggguuggaucuauuauua

SEQ ID NO: 998523 - RNA, 19 nt, Homo sapiens
gcauauauguucuauucug

SEQ ID NO: 998524 - RNA, 19 nt, Homo sapiens
ggauggcucugcucauuau

SEQ ID NO: 998525 - RNA, 19 nt, Homo sapiens
aaaccagaguucuucauaa

SEQ ID NO: 998526 - RNA, 19 nt, Homo sapiens
uggcauauauguucuauuc

SEQ ID NO: 998527 - RNA, 19 nt, Homo sapiens
gagagagggugaaccguau

SEQ ID NO: 998528 - RNA, 19 nt, Homo sapiens
gcuauaugguauuguguaa

SEQ ID NO: 998529 - RNA, 19 nt, Homo sapiens
guuccuccuuucuaaauua

SEQ ID NO: 998530 - RNA, 19 nt, Homo sapiens
ucaagaagcccaagcgaaa

SEQ ID NO: 998531 - RNA, 19 nt, Homo sapiens
caugauuccuggacuauug

SEQ ID NO: 998532 - RNA, 19 nt, Homo sapiens
caaaccagaguucuucaua

SEQ ID NO: 998533 - RNA, 19 nt, Homo sapiens
gagcucugccgauuauaua

SEQ ID NO: 998534 - RNA, 19 nt, Homo sapiens
caucugagcucugccgauu

SEQ ID NO: 998535 - RNA, 19 nt, Homo sapiens
gaauaaacuugaucaucca

SEQ ID NO: 998536 - RNA, 19 nt, Homo sapiens
aaccagaguucuucauaaa

SEQ ID NO: 998537 - RNA, 19 nt, Homo sapiens
gaaacauuguagggaagua

SEQ ID NO: 998538 - RNA, 19 nt, Homo sapiens
ggaaacuuauagaaccauu

SEQ ID NO: 998539 - RNA, 19 nt, Homo sapiens
cgugaguacuuaagaauau

SEQ ID NO: 998540 - RNA, 19 nt, Homo sapiens
caagagcccuaucuaaagg

SEQ ID NO: 998541 - RNA, 19 nt, Homo sapiens
uagcaugggaggaaacuua

SEQ ID NO: 998542 - RNA, 19 nt, Homo sapiens
gguuggaucuauuauuaug

SEQ ID NO: 998543 - RNA, 19 nt, Homo sapiens
ucagagguuugauugcuuu

SEQ ID NO: 998544 - RNA, 19 nt, Homo sapiens
ugagaagaccauuugauuu

SEQ ID NO: 998545 - RNA, 19 nt, Homo sapiens
ccgauuauauacgcaauuu

SEQ ID NO: 998546 - RNA, 19 nt, Homo sapiens
ccauuucacucucuucuca

SEQ ID NO: 998547 - RNA, 19 nt, Homo sapiens
cuacagagucccugaagaa

SEQ ID NO: 998548 - RNA, 19 nt, Homo sapiens
gcgaaagaccugcugagaa

SEQ ID NO: 998549 - RNA, 19 nt, Homo sapiens
ucauaggacuggagcaaga

SEQ ID NO: 998550 - RNA, 19 nt, Homo sapiens
ucauguuccuccuuucuaa

SEQ ID NO: 998551 - RNA, 19 nt, Homo sapiens
cagcaugauuccuggacua

SEQ ID NO: 998552 - RNA, 19 nt, Homo sapiens
gaaggaaaauggaaauucu

SEQ ID NO: 998553 - RNA, 19 nt, Homo sapiens
gagguuugauugcuuugga

SEQ ID NO: 998554 - RNA, 19 nt, Homo sapiens
ugugugagcuauaugguau

SEQ ID NO: 998555 - RNA, 19 nt, Homo sapiens
cagagucccugaagaagca

SEQ ID NO: 998556 - RNA, 19 nt, Homo sapiens
uauauuggguuggaucuau

SEQ ID NO: 998557 - RNA, 19 nt, Homo sapiens
gaaccauuggccuauauug

SEQ ID NO: 998558 - RNA, 19 nt, Homo sapiens
gggauggcucugcucauua

SEQ ID NO: 998559 - RNA, 19 nt, Homo sapiens
gauuuaauguugguugugu

SEQ ID NO: 998560 - RNA, 19 nt, Homo sapiens
ucugagcucugccgauuau

SEQ ID NO: 998561 - RNA, 19 nt, Homo sapiens
uauaaucagccaucagaaa

SEQ ID NO: 998562 - RNA, 19 nt, Homo sapiens
gggacccacuguucuaugu

SEQ ID NO: 998563 - RNA, 19 nt, Homo sapiens
ucacauuggugcaucucuu

SEQ ID NO: 998564 - RNA, 19 nt, Homo sapiens
uagaaccauuggccuauau

SEQ ID NO: 998565 - RNA, 19 nt, Homo sapiens
gaggaaacuuauagaacca

SEQ ID NO: 998566 - RNA, 19 nt, Homo sapiens
guucaugacacacuacuug

SEQ ID NO: 998567 - RNA, 19 nt, Homo sapiens
gagcaagauggaaucauug

SEQ ID NO: 998568 - RNA, 19 nt, Homo sapiens
gaaguauggaacacgaauu

SEQ ID NO: 998569 - RNA, 19 nt, Homo sapiens
uaaacuugaucauccaucu

SEQ ID NO: 998570 - RNA, 19 nt, Homo sapiens
gcucuuggccuaucguugu

SEQ ID NO: 998571 - RNA, 19 nt, Homo sapiens
aaaggauccugcugcuuau

SEQ ID NO: 998572 - RNA, 19 nt, Homo sapiens
ugagcuauaugguauugug

SEQ ID NO: 998573 - RNA, 19 nt, Homo sapiens
ucaagagcccuaucuaaag

SEQ ID NO: 998574 - RNA, 19 nt, Homo sapiens
ugggauggcucugcucauu

SEQ ID NO: 998575 - RNA, 19 nt, Homo sapiens
ucuauucuguuccuuacuu

SEQ ID NO: 998576 - RNA, 19 nt, Homo sapiens
cugagaagaccauuugauu

SEQ ID NO: 998577 - RNA, 19 nt, Homo sapiens
gagggugaaccguaucuga

SEQ ID NO: 998578 - RNA, 19 nt, Homo sapiens
auacgugaguacuuaagaa

SEQ ID NO: 998579 - RNA, 19 nt, Homo sapiens
gacccacuguucuaugugu

SEQ ID NO: 998580 - RNA, 19 nt, Homo sapiens
acacgaauuugcccugcuu

SEQ ID NO: 998581 - RNA, 19 nt, Homo sapiens
ggaaguauggaacacgaau

SEQ ID NO: 998582 - RNA, 19 nt, Homo sapiens
ucaccuaugucuucaacca

SEQ ID NO: 998583 - RNA, 19 nt, Homo sapiens
ccuccuuucuaaauuacua

SEQ ID NO: 998584 - RNA, 19 nt, Homo sapiens
gaaacuuauagaaccauug

SEQ ID NO: 998585 - RNA, 19 nt, Homo sapiens
aaacaaaggcagaagaaaa

SEQ ID NO: 998586 - RNA, 19 nt, Homo sapiens
cuacaaaccagaguucuuc

SEQ ID NO: 998587 - RNA, 19 nt, Homo sapiens
uucaagagcccuaucuaaa

SEQ ID NO: 998588 - RNA, 19 nt, Homo sapiens
gcaugggaggaaacuuaua

SEQ ID NO: 998589 - RNA, 19 nt, Homo sapiens
ugauguaccuggugauggu

SEQ ID NO: 998590 - RNA, 19 nt, Homo sapiens
ggugaaccguaucugaaca

SEQ ID NO: 998591 - RNA, 19 nt, Homo sapiens
ggucaccuaugucuucaac

SEQ ID NO: 998592 - RNA, 19 nt, Homo sapiens
guggugaaccucaucauag

SEQ ID NO: 998593 - RNA, 19 nt, Homo sapiens
gggcugguuucagaaucua

SEQ ID NO: 998594 - RNA, 19 nt, Homo sapiens
aagcauaccauauacuugu

SEQ ID NO: 998595 - RNA, 19 nt, Homo sapiens
guucagagguuugauugcu

SEQ ID NO: 998596 - RNA, 19 nt, Homo sapiens
gcugguuucagaaucuaua

SEQ ID NO: 998597 - RNA, 19 nt, Homo sapiens
aaguauggaacacgaauuu

SEQ ID NO: 998598 - RNA, 19 nt, Homo sapiens
cucaaagguuauucaagaa

SEQ ID NO: 998599 - RNA, 19 nt, Homo sapiens
ucuauaaucagccaucaga

SEQ ID NO: 998600 - RNA, 19 nt, Homo sapiens
caugacacacuacuugaga

SEQ ID NO: 998601 - RNA, 19 nt, Homo sapiens
cugcuuaugucuacagagu

SEQ ID NO: 998602 - RNA, 19 nt, Homo sapiens
guucuauucuguuccuuac

SEQ ID NO: 998603 - RNA, 19 nt, Homo sapiens
gcuggcauauauguucuau

SEQ ID NO: 998604 - RNA, 19 nt, Homo sapiens
uaauguugguugugugucu

SEQ ID NO: 998605 - RNA, 19 nt, Homo sapiens
gaaagaccugcugagaaga

SEQ ID NO: 998606 - RNA, 19 nt, Homo sapiens
gggaggaaacuuauagaac

SEQ ID NO: 998607 - RNA, 19 nt, Homo sapiens
gugaauaaacuugaucauc

SEQ ID NO: 998608 - RNA, 19 nt, Homo sapiens
uuucaagagcccuaucuaa

SEQ ID NO: 998609 - RNA, 19 nt, Homo sapiens
gcauaugggcacaugaucu

SEQ ID NO: 998610 - RNA, 19 nt, Homo sapiens
gaacugcuuaugucuacag

SEQ ID NO: 998611 - RNA, 19 nt, Homo sapiens
cguggugaaccucaucaua

SEQ ID NO: 998612 - RNA, 19 nt, Homo sapiens
gcacuguaugugugagcua

SEQ ID NO: 998613 - RNA, 19 nt, Homo sapiens
gugaguacuuaagaauaug

SEQ ID NO: 998614 - RNA, 19 nt, Homo sapiens
guuauacugguacugauau

SEQ ID NO: 998615 - RNA, 19 nt, Homo sapiens
cuauucuguuccuuacuuu

SEQ ID NO: 998616 - RNA, 19 nt, Homo sapiens
gcugagaagaccauuugau

SEQ ID NO: 998617 - RNA, 19 nt, Homo sapiens
ggaagcaucucucuuagca

SEQ ID NO: 998618 - RNA, 19 nt, Homo sapiens
ccacggugauguugucaua

SEQ ID NO: 998619 - RNA, 19 nt, Homo sapiens
caagaguucuggagagaga

SEQ ID NO: 998620 - RNA, 19 nt, Homo sapiens
gcaaugacccuucccuaga

SEQ ID NO: 998621 - RNA, 19 nt, Homo sapiens
ugagagcccuauuccagua

SEQ ID NO: 998622 - RNA, 19 nt, Homo sapiens
ggacagugguaucagaauc

SEQ ID NO: 998623 - RNA, 19 nt, Homo sapiens
gaccugaacuccagaaagg

SEQ ID NO: 998624 - RNA, 19 nt, Homo sapiens
gcauuuaacuggaggaacu

SEQ ID NO: 998625 - RNA, 19 nt, Homo sapiens
gcaaagaacagagcucaug

SEQ ID NO: 998626 - RNA, 19 nt, Homo sapiens
gaggcaaauuucaacauug

SEQ ID NO: 998627 - RNA, 19 nt, Homo sapiens
ggaucuaaccacuucauuu

SEQ ID NO: 998628 - RNA, 19 nt, Homo sapiens
aguggaaccuggaaucuuu

SEQ ID NO: 998629 - RNA, 19 nt, Homo sapiens
cacggaagcaucucucuua

SEQ ID NO: 998630 - RNA, 19 nt, Homo sapiens
ccaucacucuuuagccaua

SEQ ID NO: 998631 - RNA, 19 nt, Homo sapiens
gcugagcaauuuaacuaga

SEQ ID NO: 998632 - RNA, 19 nt, Homo sapiens
gaaccuggaaucuuugaau

SEQ ID NO: 998633 - RNA, 19 nt, Homo sapiens
agaaucagcucuguguuug

SEQ ID NO: 998634 - RNA, 19 nt, Homo sapiens
gcugggagaugcugcuguu

SEQ ID NO: 998635 - RNA, 19 nt, Homo sapiens
agaggcaaauuucaacauu

SEQ ID NO: 998636 - RNA, 19 nt, Homo sapiens
caaacggcaaggagucuua

SEQ ID NO: 998637 - RNA, 19 nt, Homo sapiens
ggugucauccuaauuguga

SEQ ID NO: 998638 - RNA, 19 nt, Homo sapiens
caaagaacagagcucauga

SEQ ID NO: 998639 - RNA, 19 nt, Homo sapiens
aggcauggcugcagcaaug

SEQ ID NO: 998640 - RNA, 19 nt, Homo sapiens
cgugaagccuugcaccaaa

SEQ ID NO: 998641 - RNA, 19 nt, Homo sapiens
gcucuccacuccuccauca

SEQ ID NO: 998642 - RNA, 19 nt, Homo sapiens
uaaaacagguguaauaguc

SEQ ID NO: 998643 - RNA, 19 nt, Homo sapiens
caaggagucuuagcagcuu

SEQ ID NO: 998644 - RNA, 19 nt, Homo sapiens
gcacucuacucccgagaca

SEQ ID NO: 998645 - RNA, 19 nt, Homo sapiens
cagguguaauagucaauaa

SEQ ID NO: 998646 - RNA, 19 nt, Homo sapiens
aaacagguguaauagucaa

SEQ ID NO: 998647 - RNA, 19 nt, Homo sapiens
gaucuaaccacuucauuuu

SEQ ID NO: 998648 - RNA, 19 nt, Homo sapiens
gauguacaccuucagucua

SEQ ID NO: 998649 - RNA, 19 nt, Homo sapiens
gggcgaacgcagcauuuaa

SEQ ID NO: 998650 - RNA, 19 nt, Homo sapiens
ccaaacucauccuggaaga

SEQ ID NO: 998651 - RNA, 19 nt, Homo sapiens
uggaugagcugacgcuaag

SEQ ID NO: 998652 - RNA, 19 nt, Homo sapiens
gacacucugugacuucuuc

SEQ ID NO: 998653 - RNA, 19 nt, Homo sapiens
gagccacggugauguuguc

SEQ ID NO: 998654 - RNA, 19 nt, Homo sapiens
gggagagaguggaucagau

SEQ ID NO: 998655 - RNA, 19 nt, Homo sapiens
gcccaacucgugagaaaga

SEQ ID NO: 998656 - RNA, 19 nt, Homo sapiens
gcagacggccaaacucauc

SEQ ID NO: 998657 - RNA, 19 nt, Homo sapiens
gcaccaaacagcugcaucu

SEQ ID NO: 998658 - RNA, 19 nt, Homo sapiens
gaagguggaaugccuguac

SEQ ID NO: 998659 - RNA, 19 nt, Homo sapiens
caaugacccuucccuagac

SEQ ID NO: 998660 - RNA, 19 nt, Homo sapiens
guuucccgcuucuggauuu

SEQ ID NO: 998661 - RNA, 19 nt, Homo sapiens
cuggguccaucacucuuua

SEQ ID NO: 998662 - RNA, 19 nt, Homo sapiens
cacccaaugugauuuguag

SEQ ID NO: 998663 - RNA, 19 nt, Homo sapiens
ccaaugugauuuguagaag

SEQ ID NO: 998664 - RNA, 19 nt, Homo sapiens
gaaaaugggaguuggugaa

SEQ ID NO: 998665 - RNA, 19 nt, Homo sapiens
caacauugacacugauuac

SEQ ID NO: 998666 - RNA, 19 nt, Homo sapiens
gagcugaaagaggcaaauu

SEQ ID NO: 998667 - RNA, 19 nt, Homo sapiens
uggccuggcugcaugauca

SEQ ID NO: 998668 - RNA, 19 nt, Homo sapiens
ccuggaaucuuugaaugga

SEQ ID NO: 998669 - RNA, 19 nt, Homo sapiens
guacgaggcgcugaagaga

SEQ ID NO: 998670 - RNA, 19 nt, Homo sapiens
gggcaugugcuucugugaa

SEQ ID NO: 998671 - RNA, 19 nt, Homo sapiens
gcaaugcuccacuccugau

SEQ ID NO: 998672 - RNA, 19 nt, Homo sapiens
aggcugagcaauuuaacua

SEQ ID NO: 998673 - RNA, 19 nt, Homo sapiens
gaagagcgugcuggugguu

SEQ ID NO: 998674 - RNA, 19 nt, Homo sapiens
gaagccagcagcagaugca

SEQ ID NO: 998675 - RNA, 19 nt, Homo sapiens
ggauguacaccuucagucu

SEQ ID NO: 998676 - RNA, 19 nt, Homo sapiens
acgccaaggucuccaacaa

SEQ ID NO: 998677 - RNA, 19 nt, Homo sapiens
auuaaagacucaccacaca

SEQ ID NO: 998678 - RNA, 19 nt, Homo sapiens
gacagugguaucagaauca

SEQ ID NO: 998679 - RNA, 19 nt, Homo sapiens
ccuggugacuacaucuuug

SEQ ID NO: 998680 - RNA, 19 nt, Homo sapiens
cuuuguaacucccaucugu

SEQ ID NO: 998681 - RNA, 19 nt, Homo sapiens
ggagucgugggaucaaaga

SEQ ID NO: 998682 - RNA, 19 nt, Homo sapiens
gggugaagcacaggaugua

SEQ ID NO: 998683 - RNA, 19 nt, Homo sapiens
gaagcacgagacgcacuuu

SEQ ID NO: 998684 - RNA, 19 nt, Homo sapiens
gggagaugcugcuguuucc

SEQ ID NO: 998685 - RNA, 19 nt, Homo sapiens
aaccuggaaucuuugaaug

SEQ ID NO: 998686 - RNA, 19 nt, Homo sapiens
gaacucaaacuggagaaaa

SEQ ID NO: 998687 - RNA, 19 nt, Homo sapiens
acacggaucgagccaguga

SEQ ID NO: 998688 - RNA, 19 nt, Homo sapiens
gcacuaccagacccugaga

SEQ ID NO: 998689 - RNA, 19 nt, Homo sapiens
aaccugaggcugagcaauu

SEQ ID NO: 998690 - RNA, 19 nt, Homo sapiens
ggagaggcagaaaccaugu

SEQ ID NO: 998691 - RNA, 19 nt, Homo sapiens
uugcccaacucgugagaaa

SEQ ID NO: 998692 - RNA, 19 nt, Homo sapiens
cggcgagcauggugcaaau

SEQ ID NO: 998693 - RNA, 19 nt, Homo sapiens
cacaggauguacaccuuca

SEQ ID NO: 998694 - RNA, 19 nt, Homo sapiens
guggaugagcugacgcuaa

SEQ ID NO: 998695 - RNA, 19 nt, Homo sapiens
gcagacgucauccgggaau

SEQ ID NO: 998696 - RNA, 19 nt, Homo sapiens
cauuaaauucccaaucguu

SEQ ID NO: 998697 - RNA, 19 nt, Homo sapiens
gcacgagacgcacuuuuau

SEQ ID NO: 998698 - RNA, 19 nt, Homo sapiens
aaugugauuuguagaagca

SEQ ID NO: 998699 - RNA, 19 nt, Homo sapiens
gugcagaggcugggagaug

SEQ ID NO: 998700 - RNA, 19 nt, Homo sapiens
cauccuggaagaacucaaa

SEQ ID NO: 998701 - RNA, 19 nt, Homo sapiens
ucagcuaccucggcuucuu

SEQ ID NO: 998702 - RNA, 19 nt, Homo sapiens
ccacuccugaugggaaaua

SEQ ID NO: 998703 - RNA, 19 nt, Homo sapiens
ccacacacgaaggaucuaa

SEQ ID NO: 998704 - RNA, 19 nt, Homo sapiens
ugagagccacggugauguu

SEQ ID NO: 998705 - RNA, 19 nt, Homo sapiens
gaaaauaaagaggaaggaa

SEQ ID NO: 998706 - RNA, 19 nt, Homo sapiens
gugcagacggccaaacuca

SEQ ID NO: 998707 - RNA, 19 nt, Homo sapiens
gucgugggaucaaagacuu

SEQ ID NO: 998708 - RNA, 19 nt, Homo sapiens
ggaucgagccagugagucu

SEQ ID NO: 998709 - RNA, 19 nt, Homo sapiens
ggcuaaaacagguguaaua

SEQ ID NO: 998710 - RNA, 19 nt, Homo sapiens
gucuuagucucacccaaug

SEQ ID NO: 998711 - RNA, 19 nt, Homo sapiens
gcaagcgccagugugcaaa

SEQ ID NO: 998712 - RNA, 19 nt, Homo sapiens
ccuaagggcaggaagagau

SEQ ID NO: 998713 - RNA, 19 nt, Homo sapiens
aauauuucccuccggcuuu

SEQ ID NO: 998714 - RNA, 19 nt, Homo sapiens
cagaggcgucuuagucuca

SEQ ID NO: 998715 - RNA, 19 nt, Homo sapiens
gaguggaaccuggaaucuu

SEQ ID NO: 998716 - RNA, 19 nt, Homo sapiens
aggcuaccguugcaaggaa

SEQ ID NO: 998717 - RNA, 19 nt, Homo sapiens
gaacacagaugacuacauu

SEQ ID NO: 998718 - RNA, 19 nt, Homo sapiens
gagagaaacugccauauaa

SEQ ID NO: 998719 - RNA, 19 nt, Homo sapiens
gcaaaucgcucucagauga

SEQ ID NO: 998720 - RNA, 19 nt, Homo sapiens
gaauauaccugugaagaua

SEQ ID NO: 998721 - RNA, 19 nt, Homo sapiens
gaacauagauugugcagau

SEQ ID NO: 998722 - RNA, 19 nt, Homo sapiens
gaacaaugaucuucccaua

SEQ ID NO: 998723 - RNA, 19 nt, Homo sapiens
agacaacucugaugaauua

SEQ ID NO: 998724 - RNA, 19 nt, Homo sapiens
gaaagagacuguccugaaa

SEQ ID NO: 998725 - RNA, 19 nt, Homo sapiens
caagauagcugaugaauac

SEQ ID NO: 998726 - RNA, 19 nt, Homo sapiens
gaagaugaauccaaucaaa

SEQ ID NO: 998727 - RNA, 19 nt, Homo sapiens
gaacaaggauaauugauuc

SEQ ID NO: 998728 - RNA, 19 nt, Homo sapiens
aaacaucucugcaugauaa

SEQ ID NO: 998729 - RNA, 19 nt, Homo sapiens
ggacagauguuguagaaga

SEQ ID NO: 998730 - RNA, 19 nt, Homo sapiens
ggacugauauucacucauu

SEQ ID NO: 998731 - RNA, 19 nt, Homo sapiens
gagaagaauucaucuauug

SEQ ID NO: 998732 - RNA, 19 nt, Homo sapiens
guaaacugcuucaaucaua

SEQ ID NO: 998733 - RNA, 19 nt, Homo sapiens
uaacagggauggauguaua

SEQ ID NO: 998734 - RNA, 19 nt, Homo sapiens
gugguaagcugacauauaa

SEQ ID NO: 998735 - RNA, 19 nt, Homo sapiens
ggaggaaccugcauuguga

SEQ ID NO: 998736 - RNA, 19 nt, Homo sapiens
ccuaagaacuacacuaaua

SEQ ID NO: 998737 - RNA, 19 nt, Homo sapiens
ucauugagcugaagaauuu

SEQ ID NO: 998738 - RNA, 19 nt, Homo sapiens
ccaguaaacuuaagaugua

SEQ ID NO: 998739 - RNA, 19 nt, Homo sapiens
gaagaucacugugguggua

SEQ ID NO: 998740 - RNA, 19 nt, Homo sapiens
caagagauauucagaguau

SEQ ID NO: 998741 - RNA, 19 nt, Homo sapiens
gacaauaugugccgaguaa

SEQ ID NO: 998742 - RNA, 19 nt, Homo sapiens
gaaaagaacugcaauaaca

SEQ ID NO: 998743 - RNA, 19 nt, Homo sapiens
gaucaugguuucaacuuaa

SEQ ID NO: 998744 - RNA, 19 nt, Homo sapiens
gaauagcuccuacugaaua

SEQ ID NO: 998745 - RNA, 19 nt, Homo sapiens
ccacagacauguacauuga

SEQ ID NO: 998746 - RNA, 19 nt, Homo sapiens
ggaggaagaugaaauagau

SEQ ID NO: 998747 - RNA, 19 nt, Homo sapiens
ggacaaaugcccuguauug

SEQ ID NO: 998748 - RNA, 19 nt, Homo sapiens
caacaaugcugcugauaug

SEQ ID NO: 998749 - RNA, 19 nt, Homo sapiens
gcaccagacucuuaacaaa

SEQ ID NO: 998750 - RNA, 19 nt, Homo sapiens
gaagaggaauugucuguuc

SEQ ID NO: 998751 - RNA, 19 nt, Homo sapiens
gcaacaaggugacaauaug

SEQ ID NO: 998752 - RNA, 19 nt, Homo sapiens
gaggauggauucgaaauaa

SEQ ID NO: 998753 - RNA, 19 nt, Homo sapiens
cagaauagcuccuacugaa

SEQ ID NO: 998754 - RNA, 19 nt, Homo sapiens
gagcaaggaugcagaauag

SEQ ID NO: 998755 - RNA, 19 nt, Homo sapiens
ccucacagaugcagaaaua

SEQ ID NO: 998756 - RNA, 19 nt, Homo sapiens
guacaaguguugauccuuu

SEQ ID NO: 998757 - RNA, 19 nt, Homo sapiens
caugugaaauuguggauua

SEQ ID NO: 998758 - RNA, 19 nt, Homo sapiens
gaaauggcaucuugugaau

SEQ ID NO: 998759 - RNA, 19 nt, Homo sapiens
ggauuuagcaugcgaauuu

SEQ ID NO: 998760 - RNA, 19 nt, Homo sapiens
gauaugcgauggucagaaa

SEQ ID NO: 998761 - RNA, 19 nt, Homo sapiens
guaagcaacucugucuuua

SEQ ID NO: 998762 - RNA, 19 nt, Homo sapiens
gaaauuagccuuagauugc

SEQ ID NO: 998763 - RNA, 19 nt, Homo sapiens
gaaagaggaggaaauauau

SEQ ID NO: 998764 - RNA, 19 nt, Homo sapiens
gaagagaacugugaaagag

SEQ ID NO: 998765 - RNA, 19 nt, Homo sapiens
gaaaugugauggccaugaa

SEQ ID NO: 998766 - RNA, 19 nt, Homo sapiens
caaaugcccuguauuggaa

SEQ ID NO: 998767 - RNA, 19 nt, Homo sapiens
guaauugcguuccugauuu

SEQ ID NO: 998768 - RNA, 19 nt, Homo sapiens
gagaaaccauccugaaaga

SEQ ID NO: 998769 - RNA, 19 nt, Homo sapiens
ggagaaagaugugaaguca

SEQ ID NO: 998770 - RNA, 19 nt, Homo sapiens
gacagacucucacugauuu

SEQ ID NO: 998771 - RNA, 19 nt, Homo sapiens
gaacagucaugcaacaguu

SEQ ID NO: 998772 - RNA, 19 nt, Homo sapiens
gauaugauuuguuggauug

SEQ ID NO: 998773 - RNA, 19 nt, Homo sapiens
gaagggagaagcuuuguuu

SEQ ID NO: 998774 - RNA, 19 nt, Homo sapiens
gugaagaccuuaaugaaug

SEQ ID NO: 998775 - RNA, 19 nt, Homo sapiens
aaacagggauuaaacaaug

SEQ ID NO: 998776 - RNA, 19 nt, Homo sapiens
gauaaucaguucagauguu

SEQ ID NO: 998777 - RNA, 19 nt, Homo sapiens
ggaaggaucauauaaaugu

SEQ ID NO: 998778 - RNA, 19 nt, Homo sapiens
caaaaugacugcagugaua

SEQ ID NO: 998779 - RNA, 19 nt, Homo sapiens
gaagcaauguggauauguu

SEQ ID NO: 998780 - RNA, 19 nt, Homo sapiens
gggagaagcuguaaagauc

SEQ ID NO: 998781 - RNA, 19 nt, Homo sapiens
gaacgcauccucuuugcua

SEQ ID NO: 998782 - RNA, 19 nt, Homo sapiens
gaucauaucagcacaagaa

SEQ ID NO: 998783 - RNA, 19 nt, Homo sapiens
gaaacugccauauaaauga

SEQ ID NO: 998784 - RNA, 19 nt, Homo sapiens
gaaguaaucgagucaauga

SEQ ID NO: 998785 - RNA, 19 nt, Homo sapiens
aagaagaccugcuaugaaa

SEQ ID NO: 998786 - RNA, 19 nt, Homo sapiens
acacuacacugaacacuaa

SEQ ID NO: 998787 - RNA, 19 nt, Homo sapiens
ucacagauauccaggugua

SEQ ID NO: 998788 - RNA, 19 nt, Homo sapiens
gaauuaaagugcccaguuc

SEQ ID NO: 998789 - RNA, 19 nt, Homo sapiens
caacagaugugugacuaaa

SEQ ID NO: 998790 - RNA, 19 nt, Homo sapiens
cauuugaccuucagauaua

SEQ ID NO: 998791 - RNA, 19 nt, Homo sapiens
ccuaaacucugauuugaaa

SEQ ID NO: 998792 - RNA, 19 nt, Homo sapiens
gaagacaaccuauuaucaa

SEQ ID NO: 998793 - RNA, 19 nt, Homo sapiens
ugaaagaggaggaaauaua

SEQ ID NO: 998794 - RNA, 19 nt, Homo sapiens
gcagugugauggagacuuu

SEQ ID NO: 998795 - RNA, 19 nt, Homo sapiens
gaugggcggugucuucuaa

SEQ ID NO: 998796 - RNA, 19 nt, Homo sapiens
caaguuaugugauggagaa

SEQ ID NO: 998797 - RNA, 19 nt, Homo sapiens
uauuugggcuucagauuua

SEQ ID NO: 998798 - RNA, 19 nt, Homo sapiens
gaaaggacgcccaggaauu

SEQ ID NO: 998799 - RNA, 19 nt, Homo sapiens
ccauaaagaucgauucaga

SEQ ID NO: 998800 - RNA, 19 nt, Homo sapiens
gauaaccaccuuaguaauu

SEQ ID NO: 998801 - RNA, 19 nt, Homo sapiens
cuagauggcucccuaagaa

SEQ ID NO: 998802 - RNA, 19 nt, Homo sapiens
ggaaacauauacuggauag

SEQ ID NO: 998803 - RNA, 19 nt, Homo sapiens
ucacaauccuaaagcaaua

SEQ ID NO: 998804 - RNA, 19 nt, Homo sapiens
gcaggaggauuaacagaug

SEQ ID NO: 998805 - RNA, 19 nt, Homo sapiens
ggucaacucucuucuuugu

SEQ ID NO: 998806 - RNA, 19 nt, Homo sapiens
gauccuggcuuuaugauag

SEQ ID NO: 998807 - RNA, 19 nt, Homo sapiens
ggaggaagaugcauuuuaa

SEQ ID NO: 998808 - RNA, 19 nt, Homo sapiens
ggagaacccuaugcuauug

SEQ ID NO: 998809 - RNA, 19 nt, Homo sapiens
gaccggaucuuuguuugua

SEQ ID NO: 998810 - RNA, 19 nt, Homo sapiens
guauuaaccuaacagauga

SEQ ID NO: 998811 - RNA, 19 nt, Homo sapiens
cauauaagcacacaaauug

SEQ ID NO: 998812 - RNA, 19 nt, Homo sapiens
caacugcaccagacucuua

SEQ ID NO: 998813 - RNA, 19 nt, Homo sapiens
ccagaaauguaucccagua

SEQ ID NO: 998814 - RNA, 19 nt, Homo sapiens
gaagugacauuaagguagu

SEQ ID NO: 998815 - RNA, 19 nt, Homo sapiens
gaacaacauccaaguauca

SEQ ID NO: 998816 - RNA, 19 nt, Homo sapiens
ggaacaaacaugauagaaa

SEQ ID NO: 998817 - RNA, 19 nt, Homo sapiens
cuacaaaucuggcauguuu

SEQ ID NO: 998818 - RNA, 19 nt, Homo sapiens
gaacuggacugucugauuc

SEQ ID NO: 998819 - RNA, 19 nt, Homo sapiens
agaaggaccugauauguaa

SEQ ID NO: 998820 - RNA, 19 nt, Homo sapiens
guauugagcuuauuguuga

SEQ ID NO: 998821 - RNA, 19 nt, Homo sapiens
guggaacgcugguuaaauu

SEQ ID NO: 998822 - RNA, 19 nt, Homo sapiens
gaauaugaauggcagcaaa

SEQ ID NO: 998823 - RNA, 19 nt, Homo sapiens
ccaugaagcugcuggcaua

SEQ ID NO: 998824 - RNA, 19 nt, Homo sapiens
guucauaucaggagauuua

SEQ ID NO: 998825 - RNA, 19 nt, Homo sapiens
gaacauagacagaguugug

SEQ ID NO: 998826 - RNA, 19 nt, Homo sapiens
caacaacauuggcuccauu

SEQ ID NO: 998827 - RNA, 19 nt, Homo sapiens
cccaugaucuuguguauug

SEQ ID NO: 998828 - RNA, 19 nt, Homo sapiens
gagaagacugaauguguua

SEQ ID NO: 998829 - RNA, 19 nt, Homo sapiens
gcugugggauguaaauuug

SEQ ID NO: 998830 - RNA, 19 nt, Homo sapiens
ucacuugucugguugaaau

SEQ ID NO: 998831 - RNA, 19 nt, Homo sapiens
gaacaauuacuccaugaug

SEQ ID NO: 998832 - RNA, 19 nt, Homo sapiens
agaugaaccugcuggauuu

SEQ ID NO: 998833 - RNA, 19 nt, Homo sapiens
cauuaagacugauggguaa

SEQ ID NO: 998834 - RNA, 19 nt, Homo sapiens
agaauucacuugucugguu

SEQ ID NO: 998835 - RNA, 19 nt, Homo sapiens
guacuucaaucucaguuuc

SEQ ID NO: 998836 - RNA, 19 nt, Homo sapiens
aaauaaagccuguuucugu

SEQ ID NO: 998837 - RNA, 19 nt, Homo sapiens
ugagggucauguacaaaua

SEQ ID NO: 998838 - RNA, 19 nt, Homo sapiens
aaacuguacuucaaucuca

SEQ ID NO: 998839 - RNA, 19 nt, Homo sapiens
ccagcucaauacaaaguua

SEQ ID NO: 998840 - RNA, 19 nt, Homo sapiens
ggccaaaccuaccaauugu

SEQ ID NO: 998841 - RNA, 19 nt, Homo sapiens
gcaacaugaugaguaaaga

SEQ ID NO: 998842 - RNA, 19 nt, Homo sapiens
gaccauguguggacgcaaa

SEQ ID NO: 998843 - RNA, 19 nt, Homo sapiens
ugagcaccgucuuuaauuu

SEQ ID NO: 998844 - RNA, 19 nt, Homo sapiens
ggacggaagccaagccauu

SEQ ID NO: 998845 - RNA, 19 nt, Homo sapiens
gggcucaggugucagcauu

SEQ ID NO: 998846 - RNA, 19 nt, Homo sapiens
guacaaauauugggaugca

SEQ ID NO: 998847 - RNA, 19 nt, Homo sapiens
gaagugcauuauuucacaa

SEQ ID NO: 998848 - RNA, 19 nt, Homo sapiens
gaagcucauucaacugguu

SEQ ID NO: 998849 - RNA, 19 nt, Homo sapiens
uaauacugcuuaugggaaa

SEQ ID NO: 998850 - RNA, 19 nt, Homo sapiens
aauaaagccuguuucuguu

SEQ ID NO: 998851 - RNA, 19 nt, Homo sapiens
cccaguagauuaauuguuc

SEQ ID NO: 998852 - RNA, 19 nt, Homo sapiens
agagaagacugaauguguu

SEQ ID NO: 998853 - RNA, 19 nt, Homo sapiens
gacugaauguguuaaugaa

SEQ ID NO: 998854 - RNA, 19 nt, Homo sapiens
ccaauuguaugcauuaacu

SEQ ID NO: 998855 - RNA, 19 nt, Homo sapiens
agacagaguuguguuuguu

SEQ ID NO: 998856 - RNA, 19 nt, Homo sapiens
ugaagagcauccggaagua

SEQ ID NO: 998857 - RNA, 19 nt, Homo sapiens
gaacgcugguuaaauuggu

SEQ ID NO: 998858 - RNA, 19 nt, Homo sapiens
ggaaaagccucccaguaga

SEQ ID NO: 998859 - RNA, 19 nt, Homo sapiens
gugauuaaauguccucauc

SEQ ID NO: 998860 - RNA, 19 nt, Homo sapiens
gacggaagccaagccauua

SEQ ID NO: 998861 - RNA, 19 nt, Homo sapiens
uugaaggacagaacaauua

SEQ ID NO: 998862 - RNA, 19 nt, Homo sapiens
gaucuuguguauugagcuu

SEQ ID NO: 998863 - RNA, 19 nt, Homo sapiens
auggguaacuuucaaauga

SEQ ID NO: 998864 - RNA, 19 nt, Homo sapiens
gaaccugcuggauuuguaa

SEQ ID NO: 998865 - RNA, 19 nt, Homo sapiens
ugaaccugcuggauuugua

SEQ ID NO: 998866 - RNA, 19 nt, Homo sapiens
uacccuauguugcugguua

SEQ ID NO: 998867 - RNA, 19 nt, Homo sapiens
gcaaagggaaccugcacuu

SEQ ID NO: 998868 - RNA, 19 nt, Homo sapiens
cagaacaauuacuccauga

SEQ ID NO: 998869 - RNA, 19 nt, Homo sapiens
aagaaggaccugauaugua

SEQ ID NO: 998870 - RNA, 19 nt, Homo sapiens
gaacuucucuagccuucac

SEQ ID NO: 998871 - RNA, 19 nt, Homo sapiens
guugaggugucagauagua

SEQ ID NO: 998872 - RNA, 19 nt, Homo sapiens
ggguugaggugucagauag

SEQ ID NO: 998873 - RNA, 19 nt, Homo sapiens
ucauucaacugguuacuuc

SEQ ID NO: 998874 - RNA, 19 nt, Homo sapiens
cagaugaaccugcuggauu

SEQ ID NO: 998875 - RNA, 19 nt, Homo sapiens
gagauuccaucagcaagga

SEQ ID NO: 998876 - RNA, 19 nt, Homo sapiens
ugacuucuaauacugcuua

SEQ ID NO: 998877 - RNA, 19 nt, Homo sapiens
aacaauuacuccaugauga

SEQ ID NO: 998878 - RNA, 19 nt, Homo sapiens
gcuagguuauauuaaguug

SEQ ID NO: 998879 - RNA, 19 nt, Homo sapiens
cugaccagcucaauacaaa

SEQ ID NO: 998880 - RNA, 19 nt, Homo sapiens
gaccagcuuuggcaacaug

SEQ ID NO: 998881 - RNA, 19 nt, Homo sapiens
caugaugaaucuuccuuuc

SEQ ID NO: 998882 - RNA, 19 nt, Homo sapiens
gauuaaauguccucaucca

SEQ ID NO: 998883 - RNA, 19 nt, Homo sapiens
ggaugugcgcguugaauga

SEQ ID NO: 998884 - RNA, 19 nt, Homo sapiens
ucccacaaauccugaauug

SEQ ID NO: 998885 - RNA, 19 nt, Homo sapiens
aaugguaguuuguaaagug

SEQ ID NO: 998886 - RNA, 19 nt, Homo sapiens
gugaagagaagacugaaug

SEQ ID NO: 998887 - RNA, 19 nt, Homo sapiens
uguaagcgcuggucauuuu

SEQ ID NO: 998888 - RNA, 19 nt, Homo sapiens
ccaaaccuaccaauuguau

SEQ ID NO: 998889 - RNA, 19 nt, Homo sapiens
gccagaauguuacuauuuu

SEQ ID NO: 998890 - RNA, 19 nt, Homo sapiens
uccuaucgcuuauaaaugu

SEQ ID NO: 998891 - RNA, 19 nt, Homo sapiens
gaagagaagacugaaugug

SEQ ID NO: 998892 - RNA, 19 nt, Homo sapiens
guaauuacucuaggagauu

SEQ ID NO: 998893 - RNA, 19 nt, Homo sapiens
ggaaacagccucccaaaag

SEQ ID NO: 998894 - RNA, 19 nt, Homo sapiens
ugugggauguaaauuugua

SEQ ID NO: 998895 - RNA, 19 nt, Homo sapiens
gagcaccgucuuuaauuuc

SEQ ID NO: 998896 - RNA, 19 nt, Homo sapiens
ccucauccaugcacagaau

SEQ ID NO: 998897 - RNA, 19 nt, Homo sapiens
gaagacugaauguguuaau

SEQ ID NO: 998898 - RNA, 19 nt, Homo sapiens
uaagaaggaccugauaugu

SEQ ID NO: 998899 - RNA, 19 nt, Homo sapiens
cuaccaauuguaugcauua

SEQ ID NO: 998900 - RNA, 19 nt, Homo sapiens
gaacaugaggguuauuuug

SEQ ID NO: 998901 - RNA, 19 nt, Homo sapiens
gagaacauagacagaguug

SEQ ID NO: 998902 - RNA, 19 nt, Homo sapiens
caacaugaugaguaaagaa

SEQ ID NO: 998903 - RNA, 19 nt, Homo sapiens
ugaauggcagcaaaucuuu

SEQ ID NO: 998904 - RNA, 19 nt, Homo sapiens
gcucggaugugcgcguuga

SEQ ID NO: 998905 - RNA, 19 nt, Homo sapiens
gcacagguucauucagaug

SEQ ID NO: 998906 - RNA, 19 nt, Homo sapiens
guugaaauagucugugauu

SEQ ID NO: 998907 - RNA, 19 nt, Homo sapiens
agacugaauguguuaauga

SEQ ID NO: 998908 - RNA, 19 nt, Homo sapiens
uggaugaacuggacugucu

SEQ ID NO: 998909 - RNA, 19 nt, Homo sapiens
gaagagcauccggaaguau

SEQ ID NO: 998910 - RNA, 19 nt, Homo sapiens
caaauauugggaugcauga

SEQ ID NO: 998911 - RNA, 19 nt, Homo sapiens
gaaugagaacauagacaga

SEQ ID NO: 998912 - RNA, 19 nt, Homo sapiens
aagccguacugccuugaua

SEQ ID NO: 998913 - RNA, 19 nt, Homo sapiens
aauccugaauugugucaaa

SEQ ID NO: 998914 - RNA, 19 nt, Homo sapiens
gugggugucuuuaaugaag

SEQ ID NO: 998915 - RNA, 19 nt, Homo sapiens
gaucuaaagcucuugaaaa

SEQ ID NO: 998916 - RNA, 19 nt, Homo sapiens
gaguuguguuuguuggaaa

SEQ ID NO: 998917 - RNA, 19 nt, Homo sapiens
cuacaaaucuggcauguuu

SEQ ID NO: 998918 - RNA, 19 nt, Homo sapiens
gaacuggacugucugauuc

SEQ ID NO: 998919 - RNA, 19 nt, Homo sapiens
agaaggaccugauauguaa

SEQ ID NO: 998920 - RNA, 19 nt, Homo sapiens
guauugagcuuauuguuga

SEQ ID NO: 998921 - RNA, 19 nt, Homo sapiens
guggaacgcugguuaaauu

SEQ ID NO: 998922 - RNA, 19 nt, Homo sapiens
gaauaugaauggcagcaaa

SEQ ID NO: 998923 - RNA, 19 nt, Homo sapiens
ccaugaagcugcuggcaua

SEQ ID NO: 998924 - RNA, 19 nt, Homo sapiens
guucauaucaggagauuua

SEQ ID NO: 998925 - RNA, 19 nt, Homo sapiens
ugaagaagcucuggaaaug

SEQ ID NO: 998926 - RNA, 19 nt, Homo sapiens
gaacauagacagaguugug

SEQ ID NO: 998927 - RNA, 19 nt, Homo sapiens
uaaagacgccggagaauga

SEQ ID NO: 998928 - RNA, 19 nt, Homo sapiens
caacaacauuggcuccauu

SEQ ID NO: 998929 - RNA, 19 nt, Homo sapiens
cccaugaucuuguguauug

SEQ ID NO: 998930 - RNA, 19 nt, Homo sapiens
gcaccaauguugauaaacu

SEQ ID NO: 998931 - RNA, 19 nt, Homo sapiens
gagaagacugaauguguua

SEQ ID NO: 998932 - RNA, 19 nt, Homo sapiens
ucacuugucugguugaaau

SEQ ID NO: 998933 - RNA, 19 nt, Homo sapiens
gaacaauuacuccaugaug

SEQ ID NO: 998934 - RNA, 19 nt, Homo sapiens
agaugaaccugcuggauuu

SEQ ID NO: 998935 - RNA, 19 nt, Homo sapiens
cauuaagacugauggguaa

SEQ ID NO: 998936 - RNA, 19 nt, Homo sapiens
agaauucacuugucugguu

SEQ ID NO: 998937 - RNA, 19 nt, Homo sapiens
guacuucaaucucaguuuc

SEQ ID NO: 998938 - RNA, 19 nt, Homo sapiens
ugacaccucugcaaauaau

SEQ ID NO: 998939 - RNA, 19 nt, Homo sapiens
aaauaaagccuguuucugu

SEQ ID NO: 998940 - RNA, 19 nt, Homo sapiens
ugagggucauguacaaaua

SEQ ID NO: 998941 - RNA, 19 nt, Homo sapiens
aaacuguacuucaaucuca

SEQ ID NO: 998942 - RNA, 19 nt, Homo sapiens
ccagcucaauacaaaguua

SEQ ID NO: 998943 - RNA, 19 nt, Homo sapiens
ggccaaaccuaccaauugu

SEQ ID NO: 998944 - RNA, 19 nt, Homo sapiens
gcaacaugaugaguaaaga

SEQ ID NO: 998945 - RNA, 19 nt, Homo sapiens
gaccauguguggacgcaaa

SEQ ID NO: 998946 - RNA, 19 nt, Homo sapiens
ugagcaccgucuuuaauuu

SEQ ID NO: 998947 - RNA, 19 nt, Homo sapiens
ggacggaagccaagccauu

SEQ ID NO: 998948 - RNA, 19 nt, Homo sapiens
cagcaccaauguugauaaa

SEQ ID NO: 998949 - RNA, 19 nt, Homo sapiens
gggcucaggugucagcauu

SEQ ID NO: 998950 - RNA, 19 nt, Homo sapiens
guacaaauauugggaugca

SEQ ID NO: 998951 - RNA, 19 nt, Homo sapiens
gaacauuccuaggccuaug

SEQ ID NO: 998952 - RNA, 19 nt, Homo sapiens
uaauacugcuuaugggaaa

SEQ ID NO: 998953 - RNA, 19 nt, Homo sapiens
aauaaagccuguuucuguu

SEQ ID NO: 998954 - RNA, 19 nt, Homo sapiens
ugaaacgguucgcuccuuu

SEQ ID NO: 998955 - RNA, 19 nt, Homo sapiens
cccaguagauuaauuguuc

SEQ ID NO: 998956 - RNA, 19 nt, Homo sapiens
agagaagacugaauguguu

SEQ ID NO: 998957 - RNA, 19 nt, Homo sapiens
gacugaauguguuaaugaa

SEQ ID NO: 998958 - RNA, 19 nt, Homo sapiens
ccaauuguaugcauuaacu

SEQ ID NO: 998959 - RNA, 19 nt, Homo sapiens
agacagaguuguguuuguu

SEQ ID NO: 998960 - RNA, 19 nt, Homo sapiens
ugaagagcauccggaagua

SEQ ID NO: 998961 - RNA, 19 nt, Homo sapiens
gaacgcugguuaaauuggu

SEQ ID NO: 998962 - RNA, 19 nt, Homo sapiens
ggaaaagccucccaguaga

SEQ ID NO: 998963 - RNA, 19 nt, Homo sapiens
gugauuaaauguccucauc

SEQ ID NO: 998964 - RNA, 19 nt, Homo sapiens
gacggaagccaagccauua

SEQ ID NO: 998965 - RNA, 19 nt, Homo sapiens
gcaucaagcuuuggcaaca

SEQ ID NO: 998966 - RNA, 19 nt, Homo sapiens
uugaaggacagaacaauua

SEQ ID NO: 998967 - RNA, 19 nt, Homo sapiens
gaucuuguguauugagcuu

SEQ ID NO: 998968 - RNA, 19 nt, Homo sapiens
auggguaacuuucaaauga

SEQ ID NO: 998969 - RNA, 19 nt, Homo sapiens
gaaccugcuggauuuguaa

SEQ ID NO: 998970 - RNA, 19 nt, Homo sapiens
ugaaccugcuggauuugua

SEQ ID NO: 998971 - RNA, 19 nt, Homo sapiens
uacccuauguugcugguua

SEQ ID NO: 998972 - RNA, 19 nt, Homo sapiens
gcaaagggaaccugcacuu

SEQ ID NO: 998973 - RNA, 19 nt, Homo sapiens
cagaacaauuacuccauga

SEQ ID NO: 998974 - RNA, 19 nt, Homo sapiens
aagaaggaccugauaugua

SEQ ID NO: 998975 - RNA, 19 nt, Homo sapiens
gaacuucucuagccuucac

SEQ ID NO: 998976 - RNA, 19 nt, Homo sapiens
guugaggugucagauagua

SEQ ID NO: 998977 - RNA, 19 nt, Homo sapiens
ggguugaggugucagauag

SEQ ID NO: 998978 - RNA, 19 nt, Homo sapiens
cagaugaaccugcuggauu

SEQ ID NO: 998979 - RNA, 19 nt, Homo sapiens
gagauuccaucagcaagga

SEQ ID NO: 998980 - RNA, 19 nt, Homo sapiens
uugauaaacuggugaagga

SEQ ID NO: 998981 - RNA, 19 nt, Homo sapiens
ugacuucuaauacugcuua

SEQ ID NO: 998982 - RNA, 19 nt, Homo sapiens
aacaauuacuccaugauga

SEQ ID NO: 998983 - RNA, 19 nt, Homo sapiens
gcuagguuauauuaaguug

SEQ ID NO: 998984 - RNA, 19 nt, Homo sapiens
cugaccagcucaauacaaa

SEQ ID NO: 998985 - RNA, 19 nt, Homo sapiens
ugaacgggcugcugcacaa

SEQ ID NO: 998986 - RNA, 19 nt, Homo sapiens
caugaugaaucuuccuuuc

SEQ ID NO: 998987 - RNA, 19 nt, Homo sapiens
gauuaaauguccucaucca

SEQ ID NO: 998988 - RNA, 19 nt, Homo sapiens
aaauaaagacgccggagaa

SEQ ID NO: 998989 - RNA, 19 nt, Homo sapiens
ggaugugcgcguugaauga

SEQ ID NO: 998990 - RNA, 19 nt, Homo sapiens
gcuguagcaucaagcuuug

SEQ ID NO: 998991 - RNA, 19 nt, Homo sapiens
ucccacaaauccugaauug

SEQ ID NO: 998992 - RNA, 19 nt, Homo sapiens
gugaagagaagacugaaug

SEQ ID NO: 998993 - RNA, 19 nt, Homo sapiens
uguaagcgcuggucauuuu

SEQ ID NO: 998994 - RNA, 19 nt, Homo sapiens
ccaaaccuaccaauuguau

SEQ ID NO: 998995 - RNA, 19 nt, Homo sapiens
aggagacuaugaacgauuu

SEQ ID NO: 998996 - RNA, 19 nt, Homo sapiens
gccagaauguuacuauuuu

SEQ ID NO: 998997 - RNA, 19 nt, Homo sapiens
uccuaucgcuuauaaaugu

SEQ ID NO: 998998 - RNA, 19 nt, Homo sapiens
gaagagaagacugaaugug

SEQ ID NO: 998999 - RNA, 19 nt, Homo sapiens
guaauuacucuaggagauu

SEQ ID NO: 999000 - RNA, 19 nt, Homo sapiens
ggaaacagccucccaaaag

SEQ ID NO: 999001 - RNA, 19 nt, Homo sapiens
gagcaccgucuuuaauuuc

SEQ ID NO: 999002 - RNA, 19 nt, Homo sapiens
gcgaggaagccgcguuuga

SEQ ID NO: 999003 - RNA, 19 nt, Homo sapiens
ccucauccaugcacagaau

SEQ ID NO: 999004 - RNA, 19 nt, Homo sapiens
gaacuugauuccccauguu

SEQ ID NO: 999005 - RNA, 19 nt, Homo sapiens
gaagacugaauguguuaau

SEQ ID NO: 999006 - RNA, 19 nt, Homo sapiens
uaagaaggaccugauaugu

SEQ ID NO: 999007 - RNA, 19 nt, Homo sapiens
cuaccaauuguaugcauua

SEQ ID NO: 999008 - RNA, 19 nt, Homo sapiens
gaacaugaggguuauuuug

SEQ ID NO: 999009 - RNA, 19 nt, Homo sapiens
gagaacauagacagaguug

SEQ ID NO: 999010 - RNA, 19 nt, Homo sapiens
caacaugaugaguaaagaa

SEQ ID NO: 999011 - RNA, 19 nt, Homo sapiens
ugaauggcagcaaaucuuu

SEQ ID NO: 999012 - RNA, 19 nt, Homo sapiens
gcucggaugugcgcguuga

SEQ ID NO: 999013 - RNA, 19 nt, Homo sapiens
ggaagccgcguuugaaguc

SEQ ID NO: 999014 - RNA, 19 nt, Homo sapiens
gcacagguucauucagaug

SEQ ID NO: 999015 - RNA, 19 nt, Homo sapiens
guugaaauagucugugauu

SEQ ID NO: 999016 - RNA, 19 nt, Homo sapiens
agacugaauguguuaauga

SEQ ID NO: 999017 - RNA, 19 nt, Homo sapiens
cuacaaaucuggcauguuu

SEQ ID NO: 999018 - RNA, 19 nt, Homo sapiens
gaacuggacugucugauuc

SEQ ID NO: 999019 - RNA, 19 nt, Homo sapiens
agaaggaccugauauguaa

SEQ ID NO: 999020 - RNA, 19 nt, Homo sapiens
guauugagcuuauuguuga

SEQ ID NO: 999021 - RNA, 19 nt, Homo sapiens
guggaacgcugguuaaauu

SEQ ID NO: 999022 - RNA, 19 nt, Homo sapiens
gaauaugaauggcagcaaa

SEQ ID NO: 999023 - RNA, 19 nt, Homo sapiens
ccaugaagcugcuggcaua

SEQ ID NO: 999024 - RNA, 19 nt, Homo sapiens
guucauaucaggagauuua

SEQ ID NO: 999025 - RNA, 19 nt, Homo sapiens
ugaagaagcucuggaaaug

SEQ ID NO: 999026 - RNA, 19 nt, Homo sapiens
gaacauagacagaguugug

SEQ ID NO: 999027 - RNA, 19 nt, Homo sapiens
caacaacauuggcuccauu

SEQ ID NO: 999028 - RNA, 19 nt, Homo sapiens
cccaugaucuuguguauug

SEQ ID NO: 999029 - RNA, 19 nt, Homo sapiens
gcaccaauguugauaaacu

SEQ ID NO: 999030 - RNA, 19 nt, Homo sapiens
gagaagacugaauguguua

SEQ ID NO: 999031 - RNA, 19 nt, Homo sapiens
gcugugggauguaaauuug

SEQ ID NO: 999032 - RNA, 19 nt, Homo sapiens
ucacuugucugguugaaau

SEQ ID NO: 999033 - RNA, 19 nt, Homo sapiens
gaacaauuacuccaugaug

SEQ ID NO: 999034 - RNA, 19 nt, Homo sapiens
agaugaaccugcuggauuu

SEQ ID NO: 999035 - RNA, 19 nt, Homo sapiens
cauuaagacugauggguaa

SEQ ID NO: 999036 - RNA, 19 nt, Homo sapiens
agaauucacuugucugguu

SEQ ID NO: 999037 - RNA, 19 nt, Homo sapiens
guacuucaaucucaguuuc

SEQ ID NO: 999038 - RNA, 19 nt, Homo sapiens
aaauaaagccuguuucugu

SEQ ID NO: 999039 - RNA, 19 nt, Homo sapiens
ugagggucauguacaaaua

SEQ ID NO: 999040 - RNA, 19 nt, Homo sapiens
aaacuguacuucaaucuca

SEQ ID NO: 999041 - RNA, 19 nt, Homo sapiens
ccagcucaauacaaaguua

SEQ ID NO: 999042 - RNA, 19 nt, Homo sapiens
ggccaaaccuaccaauugu

SEQ ID NO: 999043 - RNA, 19 nt, Homo sapiens
gcaacaugaugaguaaaga

SEQ ID NO: 999044 - RNA, 19 nt, Homo sapiens
gaccauguguggacgcaaa

SEQ ID NO: 999045 - RNA, 19 nt, Homo sapiens
ugagcaccgucuuuaauuu

SEQ ID NO: 999046 - RNA, 19 nt, Homo sapiens
ggacggaagccaagccauu

SEQ ID NO: 999047 - RNA, 19 nt, Homo sapiens
cagcaccaauguugauaaa

SEQ ID NO: 999048 - RNA, 19 nt, Homo sapiens
gggcucaggugucagcauu

SEQ ID NO: 999049 - RNA, 19 nt, Homo sapiens
guacaaauauugggaugca

SEQ ID NO: 999050 - RNA, 19 nt, Homo sapiens
gaagugcauuauuucacaa

SEQ ID NO: 999051 - RNA, 19 nt, Homo sapiens
gaagcucauucaacugguu

SEQ ID NO: 999052 - RNA, 19 nt, Homo sapiens
gaacauuccuaggccuaug

SEQ ID NO: 999053 - RNA, 19 nt, Homo sapiens
uaauacugcuuaugggaaa

SEQ ID NO: 999054 - RNA, 19 nt, Homo sapiens
aauaaagccuguuucuguu

SEQ ID NO: 999055 - RNA, 19 nt, Homo sapiens
cccaguagauuaauuguuc

SEQ ID NO: 999056 - RNA, 19 nt, Homo sapiens
agagaagacugaauguguu

SEQ ID NO: 999057 - RNA, 19 nt, Homo sapiens
gacugaauguguuaaugaa

SEQ ID NO: 999058 - RNA, 19 nt, Homo sapiens
ccaauuguaugcauuaacu

SEQ ID NO: 999059 - RNA, 19 nt, Homo sapiens
agacagaguuguguuuguu

SEQ ID NO: 999060 - RNA, 19 nt, Homo sapiens
ugaagagcauccggaagua

SEQ ID NO: 999061 - RNA, 19 nt, Homo sapiens
gaacgcugguuaaauuggu

SEQ ID NO: 999062 - RNA, 19 nt, Homo sapiens
ggaaaagccucccaguaga

SEQ ID NO: 999063 - RNA, 19 nt, Homo sapiens
gugauuaaauguccucauc

SEQ ID NO: 999064 - RNA, 19 nt, Homo sapiens
gacggaagccaagccauua

SEQ ID NO: 999065 - RNA, 19 nt, Homo sapiens
gcaucaagcuuuggcaaca

SEQ ID NO: 999066 - RNA, 19 nt, Homo sapiens
uugaaggacagaacaauua

SEQ ID NO: 999067 - RNA, 19 nt, Homo sapiens
gaucuuguguauugagcuu

SEQ ID NO: 999068 - RNA, 19 nt, Homo sapiens
auggguaacuuucaaauga

SEQ ID NO: 999069 - RNA, 19 nt, Homo sapiens
gaaccugcuggauuuguaa

SEQ ID NO: 999070 - RNA, 19 nt, Homo sapiens
ugaaccugcuggauuugua

SEQ ID NO: 999071 - RNA, 19 nt, Homo sapiens
uacccuauguugcugguua

SEQ ID NO: 999072 - RNA, 19 nt, Homo sapiens
gcaaagggaaccugcacuu

SEQ ID NO: 999073 - RNA, 19 nt, Homo sapiens
cagaacaauuacuccauga

SEQ ID NO: 999074 - RNA, 19 nt, Homo sapiens
aagaaggaccugauaugua

SEQ ID NO: 999075 - RNA, 19 nt, Homo sapiens
gaacuucucuagccuucac

SEQ ID NO: 999076 - RNA, 19 nt, Homo sapiens
guugaggugucagauagua

SEQ ID NO: 999077 - RNA, 19 nt, Homo sapiens
ggguugaggugucagauag

SEQ ID NO: 999078 - RNA, 19 nt, Homo sapiens
cagaugaaccugcuggauu

SEQ ID NO: 999079 - RNA, 19 nt, Homo sapiens
gagauuccaucagcaagga

SEQ ID NO: 999080 - RNA, 19 nt, Homo sapiens
uugauaaacuggugaagga

SEQ ID NO: 999081 - RNA, 19 nt, Homo sapiens
ucauucaacugguuacuuc

SEQ ID NO: 999082 - RNA, 19 nt, Homo sapiens
ugacuucuaauacugcuua

SEQ ID NO: 999083 - RNA, 19 nt, Homo sapiens
aacaauuacuccaugauga

SEQ ID NO: 999084 - RNA, 19 nt, Homo sapiens
gcuagguuauauuaaguug

SEQ ID NO: 999085 - RNA, 19 nt, Homo sapiens
cugaccagcucaauacaaa

SEQ ID NO: 999086 - RNA, 19 nt, Homo sapiens
caugaugaaucuuccuuuc

SEQ ID NO: 999087 - RNA, 19 nt, Homo sapiens
gauuaaauguccucaucca

SEQ ID NO: 999088 - RNA, 19 nt, Homo sapiens
ggaugugcgcguugaauga

SEQ ID NO: 999089 - RNA, 19 nt, Homo sapiens
gcuguagcaucaagcuuug

SEQ ID NO: 999090 - RNA, 19 nt, Homo sapiens
ucccacaaauccugaauug

SEQ ID NO: 999091 - RNA, 19 nt, Homo sapiens
aaugguaguuuguaaagug

SEQ ID NO: 999092 - RNA, 19 nt, Homo sapiens
gugaagagaagacugaaug

SEQ ID NO: 999093 - RNA, 19 nt, Homo sapiens
uguaagcgcuggucauuuu

SEQ ID NO: 999094 - RNA, 19 nt, Homo sapiens
ccaaaccuaccaauuguau

SEQ ID NO: 999095 - RNA, 19 nt, Homo sapiens
aggagacuaugaacgauuu

SEQ ID NO: 999096 - RNA, 19 nt, Homo sapiens
gccagaauguuacuauuuu

SEQ ID NO: 999097 - RNA, 19 nt, Homo sapiens
uccuaucgcuuauaaaugu

SEQ ID NO: 999098 - RNA, 19 nt, Homo sapiens
gaagagaagacugaaugug

SEQ ID NO: 999099 - RNA, 19 nt, Homo sapiens
guaauuacucuaggagauu

SEQ ID NO: 999100 - RNA, 19 nt, Homo sapiens
ggaaacagccucccaaaag

SEQ ID NO: 999101 - RNA, 19 nt, Homo sapiens
gagcaccgucuuuaauuuc

SEQ ID NO: 999102 - RNA, 19 nt, Homo sapiens
ccucauccaugcacagaau

SEQ ID NO: 999103 - RNA, 19 nt, Homo sapiens
gaagacugaauguguuaau

SEQ ID NO: 999104 - RNA, 19 nt, Homo sapiens
uaagaaggaccugauaugu

SEQ ID NO: 999105 - RNA, 19 nt, Homo sapiens
cuaccaauuguaugcauua

SEQ ID NO: 999106 - RNA, 19 nt, Homo sapiens
ugugggauguaaauuugua

SEQ ID NO: 999107 - RNA, 19 nt, Homo sapiens
gaacaugaggguuauuuug

SEQ ID NO: 999108 - RNA, 19 nt, Homo sapiens
gagaacauagacagaguug

SEQ ID NO: 999109 - RNA, 19 nt, Homo sapiens
caacaugaugaguaaagaa

SEQ ID NO: 999110 - RNA, 19 nt, Homo sapiens
ugaauggcagcaaaucuuu

SEQ ID NO: 999111 - RNA, 19 nt, Homo sapiens
gcucggaugugcgcguuga

SEQ ID NO: 999112 - RNA, 19 nt, Homo sapiens
gcacagguucauucagaug

SEQ ID NO: 999113 - RNA, 19 nt, Homo sapiens
gaagagcauccggaaguau

SEQ ID NO: 999114 - RNA, 19 nt, Homo sapiens
guugaaauagucugugauu

SEQ ID NO: 999115 - RNA, 19 nt, Homo sapiens
agacugaauguguuaauga

SEQ ID NO: 999116 - RNA, 19 nt, Homo sapiens
ggaggagacuaugaacgau

SEQ ID NO: 999117 - RNA, 19 nt, Homo sapiens
gaaaagagcagacuuauua

SEQ ID NO: 999118 - RNA, 19 nt, Homo sapiens
ggaaugagcaucucucuga

SEQ ID NO: 999119 - RNA, 19 nt, Homo sapiens
gagaaagccuccaagcaaa

SEQ ID NO: 999120 - RNA, 19 nt, Homo sapiens
ggacacgacugacuauguu

SEQ ID NO: 999121 - RNA, 19 nt, Homo sapiens
ucgcagagcuugucacauu

SEQ ID NO: 999122 - RNA, 19 nt, Homo sapiens
uaagaaagacguaagacua

SEQ ID NO: 999123 - RNA, 19 nt, Homo sapiens
gaaguucugcgcucaauga

SEQ ID NO: 999124 - RNA, 19 nt, Homo sapiens
ucaccuacguggucaagua

SEQ ID NO: 999125 - RNA, 19 nt, Homo sapiens
gacaguggcucgccugcua

SEQ ID NO: 999126 - RNA, 19 nt, Homo sapiens
gacagagucuuugacagua

SEQ ID NO: 999127 - RNA, 19 nt, Homo sapiens
gcucagaccacccauacua

SEQ ID NO: 999128 - RNA, 19 nt, Homo sapiens
ggacagagucuuugacagu

SEQ ID NO: 999129 - RNA, 19 nt, Homo sapiens
ggaagacacuuaggagaca

SEQ ID NO: 999130 - RNA, 19 nt, Homo sapiens
uauaaccgcuucaggaaug

SEQ ID NO: 999131 - RNA, 19 nt, Homo sapiens
gaccuggaguggacuagaa

SEQ ID NO: 999132 - RNA, 19 nt, Homo sapiens
gaaagacguaagacuaaug

SEQ ID NO: 999133 - RNA, 19 nt, Homo sapiens
guacaaauuaucccucuau

SEQ ID NO: 999134 - RNA, 19 nt, Homo sapiens
guacauaccuauacauccu

SEQ ID NO: 999135 - RNA, 19 nt, Homo sapiens
ccaccuacgucaacacuca

SEQ ID NO: 999136 - RNA, 19 nt, Homo sapiens
guucugaauuucucauaug

SEQ ID NO: 999137 - RNA, 19 nt, Homo sapiens
gaaagagcaaccuccaguu

SEQ ID NO: 999138 - RNA, 19 nt, Homo sapiens
gagcuccgguuuaagcaau

SEQ ID NO: 999139 - RNA, 19 nt, Homo sapiens
ugacuaaggacccuguuaa

SEQ ID NO: 999140 - RNA, 19 nt, Homo sapiens
ggcgaagacuggcagcaaa

SEQ ID NO: 999141 - RNA, 19 nt, Homo sapiens
ccuuugagcuccgguuuaa

SEQ ID NO: 999142 - RNA, 19 nt, Homo sapiens
aagaaagacguaagacuaa

SEQ ID NO: 999143 - RNA, 19 nt, Homo sapiens
aaagagcaaccuccaguuu

SEQ ID NO: 999144 - RNA, 19 nt, Homo sapiens
agagaaagccuccaagcaa

SEQ ID NO: 999145 - RNA, 19 nt, Homo sapiens
ucucuugacuucaguacaa

SEQ ID NO: 999146 - RNA, 19 nt, Homo sapiens
aaugaggucucuugacuuc

SEQ ID NO: 999147 - RNA, 19 nt, Homo sapiens
gagagcagcccaaggaaag

SEQ ID NO: 999148 - RNA, 19 nt, Homo sapiens
aaacuugguucugaauuuc

SEQ ID NO: 999149 - RNA, 19 nt, Homo sapiens
uugcauaugugacuaagga

SEQ ID NO: 999150 - RNA, 19 nt, Homo sapiens
gaacuccggacuccaaaca

SEQ ID NO: 999151 - RNA, 19 nt, Homo sapiens
ucauaaacuugguucugaa

SEQ ID NO: 999152 - RNA, 19 nt, Homo sapiens
cagaggcaacuaugacuuu

SEQ ID NO: 999153 - RNA, 19 nt, Homo sapiens
ugaagaugcucucaagaac

SEQ ID NO: 999154 - RNA, 19 nt, Homo sapiens
ggaaugacucggugacauc

SEQ ID NO: 999155 - RNA, 19 nt, Homo sapiens
caucaaccaccaccuagaa

SEQ ID NO: 999156 - RNA, 19 nt, Homo sapiens
ccaagaugcuggaggaacu

SEQ ID NO: 999157 - RNA, 19 nt, Homo sapiens
caugaaaccuuuugaagau

SEQ ID NO: 999158 - RNA, 19 nt, Homo sapiens
gcacgauccagacaaagga

SEQ ID NO: 999159 - RNA, 19 nt, Homo sapiens
ucacgggcaugcacaaugg

SEQ ID NO: 999160 - RNA, 19 nt, Homo sapiens
cuaauguucugugcuguau

SEQ ID NO: 999161 - RNA, 19 nt, Homo sapiens
gagaggaagcagugacaug

SEQ ID NO: 999162 - RNA, 19 nt, Homo sapiens
aaggagagaugagcaggaa

SEQ ID NO: 999163 - RNA, 19 nt, Homo sapiens
ucuuugacaugaaaccuuu

SEQ ID NO: 999164 - RNA, 19 nt, Homo sapiens
ggacuccaaacagaucaua

SEQ ID NO: 999165 - RNA, 19 nt, Homo sapiens
gagaagcacccaccuacgu

SEQ ID NO: 999166 - RNA, 19 nt, Homo sapiens
gguucugaauuucucauau

SEQ ID NO: 999167 - RNA, 19 nt, Homo sapiens
agaccucuuugacaugaaa

SEQ ID NO: 999168 - RNA, 19 nt, Homo sapiens
aaacagaucauagcgaauc

SEQ ID NO: 999169 - RNA, 19 nt, Homo sapiens
guacaagaacacaaauuac

SEQ ID NO: 999170 - RNA, 19 nt, Homo sapiens
ugacuucaguacaagaaca

SEQ ID NO: 999171 - RNA, 19 nt, Homo sapiens
cauagcgaaucaccacaug

SEQ ID NO: 999172 - RNA, 19 nt, Homo sapiens
agaaagacguaagacuaau

SEQ ID NO: 999173 - RNA, 19 nt, Homo sapiens
cuaaggacccuguuaaucg

SEQ ID NO: 999174 - RNA, 19 nt, Homo sapiens
aauguucugugcuguaugu

SEQ ID NO: 999175 - RNA, 19 nt, Homo sapiens
uucauaaacuugguucuga

SEQ ID NO: 999176 - RNA, 19 nt, Homo sapiens
gaaggcacgauccagacaa

SEQ ID NO: 999177 - RNA, 19 nt, Homo sapiens
gcacccaccuacgucaaca

SEQ ID NO: 999178 - RNA, 19 nt, Homo sapiens
cagcccaguuugcaggaaa

SEQ ID NO: 999179 - RNA, 19 nt, Homo sapiens
cgucaacacucagcagauc

SEQ ID NO: 999180 - RNA, 19 nt, Homo sapiens
acaguguccuaccaagauu

SEQ ID NO: 999181 - RNA, 19 nt, Homo sapiens
guucugugcuguauguuuu

SEQ ID NO: 999182 - RNA, 19 nt, Homo sapiens
aagaugcucucaagaacca

SEQ ID NO: 999183 - RNA, 19 nt, Homo sapiens
cgcagagcuugucacauuu

SEQ ID NO: 999184 - RNA, 19 nt, Homo sapiens
agacguaagacuaauguuc

SEQ ID NO: 999185 - RNA, 19 nt, Homo sapiens
acagagucuuugacaguau

SEQ ID NO: 999186 - RNA, 19 nt, Homo sapiens
aaggcacgauccagacaaa

SEQ ID NO: 999187 - RNA, 19 nt, Homo sapiens
ggaaaagagcagacuuauu

SEQ ID NO: 999188 - RNA, 19 nt, Homo sapiens
gaccacccauacuacaaca

SEQ ID NO: 999189 - RNA, 19 nt, Homo sapiens
gacguaagacuaauguucu

SEQ ID NO: 999190 - RNA, 19 nt, Homo sapiens
gcaucucucugaccaucuc

SEQ ID NO: 999191 - RNA, 19 nt, Homo sapiens
gggcuuucuugauacuaga

SEQ ID NO: 999192 - RNA, 19 nt, Homo sapiens
gauucccgcucuccaugau

SEQ ID NO: 999193 - RNA, 19 nt, Homo sapiens
gacuaaggacccuguuaau

SEQ ID NO: 999194 - RNA, 19 nt, Homo sapiens
gugacuaaggacccuguua

SEQ ID NO: 999195 - RNA, 19 nt, Homo sapiens
ucaaaagcuucaaaaggaa

SEQ ID NO: 999196 - RNA, 19 nt, Homo sapiens
uucaaaagcuucaaaagga

SEQ ID NO: 999197 - RNA, 19 nt, Homo sapiens
ccucaucaaccaccaccua

SEQ ID NO: 999198 - RNA, 19 nt, Homo sapiens
gaacugcaagccgagacuu

SEQ ID NO: 999199 - RNA, 19 nt, Homo sapiens
ugagagcagcccaaggaaa

SEQ ID NO: 999200 - RNA, 19 nt, Homo sapiens
ccagggaagacacuuagga

SEQ ID NO: 999201 - RNA, 19 nt, Homo sapiens
ugaggucucuugacuucag

SEQ ID NO: 999202 - RNA, 19 nt, Homo sapiens
uggcagcaaacaccuuuaa

SEQ ID NO: 999203 - RNA, 19 nt, Homo sapiens
acaacagcaucccaagcaa

SEQ ID NO: 999204 - RNA, 19 nt, Homo sapiens
gacuaagaaagacguaaga

SEQ ID NO: 999205 - RNA, 19 nt, Homo sapiens
cugaauuucucauaugcau

SEQ ID NO: 999206 - RNA, 19 nt, Homo sapiens
cagagucuuugacaguauc

SEQ ID NO: 999207 - RNA, 19 nt, Homo sapiens
ccgcugugcuggcuuuuaa

SEQ ID NO: 999208 - RNA, 19 nt, Homo sapiens
uuaccagggaagacacuua

SEQ ID NO: 999209 - RNA, 19 nt, Homo sapiens
ugacacagcccaguuugca

SEQ ID NO: 999210 - RNA, 19 nt, Homo sapiens
caauauuuacaguguccua

SEQ ID NO: 999211 - RNA, 19 nt, Homo sapiens
aaagacguaagacuaaugu

SEQ ID NO: 999212 - RNA, 19 nt, Homo sapiens
caggaaaagagcagacuua

SEQ ID NO: 999213 - RNA, 19 nt, Homo sapiens
aagagcaaccuccaguuug

SEQ ID NO: 999214 - RNA, 19 nt, Homo sapiens
ccuacguggucaaguacuu

SEQ ID NO: 999215 - RNA, 19 nt, Homo sapiens
uauuaaagguguacauacc

SEQ ID NO: 999216 - RNA, 19 nt, Homo sapiens
ucagccaccucaucaacca

SEQ ID NO: 999217 - RNA, 19 nt, Homo sapiens
gaacauggauugaaugaaa

SEQ ID NO: 999218 - RNA, 19 nt, Homo sapiens
gaagaaagguauuacauag

SEQ ID NO: 999219 - RNA, 19 nt, Homo sapiens
gagcacaccuaagcaauua

SEQ ID NO: 999220 - RNA, 19 nt, Homo sapiens
caucagagguggugucuuu

SEQ ID NO: 999221 - RNA, 19 nt, Homo sapiens
caucagaccuuccuuaaga

SEQ ID NO: 999222 - RNA, 19 nt, Homo sapiens
gcagaucuguuacgagaaa

SEQ ID NO: 999223 - RNA, 19 nt, Homo sapiens
gaagagugguuaugccauu

SEQ ID NO: 999224 - RNA, 19 nt, Homo sapiens
gaagagcaguugcgaguuc

SEQ ID NO: 999225 - RNA, 19 nt, Homo sapiens
caucaaaccagauuagaua

SEQ ID NO: 999226 - RNA, 19 nt, Homo sapiens
gcacagaucaaacagcuuu

SEQ ID NO: 999227 - RNA, 19 nt, Homo sapiens
ggccuuagccauuugauua

SEQ ID NO: 999228 - RNA, 19 nt, Homo sapiens
ggaggaaaccagacccuua

SEQ ID NO: 999229 - RNA, 19 nt, Homo sapiens
ggauuuggaggauuuaaua

SEQ ID NO: 999230 - RNA, 19 nt, Homo sapiens
gcacauaacagaacaaacu

SEQ ID NO: 999231 - RNA, 19 nt, Homo sapiens
ccaaccagcugauaaauac

SEQ ID NO: 999232 - RNA, 19 nt, Homo sapiens
gguguaacccuuucuauga

SEQ ID NO: 999233 - RNA, 19 nt, Homo sapiens
gaaugaaaccgaccacaug

SEQ ID NO: 999234 - RNA, 19 nt, Homo sapiens
caaaccagauuagauauca

SEQ ID NO: 999235 - RNA, 19 nt, Homo sapiens
gaacaggccaagguagaua

SEQ ID NO: 999236 - RNA, 19 nt, Homo sapiens
gaacuggacugggauuugg

SEQ ID NO: 999237 - RNA, 19 nt, Homo sapiens
ggucgaacauggauugaau

SEQ ID NO: 999238 - RNA, 19 nt, Homo sapiens
gaagaugggcuagugguuu

SEQ ID NO: 999239 - RNA, 19 nt, Homo sapiens
gagguggugucuuuaguug

SEQ ID NO: 999240 - RNA, 19 nt, Homo sapiens
guauaaauguacaccaguu

SEQ ID NO: 999241 - RNA, 19 nt, Homo sapiens
gaucugaagaaagguauua

SEQ ID NO: 999242 - RNA, 19 nt, Homo sapiens
gaucagacagaaguuguua

SEQ ID NO: 999243 - RNA, 19 nt, Homo sapiens
gaaagguauuacauagaug

SEQ ID NO: 999244 - RNA, 19 nt, Homo sapiens
ucaaacagcuuuuacagaa

SEQ ID NO: 999245 - RNA, 19 nt, Homo sapiens
gauuuaaggcaguagguua

SEQ ID NO: 999246 - RNA, 19 nt, Homo sapiens
gcagcaaacuacauuaggu

SEQ ID NO: 999247 - RNA, 19 nt, Homo sapiens
gaaaccagacccuuacugu

SEQ ID NO: 999248 - RNA, 19 nt, Homo sapiens
ggaaggccuuagccauuug

SEQ ID NO: 999249 - RNA, 19 nt, Homo sapiens
uaaaugcaccuacucaguu

SEQ ID NO: 999250 - RNA, 19 nt, Homo sapiens
guuaauuccuguaccaaug

SEQ ID NO: 999251 - RNA, 19 nt, Homo sapiens
uagauaacccugauucuga

SEQ ID NO: 999252 - RNA, 19 nt, Homo sapiens
uguaaagguuugugaaaug

SEQ ID NO: 999253 - RNA, 19 nt, Homo sapiens
gaugagagagaugcuauuu

SEQ ID NO: 999254 - RNA, 19 nt, Homo sapiens
guacucagaacaaagguuu

SEQ ID NO: 999255 - RNA, 19 nt, Homo sapiens
gaguucagcuggauacgau

SEQ ID NO: 999256 - RNA, 19 nt, Homo sapiens
guagaaucauugcauaaag

SEQ ID NO: 999257 - RNA, 19 nt, Homo sapiens
ggacugggauuuggaggau

SEQ ID NO: 999258 - RNA, 19 nt, Homo sapiens
agaccuuccuuaagaauga

SEQ ID NO: 999259 - RNA, 19 nt, Homo sapiens
cauuaaagacgaucuagaa

SEQ ID NO: 999260 - RNA, 19 nt, Homo sapiens
uuacuuggcuguuggagau

SEQ ID NO: 999261 - RNA, 19 nt, Homo sapiens
caagguagauaacccugau

SEQ ID NO: 999262 - RNA, 19 nt, Homo sapiens
uacauuagguggucucuuc

SEQ ID NO: 999263 - RNA, 19 nt, Homo sapiens
gaaaugcaucuucuuacug

SEQ ID NO: 999264 - RNA, 19 nt, Homo sapiens
auauaaagcuggucgaaca

SEQ ID NO: 999265 - RNA, 19 nt, Homo sapiens
gauauuagugagcuacaaa

SEQ ID NO: 999266 - RNA, 19 nt, Homo sapiens
cgacauggccuucaauuuu

SEQ ID NO: 999267 - RNA, 19 nt, Homo sapiens
ugagagagaugcuauuuug

SEQ ID NO: 999268 - RNA, 19 nt, Homo sapiens
gaaugaaaccauccacauc

SEQ ID NO: 999269 - RNA, 19 nt, Homo sapiens
ccaaaugguacuucaagaa

SEQ ID NO: 999270 - RNA, 19 nt, Homo sapiens
gggaacuaguacugguuua

SEQ ID NO: 999271 - RNA, 19 nt, Homo sapiens
uauaauuacuuggcuguug

SEQ ID NO: 999272 - RNA, 19 nt, Homo sapiens
ggaacucggugaucugacu

SEQ ID NO: 999273 - RNA, 19 nt, Homo sapiens
ucaagaagaguuccagcua

SEQ ID NO: 999274 - RNA, 19 nt, Homo sapiens
agaggaaacucauggaucu

SEQ ID NO: 999275 - RNA, 19 nt, Homo sapiens
caacuugguguaacccuuu

SEQ ID NO: 999276 - RNA, 19 nt, Homo sapiens
gguagaaucauugcauaaa

SEQ ID NO: 999277 - RNA, 19 nt, Homo sapiens
ugagaaguuuacugacaaa

SEQ ID NO: 999278 - RNA, 19 nt, Homo sapiens
ugaaaugcaucuucuuacu

SEQ ID NO: 999279 - RNA, 19 nt, Homo sapiens
gggacaacaucuacaacug

SEQ ID NO: 999280 - RNA, 19 nt, Homo sapiens
ugugaaaugcaucuucuua

SEQ ID NO: 999281 - RNA, 19 nt, Homo sapiens
gaacuuuacagguccuaau

SEQ ID NO: 999282 - RNA, 19 nt, Homo sapiens
guugagcguucgccaaaug

SEQ ID NO: 999283 - RNA, 19 nt, Homo sapiens
caggaaggccuuagccauu

SEQ ID NO: 999284 - RNA, 19 nt, Homo sapiens
ccgacuaaaugaauugaug

SEQ ID NO: 999285 - RNA, 19 nt, Homo sapiens
agauaacccugauucugaa

SEQ ID NO: 999286 - RNA, 19 nt, Homo sapiens
ucagacagaaguuguuauu

SEQ ID NO: 999287 - RNA, 19 nt, Homo sapiens
aggaaggccuuagccauuu

SEQ ID NO: 999288 - RNA, 19 nt, Homo sapiens
aaaucaggaugcagaauca

SEQ ID NO: 999289 - RNA, 19 nt, Homo sapiens
aacaggaaauucaaaggaa

SEQ ID NO: 999290 - RNA, 19 nt, Homo sapiens
aaacauugccagaugauca

SEQ ID NO: 999291 - RNA, 19 nt, Homo sapiens
gagaugagagagaugcuau

SEQ ID NO: 999292 - RNA, 19 nt, Homo sapiens
guguaaagguuugugaaau

SEQ ID NO: 999293 - RNA, 19 nt, Homo sapiens
cgagaaaucaagcagcauu

SEQ ID NO: 999294 - RNA, 19 nt, Homo sapiens
guucaagggccgacuaaau

SEQ ID NO: 999295 - RNA, 19 nt, Homo sapiens
gaacuaaaugcaccuacuc

SEQ ID NO: 999296 - RNA, 19 nt, Homo sapiens
gccaaaugguacuucaaga

SEQ ID NO: 999297 - RNA, 19 nt, Homo sapiens
gcagcagcaaacuacauua

SEQ ID NO: 999298 - RNA, 19 nt, Homo sapiens
guaaagguuugugaaaugc

SEQ ID NO: 999299 - RNA, 19 nt, Homo sapiens
gacauggccuucaauuuug

SEQ ID NO: 999300 - RNA, 19 nt, Homo sapiens
caaaucaggaugcagaauc

SEQ ID NO: 999301 - RNA, 19 nt, Homo sapiens
aaacaggaaauucaaagga

SEQ ID NO: 999302 - RNA, 19 nt, Homo sapiens
guaacccuuucuaugacua

SEQ ID NO: 999303 - RNA, 19 nt, Homo sapiens
auaguugcaugcccaguaa

SEQ ID NO: 999304 - RNA, 19 nt, Homo sapiens
gcaguagguuauaguugca

SEQ ID NO: 999305 - RNA, 19 nt, Homo sapiens
uagguggucucuucaguca

SEQ ID NO: 999306 - RNA, 19 nt, Homo sapiens
ucaggaugcagaaucauuu

SEQ ID NO: 999307 - RNA, 19 nt, Homo sapiens
aagaucagaugacuaagca

SEQ ID NO: 999308 - RNA, 19 nt, Homo sapiens
ggauuugggacaacaucua

SEQ ID NO: 999309 - RNA, 19 nt, Homo sapiens
aaaccagacccuuacugua

SEQ ID NO: 999310 - RNA, 19 nt, Homo sapiens
gcgacauggccuucaauuu

SEQ ID NO: 999311 - RNA, 19 nt, Homo sapiens
ggaacuggacugggauuug

SEQ ID NO: 999312 - RNA, 19 nt, Homo sapiens
gcacaacaacgggaacuag

SEQ ID NO: 999313 - RNA, 19 nt, Homo sapiens
caacaacaggaaggccuua

SEQ ID NO: 999314 - RNA, 19 nt, Homo sapiens
gggaacaggccaagguaga

SEQ ID NO: 999315 - RNA, 19 nt, Homo sapiens
aagaagaguuccagcuaca

SEQ ID NO: 999316 - RNA, 19 nt, Homo sapiens
uuaaagacgaucuagaaga

SEQ ID NO: 999317 - RNA, 19 nt, Homo sapiens
gaacauggcugugaguuug

SEQ ID NO: 999318 - RNA, 19 nt, Homo sapiens
gcacacaacugggagauga

SEQ ID NO: 999319 - RNA, 19 nt, Homo sapiens
ggacggcgcuccucaucuu

SEQ ID NO: 999320 - RNA, 19 nt, Homo sapiens
ggaguuaccucgucuuucu

SEQ ID NO: 999321 - RNA, 19 nt, Homo sapiens
ggaggaaggcuacuauuau

SEQ ID NO: 999322 - RNA, 19 nt, Homo sapiens
cgaaagccgucucuucuau

SEQ ID NO: 999323 - RNA, 19 nt, Homo sapiens
gaaggaaaucuccaaagaa

SEQ ID NO: 999324 - RNA, 19 nt, Homo sapiens
agaaggaaaucuccaaaga

SEQ ID NO: 999325 - RNA, 19 nt, Homo sapiens
gaggaaggcuacuauuauc

SEQ ID NO: 999326 - RNA, 19 nt, Homo sapiens
ccaaggccuuccaguauuu

SEQ ID NO: 999327 - RNA, 19 nt, Homo sapiens
gaagagaacauggcuguga

SEQ ID NO: 999328 - RNA, 19 nt, Homo sapiens
ggagaugaauuaccaagag

SEQ ID NO: 999329 - RNA, 19 nt, Homo sapiens
acauggagcccuucuauuu

SEQ ID NO: 999330 - RNA, 19 nt, Homo sapiens
ggauggaacuuguuugacu

SEQ ID NO: 999331 - RNA, 19 nt, Homo sapiens
caacauggagcccuucuau

SEQ ID NO: 999332 - RNA, 19 nt, Homo sapiens
gaccugagccugaagaugu

SEQ ID NO: 999333 - RNA, 19 nt, Homo sapiens
gaaggcuacuauuaucuca

SEQ ID NO: 999334 - RNA, 19 nt, Homo sapiens
gcugaaaggugggaacuuc

SEQ ID NO: 999335 - RNA, 19 nt, Homo sapiens
gcacugguuugaugagcuu

SEQ ID NO: 999336 - RNA, 19 nt, Homo sapiens
cuacgaaguugcugcuuug

SEQ ID NO: 999337 - RNA, 19 nt, Homo sapiens
ggaaaucuccaaagaagag

SEQ ID NO: 999338 - RNA, 19 nt, Homo sapiens
agagagcacugguuugaug

SEQ ID NO: 999339 - RNA, 19 nt, Homo sapiens
cgaaguugcugcuuugaag

SEQ ID NO: 999340 - RNA, 19 nt, Homo sapiens
gucaacaacugguacauca

SEQ ID NO: 999341 - RNA, 19 nt, Homo sapiens
gauggaacuuguuugacuu

SEQ ID NO: 999342 - RNA, 19 nt, Homo sapiens
ggguggagcuguuccugaa

SEQ ID NO: 999343 - RNA, 19 nt, Homo sapiens
cauccucgguuucuacuug

SEQ ID NO: 999344 - RNA, 19 nt, Homo sapiens
ggagacauuuaugcugaaa

SEQ ID NO: 999345 - RNA, 19 nt, Homo sapiens
gaaguggaaggccaagaaa

SEQ ID NO: 999346 - RNA, 19 nt, Homo sapiens
aaggaaaucuccaaagaag

SEQ ID NO: 999347 - RNA, 19 nt, Homo sapiens
acaacugggagaugaauua

SEQ ID NO: 999348 - RNA, 19 nt, Homo sapiens
gacgaucauugucgccuuu

SEQ ID NO: 999349 - RNA, 19 nt, Homo sapiens
gaaccaggacucggaaguu

SEQ ID NO: 999350 - RNA, 19 nt, Homo sapiens
uggaggaaggcuacuauua

SEQ ID NO: 999351 - RNA, 19 nt, Homo sapiens
gcaacgugcuggacaccau

SEQ ID NO: 999352 - RNA, 19 nt, Homo sapiens
guaagaugccucuaaugga

SEQ ID NO: 999353 - RNA, 19 nt, Homo sapiens
uaccucgucuuucuaacua

SEQ ID NO: 999354 - RNA, 19 nt, Homo sapiens
gcgcguaagaugccucuaa

SEQ ID NO: 999355 - RNA, 19 nt, Homo sapiens
cugcugagguuguuuaagu

SEQ ID NO: 999356 - RNA, 19 nt, Homo sapiens
caacauccucaacagcuuu

SEQ ID NO: 999357 - RNA, 19 nt, Homo sapiens
gagaaacgcaaguucaagu

SEQ ID NO: 999358 - RNA, 19 nt, Homo sapiens
gaaagccgucucuucuaug

SEQ ID NO: 999359 - RNA, 19 nt, Homo sapiens
gagcagcagcgacaacuca

SEQ ID NO: 999360 - RNA, 19 nt, Homo sapiens
gguauuaauauccuuguga

SEQ ID NO: 999361 - RNA, 19 nt, Homo sapiens
guucaagucuuugcuacug

SEQ ID NO: 999362 - RNA, 19 nt, Homo sapiens
aaacgcaaguucaagucuu

SEQ ID NO: 999363 - RNA, 19 nt, Homo sapiens
ccaucgagcuguauuucau

SEQ ID NO: 999364 - RNA, 19 nt, Homo sapiens
gcucaaaccagagacuauu

SEQ ID NO: 999365 - RNA, 19 nt, Homo sapiens
cuccucaucuucaaaggua

SEQ ID NO: 999366 - RNA, 19 nt, Homo sapiens
gccagggagcgcuaucuua

SEQ ID NO: 999367 - RNA, 19 nt, Homo sapiens
caacaacugguacaucauc

SEQ ID NO: 999368 - RNA, 19 nt, Homo sapiens
guccaaggccuuccaguau

SEQ ID NO: 999369 - RNA, 19 nt, Homo sapiens
ucuacgaaguugcugcuuu

SEQ ID NO: 999370 - RNA, 19 nt, Homo sapiens
cgagcuguauuucaucaug

SEQ ID NO: 999371 - RNA, 19 nt, Homo sapiens
gcgagaacaacgacaaguu

SEQ ID NO: 999372 - RNA, 19 nt, Homo sapiens
gagagauaccagcaacauu

SEQ ID NO: 999373 - RNA, 19 nt, Homo sapiens
gaacuacagccgcaagaac

SEQ ID NO: 999374 - RNA, 19 nt, Homo sapiens
agagauaccagcaacauuc

SEQ ID NO: 999375 - RNA, 19 nt, Homo sapiens
gaaggcgucaccucucaga

SEQ ID NO: 999376 - RNA, 19 nt, Homo sapiens
gaaaggugggaacuucuuc

SEQ ID NO: 999377 - RNA, 19 nt, Homo sapiens
uccaaggccuuccaguauu

SEQ ID NO: 999378 - RNA, 19 nt, Homo sapiens
uuaauauccuugugaaguc

SEQ ID NO: 999379 - RNA, 19 nt, Homo sapiens
uacgauaucuacgaaguug

SEQ ID NO: 999380 - RNA, 19 nt, Homo sapiens
caaguucaagucuuugcua

SEQ ID NO: 999381 - RNA, 19 nt, Homo sapiens
ucucuucuaugcaauaaca

SEQ ID NO: 999382 - RNA, 19 nt, Homo sapiens
caacugguacaucaucaug

SEQ ID NO: 999383 - RNA, 19 nt, Homo sapiens
ugagguuguuuaaguugaa

SEQ ID NO: 999384 - RNA, 19 nt, Homo sapiens
acagagagcacugguuuga

SEQ ID NO: 999385 - RNA, 19 nt, Homo sapiens
gcgaaccgcuauccagcau

SEQ ID NO: 999386 - RNA, 19 nt, Homo sapiens
cagcaucgucagucuguuu

SEQ ID NO: 999387 - RNA, 19 nt, Homo sapiens
ggagcuguuugcccugaug

SEQ ID NO: 999388 - RNA, 19 nt, Homo sapiens
ggagagauaccagcaacau

SEQ ID NO: 999389 - RNA, 19 nt, Homo sapiens
ugaaguggaaggccaagaa

SEQ ID NO: 999390 - RNA, 19 nt, Homo sapiens
uguuugagcucacaguugu

SEQ ID NO: 999391 - RNA, 19 nt, Homo sapiens
agacauuuaugcugaaagg

SEQ ID NO: 999392 - RNA, 19 nt, Homo sapiens
cugcugcuguucuucauga

SEQ ID NO: 999393 - RNA, 19 nt, Homo sapiens
ccaagaggcagcaaucuac

SEQ ID NO: 999394 - RNA, 19 nt, Homo sapiens
ggaaggcuacuauuaucuc

SEQ ID NO: 999395 - RNA, 19 nt, Homo sapiens
cguaagaugccucuaaugg

SEQ ID NO: 999396 - RNA, 19 nt, Homo sapiens
aacgcaaguucaagucuuu

SEQ ID NO: 999397 - RNA, 19 nt, Homo sapiens
cagccaauuucccagaugu

SEQ ID NO: 999398 - RNA, 19 nt, Homo sapiens
gaucauugucgccuuuauc

SEQ ID NO: 999399 - RNA, 19 nt, Homo sapiens
ucacccugcucaucuuuua

SEQ ID NO: 999400 - RNA, 19 nt, Homo sapiens
gagagcacugguuugauga

SEQ ID NO: 999401 - RNA, 19 nt, Homo sapiens
gaaacgcaaguucaagucu

SEQ ID NO: 999402 - RNA, 19 nt, Homo sapiens
aaccaggacucggaaguug

SEQ ID NO: 999403 - RNA, 19 nt, Homo sapiens
uggaaggcgucaccucuca

SEQ ID NO: 999404 - RNA, 19 nt, Homo sapiens
ggaacuucuucuccaagca

SEQ ID NO: 999405 - RNA, 19 nt, Homo sapiens
gagcucaaaccagagacua

SEQ ID NO: 999406 - RNA, 19 nt, Homo sapiens
caauuucccagaugugaug

SEQ ID NO: 999407 - RNA, 19 nt, Homo sapiens
gcucccagaccguuaccua

SEQ ID NO: 999408 - RNA, 19 nt, Homo sapiens
ggaacuuguuugacuucuc

SEQ ID NO: 999409 - RNA, 19 nt, Homo sapiens
acaaucaccucuucuaccu

SEQ ID NO: 999410 - RNA, 19 nt, Homo sapiens
ccgaaagccgucucuucua

SEQ ID NO: 999411 - RNA, 19 nt, Homo sapiens
ccucgaggccuucgucuuc

SEQ ID NO: 999412 - RNA, 19 nt, Homo sapiens
ggagccgccucuacuucau

SEQ ID NO: 999413 - RNA, 19 nt, Homo sapiens
aggcuacuauuaucucaau

SEQ ID NO: 999414 - RNA, 19 nt, Homo sapiens
caaaccagagacuauuuca

SEQ ID NO: 999415 - RNA, 19 nt, Homo sapiens
cgucucuucuaugcaauaa

SEQ ID NO: 999416 - RNA, 19 nt, Homo sapiens
ggagugguaugaggagcau

SEQ ID NO: 999417 - RNA, 19 nt, Homo sapiens
gaacaaugcugcucuugaa

SEQ ID NO: 999418 - RNA, 19 nt, Homo sapiens
aaacacagcuucagucuca

SEQ ID NO: 999419 - RNA, 19 nt, Homo sapiens
gaaucuagcagaaaugaua

SEQ ID NO: 999420 - RNA, 19 nt, Homo sapiens
ccaaggcucuaaagaaauu

SEQ ID NO: 999421 - RNA, 19 nt, Homo sapiens
ugacugugcuuaccaauga

SEQ ID NO: 999422 - RNA, 19 nt, Homo sapiens
ucaauaagaucgaggaguu

SEQ ID NO: 999423 - RNA, 19 nt, Homo sapiens
gagagugaauggaggagua

SEQ ID NO: 999424 - RNA, 19 nt, Homo sapiens
caaaauaccuucucagaug

SEQ ID NO: 999425 - RNA, 19 nt, Homo sapiens
guaccgagcuggcuaugga

SEQ ID NO: 999426 - RNA, 19 nt, Homo sapiens
gauguucccugguaaacuu

SEQ ID NO: 999427 - RNA, 19 nt, Homo sapiens
agaaauaccgcaacuauga

SEQ ID NO: 999428 - RNA, 19 nt, Homo sapiens
gagguggucugaucauaga

SEQ ID NO: 999429 - RNA, 19 nt, Homo sapiens
gaggagagaugggugaaga

SEQ ID NO: 999430 - RNA, 19 nt, Homo sapiens
caagaaauaccgcaacuau

SEQ ID NO: 999431 - RNA, 19 nt, Homo sapiens
aaccaaggcucuaaagaaa

SEQ ID NO: 999432 - RNA, 19 nt, Homo sapiens
gaucugggcucagcauguu

SEQ ID NO: 999433 - RNA, 19 nt, Homo sapiens
agacagacgucaauaagau

SEQ ID NO: 999434 - RNA, 19 nt, Homo sapiens
agagaugggugaagacaaa

SEQ ID NO: 999435 - RNA, 19 nt, Homo sapiens
gaagacagacgucaauaag

SEQ ID NO: 999436 - RNA, 19 nt, Homo sapiens
uaaccaaggcucuaaagaa

SEQ ID NO: 999437 - RNA, 19 nt, Homo sapiens
gagcaguguugaugccaaa

SEQ ID NO: 999438 - RNA, 19 nt, Homo sapiens
uagaacaccuuaggaagaa

SEQ ID NO: 999439 - RNA, 19 nt, Homo sapiens
ggccuucucucaugaucua

SEQ ID NO: 999440 - RNA, 19 nt, Homo sapiens
gagaauagaugguuuugug

SEQ ID NO: 999441 - RNA, 19 nt, Homo sapiens
ccaugagacuuucugacua

SEQ ID NO: 999442 - RNA, 19 nt, Homo sapiens
gaaaggagucguguucaau

SEQ ID NO: 999443 - RNA, 19 nt, Homo sapiens
gagacuuucugacuaggaa

SEQ ID NO: 999444 - RNA, 19 nt, Homo sapiens
ggacaaacgccaucuucau

SEQ ID NO: 999445 - RNA, 19 nt, Homo sapiens
cauaugggauugccacuag

SEQ ID NO: 999446 - RNA, 19 nt, Homo sapiens
ggagucguguucaauguca

SEQ ID NO: 999447 - RNA, 19 nt, Homo sapiens
gcaacuguccuuucucuca

SEQ ID NO: 999448 - RNA, 19 nt, Homo sapiens
ucauguaacugcuaaccuu

SEQ ID NO: 999449 - RNA, 19 nt, Homo sapiens
ggacugguggcaucaugua

SEQ ID NO: 999450 - RNA, 19 nt, Homo sapiens
caugagacuuucugacuag

SEQ ID NO: 999451 - RNA, 19 nt, Homo sapiens
cuaagacuccagcuucaua

SEQ ID NO: 999452 - RNA, 19 nt, Homo sapiens
ucaagauuguggccaagaa

SEQ ID NO: 999453 - RNA, 19 nt, Homo sapiens
ugaagacagacgucaauaa

SEQ ID NO: 999454 - RNA, 19 nt, Homo sapiens
gaucauagaacaccuuagg

SEQ ID NO: 999455 - RNA, 19 nt, Homo sapiens
cauagacuccucuguauca

SEQ ID NO: 999456 - RNA, 19 nt, Homo sapiens
gaacgccuaugcccgugau

SEQ ID NO: 999457 - RNA, 19 nt, Homo sapiens
gaaauaccgcaacuaugau

SEQ ID NO: 999458 - RNA, 19 nt, Homo sapiens
gacccuggcugacugcaau

SEQ ID NO: 999459 - RNA, 19 nt, Homo sapiens
ucucagcgccucuucauga

SEQ ID NO: 999460 - RNA, 19 nt, Homo sapiens
gagaaagcaucggcaacug

SEQ ID NO: 999461 - RNA, 19 nt, Homo sapiens
gcuggagaauagaugguuu

SEQ ID NO: 999462 - RNA, 19 nt, Homo sapiens
ggcaucauguaacugcuaa

SEQ ID NO: 999463 - RNA, 19 nt, Homo sapiens
aaaggaaauuggcaugcaa

SEQ ID NO: 999464 - RNA, 19 nt, Homo sapiens
cgacaucuuuuccaaguuu

SEQ ID NO: 999465 - RNA, 19 nt, Homo sapiens
gacaaacgccaucuucauc

SEQ ID NO: 999466 - RNA, 19 nt, Homo sapiens
ucccuggccuccucacaua

SEQ ID NO: 999467 - RNA, 19 nt, Homo sapiens
gguuugaacuugaagaaaa

SEQ ID NO: 999468 - RNA, 19 nt, Homo sapiens
ccaugugguuugaacuuga

SEQ ID NO: 999469 - RNA, 19 nt, Homo sapiens
cccacgaccuguugucauu

SEQ ID NO: 999470 - RNA, 19 nt, Homo sapiens
cuucauagacuccucugua

SEQ ID NO: 999471 - RNA, 19 nt, Homo sapiens
agaucgagcucuuugugaa

SEQ ID NO: 999472 - RNA, 19 nt, Homo sapiens
gcugaaaggagucguguuc

SEQ ID NO: 999473 - RNA, 19 nt, Homo sapiens
ugugaaggcuggaaucgau

SEQ ID NO: 999474 - RNA, 19 nt, Homo sapiens
gcaaacacagcuucagucu

SEQ ID NO: 999475 - RNA, 19 nt, Homo sapiens
auaggaaucuagcagaaau

SEQ ID NO: 999476 - RNA, 19 nt, Homo sapiens
acauaggaaucuagcagaa

SEQ ID NO: 999477 - RNA, 19 nt, Homo sapiens
gagaucgagcucuuuguga

SEQ ID NO: 999478 - RNA, 19 nt, Homo sapiens
ucauagaacaccuuaggaa

SEQ ID NO: 999479 - RNA, 19 nt, Homo sapiens
ggcaugcaauucuaaacug

SEQ ID NO: 999480 - RNA, 19 nt, Homo sapiens
ggagacagagagagugaau

SEQ ID NO: 999481 - RNA, 19 nt, Homo sapiens
acuccagccugcuaucuuu

SEQ ID NO: 999482 - RNA, 19 nt, Homo sapiens
aaauaccgcaacuaugaua

SEQ ID NO: 999483 - RNA, 19 nt, Homo sapiens
cuaaagaaauuggaugacu

SEQ ID NO: 999484 - RNA, 19 nt, Homo sapiens
ggagguggucugaucauag

SEQ ID NO: 999485 - RNA, 19 nt, Homo sapiens
cagcugcuccugccugauu

SEQ ID NO: 999486 - RNA, 19 nt, Homo sapiens
gagauugacgccaacacuu

SEQ ID NO: 999487 - RNA, 19 nt, Homo sapiens
cuacaaggccaaggacaaa

SEQ ID NO: 999488 - RNA, 19 nt, Homo sapiens
gauagacacaguccaccuu

SEQ ID NO: 999489 - RNA, 19 nt, Homo sapiens
cagaaaugauagacacagu

SEQ ID NO: 999490 - RNA, 19 nt, Homo sapiens
ggagaaagcaucggcaacu

SEQ ID NO: 999491 - RNA, 19 nt, Homo sapiens
cauguaacugcuaaccuua

SEQ ID NO: 999492 - RNA, 19 nt, Homo sapiens
gcuucagucucacuacuuc

SEQ ID NO: 999493 - RNA, 19 nt, Homo sapiens
caugugguuugaacuugaa

SEQ ID NO: 999494 - RNA, 19 nt, Homo sapiens
gcuauggacuugggugucu

SEQ ID NO: 999495 - RNA, 19 nt, Homo sapiens
cgagcuggcuauggacuug

SEQ ID NO: 999496 - RNA, 19 nt, Homo sapiens
uaccuucucagaugcuuua

SEQ ID NO: 999497 - RNA, 19 nt, Homo sapiens
caagauuguggccaagaaa

SEQ ID NO: 999498 - RNA, 19 nt, Homo sapiens
ccaagcagcagaacaaugc

SEQ ID NO: 999499 - RNA, 19 nt, Homo sapiens
cagcugaccugcacaaccu

SEQ ID NO: 999500 - RNA, 19 nt, Homo sapiens
uaggaguaguuguuucaga

SEQ ID NO: 999501 - RNA, 19 nt, Homo sapiens
gauugccacuagcuucuuc

SEQ ID NO: 999502 - RNA, 19 nt, Homo sapiens
ccugcuaucuuucaugaag

SEQ ID NO: 999503 - RNA, 19 nt, Homo sapiens
ccuacaaucugacucaacu

SEQ ID NO: 999504 - RNA, 19 nt, Homo sapiens
gaacaccuuaggaagaaag

SEQ ID NO: 999505 - RNA, 19 nt, Homo sapiens
cagaugcuuuagaaacaug

SEQ ID NO: 999506 - RNA, 19 nt, Homo sapiens
uuuaggagguggucugauc

SEQ ID NO: 999507 - RNA, 19 nt, Homo sapiens
auucaacuguagccuguaa

SEQ ID NO: 999508 - RNA, 19 nt, Homo sapiens
gcuccugccugauucaacu

SEQ ID NO: 999509 - RNA, 19 nt, Homo sapiens
ucaucuugcugguaucaug

SEQ ID NO: 999510 - RNA, 19 nt, Homo sapiens
gccaagaaauaccgcaacu

SEQ ID NO: 999511 - RNA, 19 nt, Homo sapiens
agauuguggccaagaaaua

SEQ ID NO: 999512 - RNA, 19 nt, Homo sapiens
cagcgggcaucgacaucuu

SEQ ID NO: 999513 - RNA, 19 nt, Homo sapiens
auagaacaccuuaggaaga

SEQ ID NO: 999514 - RNA, 19 nt, Homo sapiens
ccucgauguucccugguaa

SEQ ID NO: 999515 - RNA, 19 nt, Homo sapiens
gacacauucucaguuuguu

SEQ ID NO: 999516 - RNA, 19 nt, Homo sapiens
gccaucuucauccuucuua

SEQ ID NO: 999517 - RNA, 19 nt, Homo sapiens
caagagauauucacggaaa

SEQ ID NO: 999518 - RNA, 19 nt, Homo sapiens
uaacgucucucaacaaaug

SEQ ID NO: 999519 - RNA, 19 nt, Homo sapiens
ggaaaggaguucagacaga

SEQ ID NO: 999520 - RNA, 19 nt, Homo sapiens
gaacagaagcucacaagga

SEQ ID NO: 999521 - RNA, 19 nt, Homo sapiens
caacgaauacacagacuua

SEQ ID NO: 999522 - RNA, 19 nt, Homo sapiens
ugacagcauucaccaguua

SEQ ID NO: 999523 - RNA, 19 nt, Homo sapiens
ggagauacauucccagcaa

SEQ ID NO: 999524 - RNA, 19 nt, Homo sapiens
gugauuagcugcuccuuga

SEQ ID NO: 999525 - RNA, 19 nt, Homo sapiens
acacagacuuacuggauua

SEQ ID NO: 999526 - RNA, 19 nt, Homo sapiens
gggaagaucauaguuaaua

SEQ ID NO: 999527 - RNA, 19 nt, Homo sapiens
caaaggcgaagaugaguua

SEQ ID NO: 999528 - RNA, 19 nt, Homo sapiens
cagggaagaucauaguuaa

SEQ ID NO: 999529 - RNA, 19 nt, Homo sapiens
ggaaggcaacgaagacaua

SEQ ID NO: 999530 - RNA, 19 nt, Homo sapiens
gaacacaggaaagauuaua

SEQ ID NO: 999531 - RNA, 19 nt, Homo sapiens
ggagagugguugagauuuc

SEQ ID NO: 999532 - RNA, 19 nt, Homo sapiens
auucacaucugccuuguua

SEQ ID NO: 999533 - RNA, 19 nt, Homo sapiens
gccauaccaugucugaaua

SEQ ID NO: 999534 - RNA, 19 nt, Homo sapiens
aaagagugguggauaagaa

SEQ ID NO: 999535 - RNA, 19 nt, Homo sapiens
aauaacgucucucaacaaa

SEQ ID NO: 999536 - RNA, 19 nt, Homo sapiens
cauaagagaggccauuaaa

SEQ ID NO: 999537 - RNA, 19 nt, Homo sapiens
gaaaaucagcgacuaauug

SEQ ID NO: 999538 - RNA, 19 nt, Homo sapiens
gaaccagaaccaaauacaa

SEQ ID NO: 999539 - RNA, 19 nt, Homo sapiens
agaccaggaugcccagaua

SEQ ID NO: 999540 - RNA, 19 nt, Homo sapiens
gaauccacaucuucugaga

SEQ ID NO: 999541 - RNA, 19 nt, Homo sapiens
ucagggaagaucauaguua

SEQ ID NO: 999542 - RNA, 19 nt, Homo sapiens
gcgacuaauuggugaaaug

SEQ ID NO: 999543 - RNA, 19 nt, Homo sapiens
ggacaucacgcugcuauuc

SEQ ID NO: 999544 - RNA, 19 nt, Homo sapiens
cagagagccauccgaguua

SEQ ID NO: 999545 - RNA, 19 nt, Homo sapiens
uuaauaacgucucucaaca

SEQ ID NO: 999546 - RNA, 19 nt, Homo sapiens
gaaggcaacgaagacauaa

SEQ ID NO: 999547 - RNA, 19 nt, Homo sapiens
gcaacaggaagcugagauu

SEQ ID NO: 999548 - RNA, 19 nt, Homo sapiens
ugaaacacaaccugaauug

SEQ ID NO: 999549 - RNA, 19 nt, Homo sapiens
gcaacgaagacauaagaga

SEQ ID NO: 999550 - RNA, 19 nt, Homo sapiens
gaagggagagugguugaga

SEQ ID NO: 999551 - RNA, 19 nt, Homo sapiens
gaagauuacuugaaaagag

SEQ ID NO: 999552 - RNA, 19 nt, Homo sapiens
caucugccuuguuaaucua

SEQ ID NO: 999553 - RNA, 19 nt, Homo sapiens
gacauaagagaggccauua

SEQ ID NO: 999554 - RNA, 19 nt, Homo sapiens
caaauacaaagacaagaga

SEQ ID NO: 999555 - RNA, 19 nt, Homo sapiens
aaacuuuacucagaacaga

SEQ ID NO: 999556 - RNA, 19 nt, Homo sapiens
gcaauucagcaacuacgaa

SEQ ID NO: 999557 - RNA, 19 nt, Homo sapiens
gaaccaaauacaaagacaa

SEQ ID NO: 999558 - RNA, 19 nt, Homo sapiens
gaggaugacagacacagaa

SEQ ID NO: 999559 - RNA, 19 nt, Homo sapiens
cagacuuacuggauuauag

SEQ ID NO: 999560 - RNA, 19 nt, Homo sapiens
ggaccgcuguuuuggauuu

SEQ ID NO: 999561 - RNA, 19 nt, Homo sapiens
gcuuauagccauaccaugu

SEQ ID NO: 999562 - RNA, 19 nt, Homo sapiens
guucaaaggaagacacuga

SEQ ID NO: 999563 - RNA, 19 nt, Homo sapiens
uggaacacaggaaagauua

SEQ ID NO: 999564 - RNA, 19 nt, Homo sapiens
gaagggaaaggaguucaga

SEQ ID NO: 999565 - RNA, 19 nt, Homo sapiens
gcaaaggcgaagaugaguu

SEQ ID NO: 999566 - RNA, 19 nt, Homo sapiens
gacaagagaauccacaucu

SEQ ID NO: 999567 - RNA, 19 nt, Homo sapiens
acagagagccauccgaguu

SEQ ID NO: 999568 - RNA, 19 nt, Homo sapiens
cagcuuguuugaugaagug

SEQ ID NO: 999569 - RNA, 19 nt, Homo sapiens
ccagaagaaauacaaaugu

SEQ ID NO: 999570 - RNA, 19 nt, Homo sapiens
caaaagacucugaagaaaa

SEQ ID NO: 999571 - RNA, 19 nt, Homo sapiens
ucaaaagacucugaagaaa

SEQ ID NO: 999572 - RNA, 19 nt, Homo sapiens
gaggaccuguucagaagca

SEQ ID NO: 999573 - RNA, 19 nt, Homo sapiens
ucacaucugccuuguuaau

SEQ ID NO: 999574 - RNA, 19 nt, Homo sapiens
aaccagaaccaaauacaaa

SEQ ID NO: 999575 - RNA, 19 nt, Homo sapiens
uuaaaagagugguggauaa

SEQ ID NO: 999576 - RNA, 19 nt, Homo sapiens
caugaggaccuguucagaa

SEQ ID NO: 999577 - RNA, 19 nt, Homo sapiens
caacaggaagcugagauug

SEQ ID NO: 999578 - RNA, 19 nt, Homo sapiens
cagaagcaauucagcaacu

SEQ ID NO: 999579 - RNA, 19 nt, Homo sapiens
uaauaacgucucucaacaa

SEQ ID NO: 999580 - RNA, 19 nt, Homo sapiens
cuaauugucucaggguuca

SEQ ID NO: 999581 - RNA, 19 nt, Homo sapiens
cuuacuggauuauagaaga

SEQ ID NO: 999582 - RNA, 19 nt, Homo sapiens
uacacagacuuacuggauu

SEQ ID NO: 999583 - RNA, 19 nt, Homo sapiens
cgacuaauuggugaaauga

SEQ ID NO: 999584 - RNA, 19 nt, Homo sapiens
ggaaccagaaccaaauaca

SEQ ID NO: 999585 - RNA, 19 nt, Homo sapiens
agagagccauccgaguuaa

SEQ ID NO: 999586 - RNA, 19 nt, Homo sapiens
agaagcaauucagcaacua

SEQ ID NO: 999587 - RNA, 19 nt, Homo sapiens
gaugacagacacagaacga

SEQ ID NO: 999588 - RNA, 19 nt, Homo sapiens
cgaauacacagacuuacug

SEQ ID NO: 999589 - RNA, 19 nt, Homo sapiens
cacagaacgagaccagaua

SEQ ID NO: 999590 - RNA, 19 nt, Homo sapiens
cucaacaaaugauuacuuc

SEQ ID NO: 999591 - RNA, 19 nt, Homo sapiens
guucagacagacagacgua

SEQ ID NO: 999592 - RNA, 19 nt, Homo sapiens
gcacagcaggccucaagag

SEQ ID NO: 999593 - RNA, 19 nt, Homo sapiens
cagacugcgugcuuucaug

SEQ ID NO: 999594 - RNA, 19 nt, Homo sapiens
gcguguggauccucuucuu

SEQ ID NO: 999595 - RNA, 19 nt, Homo sapiens
ucaaggaaggcaacgaaga

SEQ ID NO: 999596 - RNA, 19 nt, Homo sapiens
gcugaaacacaaccugaau

SEQ ID NO: 999597 - RNA, 19 nt, Homo sapiens
gcucacaaggagauacauu

SEQ ID NO: 999598 - RNA, 19 nt, Homo sapiens
ggaacacaggaaagauuau

SEQ ID NO: 999599 - RNA, 19 nt, Homo sapiens
uaucaaggaaggcaacgaa

SEQ ID NO: 999600 - RNA, 19 nt, Homo sapiens
ccaaauacaaagacaagag

SEQ ID NO: 999601 - RNA, 19 nt, Homo sapiens
ucagacagacagacguauu

SEQ ID NO: 999602 - RNA, 19 nt, Homo sapiens
ccagaaccaaauacaaaga

SEQ ID NO: 999603 - RNA, 19 nt, Homo sapiens
gaccuguucagaagcaauu

SEQ ID NO: 999604 - RNA, 19 nt, Homo sapiens
aaaagacucugaagaaaac

SEQ ID NO: 999605 - RNA, 19 nt, Homo sapiens
ucacauuggcaaacugaga

SEQ ID NO: 999606 - RNA, 19 nt, Homo sapiens
ggaggaugacagacacaga

SEQ ID NO: 999607 - RNA, 19 nt, Homo sapiens
gcauucaccaguuaguugu

SEQ ID NO: 999608 - RNA, 19 nt, Homo sapiens
gaaacacaaccugaauugg

SEQ ID NO: 999609 - RNA, 19 nt, Homo sapiens
gagagccauccgaguuaaa

SEQ ID NO: 999610 - RNA, 19 nt, Homo sapiens
gaagagaaaauucacaucu

SEQ ID NO: 999611 - RNA, 19 nt, Homo sapiens
uuggcaaacugagagauuu

SEQ ID NO: 999612 - RNA, 19 nt, Homo sapiens
ggaaaaucagcgacuaauu

SEQ ID NO: 999613 - RNA, 19 nt, Homo sapiens
gagauuuucuucuggaaca

SEQ ID NO: 999614 - RNA, 19 nt, Homo sapiens
cugccuuguuaaucuaaua

SEQ ID NO: 999615 - RNA, 19 nt, Homo sapiens
acaggaagcugagauugac

SEQ ID NO: 999616 - RNA, 19 nt, Homo sapiens
cagaagcucacaaggagau

SEQ ID NO: 999617 - RNA, 19 nt, Homo sapiens
ugagggaucugcuccuuaa

SEQ ID NO: 999618 - RNA, 19 nt, Homo sapiens
gggaagaagugcccagaag

SEQ ID NO: 999619 - RNA, 19 nt, Homo sapiens
gaccuuaggcccauagaga

SEQ ID NO: 999620 - RNA, 19 nt, Homo sapiens
gaagaagugcccagaaggu

SEQ ID NO: 999621 - RNA, 19 nt, Homo sapiens
ugaccaagauuaccaacca

SEQ ID NO: 999622 - RNA, 19 nt, Homo sapiens
ggagauggagcacgucuag

SEQ ID NO: 999623 - RNA, 19 nt, Homo sapiens
ugagcaagaugaacaagag

SEQ ID NO: 999624 - RNA, 19 nt, Homo sapiens
ccugaacgccuucgacauu

SEQ ID NO: 999625 - RNA, 19 nt, Homo sapiens
cccaagagcuucccaucuc

SEQ ID NO: 999626 - RNA, 19 nt, Homo sapiens
ucaagcagccggugaccaa

SEQ ID NO: 999627 - RNA, 19 nt, Homo sapiens
ccuccacgcucguccucua

SEQ ID NO: 999628 - RNA, 19 nt, Homo sapiens
gacacaggcacccagcuuu

SEQ ID NO: 999629 - RNA, 19 nt, Homo sapiens
cugaggagcuggucaagac

SEQ ID NO: 999630 - RNA, 19 nt, Homo sapiens
ccaccugcauugaccuuag

SEQ ID NO: 999631 - RNA, 19 nt, Homo sapiens
ccauggaccugagcaccuu

SEQ ID NO: 999632 - RNA, 19 nt, Homo sapiens
ccacagggaugucuuuuac

SEQ ID NO: 999633 - RNA, 19 nt, Homo sapiens
aggccgcucuccuucagua

SEQ ID NO: 999634 - RNA, 19 nt, Homo sapiens
acagggaugucuuuuacua

SEQ ID NO: 999635 - RNA, 19 nt, Homo sapiens
cccuguggcuggacuguga

SEQ ID NO: 999636 - RNA, 19 nt, Homo sapiens
ccgcucuccuucaguaaau

SEQ ID NO: 999637 - RNA, 19 nt, Homo sapiens
cagccggugaccaagauua

SEQ ID NO: 999638 - RNA, 19 nt, Homo sapiens
cgacacaggcacccagcuu

SEQ ID NO: 999639 - RNA, 19 nt, Homo sapiens
cgguuucccuucuguuuag

SEQ ID NO: 999640 - RNA, 19 nt, Homo sapiens
acacaggcacccagcuuug

SEQ ID NO: 999641 - RNA, 19 nt, Homo sapiens
cgccagccuucgcuucuga

SEQ ID NO: 999642 - RNA, 19 nt, Homo sapiens
ugaggacgacgacgaggaa

SEQ ID NO: 999643 - RNA, 19 nt, Homo sapiens
ggacaucaggaagcaggaa

SEQ ID NO: 999644 - RNA, 19 nt, Homo sapiens
cugaacgccuucgacauug

SEQ ID NO: 999645 - RNA, 19 nt, Homo sapiens
agggaugucuuuuacuaua

SEQ ID NO: 999646 - RNA, 19 nt, Homo sapiens
ccugagcaccuucgacuuc

SEQ ID NO: 999647 - RNA, 19 nt, Homo sapiens
cggcguccaucuucaagca

SEQ ID NO: 999648 - RNA, 19 nt, Homo sapiens
ucgguuucccuucuguuua

SEQ ID NO: 999649 - RNA, 19 nt, Homo sapiens
ugacgggugccucccaaga

SEQ ID NO: 999650 - RNA, 19 nt, Homo sapiens
gggacugccuggugaacac

SEQ ID NO: 999651 - RNA, 19 nt, Homo sapiens
gcugggagagggaagaagu

SEQ ID NO: 999652 - RNA, 19 nt, Homo sapiens
ggacgacgacgaggaagac

SEQ ID NO: 999653 - RNA, 19 nt, Homo sapiens
caagagcgacccgcagaag

SEQ ID NO: 999654 - RNA, 19 nt, Homo sapiens
cagagucaaagcacaaauc

SEQ ID NO: 999655 - RNA, 19 nt, Homo sapiens
gcacgggcaagaugcugau

SEQ ID NO: 999656 - RNA, 19 nt, Homo sapiens
gaacauggcagauuuaaua

SEQ ID NO: 999657 - RNA, 19 nt, Homo sapiens
caacaaaccuucuaagcuu

SEQ ID NO: 999658 - RNA, 19 nt, Homo sapiens
guaaugagcugaagugugu

SEQ ID NO: 999659 - RNA, 19 nt, Homo sapiens
gaaauggaguuugcaguaa

SEQ ID NO: 999660 - RNA, 19 nt, Homo sapiens
gaaaucacaucuacuuuag

SEQ ID NO: 999661 - RNA, 19 nt, Homo sapiens
uaucaugacuuccugaaua

SEQ ID NO: 999662 - RNA, 19 nt, Homo sapiens
gcaagacuguggaaguuaa

SEQ ID NO: 999663 - RNA, 19 nt, Homo sapiens
gaaacgugcucaggaaauu

SEQ ID NO: 999664 - RNA, 19 nt, Homo sapiens
gaagaaaccaaauacauug

SEQ ID NO: 999665 - RNA, 19 nt, Homo sapiens
ggaaauggaguuugcagua

SEQ ID NO: 999666 - RNA, 19 nt, Homo sapiens
gagaagcaguaaaugauug

SEQ ID NO: 999667 - RNA, 19 nt, Homo sapiens
ggaauuugcuuuggaggaa

SEQ ID NO: 999668 - RNA, 19 nt, Homo sapiens
gaggaaacccugacucauu

SEQ ID NO: 999669 - RNA, 19 nt, Homo sapiens
gaggaggcgugaaugaauu

SEQ ID NO: 999670 - RNA, 19 nt, Homo sapiens
gggagacacuggcuauuau

SEQ ID NO: 999671 - RNA, 19 nt, Homo sapiens
ccaaauacauugaacugau

SEQ ID NO: 999672 - RNA, 19 nt, Homo sapiens
gcuguccucugaauacaua

SEQ ID NO: 999673 - RNA, 19 nt, Homo sapiens
cauaauugcuggcaccauu

SEQ ID NO: 999674 - RNA, 19 nt, Homo sapiens
gggaugugcuuugugguua

SEQ ID NO: 999675 - RNA, 19 nt, Homo sapiens
ccaagguccugugcaaaua

SEQ ID NO: 999676 - RNA, 19 nt, Homo sapiens
caaauacauugaacugaug

SEQ ID NO: 999677 - RNA, 19 nt, Homo sapiens
gaaccacacauaucucauu

SEQ ID NO: 999678 - RNA, 19 nt, Homo sapiens
guaaagaaggcacuauuug

SEQ ID NO: 999679 - RNA, 19 nt, Homo sapiens
caaaugaugugcuuagaac

SEQ ID NO: 999680 - RNA, 19 nt, Homo sapiens
gaaaggaggaggcgugaau

SEQ ID NO: 999681 - RNA, 19 nt, Homo sapiens
caacaaguuugccauaucu

SEQ ID NO: 999682 - RNA, 19 nt, Homo sapiens
gaguaagucugaaccucua

SEQ ID NO: 999683 - RNA, 19 nt, Homo sapiens
gagcugaagugugugugua

SEQ ID NO: 999684 - RNA, 19 nt, Homo sapiens
gcagcaaggaagaacauua

SEQ ID NO: 999685 - RNA, 19 nt, Homo sapiens
gauagacaaugcaaauaca

SEQ ID NO: 999686 - RNA, 19 nt, Homo sapiens
gcagaguguuguaagaaau

SEQ ID NO: 999687 - RNA, 19 nt, Homo sapiens
gcaccaauaucauaauagg

SEQ ID NO: 999688 - RNA, 19 nt, Homo sapiens
ggagcagaguguuguaaga

SEQ ID NO: 999689 - RNA, 19 nt, Homo sapiens
uuacaaauccagacuguuu

SEQ ID NO: 999690 - RNA, 19 nt, Homo sapiens
aggaaacccugacucauuu

SEQ ID NO: 999691 - RNA, 19 nt, Homo sapiens
gaggagagcacuguuacua

SEQ ID NO: 999692 - RNA, 19 nt, Homo sapiens
gcaaauagugucaaaagua

SEQ ID NO: 999693 - RNA, 19 nt, Homo sapiens
agacaaagacacauggaua

SEQ ID NO: 999694 - RNA, 19 nt, Homo sapiens
ccagggagauuauguaaaa

SEQ ID NO: 999695 - RNA, 19 nt, Homo sapiens
uguaagaaaugcaccuuga

SEQ ID NO: 999696 - RNA, 19 nt, Homo sapiens
cgaaaucuguggugaacau

SEQ ID NO: 999697 - RNA, 19 nt, Homo sapiens
cagcaaggaagaacauuaa

SEQ ID NO: 999698 - RNA, 19 nt, Homo sapiens
ggaaagacaaagacacaug

SEQ ID NO: 999699 - RNA, 19 nt, Homo sapiens
gacacuggcuauuaucuuc

SEQ ID NO: 999700 - RNA, 19 nt, Homo sapiens
gacaacaaguuugccauau

SEQ ID NO: 999701 - RNA, 19 nt, Homo sapiens
uuaagcagauagucaaaga

SEQ ID NO: 999702 - RNA, 19 nt, Homo sapiens
agacaaauauugcuaugag

SEQ ID NO: 999703 - RNA, 19 nt, Homo sapiens
gcaguaaaugauugugaua

SEQ ID NO: 999704 - RNA, 19 nt, Homo sapiens
gaacugaugauugugaaug

SEQ ID NO: 999705 - RNA, 19 nt, Homo sapiens
ugacucauuuguugcauug

SEQ ID NO: 999706 - RNA, 19 nt, Homo sapiens
gcuaugagaaacugaauau

SEQ ID NO: 999707 - RNA, 19 nt, Homo sapiens
ggugacagcaucagacaaa

SEQ ID NO: 999708 - RNA, 19 nt, Homo sapiens
gagauagacaaugcaaaua

SEQ ID NO: 999709 - RNA, 19 nt, Homo sapiens
ggauggauauucaugugau

SEQ ID NO: 999710 - RNA, 19 nt, Homo sapiens
gaaugaucaccuuauguuu

SEQ ID NO: 999711 - RNA, 19 nt, Homo sapiens
gaucuuccaucugaauuuc

SEQ ID NO: 999712 - RNA, 19 nt, Homo sapiens
uggcaccaauaucauaaua

SEQ ID NO: 999713 - RNA, 19 nt, Homo sapiens
acauugaacugaugauugu

SEQ ID NO: 999714 - RNA, 19 nt, Homo sapiens
gaaaccaaauacauugaac

SEQ ID NO: 999715 - RNA, 19 nt, Homo sapiens
gaagaagaaaccaaauaca

SEQ ID NO: 999716 - RNA, 19 nt, Homo sapiens
ucacaaugaugaugcaaag

SEQ ID NO: 999717 - RNA, 19 nt, Homo sapiens
gaagaugggacaccuugug

SEQ ID NO: 999718 - RNA, 19 nt, Homo sapiens
gcaguugacucauguugac

SEQ ID NO: 999719 - RNA, 19 nt, Homo sapiens
ggccgaauguguccuugaa

SEQ ID NO: 999720 - RNA, 19 nt, Homo sapiens
uuuaauggcuguuacacuu

SEQ ID NO: 999721 - RNA, 19 nt, Homo sapiens
cuacgugaguuuaugaaau

SEQ ID NO: 999722 - RNA, 19 nt, Homo sapiens
ugaaugaucaccuuauguu

SEQ ID NO: 999723 - RNA, 19 nt, Homo sapiens
gacagcaucagacaaauau

SEQ ID NO: 999724 - RNA, 19 nt, Homo sapiens
ggaggaggcgugaaugaau

SEQ ID NO: 999725 - RNA, 19 nt, Homo sapiens
aauccagacuguuugaauu

SEQ ID NO: 999726 - RNA, 19 nt, Homo sapiens
ucaagaggauuuccauuuu

SEQ ID NO: 999727 - RNA, 19 nt, Homo sapiens
gcagauagucaaagaacug

SEQ ID NO: 999728 - RNA, 19 nt, Homo sapiens
gcacaaacucagcaucuag

SEQ ID NO: 999729 - RNA, 19 nt, Homo sapiens
caacaaacgggaugugcuu

SEQ ID NO: 999730 - RNA, 19 nt, Homo sapiens
gacaaauauugcuaugaga

SEQ ID NO: 999731 - RNA, 19 nt, Homo sapiens
ugacagcaucagacaaaua

SEQ ID NO: 999732 - RNA, 19 nt, Homo sapiens
gagcagaguguuguaagaa

SEQ ID NO: 999733 - RNA, 19 nt, Homo sapiens
guuagcaaguggugaaugu

SEQ ID NO: 999734 - RNA, 19 nt, Homo sapiens
gcaggagacgccucauuga

SEQ ID NO: 999735 - RNA, 19 nt, Homo sapiens
acacauggauacagugcaa

SEQ ID NO: 999736 - RNA, 19 nt, Homo sapiens
aaagacacauggauacagu

SEQ ID NO: 999737 - RNA, 19 nt, Homo sapiens
ggagaggagugugauugug

SEQ ID NO: 999738 - RNA, 19 nt, Homo sapiens
ggagggauuuuaucaaaga

SEQ ID NO: 999739 - RNA, 19 nt, Homo sapiens
ugacaacaaguuugccaua

SEQ ID NO: 999740 - RNA, 19 nt, Homo sapiens
guucugauugcaacacuua

SEQ ID NO: 999741 - RNA, 19 nt, Homo sapiens
cgugaaacgugcucaggaa

SEQ ID NO: 999742 - RNA, 19 nt, Homo sapiens
gguauuaucucagacaaaa

SEQ ID NO: 999743 - RNA, 19 nt, Homo sapiens
caacuuaagaccaggauag

SEQ ID NO: 999744 - RNA, 19 nt, Homo sapiens
ucgauauccucguaaugua

SEQ ID NO: 999745 - RNA, 19 nt, Homo sapiens
gaaaaugggcgaccucgaa

SEQ ID NO: 999746 - RNA, 19 nt, Homo sapiens
gcaguaaugagcugaagug

SEQ ID NO: 999747 - RNA, 19 nt, Homo sapiens
cagcaucagacaaauauug

SEQ ID NO: 999748 - RNA, 19 nt, Homo sapiens
gaaaggauuccagacacaa

SEQ ID NO: 999749 - RNA, 19 nt, Homo sapiens
uuacuucccucacaaugau

SEQ ID NO: 999750 - RNA, 19 nt, Homo sapiens
agaacucgauggugaaauc

SEQ ID NO: 999751 - RNA, 19 nt, Homo sapiens
gaaggagcagaguguugua

SEQ ID NO: 999752 - RNA, 19 nt, Homo sapiens
ugaaaggauuccagacaca

SEQ ID NO: 999753 - RNA, 19 nt, Homo sapiens
caaggaagaacauuaaacu

SEQ ID NO: 999754 - RNA, 19 nt, Homo sapiens
gugacggucuuugcuguaa

SEQ ID NO: 999755 - RNA, 19 nt, Homo sapiens
ggugaacauggcagauuua

SEQ ID NO: 999756 - RNA, 19 nt, Homo sapiens
gaaacaacaucccauaaua

SEQ ID NO: 999757 - RNA, 19 nt, Homo sapiens
gaacauggcagauuuaaua

SEQ ID NO: 999758 - RNA, 19 nt, Homo sapiens
caacaaaccuucuaagcuu

SEQ ID NO: 999759 - RNA, 19 nt, Homo sapiens
gcaugaagcuucuguuuau

SEQ ID NO: 999760 - RNA, 19 nt, Homo sapiens
guaaugagcugaagugugu

SEQ ID NO: 999761 - RNA, 19 nt, Homo sapiens
uaaagguacugguauguua

SEQ ID NO: 999762 - RNA, 19 nt, Homo sapiens
gaaauggaguuugcaguaa

SEQ ID NO: 999763 - RNA, 19 nt, Homo sapiens
gaaaucacaucuacuuuag

SEQ ID NO: 999764 - RNA, 19 nt, Homo sapiens
uaucaugacuuccugaaua

SEQ ID NO: 999765 - RNA, 19 nt, Homo sapiens
gcaagacuguggaaguuaa

SEQ ID NO: 999766 - RNA, 19 nt, Homo sapiens
gaaacgugcucaggaaauu

SEQ ID NO: 999767 - RNA, 19 nt, Homo sapiens
gaagaaaccaaauacauug

SEQ ID NO: 999768 - RNA, 19 nt, Homo sapiens
ggaaauggaguuugcagua

SEQ ID NO: 999769 - RNA, 19 nt, Homo sapiens
ggauuuaacuaaccaugaa

SEQ ID NO: 999770 - RNA, 19 nt, Homo sapiens
gagaagcaguaaaugauug

SEQ ID NO: 999771 - RNA, 19 nt, Homo sapiens
caacaucccauaauagaaa

SEQ ID NO: 999772 - RNA, 19 nt, Homo sapiens
gcuaaggcauauaggauuu

SEQ ID NO: 999773 - RNA, 19 nt, Homo sapiens
ggaauuugcuuuggaggaa

SEQ ID NO: 999774 - RNA, 19 nt, Homo sapiens
gaggaaacccugacucauu

SEQ ID NO: 999775 - RNA, 19 nt, Homo sapiens
gcaaaucuaucugcucuuc

SEQ ID NO: 999776 - RNA, 19 nt, Homo sapiens
gaucaacuguuuacaugug

SEQ ID NO: 999777 - RNA, 19 nt, Homo sapiens
gucauuggcuuaggauuua

SEQ ID NO: 999778 - RNA, 19 nt, Homo sapiens
gaggaggcgugaaugaauu

SEQ ID NO: 999779 - RNA, 19 nt, Homo sapiens
gggagacacuggcuauuau

SEQ ID NO: 999780 - RNA, 19 nt, Homo sapiens
ccaaauacauugaacugau

SEQ ID NO: 999781 - RNA, 19 nt, Homo sapiens
gcuguccucugaauacaua

SEQ ID NO: 999782 - RNA, 19 nt, Homo sapiens
gaaaggccaauaucccaua

SEQ ID NO: 999783 - RNA, 19 nt, Homo sapiens
cauaauugcuggcaccauu

SEQ ID NO: 999784 - RNA, 19 nt, Homo sapiens
gggaugugcuuugugguua

SEQ ID NO: 999785 - RNA, 19 nt, Homo sapiens
caaauacauugaacugaug

SEQ ID NO: 999786 - RNA, 19 nt, Homo sapiens
gaaccacacauaucucauu

SEQ ID NO: 999787 - RNA, 19 nt, Homo sapiens
ggaaacaacaucccauaau

SEQ ID NO: 999788 - RNA, 19 nt, Homo sapiens
guacaauaguggauucaga

SEQ ID NO: 999789 - RNA, 19 nt, Homo sapiens
guaaagaaggcacuauuug

SEQ ID NO: 999790 - RNA, 19 nt, Homo sapiens
caaaugaugugcuuagaac

SEQ ID NO: 999791 - RNA, 19 nt, Homo sapiens
gaaaggaggaggcgugaau

SEQ ID NO: 999792 - RNA, 19 nt, Homo sapiens
caacaaguuugccauaucu

SEQ ID NO: 999793 - RNA, 19 nt, Homo sapiens
caauaaagguacugguaug

SEQ ID NO: 999794 - RNA, 19 nt, Homo sapiens
gagcugaagugugugugua

SEQ ID NO: 999795 - RNA, 19 nt, Homo sapiens
gcagcaaggaagaacauua

SEQ ID NO: 999796 - RNA, 19 nt, Homo sapiens
gauagacaaugcaaauaca

SEQ ID NO: 999797 - RNA, 19 nt, Homo sapiens
gcagaguguuguaagaaau

SEQ ID NO: 999798 - RNA, 19 nt, Homo sapiens
guacugguauguuaaugga

SEQ ID NO: 999799 - RNA, 19 nt, Homo sapiens
gcaccaauaucauaauagg

SEQ ID NO: 999800 - RNA, 19 nt, Homo sapiens
ggagcagaguguuguaaga

SEQ ID NO: 999801 - RNA, 19 nt, Homo sapiens
uuacaaauccagacuguuu

SEQ ID NO: 999802 - RNA, 19 nt, Homo sapiens
aggaaacccugacucauuu

SEQ ID NO: 999803 - RNA, 19 nt, Homo sapiens
uaacucacaugacccaaau

SEQ ID NO: 999804 - RNA, 19 nt, Homo sapiens
uggaaucacugcaaaucua

SEQ ID NO: 999805 - RNA, 19 nt, Homo sapiens
agacauccauuuaagauca

SEQ ID NO: 999806 - RNA, 19 nt, Homo sapiens
gaaagugaaccgacaaagu

SEQ ID NO: 999807 - RNA, 19 nt, Homo sapiens
gaggagagcacuguuacua

SEQ ID NO: 999808 - RNA, 19 nt, Homo sapiens
agacaaagacacauggaua

SEQ ID NO: 999809 - RNA, 19 nt, Homo sapiens
uguaagaaaugcaccuuga

SEQ ID NO: 999810 - RNA, 19 nt, Homo sapiens
cgaaaucuguggugaacau

SEQ ID NO: 999811 - RNA, 19 nt, Homo sapiens
uagcaaguuuccuaaggua

SEQ ID NO: 999812 - RNA, 19 nt, Homo sapiens
ggagacauccauuuaagau

SEQ ID NO: 999813 - RNA, 19 nt, Homo sapiens
gaaaauacccuuacccaau

SEQ ID NO: 999814 - RNA, 19 nt, Homo sapiens
cagcaaggaagaacauuaa

SEQ ID NO: 999815 - RNA, 19 nt, Homo sapiens
ggaaagacaaagacacaug

SEQ ID NO: 999816 - RNA, 19 nt, Homo sapiens
gacacuggcuauuaucuuc

SEQ ID NO: 999817 - RNA, 19 nt, Homo sapiens
gacaacaaguuugccauau

SEQ ID NO: 999818 - RNA, 19 nt, Homo sapiens
aagaucaacuguuuacaug

SEQ ID NO: 999819 - RNA, 19 nt, Homo sapiens
agacaaauauugcuaugag

SEQ ID NO: 999820 - RNA, 19 nt, Homo sapiens
gcaguaaaugauugugaua

SEQ ID NO: 999821 - RNA, 19 nt, Homo sapiens
gaacugaugauugugaaug

SEQ ID NO: 999822 - RNA, 19 nt, Homo sapiens
ugacucauuuguugcauug

SEQ ID NO: 999823 - RNA, 19 nt, Homo sapiens
gcuaugagaaacugaauau

SEQ ID NO: 999824 - RNA, 19 nt, Homo sapiens
ggugacagcaucagacaaa

SEQ ID NO: 999825 - RNA, 19 nt, Homo sapiens
gagauagacaaugcaaaua

SEQ ID NO: 999826 - RNA, 19 nt, Homo sapiens
ggauggauauucaugugau

SEQ ID NO: 999827 - RNA, 19 nt, Homo sapiens
gaaugaucaccuuauguuu

SEQ ID NO: 999828 - RNA, 19 nt, Homo sapiens
gaucuuccaucugaauuuc

SEQ ID NO: 999829 - RNA, 19 nt, Homo sapiens
uaggcuaacuuuaaacaug

SEQ ID NO: 999830 - RNA, 19 nt, Homo sapiens
caugacagauaauauguag

SEQ ID NO: 999831 - RNA, 19 nt, Homo sapiens
uggcaccaauaucauaaua

SEQ ID NO: 999832 - RNA, 19 nt, Homo sapiens
acauugaacugaugauugu

SEQ ID NO: 999833 - RNA, 19 nt, Homo sapiens
gaaaccaaauacauugaac

SEQ ID NO: 999834 - RNA, 19 nt, Homo sapiens
gaagaagaaaccaaauaca

SEQ ID NO: 999835 - RNA, 19 nt, Homo sapiens
cccauaggcuaacuuuaaa

SEQ ID NO: 999836 - RNA, 19 nt, Homo sapiens
aauaguggauucagaacuu

SEQ ID NO: 999837 - RNA, 19 nt, Homo sapiens
gcaguugacucauguugac

SEQ ID NO: 999838 - RNA, 19 nt, Homo sapiens
ucacaaugaugaugcaaag

SEQ ID NO: 999839 - RNA, 19 nt, Homo sapiens
gaagaugggacaccuugug

SEQ ID NO: 999840 - RNA, 19 nt, Homo sapiens
ggccgaauguguccuugaa

SEQ ID NO: 999841 - RNA, 19 nt, Homo sapiens
uuuaauggcuguuacacuu

SEQ ID NO: 999842 - RNA, 19 nt, Homo sapiens
cuacgugaguuuaugaaau

SEQ ID NO: 999843 - RNA, 19 nt, Homo sapiens
ugaaugaucaccuuauguu

SEQ ID NO: 999844 - RNA, 19 nt, Homo sapiens
gaagcggaguuucacaucu

SEQ ID NO: 999845 - RNA, 19 nt, Homo sapiens
gacagcaucagacaaauau

SEQ ID NO: 999846 - RNA, 19 nt, Homo sapiens
ggaggaggcgugaaugaau

SEQ ID NO: 999847 - RNA, 19 nt, Homo sapiens
aauccagacuguuugaauu

SEQ ID NO: 999848 - RNA, 19 nt, Homo sapiens
ucaagaggauuuccauuuu

SEQ ID NO: 999849 - RNA, 19 nt, Homo sapiens
uagcauacaaggacaauug

SEQ ID NO: 999850 - RNA, 19 nt, Homo sapiens
ucccauaggcuaacuuuaa

SEQ ID NO: 999851 - RNA, 19 nt, Homo sapiens
aaagugaaccgacaaagug

SEQ ID NO: 999852 - RNA, 19 nt, Homo sapiens
cuaauucaacugagacuuu

SEQ ID NO: 999853 - RNA, 19 nt, Homo sapiens
gagaacagaggucaaaugg

SEQ ID NO: 999854 - RNA, 19 nt, Homo sapiens
caacaaacgggaugugcuu

SEQ ID NO: 999855 - RNA, 19 nt, Homo sapiens
gacaaauauugcuaugaga

SEQ ID NO: 999856 - RNA, 19 nt, Homo sapiens
gaacauggcagauuuaaua

SEQ ID NO: 999857 - RNA, 19 nt, Homo sapiens
caacaaaccuucuaagcuu

SEQ ID NO: 999858 - RNA, 19 nt, Homo sapiens
guaaugagcugaagugugu

SEQ ID NO: 999859 - RNA, 19 nt, Homo sapiens
gaaauggaguuugcaguaa

SEQ ID NO: 999860 - RNA, 19 nt, Homo sapiens
gaaaucacaucuacuuuag

SEQ ID NO: 999861 - RNA, 19 nt, Homo sapiens
uaucaugacuuccugaaua

SEQ ID NO: 999862 - RNA, 19 nt, Homo sapiens
gcaagacuguggaaguuaa

SEQ ID NO: 999863 - RNA, 19 nt, Homo sapiens
gaaacgugcucaggaaauu

SEQ ID NO: 999864 - RNA, 19 nt, Homo sapiens
gaagaaaccaaauacauug

SEQ ID NO: 999865 - RNA, 19 nt, Homo sapiens
ggaaauggaguuugcagua

SEQ ID NO: 999866 - RNA, 19 nt, Homo sapiens
gagaagcaguaaaugauug

SEQ ID NO: 999867 - RNA, 19 nt, Homo sapiens
ggaauuugcuuuggaggaa

SEQ ID NO: 999868 - RNA, 19 nt, Homo sapiens
gaggaaacccugacucauu

SEQ ID NO: 999869 - RNA, 19 nt, Homo sapiens
gaggaggcgugaaugaauu

SEQ ID NO: 999870 - RNA, 19 nt, Homo sapiens
gggagacacuggcuauuau

SEQ ID NO: 999871 - RNA, 19 nt, Homo sapiens
ccaaauacauugaacugau

SEQ ID NO: 999872 - RNA, 19 nt, Homo sapiens
gcuguccucugaauacaua

SEQ ID NO: 999873 - RNA, 19 nt, Homo sapiens
cauaauugcuggcaccauu

SEQ ID NO: 999874 - RNA, 19 nt, Homo sapiens
gggaugugcuuugugguua

SEQ ID NO: 999875 - RNA, 19 nt, Homo sapiens
ccaagguccugugcaaaua

SEQ ID NO: 999876 - RNA, 19 nt, Homo sapiens
caaauacauugaacugaug

SEQ ID NO: 999877 - RNA, 19 nt, Homo sapiens
gaaccacacauaucucauu

SEQ ID NO: 999878 - RNA, 19 nt, Homo sapiens
guaaagaaggcacuauuug

SEQ ID NO: 999879 - RNA, 19 nt, Homo sapiens
caaaugaugugcuuagaac

SEQ ID NO: 999880 - RNA, 19 nt, Homo sapiens
gaaaggaggaggcgugaau

SEQ ID NO: 999881 - RNA, 19 nt, Homo sapiens
caacaaguuugccauaucu

SEQ ID NO: 999882 - RNA, 19 nt, Homo sapiens
gaguaagucugaaccucua

SEQ ID NO: 999883 - RNA, 19 nt, Homo sapiens
gagcugaagugugugugua

SEQ ID NO: 999884 - RNA, 19 nt, Homo sapiens
gcagcaaggaagaacauua

SEQ ID NO: 999885 - RNA, 19 nt, Homo sapiens
gauagacaaugcaaauaca

SEQ ID NO: 999886 - RNA, 19 nt, Homo sapiens
gcagaguguuguaagaaau

SEQ ID NO: 999887 - RNA, 19 nt, Homo sapiens
gcaccaauaucauaauagg

SEQ ID NO: 999888 - RNA, 19 nt, Homo sapiens
ggagcagaguguuguaaga

SEQ ID NO: 999889 - RNA, 19 nt, Homo sapiens
uuacaaauccagacuguuu

SEQ ID NO: 999890 - RNA, 19 nt, Homo sapiens
aggaaacccugacucauuu

SEQ ID NO: 999891 - RNA, 19 nt, Homo sapiens
gaggagagcacuguuacua

SEQ ID NO: 999892 - RNA, 19 nt, Homo sapiens
gcaaauagugucaaaagua

SEQ ID NO: 999893 - RNA, 19 nt, Homo sapiens
agacaaagacacauggaua

SEQ ID NO: 999894 - RNA, 19 nt, Homo sapiens
uguaagaaaugcaccuuga

SEQ ID NO: 999895 - RNA, 19 nt, Homo sapiens
cgaaaucuguggugaacau

SEQ ID NO: 999896 - RNA, 19 nt, Homo sapiens
cagcaaggaagaacauuaa

SEQ ID NO: 999897 - RNA, 19 nt, Homo sapiens
ggaaagacaaagacacaug

SEQ ID NO: 999898 - RNA, 19 nt, Homo sapiens
gacacuggcuauuaucuuc

SEQ ID NO: 999899 - RNA, 19 nt, Homo sapiens
gacaacaaguuugccauau

SEQ ID NO: 999900 - RNA, 19 nt, Homo sapiens
uuaagcagauagucaaaga

SEQ ID NO: 999901 - RNA, 19 nt, Homo sapiens
agacaaauauugcuaugag

SEQ ID NO: 999902 - RNA, 19 nt, Homo sapiens
gcaguaaaugauugugaua

SEQ ID NO: 999903 - RNA, 19 nt, Homo sapiens
gaacugaugauugugaaug

SEQ ID NO: 999904 - RNA, 19 nt, Homo sapiens
ugacucauuuguugcauug

SEQ ID NO: 999905 - RNA, 19 nt, Homo sapiens
gcuaugagaaacugaauau

SEQ ID NO: 999906 - RNA, 19 nt, Homo sapiens
ggugacagcaucagacaaa

SEQ ID NO: 999907 - RNA, 19 nt, Homo sapiens
gagauagacaaugcaaaua

SEQ ID NO: 999908 - RNA, 19 nt, Homo sapiens
ggauggauauucaugugau

SEQ ID NO: 999909 - RNA, 19 nt, Homo sapiens
gaaugaucaccuuauguuu

SEQ ID NO: 999910 - RNA, 19 nt, Homo sapiens
gaucuuccaucugaauuuc

SEQ ID NO: 999911 - RNA, 19 nt, Homo sapiens
uggcaccaauaucauaaua

SEQ ID NO: 999912 - RNA, 19 nt, Homo sapiens
acauugaacugaugauugu

SEQ ID NO: 999913 - RNA, 19 nt, Homo sapiens
gaaaccaaauacauugaac

SEQ ID NO: 999914 - RNA, 19 nt, Homo sapiens
gaagaagaaaccaaauaca

SEQ ID NO: 999915 - RNA, 19 nt, Homo sapiens
ucacaaugaugaugcaaag

SEQ ID NO: 999916 - RNA, 19 nt, Homo sapiens
gaagaugggacaccuugug

SEQ ID NO: 999917 - RNA, 19 nt, Homo sapiens
gcaguugacucauguugac

SEQ ID NO: 999918 - RNA, 19 nt, Homo sapiens
ggccgaauguguccuugaa

SEQ ID NO: 999919 - RNA, 19 nt, Homo sapiens
uuuaauggcuguuacacuu

SEQ ID NO: 999920 - RNA, 19 nt, Homo sapiens
cuacgugaguuuaugaaau

SEQ ID NO: 999921 - RNA, 19 nt, Homo sapiens
ugaaugaucaccuuauguu

SEQ ID NO: 999922 - RNA, 19 nt, Homo sapiens
gacagcaucagacaaauau

SEQ ID NO: 999923 - RNA, 19 nt, Homo sapiens
ggaggaggcgugaaugaau

SEQ ID NO: 999924 - RNA, 19 nt, Homo sapiens
aauccagacuguuugaauu

SEQ ID NO: 999925 - RNA, 19 nt, Homo sapiens
ucaagaggauuuccauuuu

SEQ ID NO: 999926 - RNA, 19 nt, Homo sapiens
gcagauagucaaagaacug

SEQ ID NO: 999927 - RNA, 19 nt, Homo sapiens
gagaacagaggucaaaugg

SEQ ID NO: 999928 - RNA, 19 nt, Homo sapiens
caacaaacgggaugugcuu

SEQ ID NO: 999929 - RNA, 19 nt, Homo sapiens
gacaaauauugcuaugaga

SEQ ID NO: 999930 - RNA, 19 nt, Homo sapiens
ugacagcaucagacaaaua

SEQ ID NO: 999931 - RNA, 19 nt, Homo sapiens
gagcagaguguuguaagaa

SEQ ID NO: 999932 - RNA, 19 nt, Homo sapiens
guuagcaaguggugaaugu

SEQ ID NO: 999933 - RNA, 19 nt, Homo sapiens
gcaggagacgccucauuga

SEQ ID NO: 999934 - RNA, 19 nt, Homo sapiens
acacauggauacagugcaa

SEQ ID NO: 999935 - RNA, 19 nt, Homo sapiens
aaagacacauggauacagu

SEQ ID NO: 999936 - RNA, 19 nt, Homo sapiens
ggagaggagugugauugug

SEQ ID NO: 999937 - RNA, 19 nt, Homo sapiens
ggagggauuuuaucaaaga

SEQ ID NO: 999938 - RNA, 19 nt, Homo sapiens
ugacaacaaguuugccaua

SEQ ID NO: 999939 - RNA, 19 nt, Homo sapiens
guucugauugcaacacuua

SEQ ID NO: 999940 - RNA, 19 nt, Homo sapiens
cgugaaacgugcucaggaa

SEQ ID NO: 999941 - RNA, 19 nt, Homo sapiens
gguauuaucucagacaaaa

SEQ ID NO: 999942 - RNA, 19 nt, Homo sapiens
caacuuaagaccaggauag

SEQ ID NO: 999943 - RNA, 19 nt, Homo sapiens
ucgauauccucguaaugua

SEQ ID NO: 999944 - RNA, 19 nt, Homo sapiens
gaaaaugggcgaccucgaa

SEQ ID NO: 999945 - RNA, 19 nt, Homo sapiens
gcaguaaugagcugaagug

SEQ ID NO: 999946 - RNA, 19 nt, Homo sapiens
cagcaucagacaaauauug

SEQ ID NO: 999947 - RNA, 19 nt, Homo sapiens
gaaaggauuccagacacaa

SEQ ID NO: 999948 - RNA, 19 nt, Homo sapiens
uuacuucccucacaaugau

SEQ ID NO: 999949 - RNA, 19 nt, Homo sapiens
agaacucgauggugaaauc

SEQ ID NO: 999950 - RNA, 19 nt, Homo sapiens
gaaggagcagaguguugua

SEQ ID NO: 999951 - RNA, 19 nt, Homo sapiens
ugaaaggauuccagacaca

SEQ ID NO: 999952 - RNA, 19 nt, Homo sapiens
caaggaagaacauuaaacu

SEQ ID NO: 999953 - RNA, 19 nt, Homo sapiens
gugacggucuuugcuguaa

SEQ ID NO: 999954 - RNA, 19 nt, Homo sapiens
ggugaacauggcagauuua

SEQ ID NO: 999955 - RNA, 19 nt, Homo sapiens
ggucuaauucaacugagua

SEQ ID NO: 999956 - RNA, 19 nt, Homo sapiens
gaaacaacaucccauaaua

SEQ ID NO: 999957 - RNA, 19 nt, Homo sapiens
gaacauggcagauuuaaua

SEQ ID NO: 999958 - RNA, 19 nt, Homo sapiens
caacaaaccuucuaagcuu

SEQ ID NO: 999959 - RNA, 19 nt, Homo sapiens
gcaugaagcuucuguuuau

SEQ ID NO: 999960 - RNA, 19 nt, Homo sapiens
guaaugagcugaagugugu

SEQ ID NO: 999961 - RNA, 19 nt, Homo sapiens
uaaagguacugguauguua

SEQ ID NO: 999962 - RNA, 19 nt, Homo sapiens
gaaauggaguuugcaguaa

SEQ ID NO: 999963 - RNA, 19 nt, Homo sapiens
gaaaucacaucuacuuuag

SEQ ID NO: 999964 - RNA, 19 nt, Homo sapiens
uaucaugacuuccugaaua

SEQ ID NO: 999965 - RNA, 19 nt, Homo sapiens
gcaagacuguggaaguuaa

SEQ ID NO: 999966 - RNA, 19 nt, Homo sapiens
gaaacgugcucaggaaauu

SEQ ID NO: 999967 - RNA, 19 nt, Homo sapiens
gaagaaaccaaauacauug

SEQ ID NO: 999968 - RNA, 19 nt, Homo sapiens
ggaaauggaguuugcagua

SEQ ID NO: 999969 - RNA, 19 nt, Homo sapiens
ggauuuaacuaaccaugaa

SEQ ID NO: 999970 - RNA, 19 nt, Homo sapiens
gguagaagaugugaauaaa

SEQ ID NO: 999971 - RNA, 19 nt, Homo sapiens
gagaagcaguaaaugauug

SEQ ID NO: 999972 - RNA, 19 nt, Homo sapiens
caacaucccauaauagaaa

SEQ ID NO: 999973 - RNA, 19 nt, Homo sapiens
gcuaaggcauauaggauuu

SEQ ID NO: 999974 - RNA, 19 nt, Homo sapiens
ggaauuugcuuuggaggaa

SEQ ID NO: 999975 - RNA, 19 nt, Homo sapiens
gaggaaacccugacucauu

SEQ ID NO: 999976 - RNA, 19 nt, Homo sapiens
gaucaacuguuuacaugug

SEQ ID NO: 999977 - RNA, 19 nt, Homo sapiens
gucauuggcuuaggauuua

SEQ ID NO: 999978 - RNA, 19 nt, Homo sapiens
gaggaggcgugaaugaauu

SEQ ID NO: 999979 - RNA, 19 nt, Homo sapiens
gggagacacuggcuauuau

SEQ ID NO: 999980 - RNA, 19 nt, Homo sapiens
ccaaauacauugaacugau

SEQ ID NO: 999981 - RNA, 19 nt, Homo sapiens
gcuguccucugaauacaua

SEQ ID NO: 999982 - RNA, 19 nt, Homo sapiens
gaaaggccaauaucccaua

SEQ ID NO: 999983 - RNA, 19 nt, Homo sapiens
gaccauacuuuaggacuuu

SEQ ID NO: 999984 - RNA, 19 nt, Homo sapiens
gaaggaccauacuuuagga

SEQ ID NO: 999985 - RNA, 19 nt, Homo sapiens
cauaauugcuggcaccauu

SEQ ID NO: 999986 - RNA, 19 nt, Homo sapiens
gggaugugcuuugugguua

SEQ ID NO: 999987 - RNA, 19 nt, Homo sapiens
caaauacauugaacugaug

SEQ ID NO: 999988 - RNA, 19 nt, Homo sapiens
gaaccacacauaucucauu

SEQ ID NO: 999989 - RNA, 19 nt, Homo sapiens
ggaaacaacaucccauaau

SEQ ID NO: 999990 - RNA, 19 nt, Homo sapiens
guacaauaguggauucaga

SEQ ID NO: 999991 - RNA, 19 nt, Homo sapiens
guaaagaaggcacuauuug

SEQ ID NO: 999992 - RNA, 19 nt, Homo sapiens
caaaugaugugcuuagaac

SEQ ID NO: 999993 - RNA, 19 nt, Homo sapiens
gaaaggaggaggcgugaau

SEQ ID NO: 999994 - RNA, 19 nt, Homo sapiens
caacaaguuugccauaucu

SEQ ID NO: 999995 - RNA, 19 nt, Homo sapiens
caauaaagguacugguaug

SEQ ID NO: 999996 - RNA, 19 nt, Homo sapiens
gagcugaagugugugugua

SEQ ID NO: 999997 - RNA, 19 nt, Homo sapiens
gcagcaaggaagaacauua

SEQ ID NO: 999998 - RNA, 19 nt, Homo sapiens
gauagacaaugcaaauaca

SEQ ID NO: 999999 - RNA, 19 nt, Homo sapiens
gcagaguguuguaagaaau

SEQ ID NO: 1000000 - RNA, 19 nt, Homo sapiens
guacugguauguuaaugga

SEQ ID NO: 1000001 - RNA, 19 nt, Homo sapiens
gcaccaauaucauaauagg

SEQ ID NO: 1000002 - RNA, 19 nt, Homo sapiens
ggagcagaguguuguaaga

SEQ ID NO: 1000003 - RNA, 19 nt, Homo sapiens
uuacaaauccagacuguuu

SEQ ID NO: 1000004 - RNA, 19 nt, Homo sapiens
aggaaacccugacucauuu

SEQ ID NO: 1000005 - RNA, 19 nt, Homo sapiens
uaacucacaugacccaaau

SEQ ID NO: 1000006 - RNA, 19 nt, Homo sapiens
agacauccauuuaagauca

SEQ ID NO: 1000007 - RNA, 19 nt, Homo sapiens
gaaagugaaccgacaaagu

SEQ ID NO: 1000008 - RNA, 19 nt, Homo sapiens
gaggagagcacuguuacua

SEQ ID NO: 1000009 - RNA, 19 nt, Homo sapiens
agacaaagacacauggaua

SEQ ID NO: 1000010 - RNA, 19 nt, Homo sapiens
ggaccauacuuuaggacuu

SEQ ID NO: 1000011 - RNA, 19 nt, Homo sapiens
uguaagaaaugcaccuuga

SEQ ID NO: 1000012 - RNA, 19 nt, Homo sapiens
cgaaaucuguggugaacau

SEQ ID NO: 1000013 - RNA, 19 nt, Homo sapiens
uagcaaguuuccuaaggua

SEQ ID NO: 1000014 - RNA, 19 nt, Homo sapiens
ggagacauccauuuaagau

SEQ ID NO: 1000015 - RNA, 19 nt, Homo sapiens
gaaaauacccuuacccaau

SEQ ID NO: 1000016 - RNA, 19 nt, Homo sapiens
cagcaaggaagaacauuaa

SEQ ID NO: 1000017 - RNA, 19 nt, Homo sapiens
ggaaagacaaagacacaug

SEQ ID NO: 1000018 - RNA, 19 nt, Homo sapiens
gacacuggcuauuaucuuc

SEQ ID NO: 1000019 - RNA, 19 nt, Homo sapiens
gacaacaaguuugccauau

SEQ ID NO: 1000020 - RNA, 19 nt, Homo sapiens
aagaucaacuguuuacaug

SEQ ID NO: 1000021 - RNA, 19 nt, Homo sapiens
agacaaauauugcuaugag

SEQ ID NO: 1000022 - RNA, 19 nt, Homo sapiens
gcaguaaaugauugugaua

SEQ ID NO: 1000023 - RNA, 19 nt, Homo sapiens
gaacugaugauugugaaug

SEQ ID NO: 1000024 - RNA, 19 nt, Homo sapiens
ugacucauuuguugcauug

SEQ ID NO: 1000025 - RNA, 19 nt, Homo sapiens
gcuaugagaaacugaauau

SEQ ID NO: 1000026 - RNA, 19 nt, Homo sapiens
ggugacagcaucagacaaa

SEQ ID NO: 1000027 - RNA, 19 nt, Homo sapiens
gagauagacaaugcaaaua

SEQ ID NO: 1000028 - RNA, 19 nt, Homo sapiens
ggauggauauucaugugau

SEQ ID NO: 1000029 - RNA, 19 nt, Homo sapiens
gaaugaucaccuuauguuu

SEQ ID NO: 1000030 - RNA, 19 nt, Homo sapiens
gaucuuccaucugaauuuc

SEQ ID NO: 1000031 - RNA, 19 nt, Homo sapiens
uaggcuaacuuuaaacaug

SEQ ID NO: 1000032 - RNA, 19 nt, Homo sapiens
caugacagauaauauguag

SEQ ID NO: 1000033 - RNA, 19 nt, Homo sapiens
ggguagaagaugugaauaa

SEQ ID NO: 1000034 - RNA, 19 nt, Homo sapiens
uggcaccaauaucauaaua

SEQ ID NO: 1000035 - RNA, 19 nt, Homo sapiens
acauugaacugaugauugu

SEQ ID NO: 1000036 - RNA, 19 nt, Homo sapiens
gaaaccaaauacauugaac

SEQ ID NO: 1000037 - RNA, 19 nt, Homo sapiens
gaagaagaaaccaaauaca

SEQ ID NO: 1000038 - RNA, 19 nt, Homo sapiens
cccauaggcuaacuuuaaa

SEQ ID NO: 1000039 - RNA, 19 nt, Homo sapiens
aauaguggauucagaacuu

SEQ ID NO: 1000040 - RNA, 19 nt, Homo sapiens
gagacuauaauguagcuaa

SEQ ID NO: 1000041 - RNA, 19 nt, Homo sapiens
ucacaaugaugaugcaaag

SEQ ID NO: 1000042 - RNA, 19 nt, Homo sapiens
gaagaugggacaccuugug

SEQ ID NO: 1000043 - RNA, 19 nt, Homo sapiens
ggccgaauguguccuugaa

SEQ ID NO: 1000044 - RNA, 19 nt, Homo sapiens
uuuaauggcuguuacacuu

SEQ ID NO: 1000045 - RNA, 19 nt, Homo sapiens
gcaguugacucauguugac

SEQ ID NO: 1000046 - RNA, 19 nt, Homo sapiens
cuacgugaguuuaugaaau

SEQ ID NO: 1000047 - RNA, 19 nt, Homo sapiens
ugaaugaucaccuuauguu

SEQ ID NO: 1000048 - RNA, 19 nt, Homo sapiens
gaagcggaguuucacaucu

SEQ ID NO: 1000049 - RNA, 19 nt, Homo sapiens
gacagcaucagacaaauau

SEQ ID NO: 1000050 - RNA, 19 nt, Homo sapiens
ggaggaggcgugaaugaau

SEQ ID NO: 1000051 - RNA, 19 nt, Homo sapiens
aauccagacuguuugaauu

SEQ ID NO: 1000052 - RNA, 19 nt, Homo sapiens
ucaagaggauuuccauuuu

SEQ ID NO: 1000053 - RNA, 19 nt, Homo sapiens
uagcauacaaggacaauug

SEQ ID NO: 1000054 - RNA, 19 nt, Homo sapiens
ucccauaggcuaacuuuaa

SEQ ID NO: 1000055 - RNA, 19 nt, Homo sapiens
aaagugaaccgacaaagug

SEQ ID NO: 1000056 - RNA, 19 nt, Homo sapiens
gaaacaacaucccauaaua

SEQ ID NO: 1000057 - RNA, 19 nt, Homo sapiens
gaacauggcagauuuaaua

SEQ ID NO: 1000058 - RNA, 19 nt, Homo sapiens
caacaaaccuucuaagcuu

SEQ ID NO: 1000059 - RNA, 19 nt, Homo sapiens
gcaugaagcuucuguuuau

SEQ ID NO: 1000060 - RNA, 19 nt, Homo sapiens
guaaugagcugaagugugu

SEQ ID NO: 1000061 - RNA, 19 nt, Homo sapiens
uaaagguacugguauguua

SEQ ID NO: 1000062 - RNA, 19 nt, Homo sapiens
gaaauggaguuugcaguaa

SEQ ID NO: 1000063 - RNA, 19 nt, Homo sapiens
gaaaucacaucuacuuuag

SEQ ID NO: 1000064 - RNA, 19 nt, Homo sapiens
uaucaugacuuccugaaua

SEQ ID NO: 1000065 - RNA, 19 nt, Homo sapiens
gcaagacuguggaaguuaa

SEQ ID NO: 1000066 - RNA, 19 nt, Homo sapiens
gaaacgugcucaggaaauu

SEQ ID NO: 1000067 - RNA, 19 nt, Homo sapiens
gaagaaaccaaauacauug

SEQ ID NO: 1000068 - RNA, 19 nt, Homo sapiens
ggaaauggaguuugcagua

SEQ ID NO: 1000069 - RNA, 19 nt, Homo sapiens
ggauuuaacuaaccaugaa

SEQ ID NO: 1000070 - RNA, 19 nt, Homo sapiens
gagaagcaguaaaugauug

SEQ ID NO: 1000071 - RNA, 19 nt, Homo sapiens
caacaucccauaauagaaa

SEQ ID NO: 1000072 - RNA, 19 nt, Homo sapiens
gcuaaggcauauaggauuu

SEQ ID NO: 1000073 - RNA, 19 nt, Homo sapiens
ggaauuugcuuuggaggaa

SEQ ID NO: 1000074 - RNA, 19 nt, Homo sapiens
gaggaaacccugacucauu

SEQ ID NO: 1000075 - RNA, 19 nt, Homo sapiens
gcaaaucuaucugcucuuc

SEQ ID NO: 1000076 - RNA, 19 nt, Homo sapiens
gaucaacuguuuacaugug

SEQ ID NO: 1000077 - RNA, 19 nt, Homo sapiens
gucauuggcuuaggauuua

SEQ ID NO: 1000078 - RNA, 19 nt, Homo sapiens
gaggaggcgugaaugaauu

SEQ ID NO: 1000079 - RNA, 19 nt, Homo sapiens
gggagacacuggcuauuau

SEQ ID NO: 1000080 - RNA, 19 nt, Homo sapiens
ccaaauacauugaacugau

SEQ ID NO: 1000081 - RNA, 19 nt, Homo sapiens
gcuguccucugaauacaua

SEQ ID NO: 1000082 - RNA, 19 nt, Homo sapiens
gaaaggccaauaucccaua

SEQ ID NO: 1000083 - RNA, 19 nt, Homo sapiens
cauaauugcuggcaccauu

SEQ ID NO: 1000084 - RNA, 19 nt, Homo sapiens
gggaugugcuuugugguua

SEQ ID NO: 1000085 - RNA, 19 nt, Homo sapiens
caaauacauugaacugaug

SEQ ID NO: 1000086 - RNA, 19 nt, Homo sapiens
gaaccacacauaucucauu

SEQ ID NO: 1000087 - RNA, 19 nt, Homo sapiens
ggaaacaacaucccauaau

SEQ ID NO: 1000088 - RNA, 19 nt, Homo sapiens
guacaauaguggauucaga

SEQ ID NO: 1000089 - RNA, 19 nt, Homo sapiens
guaaagaaggcacuauuug

SEQ ID NO: 1000090 - RNA, 19 nt, Homo sapiens
caaaugaugugcuuagaac

SEQ ID NO: 1000091 - RNA, 19 nt, Homo sapiens
gaaaggaggaggcgugaau

SEQ ID NO: 1000092 - RNA, 19 nt, Homo sapiens
caacaaguuugccauaucu

SEQ ID NO: 1000093 - RNA, 19 nt, Homo sapiens
caauaaagguacugguaug

SEQ ID NO: 1000094 - RNA, 19 nt, Homo sapiens
gagcugaagugugugugua

SEQ ID NO: 1000095 - RNA, 19 nt, Homo sapiens
gcagcaaggaagaacauua

SEQ ID NO: 1000096 - RNA, 19 nt, Homo sapiens
gauagacaaugcaaauaca

SEQ ID NO: 1000097 - RNA, 19 nt, Homo sapiens
gcagaguguuguaagaaau

SEQ ID NO: 1000098 - RNA, 19 nt, Homo sapiens
guacugguauguuaaugga

SEQ ID NO: 1000099 - RNA, 19 nt, Homo sapiens
gcaccaauaucauaauagg

SEQ ID NO: 1000100 - RNA, 19 nt, Homo sapiens
ggagcagaguguuguaaga

SEQ ID NO: 1000101 - RNA, 19 nt, Homo sapiens
uuacaaauccagacuguuu

SEQ ID NO: 1000102 - RNA, 19 nt, Homo sapiens
aggaaacccugacucauuu

SEQ ID NO: 1000103 - RNA, 19 nt, Homo sapiens
uaacucacaugacccaaau

SEQ ID NO: 1000104 - RNA, 19 nt, Homo sapiens
uggaaucacugcaaaucua

SEQ ID NO: 1000105 - RNA, 19 nt, Homo sapiens
agacauccauuuaagauca

SEQ ID NO: 1000106 - RNA, 19 nt, Homo sapiens
gaaagugaaccgacaaagu

SEQ ID NO: 1000107 - RNA, 19 nt, Homo sapiens
gaggagagcacuguuacua

SEQ ID NO: 1000108 - RNA, 19 nt, Homo sapiens
agacaaagacacauggaua

SEQ ID NO: 1000109 - RNA, 19 nt, Homo sapiens
ccagggagauuauguaaaa

SEQ ID NO: 1000110 - RNA, 19 nt, Homo sapiens
uguaagaaaugcaccuuga

SEQ ID NO: 1000111 - RNA, 19 nt, Homo sapiens
cgaaaucuguggugaacau

SEQ ID NO: 1000112 - RNA, 19 nt, Homo sapiens
uagcaaguuuccuaaggua

SEQ ID NO: 1000113 - RNA, 19 nt, Homo sapiens
ggagacauccauuuaagau

SEQ ID NO: 1000114 - RNA, 19 nt, Homo sapiens
gaaaauacccuuacccaau

SEQ ID NO: 1000115 - RNA, 19 nt, Homo sapiens
cagcaaggaagaacauuaa

SEQ ID NO: 1000116 - RNA, 19 nt, Homo sapiens
ggaaagacaaagacacaug

SEQ ID NO: 1000117 - RNA, 19 nt, Homo sapiens
gacacuggcuauuaucuuc

SEQ ID NO: 1000118 - RNA, 19 nt, Homo sapiens
gacaacaaguuugccauau

SEQ ID NO: 1000119 - RNA, 19 nt, Homo sapiens
aagaucaacuguuuacaug

SEQ ID NO: 1000120 - RNA, 19 nt, Homo sapiens
agacaaauauugcuaugag

SEQ ID NO: 1000121 - RNA, 19 nt, Homo sapiens
gcaguaaaugauugugaua

SEQ ID NO: 1000122 - RNA, 19 nt, Homo sapiens
gaacugaugauugugaaug

SEQ ID NO: 1000123 - RNA, 19 nt, Homo sapiens
ugacucauuuguugcauug

SEQ ID NO: 1000124 - RNA, 19 nt, Homo sapiens
gcuaugagaaacugaauau

SEQ ID NO: 1000125 - RNA, 19 nt, Homo sapiens
ggugacagcaucagacaaa

SEQ ID NO: 1000126 - RNA, 19 nt, Homo sapiens
gagauagacaaugcaaaua

SEQ ID NO: 1000127 - RNA, 19 nt, Homo sapiens
ggauggauauucaugugau

SEQ ID NO: 1000128 - RNA, 19 nt, Homo sapiens
gaaugaucaccuuauguuu

SEQ ID NO: 1000129 - RNA, 19 nt, Homo sapiens
gaucuuccaucugaauuuc

SEQ ID NO: 1000130 - RNA, 19 nt, Homo sapiens
uaggcuaacuuuaaacaug

SEQ ID NO: 1000131 - RNA, 19 nt, Homo sapiens
caugacagauaauauguag

SEQ ID NO: 1000132 - RNA, 19 nt, Homo sapiens
uggcaccaauaucauaaua

SEQ ID NO: 1000133 - RNA, 19 nt, Homo sapiens
acauugaacugaugauugu

SEQ ID NO: 1000134 - RNA, 19 nt, Homo sapiens
gaaaccaaauacauugaac

SEQ ID NO: 1000135 - RNA, 19 nt, Homo sapiens
gaagaagaaaccaaauaca

SEQ ID NO: 1000136 - RNA, 19 nt, Homo sapiens
cccauaggcuaacuuuaaa

SEQ ID NO: 1000137 - RNA, 19 nt, Homo sapiens
aauaguggauucagaacuu

SEQ ID NO: 1000138 - RNA, 19 nt, Homo sapiens
gcaguugacucauguugac

SEQ ID NO: 1000139 - RNA, 19 nt, Homo sapiens
ucacaaugaugaugcaaag

SEQ ID NO: 1000140 - RNA, 19 nt, Homo sapiens
gaagaugggacaccuugug

SEQ ID NO: 1000141 - RNA, 19 nt, Homo sapiens
ggccgaauguguccuugaa

SEQ ID NO: 1000142 - RNA, 19 nt, Homo sapiens
uuuaauggcuguuacacuu

SEQ ID NO: 1000143 - RNA, 19 nt, Homo sapiens
cuacgugaguuuaugaaau

SEQ ID NO: 1000144 - RNA, 19 nt, Homo sapiens
ugaaugaucaccuuauguu

SEQ ID NO: 1000145 - RNA, 19 nt, Homo sapiens
gaagcggaguuucacaucu

SEQ ID NO: 1000146 - RNA, 19 nt, Homo sapiens
gacagcaucagacaaauau

SEQ ID NO: 1000147 - RNA, 19 nt, Homo sapiens
ggaggaggcgugaaugaau

SEQ ID NO: 1000148 - RNA, 19 nt, Homo sapiens
aauccagacuguuugaauu

SEQ ID NO: 1000149 - RNA, 19 nt, Homo sapiens
ucaagaggauuuccauuuu

SEQ ID NO: 1000150 - RNA, 19 nt, Homo sapiens
uagcauacaaggacaauug

SEQ ID NO: 1000151 - RNA, 19 nt, Homo sapiens
ucccauaggcuaacuuuaa

SEQ ID NO: 1000152 - RNA, 19 nt, Homo sapiens
aaagugaaccgacaaagug

SEQ ID NO: 1000153 - RNA, 19 nt, Homo sapiens
cuaauucaacugagacuuu

SEQ ID NO: 1000154 - RNA, 19 nt, Homo sapiens
gcacaaacucagcaucuag

SEQ ID NO: 1000155 - RNA, 19 nt, Homo sapiens
caacaaacgggaugugcuu

SEQ ID NO: 1000156 - RNA, 19 nt, Homo sapiens
gagaagaggcagauaauua

SEQ ID NO: 1000157 - RNA, 19 nt, Homo sapiens
gaagugggcacaaauuuaa

SEQ ID NO: 1000158 - RNA, 19 nt, Homo sapiens
guaaauacguggcgguaaa

SEQ ID NO: 1000159 - RNA, 19 nt, Homo sapiens
ggaagaagauggccaaguc

SEQ ID NO: 1000160 - RNA, 19 nt, Homo sapiens
ggacaagaaugcagaagug

SEQ ID NO: 1000161 - RNA, 19 nt, Homo sapiens
uaagaucccugccacagua

SEQ ID NO: 1000162 - RNA, 19 nt, Homo sapiens
gggcacaaauuuaaucaaa

SEQ ID NO: 1000163 - RNA, 19 nt, Homo sapiens
gaagguugauuaucguaaa

SEQ ID NO: 1000164 - RNA, 19 nt, Homo sapiens
ugucagaacuccauggaua

SEQ ID NO: 1000165 - RNA, 19 nt, Homo sapiens
ggaaagcaauaccgauaug

SEQ ID NO: 1000166 - RNA, 19 nt, Homo sapiens
ggaugaggaugacggagua

SEQ ID NO: 1000167 - RNA, 19 nt, Homo sapiens
cuccauggauuauucauua

SEQ ID NO: 1000168 - RNA, 19 nt, Homo sapiens
gcauacauccggagaauga

SEQ ID NO: 1000169 - RNA, 19 nt, Homo sapiens
gaagacaaaguaugugauu

SEQ ID NO: 1000170 - RNA, 19 nt, Homo sapiens
uaaguuacaugaccaggaa

SEQ ID NO: 1000171 - RNA, 19 nt, Homo sapiens
gcaggccgcuucugaggaa

SEQ ID NO: 1000172 - RNA, 19 nt, Homo sapiens
gcaauaccgauaugucuuu

SEQ ID NO: 1000173 - RNA, 19 nt, Homo sapiens
ggaugacggaguaaucuua

SEQ ID NO: 1000174 - RNA, 19 nt, Homo sapiens
gcaccuguuugcuguuaaa

SEQ ID NO: 1000175 - RNA, 19 nt, Homo sapiens
ggaagguuaugccacuuug

SEQ ID NO: 1000176 - RNA, 19 nt, Homo sapiens
gaacgagccacuaaccuau

SEQ ID NO: 1000177 - RNA, 19 nt, Homo sapiens
ccacggcccugaaggaaga

SEQ ID NO: 1000178 - RNA, 19 nt, Homo sapiens
cgagaacuaugucaucuuc

SEQ ID NO: 1000179 - RNA, 19 nt, Homo sapiens
ccaaagcuuucuccuacuu

SEQ ID NO: 1000180 - RNA, 19 nt, Homo sapiens
gaagaggcagauaauuauu

SEQ ID NO: 1000181 - RNA, 19 nt, Homo sapiens
gcagaagugggcacaaauu

SEQ ID NO: 1000182 - RNA, 19 nt, Homo sapiens
gggaggagaagacuuauau

SEQ ID NO: 1000183 - RNA, 19 nt, Homo sapiens
caaagugacaggcaagauu

SEQ ID NO: 1000184 - RNA, 19 nt, Homo sapiens
agccaggccugaugaguua

SEQ ID NO: 1000185 - RNA, 19 nt, Homo sapiens
ccauggauauguuucuuug

SEQ ID NO: 1000186 - RNA, 19 nt, Homo sapiens
caauuaugcucacaaugga

SEQ ID NO: 1000187 - RNA, 19 nt, Homo sapiens
ucacaaagucauccuuaaa

SEQ ID NO: 1000188 - RNA, 19 nt, Homo sapiens
gaaacggcaucaggagaga

SEQ ID NO: 1000189 - RNA, 19 nt, Homo sapiens
ugaugaggcuggaaauguu

SEQ ID NO: 1000190 - RNA, 19 nt, Homo sapiens
acagacaacugccugauca

SEQ ID NO: 1000191 - RNA, 19 nt, Homo sapiens
ggccugaugaguuaaguua

SEQ ID NO: 1000192 - RNA, 19 nt, Homo sapiens
gaacuccauggauauguuu

SEQ ID NO: 1000193 - RNA, 19 nt, Homo sapiens
ggaucuccauggauuauuc

SEQ ID NO: 1000194 - RNA, 19 nt, Homo sapiens
agaagugggcacaaauuua

SEQ ID NO: 1000195 - RNA, 19 nt, Homo sapiens
caagucauggcguaauaua

SEQ ID NO: 1000196 - RNA, 19 nt, Homo sapiens
ggucaauuaugcucacaau

SEQ ID NO: 1000197 - RNA, 19 nt, Homo sapiens
caaaguggcaucuacaaca

SEQ ID NO: 1000198 - RNA, 19 nt, Homo sapiens
gagaagcgauaccuacaac

SEQ ID NO: 1000199 - RNA, 19 nt, Homo sapiens
ggacuaaauuguguaucug

SEQ ID NO: 1000200 - RNA, 19 nt, Homo sapiens
acagggaggagaagacuua

SEQ ID NO: 1000201 - RNA, 19 nt, Homo sapiens
ggagaagguugauuaucgu

SEQ ID NO: 1000202 - RNA, 19 nt, Homo sapiens
ggauuguggugucugaguu

SEQ ID NO: 1000203 - RNA, 19 nt, Homo sapiens
acaccaauauugaggcaaa

SEQ ID NO: 1000204 - RNA, 19 nt, Homo sapiens
acgagccacuaaccuauua

SEQ ID NO: 1000205 - RNA, 19 nt, Homo sapiens
ccucugaccugaugguguu

SEQ ID NO: 1000206 - RNA, 19 nt, Homo sapiens
ggacggcugcaucguguuu

SEQ ID NO: 1000207 - RNA, 19 nt, Homo sapiens
cgaccucagagaccaauua

SEQ ID NO: 1000208 - RNA, 19 nt, Homo sapiens
gccauugucucuacugauc

SEQ ID NO: 1000209 - RNA, 19 nt, Homo sapiens
gguuggauauucucaagau

SEQ ID NO: 1000210 - RNA, 19 nt, Homo sapiens
agaagaggcagauaauuau

SEQ ID NO: 1000211 - RNA, 19 nt, Homo sapiens
gagcucggcugucagaacu

SEQ ID NO: 1000212 - RNA, 19 nt, Homo sapiens
caagugagagccagccaaa

SEQ ID NO: 1000213 - RNA, 19 nt, Homo sapiens
cagaagugggcacaaauuu

SEQ ID NO: 1000214 - RNA, 19 nt, Homo sapiens
caucguguuugacgucauu

SEQ ID NO: 1000215 - RNA, 19 nt, Homo sapiens
gaagacuuauauccacauc

SEQ ID NO: 1000216 - RNA, 19 nt, Homo sapiens
caggagagcaggaaggaaa

SEQ ID NO: 1000217 - RNA, 19 nt, Homo sapiens
gggcuccucugaccugaug

SEQ ID NO: 1000218 - RNA, 19 nt, Homo sapiens
ggagggccuuuguuaccuu

SEQ ID NO: 1000219 - RNA, 19 nt, Homo sapiens
gccaaaagcuuuacggaau

SEQ ID NO: 1000220 - RNA, 19 nt, Homo sapiens
ggaguccaaucccaaccaa

SEQ ID NO: 1000221 - RNA, 19 nt, Homo sapiens
agacuuauauccacaucau

SEQ ID NO: 1000222 - RNA, 19 nt, Homo sapiens
gggaagacaaaguauguga

SEQ ID NO: 1000223 - RNA, 19 nt, Homo sapiens
caucagagacggugaaguc

SEQ ID NO: 1000224 - RNA, 19 nt, Homo sapiens
ugcaagucauggcguaaua

SEQ ID NO: 1000225 - RNA, 19 nt, Homo sapiens
uacaugaccaggaagguua

SEQ ID NO: 1000226 - RNA, 19 nt, Homo sapiens
ucaauuaugcucacaaugg

SEQ ID NO: 1000227 - RNA, 19 nt, Homo sapiens
gccggaauuucuuuaugaa

SEQ ID NO: 1000228 - RNA, 19 nt, Homo sapiens
uaccacagcuuuggaguca

SEQ ID NO: 1000229 - RNA, 19 nt, Homo sapiens
agucauggcguaauauaaa

SEQ ID NO: 1000230 - RNA, 19 nt, Homo sapiens
ccauguuucugguggacua

SEQ ID NO: 1000231 - RNA, 19 nt, Homo sapiens
acaagggcauggcaagaga

SEQ ID NO: 1000232 - RNA, 19 nt, Homo sapiens
gaacccugcuccgcaaugg

SEQ ID NO: 1000233 - RNA, 19 nt, Homo sapiens
gagggccuuuguuaccuuu

SEQ ID NO: 1000234 - RNA, 19 nt, Homo sapiens
gcaggaauaggaaagaaca

SEQ ID NO: 1000235 - RNA, 19 nt, Homo sapiens
caacgucacauccccauua

SEQ ID NO: 1000236 - RNA, 19 nt, Homo sapiens
uggagaagguugauuaucg

SEQ ID NO: 1000237 - RNA, 19 nt, Homo sapiens
cuccacagcuucaccauca

SEQ ID NO: 1000238 - RNA, 19 nt, Homo sapiens
uuagagaagaggcagauaa

SEQ ID NO: 1000239 - RNA, 19 nt, Homo sapiens
uaucagccauugucucuac

SEQ ID NO: 1000240 - RNA, 19 nt, Homo sapiens
gagaagguugauuaucgua

SEQ ID NO: 1000241 - RNA, 19 nt, Homo sapiens
gacauggacugggacacaa

SEQ ID NO: 1000242 - RNA, 19 nt, Homo sapiens
ccugagcaauggauauaau

SEQ ID NO: 1000243 - RNA, 19 nt, Homo sapiens
gaugaguuaaguuacauga

SEQ ID NO: 1000244 - RNA, 19 nt, Homo sapiens
agaacgagccacuaaccua

SEQ ID NO: 1000245 - RNA, 19 nt, Homo sapiens
uugauuagauccaguccuu

SEQ ID NO: 1000246 - RNA, 19 nt, Homo sapiens
agaacuccauggauauguu

SEQ ID NO: 1000247 - RNA, 19 nt, Homo sapiens
ggagagacagagaugugaa

SEQ ID NO: 1000248 - RNA, 19 nt, Homo sapiens
cagccggaauuucuuuaug

SEQ ID NO: 1000249 - RNA, 19 nt, Homo sapiens
caacagccacggcccugaa

SEQ ID NO: 1000250 - RNA, 19 nt, Homo sapiens
ccucagagaccaauuacau

SEQ ID NO: 1000251 - RNA, 19 nt, Homo sapiens
ccaaaagcuuuacggaauu

SEQ ID NO: 1000252 - RNA, 19 nt, Homo sapiens
guaaucuuaucagccauug

SEQ ID NO: 1000253 - RNA, 19 nt, Homo sapiens
gaaagcaauaccgauaugu

SEQ ID NO: 1000254 - RNA, 19 nt, Homo sapiens
gaacuaugucaucuuccuu

SEQ ID NO: 1000255 - RNA, 19 nt, Homo sapiens
uggaaacccuggagaaggu

SEQ ID NO: 1000256 - RNA, 19 nt, Homo sapiens
gaacucagccuucaucuuc

SEQ ID NO: 1000257 - RNA, 19 nt, Homo sapiens
gagcagccguuauuuauag

SEQ ID NO: 1000258 - RNA, 19 nt, Homo sapiens
gaagggaacuggagaacuc

SEQ ID NO: 1000259 - RNA, 19 nt, Homo sapiens
ggaacaauccaugaacuua

SEQ ID NO: 1000260 - RNA, 19 nt, Homo sapiens
gcagugagcccauguucuu

SEQ ID NO: 1000261 - RNA, 19 nt, Homo sapiens
ggacaugagugugggagaa

SEQ ID NO: 1000262 - RNA, 19 nt, Homo sapiens
gaccaucacugacuucauc

SEQ ID NO: 1000263 - RNA, 19 nt, Homo sapiens
gacuugugcuuucuaaauu

SEQ ID NO: 1000264 - RNA, 19 nt, Homo sapiens
gaagugaucgacaggauug

SEQ ID NO: 1000265 - RNA, 19 nt, Homo sapiens
uuauagaacugcccuguug

SEQ ID NO: 1000266 - RNA, 19 nt, Homo sapiens
ggagaagcccugaggaaga

SEQ ID NO: 1000267 - RNA, 19 nt, Homo sapiens
acaaacgccugcucaaguu

SEQ ID NO: 1000268 - RNA, 19 nt, Homo sapiens
ggagcagccguuauuuaua

SEQ ID NO: 1000269 - RNA, 19 nt, Homo sapiens
uagaaggccugcuggaaga

SEQ ID NO: 1000270 - RNA, 19 nt, Homo sapiens
gcuccaagcuagucaucuu

SEQ ID NO: 1000271 - RNA, 19 nt, Homo sapiens
gaacaauccaugaacuuag

SEQ ID NO: 1000272 - RNA, 19 nt, Homo sapiens
gccaaagccuugagaugga

SEQ ID NO: 1000273 - RNA, 19 nt, Homo sapiens
ugacugcacuggacaucuu

SEQ ID NO: 1000274 - RNA, 19 nt, Homo sapiens
agaaugagcaauugagaaa

SEQ ID NO: 1000275 - RNA, 19 nt, Homo sapiens
ucuaugagauugaacaaca

SEQ ID NO: 1000276 - RNA, 19 nt, Homo sapiens
gagaagcccugaggaagag

SEQ ID NO: 1000277 - RNA, 19 nt, Homo sapiens
gaacaacauaagauugaga

SEQ ID NO: 1000278 - RNA, 19 nt, Homo sapiens
gaaagaauccgugggaaac

SEQ ID NO: 1000279 - RNA, 19 nt, Homo sapiens
gagauugaacaacauaaga

SEQ ID NO: 1000280 - RNA, 19 nt, Homo sapiens
gagaaugagcaauugagaa

SEQ ID NO: 1000281 - RNA, 19 nt, Homo sapiens
ggauggauggccuuguaua

SEQ ID NO: 1000282 - RNA, 19 nt, Homo sapiens
gggcugggaugacgaacug

SEQ ID NO: 1000283 - RNA, 19 nt, Homo sapiens
cauuugaccugaacuugug

SEQ ID NO: 1000284 - RNA, 19 nt, Homo sapiens
gggaagugaucgacaggau

SEQ ID NO: 1000285 - RNA, 19 nt, Homo sapiens
gaccagcagcucagaaaga

SEQ ID NO: 1000286 - RNA, 19 nt, Homo sapiens
ggagaacucagccuucauc

SEQ ID NO: 1000287 - RNA, 19 nt, Homo sapiens
gggccucuauucccgcuuu

SEQ ID NO: 1000288 - RNA, 19 nt, Homo sapiens
gauggauggccuuguauau

SEQ ID NO: 1000289 - RNA, 19 nt, Homo sapiens
ggaagugaucgacaggauu

SEQ ID NO: 1000290 - RNA, 19 nt, Homo sapiens
ucaaguuccugcacaucuu

SEQ ID NO: 1000291 - RNA, 19 nt, Homo sapiens
ccauggagcagccguuauu

SEQ ID NO: 1000292 - RNA, 19 nt, Homo sapiens
caugggaugaugaaauuaa

SEQ ID NO: 1000293 - RNA, 19 nt, Homo sapiens
accaugggaugaugaaauu

SEQ ID NO: 1000294 - RNA, 19 nt, Homo sapiens
ucuacacccucaucaagaa

SEQ ID NO: 1000295 - RNA, 19 nt, Homo sapiens
agagacuugugcuuucuaa

SEQ ID NO: 1000296 - RNA, 19 nt, Homo sapiens
agggauggauggccuugua

SEQ ID NO: 1000297 - RNA, 19 nt, Homo sapiens
cuaaugauagccuguuuga

SEQ ID NO: 1000298 - RNA, 19 nt, Homo sapiens
aacaauccaugaacuuaga

SEQ ID NO: 1000299 - RNA, 19 nt, Homo sapiens
aaugauagccuguuugaag

SEQ ID NO: 1000300 - RNA, 19 nt, Homo sapiens
uggauggccuuguauaugg

SEQ ID NO: 1000301 - RNA, 19 nt, Homo sapiens
gagcccauguucuuagucu

SEQ ID NO: 1000302 - RNA, 19 nt, Homo sapiens
ggagaacagcugagucaag

SEQ ID NO: 1000303 - RNA, 19 nt, Homo sapiens
ggauggccuuguauaugga

SEQ ID NO: 1000304 - RNA, 19 nt, Homo sapiens
gcuucuggauccucgguuu

SEQ ID NO: 1000305 - RNA, 19 nt, Homo sapiens
ucaaagacuagaagggaaa

SEQ ID NO: 1000306 - RNA, 19 nt, Homo sapiens
guucugagcaucaagagau

SEQ ID NO: 1000307 - RNA, 19 nt, Homo sapiens
agaaagaauccgugggaaa

SEQ ID NO: 1000308 - RNA, 19 nt, Homo sapiens
uggagcagccguuauuuau

SEQ ID NO: 1000309 - RNA, 19 nt, Homo sapiens
cuagaagggaaauggauaa

SEQ ID NO: 1000310 - RNA, 19 nt, Homo sapiens
gcagaagucgguggaggaa

SEQ ID NO: 1000311 - RNA, 19 nt, Homo sapiens
cuucaggcccucccaaauu

SEQ ID NO: 1000312 - RNA, 19 nt, Homo sapiens
caaguuccugcacaucuuu

SEQ ID NO: 1000313 - RNA, 19 nt, Homo sapiens
agacuugugcuuucuaaau

SEQ ID NO: 1000314 - RNA, 19 nt, Homo sapiens
acaccaugcuggagaucaa

SEQ ID NO: 1000315 - RNA, 19 nt, Homo sapiens
gcuagaaggccugcuggaa

SEQ ID NO: 1000316 - RNA, 19 nt, Homo sapiens
ccacauccucacacacaaa

SEQ ID NO: 1000317 - RNA, 19 nt, Homo sapiens
uaccuaugcuucaccuuca

SEQ ID NO: 1000318 - RNA, 19 nt, Homo sapiens
gggaugaugaaauuaagga

SEQ ID NO: 1000319 - RNA, 19 nt, Homo sapiens
cuaccgcacuauccaagau

SEQ ID NO: 1000320 - RNA, 19 nt, Homo sapiens
cacaaacgccugcucaagu

SEQ ID NO: 1000321 - RNA, 19 nt, Homo sapiens
aaucacaagugccguuucu

SEQ ID NO: 1000322 - RNA, 19 nt, Homo sapiens
accagaggcacuaggauua

SEQ ID NO: 1000323 - RNA, 19 nt, Homo sapiens
uucaggcccucccaaauug

SEQ ID NO: 1000324 - RNA, 19 nt, Homo sapiens
cagcagcucagaaagaauc

SEQ ID NO: 1000325 - RNA, 19 nt, Homo sapiens
aguccucccuccauucuug

SEQ ID NO: 1000326 - RNA, 19 nt, Homo sapiens
ucaagccucuggucuccau

SEQ ID NO: 1000327 - RNA, 19 nt, Homo sapiens
gaaccagaggcacuaggau

SEQ ID NO: 1000328 - RNA, 19 nt, Homo sapiens
gggccaaagccuugagaug

SEQ ID NO: 1000329 - RNA, 19 nt, Homo sapiens
accagcagcucagaaagaa

SEQ ID NO: 1000330 - RNA, 19 nt, Homo sapiens
gugaccagcagcucagaaa

SEQ ID NO: 1000331 - RNA, 19 nt, Homo sapiens
cuccaucucuccuaaugau

SEQ ID NO: 1000332 - RNA, 19 nt, Homo sapiens
caaaaggaacaauccauga

SEQ ID NO: 1000333 - RNA, 19 nt, Homo sapiens
gaugagcuuccuagagcaa

SEQ ID NO: 1000334 - RNA, 19 nt, Homo sapiens
gaggaagaggacacuaugu

SEQ ID NO: 1000335 - RNA, 19 nt, Homo sapiens
ucacaagugccguuucucu

SEQ ID NO: 1000336 - RNA, 19 nt, Homo sapiens
ugagaaugagcaauugaga

SEQ ID NO: 1000337 - RNA, 19 nt, Homo sapiens
ugaggaagaggacacuaug

SEQ ID NO: 1000338 - RNA, 19 nt, Homo sapiens
gccguuauuuauagaacug

SEQ ID NO: 1000339 - RNA, 19 nt, Homo sapiens
aaggagaacagcugaguca

SEQ ID NO: 1000340 - RNA, 19 nt, Homo sapiens
ggaaacggagggccaaagc

SEQ ID NO: 1000341 - RNA, 19 nt, Homo sapiens
acuagaagggaaauggaua

SEQ ID NO: 1000342 - RNA, 19 nt, Homo sapiens
caccauggagcagccguua

SEQ ID NO: 1000343 - RNA, 19 nt, Homo sapiens
caccaugggaugaugaaau

SEQ ID NO: 1000344 - RNA, 19 nt, Homo sapiens
acaaccaccuggacaugag

SEQ ID NO: 1000345 - RNA, 19 nt, Homo sapiens
gcaacguacuccacauccu

SEQ ID NO: 1000346 - RNA, 19 nt, Homo sapiens
gaaggccugcuggaagaga

SEQ ID NO: 1000347 - RNA, 19 nt, Homo sapiens
cuggagaacucagccuuca

SEQ ID NO: 1000348 - RNA, 19 nt, Homo sapiens
gugagcccauguucuuagu

SEQ ID NO: 1000349 - RNA, 19 nt, Homo sapiens
ugagcuuccuagagcaaga

SEQ ID NO: 1000350 - RNA, 19 nt, Homo sapiens
auggagcagccguuauuua

SEQ ID NO: 1000351 - RNA, 19 nt, Homo sapiens
aaccagaggcacuaggauu

SEQ ID NO: 1000352 - RNA, 19 nt, Homo sapiens
ccaagcuagucaucuucga

SEQ ID NO: 1000353 - RNA, 19 nt, Homo sapiens
ggccugagaagaucugagu

SEQ ID NO: 1000354 - RNA, 19 nt, Homo sapiens
gucuccaucucuccuaaug

SEQ ID NO: 1000355 - RNA, 19 nt, Homo sapiens
aaggaacaauccaugaacu

SEQ ID NO: 1000356 - RNA, 19 nt, Homo sapiens
caaggaagcuguacaugca

SEQ ID NO: 1000357 - RNA, 19 nt, Homo sapiens
ccaaggaccuggagacacu

SEQ ID NO: 1000358 - RNA, 19 nt, Homo sapiens
gaucgucaacaacaaguuu

SEQ ID NO: 1000359 - RNA, 19 nt, Homo sapiens
caaagcaucgugugagauc

SEQ ID NO: 1000360 - RNA, 19 nt, Homo sapiens
uacaaagcaucgugugaga

SEQ ID NO: 1000361 - RNA, 19 nt, Homo sapiens
cgcagaagcugaucaugca

SEQ ID NO: 1000362 - RNA, 19 nt, Homo sapiens
gaccagggcaacuuuguca

SEQ ID NO: 1000363 - RNA, 19 nt, Homo sapiens
ugugagauccgcgugcuua

SEQ ID NO: 1000364 - RNA, 19 nt, Homo sapiens
gagauccgcgugcuuaugc

SEQ ID NO: 1000365 - RNA, 19 nt, Homo sapiens
caguccagaucgucaacaa

SEQ ID NO: 1000366 - RNA, 19 nt, Homo sapiens
ccagagcggcuucgucagu

SEQ ID NO: 1000367 - RNA, 19 nt, Homo sapiens
guccagaucgucaacaaca

SEQ ID NO: 1000368 - RNA, 19 nt, Homo sapiens
ggagcaggagcaacagcaa

SEQ ID NO: 1000369 - RNA, 19 nt, Homo sapiens
ccaugaccagggcaacuuu

SEQ ID NO: 1000370 - RNA, 19 nt, Homo sapiens
gaccuggagacacugaaga

SEQ ID NO: 1000371 - RNA, 19 nt, Homo sapiens
caguuccacuucaccaaca

SEQ ID NO: 1000372 - RNA, 19 nt, Homo sapiens
aaucuucauuggccucauc

SEQ ID NO: 1000373 - RNA, 19 nt, Homo sapiens
acaaggagcugaaggagua

SEQ ID NO: 1000374 - RNA, 19 nt, Homo sapiens
gcaccaccaugcccaguua

SEQ ID NO: 1000375 - RNA, 19 nt, Homo sapiens
gaaaagaacucggugauga

SEQ ID NO: 1000376 - RNA, 19 nt, Homo sapiens
caaauccuaucugguaaua

SEQ ID NO: 1000377 - RNA, 19 nt, Homo sapiens
agaacucggugaugaaaua

SEQ ID NO: 1000378 - RNA, 19 nt, Homo sapiens
gcaaugggcacaauuauag

SEQ ID NO: 1000379 - RNA, 19 nt, Homo sapiens
gaaaugugcccauguguuc

SEQ ID NO: 1000380 - RNA, 19 nt, Homo sapiens
cgacagagauggugauggu

SEQ ID NO: 1000381 - RNA, 19 nt, Homo sapiens
gaacaaugauggagauucc

SEQ ID NO: 1000382 - RNA, 19 nt, Homo sapiens
gaaauaauggagaugauuc

SEQ ID NO: 1000383 - RNA, 19 nt, Homo sapiens
gcacugagccacaggaaca

SEQ ID NO: 1000384 - RNA, 19 nt, Homo sapiens
gguagugacuugugaugug

SEQ ID NO: 1000385 - RNA, 19 nt, Homo sapiens
gaaucuagccguguuguug

SEQ ID NO: 1000386 - RNA, 19 nt, Homo sapiens
ggagaugauuccagugaca

SEQ ID NO: 1000387 - RNA, 19 nt, Homo sapiens
gcugaaaugugcccaugug

SEQ ID NO: 1000388 - RNA, 19 nt, Homo sapiens
gccaaauccuaucugguaa

SEQ ID NO: 1000389 - RNA, 19 nt, Homo sapiens
guagugacuugugauguga

SEQ ID NO: 1000390 - RNA, 19 nt, Homo sapiens
caccaugcccaguuaauaa

SEQ ID NO: 1000391 - RNA, 19 nt, Homo sapiens
agacagaauuacugaggaa

SEQ ID NO: 1000392 - RNA, 19 nt, Homo sapiens
caaaggcccugaggcugaa

SEQ ID NO: 1000393 - RNA, 19 nt, Homo sapiens
cugcagagguagugacuug

SEQ ID NO: 1000394 - RNA, 19 nt, Homo sapiens
cgacugucuucccaaguuu

SEQ ID NO: 1000395 - RNA, 19 nt, Homo sapiens
gcgcaucuacugccaggua

SEQ ID NO: 1000396 - RNA, 19 nt, Homo sapiens
gaugaaauaauggagauga

SEQ ID NO: 1000397 - RNA, 19 nt, Homo sapiens
acugaggaauugaguguaa

SEQ ID NO: 1000398 - RNA, 19 nt, Homo sapiens
uguaggaaaugcagccaaa

SEQ ID NO: 1000399 - RNA, 19 nt, Homo sapiens
cauaaaggaauuuguagga

SEQ ID NO: 1000400 - RNA, 19 nt, Homo sapiens
agaaccggcugcagacuga

SEQ ID NO: 1000401 - RNA, 19 nt, Homo sapiens
ccaccaugcccaguuaaua

SEQ ID NO: 1000402 - RNA, 19 nt, Homo sapiens
gaucaagccuggaguuccu

SEQ ID NO: 1000403 - RNA, 19 nt, Homo sapiens
gaacucggugaugaaauaa

SEQ ID NO: 1000404 - RNA, 19 nt, Homo sapiens
cagagguagugacuuguga

SEQ ID NO: 1000405 - RNA, 19 nt, Homo sapiens
ggaauggcaugcgcaaagg

SEQ ID NO: 1000406 - RNA, 19 nt, Homo sapiens
gugaugaaauaauggagau

SEQ ID NO: 1000407 - RNA, 19 nt, Homo sapiens
ggugaucacaggugucuug

SEQ ID NO: 1000408 - RNA, 19 nt, Homo sapiens
gagacaaggagcugaagga

SEQ ID NO: 1000409 - RNA, 19 nt, Homo sapiens
agccaaauccuaucuggua

SEQ ID NO: 1000410 - RNA, 19 nt, Homo sapiens
caggaacaaugauggagau

SEQ ID NO: 1000411 - RNA, 19 nt, Homo sapiens
gugcccauguguucuaaga

SEQ ID NO: 1000412 - RNA, 19 nt, Homo sapiens
guaagaguggaauaaaguu

SEQ ID NO: 1000413 - RNA, 19 nt, Homo sapiens
cagcagacagaauuacuga

SEQ ID NO: 1000414 - RNA, 19 nt, Homo sapiens
ggaccuugugggugauaua

SEQ ID NO: 1000415 - RNA, 19 nt, Homo sapiens
gaguguaagaguggaauaa

SEQ ID NO: 1000416 - RNA, 19 nt, Homo sapiens
gagaaugggaggagacaag

SEQ ID NO: 1000417 - RNA, 19 nt, Homo sapiens
gggaauggcaugcgcaaag

SEQ ID NO: 1000418 - RNA, 19 nt, Homo sapiens
ucugugcccucguggaauu

SEQ ID NO: 1000419 - RNA, 19 nt, Homo sapiens
gagacucagccaaauccua

SEQ ID NO: 1000420 - RNA, 19 nt, Homo sapiens
gaggcagcagacagaauua

SEQ ID NO: 1000421 - RNA, 19 nt, Homo sapiens
agacucagccaaauccuau

SEQ ID NO: 1000422 - RNA, 19 nt, Homo sapiens
guguaagaguggaauaaag

SEQ ID NO: 1000423 - RNA, 19 nt, Homo sapiens
gaggagacaaggagcugaa

SEQ ID NO: 1000424 - RNA, 19 nt, Homo sapiens
ugaaaugugcccauguguu

SEQ ID NO: 1000425 - RNA, 19 nt, Homo sapiens
gcagagguagugacuugug

SEQ ID NO: 1000426 - RNA, 19 nt, Homo sapiens
acucggugaugaaauaaug

SEQ ID NO: 1000427 - RNA, 19 nt, Homo sapiens
aaagaacucggugaugaaa

SEQ ID NO: 1000428 - RNA, 19 nt, Homo sapiens
gaggucaucguccugcauu

SEQ ID NO: 1000429 - RNA, 19 nt, Homo sapiens
agaggcagcagacagaauu

SEQ ID NO: 1000430 - RNA, 19 nt, Homo sapiens
aggaguaguucccgaagga

SEQ ID NO: 1000431 - RNA, 19 nt, Homo sapiens
ccaaaggugcagucggaaa

SEQ ID NO: 1000432 - RNA, 19 nt, Homo sapiens
ggaacaaugauggagauuc

SEQ ID NO: 1000433 - RNA, 19 nt, Homo sapiens
acgacugucuucccaaguu

SEQ ID NO: 1000434 - RNA, 19 nt, Homo sapiens
ugcaaugggcacaauuaua

SEQ ID NO: 1000435 - RNA, 19 nt, Homo sapiens
cuuccacgcucccauguuc

SEQ ID NO: 1000436 - RNA, 19 nt, Homo sapiens
gcccugaggcugaaaugug

SEQ ID NO: 1000437 - RNA, 19 nt, Homo sapiens
gcagcagacagaauuacug

SEQ ID NO: 1000438 - RNA, 19 nt, Homo sapiens
ccacaggaacaaugaugga

SEQ ID NO: 1000439 - RNA, 19 nt, Homo sapiens
gcgcaccuguccuguacuc

SEQ ID NO: 1000440 - RNA, 19 nt, Homo sapiens
gcuucagccucccuaguag

SEQ ID NO: 1000441 - RNA, 19 nt, Homo sapiens
gggaucuugugcucuguca

SEQ ID NO: 1000442 - RNA, 19 nt, Homo sapiens
uguaagaguggaauaaagu

SEQ ID NO: 1000443 - RNA, 19 nt, Homo sapiens
gaaaaccacagaaggugaa

SEQ ID NO: 1000444 - RNA, 19 nt, Homo sapiens
ccacugucuugccgcucua

SEQ ID NO: 1000445 - RNA, 19 nt, Homo sapiens
ugaggugggagccauagaa

SEQ ID NO: 1000446 - RNA, 19 nt, Homo sapiens
auauagaggacuucgcuuu

SEQ ID NO: 1000447 - RNA, 19 nt, Homo sapiens
gagaugauuccagugacaa

SEQ ID NO: 1000448 - RNA, 19 nt, Homo sapiens
gagguagugacuugugaug

SEQ ID NO: 1000449 - RNA, 19 nt, Homo sapiens
ucaucguccugcauuacaa

SEQ ID NO: 1000450 - RNA, 19 nt, Homo sapiens
gaccaaaagaaaagcauuu

SEQ ID NO: 1000451 - RNA, 19 nt, Homo sapiens
gacgcuugcuccacugucu

SEQ ID NO: 1000452 - RNA, 19 nt, Homo sapiens
gaaaagaugcaggggaaau

SEQ ID NO: 1000453 - RNA, 19 nt, Homo sapiens
ccaaauccuaucugguaau

SEQ ID NO: 1000454 - RNA, 19 nt, Homo sapiens
uuacugaggaauugagugu

SEQ ID NO: 1000455 - RNA, 19 nt, Homo sapiens
gaaugggaggagacaagga

SEQ ID NO: 1000456 - RNA, 19 nt, Homo sapiens
gacaaacgacagagauggu

SEQ ID NO: 1000457 - RNA, 19 nt, Homo sapiens
gccuggaguuccugcuuca

SEQ ID NO: 1000458 - RNA, 19 nt, Homo sapiens
aaaguuaucaaggacaaug

SEQ ID NO: 1000459 - RNA, 19 nt, Homo sapiens
ggugggagccauagaagcu

SEQ ID NO: 1000460 - RNA, 19 nt, Homo sapiens
gagugaggugggagccaua

SEQ ID NO: 1000461 - RNA, 19 nt, Homo sapiens
caaaggugcagucggaaaa

SEQ ID NO: 1000462 - RNA, 19 nt, Homo sapiens
aaucugugcccucguggaa

SEQ ID NO: 1000463 - RNA, 19 nt, Homo sapiens
gaaacucugucucuacuaa

SEQ ID NO: 1000464 - RNA, 19 nt, Homo sapiens
gaugaauucuuccuagaua

SEQ ID NO: 1000465 - RNA, 19 nt, Homo sapiens
gaaggucuaugucaacaga

SEQ ID NO: 1000466 - RNA, 19 nt, Homo sapiens
gcacacuacucaugacaga

SEQ ID NO: 1000467 - RNA, 19 nt, Homo sapiens
ugucaaagcgucaagaaua

SEQ ID NO: 1000468 - RNA, 19 nt, Homo sapiens
ggguagauguaguugcuua

SEQ ID NO: 1000469 - RNA, 19 nt, Homo sapiens
gaauuuauagggaguagaa

SEQ ID NO: 1000470 - RNA, 19 nt, Homo sapiens
caaagcuccuucugcauug

SEQ ID NO: 1000471 - RNA, 19 nt, Homo sapiens
ccacuccaccuccuacuua

SEQ ID NO: 1000472 - RNA, 19 nt, Homo sapiens
uaccacgccuggcuaauuu

SEQ ID NO: 1000473 - RNA, 19 nt, Homo sapiens
acagaguuguuaucucaua

SEQ ID NO: 1000474 - RNA, 19 nt, Homo sapiens
uaaggaggccuguguguau

SEQ ID NO: 1000475 - RNA, 19 nt, Homo sapiens
ggagugcagugacacaauc

SEQ ID NO: 1000476 - RNA, 19 nt, Homo sapiens
uagauguaguugcuuagua

SEQ ID NO: 1000477 - RNA, 19 nt, Homo sapiens
gagcgaaacuccgucucaa

SEQ ID NO: 1000478 - RNA, 19 nt, Homo sapiens
ucaaagcuccuucugcauu

SEQ ID NO: 1000479 - RNA, 19 nt, Homo sapiens
gagaaggucuaugucaaca

SEQ ID NO: 1000480 - RNA, 19 nt, Homo sapiens
agaaagagaaggucuaugu

SEQ ID NO: 1000481 - RNA, 19 nt, Homo sapiens
ugugaugacuguauaagga

SEQ ID NO: 1000482 - RNA, 19 nt, Homo sapiens
aaauguaugugaugacugu

SEQ ID NO: 1000483 - RNA, 19 nt, Homo sapiens
gagucgagaucgcaccauu

SEQ ID NO: 1000484 - RNA, 19 nt, Homo sapiens
ccaaagugcugggauuaca

SEQ ID NO: 1000485 - RNA, 19 nt, Homo sapiens
caagugcuccucauccaaa

SEQ ID NO: 1000486 - RNA, 19 nt, Homo sapiens
aagaauaccugcggaguuc

SEQ ID NO: 1000487 - RNA, 19 nt, Homo sapiens
uguggugucuuccuguaua

SEQ ID NO: 1000488 - RNA, 19 nt, Homo sapiens
uguaugugaugacuguaua

SEQ ID NO: 1000489 - RNA, 19 nt, Homo sapiens
uaacagaaagauagggauu

SEQ ID NO: 1000490 - RNA, 19 nt, Homo sapiens
gaacuggaaggccgcuuga

SEQ ID NO: 1000491 - RNA, 19 nt, Homo sapiens
gggcugaccaacacacuuu

SEQ ID NO: 1000492 - RNA, 19 nt, Homo sapiens
gaaaagaguaacagaaaga

SEQ ID NO: 1000493 - RNA, 19 nt, Homo sapiens
gagacucauuauuuagcua

SEQ ID NO: 1000494 - RNA, 19 nt, Homo sapiens
aagagaaggucuaugucaa

SEQ ID NO: 1000495 - RNA, 19 nt, Homo sapiens
ggagaaagagaaggucuau

SEQ ID NO: 1000496 - RNA, 19 nt, Homo sapiens
caagaauaccugcggaguu

SEQ ID NO: 1000497 - RNA, 19 nt, Homo sapiens
gugaugaauucuuccuaga

SEQ ID NO: 1000498 - RNA, 19 nt, Homo sapiens
cauguggugucuuccugua

SEQ ID NO: 1000499 - RNA, 19 nt, Homo sapiens
ccaaguggcugggauugca

SEQ ID NO: 1000500 - RNA, 19 nt, Homo sapiens
cauugucacucacugauca

SEQ ID NO: 1000501 - RNA, 19 nt, Homo sapiens
gaaagagaaggucuauguc

SEQ ID NO: 1000502 - RNA, 19 nt, Homo sapiens
gacgaugagucuacugagu

SEQ ID NO: 1000503 - RNA, 19 nt, Homo sapiens
aaacguguauuccugaaac

SEQ ID NO: 1000504 - RNA, 19 nt, Homo sapiens
gaguagaaccgucucucuu

SEQ ID NO: 1000505 - RNA, 19 nt, Homo sapiens
aaagagaaggucuauguca

SEQ ID NO: 1000506 - RNA, 19 nt, Homo sapiens
acacuacucaugacagaaa

SEQ ID NO: 1000507 - RNA, 19 nt, Homo sapiens
caaaugaaucagucucugu

SEQ ID NO: 1000508 - RNA, 19 nt, Homo sapiens
gucaaagcgucaagaauac

SEQ ID NO: 1000509 - RNA, 19 nt, Homo sapiens
agauguaguugcuuaguag

SEQ ID NO: 1000510 - RNA, 19 nt, Homo sapiens
aagccacgauugacuucua

SEQ ID NO: 1000511 - RNA, 19 nt, Homo sapiens
uaacccaugaacacuauuu

SEQ ID NO: 1000512 - RNA, 19 nt, Homo sapiens
cuucuuaguuggugacugu

SEQ ID NO: 1000513 - RNA, 19 nt, Homo sapiens
gcagagaccagggcaucaa

SEQ ID NO: 1000514 - RNA, 19 nt, Homo sapiens
ggaggccuguguguaugaa

SEQ ID NO: 1000515 - RNA, 19 nt, Homo sapiens
ggaaggccgcuugaaccua

SEQ ID NO: 1000516 - RNA, 19 nt, Homo sapiens
acgcaucccugcugagugu

SEQ ID NO: 1000517 - RNA, 19 nt, Homo sapiens
cuuaacccaugaacacuau

SEQ ID NO: 1000518 - RNA, 19 nt, Homo sapiens
gcaagugcuccucauccaa

SEQ ID NO: 1000519 - RNA, 19 nt, Homo sapiens
aagaguaacagaaagauag

SEQ ID NO: 1000520 - RNA, 19 nt, Homo sapiens
gaaagaaaagaguaacaga

SEQ ID NO: 1000521 - RNA, 19 nt, Homo sapiens
gagaucgcaccauugcauu

SEQ ID NO: 1000522 - RNA, 19 nt, Homo sapiens
gcaagccacgauugacuuc

SEQ ID NO: 1000523 - RNA, 19 nt, Homo sapiens
cuaccacgccuggcuaauu

SEQ ID NO: 1000524 - RNA, 19 nt, Homo sapiens
ucaagugauucuccugucu

SEQ ID NO: 1000525 - RNA, 19 nt, Homo sapiens
ggcaagugcuccucaucca

SEQ ID NO: 1000526 - RNA, 19 nt, Homo sapiens
gccuguguguaugaauuua

SEQ ID NO: 1000527 - RNA, 19 nt, Homo sapiens
gcgaaacuccgucucaaaa

SEQ ID NO: 1000528 - RNA, 19 nt, Homo sapiens
agacucgguuucaccaugu

SEQ ID NO: 1000529 - RNA, 19 nt, Homo sapiens
uaucuuacauguggugucu

SEQ ID NO: 1000530 - RNA, 19 nt, Homo sapiens
cguguauuccugaaacuuu

SEQ ID NO: 1000531 - RNA, 19 nt, Homo sapiens
ggaguagaaccgucucucu

SEQ ID NO: 1000532 - RNA, 19 nt, Homo sapiens
acagaaagauagggauuuu

SEQ ID NO: 1000533 - RNA, 19 nt, Homo sapiens
ccgucucucuucuuaguug

SEQ ID NO: 1000534 - RNA, 19 nt, Homo sapiens
cgagaucgcaccauugcau

SEQ ID NO: 1000535 - RNA, 19 nt, Homo sapiens
ucuauuuacccaugucaaa

SEQ ID NO: 1000536 - RNA, 19 nt, Homo sapiens
cuuaguuggugacuguuug

SEQ ID NO: 1000537 - RNA, 19 nt, Homo sapiens
ggauugcaggcaugagcua

SEQ ID NO: 1000538 - RNA, 19 nt, Homo sapiens
ucacugcaaccuccacuuc

SEQ ID NO: 1000539 - RNA, 19 nt, Homo sapiens
gaguuguuaucucauagag

SEQ ID NO: 1000540 - RNA, 19 nt, Homo sapiens
cagaguuguuaucucauag

SEQ ID NO: 1000541 - RNA, 19 nt, Homo sapiens
cgaugagucuacugagucu

SEQ ID NO: 1000542 - RNA, 19 nt, Homo sapiens
aaccgucucucuucuuagu

SEQ ID NO: 1000543 - RNA, 19 nt, Homo sapiens
ggccuguguguaugaauuu

SEQ ID NO: 1000544 - RNA, 19 nt, Homo sapiens
ugucucagccucccaagug

SEQ ID NO: 1000545 - RNA, 19 nt, Homo sapiens
gacacaaucucggcucacu

SEQ ID NO: 1000546 - RNA, 19 nt, Homo sapiens
cacuccaccuccuacuuaa

SEQ ID NO: 1000547 - RNA, 19 nt, Homo sapiens
guggugucuuccuguauau

SEQ ID NO: 1000548 - RNA, 19 nt, Homo sapiens
guaugugaugacuguauaa

SEQ ID NO: 1000549 - RNA, 19 nt, Homo sapiens
guuucagcauccuguaaga

SEQ ID NO: 1000550 - RNA, 19 nt, Homo sapiens
ucuuacauguggugucuuc

SEQ ID NO: 1000551 - RNA, 19 nt, Homo sapiens
aggccuguguguaugaauu

SEQ ID NO: 1000552 - RNA, 19 nt, Homo sapiens
augcugagcugaccagaac

SEQ ID NO: 1000553 - RNA, 19 nt, Homo sapiens
uaaacguguauuccugaaa

SEQ ID NO: 1000554 - RNA, 19 nt, Homo sapiens
auaaacguguauuccugaa

SEQ ID NO: 1000555 - RNA, 19 nt, Homo sapiens
ugaccagcguggagaaacu

SEQ ID NO: 1000556 - RNA, 19 nt, Homo sapiens
ccagugcaagccacgauug

SEQ ID NO: 1000557 - RNA, 19 nt, Homo sapiens
auaaggaggccugugugua

SEQ ID NO: 1000558 - RNA, 19 nt, Homo sapiens
gaugcugagcugaccagaa

SEQ ID NO: 1000559 - RNA, 19 nt, Homo sapiens
ugacggaguuuugcucuug

SEQ ID NO: 1000560 - RNA, 19 nt, Homo sapiens
ugucuuccuguauauagua

SEQ ID NO: 1000561 - RNA, 19 nt, Homo sapiens
ggugucuuccuguauauag

SEQ ID NO: 1000562 - RNA, 19 nt, Homo sapiens
caugucaaagcgucaagaa

SEQ ID NO: 1000563 - RNA, 19 nt, Homo sapiens
ugaggaaccugacccauuu

SEQ ID NO: 1000564 - RNA, 19 nt, Homo sapiens
guccaugucuugagcuuaa

SEQ ID NO: 1000565 - RNA, 19 nt, Homo sapiens
gucuugagcuuaauaaaug

SEQ ID NO: 1000566 - RNA, 19 nt, Homo sapiens
gcaaauccuguaagucuga

SEQ ID NO: 1000567 - RNA, 19 nt, Homo sapiens
agucugagcuucccucuuc

SEQ ID NO: 1000568 - RNA, 19 nt, Homo sapiens
gcaugacucuggcaaccau

SEQ ID NO: 1000569 - RNA, 19 nt, Homo sapiens
acaacacggugcagacugu

SEQ ID NO: 1000570 - RNA, 19 nt, Homo sapiens
caaccugcaaauccuguaa

SEQ ID NO: 1000571 - RNA, 19 nt, Homo sapiens
cuccaggccuuggcaauga

SEQ ID NO: 1000572 - RNA, 19 nt, Homo sapiens
cugcaaauccuguaagucu

SEQ ID NO: 1000573 - RNA, 19 nt, Homo sapiens
cugaggaaccugacccauu

SEQ ID NO: 1000574 - RNA, 19 nt, Homo sapiens
ucagcaagaaggugaagug

SEQ ID NO: 1000575 - RNA, 19 nt, Homo sapiens
ccaugucuugagcuuaaua

SEQ ID NO: 1000576 - RNA, 19 nt, Homo sapiens
ugagagcccaaccugcaaa

SEQ ID NO: 1000577 - RNA, 19 nt, Homo sapiens
gaucuauccucaacaacaa

SEQ ID NO: 1000578 - RNA, 19 nt, Homo sapiens
gaaggucucuuagcaacug

SEQ ID NO: 1000579 - RNA, 19 nt, Homo sapiens
gaugguauuguguuuguua

SEQ ID NO: 1000580 - RNA, 19 nt, Homo sapiens
ggacuccuuucacuccuuu

SEQ ID NO: 1000581 - RNA, 19 nt, Homo sapiens
aaaugucgaugcuuaagaa

SEQ ID NO: 1000582 - RNA, 19 nt, Homo sapiens
gcauaucuucucagcaaua

SEQ ID NO: 1000583 - RNA, 19 nt, Homo sapiens
augcaaaugucgaugcuua

SEQ ID NO: 1000584 - RNA, 19 nt, Homo sapiens
cugcauaucuucucagcaa

SEQ ID NO: 1000585 - RNA, 19 nt, Homo sapiens
gcagcacuuugucaucauu

SEQ ID NO: 1000586 - RNA, 19 nt, Homo sapiens
ccagaaagcagagaacuga

SEQ ID NO: 1000587 - RNA, 19 nt, Homo sapiens
gcaagugcaguuucaauca

SEQ ID NO: 1000588 - RNA, 19 nt, Homo sapiens
cauaucuucucagcaauaa

SEQ ID NO: 1000589 - RNA, 19 nt, Homo sapiens
guauuguguuuguuaguga

SEQ ID NO: 1000590 - RNA, 19 nt, Homo sapiens
gagguggguuggagacuca

SEQ ID NO: 1000591 - RNA, 19 nt, Homo sapiens
gguauuguguuuguuagug

SEQ ID NO: 1000592 - RNA, 19 nt, Homo sapiens
ccauugcuguucucuguau

SEQ ID NO: 1000593 - RNA, 19 nt, Homo sapiens
gacuguguguguuugcuaa

SEQ ID NO: 1000594 - RNA, 19 nt, Homo sapiens
gaaagcagagaacugaagu

SEQ ID NO: 1000595 - RNA, 19 nt, Homo sapiens
uaccagacccugaggauug

SEQ ID NO: 1000596 - RNA, 19 nt, Homo sapiens
gggaagguuugcagcacuu

SEQ ID NO: 1000597 - RNA, 19 nt, Homo sapiens
cgugaucuauccucaacaa

SEQ ID NO: 1000598 - RNA, 19 nt, Homo sapiens
gcagaggccuuugcuucuc

SEQ ID NO: 1000599 - RNA, 19 nt, Homo sapiens
cagcccagcucauccagau

SEQ ID NO: 1000600 - RNA, 19 nt, Homo sapiens
gcaacucccgcauccuuug

SEQ ID NO: 1000601 - RNA, 19 nt, Homo sapiens
caaccuucccugcuucuga

SEQ ID NO: 1000602 - RNA, 19 nt, Homo sapiens
ccuaggaggcugcuuguug

SEQ ID NO: 1000603 - RNA, 19 nt, Homo sapiens
gaacuguggacucgcuuuc

SEQ ID NO: 1000604 - RNA, 19 nt, Homo sapiens
caaaugucgaugcuuaaga

SEQ ID NO: 1000605 - RNA, 19 nt, Homo sapiens
cuucugagacuucaaucua

SEQ ID NO: 1000606 - RNA, 19 nt, Homo sapiens
caggagaagccaagaacuu

SEQ ID NO: 1000607 - RNA, 19 nt, Homo sapiens
gugcagacgccauggaguu

SEQ ID NO: 1000608 - RNA, 19 nt, Homo sapiens
caccugaugaugcaacuaa

SEQ ID NO: 1000609 - RNA, 19 nt, Homo sapiens
caagugcaguuucaaucag

SEQ ID NO: 1000610 - RNA, 19 nt, Homo sapiens
ggcggcugcuugaaccuuu

SEQ ID NO: 1000611 - RNA, 19 nt, Homo sapiens
aaaccuugcuuccuuaucc

SEQ ID NO: 1000612 - RNA, 19 nt, Homo sapiens
uggaugguauuguguuugu

SEQ ID NO: 1000613 - RNA, 19 nt, Homo sapiens
cuuagcaacuggagauaca

SEQ ID NO: 1000614 - RNA, 19 nt, Homo sapiens
gaugaugcaacuaacacuu

SEQ ID NO: 1000615 - RNA, 19 nt, Homo sapiens
caacuggagauacaaagca

SEQ ID NO: 1000616 - RNA, 19 nt, Homo sapiens
ccagucugaaggucucuua

SEQ ID NO: 1000617 - RNA, 19 nt, Homo sapiens
gcaaaugucgaugcuuaag

SEQ ID NO: 1000618 - RNA, 19 nt, Homo sapiens
gugcagccaucagguggaa

SEQ ID NO: 1000619 - RNA, 19 nt, Homo sapiens
ugucaucauucuucaugga

SEQ ID NO: 1000620 - RNA, 19 nt, Homo sapiens
gaagguuugcagcacuuug

SEQ ID NO: 1000621 - RNA, 19 nt, Homo sapiens
caacagagccccagaaagc

SEQ ID NO: 1000622 - RNA, 19 nt, Homo sapiens
uuagggaugcguaggguaa

SEQ ID NO: 1000623 - RNA, 19 nt, Homo sapiens
uguggaugguauuguguuu

SEQ ID NO: 1000624 - RNA, 19 nt, Homo sapiens
guuuguggaugguauugug

SEQ ID NO: 1000625 - RNA, 19 nt, Homo sapiens
uaagaaaaccggccacuuc

SEQ ID NO: 1000626 - RNA, 19 nt, Homo sapiens
acccauugcuguucucugu

SEQ ID NO: 1000627 - RNA, 19 nt, Homo sapiens
cuuccaaccuucccugcuu

SEQ ID NO: 1000628 - RNA, 19 nt, Homo sapiens
gcacuuugucaucauucuu

SEQ ID NO: 1000629 - RNA, 19 nt, Homo sapiens
uuugcuaacuguggucuuu

SEQ ID NO: 1000630 - RNA, 19 nt, Homo sapiens
gcugugacccauugcuguu

SEQ ID NO: 1000631 - RNA, 19 nt, Homo sapiens
gcaggcaauaguugaagga

SEQ ID NO: 1000632 - RNA, 19 nt, Homo sapiens
uugcagcacuuugucauca

SEQ ID NO: 1000633 - RNA, 19 nt, Homo sapiens
ggaugcaaaugucgaugcu

SEQ ID NO: 1000634 - RNA, 19 nt, Homo sapiens
gcuugaaccuuuggaugca

SEQ ID NO: 1000635 - RNA, 19 nt, Homo sapiens
gaauguguccccugcauau

SEQ ID NO: 1000636 - RNA, 19 nt, Homo sapiens
gucugaaggucucuuagca

SEQ ID NO: 1000637 - RNA, 19 nt, Homo sapiens
caucaccgccaaugcaaca

SEQ ID NO: 1000638 - RNA, 19 nt, Homo sapiens
cuaagucgcaggugcaagu

SEQ ID NO: 1000639 - RNA, 19 nt, Homo sapiens
uauccuuuguuuccuagug

SEQ ID NO: 1000640 - RNA, 19 nt, Homo sapiens
gaacagugagagguugaag

SEQ ID NO: 1000641 - RNA, 19 nt, Homo sapiens
ucugagacuucaaucuaca

SEQ ID NO: 1000642 - RNA, 19 nt, Homo sapiens
uagcaacuggagauacaaa

SEQ ID NO: 1000643 - RNA, 19 nt, Homo sapiens
ggaugguauuguguuuguu

SEQ ID NO: 1000644 - RNA, 19 nt, Homo sapiens
caccauuccuccaccugau

SEQ ID NO: 1000645 - RNA, 19 nt, Homo sapiens
gggaacagugagagguuga

SEQ ID NO: 1000646 - RNA, 19 nt, Homo sapiens
ggcaacucccgcauccuuu

SEQ ID NO: 1000647 - RNA, 19 nt, Homo sapiens
cgguugggauccuccuuau

SEQ ID NO: 1000648 - RNA, 19 nt, Homo sapiens
ggaagguuugcagcacuuu

SEQ ID NO: 1000649 - RNA, 19 nt, Homo sapiens
aagugcaguuucaaucaga

SEQ ID NO: 1000650 - RNA, 19 nt, Homo sapiens
cuuuguggcuacuuguuug

SEQ ID NO: 1000651 - RNA, 19 nt, Homo sapiens
ugaucuauccucaacaaca

SEQ ID NO: 1000652 - RNA, 19 nt, Homo sapiens
gugcagcccuugggaacag

SEQ ID NO: 1000653 - RNA, 19 nt, Homo sapiens
ugaaggucauaacgagagu

SEQ ID NO: 1000654 - RNA, 19 nt, Homo sapiens
cuacagucccugcaauugg

SEQ ID NO: 1000655 - RNA, 19 nt, Homo sapiens
ccaccugaucccagucuga

SEQ ID NO: 1000656 - RNA, 19 nt, Homo sapiens
gcggcugcuugaaccuuug

SEQ ID NO: 1000657 - RNA, 19 nt, Homo sapiens
ggacagacguugaaagaua

SEQ ID NO: 1000658 - RNA, 19 nt, Homo sapiens
gcacagacguccagacaga

SEQ ID NO: 1000659 - RNA, 19 nt, Homo sapiens
gcaggugaguccaucagaa

SEQ ID NO: 1000660 - RNA, 19 nt, Homo sapiens
cgaagagccuggccagaga

SEQ ID NO: 1000661 - RNA, 19 nt, Homo sapiens
gaggacagacguugaaaga

SEQ ID NO: 1000662 - RNA, 19 nt, Homo sapiens
ggaagacacagaugaugaa

SEQ ID NO: 1000663 - RNA, 19 nt, Homo sapiens
caaccuggccugcugauga

SEQ ID NO: 1000664 - RNA, 19 nt, Homo sapiens
gaacacacccuccggaaac

SEQ ID NO: 1000665 - RNA, 19 nt, Homo sapiens
caacuaucauggacauuca

SEQ ID NO: 1000666 - RNA, 19 nt, Homo sapiens
gggaagacacagaugauga

SEQ ID NO: 1000667 - RNA, 19 nt, Homo sapiens
ggaugggccucuagugaca

SEQ ID NO: 1000668 - RNA, 19 nt, Homo sapiens
ucagcagacucaacuauca

SEQ ID NO: 1000669 - RNA, 19 nt, Homo sapiens
cagaugcagucuacacaga

SEQ ID NO: 1000670 - RNA, 19 nt, Homo sapiens
aaagauaccacguccaguu

SEQ ID NO: 1000671 - RNA, 19 nt, Homo sapiens
caccaucguuggccugauu

SEQ ID NO: 1000672 - RNA, 19 nt, Homo sapiens
agacacagaugaugaagcu

SEQ ID NO: 1000673 - RNA, 19 nt, Homo sapiens
gacagacguugaaagauac

SEQ ID NO: 1000674 - RNA, 19 nt, Homo sapiens
gauaccacguccaguucuu

SEQ ID NO: 1000675 - RNA, 19 nt, Homo sapiens
ugacagauccagagacaca

SEQ ID NO: 1000676 - RNA, 19 nt, Homo sapiens
gaacggaugggccucuagu

SEQ ID NO: 1000677 - RNA, 19 nt, Homo sapiens
caggugaguccaucagaaa

SEQ ID NO: 1000678 - RNA, 19 nt, Homo sapiens
ccagaggacagacguugaa

SEQ ID NO: 1000679 - RNA, 19 nt, Homo sapiens
ggucgccugugucuucuca

SEQ ID NO: 1000680 - RNA, 19 nt, Homo sapiens
gagggaagacacagaugau

SEQ ID NO: 1000681 - RNA, 19 nt, Homo sapiens
aaccuggccugcugaugaa

SEQ ID NO: 1000682 - RNA, 19 nt, Homo sapiens
ugaacacacccuccggaaa

SEQ ID NO: 1000683 - RNA, 19 nt, Homo sapiens
aagcagcucaucccacuga

SEQ ID NO: 1000684 - RNA, 19 nt, Homo sapiens
caucacaggcaucaucauc

SEQ ID NO: 1000685 - RNA, 19 nt, Homo sapiens
gaugcagucuacacagaac

SEQ ID NO: 1000686 - RNA, 19 nt, Homo sapiens
gggcugucccucaaguuau

SEQ ID NO: 1000687 - RNA, 19 nt, Homo sapiens
guucaucacaggcaucauc

SEQ ID NO: 1000688 - RNA, 19 nt, Homo sapiens
agugacagauccagagaca

SEQ ID NO: 1000689 - RNA, 19 nt, Homo sapiens
ggcugucccucaaguuauc

SEQ ID NO: 1000690 - RNA, 19 nt, Homo sapiens
agagggaagacacagauga

SEQ ID NO: 1000691 - RNA, 19 nt, Homo sapiens
cccaagaggaaaugacuga

SEQ ID NO: 1000692 - RNA, 19 nt, Homo sapiens
gaugaccccuucuucuaug

SEQ ID NO: 1000693 - RNA, 19 nt, Homo sapiens
acaccacgacgcucucuga

SEQ ID NO: 1000694 - RNA, 19 nt, Homo sapiens
ucacaggcaucaucauccu

SEQ ID NO: 1000695 - RNA, 19 nt, Homo sapiens
gauccagagacacacaaga

SEQ ID NO: 1000696 - RNA, 19 nt, Homo sapiens
ucaacuaucauggacauuc

SEQ ID NO: 1000697 - RNA, 19 nt, Homo sapiens
aggcagcugucccgguuau

SEQ ID NO: 1000698 - RNA, 19 nt, Homo sapiens
ggugaguccaucagaaaca

SEQ ID NO: 1000699 - RNA, 19 nt, Homo sapiens
acucaacuaucauggacau

SEQ ID NO: 1000700 - RNA, 19 nt, Homo sapiens
gaagacacagaugaugaag

SEQ ID NO: 1000701 - RNA, 19 nt, Homo sapiens
gagagggaagacacagaug

SEQ ID NO: 1000702 - RNA, 19 nt, Homo sapiens
aagcacagacguccagaca

SEQ ID NO: 1000703 - RNA, 19 nt, Homo sapiens
ucaggaggcuucuuuauga

SEQ ID NO: 1000704 - RNA, 19 nt, Homo sapiens
gcaggacacuggugaagga

SEQ ID NO: 1000705 - RNA, 19 nt, Homo sapiens
gggauggccugaagccuaa

SEQ ID NO: 1000706 - RNA, 19 nt, Homo sapiens
ggaggcuucuuuaugaauu

SEQ ID NO: 1000707 - RNA, 19 nt, Homo sapiens
gaggcuucuuuaugaauua

SEQ ID NO: 1000708 - RNA, 19 nt, Homo sapiens
uaaagacgaucccuucuac

SEQ ID NO: 1000709 - RNA, 19 nt, Homo sapiens
ugaggaaccugcagaguca

SEQ ID NO: 1000710 - RNA, 19 nt, Homo sapiens
gacgaucccuucuacuaug

SEQ ID NO: 1000711 - RNA, 19 nt, Homo sapiens
guaguuacuuucccaagau

SEQ ID NO: 1000712 - RNA, 19 nt, Homo sapiens
ggaagacagaaaguaguua

SEQ ID NO: 1000713 - RNA, 19 nt, Homo sapiens
gaucaggaggcuucuuuau

SEQ ID NO: 1000714 - RNA, 19 nt, Homo sapiens
gagaaggccaucccacuca

SEQ ID NO: 1000715 - RNA, 19 nt, Homo sapiens
gggaagacagaaaguaguu

SEQ ID NO: 1000716 - RNA, 19 nt, Homo sapiens
ugacccauuugccaauaaa

SEQ ID NO: 1000717 - RNA, 19 nt, Homo sapiens
gaugggaagacagaaagua

SEQ ID NO: 1000718 - RNA, 19 nt, Homo sapiens
caggaggcuucuuuaugaa

SEQ ID NO: 1000719 - RNA, 19 nt, Homo sapiens
gaagacagaaaguaguuac

SEQ ID NO: 1000720 - RNA, 19 nt, Homo sapiens
aagacgaucccuucuacua

SEQ ID NO: 1000721 - RNA, 19 nt, Homo sapiens
gacccuggcccuucuccua

SEQ ID NO: 1000722 - RNA, 19 nt, Homo sapiens
cuucuacuaugacuggaaa

SEQ ID NO: 1000723 - RNA, 19 nt, Homo sapiens
cagcugagcggacugaucu

SEQ ID NO: 1000724 - RNA, 19 nt, Homo sapiens
auaaagacgaucccuucua

SEQ ID NO: 1000725 - RNA, 19 nt, Homo sapiens
gcaagagcagccagaagca

SEQ ID NO: 1000726 - RNA, 19 nt, Homo sapiens
agacgaucccuucuacuau

SEQ ID NO: 1000727 - RNA, 19 nt, Homo sapiens
gaucgcggcaguucugagu

SEQ ID NO: 1000728 - RNA, 19 nt, Homo sapiens
cuagaugggaagacagaaa

SEQ ID NO: 1000729 - RNA, 19 nt, Homo sapiens
gagugacccuggcccuucu

SEQ ID NO: 1000730 - RNA, 19 nt, Homo sapiens
guacaccuacuuucaccau

SEQ ID NO: 1000731 - RNA, 19 nt, Homo sapiens
ugaucaggaggcuucuuua

SEQ ID NO: 1000732 - RNA, 19 nt, Homo sapiens
acgaucccuucuacuauga

SEQ ID NO: 1000733 - RNA, 19 nt, Homo sapiens
uccucucgcugaccaauug

SEQ ID NO: 1000734 - RNA, 19 nt, Homo sapiens
ggguuuguacaccuacuuu

SEQ ID NO: 1000735 - RNA, 19 nt, Homo sapiens
cugaucaggaggcuucuuu

SEQ ID NO: 1000736 - RNA, 19 nt, Homo sapiens
gaaccugcagagucacaca

SEQ ID NO: 1000737 - RNA, 19 nt, Homo sapiens
cugcagagucacacaguug

SEQ ID NO: 1000738 - RNA, 19 nt, Homo sapiens
gaaggccaucccacucauc

SEQ ID NO: 1000739 - RNA, 19 nt, Homo sapiens
gaaauggcaucaaauggua

SEQ ID NO: 1000740 - RNA, 19 nt, Homo sapiens
ccacuuugcuuacaccuua

SEQ ID NO: 1000741 - RNA, 19 nt, Homo sapiens
ccaaacaccuucucacauu

SEQ ID NO: 1000742 - RNA, 19 nt, Homo sapiens
guagauaugugcugaaaga

SEQ ID NO: 1000743 - RNA, 19 nt, Homo sapiens
gcacaagcaccauuauuaa

SEQ ID NO: 1000744 - RNA, 19 nt, Homo sapiens
caacacaucuauugaaagu

SEQ ID NO: 1000745 - RNA, 19 nt, Homo sapiens
agacagacaugccagauuu

SEQ ID NO: 1000746 - RNA, 19 nt, Homo sapiens
aaacguauaucccuacaaa

SEQ ID NO: 1000747 - RNA, 19 nt, Homo sapiens
caagagcauuucacuuuaa

SEQ ID NO: 1000748 - RNA, 19 nt, Homo sapiens
ucaagagcauuucacuuua

SEQ ID NO: 1000749 - RNA, 19 nt, Homo sapiens
gaacaaaugcucucuuaca

SEQ ID NO: 1000750 - RNA, 19 nt, Homo sapiens
cuaguuagcuauauucuug

SEQ ID NO: 1000751 - RNA, 19 nt, Homo sapiens
ugaaagggaugcagacuug

SEQ ID NO: 1000752 - RNA, 19 nt, Homo sapiens
caaauacgaucuugagcaa

SEQ ID NO: 1000753 - RNA, 19 nt, Homo sapiens
gcucauagccuuugacaga

SEQ ID NO: 1000754 - RNA, 19 nt, Homo sapiens
ggcaucaaaugguaaauaa

SEQ ID NO: 1000755 - RNA, 19 nt, Homo sapiens
gcaaugaacaccacaguga

SEQ ID NO: 1000756 - RNA, 19 nt, Homo sapiens
gggcugaaauggcaucaaa

SEQ ID NO: 1000757 - RNA, 19 nt, Homo sapiens
gcaccacacauguauauuu

SEQ ID NO: 1000758 - RNA, 19 nt, Homo sapiens
cuugguaucucccauaaua

SEQ ID NO: 1000759 - RNA, 19 nt, Homo sapiens
uggaacaaaugcucucuua

SEQ ID NO: 1000760 - RNA, 19 nt, Homo sapiens
guauggaucccuuaauaua

SEQ ID NO: 1000761 - RNA, 19 nt, Homo sapiens
ggcacaagcaccauuauua

SEQ ID NO: 1000762 - RNA, 19 nt, Homo sapiens
gaugagacuuccguagaua

SEQ ID NO: 1000763 - RNA, 19 nt, Homo sapiens
aaggagagauuguuucauu

SEQ ID NO: 1000764 - RNA, 19 nt, Homo sapiens
ucaguaacauccauauuga

SEQ ID NO: 1000765 - RNA, 19 nt, Homo sapiens
gaacuugccuaccuuucug

SEQ ID NO: 1000766 - RNA, 19 nt, Homo sapiens
gcaacaccaucgucuguga

SEQ ID NO: 1000767 - RNA, 19 nt, Homo sapiens
uaacauccauauugagaga

SEQ ID NO: 1000768 - RNA, 19 nt, Homo sapiens
gauaaaugcaggauguuaa

SEQ ID NO: 1000769 - RNA, 19 nt, Homo sapiens
caauaagacugacuguaga

SEQ ID NO: 1000770 - RNA, 19 nt, Homo sapiens
ugucguggcugucuucuuu

SEQ ID NO: 1000771 - RNA, 19 nt, Homo sapiens
caacuaacauuuguaugga

SEQ ID NO: 1000772 - RNA, 19 nt, Homo sapiens
caucagaccuuugagaaau

SEQ ID NO: 1000773 - RNA, 19 nt, Homo sapiens
guaauuacuuccugaccuu

SEQ ID NO: 1000774 - RNA, 19 nt, Homo sapiens
guuaagcucuguaaaugug

SEQ ID NO: 1000775 - RNA, 19 nt, Homo sapiens
ugaaaguguuggauaaaug

SEQ ID NO: 1000776 - RNA, 19 nt, Homo sapiens
cagagacacucggauagua

SEQ ID NO: 1000777 - RNA, 19 nt, Homo sapiens
ucacuugguccaugaaaua

SEQ ID NO: 1000778 - RNA, 19 nt, Homo sapiens
cuugguccaugaaauauua

SEQ ID NO: 1000779 - RNA, 19 nt, Homo sapiens
ggauacaaauggccacuag

SEQ ID NO: 1000780 - RNA, 19 nt, Homo sapiens
ggauaaaugcaggauguua

SEQ ID NO: 1000781 - RNA, 19 nt, Homo sapiens
caaauacucuaaugauggu

SEQ ID NO: 1000782 - RNA, 19 nt, Homo sapiens
gaaugcaacaggauacaaa

SEQ ID NO: 1000783 - RNA, 19 nt, Homo sapiens
gcaacuaacauuuguaugg

SEQ ID NO: 1000784 - RNA, 19 nt, Homo sapiens
gcuggaaggcaaaguauuu

SEQ ID NO: 1000785 - RNA, 19 nt, Homo sapiens
gcauccugcugaauacuuu

SEQ ID NO: 1000786 - RNA, 19 nt, Homo sapiens
ggaggcacaagcaccauua

SEQ ID NO: 1000787 - RNA, 19 nt, Homo sapiens
ccucugaaauccuggguaa

SEQ ID NO: 1000788 - RNA, 19 nt, Homo sapiens
gaaacccuauguugucauc

SEQ ID NO: 1000789 - RNA, 19 nt, Homo sapiens
agaaugcuguguuaacuau

SEQ ID NO: 1000790 - RNA, 19 nt, Homo sapiens
gauaugugcugaaagaaaa

SEQ ID NO: 1000791 - RNA, 19 nt, Homo sapiens
guaguuaagcucuguaaau

SEQ ID NO: 1000792 - RNA, 19 nt, Homo sapiens
aacagccucuuucacauua

SEQ ID NO: 1000793 - RNA, 19 nt, Homo sapiens
ccacuagaggucauuauuu

SEQ ID NO: 1000794 - RNA, 19 nt, Homo sapiens
cagaaaagcuaccauguau

SEQ ID NO: 1000795 - RNA, 19 nt, Homo sapiens
aaagugugcuuccuuaaag

SEQ ID NO: 1000796 - RNA, 19 nt, Homo sapiens
uaguuaagcucuguaaaug

SEQ ID NO: 1000797 - RNA, 19 nt, Homo sapiens
gcaggauguuaauaugcua

SEQ ID NO: 1000798 - RNA, 19 nt, Homo sapiens
gugugagaaugcuguguua

SEQ ID NO: 1000799 - RNA, 19 nt, Homo sapiens
caaacagccucuuucacau

SEQ ID NO: 1000800 - RNA, 19 nt, Homo sapiens
uuguauggaucccuuaaua

SEQ ID NO: 1000801 - RNA, 19 nt, Homo sapiens
cacuagaggucauuauuuc

SEQ ID NO: 1000802 - RNA, 19 nt, Homo sapiens
uacauaggguuaacuucua

SEQ ID NO: 1000803 - RNA, 19 nt, Homo sapiens
gagaaagaccacagcauca

SEQ ID NO: 1000804 - RNA, 19 nt, Homo sapiens
caccacacauguauauuuc

SEQ ID NO: 1000805 - RNA, 19 nt, Homo sapiens
auccaucucuugaacuuua

SEQ ID NO: 1000806 - RNA, 19 nt, Homo sapiens
gagaaugcuguguuaacua

SEQ ID NO: 1000807 - RNA, 19 nt, Homo sapiens
ucacauaacacuacugcuu

SEQ ID NO: 1000808 - RNA, 19 nt, Homo sapiens
ggaaaagacuaaggagaaa

SEQ ID NO: 1000809 - RNA, 19 nt, Homo sapiens
gagagauuguuucauugug

SEQ ID NO: 1000810 - RNA, 19 nt, Homo sapiens
cguaauugcugacccacaa

SEQ ID NO: 1000811 - RNA, 19 nt, Homo sapiens
guuaaagcuucuugagaga

SEQ ID NO: 1000812 - RNA, 19 nt, Homo sapiens
caaacaccuucucacauuc

SEQ ID NO: 1000813 - RNA, 19 nt, Homo sapiens
ggagagauuguuucauugu

SEQ ID NO: 1000814 - RNA, 19 nt, Homo sapiens
acaaacagccucuuucaca

SEQ ID NO: 1000815 - RNA, 19 nt, Homo sapiens
guacauaggguuaacuucu

SEQ ID NO: 1000816 - RNA, 19 nt, Homo sapiens
gcugacaacuguacauagg

SEQ ID NO: 1000817 - RNA, 19 nt, Homo sapiens
cuuaucacauugcauugua

SEQ ID NO: 1000818 - RNA, 19 nt, Homo sapiens
gacagacaacauaaccuua

SEQ ID NO: 1000819 - RNA, 19 nt, Homo sapiens
acaauaagacugacuguag

SEQ ID NO: 1000820 - RNA, 19 nt, Homo sapiens
ugacccugcuuguauuuau

SEQ ID NO: 1000821 - RNA, 19 nt, Homo sapiens
uugcuauucucgauacaua

SEQ ID NO: 1000822 - RNA, 19 nt, Homo sapiens
cagcaagaccucugaaauc

SEQ ID NO: 1000823 - RNA, 19 nt, Homo sapiens
acagucaaaccaacaauaa

SEQ ID NO: 1000824 - RNA, 19 nt, Homo sapiens
gcugaaauggcaucaaaug

SEQ ID NO: 1000825 - RNA, 19 nt, Homo sapiens
gaucaucagaccuuugaga

SEQ ID NO: 1000826 - RNA, 19 nt, Homo sapiens
ugacacucaugcuuccuuu

SEQ ID NO: 1000827 - RNA, 19 nt, Homo sapiens
cuacuuauccaucucuuga

SEQ ID NO: 1000828 - RNA, 19 nt, Homo sapiens
gaugcaaggcuucaacaga

SEQ ID NO: 1000829 - RNA, 19 nt, Homo sapiens
uaaagcuucuugagagaca

SEQ ID NO: 1000830 - RNA, 19 nt, Homo sapiens
gacccugcuuguauuuauu

SEQ ID NO: 1000831 - RNA, 19 nt, Homo sapiens
cagcaaauacucuaaugau

SEQ ID NO: 1000832 - RNA, 19 nt, Homo sapiens
aaacagccucuuucacauu

SEQ ID NO: 1000833 - RNA, 19 nt, Homo sapiens
gaaccauuacuaagagaau

SEQ ID NO: 1000834 - RNA, 19 nt, Homo sapiens
ggcagcaacuaacauuugu

SEQ ID NO: 1000835 - RNA, 19 nt, Homo sapiens
ucaaaggcccuagaacuug

SEQ ID NO: 1000836 - RNA, 19 nt, Homo sapiens
gaucucccuuuucuaguua

SEQ ID NO: 1000837 - RNA, 19 nt, Homo sapiens
uucaagagcauuucacuuu

SEQ ID NO: 1000838 - RNA, 19 nt, Homo sapiens
agacuuccguagauaaugu

SEQ ID NO: 1000839 - RNA, 19 nt, Homo sapiens
gagaauaggugaaauaaca

SEQ ID NO: 1000840 - RNA, 19 nt, Homo sapiens
gaaggugacucgaaugugu

SEQ ID NO: 1000841 - RNA, 19 nt, Homo sapiens
ggaccaaaguggccaggua

SEQ ID NO: 1000842 - RNA, 19 nt, Homo sapiens
caagagagcuaagcagaug

SEQ ID NO: 1000843 - RNA, 19 nt, Homo sapiens
cacaggcacuggaccaaua

SEQ ID NO: 1000844 - RNA, 19 nt, Homo sapiens
ccaaagcccagccaauuaa

SEQ ID NO: 1000845 - RNA, 19 nt, Homo sapiens
gccaaagcccagccaauua

SEQ ID NO: 1000846 - RNA, 19 nt, Homo sapiens
gaacuucuuccauuauaga

SEQ ID NO: 1000847 - RNA, 19 nt, Homo sapiens
gaaaagcccuccagaagca

SEQ ID NO: 1000848 - RNA, 19 nt, Homo sapiens
cuaagcagauggcagagaa

SEQ ID NO: 1000849 - RNA, 19 nt, Homo sapiens
aaacucagccucuaucaug

SEQ ID NO: 1000850 - RNA, 19 nt, Homo sapiens
caucaacccugugcucuau

SEQ ID NO: 1000851 - RNA, 19 nt, Homo sapiens
gagaccagaucaacagcaa

SEQ ID NO: 1000852 - RNA, 19 nt, Homo sapiens
gcccaaggaguauuauuaa

SEQ ID NO: 1000853 - RNA, 19 nt, Homo sapiens
ccaaaguggccagguaaua

SEQ ID NO: 1000854 - RNA, 19 nt, Homo sapiens
uccauaggcuccauuagaa

SEQ ID NO: 1000855 - RNA, 19 nt, Homo sapiens
gcucauagccaaccucaca

SEQ ID NO: 1000856 - RNA, 19 nt, Homo sapiens
gcaaugugcucacccuacu

SEQ ID NO: 1000857 - RNA, 19 nt, Homo sapiens
ggacagcagguuagcauca

SEQ ID NO: 1000858 - RNA, 19 nt, Homo sapiens
gugcugggcuaucguuaug

SEQ ID NO: 1000859 - RNA, 19 nt, Homo sapiens
gaccaaaguggccagguaa

SEQ ID NO: 1000860 - RNA, 19 nt, Homo sapiens
gcccuagacugcccaagga

SEQ ID NO: 1000861 - RNA, 19 nt, Homo sapiens
ggccaugccuggucguuuc

SEQ ID NO: 1000862 - RNA, 19 nt, Homo sapiens
uaggagaauaggugaaaua

SEQ ID NO: 1000863 - RNA, 19 nt, Homo sapiens
caaaguggccagguaauag

SEQ ID NO: 1000864 - RNA, 19 nt, Homo sapiens
gcugggcuaucguuauguu

SEQ ID NO: 1000865 - RNA, 19 nt, Homo sapiens
gaccagaucaacagcaaga

SEQ ID NO: 1000866 - RNA, 19 nt, Homo sapiens
gcacuggaccaauacaagu

SEQ ID NO: 1000867 - RNA, 19 nt, Homo sapiens
gcaagagagcuaagcagau

SEQ ID NO: 1000868 - RNA, 19 nt, Homo sapiens
caucuucuauugccucauc

SEQ ID NO: 1000869 - RNA, 19 nt, Homo sapiens
ggacgcuaccuccucauug

SEQ ID NO: 1000870 - RNA, 19 nt, Homo sapiens
uggcugaucuccucuacug

SEQ ID NO: 1000871 - RNA, 19 nt, Homo sapiens
ccaauuccgccaagcauau

SEQ ID NO: 1000872 - RNA, 19 nt, Homo sapiens
guguuggcaucuucuauug

SEQ ID NO: 1000873 - RNA, 19 nt, Homo sapiens
uaacacaugugggcauuuu

SEQ ID NO: 1000874 - RNA, 19 nt, Homo sapiens
gcaucaacccugugcucua

SEQ ID NO: 1000875 - RNA, 19 nt, Homo sapiens
gaagugggagaccagauca

SEQ ID NO: 1000876 - RNA, 19 nt, Homo sapiens
gaaggggacucaucagaag

SEQ ID NO: 1000877 - RNA, 19 nt, Homo sapiens
caacuucuccugcuaccau

SEQ ID NO: 1000878 - RNA, 19 nt, Homo sapiens
cagcaguguuggcaucuuc

SEQ ID NO: 1000879 - RNA, 19 nt, Homo sapiens
ccucaugggcaucuacuuu

SEQ ID NO: 1000880 - RNA, 19 nt, Homo sapiens
guauuugggcuccuccuuu

SEQ ID NO: 1000881 - RNA, 19 nt, Homo sapiens
ugcccaaggaguauuauua

SEQ ID NO: 1000882 - RNA, 19 nt, Homo sapiens
gagaaacucagccucuauc

SEQ ID NO: 1000883 - RNA, 19 nt, Homo sapiens
uaggugaaauaacacaugu

SEQ ID NO: 1000884 - RNA, 19 nt, Homo sapiens
gagaaaagcccuccagaag

SEQ ID NO: 1000885 - RNA, 19 nt, Homo sapiens
cagccucuaucauguggaa

SEQ ID NO: 1000886 - RNA, 19 nt, Homo sapiens
caaagcccagccaauuaaa

SEQ ID NO: 1000887 - RNA, 19 nt, Homo sapiens
gaaacucagccucuaucau

SEQ ID NO: 1000888 - RNA, 19 nt, Homo sapiens
gggcaucuacuuugugcuu

SEQ ID NO: 1000889 - RNA, 19 nt, Homo sapiens
ccucuggccuauuuauauc

SEQ ID NO: 1000890 - RNA, 19 nt, Homo sapiens
aauaacacaugugggcauu

SEQ ID NO: 1000891 - RNA, 19 nt, Homo sapiens
gggaaggugacucgaaugu

SEQ ID NO: 1000892 - RNA, 19 nt, Homo sapiens
cuagacugcccaaggagua

SEQ ID NO: 1000893 - RNA, 19 nt, Homo sapiens
gaauaggugaaauaacaca

SEQ ID NO: 1000894 - RNA, 19 nt, Homo sapiens
gccaauuccgccaagcaua

SEQ ID NO: 1000895 - RNA, 19 nt, Homo sapiens
aaccucaccuggcucaaug

SEQ ID NO: 1000896 - RNA, 19 nt, Homo sapiens
ccagaagagcuccggauuc

SEQ ID NO: 1000897 - RNA, 19 nt, Homo sapiens
gacgcuaccuccucauugc

SEQ ID NO: 1000898 - RNA, 19 nt, Homo sapiens
ugaacuucuuccauuauag

SEQ ID NO: 1000899 - RNA, 19 nt, Homo sapiens
gcacaggcacuggaccaau

SEQ ID NO: 1000900 - RNA, 19 nt, Homo sapiens
ucaugggcaucuacuuugu

SEQ ID NO: 1000901 - RNA, 19 nt, Homo sapiens
gauucaaccugcucauagc

SEQ ID NO: 1000902 - RNA, 19 nt, Homo sapiens
caagcuccguacccgauuc

SEQ ID NO: 1000903 - RNA, 19 nt, Homo sapiens
gccagaagagcuccggauu

SEQ ID NO: 1000904 - RNA, 19 nt, Homo sapiens
ccaauuaaaggagccagaa

SEQ ID NO: 1000905 - RNA, 19 nt, Homo sapiens
ugccaaagcccagccaauu

SEQ ID NO: 1000906 - RNA, 19 nt, Homo sapiens
agaauugaaggcugagaaa

SEQ ID NO: 1000907 - RNA, 19 nt, Homo sapiens
ggaaggggacucaucagaa

SEQ ID NO: 1000908 - RNA, 19 nt, Homo sapiens
gugaggggauuucaucuga

SEQ ID NO: 1000909 - RNA, 19 nt, Homo sapiens
caccagaauucaggacugu

SEQ ID NO: 1000910 - RNA, 19 nt, Homo sapiens
gacccuagucaccagaauu

SEQ ID NO: 1000911 - RNA, 19 nt, Homo sapiens
ccagaucaacagcaagaga

SEQ ID NO: 1000912 - RNA, 19 nt, Homo sapiens
gccuauuuauauccuggua

SEQ ID NO: 1000913 - RNA, 19 nt, Homo sapiens
ccagguaauaggagaauag

SEQ ID NO: 1000914 - RNA, 19 nt, Homo sapiens
gccagguaauaggagaaua

SEQ ID NO: 1000915 - RNA, 19 nt, Homo sapiens
cgauucaaccugcucauag

SEQ ID NO: 1000916 - RNA, 19 nt, Homo sapiens
gcaguguuggcaucuucua

SEQ ID NO: 1000917 - RNA, 19 nt, Homo sapiens
gcuccccucuggccuauuu

SEQ ID NO: 1000918 - RNA, 19 nt, Homo sapiens
aauaggagaauaggugaaa

SEQ ID NO: 1000919 - RNA, 19 nt, Homo sapiens
gggcuaucguuauguugca

SEQ ID NO: 1000920 - RNA, 19 nt, Homo sapiens
gacugcccaaggaguauua

SEQ ID NO: 1000921 - RNA, 19 nt, Homo sapiens
caaccucaccuggcucaau

SEQ ID NO: 1000922 - RNA, 19 nt, Homo sapiens
ggaaggugacucgaaugug

SEQ ID NO: 1000923 - RNA, 19 nt, Homo sapiens
guugaacuucuuccauuau

SEQ ID NO: 1000924 - RNA, 19 nt, Homo sapiens
aaucaagucucuccaucac

SEQ ID NO: 1000925 - RNA, 19 nt, Homo sapiens
uuagaacugugacccuagu

SEQ ID NO: 1000926 - RNA, 19 nt, Homo sapiens
aggcaagcauccacuccaa

SEQ ID NO: 1000927 - RNA, 19 nt, Homo sapiens
gggacgcuaccuccucauu

SEQ ID NO: 1000928 - RNA, 19 nt, Homo sapiens
ccaaaucaagucucuccau

SEQ ID NO: 1000929 - RNA, 19 nt, Homo sapiens
aggagaauaggugaaauaa

SEQ ID NO: 1000930 - RNA, 19 nt, Homo sapiens
caucggaauuugggaaggu

SEQ ID NO: 1000931 - RNA, 19 nt, Homo sapiens
gcucuuugggugaguugaa

SEQ ID NO: 1000932 - RNA, 19 nt, Homo sapiens
ccaauucugucuccauccu

SEQ ID NO: 1000933 - RNA, 19 nt, Homo sapiens
ccgauucaaccugcucaua

SEQ ID NO: 1000934 - RNA, 19 nt, Homo sapiens
gcuguguuccucugcuuug

SEQ ID NO: 1000935 - RNA, 19 nt, Homo sapiens
gagcuccggauucuucauc

SEQ ID NO: 1000936 - RNA, 19 nt, Homo sapiens
uuccauaggcuccauuaga

SEQ ID NO: 1000937 - RNA, 19 nt, Homo sapiens
gaauguguuuugcuguguu

SEQ ID NO: 1000938 - RNA, 19 nt, Homo sapiens
uugggaaggugacucgaau

SEQ ID NO: 1000939 - RNA, 19 nt, Homo sapiens
gcacagaccuucaugauau

SEQ ID NO: 1000940 - RNA, 19 nt, Homo sapiens
gcacucgccucgcucauua

SEQ ID NO: 1000941 - RNA, 19 nt, Homo sapiens
guaggucucuuaacaauga

SEQ ID NO: 1000942 - RNA, 19 nt, Homo sapiens
caaauauacuccaaucuga

SEQ ID NO: 1000943 - RNA, 19 nt, Homo sapiens
agaaauggcugaauaaauc

SEQ ID NO: 1000944 - RNA, 19 nt, Homo sapiens
caaaagaaauggcugaaua

SEQ ID NO: 1000945 - RNA, 19 nt, Homo sapiens
uaaaguaccugggaugaaa

SEQ ID NO: 1000946 - RNA, 19 nt, Homo sapiens
aaaccuaucucaugcaauu

SEQ ID NO: 1000947 - RNA, 19 nt, Homo sapiens
caucagaguucaaggcuaa

SEQ ID NO: 1000948 - RNA, 19 nt, Homo sapiens
gaagagaaauccagaagac

SEQ ID NO: 1000949 - RNA, 19 nt, Homo sapiens
caacaaauauacuccaauc

SEQ ID NO: 1000950 - RNA, 19 nt, Homo sapiens
gcauguaggucucuuaaca

SEQ ID NO: 1000951 - RNA, 19 nt, Homo sapiens
gcagaaauaucaauagaac

SEQ ID NO: 1000952 - RNA, 19 nt, Homo sapiens
gacaagcaguaacuucaua

SEQ ID NO: 1000953 - RNA, 19 nt, Homo sapiens
aagcacacuuguacaauua

SEQ ID NO: 1000954 - RNA, 19 nt, Homo sapiens
aagaggaggugaaacauuu

SEQ ID NO: 1000955 - RNA, 19 nt, Homo sapiens
gcaguaacuucauaugguu

SEQ ID NO: 1000956 - RNA, 19 nt, Homo sapiens
aacaauagcuuucuaguuc

SEQ ID NO: 1000957 - RNA, 19 nt, Homo sapiens
gcucuagguuacuguguua

SEQ ID NO: 1000958 - RNA, 19 nt, Homo sapiens
cauaugguuugccuuaaua

SEQ ID NO: 1000959 - RNA, 19 nt, Homo sapiens
gugaaaaccucaacuauuu

SEQ ID NO: 1000960 - RNA, 19 nt, Homo sapiens
gaaauuuacuguaggaacu

SEQ ID NO: 1000961 - RNA, 19 nt, Homo sapiens
ggacauacaagagaaauga

SEQ ID NO: 1000962 - RNA, 19 nt, Homo sapiens
gaguaguucuggaguguaa

SEQ ID NO: 1000963 - RNA, 19 nt, Homo sapiens
ucccaaagaucacucauuu

SEQ ID NO: 1000964 - RNA, 19 nt, Homo sapiens
gcuauuccaucuaccgaua

SEQ ID NO: 1000965 - RNA, 19 nt, Homo sapiens
ccagagaaguggaagagaa

SEQ ID NO: 1000966 - RNA, 19 nt, Homo sapiens
agaaagcagucaauaaaug

SEQ ID NO: 1000967 - RNA, 19 nt, Homo sapiens
ggugaaacauuuaggguau

SEQ ID NO: 1000968 - RNA, 19 nt, Homo sapiens
guucuggaguguaaacaua

SEQ ID NO: 1000969 - RNA, 19 nt, Homo sapiens
guaaguuggucgcauguga

SEQ ID NO: 1000970 - RNA, 19 nt, Homo sapiens
acuccaaucugaaguauaa

SEQ ID NO: 1000971 - RNA, 19 nt, Homo sapiens
ugaagaauguccuacaaug

SEQ ID NO: 1000972 - RNA, 19 nt, Homo sapiens
cagacugggugcagaauuu

SEQ ID NO: 1000973 - RNA, 19 nt, Homo sapiens
gcaaacaucaccuucuuau

SEQ ID NO: 1000974 - RNA, 19 nt, Homo sapiens
gucaugaccuuucgugauu

SEQ ID NO: 1000975 - RNA, 19 nt, Homo sapiens
gaugaaauuuacuguagga

SEQ ID NO: 1000976 - RNA, 19 nt, Homo sapiens
gaaagcagucaauaaaugu

SEQ ID NO: 1000977 - RNA, 19 nt, Homo sapiens
gagaaacacccagcaaauu

SEQ ID NO: 1000978 - RNA, 19 nt, Homo sapiens
gcacacuuguacaauuauu

SEQ ID NO: 1000979 - RNA, 19 nt, Homo sapiens
gaagaggaggugaaacauu

SEQ ID NO: 1000980 - RNA, 19 nt, Homo sapiens
gaaacacccagcaaauuug

SEQ ID NO: 1000981 - RNA, 19 nt, Homo sapiens
agagaaagcagucaauaaa

SEQ ID NO: 1000982 - RNA, 19 nt, Homo sapiens
gcagagaaagcagucaaua

SEQ ID NO: 1000983 - RNA, 19 nt, Homo sapiens
gaggccaucuuuaauacuu

SEQ ID NO: 1000984 - RNA, 19 nt, Homo sapiens
ccaaagaucacucauuuua

SEQ ID NO: 1000985 - RNA, 19 nt, Homo sapiens
ggccaucuuuaauacuuua

SEQ ID NO: 1000986 - RNA, 19 nt, Homo sapiens
agaaacacccagcaaauuu

SEQ ID NO: 1000987 - RNA, 19 nt, Homo sapiens
gguguacucuggccucuug

SEQ ID NO: 1000988 - RNA, 19 nt, Homo sapiens
gagcaggaggagauacuua

SEQ ID NO: 1000989 - RNA, 19 nt, Homo sapiens
uaacgugucuguguugaau

SEQ ID NO: 1000990 - RNA, 19 nt, Homo sapiens
gaaaguggacgguucuauc

SEQ ID NO: 1000991 - RNA, 19 nt, Homo sapiens
uaucacccauauuuccuua

SEQ ID NO: 1000992 - RNA, 19 nt, Homo sapiens
guaagggagaguuuauuaa

SEQ ID NO: 1000993 - RNA, 19 nt, Homo sapiens
cagaaccacugacauuugu

SEQ ID NO: 1000994 - RNA, 19 nt, Homo sapiens
caagagugagaaagaauaa

SEQ ID NO: 1000995 - RNA, 19 nt, Homo sapiens
ucacccauauuuccuuauu

SEQ ID NO: 1000996 - RNA, 19 nt, Homo sapiens
gagaaagcagucaauaaau

SEQ ID NO: 1000997 - RNA, 19 nt, Homo sapiens
cagagaaagcagucaauaa

SEQ ID NO: 1000998 - RNA, 19 nt, Homo sapiens
ugaaacuucugacuacgaa

SEQ ID NO: 1000999 - RNA, 19 nt, Homo sapiens
acuagaaaguguuagguaa

SEQ ID NO: 1001000 - RNA, 19 nt, Homo sapiens
guguaaacauaaacgagua

SEQ ID NO: 1001001 - RNA, 19 nt, Homo sapiens
caugaagaauguccuacaa

SEQ ID NO: 1001002 - RNA, 19 nt, Homo sapiens
gaacguggucccagugugu

SEQ ID NO: 1001003 - RNA, 19 nt, Homo sapiens
cauugaugcucuuucauga

SEQ ID NO: 1001004 - RNA, 19 nt, Homo sapiens
uguaagggagaguuuauua

SEQ ID NO: 1001005 - RNA, 19 nt, Homo sapiens
gguuauaugugcagaugga

SEQ ID NO: 1001006 - RNA, 19 nt, Homo sapiens
aaagaucaaucaucagagu

SEQ ID NO: 1001007 - RNA, 19 nt, Homo sapiens
ugaaagaucaaucaucaga

SEQ ID NO: 1001008 - RNA, 19 nt, Homo sapiens
cuucaaggaguuaaaguua

SEQ ID NO: 1001009 - RNA, 19 nt, Homo sapiens
guucaagagugagaaagaa

SEQ ID NO: 1001010 - RNA, 19 nt, Homo sapiens
gaacucauaauccauugau

SEQ ID NO: 1001011 - RNA, 19 nt, Homo sapiens
uauaggacauacaagagaa

SEQ ID NO: 1001012 - RNA, 19 nt, Homo sapiens
gaaaaguguccucucaaua

SEQ ID NO: 1001013 - RNA, 19 nt, Homo sapiens
ccagguuggugguaaguug

SEQ ID NO: 1001014 - RNA, 19 nt, Homo sapiens
ucucauagcacguguguga

SEQ ID NO: 1001015 - RNA, 19 nt, Homo sapiens
aaaaguaguucaagaguga

SEQ ID NO: 1001016 - RNA, 19 nt, Homo sapiens
ccucaacuauuuaaucauc

SEQ ID NO: 1001017 - RNA, 19 nt, Homo sapiens
aaacguuacaguacucaua

SEQ ID NO: 1001018 - RNA, 19 nt, Homo sapiens
ccaguauuaugccaaaguu

SEQ ID NO: 1001019 - RNA, 19 nt, Homo sapiens
gaagaauguccuacaaugg

SEQ ID NO: 1001020 - RNA, 19 nt, Homo sapiens
ucaagagugagaaagaaua

SEQ ID NO: 1001021 - RNA, 19 nt, Homo sapiens
gccuaaaccugcaaacauc

SEQ ID NO: 1001022 - RNA, 19 nt, Homo sapiens
ugaaaccuaucucaugcaa

SEQ ID NO: 1001023 - RNA, 19 nt, Homo sapiens
caaacuggcaggcugugua

SEQ ID NO: 1001024 - RNA, 19 nt, Homo sapiens
uaucucggaugauucuaaa

SEQ ID NO: 1001025 - RNA, 19 nt, Homo sapiens
ucuauuaccguguuucuuu

SEQ ID NO: 1001026 - RNA, 19 nt, Homo sapiens
ggaagagaaauccagaaga

SEQ ID NO: 1001027 - RNA, 19 nt, Homo sapiens
gaaauggcugaauaaauca

SEQ ID NO: 1001028 - RNA, 19 nt, Homo sapiens
uagguaaagcucuagguua

SEQ ID NO: 1001029 - RNA, 19 nt, Homo sapiens
aguguccucucaauaauuu

SEQ ID NO: 1001030 - RNA, 19 nt, Homo sapiens
aaaguguccucucaauaau

SEQ ID NO: 1001031 - RNA, 19 nt, Homo sapiens
agugauguauccagccuua

SEQ ID NO: 1001032 - RNA, 19 nt, Homo sapiens
aaacugaugccaacacuuc

SEQ ID NO: 1001033 - RNA, 19 nt, Homo sapiens
gaggagggucuucuaucua

SEQ ID NO: 1001034 - RNA, 19 nt, Homo sapiens
ggaggaagaggaggugaaa

SEQ ID NO: 1001035 - RNA, 19 nt, Homo sapiens
caauagaaccuacugugau

SEQ ID NO: 1001036 - RNA, 19 nt, Homo sapiens
gcagacaacccugguagga

SEQ ID NO: 1001037 - RNA, 19 nt, Homo sapiens
gcaggaggagauacuuaaa

SEQ ID NO: 1001038 - RNA, 19 nt, Homo sapiens
ggagaggagggucuucuau

SEQ ID NO: 1001039 - RNA, 19 nt, Homo sapiens
ggacggagcugcagacgaa

SEQ ID NO: 1001040 - RNA, 19 nt, Homo sapiens
cagauaagcugcccaaaug

SEQ ID NO: 1001041 - RNA, 19 nt, Homo sapiens
gcacacacaugcagauaug

SEQ ID NO: 1001042 - RNA, 19 nt, Homo sapiens
ggacacacaugcacacaca

SEQ ID NO: 1001043 - RNA, 19 nt, Homo sapiens
acacacacgugcacagaua

SEQ ID NO: 1001044 - RNA, 19 nt, Homo sapiens
acacagcccuccaagauga

SEQ ID NO: 1001045 - RNA, 19 nt, Homo sapiens
cagauaugcuguccggaua

SEQ ID NO: 1001046 - RNA, 19 nt, Homo sapiens
ucacacacgugcagauauu

SEQ ID NO: 1001047 - RNA, 19 nt, Homo sapiens
gauauugccuggacacaca

SEQ ID NO: 1001048 - RNA, 19 nt, Homo sapiens
gauauugccuggacacaca

SEQ ID NO: 1001049 - RNA, 19 nt, Homo sapiens
acacacacaugcacggaua

SEQ ID NO: 1001050 - RNA, 19 nt, Homo sapiens
acacgcacaugcacagaua

SEQ ID NO: 1001051 - RNA, 19 nt, Homo sapiens
acacacaggugcagauaug

SEQ ID NO: 1001052 - RNA, 19 nt, Homo sapiens
acacacgcaugcacagaua

SEQ ID NO: 1001053 - RNA, 19 nt, Homo sapiens
gauaugcugucuagucaca

SEQ ID NO: 1001054 - RNA, 19 nt, Homo sapiens
cagauaugcugucuaguca

SEQ ID NO: 1001055 - RNA, 19 nt, Homo sapiens
gcagauaugcugucuaguc

SEQ ID NO: 1001056 - RNA, 19 nt, Homo sapiens
gcacagagacaugccagaa

SEQ ID NO: 1001057 - RNA, 19 nt, Homo sapiens
acacagacauccacacaca

SEQ ID NO: 1001058 - RNA, 19 nt, Homo sapiens
ucaauaagcugcucaucac

SEQ ID NO: 1001059 - RNA, 19 nt, Homo sapiens
ucacacagcccuccaagau

SEQ ID NO: 1001060 - RNA, 19 nt, Homo sapiens
ggacacacacuuccagaca

SEQ ID NO: 1001061 - RNA, 19 nt, Homo sapiens
ggacacacacacagauaau

SEQ ID NO: 1001062 - RNA, 19 nt, Homo sapiens
gcacacccaugcgcagaug

SEQ ID NO: 1001063 - RNA, 19 nt, Homo sapiens
gaacauacaaggacaugcu

SEQ ID NO: 1001064 - RNA, 19 nt, Homo sapiens
acagagacaugccagaaca

SEQ ID NO: 1001065 - RNA, 19 nt, Homo sapiens
gcuccuaccucaauaagcu

SEQ ID NO: 1001066 - RNA, 19 nt, Homo sapiens
gcacgcacacgcacagaga

SEQ ID NO: 1001067 - RNA, 19 nt, Homo sapiens
ggccuugguauuuauauuu

SEQ ID NO: 1001068 - RNA, 19 nt, Homo sapiens
ggacacugagccugaagaa

SEQ ID NO: 1001069 - RNA, 19 nt, Homo sapiens
gcacacacuuccggacaca

SEQ ID NO: 1001070 - RNA, 19 nt, Homo sapiens
gaggacagcggcaaauaca

SEQ ID NO: 1001071 - RNA, 19 nt, Homo sapiens
gggccuugguauuuauauu

SEQ ID NO: 1001072 - RNA, 19 nt, Homo sapiens
ggacacacacgugcacaga

SEQ ID NO: 1001073 - RNA, 19 nt, Homo sapiens
gaacacgacgguggacuuc

SEQ ID NO: 1001074 - RNA, 19 nt, Homo sapiens
acgcagauaugcugucuag

SEQ ID NO: 1001075 - RNA, 19 nt, Homo sapiens
gaaggaagacuggguugca

SEQ ID NO: 1001076 - RNA, 19 nt, Homo sapiens
ggacacacacacacagaca

SEQ ID NO: 1001077 - RNA, 19 nt, Homo sapiens
gauaugcuguccggauaca

SEQ ID NO: 1001078 - RNA, 19 nt, Homo sapiens
cgacggcuccuaccucaau

SEQ ID NO: 1001079 - RNA, 19 nt, Homo sapiens
agauaaugcugccucaaca

SEQ ID NO: 1001080 - RNA, 19 nt, Homo sapiens
agauaaugcugccuugaca

SEQ ID NO: 1001081 - RNA, 19 nt, Homo sapiens
gacggcuccuaccucaaua

SEQ ID NO: 1001082 - RNA, 19 nt, Homo sapiens
gacaugcugccugaacaua

SEQ ID NO: 1001083 - RNA, 19 nt, Homo sapiens
gauaagcugcccaaaugca

SEQ ID NO: 1001084 - RNA, 19 nt, Homo sapiens
ccacguccuuccagugcaa

SEQ ID NO: 1001085 - RNA, 19 nt, Homo sapiens
gcugaagccccguauauuu

SEQ ID NO: 1001086 - RNA, 19 nt, Homo sapiens
acacacacuuccagacaca

SEQ ID NO: 1001087 - RNA, 19 nt, Homo sapiens
gcacacgcacagagacaug

SEQ ID NO: 1001088 - RNA, 19 nt, Homo sapiens
ggaggacagcggcaaauac

SEQ ID NO: 1001089 - RNA, 19 nt, Homo sapiens
gugcacaggcgcagauaug

SEQ ID NO: 1001090 - RNA, 19 nt, Homo sapiens
ccgcugagcccaggaagaa

SEQ ID NO: 1001091 - RNA, 19 nt, Homo sapiens
acacacacacacacggaua

SEQ ID NO: 1001092 - RNA, 19 nt, Homo sapiens
acagauaagcugcccaaau

SEQ ID NO: 1001093 - RNA, 19 nt, Homo sapiens
gugcauccuuucccuccaa

SEQ ID NO: 1001094 - RNA, 19 nt, Homo sapiens
acgcacacaugcagauaug

SEQ ID NO: 1001095 - RNA, 19 nt, Homo sapiens
caucaacgccaccuacaag

SEQ ID NO: 1001096 - RNA, 19 nt, Homo sapiens
gcugagcccaggaagaaga

SEQ ID NO: 1001097 - RNA, 19 nt, Homo sapiens
ccaggcagucuguguguga

SEQ ID NO: 1001098 - RNA, 19 nt, Homo sapiens
caugcugccugaacauaca

SEQ ID NO: 1001099 - RNA, 19 nt, Homo sapiens
agagacaugccagaacaua

SEQ ID NO: 1001100 - RNA, 19 nt, Homo sapiens
ggcugaagcgcguggagua

SEQ ID NO: 1001101 - RNA, 19 nt, Homo sapiens
ccuacaagguggaugugau

SEQ ID NO: 1001102 - RNA, 19 nt, Homo sapiens
caaagauggcggacaaggu

SEQ ID NO: 1001103 - RNA, 19 nt, Homo sapiens
acacacacacgcagacaug

SEQ ID NO: 1001104 - RNA, 19 nt, Homo sapiens
ggacaugcugccugaacau

SEQ ID NO: 1001105 - RNA, 19 nt, Homo sapiens
cccaaacucuacacagaca

SEQ ID NO: 1001106 - RNA, 19 nt, Homo sapiens
gagcugaagccccguauau

SEQ ID NO: 1001107 - RNA, 19 nt, Homo sapiens
agacaugccagaacauaca

SEQ ID NO: 1001108 - RNA, 19 nt, Homo sapiens
cgccugggcacacagauaa

SEQ ID NO: 1001109 - RNA, 19 nt, Homo sapiens
cgugaagccugcaguacgu

SEQ ID NO: 1001110 - RNA, 19 nt, Homo sapiens
cagcacauccacuaucagu

SEQ ID NO: 1001111 - RNA, 19 nt, Homo sapiens
cauaguugaugagggacuu

SEQ ID NO: 1001112 - RNA, 19 nt, Homo sapiens
aaugcugccucaacacuca

SEQ ID NO: 1001113 - RNA, 19 nt, Homo sapiens
uaugguauccggacacaca

SEQ ID NO: 1001114 - RNA, 19 nt, Homo sapiens
cuacacagacauccacaca

SEQ ID NO: 1001115 - RNA, 19 nt, Homo sapiens
cggaggacagcggcaaaua

SEQ ID NO: 1001116 - RNA, 19 nt, Homo sapiens
gcacacaugcagauaugcu

SEQ ID NO: 1001117 - RNA, 19 nt, Homo sapiens
acacaugugcacagauaug

SEQ ID NO: 1001118 - RNA, 19 nt, Homo sapiens
acacacacacucucacaca

SEQ ID NO: 1001119 - RNA, 19 nt, Homo sapiens
ccacacacacacacacaca

SEQ ID NO: 1001120 - RNA, 19 nt, Homo sapiens
ggcccgacaucacguggau

SEQ ID NO: 1001121 - RNA, 19 nt, Homo sapiens
cugaagccccguauauuua

SEQ ID NO: 1001122 - RNA, 19 nt, Homo sapiens
acacacacgcacgcagaua

SEQ ID NO: 1001123 - RNA, 19 nt, Homo sapiens
uugcuggcccuaaguugua

SEQ ID NO: 1001124 - RNA, 19 nt, Homo sapiens
uggacacacacacagauaa

SEQ ID NO: 1001125 - RNA, 19 nt, Homo sapiens
uaugcugccuggacacaca

SEQ ID NO: 1001126 - RNA, 19 nt, Homo sapiens
ggacacacgcagauaugcu

SEQ ID NO: 1001127 - RNA, 19 nt, Homo sapiens
uaugcugccuggacacaca

SEQ ID NO: 1001128 - RNA, 19 nt, Homo sapiens
uaugcugccuggacacaca

SEQ ID NO: 1001129 - RNA, 19 nt, Homo sapiens
acacacacacacacucuca

SEQ ID NO: 1001130 - RNA, 19 nt, Homo sapiens
caaacucuacacagacauc

SEQ ID NO: 1001131 - RNA, 19 nt, Homo sapiens
cagauaaugcugccucaac

SEQ ID NO: 1001132 - RNA, 19 nt, Homo sapiens
gagacaugccagaacauac

SEQ ID NO: 1001133 - RNA, 19 nt, Homo sapiens
accagcacauccacuauca

SEQ ID NO: 1001134 - RNA, 19 nt, Homo sapiens
gaucggaaguucgcauaua

SEQ ID NO: 1001135 - RNA, 19 nt, Homo sapiens
gaaaucaaaccaggaauaa

SEQ ID NO: 1001136 - RNA, 19 nt, Homo sapiens
ggagauaccuaccuugucu

SEQ ID NO: 1001137 - RNA, 19 nt, Homo sapiens
ugacacgcaucuuugcuua

SEQ ID NO: 1001138 - RNA, 19 nt, Homo sapiens
gcaaguuguuccaguaguu

SEQ ID NO: 1001139 - RNA, 19 nt, Homo sapiens
gaaucgauauguacaaagu

SEQ ID NO: 1001140 - RNA, 19 nt, Homo sapiens
gaacaccacccuucacaau

SEQ ID NO: 1001141 - RNA, 19 nt, Homo sapiens
caucacaacugaagaaugg

SEQ ID NO: 1001142 - RNA, 19 nt, Homo sapiens
gauaagcauugaucgcuau

SEQ ID NO: 1001143 - RNA, 19 nt, Homo sapiens
gaaagaacaccacccuuca

SEQ ID NO: 1001144 - RNA, 19 nt, Homo sapiens
ccauaucacuugugcagaa

SEQ ID NO: 1001145 - RNA, 19 nt, Homo sapiens
gcaucuugcugaaugguuu

SEQ ID NO: 1001146 - RNA, 19 nt, Homo sapiens
gaccuuaguuucaaagcuu

SEQ ID NO: 1001147 - RNA, 19 nt, Homo sapiens
acaccacccuucacaauga

SEQ ID NO: 1001148 - RNA, 19 nt, Homo sapiens
ccagguacauccacaaauc

SEQ ID NO: 1001149 - RNA, 19 nt, Homo sapiens
gaauaaaaccagcuucaua

SEQ ID NO: 1001150 - RNA, 19 nt, Homo sapiens
ccaagagagucacaauuca

SEQ ID NO: 1001151 - RNA, 19 nt, Homo sapiens
aaacauaaccagagcauca

SEQ ID NO: 1001152 - RNA, 19 nt, Homo sapiens
gcaggcaauucauaaguca

SEQ ID NO: 1001153 - RNA, 19 nt, Homo sapiens
caaacaucauccugacaaa

SEQ ID NO: 1001154 - RNA, 19 nt, Homo sapiens
cggaaguucgcauauauua

SEQ ID NO: 1001155 - RNA, 19 nt, Homo sapiens
ggaauaaccuaugcugaac

SEQ ID NO: 1001156 - RNA, 19 nt, Homo sapiens
ccacuucccugcugaccuu

SEQ ID NO: 1001157 - RNA, 19 nt, Homo sapiens
gcaaacauguauacuucca

SEQ ID NO: 1001158 - RNA, 19 nt, Homo sapiens
gaucauggcuguuuugucu

SEQ ID NO: 1001159 - RNA, 19 nt, Homo sapiens
gccaagagagucacaauuc

SEQ ID NO: 1001160 - RNA, 19 nt, Homo sapiens
agagcaaguuguuccagua

SEQ ID NO: 1001161 - RNA, 19 nt, Homo sapiens
agaaaucaaaccaggaaua

SEQ ID NO: 1001162 - RNA, 19 nt, Homo sapiens
caaauggucagccaacaga

SEQ ID NO: 1001163 - RNA, 19 nt, Homo sapiens
gacauuuccauuucgaaua

SEQ ID NO: 1001164 - RNA, 19 nt, Homo sapiens
ggugcuuuaucucauuaua

SEQ ID NO: 1001165 - RNA, 19 nt, Homo sapiens
caaaggacaaucucuaaag

SEQ ID NO: 1001166 - RNA, 19 nt, Homo sapiens
ccaccacaaugaaagaaau

SEQ ID NO: 1001167 - RNA, 19 nt, Homo sapiens
gugagaagaucggaaguuc

SEQ ID NO: 1001168 - RNA, 19 nt, Homo sapiens
gccuggauccaauaauuua

SEQ ID NO: 1001169 - RNA, 19 nt, Homo sapiens
ugaagguggucaagccauu

SEQ ID NO: 1001170 - RNA, 19 nt, Homo sapiens
caugacugcucaaaacuua

SEQ ID NO: 1001171 - RNA, 19 nt, Homo sapiens
caacagaggacaauaucca

SEQ ID NO: 1001172 - RNA, 19 nt, Homo sapiens
ccaaacaucauccugacaa

SEQ ID NO: 1001173 - RNA, 19 nt, Homo sapiens
gcauugaucgcuaucugaa

SEQ ID NO: 1001174 - RNA, 19 nt, Homo sapiens
gcagauacacuucaguuuu

SEQ ID NO: 1001175 - RNA, 19 nt, Homo sapiens
aaaccagcuucauauucua

SEQ ID NO: 1001176 - RNA, 19 nt, Homo sapiens
aaagaaaucaaaccaggaa

SEQ ID NO: 1001177 - RNA, 19 nt, Homo sapiens
gcagaauuccuuuuacuuu

SEQ ID NO: 1001178 - RNA, 19 nt, Homo sapiens
ccaaaggacaaucucuaaa

SEQ ID NO: 1001179 - RNA, 19 nt, Homo sapiens
ggaaguucgcauauauuau

SEQ ID NO: 1001180 - RNA, 19 nt, Homo sapiens
ucacgaagguuuuaucugu

SEQ ID NO: 1001181 - RNA, 19 nt, Homo sapiens
gaagguggucaagccauuu

SEQ ID NO: 1001182 - RNA, 19 nt, Homo sapiens
augcaaacauguauacuuc

SEQ ID NO: 1001183 - RNA, 19 nt, Homo sapiens
uggaaucgauauguacaaa

SEQ ID NO: 1001184 - RNA, 19 nt, Homo sapiens
ggagugaaagcaucagauc

SEQ ID NO: 1001185 - RNA, 19 nt, Homo sapiens
cagaggacaauauccauga

SEQ ID NO: 1001186 - RNA, 19 nt, Homo sapiens
aaaggacaaucucuaaagg

SEQ ID NO: 1001187 - RNA, 19 nt, Homo sapiens
cagauacacuucaguuuug

SEQ ID NO: 1001188 - RNA, 19 nt, Homo sapiens
ccggugcuuuaucucauua

SEQ ID NO: 1001189 - RNA, 19 nt, Homo sapiens
uugccuggauccaauaauu

SEQ ID NO: 1001190 - RNA, 19 nt, Homo sapiens
uaucacuugugcagaauuc

SEQ ID NO: 1001191 - RNA, 19 nt, Homo sapiens
acauagccauauccaggua

SEQ ID NO: 1001192 - RNA, 19 nt, Homo sapiens
gcauacggcagucaccuau

SEQ ID NO: 1001193 - RNA, 19 nt, Homo sapiens
acauuuccauuucgaauag

SEQ ID NO: 1001194 - RNA, 19 nt, Homo sapiens
acgcugacauuuccauuuc

SEQ ID NO: 1001195 - RNA, 19 nt, Homo sapiens
gagcugcacggccaagaga

SEQ ID NO: 1001196 - RNA, 19 nt, Homo sapiens
ggacagccagccaccacaa

SEQ ID NO: 1001197 - RNA, 19 nt, Homo sapiens
ugauuauacugauguguag

SEQ ID NO: 1001198 - RNA, 19 nt, Homo sapiens
uuaccugcuuucuaccaua

SEQ ID NO: 1001199 - RNA, 19 nt, Homo sapiens
auacggcagucaccuaugu

SEQ ID NO: 1001200 - RNA, 19 nt, Homo sapiens
aggaauaaccuaugcugaa

SEQ ID NO: 1001201 - RNA, 19 nt, Homo sapiens
gaaccaggagugaaagcau

SEQ ID NO: 1001202 - RNA, 19 nt, Homo sapiens
ugauucugaucggauguua

SEQ ID NO: 1001203 - RNA, 19 nt, Homo sapiens
gacaaauggucagccaaca

SEQ ID NO: 1001204 - RNA, 19 nt, Homo sapiens
gcugacauuuccauuucga

SEQ ID NO: 1001205 - RNA, 19 nt, Homo sapiens
acacgcaucuuugcuuaca

SEQ ID NO: 1001206 - RNA, 19 nt, Homo sapiens
uagacaggcuuuuagauga

SEQ ID NO: 1001207 - RNA, 19 nt, Homo sapiens
cacaaugaauuugacacaa

SEQ ID NO: 1001208 - RNA, 19 nt, Homo sapiens
cccaaaggacaaucucuaa

SEQ ID NO: 1001209 - RNA, 19 nt, Homo sapiens
gugcaucacaacugaagaa

SEQ ID NO: 1001210 - RNA, 19 nt, Homo sapiens
caucagaucacugcaaagu

SEQ ID NO: 1001211 - RNA, 19 nt, Homo sapiens
ggggagauguuucguuuuc

SEQ ID NO: 1001212 - RNA, 19 nt, Homo sapiens
ucaagaaggcuguucaaaa

SEQ ID NO: 1001213 - RNA, 19 nt, Homo sapiens
gagcaucaggguuguugug

SEQ ID NO: 1001214 - RNA, 19 nt, Homo sapiens
gacgcugacauuuccauuu

SEQ ID NO: 1001215 - RNA, 19 nt, Homo sapiens
gccggugcuuuaucucauu

SEQ ID NO: 1001216 - RNA, 19 nt, Homo sapiens
uuuauucucugcagauaca

SEQ ID NO: 1001217 - RNA, 19 nt, Homo sapiens
gaugcaggauuuggaccuu

SEQ ID NO: 1001218 - RNA, 19 nt, Homo sapiens
gguugcagaccucauaaug

SEQ ID NO: 1001219 - RNA, 19 nt, Homo sapiens
cugcugaccuuaguuucaa

SEQ ID NO: 1001220 - RNA, 19 nt, Homo sapiens
gagcaaguuguuccaguag

SEQ ID NO: 1001221 - RNA, 19 nt, Homo sapiens
uaggggagauguuucguuu

SEQ ID NO: 1001222 - RNA, 19 nt, Homo sapiens
uaccugcuuucuaccauau

SEQ ID NO: 1001223 - RNA, 19 nt, Homo sapiens
gcaauucauaagucaguca

SEQ ID NO: 1001224 - RNA, 19 nt, Homo sapiens
ggccaagagagucacaauu

SEQ ID NO: 1001225 - RNA, 19 nt, Homo sapiens
gcaagagagcaaguuguuc

SEQ ID NO: 1001226 - RNA, 19 nt, Homo sapiens
agcaucagaucacugcaaa

SEQ ID NO: 1001227 - RNA, 19 nt, Homo sapiens
gguuuuaucuguuuguguu

SEQ ID NO: 1001228 - RNA, 19 nt, Homo sapiens
gggcugauaagcauugauc

SEQ ID NO: 1001229 - RNA, 19 nt, Homo sapiens
aguccaugaugcaggauuu

SEQ ID NO: 1001230 - RNA, 19 nt, Homo sapiens
caacuugacgcuugcaaaa

SEQ ID NO: 1001231 - RNA, 19 nt, Homo sapiens
caaaccaggaauaaccuau

SEQ ID NO: 1001232 - RNA, 19 nt, Homo sapiens
caacuugaagacaccguau

SEQ ID NO: 1001233 - RNA, 19 nt, Homo sapiens
aacaucauccugacaaaug

SEQ ID NO: 1001234 - RNA, 19 nt, Homo sapiens
gcacagcccucgcacaagu

SEQ ID NO: 1001235 - RNA, 19 nt, Homo sapiens
uaugagagcuacaagaaga

SEQ ID NO: 1001236 - RNA, 19 nt, Homo sapiens
cagcaacccuggccacauu

SEQ ID NO: 1001237 - RNA, 19 nt, Homo sapiens
ggacagcucuugugcucau

SEQ ID NO: 1001238 - RNA, 19 nt, Homo sapiens
gcccacagcucuccaagga

SEQ ID NO: 1001239 - RNA, 19 nt, Homo sapiens
gagauaugccagaugcuua

SEQ ID NO: 1001240 - RNA, 19 nt, Homo sapiens
caugaucacuaaagaguug

SEQ ID NO: 1001241 - RNA, 19 nt, Homo sapiens
gugguuaacacaacaaaua

SEQ ID NO: 1001242 - RNA, 19 nt, Homo sapiens
gaaugcaucuguggaaaca

SEQ ID NO: 1001243 - RNA, 19 nt, Homo sapiens
caaaccaagugcuuccaaa

SEQ ID NO: 1001244 - RNA, 19 nt, Homo sapiens
ccaagcacaugcccaguga

SEQ ID NO: 1001245 - RNA, 19 nt, Homo sapiens
cagauuaauuccaugauca

SEQ ID NO: 1001246 - RNA, 19 nt, Homo sapiens
ccacacccaugcccucaaa

SEQ ID NO: 1001247 - RNA, 19 nt, Homo sapiens
gagccugaccugaauuaaa

SEQ ID NO: 1001248 - RNA, 19 nt, Homo sapiens
ccagaugcuuaaacacauu

SEQ ID NO: 1001249 - RNA, 19 nt, Homo sapiens
ggaugcgucuguuacuaga

SEQ ID NO: 1001250 - RNA, 19 nt, Homo sapiens
guacaacuguggccuccau

SEQ ID NO: 1001251 - RNA, 19 nt, Homo sapiens
caacgauccacgcaacuuu

SEQ ID NO: 1001252 - RNA, 19 nt, Homo sapiens
gcucccagcucacccacaa

SEQ ID NO: 1001253 - RNA, 19 nt, Homo sapiens
cagguggacuacuuaauca

SEQ ID NO: 1001254 - RNA, 19 nt, Homo sapiens
cagcccaccucaacucuau

SEQ ID NO: 1001255 - RNA, 19 nt, Homo sapiens
caugagcacucguccaagu

SEQ ID NO: 1001256 - RNA, 19 nt, Homo sapiens
cagcuucuccugucacauu

SEQ ID NO: 1001257 - RNA, 19 nt, Homo sapiens
gcugucagauuaauuccau

SEQ ID NO: 1001258 - RNA, 19 nt, Homo sapiens
caagcacaaggucccauua

SEQ ID NO: 1001259 - RNA, 19 nt, Homo sapiens
guggaaacaguugauaaua

SEQ ID NO: 1001260 - RNA, 19 nt, Homo sapiens
ggauguaugcggacucaga

SEQ ID NO: 1001261 - RNA, 19 nt, Homo sapiens
gaggaaugcaucuguggaa

SEQ ID NO: 1001262 - RNA, 19 nt, Homo sapiens
ggaagggauuagucaagag

SEQ ID NO: 1001263 - RNA, 19 nt, Homo sapiens
gaccugaauuaaaguacug

SEQ ID NO: 1001264 - RNA, 19 nt, Homo sapiens
ggagauaugccagaugcuu

SEQ ID NO: 1001265 - RNA, 19 nt, Homo sapiens
gcuacaagaagaaggacua

SEQ ID NO: 1001266 - RNA, 19 nt, Homo sapiens
gcuguggccuccaguacga

SEQ ID NO: 1001267 - RNA, 19 nt, Homo sapiens
cuauggaagucacaacaga

SEQ ID NO: 1001268 - RNA, 19 nt, Homo sapiens
accaagugcuuccaaauuc

SEQ ID NO: 1001269 - RNA, 19 nt, Homo sapiens
ccuaugagagcuacaagaa

SEQ ID NO: 1001270 - RNA, 19 nt, Homo sapiens
gagcagcgcguugccaaga

SEQ ID NO: 1001271 - RNA, 19 nt, Homo sapiens
cagcacagcccucgcacaa

SEQ ID NO: 1001272 - RNA, 19 nt, Homo sapiens
gcaggacagaugugaguga

SEQ ID NO: 1001273 - RNA, 19 nt, Homo sapiens
gacacaagcaggacagaug

SEQ ID NO: 1001274 - RNA, 19 nt, Homo sapiens
ucagauuaauuccaugauc

SEQ ID NO: 1001275 - RNA, 19 nt, Homo sapiens
cggagcagguagagacuga

SEQ ID NO: 1001276 - RNA, 19 nt, Homo sapiens
aagcaggagggaaccauua

SEQ ID NO: 1001277 - RNA, 19 nt, Homo sapiens
uaaaacgucugaggaugua

SEQ ID NO: 1001278 - RNA, 19 nt, Homo sapiens
uggaagggauuagucaaga

SEQ ID NO: 1001279 - RNA, 19 nt, Homo sapiens
gccagaugcuuaaacacau

SEQ ID NO: 1001280 - RNA, 19 nt, Homo sapiens
ccaagugcuuccaaauucu

SEQ ID NO: 1001281 - RNA, 19 nt, Homo sapiens
ccagguggacuacuuaauc

SEQ ID NO: 1001282 - RNA, 19 nt, Homo sapiens
gcagcagcuucuccuguca

SEQ ID NO: 1001283 - RNA, 19 nt, Homo sapiens
acauuuaauugcugucaga

SEQ ID NO: 1001284 - RNA, 19 nt, Homo sapiens
agccugaccugaauuaaag

SEQ ID NO: 1001285 - RNA, 19 nt, Homo sapiens
gauguaugcggacucagaa

SEQ ID NO: 1001286 - RNA, 19 nt, Homo sapiens
caggacagaugugagugaa

SEQ ID NO: 1001287 - RNA, 19 nt, Homo sapiens
uaugccagaugcuuaaaca

SEQ ID NO: 1001288 - RNA, 19 nt, Homo sapiens
ugagugaaccagcaacuuc

SEQ ID NO: 1001289 - RNA, 19 nt, Homo sapiens
ccggaugcgucuguuacua

SEQ ID NO: 1001290 - RNA, 19 nt, Homo sapiens
agacaaaacucuccuucug

SEQ ID NO: 1001291 - RNA, 19 nt, Homo sapiens
ugucggagccugaccugaa

SEQ ID NO: 1001292 - RNA, 19 nt, Homo sapiens
cagcucuugugcucauuug

SEQ ID NO: 1001293 - RNA, 19 nt, Homo sapiens
aaccaagugcuuccaaauu

SEQ ID NO: 1001294 - RNA, 19 nt, Homo sapiens
cccaugcccucaaacacaa

SEQ ID NO: 1001295 - RNA, 19 nt, Homo sapiens
ccacugggcauccaucucu

SEQ ID NO: 1001296 - RNA, 19 nt, Homo sapiens
ucaagaggaaugcaucugu

SEQ ID NO: 1001297 - RNA, 19 nt, Homo sapiens
uuacuagaguggagagucu

SEQ ID NO: 1001298 - RNA, 19 nt, Homo sapiens
agauaugccagaugcuuaa

SEQ ID NO: 1001299 - RNA, 19 nt, Homo sapiens
ggauuagucaagaggaaug

SEQ ID NO: 1001300 - RNA, 19 nt, Homo sapiens
guaugcggacucagaaaug

SEQ ID NO: 1001301 - RNA, 19 nt, Homo sapiens
gcucuugugcucauuugga

SEQ ID NO: 1001302 - RNA, 19 nt, Homo sapiens
ccaccucaacucuauggaa

SEQ ID NO: 1001303 - RNA, 19 nt, Homo sapiens
cggagccugaccugaauua

SEQ ID NO: 1001304 - RNA, 19 nt, Homo sapiens
gcagcgcguugccaagaac

SEQ ID NO: 1001305 - RNA, 19 nt, Homo sapiens
cacgcaacuuugucccuaa

SEQ ID NO: 1001306 - RNA, 19 nt, Homo sapiens
caagugcuuccaaauucuu

SEQ ID NO: 1001307 - RNA, 19 nt, Homo sapiens
aaaccaagugcuuccaaau

SEQ ID NO: 1001308 - RNA, 19 nt, Homo sapiens
gauguggacagcucuugug

SEQ ID NO: 1001309 - RNA, 19 nt, Homo sapiens
ccacacgugcucagacugu

SEQ ID NO: 1001310 - RNA, 19 nt, Homo sapiens
cgacugcggccuccauuac

SEQ ID NO: 1001311 - RNA, 19 nt, Homo sapiens
ccucaacucuauggaaguc

SEQ ID NO: 1001312 - RNA, 19 nt, Homo sapiens
gcagcccaccucaacucua

SEQ ID NO: 1001313 - RNA, 19 nt, Homo sapiens
ggaaugcaucuguggaaac

SEQ ID NO: 1001314 - RNA, 19 nt, Homo sapiens
caagcaggagggaaccauu

SEQ ID NO: 1001315 - RNA, 19 nt, Homo sapiens
gucggagccugaccugaau

SEQ ID NO: 1001316 - RNA, 19 nt, Homo sapiens
gagaccaaaccaagugcuu

SEQ ID NO: 1001317 - RNA, 19 nt, Homo sapiens
ccaagcacaaggucccauu

SEQ ID NO: 1001318 - RNA, 19 nt, Homo sapiens
uaugcggacucagaaaugu

SEQ ID NO: 1001319 - RNA, 19 nt, Homo sapiens
ccacaccagguacugauuc

SEQ ID NO: 1001320 - RNA, 19 nt, Homo sapiens
ucaggcuccuuccuacugu

SEQ ID NO: 1001321 - RNA, 19 nt, Homo sapiens
ccagcucacccacaagaug

SEQ ID NO: 1001322 - RNA, 19 nt, Homo sapiens
ggccacacgugcucagacu

SEQ ID NO: 1001323 - RNA, 19 nt, Homo sapiens
ggacacaagcaggacagau

SEQ ID NO: 1001324 - RNA, 19 nt, Homo sapiens
aggaaugcaucuguggaaa

SEQ ID NO: 1001325 - RNA, 19 nt, Homo sapiens
ugaccugaauuaaaguacu

SEQ ID NO: 1001326 - RNA, 19 nt, Homo sapiens
gauaugccagaugcuuaaa

SEQ ID NO: 1001327 - RNA, 19 nt, Homo sapiens
cuccagcacucccaugaca

SEQ ID NO: 1001328 - RNA, 19 nt, Homo sapiens
cagcucacccacaagaugu

SEQ ID NO: 1001329 - RNA, 19 nt, Homo sapiens
cuugugcucauuuggauuu

SEQ ID NO: 1001330 - RNA, 19 nt, Homo sapiens
caaaauguggaagggauua

SEQ ID NO: 1001331 - RNA, 19 nt, Homo sapiens
cagaugcuuaaacacauuu

SEQ ID NO: 1001332 - RNA, 19 nt, Homo sapiens
ccaaaccaagugcuuccaa

SEQ ID NO: 1001333 - RNA, 19 nt, Homo sapiens
uuaaucaacgggauguaug

SEQ ID NO: 1001334 - RNA, 19 nt, Homo sapiens
gcucaaaccuugccuguug

SEQ ID NO: 1001335 - RNA, 19 nt, Homo sapiens
gagagaugcuuauuuauuc

SEQ ID NO: 1001336 - RNA, 19 nt, Homo sapiens
agagagagcugcaaagauu

SEQ ID NO: 1001337 - RNA, 19 nt, Homo sapiens
ugagauguaugguguauuu

SEQ ID NO: 1001338 - RNA, 19 nt, Homo sapiens
guuauaggguuacagaaua

SEQ ID NO: 1001339 - RNA, 19 nt, Homo sapiens
ccaagaaacugaagacugu

SEQ ID NO: 1001340 - RNA, 19 nt, Homo sapiens
cuaagugucucuaaaugua

SEQ ID NO: 1001341 - RNA, 19 nt, Homo sapiens
gaagcauccuaaauaauga

SEQ ID NO: 1001342 - RNA, 19 nt, Homo sapiens
agaagacgcuggauaaguu

SEQ ID NO: 1001343 - RNA, 19 nt, Homo sapiens
ucaagaggcugaagaagga

SEQ ID NO: 1001344 - RNA, 19 nt, Homo sapiens
gcagugcaauggcuucaaa

SEQ ID NO: 1001345 - RNA, 19 nt, Homo sapiens
gaugaauacuuucucaguu

SEQ ID NO: 1001346 - RNA, 19 nt, Homo sapiens
gaaguauguuguuagaaga

SEQ ID NO: 1001347 - RNA, 19 nt, Homo sapiens
guauuuggcuugaguuaug

SEQ ID NO: 1001348 - RNA, 19 nt, Homo sapiens
gacuguaccuaacuauuaa

SEQ ID NO: 1001349 - RNA, 19 nt, Homo sapiens
gcaacugacucaucugcaa

SEQ ID NO: 1001350 - RNA, 19 nt, Homo sapiens
gcaaagauuggaagaagaa

SEQ ID NO: 1001351 - RNA, 19 nt, Homo sapiens
gacaaaggauacaaacaga

SEQ ID NO: 1001352 - RNA, 19 nt, Homo sapiens
guaccuaacuauuaagauc

SEQ ID NO: 1001353 - RNA, 19 nt, Homo sapiens
ugacucaucugcaacauuc

SEQ ID NO: 1001354 - RNA, 19 nt, Homo sapiens
agacuguaccuaacuauua

SEQ ID NO: 1001355 - RNA, 19 nt, Homo sapiens
gaagaucagagacaaguga

SEQ ID NO: 1001356 - RNA, 19 nt, Homo sapiens
guaggaugcugcaaauguu

SEQ ID NO: 1001357 - RNA, 19 nt, Homo sapiens
caaggaaugucaggagaaa

SEQ ID NO: 1001358 - RNA, 19 nt, Homo sapiens
cagagaaaguuaccuaauc

SEQ ID NO: 1001359 - RNA, 19 nt, Homo sapiens
ggaguuaggaccagaagaa

SEQ ID NO: 1001360 - RNA, 19 nt, Homo sapiens
gauuuaagacuguaccuaa

SEQ ID NO: 1001361 - RNA, 19 nt, Homo sapiens
cuauuaagaucacugugua

SEQ ID NO: 1001362 - RNA, 19 nt, Homo sapiens
gcaaauguuuagagaacug

SEQ ID NO: 1001363 - RNA, 19 nt, Homo sapiens
cgacuuaucuccugcaacu

SEQ ID NO: 1001364 - RNA, 19 nt, Homo sapiens
cuauuuggcuacuggguua

SEQ ID NO: 1001365 - RNA, 19 nt, Homo sapiens
ugaaguauguuguuagaag

SEQ ID NO: 1001366 - RNA, 19 nt, Homo sapiens
ugaauucagucaaccuaaa

SEQ ID NO: 1001367 - RNA, 19 nt, Homo sapiens
guaaguauggugucuuuga

SEQ ID NO: 1001368 - RNA, 19 nt, Homo sapiens
cuacuggguuauaggguua

SEQ ID NO: 1001369 - RNA, 19 nt, Homo sapiens
ccaccaacaucaacuaaag

SEQ ID NO: 1001370 - RNA, 19 nt, Homo sapiens
uaaguauggugucuuugaa

SEQ ID NO: 1001371 - RNA, 19 nt, Homo sapiens
gguauacuguagaacauau

SEQ ID NO: 1001372 - RNA, 19 nt, Homo sapiens
gguaucaguuacucauuug

SEQ ID NO: 1001373 - RNA, 19 nt, Homo sapiens
uuuagugucuggaacauaa

SEQ ID NO: 1001374 - RNA, 19 nt, Homo sapiens
ugaguggaaucaugaaaug

SEQ ID NO: 1001375 - RNA, 19 nt, Homo sapiens
gaaaagaagacgcuggaua

SEQ ID NO: 1001376 - RNA, 19 nt, Homo sapiens
guuagaagaugugcaaauc

SEQ ID NO: 1001377 - RNA, 19 nt, Homo sapiens
ccagguacaucaaggaauc

SEQ ID NO: 1001378 - RNA, 19 nt, Homo sapiens
ugauaucugugccaauuug

SEQ ID NO: 1001379 - RNA, 19 nt, Homo sapiens
acagaacccuugagucuag

SEQ ID NO: 1001380 - RNA, 19 nt, Homo sapiens
aagcaggcauugucucauu

SEQ ID NO: 1001381 - RNA, 19 nt, Homo sapiens
agaagcauccuaaauaaug

SEQ ID NO: 1001382 - RNA, 19 nt, Homo sapiens
caaaggauacaaacagaau

SEQ ID NO: 1001383 - RNA, 19 nt, Homo sapiens
ggaaguaucagguacaaac

SEQ ID NO: 1001384 - RNA, 19 nt, Homo sapiens
ugaguaggaugcugcaaau

SEQ ID NO: 1001385 - RNA, 19 nt, Homo sapiens
gaagacgcuggauaaguuu

SEQ ID NO: 1001386 - RNA, 19 nt, Homo sapiens
ggaggaaguauucaaggaa

SEQ ID NO: 1001387 - RNA, 19 nt, Homo sapiens
uuaagacuguaccuaacua

SEQ ID NO: 1001388 - RNA, 19 nt, Homo sapiens
gguacaaacugagagacaa

SEQ ID NO: 1001389 - RNA, 19 nt, Homo sapiens
ugacagaacccuugagucu

SEQ ID NO: 1001390 - RNA, 19 nt, Homo sapiens
gaagaaggaagaggaggaa

SEQ ID NO: 1001391 - RNA, 19 nt, Homo sapiens
gaggauaggaaagucauuu

SEQ ID NO: 1001392 - RNA, 19 nt, Homo sapiens
agagacaagugauaucugu

SEQ ID NO: 1001393 - RNA, 19 nt, Homo sapiens
gagagacaaaggauacaaa

SEQ ID NO: 1001394 - RNA, 19 nt, Homo sapiens
gaacaucuacaggcuaauc

SEQ ID NO: 1001395 - RNA, 19 nt, Homo sapiens
guacaaacugagagacaaa

SEQ ID NO: 1001396 - RNA, 19 nt, Homo sapiens
caugaugaauacuuucuca

SEQ ID NO: 1001397 - RNA, 19 nt, Homo sapiens
agugauaucugugccaauu

SEQ ID NO: 1001398 - RNA, 19 nt, Homo sapiens
gaaacugaagacuguauuc

SEQ ID NO: 1001399 - RNA, 19 nt, Homo sapiens
agaagcaguuggugagaga

SEQ ID NO: 1001400 - RNA, 19 nt, Homo sapiens
gaauucagucaaccuaaau

SEQ ID NO: 1001401 - RNA, 19 nt, Homo sapiens
aggagagccucaggaguua

SEQ ID NO: 1001402 - RNA, 19 nt, Homo sapiens
uugaacaucuacaggcuaa

SEQ ID NO: 1001403 - RNA, 19 nt, Homo sapiens
ugguaucaguuacucauuu

SEQ ID NO: 1001404 - RNA, 19 nt, Homo sapiens
ugaauacuuucucaguuuc

SEQ ID NO: 1001405 - RNA, 19 nt, Homo sapiens
gaggguaugucaguguguu

SEQ ID NO: 1001406 - RNA, 19 nt, Homo sapiens
gcaaaucgucaaaaucuuu

SEQ ID NO: 1001407 - RNA, 19 nt, Homo sapiens
ugacaucagagaagagaaa

SEQ ID NO: 1001408 - RNA, 19 nt, Homo sapiens
auccuugccuucccauuua

SEQ ID NO: 1001409 - RNA, 19 nt, Homo sapiens
aaaagaagacgcuggauaa

SEQ ID NO: 1001410 - RNA, 19 nt, Homo sapiens
acacagcaguauggguaua

SEQ ID NO: 1001411 - RNA, 19 nt, Homo sapiens
uaaagacacagcaguaugg

SEQ ID NO: 1001412 - RNA, 19 nt, Homo sapiens
ccuaaucccuccuaaagac

SEQ ID NO: 1001413 - RNA, 19 nt, Homo sapiens
uagaagaugugcaaaucgu

SEQ ID NO: 1001414 - RNA, 19 nt, Homo sapiens
gaauuugaucagcuuagaa

SEQ ID NO: 1001415 - RNA, 19 nt, Homo sapiens
cggaggaaguauucaagga

SEQ ID NO: 1001416 - RNA, 19 nt, Homo sapiens
guaaugcaucgauuuagug

SEQ ID NO: 1001417 - RNA, 19 nt, Homo sapiens
cauccuugccuucccauuu

SEQ ID NO: 1001418 - RNA, 19 nt, Homo sapiens
gcucuugaauuuucucauu

SEQ ID NO: 1001419 - RNA, 19 nt, Homo sapiens
aaaagcagcuguccugugu

SEQ ID NO: 1001420 - RNA, 19 nt, Homo sapiens
uguaaugcaucgauuuagu

SEQ ID NO: 1001421 - RNA, 19 nt, Homo sapiens
gguuauaggguuacagaau

SEQ ID NO: 1001422 - RNA, 19 nt, Homo sapiens
ggguggaugucacacugaa

SEQ ID NO: 1001423 - RNA, 19 nt, Homo sapiens
gacagaacccuugagucua

SEQ ID NO: 1001424 - RNA, 19 nt, Homo sapiens
guaaggaggauaggaaagu

SEQ ID NO: 1001425 - RNA, 19 nt, Homo sapiens
gauuuuauguccagaguau

SEQ ID NO: 1001426 - RNA, 19 nt, Homo sapiens
uggcuugaguuaugagaga

SEQ ID NO: 1001427 - RNA, 19 nt, Homo sapiens
aagcagcuguccugugugu

SEQ ID NO: 1001428 - RNA, 19 nt, Homo sapiens
cggagucaguggucaacaa

SEQ ID NO: 1001429 - RNA, 19 nt, Homo sapiens
agaauuugaucagcuuaga

SEQ ID NO: 1001430 - RNA, 19 nt, Homo sapiens
gucaaaaucuuuacaccaa

SEQ ID NO: 1001431 - RNA, 19 nt, Homo sapiens
guggaugucacacugaauu

SEQ ID NO: 1001432 - RNA, 19 nt, Homo sapiens
cugcaaauguuuagagaac

SEQ ID NO: 1001433 - RNA, 19 nt, Homo sapiens
uugcagaggcugaggauga

SEQ ID NO: 1001434 - RNA, 19 nt, Homo sapiens
gcucaaaccuugccuguug

SEQ ID NO: 1001435 - RNA, 19 nt, Homo sapiens
gagagaugcuuauuuauuc

SEQ ID NO: 1001436 - RNA, 19 nt, Homo sapiens
agagagagcugcaaagauu

SEQ ID NO: 1001437 - RNA, 19 nt, Homo sapiens
ugagauguaugguguauuu

SEQ ID NO: 1001438 - RNA, 19 nt, Homo sapiens
guuauaggguuacagaaua

SEQ ID NO: 1001439 - RNA, 19 nt, Homo sapiens
ccaagaaacugaagacugu

SEQ ID NO: 1001440 - RNA, 19 nt, Homo sapiens
cuaagugucucuaaaugua

SEQ ID NO: 1001441 - RNA, 19 nt, Homo sapiens
gaagcauccuaaauaauga

SEQ ID NO: 1001442 - RNA, 19 nt, Homo sapiens
agaagacgcuggauaaguu

SEQ ID NO: 1001443 - RNA, 19 nt, Homo sapiens
ucaagaggcugaagaagga

SEQ ID NO: 1001444 - RNA, 19 nt, Homo sapiens
gcagugcaauggcuucaaa

SEQ ID NO: 1001445 - RNA, 19 nt, Homo sapiens
gaugaauacuuucucaguu

SEQ ID NO: 1001446 - RNA, 19 nt, Homo sapiens
gaaguauguuguuagaaga

SEQ ID NO: 1001447 - RNA, 19 nt, Homo sapiens
gauaggaaguauucaagga

SEQ ID NO: 1001448 - RNA, 19 nt, Homo sapiens
guauuuggcuugaguuaug

SEQ ID NO: 1001449 - RNA, 19 nt, Homo sapiens
gacuguaccuaacuauuaa

SEQ ID NO: 1001450 - RNA, 19 nt, Homo sapiens
gcaacugacucaucugcaa

SEQ ID NO: 1001451 - RNA, 19 nt, Homo sapiens
gcaaagauuggaagaagaa

SEQ ID NO: 1001452 - RNA, 19 nt, Homo sapiens
gacaaaggauacaaacaga

SEQ ID NO: 1001453 - RNA, 19 nt, Homo sapiens
guaccuaacuauuaagauc

SEQ ID NO: 1001454 - RNA, 19 nt, Homo sapiens
ugacucaucugcaacauuc

SEQ ID NO: 1001455 - RNA, 19 nt, Homo sapiens
agacuguaccuaacuauua

SEQ ID NO: 1001456 - RNA, 19 nt, Homo sapiens
gaagaucagagacaaguga

SEQ ID NO: 1001457 - RNA, 19 nt, Homo sapiens
guaggaugcugcaaauguu

SEQ ID NO: 1001458 - RNA, 19 nt, Homo sapiens
caaggaaugucaggagaaa

SEQ ID NO: 1001459 - RNA, 19 nt, Homo sapiens
cagagaaaguuaccuaauc

SEQ ID NO: 1001460 - RNA, 19 nt, Homo sapiens
ggaguuaggaccagaagaa

SEQ ID NO: 1001461 - RNA, 19 nt, Homo sapiens
gauuuaagacuguaccuaa

SEQ ID NO: 1001462 - RNA, 19 nt, Homo sapiens
cuauuaagaucacugugua

SEQ ID NO: 1001463 - RNA, 19 nt, Homo sapiens
gcaaauguuuagagaacug

SEQ ID NO: 1001464 - RNA, 19 nt, Homo sapiens
cgacuuaucuccugcaacu

SEQ ID NO: 1001465 - RNA, 19 nt, Homo sapiens
cuauuuggcuacuggguua

SEQ ID NO: 1001466 - RNA, 19 nt, Homo sapiens
ugaaguauguuguuagaag

SEQ ID NO: 1001467 - RNA, 19 nt, Homo sapiens
ugaauucagucaaccuaaa

SEQ ID NO: 1001468 - RNA, 19 nt, Homo sapiens
guaaggaggauaggaagua

SEQ ID NO: 1001469 - RNA, 19 nt, Homo sapiens
guaaguauggugucuuuga

SEQ ID NO: 1001470 - RNA, 19 nt, Homo sapiens
cuacuggguuauaggguua

SEQ ID NO: 1001471 - RNA, 19 nt, Homo sapiens
ccaccaacaucaacuaaag

SEQ ID NO: 1001472 - RNA, 19 nt, Homo sapiens
uaaguauggugucuuugaa

SEQ ID NO: 1001473 - RNA, 19 nt, Homo sapiens
gguauacuguagaacauau

SEQ ID NO: 1001474 - RNA, 19 nt, Homo sapiens
gguaucaguuacucauuug

SEQ ID NO: 1001475 - RNA, 19 nt, Homo sapiens
uuuagugucuggaacauaa

SEQ ID NO: 1001476 - RNA, 19 nt, Homo sapiens
ugaguggaaucaugaaaug

SEQ ID NO: 1001477 - RNA, 19 nt, Homo sapiens
gaaaagaagacgcuggaua

SEQ ID NO: 1001478 - RNA, 19 nt, Homo sapiens
guuagaagaugugcaaauc

SEQ ID NO: 1001479 - RNA, 19 nt, Homo sapiens
ccagguacaucaaggaauc

SEQ ID NO: 1001480 - RNA, 19 nt, Homo sapiens
ugauaucugugccaauuug

SEQ ID NO: 1001481 - RNA, 19 nt, Homo sapiens
acagaacccuugagucuag

SEQ ID NO: 1001482 - RNA, 19 nt, Homo sapiens
aagcaggcauugucucauu

SEQ ID NO: 1001483 - RNA, 19 nt, Homo sapiens
agaagcauccuaaauaaug

SEQ ID NO: 1001484 - RNA, 19 nt, Homo sapiens
caaaggauacaaacagaau

SEQ ID NO: 1001485 - RNA, 19 nt, Homo sapiens
ggaaguaucagguacaaac

SEQ ID NO: 1001486 - RNA, 19 nt, Homo sapiens
ugaguaggaugcugcaaau

SEQ ID NO: 1001487 - RNA, 19 nt, Homo sapiens
gaagacgcuggauaaguuu

SEQ ID NO: 1001488 - RNA, 19 nt, Homo sapiens
uuaagacuguaccuaacua

SEQ ID NO: 1001489 - RNA, 19 nt, Homo sapiens
ugacagaacccuugagucu

SEQ ID NO: 1001490 - RNA, 19 nt, Homo sapiens
gguacaaacugagagacaa

SEQ ID NO: 1001491 - RNA, 19 nt, Homo sapiens
gaagaaggaagaggaggaa

SEQ ID NO: 1001492 - RNA, 19 nt, Homo sapiens
agagacaagugauaucugu

SEQ ID NO: 1001493 - RNA, 19 nt, Homo sapiens
gagagacaaaggauacaaa

SEQ ID NO: 1001494 - RNA, 19 nt, Homo sapiens
gaacaucuacaggcuaauc

SEQ ID NO: 1001495 - RNA, 19 nt, Homo sapiens
guacaaacugagagacaaa

SEQ ID NO: 1001496 - RNA, 19 nt, Homo sapiens
caugaugaauacuuucuca

SEQ ID NO: 1001497 - RNA, 19 nt, Homo sapiens
agugauaucugugccaauu

SEQ ID NO: 1001498 - RNA, 19 nt, Homo sapiens
gaaacugaagacuguauuc

SEQ ID NO: 1001499 - RNA, 19 nt, Homo sapiens
agaagcaguuggugagaga

SEQ ID NO: 1001500 - RNA, 19 nt, Homo sapiens
gaauucagucaaccuaaau

SEQ ID NO: 1001501 - RNA, 19 nt, Homo sapiens
aggagagccucaggaguua

SEQ ID NO: 1001502 - RNA, 19 nt, Homo sapiens
uaaggaggauaggaaguau

SEQ ID NO: 1001503 - RNA, 19 nt, Homo sapiens
uugaacaucuacaggcuaa

SEQ ID NO: 1001504 - RNA, 19 nt, Homo sapiens
ugguaucaguuacucauuu

SEQ ID NO: 1001505 - RNA, 19 nt, Homo sapiens
ugaauacuuucucaguuuc

SEQ ID NO: 1001506 - RNA, 19 nt, Homo sapiens
gaggguaugucaguguguu

SEQ ID NO: 1001507 - RNA, 19 nt, Homo sapiens
gcaaaucgucaaaaucuuu

SEQ ID NO: 1001508 - RNA, 19 nt, Homo sapiens
ugacaucagagaagagaaa

SEQ ID NO: 1001509 - RNA, 19 nt, Homo sapiens
auccuugccuucccauuua

SEQ ID NO: 1001510 - RNA, 19 nt, Homo sapiens
aaaagaagacgcuggauaa

SEQ ID NO: 1001511 - RNA, 19 nt, Homo sapiens
gaggauaggaaguauucaa

SEQ ID NO: 1001512 - RNA, 19 nt, Homo sapiens
acacagcaguauggguaua

SEQ ID NO: 1001513 - RNA, 19 nt, Homo sapiens
uaaagacacagcaguaugg

SEQ ID NO: 1001514 - RNA, 19 nt, Homo sapiens
ccuaaucccuccuaaagac

SEQ ID NO: 1001515 - RNA, 19 nt, Homo sapiens
uagaagaugugcaaaucgu

SEQ ID NO: 1001516 - RNA, 19 nt, Homo sapiens
gaauuugaucagcuuagaa

SEQ ID NO: 1001517 - RNA, 19 nt, Homo sapiens
guaaugcaucgauuuagug

SEQ ID NO: 1001518 - RNA, 19 nt, Homo sapiens
cauccuugccuucccauuu

SEQ ID NO: 1001519 - RNA, 19 nt, Homo sapiens
gcucuugaauuuucucauu

SEQ ID NO: 1001520 - RNA, 19 nt, Homo sapiens
aaaagcagcuguccugugu

SEQ ID NO: 1001521 - RNA, 19 nt, Homo sapiens
uguaaugcaucgauuuagu

SEQ ID NO: 1001522 - RNA, 19 nt, Homo sapiens
gguuauaggguuacagaau

SEQ ID NO: 1001523 - RNA, 19 nt, Homo sapiens
ggguggaugucacacugaa

SEQ ID NO: 1001524 - RNA, 19 nt, Homo sapiens
gacagaacccuugagucua

SEQ ID NO: 1001525 - RNA, 19 nt, Homo sapiens
gauuuuauguccagaguau

SEQ ID NO: 1001526 - RNA, 19 nt, Homo sapiens
uggcuugaguuaugagaga

SEQ ID NO: 1001527 - RNA, 19 nt, Homo sapiens
aagcagcuguccugugugu

SEQ ID NO: 1001528 - RNA, 19 nt, Homo sapiens
cggagucaguggucaacaa

SEQ ID NO: 1001529 - RNA, 19 nt, Homo sapiens
agaauuugaucagcuuaga

SEQ ID NO: 1001530 - RNA, 19 nt, Homo sapiens
gucaaaaucuuuacaccaa

SEQ ID NO: 1001531 - RNA, 19 nt, Homo sapiens
guggaugucacacugaauu

SEQ ID NO: 1001532 - RNA, 19 nt, Homo sapiens
cugcaaauguuuagagaac

SEQ ID NO: 1001533 - RNA, 19 nt, Homo sapiens
uugcagaggcugaggauga

SEQ ID NO: 1001534 - RNA, 19 nt, Homo sapiens
agagagagcugcaaagauu

SEQ ID NO: 1001535 - RNA, 19 nt, Homo sapiens
gaguggugcuugugaguua

SEQ ID NO: 1001536 - RNA, 19 nt, Homo sapiens
gaagcauccuaaauaauga

SEQ ID NO: 1001537 - RNA, 19 nt, Homo sapiens
agaagacgcuggauaaguu

SEQ ID NO: 1001538 - RNA, 19 nt, Homo sapiens
ucaagaggcugaagaagga

SEQ ID NO: 1001539 - RNA, 19 nt, Homo sapiens
gcagugcaauggcuucaaa

SEQ ID NO: 1001540 - RNA, 19 nt, Homo sapiens
gcaaagauuggaagaagaa

SEQ ID NO: 1001541 - RNA, 19 nt, Homo sapiens
gacaaaggauacaaacaga

SEQ ID NO: 1001542 - RNA, 19 nt, Homo sapiens
caaggaaugucaggagaaa

SEQ ID NO: 1001543 - RNA, 19 nt, Homo sapiens
ggaguuaggaccagaagaa

SEQ ID NO: 1001544 - RNA, 19 nt, Homo sapiens
ggaagaaguauucaaggaa

SEQ ID NO: 1001545 - RNA, 19 nt, Homo sapiens
guuauuugguggucaauug

SEQ ID NO: 1001546 - RNA, 19 nt, Homo sapiens
gguaucaguuacucauuug

SEQ ID NO: 1001547 - RNA, 19 nt, Homo sapiens
guuuguagcuauuagaguu

SEQ ID NO: 1001548 - RNA, 19 nt, Homo sapiens
ugaguggaaucaugaaaug

SEQ ID NO: 1001549 - RNA, 19 nt, Homo sapiens
gaaaagaagacgcuggaua

SEQ ID NO: 1001550 - RNA, 19 nt, Homo sapiens
gcuugugaguuauaaagaa

SEQ ID NO: 1001551 - RNA, 19 nt, Homo sapiens
acagaacccuugagucuag

SEQ ID NO: 1001552 - RNA, 19 nt, Homo sapiens
aaagaaguguuuguagcua

SEQ ID NO: 1001553 - RNA, 19 nt, Homo sapiens
agaagcauccuaaauaaug

SEQ ID NO: 1001554 - RNA, 19 nt, Homo sapiens
caaaggauacaaacagaau

SEQ ID NO: 1001555 - RNA, 19 nt, Homo sapiens
ggaaguaucagguacaaac

SEQ ID NO: 1001556 - RNA, 19 nt, Homo sapiens
cggaagaaguauucaagga

SEQ ID NO: 1001557 - RNA, 19 nt, Homo sapiens
gaagacgcuggauaaguuu

SEQ ID NO: 1001558 - RNA, 19 nt, Homo sapiens
gaaguguuuguagcuauua

SEQ ID NO: 1001559 - RNA, 19 nt, Homo sapiens
acacaguccucacggaaga

SEQ ID NO: 1001560 - RNA, 19 nt, Homo sapiens
gguacaaacugagagacaa

SEQ ID NO: 1001561 - RNA, 19 nt, Homo sapiens
ugacagaacccuugagucu

SEQ ID NO: 1001562 - RNA, 19 nt, Homo sapiens
gaagaaggaagaggaggaa

SEQ ID NO: 1001563 - RNA, 19 nt, Homo sapiens
gaggauaggaaagucauuu

SEQ ID NO: 1001564 - RNA, 19 nt, Homo sapiens
gagagacaaaggauacaaa

SEQ ID NO: 1001565 - RNA, 19 nt, Homo sapiens
gaacaucuacaggcuaauc

SEQ ID NO: 1001566 - RNA, 19 nt, Homo sapiens
guacaaacugagagacaaa

SEQ ID NO: 1001567 - RNA, 19 nt, Homo sapiens
agaagcaguuggugagaga

SEQ ID NO: 1001568 - RNA, 19 nt, Homo sapiens
gguggucaauuggaauaaa

SEQ ID NO: 1001569 - RNA, 19 nt, Homo sapiens
aggagagccucaggaguua

SEQ ID NO: 1001570 - RNA, 19 nt, Homo sapiens
uugaacaucuacaggcuaa

SEQ ID NO: 1001571 - RNA, 19 nt, Homo sapiens
ugguaucaguuacucauuu

SEQ ID NO: 1001572 - RNA, 19 nt, Homo sapiens
agaaguguuuguagcuauu

SEQ ID NO: 1001573 - RNA, 19 nt, Homo sapiens
ugacaucagagaagagaaa

SEQ ID NO: 1001574 - RNA, 19 nt, Homo sapiens
aaaagaagacgcuggauaa

SEQ ID NO: 1001575 - RNA, 19 nt, Homo sapiens
gaauuugaucagcuuagaa

SEQ ID NO: 1001576 - RNA, 19 nt, Homo sapiens
aaaagcagcuguccugugu

SEQ ID NO: 1001577 - RNA, 19 nt, Homo sapiens
gcuauuagaguuauuuggu

SEQ ID NO: 1001578 - RNA, 19 nt, Homo sapiens
gacagaacccuugagucua

SEQ ID NO: 1001579 - RNA, 19 nt, Homo sapiens
guaaggaggauaggaaagu

SEQ ID NO: 1001580 - RNA, 19 nt, Homo sapiens
aagaaguguuuguagcuau

SEQ ID NO: 1001581 - RNA, 19 nt, Homo sapiens
cggagucaguggucaacaa

SEQ ID NO: 1001582 - RNA, 19 nt, Homo sapiens
aagcagcuguccugugugu

SEQ ID NO: 1001583 - RNA, 19 nt, Homo sapiens
agaauuugaucagcuuaga

SEQ ID NO: 1001584 - RNA, 19 nt, Homo sapiens
uugcagaggcugaggauga

SEQ ID NO: 1001585 - RNA, 19 nt, Homo sapiens
cugcaaagauuggaagaag

SEQ ID NO: 1001586 - RNA, 19 nt, Homo sapiens
gucauuugcuggcuuugug

SEQ ID NO: 1001587 - RNA, 19 nt, Homo sapiens
caaguugagcccagacaau

SEQ ID NO: 1001588 - RNA, 19 nt, Homo sapiens
ggagucaguggucaacaau

SEQ ID NO: 1001589 - RNA, 19 nt, Homo sapiens
gagagagcugcaaagauug

SEQ ID NO: 1001590 - RNA, 19 nt, Homo sapiens
aaacuccuacucuucugua

SEQ ID NO: 1001591 - RNA, 19 nt, Homo sapiens
gaaacuccuacucuucugu

SEQ ID NO: 1001592 - RNA, 19 nt, Homo sapiens
agacaaaggauacaaacag

SEQ ID NO: 1001593 - RNA, 19 nt, Homo sapiens
gcaucuggccaacauagug

SEQ ID NO: 1001594 - RNA, 19 nt, Homo sapiens
uaaagaaguguuuguagcu

SEQ ID NO: 1001595 - RNA, 19 nt, Homo sapiens
aagauuggaagaagaagaa

SEQ ID NO: 1001596 - RNA, 19 nt, Homo sapiens
caaacugagagacaaagga

SEQ ID NO: 1001597 - RNA, 19 nt, Homo sapiens
uaaggaggauaggaaaguc

SEQ ID NO: 1001598 - RNA, 19 nt, Homo sapiens
agaguuauuugguggucaa

SEQ ID NO: 1001599 - RNA, 19 nt, Homo sapiens
aaacugagagacaaaggau

SEQ ID NO: 1001600 - RNA, 19 nt, Homo sapiens
gcagaagcaguuggugaga

SEQ ID NO: 1001601 - RNA, 19 nt, Homo sapiens
ggaagaagaagaaaagaag

SEQ ID NO: 1001602 - RNA, 19 nt, Homo sapiens
gagacaaaggauacaaaca

SEQ ID NO: 1001603 - RNA, 19 nt, Homo sapiens
acaaugggaagaagagaga

SEQ ID NO: 1001604 - RNA, 19 nt, Homo sapiens
agucaguggucaacaaugg

SEQ ID NO: 1001605 - RNA, 19 nt, Homo sapiens
ugcaaagauuggaagaaga

SEQ ID NO: 1001606 - RNA, 19 nt, Homo sapiens
auaaugaggagcagagaga

SEQ ID NO: 1001607 - RNA, 19 nt, Homo sapiens
gaaggaagaggaggaagcu

SEQ ID NO: 1001608 - RNA, 19 nt, Homo sapiens
ucaaggaaugucaggagaa

SEQ ID NO: 1001609 - RNA, 19 nt, Homo sapiens
caugaaauggugcguaugg

SEQ ID NO: 1001610 - RNA, 19 nt, Homo sapiens
ccaucugccuggagcuguu

SEQ ID NO: 1001611 - RNA, 19 nt, Homo sapiens
aacagaauuugaucagcuu

SEQ ID NO: 1001612 - RNA, 19 nt, Homo sapiens
gaagaggaggaagcugaga

SEQ ID NO: 1001613 - RNA, 19 nt, Homo sapiens
gaaguaucagguacaaacu

SEQ ID NO: 1001614 - RNA, 19 nt, Homo sapiens
aaaucuugcuuaacguaca

SEQ ID NO: 1001615 - RNA, 19 nt, Homo sapiens
acaaaggauacaaacagaa

SEQ ID NO: 1001616 - RNA, 19 nt, Homo sapiens
gauaggaaagucauuugcu

SEQ ID NO: 1001617 - RNA, 19 nt, Homo sapiens
ugaccagcaugggaggaaa

SEQ ID NO: 1001618 - RNA, 19 nt, Homo sapiens
aaucuugcuuaacguacaa

SEQ ID NO: 1001619 - RNA, 19 nt, Homo sapiens
ggcugaggaugagcuaguu

SEQ ID NO: 1001620 - RNA, 19 nt, Homo sapiens
cagagagagcugcaaagau

SEQ ID NO: 1001621 - RNA, 19 nt, Homo sapiens
ccucacggaagaaguauuc

SEQ ID NO: 1001622 - RNA, 19 nt, Homo sapiens
ggaggauaggaaagucauu

SEQ ID NO: 1001623 - RNA, 19 nt, Homo sapiens
ccagggaagcagugcaaug

SEQ ID NO: 1001624 - RNA, 19 nt, Homo sapiens
gaagaagaagaaaagaaga

SEQ ID NO: 1001625 - RNA, 19 nt, Homo sapiens
acucaaggaggucaaguug

SEQ ID NO: 1001626 - RNA, 19 nt, Homo sapiens
cagcaucuggccaacauag

SEQ ID NO: 1001627 - RNA, 19 nt, Homo sapiens
ccagacaaugggaagaaga

SEQ ID NO: 1001628 - RNA, 19 nt, Homo sapiens
gacucaaggaggucaaguu

SEQ ID NO: 1001629 - RNA, 19 nt, Homo sapiens
aaagauuggaagaagaaga

SEQ ID NO: 1001630 - RNA, 19 nt, Homo sapiens
ucacggaagaaguauucaa

SEQ ID NO: 1001631 - RNA, 19 nt, Homo sapiens
guuacucauuugaacaucu

SEQ ID NO: 1001632 - RNA, 19 nt, Homo sapiens
ggaaauacaccauuaauuc

SEQ ID NO: 1001633 - RNA, 19 nt, Homo sapiens
gaacaaggacaucuuugaa

SEQ ID NO: 1001634 - RNA, 19 nt, Homo sapiens
gaaggucgcugagguagga

SEQ ID NO: 1001635 - RNA, 19 nt, Homo sapiens
gccaucacauaucgaauua

SEQ ID NO: 1001636 - RNA, 19 nt, Homo sapiens
caacgugacuccugauuac

SEQ ID NO: 1001637 - RNA, 19 nt, Homo sapiens
uaaacacccugcccaguga

SEQ ID NO: 1001638 - RNA, 19 nt, Homo sapiens
gcacccggcucaacucaga

SEQ ID NO: 1001639 - RNA, 19 nt, Homo sapiens
ggacaucuuugaaguagag

SEQ ID NO: 1001640 - RNA, 19 nt, Homo sapiens
gaggagaacacaaauguca

SEQ ID NO: 1001641 - RNA, 19 nt, Homo sapiens
cguaaaggaucauaaacug

SEQ ID NO: 1001642 - RNA, 19 nt, Homo sapiens
gcccaguacugcucuguga

SEQ ID NO: 1001643 - RNA, 19 nt, Homo sapiens
caaggacaucuuugaagua

SEQ ID NO: 1001644 - RNA, 19 nt, Homo sapiens
gggagccgguggucucaaa

SEQ ID NO: 1001645 - RNA, 19 nt, Homo sapiens
gaggaggacacgaaaguga

SEQ ID NO: 1001646 - RNA, 19 nt, Homo sapiens
acaaggacaucuuugaagu

SEQ ID NO: 1001647 - RNA, 19 nt, Homo sapiens
caacucggccaucacauau

SEQ ID NO: 1001648 - RNA, 19 nt, Homo sapiens
ggucguaaaggaucauaaa

SEQ ID NO: 1001649 - RNA, 19 nt, Homo sapiens
ggcagaagccggucguaaa

SEQ ID NO: 1001650 - RNA, 19 nt, Homo sapiens
guacugcucugugaacaag

SEQ ID NO: 1001651 - RNA, 19 nt, Homo sapiens
ucaacucggccaucacaua

SEQ ID NO: 1001652 - RNA, 19 nt, Homo sapiens
gcagaagccggucguaaag

SEQ ID NO: 1001653 - RNA, 19 nt, Homo sapiens
ggugacagccgccaagaug

SEQ ID NO: 1001654 - RNA, 19 nt, Homo sapiens
gaaauacaccauuaauucc

SEQ ID NO: 1001655 - RNA, 19 nt, Homo sapiens
ucacauaucgaauuaccaa

SEQ ID NO: 1001656 - RNA, 19 nt, Homo sapiens
caucaucuacagcaucuuu

SEQ ID NO: 1001657 - RNA, 19 nt, Homo sapiens
ucaacgugacuccugauua

SEQ ID NO: 1001658 - RNA, 19 nt, Homo sapiens
ggccaucacauaucgaauu

SEQ ID NO: 1001659 - RNA, 19 nt, Homo sapiens
ucaaccagcccaucaucua

SEQ ID NO: 1001660 - RNA, 19 nt, Homo sapiens
ugaacaaggacaucuuuga

SEQ ID NO: 1001661 - RNA, 19 nt, Homo sapiens
ugucagcacuuucccuaau

SEQ ID NO: 1001662 - RNA, 19 nt, Homo sapiens
gaccucaacucggccauca

SEQ ID NO: 1001663 - RNA, 19 nt, Homo sapiens
agaagccggucguaaagga

SEQ ID NO: 1001664 - RNA, 19 nt, Homo sapiens
uagaggagaacacaaaugu

SEQ ID NO: 1001665 - RNA, 19 nt, Homo sapiens
ggacgacauucuguucuac

SEQ ID NO: 1001666 - RNA, 19 nt, Homo sapiens
cgacaaggacgacauucug

SEQ ID NO: 1001667 - RNA, 19 nt, Homo sapiens
caaggacgacauucuguuc

SEQ ID NO: 1001668 - RNA, 19 nt, Homo sapiens
ggccgaacaugaccuucug

SEQ ID NO: 1001669 - RNA, 19 nt, Homo sapiens
aaggacaucuuugaaguag

SEQ ID NO: 1001670 - RNA, 19 nt, Homo sapiens
gguuggagcgcagcaguaa

SEQ ID NO: 1001671 - RNA, 19 nt, Homo sapiens
ugacagcaggugccaguga

SEQ ID NO: 1001672 - RNA, 19 nt, Homo sapiens
guucuacacccuccaggaa

SEQ ID NO: 1001673 - RNA, 19 nt, Homo sapiens
aggacgacauucuguucua

SEQ ID NO: 1001674 - RNA, 19 nt, Homo sapiens
ugucagugcuggacgucaa

SEQ ID NO: 1001675 - RNA, 19 nt, Homo sapiens
ucagagcggaggcacauug

SEQ ID NO: 1001676 - RNA, 19 nt, Homo sapiens
guagaggagaacacaaaug

SEQ ID NO: 1001677 - RNA, 19 nt, Homo sapiens
gaaguagaggagaacacaa

SEQ ID NO: 1001678 - RNA, 19 nt, Homo sapiens
ccauuaauuccuuuccaaa

SEQ ID NO: 1001679 - RNA, 19 nt, Homo sapiens
gacaaggacgacauucugu

SEQ ID NO: 1001680 - RNA, 19 nt, Homo sapiens
gcuaaggguguucguguca

SEQ ID NO: 1001681 - RNA, 19 nt, Homo sapiens
gucagcacuuucccuaaug

SEQ ID NO: 1001682 - RNA, 19 nt, Homo sapiens
gcugaggagccgaugcaaa

SEQ ID NO: 1001683 - RNA, 19 nt, Homo sapiens
gaauuaccaaccacucaca

SEQ ID NO: 1001684 - RNA, 19 nt, Homo sapiens
ucuacacccuccaggaaau

SEQ ID NO: 1001685 - RNA, 19 nt, Homo sapiens
cauaucgaauuaccaacca

SEQ ID NO: 1001686 - RNA, 19 nt, Homo sapiens
caucacauaucgaauuacc

SEQ ID NO: 1001687 - RNA, 19 nt, Homo sapiens
uaaggguguucgugucagu

SEQ ID NO: 1001688 - RNA, 19 nt, Homo sapiens
aaguagaggagaacacaaa

SEQ ID NO: 1001689 - RNA, 19 nt, Homo sapiens
cgaccuugcccgcuacuca

SEQ ID NO: 1001690 - RNA, 19 nt, Homo sapiens
ggaguucucggaccucaac

SEQ ID NO: 1001691 - RNA, 19 nt, Homo sapiens
ugugaacaaggacaucuuu

SEQ ID NO: 1001692 - RNA, 19 nt, Homo sapiens
caaccagcccaucaucuac

SEQ ID NO: 1001693 - RNA, 19 nt, Homo sapiens
ggaggaggacacgaaagug

SEQ ID NO: 1001694 - RNA, 19 nt, Homo sapiens
ccacacuagugcugaacgu

SEQ ID NO: 1001695 - RNA, 19 nt, Homo sapiens
gguggaggaggacacgaaa

SEQ ID NO: 1001696 - RNA, 19 nt, Homo sapiens
ugaaguagaggagaacaca

SEQ ID NO: 1001697 - RNA, 19 nt, Homo sapiens
ggcuacgucugcauucaag

SEQ ID NO: 1001698 - RNA, 19 nt, Homo sapiens
acaaggacgacauucuguu

SEQ ID NO: 1001699 - RNA, 19 nt, Homo sapiens
ucuuugaaguagaggagaa

SEQ ID NO: 1001700 - RNA, 19 nt, Homo sapiens
uuuaagaccaaggagauaa

SEQ ID NO: 1001701 - RNA, 19 nt, Homo sapiens
ggagaagucacugcuugag

SEQ ID NO: 1001702 - RNA, 19 nt, Homo sapiens
guacaaggcugucugguuu

SEQ ID NO: 1001703 - RNA, 19 nt, Homo sapiens
gaacaaggacaucuuugaa

SEQ ID NO: 1001704 - RNA, 19 nt, Homo sapiens
gaaggucgcugagguagga

SEQ ID NO: 1001705 - RNA, 19 nt, Homo sapiens
gccaucacauaucgaauua

SEQ ID NO: 1001706 - RNA, 19 nt, Homo sapiens
caacgugacuccugauuac

SEQ ID NO: 1001707 - RNA, 19 nt, Homo sapiens
ggacaucuuugaaguagag

SEQ ID NO: 1001708 - RNA, 19 nt, Homo sapiens
gaggagaacacaaauguca

SEQ ID NO: 1001709 - RNA, 19 nt, Homo sapiens
cguaaaggaucauaaacug

SEQ ID NO: 1001710 - RNA, 19 nt, Homo sapiens
gcccaguacugcucuguga

SEQ ID NO: 1001711 - RNA, 19 nt, Homo sapiens
caaggacaucuuugaagua

SEQ ID NO: 1001712 - RNA, 19 nt, Homo sapiens
gaggaggacacgaaaguga

SEQ ID NO: 1001713 - RNA, 19 nt, Homo sapiens
acaaggacaucuuugaagu

SEQ ID NO: 1001714 - RNA, 19 nt, Homo sapiens
caacucggccaucacauau

SEQ ID NO: 1001715 - RNA, 19 nt, Homo sapiens
ggucguaaaggaucauaaa

SEQ ID NO: 1001716 - RNA, 19 nt, Homo sapiens
ggcagaagccggucguaaa

SEQ ID NO: 1001717 - RNA, 19 nt, Homo sapiens
gauacaaguuuccgaacag

SEQ ID NO: 1001718 - RNA, 19 nt, Homo sapiens
caaccacagucauugagau

SEQ ID NO: 1001719 - RNA, 19 nt, Homo sapiens
guacugcucugugaacaag

SEQ ID NO: 1001720 - RNA, 19 nt, Homo sapiens
ccacagucauugagauaca

SEQ ID NO: 1001721 - RNA, 19 nt, Homo sapiens
ucaacucggccaucacaua

SEQ ID NO: 1001722 - RNA, 19 nt, Homo sapiens
gcagaagccggucguaaag

SEQ ID NO: 1001723 - RNA, 19 nt, Homo sapiens
ggugacagccgccaagaug

SEQ ID NO: 1001724 - RNA, 19 nt, Homo sapiens
ucacauaucgaauuaccaa

SEQ ID NO: 1001725 - RNA, 19 nt, Homo sapiens
caucaucuacagcaucuuu

SEQ ID NO: 1001726 - RNA, 19 nt, Homo sapiens
ucaacgugacuccugauua

SEQ ID NO: 1001727 - RNA, 19 nt, Homo sapiens
ggccaucacauaucgaauu

SEQ ID NO: 1001728 - RNA, 19 nt, Homo sapiens
ucaaccagcccaucaucua

SEQ ID NO: 1001729 - RNA, 19 nt, Homo sapiens
ugaacaaggacaucuuuga

SEQ ID NO: 1001730 - RNA, 19 nt, Homo sapiens
aaacagcaccucccaccaa

SEQ ID NO: 1001731 - RNA, 19 nt, Homo sapiens
ucauugagauacaaguuuc

SEQ ID NO: 1001732 - RNA, 19 nt, Homo sapiens
gaccucaacucggccauca

SEQ ID NO: 1001733 - RNA, 19 nt, Homo sapiens
gguacaaggcugucugguu

SEQ ID NO: 1001734 - RNA, 19 nt, Homo sapiens
agaagccggucguaaagga

SEQ ID NO: 1001735 - RNA, 19 nt, Homo sapiens
uagaggagaacacaaaugu

SEQ ID NO: 1001736 - RNA, 19 nt, Homo sapiens
ggacgacauucuguucuac

SEQ ID NO: 1001737 - RNA, 19 nt, Homo sapiens
cgacaaggacgacauucug

SEQ ID NO: 1001738 - RNA, 19 nt, Homo sapiens
caaggacgacauucuguuc

SEQ ID NO: 1001739 - RNA, 19 nt, Homo sapiens
caagugcugcucuggcaaa

SEQ ID NO: 1001740 - RNA, 19 nt, Homo sapiens
gcaaccacagucauugaga

SEQ ID NO: 1001741 - RNA, 19 nt, Homo sapiens
gcuucucggugguggauau

SEQ ID NO: 1001742 - RNA, 19 nt, Homo sapiens
ggccgaacaugaccuucug

SEQ ID NO: 1001743 - RNA, 19 nt, Homo sapiens
aaggacaucuuugaaguag

SEQ ID NO: 1001744 - RNA, 19 nt, Homo sapiens
ugacagcaggugccaguga

SEQ ID NO: 1001745 - RNA, 19 nt, Homo sapiens
guucuacacccuccaggaa

SEQ ID NO: 1001746 - RNA, 19 nt, Homo sapiens
uaaagcaaggcucccgaaa

SEQ ID NO: 1001747 - RNA, 19 nt, Homo sapiens
agauacaaguuuccgaaca

SEQ ID NO: 1001748 - RNA, 19 nt, Homo sapiens
aggacgacauucuguucua

SEQ ID NO: 1001749 - RNA, 19 nt, Homo sapiens
ugucagugcuggacgucaa

SEQ ID NO: 1001750 - RNA, 19 nt, Homo sapiens
ucagagcggaggcacauug

SEQ ID NO: 1001751 - RNA, 19 nt, Homo sapiens
guagaggagaacacaaaug

SEQ ID NO: 1001752 - RNA, 19 nt, Homo sapiens
gaaguagaggagaacacaa

SEQ ID NO: 1001753 - RNA, 19 nt, Homo sapiens
ggaggcagacguggucguu

SEQ ID NO: 1001754 - RNA, 19 nt, Homo sapiens
gacaaggacgacauucugu

SEQ ID NO: 1001755 - RNA, 19 nt, Homo sapiens
gcuaaggguguucguguca

SEQ ID NO: 1001756 - RNA, 19 nt, Homo sapiens
aagcaaggcucccgaaacc

SEQ ID NO: 1001757 - RNA, 19 nt, Homo sapiens
gugcugcucuggcaaagcu

SEQ ID NO: 1001758 - RNA, 19 nt, Homo sapiens
gaauuaccaaccacucaca

SEQ ID NO: 1001759 - RNA, 19 nt, Homo sapiens
ucuacacccuccaggaaau

SEQ ID NO: 1001760 - RNA, 19 nt, Homo sapiens
guuccucccugaccacaag

SEQ ID NO: 1001761 - RNA, 19 nt, Homo sapiens
cauaucgaauuaccaacca

SEQ ID NO: 1001762 - RNA, 19 nt, Homo sapiens
caucacauaucgaauuacc

SEQ ID NO: 1001763 - RNA, 19 nt, Homo sapiens
uaaggguguucgugucagu

SEQ ID NO: 1001764 - RNA, 19 nt, Homo sapiens
aaguagaggagaacacaaa

SEQ ID NO: 1001765 - RNA, 19 nt, Homo sapiens
gucauugagauacaaguuu

SEQ ID NO: 1001766 - RNA, 19 nt, Homo sapiens
aaccacagucauugagaua

SEQ ID NO: 1001767 - RNA, 19 nt, Homo sapiens
cgaccuugcccgcuacuca

SEQ ID NO: 1001768 - RNA, 19 nt, Homo sapiens
gacccgaggcagaauaaag

SEQ ID NO: 1001769 - RNA, 19 nt, Homo sapiens
ggaguucucggaccucaac

SEQ ID NO: 1001770 - RNA, 19 nt, Homo sapiens
ugugaacaaggacaucuuu

SEQ ID NO: 1001771 - RNA, 19 nt, Homo sapiens
caaccagcccaucaucuac

SEQ ID NO: 1001772 - RNA, 19 nt, Homo sapiens
ggaggaggacacgaaagug

SEQ ID NO: 1001773 - RNA, 19 nt, Homo sapiens
ugaaguagaggagaacaca

SEQ ID NO: 1001774 - RNA, 19 nt, Homo sapiens
ccacacuagugcugaacgu

SEQ ID NO: 1001775 - RNA, 19 nt, Homo sapiens
gguggaggaggacacgaaa

SEQ ID NO: 1001776 - RNA, 19 nt, Homo sapiens
ccgcaaccacagucauuga

SEQ ID NO: 1001777 - RNA, 19 nt, Homo sapiens
caccgcaaccacagucauu

SEQ ID NO: 1001778 - RNA, 19 nt, Homo sapiens
ggcuacgucugcauucaag

SEQ ID NO: 1001779 - RNA, 19 nt, Homo sapiens
acaaggacgacauucuguu

SEQ ID NO: 1001780 - RNA, 19 nt, Homo sapiens
uuuaagaccaaggagauaa

SEQ ID NO: 1001781 - RNA, 19 nt, Homo sapiens
ucuuugaaguagaggagaa

SEQ ID NO: 1001782 - RNA, 19 nt, Homo sapiens
ggagaagucacugcuugag

SEQ ID NO: 1001783 - RNA, 19 nt, Homo sapiens
guacaaggcugucugguuu

SEQ ID NO: 1001784 - RNA, 19 nt, Homo sapiens
gaacaaggacaucuuugaa

SEQ ID NO: 1001785 - RNA, 19 nt, Homo sapiens
gccaucacauaucgaauua

SEQ ID NO: 1001786 - RNA, 19 nt, Homo sapiens
caacgugacuccugauuac

SEQ ID NO: 1001787 - RNA, 19 nt, Homo sapiens
ggacaucuuugaaguagag

SEQ ID NO: 1001788 - RNA, 19 nt, Homo sapiens
gaggagaacacaaauguca

SEQ ID NO: 1001789 - RNA, 19 nt, Homo sapiens
gcccaguacugcucuguga

SEQ ID NO: 1001790 - RNA, 19 nt, Homo sapiens
caaggacaucuuugaagua

SEQ ID NO: 1001791 - RNA, 19 nt, Homo sapiens
gaggaggacacgaaaguga

SEQ ID NO: 1001792 - RNA, 19 nt, Homo sapiens
acaaggacaucuuugaagu

SEQ ID NO: 1001793 - RNA, 19 nt, Homo sapiens
caacucggccaucacauau

SEQ ID NO: 1001794 - RNA, 19 nt, Homo sapiens
gauacaaguuuccgaacag

SEQ ID NO: 1001795 - RNA, 19 nt, Homo sapiens
guacugcucugugaacaag

SEQ ID NO: 1001796 - RNA, 19 nt, Homo sapiens
caaccacagucauugagau

SEQ ID NO: 1001797 - RNA, 19 nt, Homo sapiens
ccacagucauugagauaca

SEQ ID NO: 1001798 - RNA, 19 nt, Homo sapiens
ucaacucggccaucacaua

SEQ ID NO: 1001799 - RNA, 19 nt, Homo sapiens
ggugacagccgccaagaug

SEQ ID NO: 1001800 - RNA, 19 nt, Homo sapiens
ucacauaucgaauuaccaa

SEQ ID NO: 1001801 - RNA, 19 nt, Homo sapiens
caucaucuacagcaucuuu

SEQ ID NO: 1001802 - RNA, 19 nt, Homo sapiens
ucaacgugacuccugauua

SEQ ID NO: 1001803 - RNA, 19 nt, Homo sapiens
ggccaucacauaucgaauu

SEQ ID NO: 1001804 - RNA, 19 nt, Homo sapiens
ucaaccagcccaucaucua

SEQ ID NO: 1001805 - RNA, 19 nt, Homo sapiens
ugaacaaggacaucuuuga

SEQ ID NO: 1001806 - RNA, 19 nt, Homo sapiens
ucauugagauacaaguuuc

SEQ ID NO: 1001807 - RNA, 19 nt, Homo sapiens
gaccucaacucggccauca

SEQ ID NO: 1001808 - RNA, 19 nt, Homo sapiens
gguacaaggcugucugguu

SEQ ID NO: 1001809 - RNA, 19 nt, Homo sapiens
uagaggagaacacaaaugu

SEQ ID NO: 1001810 - RNA, 19 nt, Homo sapiens
ggacgacauucuguucuac

SEQ ID NO: 1001811 - RNA, 19 nt, Homo sapiens
cgacaaggacgacauucug

SEQ ID NO: 1001812 - RNA, 19 nt, Homo sapiens
caaggacgacauucuguuc

SEQ ID NO: 1001813 - RNA, 19 nt, Homo sapiens
caagugcugcucuggcaaa

SEQ ID NO: 1001814 - RNA, 19 nt, Homo sapiens
gcaaccacagucauugaga

SEQ ID NO: 1001815 - RNA, 19 nt, Homo sapiens
gcuucucggugguggauau

SEQ ID NO: 1001816 - RNA, 19 nt, Homo sapiens
aaggacaucuuugaaguag

SEQ ID NO: 1001817 - RNA, 19 nt, Homo sapiens
ggccgaacaugaccuucug

SEQ ID NO: 1001818 - RNA, 19 nt, Homo sapiens
ugacagcaggugccaguga

SEQ ID NO: 1001819 - RNA, 19 nt, Homo sapiens
guucuacacccuccaggaa

SEQ ID NO: 1001820 - RNA, 19 nt, Homo sapiens
uaaagcaaggcucccgaaa

SEQ ID NO: 1001821 - RNA, 19 nt, Homo sapiens
gaaguagaggagaacacaa

SEQ ID NO: 1001822 - RNA, 19 nt, Homo sapiens
agauacaaguuuccgaaca

SEQ ID NO: 1001823 - RNA, 19 nt, Homo sapiens
guagaggagaacacaaaug

SEQ ID NO: 1001824 - RNA, 19 nt, Homo sapiens
aggacgacauucuguucua

SEQ ID NO: 1001825 - RNA, 19 nt, Homo sapiens
ugucagugcuggacgucaa

SEQ ID NO: 1001826 - RNA, 19 nt, Homo sapiens
ucagagcggaggcacauug

SEQ ID NO: 1001827 - RNA, 19 nt, Homo sapiens
ggaggcagacguggucguu

SEQ ID NO: 1001828 - RNA, 19 nt, Homo sapiens
gacaaggacgacauucugu

SEQ ID NO: 1001829 - RNA, 19 nt, Homo sapiens
gcuaaggguguucguguca

SEQ ID NO: 1001830 - RNA, 19 nt, Homo sapiens
gugcugcucuggcaaagcu

SEQ ID NO: 1001831 - RNA, 19 nt, Homo sapiens
gaauuaccaaccacucaca

SEQ ID NO: 1001832 - RNA, 19 nt, Homo sapiens
ucuacacccuccaggaaau

SEQ ID NO: 1001833 - RNA, 19 nt, Homo sapiens
guuccucccugaccacaag

SEQ ID NO: 1001834 - RNA, 19 nt, Homo sapiens
cauaucgaauuaccaacca

SEQ ID NO: 1001835 - RNA, 19 nt, Homo sapiens
caucacauaucgaauuacc

SEQ ID NO: 1001836 - RNA, 19 nt, Homo sapiens
aaguagaggagaacacaaa

SEQ ID NO: 1001837 - RNA, 19 nt, Homo sapiens
uaaggguguucgugucagu

SEQ ID NO: 1001838 - RNA, 19 nt, Homo sapiens
gucauugagauacaaguuu

SEQ ID NO: 1001839 - RNA, 19 nt, Homo sapiens
aaccacagucauugagaua

SEQ ID NO: 1001840 - RNA, 19 nt, Homo sapiens
cgaccuugcccgcuacuca

SEQ ID NO: 1001841 - RNA, 19 nt, Homo sapiens
gacccgaggcagaauaaag

SEQ ID NO: 1001842 - RNA, 19 nt, Homo sapiens
ggaguucucggaccucaac

SEQ ID NO: 1001843 - RNA, 19 nt, Homo sapiens
ugugaacaaggacaucuuu

SEQ ID NO: 1001844 - RNA, 19 nt, Homo sapiens
caaccagcccaucaucuac

SEQ ID NO: 1001845 - RNA, 19 nt, Homo sapiens
ggaggaggacacgaaagug

SEQ ID NO: 1001846 - RNA, 19 nt, Homo sapiens
ugaaguagaggagaacaca

SEQ ID NO: 1001847 - RNA, 19 nt, Homo sapiens
ccacacuagugcugaacgu

SEQ ID NO: 1001848 - RNA, 19 nt, Homo sapiens
gguggaggaggacacgaaa

SEQ ID NO: 1001849 - RNA, 19 nt, Homo sapiens
ccgcaaccacagucauuga

SEQ ID NO: 1001850 - RNA, 19 nt, Homo sapiens
caccgcaaccacagucauu

SEQ ID NO: 1001851 - RNA, 19 nt, Homo sapiens
ggcuacgucugcauucaag

SEQ ID NO: 1001852 - RNA, 19 nt, Homo sapiens
acaaggacgacauucuguu

SEQ ID NO: 1001853 - RNA, 19 nt, Homo sapiens
ggagaagucacugcuugag

SEQ ID NO: 1001854 - RNA, 19 nt, Homo sapiens
ucuuugaaguagaggagaa

SEQ ID NO: 1001855 - RNA, 19 nt, Homo sapiens
uuuaagaccaaggagauaa

SEQ ID NO: 1001856 - RNA, 19 nt, Homo sapiens
guacaaggcugucugguuu

SEQ ID NO: 1001857 - RNA, 19 nt, Homo sapiens
gaacaaggacaucuuugaa

SEQ ID NO: 1001858 - RNA, 19 nt, Homo sapiens
gccaucacauaucgaauua

SEQ ID NO: 1001859 - RNA, 19 nt, Homo sapiens
cgagaaggcugggccauuu

SEQ ID NO: 1001860 - RNA, 19 nt, Homo sapiens
caacgugacuccugauuac

SEQ ID NO: 1001861 - RNA, 19 nt, Homo sapiens
ggacaucuuugaaguagag

SEQ ID NO: 1001862 - RNA, 19 nt, Homo sapiens
gaggagaacacaaauguca

SEQ ID NO: 1001863 - RNA, 19 nt, Homo sapiens
gcccaguacugcucuguga

SEQ ID NO: 1001864 - RNA, 19 nt, Homo sapiens
caaggacaucuuugaagua

SEQ ID NO: 1001865 - RNA, 19 nt, Homo sapiens
gaggaggacacgaaaguga

SEQ ID NO: 1001866 - RNA, 19 nt, Homo sapiens
acaaggacaucuuugaagu

SEQ ID NO: 1001867 - RNA, 19 nt, Homo sapiens
caacucggccaucacauau

SEQ ID NO: 1001868 - RNA, 19 nt, Homo sapiens
gauacaaguuuccgaacag

SEQ ID NO: 1001869 - RNA, 19 nt, Homo sapiens
caaccacagucauugagau

SEQ ID NO: 1001870 - RNA, 19 nt, Homo sapiens
guacugcucugugaacaag

SEQ ID NO: 1001871 - RNA, 19 nt, Homo sapiens
gcacugaccacugaugaug

SEQ ID NO: 1001872 - RNA, 19 nt, Homo sapiens
ccacagucauugagauaca

SEQ ID NO: 1001873 - RNA, 19 nt, Homo sapiens
ucaacucggccaucacaua

SEQ ID NO: 1001874 - RNA, 19 nt, Homo sapiens
ggugacagccgccaagaug

SEQ ID NO: 1001875 - RNA, 19 nt, Homo sapiens
ucacauaucgaauuaccaa

SEQ ID NO: 1001876 - RNA, 19 nt, Homo sapiens
caucaucuacagcaucuuu

SEQ ID NO: 1001877 - RNA, 19 nt, Homo sapiens
ucaacgugacuccugauua

SEQ ID NO: 1001878 - RNA, 19 nt, Homo sapiens
ugaacaaggacaucuuuga

SEQ ID NO: 1001879 - RNA, 19 nt, Homo sapiens
ggccaucacauaucgaauu

SEQ ID NO: 1001880 - RNA, 19 nt, Homo sapiens
ucaaccagcccaucaucua

SEQ ID NO: 1001881 - RNA, 19 nt, Homo sapiens
aaacagcaccucccaccaa

SEQ ID NO: 1001882 - RNA, 19 nt, Homo sapiens
ucauugagauacaaguuuc

SEQ ID NO: 1001883 - RNA, 19 nt, Homo sapiens
gaccucaacucggccauca

SEQ ID NO: 1001884 - RNA, 19 nt, Homo sapiens
gguacaaggcugucugguu

SEQ ID NO: 1001885 - RNA, 19 nt, Homo sapiens
uagaggagaacacaaaugu

SEQ ID NO: 1001886 - RNA, 19 nt, Homo sapiens
ggacgacauucuguucuac

SEQ ID NO: 1001887 - RNA, 19 nt, Homo sapiens
cgacaaggacgacauucug

SEQ ID NO: 1001888 - RNA, 19 nt, Homo sapiens
caaggacgacauucuguuc

SEQ ID NO: 1001889 - RNA, 19 nt, Homo sapiens
caagugcugcucuggcaaa

SEQ ID NO: 1001890 - RNA, 19 nt, Homo sapiens
gcaaccacagucauugaga

SEQ ID NO: 1001891 - RNA, 19 nt, Homo sapiens
gcuucucggugguggauau

SEQ ID NO: 1001892 - RNA, 19 nt, Homo sapiens
aaggacaucuuugaaguag

SEQ ID NO: 1001893 - RNA, 19 nt, Homo sapiens
ggccgaacaugaccuucug

SEQ ID NO: 1001894 - RNA, 19 nt, Homo sapiens
ugacagcaggugccaguga

SEQ ID NO: 1001895 - RNA, 19 nt, Homo sapiens
guucuacacccuccaggaa

SEQ ID NO: 1001896 - RNA, 19 nt, Homo sapiens
uaaagcaaggcucccgaaa

SEQ ID NO: 1001897 - RNA, 19 nt, Homo sapiens
guagaggagaacacaaaug

SEQ ID NO: 1001898 - RNA, 19 nt, Homo sapiens
agauacaaguuuccgaaca

SEQ ID NO: 1001899 - RNA, 19 nt, Homo sapiens
aggacgacauucuguucua

SEQ ID NO: 1001900 - RNA, 19 nt, Homo sapiens
gaaguagaggagaacacaa

SEQ ID NO: 1001901 - RNA, 19 nt, Homo sapiens
ugucagugcuggacgucaa

SEQ ID NO: 1001902 - RNA, 19 nt, Homo sapiens
ucagagcggaggcacauug

SEQ ID NO: 1001903 - RNA, 19 nt, Homo sapiens
ggaggcagacguggucguu

SEQ ID NO: 1001904 - RNA, 19 nt, Homo sapiens
gacaaggacgacauucugu

SEQ ID NO: 1001905 - RNA, 19 nt, Homo sapiens
gcuaaggguguucguguca

SEQ ID NO: 1001906 - RNA, 19 nt, Homo sapiens
gugcugcucuggcaaagcu

SEQ ID NO: 1001907 - RNA, 19 nt, Homo sapiens
gaauuaccaaccacucaca

SEQ ID NO: 1001908 - RNA, 19 nt, Homo sapiens
ucuacacccuccaggaaau

SEQ ID NO: 1001909 - RNA, 19 nt, Homo sapiens
guuccucccugaccacaag

SEQ ID NO: 1001910 - RNA, 19 nt, Homo sapiens
aaguagaggagaacacaaa

SEQ ID NO: 1001911 - RNA, 19 nt, Homo sapiens
cauaucgaauuaccaacca

SEQ ID NO: 1001912 - RNA, 19 nt, Homo sapiens
caucacauaucgaauuacc

SEQ ID NO: 1001913 - RNA, 19 nt, Homo sapiens
uaaggguguucgugucagu

SEQ ID NO: 1001914 - RNA, 19 nt, Homo sapiens
cagcacugaccacugauga

SEQ ID NO: 1001915 - RNA, 19 nt, Homo sapiens
gucauugagauacaaguuu

SEQ ID NO: 1001916 - RNA, 19 nt, Homo sapiens
gagaaggcugggccauuuc

SEQ ID NO: 1001917 - RNA, 19 nt, Homo sapiens
aaccacagucauugagaua

SEQ ID NO: 1001918 - RNA, 19 nt, Homo sapiens
cgaccuugcccgcuacuca

SEQ ID NO: 1001919 - RNA, 19 nt, Homo sapiens
gacccgaggcagaauaaag

SEQ ID NO: 1001920 - RNA, 19 nt, Homo sapiens
ggaguucucggaccucaac

SEQ ID NO: 1001921 - RNA, 19 nt, Homo sapiens
ugugaacaaggacaucuuu

SEQ ID NO: 1001922 - RNA, 19 nt, Homo sapiens
caaccagcccaucaucuac

SEQ ID NO: 1001923 - RNA, 19 nt, Homo sapiens
ggaggaggacacgaaagug

SEQ ID NO: 1001924 - RNA, 19 nt, Homo sapiens
ccacacuagugcugaacgu

SEQ ID NO: 1001925 - RNA, 19 nt, Homo sapiens
ugaaguagaggagaacaca

SEQ ID NO: 1001926 - RNA, 19 nt, Homo sapiens
gguggaggaggacacgaaa

SEQ ID NO: 1001927 - RNA, 19 nt, Homo sapiens
ccgcaaccacagucauuga

SEQ ID NO: 1001928 - RNA, 19 nt, Homo sapiens
caccgcaaccacagucauu

SEQ ID NO: 1001929 - RNA, 19 nt, Homo sapiens
ggcuacgucugcauucaag

SEQ ID NO: 1001930 - RNA, 19 nt, Homo sapiens
acaaggacgacauucuguu

SEQ ID NO: 1001931 - RNA, 19 nt, Homo sapiens
ucuuugaaguagaggagaa

SEQ ID NO: 1001932 - RNA, 19 nt, Homo sapiens
ggagaagucacugcuugag

SEQ ID NO: 1001933 - RNA, 19 nt, Homo sapiens
uuuaagaccaaggagauaa

SEQ ID NO: 1001934 - RNA, 19 nt, Homo sapiens
gaacauagcccuaguuuaa

SEQ ID NO: 1001935 - RNA, 19 nt, Homo sapiens
gaaagcaacuucagaaaga

SEQ ID NO: 1001936 - RNA, 19 nt, Homo sapiens
gaaagaaagcgcuauaaua

SEQ ID NO: 1001937 - RNA, 19 nt, Homo sapiens
gaacagcaaucuaaggaaa

SEQ ID NO: 1001938 - RNA, 19 nt, Homo sapiens
gaaacuagcccauuacaaa

SEQ ID NO: 1001939 - RNA, 19 nt, Homo sapiens
gaagagaacagcaaucuaa

SEQ ID NO: 1001940 - RNA, 19 nt, Homo sapiens
caaaggaacuuaugggaaa

SEQ ID NO: 1001941 - RNA, 19 nt, Homo sapiens
gauauucccugauggauuu

SEQ ID NO: 1001942 - RNA, 19 nt, Homo sapiens
ggaaaucacugagacaauu

SEQ ID NO: 1001943 - RNA, 19 nt, Homo sapiens
gcaagaaacacucauaauu

SEQ ID NO: 1001944 - RNA, 19 nt, Homo sapiens
caacagaaguagcaagaaa

SEQ ID NO: 1001945 - RNA, 19 nt, Homo sapiens
agaagaaacuagcccauua

SEQ ID NO: 1001946 - RNA, 19 nt, Homo sapiens
ucaaagaccuggaagagaa

SEQ ID NO: 1001947 - RNA, 19 nt, Homo sapiens
gaaaggcaauaacauucua

SEQ ID NO: 1001948 - RNA, 19 nt, Homo sapiens
uaaaggaaguguaucugua

SEQ ID NO: 1001949 - RNA, 19 nt, Homo sapiens
ggaaagguccucuauaaug

SEQ ID NO: 1001950 - RNA, 19 nt, Homo sapiens
ucagaucagugcauuguua

SEQ ID NO: 1001951 - RNA, 19 nt, Homo sapiens
guacaagacaucaugaaua

SEQ ID NO: 1001952 - RNA, 19 nt, Homo sapiens
gcaaagaugugaugcuaca

SEQ ID NO: 1001953 - RNA, 19 nt, Homo sapiens
ggacgucucuuuaguugga

SEQ ID NO: 1001954 - RNA, 19 nt, Homo sapiens
gagugaaacuaguagauuu

SEQ ID NO: 1001955 - RNA, 19 nt, Homo sapiens
ggaauucgacuacaagaaa

SEQ ID NO: 1001956 - RNA, 19 nt, Homo sapiens
uaacaaccauucaaacuuc

SEQ ID NO: 1001957 - RNA, 19 nt, Homo sapiens
cacaaacgguugcaucaua

SEQ ID NO: 1001958 - RNA, 19 nt, Homo sapiens
ugacugaauucacagauuu

SEQ ID NO: 1001959 - RNA, 19 nt, Homo sapiens
cagcauaucuagaaaggaa

SEQ ID NO: 1001960 - RNA, 19 nt, Homo sapiens
uaaggaaaguggagaaaga

SEQ ID NO: 1001961 - RNA, 19 nt, Homo sapiens
uaaugcaaguggauucuua

SEQ ID NO: 1001962 - RNA, 19 nt, Homo sapiens
gcaauuggauaccacuuau

SEQ ID NO: 1001963 - RNA, 19 nt, Homo sapiens
ggauauacuuuaagaagga

SEQ ID NO: 1001964 - RNA, 19 nt, Homo sapiens
gaaagguccucuauaaugc

SEQ ID NO: 1001965 - RNA, 19 nt, Homo sapiens
ggaacagaaugaauaccua

SEQ ID NO: 1001966 - RNA, 19 nt, Homo sapiens
ugaaggauguagaugauuu

SEQ ID NO: 1001967 - RNA, 19 nt, Homo sapiens
gaacacauccguaggaaca

SEQ ID NO: 1001968 - RNA, 19 nt, Homo sapiens
aagaagacaucuguaguua

SEQ ID NO: 1001969 - RNA, 19 nt, Homo sapiens
ccaaugcuguggagaguaa

SEQ ID NO: 1001970 - RNA, 19 nt, Homo sapiens
gaaaggaagcuauugacaa

SEQ ID NO: 1001971 - RNA, 19 nt, Homo sapiens
gagacacucuuccuacuga

SEQ ID NO: 1001972 - RNA, 19 nt, Homo sapiens
ggauguagaugauuuagca

SEQ ID NO: 1001973 - RNA, 19 nt, Homo sapiens
gggcaaagaugugaugcua

SEQ ID NO: 1001974 - RNA, 19 nt, Homo sapiens
ggaaaucaauaacaucaag

SEQ ID NO: 1001975 - RNA, 19 nt, Homo sapiens
ggaaguguaucuguaguga

SEQ ID NO: 1001976 - RNA, 19 nt, Homo sapiens
caaaugaggacuucagaaa

SEQ ID NO: 1001977 - RNA, 19 nt, Homo sapiens
gaacagaaugaauaccuaa

SEQ ID NO: 1001978 - RNA, 19 nt, Homo sapiens
ugacaauucuagcagauuu

SEQ ID NO: 1001979 - RNA, 19 nt, Homo sapiens
caccauaagccaauuaaua

SEQ ID NO: 1001980 - RNA, 19 nt, Homo sapiens
gaagaaggauaacaaagac

SEQ ID NO: 1001981 - RNA, 19 nt, Homo sapiens
gauucaagcuugugucaga

SEQ ID NO: 1001982 - RNA, 19 nt, Homo sapiens
gagcagcugugcauuaaca

SEQ ID NO: 1001983 - RNA, 19 nt, Homo sapiens
caacugaacaccagauuga

SEQ ID NO: 1001984 - RNA, 19 nt, Homo sapiens
ggagcaacuugguaguaua

SEQ ID NO: 1001985 - RNA, 19 nt, Homo sapiens
gaacuguguuucuuugcuu

SEQ ID NO: 1001986 - RNA, 19 nt, Homo sapiens
gacaagagccacauuucua

SEQ ID NO: 1001987 - RNA, 19 nt, Homo sapiens
gcugcaaucuugaauguug

SEQ ID NO: 1001988 - RNA, 19 nt, Homo sapiens
uaaaguaaauggagacaag

SEQ ID NO: 1001989 - RNA, 19 nt, Homo sapiens
gaaccuacacuuagccaaa

SEQ ID NO: 1001990 - RNA, 19 nt, Homo sapiens
ggaaagacagucagggaaa

SEQ ID NO: 1001991 - RNA, 19 nt, Homo sapiens
gacacaguauucaaaguuu

SEQ ID NO: 1001992 - RNA, 19 nt, Homo sapiens
ggaaagaaagcgcuauaau

SEQ ID NO: 1001993 - RNA, 19 nt, Homo sapiens
cauacucgcugcaaucuug

SEQ ID NO: 1001994 - RNA, 19 nt, Homo sapiens
ggacacaguauucaaaguu

SEQ ID NO: 1001995 - RNA, 19 nt, Homo sapiens
gaucagugcauuguuauuu

SEQ ID NO: 1001996 - RNA, 19 nt, Homo sapiens
gaaggauguagaugauuua

SEQ ID NO: 1001997 - RNA, 19 nt, Homo sapiens
uaaagcagcgguauucauu

SEQ ID NO: 1001998 - RNA, 19 nt, Homo sapiens
guggagcaguuaaaucuaa

SEQ ID NO: 1001999 - RNA, 19 nt, Homo sapiens
gcauuggcauucuugauau

SEQ ID NO: 1002000 - RNA, 19 nt, Homo sapiens
gagcaauguuucaaaguca

SEQ ID NO: 1002001 - RNA, 19 nt, Homo sapiens
ccucuaauauccaaucuga

SEQ ID NO: 1002002 - RNA, 19 nt, Homo sapiens
gcaugugguuuggcaauuu

SEQ ID NO: 1002003 - RNA, 19 nt, Homo sapiens
gaaggcagcaguugaggaa

SEQ ID NO: 1002004 - RNA, 19 nt, Homo sapiens
ggagaggaauugugaagag

SEQ ID NO: 1002005 - RNA, 19 nt, Homo sapiens
gaacagcaauuggauacca

SEQ ID NO: 1002006 - RNA, 19 nt, Homo sapiens
gaagacaucuguaguuacc

SEQ ID NO: 1002007 - RNA, 19 nt, Homo sapiens
aagcuaugauccagaguua

SEQ ID NO: 1002008 - RNA, 19 nt, Homo sapiens
ugaccagacucuuguagaa

SEQ ID NO: 1002009 - RNA, 19 nt, Homo sapiens
acaauuauacgacccaaua

SEQ ID NO: 1002010 - RNA, 19 nt, Homo sapiens
cacaaagcauuccaaacua

SEQ ID NO: 1002011 - RNA, 19 nt, Homo sapiens
caacaaaacuauccacaga

SEQ ID NO: 1002012 - RNA, 19 nt, Homo sapiens
aaaggaagcuauugacaag

SEQ ID NO: 1002013 - RNA, 19 nt, Homo sapiens
cagguaaucugccacauuc

SEQ ID NO: 1002014 - RNA, 19 nt, Homo sapiens
cagaaugaauaccuaaaug

SEQ ID NO: 1002015 - RNA, 19 nt, Homo sapiens
cagcauaaauucauuacuc

SEQ ID NO: 1002016 - RNA, 19 nt, Homo sapiens
ggacuucaacauuugcaua

SEQ ID NO: 1002017 - RNA, 19 nt, Homo sapiens
gcaguaacaaccauucaaa

SEQ ID NO: 1002018 - RNA, 19 nt, Homo sapiens
gaagaggggugaaagaaug

SEQ ID NO: 1002019 - RNA, 19 nt, Homo sapiens
ggaagagguuaagcaagaa

SEQ ID NO: 1002020 - RNA, 19 nt, Homo sapiens
uaacugggcucuuggaaaa

SEQ ID NO: 1002021 - RNA, 19 nt, Homo sapiens
guagaagccuuuggcaaug

SEQ ID NO: 1002022 - RNA, 19 nt, Homo sapiens
gagaagauuuuacaaguga

SEQ ID NO: 1002023 - RNA, 19 nt, Homo sapiens
gaacuucaaccgaccucua

SEQ ID NO: 1002024 - RNA, 19 nt, Homo sapiens
ggucagauucuaugggaua

SEQ ID NO: 1002025 - RNA, 19 nt, Homo sapiens
gaaagaggaagcuaugauc

SEQ ID NO: 1002026 - RNA, 19 nt, Homo sapiens
ggagaaagaggaagcuaug

SEQ ID NO: 1002027 - RNA, 19 nt, Homo sapiens
aggaagagguuaagcaaga

SEQ ID NO: 1002028 - RNA, 19 nt, Homo sapiens
caaaaguguuccuuaagua

SEQ ID NO: 1002029 - RNA, 19 nt, Homo sapiens
uggaaaggcuaauaacaga

SEQ ID NO: 1002030 - RNA, 19 nt, Homo sapiens
ccacaaagcauuccaaacu

SEQ ID NO: 1002031 - RNA, 19 nt, Homo sapiens
caaccgaccucuaauaucc

SEQ ID NO: 1002032 - RNA, 19 nt, Homo sapiens
gaaagagaagcaugugguu

SEQ ID NO: 1002033 - RNA, 19 nt, Homo sapiens
gaaaaugagacuuccuuua

SEQ ID NO: 1002034 - RNA, 19 nt, Homo sapiens
gcaagaagguaacgucauu

SEQ ID NO: 1002035 - RNA, 19 nt, Homo sapiens
gaacugacaugggaagauu

SEQ ID NO: 1002036 - RNA, 19 nt, Homo sapiens
ggaaugggcuguucuccaa

SEQ ID NO: 1002037 - RNA, 19 nt, Homo sapiens
gaacaucgcuguguaugag

SEQ ID NO: 1002038 - RNA, 19 nt, Homo sapiens
ggacuuccaucgccucauu

SEQ ID NO: 1002039 - RNA, 19 nt, Homo sapiens
gaagaaauccgaaauacca

SEQ ID NO: 1002040 - RNA, 19 nt, Homo sapiens
cagcaucucuuucauguuc

SEQ ID NO: 1002041 - RNA, 19 nt, Homo sapiens
gcagcgacauugagacuga

SEQ ID NO: 1002042 - RNA, 19 nt, Homo sapiens
aaacaaaucucagaagaca

SEQ ID NO: 1002043 - RNA, 19 nt, Homo sapiens
agaaggagauugaagaaau

SEQ ID NO: 1002044 - RNA, 19 nt, Homo sapiens
ggagaagugauuuaucuaa

SEQ ID NO: 1002045 - RNA, 19 nt, Homo sapiens
caucauccaugguagcuuu

SEQ ID NO: 1002046 - RNA, 19 nt, Homo sapiens
ggaagaagguggagaucag

SEQ ID NO: 1002047 - RNA, 19 nt, Homo sapiens
gcacucugcugcucaagau

SEQ ID NO: 1002048 - RNA, 19 nt, Homo sapiens
caucguccuugaacaauuu

SEQ ID NO: 1002049 - RNA, 19 nt, Homo sapiens
ggcaagccauuuacagaaa

SEQ ID NO: 1002050 - RNA, 19 nt, Homo sapiens
agaaacaaaucucagaaga

SEQ ID NO: 1002051 - RNA, 19 nt, Homo sapiens
gaaccggagucuauucaca

SEQ ID NO: 1002052 - RNA, 19 nt, Homo sapiens
ggaggugccugaagucauc

SEQ ID NO: 1002053 - RNA, 19 nt, Homo sapiens
ggaaaagucucgccuuaug

SEQ ID NO: 1002054 - RNA, 19 nt, Homo sapiens
gaggaaaagucucgccuua

SEQ ID NO: 1002055 - RNA, 19 nt, Homo sapiens
gagaagugauuuaucuaag

SEQ ID NO: 1002056 - RNA, 19 nt, Homo sapiens
ugacagaugugccagauac

SEQ ID NO: 1002057 - RNA, 19 nt, Homo sapiens
ggagagggccuacuacuac

SEQ ID NO: 1002058 - RNA, 19 nt, Homo sapiens
caagcugaccugacaagua

SEQ ID NO: 1002059 - RNA, 19 nt, Homo sapiens
ggacccagcgucaguuuga

SEQ ID NO: 1002060 - RNA, 19 nt, Homo sapiens
acaaagugcugaagaugug

SEQ ID NO: 1002061 - RNA, 19 nt, Homo sapiens
ggacuagagugagaaguag

SEQ ID NO: 1002062 - RNA, 19 nt, Homo sapiens
ccaaagcuguaccuugaug

SEQ ID NO: 1002063 - RNA, 19 nt, Homo sapiens
acccaaagcuguaccuuga

SEQ ID NO: 1002064 - RNA, 19 nt, Homo sapiens
gcuaucacgugcuuucaga

SEQ ID NO: 1002065 - RNA, 19 nt, Homo sapiens
aaacaaggaucagauugga

SEQ ID NO: 1002066 - RNA, 19 nt, Homo sapiens
gggacuagagugagaagua

SEQ ID NO: 1002067 - RNA, 19 nt, Homo sapiens
ccagauacccaaagcugua

SEQ ID NO: 1002068 - RNA, 19 nt, Homo sapiens
gaugagagcagcugugaca

SEQ ID NO: 1002069 - RNA, 19 nt, Homo sapiens
gccagcaucucuuucaugu

SEQ ID NO: 1002070 - RNA, 19 nt, Homo sapiens
cauggaagcuuuggaaugg

SEQ ID NO: 1002071 - RNA, 19 nt, Homo sapiens
ccaagaaggagauugaaga

SEQ ID NO: 1002072 - RNA, 19 nt, Homo sapiens
ccaguagucucccuuccaa

SEQ ID NO: 1002073 - RNA, 19 nt, Homo sapiens
gcccacaccucaccucugu

SEQ ID NO: 1002074 - RNA, 19 nt, Homo sapiens
ccacuaugcuguacaucug

SEQ ID NO: 1002075 - RNA, 19 nt, Homo sapiens
ggaccacuaugcuguacau

SEQ ID NO: 1002076 - RNA, 19 nt, Homo sapiens
ggacaaggaggaacugaca

SEQ ID NO: 1002077 - RNA, 19 nt, Homo sapiens
gcagauccgugugguagau

SEQ ID NO: 1002078 - RNA, 19 nt, Homo sapiens
gcucuagcauggacacuuc

SEQ ID NO: 1002079 - RNA, 19 nt, Homo sapiens
gcugccaaguguucuguaa

SEQ ID NO: 1002080 - RNA, 19 nt, Homo sapiens
cguccucucuugccucuuu

SEQ ID NO: 1002081 - RNA, 19 nt, Homo sapiens
caagaaggagauugaagaa

SEQ ID NO: 1002082 - RNA, 19 nt, Homo sapiens
uagucucccuuccaaauaa

SEQ ID NO: 1002083 - RNA, 19 nt, Homo sapiens
guagucucccuuccaaaua

SEQ ID NO: 1002084 - RNA, 19 nt, Homo sapiens
gugcugcccuuccagagaa

SEQ ID NO: 1002085 - RNA, 19 nt, Homo sapiens
ggugaccgcuacugguuug

SEQ ID NO: 1002086 - RNA, 19 nt, Homo sapiens
gaagguaaaguccaugaag

SEQ ID NO: 1002087 - RNA, 19 nt, Homo sapiens
ucacuucucccaccauuau

SEQ ID NO: 1002088 - RNA, 19 nt, Homo sapiens
gcagagugcugggccaaag

SEQ ID NO: 1002089 - RNA, 19 nt, Homo sapiens
gaccuggugcugcuguuua

SEQ ID NO: 1002090 - RNA, 19 nt, Homo sapiens
ggacuuauccuggcuagag

SEQ ID NO: 1002091 - RNA, 19 nt, Homo sapiens
ggucaucaaucggaacuca

SEQ ID NO: 1002092 - RNA, 19 nt, Homo sapiens
ggacggcagcgccaucuau

SEQ ID NO: 1002093 - RNA, 19 nt, Homo sapiens
aagacaagcugaccugaca

SEQ ID NO: 1002094 - RNA, 19 nt, Homo sapiens
gauccuggccaucauguau

SEQ ID NO: 1002095 - RNA, 19 nt, Homo sapiens
gagauucggcggagguuug

SEQ ID NO: 1002096 - RNA, 19 nt, Homo sapiens
gcuggucgcuguuaucaac

SEQ ID NO: 1002097 - RNA, 19 nt, Homo sapiens
aaucggaacucaagugucu

SEQ ID NO: 1002098 - RNA, 19 nt, Homo sapiens
uaagcacguucuuucauca

SEQ ID NO: 1002099 - RNA, 19 nt, Homo sapiens
aagcugaccugacaaguac

SEQ ID NO: 1002100 - RNA, 19 nt, Homo sapiens
gccauguggugaaugugua

SEQ ID NO: 1002101 - RNA, 19 nt, Homo sapiens
guacgacuuugaugggaau

SEQ ID NO: 1002102 - RNA, 19 nt, Homo sapiens
gcauggaagcuuuggaaug

SEQ ID NO: 1002103 - RNA, 19 nt, Homo sapiens
gcgagaggaccauguguug

SEQ ID NO: 1002104 - RNA, 19 nt, Homo sapiens
gagaaaccgcacaguguug

SEQ ID NO: 1002105 - RNA, 19 nt, Homo sapiens
ucuaacaccacaacuaauu

SEQ ID NO: 1002106 - RNA, 19 nt, Homo sapiens
ucaucgagaucuccaacaa

SEQ ID NO: 1002107 - RNA, 19 nt, Homo sapiens
ccaugaagggucuccauuu

SEQ ID NO: 1002108 - RNA, 19 nt, Homo sapiens
cagcaucuccucagaguuc

SEQ ID NO: 1002109 - RNA, 19 nt, Homo sapiens
ugacaaguacuaugugugu

SEQ ID NO: 1002110 - RNA, 19 nt, Homo sapiens
gagagguggaggagaauga

SEQ ID NO: 1002111 - RNA, 19 nt, Homo sapiens
gcacaucacacgggcauca

SEQ ID NO: 1002112 - RNA, 19 nt, Homo sapiens
gacccuggcccaauaccua

SEQ ID NO: 1002113 - RNA, 19 nt, Homo sapiens
gaaacaaaucucagaagac

SEQ ID NO: 1002114 - RNA, 19 nt, Homo sapiens
gcauaaguuugagguguca

SEQ ID NO: 1002115 - RNA, 19 nt, Homo sapiens
gcagccagcaucucuuuca

SEQ ID NO: 1002116 - RNA, 19 nt, Homo sapiens
uugaagaugugcgggauuu

SEQ ID NO: 1002117 - RNA, 19 nt, Homo sapiens
caugaagggucuccauuuu

SEQ ID NO: 1002118 - RNA, 19 nt, Homo sapiens
gaucagauuggagaaguga

SEQ ID NO: 1002119 - RNA, 19 nt, Homo sapiens
cgugggaggugcagcgauu

SEQ ID NO: 1002120 - RNA, 19 nt, Homo sapiens
gaccugacaaguacuaugu

SEQ ID NO: 1002121 - RNA, 19 nt, Homo sapiens
cauagucagucaccaugug

SEQ ID NO: 1002122 - RNA, 19 nt, Homo sapiens
ccucuguucuuccuauuuc

SEQ ID NO: 1002123 - RNA, 19 nt, Homo sapiens
ucaccucuguucuuccuau

SEQ ID NO: 1002124 - RNA, 19 nt, Homo sapiens
ugccaaguguucuguaaga

SEQ ID NO: 1002125 - RNA, 19 nt, Homo sapiens
cggcgagccuccuacauca

SEQ ID NO: 1002126 - RNA, 19 nt, Homo sapiens
ucacgcagcucugugucaa

SEQ ID NO: 1002127 - RNA, 19 nt, Homo sapiens
ccggagcaaugacacugua

SEQ ID NO: 1002128 - RNA, 19 nt, Homo sapiens
gcaagccauuuacagaaac

SEQ ID NO: 1002129 - RNA, 19 nt, Homo sapiens
gaccgcuacugguuugaga

SEQ ID NO: 1002130 - RNA, 19 nt, Homo sapiens
gcaccaucguccuugaaca

SEQ ID NO: 1002131 - RNA, 19 nt, Homo sapiens
uuaagcacguucuuucauc

SEQ ID NO: 1002132 - RNA, 19 nt, Homo sapiens
cagacgggcuggcaaaugc

SEQ ID NO: 1002133 - RNA, 19 nt, Homo sapiens
caccaggaguggcauaagu

SEQ ID NO: 1002134 - RNA, 19 nt, Homo sapiens
gaacaagggcuauaucgua

SEQ ID NO: 1002135 - RNA, 19 nt, Homo sapiens
gcuaguaccuguuauuuau

SEQ ID NO: 1002136 - RNA, 19 nt, Homo sapiens
uaacaaaccugcacaugug

SEQ ID NO: 1002137 - RNA, 19 nt, Homo sapiens
gaugugagcuguugaugug

SEQ ID NO: 1002138 - RNA, 19 nt, Homo sapiens
gguaggaggugaagaggaa

SEQ ID NO: 1002139 - RNA, 19 nt, Homo sapiens
gcacuauccucaacaagau

SEQ ID NO: 1002140 - RNA, 19 nt, Homo sapiens
gcaagucaguuaaccuuuc

SEQ ID NO: 1002141 - RNA, 19 nt, Homo sapiens
cguaguccuuguuuaaaua

SEQ ID NO: 1002142 - RNA, 19 nt, Homo sapiens
agaguuaucuguuacuguu

SEQ ID NO: 1002143 - RNA, 19 nt, Homo sapiens
aaucaugucuccuucauca

SEQ ID NO: 1002144 - RNA, 19 nt, Homo sapiens
ggaagacugugaagcuaca

SEQ ID NO: 1002145 - RNA, 19 nt, Homo sapiens
gagagagauuggauuggaa

SEQ ID NO: 1002146 - RNA, 19 nt, Homo sapiens
gcacauguacucccugaau

SEQ ID NO: 1002147 - RNA, 19 nt, Homo sapiens
ggucagacuuccucuucaa

SEQ ID NO: 1002148 - RNA, 19 nt, Homo sapiens
cagacuuccucuucaaauu

SEQ ID NO: 1002149 - RNA, 19 nt, Homo sapiens
caaaucaugucuccuucau

SEQ ID NO: 1002150 - RNA, 19 nt, Homo sapiens
guaacaaaccugcacaugu

SEQ ID NO: 1002151 - RNA, 19 nt, Homo sapiens
uaucguaguccuuguuuaa

SEQ ID NO: 1002152 - RNA, 19 nt, Homo sapiens
ccacaacaacacacaauug

SEQ ID NO: 1002153 - RNA, 19 nt, Homo sapiens
ucaaauuccuggugauugg

SEQ ID NO: 1002154 - RNA, 19 nt, Homo sapiens
caagagacuuuagcgacaa

SEQ ID NO: 1002155 - RNA, 19 nt, Homo sapiens
gagcuauaguggagugaau

SEQ ID NO: 1002156 - RNA, 19 nt, Homo sapiens
ugcaggaacuggcaaauca

SEQ ID NO: 1002157 - RNA, 19 nt, Homo sapiens
gcaggagaauugcuugaac

SEQ ID NO: 1002158 - RNA, 19 nt, Homo sapiens
cuaccucccucauagaguu

SEQ ID NO: 1002159 - RNA, 19 nt, Homo sapiens
gaggaugggcucuggcauu

SEQ ID NO: 1002160 - RNA, 19 nt, Homo sapiens
agagagagauuggauugga

SEQ ID NO: 1002161 - RNA, 19 nt, Homo sapiens
gcccagcugugucacuuug

SEQ ID NO: 1002162 - RNA, 19 nt, Homo sapiens
gugaaacucugucucaaaa

SEQ ID NO: 1002163 - RNA, 19 nt, Homo sapiens
agaaugagcugauguuccu

SEQ ID NO: 1002164 - RNA, 19 nt, Homo sapiens
gaaaccccgucucuacuaa

SEQ ID NO: 1002165 - RNA, 19 nt, Homo sapiens
cuucaucaguucauugaga

SEQ ID NO: 1002166 - RNA, 19 nt, Homo sapiens
gagaaccagcuugucauuu

SEQ ID NO: 1002167 - RNA, 19 nt, Homo sapiens
acacacaauugacccaugu

SEQ ID NO: 1002168 - RNA, 19 nt, Homo sapiens
ggccuagguuugaaucuca

SEQ ID NO: 1002169 - RNA, 19 nt, Homo sapiens
agaaccagcuugucauuuu

SEQ ID NO: 1002170 - RNA, 19 nt, Homo sapiens
ggugagaaccagcuuguca

SEQ ID NO: 1002171 - RNA, 19 nt, Homo sapiens
gcaaguacuacauaagagu

SEQ ID NO: 1002172 - RNA, 19 nt, Homo sapiens
cacaacaacacacaauuga

SEQ ID NO: 1002173 - RNA, 19 nt, Homo sapiens
aaagugaaacucugucuca

SEQ ID NO: 1002174 - RNA, 19 nt, Homo sapiens
acaauugacccauguaaca

SEQ ID NO: 1002175 - RNA, 19 nt, Homo sapiens
caagucaguuaaccuuucu

SEQ ID NO: 1002176 - RNA, 19 nt, Homo sapiens
caagggcuauaucguaguc

SEQ ID NO: 1002177 - RNA, 19 nt, Homo sapiens
ugucuuggcuaacgucugu

SEQ ID NO: 1002178 - RNA, 19 nt, Homo sapiens
gcaaaucaugucuccuuca

SEQ ID NO: 1002179 - RNA, 19 nt, Homo sapiens
uguacucccugaaucuaaa

SEQ ID NO: 1002180 - RNA, 19 nt, Homo sapiens
gagaccagccugaccaaca

SEQ ID NO: 1002181 - RNA, 19 nt, Homo sapiens
gagcuguugaugugaguaa

SEQ ID NO: 1002182 - RNA, 19 nt, Homo sapiens
cagugacgcggaguuauua

SEQ ID NO: 1002183 - RNA, 19 nt, Homo sapiens
ucagugacgcggaguuauu

SEQ ID NO: 1002184 - RNA, 19 nt, Homo sapiens
caucaguucauugagaaua

SEQ ID NO: 1002185 - RNA, 19 nt, Homo sapiens
gggcaagucaguuaaccuu

SEQ ID NO: 1002186 - RNA, 19 nt, Homo sapiens
caaguacuacauaagaguu

SEQ ID NO: 1002187 - RNA, 19 nt, Homo sapiens
agagagagagauuggauug

SEQ ID NO: 1002188 - RNA, 19 nt, Homo sapiens
gaugggcucuggcauucag

SEQ ID NO: 1002189 - RNA, 19 nt, Homo sapiens
ucaccagccgggagacaua

SEQ ID NO: 1002190 - RNA, 19 nt, Homo sapiens
gagcccugcugguguacga

SEQ ID NO: 1002191 - RNA, 19 nt, Homo sapiens
caacgugggugggaagacu

SEQ ID NO: 1002192 - RNA, 19 nt, Homo sapiens
acuguuaccuauugguuug

SEQ ID NO: 1002193 - RNA, 19 nt, Homo sapiens
gaagaggaacaagggcuau

SEQ ID NO: 1002194 - RNA, 19 nt, Homo sapiens
cuggagcccugcuggugua

SEQ ID NO: 1002195 - RNA, 19 nt, Homo sapiens
uaagaguuaucuguuacug

SEQ ID NO: 1002196 - RNA, 19 nt, Homo sapiens
ggcaaguacuacauaagag

SEQ ID NO: 1002197 - RNA, 19 nt, Homo sapiens
uggcaaguacuacauaaga

SEQ ID NO: 1002198 - RNA, 19 nt, Homo sapiens
gcuauaguggagugaauga

SEQ ID NO: 1002199 - RNA, 19 nt, Homo sapiens
ugggaagacugugaagcua

SEQ ID NO: 1002200 - RNA, 19 nt, Homo sapiens
ggacuccaaccacacaauc

SEQ ID NO: 1002201 - RNA, 19 nt, Homo sapiens
gaacuggcaaaucaugucu

SEQ ID NO: 1002202 - RNA, 19 nt, Homo sapiens
gaaccagcuugucauuuuc

SEQ ID NO: 1002203 - RNA, 19 nt, Homo sapiens
ucguaguccuuguuuaaau

SEQ ID NO: 1002204 - RNA, 19 nt, Homo sapiens
ccaggagaaugagcugaug

SEQ ID NO: 1002205 - RNA, 19 nt, Homo sapiens
ugagaaccagcuugucauu

SEQ ID NO: 1002206 - RNA, 19 nt, Homo sapiens
gaggugagaaccagcuugu

SEQ ID NO: 1002207 - RNA, 19 nt, Homo sapiens
ccuguaaucccagcacuuu

SEQ ID NO: 1002208 - RNA, 19 nt, Homo sapiens
acacaauugacccauguaa

SEQ ID NO: 1002209 - RNA, 19 nt, Homo sapiens
gcccuuggccuagguuuga

SEQ ID NO: 1002210 - RNA, 19 nt, Homo sapiens
cacaaucggcguggaguuu

SEQ ID NO: 1002211 - RNA, 19 nt, Homo sapiens
caugucuccuucaucaguu

SEQ ID NO: 1002212 - RNA, 19 nt, Homo sapiens
agaccagccugaccaacau

SEQ ID NO: 1002213 - RNA, 19 nt, Homo sapiens
caauugacccauguaacaa

SEQ ID NO: 1002214 - RNA, 19 nt, Homo sapiens
gcuuugcccaggagaauga

SEQ ID NO: 1002215 - RNA, 19 nt, Homo sapiens
ggaacaagggcuauaucgu

SEQ ID NO: 1002216 - RNA, 19 nt, Homo sapiens
ggaacuggcaaaucauguc

SEQ ID NO: 1002217 - RNA, 19 nt, Homo sapiens
uagucuaccucccucauag

SEQ ID NO: 1002218 - RNA, 19 nt, Homo sapiens
uggcaaaucaugucuccuu

SEQ ID NO: 1002219 - RNA, 19 nt, Homo sapiens
cuguuacuguuaccuauug

SEQ ID NO: 1002220 - RNA, 19 nt, Homo sapiens
gaguuaucuguuacuguua

SEQ ID NO: 1002221 - RNA, 19 nt, Homo sapiens
cacauguacucccugaauc

SEQ ID NO: 1002222 - RNA, 19 nt, Homo sapiens
aggaugaugugagcuguug

SEQ ID NO: 1002223 - RNA, 19 nt, Homo sapiens
gcccugcuguugcuaguac

SEQ ID NO: 1002224 - RNA, 19 nt, Homo sapiens
gauugacucaggcgagcua

SEQ ID NO: 1002225 - RNA, 19 nt, Homo sapiens
ggagaaugagcugauguuc

SEQ ID NO: 1002226 - RNA, 19 nt, Homo sapiens
agacuuccucuucaaauuc

SEQ ID NO: 1002227 - RNA, 19 nt, Homo sapiens
aagagacuuuagcgacaaa

SEQ ID NO: 1002228 - RNA, 19 nt, Homo sapiens
gagaggccguguccuaacc

SEQ ID NO: 1002229 - RNA, 19 nt, Homo sapiens
gaggaacaagggcuauauc

SEQ ID NO: 1002230 - RNA, 19 nt, Homo sapiens
cuuccucugucuuggcuaa

SEQ ID NO: 1002231 - RNA, 19 nt, Homo sapiens
aggaugggcucuggcauuc

SEQ ID NO: 1002232 - RNA, 19 nt, Homo sapiens
ugugaugguuagagagaga

SEQ ID NO: 1002233 - RNA, 19 nt, Homo sapiens
gaugaugugagcuguugau

SEQ ID NO: 1002234 - RNA, 19 nt, Homo sapiens
ucacuucucuuuacagaua

SEQ ID NO: 1002235 - RNA, 19 nt, Homo sapiens
gaggagggcugccaaaucu

SEQ ID NO: 1002236 - RNA, 19 nt, Homo sapiens
gcacuugugucugcagauu

SEQ ID NO: 1002237 - RNA, 19 nt, Homo sapiens
gagacucccugaacugcua

SEQ ID NO: 1002238 - RNA, 19 nt, Homo sapiens
gagcaaaguucugggugaa

SEQ ID NO: 1002239 - RNA, 19 nt, Homo sapiens
ggagggauaaggcugauuu

SEQ ID NO: 1002240 - RNA, 19 nt, Homo sapiens
gggcuuggguagucaaaug

SEQ ID NO: 1002241 - RNA, 19 nt, Homo sapiens
agagugaccugcuggaaga

SEQ ID NO: 1002242 - RNA, 19 nt, Homo sapiens
agaccggacugugacauua

SEQ ID NO: 1002243 - RNA, 19 nt, Homo sapiens
gcucagcucuuugaaacau

SEQ ID NO: 1002244 - RNA, 19 nt, Homo sapiens
gacgagcucuuccagaaag

SEQ ID NO: 1002245 - RNA, 19 nt, Homo sapiens
gcgagcgaaugacggagua

SEQ ID NO: 1002246 - RNA, 19 nt, Homo sapiens
gggauaaggcugauuugga

SEQ ID NO: 1002247 - RNA, 19 nt, Homo sapiens
ggacgagcucuuccagaaa

SEQ ID NO: 1002248 - RNA, 19 nt, Homo sapiens
gcuaugaggccaugaguag

SEQ ID NO: 1002249 - RNA, 19 nt, Homo sapiens
gaaaguggcagaggauuac

SEQ ID NO: 1002250 - RNA, 19 nt, Homo sapiens
agaaaguggcagaggauua

SEQ ID NO: 1002251 - RNA, 19 nt, Homo sapiens
guaugaggcuuuagucacu

SEQ ID NO: 1002252 - RNA, 19 nt, Homo sapiens
cagcuguugucaucacuga

SEQ ID NO: 1002253 - RNA, 19 nt, Homo sapiens
acugugacauuagguauuu

SEQ ID NO: 1002254 - RNA, 19 nt, Homo sapiens
ccgguaaucugcaccuaug

SEQ ID NO: 1002255 - RNA, 19 nt, Homo sapiens
ggcagaggauuacgucagu

SEQ ID NO: 1002256 - RNA, 19 nt, Homo sapiens
ugccaaaucuacuuaugug

SEQ ID NO: 1002257 - RNA, 19 nt, Homo sapiens
gggcugccaaaucuacuua

SEQ ID NO: 1002258 - RNA, 19 nt, Homo sapiens
ggacugugacauuagguau

SEQ ID NO: 1002259 - RNA, 19 nt, Homo sapiens
uuugaaacauccagcaaga

SEQ ID NO: 1002260 - RNA, 19 nt, Homo sapiens
gcuuuagucacuucucuuu

SEQ ID NO: 1002261 - RNA, 19 nt, Homo sapiens
gcugccaaaucuacuuaug

SEQ ID NO: 1002262 - RNA, 19 nt, Homo sapiens
gcaagacaggccagagugu

SEQ ID NO: 1002263 - RNA, 19 nt, Homo sapiens
ccaggacuaugcagacagu

SEQ ID NO: 1002264 - RNA, 19 nt, Homo sapiens
ugaaacauccagcaagaca

SEQ ID NO: 1002265 - RNA, 19 nt, Homo sapiens
gagaccggacugugacauu

SEQ ID NO: 1002266 - RNA, 19 nt, Homo sapiens
ggacaagggcguggaucug

SEQ ID NO: 1002267 - RNA, 19 nt, Homo sapiens
acagacagcagcagcuuug

SEQ ID NO: 1002268 - RNA, 19 nt, Homo sapiens
uaugaggccaugaguagaa

SEQ ID NO: 1002269 - RNA, 19 nt, Homo sapiens
uuaaaggaauuccccguaa

SEQ ID NO: 1002270 - RNA, 19 nt, Homo sapiens
agucacuucucuuuacaga

SEQ ID NO: 1002271 - RNA, 19 nt, Homo sapiens
uuuagucacuucucuuuac

SEQ ID NO: 1002272 - RNA, 19 nt, Homo sapiens
gucugcagauuauuuaagu

SEQ ID NO: 1002273 - RNA, 19 nt, Homo sapiens
gugaccugcuggaagaaga

SEQ ID NO: 1002274 - RNA, 19 nt, Homo sapiens
ggagggcugccaaaucuac

SEQ ID NO: 1002275 - RNA, 19 nt, Homo sapiens
cgucugcuaugaccucaca

SEQ ID NO: 1002276 - RNA, 19 nt, Homo sapiens
cuacgugcacgaccgcuuu

SEQ ID NO: 1002277 - RNA, 19 nt, Homo sapiens
gagcggagaucgggguuug

SEQ ID NO: 1002278 - RNA, 19 nt, Homo sapiens
uaucagaacgugagugcau

SEQ ID NO: 1002279 - RNA, 19 nt, Homo sapiens
acuugugucugcagauuau

SEQ ID NO: 1002280 - RNA, 19 nt, Homo sapiens
gaggagggauaaggcugau

SEQ ID NO: 1002281 - RNA, 19 nt, Homo sapiens
ccagaaaguggcagaggau

SEQ ID NO: 1002282 - RNA, 19 nt, Homo sapiens
caagagugaccugcuggaa

SEQ ID NO: 1002283 - RNA, 19 nt, Homo sapiens
ugugucugcagauuauuua

SEQ ID NO: 1002284 - RNA, 19 nt, Homo sapiens
ggacgucaagguggugaug

SEQ ID NO: 1002285 - RNA, 19 nt, Homo sapiens
uaucuaauucucagguaug

SEQ ID NO: 1002286 - RNA, 19 nt, Homo sapiens
aggcugccaucgucugcua

SEQ ID NO: 1002287 - RNA, 19 nt, Homo sapiens
cgcgcugucuggagucgua

SEQ ID NO: 1002288 - RNA, 19 nt, Homo sapiens
ggucuucgaaggauaaucg

SEQ ID NO: 1002289 - RNA, 19 nt, Homo sapiens
cuacagcuguugucaucac

SEQ ID NO: 1002290 - RNA, 19 nt, Homo sapiens
cagccagaacggagcuuaa

SEQ ID NO: 1002291 - RNA, 19 nt, Homo sapiens
cagcaagacaggccagagu

SEQ ID NO: 1002292 - RNA, 19 nt, Homo sapiens
uuagucacuucucuuuaca

SEQ ID NO: 1002293 - RNA, 19 nt, Homo sapiens
agggcaaggugcucuagga

SEQ ID NO: 1002294 - RNA, 19 nt, Homo sapiens
gacugugacauuagguauu

SEQ ID NO: 1002295 - RNA, 19 nt, Homo sapiens
uuaaguggcuuuugaucug

SEQ ID NO: 1002296 - RNA, 19 nt, Homo sapiens
gagggauaaggcugauuug

SEQ ID NO: 1002297 - RNA, 19 nt, Homo sapiens
uauguggcaccaagaguga

SEQ ID NO: 1002298 - RNA, 19 nt, Homo sapiens
guacuaccaucuugauuaa

SEQ ID NO: 1002299 - RNA, 19 nt, Homo sapiens
ggaagaacaucgagaagga

SEQ ID NO: 1002300 - RNA, 19 nt, Homo sapiens
gaaauaaucuccacguacu

SEQ ID NO: 1002301 - RNA, 19 nt, Homo sapiens
ggcaagacauguauuuaaa

SEQ ID NO: 1002302 - RNA, 19 nt, Homo sapiens
acagaaagcugcaagaaug

SEQ ID NO: 1002303 - RNA, 19 nt, Homo sapiens
gaagaggauuaaugauuga

SEQ ID NO: 1002304 - RNA, 19 nt, Homo sapiens
ugaagaggauuaaugauug

SEQ ID NO: 1002305 - RNA, 19 nt, Homo sapiens
ggaccaacauccaagagaa

SEQ ID NO: 1002306 - RNA, 19 nt, Homo sapiens
gcccauaucugcuuaguca

SEQ ID NO: 1002307 - RNA, 19 nt, Homo sapiens
gcuagggauugucaaauaa

SEQ ID NO: 1002308 - RNA, 19 nt, Homo sapiens
gaggguaacuuaaaucagu

SEQ ID NO: 1002309 - RNA, 19 nt, Homo sapiens
ugaguuaucuguaguacuu

SEQ ID NO: 1002310 - RNA, 19 nt, Homo sapiens
gcagugggauaguguggua

SEQ ID NO: 1002311 - RNA, 19 nt, Homo sapiens
gaacagcucagccaguuga

SEQ ID NO: 1002312 - RNA, 19 nt, Homo sapiens
ggaucgagcuuucuaugga

SEQ ID NO: 1002313 - RNA, 19 nt, Homo sapiens
gaaugaguaugucaagaug

SEQ ID NO: 1002314 - RNA, 19 nt, Homo sapiens
ugacagggauggaagagaa

SEQ ID NO: 1002315 - RNA, 19 nt, Homo sapiens
guaugugauuugcuuguua

SEQ ID NO: 1002316 - RNA, 19 nt, Homo sapiens
ccaugaagcucgugaggaa

SEQ ID NO: 1002317 - RNA, 19 nt, Homo sapiens
guuguuagcauuagucaua

SEQ ID NO: 1002318 - RNA, 19 nt, Homo sapiens
auacagggauuucuuaugu

SEQ ID NO: 1002319 - RNA, 19 nt, Homo sapiens
gggaacagcucagccaguu

SEQ ID NO: 1002320 - RNA, 19 nt, Homo sapiens
ggaauuaugaguuaucugu

SEQ ID NO: 1002321 - RNA, 19 nt, Homo sapiens
guccaaauuucuucaggua

SEQ ID NO: 1002322 - RNA, 19 nt, Homo sapiens
gagaaugcaggcaccguua

SEQ ID NO: 1002323 - RNA, 19 nt, Homo sapiens
gaagcaagcguguuuccuu

SEQ ID NO: 1002324 - RNA, 19 nt, Homo sapiens
ugauuuagaggguaacuua

SEQ ID NO: 1002325 - RNA, 19 nt, Homo sapiens
acacggagccgguauguga

SEQ ID NO: 1002326 - RNA, 19 nt, Homo sapiens
ggaccuccuugguuccuuu

SEQ ID NO: 1002327 - RNA, 19 nt, Homo sapiens
uaaagacgaugccuaugca

SEQ ID NO: 1002328 - RNA, 19 nt, Homo sapiens
ccaaauuucuucagguaca

SEQ ID NO: 1002329 - RNA, 19 nt, Homo sapiens
gcugcuggcuccucacuga

SEQ ID NO: 1002330 - RNA, 19 nt, Homo sapiens
gagaaugaguaugucaaga

SEQ ID NO: 1002331 - RNA, 19 nt, Homo sapiens
cguacuaccaucuugauua

SEQ ID NO: 1002332 - RNA, 19 nt, Homo sapiens
guuaggauauucucuaguc

SEQ ID NO: 1002333 - RNA, 19 nt, Homo sapiens
acaacaaacugcucuugga

SEQ ID NO: 1002334 - RNA, 19 nt, Homo sapiens
ccuaugcaguauauuguuu

SEQ ID NO: 1002335 - RNA, 19 nt, Homo sapiens
caacaaacugcucuuggaa

SEQ ID NO: 1002336 - RNA, 19 nt, Homo sapiens
gaaguugaaguuuggcauu

SEQ ID NO: 1002337 - RNA, 19 nt, Homo sapiens
gugauuugcuuguuaugug

SEQ ID NO: 1002338 - RNA, 19 nt, Homo sapiens
ugcuagggauugucaaaua

SEQ ID NO: 1002339 - RNA, 19 nt, Homo sapiens
ggacagagccugggaagcu

SEQ ID NO: 1002340 - RNA, 19 nt, Homo sapiens
guucugcgacuacauguuu

SEQ ID NO: 1002341 - RNA, 19 nt, Homo sapiens
cggagcgccucacagcuua

SEQ ID NO: 1002342 - RNA, 19 nt, Homo sapiens
guugaaguuuggcauuaaa

SEQ ID NO: 1002343 - RNA, 19 nt, Homo sapiens
gcaggcaccguuaggauau

SEQ ID NO: 1002344 - RNA, 19 nt, Homo sapiens
ccauggcaauugacacauu

SEQ ID NO: 1002345 - RNA, 19 nt, Homo sapiens
gggccaagguggaggugaa

SEQ ID NO: 1002346 - RNA, 19 nt, Homo sapiens
uuaaaugauugccguacaa

SEQ ID NO: 1002347 - RNA, 19 nt, Homo sapiens
agggauuucuuaugucuuu

SEQ ID NO: 1002348 - RNA, 19 nt, Homo sapiens
uuaguagacuugaagacaa

SEQ ID NO: 1002349 - RNA, 19 nt, Homo sapiens
uggcaagacauguauuuaa

SEQ ID NO: 1002350 - RNA, 19 nt, Homo sapiens
ucaaagccuuggaugacuu

SEQ ID NO: 1002351 - RNA, 19 nt, Homo sapiens
ggaaaaccgguccaaauuu

SEQ ID NO: 1002352 - RNA, 19 nt, Homo sapiens
gaggugaacaucccuagga

SEQ ID NO: 1002353 - RNA, 19 nt, Homo sapiens
gcaucgagcaggccuguga

SEQ ID NO: 1002354 - RNA, 19 nt, Homo sapiens
gaacaucgagaaggacaau

SEQ ID NO: 1002355 - RNA, 19 nt, Homo sapiens
aaguugaaguuuggcauua

SEQ ID NO: 1002356 - RNA, 19 nt, Homo sapiens
ggaagcugccagugagauu

SEQ ID NO: 1002357 - RNA, 19 nt, Homo sapiens
agacgaugccuaugcagua

SEQ ID NO: 1002358 - RNA, 19 nt, Homo sapiens
gaagcugccagugagauuu

SEQ ID NO: 1002359 - RNA, 19 nt, Homo sapiens
cuuaggaaguugaaguuug

SEQ ID NO: 1002360 - RNA, 19 nt, Homo sapiens
uuagaacuuugaucugcua

SEQ ID NO: 1002361 - RNA, 19 nt, Homo sapiens
gggauagauugcaaaauuu

SEQ ID NO: 1002362 - RNA, 19 nt, Homo sapiens
gagcgcauuuagaggcauu

SEQ ID NO: 1002363 - RNA, 19 nt, Homo sapiens
caaugaagccauggcaauu

SEQ ID NO: 1002364 - RNA, 19 nt, Homo sapiens
acacaaguacucccugaaa

SEQ ID NO: 1002365 - RNA, 19 nt, Homo sapiens
gaagaccgacaacaaacug

SEQ ID NO: 1002366 - RNA, 19 nt, Homo sapiens
ugggauagauugcaaaauu

SEQ ID NO: 1002367 - RNA, 19 nt, Homo sapiens
gacgaugccuaugcaguau

SEQ ID NO: 1002368 - RNA, 19 nt, Homo sapiens
gaucacccucucaaugaaa

SEQ ID NO: 1002369 - RNA, 19 nt, Homo sapiens
gacagaaagcugcaagaau

SEQ ID NO: 1002370 - RNA, 19 nt, Homo sapiens
gaggauuaaugauugaaac

SEQ ID NO: 1002371 - RNA, 19 nt, Homo sapiens
cugaagaggauuaaugauu

SEQ ID NO: 1002372 - RNA, 19 nt, Homo sapiens
aggaaggccucgcccauau

SEQ ID NO: 1002373 - RNA, 19 nt, Homo sapiens
cgaugccuaugcaguauau

SEQ ID NO: 1002374 - RNA, 19 nt, Homo sapiens
gccaagaagcagugggaua

SEQ ID NO: 1002375 - RNA, 19 nt, Homo sapiens
ucaaaggcuuguuaaacca

SEQ ID NO: 1002376 - RNA, 19 nt, Homo sapiens
uguaguacuuggaaacaga

SEQ ID NO: 1002377 - RNA, 19 nt, Homo sapiens
aggaaauaaucuccacgua

SEQ ID NO: 1002378 - RNA, 19 nt, Homo sapiens
ucucuagucuucacguuuc

SEQ ID NO: 1002379 - RNA, 19 nt, Homo sapiens
ccaagaagcagugggauag

SEQ ID NO: 1002380 - RNA, 19 nt, Homo sapiens
ccuugaggcaucuuuauuu

SEQ ID NO: 1002381 - RNA, 19 nt, Homo sapiens
gugauuggcaagacaugua

SEQ ID NO: 1002382 - RNA, 19 nt, Homo sapiens
ccaguucugaagaggauua

SEQ ID NO: 1002383 - RNA, 19 nt, Homo sapiens
gauauucucuagucuucac

SEQ ID NO: 1002384 - RNA, 19 nt, Homo sapiens
ccaaugaagccauggcaau

SEQ ID NO: 1002385 - RNA, 19 nt, Homo sapiens
cuacagcccguggacuuua

SEQ ID NO: 1002386 - RNA, 19 nt, Homo sapiens
cacacugcaugcuuugaaa

SEQ ID NO: 1002387 - RNA, 19 nt, Homo sapiens
uuaggaaguugaaguuugg

SEQ ID NO: 1002388 - RNA, 19 nt, Homo sapiens
ugacagaaagcugcaagaa

SEQ ID NO: 1002389 - RNA, 19 nt, Homo sapiens
guucugaagaggauuaaug

SEQ ID NO: 1002390 - RNA, 19 nt, Homo sapiens
ggaaaggcaauugcucuca

SEQ ID NO: 1002391 - RNA, 19 nt, Homo sapiens
cgaggagccugaggacaug

SEQ ID NO: 1002392 - RNA, 19 nt, Homo sapiens
ugaggaagaacaucgagaa

SEQ ID NO: 1002393 - RNA, 19 nt, Homo sapiens
ggauggaagagaaaacuua

SEQ ID NO: 1002394 - RNA, 19 nt, Homo sapiens
cgaacuuucugaccaagag

SEQ ID NO: 1002395 - RNA, 19 nt, Homo sapiens
acaaguacucccugaaaga

SEQ ID NO: 1002396 - RNA, 19 nt, Homo sapiens
caggaaggccucgcccaua

SEQ ID NO: 1002397 - RNA, 19 nt, Homo sapiens
ccuuggagcgguucuauga

SEQ ID NO: 1002398 - RNA, 19 nt, Homo sapiens
gaaccaaaccugucucuua

SEQ ID NO: 1002399 - RNA, 19 nt, Homo sapiens
gaaaggaacuggcuaucuu

SEQ ID NO: 1002400 - RNA, 19 nt, Homo sapiens
gaucaucugucuuugguua

SEQ ID NO: 1002401 - RNA, 19 nt, Homo sapiens
gaagaacaauugucucuau

SEQ ID NO: 1002402 - RNA, 19 nt, Homo sapiens
gggaaucucuuaguuauaa

SEQ ID NO: 1002403 - RNA, 19 nt, Homo sapiens
gcaaggaaacucaacuuua

SEQ ID NO: 1002404 - RNA, 19 nt, Homo sapiens
uauauuagcuguacuccua

SEQ ID NO: 1002405 - RNA, 19 nt, Homo sapiens
gaaagucucccauaaaugu

SEQ ID NO: 1002406 - RNA, 19 nt, Homo sapiens
uggcauaccuggauacaua

SEQ ID NO: 1002407 - RNA, 19 nt, Homo sapiens
gcagacgguugcaauuaua

SEQ ID NO: 1002408 - RNA, 19 nt, Homo sapiens
caaugcagcuuucuauauu

SEQ ID NO: 1002409 - RNA, 19 nt, Homo sapiens
caaggaaacucaacuuuag

SEQ ID NO: 1002410 - RNA, 19 nt, Homo sapiens
ggauacauauuacuucuga

SEQ ID NO: 1002411 - RNA, 19 nt, Homo sapiens
gaacacugcucauugcaau

SEQ ID NO: 1002412 - RNA, 19 nt, Homo sapiens
gaagaaagaggaaagagaa

SEQ ID NO: 1002413 - RNA, 19 nt, Homo sapiens
gaacaauggugucuacaag

SEQ ID NO: 1002414 - RNA, 19 nt, Homo sapiens
ccaaagaguuuaccaagau

SEQ ID NO: 1002415 - RNA, 19 nt, Homo sapiens
ugacuaugguuguaaagua

SEQ ID NO: 1002416 - RNA, 19 nt, Homo sapiens
caucacauccuauacuuua

SEQ ID NO: 1002417 - RNA, 19 nt, Homo sapiens
auuaauagcucuccuacua

SEQ ID NO: 1002418 - RNA, 19 nt, Homo sapiens
uuaccaagaucccaaagua

SEQ ID NO: 1002419 - RNA, 19 nt, Homo sapiens
gaauaucccuccucagaag

SEQ ID NO: 1002420 - RNA, 19 nt, Homo sapiens
gcaaauacugcuaacaauu

SEQ ID NO: 1002421 - RNA, 19 nt, Homo sapiens
gacacuagcucuuccaugu

SEQ ID NO: 1002422 - RNA, 19 nt, Homo sapiens
ucugagaaauccaaguuua

SEQ ID NO: 1002423 - RNA, 19 nt, Homo sapiens
ucuaauagcaggaaucaua

SEQ ID NO: 1002424 - RNA, 19 nt, Homo sapiens
gacuaugguuguaaaguaa

SEQ ID NO: 1002425 - RNA, 19 nt, Homo sapiens
gaccaugcccuucaucuuu

SEQ ID NO: 1002426 - RNA, 19 nt, Homo sapiens
ggaagaugcagaugauaaa

SEQ ID NO: 1002427 - RNA, 19 nt, Homo sapiens
aaucuuugguuuccuguua

SEQ ID NO: 1002428 - RNA, 19 nt, Homo sapiens
ggaacuggcuaucuuugau

SEQ ID NO: 1002429 - RNA, 19 nt, Homo sapiens
uguaaugugucuagaguaa

SEQ ID NO: 1002430 - RNA, 19 nt, Homo sapiens
uagaggaucaugcagauua

SEQ ID NO: 1002431 - RNA, 19 nt, Homo sapiens
ccaaaccugucucuuauca

SEQ ID NO: 1002432 - RNA, 19 nt, Homo sapiens
ucauggagcaguacaaaua

SEQ ID NO: 1002433 - RNA, 19 nt, Homo sapiens
ggaauguguuuauaaugga

SEQ ID NO: 1002434 - RNA, 19 nt, Homo sapiens
cuagaucacauaaccauua

SEQ ID NO: 1002435 - RNA, 19 nt, Homo sapiens
agccacagcuuaagucuuu

SEQ ID NO: 1002436 - RNA, 19 nt, Homo sapiens
gaacccaugugcggugaaa

SEQ ID NO: 1002437 - RNA, 19 nt, Homo sapiens
gcacugggcugugaaaauu

SEQ ID NO: 1002438 - RNA, 19 nt, Homo sapiens
gcaggaaucauaagucuuc

SEQ ID NO: 1002439 - RNA, 19 nt, Homo sapiens
aaaccugucucuuaucaug

SEQ ID NO: 1002440 - RNA, 19 nt, Homo sapiens
ggaagaaagaggaaagaga

SEQ ID NO: 1002441 - RNA, 19 nt, Homo sapiens
cagaauaucccuccucaga

SEQ ID NO: 1002442 - RNA, 19 nt, Homo sapiens
uaauggaaauggcaagaga

SEQ ID NO: 1002443 - RNA, 19 nt, Homo sapiens
ggaaucauaagucuucuug

SEQ ID NO: 1002444 - RNA, 19 nt, Homo sapiens
caaaauugcuguggaguuu

SEQ ID NO: 1002445 - RNA, 19 nt, Homo sapiens
cugaaagucucccauaaau

SEQ ID NO: 1002446 - RNA, 19 nt, Homo sapiens
gaacauggagaggaagauu

SEQ ID NO: 1002447 - RNA, 19 nt, Homo sapiens
gcaaauguucagagacaaa

SEQ ID NO: 1002448 - RNA, 19 nt, Homo sapiens
aaccaaaccugucucuuau

SEQ ID NO: 1002449 - RNA, 19 nt, Homo sapiens
gcaauuauaggaccaaucu

SEQ ID NO: 1002450 - RNA, 19 nt, Homo sapiens
ggagaggaagauuucauuu

SEQ ID NO: 1002451 - RNA, 19 nt, Homo sapiens
ugucacacaugguuauauu

SEQ ID NO: 1002452 - RNA, 19 nt, Homo sapiens
gcucuccuacuauuaauuu

SEQ ID NO: 1002453 - RNA, 19 nt, Homo sapiens
ucccauagcugucuucauc

SEQ ID NO: 1002454 - RNA, 19 nt, Homo sapiens
gcuuugugcucauugauau

SEQ ID NO: 1002455 - RNA, 19 nt, Homo sapiens
ggaauugcagcuucuaaau

SEQ ID NO: 1002456 - RNA, 19 nt, Homo sapiens
caauuaccaguuucaguua

SEQ ID NO: 1002457 - RNA, 19 nt, Homo sapiens
caagagagaaagaacaaug

SEQ ID NO: 1002458 - RNA, 19 nt, Homo sapiens
aaacucccauucagccuuu

SEQ ID NO: 1002459 - RNA, 19 nt, Homo sapiens
ucaauuaccaguuucaguu

SEQ ID NO: 1002460 - RNA, 19 nt, Homo sapiens
gucaaggaauguguuuaua

SEQ ID NO: 1002461 - RNA, 19 nt, Homo sapiens
uggguuccuucaaguauua

SEQ ID NO: 1002462 - RNA, 19 nt, Homo sapiens
gaaagaacaauggugucua

SEQ ID NO: 1002463 - RNA, 19 nt, Homo sapiens
gugccaaacuauauguuga

SEQ ID NO: 1002464 - RNA, 19 nt, Homo sapiens
gauauucuccuuccuccaa

SEQ ID NO: 1002465 - RNA, 19 nt, Homo sapiens
ggagcaggguguguaauca

SEQ ID NO: 1002466 - RNA, 19 nt, Homo sapiens
ugaaauugggaaucucuua

SEQ ID NO: 1002467 - RNA, 19 nt, Homo sapiens
gagagaagguuugauaucc

SEQ ID NO: 1002468 - RNA, 19 nt, Homo sapiens
caaagaaaauauccaguug

SEQ ID NO: 1002469 - RNA, 19 nt, Homo sapiens
ggacacuucauccaaagaa

SEQ ID NO: 1002470 - RNA, 19 nt, Homo sapiens
gcagcaguauggacaguca

SEQ ID NO: 1002471 - RNA, 19 nt, Homo sapiens
gagaggauucuaauucuuc

SEQ ID NO: 1002472 - RNA, 19 nt, Homo sapiens
auagagagaagguuugaua

SEQ ID NO: 1002473 - RNA, 19 nt, Homo sapiens
agaaauguguagcagcaaa

SEQ ID NO: 1002474 - RNA, 19 nt, Homo sapiens
ggaaguagaggaucaugca

SEQ ID NO: 1002475 - RNA, 19 nt, Homo sapiens
uaaaagauguggaaguaga

SEQ ID NO: 1002476 - RNA, 19 nt, Homo sapiens
ucacacagacuaccaaaca

SEQ ID NO: 1002477 - RNA, 19 nt, Homo sapiens
gacaaugcagcuuucuaua

SEQ ID NO: 1002478 - RNA, 19 nt, Homo sapiens
gguuugauaucccuucuuc

SEQ ID NO: 1002479 - RNA, 19 nt, Homo sapiens
gcaacuuccuacuuauaca

SEQ ID NO: 1002480 - RNA, 19 nt, Homo sapiens
aaagaacaauggugucuac

SEQ ID NO: 1002481 - RNA, 19 nt, Homo sapiens
uuaccucaguuuccucuuu

SEQ ID NO: 1002482 - RNA, 19 nt, Homo sapiens
gaauugcagcuucuaaauc

SEQ ID NO: 1002483 - RNA, 19 nt, Homo sapiens
gggaucaucugucuuuggu

SEQ ID NO: 1002484 - RNA, 19 nt, Homo sapiens
gcaguggcccuuggaauau

SEQ ID NO: 1002485 - RNA, 19 nt, Homo sapiens
ucaguucaauucucuguuc

SEQ ID NO: 1002486 - RNA, 19 nt, Homo sapiens
uugccuaccuggaugauuu

SEQ ID NO: 1002487 - RNA, 19 nt, Homo sapiens
ggauggagcagaacaugga

SEQ ID NO: 1002488 - RNA, 19 nt, Homo sapiens
aaucccagcuccaguguau

SEQ ID NO: 1002489 - RNA, 19 nt, Homo sapiens
gaaaauggaaucacauaug

SEQ ID NO: 1002490 - RNA, 19 nt, Homo sapiens
gaaauugggaaucucuuag

SEQ ID NO: 1002491 - RNA, 19 nt, Homo sapiens
guuaacaugcccaauuauu

SEQ ID NO: 1002492 - RNA, 19 nt, Homo sapiens
ggaaacucaacuuuagaaa

SEQ ID NO: 1002493 - RNA, 19 nt, Homo sapiens
acaauggugucuacaagau

SEQ ID NO: 1002494 - RNA, 19 nt, Homo sapiens
caacucaagaugcaaaugu

SEQ ID NO: 1002495 - RNA, 19 nt, Homo sapiens
aaucauaagucuucuugca

SEQ ID NO: 1002496 - RNA, 19 nt, Homo sapiens
ugaagacaaugcagcuuuc

SEQ ID NO: 1002497 - RNA, 19 nt, Homo sapiens
uacaagugaucaucugcua

SEQ ID NO: 1002498 - RNA, 19 nt, Homo sapiens
gcaagaaguuugaggauga

SEQ ID NO: 1002499 - RNA, 19 nt, Homo sapiens
ugauagaccuggacaaaua

SEQ ID NO: 1002500 - RNA, 19 nt, Homo sapiens
caacuaugaucuucuauga

SEQ ID NO: 1002501 - RNA, 19 nt, Homo sapiens
gguaauagauggucuggaa

SEQ ID NO: 1002502 - RNA, 19 nt, Homo sapiens
ggacaaauaacuugacaaa

SEQ ID NO: 1002503 - RNA, 19 nt, Homo sapiens
gugaauaucuuaagcacaa

SEQ ID NO: 1002504 - RNA, 19 nt, Homo sapiens
ugaguggccugauuacaua

SEQ ID NO: 1002505 - RNA, 19 nt, Homo sapiens
uagaugaguuggagaaguu

SEQ ID NO: 1002506 - RNA, 19 nt, Homo sapiens
ggaagaggaggcaacagua

SEQ ID NO: 1002507 - RNA, 19 nt, Homo sapiens
aaaauuaccuucaggcuaa

SEQ ID NO: 1002508 - RNA, 19 nt, Homo sapiens
gcaaguccguauccuggaa

SEQ ID NO: 1002509 - RNA, 19 nt, Homo sapiens
ggugaagcccaaagacuua

SEQ ID NO: 1002510 - RNA, 19 nt, Homo sapiens
caauggaucucaguucuuc

SEQ ID NO: 1002511 - RNA, 19 nt, Homo sapiens
gaagaggaggcaacaguau

SEQ ID NO: 1002512 - RNA, 19 nt, Homo sapiens
ugucagagauugcaucauc

SEQ ID NO: 1002513 - RNA, 19 nt, Homo sapiens
gcacaauguuagagguguu

SEQ ID NO: 1002514 - RNA, 19 nt, Homo sapiens
gaggaugaauacagugaau

SEQ ID NO: 1002515 - RNA, 19 nt, Homo sapiens
gcccaaagaaacuauaauu

SEQ ID NO: 1002516 - RNA, 19 nt, Homo sapiens
ggaugaauacagugaauau

SEQ ID NO: 1002517 - RNA, 19 nt, Homo sapiens
gauagaccuggacaaauaa

SEQ ID NO: 1002518 - RNA, 19 nt, Homo sapiens
caccguauuuggaaaggua

SEQ ID NO: 1002519 - RNA, 19 nt, Homo sapiens
uaacaacggcugugcuaga

SEQ ID NO: 1002520 - RNA, 19 nt, Homo sapiens
gaagcccaaagacuuauuu

SEQ ID NO: 1002521 - RNA, 19 nt, Homo sapiens
uuggagaaguugccaguaa

SEQ ID NO: 1002522 - RNA, 19 nt, Homo sapiens
caagaaguuugaggaugaa

SEQ ID NO: 1002523 - RNA, 19 nt, Homo sapiens
gcuguaagacugagaaauc

SEQ ID NO: 1002524 - RNA, 19 nt, Homo sapiens
gaauuaaaucguaggacaa

SEQ ID NO: 1002525 - RNA, 19 nt, Homo sapiens
gagauugcaucauccuucu

SEQ ID NO: 1002526 - RNA, 19 nt, Homo sapiens
agacauaccgaccucuuaa

SEQ ID NO: 1002527 - RNA, 19 nt, Homo sapiens
ggaucucaguucuucauca

SEQ ID NO: 1002528 - RNA, 19 nt, Homo sapiens
caguaaaugagaagacaua

SEQ ID NO: 1002529 - RNA, 19 nt, Homo sapiens
uggagaaguugccaguaaa

SEQ ID NO: 1002530 - RNA, 19 nt, Homo sapiens
gaaguuugaggaugaauac

SEQ ID NO: 1002531 - RNA, 19 nt, Homo sapiens
caacccauuugcucaguag

SEQ ID NO: 1002532 - RNA, 19 nt, Homo sapiens
agaaguugccaguaaauga

SEQ ID NO: 1002533 - RNA, 19 nt, Homo sapiens
uagauggucuggaaacucu

SEQ ID NO: 1002534 - RNA, 19 nt, Homo sapiens
acagauguaggugauauua

SEQ ID NO: 1002535 - RNA, 19 nt, Homo sapiens
ugaaaccacuaagaggaaa

SEQ ID NO: 1002536 - RNA, 19 nt, Homo sapiens
gaaguugccaguaaaugag

SEQ ID NO: 1002537 - RNA, 19 nt, Homo sapiens
ggagaaguugccaguaaau

SEQ ID NO: 1002538 - RNA, 19 nt, Homo sapiens
uguuagagguguuguaucu

SEQ ID NO: 1002539 - RNA, 19 nt, Homo sapiens
agaggaggcaacaguauuu

SEQ ID NO: 1002540 - RNA, 19 nt, Homo sapiens
uaugauagaccuggacaaa

SEQ ID NO: 1002541 - RNA, 19 nt, Homo sapiens
ccaacccauuugcucagua

SEQ ID NO: 1002542 - RNA, 19 nt, Homo sapiens
auaccgaccucuuaaugau

SEQ ID NO: 1002543 - RNA, 19 nt, Homo sapiens
gcuuuuauccccauucuua

SEQ ID NO: 1002544 - RNA, 19 nt, Homo sapiens
cauaccgaccucuuaauga

SEQ ID NO: 1002545 - RNA, 19 nt, Homo sapiens
gaccuggacaaauaacuug

SEQ ID NO: 1002546 - RNA, 19 nt, Homo sapiens
gccaguaaaugagaagaca

SEQ ID NO: 1002547 - RNA, 19 nt, Homo sapiens
ucacguaguccuuccugaa

SEQ ID NO: 1002548 - RNA, 19 nt, Homo sapiens
gagaaaucacguaguccuu

SEQ ID NO: 1002549 - RNA, 19 nt, Homo sapiens
uaaaugcucagccucaagu

SEQ ID NO: 1002550 - RNA, 19 nt, Homo sapiens
ucauccuucugcuuguuua

SEQ ID NO: 1002551 - RNA, 19 nt, Homo sapiens
caucauccuucugcuuguu

SEQ ID NO: 1002552 - RNA, 19 nt, Homo sapiens
gagaaguugccaguaaaug

SEQ ID NO: 1002553 - RNA, 19 nt, Homo sapiens
gaucucaguucuucaucac

SEQ ID NO: 1002554 - RNA, 19 nt, Homo sapiens
gcaucauccuucugcuugu

SEQ ID NO: 1002555 - RNA, 19 nt, Homo sapiens
guaauagauggucuggaaa

SEQ ID NO: 1002556 - RNA, 19 nt, Homo sapiens
cuucaucaccuauggcaaa

SEQ ID NO: 1002557 - RNA, 19 nt, Homo sapiens
gaauaucuuaagcacaaug

SEQ ID NO: 1002558 - RNA, 19 nt, Homo sapiens
acugagaaaucacguaguc

SEQ ID NO: 1002559 - RNA, 19 nt, Homo sapiens
guacacauuaaggacauaa

SEQ ID NO: 1002560 - RNA, 19 nt, Homo sapiens
ucuggaaacucuagaugag

SEQ ID NO: 1002561 - RNA, 19 nt, Homo sapiens
guaucuauggcuaauaaug

SEQ ID NO: 1002562 - RNA, 19 nt, Homo sapiens
guuugaggaugaauacagu

SEQ ID NO: 1002563 - RNA, 19 nt, Homo sapiens
agaaguuugaggaugaaua

SEQ ID NO: 1002564 - RNA, 19 nt, Homo sapiens
cagauguaggugauauuaa

SEQ ID NO: 1002565 - RNA, 19 nt, Homo sapiens
guuuacaacuaugaucuuc

SEQ ID NO: 1002566 - RNA, 19 nt, Homo sapiens
cacauuaaggacauaacua

SEQ ID NO: 1002567 - RNA, 19 nt, Homo sapiens
cacguaguccuuccugaaa

SEQ ID NO: 1002568 - RNA, 19 nt, Homo sapiens
caucaccuauggcaaacag

SEQ ID NO: 1002569 - RNA, 19 nt, Homo sapiens
gcuaauaauggcccgaaca

SEQ ID NO: 1002570 - RNA, 19 nt, Homo sapiens
ugacacugcauacagaugu

SEQ ID NO: 1002571 - RNA, 19 nt, Homo sapiens
caacuuccgcuggcccaaa

SEQ ID NO: 1002572 - RNA, 19 nt, Homo sapiens
cccauuugcucaguagcua

SEQ ID NO: 1002573 - RNA, 19 nt, Homo sapiens
gcuggaacacacuuauugu

SEQ ID NO: 1002574 - RNA, 19 nt, Homo sapiens
ggucuggaaacucuagaug

SEQ ID NO: 1002575 - RNA, 19 nt, Homo sapiens
cuguaagacugagaaauca

SEQ ID NO: 1002576 - RNA, 19 nt, Homo sapiens
gaggaggcaacaguauuug

SEQ ID NO: 1002577 - RNA, 19 nt, Homo sapiens
aagaggaggcaacaguauu

SEQ ID NO: 1002578 - RNA, 19 nt, Homo sapiens
uauccuggaaguguuauuu

SEQ ID NO: 1002579 - RNA, 19 nt, Homo sapiens
cuagaugaguuggagaagu

SEQ ID NO: 1002580 - RNA, 19 nt, Homo sapiens
gggcaagaaguuugaggau

SEQ ID NO: 1002581 - RNA, 19 nt, Homo sapiens
ccaauggaucucaguucuu

SEQ ID NO: 1002582 - RNA, 19 nt, Homo sapiens
uaucuauggcuaauaaugg

SEQ ID NO: 1002583 - RNA, 19 nt, Homo sapiens
acauaccgaccucuuaaug

SEQ ID NO: 1002584 - RNA, 19 nt, Homo sapiens
caauguuagagguguugua

SEQ ID NO: 1002585 - RNA, 19 nt, Homo sapiens
gaaggaggugaggcgguaa

SEQ ID NO: 1002586 - RNA, 19 nt, Homo sapiens
gcuggcaucugcgauugca

SEQ ID NO: 1002587 - RNA, 19 nt, Homo sapiens
gacauaccgaccucuuaau

SEQ ID NO: 1002588 - RNA, 19 nt, Homo sapiens
cagccacauuuggacauga

SEQ ID NO: 1002589 - RNA, 19 nt, Homo sapiens
guggccugauuacauauuc

SEQ ID NO: 1002590 - RNA, 19 nt, Homo sapiens
gagcucgcuguaagacuga

SEQ ID NO: 1002591 - RNA, 19 nt, Homo sapiens
uggcaucugcgauugcauu

SEQ ID NO: 1002592 - RNA, 19 nt, Homo sapiens
cugaaaccacuaagaggaa

SEQ ID NO: 1002593 - RNA, 19 nt, Homo sapiens
cggcugugcuagacgaagu

SEQ ID NO: 1002594 - RNA, 19 nt, Homo sapiens
gaaguggugaagcccaaag

SEQ ID NO: 1002595 - RNA, 19 nt, Homo sapiens
gcaagaaguuugaggauga

SEQ ID NO: 1002596 - RNA, 19 nt, Homo sapiens
ugauagaccuggacaaaua

SEQ ID NO: 1002597 - RNA, 19 nt, Homo sapiens
caacuaugaucuucuauga

SEQ ID NO: 1002598 - RNA, 19 nt, Homo sapiens
gguaauagauggucuggaa

SEQ ID NO: 1002599 - RNA, 19 nt, Homo sapiens
ggacaaauaacuugacaaa

SEQ ID NO: 1002600 - RNA, 19 nt, Homo sapiens
gugaauaucuuaagcacaa

SEQ ID NO: 1002601 - RNA, 19 nt, Homo sapiens
ugaguggccugauuacaua

SEQ ID NO: 1002602 - RNA, 19 nt, Homo sapiens
uaucaaggguuucaugguu

SEQ ID NO: 1002603 - RNA, 19 nt, Homo sapiens
uagaugaguuggagaaguu

SEQ ID NO: 1002604 - RNA, 19 nt, Homo sapiens
ggaagaggaggcaacagua

SEQ ID NO: 1002605 - RNA, 19 nt, Homo sapiens
aaaauuaccuucaggcuaa

SEQ ID NO: 1002606 - RNA, 19 nt, Homo sapiens
gcaaguccguauccuggaa

SEQ ID NO: 1002607 - RNA, 19 nt, Homo sapiens
ggugaagcccaaagacuua

SEQ ID NO: 1002608 - RNA, 19 nt, Homo sapiens
caauggaucucaguucuuc

SEQ ID NO: 1002609 - RNA, 19 nt, Homo sapiens
gaagaggaggcaacaguau

SEQ ID NO: 1002610 - RNA, 19 nt, Homo sapiens
ugucagagauugcaucauc

SEQ ID NO: 1002611 - RNA, 19 nt, Homo sapiens
gcacaauguuagagguguu

SEQ ID NO: 1002612 - RNA, 19 nt, Homo sapiens
gaggaugaauacagugaau

SEQ ID NO: 1002613 - RNA, 19 nt, Homo sapiens
ggaugaauacagugaauau

SEQ ID NO: 1002614 - RNA, 19 nt, Homo sapiens
gauagaccuggacaaauaa

SEQ ID NO: 1002615 - RNA, 19 nt, Homo sapiens
caccguauuuggaaaggua

SEQ ID NO: 1002616 - RNA, 19 nt, Homo sapiens
auaggaauaucaaggguuu

SEQ ID NO: 1002617 - RNA, 19 nt, Homo sapiens
uaacaacggcugugcuaga

SEQ ID NO: 1002618 - RNA, 19 nt, Homo sapiens
gaauaucaaggguuucaug

SEQ ID NO: 1002619 - RNA, 19 nt, Homo sapiens
gaagcccaaagacuuauuu

SEQ ID NO: 1002620 - RNA, 19 nt, Homo sapiens
uuggagaaguugccaguaa

SEQ ID NO: 1002621 - RNA, 19 nt, Homo sapiens
caagaaguuugaggaugaa

SEQ ID NO: 1002622 - RNA, 19 nt, Homo sapiens
gcuguaagacugagaaauc

SEQ ID NO: 1002623 - RNA, 19 nt, Homo sapiens
gaauuaaaucguaggacaa

SEQ ID NO: 1002624 - RNA, 19 nt, Homo sapiens
gagauugcaucauccuucu

SEQ ID NO: 1002625 - RNA, 19 nt, Homo sapiens
agacauaccgaccucuuaa

SEQ ID NO: 1002626 - RNA, 19 nt, Homo sapiens
ggaucucaguucuucauca

SEQ ID NO: 1002627 - RNA, 19 nt, Homo sapiens
caguaaaugagaagacaua

SEQ ID NO: 1002628 - RNA, 19 nt, Homo sapiens
uggagaaguugccaguaaa

SEQ ID NO: 1002629 - RNA, 19 nt, Homo sapiens
gaaguuugaggaugaauac

SEQ ID NO: 1002630 - RNA, 19 nt, Homo sapiens
caacccauuugcucaguag

SEQ ID NO: 1002631 - RNA, 19 nt, Homo sapiens
agaaguugccaguaaauga

SEQ ID NO: 1002632 - RNA, 19 nt, Homo sapiens
ggcuguauauuucauagga

SEQ ID NO: 1002633 - RNA, 19 nt, Homo sapiens
uagauggucuggaaacucu

SEQ ID NO: 1002634 - RNA, 19 nt, Homo sapiens
acagauguaggugauauua

SEQ ID NO: 1002635 - RNA, 19 nt, Homo sapiens
ugaaaccacuaagaggaaa

SEQ ID NO: 1002636 - RNA, 19 nt, Homo sapiens
gaaguugccaguaaaugag

SEQ ID NO: 1002637 - RNA, 19 nt, Homo sapiens
ggagaaguugccaguaaau

SEQ ID NO: 1002638 - RNA, 19 nt, Homo sapiens
uguuagagguguuguaucu

SEQ ID NO: 1002639 - RNA, 19 nt, Homo sapiens
agaggaggcaacaguauuu

SEQ ID NO: 1002640 - RNA, 19 nt, Homo sapiens
uaugauagaccuggacaaa

SEQ ID NO: 1002641 - RNA, 19 nt, Homo sapiens
ccaacccauuugcucagua

SEQ ID NO: 1002642 - RNA, 19 nt, Homo sapiens
auaccgaccucuuaaugau

SEQ ID NO: 1002643 - RNA, 19 nt, Homo sapiens
gcuuuuauccccauucuua

SEQ ID NO: 1002644 - RNA, 19 nt, Homo sapiens
caaaacaugugagaauuuc

SEQ ID NO: 1002645 - RNA, 19 nt, Homo sapiens
cauaccgaccucuuaauga

SEQ ID NO: 1002646 - RNA, 19 nt, Homo sapiens
ucaaggguuucaugguuca

SEQ ID NO: 1002647 - RNA, 19 nt, Homo sapiens
gaccuggacaaauaacuug

SEQ ID NO: 1002648 - RNA, 19 nt, Homo sapiens
gccaguaaaugagaagaca

SEQ ID NO: 1002649 - RNA, 19 nt, Homo sapiens
gagaaaucacguaguccuu

SEQ ID NO: 1002650 - RNA, 19 nt, Homo sapiens
ucacguaguccuuccugaa

SEQ ID NO: 1002651 - RNA, 19 nt, Homo sapiens
gcuguauauuucauaggaa

SEQ ID NO: 1002652 - RNA, 19 nt, Homo sapiens
uaaaugcucagccucaagu

SEQ ID NO: 1002653 - RNA, 19 nt, Homo sapiens
ucauccuucugcuuguuua

SEQ ID NO: 1002654 - RNA, 19 nt, Homo sapiens
caucauccuucugcuuguu

SEQ ID NO: 1002655 - RNA, 19 nt, Homo sapiens
gagaaguugccaguaaaug

SEQ ID NO: 1002656 - RNA, 19 nt, Homo sapiens
gaucucaguucuucaucac

SEQ ID NO: 1002657 - RNA, 19 nt, Homo sapiens
ucaaacaggagauccaaca

SEQ ID NO: 1002658 - RNA, 19 nt, Homo sapiens
gcaucauccuucugcuugu

SEQ ID NO: 1002659 - RNA, 19 nt, Homo sapiens
acugagaaaucacguaguc

SEQ ID NO: 1002660 - RNA, 19 nt, Homo sapiens
guaauagauggucuggaaa

SEQ ID NO: 1002661 - RNA, 19 nt, Homo sapiens
cuucaucaccuauggcaaa

SEQ ID NO: 1002662 - RNA, 19 nt, Homo sapiens
gaauaucuuaagcacaaug

SEQ ID NO: 1002663 - RNA, 19 nt, Homo sapiens
guacacauuaaggacauaa

SEQ ID NO: 1002664 - RNA, 19 nt, Homo sapiens
ucuggaaacucuagaugag

SEQ ID NO: 1002665 - RNA, 19 nt, Homo sapiens
guaucuauggcuaauaaug

SEQ ID NO: 1002666 - RNA, 19 nt, Homo sapiens
guuugaggaugaauacagu

SEQ ID NO: 1002667 - RNA, 19 nt, Homo sapiens
agaaguuugaggaugaaua

SEQ ID NO: 1002668 - RNA, 19 nt, Homo sapiens
cagauguaggugauauuaa

SEQ ID NO: 1002669 - RNA, 19 nt, Homo sapiens
gcucuuugugccaguaauu

SEQ ID NO: 1002670 - RNA, 19 nt, Homo sapiens
guuuacaacuaugaucuuc

SEQ ID NO: 1002671 - RNA, 19 nt, Homo sapiens
cacauuaaggacauaacua

SEQ ID NO: 1002672 - RNA, 19 nt, Homo sapiens
cacguaguccuuccugaaa

SEQ ID NO: 1002673 - RNA, 19 nt, Homo sapiens
ugacacugcauacagaugu

SEQ ID NO: 1002674 - RNA, 19 nt, Homo sapiens
gaauuucuuggcucuuugu

SEQ ID NO: 1002675 - RNA, 19 nt, Homo sapiens
caucaccuauggcaaacag

SEQ ID NO: 1002676 - RNA, 19 nt, Homo sapiens
gcuaauaauggcccgaaca

SEQ ID NO: 1002677 - RNA, 19 nt, Homo sapiens
caauggcuguauauuucau

SEQ ID NO: 1002678 - RNA, 19 nt, Homo sapiens
cccauuugcucaguagcua

SEQ ID NO: 1002679 - RNA, 19 nt, Homo sapiens
ccaaaacaugugagaauuu

SEQ ID NO: 1002680 - RNA, 19 nt, Homo sapiens
gcuggaacacacuuauugu

SEQ ID NO: 1002681 - RNA, 19 nt, Homo sapiens
ggucuggaaacucuagaug

SEQ ID NO: 1002682 - RNA, 19 nt, Homo sapiens
gaggaggcaacaguauuug

SEQ ID NO: 1002683 - RNA, 19 nt, Homo sapiens
aagaggaggcaacaguauu

SEQ ID NO: 1002684 - RNA, 19 nt, Homo sapiens
cuguaagacugagaaauca

SEQ ID NO: 1002685 - RNA, 19 nt, Homo sapiens
uauccuggaaguguuauuu

SEQ ID NO: 1002686 - RNA, 19 nt, Homo sapiens
cuagaugaguuggagaagu

SEQ ID NO: 1002687 - RNA, 19 nt, Homo sapiens
gggcaagaaguuugaggau

SEQ ID NO: 1002688 - RNA, 19 nt, Homo sapiens
ccaauggaucucaguucuu

SEQ ID NO: 1002689 - RNA, 19 nt, Homo sapiens
uaucuauggcuaauaaugg

SEQ ID NO: 1002690 - RNA, 19 nt, Homo sapiens
acauaccgaccucuuaaug

SEQ ID NO: 1002691 - RNA, 19 nt, Homo sapiens
caauguuagagguguugua

SEQ ID NO: 1002692 - RNA, 19 nt, Homo sapiens
gcuggcaucugcgauugca

SEQ ID NO: 1002693 - RNA, 19 nt, Homo sapiens
gacauaccgaccucuuaau

SEQ ID NO: 1002694 - RNA, 19 nt, Homo sapiens
cagccacauuuggacauga

SEQ ID NO: 1002695 - RNA, 19 nt, Homo sapiens
gcaagaaguuugaggauga

SEQ ID NO: 1002696 - RNA, 19 nt, Homo sapiens
ugauagaccuggacaaaua

SEQ ID NO: 1002697 - RNA, 19 nt, Homo sapiens
ggaguaacgucauuaauuc

SEQ ID NO: 1002698 - RNA, 19 nt, Homo sapiens
caacuaugaucuucuauga

SEQ ID NO: 1002699 - RNA, 19 nt, Homo sapiens
gguaauagauggucuggaa

SEQ ID NO: 1002700 - RNA, 19 nt, Homo sapiens
ggacaaauaacuugacaaa

SEQ ID NO: 1002701 - RNA, 19 nt, Homo sapiens
gugaauaucuuaagcacaa

SEQ ID NO: 1002702 - RNA, 19 nt, Homo sapiens
ugaguggccugauuacaua

SEQ ID NO: 1002703 - RNA, 19 nt, Homo sapiens
uaucaaggguuucaugguu

SEQ ID NO: 1002704 - RNA, 19 nt, Homo sapiens
uagaugaguuggagaaguu

SEQ ID NO: 1002705 - RNA, 19 nt, Homo sapiens
ggaagaggaggcaacagua

SEQ ID NO: 1002706 - RNA, 19 nt, Homo sapiens
aaaauuaccuucaggcuaa

SEQ ID NO: 1002707 - RNA, 19 nt, Homo sapiens
gcaaguccguauccuggaa

SEQ ID NO: 1002708 - RNA, 19 nt, Homo sapiens
gaugagcgugugugaguua

SEQ ID NO: 1002709 - RNA, 19 nt, Homo sapiens
caauggaucucaguucuuc

SEQ ID NO: 1002710 - RNA, 19 nt, Homo sapiens
gaagaggaggcaacaguau

SEQ ID NO: 1002711 - RNA, 19 nt, Homo sapiens
ugucagagauugcaucauc

SEQ ID NO: 1002712 - RNA, 19 nt, Homo sapiens
gagcgugugugaguuaaga

SEQ ID NO: 1002713 - RNA, 19 nt, Homo sapiens
gcacaauguuagagguguu

SEQ ID NO: 1002714 - RNA, 19 nt, Homo sapiens
gaggaugaauacagugaau

SEQ ID NO: 1002715 - RNA, 19 nt, Homo sapiens
ccaaaguguuaggauuaua

SEQ ID NO: 1002716 - RNA, 19 nt, Homo sapiens
gcccaaagaaacuauaauu

SEQ ID NO: 1002717 - RNA, 19 nt, Homo sapiens
ggaugaauacagugaauau

SEQ ID NO: 1002718 - RNA, 19 nt, Homo sapiens
gauagaccuggacaaauaa

SEQ ID NO: 1002719 - RNA, 19 nt, Homo sapiens
caccguauuuggaaaggua

SEQ ID NO: 1002720 - RNA, 19 nt, Homo sapiens
ccagugcaauuauuaguag

SEQ ID NO: 1002721 - RNA, 19 nt, Homo sapiens
auaggaauaucaaggguuu

SEQ ID NO: 1002722 - RNA, 19 nt, Homo sapiens
uaacaacggcugugcuaga

SEQ ID NO: 1002723 - RNA, 19 nt, Homo sapiens
gaauaucaaggguuucaug

SEQ ID NO: 1002724 - RNA, 19 nt, Homo sapiens
uuggagaaguugccaguaa

SEQ ID NO: 1002725 - RNA, 19 nt, Homo sapiens
caagaaguuugaggaugaa

SEQ ID NO: 1002726 - RNA, 19 nt, Homo sapiens
gcuguaagacugagaaauc

SEQ ID NO: 1002727 - RNA, 19 nt, Homo sapiens
gaauuaaaucguaggacaa

SEQ ID NO: 1002728 - RNA, 19 nt, Homo sapiens
uggaguaacgucauuaauu

SEQ ID NO: 1002729 - RNA, 19 nt, Homo sapiens
cccuuucacugucaaauuu

SEQ ID NO: 1002730 - RNA, 19 nt, Homo sapiens
gagauugcaucauccuucu

SEQ ID NO: 1002731 - RNA, 19 nt, Homo sapiens
agacauaccgaccucuuaa

SEQ ID NO: 1002732 - RNA, 19 nt, Homo sapiens
ggaucucaguucuucauca

SEQ ID NO: 1002733 - RNA, 19 nt, Homo sapiens
caguaaaugagaagacaua

SEQ ID NO: 1002734 - RNA, 19 nt, Homo sapiens
uggagaaguugccaguaaa

SEQ ID NO: 1002735 - RNA, 19 nt, Homo sapiens
gaaguuugaggaugaauac

SEQ ID NO: 1002736 - RNA, 19 nt, Homo sapiens
caacccauuugcucaguag

SEQ ID NO: 1002737 - RNA, 19 nt, Homo sapiens
agaaguugccaguaaauga

SEQ ID NO: 1002738 - RNA, 19 nt, Homo sapiens
ggcuguauauuucauagga

SEQ ID NO: 1002739 - RNA, 19 nt, Homo sapiens
ucccaaaguguuaggauua

SEQ ID NO: 1002740 - RNA, 19 nt, Homo sapiens
gcugaguucuguguugcua

SEQ ID NO: 1002741 - RNA, 19 nt, Homo sapiens
uagauggucuggaaacucu

SEQ ID NO: 1002742 - RNA, 19 nt, Homo sapiens
acagauguaggugauauua

SEQ ID NO: 1002743 - RNA, 19 nt, Homo sapiens
ugaaaccacuaagaggaaa

SEQ ID NO: 1002744 - RNA, 19 nt, Homo sapiens
gaaguugccaguaaaugag

SEQ ID NO: 1002745 - RNA, 19 nt, Homo sapiens
ggagaaguugccaguaaau

SEQ ID NO: 1002746 - RNA, 19 nt, Homo sapiens
uguuagagguguuguaucu

SEQ ID NO: 1002747 - RNA, 19 nt, Homo sapiens
gcuugagguugcccaggua

SEQ ID NO: 1002748 - RNA, 19 nt, Homo sapiens
ugguuuaguucuugggaua

SEQ ID NO: 1002749 - RNA, 19 nt, Homo sapiens
agaggaggcaacaguauuu

SEQ ID NO: 1002750 - RNA, 19 nt, Homo sapiens
gaaaaugagccuaauucuu

SEQ ID NO: 1002751 - RNA, 19 nt, Homo sapiens
caaaguguuaggauuauag

SEQ ID NO: 1002752 - RNA, 19 nt, Homo sapiens
gcuacugguuuaguucuug

SEQ ID NO: 1002753 - RNA, 19 nt, Homo sapiens
uaugauagaccuggacaaa

SEQ ID NO: 1002754 - RNA, 19 nt, Homo sapiens
ccaacccauuugcucagua

SEQ ID NO: 1002755 - RNA, 19 nt, Homo sapiens
auaccgaccucuuaaugau

SEQ ID NO: 1002756 - RNA, 19 nt, Homo sapiens
gagcucccuuucacuguca

SEQ ID NO: 1002757 - RNA, 19 nt, Homo sapiens
uaaagaugagcguguguga

SEQ ID NO: 1002758 - RNA, 19 nt, Homo sapiens
gcuuuuauccccauucuua

SEQ ID NO: 1002759 - RNA, 19 nt, Homo sapiens
gauaaauugcauugucguu

SEQ ID NO: 1002760 - RNA, 19 nt, Homo sapiens
caaaacaugugagaauuuc

SEQ ID NO: 1002761 - RNA, 19 nt, Homo sapiens
cauaccgaccucuuaauga

SEQ ID NO: 1002762 - RNA, 19 nt, Homo sapiens
ucaaggguuucaugguuca

SEQ ID NO: 1002763 - RNA, 19 nt, Homo sapiens
gaagcccaaguauggagua

SEQ ID NO: 1002764 - RNA, 19 nt, Homo sapiens
gaccuggacaaauaacuug

SEQ ID NO: 1002765 - RNA, 19 nt, Homo sapiens
gccaguaaaugagaagaca

SEQ ID NO: 1002766 - RNA, 19 nt, Homo sapiens
gcuguauauuucauaggaa

SEQ ID NO: 1002767 - RNA, 19 nt, Homo sapiens
ucacguaguccuuccugaa

SEQ ID NO: 1002768 - RNA, 19 nt, Homo sapiens
gagaaaucacguaguccuu

SEQ ID NO: 1002769 - RNA, 19 nt, Homo sapiens
cggcgaggcuguuguugca

SEQ ID NO: 1002770 - RNA, 19 nt, Homo sapiens
uaaaugcucagccucaagu

SEQ ID NO: 1002771 - RNA, 19 nt, Homo sapiens
ucauccuucugcuuguuua

SEQ ID NO: 1002772 - RNA, 19 nt, Homo sapiens
gguuugagauaggaagaug

SEQ ID NO: 1002773 - RNA, 19 nt, Homo sapiens
caucauccuucugcuuguu

SEQ ID NO: 1002774 - RNA, 19 nt, Homo sapiens
gagaaguugccaguaaaug

SEQ ID NO: 1002775 - RNA, 19 nt, Homo sapiens
gaucucaguucuucaucac

SEQ ID NO: 1002776 - RNA, 19 nt, Homo sapiens
ucaaacaggagauccaaca

SEQ ID NO: 1002777 - RNA, 19 nt, Homo sapiens
gcaucauccuucugcuugu

SEQ ID NO: 1002778 - RNA, 19 nt, Homo sapiens
gagguugcccagguaguuu

SEQ ID NO: 1002779 - RNA, 19 nt, Homo sapiens
guaauagauggucuggaaa

SEQ ID NO: 1002780 - RNA, 19 nt, Homo sapiens
cuucaucaccuauggcaaa

SEQ ID NO: 1002781 - RNA, 19 nt, Homo sapiens
gaauaucuuaagcacaaug

SEQ ID NO: 1002782 - RNA, 19 nt, Homo sapiens
cccagguaguuucgccuua

SEQ ID NO: 1002783 - RNA, 19 nt, Homo sapiens
acugagaaaucacguaguc

SEQ ID NO: 1002784 - RNA, 19 nt, Homo sapiens
guacacauuaaggacauaa

SEQ ID NO: 1002785 - RNA, 19 nt, Homo sapiens
ucuggaaacucuagaugag

SEQ ID NO: 1002786 - RNA, 19 nt, Homo sapiens
ugucccagugcaauuauua

SEQ ID NO: 1002787 - RNA, 19 nt, Homo sapiens
guaucuauggcuaauaaug

SEQ ID NO: 1002788 - RNA, 19 nt, Homo sapiens
cccaaaguguuaggauuau

SEQ ID NO: 1002789 - RNA, 19 nt, Homo sapiens
ucgaaugcuugcugaguuc

SEQ ID NO: 1002790 - RNA, 19 nt, Homo sapiens
guauggaguaacgucauua

SEQ ID NO: 1002791 - RNA, 19 nt, Homo sapiens
guuugaggaugaauacagu

SEQ ID NO: 1002792 - RNA, 19 nt, Homo sapiens
agaaguuugaggaugaaua

SEQ ID NO: 1002793 - RNA, 19 nt, Homo sapiens
gcucuuugugccaguaauu

SEQ ID NO: 1002794 - RNA, 19 nt, Homo sapiens
cagauguaggugauauuaa

SEQ ID NO: 1002795 - RNA, 19 nt, Homo sapiens
caauaaagguguccauaaa

SEQ ID NO: 1002796 - RNA, 19 nt, Homo sapiens
gcaauaaagguguccauaa

SEQ ID NO: 1002797 - RNA, 19 nt, Homo sapiens
aaaguuaucugguucucaa

SEQ ID NO: 1002798 - RNA, 19 nt, Homo sapiens
gaacuucuuccgcuacuuc

SEQ ID NO: 1002799 - RNA, 19 nt, Homo sapiens
gcaagucaagaccaucaaa

SEQ ID NO: 1002800 - RNA, 19 nt, Homo sapiens
gcauguugcccuuucagaa

SEQ ID NO: 1002801 - RNA, 19 nt, Homo sapiens
cugaguaccuguucgacaa

SEQ ID NO: 1002802 - RNA, 19 nt, Homo sapiens
gagcaagucaagaccauca

SEQ ID NO: 1002803 - RNA, 19 nt, Homo sapiens
ucuauggccuucuacuuca

SEQ ID NO: 1002804 - RNA, 19 nt, Homo sapiens
gagcaaccugcgcaagauu

SEQ ID NO: 1002805 - RNA, 19 nt, Homo sapiens
aaauggagcaugcccagaa

SEQ ID NO: 1002806 - RNA, 19 nt, Homo sapiens
gcaaccugcgcaagauuug

SEQ ID NO: 1002807 - RNA, 19 nt, Homo sapiens
acaucugccuucacgauau

SEQ ID NO: 1002808 - RNA, 19 nt, Homo sapiens
ccacaucugccuucacgau

SEQ ID NO: 1002809 - RNA, 19 nt, Homo sapiens
ugagcaaccugcgcaagau

SEQ ID NO: 1002810 - RNA, 19 nt, Homo sapiens
gugagcaaccugcgcaaga

SEQ ID NO: 1002811 - RNA, 19 nt, Homo sapiens
caucugccuucacgauauc

SEQ ID NO: 1002812 - RNA, 19 nt, Homo sapiens
acaucacgcuggagcucua

SEQ ID NO: 1002813 - RNA, 19 nt, Homo sapiens
aacguucucuucaguuuua

SEQ ID NO: 1002814 - RNA, 19 nt, Homo sapiens
ucacuauccgccauucuug

SEQ ID NO: 1002815 - RNA, 19 nt, Homo sapiens
ccacccgccuuucacuauc

SEQ ID NO: 1002816 - RNA, 19 nt, Homo sapiens
cacaucugccuucacgaua

SEQ ID NO: 1002817 - RNA, 19 nt, Homo sapiens
agagccugcuggaucugua

SEQ ID NO: 1002818 - RNA, 19 nt, Homo sapiens
gucuauggccuucuacuuc

SEQ ID NO: 1002819 - RNA, 19 nt, Homo sapiens
gcgugcauguugcccuuuc

SEQ ID NO: 1002820 - RNA, 19 nt, Homo sapiens
gccaucaacagccacauca

SEQ ID NO: 1002821 - RNA, 19 nt, Homo sapiens
gauaucaggaagccagagu

SEQ ID NO: 1002822 - RNA, 19 nt, Homo sapiens
ugaugaggcugcagaaccu

SEQ ID NO: 1002823 - RNA, 19 nt, Homo sapiens
gaacguucucuucaguuuu

SEQ ID NO: 1002824 - RNA, 19 nt, Homo sapiens
caagucaagaccaucaaag

SEQ ID NO: 1002825 - RNA, 19 nt, Homo sapiens
ggauagaacuuacuccuaa

SEQ ID NO: 1002826 - RNA, 19 nt, Homo sapiens
ggaugaagguuaaugguua

SEQ ID NO: 1002827 - RNA, 19 nt, Homo sapiens
gaaagugucccuccucuua

SEQ ID NO: 1002828 - RNA, 19 nt, Homo sapiens
gauggcaccuucauuauaa

SEQ ID NO: 1002829 - RNA, 19 nt, Homo sapiens
gcagggcacucuuuaauga

SEQ ID NO: 1002830 - RNA, 19 nt, Homo sapiens
gcaauccaguucccaguua

SEQ ID NO: 1002831 - RNA, 19 nt, Homo sapiens
gagaaagcauuguccuuaa

SEQ ID NO: 1002832 - RNA, 19 nt, Homo sapiens
gccaguaucugaagaguuu

SEQ ID NO: 1002833 - RNA, 19 nt, Homo sapiens
ggagaaagcauuguccuua

SEQ ID NO: 1002834 - RNA, 19 nt, Homo sapiens
ggaaauacguuauaucacu

SEQ ID NO: 1002835 - RNA, 19 nt, Homo sapiens
ucacauggaugaagguuaa

SEQ ID NO: 1002836 - RNA, 19 nt, Homo sapiens
aaauagaucuggaaaguga

SEQ ID NO: 1002837 - RNA, 19 nt, Homo sapiens
ucagugaugugguccauua

SEQ ID NO: 1002838 - RNA, 19 nt, Homo sapiens
cagcaaggcucucagguuu

SEQ ID NO: 1002839 - RNA, 19 nt, Homo sapiens
gggcagcucagaauuauua

SEQ ID NO: 1002840 - RNA, 19 nt, Homo sapiens
gaaaacugcugacuuaauu

SEQ ID NO: 1002841 - RNA, 19 nt, Homo sapiens
gcaagaaccagaugauauu

SEQ ID NO: 1002842 - RNA, 19 nt, Homo sapiens
acagcuaguucucaaauua

SEQ ID NO: 1002843 - RNA, 19 nt, Homo sapiens
gauuaucgcuacaguuuga

SEQ ID NO: 1002844 - RNA, 19 nt, Homo sapiens
ugaauagaguguaguguaa

SEQ ID NO: 1002845 - RNA, 19 nt, Homo sapiens
gauaguaauuguugaggaa

SEQ ID NO: 1002846 - RNA, 19 nt, Homo sapiens
ggugaaaacugcugacuua

SEQ ID NO: 1002847 - RNA, 19 nt, Homo sapiens
gauguuggcagcuauauuu

SEQ ID NO: 1002848 - RNA, 19 nt, Homo sapiens
gaaaggagacagagcaguu

SEQ ID NO: 1002849 - RNA, 19 nt, Homo sapiens
gauccuaaaugcuuccaaa

SEQ ID NO: 1002850 - RNA, 19 nt, Homo sapiens
uaacagcggugaauagagu

SEQ ID NO: 1002851 - RNA, 19 nt, Homo sapiens
aaucugaaguuguggguua

SEQ ID NO: 1002852 - RNA, 19 nt, Homo sapiens
gugaugugguccauuauaa

SEQ ID NO: 1002853 - RNA, 19 nt, Homo sapiens
gcuggagucuauauuauug

SEQ ID NO: 1002854 - RNA, 19 nt, Homo sapiens
ccuaaaugcuuccaaauca

SEQ ID NO: 1002855 - RNA, 19 nt, Homo sapiens
gcaaaggauucuggucauu

SEQ ID NO: 1002856 - RNA, 19 nt, Homo sapiens
uaaagagagucuaggaaga

SEQ ID NO: 1002857 - RNA, 19 nt, Homo sapiens
cgaaugauccgcacaaaug

SEQ ID NO: 1002858 - RNA, 19 nt, Homo sapiens
gaaagcauuguccuuaauu

SEQ ID NO: 1002859 - RNA, 19 nt, Homo sapiens
gguuacagcugcuaaagga

SEQ ID NO: 1002860 - RNA, 19 nt, Homo sapiens
gaagaaggcaugaguuagu

SEQ ID NO: 1002861 - RNA, 19 nt, Homo sapiens
cagcagcccuucauuagga

SEQ ID NO: 1002862 - RNA, 19 nt, Homo sapiens
ccaugugucuuucagagua

SEQ ID NO: 1002863 - RNA, 19 nt, Homo sapiens
ggaagaggguggacauuuu

SEQ ID NO: 1002864 - RNA, 19 nt, Homo sapiens
caaaggauucuggucauua

SEQ ID NO: 1002865 - RNA, 19 nt, Homo sapiens
gcugcuuuguuaagaauua

SEQ ID NO: 1002866 - RNA, 19 nt, Homo sapiens
uaacuggccuuuagcagau

SEQ ID NO: 1002867 - RNA, 19 nt, Homo sapiens
uuaaguaacuggccuuuag

SEQ ID NO: 1002868 - RNA, 19 nt, Homo sapiens
gaugcuggagucuauauua

SEQ ID NO: 1002869 - RNA, 19 nt, Homo sapiens
acagaaacuucaagcagua

SEQ ID NO: 1002870 - RNA, 19 nt, Homo sapiens
acacguggcuggaaggaaa

SEQ ID NO: 1002871 - RNA, 19 nt, Homo sapiens
guaaagacagucccagaaa

SEQ ID NO: 1002872 - RNA, 19 nt, Homo sapiens
gauagaacuuacuccuaaa

SEQ ID NO: 1002873 - RNA, 19 nt, Homo sapiens
ucaaucagaugcuggaaug

SEQ ID NO: 1002874 - RNA, 19 nt, Homo sapiens
agaaauagaucuggaaagu

SEQ ID NO: 1002875 - RNA, 19 nt, Homo sapiens
gaagguagcauugaauugu

SEQ ID NO: 1002876 - RNA, 19 nt, Homo sapiens
gaugguuaauggaguauug

SEQ ID NO: 1002877 - RNA, 19 nt, Homo sapiens
uaaagacagucccagaaau

SEQ ID NO: 1002878 - RNA, 19 nt, Homo sapiens
ccaagaaguugucauagag

SEQ ID NO: 1002879 - RNA, 19 nt, Homo sapiens
gugcugagcugaagauucu

SEQ ID NO: 1002880 - RNA, 19 nt, Homo sapiens
gaaauggaacagaaauaga

SEQ ID NO: 1002881 - RNA, 19 nt, Homo sapiens
aaauuaggguaccaucaua

SEQ ID NO: 1002882 - RNA, 19 nt, Homo sapiens
gaagacagcacccaccaau

SEQ ID NO: 1002883 - RNA, 19 nt, Homo sapiens
gaaccgcucucucugaacu

SEQ ID NO: 1002884 - RNA, 19 nt, Homo sapiens
ccaucaaucuuuaucauuc

SEQ ID NO: 1002885 - RNA, 19 nt, Homo sapiens
agacagagcaguuagagaa

SEQ ID NO: 1002886 - RNA, 19 nt, Homo sapiens
gacaagaagugcagucucu

SEQ ID NO: 1002887 - RNA, 19 nt, Homo sapiens
gacuauacauggugaacuu

SEQ ID NO: 1002888 - RNA, 19 nt, Homo sapiens
gaaguucgagcauauagug

SEQ ID NO: 1002889 - RNA, 19 nt, Homo sapiens
uaacaggauuagaaggaaa

SEQ ID NO: 1002890 - RNA, 19 nt, Homo sapiens
gaaaguacggccacacugu

SEQ ID NO: 1002891 - RNA, 19 nt, Homo sapiens
ugagaugguuaauggagua

SEQ ID NO: 1002892 - RNA, 19 nt, Homo sapiens
gaugaagguuaaugguuau

SEQ ID NO: 1002893 - RNA, 19 nt, Homo sapiens
gaucuacuaagcaucauuu

SEQ ID NO: 1002894 - RNA, 19 nt, Homo sapiens
acaggcaaccuuuauauuu

SEQ ID NO: 1002895 - RNA, 19 nt, Homo sapiens
ggaguauucuuaguagaga

SEQ ID NO: 1002896 - RNA, 19 nt, Homo sapiens
gugauuaucgcuacaguuu

SEQ ID NO: 1002897 - RNA, 19 nt, Homo sapiens
uagcagaucuguuucaaaa

SEQ ID NO: 1002898 - RNA, 19 nt, Homo sapiens
gacagucccagaaaucaua

SEQ ID NO: 1002899 - RNA, 19 nt, Homo sapiens
gaaaggacagccuauugau

SEQ ID NO: 1002900 - RNA, 19 nt, Homo sapiens
caggcaaccuuuauauuuc

SEQ ID NO: 1002901 - RNA, 19 nt, Homo sapiens
auagauggcaccuucauua

SEQ ID NO: 1002902 - RNA, 19 nt, Homo sapiens
ucagguuucucuuugguuu

SEQ ID NO: 1002903 - RNA, 19 nt, Homo sapiens
agacaggaauugagaguca

SEQ ID NO: 1002904 - RNA, 19 nt, Homo sapiens
aaggacagccuauugauuu

SEQ ID NO: 1002905 - RNA, 19 nt, Homo sapiens
ggagacaggcaaccuuuau

SEQ ID NO: 1002906 - RNA, 19 nt, Homo sapiens
aaaggauucuggucauuau

SEQ ID NO: 1002907 - RNA, 19 nt, Homo sapiens
ucagaugccuucaaacaag

SEQ ID NO: 1002908 - RNA, 19 nt, Homo sapiens
gauaccaguuccuuuguca

SEQ ID NO: 1002909 - RNA, 19 nt, Homo sapiens
gugaauagaguguagugua

SEQ ID NO: 1002910 - RNA, 19 nt, Homo sapiens
gaaacuucaagcaguagua

SEQ ID NO: 1002911 - RNA, 19 nt, Homo sapiens
gcaaggcucucagguuucu

SEQ ID NO: 1002912 - RNA, 19 nt, Homo sapiens
aguggagucuggcaucuua

SEQ ID NO: 1002913 - RNA, 19 nt, Homo sapiens
gaggaaauaaccgaaagua

SEQ ID NO: 1002914 - RNA, 19 nt, Homo sapiens
gcauuguccuuaauugcaa

SEQ ID NO: 1002915 - RNA, 19 nt, Homo sapiens
aaaagaaccuacaaggaua

SEQ ID NO: 1002916 - RNA, 19 nt, Homo sapiens
gagacaggcaaccuuuaua

SEQ ID NO: 1002917 - RNA, 19 nt, Homo sapiens
gaagcuacacugcaguuug

SEQ ID NO: 1002918 - RNA, 19 nt, Homo sapiens
caagaaccagaugauauua

SEQ ID NO: 1002919 - RNA, 19 nt, Homo sapiens
ggguugagaugguuaaugg

SEQ ID NO: 1002920 - RNA, 19 nt, Homo sapiens
gaaagugauuaucgcuaca

SEQ ID NO: 1002921 - RNA, 19 nt, Homo sapiens
uucauaugcugcuuuguua

SEQ ID NO: 1002922 - RNA, 19 nt, Homo sapiens
caacagccaaguuauugaa

SEQ ID NO: 1002923 - RNA, 19 nt, Homo sapiens
gaagugaaaguuggcguuu

SEQ ID NO: 1002924 - RNA, 19 nt, Homo sapiens
gaaugauccgcacaaauga

SEQ ID NO: 1002925 - RNA, 19 nt, Homo sapiens
ggauagaacuuacuccuaa

SEQ ID NO: 1002926 - RNA, 19 nt, Homo sapiens
ggaugaagguuaaugguua

SEQ ID NO: 1002927 - RNA, 19 nt, Homo sapiens
gaaagugucccuccucuua

SEQ ID NO: 1002928 - RNA, 19 nt, Homo sapiens
gauggcaccuucauuauaa

SEQ ID NO: 1002929 - RNA, 19 nt, Homo sapiens
gcagggcacucuuuaauga

SEQ ID NO: 1002930 - RNA, 19 nt, Homo sapiens
gcaauccaguucccaguua

SEQ ID NO: 1002931 - RNA, 19 nt, Homo sapiens
gagaaagcauuguccuuaa

SEQ ID NO: 1002932 - RNA, 19 nt, Homo sapiens
gccaguaucugaagaguuu

SEQ ID NO: 1002933 - RNA, 19 nt, Homo sapiens
ggagaaagcauuguccuua

SEQ ID NO: 1002934 - RNA, 19 nt, Homo sapiens
ggaaauacguuauaucacu

SEQ ID NO: 1002935 - RNA, 19 nt, Homo sapiens
ucacauggaugaagguuaa

SEQ ID NO: 1002936 - RNA, 19 nt, Homo sapiens
aaauagaucuggaaaguga

SEQ ID NO: 1002937 - RNA, 19 nt, Homo sapiens
ucagugaugugguccauua

SEQ ID NO: 1002938 - RNA, 19 nt, Homo sapiens
cagcaaggcucucagguuu

SEQ ID NO: 1002939 - RNA, 19 nt, Homo sapiens
gaaaacugcugacuuaauu

SEQ ID NO: 1002940 - RNA, 19 nt, Homo sapiens
gcaagaaccagaugauauu

SEQ ID NO: 1002941 - RNA, 19 nt, Homo sapiens
acagcuaguucucaaauua

SEQ ID NO: 1002942 - RNA, 19 nt, Homo sapiens
gauuaucgcuacaguuuga

SEQ ID NO: 1002943 - RNA, 19 nt, Homo sapiens
ugaauagaguguaguguaa

SEQ ID NO: 1002944 - RNA, 19 nt, Homo sapiens
gauaguaauuguugaggaa

SEQ ID NO: 1002945 - RNA, 19 nt, Homo sapiens
ggugaaaacugcugacuua

SEQ ID NO: 1002946 - RNA, 19 nt, Homo sapiens
gauguuggcagcuauauuu

SEQ ID NO: 1002947 - RNA, 19 nt, Homo sapiens
gaaaggagacagagcaguu

SEQ ID NO: 1002948 - RNA, 19 nt, Homo sapiens
gauccuaaaugcuuccaaa

SEQ ID NO: 1002949 - RNA, 19 nt, Homo sapiens
uaacagcggugaauagagu

SEQ ID NO: 1002950 - RNA, 19 nt, Homo sapiens
aaucugaaguuguggguua

SEQ ID NO: 1002951 - RNA, 19 nt, Homo sapiens
gugaugugguccauuauaa

SEQ ID NO: 1002952 - RNA, 19 nt, Homo sapiens
gcuggagucuauauuauug

SEQ ID NO: 1002953 - RNA, 19 nt, Homo sapiens
ccuaaaugcuuccaaauca

SEQ ID NO: 1002954 - RNA, 19 nt, Homo sapiens
gcaaaggauucuggucauu

SEQ ID NO: 1002955 - RNA, 19 nt, Homo sapiens
uaaagagagucuaggaaga

SEQ ID NO: 1002956 - RNA, 19 nt, Homo sapiens
cgaaugauccgcacaaaug

SEQ ID NO: 1002957 - RNA, 19 nt, Homo sapiens
gaaagcauuguccuuaauu

SEQ ID NO: 1002958 - RNA, 19 nt, Homo sapiens
gguuacagcugcuaaagga

SEQ ID NO: 1002959 - RNA, 19 nt, Homo sapiens
gaagaaggcaugaguuagu

SEQ ID NO: 1002960 - RNA, 19 nt, Homo sapiens
ggaagaggguggacauuuu

SEQ ID NO: 1002961 - RNA, 19 nt, Homo sapiens
caaaggauucuggucauua

SEQ ID NO: 1002962 - RNA, 19 nt, Homo sapiens
uaacuggccuuuagcagau

SEQ ID NO: 1002963 - RNA, 19 nt, Homo sapiens
uuaaguaacuggccuuuag

SEQ ID NO: 1002964 - RNA, 19 nt, Homo sapiens
gaugcuggagucuauauua

SEQ ID NO: 1002965 - RNA, 19 nt, Homo sapiens
acagaaacuucaagcagua

SEQ ID NO: 1002966 - RNA, 19 nt, Homo sapiens
acacguggcuggaaggaaa

SEQ ID NO: 1002967 - RNA, 19 nt, Homo sapiens
guaaagacagucccagaaa

SEQ ID NO: 1002968 - RNA, 19 nt, Homo sapiens
gauagaacuuacuccuaaa

SEQ ID NO: 1002969 - RNA, 19 nt, Homo sapiens
ucaaucagaugcuggaaug

SEQ ID NO: 1002970 - RNA, 19 nt, Homo sapiens
agaaauagaucuggaaagu

SEQ ID NO: 1002971 - RNA, 19 nt, Homo sapiens
gaagguagcauugaauugu

SEQ ID NO: 1002972 - RNA, 19 nt, Homo sapiens
gaugguuaauggaguauug

SEQ ID NO: 1002973 - RNA, 19 nt, Homo sapiens
uaaagacagucccagaaau

SEQ ID NO: 1002974 - RNA, 19 nt, Homo sapiens
ccaagaaguugucauagag

SEQ ID NO: 1002975 - RNA, 19 nt, Homo sapiens
gugcugagcugaagauucu

SEQ ID NO: 1002976 - RNA, 19 nt, Homo sapiens
gaaauggaacagaaauaga

SEQ ID NO: 1002977 - RNA, 19 nt, Homo sapiens
aaauuaggguaccaucaua

SEQ ID NO: 1002978 - RNA, 19 nt, Homo sapiens
gaagacagcacccaccaau

SEQ ID NO: 1002979 - RNA, 19 nt, Homo sapiens
gaaccgcucucucugaacu

SEQ ID NO: 1002980 - RNA, 19 nt, Homo sapiens
agacagagcaguuagagaa

SEQ ID NO: 1002981 - RNA, 19 nt, Homo sapiens
gacaagaagugcagucucu

SEQ ID NO: 1002982 - RNA, 19 nt, Homo sapiens
gacuauacauggugaacuu

SEQ ID NO: 1002983 - RNA, 19 nt, Homo sapiens
gaaguucgagcauauagug

SEQ ID NO: 1002984 - RNA, 19 nt, Homo sapiens
uaacaggauuagaaggaaa

SEQ ID NO: 1002985 - RNA, 19 nt, Homo sapiens
gaaaguacggccacacugu

SEQ ID NO: 1002986 - RNA, 19 nt, Homo sapiens
ugagaugguuaauggagua

SEQ ID NO: 1002987 - RNA, 19 nt, Homo sapiens
gaugaagguuaaugguuau

SEQ ID NO: 1002988 - RNA, 19 nt, Homo sapiens
acaggcaaccuuuauauuu

SEQ ID NO: 1002989 - RNA, 19 nt, Homo sapiens
ggaguauucuuaguagaga

SEQ ID NO: 1002990 - RNA, 19 nt, Homo sapiens
gaucuacuaagcaucauuu

SEQ ID NO: 1002991 - RNA, 19 nt, Homo sapiens
gugauuaucgcuacaguuu

SEQ ID NO: 1002992 - RNA, 19 nt, Homo sapiens
uagcagaucuguuucaaaa

SEQ ID NO: 1002993 - RNA, 19 nt, Homo sapiens
gacagucccagaaaucaua

SEQ ID NO: 1002994 - RNA, 19 nt, Homo sapiens
gaaaggacagccuauugau

SEQ ID NO: 1002995 - RNA, 19 nt, Homo sapiens
caggcaaccuuuauauuuc

SEQ ID NO: 1002996 - RNA, 19 nt, Homo sapiens
auagauggcaccuucauua

SEQ ID NO: 1002997 - RNA, 19 nt, Homo sapiens
agacaggaauugagaguca

SEQ ID NO: 1002998 - RNA, 19 nt, Homo sapiens
ucagguuucucuuugguuu

SEQ ID NO: 1002999 - RNA, 19 nt, Homo sapiens
aaggacagccuauugauuu

SEQ ID NO: 1003000 - RNA, 19 nt, Homo sapiens
ggagacaggcaaccuuuau

SEQ ID NO: 1003001 - RNA, 19 nt, Homo sapiens
aaaggauucuggucauuau

SEQ ID NO: 1003002 - RNA, 19 nt, Homo sapiens
gauaccaguuccuuuguca

SEQ ID NO: 1003003 - RNA, 19 nt, Homo sapiens
gugaauagaguguagugua

SEQ ID NO: 1003004 - RNA, 19 nt, Homo sapiens
gaaacuucaagcaguagua

SEQ ID NO: 1003005 - RNA, 19 nt, Homo sapiens
gcaaggcucucagguuucu

SEQ ID NO: 1003006 - RNA, 19 nt, Homo sapiens
gaggaaauaaccgaaagua

SEQ ID NO: 1003007 - RNA, 19 nt, Homo sapiens
aguggagucuggcaucuua

SEQ ID NO: 1003008 - RNA, 19 nt, Homo sapiens
gcauuguccuuaauugcaa

SEQ ID NO: 1003009 - RNA, 19 nt, Homo sapiens
aaaagaaccuacaaggaua

SEQ ID NO: 1003010 - RNA, 19 nt, Homo sapiens
gagacaggcaaccuuuaua

SEQ ID NO: 1003011 - RNA, 19 nt, Homo sapiens
gaagcuacacugcaguuug

SEQ ID NO: 1003012 - RNA, 19 nt, Homo sapiens
caagaaccagaugauauua

SEQ ID NO: 1003013 - RNA, 19 nt, Homo sapiens
ggguugagaugguuaaugg

SEQ ID NO: 1003014 - RNA, 19 nt, Homo sapiens
gaaagugauuaucgcuaca

SEQ ID NO: 1003015 - RNA, 19 nt, Homo sapiens
cagaaaguguggacuaugg

SEQ ID NO: 1003016 - RNA, 19 nt, Homo sapiens
caacagccaaguuauugaa

SEQ ID NO: 1003017 - RNA, 19 nt, Homo sapiens
gaagugaaaguuggcguuu

SEQ ID NO: 1003018 - RNA, 19 nt, Homo sapiens
gaaugauccgcacaaauga

SEQ ID NO: 1003019 - RNA, 19 nt, Homo sapiens
ugaaaggacagccuauuga

SEQ ID NO: 1003020 - RNA, 19 nt, Homo sapiens
caagaucuacuaagcauca

SEQ ID NO: 1003021 - RNA, 19 nt, Homo sapiens
ccaacaaucacauggauga

SEQ ID NO: 1003022 - RNA, 19 nt, Homo sapiens
gggagaauaugagccgaaa

SEQ ID NO: 1003023 - RNA, 19 nt, Homo sapiens
uauaagcaauccaagugaa

SEQ ID NO: 1003024 - RNA, 19 nt, Homo sapiens
ugugguccauuauaagaua

SEQ ID NO: 1003025 - RNA, 19 nt, Homo sapiens
ccagagaacuuccugauug

SEQ ID NO: 1003026 - RNA, 19 nt, Homo sapiens
acucaaggcugacacauua

SEQ ID NO: 1003027 - RNA, 19 nt, Homo sapiens
ggacaaaagucacauauga

SEQ ID NO: 1003028 - RNA, 19 nt, Homo sapiens
cgacuggacuucuuugaaa

SEQ ID NO: 1003029 - RNA, 19 nt, Homo sapiens
gaagcuacuugcuguacua

SEQ ID NO: 1003030 - RNA, 19 nt, Homo sapiens
cgagaaagccacacacaua

SEQ ID NO: 1003031 - RNA, 19 nt, Homo sapiens
gagcaaagccggagagaug

SEQ ID NO: 1003032 - RNA, 19 nt, Homo sapiens
gaccgaacauuuacuuuga

SEQ ID NO: 1003033 - RNA, 19 nt, Homo sapiens
gaaagacaacggacaacua

SEQ ID NO: 1003034 - RNA, 19 nt, Homo sapiens
caaccuaccuucgauaugu

SEQ ID NO: 1003035 - RNA, 19 nt, Homo sapiens
ggaagggacuccucuuugg

SEQ ID NO: 1003036 - RNA, 19 nt, Homo sapiens
cagaggagauggcaaccua

SEQ ID NO: 1003037 - RNA, 19 nt, Homo sapiens
ggccauauguucauguauu

SEQ ID NO: 1003038 - RNA, 19 nt, Homo sapiens
gaagacgguguuaaugaua

SEQ ID NO: 1003039 - RNA, 19 nt, Homo sapiens
ggagagcucagauuaggua

SEQ ID NO: 1003040 - RNA, 19 nt, Homo sapiens
gaagcuaagugcugcuguu

SEQ ID NO: 1003041 - RNA, 19 nt, Homo sapiens
caacacgcaucuuggcaaa

SEQ ID NO: 1003042 - RNA, 19 nt, Homo sapiens
gaagaggcaccuaaacaga

SEQ ID NO: 1003043 - RNA, 19 nt, Homo sapiens
ucacagaccucuuugaaaa

SEQ ID NO: 1003044 - RNA, 19 nt, Homo sapiens
uaacuggaacugcaagaua

SEQ ID NO: 1003045 - RNA, 19 nt, Homo sapiens
gaaagagcauguuauacac

SEQ ID NO: 1003046 - RNA, 19 nt, Homo sapiens
gccauauguucauguauuu

SEQ ID NO: 1003047 - RNA, 19 nt, Homo sapiens
uggaauacgugcacucaaa

SEQ ID NO: 1003048 - RNA, 19 nt, Homo sapiens
ggacuuguuugaccucugu

SEQ ID NO: 1003049 - RNA, 19 nt, Homo sapiens
accaauaccucauaccuaa

SEQ ID NO: 1003050 - RNA, 19 nt, Homo sapiens
ccggagagaugauuuggaa

SEQ ID NO: 1003051 - RNA, 19 nt, Homo sapiens
uaaaagaacuccuuaccuu

SEQ ID NO: 1003052 - RNA, 19 nt, Homo sapiens
gaccaugugggaaauauaa

SEQ ID NO: 1003053 - RNA, 19 nt, Homo sapiens
caaugaauauguagcaauc

SEQ ID NO: 1003054 - RNA, 19 nt, Homo sapiens
ggaaaaggaugaaagacaa

SEQ ID NO: 1003055 - RNA, 19 nt, Homo sapiens
ccacagguguauuacuuug

SEQ ID NO: 1003056 - RNA, 19 nt, Homo sapiens
gauaggaugugggaacuuc

SEQ ID NO: 1003057 - RNA, 19 nt, Homo sapiens
gcuacuugcuguacuauag

SEQ ID NO: 1003058 - RNA, 19 nt, Homo sapiens
gcuaagugcugcuguuucu

SEQ ID NO: 1003059 - RNA, 19 nt, Homo sapiens
ccucauaccuaacgucuca

SEQ ID NO: 1003060 - RNA, 19 nt, Homo sapiens
acucaaagaaccucauuua

SEQ ID NO: 1003061 - RNA, 19 nt, Homo sapiens
gcaauaagaaagagcaugu

SEQ ID NO: 1003062 - RNA, 19 nt, Homo sapiens
aaagacaacggacaacuaa

SEQ ID NO: 1003063 - RNA, 19 nt, Homo sapiens
gagcaagaucagaauagua

SEQ ID NO: 1003064 - RNA, 19 nt, Homo sapiens
gcacacugcucucgaccau

SEQ ID NO: 1003065 - RNA, 19 nt, Homo sapiens
agaaagagcauguuauaca

SEQ ID NO: 1003066 - RNA, 19 nt, Homo sapiens
gaaccucauuuaccgagau

SEQ ID NO: 1003067 - RNA, 19 nt, Homo sapiens
ugaagacgguguuaaugau

SEQ ID NO: 1003068 - RNA, 19 nt, Homo sapiens
caaucaaacuggaaccaau

SEQ ID NO: 1003069 - RNA, 19 nt, Homo sapiens
ggacucugacucaauugua

SEQ ID NO: 1003070 - RNA, 19 nt, Homo sapiens
cagaauaguagcagaugua

SEQ ID NO: 1003071 - RNA, 19 nt, Homo sapiens
caacagcagccucuucgaa

SEQ ID NO: 1003072 - RNA, 19 nt, Homo sapiens
gcugagcauuaugauguua

SEQ ID NO: 1003073 - RNA, 19 nt, Homo sapiens
ggaaauauaaugccauggu

SEQ ID NO: 1003074 - RNA, 19 nt, Homo sapiens
uaagugcugcuguuucuuu

SEQ ID NO: 1003075 - RNA, 19 nt, Homo sapiens
gagaaagccacacacauag

SEQ ID NO: 1003076 - RNA, 19 nt, Homo sapiens
gaugaaagacaacggacaa

SEQ ID NO: 1003077 - RNA, 19 nt, Homo sapiens
auggagagcugaauguuga

SEQ ID NO: 1003078 - RNA, 19 nt, Homo sapiens
cagcugagcauuaugaugu

SEQ ID NO: 1003079 - RNA, 19 nt, Homo sapiens
gaacauuuacuuugaagac

SEQ ID NO: 1003080 - RNA, 19 nt, Homo sapiens
cuccacagcuucauuuaga

SEQ ID NO: 1003081 - RNA, 19 nt, Homo sapiens
aaaggaauacucccauuga

SEQ ID NO: 1003082 - RNA, 19 nt, Homo sapiens
gaccaauaccucauaccua

SEQ ID NO: 1003083 - RNA, 19 nt, Homo sapiens
gggaagaggcaccuaaaca

SEQ ID NO: 1003084 - RNA, 19 nt, Homo sapiens
uugaagagagguauacaua

SEQ ID NO: 1003085 - RNA, 19 nt, Homo sapiens
cauaugagcaagaucagaa

SEQ ID NO: 1003086 - RNA, 19 nt, Homo sapiens
gcaccuaaacagauucuuc

SEQ ID NO: 1003087 - RNA, 19 nt, Homo sapiens
agaggcaccuaaacagauu

SEQ ID NO: 1003088 - RNA, 19 nt, Homo sapiens
gagcucagauuagguaaaa

SEQ ID NO: 1003089 - RNA, 19 nt, Homo sapiens
ucacauaugagcaagauca

SEQ ID NO: 1003090 - RNA, 19 nt, Homo sapiens
gacaaggcaauaagaaaga

SEQ ID NO: 1003091 - RNA, 19 nt, Homo sapiens
gaacuucggagagcucaga

SEQ ID NO: 1003092 - RNA, 19 nt, Homo sapiens
ggaagaggcaccuaaacag

SEQ ID NO: 1003093 - RNA, 19 nt, Homo sapiens
ggagauggcaaccuaccuu

SEQ ID NO: 1003094 - RNA, 19 nt, Homo sapiens
guucauguauuuccuucga

SEQ ID NO: 1003095 - RNA, 19 nt, Homo sapiens
gcacucaaagaaccucauu

SEQ ID NO: 1003096 - RNA, 19 nt, Homo sapiens
cuucggagagcucagauua

SEQ ID NO: 1003097 - RNA, 19 nt, Homo sapiens
gaggagagugggaaauuca

SEQ ID NO: 1003098 - RNA, 19 nt, Homo sapiens
gcauuaugauguuaacaac

SEQ ID NO: 1003099 - RNA, 19 nt, Homo sapiens
ggaacugcaagauauaugu

SEQ ID NO: 1003100 - RNA, 19 nt, Homo sapiens
gcagaccaauaccucauac

SEQ ID NO: 1003101 - RNA, 19 nt, Homo sapiens
aaagcagaauguaucauca

SEQ ID NO: 1003102 - RNA, 19 nt, Homo sapiens
ggaccaugugggaaauaua

SEQ ID NO: 1003103 - RNA, 19 nt, Homo sapiens
aaucaaacuggaaccaaua

SEQ ID NO: 1003104 - RNA, 19 nt, Homo sapiens
gaauacgugcacucaaaga

SEQ ID NO: 1003105 - RNA, 19 nt, Homo sapiens
ucccacagguguauuacuu

SEQ ID NO: 1003106 - RNA, 19 nt, Homo sapiens
cgacaaggcaauaagaaag

SEQ ID NO: 1003107 - RNA, 19 nt, Homo sapiens
acacugcucucgaccaucu

SEQ ID NO: 1003108 - RNA, 19 nt, Homo sapiens
gaucagaauaguagcagau

SEQ ID NO: 1003109 - RNA, 19 nt, Homo sapiens
guuaacaacucagccaucu

SEQ ID NO: 1003110 - RNA, 19 nt, Homo sapiens
uuacagcugagcauuauga

SEQ ID NO: 1003111 - RNA, 19 nt, Homo sapiens
guugggagaccuauuccua

SEQ ID NO: 1003112 - RNA, 19 nt, Homo sapiens
aaggaauacucccauugaa

SEQ ID NO: 1003113 - RNA, 19 nt, Homo sapiens
caaaaggaauacucccauu

SEQ ID NO: 1003114 - RNA, 19 nt, Homo sapiens
ugaccgaacauuuacuuug

SEQ ID NO: 1003115 - RNA, 19 nt, Homo sapiens
gcaccaaucacagcucaug

SEQ ID NO: 1003116 - RNA, 19 nt, Homo sapiens
cgaggagagugggaaauuc

SEQ ID NO: 1003117 - RNA, 19 nt, Homo sapiens
gaauaguagcagauguaaa

SEQ ID NO: 1003118 - RNA, 19 nt, Homo sapiens
cgaaaucagagccuuagga

SEQ ID NO: 1003119 - RNA, 19 nt, Homo sapiens
ccauugaagcucucuguga

SEQ ID NO: 1003120 - RNA, 19 nt, Homo sapiens
uaggccauauguucaugua

SEQ ID NO: 1003121 - RNA, 19 nt, Homo sapiens
cagagaacuuccugauugg

SEQ ID NO: 1003122 - RNA, 19 nt, Homo sapiens
uagcuuggaggacuuguuu

SEQ ID NO: 1003123 - RNA, 19 nt, Homo sapiens
aagugcugcuguuucuuua

SEQ ID NO: 1003124 - RNA, 19 nt, Homo sapiens
ccacuccaaugcaccaauc

SEQ ID NO: 1003125 - RNA, 19 nt, Homo sapiens
ggaggaugcuuuguucuuu

SEQ ID NO: 1003126 - RNA, 19 nt, Homo sapiens
agaaagggcagcucuauaa

SEQ ID NO: 1003127 - RNA, 19 nt, Homo sapiens
gagaaagggcagcucuaua

SEQ ID NO: 1003128 - RNA, 19 nt, Homo sapiens
ggacacggacuucauuguu

SEQ ID NO: 1003129 - RNA, 19 nt, Homo sapiens
gaagggccguguucguguu

SEQ ID NO: 1003130 - RNA, 19 nt, Homo sapiens
ggagaagcauuuuaaagaa

SEQ ID NO: 1003131 - RNA, 19 nt, Homo sapiens
ggacuucauuguucucaag

SEQ ID NO: 1003132 - RNA, 19 nt, Homo sapiens
aaacacaggagaauaauca

SEQ ID NO: 1003133 - RNA, 19 nt, Homo sapiens
cacaggagaauaaucaaua

SEQ ID NO: 1003134 - RNA, 19 nt, Homo sapiens
ggaagaagggacaagauuc

SEQ ID NO: 1003135 - RNA, 19 nt, Homo sapiens
gacacggacuucauuguuc

SEQ ID NO: 1003136 - RNA, 19 nt, Homo sapiens
ggaucgcacucauguggaa

SEQ ID NO: 1003137 - RNA, 19 nt, Homo sapiens
gggaagaagggacaagauu

SEQ ID NO: 1003138 - RNA, 19 nt, Homo sapiens
caacaggcaggaaggauga

SEQ ID NO: 1003139 - RNA, 19 nt, Homo sapiens
ggagaaagggcagcucuau

SEQ ID NO: 1003140 - RNA, 19 nt, Homo sapiens
ggaagcuccuggucugauc

SEQ ID NO: 1003141 - RNA, 19 nt, Homo sapiens
gaaguacuuugaggacauc

SEQ ID NO: 1003142 - RNA, 19 nt, Homo sapiens
caucaucggcuucaaguuc

SEQ ID NO: 1003143 - RNA, 19 nt, Homo sapiens
ggaggcuguugguaggaaa

SEQ ID NO: 1003144 - RNA, 19 nt, Homo sapiens
ggcggaggaugcuuuguuc

SEQ ID NO: 1003145 - RNA, 19 nt, Homo sapiens
gcggaaagccaggcaguug

SEQ ID NO: 1003146 - RNA, 19 nt, Homo sapiens
ccaacuuccuguucaugug

SEQ ID NO: 1003147 - RNA, 19 nt, Homo sapiens
acaggagaauaaucaauag

SEQ ID NO: 1003148 - RNA, 19 nt, Homo sapiens
gggcggaggaugcuuuguu

SEQ ID NO: 1003149 - RNA, 19 nt, Homo sapiens
uggcaggacuggaagaagu

SEQ ID NO: 1003150 - RNA, 19 nt, Homo sapiens
ggacuggaagaaguacuuu

SEQ ID NO: 1003151 - RNA, 19 nt, Homo sapiens
ggagaggaggcuguuggua

SEQ ID NO: 1003152 - RNA, 19 nt, Homo sapiens
cugggcaucucacuucuga

SEQ ID NO: 1003153 - RNA, 19 nt, Homo sapiens
gaggaugcuuuguucuuuu

SEQ ID NO: 1003154 - RNA, 19 nt, Homo sapiens
gaagaagggacaagauucc

SEQ ID NO: 1003155 - RNA, 19 nt, Homo sapiens
gaaagggcagcucuauaac

SEQ ID NO: 1003156 - RNA, 19 nt, Homo sapiens
agaaguacuuugaggacau

SEQ ID NO: 1003157 - RNA, 19 nt, Homo sapiens
ggcaggacuggaagaagua

SEQ ID NO: 1003158 - RNA, 19 nt, Homo sapiens
acacggacuucauuguucu

SEQ ID NO: 1003159 - RNA, 19 nt, Homo sapiens
gcaccugggcaucucacuu

SEQ ID NO: 1003160 - RNA, 19 nt, Homo sapiens
cauuauaaacacaggagaa

SEQ ID NO: 1003161 - RNA, 19 nt, Homo sapiens
gggcuuaggcaggcuguug

SEQ ID NO: 1003162 - RNA, 19 nt, Homo sapiens
ucaagaaccugcggaaccu

SEQ ID NO: 1003163 - RNA, 19 nt, Homo sapiens
ggagcuagagauggauuug

SEQ ID NO: 1003164 - RNA, 19 nt, Homo sapiens
gagaggagaggaggcuguu

SEQ ID NO: 1003165 - RNA, 19 nt, Homo sapiens
gcugcucagugccaccuau

SEQ ID NO: 1003166 - RNA, 19 nt, Homo sapiens
gaggcagggcugacacaug

SEQ ID NO: 1003167 - RNA, 19 nt, Homo sapiens
gaucuacuggcacguugug

SEQ ID NO: 1003168 - RNA, 19 nt, Homo sapiens
ggaggucaacagggacuga

SEQ ID NO: 1003169 - RNA, 19 nt, Homo sapiens
ugagcugcuucccgaaugu

SEQ ID NO: 1003170 - RNA, 19 nt, Homo sapiens
caccugggcaucucacuuc

SEQ ID NO: 1003171 - RNA, 19 nt, Homo sapiens
gggagagcccaaggagaaa

SEQ ID NO: 1003172 - RNA, 19 nt, Homo sapiens
cggaggaugcuuuguucuu

SEQ ID NO: 1003173 - RNA, 19 nt, Homo sapiens
gccaggcaguugggacaga

SEQ ID NO: 1003174 - RNA, 19 nt, Homo sapiens
gcacgaggccaugaaaaug

SEQ ID NO: 1003175 - RNA, 19 nt, Homo sapiens
acuggaagaaguacuuuga

SEQ ID NO: 1003176 - RNA, 19 nt, Homo sapiens
gugcugguccugaugaaag

SEQ ID NO: 1003177 - RNA, 19 nt, Homo sapiens
ggacaaaucuuucucuauu

SEQ ID NO: 1003178 - RNA, 19 nt, Homo sapiens
guaccaagaugaaacauua

SEQ ID NO: 1003179 - RNA, 19 nt, Homo sapiens
gaacauguaugcauaauca

SEQ ID NO: 1003180 - RNA, 19 nt, Homo sapiens
gauauugacuguacugaua

SEQ ID NO: 1003181 - RNA, 19 nt, Homo sapiens
cagcagagcuugcaaauau

SEQ ID NO: 1003182 - RNA, 19 nt, Homo sapiens
gaucagauguucuuccaua

SEQ ID NO: 1003183 - RNA, 19 nt, Homo sapiens
gcaguaaacuaugagaaua

SEQ ID NO: 1003184 - RNA, 19 nt, Homo sapiens
caaauggccugcuauaaga

SEQ ID NO: 1003185 - RNA, 19 nt, Homo sapiens
ggacacacaggaucaauua

SEQ ID NO: 1003186 - RNA, 19 nt, Homo sapiens
cagaugagcuagagaaauu

SEQ ID NO: 1003187 - RNA, 19 nt, Homo sapiens
gaaauugagugauugugaa

SEQ ID NO: 1003188 - RNA, 19 nt, Homo sapiens
gaugaaauaucuacugaga

SEQ ID NO: 1003189 - RNA, 19 nt, Homo sapiens
ggacaucuaucugcuguuu

SEQ ID NO: 1003190 - RNA, 19 nt, Homo sapiens
aaagauaacugaccaacuu

SEQ ID NO: 1003191 - RNA, 19 nt, Homo sapiens
ucaaaugggugaugaggua

SEQ ID NO: 1003192 - RNA, 19 nt, Homo sapiens
gaagaugucaguuuagaaa

SEQ ID NO: 1003193 - RNA, 19 nt, Homo sapiens
gaaagauucugcaucacaa

SEQ ID NO: 1003194 - RNA, 19 nt, Homo sapiens
caggaaaucugaacuguga

SEQ ID NO: 1003195 - RNA, 19 nt, Homo sapiens
cgaaagagagucuauuuaa

SEQ ID NO: 1003196 - RNA, 19 nt, Homo sapiens
gcacggauuuggagauuug

SEQ ID NO: 1003197 - RNA, 19 nt, Homo sapiens
gaaauaaauugcagagucu

SEQ ID NO: 1003198 - RNA, 19 nt, Homo sapiens
gcacaggcauaccaauauu

SEQ ID NO: 1003199 - RNA, 19 nt, Homo sapiens
gaaagagagucuauuuaag

SEQ ID NO: 1003200 - RNA, 19 nt, Homo sapiens
caaccgaucuuuacacaau

SEQ ID NO: 1003201 - RNA, 19 nt, Homo sapiens
ggaaauaggcaauuagaga

SEQ ID NO: 1003202 - RNA, 19 nt, Homo sapiens
uguagaagaugucaguuua

SEQ ID NO: 1003203 - RNA, 19 nt, Homo sapiens
gaucaugcauguaacagaa

SEQ ID NO: 1003204 - RNA, 19 nt, Homo sapiens
guaaggaacuagugaacuu

SEQ ID NO: 1003205 - RNA, 19 nt, Homo sapiens
gaaagcaacuggaagaaac

SEQ ID NO: 1003206 - RNA, 19 nt, Homo sapiens
cauagaaucuuuacagguu

SEQ ID NO: 1003207 - RNA, 19 nt, Homo sapiens
gaaaaugucuggauuagga

SEQ ID NO: 1003208 - RNA, 19 nt, Homo sapiens
gcaaauggauguggcagaa

SEQ ID NO: 1003209 - RNA, 19 nt, Homo sapiens
caagaggacuuucaaaugg

SEQ ID NO: 1003210 - RNA, 19 nt, Homo sapiens
gaagauauguugaauucag

SEQ ID NO: 1003211 - RNA, 19 nt, Homo sapiens
aaaccaagauucugaguga

SEQ ID NO: 1003212 - RNA, 19 nt, Homo sapiens
gcuaaugagugauguagaa

SEQ ID NO: 1003213 - RNA, 19 nt, Homo sapiens
ggucagaaaucaagagaug

SEQ ID NO: 1003214 - RNA, 19 nt, Homo sapiens
gaacugaacccuaauaagg

SEQ ID NO: 1003215 - RNA, 19 nt, Homo sapiens
ucagaugacuguuugguaa

SEQ ID NO: 1003216 - RNA, 19 nt, Homo sapiens
gaaguagaguguuggaaau

SEQ ID NO: 1003217 - RNA, 19 nt, Homo sapiens
gcagucagauugcuacaga

SEQ ID NO: 1003218 - RNA, 19 nt, Homo sapiens
gaaauaggcaauuagagaa

SEQ ID NO: 1003219 - RNA, 19 nt, Homo sapiens
gaaagaaaaugcacaauag

SEQ ID NO: 1003220 - RNA, 19 nt, Homo sapiens
gcucaugagugauguagaa

SEQ ID NO: 1003221 - RNA, 19 nt, Homo sapiens
uaacgaaccugagagugua

SEQ ID NO: 1003222 - RNA, 19 nt, Homo sapiens
gaauuaggagcuaguauuu

SEQ ID NO: 1003223 - RNA, 19 nt, Homo sapiens
ggaauuggcagucuuguga

SEQ ID NO: 1003224 - RNA, 19 nt, Homo sapiens
gaagaggaaagguuuauga

SEQ ID NO: 1003225 - RNA, 19 nt, Homo sapiens
gcgcaucgguccuauguug

SEQ ID NO: 1003226 - RNA, 19 nt, Homo sapiens
ugaagauucugaaccauuu

SEQ ID NO: 1003227 - RNA, 19 nt, Homo sapiens
gacaggacauagaaucuuu

SEQ ID NO: 1003228 - RNA, 19 nt, Homo sapiens
gugagaacauguaugcaua

SEQ ID NO: 1003229 - RNA, 19 nt, Homo sapiens
gcagaagacucaggaccua

SEQ ID NO: 1003230 - RNA, 19 nt, Homo sapiens
gaacacaagcacaggcaua

SEQ ID NO: 1003231 - RNA, 19 nt, Homo sapiens
gaagaaacaguguaaggaa

SEQ ID NO: 1003232 - RNA, 19 nt, Homo sapiens
ggaauacgauaugaaguug

SEQ ID NO: 1003233 - RNA, 19 nt, Homo sapiens
gaauuucacccuccaguuu

SEQ ID NO: 1003234 - RNA, 19 nt, Homo sapiens
ucaagugacucuucaucua

SEQ ID NO: 1003235 - RNA, 19 nt, Homo sapiens
guggagagguggaaagaaa

SEQ ID NO: 1003236 - RNA, 19 nt, Homo sapiens
gugaaacucugaaagcaaa

SEQ ID NO: 1003237 - RNA, 19 nt, Homo sapiens
guacaaauaucucagaacu

SEQ ID NO: 1003238 - RNA, 19 nt, Homo sapiens
ugauccaccugaagaauua

SEQ ID NO: 1003239 - RNA, 19 nt, Homo sapiens
gaauuuaucuccuccaaaa

SEQ ID NO: 1003240 - RNA, 19 nt, Homo sapiens
gagcagaucaggauacuau

SEQ ID NO: 1003241 - RNA, 19 nt, Homo sapiens
gggacaugcugaugaagua

SEQ ID NO: 1003242 - RNA, 19 nt, Homo sapiens
caaaggcucucaaagauac

SEQ ID NO: 1003243 - RNA, 19 nt, Homo sapiens
caggaucaauuacaucuuu

SEQ ID NO: 1003244 - RNA, 19 nt, Homo sapiens
gaagagaucgcauccugaa

SEQ ID NO: 1003245 - RNA, 19 nt, Homo sapiens
ugacagcccuuuggaguuu

SEQ ID NO: 1003246 - RNA, 19 nt, Homo sapiens
gaaaucaagagaugaagaa

SEQ ID NO: 1003247 - RNA, 19 nt, Homo sapiens
ugaguuaucuucuggaaau

SEQ ID NO: 1003248 - RNA, 19 nt, Homo sapiens
gcaaaccaaugauaaugau

SEQ ID NO: 1003249 - RNA, 19 nt, Homo sapiens
gacuaucgaccacuuauua

SEQ ID NO: 1003250 - RNA, 19 nt, Homo sapiens
caugauggcagcauauuua

SEQ ID NO: 1003251 - RNA, 19 nt, Homo sapiens
gccaaaggcucucaaagau

SEQ ID NO: 1003252 - RNA, 19 nt, Homo sapiens
gcucccagcucuaaaauua

SEQ ID NO: 1003253 - RNA, 19 nt, Homo sapiens
uaugaaagauucugcauca

SEQ ID NO: 1003254 - RNA, 19 nt, Homo sapiens
gaaugcgaguuucuuuaaa

SEQ ID NO: 1003255 - RNA, 19 nt, Homo sapiens
caucagagcuacgaacuau

SEQ ID NO: 1003256 - RNA, 19 nt, Homo sapiens
gaaugagacuuguuaaucg

SEQ ID NO: 1003257 - RNA, 19 nt, Homo sapiens
agagaaaggugaagaggaa

SEQ ID NO: 1003258 - RNA, 19 nt, Homo sapiens
gagcuguguuugacuguaa

SEQ ID NO: 1003259 - RNA, 19 nt, Homo sapiens
uugaagacaugauuccuua

SEQ ID NO: 1003260 - RNA, 19 nt, Homo sapiens
gagcuuaaagucagaaauu

SEQ ID NO: 1003261 - RNA, 19 nt, Homo sapiens
gagaucgcauccugaauug

SEQ ID NO: 1003262 - RNA, 19 nt, Homo sapiens
ggagacuggugaaauucua

SEQ ID NO: 1003263 - RNA, 19 nt, Homo sapiens
gacagauuccgcucuauua

SEQ ID NO: 1003264 - RNA, 19 nt, Homo sapiens
ggacauguaggcguaaaua

SEQ ID NO: 1003265 - RNA, 19 nt, Homo sapiens
ggauauggcuaccagaauc

SEQ ID NO: 1003266 - RNA, 19 nt, Homo sapiens
ucucaaagauacaugguuu

SEQ ID NO: 1003267 - RNA, 19 nt, Homo sapiens
gaagaugaacagagcuuaa

SEQ ID NO: 1003268 - RNA, 19 nt, Homo sapiens
gaugaagaaugugauagaa

SEQ ID NO: 1003269 - RNA, 19 nt, Homo sapiens
ggaaaugagucuucaagcu

SEQ ID NO: 1003270 - RNA, 19 nt, Homo sapiens
gaaaggaggaaaagaaaua

SEQ ID NO: 1003271 - RNA, 19 nt, Homo sapiens
gaagucagauauauagaac

SEQ ID NO: 1003272 - RNA, 19 nt, Homo sapiens
gacaacugcuucauaacuu

SEQ ID NO: 1003273 - RNA, 19 nt, Homo sapiens
gaaugaucauguccucaaa

SEQ ID NO: 1003274 - RNA, 19 nt, Homo sapiens
uaacaaugauagcuuggaa

SEQ ID NO: 1003275 - RNA, 19 nt, Homo sapiens
gaaaguccauugaugucau

SEQ ID NO: 1003276 - RNA, 19 nt, Homo sapiens
ugaaggaaguguacauugu

SEQ ID NO: 1003277 - RNA, 19 nt, Homo sapiens
ggacaaaucuuucucuauu

SEQ ID NO: 1003278 - RNA, 19 nt, Homo sapiens
guaccaagaugaaacauua

SEQ ID NO: 1003279 - RNA, 19 nt, Homo sapiens
gauauugacuguacugaua

SEQ ID NO: 1003280 - RNA, 19 nt, Homo sapiens
cagcagagcuugcaaauau

SEQ ID NO: 1003281 - RNA, 19 nt, Homo sapiens
gaucagauguucuuccaua

SEQ ID NO: 1003282 - RNA, 19 nt, Homo sapiens
ggugaaagcuggcuguuaa

SEQ ID NO: 1003283 - RNA, 19 nt, Homo sapiens
gcaguaaacuaugagaaua

SEQ ID NO: 1003284 - RNA, 19 nt, Homo sapiens
ggacacacaggaucaauua

SEQ ID NO: 1003285 - RNA, 19 nt, Homo sapiens
cagaugagcuagagaaauu

SEQ ID NO: 1003286 - RNA, 19 nt, Homo sapiens
gaaauugagugauugugaa

SEQ ID NO: 1003287 - RNA, 19 nt, Homo sapiens
gaugaaauaucuacugaga

SEQ ID NO: 1003288 - RNA, 19 nt, Homo sapiens
ggacaucuaucugcuguuu

SEQ ID NO: 1003289 - RNA, 19 nt, Homo sapiens
aaagauaacugaccaacuu

SEQ ID NO: 1003290 - RNA, 19 nt, Homo sapiens
ucaaaugggugaugaggua

SEQ ID NO: 1003291 - RNA, 19 nt, Homo sapiens
caaccuauguuuacagauu

SEQ ID NO: 1003292 - RNA, 19 nt, Homo sapiens
gaaugugacuaaaucauga

SEQ ID NO: 1003293 - RNA, 19 nt, Homo sapiens
gacaguauuugacuacaua

SEQ ID NO: 1003294 - RNA, 19 nt, Homo sapiens
gaagaugucaguuuagaaa

SEQ ID NO: 1003295 - RNA, 19 nt, Homo sapiens
gaaagauucugcaucacaa

SEQ ID NO: 1003296 - RNA, 19 nt, Homo sapiens
caggaaaucugaacuguga

SEQ ID NO: 1003297 - RNA, 19 nt, Homo sapiens
cgaaagagagucuauuuaa

SEQ ID NO: 1003298 - RNA, 19 nt, Homo sapiens
gcacggauuuggagauuug

SEQ ID NO: 1003299 - RNA, 19 nt, Homo sapiens
gcacaggcauaccaauauu

SEQ ID NO: 1003300 - RNA, 19 nt, Homo sapiens
gaaagagagucuauuuaag

SEQ ID NO: 1003301 - RNA, 19 nt, Homo sapiens
caaccgaucuuuacacaau

SEQ ID NO: 1003302 - RNA, 19 nt, Homo sapiens
uguagaagaugucaguuua

SEQ ID NO: 1003303 - RNA, 19 nt, Homo sapiens
gaucaugcauguaacagaa

SEQ ID NO: 1003304 - RNA, 19 nt, Homo sapiens
guaaggaacuagugaacuu

SEQ ID NO: 1003305 - RNA, 19 nt, Homo sapiens
gaaagcaacuggaagaaac

SEQ ID NO: 1003306 - RNA, 19 nt, Homo sapiens
cauagaaucuuuacagguu

SEQ ID NO: 1003307 - RNA, 19 nt, Homo sapiens
gcaaauggauguggcagaa

SEQ ID NO: 1003308 - RNA, 19 nt, Homo sapiens
caagaggacuuucaaaugg

SEQ ID NO: 1003309 - RNA, 19 nt, Homo sapiens
gcaagaguuugaaauaugu

SEQ ID NO: 1003310 - RNA, 19 nt, Homo sapiens
gaagauauguugaauucag

SEQ ID NO: 1003311 - RNA, 19 nt, Homo sapiens
aaaccaagauucugaguga

SEQ ID NO: 1003312 - RNA, 19 nt, Homo sapiens
gcuaaugagugauguagaa

SEQ ID NO: 1003313 - RNA, 19 nt, Homo sapiens
ggucagaaaucaagagaug

SEQ ID NO: 1003314 - RNA, 19 nt, Homo sapiens
gaacugaacccuaauaagg

SEQ ID NO: 1003315 - RNA, 19 nt, Homo sapiens
ucagaugacuguuugguaa

SEQ ID NO: 1003316 - RNA, 19 nt, Homo sapiens
gcagucagauugcuacaga

SEQ ID NO: 1003317 - RNA, 19 nt, Homo sapiens
gaaguguguucuuuaauag

SEQ ID NO: 1003318 - RNA, 19 nt, Homo sapiens
ggaaagccaguucauuuaa

SEQ ID NO: 1003319 - RNA, 19 nt, Homo sapiens
gcucaugagugauguagaa

SEQ ID NO: 1003320 - RNA, 19 nt, Homo sapiens
uaacgaaccugagagugua

SEQ ID NO: 1003321 - RNA, 19 nt, Homo sapiens
gaauuaggagcuaguauuu

SEQ ID NO: 1003322 - RNA, 19 nt, Homo sapiens
ggaauuggcagucuuguga

SEQ ID NO: 1003323 - RNA, 19 nt, Homo sapiens
gaagaggaaagguuuauga

SEQ ID NO: 1003324 - RNA, 19 nt, Homo sapiens
gcgcaucgguccuauguug

SEQ ID NO: 1003325 - RNA, 19 nt, Homo sapiens
gggaaagccaguucauuua

SEQ ID NO: 1003326 - RNA, 19 nt, Homo sapiens
guagaaggacugugagaua

SEQ ID NO: 1003327 - RNA, 19 nt, Homo sapiens
ugaagauucugaaccauuu

SEQ ID NO: 1003328 - RNA, 19 nt, Homo sapiens
gacaggacauagaaucuuu

SEQ ID NO: 1003329 - RNA, 19 nt, Homo sapiens
gauaaugacugggaggauu

SEQ ID NO: 1003330 - RNA, 19 nt, Homo sapiens
gcagaagacucaggaccua

SEQ ID NO: 1003331 - RNA, 19 nt, Homo sapiens
gaacacaagcacaggcaua

SEQ ID NO: 1003332 - RNA, 19 nt, Homo sapiens
gaagaaacaguguaaggaa

SEQ ID NO: 1003333 - RNA, 19 nt, Homo sapiens
ggaauacgauaugaaguug

SEQ ID NO: 1003334 - RNA, 19 nt, Homo sapiens
gaauuucacccuccaguuu

SEQ ID NO: 1003335 - RNA, 19 nt, Homo sapiens
ucaagugacucuucaucua

SEQ ID NO: 1003336 - RNA, 19 nt, Homo sapiens
guacaaauaucucagaacu

SEQ ID NO: 1003337 - RNA, 19 nt, Homo sapiens
ugauccaccugaagaauua

SEQ ID NO: 1003338 - RNA, 19 nt, Homo sapiens
gaauuuaucuccuccaaaa

SEQ ID NO: 1003339 - RNA, 19 nt, Homo sapiens
gagcagaucaggauacuau

SEQ ID NO: 1003340 - RNA, 19 nt, Homo sapiens
gggacaugcugaugaagua

SEQ ID NO: 1003341 - RNA, 19 nt, Homo sapiens
caaaggcucucaaagauac

SEQ ID NO: 1003342 - RNA, 19 nt, Homo sapiens
caggaucaauuacaucuuu

SEQ ID NO: 1003343 - RNA, 19 nt, Homo sapiens
gacuaaaucaugacuguua

SEQ ID NO: 1003344 - RNA, 19 nt, Homo sapiens
gaagagaucgcauccugaa

SEQ ID NO: 1003345 - RNA, 19 nt, Homo sapiens
ugacagcccuuuggaguuu

SEQ ID NO: 1003346 - RNA, 19 nt, Homo sapiens
gaaaucaagagaugaagaa

SEQ ID NO: 1003347 - RNA, 19 nt, Homo sapiens
ugaguuaucuucuggaaau

SEQ ID NO: 1003348 - RNA, 19 nt, Homo sapiens
gcaaaccaaugauaaugau

SEQ ID NO: 1003349 - RNA, 19 nt, Homo sapiens
gacuaucgaccacuuauua

SEQ ID NO: 1003350 - RNA, 19 nt, Homo sapiens
caugauggcagcauauuua

SEQ ID NO: 1003351 - RNA, 19 nt, Homo sapiens
gccaaaggcucucaaagau

SEQ ID NO: 1003352 - RNA, 19 nt, Homo sapiens
gagcauagucagagcauuu

SEQ ID NO: 1003353 - RNA, 19 nt, Homo sapiens
uaugaaagauucugcauca

SEQ ID NO: 1003354 - RNA, 19 nt, Homo sapiens
gaaugcgaguuucuuuaaa

SEQ ID NO: 1003355 - RNA, 19 nt, Homo sapiens
caucagagcuacgaacuau

SEQ ID NO: 1003356 - RNA, 19 nt, Homo sapiens
gaaugagacuuguuaaucg

SEQ ID NO: 1003357 - RNA, 19 nt, Homo sapiens
agagaaaggugaagaggaa

SEQ ID NO: 1003358 - RNA, 19 nt, Homo sapiens
gagcuguguuugacuguaa

SEQ ID NO: 1003359 - RNA, 19 nt, Homo sapiens
gagcuuaaagucagaaauu

SEQ ID NO: 1003360 - RNA, 19 nt, Homo sapiens
gaaagccaguucauuuaag

SEQ ID NO: 1003361 - RNA, 19 nt, Homo sapiens
gagaucgcauccugaauug

SEQ ID NO: 1003362 - RNA, 19 nt, Homo sapiens
ggagacuggugaaauucua

SEQ ID NO: 1003363 - RNA, 19 nt, Homo sapiens
gacagauuccgcucuauua

SEQ ID NO: 1003364 - RNA, 19 nt, Homo sapiens
ggacauguaggcguaaaua

SEQ ID NO: 1003365 - RNA, 19 nt, Homo sapiens
ggauauggcuaccagaauc

SEQ ID NO: 1003366 - RNA, 19 nt, Homo sapiens
ucucaaagauacaugguuu

SEQ ID NO: 1003367 - RNA, 19 nt, Homo sapiens
gguuaaguguggaugauaa

SEQ ID NO: 1003368 - RNA, 19 nt, Homo sapiens
gaagaugaacagagcuuaa

SEQ ID NO: 1003369 - RNA, 19 nt, Homo sapiens
gaugaagaaugugauagaa

SEQ ID NO: 1003370 - RNA, 19 nt, Homo sapiens
ggaaaugagucuucaagcu

SEQ ID NO: 1003371 - RNA, 19 nt, Homo sapiens
guacagggcuaaaagagua

SEQ ID NO: 1003372 - RNA, 19 nt, Homo sapiens
ggagguguaaccaugauua

SEQ ID NO: 1003373 - RNA, 19 nt, Homo sapiens
gaaaggaggaaaagaaaua

SEQ ID NO: 1003374 - RNA, 19 nt, Homo sapiens
gaagucagauauauagaac

SEQ ID NO: 1003375 - RNA, 19 nt, Homo sapiens
gacaacugcuucauaacuu

SEQ ID NO: 1003376 - RNA, 19 nt, Homo sapiens
gaaugaucauguccucaaa

SEQ ID NO: 1003377 - RNA, 19 nt, Homo sapiens
ggaaggagagguuugauua

SEQ ID NO: 1003378 - RNA, 19 nt, Homo sapiens
gcaacagacuggguuauuu

SEQ ID NO: 1003379 - RNA, 19 nt, Homo sapiens
caacagacuggguuauuua

SEQ ID NO: 1003380 - RNA, 19 nt, Homo sapiens
cagacuggguuauuuauuu

SEQ ID NO: 1003381 - RNA, 19 nt, Homo sapiens
gagggaagucuuugaaaua

SEQ ID NO: 1003382 - RNA, 19 nt, Homo sapiens
ggagggaagucuuugaaau

SEQ ID NO: 1003383 - RNA, 19 nt, Homo sapiens
ccacagaacaucaaaguga

SEQ ID NO: 1003384 - RNA, 19 nt, Homo sapiens
auacuuaucugcccuuuga

SEQ ID NO: 1003385 - RNA, 19 nt, Homo sapiens
ggagacauauugcugaaca

SEQ ID NO: 1003386 - RNA, 19 nt, Homo sapiens
caaggacaguucagacaaa

SEQ ID NO: 1003387 - RNA, 19 nt, Homo sapiens
uaucugcccuuugaaauaa

SEQ ID NO: 1003388 - RNA, 19 nt, Homo sapiens
ggaccaaguuccauuuaag

SEQ ID NO: 1003389 - RNA, 19 nt, Homo sapiens
ggaagucuuugaaauacga

SEQ ID NO: 1003390 - RNA, 19 nt, Homo sapiens
agggugagcuccacaagua

SEQ ID NO: 1003391 - RNA, 19 nt, Homo sapiens
gggaccaaguuccauuuaa

SEQ ID NO: 1003392 - RNA, 19 nt, Homo sapiens
gggcaccguuugauaagaa

SEQ ID NO: 1003393 - RNA, 19 nt, Homo sapiens
guaccucaguggcaucauu

SEQ ID NO: 1003394 - RNA, 19 nt, Homo sapiens
uaagauguguauuguguca

SEQ ID NO: 1003395 - RNA, 19 nt, Homo sapiens
ucgaaagccuaucagcaua

SEQ ID NO: 1003396 - RNA, 19 nt, Homo sapiens
ggaagcaccuccgguugga

SEQ ID NO: 1003397 - RNA, 19 nt, Homo sapiens
aaagggcccugcauggaaa

SEQ ID NO: 1003398 - RNA, 19 nt, Homo sapiens
gaaggagagguuugauuau

SEQ ID NO: 1003399 - RNA, 19 nt, Homo sapiens
agauguguauugugucaua

SEQ ID NO: 1003400 - RNA, 19 nt, Homo sapiens
caaagggcccugcauggaa

SEQ ID NO: 1003401 - RNA, 19 nt, Homo sapiens
ggcauucgcuucaucaucu

SEQ ID NO: 1003402 - RNA, 19 nt, Homo sapiens
ucuacaacauccacaguuu

SEQ ID NO: 1003403 - RNA, 19 nt, Homo sapiens
gggacggucucaagcuauu

SEQ ID NO: 1003404 - RNA, 19 nt, Homo sapiens
acagcgaccuucuggguuu

SEQ ID NO: 1003405 - RNA, 19 nt, Homo sapiens
ugacgugggcggaaucuuu

SEQ ID NO: 1003406 - RNA, 19 nt, Homo sapiens
ugacauuucugcuguaugc

SEQ ID NO: 1003407 - RNA, 19 nt, Homo sapiens
cagcuauacuuuccucuuc

SEQ ID NO: 1003408 - RNA, 19 nt, Homo sapiens
gaaaauuccaggcgugaua

SEQ ID NO: 1003409 - RNA, 19 nt, Homo sapiens
gcugggcaccguuugauaa

SEQ ID NO: 1003410 - RNA, 19 nt, Homo sapiens
gauugagacuccagaagca

SEQ ID NO: 1003411 - RNA, 19 nt, Homo sapiens
gcuacuggguguccacaug

SEQ ID NO: 1003412 - RNA, 19 nt, Homo sapiens
gcagaugccugugccuuac

SEQ ID NO: 1003413 - RNA, 19 nt, Homo sapiens
gauagugugcuuucucuuc

SEQ ID NO: 1003414 - RNA, 19 nt, Homo sapiens
gauucuacgugguaacuca

SEQ ID NO: 1003415 - RNA, 19 nt, Homo sapiens
ugagaaugguacaaacaga

SEQ ID NO: 1003416 - RNA, 19 nt, Homo sapiens
gcuaugagaaugguacaaa

SEQ ID NO: 1003417 - RNA, 19 nt, Homo sapiens
aaggagagguuugauuaug

SEQ ID NO: 1003418 - RNA, 19 nt, Homo sapiens
gaacagcagugagaaaagu

SEQ ID NO: 1003419 - RNA, 19 nt, Homo sapiens
cuucacaacugccuuucaa

SEQ ID NO: 1003420 - RNA, 19 nt, Homo sapiens
gggauagugugcuuucucu

SEQ ID NO: 1003421 - RNA, 19 nt, Homo sapiens
cggcuccucuccuuccuuu

SEQ ID NO: 1003422 - RNA, 19 nt, Homo sapiens
gccugccgauuagguauua

SEQ ID NO: 1003423 - RNA, 19 nt, Homo sapiens
cgaaccaggucgucauucu

SEQ ID NO: 1003424 - RNA, 19 nt, Homo sapiens
caccagagcccaccagaca

SEQ ID NO: 1003425 - RNA, 19 nt, Homo sapiens
ggucaguggcgacguaaau

SEQ ID NO: 1003426 - RNA, 19 nt, Homo sapiens
uggcaggugugaucucaga

SEQ ID NO: 1003427 - RNA, 19 nt, Homo sapiens
gagaaugguacaaacagau

SEQ ID NO: 1003428 - RNA, 19 nt, Homo sapiens
cagcgaccuucuggguuua

SEQ ID NO: 1003429 - RNA, 19 nt, Homo sapiens
gagaaccccuggugcuauu

SEQ ID NO: 1003430 - RNA, 19 nt, Homo sapiens
cacaaguacugcacugcuu

SEQ ID NO: 1003431 - RNA, 19 nt, Homo sapiens
cacagaagccaaccugaga

SEQ ID NO: 1003432 - RNA, 19 nt, Homo sapiens
gaaugguacaaacagauug

SEQ ID NO: 1003433 - RNA, 19 nt, Homo sapiens
uuaucugcccuuugaaaua

SEQ ID NO: 1003434 - RNA, 19 nt, Homo sapiens
uguguauugugucauauga

SEQ ID NO: 1003435 - RNA, 19 nt, Homo sapiens
gaaauacgacaucuaaaag

SEQ ID NO: 1003436 - RNA, 19 nt, Homo sapiens
gcgaccuucuggguuuaua

SEQ ID NO: 1003437 - RNA, 19 nt, Homo sapiens
uaugaagcaucuuauucug

SEQ ID NO: 1003438 - RNA, 19 nt, Homo sapiens
caccuucuuuccacgcuuu

SEQ ID NO: 1003439 - RNA, 19 nt, Homo sapiens
aaggagacauauugcugaa

SEQ ID NO: 1003440 - RNA, 19 nt, Homo sapiens
gcuauacuuuccucuucug

SEQ ID NO: 1003441 - RNA, 19 nt, Homo sapiens
gauagaguucucacugugu

SEQ ID NO: 1003442 - RNA, 19 nt, Homo sapiens
uuaagacaaacuccaauug

SEQ ID NO: 1003443 - RNA, 19 nt, Homo sapiens
cuucagagaaccuguaugu

SEQ ID NO: 1003444 - RNA, 19 nt, Homo sapiens
ucaagaaggccgacaacca

SEQ ID NO: 1003445 - RNA, 19 nt, Homo sapiens
gcggagggaagucuuugaa

SEQ ID NO: 1003446 - RNA, 19 nt, Homo sapiens
uguauugugucauaugaag

SEQ ID NO: 1003447 - RNA, 19 nt, Homo sapiens
gauguguauugugucauau

SEQ ID NO: 1003448 - RNA, 19 nt, Homo sapiens
gacgugggcggaaucuuug

SEQ ID NO: 1003449 - RNA, 19 nt, Homo sapiens
aaaggaaggagagguuuga

SEQ ID NO: 1003450 - RNA, 19 nt, Homo sapiens
ggaaaaggaaggagagguu

SEQ ID NO: 1003451 - RNA, 19 nt, Homo sapiens
uaggguauuucuacaacau

SEQ ID NO: 1003452 - RNA, 19 nt, Homo sapiens
gcaggacaccuucuuucca

SEQ ID NO: 1003453 - RNA, 19 nt, Homo sapiens
ccaugcagccacccaaaug

SEQ ID NO: 1003454 - RNA, 19 nt, Homo sapiens
ucaaggacaguucagacaa

SEQ ID NO: 1003455 - RNA, 19 nt, Homo sapiens
agaaugguacaaacagauu

SEQ ID NO: 1003456 - RNA, 19 nt, Homo sapiens
ucaaaaggcuaugagaaug

SEQ ID NO: 1003457 - RNA, 19 nt, Homo sapiens
caacugguuuggaaaagga

SEQ ID NO: 1003458 - RNA, 19 nt, Homo sapiens
caccacaccugggacuguu

SEQ ID NO: 1003459 - RNA, 19 nt, Homo sapiens
gagcucagacccaccacau

SEQ ID NO: 1003460 - RNA, 19 nt, Homo sapiens
caaaugcacgcgugacaac

SEQ ID NO: 1003461 - RNA, 19 nt, Homo sapiens
ggcccacccuucacaacug

SEQ ID NO: 1003462 - RNA, 19 nt, Homo sapiens
ugacgggacgggcucugua

SEQ ID NO: 1003463 - RNA, 19 nt, Homo sapiens
guacaaacagauugagacu

SEQ ID NO: 1003464 - RNA, 19 nt, Homo sapiens
ccagcaggacaccuucuuu

SEQ ID NO: 1003465 - RNA, 19 nt, Homo sapiens
caauuguucucuggcuguu

SEQ ID NO: 1003466 - RNA, 19 nt, Homo sapiens
cagcaggacaccuucuuuc

SEQ ID NO: 1003467 - RNA, 19 nt, Homo sapiens
cgugguaacucaggucauc

SEQ ID NO: 1003468 - RNA, 19 nt, Homo sapiens
acaaagggcccugcaugga

SEQ ID NO: 1003469 - RNA, 19 nt, Homo sapiens
cgaauguggaucaccuuga

SEQ ID NO: 1003470 - RNA, 19 nt, Homo sapiens
gaaccaggucgucauucuc

SEQ ID NO: 1003471 - RNA, 19 nt, Homo sapiens
gaaaaggaaggagagguuu

SEQ ID NO: 1003472 - RNA, 19 nt, Homo sapiens
ggacggucucaagcuauuu

SEQ ID NO: 1003473 - RNA, 19 nt, Homo sapiens
ccagcucccugacaaugag

SEQ ID NO: 1003474 - RNA, 19 nt, Homo sapiens
cggcuucgcuccacaacac

SEQ ID NO: 1003475 - RNA, 19 nt, Homo sapiens
acaucaaagugagcgagua

SEQ ID NO: 1003476 - RNA, 19 nt, Homo sapiens
ugcagaugccugugccuua

SEQ ID NO: 1003477 - RNA, 19 nt, Homo sapiens
gaucuuaguucucuuauga

SEQ ID NO: 1003478 - RNA, 19 nt, Homo sapiens
gguuugagaugcuauauua

SEQ ID NO: 1003479 - RNA, 19 nt, Homo sapiens
ggacccagcucauauaaau

SEQ ID NO: 1003480 - RNA, 19 nt, Homo sapiens
ggacccagcucauauaaau

SEQ ID NO: 1003481 - RNA, 19 nt, Homo sapiens
ggaauucguuuauauggaa

SEQ ID NO: 1003482 - RNA, 19 nt, Homo sapiens
gaaaguagugcagauauuu

SEQ ID NO: 1003483 - RNA, 19 nt, Homo sapiens
gaaagaaaguagugcagau

SEQ ID NO: 1003484 - RNA, 19 nt, Homo sapiens
caaagugacuauaugcaaa

SEQ ID NO: 1003485 - RNA, 19 nt, Homo sapiens
uaaauggacucaccaacaa

SEQ ID NO: 1003486 - RNA, 19 nt, Homo sapiens
uaaauggacucaccaacaa

SEQ ID NO: 1003487 - RNA, 19 nt, Homo sapiens
gggaagagauucuguacga

SEQ ID NO: 1003488 - RNA, 19 nt, Homo sapiens
caaacuagagugaugaaua

SEQ ID NO: 1003489 - RNA, 19 nt, Homo sapiens
ugagagcuguguuaagaua

SEQ ID NO: 1003490 - RNA, 19 nt, Homo sapiens
ccacucaauucaauaguaa

SEQ ID NO: 1003491 - RNA, 19 nt, Homo sapiens
gugcagauauuuaaggauu

SEQ ID NO: 1003492 - RNA, 19 nt, Homo sapiens
gcaaacaagugauagugau

SEQ ID NO: 1003493 - RNA, 19 nt, Homo sapiens
gaaagucuaagaagaagaa

SEQ ID NO: 1003494 - RNA, 19 nt, Homo sapiens
caaauaggcugggauucaa

SEQ ID NO: 1003495 - RNA, 19 nt, Homo sapiens
caacagaggcaacgaaugu

SEQ ID NO: 1003496 - RNA, 19 nt, Homo sapiens
cuacaggaaugaagaaaug

SEQ ID NO: 1003497 - RNA, 19 nt, Homo sapiens
uaaccaaagugacuauaug

SEQ ID NO: 1003498 - RNA, 19 nt, Homo sapiens
uaaacaaugucauggcuau

SEQ ID NO: 1003499 - RNA, 19 nt, Homo sapiens
gaaaugacagcuccacuuc

SEQ ID NO: 1003500 - RNA, 19 nt, Homo sapiens
aaacuuaccuacacugauc

SEQ ID NO: 1003501 - RNA, 19 nt, Homo sapiens
ucacacaacuacaggaaug

SEQ ID NO: 1003502 - RNA, 19 nt, Homo sapiens
ggacauaugauaaugauac

SEQ ID NO: 1003503 - RNA, 19 nt, Homo sapiens
aaagugaggacauaugaua

SEQ ID NO: 1003504 - RNA, 19 nt, Homo sapiens
gauugcauauuguuccuaa

SEQ ID NO: 1003505 - RNA, 19 nt, Homo sapiens
ccaagugacucugaccuuu

SEQ ID NO: 1003506 - RNA, 19 nt, Homo sapiens
ccaagugacucugaccuuu

SEQ ID NO: 1003507 - RNA, 19 nt, Homo sapiens
gaggacauaugauaaugau

SEQ ID NO: 1003508 - RNA, 19 nt, Homo sapiens
ggauuugucugcuuuaaac

SEQ ID NO: 1003509 - RNA, 19 nt, Homo sapiens
caagugacucugaccuuua

SEQ ID NO: 1003510 - RNA, 19 nt, Homo sapiens
caagugacucugaccuuua

SEQ ID NO: 1003511 - RNA, 19 nt, Homo sapiens
gcaaagacagagaaggaaa

SEQ ID NO: 1003512 - RNA, 19 nt, Homo sapiens
gcagcuuccuuacuaugaa

SEQ ID NO: 1003513 - RNA, 19 nt, Homo sapiens
caacacucaacuacaaaua

SEQ ID NO: 1003514 - RNA, 19 nt, Homo sapiens
gaauuuagaggcccgaguu

SEQ ID NO: 1003515 - RNA, 19 nt, Homo sapiens
agaaaguagugcagauauu

SEQ ID NO: 1003516 - RNA, 19 nt, Homo sapiens
caaacaagugauagugaua

SEQ ID NO: 1003517 - RNA, 19 nt, Homo sapiens
cagaaucggugucuuaugc

SEQ ID NO: 1003518 - RNA, 19 nt, Homo sapiens
cugguuugcuguucaauuu

SEQ ID NO: 1003519 - RNA, 19 nt, Homo sapiens
ggaguucucgcucuucuga

SEQ ID NO: 1003520 - RNA, 19 nt, Homo sapiens
gaaggaaagccaaagucuu

SEQ ID NO: 1003521 - RNA, 19 nt, Homo sapiens
gcuaugucaguguguauua

SEQ ID NO: 1003522 - RNA, 19 nt, Homo sapiens
ucauggcuaucuugucuuu

SEQ ID NO: 1003523 - RNA, 19 nt, Homo sapiens
cagcuccacuuccuaauag

SEQ ID NO: 1003524 - RNA, 19 nt, Homo sapiens
cagcuccacuuccuaauag

SEQ ID NO: 1003525 - RNA, 19 nt, Homo sapiens
gacaggaccguguuuguug

SEQ ID NO: 1003526 - RNA, 19 nt, Homo sapiens
caaaugaaacuuaccuaca

SEQ ID NO: 1003527 - RNA, 19 nt, Homo sapiens
uuugagagcuguguuaaga

SEQ ID NO: 1003528 - RNA, 19 nt, Homo sapiens
uaacgugcaguaucgauuu

SEQ ID NO: 1003529 - RNA, 19 nt, Homo sapiens
aaccaacacucaacuacaa

SEQ ID NO: 1003530 - RNA, 19 nt, Homo sapiens
ugaaccagcuaaccaaagu

SEQ ID NO: 1003531 - RNA, 19 nt, Homo sapiens
gauaccaaaggaaagauaa

SEQ ID NO: 1003532 - RNA, 19 nt, Homo sapiens
cgacaaaagcuuucuaaaa

SEQ ID NO: 1003533 - RNA, 19 nt, Homo sapiens
ugacagcuccacuuccuaa

SEQ ID NO: 1003534 - RNA, 19 nt, Homo sapiens
ugacagcuccacuuccuaa

SEQ ID NO: 1003535 - RNA, 19 nt, Homo sapiens
gcaguggcauguguauaau

SEQ ID NO: 1003536 - RNA, 19 nt, Homo sapiens
caauuaacgugcaguaucg

SEQ ID NO: 1003537 - RNA, 19 nt, Homo sapiens
aaagaaaguagugcagaua

SEQ ID NO: 1003538 - RNA, 19 nt, Homo sapiens
caacaacagaggcaacgaa

SEQ ID NO: 1003539 - RNA, 19 nt, Homo sapiens
gaugacagcuccacuuccu

SEQ ID NO: 1003540 - RNA, 19 nt, Homo sapiens
acacugaucuuaguucucu

SEQ ID NO: 1003541 - RNA, 19 nt, Homo sapiens
gauaguagcacagacaaca

SEQ ID NO: 1003542 - RNA, 19 nt, Homo sapiens
ugccauagcuuugcugaau

SEQ ID NO: 1003543 - RNA, 19 nt, Homo sapiens
uguacgagcuguuccuuca

SEQ ID NO: 1003544 - RNA, 19 nt, Homo sapiens
ugaaucauguuccagaucu

SEQ ID NO: 1003545 - RNA, 19 nt, Homo sapiens
ugaaucauguuccagaucu

SEQ ID NO: 1003546 - RNA, 19 nt, Homo sapiens
uagcuuugcugaauggaau

SEQ ID NO: 1003547 - RNA, 19 nt, Homo sapiens
gauaaugauaccaaaggaa

SEQ ID NO: 1003548 - RNA, 19 nt, Homo sapiens
ggcaacgaauguagccaaa

SEQ ID NO: 1003549 - RNA, 19 nt, Homo sapiens
caagugauagugauaguag

SEQ ID NO: 1003550 - RNA, 19 nt, Homo sapiens
ccaaagugacuauaugcaa

SEQ ID NO: 1003551 - RNA, 19 nt, Homo sapiens
aauguggagugguggauuu

SEQ ID NO: 1003552 - RNA, 19 nt, Homo sapiens
gugaggacauaugauaaug

SEQ ID NO: 1003553 - RNA, 19 nt, Homo sapiens
gugacuauaugcaaagaca

SEQ ID NO: 1003554 - RNA, 19 nt, Homo sapiens
guaccaaugaugaaauuuc

SEQ ID NO: 1003555 - RNA, 19 nt, Homo sapiens
ugucauggcuaucuugucu

SEQ ID NO: 1003556 - RNA, 19 nt, Homo sapiens
caaaagcaaacaagugaua

SEQ ID NO: 1003557 - RNA, 19 nt, Homo sapiens
cagcuuccuuacuaugaaa

SEQ ID NO: 1003558 - RNA, 19 nt, Homo sapiens
caacuacaggaaugaagaa

SEQ ID NO: 1003559 - RNA, 19 nt, Homo sapiens
agagcuguguuaagauaaa

SEQ ID NO: 1003560 - RNA, 19 nt, Homo sapiens
cuacaaauaggcugggauu

SEQ ID NO: 1003561 - RNA, 19 nt, Homo sapiens
aaaugaaacuuaccuacac

SEQ ID NO: 1003562 - RNA, 19 nt, Homo sapiens
gauaaauucacacaacuac

SEQ ID NO: 1003563 - RNA, 19 nt, Homo sapiens
ccaauuaacgugcaguauc

SEQ ID NO: 1003564 - RNA, 19 nt, Homo sapiens
cauguugccuagcauuuua

SEQ ID NO: 1003565 - RNA, 19 nt, Homo sapiens
uuccucuucucacauauua

SEQ ID NO: 1003566 - RNA, 19 nt, Homo sapiens
gcauauuguuccuaaugag

SEQ ID NO: 1003567 - RNA, 19 nt, Homo sapiens
acaaauaggcugggauuca

SEQ ID NO: 1003568 - RNA, 19 nt, Homo sapiens
gaaacuuaccuacacugau

SEQ ID NO: 1003569 - RNA, 19 nt, Homo sapiens
ucagaugaauaaacgaaag

SEQ ID NO: 1003570 - RNA, 19 nt, Homo sapiens
cgacaggaccguguuuguu

SEQ ID NO: 1003571 - RNA, 19 nt, Homo sapiens
gcagauauuuaaggauugc

SEQ ID NO: 1003572 - RNA, 19 nt, Homo sapiens
gaaucauguuccagaucuu

SEQ ID NO: 1003573 - RNA, 19 nt, Homo sapiens
gaaucauguuccagaucuu

SEQ ID NO: 1003574 - RNA, 19 nt, Homo sapiens
gaucuuccuuucccaugca

SEQ ID NO: 1003575 - RNA, 19 nt, Homo sapiens
ugauaaugauaccaaagga

SEQ ID NO: 1003576 - RNA, 19 nt, Homo sapiens
agacuuaucucugguuugc

SEQ ID NO: 1003577 - RNA, 19 nt, Homo sapiens
cuaauaggcugcauaauug

SEQ ID NO: 1003578 - RNA, 19 nt, Homo sapiens
gcacacagcugcucucuac

SEQ ID NO: 1003579 - RNA, 19 nt, Homo sapiens
gaagguggccugaauguga

SEQ ID NO: 1003580 - RNA, 19 nt, Homo sapiens
gagaaacugugaagaagau

SEQ ID NO: 1003581 - RNA, 19 nt, Homo sapiens
uaaaucaccugcugugguu

SEQ ID NO: 1003582 - RNA, 19 nt, Homo sapiens
gagggaaacugcccagaga

SEQ ID NO: 1003583 - RNA, 19 nt, Homo sapiens
ccucagaguucaauaaaug

SEQ ID NO: 1003584 - RNA, 19 nt, Homo sapiens
ugaccaagcuccaccaguu

SEQ ID NO: 1003585 - RNA, 19 nt, Homo sapiens
gaucuaauaggcugcauaa

SEQ ID NO: 1003586 - RNA, 19 nt, Homo sapiens
gaucugcucuaaaccuuau

SEQ ID NO: 1003587 - RNA, 19 nt, Homo sapiens
gcaccggcaugcaguggua

SEQ ID NO: 1003588 - RNA, 19 nt, Homo sapiens
gaaaggaaguuggaagcau

SEQ ID NO: 1003589 - RNA, 19 nt, Homo sapiens
ggacguaugccauggagaa

SEQ ID NO: 1003590 - RNA, 19 nt, Homo sapiens
ucuaauaggcugcauaauu

SEQ ID NO: 1003591 - RNA, 19 nt, Homo sapiens
caauacgucugaaccuuug

SEQ ID NO: 1003592 - RNA, 19 nt, Homo sapiens
caugaucgcauacaaguuu

SEQ ID NO: 1003593 - RNA, 19 nt, Homo sapiens
aaagucaacccuucuguaa

SEQ ID NO: 1003594 - RNA, 19 nt, Homo sapiens
ucacagauaccaauagaga

SEQ ID NO: 1003595 - RNA, 19 nt, Homo sapiens
ccagaacuguugccugaga

SEQ ID NO: 1003596 - RNA, 19 nt, Homo sapiens
guagcugucugucuuagga

SEQ ID NO: 1003597 - RNA, 19 nt, Homo sapiens
gcagaucuguguggucaug

SEQ ID NO: 1003598 - RNA, 19 nt, Homo sapiens
gcugaugcauggaaaggaa

SEQ ID NO: 1003599 - RNA, 19 nt, Homo sapiens
caaugaaauucgacagaug

SEQ ID NO: 1003600 - RNA, 19 nt, Homo sapiens
gaaaggagaaacugugaag

SEQ ID NO: 1003601 - RNA, 19 nt, Homo sapiens
gaagaugcgugaggagagu

SEQ ID NO: 1003602 - RNA, 19 nt, Homo sapiens
agucaacccuucuguaaau

SEQ ID NO: 1003603 - RNA, 19 nt, Homo sapiens
caauagagagguuuucuua

SEQ ID NO: 1003604 - RNA, 19 nt, Homo sapiens
ggagaaacugugaagaaga

SEQ ID NO: 1003605 - RNA, 19 nt, Homo sapiens
ggcaugcagugguaauuau

SEQ ID NO: 1003606 - RNA, 19 nt, Homo sapiens
ccucacagauaccaauaga

SEQ ID NO: 1003607 - RNA, 19 nt, Homo sapiens
ggaccaaaaucaaugaaau

SEQ ID NO: 1003608 - RNA, 19 nt, Homo sapiens
caucagccuugcccaguau

SEQ ID NO: 1003609 - RNA, 19 nt, Homo sapiens
cgaagaagcucaaaaucug

SEQ ID NO: 1003610 - RNA, 19 nt, Homo sapiens
ccacagacgccaucuucaa

SEQ ID NO: 1003611 - RNA, 19 nt, Homo sapiens
gaaccguccagaacuguug

SEQ ID NO: 1003612 - RNA, 19 nt, Homo sapiens
ucaaugaaauucgacagau

SEQ ID NO: 1003613 - RNA, 19 nt, Homo sapiens
ggaagaaaggagaaacugu

SEQ ID NO: 1003614 - RNA, 19 nt, Homo sapiens
ccagaaccguccagaacug

SEQ ID NO: 1003615 - RNA, 19 nt, Homo sapiens
ucaauacgucugaaccuuu

SEQ ID NO: 1003616 - RNA, 19 nt, Homo sapiens
ggagggucauggaggaugu

SEQ ID NO: 1003617 - RNA, 19 nt, Homo sapiens
gaagcaucaucgggaagaa

SEQ ID NO: 1003618 - RNA, 19 nt, Homo sapiens
cuauggaucugcucuaaac

SEQ ID NO: 1003619 - RNA, 19 nt, Homo sapiens
gcuccucagaguucaauaa

SEQ ID NO: 1003620 - RNA, 19 nt, Homo sapiens
cagagaggauugugaccau

SEQ ID NO: 1003621 - RNA, 19 nt, Homo sapiens
gaaacugcccagagaggau

SEQ ID NO: 1003622 - RNA, 19 nt, Homo sapiens
gugcaaggaucaacaucuc

SEQ ID NO: 1003623 - RNA, 19 nt, Homo sapiens
ggaagcaucaucgggaaga

SEQ ID NO: 1003624 - RNA, 19 nt, Homo sapiens
gcaugcagugguaauuauu

SEQ ID NO: 1003625 - RNA, 19 nt, Homo sapiens
ggucaggccuacacaaucc

SEQ ID NO: 1003626 - RNA, 19 nt, Homo sapiens
aaggagaaacugugaagaa

SEQ ID NO: 1003627 - RNA, 19 nt, Homo sapiens
ggcccugccuucacagaga

SEQ ID NO: 1003628 - RNA, 19 nt, Homo sapiens
cguaugccauggagaaaca

SEQ ID NO: 1003629 - RNA, 19 nt, Homo sapiens
guuaugaugcucugaguuc

SEQ ID NO: 1003630 - RNA, 19 nt, Homo sapiens
ccuuauagccugcuuaugg

SEQ ID NO: 1003631 - RNA, 19 nt, Homo sapiens
ggaucugcucuaaaccuua

SEQ ID NO: 1003632 - RNA, 19 nt, Homo sapiens
ugucugggcucgaguuucu

SEQ ID NO: 1003633 - RNA, 19 nt, Homo sapiens
cggcaugcagugguaauua

SEQ ID NO: 1003634 - RNA, 19 nt, Homo sapiens
gaaccuuugcugucuaugg

SEQ ID NO: 1003635 - RNA, 19 nt, Homo sapiens
gucuauggaucugcucuaa

SEQ ID NO: 1003636 - RNA, 19 nt, Homo sapiens
ugggcacgcuguaauccua

SEQ ID NO: 1003637 - RNA, 19 nt, Homo sapiens
acaucagccuugcccagua

SEQ ID NO: 1003638 - RNA, 19 nt, Homo sapiens
gagaggauugugaccauca

SEQ ID NO: 1003639 - RNA, 19 nt, Homo sapiens
cacagcugcucucuacaga

SEQ ID NO: 1003640 - RNA, 19 nt, Homo sapiens
gaccaagcuccaccaguug

SEQ ID NO: 1003641 - RNA, 19 nt, Homo sapiens
ccacggaaggguccucaga

SEQ ID NO: 1003642 - RNA, 19 nt, Homo sapiens
ccuuugccaugaucgcaua

SEQ ID NO: 1003643 - RNA, 19 nt, Homo sapiens
ccucagagccauuguuguc

SEQ ID NO: 1003644 - RNA, 19 nt, Homo sapiens
gagaguggugcaaggauca

SEQ ID NO: 1003645 - RNA, 19 nt, Homo sapiens
ggaaaggaaguuggaagca

SEQ ID NO: 1003646 - RNA, 19 nt, Homo sapiens
gcauggaaaggaaguugga

SEQ ID NO: 1003647 - RNA, 19 nt, Homo sapiens
caugcagugguaauuauuu

SEQ ID NO: 1003648 - RNA, 19 nt, Homo sapiens
gagcgucagaucaccauca

SEQ ID NO: 1003649 - RNA, 19 nt, Homo sapiens
ucaaggccuuugccaugau

SEQ ID NO: 1003650 - RNA, 19 nt, Homo sapiens
cagguugugugcuggaauc

SEQ ID NO: 1003651 - RNA, 19 nt, Homo sapiens
aaccuuugcugucuaugga

SEQ ID NO: 1003652 - RNA, 19 nt, Homo sapiens
gggaugggcacgcuguaau

SEQ ID NO: 1003653 - RNA, 19 nt, Homo sapiens
ccaccacccucagccacaa

SEQ ID NO: 1003654 - RNA, 19 nt, Homo sapiens
gggacaugcugcccaacuc

SEQ ID NO: 1003655 - RNA, 19 nt, Homo sapiens
ggaugggcacgcuguaauc

SEQ ID NO: 1003656 - RNA, 19 nt, Homo sapiens
gccaugaucgcauacaagu

SEQ ID NO: 1003657 - RNA, 19 nt, Homo sapiens
caaggccuuugccaugauc

SEQ ID NO: 1003658 - RNA, 19 nt, Homo sapiens
aagaaaggagaaacuguga

SEQ ID NO: 1003659 - RNA, 19 nt, Homo sapiens
cagaagguggccugaaugu

SEQ ID NO: 1003660 - RNA, 19 nt, Homo sapiens
ugaggaggauaucaucaac

SEQ ID NO: 1003661 - RNA, 19 nt, Homo sapiens
gaagaagcucaaaaucuga

SEQ ID NO: 1003662 - RNA, 19 nt, Homo sapiens
gaggagaguggugcaagga

SEQ ID NO: 1003663 - RNA, 19 nt, Homo sapiens
aggagaaacugugaagaag

SEQ ID NO: 1003664 - RNA, 19 nt, Homo sapiens
caccugcugugguuaugau

SEQ ID NO: 1003665 - RNA, 19 nt, Homo sapiens
uggaucugcucuaaaccuu

SEQ ID NO: 1003666 - RNA, 19 nt, Homo sapiens
ggaguccaaggucucagaa

SEQ ID NO: 1003667 - RNA, 19 nt, Homo sapiens
aggaggauaucaucaacuc

SEQ ID NO: 1003668 - RNA, 19 nt, Homo sapiens
caacaucucagagggaaac

SEQ ID NO: 1003669 - RNA, 19 nt, Homo sapiens
gcacucaugagcucaccau

SEQ ID NO: 1003670 - RNA, 19 nt, Homo sapiens
uucaaggccuuugccauga

SEQ ID NO: 1003671 - RNA, 19 nt, Homo sapiens
gggaagaaaggagaaacug

SEQ ID NO: 1003672 - RNA, 19 nt, Homo sapiens
ggaaguuggaagcaucauc

SEQ ID NO: 1003673 - RNA, 19 nt, Homo sapiens
ucugaaccuuugcugucua

SEQ ID NO: 1003674 - RNA, 19 nt, Homo sapiens
cugaaccuuugcugucuau

SEQ ID NO: 1003675 - RNA, 19 nt, Homo sapiens
aaugaaauucgacagaugu

SEQ ID NO: 1003676 - RNA, 19 nt, Homo sapiens
gcgucaagcagaucugugu

SEQ ID NO: 1003677 - RNA, 19 nt, Homo sapiens
gacagaagcuggagcaaga

SEQ ID NO: 1003678 - RNA, 19 nt, Homo sapiens
caggacagauucuuucauu

SEQ ID NO: 1003679 - RNA, 19 nt, Homo sapiens
guuaaaagcucaaaccaaa

SEQ ID NO: 1003680 - RNA, 19 nt, Homo sapiens
gagacaggaugaccagaga

SEQ ID NO: 1003681 - RNA, 19 nt, Homo sapiens
caacggucaggaaguauua

SEQ ID NO: 1003682 - RNA, 19 nt, Homo sapiens
caggaaguauuaaggaaga

SEQ ID NO: 1003683 - RNA, 19 nt, Homo sapiens
ucccagugcuuccaucuuu

SEQ ID NO: 1003684 - RNA, 19 nt, Homo sapiens
acucaacggucaggaagua

SEQ ID NO: 1003685 - RNA, 19 nt, Homo sapiens
gaaggugauuccagagacu

SEQ ID NO: 1003686 - RNA, 19 nt, Homo sapiens
gagcaagugacccgacuga

SEQ ID NO: 1003687 - RNA, 19 nt, Homo sapiens
acucugugcucucguuaaa

SEQ ID NO: 1003688 - RNA, 19 nt, Homo sapiens
ccaccaugcuggacucauc

SEQ ID NO: 1003689 - RNA, 19 nt, Homo sapiens
gucaggaaguauuaaggaa

SEQ ID NO: 1003690 - RNA, 19 nt, Homo sapiens
caguaacacucacuucucu

SEQ ID NO: 1003691 - RNA, 19 nt, Homo sapiens
ggacagauucuuucauucc

SEQ ID NO: 1003692 - RNA, 19 nt, Homo sapiens
ggucaggaaguauuaagga

SEQ ID NO: 1003693 - RNA, 19 nt, Homo sapiens
gacugacgcugaagcucuu

SEQ ID NO: 1003694 - RNA, 19 nt, Homo sapiens
guaacacucacuucucuca

SEQ ID NO: 1003695 - RNA, 19 nt, Homo sapiens
gcaguaacacucacuucuc

SEQ ID NO: 1003696 - RNA, 19 nt, Homo sapiens
gcagagacuccgggaacaa

SEQ ID NO: 1003697 - RNA, 19 nt, Homo sapiens
caggaugaccagagaguug

SEQ ID NO: 1003698 - RNA, 19 nt, Homo sapiens
cugaagcucuugggacaga

SEQ ID NO: 1003699 - RNA, 19 nt, Homo sapiens
ccacucauagcacagauuc

SEQ ID NO: 1003700 - RNA, 19 nt, Homo sapiens
aacacucacuucucucaga

SEQ ID NO: 1003701 - RNA, 19 nt, Homo sapiens
ugacccgacugacgcugaa

SEQ ID NO: 1003702 - RNA, 19 nt, Homo sapiens
ccagugcuuccaucuuuga

SEQ ID NO: 1003703 - RNA, 19 nt, Homo sapiens
gagggaccuucugcagaga

SEQ ID NO: 1003704 - RNA, 19 nt, Homo sapiens
ucaacggucaggaaguauu

SEQ ID NO: 1003705 - RNA, 19 nt, Homo sapiens
gacagauucuuucauuccu

SEQ ID NO: 1003706 - RNA, 19 nt, Homo sapiens
gaaguauuaaggaagacau

SEQ ID NO: 1003707 - RNA, 19 nt, Homo sapiens
uuucgugccucuugaaggu

SEQ ID NO: 1003708 - RNA, 19 nt, Homo sapiens
accagagaguugccacuga

SEQ ID NO: 1003709 - RNA, 19 nt, Homo sapiens
gacaggaugaccagagagu

SEQ ID NO: 1003710 - RNA, 19 nt, Homo sapiens
gcaggacagauucuuucau

SEQ ID NO: 1003711 - RNA, 19 nt, Homo sapiens
gcaaugaagucaauucgaa

SEQ ID NO: 1003712 - RNA, 19 nt, Homo sapiens
gaaaugcuauauagugcaa

SEQ ID NO: 1003713 - RNA, 19 nt, Homo sapiens
gauaaucucaucaugguaa

SEQ ID NO: 1003714 - RNA, 19 nt, Homo sapiens
gagcuaaagacauuucaua

SEQ ID NO: 1003715 - RNA, 19 nt, Homo sapiens
gaauaaagcaaacacucua

SEQ ID NO: 1003716 - RNA, 19 nt, Homo sapiens
ugaaauauguggucuccaa

SEQ ID NO: 1003717 - RNA, 19 nt, Homo sapiens
ggaagaagcaaucagagaa

SEQ ID NO: 1003718 - RNA, 19 nt, Homo sapiens
gaagaagcaaucagagaaa

SEQ ID NO: 1003719 - RNA, 19 nt, Homo sapiens
gcgaccaucuggacaauau

SEQ ID NO: 1003720 - RNA, 19 nt, Homo sapiens
gaagucaauucgaagacaa

SEQ ID NO: 1003721 - RNA, 19 nt, Homo sapiens
ccaacuauguggaacagaa

SEQ ID NO: 1003722 - RNA, 19 nt, Homo sapiens
caacaugaauaaagcaaac

SEQ ID NO: 1003723 - RNA, 19 nt, Homo sapiens
gaaauauguggucuccaaa

SEQ ID NO: 1003724 - RNA, 19 nt, Homo sapiens
guccuuugcucuacuguug

SEQ ID NO: 1003725 - RNA, 19 nt, Homo sapiens
ggucagguccuuugcucua

SEQ ID NO: 1003726 - RNA, 19 nt, Homo sapiens
ucagaaguauggaaaagua

SEQ ID NO: 1003727 - RNA, 19 nt, Homo sapiens
caaaugaagacguggacaa

SEQ ID NO: 1003728 - RNA, 19 nt, Homo sapiens
ccacuuugccgacaaggaa

SEQ ID NO: 1003729 - RNA, 19 nt, Homo sapiens
gaaccgcagugugaaaugc

SEQ ID NO: 1003730 - RNA, 19 nt, Homo sapiens
cagcagguuugaguggaua

SEQ ID NO: 1003731 - RNA, 19 nt, Homo sapiens
uggauuacuuugagcuaaa

SEQ ID NO: 1003732 - RNA, 19 nt, Homo sapiens
guggauuacuuugagcuaa

SEQ ID NO: 1003733 - RNA, 19 nt, Homo sapiens
aaaggaagaagcaaucaga

SEQ ID NO: 1003734 - RNA, 19 nt, Homo sapiens
gcuuauguaugcaauaugc

SEQ ID NO: 1003735 - RNA, 19 nt, Homo sapiens
agauguggguguaaauaug

SEQ ID NO: 1003736 - RNA, 19 nt, Homo sapiens
agugugaaaugcuauauag

SEQ ID NO: 1003737 - RNA, 19 nt, Homo sapiens
uuaauucucugccugacau

SEQ ID NO: 1003738 - RNA, 19 nt, Homo sapiens
caaacacucuagacuucuc

SEQ ID NO: 1003739 - RNA, 19 nt, Homo sapiens
agcaaacacucuagacuuc

SEQ ID NO: 1003740 - RNA, 19 nt, Homo sapiens
cgcauaaacaacaugaaua

SEQ ID NO: 1003741 - RNA, 19 nt, Homo sapiens
gcuauauagugcaaugaag

SEQ ID NO: 1003742 - RNA, 19 nt, Homo sapiens
ugaauuggaagguucuuga

SEQ ID NO: 1003743 - RNA, 19 nt, Homo sapiens
uaacgcauaaacaacauga

SEQ ID NO: 1003744 - RNA, 19 nt, Homo sapiens
gguggaaguggcaauggua

SEQ ID NO: 1003745 - RNA, 19 nt, Homo sapiens
ucucaucaugguaaaguua

SEQ ID NO: 1003746 - RNA, 19 nt, Homo sapiens
aaaugggcaugaaggauuc

SEQ ID NO: 1003747 - RNA, 19 nt, Homo sapiens
uaacugaagguccuaacug

SEQ ID NO: 1003748 - RNA, 19 nt, Homo sapiens
cgguagaagucgugguuug

SEQ ID NO: 1003749 - RNA, 19 nt, Homo sapiens
gcaaugguaguccuagagu

SEQ ID NO: 1003750 - RNA, 19 nt, Homo sapiens
auaauuggcuuguggucau

SEQ ID NO: 1003751 - RNA, 19 nt, Homo sapiens
aauauguggucuccaaaca

SEQ ID NO: 1003752 - RNA, 19 nt, Homo sapiens
ggagcucaaguuuggauga

SEQ ID NO: 1003753 - RNA, 19 nt, Homo sapiens
ccagcugccucucauguac

SEQ ID NO: 1003754 - RNA, 19 nt, Homo sapiens
ugaagucaauucgaagaca

SEQ ID NO: 1003755 - RNA, 19 nt, Homo sapiens
cacagucuaccaugaauug

SEQ ID NO: 1003756 - RNA, 19 nt, Homo sapiens
agucuaccaugaauuggaa

SEQ ID NO: 1003757 - RNA, 19 nt, Homo sapiens
aaaugaagacguggacaaa

SEQ ID NO: 1003758 - RNA, 19 nt, Homo sapiens
aagcaaacacucuagacuu

SEQ ID NO: 1003759 - RNA, 19 nt, Homo sapiens
ugugaaaugcuauauagug

SEQ ID NO: 1003760 - RNA, 19 nt, Homo sapiens
gacgguagaagucgugguu

SEQ ID NO: 1003761 - RNA, 19 nt, Homo sapiens
ggaggagggagucuugcuu

SEQ ID NO: 1003762 - RNA, 19 nt, Homo sapiens
gguguaaauaugcuuaugu

SEQ ID NO: 1003763 - RNA, 19 nt, Homo sapiens
gccaggaucagcagguuug

SEQ ID NO: 1003764 - RNA, 19 nt, Homo sapiens
uaacugggaccaccuacuc

SEQ ID NO: 1003765 - RNA, 19 nt, Homo sapiens
gaaaggaagaagcaaucag

SEQ ID NO: 1003766 - RNA, 19 nt, Homo sapiens
uuagauguggguguaaaua

SEQ ID NO: 1003767 - RNA, 19 nt, Homo sapiens
auagugcaaugaagucaau

SEQ ID NO: 1003768 - RNA, 19 nt, Homo sapiens
ggaaguggcaaugguaguc

SEQ ID NO: 1003769 - RNA, 19 nt, Homo sapiens
uaccaugaauuggaagguu

SEQ ID NO: 1003770 - RNA, 19 nt, Homo sapiens
uaauuggcuuguggucauu

SEQ ID NO: 1003771 - RNA, 19 nt, Homo sapiens
ugaauaaagcaaacacucu

SEQ ID NO: 1003772 - RNA, 19 nt, Homo sapiens
uagauguggguguaaauau

SEQ ID NO: 1003773 - RNA, 19 nt, Homo sapiens
ggaaccgcagugugaaaug

SEQ ID NO: 1003774 - RNA, 19 nt, Homo sapiens
guugaauggaggaggauuu

SEQ ID NO: 1003775 - RNA, 19 nt, Homo sapiens
gcugaaaggaagaagcaau

SEQ ID NO: 1003776 - RNA, 19 nt, Homo sapiens
ggguguaaauaugcuuaug

SEQ ID NO: 1003777 - RNA, 19 nt, Homo sapiens
cucauguacuugucuguug

SEQ ID NO: 1003778 - RNA, 19 nt, Homo sapiens
ucaauucgaagacaagagu

SEQ ID NO: 1003779 - RNA, 19 nt, Homo sapiens
gccuggaaccgcaguguga

SEQ ID NO: 1003780 - RNA, 19 nt, Homo sapiens
uggcugcucugguggaagu

SEQ ID NO: 1003781 - RNA, 19 nt, Homo sapiens
agguuugaguggauaauug

SEQ ID NO: 1003782 - RNA, 19 nt, Homo sapiens
gguagaagucgugguuugu

SEQ ID NO: 1003783 - RNA, 19 nt, Homo sapiens
gacaaggaaggaaggacaa

SEQ ID NO: 1003784 - RNA, 19 nt, Homo sapiens
ggaggguccggauggaguu

SEQ ID NO: 1003785 - RNA, 19 nt, Homo sapiens
cagugugaaaugcuauaua

SEQ ID NO: 1003786 - RNA, 19 nt, Homo sapiens
ggaugccaacuauguggaa

SEQ ID NO: 1003787 - RNA, 19 nt, Homo sapiens
aaugcuauauagugcaaug

SEQ ID NO: 1003788 - RNA, 19 nt, Homo sapiens
acacagggguuuucuugga

SEQ ID NO: 1003789 - RNA, 19 nt, Homo sapiens
ccuuugcucuacuguugaa

SEQ ID NO: 1003790 - RNA, 19 nt, Homo sapiens
gcagugugaaaugcuauau

SEQ ID NO: 1003791 - RNA, 19 nt, Homo sapiens
gagcucaaguuuggaugac

SEQ ID NO: 1003792 - RNA, 19 nt, Homo sapiens
guagaagucgugguuugug

SEQ ID NO: 1003793 - RNA, 19 nt, Homo sapiens
ccugucagccacacccuuu

SEQ ID NO: 1003794 - RNA, 19 nt, Homo sapiens
gacauuugcuggggugaaa

SEQ ID NO: 1003795 - RNA, 19 nt, Homo sapiens
gcaaacacucuagacuucu

SEQ ID NO: 1003796 - RNA, 19 nt, Homo sapiens
ggagcaaucagaccuucca

SEQ ID NO: 1003797 - RNA, 19 nt, Homo sapiens
ugaauucacagucuaccau

SEQ ID NO: 1003798 - RNA, 19 nt, Homo sapiens
ucagcagguuugaguggau

SEQ ID NO: 1003799 - RNA, 19 nt, Homo sapiens
ccaccacuuugccgacaag

SEQ ID NO: 1003800 - RNA, 19 nt, Homo sapiens
cuguauaucuuggcagcaa

SEQ ID NO: 1003801 - RNA, 19 nt, Homo sapiens
guggguguaaauaugcuua

SEQ ID NO: 1003802 - RNA, 19 nt, Homo sapiens
uggcaaugguaguccuaga

SEQ ID NO: 1003803 - RNA, 19 nt, Homo sapiens
ucacagucuaccaugaauu

SEQ ID NO: 1003804 - RNA, 19 nt, Homo sapiens
gaauuggaagguucuugag

SEQ ID NO: 1003805 - RNA, 19 nt, Homo sapiens
uaacacagauggaagaugu

SEQ ID NO: 1003806 - RNA, 19 nt, Homo sapiens
caaauugugucagaagaua

SEQ ID NO: 1003807 - RNA, 19 nt, Homo sapiens
aagcagaguugaaauagaa

SEQ ID NO: 1003808 - RNA, 19 nt, Homo sapiens
gaacagaagcuauccaaac

SEQ ID NO: 1003809 - RNA, 19 nt, Homo sapiens
ugaaagcagaguugaaaua

SEQ ID NO: 1003810 - RNA, 19 nt, Homo sapiens
uugaagccauugaaaguua

SEQ ID NO: 1003811 - RNA, 19 nt, Homo sapiens
gaaagcagaguugaaauag

SEQ ID NO: 1003812 - RNA, 19 nt, Homo sapiens
aagcugaacucuagucugu

SEQ ID NO: 1003813 - RNA, 19 nt, Homo sapiens
gcugaacucuagucugugu

SEQ ID NO: 1003814 - RNA, 19 nt, Homo sapiens
gaagcuauccaaacgugaa

SEQ ID NO: 1003815 - RNA, 19 nt, Homo sapiens
gccaccagcuguugcagaa

SEQ ID NO: 1003816 - RNA, 19 nt, Homo sapiens
uaaaugaagcaacauagug

SEQ ID NO: 1003817 - RNA, 19 nt, Homo sapiens
ggaggccgaauccaaauug

SEQ ID NO: 1003818 - RNA, 19 nt, Homo sapiens
uguguuuccuguaauguuu

SEQ ID NO: 1003819 - RNA, 19 nt, Homo sapiens
gauaaggaacagaagcuau

SEQ ID NO: 1003820 - RNA, 19 nt, Homo sapiens
guaauguuucuguggauaa

SEQ ID NO: 1003821 - RNA, 19 nt, Homo sapiens
aaaugaagcaacauaguga

SEQ ID NO: 1003822 - RNA, 19 nt, Homo sapiens
uguaaaagcugaacucuag

SEQ ID NO: 1003823 - RNA, 19 nt, Homo sapiens
aaagcagaguugaaauaga

SEQ ID NO: 1003824 - RNA, 19 nt, Homo sapiens
gcaaauugugucagaagau

SEQ ID NO: 1003825 - RNA, 19 nt, Homo sapiens
gucagaagauaaagagcuu

SEQ ID NO: 1003826 - RNA, 19 nt, Homo sapiens
ggaaaaugguugcguccuu

SEQ ID NO: 1003827 - RNA, 19 nt, Homo sapiens
ggaacagaagcuauccaaa

SEQ ID NO: 1003828 - RNA, 19 nt, Homo sapiens
gccauugaaaguuauguuu

SEQ ID NO: 1003829 - RNA, 19 nt, Homo sapiens
guugcguccuugagacuuu

SEQ ID NO: 1003830 - RNA, 19 nt, Homo sapiens
uguaauguuucuguggaua

SEQ ID NO: 1003831 - RNA, 19 nt, Homo sapiens
ugaagccauugaaaguuau

SEQ ID NO: 1003832 - RNA, 19 nt, Homo sapiens
gaugcacgcccaagaaucu

SEQ ID NO: 1003833 - RNA, 19 nt, Homo sapiens
ggauaaggaacagaagcua

SEQ ID NO: 1003834 - RNA, 19 nt, Homo sapiens
ccucaguguugaagccauu

SEQ ID NO: 1003835 - RNA, 19 nt, Homo sapiens
aaaagcaaauugugucaga

SEQ ID NO: 1003836 - RNA, 19 nt, Homo sapiens
caccagcuguugcagaagu

SEQ ID NO: 1003837 - RNA, 19 nt, Homo sapiens
gugggaggccgaauccaaa

SEQ ID NO: 1003838 - RNA, 19 nt, Homo sapiens
aaagcaaauugugucagaa

SEQ ID NO: 1003839 - RNA, 19 nt, Homo sapiens
gaggccgaauccaaauugu

SEQ ID NO: 1003840 - RNA, 19 nt, Homo sapiens
cuugaaagcagaguugaaa

SEQ ID NO: 1003841 - RNA, 19 nt, Homo sapiens
acagaugcacgcccaagaa

SEQ ID NO: 1003842 - RNA, 19 nt, Homo sapiens
aacagaagcuauccaaacg

SEQ ID NO: 1003843 - RNA, 19 nt, Homo sapiens
guuaaaugaagcaacauag

SEQ ID NO: 1003844 - RNA, 19 nt, Homo sapiens
gggaggccgaauccaaauu

SEQ ID NO: 1003845 - RNA, 19 nt, Homo sapiens
gaaaagucucuaacacaga

SEQ ID NO: 1003846 - RNA, 19 nt, Homo sapiens
gcaggcguucggucacuga

SEQ ID NO: 1003847 - RNA, 19 nt, Homo sapiens
guugaagccauugaaaguu

SEQ ID NO: 1003848 - RNA, 19 nt, Homo sapiens
cagaugcacgcccaagaau

SEQ ID NO: 1003849 - RNA, 19 nt, Homo sapiens
uaauguuucuguggauaag

SEQ ID NO: 1003850 - RNA, 19 nt, Homo sapiens
aaaagucucuaacacagau

SEQ ID NO: 1003851 - RNA, 19 nt, Homo sapiens
gaagccauugaaaguuaug

SEQ ID NO: 1003852 - RNA, 19 nt, Homo sapiens
aaagaugacuccugaaaua

SEQ ID NO: 1003853 - RNA, 19 nt, Homo sapiens
ggagaugaauaaagaagaa

SEQ ID NO: 1003854 - RNA, 19 nt, Homo sapiens
uaaaggauuugguucguaa

SEQ ID NO: 1003855 - RNA, 19 nt, Homo sapiens
uaauguagcucuagguuau

SEQ ID NO: 1003856 - RNA, 19 nt, Homo sapiens
gucuagaccucaaaucuua

SEQ ID NO: 1003857 - RNA, 19 nt, Homo sapiens
gaacuccauucuuguaaau

SEQ ID NO: 1003858 - RNA, 19 nt, Homo sapiens
gcuaugauauucaggaaga

SEQ ID NO: 1003859 - RNA, 19 nt, Homo sapiens
aagaggagaugaauaaaga

SEQ ID NO: 1003860 - RNA, 19 nt, Homo sapiens
gaagagaagauuugaggaa

SEQ ID NO: 1003861 - RNA, 19 nt, Homo sapiens
gagcacagaucacaucaag

SEQ ID NO: 1003862 - RNA, 19 nt, Homo sapiens
ucucuuaguugcuucuuua

SEQ ID NO: 1003863 - RNA, 19 nt, Homo sapiens
guaaaucucuuaguugcuu

SEQ ID NO: 1003864 - RNA, 19 nt, Homo sapiens
gugaagaggagaugaauaa

SEQ ID NO: 1003865 - RNA, 19 nt, Homo sapiens
gagaacagauaucuucauc

SEQ ID NO: 1003866 - RNA, 19 nt, Homo sapiens
caggagaauucuacuguuu

SEQ ID NO: 1003867 - RNA, 19 nt, Homo sapiens
uaaccacagucaauaaaga

SEQ ID NO: 1003868 - RNA, 19 nt, Homo sapiens
gaugacuccugaaauaaga

SEQ ID NO: 1003869 - RNA, 19 nt, Homo sapiens
aggcuaaacuuaaguggua

SEQ ID NO: 1003870 - RNA, 19 nt, Homo sapiens
gaucacaucaagagucuaa

SEQ ID NO: 1003871 - RNA, 19 nt, Homo sapiens
gcacagaucacaucaagag

SEQ ID NO: 1003872 - RNA, 19 nt, Homo sapiens
gauaaggagaucugaaauu

SEQ ID NO: 1003873 - RNA, 19 nt, Homo sapiens
ugacuuacguccuuuaaag

SEQ ID NO: 1003874 - RNA, 19 nt, Homo sapiens
gaaacacgauaaccacagu

SEQ ID NO: 1003875 - RNA, 19 nt, Homo sapiens
gaagaggaagagaagauuu

SEQ ID NO: 1003876 - RNA, 19 nt, Homo sapiens
gaacacaugcacaaacuca

SEQ ID NO: 1003877 - RNA, 19 nt, Homo sapiens
agagaagauuugaggaaua

SEQ ID NO: 1003878 - RNA, 19 nt, Homo sapiens
gaaauaagacagugaucau

SEQ ID NO: 1003879 - RNA, 19 nt, Homo sapiens
uaccaaggauuaaggauga

SEQ ID NO: 1003880 - RNA, 19 nt, Homo sapiens
ggaacuuuaccaaggauua

SEQ ID NO: 1003881 - RNA, 19 nt, Homo sapiens
cagcagaagagaaaguuua

SEQ ID NO: 1003882 - RNA, 19 nt, Homo sapiens
auaaggagaucugaaauug

SEQ ID NO: 1003883 - RNA, 19 nt, Homo sapiens
caucuaauguucccugaau

SEQ ID NO: 1003884 - RNA, 19 nt, Homo sapiens
gagaagauuugaggaauac

SEQ ID NO: 1003885 - RNA, 19 nt, Homo sapiens
uaacuugcauuuccuuauc

SEQ ID NO: 1003886 - RNA, 19 nt, Homo sapiens
gauaaccacagucaauaaa

SEQ ID NO: 1003887 - RNA, 19 nt, Homo sapiens
gaaacaaucucuggaaaau

SEQ ID NO: 1003888 - RNA, 19 nt, Homo sapiens
gaacuuuaccaaggauuaa

SEQ ID NO: 1003889 - RNA, 19 nt, Homo sapiens
uaacagaugucaguaggau

SEQ ID NO: 1003890 - RNA, 19 nt, Homo sapiens
ggauuugguucguaagguu

SEQ ID NO: 1003891 - RNA, 19 nt, Homo sapiens
gagcagaacacaugcacaa

SEQ ID NO: 1003892 - RNA, 19 nt, Homo sapiens
caucaagagucuaaauauc

SEQ ID NO: 1003893 - RNA, 19 nt, Homo sapiens
ccucaaacuuguagcugua

SEQ ID NO: 1003894 - RNA, 19 nt, Homo sapiens
gaaaacacccucaaaggaa

SEQ ID NO: 1003895 - RNA, 19 nt, Homo sapiens
gaagaggagaugaauaaag

SEQ ID NO: 1003896 - RNA, 19 nt, Homo sapiens
gaggaauacuuagaacaga

SEQ ID NO: 1003897 - RNA, 19 nt, Homo sapiens
uccagcagcuccacgauaa

SEQ ID NO: 1003898 - RNA, 19 nt, Homo sapiens
gaaaagaugacuccugaaa

SEQ ID NO: 1003899 - RNA, 19 nt, Homo sapiens
aaggagaucugaaauugau

SEQ ID NO: 1003900 - RNA, 19 nt, Homo sapiens
cagaagagaaaguuuaaga

SEQ ID NO: 1003901 - RNA, 19 nt, Homo sapiens
gauuaaggaugagcacaga

SEQ ID NO: 1003902 - RNA, 19 nt, Homo sapiens
gacucuggcugaagaauuc

SEQ ID NO: 1003903 - RNA, 19 nt, Homo sapiens
gugguaaagaucugaaaua

SEQ ID NO: 1003904 - RNA, 19 nt, Homo sapiens
uauuucaucuucccuauuc

SEQ ID NO: 1003905 - RNA, 19 nt, Homo sapiens
gaagauuugaggaauacuu

SEQ ID NO: 1003906 - RNA, 19 nt, Homo sapiens
gugcagaucagauuuggaa

SEQ ID NO: 1003907 - RNA, 19 nt, Homo sapiens
uaacacagaacaaccacaa

SEQ ID NO: 1003908 - RNA, 19 nt, Homo sapiens
ugcacaaacucaugccaua

SEQ ID NO: 1003909 - RNA, 19 nt, Homo sapiens
ucauaggucucuaauaacu

SEQ ID NO: 1003910 - RNA, 19 nt, Homo sapiens
gaaaauaugugugacuuac

SEQ ID NO: 1003911 - RNA, 19 nt, Homo sapiens
guagcuguaugaacaagug

SEQ ID NO: 1003912 - RNA, 19 nt, Homo sapiens
agagaaaguuuaagaaagc

SEQ ID NO: 1003913 - RNA, 19 nt, Homo sapiens
ccuauuccaucuaauguuc

SEQ ID NO: 1003914 - RNA, 19 nt, Homo sapiens
cagaacacaugcacaaacu

SEQ ID NO: 1003915 - RNA, 19 nt, Homo sapiens
caacaacaggagaauucua

SEQ ID NO: 1003916 - RNA, 19 nt, Homo sapiens
agacagugaucauuaggau

SEQ ID NO: 1003917 - RNA, 19 nt, Homo sapiens
cagaucagauuuggaagug

SEQ ID NO: 1003918 - RNA, 19 nt, Homo sapiens
uuaaaggauuugguucgua

SEQ ID NO: 1003919 - RNA, 19 nt, Homo sapiens
cgauaaccacagucaauaa

SEQ ID NO: 1003920 - RNA, 19 nt, Homo sapiens
aaacccagcagaagagaaa

SEQ ID NO: 1003921 - RNA, 19 nt, Homo sapiens
ucuaauaacuugcauuucc

SEQ ID NO: 1003922 - RNA, 19 nt, Homo sapiens
ggucgucgccaauaccaaa

SEQ ID NO: 1003923 - RNA, 19 nt, Homo sapiens
gagucuaaauaucacuuug

SEQ ID NO: 1003924 - RNA, 19 nt, Homo sapiens
ucaucuccuucaugcauua

SEQ ID NO: 1003925 - RNA, 19 nt, Homo sapiens
auaggucucuaauaacuug

SEQ ID NO: 1003926 - RNA, 19 nt, Homo sapiens
cuaagcuucugcuguguau

SEQ ID NO: 1003927 - RNA, 19 nt, Homo sapiens
caauuagucuagaccucaa

SEQ ID NO: 1003928 - RNA, 19 nt, Homo sapiens
cacaucaagagucuaaaua

SEQ ID NO: 1003929 - RNA, 19 nt, Homo sapiens
auacuaggcuaaacuuaag

SEQ ID NO: 1003930 - RNA, 19 nt, Homo sapiens
ucuaauguucccugaauuu

SEQ ID NO: 1003931 - RNA, 19 nt, Homo sapiens
ggaauacuuagaacagaau

SEQ ID NO: 1003932 - RNA, 19 nt, Homo sapiens
caugcauuauccuuaguaa

SEQ ID NO: 1003933 - RNA, 19 nt, Homo sapiens
uaccuacaguaugauguua

SEQ ID NO: 1003934 - RNA, 19 nt, Homo sapiens
caucuucccuauuccaucu

SEQ ID NO: 1003935 - RNA, 19 nt, Homo sapiens
uaaagaccaaggccacauu

SEQ ID NO: 1003936 - RNA, 19 nt, Homo sapiens
gcagaacacaugcacaaac

SEQ ID NO: 1003937 - RNA, 19 nt, Homo sapiens
aagagaagauuugaggaau

SEQ ID NO: 1003938 - RNA, 19 nt, Homo sapiens
auaagacagugaucauuag

SEQ ID NO: 1003939 - RNA, 19 nt, Homo sapiens
cagaucacaucaagagucu

SEQ ID NO: 1003940 - RNA, 19 nt, Homo sapiens
uaaggagaucugaaauuga

SEQ ID NO: 1003941 - RNA, 19 nt, Homo sapiens
caaggccacauuccauuga

SEQ ID NO: 1003942 - RNA, 19 nt, Homo sapiens
uagcuaugauauucaggaa

SEQ ID NO: 1003943 - RNA, 19 nt, Homo sapiens
ggacaagguuccccacauc

SEQ ID NO: 1003944 - RNA, 19 nt, Homo sapiens
gcagaucagauuuggaagu

SEQ ID NO: 1003945 - RNA, 19 nt, Homo sapiens
gaugcaucuuuaugucuga

SEQ ID NO: 1003946 - RNA, 19 nt, Homo sapiens
acaguaugauguuagugaa

SEQ ID NO: 1003947 - RNA, 19 nt, Homo sapiens
gagaacacacuggagauca

SEQ ID NO: 1003948 - RNA, 19 nt, Homo sapiens
acuuguagcuguaugaaca

SEQ ID NO: 1003949 - RNA, 19 nt, Homo sapiens
gaaaagccucaaacuugua

SEQ ID NO: 1003950 - RNA, 19 nt, Homo sapiens
gaagaaaacacccucaaag

SEQ ID NO: 1003951 - RNA, 19 nt, Homo sapiens
ggaugaagaggaagagaag

SEQ ID NO: 1003952 - RNA, 19 nt, Homo sapiens
gcacaggccuuuccaauga

SEQ ID NO: 1003953 - RNA, 19 nt, Homo sapiens
ggaacaagcugccaauaau

SEQ ID NO: 1003954 - RNA, 19 nt, Homo sapiens
gaacuucccuucuaaacug

SEQ ID NO: 1003955 - RNA, 19 nt, Homo sapiens
gcaaagagacgaaucaaga

SEQ ID NO: 1003956 - RNA, 19 nt, Homo sapiens
cuacaggucugguaacauu

SEQ ID NO: 1003957 - RNA, 19 nt, Homo sapiens
ugagagagauaacauauuc

SEQ ID NO: 1003958 - RNA, 19 nt, Homo sapiens
gcaaauuuguccagacuuc

SEQ ID NO: 1003959 - RNA, 19 nt, Homo sapiens
gcagagaacacagcaaauu

SEQ ID NO: 1003960 - RNA, 19 nt, Homo sapiens
gaagaugggagagacauuu

SEQ ID NO: 1003961 - RNA, 19 nt, Homo sapiens
ugacuagucucauggauca

SEQ ID NO: 1003962 - RNA, 19 nt, Homo sapiens
gagcagagaacacagcaaa

SEQ ID NO: 1003963 - RNA, 19 nt, Homo sapiens
gaagaggaccuugaaccua

SEQ ID NO: 1003964 - RNA, 19 nt, Homo sapiens
gacaauagguacagcaaag

SEQ ID NO: 1003965 - RNA, 19 nt, Homo sapiens
gaacaagcugccaauaaug

SEQ ID NO: 1003966 - RNA, 19 nt, Homo sapiens
ucucauggaucaaaucuau

SEQ ID NO: 1003967 - RNA, 19 nt, Homo sapiens
guuuggaauuugcaucuua

SEQ ID NO: 1003968 - RNA, 19 nt, Homo sapiens
aaucacuccucucucuuua

SEQ ID NO: 1003969 - RNA, 19 nt, Homo sapiens
cagagaacacagcaaauuu

SEQ ID NO: 1003970 - RNA, 19 nt, Homo sapiens
gagaaggaauauaaauagg

SEQ ID NO: 1003971 - RNA, 19 nt, Homo sapiens
gcuguagccuaucugacua

SEQ ID NO: 1003972 - RNA, 19 nt, Homo sapiens
gugagugcuuagaguguua

SEQ ID NO: 1003973 - RNA, 19 nt, Homo sapiens
gaccuugaaccuagaauga

SEQ ID NO: 1003974 - RNA, 19 nt, Homo sapiens
cuacagaaacugagauaau

SEQ ID NO: 1003975 - RNA, 19 nt, Homo sapiens
gaagaggaagccagaagau

SEQ ID NO: 1003976 - RNA, 19 nt, Homo sapiens
cuucuaaacugcaauugga

SEQ ID NO: 1003977 - RNA, 19 nt, Homo sapiens
uggaucaaaucuauuguga

SEQ ID NO: 1003978 - RNA, 19 nt, Homo sapiens
ccaacacccuucucagcuu

SEQ ID NO: 1003979 - RNA, 19 nt, Homo sapiens
uauaaagccugacaauagg

SEQ ID NO: 1003980 - RNA, 19 nt, Homo sapiens
aaagugaauucuuccaaca

SEQ ID NO: 1003981 - RNA, 19 nt, Homo sapiens
auauaaagccugacaauag

SEQ ID NO: 1003982 - RNA, 19 nt, Homo sapiens
acaguugccugcuuucaau

SEQ ID NO: 1003983 - RNA, 19 nt, Homo sapiens
gagaacacagcaaauuugu

SEQ ID NO: 1003984 - RNA, 19 nt, Homo sapiens
ucacuccucucucuuuaca

SEQ ID NO: 1003985 - RNA, 19 nt, Homo sapiens
caaucacuccucucucuuu

SEQ ID NO: 1003986 - RNA, 19 nt, Homo sapiens
gaaggaacaagcugccaau

SEQ ID NO: 1003987 - RNA, 19 nt, Homo sapiens
ucugggaaaugguucauau

SEQ ID NO: 1003988 - RNA, 19 nt, Homo sapiens
caauauaaagccugacaau

SEQ ID NO: 1003989 - RNA, 19 nt, Homo sapiens
cauggugugugagugcuua

SEQ ID NO: 1003990 - RNA, 19 nt, Homo sapiens
uagccuaucugacuagucu

SEQ ID NO: 1003991 - RNA, 19 nt, Homo sapiens
gggcaaaucagagugaaga

SEQ ID NO: 1003992 - RNA, 19 nt, Homo sapiens
ugaauucuuccaacaacua

SEQ ID NO: 1003993 - RNA, 19 nt, Homo sapiens
cagcaaauuuguccagacu

SEQ ID NO: 1003994 - RNA, 19 nt, Homo sapiens
aaaccuucuuccacacuuu

SEQ ID NO: 1003995 - RNA, 19 nt, Homo sapiens
caaaccuucuuccacacuu

SEQ ID NO: 1003996 - RNA, 19 nt, Homo sapiens
uguccagacuucucaucua

SEQ ID NO: 1003997 - RNA, 19 nt, Homo sapiens
agagaacacagcaaauuug

SEQ ID NO: 1003998 - RNA, 19 nt, Homo sapiens
aggaacaagcugccaauaa

SEQ ID NO: 1003999 - RNA, 19 nt, Homo sapiens
uaaagccugacaauaggua

SEQ ID NO: 1004000 - RNA, 19 nt, Homo sapiens
ucauggaucaaaucuauug

SEQ ID NO: 1004001 - RNA, 19 nt, Homo sapiens
guugagagagauaacauau

SEQ ID NO: 1004002 - RNA, 19 nt, Homo sapiens
gucagugucuccuucuguu

SEQ ID NO: 1004003 - RNA, 19 nt, Homo sapiens
ccuugaaccuagaaugaga

SEQ ID NO: 1004004 - RNA, 19 nt, Homo sapiens
gaugcccugugcucuauca

SEQ ID NO: 1004005 - RNA, 19 nt, Homo sapiens
gggcacaggccuuuccaau

SEQ ID NO: 1004006 - RNA, 19 nt, Homo sapiens
ggaaucauggugugugagu

SEQ ID NO: 1004007 - RNA, 19 nt, Homo sapiens
gugauguuguugagagaga

SEQ ID NO: 1004008 - RNA, 19 nt, Homo sapiens
uuacaguucccacccauug

SEQ ID NO: 1004009 - RNA, 19 nt, Homo sapiens
ggaagaggaccuugaaccu

SEQ ID NO: 1004010 - RNA, 19 nt, Homo sapiens
aaggaaucaugguguguga

SEQ ID NO: 1004011 - RNA, 19 nt, Homo sapiens
guccagacuucucaucuac

SEQ ID NO: 1004012 - RNA, 19 nt, Homo sapiens
ugaagaggaagccagaaga

SEQ ID NO: 1004013 - RNA, 19 nt, Homo sapiens
uguuacaguugccugcuuu

SEQ ID NO: 1004014 - RNA, 19 nt, Homo sapiens
ggaccuugaaccuagaaug

SEQ ID NO: 1004015 - RNA, 19 nt, Homo sapiens
aaaucagagugaagaggaa

SEQ ID NO: 1004016 - RNA, 19 nt, Homo sapiens
gagagcuacaggucuggua

SEQ ID NO: 1004017 - RNA, 19 nt, Homo sapiens
gauguuguugagagagaua

SEQ ID NO: 1004018 - RNA, 19 nt, Homo sapiens
gcuuagaguguuacaguuc

SEQ ID NO: 1004019 - RNA, 19 nt, Homo sapiens
acuccucucucuuuacaug

SEQ ID NO: 1004020 - RNA, 19 nt, Homo sapiens
ccagacuucucaucuacag

SEQ ID NO: 1004021 - RNA, 19 nt, Homo sapiens
caacuacgugagcuuggaa

SEQ ID NO: 1004022 - RNA, 19 nt, Homo sapiens
uggaugcccugugcucuau

SEQ ID NO: 1004023 - RNA, 19 nt, Homo sapiens
ggcacaggccuuuccaaug

SEQ ID NO: 1004024 - RNA, 19 nt, Homo sapiens
ucagugucuccuucuguua

SEQ ID NO: 1004025 - RNA, 19 nt, Homo sapiens
uuagugauuugagaaggaa

SEQ ID NO: 1004026 - RNA, 19 nt, Homo sapiens
gugcuuagaguguuacagu

SEQ ID NO: 1004027 - RNA, 19 nt, Homo sapiens
gugaaacccagaaggaauc

SEQ ID NO: 1004028 - RNA, 19 nt, Homo sapiens
gauccugccugggagaaac

SEQ ID NO: 1004029 - RNA, 19 nt, Homo sapiens
ugacaauagguacagcaaa

SEQ ID NO: 1004030 - RNA, 19 nt, Homo sapiens
cacccauuguuuggaauuu

SEQ ID NO: 1004031 - RNA, 19 nt, Homo sapiens
ggggaaauauuuaauccau

SEQ ID NO: 1004032 - RNA, 19 nt, Homo sapiens
aaacccagaaggaaucaug

SEQ ID NO: 1004033 - RNA, 19 nt, Homo sapiens
ucucaucuacagaaacuga

SEQ ID NO: 1004034 - RNA, 19 nt, Homo sapiens
ugccaauaaugucugcaaa

SEQ ID NO: 1004035 - RNA, 19 nt, Homo sapiens
caaagagacgaaucaagac

SEQ ID NO: 1004036 - RNA, 19 nt, Homo sapiens
cuuccacacuuuauacaag

SEQ ID NO: 1004037 - RNA, 19 nt, Homo sapiens
ggucagugucuccuucugu

SEQ ID NO: 1004038 - RNA, 19 nt, Homo sapiens
ugccugcuuucaauccuaa

SEQ ID NO: 1004039 - RNA, 19 nt, Homo sapiens
acaacuacgugagcuugga

SEQ ID NO: 1004040 - RNA, 19 nt, Homo sapiens
ugcaguuguugucagagua

SEQ ID NO: 1004041 - RNA, 19 nt, Homo sapiens
gagguguccuagccuucug

SEQ ID NO: 1004042 - RNA, 19 nt, Homo sapiens
aacaagcugccaauaaugu

SEQ ID NO: 1004043 - RNA, 19 nt, Homo sapiens
gagagagauaacauauuca

SEQ ID NO: 1004044 - RNA, 19 nt, Homo sapiens
gggcaugucagaccaacag

SEQ ID NO: 1004045 - RNA, 19 nt, Homo sapiens
cuaucugacuagucucaug

SEQ ID NO: 1004046 - RNA, 19 nt, Homo sapiens
ugugagugcuuagaguguu

SEQ ID NO: 1004047 - RNA, 19 nt, Homo sapiens
uuuagugauuugagaagga

SEQ ID NO: 1004048 - RNA, 19 nt, Homo sapiens
gcgugaaacccagaaggaa

SEQ ID NO: 1004049 - RNA, 19 nt, Homo sapiens
cagaguacaaaccuucuuc

SEQ ID NO: 1004050 - RNA, 19 nt, Homo sapiens
agaggaccuugaaccuaga

SEQ ID NO: 1004051 - RNA, 19 nt, Homo sapiens
uucaaucacuccucucucu

SEQ ID NO: 1004052 - RNA, 19 nt, Homo sapiens
caagaagccuguccuggaa

SEQ ID NO: 1004053 - RNA, 19 nt, Homo sapiens
gaccacaagucaacaagga

SEQ ID NO: 1004054 - RNA, 19 nt, Homo sapiens
gaccugggcugcuccacuu

SEQ ID NO: 1004055 - RNA, 19 nt, Homo sapiens
gagaagucauggcugugaa

SEQ ID NO: 1004056 - RNA, 19 nt, Homo sapiens
guccugagaugcagucaug

SEQ ID NO: 1004057 - RNA, 19 nt, Homo sapiens
ggccuaacaaagacauuua

SEQ ID NO: 1004058 - RNA, 19 nt, Homo sapiens
gggcaaagagugagaccuu

SEQ ID NO: 1004059 - RNA, 19 nt, Homo sapiens
ggcgauguauaguuuguau

SEQ ID NO: 1004060 - RNA, 19 nt, Homo sapiens
ccacaagucaacaaggaaa

SEQ ID NO: 1004061 - RNA, 19 nt, Homo sapiens
ccacuuacuaggcgaugua

SEQ ID NO: 1004062 - RNA, 19 nt, Homo sapiens
gagcuugagcguugcaaug

SEQ ID NO: 1004063 - RNA, 19 nt, Homo sapiens
auaaugagcggccuaacaa

SEQ ID NO: 1004064 - RNA, 19 nt, Homo sapiens
gauccuacaguuucucaug

SEQ ID NO: 1004065 - RNA, 19 nt, Homo sapiens
uggcguggauccuacaguu

SEQ ID NO: 1004066 - RNA, 19 nt, Homo sapiens
cagcuucucuacugaaagg

SEQ ID NO: 1004067 - RNA, 19 nt, Homo sapiens
cagcuucucuacugaaagg

SEQ ID NO: 1004068 - RNA, 19 nt, Homo sapiens
cagcuucucuacugaaagg

SEQ ID NO: 1004069 - RNA, 19 nt, Homo sapiens
uggcguggauccuacaguu

SEQ ID NO: 1004070 - RNA, 19 nt, Homo sapiens
gaauguugggcaaauuaau

SEQ ID NO: 1004071 - RNA, 19 nt, Homo sapiens
gaaaggcgguguggauccu

SEQ ID NO: 1004072 - RNA, 19 nt, Homo sapiens
gaaaggcgguguggauccu

SEQ ID NO: 1004073 - RNA, 19 nt, Homo sapiens
aaacaggagggaucauaau

SEQ ID NO: 1004074 - RNA, 19 nt, Homo sapiens
cauaaugagcggccuaaca

SEQ ID NO: 1004075 - RNA, 19 nt, Homo sapiens
ugaauguugggcaaauuaa

SEQ ID NO: 1004076 - RNA, 19 nt, Homo sapiens
uugaauguugggcaaauua

SEQ ID NO: 1004077 - RNA, 19 nt, Homo sapiens
cggcguggauccucagcuu

SEQ ID NO: 1004078 - RNA, 19 nt, Homo sapiens
acugaaagguggcguggau

SEQ ID NO: 1004079 - RNA, 19 nt, Homo sapiens
uacagcuucucuacugaaa

SEQ ID NO: 1004080 - RNA, 19 nt, Homo sapiens
acugaaagguggcguggau

SEQ ID NO: 1004081 - RNA, 19 nt, Homo sapiens
uacagcuucucuacugaaa

SEQ ID NO: 1004082 - RNA, 19 nt, Homo sapiens
acugaaagguggcguggau

SEQ ID NO: 1004083 - RNA, 19 nt, Homo sapiens
uacagcuucucuacugaaa

SEQ ID NO: 1004084 - RNA, 19 nt, Homo sapiens
acugaaagguggcguggau

SEQ ID NO: 1004085 - RNA, 19 nt, Homo sapiens
uuaaagacacgccaagaag

SEQ ID NO: 1004086 - RNA, 19 nt, Homo sapiens
ucccaguguuuacaagauu

SEQ ID NO: 1004087 - RNA, 19 nt, Homo sapiens
gcguggagcagcacaagga

SEQ ID NO: 1004088 - RNA, 19 nt, Homo sapiens
cccaguguuuacaagauuu

SEQ ID NO: 1004089 - RNA, 19 nt, Homo sapiens
cuugagcguugcaaugaga

SEQ ID NO: 1004090 - RNA, 19 nt, Homo sapiens
auccucagcuucucgugua

SEQ ID NO: 1004091 - RNA, 19 nt, Homo sapiens
gcguggauccuacaguuuc

SEQ ID NO: 1004092 - RNA, 19 nt, Homo sapiens
gccuaacaaagacauuuaa

SEQ ID NO: 1004093 - RNA, 19 nt, Homo sapiens
ccuacagcuucucuacuga

SEQ ID NO: 1004094 - RNA, 19 nt, Homo sapiens
ccuacagcuucucuacuga

SEQ ID NO: 1004095 - RNA, 19 nt, Homo sapiens
ccuacagcuucucuacuga

SEQ ID NO: 1004096 - RNA, 19 nt, Homo sapiens
gcguggauccuacaguuuc

SEQ ID NO: 1004097 - RNA, 19 nt, Homo sapiens
caagucaacaaggaaaguu

SEQ ID NO: 1004098 - RNA, 19 nt, Homo sapiens
ugagaagucauggcuguga

SEQ ID NO: 1004099 - RNA, 19 nt, Homo sapiens
uuuagacucuuaagaugca

SEQ ID NO: 1004100 - RNA, 19 nt, Homo sapiens
uaaaacaggagggaucaua

SEQ ID NO: 1004101 - RNA, 19 nt, Homo sapiens
uccuacagcuucucuacug

SEQ ID NO: 1004102 - RNA, 19 nt, Homo sapiens
gauccuacagcuucucuac

SEQ ID NO: 1004103 - RNA, 19 nt, Homo sapiens
uuuaaagacacgccaagaa

SEQ ID NO: 1004104 - RNA, 19 nt, Homo sapiens
uccuacagcuucucuacug

SEQ ID NO: 1004105 - RNA, 19 nt, Homo sapiens
gauccuacagcuucucuac

SEQ ID NO: 1004106 - RNA, 19 nt, Homo sapiens
uccuacagcuucucuacug

SEQ ID NO: 1004107 - RNA, 19 nt, Homo sapiens
gauccuacagcuucucuac

SEQ ID NO: 1004108 - RNA, 19 nt, Homo sapiens
uaggcgauguauaguuugu

SEQ ID NO: 1004109 - RNA, 19 nt, Homo sapiens
cuuacuaggcgauguauag

SEQ ID NO: 1004110 - RNA, 19 nt, Homo sapiens
gaagucauggcugugaauc

SEQ ID NO: 1004111 - RNA, 19 nt, Homo sapiens
aaagguggcguggauccua

SEQ ID NO: 1004112 - RNA, 19 nt, Homo sapiens
aaagguggcguggauccua

SEQ ID NO: 1004113 - RNA, 19 nt, Homo sapiens
aaagguggcguggauccua

SEQ ID NO: 1004114 - RNA, 19 nt, Homo sapiens
aaagguggcguggauccua

SEQ ID NO: 1004115 - RNA, 19 nt, Homo sapiens
ugggaacccgcaccuguuu

SEQ ID NO: 1004116 - RNA, 19 nt, Homo sapiens
cuacagcuucucuacugaa

SEQ ID NO: 1004117 - RNA, 19 nt, Homo sapiens
cuacagcuucucuacugaa

SEQ ID NO: 1004118 - RNA, 19 nt, Homo sapiens
cuacagcuucucuacugaa

SEQ ID NO: 1004119 - RNA, 19 nt, Homo sapiens
uaaugagcggccuaacaaa

SEQ ID NO: 1004120 - RNA, 19 nt, Homo sapiens
gggcugcuccacuuucaca

SEQ ID NO: 1004121 - RNA, 19 nt, Homo sapiens
cuucaugccagucauuguu

SEQ ID NO: 1004122 - RNA, 19 nt, Homo sapiens
gcguugcaaugagaaguca

SEQ ID NO: 1004123 - RNA, 19 nt, Homo sapiens
agaagccuguccuggaaag

SEQ ID NO: 1004124 - RNA, 19 nt, Homo sapiens
gaacggaaguguauuuaua

SEQ ID NO: 1004125 - RNA, 19 nt, Homo sapiens
gaaaggagcucgauucuuc

SEQ ID NO: 1004126 - RNA, 19 nt, Homo sapiens
cauggaaagugccaauuua

SEQ ID NO: 1004127 - RNA, 19 nt, Homo sapiens
ggacaaaacuuccuauuuc

SEQ ID NO: 1004128 - RNA, 19 nt, Homo sapiens
ggauuucgcugucaaggaa

SEQ ID NO: 1004129 - RNA, 19 nt, Homo sapiens
ccaauucacucaaccaaga

SEQ ID NO: 1004130 - RNA, 19 nt, Homo sapiens
gaagcugccuuucccuuug

SEQ ID NO: 1004131 - RNA, 19 nt, Homo sapiens
uaaacucagugucuacuuu

SEQ ID NO: 1004132 - RNA, 19 nt, Homo sapiens
gagauaaacagguaacuga

SEQ ID NO: 1004133 - RNA, 19 nt, Homo sapiens
acagaaagcugaaguuuac

SEQ ID NO: 1004134 - RNA, 19 nt, Homo sapiens
ucaaggaaccguuucuaua

SEQ ID NO: 1004135 - RNA, 19 nt, Homo sapiens
gaaagugccaauuuacuga

SEQ ID NO: 1004136 - RNA, 19 nt, Homo sapiens
ggaguucucugucauuuac

SEQ ID NO: 1004137 - RNA, 19 nt, Homo sapiens
gaaaccaacauucgaguga

SEQ ID NO: 1004138 - RNA, 19 nt, Homo sapiens
gaacggugcuccugcuucu

SEQ ID NO: 1004139 - RNA, 19 nt, Homo sapiens
aaucagaacuguggacaaa

SEQ ID NO: 1004140 - RNA, 19 nt, Homo sapiens
gaacuuguccaccaacuca

SEQ ID NO: 1004141 - RNA, 19 nt, Homo sapiens
gaagauaacgaggugcuaa

SEQ ID NO: 1004142 - RNA, 19 nt, Homo sapiens
ccaccuauuuauuguguuu

SEQ ID NO: 1004143 - RNA, 19 nt, Homo sapiens
ucagagaguuuacaaugug

SEQ ID NO: 1004144 - RNA, 19 nt, Homo sapiens
ggucaggaguucucuguca

SEQ ID NO: 1004145 - RNA, 19 nt, Homo sapiens
uguccuagcucccugguaa

SEQ ID NO: 1004146 - RNA, 19 nt, Homo sapiens
ccauguaggugccagagaa

SEQ ID NO: 1004147 - RNA, 19 nt, Homo sapiens
ggagcaaucagucauguga

SEQ ID NO: 1004148 - RNA, 19 nt, Homo sapiens
ggaaagugccaauuuacug

SEQ ID NO: 1004149 - RNA, 19 nt, Homo sapiens
gcagcugucuguucaccuu

SEQ ID NO: 1004150 - RNA, 19 nt, Homo sapiens
ggaaccguuucuauacauu

SEQ ID NO: 1004151 - RNA, 19 nt, Homo sapiens
ggaggagcaucagaacuug

SEQ ID NO: 1004152 - RNA, 19 nt, Homo sapiens
uuacugagcacgagauaaa

SEQ ID NO: 1004153 - RNA, 19 nt, Homo sapiens
gaaccguuucuauacauuu

SEQ ID NO: 1004154 - RNA, 19 nt, Homo sapiens
cacagaaagcugaaguuua

SEQ ID NO: 1004155 - RNA, 19 nt, Homo sapiens
gcuaaaauaucccuaugaa

SEQ ID NO: 1004156 - RNA, 19 nt, Homo sapiens
caaggaaccguuucuauac

SEQ ID NO: 1004157 - RNA, 19 nt, Homo sapiens
ccacagaaagcugaaguuu

SEQ ID NO: 1004158 - RNA, 19 nt, Homo sapiens
ccacagggaccucaacuuc

SEQ ID NO: 1004159 - RNA, 19 nt, Homo sapiens
caggaguucucugucauuu

SEQ ID NO: 1004160 - RNA, 19 nt, Homo sapiens
cgagugggucuccguguua

SEQ ID NO: 1004161 - RNA, 19 nt, Homo sapiens
ucuccugggugcauccuua

SEQ ID NO: 1004162 - RNA, 19 nt, Homo sapiens
cuccugaccuuucguaaug

SEQ ID NO: 1004163 - RNA, 19 nt, Homo sapiens
agagagcacuccugaccuu

SEQ ID NO: 1004164 - RNA, 19 nt, Homo sapiens
ucggugaacaguauuauuu

SEQ ID NO: 1004165 - RNA, 19 nt, Homo sapiens
cagagacccugggcauuga

SEQ ID NO: 1004166 - RNA, 19 nt, Homo sapiens
ccaaagaaagacuggacua

SEQ ID NO: 1004167 - RNA, 19 nt, Homo sapiens
gagcgauccucagagaguu

SEQ ID NO: 1004168 - RNA, 19 nt, Homo sapiens
acaaauggagccacagaaa

SEQ ID NO: 1004169 - RNA, 19 nt, Homo sapiens
guuagcagccaaagaaaga

SEQ ID NO: 1004170 - RNA, 19 nt, Homo sapiens
auaacgaggugcuaaaaua

SEQ ID NO: 1004171 - RNA, 19 nt, Homo sapiens
caccgcagcugucuguuca

SEQ ID NO: 1004172 - RNA, 19 nt, Homo sapiens
uaucugaacggaaguguau

SEQ ID NO: 1004173 - RNA, 19 nt, Homo sapiens
gcgcaggccuuugucaagu

SEQ ID NO: 1004174 - RNA, 19 nt, Homo sapiens
agaugcaaguccagaauga

SEQ ID NO: 1004175 - RNA, 19 nt, Homo sapiens
agaaguucgucucauauca

SEQ ID NO: 1004176 - RNA, 19 nt, Homo sapiens
gcacuccugaccuuucgua

SEQ ID NO: 1004177 - RNA, 19 nt, Homo sapiens
ccucagagaguuuacaaug

SEQ ID NO: 1004178 - RNA, 19 nt, Homo sapiens
ggugaacaguauuauuuac

SEQ ID NO: 1004179 - RNA, 19 nt, Homo sapiens
gcaggccuuugucaaguuc

SEQ ID NO: 1004180 - RNA, 19 nt, Homo sapiens
ugagaagggucaggaguuc

SEQ ID NO: 1004181 - RNA, 19 nt, Homo sapiens
gucagcaucuccacuagug

SEQ ID NO: 1004182 - RNA, 19 nt, Homo sapiens
ucauggaaagugccaauuu

SEQ ID NO: 1004183 - RNA, 19 nt, Homo sapiens
acuaguggcugcucugugu

SEQ ID NO: 1004184 - RNA, 19 nt, Homo sapiens
ggagcgauccucagagagu

SEQ ID NO: 1004185 - RNA, 19 nt, Homo sapiens
acagggaccucaacuucug

SEQ ID NO: 1004186 - RNA, 19 nt, Homo sapiens
ggagaugcaaguccagaau

SEQ ID NO: 1004187 - RNA, 19 nt, Homo sapiens
ccacauccgccgucuacaa

SEQ ID NO: 1004188 - RNA, 19 nt, Homo sapiens
cguguuagcagccaaagaa

SEQ ID NO: 1004189 - RNA, 19 nt, Homo sapiens
ggugggagaagauuauuuc

SEQ ID NO: 1004190 - RNA, 19 nt, Homo sapiens
cagcuacgauguggagaug

SEQ ID NO: 1004191 - RNA, 19 nt, Homo sapiens
ucagagacccugggcauug

SEQ ID NO: 1004192 - RNA, 19 nt, Homo sapiens
aagaaagacuggacuacgu

SEQ ID NO: 1004193 - RNA, 19 nt, Homo sapiens
cggaagggccuguaucugu

SEQ ID NO: 1004194 - RNA, 19 nt, Homo sapiens
ggucagcaccugugaaagg

SEQ ID NO: 1004195 - RNA, 19 nt, Homo sapiens
ggccacagccaaucgcaaa

SEQ ID NO: 1004196 - RNA, 19 nt, Homo sapiens
gugccuaccucaucuacuc

SEQ ID NO: 1004197 - RNA, 19 nt, Homo sapiens
caucaacuccgucaucuac

SEQ ID NO: 1004198 - RNA, 19 nt, Homo sapiens
gguggaagacgcccaguuc

SEQ ID NO: 1004199 - RNA, 19 nt, Homo sapiens
gcacgagauaaacagguaa

SEQ ID NO: 1004200 - RNA, 19 nt, Homo sapiens
gaucaggauaguucagguu

SEQ ID NO: 1004201 - RNA, 19 nt, Homo sapiens
ccauugccgccaccuauuu

SEQ ID NO: 1004202 - RNA, 19 nt, Homo sapiens
cggugaacaguauuauuua

SEQ ID NO: 1004203 - RNA, 19 nt, Homo sapiens
gcuacgauguggagaugca

SEQ ID NO: 1004204 - RNA, 19 nt, Homo sapiens
caaauggagccacagaaag

SEQ ID NO: 1004205 - RNA, 19 nt, Homo sapiens
caaguggaccgaagagaag

SEQ ID NO: 1004206 - RNA, 19 nt, Homo sapiens
cagccacccugucagugaa

SEQ ID NO: 1004207 - RNA, 19 nt, Homo sapiens
gagaugcaaguccagaaug

SEQ ID NO: 1004208 - RNA, 19 nt, Homo sapiens
acaaguggaccgaagagaa

SEQ ID NO: 1004209 - RNA, 19 nt, Homo sapiens
gagcacuccugaccuuucg

SEQ ID NO: 1004210 - RNA, 19 nt, Homo sapiens
ggacuccagcucucaguag

SEQ ID NO: 1004211 - RNA, 19 nt, Homo sapiens
ucaacuccgucaucuacga

SEQ ID NO: 1004212 - RNA, 19 nt, Homo sapiens
ccugugaaaggaagauuaa

SEQ ID NO: 1004213 - RNA, 19 nt, Homo sapiens
gcucuccuguggucaucuu

SEQ ID NO: 1004214 - RNA, 19 nt, Homo sapiens
caccggugcuccucucuag

SEQ ID NO: 1004215 - RNA, 19 nt, Homo sapiens
cauugccgccaccuauuua

SEQ ID NO: 1004216 - RNA, 19 nt, Homo sapiens
uggaggagcaucagaacuu

SEQ ID NO: 1004217 - RNA, 19 nt, Homo sapiens
auaaacuucuccauugauc

SEQ ID NO: 1004218 - RNA, 19 nt, Homo sapiens
ccagugcucgcccaucuga

SEQ ID NO: 1004219 - RNA, 19 nt, Homo sapiens
gaaguucgucucauaucag

SEQ ID NO: 1004220 - RNA, 19 nt, Homo sapiens
ucacucaaccaagaagaaa

SEQ ID NO: 1004221 - RNA, 19 nt, Homo sapiens
ccucuuaacccauguaggu

SEQ ID NO: 1004222 - RNA, 19 nt, Homo sapiens
gcacuagcgcgaggucaga

SEQ ID NO: 1004223 - RNA, 19 nt, Homo sapiens
aaggaaccguuucuauaca

SEQ ID NO: 1004224 - RNA, 19 nt, Homo sapiens
ccacaagucugaauuuaua

SEQ ID NO: 1004225 - RNA, 19 nt, Homo sapiens
gaucauggcuauauagaaa

SEQ ID NO: 1004226 - RNA, 19 nt, Homo sapiens
gaagagggcugaugaguca

SEQ ID NO: 1004227 - RNA, 19 nt, Homo sapiens
gaagacaaguuuggacaua

SEQ ID NO: 1004228 - RNA, 19 nt, Homo sapiens
gagaaagcaugaagaggua

SEQ ID NO: 1004229 - RNA, 19 nt, Homo sapiens
cuaaugcucuuccgaauaa

SEQ ID NO: 1004230 - RNA, 19 nt, Homo sapiens
gaagagguauucaucuguu

SEQ ID NO: 1004231 - RNA, 19 nt, Homo sapiens
gcuaggaaguuucaagauu

SEQ ID NO: 1004232 - RNA, 19 nt, Homo sapiens
gcugaaagcuaggaaguuu

SEQ ID NO: 1004233 - RNA, 19 nt, Homo sapiens
gcguauaccugcccuguuu

SEQ ID NO: 1004234 - RNA, 19 nt, Homo sapiens
gggcauacauuacuaagug

SEQ ID NO: 1004235 - RNA, 19 nt, Homo sapiens
ucaaauuccuuucucauug

SEQ ID NO: 1004236 - RNA, 19 nt, Homo sapiens
ggaacugccugcguaagua

SEQ ID NO: 1004237 - RNA, 19 nt, Homo sapiens
ggacauagcccagaaaaua

SEQ ID NO: 1004238 - RNA, 19 nt, Homo sapiens
gcacugagguggguguuga

SEQ ID NO: 1004239 - RNA, 19 nt, Homo sapiens
ggagagaggcggacuguga

SEQ ID NO: 1004240 - RNA, 19 nt, Homo sapiens
ucacagcccuuaaguuguu

SEQ ID NO: 1004241 - RNA, 19 nt, Homo sapiens
gaaacucauucuuacgaaa

SEQ ID NO: 1004242 - RNA, 19 nt, Homo sapiens
cgaaugagaagacaaguuu

SEQ ID NO: 1004243 - RNA, 19 nt, Homo sapiens
gaacucaaauuccuuucuc

SEQ ID NO: 1004244 - RNA, 19 nt, Homo sapiens
ucuggaagcugagaaauuu

SEQ ID NO: 1004245 - RNA, 19 nt, Homo sapiens
auaaagugcugaacuguga

SEQ ID NO: 1004246 - RNA, 19 nt, Homo sapiens
cgaauaaagugcugaacug

SEQ ID NO: 1004247 - RNA, 19 nt, Homo sapiens
caaaaggugucucauauga

SEQ ID NO: 1004248 - RNA, 19 nt, Homo sapiens
ggacgccgcuuagacaaug

SEQ ID NO: 1004249 - RNA, 19 nt, Homo sapiens
cagcggcucuuucugcuuu

SEQ ID NO: 1004250 - RNA, 19 nt, Homo sapiens
cagcacagguucugggauu

SEQ ID NO: 1004251 - RNA, 19 nt, Homo sapiens
gaaauuuacaugcuggaaa

SEQ ID NO: 1004252 - RNA, 19 nt, Homo sapiens
gaguggaccuaaauauguu

SEQ ID NO: 1004253 - RNA, 19 nt, Homo sapiens
gcgcuugucuaauuauuca

SEQ ID NO: 1004254 - RNA, 19 nt, Homo sapiens
gaacaagccggaucagaag

SEQ ID NO: 1004255 - RNA, 19 nt, Homo sapiens
gaacugccugcguaaguaa

SEQ ID NO: 1004256 - RNA, 19 nt, Homo sapiens
gacagaugauuauuucguu

SEQ ID NO: 1004257 - RNA, 19 nt, Homo sapiens
ggcagcaugucaaccauuu

SEQ ID NO: 1004258 - RNA, 19 nt, Homo sapiens
gguggcgcuugucuaauua

SEQ ID NO: 1004259 - RNA, 19 nt, Homo sapiens
ccgagacccugcacaguuu

SEQ ID NO: 1004260 - RNA, 19 nt, Homo sapiens
cggaagagcuaaagauucu

SEQ ID NO: 1004261 - RNA, 19 nt, Homo sapiens
aaaggaucauggcuauaua

SEQ ID NO: 1004262 - RNA, 19 nt, Homo sapiens
uucaguagcugcaguauau

SEQ ID NO: 1004263 - RNA, 19 nt, Homo sapiens
gcaguguauuucaucauau

SEQ ID NO: 1004264 - RNA, 19 nt, Homo sapiens
uaaaggaucauggcuauau

SEQ ID NO: 1004265 - RNA, 19 nt, Homo sapiens
ggaggcaggcagaguuuaa

SEQ ID NO: 1004266 - RNA, 19 nt, Homo sapiens
caagaacucaaauuccuuu

SEQ ID NO: 1004267 - RNA, 19 nt, Homo sapiens
uaacuuugguggaauccuu

SEQ ID NO: 1004268 - RNA, 19 nt, Homo sapiens
cuaggaaguuucaagauuc

SEQ ID NO: 1004269 - RNA, 19 nt, Homo sapiens
caaauuccuuucucauugg

SEQ ID NO: 1004270 - RNA, 19 nt, Homo sapiens
aagaugcucugauaccauu

SEQ ID NO: 1004271 - RNA, 19 nt, Homo sapiens
ugacacagcagcuaucaga

SEQ ID NO: 1004272 - RNA, 19 nt, Homo sapiens
gauaaaccaacuaacuuug

SEQ ID NO: 1004273 - RNA, 19 nt, Homo sapiens
aaaggugucucauaugaag

SEQ ID NO: 1004274 - RNA, 19 nt, Homo sapiens
gagggacagaugauuauuu

SEQ ID NO: 1004275 - RNA, 19 nt, Homo sapiens
caggagggacagaugauua

SEQ ID NO: 1004276 - RNA, 19 nt, Homo sapiens
ggacggaagagcuaaagau

SEQ ID NO: 1004277 - RNA, 19 nt, Homo sapiens
cggaaguucugaaucaaga

SEQ ID NO: 1004278 - RNA, 19 nt, Homo sapiens
gggccugucugcuugauuc

SEQ ID NO: 1004279 - RNA, 19 nt, Homo sapiens
cccaggacaugcaggauuu

SEQ ID NO: 1004280 - RNA, 19 nt, Homo sapiens
aagcagcguuuaaugaaga

SEQ ID NO: 1004281 - RNA, 19 nt, Homo sapiens
gcccacauguccagguaaa

SEQ ID NO: 1004282 - RNA, 19 nt, Homo sapiens
gggcaccgaucucuuugga

SEQ ID NO: 1004283 - RNA, 19 nt, Homo sapiens
ggaaguuucaagauucaaa

SEQ ID NO: 1004284 - RNA, 19 nt, Homo sapiens
ugcaguguauuucaucaua

SEQ ID NO: 1004285 - RNA, 19 nt, Homo sapiens
gcuuuguucuggcgacuuu

SEQ ID NO: 1004286 - RNA, 19 nt, Homo sapiens
caacuaacuuugguggaau

SEQ ID NO: 1004287 - RNA, 19 nt, Homo sapiens
ggauuuguuucuguccaua

SEQ ID NO: 1004288 - RNA, 19 nt, Homo sapiens
gacagcaucuucagcuaca

SEQ ID NO: 1004289 - RNA, 19 nt, Homo sapiens
uuauagagcugaggaagug

SEQ ID NO: 1004290 - RNA, 19 nt, Homo sapiens
gacagccccuugaacauua

SEQ ID NO: 1004291 - RNA, 19 nt, Homo sapiens
gagccacaagucugaauuu

SEQ ID NO: 1004292 - RNA, 19 nt, Homo sapiens
gaagagcuaaagauucuca

SEQ ID NO: 1004293 - RNA, 19 nt, Homo sapiens
gaauacggauuuguuucug

SEQ ID NO: 1004294 - RNA, 19 nt, Homo sapiens
gaaagcaugaagagguauu

SEQ ID NO: 1004295 - RNA, 19 nt, Homo sapiens
agaacaagccggaucagaa

SEQ ID NO: 1004296 - RNA, 19 nt, Homo sapiens
cuagaacuguauuucagaa

SEQ ID NO: 1004297 - RNA, 19 nt, Homo sapiens
ggaauacggauuuguuucu

SEQ ID NO: 1004298 - RNA, 19 nt, Homo sapiens
aagagguauucaucuguua

SEQ ID NO: 1004299 - RNA, 19 nt, Homo sapiens
gaaauuagaacgacuucac

SEQ ID NO: 1004300 - RNA, 19 nt, Homo sapiens
gaaccuucuucccaaaucu

SEQ ID NO: 1004301 - RNA, 19 nt, Homo sapiens
ggugaaccuucuucccaaa

SEQ ID NO: 1004302 - RNA, 19 nt, Homo sapiens
gcaggcagaguuuaaaaua

SEQ ID NO: 1004303 - RNA, 19 nt, Homo sapiens
gacggaagagcuaaagauu

SEQ ID NO: 1004304 - RNA, 19 nt, Homo sapiens
caacagauaaacagaugga

SEQ ID NO: 1004305 - RNA, 19 nt, Homo sapiens
uuacggcccucacgauaau

SEQ ID NO: 1004306 - RNA, 19 nt, Homo sapiens
gcugggcaccgaucucuuu

SEQ ID NO: 1004307 - RNA, 19 nt, Homo sapiens
aaacuuagcgccugcuugu

SEQ ID NO: 1004308 - RNA, 19 nt, Homo sapiens
gcugagaaauuuacaugcu

SEQ ID NO: 1004309 - RNA, 19 nt, Homo sapiens
uuuaaaggaucauggcuau

SEQ ID NO: 1004310 - RNA, 19 nt, Homo sapiens
gugcaggaguucuuugcuu

SEQ ID NO: 1004311 - RNA, 19 nt, Homo sapiens
ggacagaugauuauuucgu

SEQ ID NO: 1004312 - RNA, 19 nt, Homo sapiens
ugaguggaccuaaauaugu

SEQ ID NO: 1004313 - RNA, 19 nt, Homo sapiens
caugauuucuugaacaucu

SEQ ID NO: 1004314 - RNA, 19 nt, Homo sapiens
gcccuuaaguuguuauguc

SEQ ID NO: 1004315 - RNA, 19 nt, Homo sapiens
cugcggaaguucugaauca

SEQ ID NO: 1004316 - RNA, 19 nt, Homo sapiens
gagcccacgugcaggaguu

SEQ ID NO: 1004317 - RNA, 19 nt, Homo sapiens
ggucuuagucccagcgauu

SEQ ID NO: 1004318 - RNA, 19 nt, Homo sapiens
ucaguauaaugcaguguau

SEQ ID NO: 1004319 - RNA, 19 nt, Homo sapiens
gaauaaagugcugaacugu

SEQ ID NO: 1004320 - RNA, 19 nt, Homo sapiens
ggagguaauuucagauacg

SEQ ID NO: 1004321 - RNA, 19 nt, Homo sapiens
acucacagcccuuaaguug

SEQ ID NO: 1004322 - RNA, 19 nt, Homo sapiens
acacagugauucgaagcua

SEQ ID NO: 1004323 - RNA, 19 nt, Homo sapiens
guaaccauuugaagcuuuc

SEQ ID NO: 1004324 - RNA, 19 nt, Homo sapiens
gcacaagacugaauaacga

SEQ ID NO: 1004325 - RNA, 19 nt, Homo sapiens
gaauaaacauugccauugu

SEQ ID NO: 1004326 - RNA, 19 nt, Homo sapiens
gaauaacgaugccaagaau

SEQ ID NO: 1004327 - RNA, 19 nt, Homo sapiens
gagaacagcugggaaaugu

SEQ ID NO: 1004328 - RNA, 19 nt, Homo sapiens
caaggacguuuguugguua

SEQ ID NO: 1004329 - RNA, 19 nt, Homo sapiens
guagugaagaugucaauua

SEQ ID NO: 1004330 - RNA, 19 nt, Homo sapiens
gaguaaauguguucuguau

SEQ ID NO: 1004331 - RNA, 19 nt, Homo sapiens
ggaagcacaagacugaaua

SEQ ID NO: 1004332 - RNA, 19 nt, Homo sapiens
ggaccgaugacaaaguuua

SEQ ID NO: 1004333 - RNA, 19 nt, Homo sapiens
ggaauaaacauugccauug

SEQ ID NO: 1004334 - RNA, 19 nt, Homo sapiens
guaaagaaaucaggaacau

SEQ ID NO: 1004335 - RNA, 19 nt, Homo sapiens
gcccauauuugaugaguau

SEQ ID NO: 1004336 - RNA, 19 nt, Homo sapiens
aaagaaaucaggaacauga

SEQ ID NO: 1004337 - RNA, 19 nt, Homo sapiens
guuaagaccuaaaccaaca

SEQ ID NO: 1004338 - RNA, 19 nt, Homo sapiens
gugaagaugucaauuagca

SEQ ID NO: 1004339 - RNA, 19 nt, Homo sapiens
caacagcccauauuugaug

SEQ ID NO: 1004340 - RNA, 19 nt, Homo sapiens
ccagauagaaggcugcaua

SEQ ID NO: 1004341 - RNA, 19 nt, Homo sapiens
gcuaagaacaacagauauu

SEQ ID NO: 1004342 - RNA, 19 nt, Homo sapiens
caacagcaaauacaacuug

SEQ ID NO: 1004343 - RNA, 19 nt, Homo sapiens
uggaaucgcucaagaaucu

SEQ ID NO: 1004344 - RNA, 19 nt, Homo sapiens
gaaaucaggaacaugaaau

SEQ ID NO: 1004345 - RNA, 19 nt, Homo sapiens
ugacauaaacguucaagga

SEQ ID NO: 1004346 - RNA, 19 nt, Homo sapiens
gauuagcugcuuugacaua

SEQ ID NO: 1004347 - RNA, 19 nt, Homo sapiens
gaacauuugcuaguuguau

SEQ ID NO: 1004348 - RNA, 19 nt, Homo sapiens
cugcagagauccagauaga

SEQ ID NO: 1004349 - RNA, 19 nt, Homo sapiens
cuaguuguaucaaaucuug

SEQ ID NO: 1004350 - RNA, 19 nt, Homo sapiens
gcagagauccagauagaag

SEQ ID NO: 1004351 - RNA, 19 nt, Homo sapiens
gaaguaaagaaaucaggaa

SEQ ID NO: 1004352 - RNA, 19 nt, Homo sapiens
gaacucccuuccgaaauuc

SEQ ID NO: 1004353 - RNA, 19 nt, Homo sapiens
gcagagcucauuccagaug

SEQ ID NO: 1004354 - RNA, 19 nt, Homo sapiens
gaagcacaagacugaauaa

SEQ ID NO: 1004355 - RNA, 19 nt, Homo sapiens
gacggaagcacaagacuga

SEQ ID NO: 1004356 - RNA, 19 nt, Homo sapiens
caaccacucugaugcuaag

SEQ ID NO: 1004357 - RNA, 19 nt, Homo sapiens
uugauuagcugcuuugaca

SEQ ID NO: 1004358 - RNA, 19 nt, Homo sapiens
ucaaggacguuuguugguu

SEQ ID NO: 1004359 - RNA, 19 nt, Homo sapiens
gaccuaaaccaacagcaaa

SEQ ID NO: 1004360 - RNA, 19 nt, Homo sapiens
uagugaagaugucaauuag

SEQ ID NO: 1004361 - RNA, 19 nt, Homo sapiens
ggucuucgccuccuugugu

SEQ ID NO: 1004362 - RNA, 19 nt, Homo sapiens
cagcuggaaucgcucaaga

SEQ ID NO: 1004363 - RNA, 19 nt, Homo sapiens
ugaauaacgaugccaagaa

SEQ ID NO: 1004364 - RNA, 19 nt, Homo sapiens
ggaaauguugccagaggaa

SEQ ID NO: 1004365 - RNA, 19 nt, Homo sapiens
ggacguuuguugguuaagu

SEQ ID NO: 1004366 - RNA, 19 nt, Homo sapiens
gacguuuguugguuaaguu

SEQ ID NO: 1004367 - RNA, 19 nt, Homo sapiens
gaugucaauuagcaggaaa

SEQ ID NO: 1004368 - RNA, 19 nt, Homo sapiens
acauugccauugucaacua

SEQ ID NO: 1004369 - RNA, 19 nt, Homo sapiens
ggagaacagcugggaaaug

SEQ ID NO: 1004370 - RNA, 19 nt, Homo sapiens
uccaacagcccauauuuga

SEQ ID NO: 1004371 - RNA, 19 nt, Homo sapiens
aggucuagcuggguauuua

SEQ ID NO: 1004372 - RNA, 19 nt, Homo sapiens
ugccaagaaugccauagaa

SEQ ID NO: 1004373 - RNA, 19 nt, Homo sapiens
gacaaaguuuauucagagu

SEQ ID NO: 1004374 - RNA, 19 nt, Homo sapiens
ggagguggcagaagcaagu

SEQ ID NO: 1004375 - RNA, 19 nt, Homo sapiens
caagaaugccauagaagca

SEQ ID NO: 1004376 - RNA, 19 nt, Homo sapiens
caaaaucccugcucuucau

SEQ ID NO: 1004377 - RNA, 19 nt, Homo sapiens
aaaucugcuuugaggauaa

SEQ ID NO: 1004378 - RNA, 19 nt, Homo sapiens
aaacaaaugcagcuggaau

SEQ ID NO: 1004379 - RNA, 19 nt, Homo sapiens
gccauugucaacuauguaa

SEQ ID NO: 1004380 - RNA, 19 nt, Homo sapiens
gcuggaaucgcucaagaau

SEQ ID NO: 1004381 - RNA, 19 nt, Homo sapiens
aaauguugccagaggaaua

SEQ ID NO: 1004382 - RNA, 19 nt, Homo sapiens
cccauuggcuggugguuca

SEQ ID NO: 1004383 - RNA, 19 nt, Homo sapiens
ucagagugcugcuccaaaa

SEQ ID NO: 1004384 - RNA, 19 nt, Homo sapiens
gccagaggaauaaacauug

SEQ ID NO: 1004385 - RNA, 19 nt, Homo sapiens
gugcuugauuagcugcuuu

SEQ ID NO: 1004386 - RNA, 19 nt, Homo sapiens
ccuaaaccaacagcaaaua

SEQ ID NO: 1004387 - RNA, 19 nt, Homo sapiens
guaugaaggcgauaacucu

SEQ ID NO: 1004388 - RNA, 19 nt, Homo sapiens
aaaccaacagcaaauacaa

SEQ ID NO: 1004389 - RNA, 19 nt, Homo sapiens
gcuuugacauaaacguuca

SEQ ID NO: 1004390 - RNA, 19 nt, Homo sapiens
cuggaccgaugacaaaguu

SEQ ID NO: 1004391 - RNA, 19 nt, Homo sapiens
ccagaggaauaaacauugc

SEQ ID NO: 1004392 - RNA, 19 nt, Homo sapiens
aauccaacagcccauauuu

SEQ ID NO: 1004393 - RNA, 19 nt, Homo sapiens
augcuaagaacaacagaua

SEQ ID NO: 1004394 - RNA, 19 nt, Homo sapiens
cuuccgaaauucagagaga

SEQ ID NO: 1004395 - RNA, 19 nt, Homo sapiens
uaaccuacuuaugggagaa

SEQ ID NO: 1004396 - RNA, 19 nt, Homo sapiens
agaaaucaggaacaugaaa

SEQ ID NO: 1004397 - RNA, 19 nt, Homo sapiens
uaaaccaacagcaaauaca

SEQ ID NO: 1004398 - RNA, 19 nt, Homo sapiens
cuauguaacugggaaugug

SEQ ID NO: 1004399 - RNA, 19 nt, Homo sapiens
gagcggcaccuggaagaug

SEQ ID NO: 1004400 - RNA, 19 nt, Homo sapiens
caaaucuugguacgcagua

SEQ ID NO: 1004401 - RNA, 19 nt, Homo sapiens
gguccugaguaaauguguu

SEQ ID NO: 1004402 - RNA, 19 nt, Homo sapiens
ccuggaagaugcgcccauu

SEQ ID NO: 1004403 - RNA, 19 nt, Homo sapiens
ugaguaaauguguucugua

SEQ ID NO: 1004404 - RNA, 19 nt, Homo sapiens
gaaggcugcauacccaaag

SEQ ID NO: 1004405 - RNA, 19 nt, Homo sapiens
cuaagaacaacagauauuc

SEQ ID NO: 1004406 - RNA, 19 nt, Homo sapiens
cagaagcaaguacgccaaa

SEQ ID NO: 1004407 - RNA, 19 nt, Homo sapiens
uaaauccaacagcccauau

SEQ ID NO: 1004408 - RNA, 19 nt, Homo sapiens
gaccgaugacaaaguuuau

SEQ ID NO: 1004409 - RNA, 19 nt, Homo sapiens
aaacauugccauugucaac

SEQ ID NO: 1004410 - RNA, 19 nt, Homo sapiens
aauaaacauugccauuguc

SEQ ID NO: 1004411 - RNA, 19 nt, Homo sapiens
gaaauguugccagaggaau

SEQ ID NO: 1004412 - RNA, 19 nt, Homo sapiens
aaggacguuuguugguuaa

SEQ ID NO: 1004413 - RNA, 19 nt, Homo sapiens
cugaguaaauguguucugu

SEQ ID NO: 1004414 - RNA, 19 nt, Homo sapiens
ccaaagaacgaagcugaca

SEQ ID NO: 1004415 - RNA, 19 nt, Homo sapiens
uuagcugcuuugacauaaa

SEQ ID NO: 1004416 - RNA, 19 nt, Homo sapiens
uggcuggccugcagagauc

SEQ ID NO: 1004417 - RNA, 19 nt, Homo sapiens
ccacucugaugcuaagaac

SEQ ID NO: 1004418 - RNA, 19 nt, Homo sapiens
uagcugcuuugacauaaac

SEQ ID NO: 1004419 - RNA, 19 nt, Homo sapiens
cuaaauccaacagcccaua

SEQ ID NO: 1004420 - RNA, 19 nt, Homo sapiens
uaaguuaagaccuaaacca

SEQ ID NO: 1004421 - RNA, 19 nt, Homo sapiens
aaaaucugcuuugaggaua

SEQ ID NO: 1004422 - RNA, 19 nt, Homo sapiens
guuguaaaccaaugaacau

SEQ ID NO: 1004423 - RNA, 19 nt, Homo sapiens
uaaagaaaucaggaacaug

SEQ ID NO: 1004424 - RNA, 19 nt, Homo sapiens
gaaagaaacugcucaugau

SEQ ID NO: 1004425 - RNA, 19 nt, Homo sapiens
gacaagaaguuccauuuga

SEQ ID NO: 1004426 - RNA, 19 nt, Homo sapiens
ccacagacguccagaagaa

SEQ ID NO: 1004427 - RNA, 19 nt, Homo sapiens
gggaagaggugcaggagaa

SEQ ID NO: 1004428 - RNA, 19 nt, Homo sapiens
gcacacggcugcuguugga

SEQ ID NO: 1004429 - RNA, 19 nt, Homo sapiens
cagcauggauggccuguuu

SEQ ID NO: 1004430 - RNA, 19 nt, Homo sapiens
gaauaaguuuguugcagaa

SEQ ID NO: 1004431 - RNA, 19 nt, Homo sapiens
ggaaauauccaagcuguug

SEQ ID NO: 1004432 - RNA, 19 nt, Homo sapiens
caacaaggaacgaauggua

SEQ ID NO: 1004433 - RNA, 19 nt, Homo sapiens
ggacagcccuccacuuugc

SEQ ID NO: 1004434 - RNA, 19 nt, Homo sapiens
gagacgggcucccuggaaa

SEQ ID NO: 1004435 - RNA, 19 nt, Homo sapiens
gaaguuccauuugauguca

SEQ ID NO: 1004436 - RNA, 19 nt, Homo sapiens
ucuaaaugauggcuaagua

SEQ ID NO: 1004437 - RNA, 19 nt, Homo sapiens
ggucagcgccgaugucauu

SEQ ID NO: 1004438 - RNA, 19 nt, Homo sapiens
ugaaagaaacugcucauga

SEQ ID NO: 1004439 - RNA, 19 nt, Homo sapiens
gaucuccgguuccgaauca

SEQ ID NO: 1004440 - RNA, 19 nt, Homo sapiens
ggacaagaaguuccauuug

SEQ ID NO: 1004441 - RNA, 19 nt, Homo sapiens
gcagagaggccugucuuaa

SEQ ID NO: 1004442 - RNA, 19 nt, Homo sapiens
gcacaugcccgcuccauca

SEQ ID NO: 1004443 - RNA, 19 nt, Homo sapiens
uaucagcuguugcuugaaa

SEQ ID NO: 1004444 - RNA, 19 nt, Homo sapiens
ggccagcucuuaaccauuc

SEQ ID NO: 1004445 - RNA, 19 nt, Homo sapiens
ccucguaacuucacuguca

SEQ ID NO: 1004446 - RNA, 19 nt, Homo sapiens
uggcuuaccuaaauguuaa

SEQ ID NO: 1004447 - RNA, 19 nt, Homo sapiens
ggaagaagccaagaagaug

SEQ ID NO: 1004448 - RNA, 19 nt, Homo sapiens
ccagcaaacugaugaagau

SEQ ID NO: 1004449 - RNA, 19 nt, Homo sapiens
caucuagccucguaacuuc

SEQ ID NO: 1004450 - RNA, 19 nt, Homo sapiens
ccaaguggcugcugcucaa

SEQ ID NO: 1004451 - RNA, 19 nt, Homo sapiens
gguauaugauagagauuga

SEQ ID NO: 1004452 - RNA, 19 nt, Homo sapiens
uaaccauuccagucuauua

SEQ ID NO: 1004453 - RNA, 19 nt, Homo sapiens
cuuaagagaugaauaccuu

SEQ ID NO: 1004454 - RNA, 19 nt, Homo sapiens
gcauggagcuuuuggaaga

SEQ ID NO: 1004455 - RNA, 19 nt, Homo sapiens
cagagaggccugucuuaaa

SEQ ID NO: 1004456 - RNA, 19 nt, Homo sapiens
gaagaagccguuugcagau

SEQ ID NO: 1004457 - RNA, 19 nt, Homo sapiens
uauccaagcuguugaaacu

SEQ ID NO: 1004458 - RNA, 19 nt, Homo sapiens
uggauagucuagucucuaa

SEQ ID NO: 1004459 - RNA, 19 nt, Homo sapiens
acaagaaguuccauuugau

SEQ ID NO: 1004460 - RNA, 19 nt, Homo sapiens
ccauguauguuaaugugaa

SEQ ID NO: 1004461 - RNA, 19 nt, Homo sapiens
cuuaucagcuguugcuuga

SEQ ID NO: 1004462 - RNA, 19 nt, Homo sapiens
gaacauccugcacaucaug

SEQ ID NO: 1004463 - RNA, 19 nt, Homo sapiens
gggacaagaaguuccauuu

SEQ ID NO: 1004464 - RNA, 19 nt, Homo sapiens
agauggagauggccaaguu

SEQ ID NO: 1004465 - RNA, 19 nt, Homo sapiens
agagaggccugucuuaaag

SEQ ID NO: 1004466 - RNA, 19 nt, Homo sapiens
cuaggcaccugcugucuga

SEQ ID NO: 1004467 - RNA, 19 nt, Homo sapiens
cauugugccuuuacuguug

SEQ ID NO: 1004468 - RNA, 19 nt, Homo sapiens
gggcgguucuuggauguaa

SEQ ID NO: 1004469 - RNA, 19 nt, Homo sapiens
gcacggaagaucaguguca

SEQ ID NO: 1004470 - RNA, 19 nt, Homo sapiens
caauaaagcaaaguacuug

SEQ ID NO: 1004471 - RNA, 19 nt, Homo sapiens
acaccaagcacgauguaua

SEQ ID NO: 1004472 - RNA, 19 nt, Homo sapiens
gaaauauccaagcuguuga

SEQ ID NO: 1004473 - RNA, 19 nt, Homo sapiens
cuagacauagacaguauua

SEQ ID NO: 1004474 - RNA, 19 nt, Homo sapiens
agagaugaauaccuuauca

SEQ ID NO: 1004475 - RNA, 19 nt, Homo sapiens
gcuggucucucagugauga

SEQ ID NO: 1004476 - RNA, 19 nt, Homo sapiens
aguauuaccuagacauaga

SEQ ID NO: 1004477 - RNA, 19 nt, Homo sapiens
acacacacgugcccacaug

SEQ ID NO: 1004478 - RNA, 19 nt, Homo sapiens
gauagucuagucucuaaau

SEQ ID NO: 1004479 - RNA, 19 nt, Homo sapiens
cguuguggcuuaccuaaau

SEQ ID NO: 1004480 - RNA, 19 nt, Homo sapiens
gaagaagaagcuuguggau

SEQ ID NO: 1004481 - RNA, 19 nt, Homo sapiens
gguacuagcugccguucgu

SEQ ID NO: 1004482 - RNA, 19 nt, Homo sapiens
gaagaacgccucggucaac

SEQ ID NO: 1004483 - RNA, 19 nt, Homo sapiens
ccacuaccacgucaagauu

SEQ ID NO: 1004484 - RNA, 19 nt, Homo sapiens
caagaaguuccauuugaug

SEQ ID NO: 1004485 - RNA, 19 nt, Homo sapiens
cacugucgcuguccuuuga

SEQ ID NO: 1004486 - RNA, 19 nt, Homo sapiens
ugaaaagccugaugacgaa

SEQ ID NO: 1004487 - RNA, 19 nt, Homo sapiens
agaagccguuugcagauga

SEQ ID NO: 1004488 - RNA, 19 nt, Homo sapiens
gcacgauguauacagcuuu

SEQ ID NO: 1004489 - RNA, 19 nt, Homo sapiens
ucuccgagcuucucucaca

SEQ ID NO: 1004490 - RNA, 19 nt, Homo sapiens
uguugaaacuggcuauguu

SEQ ID NO: 1004491 - RNA, 19 nt, Homo sapiens
uaccauguauguuaaugug

SEQ ID NO: 1004492 - RNA, 19 nt, Homo sapiens
cccauagggugccuucuga

SEQ ID NO: 1004493 - RNA, 19 nt, Homo sapiens
ggauagggauaguguuuug

SEQ ID NO: 1004494 - RNA, 19 nt, Homo sapiens
ggucaacgagguggacuuu

SEQ ID NO: 1004495 - RNA, 19 nt, Homo sapiens
agaagaacauccugcacau

SEQ ID NO: 1004496 - RNA, 19 nt, Homo sapiens
uagggugccuucugaauac

SEQ ID NO: 1004497 - RNA, 19 nt, Homo sapiens
agaaggccgugaccucaga

SEQ ID NO: 1004498 - RNA, 19 nt, Homo sapiens
agaaacugcucaugaucug

SEQ ID NO: 1004499 - RNA, 19 nt, Homo sapiens
acgucaagauuucugauuu

SEQ ID NO: 1004500 - RNA, 19 nt, Homo sapiens
ggacaccagcaaacugaug

SEQ ID NO: 1004501 - RNA, 19 nt, Homo sapiens
gaugacgaagugaaagaaa

SEQ ID NO: 1004502 - RNA, 19 nt, Homo sapiens
aaaccgaggaccuguguga

SEQ ID NO: 1004503 - RNA, 19 nt, Homo sapiens
ccugguauaugauagagau

SEQ ID NO: 1004504 - RNA, 19 nt, Homo sapiens
ucagaaucauuucguugug

SEQ ID NO: 1004505 - RNA, 19 nt, Homo sapiens
gcaaacugaugaagauccu

SEQ ID NO: 1004506 - RNA, 19 nt, Homo sapiens
gacccugcgugcaaacaug

SEQ ID NO: 1004507 - RNA, 19 nt, Homo sapiens
gaguguuucugaccugcuu

SEQ ID NO: 1004508 - RNA, 19 nt, Homo sapiens
acacgcaguaugaagauaa

SEQ ID NO: 1004509 - RNA, 19 nt, Homo sapiens
aagaacauccugcacauca

SEQ ID NO: 1004510 - RNA, 19 nt, Homo sapiens
aaugguagcagccagcuuu

SEQ ID NO: 1004511 - RNA, 19 nt, Homo sapiens
agucuagucucuaaaugau

SEQ ID NO: 1004512 - RNA, 19 nt, Homo sapiens
agaggccugucuuaaaguu

SEQ ID NO: 1004513 - RNA, 19 nt, Homo sapiens
ggcagagaggccugucuua

SEQ ID NO: 1004514 - RNA, 19 nt, Homo sapiens
guggcuuaccuaaauguua

SEQ ID NO: 1004515 - RNA, 19 nt, Homo sapiens
caagaggagugcgccaagu

SEQ ID NO: 1004516 - RNA, 19 nt, Homo sapiens
cgacaccaagcacgaugua

SEQ ID NO: 1004517 - RNA, 19 nt, Homo sapiens
auagggugccuucugaaua

SEQ ID NO: 1004518 - RNA, 19 nt, Homo sapiens
ccauuccagucuauuacuu

SEQ ID NO: 1004519 - RNA, 19 nt, Homo sapiens
ggccaaguuucgcuacauc

SEQ ID NO: 1004520 - RNA, 19 nt, Homo sapiens
uaaaugauggcuaaguagu

SEQ ID NO: 1004521 - RNA, 19 nt, Homo sapiens
cucaugaucuggacgugaa

SEQ ID NO: 1004522 - RNA, 19 nt, Homo sapiens
gacaccagcaaacugauga

SEQ ID NO: 1004523 - RNA, 19 nt, Homo sapiens
guggccaucuagccucgua

SEQ ID NO: 1004524 - RNA, 19 nt, Homo sapiens
ugaggaagcuggauaauua

SEQ ID NO: 1004525 - RNA, 19 nt, Homo sapiens
gaagcuggauaauuacuua

SEQ ID NO: 1004526 - RNA, 19 nt, Homo sapiens
gaaccucccugcccugaaa

SEQ ID NO: 1004527 - RNA, 19 nt, Homo sapiens
gcugaaaggcguuauauuu

SEQ ID NO: 1004528 - RNA, 19 nt, Homo sapiens
agagaugaguucacaaaua

SEQ ID NO: 1004529 - RNA, 19 nt, Homo sapiens
gaagaaggaugcaaaugag

SEQ ID NO: 1004530 - RNA, 19 nt, Homo sapiens
ugaauaagaucgaggaguu

SEQ ID NO: 1004531 - RNA, 19 nt, Homo sapiens
gaacaaacccuccuuucau

SEQ ID NO: 1004532 - RNA, 19 nt, Homo sapiens
gagaugaguucacaaauac

SEQ ID NO: 1004533 - RNA, 19 nt, Homo sapiens
gaaccuggcucccggaaca

SEQ ID NO: 1004534 - RNA, 19 nt, Homo sapiens
gaacacgcauauucagaug

SEQ ID NO: 1004535 - RNA, 19 nt, Homo sapiens
acagaggacuuacaccaua

SEQ ID NO: 1004536 - RNA, 19 nt, Homo sapiens
ggagauacuugaauaaugc

SEQ ID NO: 1004537 - RNA, 19 nt, Homo sapiens
gagaagaugcuugagguua

SEQ ID NO: 1004538 - RNA, 19 nt, Homo sapiens
gcagucagcugucuuuguc

SEQ ID NO: 1004539 - RNA, 19 nt, Homo sapiens
guacacaucuuacagaaaa

SEQ ID NO: 1004540 - RNA, 19 nt, Homo sapiens
aaaugaagcugggcuguuu

SEQ ID NO: 1004541 - RNA, 19 nt, Homo sapiens
cgaagaaggaugcaaauga

SEQ ID NO: 1004542 - RNA, 19 nt, Homo sapiens
caacaucccgaaucuaauu

SEQ ID NO: 1004543 - RNA, 19 nt, Homo sapiens
uaaccaaccucucaucaca

SEQ ID NO: 1004544 - RNA, 19 nt, Homo sapiens
gcaggacucuuaauaucug

SEQ ID NO: 1004545 - RNA, 19 nt, Homo sapiens
ucacaggagcugagacuua

SEQ ID NO: 1004546 - RNA, 19 nt, Homo sapiens
ggcguuauauuuaauguga

SEQ ID NO: 1004547 - RNA, 19 nt, Homo sapiens
agaguaagaugcauuaaca

SEQ ID NO: 1004548 - RNA, 19 nt, Homo sapiens
ggaacaaacccuccuuuca

SEQ ID NO: 1004549 - RNA, 19 nt, Homo sapiens
cagcaggacucuuaauauc

SEQ ID NO: 1004550 - RNA, 19 nt, Homo sapiens
gccaagaaguacagagauu

SEQ ID NO: 1004551 - RNA, 19 nt, Homo sapiens
cugaaaggcguuauauuua

SEQ ID NO: 1004552 - RNA, 19 nt, Homo sapiens
cagcgucucuuuaugauuc

SEQ ID NO: 1004553 - RNA, 19 nt, Homo sapiens
gaagaugcuugagguuaga

SEQ ID NO: 1004554 - RNA, 19 nt, Homo sapiens
uaucggaaauugcccguuu

SEQ ID NO: 1004555 - RNA, 19 nt, Homo sapiens
caaauucucagcguuuaua

SEQ ID NO: 1004556 - RNA, 19 nt, Homo sapiens
uacccaagcuccauauuau

SEQ ID NO: 1004557 - RNA, 19 nt, Homo sapiens
gccaaauucucagcguuua

SEQ ID NO: 1004558 - RNA, 19 nt, Homo sapiens
ucaagacggaugugaauaa

SEQ ID NO: 1004559 - RNA, 19 nt, Homo sapiens
gaaaaugugagguuguuua

SEQ ID NO: 1004560 - RNA, 19 nt, Homo sapiens
ccagggagauuaaauucau

SEQ ID NO: 1004561 - RNA, 19 nt, Homo sapiens
agacggaugugaauaagau

SEQ ID NO: 1004562 - RNA, 19 nt, Homo sapiens
cgucaaggcugguuaugau

SEQ ID NO: 1004563 - RNA, 19 nt, Homo sapiens
cccaagcuccauauuauua

SEQ ID NO: 1004564 - RNA, 19 nt, Homo sapiens
gagauugggucuagcacau

SEQ ID NO: 1004565 - RNA, 19 nt, Homo sapiens
gaaggaugcaaaugagauu

SEQ ID NO: 1004566 - RNA, 19 nt, Homo sapiens
guauguguuugaugcuaua

SEQ ID NO: 1004567 - RNA, 19 nt, Homo sapiens
uaucagaggguguaaagaa

SEQ ID NO: 1004568 - RNA, 19 nt, Homo sapiens
cgcaggaaaugacguguuu

SEQ ID NO: 1004569 - RNA, 19 nt, Homo sapiens
guaagaugcauuaacagaa

SEQ ID NO: 1004570 - RNA, 19 nt, Homo sapiens
gacagucguacacaucuua

SEQ ID NO: 1004571 - RNA, 19 nt, Homo sapiens
gguaaacgguccaguuagg

SEQ ID NO: 1004572 - RNA, 19 nt, Homo sapiens
ggacagucguacacaucuu

SEQ ID NO: 1004573 - RNA, 19 nt, Homo sapiens
aaugugagguuguuuagau

SEQ ID NO: 1004574 - RNA, 19 nt, Homo sapiens
gaaaugaagcugggcuguu

SEQ ID NO: 1004575 - RNA, 19 nt, Homo sapiens
cacaggagcugagacuuau

SEQ ID NO: 1004576 - RNA, 19 nt, Homo sapiens
acacgcauauucagauguu

SEQ ID NO: 1004577 - RNA, 19 nt, Homo sapiens
ggagggaguagaaacuauu

SEQ ID NO: 1004578 - RNA, 19 nt, Homo sapiens
acacacacacacacaauuu

SEQ ID NO: 1004579 - RNA, 19 nt, Homo sapiens
cucuuucgcucuucgauua

SEQ ID NO: 1004580 - RNA, 19 nt, Homo sapiens
gggagggaguagaaacuau

SEQ ID NO: 1004581 - RNA, 19 nt, Homo sapiens
gaucauacacagaggacuu

SEQ ID NO: 1004582 - RNA, 19 nt, Homo sapiens
ggacuuacaccauacaaaa

SEQ ID NO: 1004583 - RNA, 19 nt, Homo sapiens
uggagauacuugaauaaug

SEQ ID NO: 1004584 - RNA, 19 nt, Homo sapiens
uuacccaagcuccauauua

SEQ ID NO: 1004585 - RNA, 19 nt, Homo sapiens
aacaaacccuccuuucaug

SEQ ID NO: 1004586 - RNA, 19 nt, Homo sapiens
gaaagagaguaagaugcau

SEQ ID NO: 1004587 - RNA, 19 nt, Homo sapiens
gguauguguuugaugcuau

SEQ ID NO: 1004588 - RNA, 19 nt, Homo sapiens
aguagaaacuauugacuca

SEQ ID NO: 1004589 - RNA, 19 nt, Homo sapiens
gugagaguaucggaaauug

SEQ ID NO: 1004590 - RNA, 19 nt, Homo sapiens
agaagaugcuugagguuag

SEQ ID NO: 1004591 - RNA, 19 nt, Homo sapiens
cuuaauaucugcugcaacu

SEQ ID NO: 1004592 - RNA, 19 nt, Homo sapiens
ccaagaaguacagagauuu

SEQ ID NO: 1004593 - RNA, 19 nt, Homo sapiens
gcaccgaggaugucacugu

SEQ ID NO: 1004594 - RNA, 19 nt, Homo sapiens
uuccaaaucuucaguaucu

SEQ ID NO: 1004595 - RNA, 19 nt, Homo sapiens
ugucuuauuucucaguuga

SEQ ID NO: 1004596 - RNA, 19 nt, Homo sapiens
gcuguuuucugucuuauuu

SEQ ID NO: 1004597 - RNA, 19 nt, Homo sapiens
cccaacaucccgaaucuaa

SEQ ID NO: 1004598 - RNA, 19 nt, Homo sapiens
gacccaacaucccgaaucu

SEQ ID NO: 1004599 - RNA, 19 nt, Homo sapiens
gauugggucuagcacaugu

SEQ ID NO: 1004600 - RNA, 19 nt, Homo sapiens
uaauaucugcugcaacuug

SEQ ID NO: 1004601 - RNA, 19 nt, Homo sapiens
caagacggaugugaauaag

SEQ ID NO: 1004602 - RNA, 19 nt, Homo sapiens
ugaaagagaguaagaugca

SEQ ID NO: 1004603 - RNA, 19 nt, Homo sapiens
gagaaaaugugagguuguu

SEQ ID NO: 1004604 - RNA, 19 nt, Homo sapiens
cuagagaugaguucacaaa

SEQ ID NO: 1004605 - RNA, 19 nt, Homo sapiens
agacuuaucagccagaaug

SEQ ID NO: 1004606 - RNA, 19 nt, Homo sapiens
gagguuguuuagauacuca

SEQ ID NO: 1004607 - RNA, 19 nt, Homo sapiens
ccaaaucuucaguaucuug

SEQ ID NO: 1004608 - RNA, 19 nt, Homo sapiens
uuaagauuguggccaagaa

SEQ ID NO: 1004609 - RNA, 19 nt, Homo sapiens
ccaagcuccauauuauuaa

SEQ ID NO: 1004610 - RNA, 19 nt, Homo sapiens
aagagaguaagaugcauua

SEQ ID NO: 1004611 - RNA, 19 nt, Homo sapiens
gacaaguccugggcaguuc

SEQ ID NO: 1004612 - RNA, 19 nt, Homo sapiens
gccuucagcaggacucuua

SEQ ID NO: 1004613 - RNA, 19 nt, Homo sapiens
ccgaggaugucacuguuuc

SEQ ID NO: 1004614 - RNA, 19 nt, Homo sapiens
acacgaagaaggaugcaaa

SEQ ID NO: 1004615 - RNA, 19 nt, Homo sapiens
uagcacaugucacccuugu

SEQ ID NO: 1004616 - RNA, 19 nt, Homo sapiens
gaugcuauaaagcucauuu

SEQ ID NO: 1004617 - RNA, 19 nt, Homo sapiens
ucucagcgucucuuuauga

SEQ ID NO: 1004618 - RNA, 19 nt, Homo sapiens
gaagagaaaaugugagguu

SEQ ID NO: 1004619 - RNA, 19 nt, Homo sapiens
gcugagugcuggccuuaac

SEQ ID NO: 1004620 - RNA, 19 nt, Homo sapiens
ucccugcccugaaauguga

SEQ ID NO: 1004621 - RNA, 19 nt, Homo sapiens
acacacacacaauuucauu

SEQ ID NO: 1004622 - RNA, 19 nt, Homo sapiens
cagaggguguaaagaagga

SEQ ID NO: 1004623 - RNA, 19 nt, Homo sapiens
gaagucaagacggauguga

SEQ ID NO: 1004624 - RNA, 19 nt, Homo sapiens
gaagggaccucgaguguga

SEQ ID NO: 1004625 - RNA, 19 nt, Homo sapiens
acaauaagcuggaccucua

SEQ ID NO: 1004626 - RNA, 19 nt, Homo sapiens
gaaguguccucuuagaaug

SEQ ID NO: 1004627 - RNA, 19 nt, Homo sapiens
gcaacuggcuguuccugaa

SEQ ID NO: 1004628 - RNA, 19 nt, Homo sapiens
gcaaugcacugggccauau

SEQ ID NO: 1004629 - RNA, 19 nt, Homo sapiens
ggagcugucugccauuuga

SEQ ID NO: 1004630 - RNA, 19 nt, Homo sapiens
ggguggaaguguccucuua

SEQ ID NO: 1004631 - RNA, 19 nt, Homo sapiens
ggacaaccaccacuucuau

SEQ ID NO: 1004632 - RNA, 19 nt, Homo sapiens
ggaaguguccucuuagaau

SEQ ID NO: 1004633 - RNA, 19 nt, Homo sapiens
ugaaggagcuggacaugca

SEQ ID NO: 1004634 - RNA, 19 nt, Homo sapiens
acaauuaccuggccuucuu

SEQ ID NO: 1004635 - RNA, 19 nt, Homo sapiens
gagcaggcacucaauaaau

SEQ ID NO: 1004636 - RNA, 19 nt, Homo sapiens
gcccugcgcuuccuauuca

SEQ ID NO: 1004637 - RNA, 19 nt, Homo sapiens
cuacuaggcugguauaaaa

SEQ ID NO: 1004638 - RNA, 19 nt, Homo sapiens
cuagaccugucccacaaua

SEQ ID NO: 1004639 - RNA, 19 nt, Homo sapiens
ugaaggcccugaccaaugg

SEQ ID NO: 1004640 - RNA, 19 nt, Homo sapiens
ggauguaggcugucugaga

SEQ ID NO: 1004641 - RNA, 19 nt, Homo sapiens
aaucuuacuuccucuauuc

SEQ ID NO: 1004642 - RNA, 19 nt, Homo sapiens
gacggcaacuguuauuaca

SEQ ID NO: 1004643 - RNA, 19 nt, Homo sapiens
cagagcaggcacucaauaa

SEQ ID NO: 1004644 - RNA, 19 nt, Homo sapiens
gugagaacuuccucuacaa

SEQ ID NO: 1004645 - RNA, 19 nt, Homo sapiens
acaacaacaucaugacugu

SEQ ID NO: 1004646 - RNA, 19 nt, Homo sapiens
gacaaccaccacuucuaua

SEQ ID NO: 1004647 - RNA, 19 nt, Homo sapiens
gaacuuccucuacaaaugc

SEQ ID NO: 1004648 - RNA, 19 nt, Homo sapiens
agaacuuccucuacaaaug

SEQ ID NO: 1004649 - RNA, 19 nt, Homo sapiens
ggaccugagugagaacuuc

SEQ ID NO: 1004650 - RNA, 19 nt, Homo sapiens
caacuguuauuacaagaac

SEQ ID NO: 1004651 - RNA, 19 nt, Homo sapiens
gagcuacuaggcugguaua

SEQ ID NO: 1004652 - RNA, 19 nt, Homo sapiens
cuacaaaugcaucacuaaa

SEQ ID NO: 1004653 - RNA, 19 nt, Homo sapiens
acaaccaccacuucuauaa

SEQ ID NO: 1004654 - RNA, 19 nt, Homo sapiens
guggaaguguccucuuaga

SEQ ID NO: 1004655 - RNA, 19 nt, Homo sapiens
gcaaauacuagauguaagc

SEQ ID NO: 1004656 - RNA, 19 nt, Homo sapiens
ccaacgcccucaagacagu

SEQ ID NO: 1004657 - RNA, 19 nt, Homo sapiens
gagaacuuccucuacaaau

SEQ ID NO: 1004658 - RNA, 19 nt, Homo sapiens
ggacggcaacuguuauuac

SEQ ID NO: 1004659 - RNA, 19 nt, Homo sapiens
uaccuugccugccuuccua

SEQ ID NO: 1004660 - RNA, 19 nt, Homo sapiens
caacauccacagccaagug

SEQ ID NO: 1004661 - RNA, 19 nt, Homo sapiens
gcaacuguuauuacaagaa

SEQ ID NO: 1004662 - RNA, 19 nt, Homo sapiens
uaccuggccuucuuuaagu

SEQ ID NO: 1004663 - RNA, 19 nt, Homo sapiens
uugaaggccugguguugaa

SEQ ID NO: 1004664 - RNA, 19 nt, Homo sapiens
caaccucacccaccuguca

SEQ ID NO: 1004665 - RNA, 19 nt, Homo sapiens
cggcaacuguuauuacaag

SEQ ID NO: 1004666 - RNA, 19 nt, Homo sapiens
gggaagggaccucgagugu

SEQ ID NO: 1004667 - RNA, 19 nt, Homo sapiens
ugcgagagcucaaccuuag

SEQ ID NO: 1004668 - RNA, 19 nt, Homo sapiens
uggaguaucugcuguuguc

SEQ ID NO: 1004669 - RNA, 19 nt, Homo sapiens
ucauggacggcaacuguua

SEQ ID NO: 1004670 - RNA, 19 nt, Homo sapiens
aaccugagcuacaacaaca

SEQ ID NO: 1004671 - RNA, 19 nt, Homo sapiens
ggcaaugucaccagccuuu

SEQ ID NO: 1004672 - RNA, 19 nt, Homo sapiens
gcuacuaggcugguauaaa

SEQ ID NO: 1004673 - RNA, 19 nt, Homo sapiens
acacagagcaggcacucaa

SEQ ID NO: 1004674 - RNA, 19 nt, Homo sapiens
cuuaaccuguccuucaauu

SEQ ID NO: 1004675 - RNA, 19 nt, Homo sapiens
gggacaaccaccacuucua

SEQ ID NO: 1004676 - RNA, 19 nt, Homo sapiens
cagacuggguguacaacga

SEQ ID NO: 1004677 - RNA, 19 nt, Homo sapiens
gcugggaccucugguacug

SEQ ID NO: 1004678 - RNA, 19 nt, Homo sapiens
cgagugcccugcaaauacu

SEQ ID NO: 1004679 - RNA, 19 nt, Homo sapiens
cugaggaccuggccaaucu

SEQ ID NO: 1004680 - RNA, 19 nt, Homo sapiens
agcaggcacucaauaaaug

SEQ ID NO: 1004681 - RNA, 19 nt, Homo sapiens
cugcaaauacuagauguaa

SEQ ID NO: 1004682 - RNA, 19 nt, Homo sapiens
gcgagugcccugcaaauac

SEQ ID NO: 1004683 - RNA, 19 nt, Homo sapiens
ggcgagugcccugcaaaua

SEQ ID NO: 1004684 - RNA, 19 nt, Homo sapiens
gagcuacaacaacaucaug

SEQ ID NO: 1004685 - RNA, 19 nt, Homo sapiens
uaaccuguccuucaauuac

SEQ ID NO: 1004686 - RNA, 19 nt, Homo sapiens
ugagaacuuccucuacaaa

SEQ ID NO: 1004687 - RNA, 19 nt, Homo sapiens
agugagaacuuccucuaca

SEQ ID NO: 1004688 - RNA, 19 nt, Homo sapiens
ucacccaccugucacucaa

SEQ ID NO: 1004689 - RNA, 19 nt, Homo sapiens
acagagcaggcacucaaua

SEQ ID NO: 1004690 - RNA, 19 nt, Homo sapiens
ucaccagccuuuccuuguc

SEQ ID NO: 1004691 - RNA, 19 nt, Homo sapiens
ugagugagaacuuccucua

SEQ ID NO: 1004692 - RNA, 19 nt, Homo sapiens
aaggagcugucugccauuu

SEQ ID NO: 1004693 - RNA, 19 nt, Homo sapiens
gaaggagcugucugccauu

SEQ ID NO: 1004694 - RNA, 19 nt, Homo sapiens
ggacuucagcggcaaugca

SEQ ID NO: 1004695 - RNA, 19 nt, Homo sapiens
caccugagccgucuugaag

SEQ ID NO: 1004696 - RNA, 19 nt, Homo sapiens
cuacaaccgcaucgucaaa

SEQ ID NO: 1004697 - RNA, 19 nt, Homo sapiens
gcccaaaucccucauaucc

SEQ ID NO: 1004698 - RNA, 19 nt, Homo sapiens
ugccugcgcugcccaaauc

SEQ ID NO: 1004699 - RNA, 19 nt, Homo sapiens
aagcuuaaccuguccuuca

SEQ ID NO: 1004700 - RNA, 19 nt, Homo sapiens
aguaucugcuguuguccua

SEQ ID NO: 1004701 - RNA, 19 nt, Homo sapiens
gugcuggaccugagugaga

SEQ ID NO: 1004702 - RNA, 19 nt, Homo sapiens
ggaccucgagugugaagca

SEQ ID NO: 1004703 - RNA, 19 nt, Homo sapiens
ccgggucaguggucucuug

SEQ ID NO: 1004704 - RNA, 19 nt, Homo sapiens
ggccugagcgguuugaucu

SEQ ID NO: 1004705 - RNA, 19 nt, Homo sapiens
caacuucaccuuggaucug

SEQ ID NO: 1004706 - RNA, 19 nt, Homo sapiens
uccaaggccugagcgguuu

SEQ ID NO: 1004707 - RNA, 19 nt, Homo sapiens
gcagcacccucaacuucac

SEQ ID NO: 1004708 - RNA, 19 nt, Homo sapiens
aaauggccuuugacucaug

SEQ ID NO: 1004709 - RNA, 19 nt, Homo sapiens
ggacacucccagcucugaa

SEQ ID NO: 1004710 - RNA, 19 nt, Homo sapiens
uaucugcuguuguccuaca

SEQ ID NO: 1004711 - RNA, 19 nt, Homo sapiens
agagcaggcacucaauaaa

SEQ ID NO: 1004712 - RNA, 19 nt, Homo sapiens
caauuaccuggccuucuuu

SEQ ID NO: 1004713 - RNA, 19 nt, Homo sapiens
uuaaccuguccuucaauua

SEQ ID NO: 1004714 - RNA, 19 nt, Homo sapiens
gaggaccuggccaaucuga

SEQ ID NO: 1004715 - RNA, 19 nt, Homo sapiens
ggcaacuguuauuacaaga

SEQ ID NO: 1004716 - RNA, 19 nt, Homo sapiens
ccucagccauaccaacauc

SEQ ID NO: 1004717 - RNA, 19 nt, Homo sapiens
uacaacagccagcccuuug

SEQ ID NO: 1004718 - RNA, 19 nt, Homo sapiens
gcugaaggcccugaccaau

SEQ ID NO: 1004719 - RNA, 19 nt, Homo sapiens
ugaucuggcuggacuuguc

SEQ ID NO: 1004720 - RNA, 19 nt, Homo sapiens
cuacaacagccagcccuuu

SEQ ID NO: 1004721 - RNA, 19 nt, Homo sapiens
gcacuuccccugccacaug

SEQ ID NO: 1004722 - RNA, 19 nt, Homo sapiens
cugcgagagcucaaccuua

SEQ ID NO: 1004723 - RNA, 19 nt, Homo sapiens
ggcaaugcacugggccaua

SEQ ID NO: 1004724 - RNA, 19 nt, Homo sapiens
acaauaagcuggaccucua

SEQ ID NO: 1004725 - RNA, 19 nt, Homo sapiens
gcaacuggcuguuccugaa

SEQ ID NO: 1004726 - RNA, 19 nt, Homo sapiens
gcaaugcacugggccauau

SEQ ID NO: 1004727 - RNA, 19 nt, Homo sapiens
ggacaaccaccacuucuau

SEQ ID NO: 1004728 - RNA, 19 nt, Homo sapiens
ugaaggagcuggacaugca

SEQ ID NO: 1004729 - RNA, 19 nt, Homo sapiens
acaauuaccuggccuucuu

SEQ ID NO: 1004730 - RNA, 19 nt, Homo sapiens
gagcaggcacucaauaaau

SEQ ID NO: 1004731 - RNA, 19 nt, Homo sapiens
gcccugcgcuuccuauuca

SEQ ID NO: 1004732 - RNA, 19 nt, Homo sapiens
cuagaccugucccacaaua

SEQ ID NO: 1004733 - RNA, 19 nt, Homo sapiens
ugaaggcccugaccaaugg

SEQ ID NO: 1004734 - RNA, 19 nt, Homo sapiens
gacggcaacuguuauuaca

SEQ ID NO: 1004735 - RNA, 19 nt, Homo sapiens
cagagcaggcacucaauaa

SEQ ID NO: 1004736 - RNA, 19 nt, Homo sapiens
gugagaacuuccucuacaa

SEQ ID NO: 1004737 - RNA, 19 nt, Homo sapiens
acaacaacaucaugacugu

SEQ ID NO: 1004738 - RNA, 19 nt, Homo sapiens
gacaaccaccacuucuaua

SEQ ID NO: 1004739 - RNA, 19 nt, Homo sapiens
gaacuuccucuacaaaugc

SEQ ID NO: 1004740 - RNA, 19 nt, Homo sapiens
agaacuuccucuacaaaug

SEQ ID NO: 1004741 - RNA, 19 nt, Homo sapiens
ggaccugagugagaacuuc

SEQ ID NO: 1004742 - RNA, 19 nt, Homo sapiens
caacuguuauuacaagaac

SEQ ID NO: 1004743 - RNA, 19 nt, Homo sapiens
cuacaaaugcaucacuaaa

SEQ ID NO: 1004744 - RNA, 19 nt, Homo sapiens
acaaccaccacuucuauaa

SEQ ID NO: 1004745 - RNA, 19 nt, Homo sapiens
gcaaauacuagauguaagc

SEQ ID NO: 1004746 - RNA, 19 nt, Homo sapiens
ccaacgcccucaagacagu

SEQ ID NO: 1004747 - RNA, 19 nt, Homo sapiens
gagaacuuccucuacaaau

SEQ ID NO: 1004748 - RNA, 19 nt, Homo sapiens
ggacggcaacuguuauuac

SEQ ID NO: 1004749 - RNA, 19 nt, Homo sapiens
caacauccacagccaagug

SEQ ID NO: 1004750 - RNA, 19 nt, Homo sapiens
gcaacuguuauuacaagaa

SEQ ID NO: 1004751 - RNA, 19 nt, Homo sapiens
uaccuggccuucuuuaagu

SEQ ID NO: 1004752 - RNA, 19 nt, Homo sapiens
uugaaggccugguguugaa

SEQ ID NO: 1004753 - RNA, 19 nt, Homo sapiens
caaccucacccaccuguca

SEQ ID NO: 1004754 - RNA, 19 nt, Homo sapiens
cggcaacuguuauuacaag

SEQ ID NO: 1004755 - RNA, 19 nt, Homo sapiens
ugcgagagcucaaccuuag

SEQ ID NO: 1004756 - RNA, 19 nt, Homo sapiens
uggaguaucugcuguuguc

SEQ ID NO: 1004757 - RNA, 19 nt, Homo sapiens
ucauggacggcaacuguua

SEQ ID NO: 1004758 - RNA, 19 nt, Homo sapiens
ggcaaugucaccagccuuu

SEQ ID NO: 1004759 - RNA, 19 nt, Homo sapiens
aaccugagcuacaacaaca

SEQ ID NO: 1004760 - RNA, 19 nt, Homo sapiens
acacagagcaggcacucaa

SEQ ID NO: 1004761 - RNA, 19 nt, Homo sapiens
cuuaaccuguccuucaauu

SEQ ID NO: 1004762 - RNA, 19 nt, Homo sapiens
gggacaaccaccacuucua

SEQ ID NO: 1004763 - RNA, 19 nt, Homo sapiens
cagacuggguguacaacga

SEQ ID NO: 1004764 - RNA, 19 nt, Homo sapiens
gcugggaccucugguacug

SEQ ID NO: 1004765 - RNA, 19 nt, Homo sapiens
cgagugcccugcaaauacu

SEQ ID NO: 1004766 - RNA, 19 nt, Homo sapiens
cugaggaccuggccaaucu

SEQ ID NO: 1004767 - RNA, 19 nt, Homo sapiens
agcaggcacucaauaaaug

SEQ ID NO: 1004768 - RNA, 19 nt, Homo sapiens
cugcaaauacuagauguaa

SEQ ID NO: 1004769 - RNA, 19 nt, Homo sapiens
gcgagugcccugcaaauac

SEQ ID NO: 1004770 - RNA, 19 nt, Homo sapiens
ggcgagugcccugcaaaua

SEQ ID NO: 1004771 - RNA, 19 nt, Homo sapiens
gagcuacaacaacaucaug

SEQ ID NO: 1004772 - RNA, 19 nt, Homo sapiens
uaaccuguccuucaauuac

SEQ ID NO: 1004773 - RNA, 19 nt, Homo sapiens
ugagaacuuccucuacaaa

SEQ ID NO: 1004774 - RNA, 19 nt, Homo sapiens
agugagaacuuccucuaca

SEQ ID NO: 1004775 - RNA, 19 nt, Homo sapiens
ucacccaccugucacucaa

SEQ ID NO: 1004776 - RNA, 19 nt, Homo sapiens
acagagcaggcacucaaua

SEQ ID NO: 1004777 - RNA, 19 nt, Homo sapiens
ucaccagccuuuccuuguc

SEQ ID NO: 1004778 - RNA, 19 nt, Homo sapiens
ugagugagaacuuccucua

SEQ ID NO: 1004779 - RNA, 19 nt, Homo sapiens
ggacuucagcggcaaugca

SEQ ID NO: 1004780 - RNA, 19 nt, Homo sapiens
caccugagccgucuugaag

SEQ ID NO: 1004781 - RNA, 19 nt, Homo sapiens
cuacaaccgcaucgucaaa

SEQ ID NO: 1004782 - RNA, 19 nt, Homo sapiens
gcccaaaucccucauaucc

SEQ ID NO: 1004783 - RNA, 19 nt, Homo sapiens
ugccugcgcugcccaaauc

SEQ ID NO: 1004784 - RNA, 19 nt, Homo sapiens
aagcuuaaccuguccuuca

SEQ ID NO: 1004785 - RNA, 19 nt, Homo sapiens
aguaucugcuguuguccua

SEQ ID NO: 1004786 - RNA, 19 nt, Homo sapiens
gugcuggaccugagugaga

SEQ ID NO: 1004787 - RNA, 19 nt, Homo sapiens
ccgggucaguggucucuug

SEQ ID NO: 1004788 - RNA, 19 nt, Homo sapiens
ggccugagcgguuugaucu

SEQ ID NO: 1004789 - RNA, 19 nt, Homo sapiens
caacuucaccuuggaucug

SEQ ID NO: 1004790 - RNA, 19 nt, Homo sapiens
uccaaggccugagcgguuu

SEQ ID NO: 1004791 - RNA, 19 nt, Homo sapiens
gcagcacccucaacuucac

SEQ ID NO: 1004792 - RNA, 19 nt, Homo sapiens
ggacacucccagcucugaa

SEQ ID NO: 1004793 - RNA, 19 nt, Homo sapiens
uaucugcuguuguccuaca

SEQ ID NO: 1004794 - RNA, 19 nt, Homo sapiens
agagcaggcacucaauaaa

SEQ ID NO: 1004795 - RNA, 19 nt, Homo sapiens
caauuaccuggccuucuuu

SEQ ID NO: 1004796 - RNA, 19 nt, Homo sapiens
uuaaccuguccuucaauua

SEQ ID NO: 1004797 - RNA, 19 nt, Homo sapiens
gaggaccuggccaaucuga

SEQ ID NO: 1004798 - RNA, 19 nt, Homo sapiens
ggcaacuguuauuacaaga

SEQ ID NO: 1004799 - RNA, 19 nt, Homo sapiens
ccucagccauaccaacauc

SEQ ID NO: 1004800 - RNA, 19 nt, Homo sapiens
uacaacagccagcccuuug

SEQ ID NO: 1004801 - RNA, 19 nt, Homo sapiens
gcacuuccccugccacaug

SEQ ID NO: 1004802 - RNA, 19 nt, Homo sapiens
gcugaaggcccugaccaau

SEQ ID NO: 1004803 - RNA, 19 nt, Homo sapiens
ugaucuggcuggacuuguc

SEQ ID NO: 1004804 - RNA, 19 nt, Homo sapiens
cuacaacagccagcccuuu

SEQ ID NO: 1004805 - RNA, 19 nt, Homo sapiens
cugcgagagcucaaccuua

SEQ ID NO: 1004806 - RNA, 19 nt, Homo sapiens
ggcaaugcacugggccaua

SEQ ID NO: 1004807 - RNA, 19 nt, Homo sapiens
ugcuagaccugucccacaa

SEQ ID NO: 1004808 - RNA, 19 nt, Homo sapiens
aggaugcccugcccuacga

SEQ ID NO: 1004809 - RNA, 19 nt, Homo sapiens
cugaaggcccugaccaaug

SEQ ID NO: 1004810 - RNA, 19 nt, Homo sapiens
uuaccuggccuucuuuaag

SEQ ID NO: 1004811 - RNA, 19 nt, Homo sapiens
cugcagcacccucaacuuc

SEQ ID NO: 1004812 - RNA, 19 nt, Homo sapiens
ccaccugagccgucuugaa

SEQ ID NO: 1004813 - RNA, 19 nt, Homo sapiens
caaccaccacuucuauaac

SEQ ID NO: 1004814 - RNA, 19 nt, Homo sapiens
cgccaacgcccucaagaca

SEQ ID NO: 1004815 - RNA, 19 nt, Homo sapiens
gcaacagcaucagcuucgu

SEQ ID NO: 1004816 - RNA, 19 nt, Homo sapiens
gcacucauucacggagcua

SEQ ID NO: 1004817 - RNA, 19 nt, Homo sapiens
cugcccaaaucccucauau

SEQ ID NO: 1004818 - RNA, 19 nt, Homo sapiens
ccuggaguaucugcuguug

SEQ ID NO: 1004819 - RNA, 19 nt, Homo sapiens
gaaagaagcucuggaagca

SEQ ID NO: 1004820 - RNA, 19 nt, Homo sapiens
gaagaaugcugagaagauu

SEQ ID NO: 1004821 - RNA, 19 nt, Homo sapiens
ggacaaugaugaagacgaa

SEQ ID NO: 1004822 - RNA, 19 nt, Homo sapiens
gaaucuaacucucccuaaa

SEQ ID NO: 1004823 - RNA, 19 nt, Homo sapiens
gcuaacaacuuugcaauga

SEQ ID NO: 1004824 - RNA, 19 nt, Homo sapiens
gaaugaagaggaagaagua

SEQ ID NO: 1004825 - RNA, 19 nt, Homo sapiens
gaagguaccacuugaaaug

SEQ ID NO: 1004826 - RNA, 19 nt, Homo sapiens
guagugacguguaguuuga

SEQ ID NO: 1004827 - RNA, 19 nt, Homo sapiens
gaagaaggacaaagacaaa

SEQ ID NO: 1004828 - RNA, 19 nt, Homo sapiens
caagagggauucugaacga

SEQ ID NO: 1004829 - RNA, 19 nt, Homo sapiens
aagaagcucuggaagcaua

SEQ ID NO: 1004830 - RNA, 19 nt, Homo sapiens
aagaaaggcuggaagaaga

SEQ ID NO: 1004831 - RNA, 19 nt, Homo sapiens
gcacagucuuugacaauag

SEQ ID NO: 1004832 - RNA, 19 nt, Homo sapiens
ggaagaaguagacaacuga

SEQ ID NO: 1004833 - RNA, 19 nt, Homo sapiens
ggaagaagaagaacagaau

SEQ ID NO: 1004834 - RNA, 19 nt, Homo sapiens
ucacuugacagaagcauua

SEQ ID NO: 1004835 - RNA, 19 nt, Homo sapiens
ugaguaagcuuuaggaaac

SEQ ID NO: 1004836 - RNA, 19 nt, Homo sapiens
gaaggaggccucagagcaa

SEQ ID NO: 1004837 - RNA, 19 nt, Homo sapiens
gagaagauuguaaugcuuu

SEQ ID NO: 1004838 - RNA, 19 nt, Homo sapiens
gagcagggaugaggacaau

SEQ ID NO: 1004839 - RNA, 19 nt, Homo sapiens
gcaagaaggaggccucaga

SEQ ID NO: 1004840 - RNA, 19 nt, Homo sapiens
cuguacagcuuuaggauuu

SEQ ID NO: 1004841 - RNA, 19 nt, Homo sapiens
gagggauucugaacgacua

SEQ ID NO: 1004842 - RNA, 19 nt, Homo sapiens
gcagggaugaggacaauga

SEQ ID NO: 1004843 - RNA, 19 nt, Homo sapiens
gaagaaaggcuggaagaag

SEQ ID NO: 1004844 - RNA, 19 nt, Homo sapiens
gacuagaaauaccgucaaa

SEQ ID NO: 1004845 - RNA, 19 nt, Homo sapiens
gacagaagcauuaacugaa

SEQ ID NO: 1004846 - RNA, 19 nt, Homo sapiens
ugacagaagcauuaacuga

SEQ ID NO: 1004847 - RNA, 19 nt, Homo sapiens
gggaugaggacaaugauga

SEQ ID NO: 1004848 - RNA, 19 nt, Homo sapiens
gcucauugcauccuugaaa

SEQ ID NO: 1004849 - RNA, 19 nt, Homo sapiens
gaguuccucugaucucuug

SEQ ID NO: 1004850 - RNA, 19 nt, Homo sapiens
ccauugagccaaauaaguu

SEQ ID NO: 1004851 - RNA, 19 nt, Homo sapiens
ggagugcaguggcaugauc

SEQ ID NO: 1004852 - RNA, 19 nt, Homo sapiens
gaccuaaaccugcccaaug

SEQ ID NO: 1004853 - RNA, 19 nt, Homo sapiens
cagaagcauuaacugaauu

SEQ ID NO: 1004854 - RNA, 19 nt, Homo sapiens
ucaccaggaucaucaagga

SEQ ID NO: 1004855 - RNA, 19 nt, Homo sapiens
guuugacacuguuaacuug

SEQ ID NO: 1004856 - RNA, 19 nt, Homo sapiens
uauauugccuguagaugau

SEQ ID NO: 1004857 - RNA, 19 nt, Homo sapiens
acagaagcauuaacugaau

SEQ ID NO: 1004858 - RNA, 19 nt, Homo sapiens
gaagaagaagaacagaaug

SEQ ID NO: 1004859 - RNA, 19 nt, Homo sapiens
ccaaaaccuuucuauauug

SEQ ID NO: 1004860 - RNA, 19 nt, Homo sapiens
ucaucaaucugaagguuau

SEQ ID NO: 1004861 - RNA, 19 nt, Homo sapiens
uugauaaccugcuuaauac

SEQ ID NO: 1004862 - RNA, 19 nt, Homo sapiens
ggaaugguauuagucaaac

SEQ ID NO: 1004863 - RNA, 19 nt, Homo sapiens
gaagaagaacagaaugaag

SEQ ID NO: 1004864 - RNA, 19 nt, Homo sapiens
guucuaaucucacguuuug

SEQ ID NO: 1004865 - RNA, 19 nt, Homo sapiens
gcuuaauacuccaaagugu

SEQ ID NO: 1004866 - RNA, 19 nt, Homo sapiens
ucagaaugaguaagcuuua

SEQ ID NO: 1004867 - RNA, 19 nt, Homo sapiens
uuacuaagacugcucagaa

SEQ ID NO: 1004868 - RNA, 19 nt, Homo sapiens
cuaacaacuuugcaaugaa

SEQ ID NO: 1004869 - RNA, 19 nt, Homo sapiens
gugaaaaguuugugaguga

SEQ ID NO: 1004870 - RNA, 19 nt, Homo sapiens
aagaagaacagaaugaaga

SEQ ID NO: 1004871 - RNA, 19 nt, Homo sapiens
cuaagacugcucagaauga

SEQ ID NO: 1004872 - RNA, 19 nt, Homo sapiens
ugagaagauuguaaugcuu

SEQ ID NO: 1004873 - RNA, 19 nt, Homo sapiens
ugaagaaugcugagaagau

SEQ ID NO: 1004874 - RNA, 19 nt, Homo sapiens
ucacuucugucagucugua

SEQ ID NO: 1004875 - RNA, 19 nt, Homo sapiens
ucagcaguguggaauggua

SEQ ID NO: 1004876 - RNA, 19 nt, Homo sapiens
gaagaaguagacaacugaa

SEQ ID NO: 1004877 - RNA, 19 nt, Homo sapiens
ggaaucuaacucucccuaa

SEQ ID NO: 1004878 - RNA, 19 nt, Homo sapiens
cgccugagccuccugagua

SEQ ID NO: 1004879 - RNA, 19 nt, Homo sapiens
ucugaucucuugauuccuu

SEQ ID NO: 1004880 - RNA, 19 nt, Homo sapiens
uuucucaucugccuccuuu

SEQ ID NO: 1004881 - RNA, 19 nt, Homo sapiens
gcaguguggaaugguauua

SEQ ID NO: 1004882 - RNA, 19 nt, Homo sapiens
cccaaaaccuuucuauauu

SEQ ID NO: 1004883 - RNA, 19 nt, Homo sapiens
gaaugaguaagcuuuagga

SEQ ID NO: 1004884 - RNA, 19 nt, Homo sapiens
ggaagguaccacuugaaau

SEQ ID NO: 1004885 - RNA, 19 nt, Homo sapiens
agaacagaaugaagaggaa

SEQ ID NO: 1004886 - RNA, 19 nt, Homo sapiens
aaaccauccucuuuaacug

SEQ ID NO: 1004887 - RNA, 19 nt, Homo sapiens
ggacggaagcuccauugag

SEQ ID NO: 1004888 - RNA, 19 nt, Homo sapiens
gcgguucguuaucccauug

SEQ ID NO: 1004889 - RNA, 19 nt, Homo sapiens
gagugaagaaugcugagaa

SEQ ID NO: 1004890 - RNA, 19 nt, Homo sapiens
cuauauugccuguagauga

SEQ ID NO: 1004891 - RNA, 19 nt, Homo sapiens
gcccaaaaccuuucuauau

SEQ ID NO: 1004892 - RNA, 19 nt, Homo sapiens
cagaguagucucaggcaaa

SEQ ID NO: 1004893 - RNA, 19 nt, Homo sapiens
gguaccacuugaaaugaga

SEQ ID NO: 1004894 - RNA, 19 nt, Homo sapiens
gguagugacguguaguuug

SEQ ID NO: 1004895 - RNA, 19 nt, Homo sapiens
uuaauacuccaaaguguga

SEQ ID NO: 1004896 - RNA, 19 nt, Homo sapiens
caggcuuccucuucuugua

SEQ ID NO: 1004897 - RNA, 19 nt, Homo sapiens
guacagcuuuaggauuugu

SEQ ID NO: 1004898 - RNA, 19 nt, Homo sapiens
cugcuacuguacagcuuua

SEQ ID NO: 1004899 - RNA, 19 nt, Homo sapiens
cagauggcauagugucaga

SEQ ID NO: 1004900 - RNA, 19 nt, Homo sapiens
gaaugguauuagucaaaca

SEQ ID NO: 1004901 - RNA, 19 nt, Homo sapiens
cauauaggcgggagcagaa

SEQ ID NO: 1004902 - RNA, 19 nt, Homo sapiens
gcaguggcaugaucauagc

SEQ ID NO: 1004903 - RNA, 19 nt, Homo sapiens
gcagaauccuguuuugcuu

SEQ ID NO: 1004904 - RNA, 19 nt, Homo sapiens
aagaagaagaacagaauga

SEQ ID NO: 1004905 - RNA, 19 nt, Homo sapiens
ggaugaggacaaugaugaa

SEQ ID NO: 1004906 - RNA, 19 nt, Homo sapiens
caugacgagugccaaacuu

SEQ ID NO: 1004907 - RNA, 19 nt, Homo sapiens
gcuuuaggauuugucauca

SEQ ID NO: 1004908 - RNA, 19 nt, Homo sapiens
cuuacucucugcuacugua

SEQ ID NO: 1004909 - RNA, 19 nt, Homo sapiens
uggcauagugucagaugua

SEQ ID NO: 1004910 - RNA, 19 nt, Homo sapiens
gauucugaacgacuaaauu

SEQ ID NO: 1004911 - RNA, 19 nt, Homo sapiens
gggaaguccggacgcagua

SEQ ID NO: 1004912 - RNA, 19 nt, Homo sapiens
ugacagguagugacgugua

SEQ ID NO: 1004913 - RNA, 19 nt, Homo sapiens
agaagaaggacaaagacaa

SEQ ID NO: 1004914 - RNA, 19 nt, Homo sapiens
gacagguagugacguguag

SEQ ID NO: 1004915 - RNA, 19 nt, Homo sapiens
gccugagccuccugaguau

SEQ ID NO: 1004916 - RNA, 19 nt, Homo sapiens
ccucugaucucuugauucc

SEQ ID NO: 1004917 - RNA, 19 nt, Homo sapiens
caaaauccguucucucucu

SEQ ID NO: 1004918 - RNA, 19 nt, Homo sapiens
ggucagccuauguuugauu

SEQ ID NO: 1004919 - RNA, 19 nt, Homo sapiens
gcagauauauuaccaaaga

SEQ ID NO: 1004920 - RNA, 19 nt, Homo sapiens
guaaauacuugcuagcuua

SEQ ID NO: 1004921 - RNA, 19 nt, Homo sapiens
gaacucagcuguuguagca

SEQ ID NO: 1004922 - RNA, 19 nt, Homo sapiens
gaaagcagccagguaauua

SEQ ID NO: 1004923 - RNA, 19 nt, Homo sapiens
guaaauaguucaagcuuug

SEQ ID NO: 1004924 - RNA, 19 nt, Homo sapiens
aaaguugacuguucagaua

SEQ ID NO: 1004925 - RNA, 19 nt, Homo sapiens
gcuauucucugucccuaua

SEQ ID NO: 1004926 - RNA, 19 nt, Homo sapiens
ggaagaagaugaggagaau

SEQ ID NO: 1004927 - RNA, 19 nt, Homo sapiens
ccacggagcucuuuguuca

SEQ ID NO: 1004928 - RNA, 19 nt, Homo sapiens
ugaugaagcugacuccuaa

SEQ ID NO: 1004929 - RNA, 19 nt, Homo sapiens
ucacggagcucguaguuuc

SEQ ID NO: 1004930 - RNA, 19 nt, Homo sapiens
ggaaucaguucuuauaaac

SEQ ID NO: 1004931 - RNA, 19 nt, Homo sapiens
ccacuuaggguaaauguuu

SEQ ID NO: 1004932 - RNA, 19 nt, Homo sapiens
gcacagcaaucagaaacuu

SEQ ID NO: 1004933 - RNA, 19 nt, Homo sapiens
aaagacagauucucacuca

SEQ ID NO: 1004934 - RNA, 19 nt, Homo sapiens
uagcuuaugugccauuaaa

SEQ ID NO: 1004935 - RNA, 19 nt, Homo sapiens
acacagcacugcccgcuuu

SEQ ID NO: 1004936 - RNA, 19 nt, Homo sapiens
gaaaggcccaugcaguaaa

SEQ ID NO: 1004937 - RNA, 19 nt, Homo sapiens
gguguacaguucugaguuu

SEQ ID NO: 1004938 - RNA, 19 nt, Homo sapiens
gaaugcagguggcuguguu

SEQ ID NO: 1004939 - RNA, 19 nt, Homo sapiens
gcagguggcuguguuucaa

SEQ ID NO: 1004940 - RNA, 19 nt, Homo sapiens
gcagaggcaaggccaauuu

SEQ ID NO: 1004941 - RNA, 19 nt, Homo sapiens
ggaaaggcccaugcaguaa

SEQ ID NO: 1004942 - RNA, 19 nt, Homo sapiens
gcacgaaagcagccaggua

SEQ ID NO: 1004943 - RNA, 19 nt, Homo sapiens
gaagcugacuccuaaacca

SEQ ID NO: 1004944 - RNA, 19 nt, Homo sapiens
auaaacagcucgauucagu

SEQ ID NO: 1004945 - RNA, 19 nt, Homo sapiens
uaccaggugucaucaaauu

SEQ ID NO: 1004946 - RNA, 19 nt, Homo sapiens
ccagguaauuacuagauga

SEQ ID NO: 1004947 - RNA, 19 nt, Homo sapiens
ccaccacaauuaacagcua

SEQ ID NO: 1004948 - RNA, 19 nt, Homo sapiens
gacagauucucacucaguu

SEQ ID NO: 1004949 - RNA, 19 nt, Homo sapiens
uauaccaggugucaucaaa

SEQ ID NO: 1004950 - RNA, 19 nt, Homo sapiens
gcagccagguaauuacuag

SEQ ID NO: 1004951 - RNA, 19 nt, Homo sapiens
gguauucuuucgagguauu

SEQ ID NO: 1004952 - RNA, 19 nt, Homo sapiens
uggaaaggcccaugcagua

SEQ ID NO: 1004953 - RNA, 19 nt, Homo sapiens
caaaugcagucaagucacu

SEQ ID NO: 1004954 - RNA, 19 nt, Homo sapiens
gaggagaaugacaaugaua

SEQ ID NO: 1004955 - RNA, 19 nt, Homo sapiens
gaaaaugcuuaaagaggaa

SEQ ID NO: 1004956 - RNA, 19 nt, Homo sapiens
gugguauucuuucgaggua

SEQ ID NO: 1004957 - RNA, 19 nt, Homo sapiens
uaagaaaaguugacuguuc

SEQ ID NO: 1004958 - RNA, 19 nt, Homo sapiens
uggccaggcuugucucaaa

SEQ ID NO: 1004959 - RNA, 19 nt, Homo sapiens
caccaugcccaaccuauuu

SEQ ID NO: 1004960 - RNA, 19 nt, Homo sapiens
ucaguuucuugcagauaua

SEQ ID NO: 1004961 - RNA, 19 nt, Homo sapiens
gcuagcuuaugugccauua

SEQ ID NO: 1004962 - RNA, 19 nt, Homo sapiens
cuauaucacccuccaguaa

SEQ ID NO: 1004963 - RNA, 19 nt, Homo sapiens
gcuuacugccugcaaauuu

SEQ ID NO: 1004964 - RNA, 19 nt, Homo sapiens
gggaagaagaugaggagaa

SEQ ID NO: 1004965 - RNA, 19 nt, Homo sapiens
guaauuacuagaugaagga

SEQ ID NO: 1004966 - RNA, 19 nt, Homo sapiens
cgaaagcagccagguaauu

SEQ ID NO: 1004967 - RNA, 19 nt, Homo sapiens
cacgaaagcagccagguaa

SEQ ID NO: 1004968 - RNA, 19 nt, Homo sapiens
gagaaugacaaugauaaug

SEQ ID NO: 1004969 - RNA, 19 nt, Homo sapiens
ggagaaugacaaugauaau

SEQ ID NO: 1004970 - RNA, 19 nt, Homo sapiens
aagaagaugaggagaauga

SEQ ID NO: 1004971 - RNA, 19 nt, Homo sapiens
guaaauaccugaaaaugcu

SEQ ID NO: 1004972 - RNA, 19 nt, Homo sapiens
ucugcaaacugaaacuuga

SEQ ID NO: 1004973 - RNA, 19 nt, Homo sapiens
acacggcaguggaaaggaa

SEQ ID NO: 1004974 - RNA, 19 nt, Homo sapiens
uguaaauacuugcuagcuu

SEQ ID NO: 1004975 - RNA, 19 nt, Homo sapiens
guguuucaauagagcuuua

SEQ ID NO: 1004976 - RNA, 19 nt, Homo sapiens
ggucguggguaaagacaag

SEQ ID NO: 1004977 - RNA, 19 nt, Homo sapiens
gagaaaaccuaucauaagc

SEQ ID NO: 1004978 - RNA, 19 nt, Homo sapiens
gcuaguaaauaccugaaaa

SEQ ID NO: 1004979 - RNA, 19 nt, Homo sapiens
aaaggcccaugcaguaaau

SEQ ID NO: 1004980 - RNA, 19 nt, Homo sapiens
uggcaaccgucaagcuauu

SEQ ID NO: 1004981 - RNA, 19 nt, Homo sapiens
caaggccaauuuuaacuuu

SEQ ID NO: 1004982 - RNA, 19 nt, Homo sapiens
uauaucacccuccaguaaa

SEQ ID NO: 1004983 - RNA, 19 nt, Homo sapiens
ccacuccacugucucuaag

SEQ ID NO: 1004984 - RNA, 19 nt, Homo sapiens
gaagaugaggagaaugaca

SEQ ID NO: 1004985 - RNA, 19 nt, Homo sapiens
ugaggagaaugacaaugau

SEQ ID NO: 1004986 - RNA, 19 nt, Homo sapiens
uuuagugucuagucuguga

SEQ ID NO: 1004987 - RNA, 19 nt, Homo sapiens
ccuaucauaagcccaauuu

SEQ ID NO: 1004988 - RNA, 19 nt, Homo sapiens
acuccacugucucuaagua

SEQ ID NO: 1004989 - RNA, 19 nt, Homo sapiens
uuacagugauuuagcaaac

SEQ ID NO: 1004990 - RNA, 19 nt, Homo sapiens
gccagguaauuacuagaug

SEQ ID NO: 1004991 - RNA, 19 nt, Homo sapiens
cugaguagcugggauuaca

SEQ ID NO: 1004992 - RNA, 19 nt, Homo sapiens
guugacuguucagauauuu

SEQ ID NO: 1004993 - RNA, 19 nt, Homo sapiens
ggagcucuuuguucaaugc

SEQ ID NO: 1004994 - RNA, 19 nt, Homo sapiens
aauacuugcuagcuuaugu

SEQ ID NO: 1004995 - RNA, 19 nt, Homo sapiens
cuuuauuucugcaaacuga

SEQ ID NO: 1004996 - RNA, 19 nt, Homo sapiens
gcccaugcaguaaauaguu

SEQ ID NO: 1004997 - RNA, 19 nt, Homo sapiens
gcuauaucacccuccagua

SEQ ID NO: 1004998 - RNA, 19 nt, Homo sapiens
guucuuugcuuuaaauucc

SEQ ID NO: 1004999 - RNA, 19 nt, Homo sapiens
gcaaacacugcacagcaau

SEQ ID NO: 1005000 - RNA, 19 nt, Homo sapiens
acagcucgauucaguuuua

SEQ ID NO: 1005001 - RNA, 19 nt, Homo sapiens
auuacuagaugaaggaaug

SEQ ID NO: 1005002 - RNA, 19 nt, Homo sapiens
cuaccaccaccacaauuaa

SEQ ID NO: 1005003 - RNA, 19 nt, Homo sapiens
ggacguggucguggguaaa

SEQ ID NO: 1005004 - RNA, 19 nt, Homo sapiens
uuaaauuccuggcacuucu

SEQ ID NO: 1005005 - RNA, 19 nt, Homo sapiens
acagacagccagagggaaa

SEQ ID NO: 1005006 - RNA, 19 nt, Homo sapiens
acuaccaccaccacaauua

SEQ ID NO: 1005007 - RNA, 19 nt, Homo sapiens
caccaugccuggccuucau

SEQ ID NO: 1005008 - RNA, 19 nt, Homo sapiens
cuccuaaccucaacugauc

SEQ ID NO: 1005009 - RNA, 19 nt, Homo sapiens
ccaccaugcccaaccuauu

SEQ ID NO: 1005010 - RNA, 19 nt, Homo sapiens
gacuuacagugauuuagca

SEQ ID NO: 1005011 - RNA, 19 nt, Homo sapiens
ggcaaaugcagucaaguca

SEQ ID NO: 1005012 - RNA, 19 nt, Homo sapiens
gugucuagucugugaauuu

SEQ ID NO: 1005013 - RNA, 19 nt, Homo sapiens
cagcucaggcaccaagaaa

SEQ ID NO: 1005014 - RNA, 19 nt, Homo sapiens
aggagaaugacaaugauaa

SEQ ID NO: 1005015 - RNA, 19 nt, Homo sapiens
gagcuuuauuucugcaaac

SEQ ID NO: 1005016 - RNA, 19 nt, Homo sapiens
ucucucaucuuacuguucu

SEQ ID NO: 1005017 - RNA, 19 nt, Homo sapiens
gaggcaaggccaauuuuaa

SEQ ID NO: 1005018 - RNA, 19 nt, Homo sapiens
ccaaagaagauuuuagcua

SEQ ID NO: 1005019 - RNA, 19 nt, Homo sapiens
caaaugagguagaaucuua

SEQ ID NO: 1005020 - RNA, 19 nt, Homo sapiens
gaaauggccuucaauuauu

SEQ ID NO: 1005021 - RNA, 19 nt, Homo sapiens
caagacggaucaauaauau

SEQ ID NO: 1005022 - RNA, 19 nt, Homo sapiens
guauaacccuuuccacuuu

SEQ ID NO: 1005023 - RNA, 19 nt, Homo sapiens
cucaagcccuuuauucuua

SEQ ID NO: 1005024 - RNA, 19 nt, Homo sapiens
ccacuuucaucgucuuaua

SEQ ID NO: 1005025 - RNA, 19 nt, Homo sapiens
acaaucagcugucauuuua

SEQ ID NO: 1005026 - RNA, 19 nt, Homo sapiens
agaaauggccuucaauuau

SEQ ID NO: 1005027 - RNA, 19 nt, Homo sapiens
aaauuggcguugaguguua

SEQ ID NO: 1005028 - RNA, 19 nt, Homo sapiens
gaaccaaggcgucucucua

SEQ ID NO: 1005029 - RNA, 19 nt, Homo sapiens
caucaaaucugggcccaaa

SEQ ID NO: 1005030 - RNA, 19 nt, Homo sapiens
ucaagacggaucaauaaua

SEQ ID NO: 1005031 - RNA, 19 nt, Homo sapiens
gauugcagcuuugaacauu

SEQ ID NO: 1005032 - RNA, 19 nt, Homo sapiens
caccauuucucucuuacua

SEQ ID NO: 1005033 - RNA, 19 nt, Homo sapiens
ugaaugugauugcagcuuu

SEQ ID NO: 1005034 - RNA, 19 nt, Homo sapiens
ccagagacuugaagaacuu

SEQ ID NO: 1005035 - RNA, 19 nt, Homo sapiens
aagaaauggccuucaauua

SEQ ID NO: 1005036 - RNA, 19 nt, Homo sapiens
augcuucucuuaccauuua

SEQ ID NO: 1005037 - RNA, 19 nt, Homo sapiens
ggaaauaacauugaagaag

SEQ ID NO: 1005038 - RNA, 19 nt, Homo sapiens
ugaaggagguauaauaaac

SEQ ID NO: 1005039 - RNA, 19 nt, Homo sapiens
gugaagaguuggccagaau

SEQ ID NO: 1005040 - RNA, 19 nt, Homo sapiens
caaauauguucaucaccaa

SEQ ID NO: 1005041 - RNA, 19 nt, Homo sapiens
gcccaaacagccucaguua

SEQ ID NO: 1005042 - RNA, 19 nt, Homo sapiens
uaccaugacugcauagcua

SEQ ID NO: 1005043 - RNA, 19 nt, Homo sapiens
gaaugugauugcagcuuug

SEQ ID NO: 1005044 - RNA, 19 nt, Homo sapiens
caguaugaguugccauuaa

SEQ ID NO: 1005045 - RNA, 19 nt, Homo sapiens
caaggcgucucucuaagug

SEQ ID NO: 1005046 - RNA, 19 nt, Homo sapiens
gaagaguuggccagaauga

SEQ ID NO: 1005047 - RNA, 19 nt, Homo sapiens
gaguuucuccuguugauuu

SEQ ID NO: 1005048 - RNA, 19 nt, Homo sapiens
guugaaggagguauaauaa

SEQ ID NO: 1005049 - RNA, 19 nt, Homo sapiens
agacaccucuggcuaccua

SEQ ID NO: 1005050 - RNA, 19 nt, Homo sapiens
auaauaccaugacugcaua

SEQ ID NO: 1005051 - RNA, 19 nt, Homo sapiens
ccaaaggaaauaacauuga

SEQ ID NO: 1005052 - RNA, 19 nt, Homo sapiens
uuaaacaagccacacguua

SEQ ID NO: 1005053 - RNA, 19 nt, Homo sapiens
gcaugaaccaaaggaaaua

SEQ ID NO: 1005054 - RNA, 19 nt, Homo sapiens
uagguaccguuucacauuu

SEQ ID NO: 1005055 - RNA, 19 nt, Homo sapiens
uaaccugucuuugaugaug

SEQ ID NO: 1005056 - RNA, 19 nt, Homo sapiens
cagcugaguuucuccuguu

SEQ ID NO: 1005057 - RNA, 19 nt, Homo sapiens
ccaacaaucagcugucauu

SEQ ID NO: 1005058 - RNA, 19 nt, Homo sapiens
guugggacauguuaaggaa

SEQ ID NO: 1005059 - RNA, 19 nt, Homo sapiens
uugaagaacuugcaaacug

SEQ ID NO: 1005060 - RNA, 19 nt, Homo sapiens
ccaaacagccucaguuaac

SEQ ID NO: 1005061 - RNA, 19 nt, Homo sapiens
gcuauugcaugcuccuaga

SEQ ID NO: 1005062 - RNA, 19 nt, Homo sapiens
aaucuuagccagugagaaa

SEQ ID NO: 1005063 - RNA, 19 nt, Homo sapiens
ccacgacauuuaacaucaa

SEQ ID NO: 1005064 - RNA, 19 nt, Homo sapiens
caaguggaaucacagucaa

SEQ ID NO: 1005065 - RNA, 19 nt, Homo sapiens
gaauaaguccuucuguuuu

SEQ ID NO: 1005066 - RNA, 19 nt, Homo sapiens
ucaagcccuuuauucuuaa

SEQ ID NO: 1005067 - RNA, 19 nt, Homo sapiens
cauaauguauaacccuuuc

SEQ ID NO: 1005068 - RNA, 19 nt, Homo sapiens
ccaacggcauggucaucua

SEQ ID NO: 1005069 - RNA, 19 nt, Homo sapiens
gaacaaaaccagcuugcuu

SEQ ID NO: 1005070 - RNA, 19 nt, Homo sapiens
aaacaagccacacguuaga

SEQ ID NO: 1005071 - RNA, 19 nt, Homo sapiens
ccagacaccagaagaaaug

SEQ ID NO: 1005072 - RNA, 19 nt, Homo sapiens
gacugcauagcuaauauua

SEQ ID NO: 1005073 - RNA, 19 nt, Homo sapiens
gauaccagcugagaagucu

SEQ ID NO: 1005074 - RNA, 19 nt, Homo sapiens
cagcaacgccuucauugug

SEQ ID NO: 1005075 - RNA, 19 nt, Homo sapiens
gaaguugggacauguuaag

SEQ ID NO: 1005076 - RNA, 19 nt, Homo sapiens
gacauuaggaccacuuguu

SEQ ID NO: 1005077 - RNA, 19 nt, Homo sapiens
caaaugggaaaguguucua

SEQ ID NO: 1005078 - RNA, 19 nt, Homo sapiens
ucucaaugcacaugauaua

SEQ ID NO: 1005079 - RNA, 19 nt, Homo sapiens
acagggugcucuccucuug

SEQ ID NO: 1005080 - RNA, 19 nt, Homo sapiens
cuacuuaccacaucaaauc

SEQ ID NO: 1005081 - RNA, 19 nt, Homo sapiens
agucaagacggaucaauaa

SEQ ID NO: 1005082 - RNA, 19 nt, Homo sapiens
ccaauuuauuugccuuaug

SEQ ID NO: 1005083 - RNA, 19 nt, Homo sapiens
gcacugaucccagcugagu

SEQ ID NO: 1005084 - RNA, 19 nt, Homo sapiens
aaaccagcuugcuuuguug

SEQ ID NO: 1005085 - RNA, 19 nt, Homo sapiens
gaaaagagacacagagaca

SEQ ID NO: 1005086 - RNA, 19 nt, Homo sapiens
ggaaguugggacauguuaa

SEQ ID NO: 1005087 - RNA, 19 nt, Homo sapiens
caaacagccucaguuaacu

SEQ ID NO: 1005088 - RNA, 19 nt, Homo sapiens
uaaacaagccacacguuag

SEQ ID NO: 1005089 - RNA, 19 nt, Homo sapiens
ucuauagcaugcacacuug

SEQ ID NO: 1005090 - RNA, 19 nt, Homo sapiens
guagaaucuuagccaguga

SEQ ID NO: 1005091 - RNA, 19 nt, Homo sapiens
uaagaccucaagcccuuua

SEQ ID NO: 1005092 - RNA, 19 nt, Homo sapiens
gaugaugcuucucuuacca

SEQ ID NO: 1005093 - RNA, 19 nt, Homo sapiens
gaaccaaaggaaauaacau

SEQ ID NO: 1005094 - RNA, 19 nt, Homo sapiens
ccaccacuccugcuucuga

SEQ ID NO: 1005095 - RNA, 19 nt, Homo sapiens
gaaggagguauaauaaacu

SEQ ID NO: 1005096 - RNA, 19 nt, Homo sapiens
caacaaucagcugucauuu

SEQ ID NO: 1005097 - RNA, 19 nt, Homo sapiens
cagucaagacggaucaaua

SEQ ID NO: 1005098 - RNA, 19 nt, Homo sapiens
cuaagaagaauaaguccuu

SEQ ID NO: 1005099 - RNA, 19 nt, Homo sapiens
gaccucaagcccuuuauuc

SEQ ID NO: 1005100 - RNA, 19 nt, Homo sapiens
aaccaaggcgucucucuaa

SEQ ID NO: 1005101 - RNA, 19 nt, Homo sapiens
gcaaaauugugugaaauca

SEQ ID NO: 1005102 - RNA, 19 nt, Homo sapiens
cuuccugucuugaccaauu

SEQ ID NO: 1005103 - RNA, 19 nt, Homo sapiens
aguaaccugucuuugauga

SEQ ID NO: 1005104 - RNA, 19 nt, Homo sapiens
cgagggaggugugaagagu

SEQ ID NO: 1005105 - RNA, 19 nt, Homo sapiens
aaaaccagcuugcuuuguu

SEQ ID NO: 1005106 - RNA, 19 nt, Homo sapiens
uguugaaggagguauaaua

SEQ ID NO: 1005107 - RNA, 19 nt, Homo sapiens
ugucuugaccaauuuauga

SEQ ID NO: 1005108 - RNA, 19 nt, Homo sapiens
uuagguaccguuucacauu

SEQ ID NO: 1005109 - RNA, 19 nt, Homo sapiens
guugaguguuauagugaaa

SEQ ID NO: 1005110 - RNA, 19 nt, Homo sapiens
ggcguugaguguuauagug

SEQ ID NO: 1005111 - RNA, 19 nt, Homo sapiens
gaaaauuggcguugagugu

SEQ ID NO: 1005112 - RNA, 19 nt, Homo sapiens
gugcaugaaccaaaggaaa

SEQ ID NO: 1005113 - RNA, 19 nt, Homo sapiens
ucucacaaguggaaucaca

SEQ ID NO: 1005114 - RNA, 19 nt, Homo sapiens
ccaccuaccaggcgcugua

SEQ ID NO: 1005115 - RNA, 19 nt, Homo sapiens
cggugucacuccuguauuc

SEQ ID NO: 1005116 - RNA, 19 nt, Homo sapiens
aguuucaucuguucacauu

SEQ ID NO: 1005117 - RNA, 19 nt, Homo sapiens
augcaccauuucucucuua

SEQ ID NO: 1005118 - RNA, 19 nt, Homo sapiens
aaucauaugucagcauucu

SEQ ID NO: 1005119 - RNA, 19 nt, Homo sapiens
ccaaggccgucaccaagua

SEQ ID NO: 1005120 - RNA, 19 nt, Homo sapiens
cgaagaaagccgugacuaa

SEQ ID NO: 1005121 - RNA, 19 nt, Homo sapiens
gaagaaagccgugacuaag

SEQ ID NO: 1005122 - RNA, 19 nt, Homo sapiens
ugacuaaggcgcagaagaa

SEQ ID NO: 1005123 - RNA, 19 nt, Homo sapiens
guacaccagcgcuaaguaa

SEQ ID NO: 1005124 - RNA, 19 nt, Homo sapiens
ccaagaagggcucgaagaa

SEQ ID NO: 1005125 - RNA, 19 nt, Homo sapiens
aagaagggcucgaagaaag

SEQ ID NO: 1005126 - RNA, 19 nt, Homo sapiens
aacaagcgcucgaccauca

SEQ ID NO: 1005127 - RNA, 19 nt, Homo sapiens
caagaagggcucgaagaaa

SEQ ID NO: 1005128 - RNA, 19 nt, Homo sapiens
gcaccaaggccgucaccaa

SEQ ID NO: 1005129 - RNA, 19 nt, Homo sapiens
acaccggcaucuccucuaa

SEQ ID NO: 1005130 - RNA, 19 nt, Homo sapiens
ccaaguacaccagcgcuaa

SEQ ID NO: 1005131 - RNA, 19 nt, Homo sapiens
gcuacuccguauacgugua

SEQ ID NO: 1005132 - RNA, 19 nt, Homo sapiens
cuaaggcgcagaagaagga

SEQ ID NO: 1005133 - RNA, 19 nt, Homo sapiens
cuucccgccugccgcauua

SEQ ID NO: 1005134 - RNA, 19 nt, Homo sapiens
ccguauacguguacaaggu

SEQ ID NO: 1005135 - RNA, 19 nt, Homo sapiens
cgucaacgacaucuucgaa

SEQ ID NO: 1005136 - RNA, 19 nt, Homo sapiens
ccucuaaggccaugggaau

SEQ ID NO: 1005137 - RNA, 19 nt, Homo sapiens
caugaacuccuucgucaac

SEQ ID NO: 1005138 - RNA, 19 nt, Homo sapiens
ggucagagcuccagaaguu

SEQ ID NO: 1005139 - RNA, 19 nt, Homo sapiens
cagaauaggugacuucauu

SEQ ID NO: 1005140 - RNA, 19 nt, Homo sapiens
ggacauguauaagccuuua

SEQ ID NO: 1005141 - RNA, 19 nt, Homo sapiens
acaaaguccugugaaauua

SEQ ID NO: 1005142 - RNA, 19 nt, Homo sapiens
ugacagaaaugcggaauga

SEQ ID NO: 1005143 - RNA, 19 nt, Homo sapiens
gaauguacaucuaccuaau

SEQ ID NO: 1005144 - RNA, 19 nt, Homo sapiens
gaugaugggcugugugaua

SEQ ID NO: 1005145 - RNA, 19 nt, Homo sapiens
cgacagaauugacagaaau

SEQ ID NO: 1005146 - RNA, 19 nt, Homo sapiens
gggauaagcuauuggaaag

SEQ ID NO: 1005147 - RNA, 19 nt, Homo sapiens
gaacugagaagauagaagu

SEQ ID NO: 1005148 - RNA, 19 nt, Homo sapiens
ggaaagaucucggaaaaug

SEQ ID NO: 1005149 - RNA, 19 nt, Homo sapiens
gucuuuaccuguucacuua

SEQ ID NO: 1005150 - RNA, 19 nt, Homo sapiens
gcaaguacaaaguagauuu

SEQ ID NO: 1005151 - RNA, 19 nt, Homo sapiens
gaagauagaaguuaagcau

SEQ ID NO: 1005152 - RNA, 19 nt, Homo sapiens
gagagggcauucaaagaug

SEQ ID NO: 1005153 - RNA, 19 nt, Homo sapiens
gauaagcuauuggaaagau

SEQ ID NO: 1005154 - RNA, 19 nt, Homo sapiens
caacaucgccagcuucuca

SEQ ID NO: 1005155 - RNA, 19 nt, Homo sapiens
gccaggcaguuaucauuaa

SEQ ID NO: 1005156 - RNA, 19 nt, Homo sapiens
ggaauguacaucuaccuaa

SEQ ID NO: 1005157 - RNA, 19 nt, Homo sapiens
guauuuguuuccaguauga

SEQ ID NO: 1005158 - RNA, 19 nt, Homo sapiens
gagaagugaauaaggcaua

SEQ ID NO: 1005159 - RNA, 19 nt, Homo sapiens
gauagaaguuaagcauguu

SEQ ID NO: 1005160 - RNA, 19 nt, Homo sapiens
gaagaucaaaguaaagcaa

SEQ ID NO: 1005161 - RNA, 19 nt, Homo sapiens
gaauaggugacuucauuga

SEQ ID NO: 1005162 - RNA, 19 nt, Homo sapiens
uuaacaaaguccugugaaa

SEQ ID NO: 1005163 - RNA, 19 nt, Homo sapiens
agagaaagccaggcaguua

SEQ ID NO: 1005164 - RNA, 19 nt, Homo sapiens
acagaggaauguacaucua

SEQ ID NO: 1005165 - RNA, 19 nt, Homo sapiens
cugagaagauagaaguuaa

SEQ ID NO: 1005166 - RNA, 19 nt, Homo sapiens
gaauauauggucaauuugg

SEQ ID NO: 1005167 - RNA, 19 nt, Homo sapiens
gcggaaugaucucuuuaau

SEQ ID NO: 1005168 - RNA, 19 nt, Homo sapiens
caaaguccugugaaauuaa

SEQ ID NO: 1005169 - RNA, 19 nt, Homo sapiens
cggaaugaucucuuuaaua

SEQ ID NO: 1005170 - RNA, 19 nt, Homo sapiens
uccagaaguuccuguaauu

SEQ ID NO: 1005171 - RNA, 19 nt, Homo sapiens
agauagaaguuaagcaugu

SEQ ID NO: 1005172 - RNA, 19 nt, Homo sapiens
aaugguaacugaagaucaa

SEQ ID NO: 1005173 - RNA, 19 nt, Homo sapiens
gagaaagccaggcaguuau

SEQ ID NO: 1005174 - RNA, 19 nt, Homo sapiens
ggagauuuauagcaacauc

SEQ ID NO: 1005175 - RNA, 19 nt, Homo sapiens
gguacugucuucgugauga

SEQ ID NO: 1005176 - RNA, 19 nt, Homo sapiens
acacagcaaguacaaagua

SEQ ID NO: 1005177 - RNA, 19 nt, Homo sapiens
caacacagcaaguacaaag

SEQ ID NO: 1005178 - RNA, 19 nt, Homo sapiens
aaaguggcauuggaaauau

SEQ ID NO: 1005179 - RNA, 19 nt, Homo sapiens
uaacaaaguccugugaaau

SEQ ID NO: 1005180 - RNA, 19 nt, Homo sapiens
ggacagccuugggacaugu

SEQ ID NO: 1005181 - RNA, 19 nt, Homo sapiens
guacaucuaccuaauaacu

SEQ ID NO: 1005182 - RNA, 19 nt, Homo sapiens
gauagagagggcauucaaa

SEQ ID NO: 1005183 - RNA, 19 nt, Homo sapiens
aacaaaguccugugaaauu

SEQ ID NO: 1005184 - RNA, 19 nt, Homo sapiens
ggaaaaugguaacugaaga

SEQ ID NO: 1005185 - RNA, 19 nt, Homo sapiens
guaaagcaacagaggaaug

SEQ ID NO: 1005186 - RNA, 19 nt, Homo sapiens
guacugucuucgugaugaa

SEQ ID NO: 1005187 - RNA, 19 nt, Homo sapiens
auaggugacuucauugaug

SEQ ID NO: 1005188 - RNA, 19 nt, Homo sapiens
guaacugaagaucaaagua

SEQ ID NO: 1005189 - RNA, 19 nt, Homo sapiens
gggugugucuuuaccuguu

SEQ ID NO: 1005190 - RNA, 19 nt, Homo sapiens
gaucuuccauuugaaacuc

SEQ ID NO: 1005191 - RNA, 19 nt, Homo sapiens
cagaaguuccuguaauuuc

SEQ ID NO: 1005192 - RNA, 19 nt, Homo sapiens
ccagaaguuccuguaauuu

SEQ ID NO: 1005193 - RNA, 19 nt, Homo sapiens
gagcacauuuuacaauaug

SEQ ID NO: 1005194 - RNA, 19 nt, Homo sapiens
ccaagucucauacgaagau

SEQ ID NO: 1005195 - RNA, 19 nt, Homo sapiens
ccgacagaauugacagaaa

SEQ ID NO: 1005196 - RNA, 19 nt, Homo sapiens
agagggcauucaaagauga

SEQ ID NO: 1005197 - RNA, 19 nt, Homo sapiens
ugucagcaguucacaaucu

SEQ ID NO: 1005198 - RNA, 19 nt, Homo sapiens
ugacuucauugaugugagu

SEQ ID NO: 1005199 - RNA, 19 nt, Homo sapiens
caaguacaaaguagauuuc

SEQ ID NO: 1005200 - RNA, 19 nt, Homo sapiens
caacagaggaauguacauc

SEQ ID NO: 1005201 - RNA, 19 nt, Homo sapiens
uaaagcaacagaggaaugu

SEQ ID NO: 1005202 - RNA, 19 nt, Homo sapiens
uaggugacuucauugaugu

SEQ ID NO: 1005203 - RNA, 19 nt, Homo sapiens
gaugcucaugcuuuaauuu

SEQ ID NO: 1005204 - RNA, 19 nt, Homo sapiens
ugccuucuguuaugacgua

SEQ ID NO: 1005205 - RNA, 19 nt, Homo sapiens
aaugcggaaugaucucuuu

SEQ ID NO: 1005206 - RNA, 19 nt, Homo sapiens
agagagggcauucaaagau

SEQ ID NO: 1005207 - RNA, 19 nt, Homo sapiens
uuucaaagauugugaucca

SEQ ID NO: 1005208 - RNA, 19 nt, Homo sapiens
gaaagccaggcaguuauca

SEQ ID NO: 1005209 - RNA, 19 nt, Homo sapiens
uacaauaugggauaagcua

SEQ ID NO: 1005210 - RNA, 19 nt, Homo sapiens
uagucaagcuacacagaau

SEQ ID NO: 1005211 - RNA, 19 nt, Homo sapiens
augaguggaugccaacaaa

SEQ ID NO: 1005212 - RNA, 19 nt, Homo sapiens
ucuggugccuucuguuaug

SEQ ID NO: 1005213 - RNA, 19 nt, Homo sapiens
ugagagaauagucaagcua

SEQ ID NO: 1005214 - RNA, 19 nt, Homo sapiens
acaguugugccaugcauuu

SEQ ID NO: 1005215 - RNA, 19 nt, Homo sapiens
cauuucaacucccuacagu

SEQ ID NO: 1005216 - RNA, 19 nt, Homo sapiens
aaaaguggcauuggaaaua

SEQ ID NO: 1005217 - RNA, 19 nt, Homo sapiens
agaagugaauaaggcauau

SEQ ID NO: 1005218 - RNA, 19 nt, Homo sapiens
acagaaaugcggaaugauc

SEQ ID NO: 1005219 - RNA, 19 nt, Homo sapiens
gaugaguggaugccaacaa

SEQ ID NO: 1005220 - RNA, 19 nt, Homo sapiens
gcuccagaaguuccuguaa

SEQ ID NO: 1005221 - RNA, 19 nt, Homo sapiens
gcauuuaagcgagugguau

SEQ ID NO: 1005222 - RNA, 19 nt, Homo sapiens
ugggauaagcuauuggaaa

SEQ ID NO: 1005223 - RNA, 19 nt, Homo sapiens
ccagccaagucucauacga

SEQ ID NO: 1005224 - RNA, 19 nt, Homo sapiens
uagagagggcauucaaaga

SEQ ID NO: 1005225 - RNA, 19 nt, Homo sapiens
gauccaggagaagugaaua

SEQ ID NO: 1005226 - RNA, 19 nt, Homo sapiens
gauuccagggugugucuuu

SEQ ID NO: 1005227 - RNA, 19 nt, Homo sapiens
cagccaagucucauacgaa

SEQ ID NO: 1005228 - RNA, 19 nt, Homo sapiens
uaugaagugucagcaguuc

SEQ ID NO: 1005229 - RNA, 19 nt, Homo sapiens
guaugaagugucagcaguu

SEQ ID NO: 1005230 - RNA, 19 nt, Homo sapiens
caaguauuuguuuccagua

SEQ ID NO: 1005231 - RNA, 19 nt, Homo sapiens
uuucuggugccuucuguua

SEQ ID NO: 1005232 - RNA, 19 nt, Homo sapiens
gacagaauugacagaaaug

SEQ ID NO: 1005233 - RNA, 19 nt, Homo sapiens
gucagcaguucacaaucuu

SEQ ID NO: 1005234 - RNA, 19 nt, Homo sapiens
acacagaauaggugacuuc

SEQ ID NO: 1005235 - RNA, 19 nt, Homo sapiens
guagauuucauagaagaga

SEQ ID NO: 1005236 - RNA, 19 nt, Homo sapiens
gaaaugcggaaugaucucu

SEQ ID NO: 1005237 - RNA, 19 nt, Homo sapiens
cagcaaguacaaaguagau

SEQ ID NO: 1005238 - RNA, 19 nt, Homo sapiens
ggucagagcuccagaaguu

SEQ ID NO: 1005239 - RNA, 19 nt, Homo sapiens
cagaauaggugacuucauu

SEQ ID NO: 1005240 - RNA, 19 nt, Homo sapiens
ggacauguauaagccuuua

SEQ ID NO: 1005241 - RNA, 19 nt, Homo sapiens
acaaaguccugugaaauua

SEQ ID NO: 1005242 - RNA, 19 nt, Homo sapiens
ugacagaaaugcggaauga

SEQ ID NO: 1005243 - RNA, 19 nt, Homo sapiens
gaauguacaucuaccuaau

SEQ ID NO: 1005244 - RNA, 19 nt, Homo sapiens
gaugaugggcugugugaua

SEQ ID NO: 1005245 - RNA, 19 nt, Homo sapiens
cgacagaauugacagaaau

SEQ ID NO: 1005246 - RNA, 19 nt, Homo sapiens
cagaguaacugaagaucaa

SEQ ID NO: 1005247 - RNA, 19 nt, Homo sapiens
gggauaagcuauuggaaag

SEQ ID NO: 1005248 - RNA, 19 nt, Homo sapiens
gaacugagaagauagaagu

SEQ ID NO: 1005249 - RNA, 19 nt, Homo sapiens
ggaaagaucucggaaaaug

SEQ ID NO: 1005250 - RNA, 19 nt, Homo sapiens
gucuuuaccuguucacuua

SEQ ID NO: 1005251 - RNA, 19 nt, Homo sapiens
gcaaguacaaaguagauuu

SEQ ID NO: 1005252 - RNA, 19 nt, Homo sapiens
gaagauagaaguuaagcau

SEQ ID NO: 1005253 - RNA, 19 nt, Homo sapiens
gagagggcauucaaagaug

SEQ ID NO: 1005254 - RNA, 19 nt, Homo sapiens
gauaagcuauuggaaagau

SEQ ID NO: 1005255 - RNA, 19 nt, Homo sapiens
caacaucgccagcuucuca

SEQ ID NO: 1005256 - RNA, 19 nt, Homo sapiens
gccaggcaguuaucauuaa

SEQ ID NO: 1005257 - RNA, 19 nt, Homo sapiens
ggaauguacaucuaccuaa

SEQ ID NO: 1005258 - RNA, 19 nt, Homo sapiens
guauuuguuuccaguauga

SEQ ID NO: 1005259 - RNA, 19 nt, Homo sapiens
gagaagugaauaaggcaua

SEQ ID NO: 1005260 - RNA, 19 nt, Homo sapiens
gauagaaguuaagcauguu

SEQ ID NO: 1005261 - RNA, 19 nt, Homo sapiens
gaagaucaaaguaaagcaa

SEQ ID NO: 1005262 - RNA, 19 nt, Homo sapiens
gaauaggugacuucauuga

SEQ ID NO: 1005263 - RNA, 19 nt, Homo sapiens
uuaacaaaguccugugaaa

SEQ ID NO: 1005264 - RNA, 19 nt, Homo sapiens
agagaaagccaggcaguua

SEQ ID NO: 1005265 - RNA, 19 nt, Homo sapiens
acagaggaauguacaucua

SEQ ID NO: 1005266 - RNA, 19 nt, Homo sapiens
cugagaagauagaaguuaa

SEQ ID NO: 1005267 - RNA, 19 nt, Homo sapiens
gaauauauggucaauuugg

SEQ ID NO: 1005268 - RNA, 19 nt, Homo sapiens
gcggaaugaucucuuuaau

SEQ ID NO: 1005269 - RNA, 19 nt, Homo sapiens
caaaguccugugaaauuaa

SEQ ID NO: 1005270 - RNA, 19 nt, Homo sapiens
cggaaugaucucuuuaaua

SEQ ID NO: 1005271 - RNA, 19 nt, Homo sapiens
cccauucuccuucuauuua

SEQ ID NO: 1005272 - RNA, 19 nt, Homo sapiens
uccagaaguuccuguaauu

SEQ ID NO: 1005273 - RNA, 19 nt, Homo sapiens
agauagaaguuaagcaugu

SEQ ID NO: 1005274 - RNA, 19 nt, Homo sapiens
gagaaagccaggcaguuau

SEQ ID NO: 1005275 - RNA, 19 nt, Homo sapiens
ggagauuuauagcaacauc

SEQ ID NO: 1005276 - RNA, 19 nt, Homo sapiens
gguacugucuucgugauga

SEQ ID NO: 1005277 - RNA, 19 nt, Homo sapiens
acacagcaaguacaaagua

SEQ ID NO: 1005278 - RNA, 19 nt, Homo sapiens
caacacagcaaguacaaag

SEQ ID NO: 1005279 - RNA, 19 nt, Homo sapiens
aaaguggcauuggaaauau

SEQ ID NO: 1005280 - RNA, 19 nt, Homo sapiens
uaacaaaguccugugaaau

SEQ ID NO: 1005281 - RNA, 19 nt, Homo sapiens
ggacagccuugggacaugu

SEQ ID NO: 1005282 - RNA, 19 nt, Homo sapiens
guacaucuaccuaauaacu

SEQ ID NO: 1005283 - RNA, 19 nt, Homo sapiens
gauagagagggcauucaaa

SEQ ID NO: 1005284 - RNA, 19 nt, Homo sapiens
aacaaaguccugugaaauu

SEQ ID NO: 1005285 - RNA, 19 nt, Homo sapiens
guaaagcaacagaggaaug

SEQ ID NO: 1005286 - RNA, 19 nt, Homo sapiens
guacugucuucgugaugaa

SEQ ID NO: 1005287 - RNA, 19 nt, Homo sapiens
cuaccucgccugagucgua

SEQ ID NO: 1005288 - RNA, 19 nt, Homo sapiens
auaggugacuucauugaug

SEQ ID NO: 1005289 - RNA, 19 nt, Homo sapiens
guaacugaagaucaaagua

SEQ ID NO: 1005290 - RNA, 19 nt, Homo sapiens
gggugugucuuuaccuguu

SEQ ID NO: 1005291 - RNA, 19 nt, Homo sapiens
gaucuuccauuugaaacuc

SEQ ID NO: 1005292 - RNA, 19 nt, Homo sapiens
cagaaguuccuguaauuuc

SEQ ID NO: 1005293 - RNA, 19 nt, Homo sapiens
ccagaaguuccuguaauuu

SEQ ID NO: 1005294 - RNA, 19 nt, Homo sapiens
gagcacauuuuacaauaug

SEQ ID NO: 1005295 - RNA, 19 nt, Homo sapiens
ccaagucucauacgaagau

SEQ ID NO: 1005296 - RNA, 19 nt, Homo sapiens
ccgacagaauugacagaaa

SEQ ID NO: 1005297 - RNA, 19 nt, Homo sapiens
uggaacagucucagaguaa

SEQ ID NO: 1005298 - RNA, 19 nt, Homo sapiens
agagggcauucaaagauga

SEQ ID NO: 1005299 - RNA, 19 nt, Homo sapiens
ugucagcaguucacaaucu

SEQ ID NO: 1005300 - RNA, 19 nt, Homo sapiens
ugacuucauugaugugagu

SEQ ID NO: 1005301 - RNA, 19 nt, Homo sapiens
caaguacaaaguagauuuc

SEQ ID NO: 1005302 - RNA, 19 nt, Homo sapiens
caacagaggaauguacauc

SEQ ID NO: 1005303 - RNA, 19 nt, Homo sapiens
uaaagcaacagaggaaugu

SEQ ID NO: 1005304 - RNA, 19 nt, Homo sapiens
uaggugacuucauugaugu

SEQ ID NO: 1005305 - RNA, 19 nt, Homo sapiens
gaugcucaugcuuuaauuu

SEQ ID NO: 1005306 - RNA, 19 nt, Homo sapiens
ugccuucuguuaugacgua

SEQ ID NO: 1005307 - RNA, 19 nt, Homo sapiens
aaugcggaaugaucucuuu

SEQ ID NO: 1005308 - RNA, 19 nt, Homo sapiens
ggaacagucucagaguaac

SEQ ID NO: 1005309 - RNA, 19 nt, Homo sapiens
agagagggcauucaaagau

SEQ ID NO: 1005310 - RNA, 19 nt, Homo sapiens
uuucaaagauugugaucca

SEQ ID NO: 1005311 - RNA, 19 nt, Homo sapiens
uacaauaugggauaagcua

SEQ ID NO: 1005312 - RNA, 19 nt, Homo sapiens
uagucaagcuacacagaau

SEQ ID NO: 1005313 - RNA, 19 nt, Homo sapiens
augaguggaugccaacaaa

SEQ ID NO: 1005314 - RNA, 19 nt, Homo sapiens
ucuggugccuucuguuaug

SEQ ID NO: 1005315 - RNA, 19 nt, Homo sapiens
gaaagccaggcaguuauca

SEQ ID NO: 1005316 - RNA, 19 nt, Homo sapiens
ugagagaauagucaagcua

SEQ ID NO: 1005317 - RNA, 19 nt, Homo sapiens
acaguugugccaugcauuu

SEQ ID NO: 1005318 - RNA, 19 nt, Homo sapiens
cauuucaacucccuacagu

SEQ ID NO: 1005319 - RNA, 19 nt, Homo sapiens
aaaaguggcauuggaaaua

SEQ ID NO: 1005320 - RNA, 19 nt, Homo sapiens
agaagugaauaaggcauau

SEQ ID NO: 1005321 - RNA, 19 nt, Homo sapiens
acagaaaugcggaaugauc

SEQ ID NO: 1005322 - RNA, 19 nt, Homo sapiens
gaugaguggaugccaacaa

SEQ ID NO: 1005323 - RNA, 19 nt, Homo sapiens
gcuccagaaguuccuguaa

SEQ ID NO: 1005324 - RNA, 19 nt, Homo sapiens
gcauuuaagcgagugguau

SEQ ID NO: 1005325 - RNA, 19 nt, Homo sapiens
gaaagaucucggaaaauga

SEQ ID NO: 1005326 - RNA, 19 nt, Homo sapiens
ugggauaagcuauuggaaa

SEQ ID NO: 1005327 - RNA, 19 nt, Homo sapiens
ccagccaagucucauacga

SEQ ID NO: 1005328 - RNA, 19 nt, Homo sapiens
uagagagggcauucaaaga

SEQ ID NO: 1005329 - RNA, 19 nt, Homo sapiens
gauccaggagaagugaaua

SEQ ID NO: 1005330 - RNA, 19 nt, Homo sapiens
auggaacagucucagagua

SEQ ID NO: 1005331 - RNA, 19 nt, Homo sapiens
acgcagucauucuucacua

SEQ ID NO: 1005332 - RNA, 19 nt, Homo sapiens
uuacuacgcagucauucuu

SEQ ID NO: 1005333 - RNA, 19 nt, Homo sapiens
gauuccagggugugucuuu

SEQ ID NO: 1005334 - RNA, 19 nt, Homo sapiens
cagccaagucucauacgaa

SEQ ID NO: 1005335 - RNA, 19 nt, Homo sapiens
uaugaagugucagcaguuc

SEQ ID NO: 1005336 - RNA, 19 nt, Homo sapiens
guaugaagugucagcaguu

SEQ ID NO: 1005337 - RNA, 19 nt, Homo sapiens
caaguauuuguuuccagua

SEQ ID NO: 1005338 - RNA, 19 nt, Homo sapiens
uaaacagacuuacuucgua

SEQ ID NO: 1005339 - RNA, 19 nt, Homo sapiens
gaagaaguuugaagaaagu

SEQ ID NO: 1005340 - RNA, 19 nt, Homo sapiens
gaacgaagaggagcaguuu

SEQ ID NO: 1005341 - RNA, 19 nt, Homo sapiens
guaagaagauaaacuggau

SEQ ID NO: 1005342 - RNA, 19 nt, Homo sapiens
gaagaggagcaguuuguaa

SEQ ID NO: 1005343 - RNA, 19 nt, Homo sapiens
gguggcaucucuaacugua

SEQ ID NO: 1005344 - RNA, 19 nt, Homo sapiens
caacugaccuaaacagacu

SEQ ID NO: 1005345 - RNA, 19 nt, Homo sapiens
ugaagaaguuugaagaaag

SEQ ID NO: 1005346 - RNA, 19 nt, Homo sapiens
ggcaguauuuaacaucuuu

SEQ ID NO: 1005347 - RNA, 19 nt, Homo sapiens
aaacagacuuacuucguau

SEQ ID NO: 1005348 - RNA, 19 nt, Homo sapiens
ucccagacaugcaaacuuu

SEQ ID NO: 1005349 - RNA, 19 nt, Homo sapiens
cagcagagaggaauaaguu

SEQ ID NO: 1005350 - RNA, 19 nt, Homo sapiens
gaagauaaacuggauugug

SEQ ID NO: 1005351 - RNA, 19 nt, Homo sapiens
agauucaggugccacuuua

SEQ ID NO: 1005352 - RNA, 19 nt, Homo sapiens
gaagucgcaccuacccaua

SEQ ID NO: 1005353 - RNA, 19 nt, Homo sapiens
agaaaguugugguccguuu

SEQ ID NO: 1005354 - RNA, 19 nt, Homo sapiens
gaccuaaacagacuuacuu

SEQ ID NO: 1005355 - RNA, 19 nt, Homo sapiens
auaaacaacugaccuaaac

SEQ ID NO: 1005356 - RNA, 19 nt, Homo sapiens
agacccagcauccacauua

SEQ ID NO: 1005357 - RNA, 19 nt, Homo sapiens
cguaugcccugcccuuuau

SEQ ID NO: 1005358 - RNA, 19 nt, Homo sapiens
gaacagacaaagaaacacu

SEQ ID NO: 1005359 - RNA, 19 nt, Homo sapiens
cauaaacaacugaccuaaa

SEQ ID NO: 1005360 - RNA, 19 nt, Homo sapiens
caaguagggcgaacaggaa

SEQ ID NO: 1005361 - RNA, 19 nt, Homo sapiens
accaaagucugaucucuug

SEQ ID NO: 1005362 - RNA, 19 nt, Homo sapiens
caaacauaaggcaguauuu

SEQ ID NO: 1005363 - RNA, 19 nt, Homo sapiens
gacuuucuauguuacaaga

SEQ ID NO: 1005364 - RNA, 19 nt, Homo sapiens
cuuuggacuuucuauguua

SEQ ID NO: 1005365 - RNA, 19 nt, Homo sapiens
aaauaaggaucuggauuca

SEQ ID NO: 1005366 - RNA, 19 nt, Homo sapiens
uaaguuaccaugucugcaa

SEQ ID NO: 1005367 - RNA, 19 nt, Homo sapiens
aauacagacuuuggacuuu

SEQ ID NO: 1005368 - RNA, 19 nt, Homo sapiens
gagggaaaauacagacuuu

SEQ ID NO: 1005369 - RNA, 19 nt, Homo sapiens
gggaacagacaaagaaaca

SEQ ID NO: 1005370 - RNA, 19 nt, Homo sapiens
ccaaacauaaggcaguauu

SEQ ID NO: 1005371 - RNA, 19 nt, Homo sapiens
aagaggagcaguuuguaaa

SEQ ID NO: 1005372 - RNA, 19 nt, Homo sapiens
uguccucgaucuaagcuuu

SEQ ID NO: 1005373 - RNA, 19 nt, Homo sapiens
gaaguuugaagaaaguugu

SEQ ID NO: 1005374 - RNA, 19 nt, Homo sapiens
gcagguggcaucucuaacu

SEQ ID NO: 1005375 - RNA, 19 nt, Homo sapiens
guuaccaugucugcaagua

SEQ ID NO: 1005376 - RNA, 19 nt, Homo sapiens
cauuugcaguguuuguaaa

SEQ ID NO: 1005377 - RNA, 19 nt, Homo sapiens
ucacaaccaggcacagaaa

SEQ ID NO: 1005378 - RNA, 19 nt, Homo sapiens
ggugccacuuuaugucgua

SEQ ID NO: 1005379 - RNA, 19 nt, Homo sapiens
guaccaaagucugaucucu

SEQ ID NO: 1005380 - RNA, 19 nt, Homo sapiens
gcaccuacccauaaacaac

SEQ ID NO: 1005381 - RNA, 19 nt, Homo sapiens
guucuaaguuaccaugucu

SEQ ID NO: 1005382 - RNA, 19 nt, Homo sapiens
cauaaggcaguauuuaaca

SEQ ID NO: 1005383 - RNA, 19 nt, Homo sapiens
uaacucaccaagugcaaga

SEQ ID NO: 1005384 - RNA, 19 nt, Homo sapiens
gcagagaggaauaaguuuu

SEQ ID NO: 1005385 - RNA, 19 nt, Homo sapiens
cgaagaggagcaguuugua

SEQ ID NO: 1005386 - RNA, 19 nt, Homo sapiens
gugcagguggcaucucuaa

SEQ ID NO: 1005387 - RNA, 19 nt, Homo sapiens
ugaguaagaagauaaacug

SEQ ID NO: 1005388 - RNA, 19 nt, Homo sapiens
gcacaccaaaucauuaagg

SEQ ID NO: 1005389 - RNA, 19 nt, Homo sapiens
aaauacagacuuuggacuu

SEQ ID NO: 1005390 - RNA, 19 nt, Homo sapiens
acaguuugacucccaagua

SEQ ID NO: 1005391 - RNA, 19 nt, Homo sapiens
agucgcaccuacccauaaa

SEQ ID NO: 1005392 - RNA, 19 nt, Homo sapiens
ccacauuuguuuugagcua

SEQ ID NO: 1005393 - RNA, 19 nt, Homo sapiens
gacuuuggacuuucuaugu

SEQ ID NO: 1005394 - RNA, 19 nt, Homo sapiens
aagcagaucauuauacucu

SEQ ID NO: 1005395 - RNA, 19 nt, Homo sapiens
uaaacugggaacagacaaa

SEQ ID NO: 1005396 - RNA, 19 nt, Homo sapiens
aaauuacucccacaguuug

SEQ ID NO: 1005397 - RNA, 19 nt, Homo sapiens
acaaagaaacacucuccuu

SEQ ID NO: 1005398 - RNA, 19 nt, Homo sapiens
guagggcgaacaggaauga

SEQ ID NO: 1005399 - RNA, 19 nt, Homo sapiens
uuacagcagagaggaauaa

SEQ ID NO: 1005400 - RNA, 19 nt, Homo sapiens
cuguuuaauuucaggcaua

SEQ ID NO: 1005401 - RNA, 19 nt, Homo sapiens
caguuugacucccaaguac

SEQ ID NO: 1005402 - RNA, 19 nt, Homo sapiens
aagaagauaaacuggauug

SEQ ID NO: 1005403 - RNA, 19 nt, Homo sapiens
ccauaaacaacugaccuaa

SEQ ID NO: 1005404 - RNA, 19 nt, Homo sapiens
uggcaucucuaacuguaca

SEQ ID NO: 1005405 - RNA, 19 nt, Homo sapiens
cagguggcaucucuaacug

SEQ ID NO: 1005406 - RNA, 19 nt, Homo sapiens
ucguaugcccugcccuuua

SEQ ID NO: 1005407 - RNA, 19 nt, Homo sapiens
gacccagcauccacauuac

SEQ ID NO: 1005408 - RNA, 19 nt, Homo sapiens
uuuguaaacugggaacaga

SEQ ID NO: 1005409 - RNA, 19 nt, Homo sapiens
acuuuggacuuucuauguu

SEQ ID NO: 1005410 - RNA, 19 nt, Homo sapiens
auacagacuuuggacuuuc

SEQ ID NO: 1005411 - RNA, 19 nt, Homo sapiens
cuaaacagacuuacuucgu

SEQ ID NO: 1005412 - RNA, 19 nt, Homo sapiens
aguguauuguggccucaua

SEQ ID NO: 1005413 - RNA, 19 nt, Homo sapiens
aaaauuacucccacaguuu

SEQ ID NO: 1005414 - RNA, 19 nt, Homo sapiens
caaagucugaucucuugca

SEQ ID NO: 1005415 - RNA, 19 nt, Homo sapiens
uauuguggccucauaguca

SEQ ID NO: 1005416 - RNA, 19 nt, Homo sapiens
cacuuuaugucguaacagu

SEQ ID NO: 1005417 - RNA, 19 nt, Homo sapiens
ggcauaagccagaagaaaa

SEQ ID NO: 1005418 - RNA, 19 nt, Homo sapiens
uaaggcaguauuuaacauc

SEQ ID NO: 1005419 - RNA, 19 nt, Homo sapiens
ugauuugaaugaugacaac

SEQ ID NO: 1005420 - RNA, 19 nt, Homo sapiens
gggcgaacaggaaugaagu

SEQ ID NO: 1005421 - RNA, 19 nt, Homo sapiens
guaccaaaauauucugcaa

SEQ ID NO: 1005422 - RNA, 19 nt, Homo sapiens
uugcacaccaaaucauuaa

SEQ ID NO: 1005423 - RNA, 19 nt, Homo sapiens
gccacuuuaugucguaaca

SEQ ID NO: 1005424 - RNA, 19 nt, Homo sapiens
aagauucaggugccacuuu

SEQ ID NO: 1005425 - RNA, 19 nt, Homo sapiens
acauuugcaguguuuguaa

SEQ ID NO: 1005426 - RNA, 19 nt, Homo sapiens
ugaacgaagaggagcaguu

SEQ ID NO: 1005427 - RNA, 19 nt, Homo sapiens
cuugcacaccaaaucauua

SEQ ID NO: 1005428 - RNA, 19 nt, Homo sapiens
aaaauaaggaucuggauuc

SEQ ID NO: 1005429 - RNA, 19 nt, Homo sapiens
aaacaacugaccuaaacag

SEQ ID NO: 1005430 - RNA, 19 nt, Homo sapiens
ccgccacguugccaucgaa

SEQ ID NO: 1005431 - RNA, 19 nt, Homo sapiens
ggaaaauacagacuuugga

SEQ ID NO: 1005432 - RNA, 19 nt, Homo sapiens
uaccaaagucugaucucuu

SEQ ID NO: 1005433 - RNA, 19 nt, Homo sapiens
aggcauaagccagaagaaa

SEQ ID NO: 1005434 - RNA, 19 nt, Homo sapiens
acugggaacagacaaagaa

SEQ ID NO: 1005435 - RNA, 19 nt, Homo sapiens
acgaagaggagcaguuugu

SEQ ID NO: 1005436 - RNA, 19 nt, Homo sapiens
gauugugcaguaugccaaa

SEQ ID NO: 1005437 - RNA, 19 nt, Homo sapiens
cagaugacaugucuaauua

SEQ ID NO: 1005438 - RNA, 19 nt, Homo sapiens
ggauaaaguucgucaguuu

SEQ ID NO: 1005439 - RNA, 19 nt, Homo sapiens
ggacugaacugaagaucaa

SEQ ID NO: 1005440 - RNA, 19 nt, Homo sapiens
gaaagaaccaggacgauuu

SEQ ID NO: 1005441 - RNA, 19 nt, Homo sapiens
ccacgaaauucaaucuuua

SEQ ID NO: 1005442 - RNA, 19 nt, Homo sapiens
gaaauagacuagaaagcuu

SEQ ID NO: 1005443 - RNA, 19 nt, Homo sapiens
ggucuaggguugauauuaa

SEQ ID NO: 1005444 - RNA, 19 nt, Homo sapiens
gaagaucaauccucacaau

SEQ ID NO: 1005445 - RNA, 19 nt, Homo sapiens
gaaaaugucugcauaaugu

SEQ ID NO: 1005446 - RNA, 19 nt, Homo sapiens
gcacaaugcugucuucauc

SEQ ID NO: 1005447 - RNA, 19 nt, Homo sapiens
gaacaagaauugaaagaac

SEQ ID NO: 1005448 - RNA, 19 nt, Homo sapiens
gaacagcuguacaauagau

SEQ ID NO: 1005449 - RNA, 19 nt, Homo sapiens
gaagauaguaggaguuaaa

SEQ ID NO: 1005450 - RNA, 19 nt, Homo sapiens
uagaacagcuguacaauag

SEQ ID NO: 1005451 - RNA, 19 nt, Homo sapiens
gaacacaaaugaaauucuc

SEQ ID NO: 1005452 - RNA, 19 nt, Homo sapiens
ugagagagauugacagaga

SEQ ID NO: 1005453 - RNA, 19 nt, Homo sapiens
ucauuucccuguucacuua

SEQ ID NO: 1005454 - RNA, 19 nt, Homo sapiens
ucacugugguugccaaaua

SEQ ID NO: 1005455 - RNA, 19 nt, Homo sapiens
ggauacaucuuggaccaua

SEQ ID NO: 1005456 - RNA, 19 nt, Homo sapiens
gaucaauccucacaauuca

SEQ ID NO: 1005457 - RNA, 19 nt, Homo sapiens
gcagaugacaugucuaauu

SEQ ID NO: 1005458 - RNA, 19 nt, Homo sapiens
gcauaucucuguaaguuca

SEQ ID NO: 1005459 - RNA, 19 nt, Homo sapiens
gaaaagagaagacugauuu

SEQ ID NO: 1005460 - RNA, 19 nt, Homo sapiens
cuacuggaauugguuauua

SEQ ID NO: 1005461 - RNA, 19 nt, Homo sapiens
gcaaaucacauauguuguu

SEQ ID NO: 1005462 - RNA, 19 nt, Homo sapiens
gaaaacaguuggcauaaga

SEQ ID NO: 1005463 - RNA, 19 nt, Homo sapiens
cauuguggauuucaucuua

SEQ ID NO: 1005464 - RNA, 19 nt, Homo sapiens
agagaagacugauuuaaug

SEQ ID NO: 1005465 - RNA, 19 nt, Homo sapiens
cagaauaaccgacaugaaa

SEQ ID NO: 1005466 - RNA, 19 nt, Homo sapiens
gaugacaugucuaauuaug

SEQ ID NO: 1005467 - RNA, 19 nt, Homo sapiens
gauuuaauguggugugauu

SEQ ID NO: 1005468 - RNA, 19 nt, Homo sapiens
guacugcucuuucagacaa

SEQ ID NO: 1005469 - RNA, 19 nt, Homo sapiens
gcgcuuaccuuacccaugu

SEQ ID NO: 1005470 - RNA, 19 nt, Homo sapiens
gaccauaucguauuucauu

SEQ ID NO: 1005471 - RNA, 19 nt, Homo sapiens
guacgaugauugcagauga

SEQ ID NO: 1005472 - RNA, 19 nt, Homo sapiens
acaguuggcauaagaauua

SEQ ID NO: 1005473 - RNA, 19 nt, Homo sapiens
gagcauggccuguucuuau

SEQ ID NO: 1005474 - RNA, 19 nt, Homo sapiens
cauaaacgaucaauaccaa

SEQ ID NO: 1005475 - RNA, 19 nt, Homo sapiens
gaaggagcauggccuguuc

SEQ ID NO: 1005476 - RNA, 19 nt, Homo sapiens
caagauggaacaagaauug

SEQ ID NO: 1005477 - RNA, 19 nt, Homo sapiens
gcauuaguguguugauuau

SEQ ID NO: 1005478 - RNA, 19 nt, Homo sapiens
acaaagacccucaagauga

SEQ ID NO: 1005479 - RNA, 19 nt, Homo sapiens
uagaagugcccacauauaa

SEQ ID NO: 1005480 - RNA, 19 nt, Homo sapiens
aagaggaacuucaauuaug

SEQ ID NO: 1005481 - RNA, 19 nt, Homo sapiens
gccacgaaauucaaucuuu

SEQ ID NO: 1005482 - RNA, 19 nt, Homo sapiens
gaacuuagugcuuaaugga

SEQ ID NO: 1005483 - RNA, 19 nt, Homo sapiens
acaaaggaauguacuuaga

SEQ ID NO: 1005484 - RNA, 19 nt, Homo sapiens
gaagcuuuauggugauuau

SEQ ID NO: 1005485 - RNA, 19 nt, Homo sapiens
ccaggacgauuuaaggauu

SEQ ID NO: 1005486 - RNA, 19 nt, Homo sapiens
gaauugcuuuaacuccuaa

SEQ ID NO: 1005487 - RNA, 19 nt, Homo sapiens
agaggaacuucaauuauga

SEQ ID NO: 1005488 - RNA, 19 nt, Homo sapiens
ggaccauccuaguuuauuc

SEQ ID NO: 1005489 - RNA, 19 nt, Homo sapiens
aggauuagaucuagaaaug

SEQ ID NO: 1005490 - RNA, 19 nt, Homo sapiens
guuauugguuucagauuga

SEQ ID NO: 1005491 - RNA, 19 nt, Homo sapiens
gguuugggcuugucuucua

SEQ ID NO: 1005492 - RNA, 19 nt, Homo sapiens
aauaaaagcugcagugaaa

SEQ ID NO: 1005493 - RNA, 19 nt, Homo sapiens
gcaaagaauccaggacaaa

SEQ ID NO: 1005494 - RNA, 19 nt, Homo sapiens
aauuagaagugcccacaua

SEQ ID NO: 1005495 - RNA, 19 nt, Homo sapiens
gagagagauugacagagaa

SEQ ID NO: 1005496 - RNA, 19 nt, Homo sapiens
gaguuaugguuauugguuu

SEQ ID NO: 1005497 - RNA, 19 nt, Homo sapiens
caaaucacauauguuguug

SEQ ID NO: 1005498 - RNA, 19 nt, Homo sapiens
cagugagagugauauauuu

SEQ ID NO: 1005499 - RNA, 19 nt, Homo sapiens
gcaguaaguugucuuucuc

SEQ ID NO: 1005500 - RNA, 19 nt, Homo sapiens
acaccaacaugaacaaguu

SEQ ID NO: 1005501 - RNA, 19 nt, Homo sapiens
cugcauaucucuguaaguu

SEQ ID NO: 1005502 - RNA, 19 nt, Homo sapiens
caaaggaauguacuuagaa

SEQ ID NO: 1005503 - RNA, 19 nt, Homo sapiens
ggaacaagaauugaaagaa

SEQ ID NO: 1005504 - RNA, 19 nt, Homo sapiens
ugaauugcuuuaacuccua

SEQ ID NO: 1005505 - RNA, 19 nt, Homo sapiens
gguuauugguuucagauug

SEQ ID NO: 1005506 - RNA, 19 nt, Homo sapiens
gaauguacuuagaauagca

SEQ ID NO: 1005507 - RNA, 19 nt, Homo sapiens
ggccuguucuuauugauga

SEQ ID NO: 1005508 - RNA, 19 nt, Homo sapiens
aaucaucgcagaaggauaa

SEQ ID NO: 1005509 - RNA, 19 nt, Homo sapiens
aaagaaccaggacgauuua

SEQ ID NO: 1005510 - RNA, 19 nt, Homo sapiens
gaaucuugcugcuuucagu

SEQ ID NO: 1005511 - RNA, 19 nt, Homo sapiens
ggcuagaaauguaauacuu

SEQ ID NO: 1005512 - RNA, 19 nt, Homo sapiens
uaauauagguacugcucuu

SEQ ID NO: 1005513 - RNA, 19 nt, Homo sapiens
ugaacaaguugaaaucauc

SEQ ID NO: 1005514 - RNA, 19 nt, Homo sapiens
ccagugagagugauauauu

SEQ ID NO: 1005515 - RNA, 19 nt, Homo sapiens
gauggaacaagaauugaaa

SEQ ID NO: 1005516 - RNA, 19 nt, Homo sapiens
caucuuggaccauaucgua

SEQ ID NO: 1005517 - RNA, 19 nt, Homo sapiens
caucauaaacgaucaauac

SEQ ID NO: 1005518 - RNA, 19 nt, Homo sapiens
uuaagguuguucacuauga

SEQ ID NO: 1005519 - RNA, 19 nt, Homo sapiens
caaaaugacuggaaguuag

SEQ ID NO: 1005520 - RNA, 19 nt, Homo sapiens
gcaaagauuuucaaacaag

SEQ ID NO: 1005521 - RNA, 19 nt, Homo sapiens
gcagaaggauaaaguucgu

SEQ ID NO: 1005522 - RNA, 19 nt, Homo sapiens
gacugaggguugagacaaa

SEQ ID NO: 1005523 - RNA, 19 nt, Homo sapiens
ggaacuuagugcuuaaugg

SEQ ID NO: 1005524 - RNA, 19 nt, Homo sapiens
gaaccaggacgauuuaagg

SEQ ID NO: 1005525 - RNA, 19 nt, Homo sapiens
gcauaauguuagauucuuc

SEQ ID NO: 1005526 - RNA, 19 nt, Homo sapiens
ugcaaagacuaugcuaaua

SEQ ID NO: 1005527 - RNA, 19 nt, Homo sapiens
gugcuuaauggaagauuua

SEQ ID NO: 1005528 - RNA, 19 nt, Homo sapiens
ugacagaauuaggauguga

SEQ ID NO: 1005529 - RNA, 19 nt, Homo sapiens
aaguuaagguuguucacua

SEQ ID NO: 1005530 - RNA, 19 nt, Homo sapiens
ggccuaaugccuuggauuu

SEQ ID NO: 1005531 - RNA, 19 nt, Homo sapiens
cagcauagaacaacuaaag

SEQ ID NO: 1005532 - RNA, 19 nt, Homo sapiens
ccagagagagugagagaga

SEQ ID NO: 1005533 - RNA, 19 nt, Homo sapiens
caggacgauuuaaggauuu

SEQ ID NO: 1005534 - RNA, 19 nt, Homo sapiens
gagaagacugauuuaaugu

SEQ ID NO: 1005535 - RNA, 19 nt, Homo sapiens
guguguauguguguauaua

SEQ ID NO: 1005536 - RNA, 19 nt, Homo sapiens
cuacauaauuggacuucau

SEQ ID NO: 1005537 - RNA, 19 nt, Homo sapiens
gagcuagaauucaaguuua

SEQ ID NO: 1005538 - RNA, 19 nt, Homo sapiens
gagauggccugcaaugaga

SEQ ID NO: 1005539 - RNA, 19 nt, Homo sapiens
gaagcaaguuuaucagauc

SEQ ID NO: 1005540 - RNA, 19 nt, Homo sapiens
acagggagcugcagaggua

SEQ ID NO: 1005541 - RNA, 19 nt, Homo sapiens
uggaagaauugguagauaa

SEQ ID NO: 1005542 - RNA, 19 nt, Homo sapiens
gaagcucuuuccugacauu

SEQ ID NO: 1005543 - RNA, 19 nt, Homo sapiens
ucacauaacuuuggacaag

SEQ ID NO: 1005544 - RNA, 19 nt, Homo sapiens
gaucuggagacacuaauaa

SEQ ID NO: 1005545 - RNA, 19 nt, Homo sapiens
caaaggcuauccuccugaa

SEQ ID NO: 1005546 - RNA, 19 nt, Homo sapiens
caacacccgugcuucauca

SEQ ID NO: 1005547 - RNA, 19 nt, Homo sapiens
gaagagugagcuagaauuc

SEQ ID NO: 1005548 - RNA, 19 nt, Homo sapiens
gaaggcaccauucuaacaa

SEQ ID NO: 1005549 - RNA, 19 nt, Homo sapiens
cagaagcucuuuccugaca

SEQ ID NO: 1005550 - RNA, 19 nt, Homo sapiens
ccauacaccucgaagcauu

SEQ ID NO: 1005551 - RNA, 19 nt, Homo sapiens
gaacgucacauaacuuugg

SEQ ID NO: 1005552 - RNA, 19 nt, Homo sapiens
agagugagcuagaauucaa

SEQ ID NO: 1005553 - RNA, 19 nt, Homo sapiens
gaaacaggcauagcgauau

SEQ ID NO: 1005554 - RNA, 19 nt, Homo sapiens
caucauggaagaauuggua

SEQ ID NO: 1005555 - RNA, 19 nt, Homo sapiens
ggaaggcaccauucuaaca

SEQ ID NO: 1005556 - RNA, 19 nt, Homo sapiens
ugaaacaggcauagcgaua

SEQ ID NO: 1005557 - RNA, 19 nt, Homo sapiens
uggaugagauggcaguuga

SEQ ID NO: 1005558 - RNA, 19 nt, Homo sapiens
ccagugggaugcagucaau

SEQ ID NO: 1005559 - RNA, 19 nt, Homo sapiens
ugagauggcaguugaauuc

SEQ ID NO: 1005560 - RNA, 19 nt, Homo sapiens
caaacgacaucuggaguuc

SEQ ID NO: 1005561 - RNA, 19 nt, Homo sapiens
ggaagaauugguagauaau

SEQ ID NO: 1005562 - RNA, 19 nt, Homo sapiens
ccagaagagugagcuagaa

SEQ ID NO: 1005563 - RNA, 19 nt, Homo sapiens
gguagauaaucauggcaaa

SEQ ID NO: 1005564 - RNA, 19 nt, Homo sapiens
ugaagcaaguuuaucagau

SEQ ID NO: 1005565 - RNA, 19 nt, Homo sapiens
cuggagacacuaauaauuu

SEQ ID NO: 1005566 - RNA, 19 nt, Homo sapiens
aaacaggcauagcgauauc

SEQ ID NO: 1005567 - RNA, 19 nt, Homo sapiens
ugagcuagaauucaaguuu

SEQ ID NO: 1005568 - RNA, 19 nt, Homo sapiens
gguguuggaacgucacaua

SEQ ID NO: 1005569 - RNA, 19 nt, Homo sapiens
agacaucuuuaaucuagug

SEQ ID NO: 1005570 - RNA, 19 nt, Homo sapiens
ccggaaggcaccauucuaa

SEQ ID NO: 1005571 - RNA, 19 nt, Homo sapiens
ccaugaagcaaguuuauca

SEQ ID NO: 1005572 - RNA, 19 nt, Homo sapiens
ggaucuggagacacuaaua

SEQ ID NO: 1005573 - RNA, 19 nt, Homo sapiens
gcuggagccuggagaacug

SEQ ID NO: 1005574 - RNA, 19 nt, Homo sapiens
caguugaauuccugcauga

SEQ ID NO: 1005575 - RNA, 19 nt, Homo sapiens
cacccgugcuucaucauug

SEQ ID NO: 1005576 - RNA, 19 nt, Homo sapiens
ccugugagauggccugcaa

SEQ ID NO: 1005577 - RNA, 19 nt, Homo sapiens
guucagccaugaccaguac

SEQ ID NO: 1005578 - RNA, 19 nt, Homo sapiens
gggcaacacccgugcuuca

SEQ ID NO: 1005579 - RNA, 19 nt, Homo sapiens
agaagguccuggucacugu

SEQ ID NO: 1005580 - RNA, 19 nt, Homo sapiens
gaagaauugguagauaauc

SEQ ID NO: 1005581 - RNA, 19 nt, Homo sapiens
guuggaacgucacauaacu

SEQ ID NO: 1005582 - RNA, 19 nt, Homo sapiens
gaauugguagauaaucaug

SEQ ID NO: 1005583 - RNA, 19 nt, Homo sapiens
aaaguuggaucuggagaca

SEQ ID NO: 1005584 - RNA, 19 nt, Homo sapiens
gcaacacccgugcuucauc

SEQ ID NO: 1005585 - RNA, 19 nt, Homo sapiens
uggaacgucacauaacuuu

SEQ ID NO: 1005586 - RNA, 19 nt, Homo sapiens
gagguacgccgaggagguu

SEQ ID NO: 1005587 - RNA, 19 nt, Homo sapiens
ugagauggccugcaaugag

SEQ ID NO: 1005588 - RNA, 19 nt, Homo sapiens
cacauaacuuuggacaaga

SEQ ID NO: 1005589 - RNA, 19 nt, Homo sapiens
gaauaucagaagcucuuuc

SEQ ID NO: 1005590 - RNA, 19 nt, Homo sapiens
ggucacuguugaagaggau

SEQ ID NO: 1005591 - RNA, 19 nt, Homo sapiens
gaugagauggcaguugaau

SEQ ID NO: 1005592 - RNA, 19 nt, Homo sapiens
ccgaggagguugggaucuu

SEQ ID NO: 1005593 - RNA, 19 nt, Homo sapiens
ccuggucacuguugaagag

SEQ ID NO: 1005594 - RNA, 19 nt, Homo sapiens
cggaauaucagaagcucuu

SEQ ID NO: 1005595 - RNA, 19 nt, Homo sapiens
cgaggagguugggaucuuc

SEQ ID NO: 1005596 - RNA, 19 nt, Homo sapiens
ggccauacaccucgaagca

SEQ ID NO: 1005597 - RNA, 19 nt, Homo sapiens
ugacauucccauaggguau

SEQ ID NO: 1005598 - RNA, 19 nt, Homo sapiens
ggaauaucagaagcucuuu

SEQ ID NO: 1005599 - RNA, 19 nt, Homo sapiens
agaagagugagcuagaauu

SEQ ID NO: 1005600 - RNA, 19 nt, Homo sapiens
ucuggagacacuaauaauu

SEQ ID NO: 1005601 - RNA, 19 nt, Homo sapiens
acaaacgacaucuggaguu

SEQ ID NO: 1005602 - RNA, 19 nt, Homo sapiens
auggaagaauugguagaua

SEQ ID NO: 1005603 - RNA, 19 nt, Homo sapiens
cagaagagugagcuagaau

SEQ ID NO: 1005604 - RNA, 19 nt, Homo sapiens
gagguugggaucuucuuca

SEQ ID NO: 1005605 - RNA, 19 nt, Homo sapiens
gaagguccuggucacuguu

SEQ ID NO: 1005606 - RNA, 19 nt, Homo sapiens
caccaugaagcaaguuuau

SEQ ID NO: 1005607 - RNA, 19 nt, Homo sapiens
acaccaugaagcaaguuua

SEQ ID NO: 1005608 - RNA, 19 nt, Homo sapiens
ccucuggcauggaugagau

SEQ ID NO: 1005609 - RNA, 19 nt, Homo sapiens
agacugguagugaggcuuu

SEQ ID NO: 1005610 - RNA, 19 nt, Homo sapiens
ggaacgucacauaacuuug

SEQ ID NO: 1005611 - RNA, 19 nt, Homo sapiens
guguuggaacgucacauaa

SEQ ID NO: 1005612 - RNA, 19 nt, Homo sapiens
gacauucccauaggguauu

SEQ ID NO: 1005613 - RNA, 19 nt, Homo sapiens
aaauaaagugccauucucu

SEQ ID NO: 1005614 - RNA, 19 nt, Homo sapiens
ugugguggccaaagugaaa

SEQ ID NO: 1005615 - RNA, 19 nt, Homo sapiens
ggucaucucggaauaucag

SEQ ID NO: 1005616 - RNA, 19 nt, Homo sapiens
augagaagcugggcaaguc

SEQ ID NO: 1005617 - RNA, 19 nt, Homo sapiens
ggagguugggaucuucuuc

SEQ ID NO: 1005618 - RNA, 19 nt, Homo sapiens
caacaccucucacaucuua

SEQ ID NO: 1005619 - RNA, 19 nt, Homo sapiens
ggacaauucuggacuaaug

SEQ ID NO: 1005620 - RNA, 19 nt, Homo sapiens
guuaagcccuugaaauaua

SEQ ID NO: 1005621 - RNA, 19 nt, Homo sapiens
aaacagaaaugucucauga

SEQ ID NO: 1005622 - RNA, 19 nt, Homo sapiens
agaaaugucucaugacuuu

SEQ ID NO: 1005623 - RNA, 19 nt, Homo sapiens
caagguaagucauaaagaa

SEQ ID NO: 1005624 - RNA, 19 nt, Homo sapiens
uaacggagauauacacaaa

SEQ ID NO: 1005625 - RNA, 19 nt, Homo sapiens
gccacugccuuauuuauua

SEQ ID NO: 1005626 - RNA, 19 nt, Homo sapiens
ggaaauugcuucacugucu

SEQ ID NO: 1005627 - RNA, 19 nt, Homo sapiens
ggaagaaagggcagacuua

SEQ ID NO: 1005628 - RNA, 19 nt, Homo sapiens
gcugagaacuguaucuuug

SEQ ID NO: 1005629 - RNA, 19 nt, Homo sapiens
gcuaguggcuacuguauug

SEQ ID NO: 1005630 - RNA, 19 nt, Homo sapiens
gauuagacuucguuaguaa

SEQ ID NO: 1005631 - RNA, 19 nt, Homo sapiens
gggcagacuuaauagcuua

SEQ ID NO: 1005632 - RNA, 19 nt, Homo sapiens
agaaagggcagacuuaaua

SEQ ID NO: 1005633 - RNA, 19 nt, Homo sapiens
uaaauaagguugcaauguc

SEQ ID NO: 1005634 - RNA, 19 nt, Homo sapiens
gagaaaggcaagaagauuu

SEQ ID NO: 1005635 - RNA, 19 nt, Homo sapiens
gaaacccugucucuacaaa

SEQ ID NO: 1005636 - RNA, 19 nt, Homo sapiens
caccacgccuggccaauua

SEQ ID NO: 1005637 - RNA, 19 nt, Homo sapiens
ucccaaaguucuaggauua

SEQ ID NO: 1005638 - RNA, 19 nt, Homo sapiens
gcacaagacugggccaaau

SEQ ID NO: 1005639 - RNA, 19 nt, Homo sapiens
gagugaaacugucuccaaa

SEQ ID NO: 1005640 - RNA, 19 nt, Homo sapiens
ggauauauaccuucagaaa

SEQ ID NO: 1005641 - RNA, 19 nt, Homo sapiens
guaaguggcuagguuggua

SEQ ID NO: 1005642 - RNA, 19 nt, Homo sapiens
ugacucagccucucaagua

SEQ ID NO: 1005643 - RNA, 19 nt, Homo sapiens
gaucacaagacuaaagaua

SEQ ID NO: 1005644 - RNA, 19 nt, Homo sapiens
gaagaaagggcagacuuaa

SEQ ID NO: 1005645 - RNA, 19 nt, Homo sapiens
ugagauaauuucacucuug

SEQ ID NO: 1005646 - RNA, 19 nt, Homo sapiens
agaaagaccugaagugaag

SEQ ID NO: 1005647 - RNA, 19 nt, Homo sapiens
guacaguggugcaaucuca

SEQ ID NO: 1005648 - RNA, 19 nt, Homo sapiens
guaaucagcccaguaguaa

SEQ ID NO: 1005649 - RNA, 19 nt, Homo sapiens
guggaaagcuugcuguaau

SEQ ID NO: 1005650 - RNA, 19 nt, Homo sapiens
aaacagccauucagaaaca

SEQ ID NO: 1005651 - RNA, 19 nt, Homo sapiens
gaugccaccuacaugcuua

SEQ ID NO: 1005652 - RNA, 19 nt, Homo sapiens
gagcacaagguaagucaua

SEQ ID NO: 1005653 - RNA, 19 nt, Homo sapiens
gaaauugcuucacugucuu

SEQ ID NO: 1005654 - RNA, 19 nt, Homo sapiens
guaaaugguaucacuguuu

SEQ ID NO: 1005655 - RNA, 19 nt, Homo sapiens
gagauaauuucacucuugu

SEQ ID NO: 1005656 - RNA, 19 nt, Homo sapiens
caccacgccuggcuaauuu

SEQ ID NO: 1005657 - RNA, 19 nt, Homo sapiens
gaaguaaucagcccaguag

SEQ ID NO: 1005658 - RNA, 19 nt, Homo sapiens
gugaauccauggucucaaa

SEQ ID NO: 1005659 - RNA, 19 nt, Homo sapiens
ggcaaggguugaagauaaa

SEQ ID NO: 1005660 - RNA, 19 nt, Homo sapiens
ucaaguagcugggauuaca

SEQ ID NO: 1005661 - RNA, 19 nt, Homo sapiens
ggugcuagauuguuuacuu

SEQ ID NO: 1005662 - RNA, 19 nt, Homo sapiens
aaccacagaucaugacuuu

SEQ ID NO: 1005663 - RNA, 19 nt, Homo sapiens
gaagauaaauaagguugca

SEQ ID NO: 1005664 - RNA, 19 nt, Homo sapiens
aggcaaggguugaagauaa

SEQ ID NO: 1005665 - RNA, 19 nt, Homo sapiens
cauguucauuugccucuua

SEQ ID NO: 1005666 - RNA, 19 nt, Homo sapiens
augaaugacugacagaaua

SEQ ID NO: 1005667 - RNA, 19 nt, Homo sapiens
guacaucccuggaacaaaa

SEQ ID NO: 1005668 - RNA, 19 nt, Homo sapiens
gagaaagaccugaagugaa

SEQ ID NO: 1005669 - RNA, 19 nt, Homo sapiens
guagaacuguguauuugau

SEQ ID NO: 1005670 - RNA, 19 nt, Homo sapiens
gcaagauucaccuguguuu

SEQ ID NO: 1005671 - RNA, 19 nt, Homo sapiens
ugaaauauagcuaguguga

SEQ ID NO: 1005672 - RNA, 19 nt, Homo sapiens
ggacuuggugacuguauaa

SEQ ID NO: 1005673 - RNA, 19 nt, Homo sapiens
guugggcaguccugauuua

SEQ ID NO: 1005674 - RNA, 19 nt, Homo sapiens
gauaauuucacucuuguug

SEQ ID NO: 1005675 - RNA, 19 nt, Homo sapiens
guugcaaugucuauaguuu

SEQ ID NO: 1005676 - RNA, 19 nt, Homo sapiens
caacuagaauaacacuuca

SEQ ID NO: 1005677 - RNA, 19 nt, Homo sapiens
uguguaccauccuuuaaua

SEQ ID NO: 1005678 - RNA, 19 nt, Homo sapiens
gcgaaacccugucucuaca

SEQ ID NO: 1005679 - RNA, 19 nt, Homo sapiens
auugagaacugcagcauuu

SEQ ID NO: 1005680 - RNA, 19 nt, Homo sapiens
ugauuagacuucguuagua

SEQ ID NO: 1005681 - RNA, 19 nt, Homo sapiens
guaccauccuuuaauagau

SEQ ID NO: 1005682 - RNA, 19 nt, Homo sapiens
gcacaagguaagucauaaa

SEQ ID NO: 1005683 - RNA, 19 nt, Homo sapiens
uuaaacagccauucagaaa

SEQ ID NO: 1005684 - RNA, 19 nt, Homo sapiens
aagacuggcuugugguuaa

SEQ ID NO: 1005685 - RNA, 19 nt, Homo sapiens
uggagaaucccaagaagua

SEQ ID NO: 1005686 - RNA, 19 nt, Homo sapiens
ugauagggacgauuagaua

SEQ ID NO: 1005687 - RNA, 19 nt, Homo sapiens
gaguaguccuuggagauuu

SEQ ID NO: 1005688 - RNA, 19 nt, Homo sapiens
aaacaaaacuguagaacug

SEQ ID NO: 1005689 - RNA, 19 nt, Homo sapiens
ccaauucaguaaaugguau

SEQ ID NO: 1005690 - RNA, 19 nt, Homo sapiens
aaauauagcuagugugacu

SEQ ID NO: 1005691 - RNA, 19 nt, Homo sapiens
gcaggagcccuaaauguca

SEQ ID NO: 1005692 - RNA, 19 nt, Homo sapiens
caugacugaugcacaaauu

SEQ ID NO: 1005693 - RNA, 19 nt, Homo sapiens
gcuugugguuaaaugaaua

SEQ ID NO: 1005694 - RNA, 19 nt, Homo sapiens
gcauuaagaagaaggaaga

SEQ ID NO: 1005695 - RNA, 19 nt, Homo sapiens
ggagugcaauggcgugauc

SEQ ID NO: 1005696 - RNA, 19 nt, Homo sapiens
aagcacuucuggugguuua

SEQ ID NO: 1005697 - RNA, 19 nt, Homo sapiens
uaacugccauguucuaggu

SEQ ID NO: 1005698 - RNA, 19 nt, Homo sapiens
uucuaugccuccuauauua

SEQ ID NO: 1005699 - RNA, 19 nt, Homo sapiens
aggauacacugauggagua

SEQ ID NO: 1005700 - RNA, 19 nt, Homo sapiens
cuguuaagcccuugaaaua

SEQ ID NO: 1005701 - RNA, 19 nt, Homo sapiens
ccaaagugcugggauuaca

SEQ ID NO: 1005702 - RNA, 19 nt, Homo sapiens
gggagaggauacacugaug

SEQ ID NO: 1005703 - RNA, 19 nt, Homo sapiens
ugagaagacugagaagaug

SEQ ID NO: 1005704 - RNA, 19 nt, Homo sapiens
ccauacacauuuagaguag

SEQ ID NO: 1005705 - RNA, 19 nt, Homo sapiens
ggauuaaaguaacggagau

SEQ ID NO: 1005706 - RNA, 19 nt, Homo sapiens
ucuauaaggucacaugcuu

SEQ ID NO: 1005707 - RNA, 19 nt, Homo sapiens
acaagggccagauguauuu

SEQ ID NO: 1005708 - RNA, 19 nt, Homo sapiens
uggaaagcuugcuguaauu

SEQ ID NO: 1005709 - RNA, 19 nt, Homo sapiens
ggccugaaagcaauuuaua

SEQ ID NO: 1005710 - RNA, 19 nt, Homo sapiens
ucauggugcuagauuguuu

SEQ ID NO: 1005711 - RNA, 19 nt, Homo sapiens
gaaagggcagacuuaauag

SEQ ID NO: 1005712 - RNA, 19 nt, Homo sapiens
aggaaugccuguggucaua

SEQ ID NO: 1005713 - RNA, 19 nt, Homo sapiens
ugagaaagaccugaaguga

SEQ ID NO: 1005714 - RNA, 19 nt, Homo sapiens
cuucacuaauugacucuua

SEQ ID NO: 1005715 - RNA, 19 nt, Homo sapiens
gugcuagauuguuuacuug

SEQ ID NO: 1005716 - RNA, 19 nt, Homo sapiens
acggagauauacacaaauu

SEQ ID NO: 1005717 - RNA, 19 nt, Homo sapiens
gggcaguccugauuuaaaa

SEQ ID NO: 1005718 - RNA, 19 nt, Homo sapiens
gaccauagcugcagguuaa

SEQ ID NO: 1005719 - RNA, 19 nt, Homo sapiens
caccauaccuggacaaaua

SEQ ID NO: 1005720 - RNA, 19 nt, Homo sapiens
gaaagcuacugguugauuu

SEQ ID NO: 1005721 - RNA, 19 nt, Homo sapiens
gagaaacccugacuuuguu

SEQ ID NO: 1005722 - RNA, 19 nt, Homo sapiens
gcaaagcacugcaaagaca

SEQ ID NO: 1005723 - RNA, 19 nt, Homo sapiens
gcuaugugauugagaguua

SEQ ID NO: 1005724 - RNA, 19 nt, Homo sapiens
agacaggccucccaaagua

SEQ ID NO: 1005725 - RNA, 19 nt, Homo sapiens
cagcagagguuacauagga

SEQ ID NO: 1005726 - RNA, 19 nt, Homo sapiens
ugaagaggaucaaguugua

SEQ ID NO: 1005727 - RNA, 19 nt, Homo sapiens
uaacagagguacauuacug

SEQ ID NO: 1005728 - RNA, 19 nt, Homo sapiens
ggagaaaugaguccugaua

SEQ ID NO: 1005729 - RNA, 19 nt, Homo sapiens
uuacugcaauguucucuua

SEQ ID NO: 1005730 - RNA, 19 nt, Homo sapiens
aagagaaggugcucacuaa

SEQ ID NO: 1005731 - RNA, 19 nt, Homo sapiens
ccaaaagccuuccgucuua

SEQ ID NO: 1005732 - RNA, 19 nt, Homo sapiens
uaacuccgaugaagacaaa

SEQ ID NO: 1005733 - RNA, 19 nt, Homo sapiens
gaaccuuugucaccgagua

SEQ ID NO: 1005734 - RNA, 19 nt, Homo sapiens
gaagaagguuaguucaaca

SEQ ID NO: 1005735 - RNA, 19 nt, Homo sapiens
ggagaucagagucccauua

SEQ ID NO: 1005736 - RNA, 19 nt, Homo sapiens
gcacugauuucugcauuau

SEQ ID NO: 1005737 - RNA, 19 nt, Homo sapiens
gaagagaaggugcucacua

SEQ ID NO: 1005738 - RNA, 19 nt, Homo sapiens
gagguggaauuccuaacua

SEQ ID NO: 1005739 - RNA, 19 nt, Homo sapiens
ugaaguagcucaucguagu

SEQ ID NO: 1005740 - RNA, 19 nt, Homo sapiens
gagcaaaugguucucaauu

SEQ ID NO: 1005741 - RNA, 19 nt, Homo sapiens
cagcagaucucagcuaugu

SEQ ID NO: 1005742 - RNA, 19 nt, Homo sapiens
ggaagaagguuaguucaac

SEQ ID NO: 1005743 - RNA, 19 nt, Homo sapiens
gggaccagcuggcuccuuu

SEQ ID NO: 1005744 - RNA, 19 nt, Homo sapiens
gcagugagacacauaguug

SEQ ID NO: 1005745 - RNA, 19 nt, Homo sapiens
aaugaaagcuacugguuga

SEQ ID NO: 1005746 - RNA, 19 nt, Homo sapiens
caaaguaccgccaagagaa

SEQ ID NO: 1005747 - RNA, 19 nt, Homo sapiens
gagaucagagucccauuaa

SEQ ID NO: 1005748 - RNA, 19 nt, Homo sapiens
gcugcagguuaaccaauua

SEQ ID NO: 1005749 - RNA, 19 nt, Homo sapiens
acucuacacuuucugauuu

SEQ ID NO: 1005750 - RNA, 19 nt, Homo sapiens
gcaaauggaagaagauaca

SEQ ID NO: 1005751 - RNA, 19 nt, Homo sapiens
agaaaugaguccugauaga

SEQ ID NO: 1005752 - RNA, 19 nt, Homo sapiens
ggaaugaaagcuacugguu

SEQ ID NO: 1005753 - RNA, 19 nt, Homo sapiens
gcugagaaacccugacuuu

SEQ ID NO: 1005754 - RNA, 19 nt, Homo sapiens
cgaaggaucugccaguaag

SEQ ID NO: 1005755 - RNA, 19 nt, Homo sapiens
acacagagcuucuccuaac

SEQ ID NO: 1005756 - RNA, 19 nt, Homo sapiens
ggcaggguauccauucuuu

SEQ ID NO: 1005757 - RNA, 19 nt, Homo sapiens
ccuaugugguuucuccuua

SEQ ID NO: 1005758 - RNA, 19 nt, Homo sapiens
guugugagaugcuguuaug

SEQ ID NO: 1005759 - RNA, 19 nt, Homo sapiens
gaagagauaagcacagaag

SEQ ID NO: 1005760 - RNA, 19 nt, Homo sapiens
gaauaaggcacaaugucaa

SEQ ID NO: 1005761 - RNA, 19 nt, Homo sapiens
ugauugaagugcagagaaa

SEQ ID NO: 1005762 - RNA, 19 nt, Homo sapiens
ggaagcagaagaaacaaau

SEQ ID NO: 1005763 - RNA, 19 nt, Homo sapiens
gagauaagcacagaagaga

SEQ ID NO: 1005764 - RNA, 19 nt, Homo sapiens
gaagacaggccucccaaag

SEQ ID NO: 1005765 - RNA, 19 nt, Homo sapiens
ccagcuggcuccuuuaaca

SEQ ID NO: 1005766 - RNA, 19 nt, Homo sapiens
gauugagaguuauuguuug

SEQ ID NO: 1005767 - RNA, 19 nt, Homo sapiens
gaaaaugggaagaagguua

SEQ ID NO: 1005768 - RNA, 19 nt, Homo sapiens
gagcaccuauagugaugaa

SEQ ID NO: 1005769 - RNA, 19 nt, Homo sapiens
aaagccagauuauagaaga

SEQ ID NO: 1005770 - RNA, 19 nt, Homo sapiens
gagcaaauggaagaagaua

SEQ ID NO: 1005771 - RNA, 19 nt, Homo sapiens
gcagaucucagcuaugugu

SEQ ID NO: 1005772 - RNA, 19 nt, Homo sapiens
ggacaaaucaacuaugcau

SEQ ID NO: 1005773 - RNA, 19 nt, Homo sapiens
gauaauagaacuagugacu

SEQ ID NO: 1005774 - RNA, 19 nt, Homo sapiens
gaagauuucuggcuuuuag

SEQ ID NO: 1005775 - RNA, 19 nt, Homo sapiens
ugagaaacccugacuuugu

SEQ ID NO: 1005776 - RNA, 19 nt, Homo sapiens
aagguuaguucaacacauu

SEQ ID NO: 1005777 - RNA, 19 nt, Homo sapiens
uuggagaugucccagaaua

SEQ ID NO: 1005778 - RNA, 19 nt, Homo sapiens
gaucagagucccauuaaaa

SEQ ID NO: 1005779 - RNA, 19 nt, Homo sapiens
gguauaaccauagaccaua

SEQ ID NO: 1005780 - RNA, 19 nt, Homo sapiens
cagcaaagcacugcaaaga

SEQ ID NO: 1005781 - RNA, 19 nt, Homo sapiens
cauuauguguacaguauug

SEQ ID NO: 1005782 - RNA, 19 nt, Homo sapiens
gagaaggugcucacuaaca

SEQ ID NO: 1005783 - RNA, 19 nt, Homo sapiens
aaacacuucugacccauag

SEQ ID NO: 1005784 - RNA, 19 nt, Homo sapiens
gaagcaauuagcuauguga

SEQ ID NO: 1005785 - RNA, 19 nt, Homo sapiens
gaagguuaguucaacacau

SEQ ID NO: 1005786 - RNA, 19 nt, Homo sapiens
gcaccuauagugaugaaga

SEQ ID NO: 1005787 - RNA, 19 nt, Homo sapiens
caagccagccauaaggaua

SEQ ID NO: 1005788 - RNA, 19 nt, Homo sapiens
caccgaagauuaagaaggu

SEQ ID NO: 1005789 - RNA, 19 nt, Homo sapiens
ggaauaugaggaagaccua

SEQ ID NO: 1005790 - RNA, 19 nt, Homo sapiens
ggacaaaggauuuuauuca

SEQ ID NO: 1005791 - RNA, 19 nt, Homo sapiens
guaaagccagauuauagaa

SEQ ID NO: 1005792 - RNA, 19 nt, Homo sapiens
ccaguaaagccagauuaua

SEQ ID NO: 1005793 - RNA, 19 nt, Homo sapiens
caaaucugcuccgaugaau

SEQ ID NO: 1005794 - RNA, 19 nt, Homo sapiens
cauaguugguguuccgauu

SEQ ID NO: 1005795 - RNA, 19 nt, Homo sapiens
ccaaguaugucagcagcaa

SEQ ID NO: 1005796 - RNA, 19 nt, Homo sapiens
caguaaagccagauuauag

SEQ ID NO: 1005797 - RNA, 19 nt, Homo sapiens
gaccaguaaagccagauua

SEQ ID NO: 1005798 - RNA, 19 nt, Homo sapiens
gaugaauggccacugcuuu

SEQ ID NO: 1005799 - RNA, 19 nt, Homo sapiens
gauaagcacagaagagaag

SEQ ID NO: 1005800 - RNA, 19 nt, Homo sapiens
agacucagauggaaaagua

SEQ ID NO: 1005801 - RNA, 19 nt, Homo sapiens
ccaaaucugcuccgaugaa

SEQ ID NO: 1005802 - RNA, 19 nt, Homo sapiens
guuuggagaugucccagaa

SEQ ID NO: 1005803 - RNA, 19 nt, Homo sapiens
gcagguuaaccaauuaguu

SEQ ID NO: 1005804 - RNA, 19 nt, Homo sapiens
gcgaaggaucugccaguaa

SEQ ID NO: 1005805 - RNA, 19 nt, Homo sapiens
auaaggauauccaacuguu

SEQ ID NO: 1005806 - RNA, 19 nt, Homo sapiens
ucagacccaccgaagauua

SEQ ID NO: 1005807 - RNA, 19 nt, Homo sapiens
caaguuguaugugguuuua

SEQ ID NO: 1005808 - RNA, 19 nt, Homo sapiens
ugcauuauguguacaguau

SEQ ID NO: 1005809 - RNA, 19 nt, Homo sapiens
ccauggguguaccugcuua

SEQ ID NO: 1005810 - RNA, 19 nt, Homo sapiens
gcaggguauccauucuuua

SEQ ID NO: 1005811 - RNA, 19 nt, Homo sapiens
guauaaccauagaccauag

SEQ ID NO: 1005812 - RNA, 19 nt, Homo sapiens
gagguuacauaggagcaaa

SEQ ID NO: 1005813 - RNA, 19 nt, Homo sapiens
ugacugcgguauaucuuca

SEQ ID NO: 1005814 - RNA, 19 nt, Homo sapiens
gguuucauguugcgucuug

SEQ ID NO: 1005815 - RNA, 19 nt, Homo sapiens
gaaaugaguccugauagac

SEQ ID NO: 1005816 - RNA, 19 nt, Homo sapiens
ucccuuagauugcaaaaua

SEQ ID NO: 1005817 - RNA, 19 nt, Homo sapiens
guucagcagagguuacaua

SEQ ID NO: 1005818 - RNA, 19 nt, Homo sapiens
gagaacaacucauuacuug

SEQ ID NO: 1005819 - RNA, 19 nt, Homo sapiens
gaacaacucauuacuugaa

SEQ ID NO: 1005820 - RNA, 19 nt, Homo sapiens
gaacaagaacuucauuuca

SEQ ID NO: 1005821 - RNA, 19 nt, Homo sapiens
gaaacgcuggcaucaauua

SEQ ID NO: 1005822 - RNA, 19 nt, Homo sapiens
gaauuccacucuuugguuu

SEQ ID NO: 1005823 - RNA, 19 nt, Homo sapiens
gggaaacgcuggcaucaau

SEQ ID NO: 1005824 - RNA, 19 nt, Homo sapiens
gagaagcgcucugucuuug

SEQ ID NO: 1005825 - RNA, 19 nt, Homo sapiens
gagagcagccagaagaaua

SEQ ID NO: 1005826 - RNA, 19 nt, Homo sapiens
gagagcaccuggaauuugu

SEQ ID NO: 1005827 - RNA, 19 nt, Homo sapiens
uacaagaccuuccggaauu

SEQ ID NO: 1005828 - RNA, 19 nt, Homo sapiens
gacagaaacuaaaugugaa

SEQ ID NO: 1005829 - RNA, 19 nt, Homo sapiens
uaacccgccugaagcaaua

SEQ ID NO: 1005830 - RNA, 19 nt, Homo sapiens
gaaagaaacaggugugucu

SEQ ID NO: 1005831 - RNA, 19 nt, Homo sapiens
gaucagagcacacguacga

SEQ ID NO: 1005832 - RNA, 19 nt, Homo sapiens
ggugggagcugguuaugug

SEQ ID NO: 1005833 - RNA, 19 nt, Homo sapiens
gaagacagaaacuaaaugu

SEQ ID NO: 1005834 - RNA, 19 nt, Homo sapiens
gaucccugcugucaucuuu

SEQ ID NO: 1005835 - RNA, 19 nt, Homo sapiens
agacagaaacuaaauguga

SEQ ID NO: 1005836 - RNA, 19 nt, Homo sapiens
caucauaccuagucuuucu

SEQ ID NO: 1005837 - RNA, 19 nt, Homo sapiens
gaaacuucguugccagaga

SEQ ID NO: 1005838 - RNA, 19 nt, Homo sapiens
ggagaacaacucauuacuu

SEQ ID NO: 1005839 - RNA, 19 nt, Homo sapiens
ucaauuaucgggaguggua

SEQ ID NO: 1005840 - RNA, 19 nt, Homo sapiens
gaaggacauuggucuugga

SEQ ID NO: 1005841 - RNA, 19 nt, Homo sapiens
gcagcuguccucaguauga

SEQ ID NO: 1005842 - RNA, 19 nt, Homo sapiens
ggaauuccacucuuugguu

SEQ ID NO: 1005843 - RNA, 19 nt, Homo sapiens
ccacacggcauucauuaaa

SEQ ID NO: 1005844 - RNA, 19 nt, Homo sapiens
gggagcugguuauguguaa

SEQ ID NO: 1005845 - RNA, 19 nt, Homo sapiens
acaagaacuucauuucaga

SEQ ID NO: 1005846 - RNA, 19 nt, Homo sapiens
uggagaaggucuuucgaaa

SEQ ID NO: 1005847 - RNA, 19 nt, Homo sapiens
gagaacaagaacuucauuu

SEQ ID NO: 1005848 - RNA, 19 nt, Homo sapiens
acaagaccuuccggaauua

SEQ ID NO: 1005849 - RNA, 19 nt, Homo sapiens
gaacugucauuacgaccau

SEQ ID NO: 1005850 - RNA, 19 nt, Homo sapiens
gacggugguugccaucuuu

SEQ ID NO: 1005851 - RNA, 19 nt, Homo sapiens
gaacuucauuucagauagc

SEQ ID NO: 1005852 - RNA, 19 nt, Homo sapiens
uacacagacuucuuucuuu

SEQ ID NO: 1005853 - RNA, 19 nt, Homo sapiens
gcagaucagagcacacgua

SEQ ID NO: 1005854 - RNA, 19 nt, Homo sapiens
gggagucaguccaauagga

SEQ ID NO: 1005855 - RNA, 19 nt, Homo sapiens
acacagacuucuuucuuuc

SEQ ID NO: 1005856 - RNA, 19 nt, Homo sapiens
guucuggccguacauguua

SEQ ID NO: 1005857 - RNA, 19 nt, Homo sapiens
gacgaucccugcugucauc

SEQ ID NO: 1005858 - RNA, 19 nt, Homo sapiens
agaccagccuccugaaaga

SEQ ID NO: 1005859 - RNA, 19 nt, Homo sapiens
caaccauccuguucaucuu

SEQ ID NO: 1005860 - RNA, 19 nt, Homo sapiens
caacuuggaaccaucuuug

SEQ ID NO: 1005861 - RNA, 19 nt, Homo sapiens
cgagaagcgcucugucuuu

SEQ ID NO: 1005862 - RNA, 19 nt, Homo sapiens
gcugucaucuuuaaguaca

SEQ ID NO: 1005863 - RNA, 19 nt, Homo sapiens
gcaauagccauggaaguug

SEQ ID NO: 1005864 - RNA, 19 nt, Homo sapiens
gcaauugcuuuucucauga

SEQ ID NO: 1005865 - RNA, 19 nt, Homo sapiens
ggccacacggcauucauua

SEQ ID NO: 1005866 - RNA, 19 nt, Homo sapiens
aagaagaggugggugaaau

SEQ ID NO: 1005867 - RNA, 19 nt, Homo sapiens
ggagucaguccaauaggaa

SEQ ID NO: 1005868 - RNA, 19 nt, Homo sapiens
aaacuucguugccagagau

SEQ ID NO: 1005869 - RNA, 19 nt, Homo sapiens
gacaugugccuuaaacaga

SEQ ID NO: 1005870 - RNA, 19 nt, Homo sapiens
cggagcagcugaacaagca

SEQ ID NO: 1005871 - RNA, 19 nt, Homo sapiens
cuuauuggcuggaauugga

SEQ ID NO: 1005872 - RNA, 19 nt, Homo sapiens
acucuuugguuucuuauug

SEQ ID NO: 1005873 - RNA, 19 nt, Homo sapiens
ccugagagcaccuggaauu

SEQ ID NO: 1005874 - RNA, 19 nt, Homo sapiens
gaagcgcucugucuuugcu

SEQ ID NO: 1005875 - RNA, 19 nt, Homo sapiens
gaagaggugggugaaauca

SEQ ID NO: 1005876 - RNA, 19 nt, Homo sapiens
ggaaaagcauugcaagagu

SEQ ID NO: 1005877 - RNA, 19 nt, Homo sapiens
uaguggagucguaguaaua

SEQ ID NO: 1005878 - RNA, 19 nt, Homo sapiens
gggcagcuauuccuuagac

SEQ ID NO: 1005879 - RNA, 19 nt, Homo sapiens
ugagacaugugccuuaaac

SEQ ID NO: 1005880 - RNA, 19 nt, Homo sapiens
ccaacaaccugcgccugaa

SEQ ID NO: 1005881 - RNA, 19 nt, Homo sapiens
cuacacagacuucuuucuu

SEQ ID NO: 1005882 - RNA, 19 nt, Homo sapiens
aaucagagaacaagaacuu

SEQ ID NO: 1005883 - RNA, 19 nt, Homo sapiens
caacaucaucaacaaguuc

SEQ ID NO: 1005884 - RNA, 19 nt, Homo sapiens
ggaguccauuuacuuugug

SEQ ID NO: 1005885 - RNA, 19 nt, Homo sapiens
gauccagcaugcucuugau

SEQ ID NO: 1005886 - RNA, 19 nt, Homo sapiens
gaaagcuugcucugccaaa

SEQ ID NO: 1005887 - RNA, 19 nt, Homo sapiens
gaggacaacaucaucaaca

SEQ ID NO: 1005888 - RNA, 19 nt, Homo sapiens
ggaaacgcuggcaucaauu

SEQ ID NO: 1005889 - RNA, 19 nt, Homo sapiens
gaccugagagcaccuggaa

SEQ ID NO: 1005890 - RNA, 19 nt, Homo sapiens
gacaacaucaucaacaagu

SEQ ID NO: 1005891 - RNA, 19 nt, Homo sapiens
cugcugucaucuuuaagua

SEQ ID NO: 1005892 - RNA, 19 nt, Homo sapiens
caagugagucagaccaaga

SEQ ID NO: 1005893 - RNA, 19 nt, Homo sapiens
gcacagagggagacagaac

SEQ ID NO: 1005894 - RNA, 19 nt, Homo sapiens
ggaaccaucuuugggaaaa

SEQ ID NO: 1005895 - RNA, 19 nt, Homo sapiens
uauaugccaucuuuggaau

SEQ ID NO: 1005896 - RNA, 19 nt, Homo sapiens
uuucuaugcuccaaaugaa

SEQ ID NO: 1005897 - RNA, 19 nt, Homo sapiens
aacaagaacuucauuucag

SEQ ID NO: 1005898 - RNA, 19 nt, Homo sapiens
cauaaacaacugaaagcuu

SEQ ID NO: 1005899 - RNA, 19 nt, Homo sapiens
ucccugcugucaucuuuaa

SEQ ID NO: 1005900 - RNA, 19 nt, Homo sapiens
agaauaccaucgccuugga

SEQ ID NO: 1005901 - RNA, 19 nt, Homo sapiens
gcaccuggaauuuguugga

SEQ ID NO: 1005902 - RNA, 19 nt, Homo sapiens
acacggcauucauuaaagu

SEQ ID NO: 1005903 - RNA, 19 nt, Homo sapiens
acaacaucaucaacaaguu

SEQ ID NO: 1005904 - RNA, 19 nt, Homo sapiens
ggccggagcagcugaacaa

SEQ ID NO: 1005905 - RNA, 19 nt, Homo sapiens
guuggagaacggaaugaua

SEQ ID NO: 1005906 - RNA, 19 nt, Homo sapiens
cuacaagaccuuccggaau

SEQ ID NO: 1005907 - RNA, 19 nt, Homo sapiens
gagauuggcuacggguucu

SEQ ID NO: 1005908 - RNA, 19 nt, Homo sapiens
gcgccacgauguuuuguuu

SEQ ID NO: 1005909 - RNA, 19 nt, Homo sapiens
auauuucacugugccauaa

SEQ ID NO: 1005910 - RNA, 19 nt, Homo sapiens
gcccgaggacguucagaaa

SEQ ID NO: 1005911 - RNA, 19 nt, Homo sapiens
ggacaacaucaucaacaag

SEQ ID NO: 1005912 - RNA, 19 nt, Homo sapiens
agaggugggugaaaucaag

SEQ ID NO: 1005913 - RNA, 19 nt, Homo sapiens
ucaguaugaucggagauug

SEQ ID NO: 1005914 - RNA, 19 nt, Homo sapiens
gcauuguguuugugacgau

SEQ ID NO: 1005915 - RNA, 19 nt, Homo sapiens
cauuggagcagcccuuuga

SEQ ID NO: 1005916 - RNA, 19 nt, Homo sapiens
ucagagcacacguacgaaa

SEQ ID NO: 1005917 - RNA, 19 nt, Homo sapiens
ugagagcaccuggaauuug

SEQ ID NO: 1005918 - RNA, 19 nt, Homo sapiens
gagaacaacucauuacuug

SEQ ID NO: 1005919 - RNA, 19 nt, Homo sapiens
gaacugggauccuaaagug

SEQ ID NO: 1005920 - RNA, 19 nt, Homo sapiens
gaacaacucauuacuugaa

SEQ ID NO: 1005921 - RNA, 19 nt, Homo sapiens
gaacaagaacuucauuuca

SEQ ID NO: 1005922 - RNA, 19 nt, Homo sapiens
gaaacgcuggcaucaauua

SEQ ID NO: 1005923 - RNA, 19 nt, Homo sapiens
gaauuccacucuuugguuu

SEQ ID NO: 1005924 - RNA, 19 nt, Homo sapiens
gcaaugaaauuuccaaucg

SEQ ID NO: 1005925 - RNA, 19 nt, Homo sapiens
gggaaacgcuggcaucaau

SEQ ID NO: 1005926 - RNA, 19 nt, Homo sapiens
gagaagcgcucugucuuug

SEQ ID NO: 1005927 - RNA, 19 nt, Homo sapiens
caacgaagcaaugaaauuu

SEQ ID NO: 1005928 - RNA, 19 nt, Homo sapiens
gagagcagccagaagaaua

SEQ ID NO: 1005929 - RNA, 19 nt, Homo sapiens
gagagcaccuggaauuugu

SEQ ID NO: 1005930 - RNA, 19 nt, Homo sapiens
uacaagaccuuccggaauu

SEQ ID NO: 1005931 - RNA, 19 nt, Homo sapiens
gacagaaacuaaaugugaa

SEQ ID NO: 1005932 - RNA, 19 nt, Homo sapiens
gaaagaaacaggugugucu

SEQ ID NO: 1005933 - RNA, 19 nt, Homo sapiens
gaucagagcacacguacga

SEQ ID NO: 1005934 - RNA, 19 nt, Homo sapiens
ggugggagcugguuaugug

SEQ ID NO: 1005935 - RNA, 19 nt, Homo sapiens
gaagacagaaacuaaaugu

SEQ ID NO: 1005936 - RNA, 19 nt, Homo sapiens
gaucccugcugucaucuuu

SEQ ID NO: 1005937 - RNA, 19 nt, Homo sapiens
gcaacgaagcaaugaaauu

SEQ ID NO: 1005938 - RNA, 19 nt, Homo sapiens
agacagaaacuaaauguga

SEQ ID NO: 1005939 - RNA, 19 nt, Homo sapiens
caucauaccuagucuuucu

SEQ ID NO: 1005940 - RNA, 19 nt, Homo sapiens
guguaaagcuugaggacuu

SEQ ID NO: 1005941 - RNA, 19 nt, Homo sapiens
ggagaacaacucauuacuu

SEQ ID NO: 1005942 - RNA, 19 nt, Homo sapiens
ucaauuaucgggaguggua

SEQ ID NO: 1005943 - RNA, 19 nt, Homo sapiens
gaaggacauuggucuugga

SEQ ID NO: 1005944 - RNA, 19 nt, Homo sapiens
gcagcuguccucaguauga

SEQ ID NO: 1005945 - RNA, 19 nt, Homo sapiens
ggaauuccacucuuugguu

SEQ ID NO: 1005946 - RNA, 19 nt, Homo sapiens
gggagcugguuauguguaa

SEQ ID NO: 1005947 - RNA, 19 nt, Homo sapiens
acaagaacuucauuucaga

SEQ ID NO: 1005948 - RNA, 19 nt, Homo sapiens
uggagaaggucuuucgaaa

SEQ ID NO: 1005949 - RNA, 19 nt, Homo sapiens
gagaacaagaacuucauuu

SEQ ID NO: 1005950 - RNA, 19 nt, Homo sapiens
acaagaccuuccggaauua

SEQ ID NO: 1005951 - RNA, 19 nt, Homo sapiens
gaacugucauuacgaccau

SEQ ID NO: 1005952 - RNA, 19 nt, Homo sapiens
gacggugguugccaucuuu

SEQ ID NO: 1005953 - RNA, 19 nt, Homo sapiens
gaacuucauuucagauagc

SEQ ID NO: 1005954 - RNA, 19 nt, Homo sapiens
gcagaucagagcacacgua

SEQ ID NO: 1005955 - RNA, 19 nt, Homo sapiens
gggagucaguccaauagga

SEQ ID NO: 1005956 - RNA, 19 nt, Homo sapiens
guucuggccguacauguua

SEQ ID NO: 1005957 - RNA, 19 nt, Homo sapiens
gacgaucccugcugucauc

SEQ ID NO: 1005958 - RNA, 19 nt, Homo sapiens
gggcaacgaagcaaugaaa

SEQ ID NO: 1005959 - RNA, 19 nt, Homo sapiens
agaccagccuccugaaaga

SEQ ID NO: 1005960 - RNA, 19 nt, Homo sapiens
caaccauccuguucaucuu

SEQ ID NO: 1005961 - RNA, 19 nt, Homo sapiens
caacuuggaaccaucuuug

SEQ ID NO: 1005962 - RNA, 19 nt, Homo sapiens
cgagaagcgcucugucuuu

SEQ ID NO: 1005963 - RNA, 19 nt, Homo sapiens
gcugucaucuuuaaguaca

SEQ ID NO: 1005964 - RNA, 19 nt, Homo sapiens
gcaauugcuuuucucauga

SEQ ID NO: 1005965 - RNA, 19 nt, Homo sapiens
caggugaacugggauccua

SEQ ID NO: 1005966 - RNA, 19 nt, Homo sapiens
aagaagaggugggugaaau

SEQ ID NO: 1005967 - RNA, 19 nt, Homo sapiens
ggagucaguccaauaggaa

SEQ ID NO: 1005968 - RNA, 19 nt, Homo sapiens
gacaugugccuuaaacaga

SEQ ID NO: 1005969 - RNA, 19 nt, Homo sapiens
gcuaaaccgaggcguguaa

SEQ ID NO: 1005970 - RNA, 19 nt, Homo sapiens
cggagcagcugaacaagca

SEQ ID NO: 1005971 - RNA, 19 nt, Homo sapiens
cuuauuggcuggaauugga

SEQ ID NO: 1005972 - RNA, 19 nt, Homo sapiens
acucuuugguuucuuauug

SEQ ID NO: 1005973 - RNA, 19 nt, Homo sapiens
ccugagagcaccuggaauu

SEQ ID NO: 1005974 - RNA, 19 nt, Homo sapiens
gaagcgcucugucuuugcu

SEQ ID NO: 1005975 - RNA, 19 nt, Homo sapiens
gaagaggugggugaaauca

SEQ ID NO: 1005976 - RNA, 19 nt, Homo sapiens
caaucgagacgccaagaaa

SEQ ID NO: 1005977 - RNA, 19 nt, Homo sapiens
caaugaaauuuccaaucga

SEQ ID NO: 1005978 - RNA, 19 nt, Homo sapiens
ggaaaagcauugcaagagu

SEQ ID NO: 1005979 - RNA, 19 nt, Homo sapiens
uaguggagucguaguaaua

SEQ ID NO: 1005980 - RNA, 19 nt, Homo sapiens
gggcagcuauuccuuagac

SEQ ID NO: 1005981 - RNA, 19 nt, Homo sapiens
ugagacaugugccuuaaac

SEQ ID NO: 1005982 - RNA, 19 nt, Homo sapiens
ccaacaaccugcgccugaa

SEQ ID NO: 1005983 - RNA, 19 nt, Homo sapiens
aaucagagaacaagaacuu

SEQ ID NO: 1005984 - RNA, 19 nt, Homo sapiens
caacaucaucaacaaguuc

SEQ ID NO: 1005985 - RNA, 19 nt, Homo sapiens
ggaguccauuuacuuugug

SEQ ID NO: 1005986 - RNA, 19 nt, Homo sapiens
gauccagcaugcucuugau

SEQ ID NO: 1005987 - RNA, 19 nt, Homo sapiens
gcuugaggacuuuauuauu

SEQ ID NO: 1005988 - RNA, 19 nt, Homo sapiens
gaaagcuugcucugccaaa

SEQ ID NO: 1005989 - RNA, 19 nt, Homo sapiens
gaggacaacaucaucaaca

SEQ ID NO: 1005990 - RNA, 19 nt, Homo sapiens
ggaaacgcuggcaucaauu

SEQ ID NO: 1005991 - RNA, 19 nt, Homo sapiens
gaccugagagcaccuggaa

SEQ ID NO: 1005992 - RNA, 19 nt, Homo sapiens
gacaacaucaucaacaagu

SEQ ID NO: 1005993 - RNA, 19 nt, Homo sapiens
cugcugucaucuuuaagua

SEQ ID NO: 1005994 - RNA, 19 nt, Homo sapiens
caagugagucagaccaaga

SEQ ID NO: 1005995 - RNA, 19 nt, Homo sapiens
ggaaccaucuuugggaaaa

SEQ ID NO: 1005996 - RNA, 19 nt, Homo sapiens
cccaagcccucuccaguuc

SEQ ID NO: 1005997 - RNA, 19 nt, Homo sapiens
uauaugccaucuuuggaau

SEQ ID NO: 1005998 - RNA, 19 nt, Homo sapiens
uuucuaugcuccaaaugaa

SEQ ID NO: 1005999 - RNA, 19 nt, Homo sapiens
aacaagaacuucauuucag

SEQ ID NO: 1006000 - RNA, 19 nt, Homo sapiens
cauaaacaacugaaagcuu

SEQ ID NO: 1006001 - RNA, 19 nt, Homo sapiens
ucccugcugucaucuuuaa

SEQ ID NO: 1006002 - RNA, 19 nt, Homo sapiens
agaauaccaucgccuugga

SEQ ID NO: 1006003 - RNA, 19 nt, Homo sapiens
gcaccuggaauuuguugga

SEQ ID NO: 1006004 - RNA, 19 nt, Homo sapiens
acaacaucaucaacaaguu

SEQ ID NO: 1006005 - RNA, 19 nt, Homo sapiens
ggccggagcagcugaacaa

SEQ ID NO: 1006006 - RNA, 19 nt, Homo sapiens
gaagcaaugaaauuuccaa

SEQ ID NO: 1006007 - RNA, 19 nt, Homo sapiens
guuggagaacggaaugaua

SEQ ID NO: 1006008 - RNA, 19 nt, Homo sapiens
cuacaagaccuuccggaau

SEQ ID NO: 1006009 - RNA, 19 nt, Homo sapiens
gagauuggcuacggguucu

SEQ ID NO: 1006010 - RNA, 19 nt, Homo sapiens
aagcuugaggacuuuauua

SEQ ID NO: 1006011 - RNA, 19 nt, Homo sapiens
auauuucacugugccauaa

SEQ ID NO: 1006012 - RNA, 19 nt, Homo sapiens
gcccgaggacguucagaaa

SEQ ID NO: 1006013 - RNA, 19 nt, Homo sapiens
ggacaacaucaucaacaag

SEQ ID NO: 1006014 - RNA, 19 nt, Homo sapiens
agaggugggugaaaucaag

SEQ ID NO: 1006015 - RNA, 19 nt, Homo sapiens
ucaguaugaucggagauug

SEQ ID NO: 1006016 - RNA, 19 nt, Homo sapiens
gcauuguguuugugacgau

SEQ ID NO: 1006017 - RNA, 19 nt, Homo sapiens
cauuggagcagcccuuuga

SEQ ID NO: 1006018 - RNA, 19 nt, Homo sapiens
gagaacaacucauuacuug

SEQ ID NO: 1006019 - RNA, 19 nt, Homo sapiens
guacauggcugguauaugg

SEQ ID NO: 1006020 - RNA, 19 nt, Homo sapiens
gaacaacucauuacuugaa

SEQ ID NO: 1006021 - RNA, 19 nt, Homo sapiens
gcauggagccugcacuuua

SEQ ID NO: 1006022 - RNA, 19 nt, Homo sapiens
gaacaagaacuucauuuca

SEQ ID NO: 1006023 - RNA, 19 nt, Homo sapiens
gaaacgcuggcaucaauua

SEQ ID NO: 1006024 - RNA, 19 nt, Homo sapiens
gaauuccacucuuugguuu

SEQ ID NO: 1006025 - RNA, 19 nt, Homo sapiens
gggaaacgcuggcaucaau

SEQ ID NO: 1006026 - RNA, 19 nt, Homo sapiens
gagaagcgcucugucuuug

SEQ ID NO: 1006027 - RNA, 19 nt, Homo sapiens
gagagcagccagaagaaua

SEQ ID NO: 1006028 - RNA, 19 nt, Homo sapiens
gagagcaccuggaauuugu

SEQ ID NO: 1006029 - RNA, 19 nt, Homo sapiens
uacaagaccuuccggaauu

SEQ ID NO: 1006030 - RNA, 19 nt, Homo sapiens
gacagaaacuaaaugugaa

SEQ ID NO: 1006031 - RNA, 19 nt, Homo sapiens
gaaagaaacaggugugucu

SEQ ID NO: 1006032 - RNA, 19 nt, Homo sapiens
gaucagagcacacguacga

SEQ ID NO: 1006033 - RNA, 19 nt, Homo sapiens
ggugggagcugguuaugug

SEQ ID NO: 1006034 - RNA, 19 nt, Homo sapiens
gaagacagaaacuaaaugu

SEQ ID NO: 1006035 - RNA, 19 nt, Homo sapiens
gaucccugcugucaucuuu

SEQ ID NO: 1006036 - RNA, 19 nt, Homo sapiens
gcacuuuacucugaauguu

SEQ ID NO: 1006037 - RNA, 19 nt, Homo sapiens
agacagaaacuaaauguga

SEQ ID NO: 1006038 - RNA, 19 nt, Homo sapiens
caucauaccuagucuuucu

SEQ ID NO: 1006039 - RNA, 19 nt, Homo sapiens
ggagaacaacucauuacuu

SEQ ID NO: 1006040 - RNA, 19 nt, Homo sapiens
ucaauuaucgggaguggua

SEQ ID NO: 1006041 - RNA, 19 nt, Homo sapiens
gaaggacauuggucuugga

SEQ ID NO: 1006042 - RNA, 19 nt, Homo sapiens
gcagcuguccucaguauga

SEQ ID NO: 1006043 - RNA, 19 nt, Homo sapiens
ggaauuccacucuuugguu

SEQ ID NO: 1006044 - RNA, 19 nt, Homo sapiens
gggagcugguuauguguaa

SEQ ID NO: 1006045 - RNA, 19 nt, Homo sapiens
acaagaacuucauuucaga

SEQ ID NO: 1006046 - RNA, 19 nt, Homo sapiens
uggagaaggucuuucgaaa

SEQ ID NO: 1006047 - RNA, 19 nt, Homo sapiens
gagagugacacaccaugua

SEQ ID NO: 1006048 - RNA, 19 nt, Homo sapiens
gagaacaagaacuucauuu

SEQ ID NO: 1006049 - RNA, 19 nt, Homo sapiens
acaagaccuuccggaauua

SEQ ID NO: 1006050 - RNA, 19 nt, Homo sapiens
gaacugucauuacgaccau

SEQ ID NO: 1006051 - RNA, 19 nt, Homo sapiens
gacggugguugccaucuuu

SEQ ID NO: 1006052 - RNA, 19 nt, Homo sapiens
gaacuucauuucagauagc

SEQ ID NO: 1006053 - RNA, 19 nt, Homo sapiens
gcagaucagagcacacgua

SEQ ID NO: 1006054 - RNA, 19 nt, Homo sapiens
gggagucaguccaauagga

SEQ ID NO: 1006055 - RNA, 19 nt, Homo sapiens
guauauggaggauggauuu

SEQ ID NO: 1006056 - RNA, 19 nt, Homo sapiens
guucuggccguacauguua

SEQ ID NO: 1006057 - RNA, 19 nt, Homo sapiens
gacgaucccugcugucauc

SEQ ID NO: 1006058 - RNA, 19 nt, Homo sapiens
agaccagccuccugaaaga

SEQ ID NO: 1006059 - RNA, 19 nt, Homo sapiens
caaccauccuguucaucuu

SEQ ID NO: 1006060 - RNA, 19 nt, Homo sapiens
caacuuggaaccaucuuug

SEQ ID NO: 1006061 - RNA, 19 nt, Homo sapiens
cgagaagcgcucugucuuu

SEQ ID NO: 1006062 - RNA, 19 nt, Homo sapiens
gcugucaucuuuaaguaca

SEQ ID NO: 1006063 - RNA, 19 nt, Homo sapiens
gcaauugcuuuucucauga

SEQ ID NO: 1006064 - RNA, 19 nt, Homo sapiens
aagaagaggugggugaaau

SEQ ID NO: 1006065 - RNA, 19 nt, Homo sapiens
ggagucaguccaauaggaa

SEQ ID NO: 1006066 - RNA, 19 nt, Homo sapiens
gacaugugccuuaaacaga

SEQ ID NO: 1006067 - RNA, 19 nt, Homo sapiens
cggagcagcugaacaagca

SEQ ID NO: 1006068 - RNA, 19 nt, Homo sapiens
cuuauuggcuggaauugga

SEQ ID NO: 1006069 - RNA, 19 nt, Homo sapiens
acucuuugguuucuuauug

SEQ ID NO: 1006070 - RNA, 19 nt, Homo sapiens
ccugagagcaccuggaauu

SEQ ID NO: 1006071 - RNA, 19 nt, Homo sapiens
gaagcgcucugucuuugcu

SEQ ID NO: 1006072 - RNA, 19 nt, Homo sapiens
gaagaggugggugaaauca

SEQ ID NO: 1006073 - RNA, 19 nt, Homo sapiens
ggaaaagcauugcaagagu

SEQ ID NO: 1006074 - RNA, 19 nt, Homo sapiens
uaguggagucguaguaaua

SEQ ID NO: 1006075 - RNA, 19 nt, Homo sapiens
gggcagcuauuccuuagac

SEQ ID NO: 1006076 - RNA, 19 nt, Homo sapiens
ugagacaugugccuuaaac

SEQ ID NO: 1006077 - RNA, 19 nt, Homo sapiens
ccaacaaccugcgccugaa

SEQ ID NO: 1006078 - RNA, 19 nt, Homo sapiens
aaucagagaacaagaacuu

SEQ ID NO: 1006079 - RNA, 19 nt, Homo sapiens
caacaucaucaacaaguuc

SEQ ID NO: 1006080 - RNA, 19 nt, Homo sapiens
ggaguccauuuacuuugug

SEQ ID NO: 1006081 - RNA, 19 nt, Homo sapiens
gauccagcaugcucuugau

SEQ ID NO: 1006082 - RNA, 19 nt, Homo sapiens
gaaagcuugcucugccaaa

SEQ ID NO: 1006083 - RNA, 19 nt, Homo sapiens
uagcaaggguccaugugau

SEQ ID NO: 1006084 - RNA, 19 nt, Homo sapiens
gaggacaacaucaucaaca

SEQ ID NO: 1006085 - RNA, 19 nt, Homo sapiens
ggaaacgcuggcaucaauu

SEQ ID NO: 1006086 - RNA, 19 nt, Homo sapiens
gaccugagagcaccuggaa

SEQ ID NO: 1006087 - RNA, 19 nt, Homo sapiens
gacaacaucaucaacaagu

SEQ ID NO: 1006088 - RNA, 19 nt, Homo sapiens
cugcugucaucuuuaagua

SEQ ID NO: 1006089 - RNA, 19 nt, Homo sapiens
caagugagucagaccaaga

SEQ ID NO: 1006090 - RNA, 19 nt, Homo sapiens
ggaaccaucuuugggaaaa

SEQ ID NO: 1006091 - RNA, 19 nt, Homo sapiens
uauaugccaucuuuggaau

SEQ ID NO: 1006092 - RNA, 19 nt, Homo sapiens
uuucuaugcuccaaaugaa

SEQ ID NO: 1006093 - RNA, 19 nt, Homo sapiens
aacaagaacuucauuucag

SEQ ID NO: 1006094 - RNA, 19 nt, Homo sapiens
cauaaacaacugaaagcuu

SEQ ID NO: 1006095 - RNA, 19 nt, Homo sapiens
ucccugcugucaucuuuaa

SEQ ID NO: 1006096 - RNA, 19 nt, Homo sapiens
agaauaccaucgccuugga

SEQ ID NO: 1006097 - RNA, 19 nt, Homo sapiens
gcaccuggaauuuguugga

SEQ ID NO: 1006098 - RNA, 19 nt, Homo sapiens
acaacaucaucaacaaguu

SEQ ID NO: 1006099 - RNA, 19 nt, Homo sapiens
ggccggagcagcugaacaa

SEQ ID NO: 1006100 - RNA, 19 nt, Homo sapiens
uauggaggauggauuuaag

SEQ ID NO: 1006101 - RNA, 19 nt, Homo sapiens
cauggagccugcacuuuac

SEQ ID NO: 1006102 - RNA, 19 nt, Homo sapiens
guuggagaacggaaugaua

SEQ ID NO: 1006103 - RNA, 19 nt, Homo sapiens
cuacaagaccuuccggaau

SEQ ID NO: 1006104 - RNA, 19 nt, Homo sapiens
gagauuggcuacggguucu

SEQ ID NO: 1006105 - RNA, 19 nt, Homo sapiens
gcaaggguccaugugauca

SEQ ID NO: 1006106 - RNA, 19 nt, Homo sapiens
auauuucacugugccauaa

SEQ ID NO: 1006107 - RNA, 19 nt, Homo sapiens
gcccgaggacguucagaaa

SEQ ID NO: 1006108 - RNA, 19 nt, Homo sapiens
ggacaacaucaucaacaag

SEQ ID NO: 1006109 - RNA, 19 nt, Homo sapiens
agaggugggugaaaucaag

SEQ ID NO: 1006110 - RNA, 19 nt, Homo sapiens
ucaguaugaucggagauug

SEQ ID NO: 1006111 - RNA, 19 nt, Homo sapiens
gcauuguguuugugacgau

SEQ ID NO: 1006112 - RNA, 19 nt, Homo sapiens
agccugcacuuuacucuga

SEQ ID NO: 1006113 - RNA, 19 nt, Homo sapiens
cauuggagcagcccuuuga

SEQ ID NO: 1006114 - RNA, 19 nt, Homo sapiens
ucagagcacacguacgaaa

SEQ ID NO: 1006115 - RNA, 19 nt, Homo sapiens
ugagagcaccuggaauuug

SEQ ID NO: 1006116 - RNA, 19 nt, Homo sapiens
gaaggcugucgcagugauu

SEQ ID NO: 1006117 - RNA, 19 nt, Homo sapiens
guagacaagggcagcuauu

SEQ ID NO: 1006118 - RNA, 19 nt, Homo sapiens
ccaagacugucauauuuaa

SEQ ID NO: 1006119 - RNA, 19 nt, Homo sapiens
ccugacaacuucugaauau

SEQ ID NO: 1006120 - RNA, 19 nt, Homo sapiens
ggacacauccacccaguga

SEQ ID NO: 1006121 - RNA, 19 nt, Homo sapiens
gguaucagcuccaaacucu

SEQ ID NO: 1006122 - RNA, 19 nt, Homo sapiens
aagaacaccugacaacuuc

SEQ ID NO: 1006123 - RNA, 19 nt, Homo sapiens
ggaagaugaugggaggaaa

SEQ ID NO: 1006124 - RNA, 19 nt, Homo sapiens
uaagaacaccugacaacuu

SEQ ID NO: 1006125 - RNA, 19 nt, Homo sapiens
caaauaaauccaagacugu

SEQ ID NO: 1006126 - RNA, 19 nt, Homo sapiens
auccaagacugucauauuu

SEQ ID NO: 1006127 - RNA, 19 nt, Homo sapiens
ugacaacuucugaauauug

SEQ ID NO: 1006128 - RNA, 19 nt, Homo sapiens
agacuacucugccugaaca

SEQ ID NO: 1006129 - RNA, 19 nt, Homo sapiens
ggucagcacgcacaacuug

SEQ ID NO: 1006130 - RNA, 19 nt, Homo sapiens
gacaacuucugaauauugg

SEQ ID NO: 1006131 - RNA, 19 nt, Homo sapiens
gaccagcccagccugcaua

SEQ ID NO: 1006132 - RNA, 19 nt, Homo sapiens
agagacacgugaaggaaga

SEQ ID NO: 1006133 - RNA, 19 nt, Homo sapiens
cugcucaucuuacucuuug

SEQ ID NO: 1006134 - RNA, 19 nt, Homo sapiens
ggaagcagggacugguuga

SEQ ID NO: 1006135 - RNA, 19 nt, Homo sapiens
aauccaagacugucauauu

SEQ ID NO: 1006136 - RNA, 19 nt, Homo sapiens
gguaagaacaccugacaac

SEQ ID NO: 1006137 - RNA, 19 nt, Homo sapiens
uaaauccaagacugucaua

SEQ ID NO: 1006138 - RNA, 19 nt, Homo sapiens
ccuccuggccugcaucuuu

SEQ ID NO: 1006139 - RNA, 19 nt, Homo sapiens
uccaagacugucauauuua

SEQ ID NO: 1006140 - RNA, 19 nt, Homo sapiens
gaacaccugacaacuucug

SEQ ID NO: 1006141 - RNA, 19 nt, Homo sapiens
gccugcaucuuucucauca

SEQ ID NO: 1006142 - RNA, 19 nt, Homo sapiens
gcaggugucuugccccuau

SEQ ID NO: 1006143 - RNA, 19 nt, Homo sapiens
ucaccgggaugcuggagau

SEQ ID NO: 1006144 - RNA, 19 nt, Homo sapiens
cagcccagccugcauacuu

SEQ ID NO: 1006145 - RNA, 19 nt, Homo sapiens
gaaaagcccaggagaaguc

SEQ ID NO: 1006146 - RNA, 19 nt, Homo sapiens
ggagcacagccaucacaga

SEQ ID NO: 1006147 - RNA, 19 nt, Homo sapiens
caugccugauccucucuuu

SEQ ID NO: 1006148 - RNA, 19 nt, Homo sapiens
ugagagacacgugaaggaa

SEQ ID NO: 1006149 - RNA, 19 nt, Homo sapiens
caucuuacucuuugucaca

SEQ ID NO: 1006150 - RNA, 19 nt, Homo sapiens
gacagaagccagggacaca

SEQ ID NO: 1006151 - RNA, 19 nt, Homo sapiens
gaagaugaugggaggaaaa

SEQ ID NO: 1006152 - RNA, 19 nt, Homo sapiens
gcugcucaucuuacucuuu

SEQ ID NO: 1006153 - RNA, 19 nt, Homo sapiens
gggcugagagacacgugaa

SEQ ID NO: 1006154 - RNA, 19 nt, Homo sapiens
acaaggcacucugcuucug

SEQ ID NO: 1006155 - RNA, 19 nt, Homo sapiens
cuucgaggaugcccaugug

SEQ ID NO: 1006156 - RNA, 19 nt, Homo sapiens
guaagaacaccugacaacu

SEQ ID NO: 1006157 - RNA, 19 nt, Homo sapiens
gaggaaaagcccaggagaa

SEQ ID NO: 1006158 - RNA, 19 nt, Homo sapiens
ccagaaagcuuggcagaua

SEQ ID NO: 1006159 - RNA, 19 nt, Homo sapiens
gaaaucaaccuuacaaaug

SEQ ID NO: 1006160 - RNA, 19 nt, Homo sapiens
ggucuucucuguccuguuu

SEQ ID NO: 1006161 - RNA, 19 nt, Homo sapiens
ggaagauucuggacuguau

SEQ ID NO: 1006162 - RNA, 19 nt, Homo sapiens
gcacagagaggccuucaaa

SEQ ID NO: 1006163 - RNA, 19 nt, Homo sapiens
ggaaaaguaugaacugaaa

SEQ ID NO: 1006164 - RNA, 19 nt, Homo sapiens
gcugguggauuccugagua

SEQ ID NO: 1006165 - RNA, 19 nt, Homo sapiens
cagaaagcuuggcagauaa

SEQ ID NO: 1006166 - RNA, 19 nt, Homo sapiens
gagaauguccucugacuuc

SEQ ID NO: 1006167 - RNA, 19 nt, Homo sapiens
ccacgagaauguccucuga

SEQ ID NO: 1006168 - RNA, 19 nt, Homo sapiens
gagaggccuucaaagaauu

SEQ ID NO: 1006169 - RNA, 19 nt, Homo sapiens
cagagaggccuucaaagaa

SEQ ID NO: 1006170 - RNA, 19 nt, Homo sapiens
ggucaaccuucaaguggaa

SEQ ID NO: 1006171 - RNA, 19 nt, Homo sapiens
agagaggccuucaaagaau

SEQ ID NO: 1006172 - RNA, 19 nt, Homo sapiens
gcacaggaaggaugaggaa

SEQ ID NO: 1006173 - RNA, 19 nt, Homo sapiens
caagucaacugccgauguc

SEQ ID NO: 1006174 - RNA, 19 nt, Homo sapiens
acagagaggccuucaaaga

SEQ ID NO: 1006175 - RNA, 19 nt, Homo sapiens
gggcagacccuggauguga

SEQ ID NO: 1006176 - RNA, 19 nt, Homo sapiens
ccacauccaucuggcaguu

SEQ ID NO: 1006177 - RNA, 19 nt, Homo sapiens
caccagcuauuucuaaagu

SEQ ID NO: 1006178 - RNA, 19 nt, Homo sapiens
ggaggaucauacuagaaga

SEQ ID NO: 1006179 - RNA, 19 nt, Homo sapiens
gaauucccauccaguccaa

SEQ ID NO: 1006180 - RNA, 19 nt, Homo sapiens
gaaagcuuggcagauaaua

SEQ ID NO: 1006181 - RNA, 19 nt, Homo sapiens
acuccgagcugcaacuaaa

SEQ ID NO: 1006182 - RNA, 19 nt, Homo sapiens
ccagcuauuucuaaaguca

SEQ ID NO: 1006183 - RNA, 19 nt, Homo sapiens
gaacuccgagcugcaacua

SEQ ID NO: 1006184 - RNA, 19 nt, Homo sapiens
cuacccagaauguguauaa

SEQ ID NO: 1006185 - RNA, 19 nt, Homo sapiens
cuagaagacuaccaugauc

SEQ ID NO: 1006186 - RNA, 19 nt, Homo sapiens
ggaucauacuagaagacua

SEQ ID NO: 1006187 - RNA, 19 nt, Homo sapiens
ggcagacccuggaugugaa

SEQ ID NO: 1006188 - RNA, 19 nt, Homo sapiens
aaaggcagggaguuaauaa

SEQ ID NO: 1006189 - RNA, 19 nt, Homo sapiens
cccagaauguguauaagau

SEQ ID NO: 1006190 - RNA, 19 nt, Homo sapiens
gaugugaaaugugacuaca

SEQ ID NO: 1006191 - RNA, 19 nt, Homo sapiens
gucagcgucucaccuuaaa

SEQ ID NO: 1006192 - RNA, 19 nt, Homo sapiens
gacccuggaugugaaaugu

SEQ ID NO: 1006193 - RNA, 19 nt, Homo sapiens
gaugcucuuugucucagaa

SEQ ID NO: 1006194 - RNA, 19 nt, Homo sapiens
ggaggagggaggagguaaa

SEQ ID NO: 1006195 - RNA, 19 nt, Homo sapiens
gaucauacuagaagacuac

SEQ ID NO: 1006196 - RNA, 19 nt, Homo sapiens
guaaucaccagcuauuucu

SEQ ID NO: 1006197 - RNA, 19 nt, Homo sapiens
gggaggaucauacuagaag

SEQ ID NO: 1006198 - RNA, 19 nt, Homo sapiens
aaucaccagcuauuucuaa

SEQ ID NO: 1006199 - RNA, 19 nt, Homo sapiens
ucuccuggcugguggauuc

SEQ ID NO: 1006200 - RNA, 19 nt, Homo sapiens
ccaaggagccucacaugcu

SEQ ID NO: 1006201 - RNA, 19 nt, Homo sapiens
acgcugaggucauuuguac

SEQ ID NO: 1006202 - RNA, 19 nt, Homo sapiens
caucaggguuccgguguuc

SEQ ID NO: 1006203 - RNA, 19 nt, Homo sapiens
acuacacgcuagagaaguu

SEQ ID NO: 1006204 - RNA, 19 nt, Homo sapiens
gguggauuccugaguaaga

SEQ ID NO: 1006205 - RNA, 19 nt, Homo sapiens
ccagaauguguauaagauu

SEQ ID NO: 1006206 - RNA, 19 nt, Homo sapiens
aaucuguaaucaccagcua

SEQ ID NO: 1006207 - RNA, 19 nt, Homo sapiens
ccgagcugcaacuaaauua

SEQ ID NO: 1006208 - RNA, 19 nt, Homo sapiens
gguaaaaggcagggaguua

SEQ ID NO: 1006209 - RNA, 19 nt, Homo sapiens
ccaagucaacugccgaugu

SEQ ID NO: 1006210 - RNA, 19 nt, Homo sapiens
gaggaaaaguaugaacuga

SEQ ID NO: 1006211 - RNA, 19 nt, Homo sapiens
uaacugaggaaaaguauga

SEQ ID NO: 1006212 - RNA, 19 nt, Homo sapiens
aauaagggacggagagaug

SEQ ID NO: 1006213 - RNA, 19 nt, Homo sapiens
aaagcuuggcagauaauaa

SEQ ID NO: 1006214 - RNA, 19 nt, Homo sapiens
gagcugcaacuaaauuaac

SEQ ID NO: 1006215 - RNA, 19 nt, Homo sapiens
aaagucagcgucucaccuu

SEQ ID NO: 1006216 - RNA, 19 nt, Homo sapiens
gcagacccuggaugugaaa

SEQ ID NO: 1006217 - RNA, 19 nt, Homo sapiens
cgagcugcaacuaaauuaa

SEQ ID NO: 1006218 - RNA, 19 nt, Homo sapiens
ccacgaacccacgagaaug

SEQ ID NO: 1006219 - RNA, 19 nt, Homo sapiens
cccuggaugugaaauguga

SEQ ID NO: 1006220 - RNA, 19 nt, Homo sapiens
acaggaaggaugaggaaga

SEQ ID NO: 1006221 - RNA, 19 nt, Homo sapiens
uguaaucaccagcuauuuc

SEQ ID NO: 1006222 - RNA, 19 nt, Homo sapiens
guaaaaggcagggaguuaa

SEQ ID NO: 1006223 - RNA, 19 nt, Homo sapiens
guucaacauugucauucuc

SEQ ID NO: 1006224 - RNA, 19 nt, Homo sapiens
uagaagacuaccaugauca

SEQ ID NO: 1006225 - RNA, 19 nt, Homo sapiens
gugacuacacgcuagagaa

SEQ ID NO: 1006226 - RNA, 19 nt, Homo sapiens
cugguggauuccugaguaa

SEQ ID NO: 1006227 - RNA, 19 nt, Homo sapiens
aaucaaccuuacaaaugug

SEQ ID NO: 1006228 - RNA, 19 nt, Homo sapiens
acucugaaaucaaccuuac

SEQ ID NO: 1006229 - RNA, 19 nt, Homo sapiens
guguauaagauuccuccua

SEQ ID NO: 1006230 - RNA, 19 nt, Homo sapiens
aagucagcgucucaccuua

SEQ ID NO: 1006231 - RNA, 19 nt, Homo sapiens
ugacuacacgcuagagaag

SEQ ID NO: 1006232 - RNA, 19 nt, Homo sapiens
ggaugcucuuugucucaga

SEQ ID NO: 1006233 - RNA, 19 nt, Homo sapiens
caaaugugacagauaucau

SEQ ID NO: 1006234 - RNA, 19 nt, Homo sapiens
acaaaugugacagauauca

SEQ ID NO: 1006235 - RNA, 19 nt, Homo sapiens
ucugaaaucaaccuuacaa

SEQ ID NO: 1006236 - RNA, 19 nt, Homo sapiens
uuacugcgcguccgaaugg

SEQ ID NO: 1006237 - RNA, 19 nt, Homo sapiens
agucagcgucucaccuuaa

SEQ ID NO: 1006238 - RNA, 19 nt, Homo sapiens
ucuguaaucaccagcuauu

SEQ ID NO: 1006239 - RNA, 19 nt, Homo sapiens
gccagcagccagaaagcuu

SEQ ID NO: 1006240 - RNA, 19 nt, Homo sapiens
gccuugugcccacucuaua

SEQ ID NO: 1006241 - RNA, 19 nt, Homo sapiens
ggccuugugcccacucuau

SEQ ID NO: 1006242 - RNA, 19 nt, Homo sapiens
caggaaggaugaggaagac

SEQ ID NO: 1006243 - RNA, 19 nt, Homo sapiens
acggagagaugcccaagac

SEQ ID NO: 1006244 - RNA, 19 nt, Homo sapiens
gggaggagggaggagguaa

SEQ ID NO: 1006245 - RNA, 19 nt, Homo sapiens
gcccucagcagcaguugga

SEQ ID NO: 1006246 - RNA, 19 nt, Homo sapiens
ucaucaggguuccgguguu

SEQ ID NO: 1006247 - RNA, 19 nt, Homo sapiens
aagcuuggcagauaauaag

SEQ ID NO: 1006248 - RNA, 19 nt, Homo sapiens
acuccugacucugaaauca

SEQ ID NO: 1006249 - RNA, 19 nt, Homo sapiens
uauaagauuccuccuacca

SEQ ID NO: 1006250 - RNA, 19 nt, Homo sapiens
gaagauucuggacuguauc

SEQ ID NO: 1006251 - RNA, 19 nt, Homo sapiens
acuagaagacuaccaugau

SEQ ID NO: 1006252 - RNA, 19 nt, Homo sapiens
gaacauaacauuccaguug

SEQ ID NO: 1006253 - RNA, 19 nt, Homo sapiens
ggauuuggauuaagcauaa

SEQ ID NO: 1006254 - RNA, 19 nt, Homo sapiens
gaaugaagauugugcaugu

SEQ ID NO: 1006255 - RNA, 19 nt, Homo sapiens
gcucaugucucuacaaguu

SEQ ID NO: 1006256 - RNA, 19 nt, Homo sapiens
ggaaauagcuuugugaaaa

SEQ ID NO: 1006257 - RNA, 19 nt, Homo sapiens
ggauuuaucugcuuugaug

SEQ ID NO: 1006258 - RNA, 19 nt, Homo sapiens
aaacaaauauggugugaga

SEQ ID NO: 1006259 - RNA, 19 nt, Homo sapiens
gaaggaugcacuuuaauuu

SEQ ID NO: 1006260 - RNA, 19 nt, Homo sapiens
gugaaaggcugggaaauuu

SEQ ID NO: 1006261 - RNA, 19 nt, Homo sapiens
gcucaaagguccacacuuc

SEQ ID NO: 1006262 - RNA, 19 nt, Homo sapiens
caacaauacagacacauua

SEQ ID NO: 1006263 - RNA, 19 nt, Homo sapiens
cauggaaagugauuaagua

SEQ ID NO: 1006264 - RNA, 19 nt, Homo sapiens
caaaugcccuaucuuguau

SEQ ID NO: 1006265 - RNA, 19 nt, Homo sapiens
caugauagauacaauguga

SEQ ID NO: 1006266 - RNA, 19 nt, Homo sapiens
cuaaacagauugaagcaaa

SEQ ID NO: 1006267 - RNA, 19 nt, Homo sapiens
gacaguggcuuacaucuca

SEQ ID NO: 1006268 - RNA, 19 nt, Homo sapiens
gcaccuagccaaagacauu

SEQ ID NO: 1006269 - RNA, 19 nt, Homo sapiens
ccacacuucuugaaauaaa

SEQ ID NO: 1006270 - RNA, 19 nt, Homo sapiens
cagaaugccuuucaaguca

SEQ ID NO: 1006271 - RNA, 19 nt, Homo sapiens
gcacaggauuuaucugcuu

SEQ ID NO: 1006272 - RNA, 19 nt, Homo sapiens
guaggaggauuuggauuaa

SEQ ID NO: 1006273 - RNA, 19 nt, Homo sapiens
guucuucacugcauucauu

SEQ ID NO: 1006274 - RNA, 19 nt, Homo sapiens
gcaauagcaacuaacauuu

SEQ ID NO: 1006275 - RNA, 19 nt, Homo sapiens
gaagucuacuaguuaauca

SEQ ID NO: 1006276 - RNA, 19 nt, Homo sapiens
caaagucaaucaaauaugc

SEQ ID NO: 1006277 - RNA, 19 nt, Homo sapiens
aaacaaaugcccuaucuug

SEQ ID NO: 1006278 - RNA, 19 nt, Homo sapiens
uaaugggacucacaauuga

SEQ ID NO: 1006279 - RNA, 19 nt, Homo sapiens
caguggagcuggaaaguga

SEQ ID NO: 1006280 - RNA, 19 nt, Homo sapiens
caacuaccaucccaacaau

SEQ ID NO: 1006281 - RNA, 19 nt, Homo sapiens
gaaaggcugggaaauuuga

SEQ ID NO: 1006282 - RNA, 19 nt, Homo sapiens
ugacaucugugaaauauac

SEQ ID NO: 1006283 - RNA, 19 nt, Homo sapiens
ggaacaggaugugauaugu

SEQ ID NO: 1006284 - RNA, 19 nt, Homo sapiens
gcagcaacuucaagaauca

SEQ ID NO: 1006285 - RNA, 19 nt, Homo sapiens
gaacggauacagugcaaga

SEQ ID NO: 1006286 - RNA, 19 nt, Homo sapiens
ggagaagaagugacucuaa

SEQ ID NO: 1006287 - RNA, 19 nt, Homo sapiens
gaaagaacggugaccauca

SEQ ID NO: 1006288 - RNA, 19 nt, Homo sapiens
ggacuauucucccuuggau

SEQ ID NO: 1006289 - RNA, 19 nt, Homo sapiens
guccacacuucuugaaaua

SEQ ID NO: 1006290 - RNA, 19 nt, Homo sapiens
guaagcuaccuaugaauaa

SEQ ID NO: 1006291 - RNA, 19 nt, Homo sapiens
gaacuuucaggacuacuuu

SEQ ID NO: 1006292 - RNA, 19 nt, Homo sapiens
gcuuaaagguucuucagau

SEQ ID NO: 1006293 - RNA, 19 nt, Homo sapiens
gagaagaagugacucuaac

SEQ ID NO: 1006294 - RNA, 19 nt, Homo sapiens
gaaaacaaaugcccuaucu

SEQ ID NO: 1006295 - RNA, 19 nt, Homo sapiens
acacuucuauucuggauga

SEQ ID NO: 1006296 - RNA, 19 nt, Homo sapiens
gcaauucuacagauaaaug

SEQ ID NO: 1006297 - RNA, 19 nt, Homo sapiens
gagaugcaauucuacagau

SEQ ID NO: 1006298 - RNA, 19 nt, Homo sapiens
agacugcucuccagaaugu

SEQ ID NO: 1006299 - RNA, 19 nt, Homo sapiens
aaagucagcuguguaugaa

SEQ ID NO: 1006300 - RNA, 19 nt, Homo sapiens
ccuuagaggugugcaauuu

SEQ ID NO: 1006301 - RNA, 19 nt, Homo sapiens
gagaaacaaaggugauauu

SEQ ID NO: 1006302 - RNA, 19 nt, Homo sapiens
ggucugcacugggauuauu

SEQ ID NO: 1006303 - RNA, 19 nt, Homo sapiens
uagaagcucugagaaauca

SEQ ID NO: 1006304 - RNA, 19 nt, Homo sapiens
uaaagguucuucagaugau

SEQ ID NO: 1006305 - RNA, 19 nt, Homo sapiens
ggaggagaguaaagucgaa

SEQ ID NO: 1006306 - RNA, 19 nt, Homo sapiens
caaauaugccaacagugua

SEQ ID NO: 1006307 - RNA, 19 nt, Homo sapiens
cuuauuagcugccaaaguc

SEQ ID NO: 1006308 - RNA, 19 nt, Homo sapiens
gcaaaggaguuggaauuuu

SEQ ID NO: 1006309 - RNA, 19 nt, Homo sapiens
gacagcaaccuuucuagaa

SEQ ID NO: 1006310 - RNA, 19 nt, Homo sapiens
gcagaaugccuuucaaguc

SEQ ID NO: 1006311 - RNA, 19 nt, Homo sapiens
gaagugacucuaacagugu

SEQ ID NO: 1006312 - RNA, 19 nt, Homo sapiens
caucagaagacaaacagua

SEQ ID NO: 1006313 - RNA, 19 nt, Homo sapiens
gguccacacuucuugaaau

SEQ ID NO: 1006314 - RNA, 19 nt, Homo sapiens
uaaccucccuugucaugga

SEQ ID NO: 1006315 - RNA, 19 nt, Homo sapiens
gccaacaguguauuaauuu

SEQ ID NO: 1006316 - RNA, 19 nt, Homo sapiens
gaucacuguuauugaaaug

SEQ ID NO: 1006317 - RNA, 19 nt, Homo sapiens
uaaauuugcccuuguguuc

SEQ ID NO: 1006318 - RNA, 19 nt, Homo sapiens
ucaaauaugccaacagugu

SEQ ID NO: 1006319 - RNA, 19 nt, Homo sapiens
gcacuuuaauuugcugaug

SEQ ID NO: 1006320 - RNA, 19 nt, Homo sapiens
cuaaugggacucacaauug

SEQ ID NO: 1006321 - RNA, 19 nt, Homo sapiens
uuacucagauuccagguau

SEQ ID NO: 1006322 - RNA, 19 nt, Homo sapiens
acaaauauggugugagaaa

SEQ ID NO: 1006323 - RNA, 19 nt, Homo sapiens
ugccaacaguguauuaauu

SEQ ID NO: 1006324 - RNA, 19 nt, Homo sapiens
aaucaaauaugccaacagu

SEQ ID NO: 1006325 - RNA, 19 nt, Homo sapiens
aaugugaaauggacuauuc

SEQ ID NO: 1006326 - RNA, 19 nt, Homo sapiens
gauguaaauuugcccuugu

SEQ ID NO: 1006327 - RNA, 19 nt, Homo sapiens
gauuucagcacaggauuua

SEQ ID NO: 1006328 - RNA, 19 nt, Homo sapiens
uuucaaaucucacaaagca

SEQ ID NO: 1006329 - RNA, 19 nt, Homo sapiens
uacaagcaauagcaacuaa

SEQ ID NO: 1006330 - RNA, 19 nt, Homo sapiens
ggugugcaauuuacucaga

SEQ ID NO: 1006331 - RNA, 19 nt, Homo sapiens
caaaggaguuggaauuuuc

SEQ ID NO: 1006332 - RNA, 19 nt, Homo sapiens
ggaucacuguuauugaaau

SEQ ID NO: 1006333 - RNA, 19 nt, Homo sapiens
gaacuuccaaaggauaauu

SEQ ID NO: 1006334 - RNA, 19 nt, Homo sapiens
ggacacauuuacucaucau

SEQ ID NO: 1006335 - RNA, 19 nt, Homo sapiens
caauacagacacauuauca

SEQ ID NO: 1006336 - RNA, 19 nt, Homo sapiens
gaugcaauucuacagauaa

SEQ ID NO: 1006337 - RNA, 19 nt, Homo sapiens
ccaggaacaggaugugaua

SEQ ID NO: 1006338 - RNA, 19 nt, Homo sapiens
gaaauuugaaagccuuaga

SEQ ID NO: 1006339 - RNA, 19 nt, Homo sapiens
uaauuacauugacccauga

SEQ ID NO: 1006340 - RNA, 19 nt, Homo sapiens
guguauugcuuucaccaaa

SEQ ID NO: 1006341 - RNA, 19 nt, Homo sapiens
aaaagaaggucauguggaa

SEQ ID NO: 1006342 - RNA, 19 nt, Homo sapiens
gggaggaccuguacuucuc

SEQ ID NO: 1006343 - RNA, 19 nt, Homo sapiens
uaaagucgaaguucuuaga

SEQ ID NO: 1006344 - RNA, 19 nt, Homo sapiens
ggagaugcaauucuacaga

SEQ ID NO: 1006345 - RNA, 19 nt, Homo sapiens
gaacaggaugugauaugug

SEQ ID NO: 1006346 - RNA, 19 nt, Homo sapiens
ggucuugaguggauugcaa

SEQ ID NO: 1006347 - RNA, 19 nt, Homo sapiens
agaauggucuugaguggau

SEQ ID NO: 1006348 - RNA, 19 nt, Homo sapiens
gacacuggcauuccaauug

SEQ ID NO: 1006349 - RNA, 19 nt, Homo sapiens
cuucuuugcugccaaggua

SEQ ID NO: 1006350 - RNA, 19 nt, Homo sapiens
ucggaaugcuggagaagaa

SEQ ID NO: 1006351 - RNA, 19 nt, Homo sapiens
aguaggaggauuuggauua

SEQ ID NO: 1006352 - RNA, 19 nt, Homo sapiens
caacgucccugucgucaua

SEQ ID NO: 1006353 - RNA, 19 nt, Homo sapiens
gaguaaagcugcuguuuca

SEQ ID NO: 1006354 - RNA, 19 nt, Homo sapiens
ccaaacagauugagaugaa

SEQ ID NO: 1006355 - RNA, 19 nt, Homo sapiens
cgaaagaggugcugacaau

SEQ ID NO: 1006356 - RNA, 19 nt, Homo sapiens
gagaaaugcuggcgaugaa

SEQ ID NO: 1006357 - RNA, 19 nt, Homo sapiens
aaggagagaugcuguguuu

SEQ ID NO: 1006358 - RNA, 19 nt, Homo sapiens
aaugugcucuggagauuua

SEQ ID NO: 1006359 - RNA, 19 nt, Homo sapiens
uaaagcugcuguuucagaa

SEQ ID NO: 1006360 - RNA, 19 nt, Homo sapiens
ccaagcagcugaccagaca

SEQ ID NO: 1006361 - RNA, 19 nt, Homo sapiens
ucugugaggugcuauuuaa

SEQ ID NO: 1006362 - RNA, 19 nt, Homo sapiens
gcuaaagguuguuucuguu

SEQ ID NO: 1006363 - RNA, 19 nt, Homo sapiens
ggagagaugcuguguuuca

SEQ ID NO: 1006364 - RNA, 19 nt, Homo sapiens
aaaugcaacucaugaagaa

SEQ ID NO: 1006365 - RNA, 19 nt, Homo sapiens
gaggugcuauuuaaaguuc

SEQ ID NO: 1006366 - RNA, 19 nt, Homo sapiens
ggcugaagcugacgaaaga

SEQ ID NO: 1006367 - RNA, 19 nt, Homo sapiens
cuauugcucuguuguauga

SEQ ID NO: 1006368 - RNA, 19 nt, Homo sapiens
gagcagaaaggaccuauca

SEQ ID NO: 1006369 - RNA, 19 nt, Homo sapiens
gcagaauauugcaacuuug

SEQ ID NO: 1006370 - RNA, 19 nt, Homo sapiens
uaaagguuguuucuguuga

SEQ ID NO: 1006371 - RNA, 19 nt, Homo sapiens
guaaagcugcuguuucaga

SEQ ID NO: 1006372 - RNA, 19 nt, Homo sapiens
gcucuggagauuuaaauuu

SEQ ID NO: 1006373 - RNA, 19 nt, Homo sapiens
guccauggcucgcaucuca

SEQ ID NO: 1006374 - RNA, 19 nt, Homo sapiens
gaagauggcgaacaaaugc

SEQ ID NO: 1006375 - RNA, 19 nt, Homo sapiens
aggaaucgcagaacuguua

SEQ ID NO: 1006376 - RNA, 19 nt, Homo sapiens
ggauuuaccuguuuugaga

SEQ ID NO: 1006377 - RNA, 19 nt, Homo sapiens
gucagagucuugccagaaa

SEQ ID NO: 1006378 - RNA, 19 nt, Homo sapiens
gaaccggguccagaacaua

SEQ ID NO: 1006379 - RNA, 19 nt, Homo sapiens
ccaaagagccacguucaug

SEQ ID NO: 1006380 - RNA, 19 nt, Homo sapiens
acaugaagauggcgaacaa

SEQ ID NO: 1006381 - RNA, 19 nt, Homo sapiens
gaaagaggugcugacaauu

SEQ ID NO: 1006382 - RNA, 19 nt, Homo sapiens
agaaugugcucuggagauu

SEQ ID NO: 1006383 - RNA, 19 nt, Homo sapiens
gagaguaagaccaagaaug

SEQ ID NO: 1006384 - RNA, 19 nt, Homo sapiens
gcucgcaucucaagguaca

SEQ ID NO: 1006385 - RNA, 19 nt, Homo sapiens
gacagcgguuugcaucuga

SEQ ID NO: 1006386 - RNA, 19 nt, Homo sapiens
gaauauugcaacuuugugu

SEQ ID NO: 1006387 - RNA, 19 nt, Homo sapiens
gauuucgcguugggauuua

SEQ ID NO: 1006388 - RNA, 19 nt, Homo sapiens
ggauuucgcguugggauuu

SEQ ID NO: 1006389 - RNA, 19 nt, Homo sapiens
guuaauggcauacauguag

SEQ ID NO: 1006390 - RNA, 19 nt, Homo sapiens
agaguaagaccaagaaugu

SEQ ID NO: 1006391 - RNA, 19 nt, Homo sapiens
cuaaggacccgagguauga

SEQ ID NO: 1006392 - RNA, 19 nt, Homo sapiens
ggcuugggccugaguauaa

SEQ ID NO: 1006393 - RNA, 19 nt, Homo sapiens
gugaggugcuauuuaaagu

SEQ ID NO: 1006394 - RNA, 19 nt, Homo sapiens
gaaaugcuggcgaugaagu

SEQ ID NO: 1006395 - RNA, 19 nt, Homo sapiens
aagaggugcugacaauuca

SEQ ID NO: 1006396 - RNA, 19 nt, Homo sapiens
aaagaggugcugacaauuc

SEQ ID NO: 1006397 - RNA, 19 nt, Homo sapiens
aaaccacuauugcucuguu

SEQ ID NO: 1006398 - RNA, 19 nt, Homo sapiens
gcuaaggacccgagguaug

SEQ ID NO: 1006399 - RNA, 19 nt, Homo sapiens
ccaaguuccuagcacugaa

SEQ ID NO: 1006400 - RNA, 19 nt, Homo sapiens
guuugcaucugaacggaaa

SEQ ID NO: 1006401 - RNA, 19 nt, Homo sapiens
gagccacguucauggaagu

SEQ ID NO: 1006402 - RNA, 19 nt, Homo sapiens
ccacuauugcucuguugua

SEQ ID NO: 1006403 - RNA, 19 nt, Homo sapiens
uagcuaaggacccgaggua

SEQ ID NO: 1006404 - RNA, 19 nt, Homo sapiens
gcuugggccugaguauaaa

SEQ ID NO: 1006405 - RNA, 19 nt, Homo sapiens
ugacaauucagaaacaaga

SEQ ID NO: 1006406 - RNA, 19 nt, Homo sapiens
gcguugggauuuaccuguu

SEQ ID NO: 1006407 - RNA, 19 nt, Homo sapiens
ccgaccagguugugcauau

SEQ ID NO: 1006408 - RNA, 19 nt, Homo sapiens
gugcaucugcugagaaaug

SEQ ID NO: 1006409 - RNA, 19 nt, Homo sapiens
gcaggaaucgcagaacugu

SEQ ID NO: 1006410 - RNA, 19 nt, Homo sapiens
ccacguucauggaaguuca

SEQ ID NO: 1006411 - RNA, 19 nt, Homo sapiens
cagaggcccuauugcuuca

SEQ ID NO: 1006412 - RNA, 19 nt, Homo sapiens
ugaagauggcgaacaaaug

SEQ ID NO: 1006413 - RNA, 19 nt, Homo sapiens
agacagggauguuguucgu

SEQ ID NO: 1006414 - RNA, 19 nt, Homo sapiens
gggcaggaaucgcagaacu

SEQ ID NO: 1006415 - RNA, 19 nt, Homo sapiens
gaaugugcucuggagauuu

SEQ ID NO: 1006416 - RNA, 19 nt, Homo sapiens
cagagaaccggguccagaa

SEQ ID NO: 1006417 - RNA, 19 nt, Homo sapiens
guucauggaaguucagaga

SEQ ID NO: 1006418 - RNA, 19 nt, Homo sapiens
gaagagccauguuuucaac

SEQ ID NO: 1006419 - RNA, 19 nt, Homo sapiens
aacaaaugcugcucuccuu

SEQ ID NO: 1006420 - RNA, 19 nt, Homo sapiens
ugacagcgguuugcaucug

SEQ ID NO: 1006421 - RNA, 19 nt, Homo sapiens
uaccaucaccguugaguau

SEQ ID NO: 1006422 - RNA, 19 nt, Homo sapiens
ugagaaaugcuggcgauga

SEQ ID NO: 1006423 - RNA, 19 nt, Homo sapiens
uaugaugagccuauaguug

SEQ ID NO: 1006424 - RNA, 19 nt, Homo sapiens
cagaauauugcaacuuugu

SEQ ID NO: 1006425 - RNA, 19 nt, Homo sapiens
cugcauccacuccuucaua

SEQ ID NO: 1006426 - RNA, 19 nt, Homo sapiens
gcaaggagagaugcugugu

SEQ ID NO: 1006427 - RNA, 19 nt, Homo sapiens
ggcccguccuucuacguuu

SEQ ID NO: 1006428 - RNA, 19 nt, Homo sapiens
gaugcuguucuccagguua

SEQ ID NO: 1006429 - RNA, 19 nt, Homo sapiens
uacagcagcuaaagguugu

SEQ ID NO: 1006430 - RNA, 19 nt, Homo sapiens
cgaguaaagcugcuguuuc

SEQ ID NO: 1006431 - RNA, 19 nt, Homo sapiens
agauugagaugaaggaacu

SEQ ID NO: 1006432 - RNA, 19 nt, Homo sapiens
ucacagaggacugcugguu

SEQ ID NO: 1006433 - RNA, 19 nt, Homo sapiens
uggugcaucugcugagaaa

SEQ ID NO: 1006434 - RNA, 19 nt, Homo sapiens
uuaauggcauacauguaga

SEQ ID NO: 1006435 - RNA, 19 nt, Homo sapiens
cuaaagguuguuucuguug

SEQ ID NO: 1006436 - RNA, 19 nt, Homo sapiens
uggcauacauguagaaaau

SEQ ID NO: 1006437 - RNA, 19 nt, Homo sapiens
cacuauugcucuguuguau

SEQ ID NO: 1006438 - RNA, 19 nt, Homo sapiens
aagcugcuguuucagaauc

SEQ ID NO: 1006439 - RNA, 19 nt, Homo sapiens
aaacuuguaucugggucuu

SEQ ID NO: 1006440 - RNA, 19 nt, Homo sapiens
ccggugagcacauucgauu

SEQ ID NO: 1006441 - RNA, 19 nt, Homo sapiens
uggcucgcaucucaaggua

SEQ ID NO: 1006442 - RNA, 19 nt, Homo sapiens
ucaccuuccucgcccauag

SEQ ID NO: 1006443 - RNA, 19 nt, Homo sapiens
guauaaagggagguucuga

SEQ ID NO: 1006444 - RNA, 19 nt, Homo sapiens
gaccagacagggauguugu

SEQ ID NO: 1006445 - RNA, 19 nt, Homo sapiens
ugaugagccuauaguugug

SEQ ID NO: 1006446 - RNA, 19 nt, Homo sapiens
cgaccagguugugcauaug

SEQ ID NO: 1006447 - RNA, 19 nt, Homo sapiens
ccagguuaauggcauacau

SEQ ID NO: 1006448 - RNA, 19 nt, Homo sapiens
agcuaaagguuguuucugu

SEQ ID NO: 1006449 - RNA, 19 nt, Homo sapiens
caaacagauugagaugaag

SEQ ID NO: 1006450 - RNA, 19 nt, Homo sapiens
cguugggauuuaccuguuu

SEQ ID NO: 1006451 - RNA, 19 nt, Homo sapiens
gagaaccggguccagaaca

SEQ ID NO: 1006452 - RNA, 19 nt, Homo sapiens
gcacucagcugcaagauug

SEQ ID NO: 1006453 - RNA, 19 nt, Homo sapiens
gaaagaggcauauuuaguu

SEQ ID NO: 1006454 - RNA, 19 nt, Homo sapiens
ggaaagaggcauauuuagu

SEQ ID NO: 1006455 - RNA, 19 nt, Homo sapiens
acaaggaccucaagaagug

SEQ ID NO: 1006456 - RNA, 19 nt, Homo sapiens
gcaagauuguggccuuuau

SEQ ID NO: 1006457 - RNA, 19 nt, Homo sapiens
gagccaaggugcaauguag

SEQ ID NO: 1006458 - RNA, 19 nt, Homo sapiens
acgcugggcuucaugcuua

SEQ ID NO: 1006459 - RNA, 19 nt, Homo sapiens
guacugcuaggacugauua

SEQ ID NO: 1006460 - RNA, 19 nt, Homo sapiens
agacaucccugcugagaga

SEQ ID NO: 1006461 - RNA, 19 nt, Homo sapiens
cgaaccaccuguaaucuag

SEQ ID NO: 1006462 - RNA, 19 nt, Homo sapiens
ucucagaagugacaauuca

SEQ ID NO: 1006463 - RNA, 19 nt, Homo sapiens
ugggaaagaggcauauuua

SEQ ID NO: 1006464 - RNA, 19 nt, Homo sapiens
ccagagaacccuacugugu

SEQ ID NO: 1006465 - RNA, 19 nt, Homo sapiens
caacaaggaccucaagaag

SEQ ID NO: 1006466 - RNA, 19 nt, Homo sapiens
gugggcaccuacaaguuua

SEQ ID NO: 1006467 - RNA, 19 nt, Homo sapiens
ggacugggaaagaggcaua

SEQ ID NO: 1006468 - RNA, 19 nt, Homo sapiens
gcaagcugcuccucuucga

SEQ ID NO: 1006469 - RNA, 19 nt, Homo sapiens
gaggaccagugcaucuuug

SEQ ID NO: 1006470 - RNA, 19 nt, Homo sapiens
gccaacaccucccaaggau

SEQ ID NO: 1006471 - RNA, 19 nt, Homo sapiens
ggaggaccagugcaucuuu

SEQ ID NO: 1006472 - RNA, 19 nt, Homo sapiens
ggucauggccaccgugaug

SEQ ID NO: 1006473 - RNA, 19 nt, Homo sapiens
agagaacccuacuguguca

SEQ ID NO: 1006474 - RNA, 19 nt, Homo sapiens
gaacccuacugugucaugu

SEQ ID NO: 1006475 - RNA, 19 nt, Homo sapiens
caagacaucccugcugaga

SEQ ID NO: 1006476 - RNA, 19 nt, Homo sapiens
ucaacaaggaccucaagaa

SEQ ID NO: 1006477 - RNA, 19 nt, Homo sapiens
ccacuucuacaaucucauu

SEQ ID NO: 1006478 - RNA, 19 nt, Homo sapiens
uaucgucaccgcaagauga

SEQ ID NO: 1006479 - RNA, 19 nt, Homo sapiens
cgcaucagcuuaugugaag

SEQ ID NO: 1006480 - RNA, 19 nt, Homo sapiens
ucagaagugacaauucaaa

SEQ ID NO: 1006481 - RNA, 19 nt, Homo sapiens
uauguuggcugugcucaug

SEQ ID NO: 1006482 - RNA, 19 nt, Homo sapiens
gcagacaggcagagagaag

SEQ ID NO: 1006483 - RNA, 19 nt, Homo sapiens
ucacugagggucccacaau

SEQ ID NO: 1006484 - RNA, 19 nt, Homo sapiens
caauguagcaggacaacuc

SEQ ID NO: 1006485 - RNA, 19 nt, Homo sapiens
gggaaagaggcauauuuag

SEQ ID NO: 1006486 - RNA, 19 nt, Homo sapiens
ggccuucccaccugucuuu

SEQ ID NO: 1006487 - RNA, 19 nt, Homo sapiens
cgugggcaccuacaaguuu

SEQ ID NO: 1006488 - RNA, 19 nt, Homo sapiens
gcgagggacugggaaagag

SEQ ID NO: 1006489 - RNA, 19 nt, Homo sapiens
cgccacggcucuucaugga

SEQ ID NO: 1006490 - RNA, 19 nt, Homo sapiens
ucgaaccaccuguaaucua

SEQ ID NO: 1006491 - RNA, 19 nt, Homo sapiens
ccucgaaccaccuguaauc

SEQ ID NO: 1006492 - RNA, 19 nt, Homo sapiens
ugagagagccaaggugcaa

SEQ ID NO: 1006493 - RNA, 19 nt, Homo sapiens
gaugaagccagugcagaug

SEQ ID NO: 1006494 - RNA, 19 nt, Homo sapiens
gcaccuacaaguuuauucg

SEQ ID NO: 1006495 - RNA, 19 nt, Homo sapiens
caagauuguggccuuuaug

SEQ ID NO: 1006496 - RNA, 19 nt, Homo sapiens
cgaucacacugcucuuucu

SEQ ID NO: 1006497 - RNA, 19 nt, Homo sapiens
ucaacccaauugucugcuu

SEQ ID NO: 1006498 - RNA, 19 nt, Homo sapiens
gaggaggaccagugcaucu

SEQ ID NO: 1006499 - RNA, 19 nt, Homo sapiens
gccaagcgcaugacacucu

SEQ ID NO: 1006500 - RNA, 19 nt, Homo sapiens
aacagaagcaggaguguca

SEQ ID NO: 1006501 - RNA, 19 nt, Homo sapiens
cuucuccacuucuacaauc

SEQ ID NO: 1006502 - RNA, 19 nt, Homo sapiens
gcgaucacacugcucuuuc

SEQ ID NO: 1006503 - RNA, 19 nt, Homo sapiens
gggcuucaugcuuauguug

SEQ ID NO: 1006504 - RNA, 19 nt, Homo sapiens
cugggaaagaggcauauuu

SEQ ID NO: 1006505 - RNA, 19 nt, Homo sapiens
acccuacugugucauguga

SEQ ID NO: 1006506 - RNA, 19 nt, Homo sapiens
gcggguaacgccaucuugu

SEQ ID NO: 1006507 - RNA, 19 nt, Homo sapiens
cugcuaggacugauuaugu

SEQ ID NO: 1006508 - RNA, 19 nt, Homo sapiens
ccacugcuguuuggaugag

SEQ ID NO: 1006509 - RNA, 19 nt, Homo sapiens
ccuuugugcuggcuucugu

SEQ ID NO: 1006510 - RNA, 19 nt, Homo sapiens
cacugagggucccacaaug

SEQ ID NO: 1006511 - RNA, 19 nt, Homo sapiens
gcucaacaaggaccucaag

SEQ ID NO: 1006512 - RNA, 19 nt, Homo sapiens
ccgcaucagcuuaugugaa

SEQ ID NO: 1006513 - RNA, 19 nt, Homo sapiens
agaggcauauuuaguuuug

SEQ ID NO: 1006514 - RNA, 19 nt, Homo sapiens
ccuguaaucuaggcaccuu

SEQ ID NO: 1006515 - RNA, 19 nt, Homo sapiens
gaguaucgucaccgcaaga

SEQ ID NO: 1006516 - RNA, 19 nt, Homo sapiens
gcacaucacugaaauaaug

SEQ ID NO: 1006517 - RNA, 19 nt, Homo sapiens
gaagaaugguuuacacuaa

SEQ ID NO: 1006518 - RNA, 19 nt, Homo sapiens
ggauacgucuguacuauuu

SEQ ID NO: 1006519 - RNA, 19 nt, Homo sapiens
gcauugaacuguauuaugu

SEQ ID NO: 1006520 - RNA, 19 nt, Homo sapiens
gauaucagcugguuggauu

SEQ ID NO: 1006521 - RNA, 19 nt, Homo sapiens
gcacaacccuucuuuacug

SEQ ID NO: 1006522 - RNA, 19 nt, Homo sapiens
gauaagaccuugcauagag

SEQ ID NO: 1006523 - RNA, 19 nt, Homo sapiens
gugaguaacuugcccauuu

SEQ ID NO: 1006524 - RNA, 19 nt, Homo sapiens
ggacugagcacacaucuga

SEQ ID NO: 1006525 - RNA, 19 nt, Homo sapiens
gcaacauucugcagucuuu

SEQ ID NO: 1006526 - RNA, 19 nt, Homo sapiens
gaacggccuuuaaauuguu

SEQ ID NO: 1006527 - RNA, 19 nt, Homo sapiens
gaccacagccuuaguauga

SEQ ID NO: 1006528 - RNA, 19 nt, Homo sapiens
ugaguuggaucuagcaaua

SEQ ID NO: 1006529 - RNA, 19 nt, Homo sapiens
caagacacauccucaguga

SEQ ID NO: 1006530 - RNA, 19 nt, Homo sapiens
gaaccuuacuguguuauau

SEQ ID NO: 1006531 - RNA, 19 nt, Homo sapiens
aaacagauauggguuaaga

SEQ ID NO: 1006532 - RNA, 19 nt, Homo sapiens
gcaauuuguuucccauuug

SEQ ID NO: 1006533 - RNA, 19 nt, Homo sapiens
gacugaggcuguauccuua

SEQ ID NO: 1006534 - RNA, 19 nt, Homo sapiens
cuuaaaggguuaucuagua

SEQ ID NO: 1006535 - RNA, 19 nt, Homo sapiens
caaaaucucucgccucuaa

SEQ ID NO: 1006536 - RNA, 19 nt, Homo sapiens
ccacuuuccucaucuacua

SEQ ID NO: 1006537 - RNA, 19 nt, Homo sapiens
gcaauaaagucuccuuggu

SEQ ID NO: 1006538 - RNA, 19 nt, Homo sapiens
aaucaucccucuauuauuc

SEQ ID NO: 1006539 - RNA, 19 nt, Homo sapiens
caucaccgcuucuauacaa

SEQ ID NO: 1006540 - RNA, 19 nt, Homo sapiens
gaaauacauuagagucugu

SEQ ID NO: 1006541 - RNA, 19 nt, Homo sapiens
gcaggcaguugauguaugu

SEQ ID NO: 1006542 - RNA, 19 nt, Homo sapiens
ucuaguauccuucaucuua

SEQ ID NO: 1006543 - RNA, 19 nt, Homo sapiens
cuaaagacgugccaaugaa

SEQ ID NO: 1006544 - RNA, 19 nt, Homo sapiens
ccaauuggcuagcaggauu

SEQ ID NO: 1006545 - RNA, 19 nt, Homo sapiens
ccucagaucugcaauuugu

SEQ ID NO: 1006546 - RNA, 19 nt, Homo sapiens
gcaaauagccaagggaaau

SEQ ID NO: 1006547 - RNA, 19 nt, Homo sapiens
gcauuggacaucuuaauaa

SEQ ID NO: 1006548 - RNA, 19 nt, Homo sapiens
gaccaaaucacauuaucua

SEQ ID NO: 1006549 - RNA, 19 nt, Homo sapiens
caaaguugauuagaucuga

SEQ ID NO: 1006550 - RNA, 19 nt, Homo sapiens
gagcauaguaccauagaaa

SEQ ID NO: 1006551 - RNA, 19 nt, Homo sapiens
gaaggcacagucuuguuua

SEQ ID NO: 1006552 - RNA, 19 nt, Homo sapiens
uaagauugcuagcauugaa

SEQ ID NO: 1006553 - RNA, 19 nt, Homo sapiens
ccaugcagcugacaacauu

SEQ ID NO: 1006554 - RNA, 19 nt, Homo sapiens
ggaauccuaugcagguauu

SEQ ID NO: 1006555 - RNA, 19 nt, Homo sapiens
ggaagcaguugacaagaca

SEQ ID NO: 1006556 - RNA, 19 nt, Homo sapiens
ggcaguugauguauguuua

SEQ ID NO: 1006557 - RNA, 19 nt, Homo sapiens
gaagcaggcaguugaugua

SEQ ID NO: 1006558 - RNA, 19 nt, Homo sapiens
ugagguaaauguguugaua

SEQ ID NO: 1006559 - RNA, 19 nt, Homo sapiens
gaaccacugcccuaaguuu

SEQ ID NO: 1006560 - RNA, 19 nt, Homo sapiens
caauaaagucuccuuggua

SEQ ID NO: 1006561 - RNA, 19 nt, Homo sapiens
caagggaaaucaaaucagu

SEQ ID NO: 1006562 - RNA, 19 nt, Homo sapiens
gcccuaaguuucuuuaugu

SEQ ID NO: 1006563 - RNA, 19 nt, Homo sapiens
ggcacuuacucauucauua

SEQ ID NO: 1006564 - RNA, 19 nt, Homo sapiens
agaaagaggugaguaacuu

SEQ ID NO: 1006565 - RNA, 19 nt, Homo sapiens
gagcugaacggccuuuaaa

SEQ ID NO: 1006566 - RNA, 19 nt, Homo sapiens
gaaagcgugucugcuaguu

SEQ ID NO: 1006567 - RNA, 19 nt, Homo sapiens
aaacguaauugcaaugaug

SEQ ID NO: 1006568 - RNA, 19 nt, Homo sapiens
uuacaagacugaggaauau

SEQ ID NO: 1006569 - RNA, 19 nt, Homo sapiens
guucaaauaucaccagcaa

SEQ ID NO: 1006570 - RNA, 19 nt, Homo sapiens
gcuuagagguucaaauauc

SEQ ID NO: 1006571 - RNA, 19 nt, Homo sapiens
cagcucaagccaugaauua

SEQ ID NO: 1006572 - RNA, 19 nt, Homo sapiens
gugcauggaagaucauuua

SEQ ID NO: 1006573 - RNA, 19 nt, Homo sapiens
gaaaaugcaugauucuaga

SEQ ID NO: 1006574 - RNA, 19 nt, Homo sapiens
ggaggcaacauuaauggua

SEQ ID NO: 1006575 - RNA, 19 nt, Homo sapiens
aaacaaaacucuucggaaa

SEQ ID NO: 1006576 - RNA, 19 nt, Homo sapiens
gcaucagugucaccagaua

SEQ ID NO: 1006577 - RNA, 19 nt, Homo sapiens
gguaacaguaguaaucaua

SEQ ID NO: 1006578 - RNA, 19 nt, Homo sapiens
ccaccuagcuauuuggaau

SEQ ID NO: 1006579 - RNA, 19 nt, Homo sapiens
guagaaacguaauugcaau

SEQ ID NO: 1006580 - RNA, 19 nt, Homo sapiens
aagacuagcuuuauuaugg

SEQ ID NO: 1006581 - RNA, 19 nt, Homo sapiens
gcacaaacuaggaagacua

SEQ ID NO: 1006582 - RNA, 19 nt, Homo sapiens
gggagcaucuguaaaucuu

SEQ ID NO: 1006583 - RNA, 19 nt, Homo sapiens
ggacgugucuggcugugau

SEQ ID NO: 1006584 - RNA, 19 nt, Homo sapiens
gcugaacggccuuuaaauu

SEQ ID NO: 1006585 - RNA, 19 nt, Homo sapiens
gaaaacagauauggguuaa

SEQ ID NO: 1006586 - RNA, 19 nt, Homo sapiens
ggagaccacagccuuagua

SEQ ID NO: 1006587 - RNA, 19 nt, Homo sapiens
caaaacaaguggaagaaaa

SEQ ID NO: 1006588 - RNA, 19 nt, Homo sapiens
gaacugcagugacuuuuau

SEQ ID NO: 1006589 - RNA, 19 nt, Homo sapiens
gcacacaucugagcugaac

SEQ ID NO: 1006590 - RNA, 19 nt, Homo sapiens
ggucugggaggcaacauua

SEQ ID NO: 1006591 - RNA, 19 nt, Homo sapiens
guucagauauccucagauc

SEQ ID NO: 1006592 - RNA, 19 nt, Homo sapiens
agauauggguuaagaguug

SEQ ID NO: 1006593 - RNA, 19 nt, Homo sapiens
gaaacguaauugcaaugau

SEQ ID NO: 1006594 - RNA, 19 nt, Homo sapiens
ggaagacuagcuuuauuau

SEQ ID NO: 1006595 - RNA, 19 nt, Homo sapiens
ccacacagcuugucuaccu

SEQ ID NO: 1006596 - RNA, 19 nt, Homo sapiens
ucaccaggauugucuauag

SEQ ID NO: 1006597 - RNA, 19 nt, Homo sapiens
uauaucaccuccacaaaca

SEQ ID NO: 1006598 - RNA, 19 nt, Homo sapiens
agagauguguaccugcuua

SEQ ID NO: 1006599 - RNA, 19 nt, Homo sapiens
ccaguaguauuuagagaug

SEQ ID NO: 1006600 - RNA, 19 nt, Homo sapiens
uaggaagacuagcuuuauu

SEQ ID NO: 1006601 - RNA, 19 nt, Homo sapiens
ggauuuaugcugcuucuug

SEQ ID NO: 1006602 - RNA, 19 nt, Homo sapiens
aggauaaucuauugacuga

SEQ ID NO: 1006603 - RNA, 19 nt, Homo sapiens
caccaaaguugauuagauc

SEQ ID NO: 1006604 - RNA, 19 nt, Homo sapiens
ccguguagccuguuaauuu

SEQ ID NO: 1006605 - RNA, 19 nt, Homo sapiens
cacauucaguguauuggua

SEQ ID NO: 1006606 - RNA, 19 nt, Homo sapiens
gagcugaggcgcuguuuca

SEQ ID NO: 1006607 - RNA, 19 nt, Homo sapiens
uagagcaccuuacuacuuc

SEQ ID NO: 1006608 - RNA, 19 nt, Homo sapiens
gcauagagcaccuuacuac

SEQ ID NO: 1006609 - RNA, 19 nt, Homo sapiens
aaagauaagaccuugcaua

SEQ ID NO: 1006610 - RNA, 19 nt, Homo sapiens
gaaagaggugaguaacuug

SEQ ID NO: 1006611 - RNA, 19 nt, Homo sapiens
ugaacggccuuuaaauugu

SEQ ID NO: 1006612 - RNA, 19 nt, Homo sapiens
gcaggaagcaguugacaag

SEQ ID NO: 1006613 - RNA, 19 nt, Homo sapiens
ccauauugcuauaguacuu

SEQ ID NO: 1006614 - RNA, 19 nt, Homo sapiens
gcauaguaccauagaaauu

SEQ ID NO: 1006615 - RNA, 19 nt, Homo sapiens
gaucaugagacuugacuga

SEQ ID NO: 1006616 - RNA, 19 nt, Homo sapiens
gaagaaacuugcugaagaa

SEQ ID NO: 1006617 - RNA, 19 nt, Homo sapiens
gaacucaacuggagaagug

SEQ ID NO: 1006618 - RNA, 19 nt, Homo sapiens
gaaacugaauugcaaagaa

SEQ ID NO: 1006619 - RNA, 19 nt, Homo sapiens
gaaagaacacccagguuaa

SEQ ID NO: 1006620 - RNA, 19 nt, Homo sapiens
ugaagaaacuugcugaaga

SEQ ID NO: 1006621 - RNA, 19 nt, Homo sapiens
guuaaugccugauaaagaa

SEQ ID NO: 1006622 - RNA, 19 nt, Homo sapiens
ugaaagaacacccagguua

SEQ ID NO: 1006623 - RNA, 19 nt, Homo sapiens
ggacaugucaacaauauau

SEQ ID NO: 1006624 - RNA, 19 nt, Homo sapiens
gcaaagaagaaaugaagaa

SEQ ID NO: 1006625 - RNA, 19 nt, Homo sapiens
aaacccagauuuacaagaa

SEQ ID NO: 1006626 - RNA, 19 nt, Homo sapiens
gcacuuagacccagaccaa

SEQ ID NO: 1006627 - RNA, 19 nt, Homo sapiens
gaaagagacuuggcagcau

SEQ ID NO: 1006628 - RNA, 19 nt, Homo sapiens
gaaacgacuuaaaucaaag

SEQ ID NO: 1006629 - RNA, 19 nt, Homo sapiens
uaggacaugucaacaauau

SEQ ID NO: 1006630 - RNA, 19 nt, Homo sapiens
gaagagggccagcaaccuu

SEQ ID NO: 1006631 - RNA, 19 nt, Homo sapiens
gcaacuacaaggauucgua

SEQ ID NO: 1006632 - RNA, 19 nt, Homo sapiens
gguugaaacugaauugcaa

SEQ ID NO: 1006633 - RNA, 19 nt, Homo sapiens
gcacaaugagccuugguuu

SEQ ID NO: 1006634 - RNA, 19 nt, Homo sapiens
caagaagcauacauugcaa

SEQ ID NO: 1006635 - RNA, 19 nt, Homo sapiens
gagaagugccuguccuuau

SEQ ID NO: 1006636 - RNA, 19 nt, Homo sapiens
ggagaagugccuguccuua

SEQ ID NO: 1006637 - RNA, 19 nt, Homo sapiens
caaacuuggaaaccuauua

SEQ ID NO: 1006638 - RNA, 19 nt, Homo sapiens
gaaaauucuugaugaguug

SEQ ID NO: 1006639 - RNA, 19 nt, Homo sapiens
aaacugaauugcaaagaag

SEQ ID NO: 1006640 - RNA, 19 nt, Homo sapiens
gccaauggaugccuauaca

SEQ ID NO: 1006641 - RNA, 19 nt, Homo sapiens
gagagcugcuugacuccuu

SEQ ID NO: 1006642 - RNA, 19 nt, Homo sapiens
gaauugcaaagaagaaaug

SEQ ID NO: 1006643 - RNA, 19 nt, Homo sapiens
gggaaaacauaauuuguga

SEQ ID NO: 1006644 - RNA, 19 nt, Homo sapiens
acaaugagccuugguuuau

SEQ ID NO: 1006645 - RNA, 19 nt, Homo sapiens
agguuaagcucauucugua

SEQ ID NO: 1006646 - RNA, 19 nt, Homo sapiens
gaaagucuuggaucagguu

SEQ ID NO: 1006647 - RNA, 19 nt, Homo sapiens
cagaaacgacuuaaaucaa

SEQ ID NO: 1006648 - RNA, 19 nt, Homo sapiens
agaagugccuguccuuauc

SEQ ID NO: 1006649 - RNA, 19 nt, Homo sapiens
agucugagcugaagaaacu

SEQ ID NO: 1006650 - RNA, 19 nt, Homo sapiens
gguuaaugccugauaaaga

SEQ ID NO: 1006651 - RNA, 19 nt, Homo sapiens
caaugagccuugguuuaug

SEQ ID NO: 1006652 - RNA, 19 nt, Homo sapiens
cacaaugagccuugguuua

SEQ ID NO: 1006653 - RNA, 19 nt, Homo sapiens
gauguaagucugcccuuga

SEQ ID NO: 1006654 - RNA, 19 nt, Homo sapiens
agcaugauauuagcacuua

SEQ ID NO: 1006655 - RNA, 19 nt, Homo sapiens
gagguuaagcucauucugu

SEQ ID NO: 1006656 - RNA, 19 nt, Homo sapiens
aaggugcgcuugguaauug

SEQ ID NO: 1006657 - RNA, 19 nt, Homo sapiens
uggagaaagucuuggauca

SEQ ID NO: 1006658 - RNA, 19 nt, Homo sapiens
ugaacagacuuuccuggau

SEQ ID NO: 1006659 - RNA, 19 nt, Homo sapiens
ugaagaaaacccagauuua

SEQ ID NO: 1006660 - RNA, 19 nt, Homo sapiens
gaaacuugcugaagaaaac

SEQ ID NO: 1006661 - RNA, 19 nt, Homo sapiens
agacuuggcagcaugauau

SEQ ID NO: 1006662 - RNA, 19 nt, Homo sapiens
gcaaaacagaaacgacuua

SEQ ID NO: 1006663 - RNA, 19 nt, Homo sapiens
cauuuuacauccugaguua

SEQ ID NO: 1006664 - RNA, 19 nt, Homo sapiens
acagaaacgacuuaaauca

SEQ ID NO: 1006665 - RNA, 19 nt, Homo sapiens
gaucccggcuuaugcaacu

SEQ ID NO: 1006666 - RNA, 19 nt, Homo sapiens
gaagugcgagggacaugau

SEQ ID NO: 1006667 - RNA, 19 nt, Homo sapiens
cuauacacauggcugcauu

SEQ ID NO: 1006668 - RNA, 19 nt, Homo sapiens
gagacuuggcagcaugaua

SEQ ID NO: 1006669 - RNA, 19 nt, Homo sapiens
uugcaggagugggauauuu

SEQ ID NO: 1006670 - RNA, 19 nt, Homo sapiens
acaagaagcauacauugca

SEQ ID NO: 1006671 - RNA, 19 nt, Homo sapiens
uaagucugcccuugaguga

SEQ ID NO: 1006672 - RNA, 19 nt, Homo sapiens
uuuaggacaugucaacaau

SEQ ID NO: 1006673 - RNA, 19 nt, Homo sapiens
uuacaagaagcauacauug

SEQ ID NO: 1006674 - RNA, 19 nt, Homo sapiens
agacccagaccaaauuauu

SEQ ID NO: 1006675 - RNA, 19 nt, Homo sapiens
aagaagaaaugaagaaacc

SEQ ID NO: 1006676 - RNA, 19 nt, Homo sapiens
acacauggcugcauuuuac

SEQ ID NO: 1006677 - RNA, 19 nt, Homo sapiens
uugaugaguuggagaaagu

SEQ ID NO: 1006678 - RNA, 19 nt, Homo sapiens
gaagaaaacccagauuuac

SEQ ID NO: 1006679 - RNA, 19 nt, Homo sapiens
caauggaugccuauacaca

SEQ ID NO: 1006680 - RNA, 19 nt, Homo sapiens
ggaaacggaaagcgaccaa

SEQ ID NO: 1006681 - RNA, 19 nt, Homo sapiens
cucacucgcugucacauug

SEQ ID NO: 1006682 - RNA, 19 nt, Homo sapiens
gcugcuugaucaugacaau

SEQ ID NO: 1006683 - RNA, 19 nt, Homo sapiens
caaauuggaaacacagagu

SEQ ID NO: 1006684 - RNA, 19 nt, Homo sapiens
caaaaggugcgcuugguaa

SEQ ID NO: 1006685 - RNA, 19 nt, Homo sapiens
uuaugcaacuacaaggauu

SEQ ID NO: 1006686 - RNA, 19 nt, Homo sapiens
aaagaacacccagguuaau

SEQ ID NO: 1006687 - RNA, 19 nt, Homo sapiens
aaggauucguagccaaauu

SEQ ID NO: 1006688 - RNA, 19 nt, Homo sapiens
acaaggauucguagccaaa

SEQ ID NO: 1006689 - RNA, 19 nt, Homo sapiens
aaagaaagcauguauuacc

SEQ ID NO: 1006690 - RNA, 19 nt, Homo sapiens
caugauauuagcacuuaga

SEQ ID NO: 1006691 - RNA, 19 nt, Homo sapiens
ggagugggauauuuugcuu

SEQ ID NO: 1006692 - RNA, 19 nt, Homo sapiens
cgacccuugugguugguuu

SEQ ID NO: 1006693 - RNA, 19 nt, Homo sapiens
uuacgagcgugucuugaag

SEQ ID NO: 1006694 - RNA, 19 nt, Homo sapiens
gaaacggaaagcgaccaaa

SEQ ID NO: 1006695 - RNA, 19 nt, Homo sapiens
aagcauacauugcaaaaca

SEQ ID NO: 1006696 - RNA, 19 nt, Homo sapiens
uuagacccagaccaaauua

SEQ ID NO: 1006697 - RNA, 19 nt, Homo sapiens
uaacaagguuuuaggacau

SEQ ID NO: 1006698 - RNA, 19 nt, Homo sapiens
cagauuuacaagaagcaua

SEQ ID NO: 1006699 - RNA, 19 nt, Homo sapiens
acuccaugaucccggcuua

SEQ ID NO: 1006700 - RNA, 19 nt, Homo sapiens
cacauugcaucgacugaag

SEQ ID NO: 1006701 - RNA, 19 nt, Homo sapiens
cuuagacccagaccaaauu

SEQ ID NO: 1006702 - RNA, 19 nt, Homo sapiens
aaaggugcgcuugguaauu

SEQ ID NO: 1006703 - RNA, 19 nt, Homo sapiens
agccuugguuuaugcguuu

SEQ ID NO: 1006704 - RNA, 19 nt, Homo sapiens
aacagacuuuccuggauga

SEQ ID NO: 1006705 - RNA, 19 nt, Homo sapiens
ggagaaagucuuggaucag

SEQ ID NO: 1006706 - RNA, 19 nt, Homo sapiens
guuuaugcguuugaacuca

SEQ ID NO: 1006707 - RNA, 19 nt, Homo sapiens
agucuuggaucagguugaa

SEQ ID NO: 1006708 - RNA, 19 nt, Homo sapiens
ugaguuggagaaagucuug

SEQ ID NO: 1006709 - RNA, 19 nt, Homo sapiens
cggaaagcgaccaaacuug

SEQ ID NO: 1006710 - RNA, 19 nt, Homo sapiens
gcccuugagugagcacaau

SEQ ID NO: 1006711 - RNA, 19 nt, Homo sapiens
gcugaagaaacuugcugaa

SEQ ID NO: 1006712 - RNA, 19 nt, Homo sapiens
uuaggacaugucaacaaua

SEQ ID NO: 1006713 - RNA, 19 nt, Homo sapiens
aaacuuggaaaccuauuac

SEQ ID NO: 1006714 - RNA, 19 nt, Homo sapiens
ucacauugcaucgacugaa

SEQ ID NO: 1006715 - RNA, 19 nt, Homo sapiens
gcuaucguguggccacuuu

SEQ ID NO: 1006716 - RNA, 19 nt, Homo sapiens
gcagugaccaugacgaaau

SEQ ID NO: 1006717 - RNA, 19 nt, Homo sapiens
gggcuucgguugaguuugg

SEQ ID NO: 1006718 - RNA, 19 nt, Homo sapiens
cagugaccaugacgaaauu

SEQ ID NO: 1006719 - RNA, 19 nt, Homo sapiens
ccucccauuucccauuaaa

SEQ ID NO: 1006720 - RNA, 19 nt, Homo sapiens
uuccucccauuucccauua

SEQ ID NO: 1006721 - RNA, 19 nt, Homo sapiens
gacagcccuuccucccauu

SEQ ID NO: 1006722 - RNA, 19 nt, Homo sapiens
gagccaguuuauuuucuaa

SEQ ID NO: 1006723 - RNA, 19 nt, Homo sapiens
ucccauuucccauuaaaga

SEQ ID NO: 1006724 - RNA, 19 nt, Homo sapiens
gagugaccaugacgaaauu

SEQ ID NO: 1006725 - RNA, 19 nt, Homo sapiens
gcuaucguguggccacuuu

SEQ ID NO: 1006726 - RNA, 19 nt, Homo sapiens
guagagugaccaugacgaa

SEQ ID NO: 1006727 - RNA, 19 nt, Homo sapiens
ccucccauuucccauuaaa

SEQ ID NO: 1006728 - RNA, 19 nt, Homo sapiens
uuccucccauuucccauua

SEQ ID NO: 1006729 - RNA, 19 nt, Homo sapiens
agagugaccaugacgaaau

SEQ ID NO: 1006730 - RNA, 19 nt, Homo sapiens
gacagcccuuccucccauu

SEQ ID NO: 1006731 - RNA, 19 nt, Homo sapiens
gagccaguuuauuuucuaa

SEQ ID NO: 1006732 - RNA, 19 nt, Homo sapiens
ucccauuucccauuaaaga

SEQ ID NO: 1006733 - RNA, 19 nt, Homo sapiens
ucaccgaguucgaccagua

SEQ ID NO: 1006734 - RNA, 19 nt, Homo sapiens
gaggagagcagccugaucu

SEQ ID NO: 1006735 - RNA, 19 nt, Homo sapiens
ccagcagcgcggucuauua

SEQ ID NO: 1006736 - RNA, 19 nt, Homo sapiens
gcaagaugcugggcaaagc

SEQ ID NO: 1006737 - RNA, 19 nt, Homo sapiens
gcagcgcggucuauuacag

SEQ ID NO: 1006738 - RNA, 19 nt, Homo sapiens
cagcuggaaugcagagauc

SEQ ID NO: 1006739 - RNA, 19 nt, Homo sapiens
uauguuugguuccauguca

SEQ ID NO: 1006740 - RNA, 19 nt, Homo sapiens
cagcagcgcggucuauuac

SEQ ID NO: 1006741 - RNA, 19 nt, Homo sapiens
ggaccuguuggcagaguug

SEQ ID NO: 1006742 - RNA, 19 nt, Homo sapiens
gaguugccaggguuacauu

SEQ ID NO: 1006743 - RNA, 19 nt, Homo sapiens
acguggaccucaccgaguu

SEQ ID NO: 1006744 - RNA, 19 nt, Homo sapiens
ccgcucugcucucucauac

SEQ ID NO: 1006745 - RNA, 19 nt, Homo sapiens
gaaaccugcuuacauuuaa

SEQ ID NO: 1006746 - RNA, 19 nt, Homo sapiens
uaaccaagcuucuauuaug

SEQ ID NO: 1006747 - RNA, 19 nt, Homo sapiens
auagaaaccugcuuacauu

SEQ ID NO: 1006748 - RNA, 19 nt, Homo sapiens
cuaacaagcuucacuuuua

SEQ ID NO: 1006749 - RNA, 19 nt, Homo sapiens
gagaacaugcacaauagua

SEQ ID NO: 1006750 - RNA, 19 nt, Homo sapiens
ggacauacacaauuacugu

SEQ ID NO: 1006751 - RNA, 19 nt, Homo sapiens
caggagagauuugguauuc

SEQ ID NO: 1006752 - RNA, 19 nt, Homo sapiens
gaaaguggcccagguagau

SEQ ID NO: 1006753 - RNA, 19 nt, Homo sapiens
gauagaaaccugcuuacau

SEQ ID NO: 1006754 - RNA, 19 nt, Homo sapiens
gaacaugcacaauaguaug

SEQ ID NO: 1006755 - RNA, 19 nt, Homo sapiens
gaaaaggacuaacaagcuu

SEQ ID NO: 1006756 - RNA, 19 nt, Homo sapiens
gaaccuccuuugagcauag

SEQ ID NO: 1006757 - RNA, 19 nt, Homo sapiens
ccagguagauuccuugaag

SEQ ID NO: 1006758 - RNA, 19 nt, Homo sapiens
gaacugagaccagagaaag

SEQ ID NO: 1006759 - RNA, 19 nt, Homo sapiens
ggagaucacccgcgacuuc

SEQ ID NO: 1006760 - RNA, 19 nt, Homo sapiens
agaaaccugcuuacauuua

SEQ ID NO: 1006761 - RNA, 19 nt, Homo sapiens
auacacagcauguugauuu

SEQ ID NO: 1006762 - RNA, 19 nt, Homo sapiens
gagaaagaacccaagagaa

SEQ ID NO: 1006763 - RNA, 19 nt, Homo sapiens
ugacugcaaugccuuggaa

SEQ ID NO: 1006764 - RNA, 19 nt, Homo sapiens
aagcuucuauuaugccuuu

SEQ ID NO: 1006765 - RNA, 19 nt, Homo sapiens
gaacaacuauuuugagaac

SEQ ID NO: 1006766 - RNA, 19 nt, Homo sapiens
ggacuaacaagcuucacuu

SEQ ID NO: 1006767 - RNA, 19 nt, Homo sapiens
ggucuuguguuaguuguau

SEQ ID NO: 1006768 - RNA, 19 nt, Homo sapiens
gcauagaguuagcaaccau

SEQ ID NO: 1006769 - RNA, 19 nt, Homo sapiens
ggaaccuccuuugagcaua

SEQ ID NO: 1006770 - RNA, 19 nt, Homo sapiens
gagauuugguauuccuguu

SEQ ID NO: 1006771 - RNA, 19 nt, Homo sapiens
aaacagggcugguauuccu

SEQ ID NO: 1006772 - RNA, 19 nt, Homo sapiens
ggaaaguggcccagguaga

SEQ ID NO: 1006773 - RNA, 19 nt, Homo sapiens
ugucagcuacccagacuua

SEQ ID NO: 1006774 - RNA, 19 nt, Homo sapiens
uuauguaucucucuaccuu

SEQ ID NO: 1006775 - RNA, 19 nt, Homo sapiens
gcaaccaugcuucucauuc

SEQ ID NO: 1006776 - RNA, 19 nt, Homo sapiens
ggagagauuugguauuccu

SEQ ID NO: 1006777 - RNA, 19 nt, Homo sapiens
gaaagaacccaagagaacu

SEQ ID NO: 1006778 - RNA, 19 nt, Homo sapiens
ggacccacucuuucauuga

SEQ ID NO: 1006779 - RNA, 19 nt, Homo sapiens
caugcacaauaguauguuu

SEQ ID NO: 1006780 - RNA, 19 nt, Homo sapiens
gaacccaagagaacuaaag

SEQ ID NO: 1006781 - RNA, 19 nt, Homo sapiens
aaagaacccaagagaacua

SEQ ID NO: 1006782 - RNA, 19 nt, Homo sapiens
ggaacugagaccagagaaa

SEQ ID NO: 1006783 - RNA, 19 nt, Homo sapiens
ugacaggacccacucuuuc

SEQ ID NO: 1006784 - RNA, 19 nt, Homo sapiens
uugagaacaugcacaauag

SEQ ID NO: 1006785 - RNA, 19 nt, Homo sapiens
uuugagaacaugcacaaua

SEQ ID NO: 1006786 - RNA, 19 nt, Homo sapiens
uugccaggaugguuagaua

SEQ ID NO: 1006787 - RNA, 19 nt, Homo sapiens
acaaagcacggaagcugua

SEQ ID NO: 1006788 - RNA, 19 nt, Homo sapiens
ucccuugacucaugucuug

SEQ ID NO: 1006789 - RNA, 19 nt, Homo sapiens
agaaagaacccaagagaac

SEQ ID NO: 1006790 - RNA, 19 nt, Homo sapiens
gaauacccaaucccaguga

SEQ ID NO: 1006791 - RNA, 19 nt, Homo sapiens
gacaggacccacucuuuca

SEQ ID NO: 1006792 - RNA, 19 nt, Homo sapiens
cugaaacuguuauguaucu

SEQ ID NO: 1006793 - RNA, 19 nt, Homo sapiens
agagaaagaacccaagaga

SEQ ID NO: 1006794 - RNA, 19 nt, Homo sapiens
cacggaagcuguacaccau

SEQ ID NO: 1006795 - RNA, 19 nt, Homo sapiens
gcaggagagauuugguauu

SEQ ID NO: 1006796 - RNA, 19 nt, Homo sapiens
caaccaugcuucucauucc

SEQ ID NO: 1006797 - RNA, 19 nt, Homo sapiens
ggacaagcugcgggacuuu

SEQ ID NO: 1006798 - RNA, 19 nt, Homo sapiens
uguguuaguuguaucugaa

SEQ ID NO: 1006799 - RNA, 19 nt, Homo sapiens
cagcuacccagacuuaaug

SEQ ID NO: 1006800 - RNA, 19 nt, Homo sapiens
acucaugucuugccaggau

SEQ ID NO: 1006801 - RNA, 19 nt, Homo sapiens
uagaaaccugcuuacauuu

SEQ ID NO: 1006802 - RNA, 19 nt, Homo sapiens
gacuaacaagcuucacuuu

SEQ ID NO: 1006803 - RNA, 19 nt, Homo sapiens
accuggacauacacaauua

SEQ ID NO: 1006804 - RNA, 19 nt, Homo sapiens
cggaagcuguacaccauca

SEQ ID NO: 1006805 - RNA, 19 nt, Homo sapiens
cuugauagaaaccugcuua

SEQ ID NO: 1006806 - RNA, 19 nt, Homo sapiens
uuagauacacagcauguug

SEQ ID NO: 1006807 - RNA, 19 nt, Homo sapiens
ugucuugccaggaugguua

SEQ ID NO: 1006808 - RNA, 19 nt, Homo sapiens
gaagcuguacaccaucaug

SEQ ID NO: 1006809 - RNA, 19 nt, Homo sapiens
uacacagcauguugauuug

SEQ ID NO: 1006810 - RNA, 19 nt, Homo sapiens
caggaugguuagauacaca

SEQ ID NO: 1006811 - RNA, 19 nt, Homo sapiens
gaaaacagggcugguauuc

SEQ ID NO: 1006812 - RNA, 19 nt, Homo sapiens
ugguauuccuguuggauga

SEQ ID NO: 1006813 - RNA, 19 nt, Homo sapiens
uaacacagacuuucuucac

SEQ ID NO: 1006814 - RNA, 19 nt, Homo sapiens
ccagagaaagaacccaaga

SEQ ID NO: 1006815 - RNA, 19 nt, Homo sapiens
guaccuggacauacacaau

SEQ ID NO: 1006816 - RNA, 19 nt, Homo sapiens
uagauacacagcauguuga

SEQ ID NO: 1006817 - RNA, 19 nt, Homo sapiens
gaaacuguuauguaucucu

SEQ ID NO: 1006818 - RNA, 19 nt, Homo sapiens
ccuguuggaugacugcaau

SEQ ID NO: 1006819 - RNA, 19 nt, Homo sapiens
cucauucccuugacucaug

SEQ ID NO: 1006820 - RNA, 19 nt, Homo sapiens
cuucacugucuuucauuua

SEQ ID NO: 1006821 - RNA, 19 nt, Homo sapiens
ggagccaugugugagauac

SEQ ID NO: 1006822 - RNA, 19 nt, Homo sapiens
ucuucacugucuuucauuu

SEQ ID NO: 1006823 - RNA, 19 nt, Homo sapiens
gagaucacccgcgacuuca

SEQ ID NO: 1006824 - RNA, 19 nt, Homo sapiens
agaacaugcacaauaguau

SEQ ID NO: 1006825 - RNA, 19 nt, Homo sapiens
cauguugauuuggucacua

SEQ ID NO: 1006826 - RNA, 19 nt, Homo sapiens
uggacaagcugcgggacuu

SEQ ID NO: 1006827 - RNA, 19 nt, Homo sapiens
uaccuggacauacacaauu

SEQ ID NO: 1006828 - RNA, 19 nt, Homo sapiens
gguuagauacacagcaugu

SEQ ID NO: 1006829 - RNA, 19 nt, Homo sapiens
acaccaucaugaacucguu

SEQ ID NO: 1006830 - RNA, 19 nt, Homo sapiens
aggacccacucuuucauug

SEQ ID NO: 1006831 - RNA, 19 nt, Homo sapiens
caggacccacucuuucauu

SEQ ID NO: 1006832 - RNA, 19 nt, Homo sapiens
cauuuaaccaagcuucuau

SEQ ID NO: 1006833 - RNA, 19 nt, Homo sapiens
acuguuauguaucucucua

SEQ ID NO: 1006834 - RNA, 19 nt, Homo sapiens
uuucuucacugucuuucau

SEQ ID NO: 1006835 - RNA, 19 nt, Homo sapiens
cacagcauguugauuuggu

SEQ ID NO: 1006836 - RNA, 19 nt, Homo sapiens
uaugucagcuacccagacu

SEQ ID NO: 1006837 - RNA, 19 nt, Homo sapiens
guuuaauggaguaauggua

SEQ ID NO: 1006838 - RNA, 19 nt, Homo sapiens
ggaaaacagggcugguauu

SEQ ID NO: 1006839 - RNA, 19 nt, Homo sapiens
ucagcuacccagacuuaau

SEQ ID NO: 1006840 - RNA, 19 nt, Homo sapiens
auguugauuuggucacuaa

SEQ ID NO: 1006841 - RNA, 19 nt, Homo sapiens
gcauguugauuuggucacu

SEQ ID NO: 1006842 - RNA, 19 nt, Homo sapiens
gauacacagcauguugauu

SEQ ID NO: 1006843 - RNA, 19 nt, Homo sapiens
gacaagcugcgggacuuug

SEQ ID NO: 1006844 - RNA, 19 nt, Homo sapiens
cagggaaggccgauaauuu

SEQ ID NO: 1006845 - RNA, 19 nt, Homo sapiens
ggaaggccauccugacaca

SEQ ID NO: 1006846 - RNA, 19 nt, Homo sapiens
gaaggccgauaauuuaaac

SEQ ID NO: 1006847 - RNA, 19 nt, Homo sapiens
ggaaggccgauaauuuaaa

SEQ ID NO: 1006848 - RNA, 19 nt, Homo sapiens
ucaugaaccuccacaacaa

SEQ ID NO: 1006849 - RNA, 19 nt, Homo sapiens
agggaaggccgauaauuua

SEQ ID NO: 1006850 - RNA, 19 nt, Homo sapiens
gggaaggccgauaauuuaa

SEQ ID NO: 1006851 - RNA, 19 nt, Homo sapiens
gcagagcccucaugaaccu

SEQ ID NO: 1006852 - RNA, 19 nt, Homo sapiens
gugcccagcuggccauuga

SEQ ID NO: 1006853 - RNA, 19 nt, Homo sapiens
ggaggagacgugcgagaaa

SEQ ID NO: 1006854 - RNA, 19 nt, Homo sapiens
gcacugaaggagaaguuug

SEQ ID NO: 1006855 - RNA, 19 nt, Homo sapiens
gguguggccuuugcaguga

SEQ ID NO: 1006856 - RNA, 19 nt, Homo sapiens
cagcagagcccucaugaac

SEQ ID NO: 1006857 - RNA, 19 nt, Homo sapiens
gcuccacacucgacuccuu

SEQ ID NO: 1006858 - RNA, 19 nt, Homo sapiens
ggccgcacaugcaacaaga

SEQ ID NO: 1006859 - RNA, 19 nt, Homo sapiens
cagaugaggaccuggugua

SEQ ID NO: 1006860 - RNA, 19 nt, Homo sapiens
gcccagggaaggccgauaa

SEQ ID NO: 1006861 - RNA, 19 nt, Homo sapiens
ucaagccgcacacagauga

SEQ ID NO: 1006862 - RNA, 19 nt, Homo sapiens
gagaagugcggcugugaca

SEQ ID NO: 1006863 - RNA, 19 nt, Homo sapiens
cccaagagauacugguugu

SEQ ID NO: 1006864 - RNA, 19 nt, Homo sapiens
augaggaccugguguacuu

SEQ ID NO: 1006865 - RNA, 19 nt, Homo sapiens
gaggagacgugcgagaaac

SEQ ID NO: 1006866 - RNA, 19 nt, Homo sapiens
ccaccuaccccaagagaua

SEQ ID NO: 1006867 - RNA, 19 nt, Homo sapiens
gaaacucaagggccugauc

SEQ ID NO: 1006868 - RNA, 19 nt, Homo sapiens
cgucuucgccgucuucuca

SEQ ID NO: 1006869 - RNA, 19 nt, Homo sapiens
gucacgcacugaaggagaa

SEQ ID NO: 1006870 - RNA, 19 nt, Homo sapiens
agaggcaggugcagaugug

SEQ ID NO: 1006871 - RNA, 19 nt, Homo sapiens
gaaggagaaguuugauggu

SEQ ID NO: 1006872 - RNA, 19 nt, Homo sapiens
ggagugccaguaccaguuc

SEQ ID NO: 1006873 - RNA, 19 nt, Homo sapiens
ggccgauaauuuaaacagu

SEQ ID NO: 1006874 - RNA, 19 nt, Homo sapiens
ccgauaauuuaaacagucu

SEQ ID NO: 1006875 - RNA, 19 nt, Homo sapiens
gcaagcggaaccuggaagu

SEQ ID NO: 1006876 - RNA, 19 nt, Homo sapiens
ccagggaaggccgauaauu

SEQ ID NO: 1006877 - RNA, 19 nt, Homo sapiens
ccacgcaacgcacaguuca

SEQ ID NO: 1006878 - RNA, 19 nt, Homo sapiens
guggggagcuggagaagug

SEQ ID NO: 1006879 - RNA, 19 nt, Homo sapiens
gaaccuccacaacaaugag

SEQ ID NO: 1006880 - RNA, 19 nt, Homo sapiens
ccauugaggagugccagua

SEQ ID NO: 1006881 - RNA, 19 nt, Homo sapiens
guucaagccgcacacagau

SEQ ID NO: 1006882 - RNA, 19 nt, Homo sapiens
ggugcugcuucgucaagug

SEQ ID NO: 1006883 - RNA, 19 nt, Homo sapiens
ggauguauguuacuucuua

SEQ ID NO: 1006884 - RNA, 19 nt, Homo sapiens
ggagaaagguguucaagau

SEQ ID NO: 1006885 - RNA, 19 nt, Homo sapiens
gaagaaacuuuggcugaua

SEQ ID NO: 1006886 - RNA, 19 nt, Homo sapiens
gaaaggcacugauguucug

SEQ ID NO: 1006887 - RNA, 19 nt, Homo sapiens
ugagaagacugacaucauu

SEQ ID NO: 1006888 - RNA, 19 nt, Homo sapiens
gguaaugccugauucacaa

SEQ ID NO: 1006889 - RNA, 19 nt, Homo sapiens
gauaucaaauggcugagaa

SEQ ID NO: 1006890 - RNA, 19 nt, Homo sapiens
gaucugacagugcacaaua

SEQ ID NO: 1006891 - RNA, 19 nt, Homo sapiens
gcacugauguucugaaagc

SEQ ID NO: 1006892 - RNA, 19 nt, Homo sapiens
ugaacaacaugcuaaauca

SEQ ID NO: 1006893 - RNA, 19 nt, Homo sapiens
ggauagcaauaaccuguga

SEQ ID NO: 1006894 - RNA, 19 nt, Homo sapiens
caucuuuagugucugaaua

SEQ ID NO: 1006895 - RNA, 19 nt, Homo sapiens
ggugauacuucuuugaaug

SEQ ID NO: 1006896 - RNA, 19 nt, Homo sapiens
gcaauaaccugugaaaaug

SEQ ID NO: 1006897 - RNA, 19 nt, Homo sapiens
ccaaucacaucuuuagugu

SEQ ID NO: 1006898 - RNA, 19 nt, Homo sapiens
gaacgggcaugauguugag

SEQ ID NO: 1006899 - RNA, 19 nt, Homo sapiens
acacuaaggugaaaagaua

SEQ ID NO: 1006900 - RNA, 19 nt, Homo sapiens
gaagguagcacuggagaga

SEQ ID NO: 1006901 - RNA, 19 nt, Homo sapiens
acaguggacuugcugcaua

SEQ ID NO: 1006902 - RNA, 19 nt, Homo sapiens
gaaagguguucaagauguc

SEQ ID NO: 1006903 - RNA, 19 nt, Homo sapiens
gcaaccgucuggaugaugu

SEQ ID NO: 1006904 - RNA, 19 nt, Homo sapiens
aagaaacuuuggcugauaa

SEQ ID NO: 1006905 - RNA, 19 nt, Homo sapiens
agaaagguguucaagaugu

SEQ ID NO: 1006906 - RNA, 19 nt, Homo sapiens
cuaaaucaguacuuccaaa

SEQ ID NO: 1006907 - RNA, 19 nt, Homo sapiens
ucacaucuuuagugucuga

SEQ ID NO: 1006908 - RNA, 19 nt, Homo sapiens
cagcauguauuacuugaca

SEQ ID NO: 1006909 - RNA, 19 nt, Homo sapiens
guauguuacuucuuagaga

SEQ ID NO: 1006910 - RNA, 19 nt, Homo sapiens
ucacaacuuugagaaggua

SEQ ID NO: 1006911 - RNA, 19 nt, Homo sapiens
acaacaugcuaaaucagua

SEQ ID NO: 1006912 - RNA, 19 nt, Homo sapiens
ugaaaccaguacuuuauca

SEQ ID NO: 1006913 - RNA, 19 nt, Homo sapiens
cagagaagaugggcuacaa

SEQ ID NO: 1006914 - RNA, 19 nt, Homo sapiens
ggaacgggcaugauguuga

SEQ ID NO: 1006915 - RNA, 19 nt, Homo sapiens
auauguggcuaaagcaaua

SEQ ID NO: 1006916 - RNA, 19 nt, Homo sapiens
caaggaugcuccggaaugu

SEQ ID NO: 1006917 - RNA, 19 nt, Homo sapiens
aaucacaucuuuagugucu

SEQ ID NO: 1006918 - RNA, 19 nt, Homo sapiens
gaaaauguguuuagacaac

SEQ ID NO: 1006919 - RNA, 19 nt, Homo sapiens
gauacuaaaggaagaauuc

SEQ ID NO: 1006920 - RNA, 19 nt, Homo sapiens
gaaacuuuggcugauaaua

SEQ ID NO: 1006921 - RNA, 19 nt, Homo sapiens
ucaaauggcugagaagacu

SEQ ID NO: 1006922 - RNA, 19 nt, Homo sapiens
cagugguucuuaaauugua

SEQ ID NO: 1006923 - RNA, 19 nt, Homo sapiens
gaaagucaucgacaagaca

SEQ ID NO: 1006924 - RNA, 19 nt, Homo sapiens
cugauaauauugcagcauu

SEQ ID NO: 1006925 - RNA, 19 nt, Homo sapiens
cggcuaauuuguaucaaug

SEQ ID NO: 1006926 - RNA, 19 nt, Homo sapiens
gguaauuggugauacuucu

SEQ ID NO: 1006927 - RNA, 19 nt, Homo sapiens
aacagugguucuuaaauug

SEQ ID NO: 1006928 - RNA, 19 nt, Homo sapiens
uaaccuguauucuguuuac

SEQ ID NO: 1006929 - RNA, 19 nt, Homo sapiens
ugaagaaacuuuggcugau

SEQ ID NO: 1006930 - RNA, 19 nt, Homo sapiens
gagaaagguguucaagaug

SEQ ID NO: 1006931 - RNA, 19 nt, Homo sapiens
ggaucuuggugucgaauca

SEQ ID NO: 1006932 - RNA, 19 nt, Homo sapiens
gggcuacaaggccauauuu

SEQ ID NO: 1006933 - RNA, 19 nt, Homo sapiens
gcacuggagagaauuggaa

SEQ ID NO: 1006934 - RNA, 19 nt, Homo sapiens
ugacaguggacacaccuua

SEQ ID NO: 1006935 - RNA, 19 nt, Homo sapiens
gagaagacugacaucauug

SEQ ID NO: 1006936 - RNA, 19 nt, Homo sapiens
aagcucagguucaaagugu

SEQ ID NO: 1006937 - RNA, 19 nt, Homo sapiens
gcauguauuacuugacaaa

SEQ ID NO: 1006938 - RNA, 19 nt, Homo sapiens
ggcugcaacuguauaucua

SEQ ID NO: 1006939 - RNA, 19 nt, Homo sapiens
ggcaaaugaugaagaaacu

SEQ ID NO: 1006940 - RNA, 19 nt, Homo sapiens
uacaaagggugucguucuu

SEQ ID NO: 1006941 - RNA, 19 nt, Homo sapiens
ggaaaggcacugauguucu

SEQ ID NO: 1006942 - RNA, 19 nt, Homo sapiens
ccaaggaugcuccggaaug

SEQ ID NO: 1006943 - RNA, 19 nt, Homo sapiens
ggaauggguggcgguaauu

SEQ ID NO: 1006944 - RNA, 19 nt, Homo sapiens
gcggaaaggcacugauguu

SEQ ID NO: 1006945 - RNA, 19 nt, Homo sapiens
uaaauuguaagcucagguu

SEQ ID NO: 1006946 - RNA, 19 nt, Homo sapiens
uagcaaacacuaaggugaa

SEQ ID NO: 1006947 - RNA, 19 nt, Homo sapiens
ggagguagcaaacacuaag

SEQ ID NO: 1006948 - RNA, 19 nt, Homo sapiens
gcuaaagugcuguauccuu

SEQ ID NO: 1006949 - RNA, 19 nt, Homo sapiens
acaagacauuggugaggaa

SEQ ID NO: 1006950 - RNA, 19 nt, Homo sapiens
ucaagauguccucgagaua

SEQ ID NO: 1006951 - RNA, 19 nt, Homo sapiens
gggagaaagguguucaaga

SEQ ID NO: 1006952 - RNA, 19 nt, Homo sapiens
cagcugggaagauaucaaa

SEQ ID NO: 1006953 - RNA, 19 nt, Homo sapiens
gaucugucgacuucuguuu

SEQ ID NO: 1006954 - RNA, 19 nt, Homo sapiens
gauacuucuuugaauguag

SEQ ID NO: 1006955 - RNA, 19 nt, Homo sapiens
gcugggaagauaucaaaug

SEQ ID NO: 1006956 - RNA, 19 nt, Homo sapiens
cuuccaaagucuauauaug

SEQ ID NO: 1006957 - RNA, 19 nt, Homo sapiens
gauuaugaacaacaugcua

SEQ ID NO: 1006958 - RNA, 19 nt, Homo sapiens
guaauuccccacuucaaua

SEQ ID NO: 1006959 - RNA, 19 nt, Homo sapiens
gaugaugugcguaacagau

SEQ ID NO: 1006960 - RNA, 19 nt, Homo sapiens
uggaauggguggcgguaau

SEQ ID NO: 1006961 - RNA, 19 nt, Homo sapiens
gcuccggaauguugcugaa

SEQ ID NO: 1006962 - RNA, 19 nt, Homo sapiens
gauguccucgagauacuaa

SEQ ID NO: 1006963 - RNA, 19 nt, Homo sapiens
gaacaacaugcuaaaucag

SEQ ID NO: 1006964 - RNA, 19 nt, Homo sapiens
gcgccaaggcuguguuugu

SEQ ID NO: 1006965 - RNA, 19 nt, Homo sapiens
ucugaaagcucuggcucuu

SEQ ID NO: 1006966 - RNA, 19 nt, Homo sapiens
gccagccacuauugauguu

SEQ ID NO: 1006967 - RNA, 19 nt, Homo sapiens
cuacaaggaccgagaaguc

SEQ ID NO: 1006968 - RNA, 19 nt, Homo sapiens
gccagaaugugaaagucau

SEQ ID NO: 1006969 - RNA, 19 nt, Homo sapiens
caagauguccucgagauac

SEQ ID NO: 1006970 - RNA, 19 nt, Homo sapiens
caguggacuugcugcauau

SEQ ID NO: 1006971 - RNA, 19 nt, Homo sapiens
gaaaccaguacuuuaucau

SEQ ID NO: 1006972 - RNA, 19 nt, Homo sapiens
accgagaagucaccaagaa

SEQ ID NO: 1006973 - RNA, 19 nt, Homo sapiens
guucaaaguguugguaaug

SEQ ID NO: 1006974 - RNA, 19 nt, Homo sapiens
uguauuacuugacaaagag
